United States Patent 11,640,849 (METHODS FOR HISTOLOGICAL DIAGNOSIS AND TREATMENT OF DISEASES) - sequence listing, part 54

SEQ ID NO: 2068590 - protein, 21 aa, Staphylococcus
GSFIPGFEEQLEGLKTGEEKD

SEQ ID NO: 2068591 - protein, 18 aa, Staphylococcus
GSFSDKMAKILTGEDGEE

SEQ ID NO: 2068592 - protein, 38 aa, Staphylococcus
GSFVYRRRLPFHAQRLEQWLMQLPQNIVRAKGIVWLAQ

SEQ ID NO: 2068593 - protein, 27 aa, Staphylococcus
GSFVYSRRLPFHAKRFNDWLEQIPNNI

SEQ ID NO: 2068594 - protein, 17 aa, Staphylococcus
GSFYANRLYGDWTTKTN

SEQ ID NO: 2068595 - protein, 19 aa, Staphylococcus
GSGDKEIEFSFSSRNGGTR

SEQ ID NO: 2068596 - protein, 25 aa, Staphylococcus
GSGFQWYSWIHIDDLTRAILFTIGN

SEQ ID NO: 2068597 - protein, 22 aa, Staphylococcus
GSGKSLAYLLAALMYNIETGRH

SEQ ID NO: 2068598 - protein, 25 aa, Staphylococcus
GSGKSLLIALIRQQVKPDKGTVYVT

SEQ ID NO: 2068599 - protein, 29 aa, Staphylococcus
GSGKSMLFDAIVFALYGKASTSSRKETAL

SEQ ID NO: 2068600 - protein, 25 aa, Staphylococcus
GSGKTMIFDAIVFALFGEASTKDRK

SEQ ID NO: 2068601 - protein, 24 aa, Staphylococcus
GSGKTMIFDAIVFSLFGKASTEGR

SEQ ID NO: 2068602 - protein, 24 aa, Staphylococcus
GSGKTMIFDGIVYALFGVASTKSR

SEQ ID NO: 2068603 - protein, 28 aa, Staphylococcus
GSGKTMLFDGIVYALFGKASTEGRNEGE

SEQ ID NO: 2068604 - protein, 24 aa, Staphylococcus
GSGQQWYSWIHIDDLIRGIIFTID

SEQ ID NO: 2068605 - protein, 26 aa, Staphylococcus
GSGRQWYSWIHIDDLVRAILFTIDES

SEQ ID NO: 2068606 - protein, 17 aa, Staphylococcus
GSGSFYANRLYGDWTTK

SEQ ID NO: 2068607 - protein, 28 aa, Staphylococcus
GSGTQTLMKILFLLLPKSKFAVEDPGYH

SEQ ID NO: 2068608 - protein, 24 aa, Staphylococcus
GSHLGPYCYPLVIDGIQNGDFPTR

SEQ ID NO: 2068609 - protein, 26 aa, Staphylococcus
GSHNWKSWKPMIGDILYYFLNNNHST

SEQ ID NO: 2068610 - protein, 25 aa, Staphylococcus
GSIAKIVPFLKYNFAEKWKVILDEL

SEQ ID NO: 2068611 - protein, 23 aa, Staphylococcus
GSIGFLIVHIPHISEDGFNTFVT

SEQ ID NO: 2068612 - protein, 23 aa, Staphylococcus
GSIGFLVIHIPHINNDSFEHFKN

SEQ ID NO: 2068613 - protein, 18 aa, Staphylococcus
GSIIGTSSLRRGAQILAK

SEQ ID NO: 2068614 - protein, 35 aa, Staphylococcus
GSIITVSHDIYFLNKLFNTTYLLKNKSLKKFEGNY

SEQ ID NO: 2068615 - protein, 27 aa, Staphylococcus
GSIPKPKDWWELKKILKFDDKYDKVVT

SEQ ID NO: 2068616 - protein, 19 aa, Staphylococcus
GSIRIRPEYFEVYREDELL

SEQ ID NO: 2068617 - protein, 22 aa, Staphylococcus
GSKAFVLPIPGHELPSVIGWRT

SEQ ID NO: 2068618 - protein, 23 aa, Staphylococcus
GSKGLIFHPYLAGERAPLWNANA

SEQ ID NO: 2068619 - protein, 17 aa, Staphylococcus
GSKNLMDAAIKHNLRKV

SEQ ID NO: 2068620 - protein, 23 aa, Staphylococcus
GSKPFNVVMTPSDKKRMLDAQKE

SEQ ID NO: 2068621 - protein, 18 aa, Staphylococcus
GSKRNPFYRIVAADARAP

SEQ ID NO: 2068622 - protein, 29 aa, Staphylococcus
GSLAAFYYAIVAPYKRHPMIKLMNAMQYD

SEQ ID NO: 2068623 - protein, 25 aa, Staphylococcus
GSLAEYIIPYIYYQNTNETIKFIKK

SEQ ID NO: 2068624 - protein, 17 aa, Staphylococcus
GSLLFTKHKIRGIEFPG

SEQ ID NO: 2068625 - protein, 24 aa, Staphylococcus
GSLNHLYVRDFEGLRIDQARLNSM

SEQ ID NO: 2068626 - protein, 25 aa, Staphylococcus
GSLNPYKWLYNLYFEARTDAIYHDL

SEQ ID NO: 2068627 - protein, 22 aa, Staphylococcus
GSLNSDLYRLWQNAFVVGKDDP

SEQ ID NO: 2068628 - protein, 19 aa, Staphylococcus
GSLTANYDRFMTWRSKDGE

SEQ ID NO: 2068629 - protein, 26 aa, Staphylococcus
GSLTNQVLQQFKFDKAFLSCGAFDTS

SEQ ID NO: 2068630 - protein, 20 aa, Staphylococcus
GSMHIGHLIPFMMMKRFQLA

SEQ ID NO: 2068631 - protein, 17 aa, Staphylococcus
GSMLLLAQDLQTAKKIV

SEQ ID NO: 2068632 - protein, 26 aa, Staphylococcus
GSMTQGMIGYWLETEINRVLSEIGSD

SEQ ID NO: 2068633 - protein, 26 aa, Staphylococcus
GSNFTTGWIFFIDNNGHHEMVADVDL

SEQ ID NO: 2068634 - protein, 23 aa, Staphylococcus
GSNQQWIPVHKSWRLNERHYGGL

SEQ ID NO: 2068635 - protein, 24 aa, Staphylococcus
GSNRKPIHLLRRDGTIREISNQSL

SEQ ID NO: 2068636 - protein, 24 aa, Staphylococcus
GSNRQPIHLLKRNGKIREISSQSL

SEQ ID NO: 2068637 - protein, 23 aa, Staphylococcus
GSNRQPIHLLRRNGSIREISSQS

SEQ ID NO: 2068638 - protein, 17 aa, Staphylococcus
GSPMVIKMGRYGKFMAC

SEQ ID NO: 2068639 - protein, 21 aa, Staphylococcus
GSPVNFSGKFYNFVEYGVDKE

SEQ ID NO: 2068640 - protein, 17 aa, Staphylococcus
GSQHTYYIISNSMIDGF

SEQ ID NO: 2068641 - protein, 22 aa, Staphylococcus
GSQLGLKYYLQAKFPDKRIFAT

SEQ ID NO: 2068642 - protein, 21 aa, Staphylococcus
GSRGKLISETFISDGQNGKDG

SEQ ID NO: 2068643 - protein, 23 aa, Staphylococcus
GSRGSVIPLFKEQIAAGGPVTVT

SEQ ID NO: 2068644 - protein, 24 aa, Staphylococcus
GSRLLVQSSLYDKLLPKLKEAFEN

SEQ ID NO: 2068645 - protein, 24 aa, Staphylococcus
GSRLSGEKILFIGTGSIAQQTARI

SEQ ID NO: 2068646 - protein, 20 aa, Staphylococcus
GSRPFVPSIPGLENVDYETT

SEQ ID NO: 2068647 - protein, 17 aa, Staphylococcus
GSRPHFPYLNQERQNYA

SEQ ID NO: 2068648 - protein, 23 aa, Staphylococcus
GSRRFLDRIWRLLITEDGSISNK

SEQ ID NO: 2068649 - protein, 21 aa, Staphylococcus
GSSAFVLPIPGSDLPSVIGWR

SEQ ID NO: 2068650 - protein, 25 aa, Staphylococcus
GSSGTIPGVLFKLEKTHDITEDQMI

SEQ ID NO: 2068651 - protein, 26 aa, Staphylococcus
GSSGTIPGVLFKLEKTHDLTEEQMID

SEQ ID NO: 2068652 - protein, 25 aa, Staphylococcus
GSSGTIPGVLFKLEKTHGLTEDQMV

SEQ ID NO: 2068653 - protein, 26 aa, Staphylococcus
GSSHLSFPSLVFDLTYFAIKQRKNES

SEQ ID NO: 2068654 - protein, 30 aa, Staphylococcus
GSSLHEAPSYVLNYFDPKDKTLLKEGLVLA

SEQ ID NO: 2068655 - protein, 23 aa, Staphylococcus
GSTFGGNPLACAVSLAALDVIVD

SEQ ID NO: 2068656 - protein, 26 aa, Staphylococcus
GSTREQIMFILFGKGRNGKSIFVEVI

SEQ ID NO: 2068657 - protein, 21 aa, Staphylococcus
GSTTLLFAKALLHKQHLTIIT

SEQ ID NO: 2068658 - protein, 17 aa, Staphylococcus
GSTYFLEEYKGKVLIIV

SEQ ID NO: 2068659 - protein, 24 aa, Staphylococcus
GSVDYLDKGFTGHIIRRGVTAADA

SEQ ID NO: 2068660 - protein, 24 aa, Staphylococcus
GSVELDIIFKSQGPKRLLANFAPI

SEQ ID NO: 2068661 - protein, 24 aa, Staphylococcus
GSVELDIIFKSQGPKRLLAQFAPI

SEQ ID NO: 2068662 - protein, 17 aa, Staphylococcus
GSVFHIPIVTTELNKFI

SEQ ID NO: 2068663 - protein, 19 aa, Staphylococcus
GSVKNKLIYTLPGSTGAVK

SEQ ID NO: 2068664 - protein, 28 aa, Staphylococcus
GSVNTEHMLFIGAGAFHVSKPSDLIPEL

SEQ ID NO: 2068665 - protein, 30 aa, Staphylococcus
GSVRSISGYPFIWWFATKPSYDGQGYGSQL

SEQ ID NO: 2068666 - protein, 18 aa, Staphylococcus
GSVYPILQMLEDRDFVTI

SEQ ID NO: 2068667 - protein, 19 aa, Staphylococcus
GSVYPILQMLEDREFVSIS

SEQ ID NO: 2068668 - protein, 19 aa, Staphylococcus
GSWGRVPFIPFKNNSEEAS

SEQ ID NO: 2068669 - protein, 18 aa, Staphylococcus
GSYYTGLRRNSMACVAFP

SEQ ID NO: 2068670 - protein, 32 aa, Staphylococcus
GTAAAGGLFALLGPFWGYGASIATSLANVYGS

SEQ ID NO: 2068671 - protein, 25 aa, Staphylococcus
GTAGIPMLEILKKLDIHNACVVVTR

SEQ ID NO: 2068672 - protein, 20 aa, Staphylococcus
GTAKDKLIFALPGSTGAVKL

SEQ ID NO: 2068673 - protein, 18 aa, Staphylococcus
GTAKGGIVLAIRNELHIP

SEQ ID NO: 2068674 - protein, 19 aa, Staphylococcus
GTAKGGIVLAIRNELHIPV

SEQ ID NO: 2068675 - protein, 33 aa, Staphylococcus
GTAKGGIVLAIRNELHIPVKYVGLGEKLDDLQP

SEQ ID NO: 2068676 - protein, 34 aa, Staphylococcus
GTAKGGIVLAIRNELRIPVKYVGLGEKLDDLQPF

SEQ ID NO: 2068677 - protein, 24 aa, Staphylococcus
GTAPKRFIREFKNINVDEYEVGQE

SEQ ID NO: 2068678 - protein, 22 aa, Staphylococcus
GTAQKLILNMISTMTMIGVGKV

SEQ ID NO: 2068679 - protein, 26 aa, Staphylococcus
GTASDIYAAVRLLWSRIGEPFVGYSD

SEQ ID NO: 2068680 - protein, 22 aa, Staphylococcus
GTCFNVGCIQSKLLIEHGKRVY

SEQ ID NO: 2068681 - protein, 24 aa, Staphylococcus
GTCWKSPAYIFTPEIRELFGVKDD

SEQ ID NO: 2068682 - protein, 24 aa, Staphylococcus
GTDARMMYWFTQKEYDVIRKPQGA

SEQ ID NO: 2068683 - protein, 25 aa, Staphylococcus
GTDARMMYWFTQKEYPVIRKPQGAN

SEQ ID NO: 2068684 - protein, 26 aa, Staphylococcus
GTDEPILYLGGFNFPNKRAKLYPLTF

SEQ ID NO: 2068685 - protein, 25 aa, Staphylococcus
GTDFDVLPLIYQLPNDSIKWYELPN

SEQ ID NO: 2068686 - protein, 26 aa, Staphylococcus
GTDFTTGWIFFIDDVGQHELVSHFEL

SEQ ID NO: 2068687 - protein, 22 aa, Staphylococcus
GTDIKVESLFYNTPARLKYIKS

SEQ ID NO: 2068688 - protein, 34 aa, Staphylococcus
GTDITVSSLFYNTPARLKYIKSLYTELGKITDIV

SEQ ID NO: 2068689 - protein, 22 aa, Staphylococcus
GTDMTFFDFPNIPKGSAGTNSI

SEQ ID NO: 2068690 - protein, 26 aa, Staphylococcus
GTDNLVLLGIKTRGAFLANRIQEKIH

SEQ ID NO: 2068691 - protein, 23 aa, Staphylococcus
GTDVLTFAVRRMNLYDKNLPNPL

SEQ ID NO: 2068692 - protein, 30 aa, Staphylococcus
GTDYLVEPGTNLLEFIRSRDTFVPAICYNE

SEQ ID NO: 2068693 - protein, 23 aa, Staphylococcus
GTDYNNQTILPDGNTYDAQGTES

SEQ ID NO: 2068694 - protein, 24 aa, Staphylococcus
GTELDLQLRRRGIDTIVLSGVATG

SEQ ID NO: 2068695 - protein, 23 aa, Staphylococcus
GTELDYIHDAFEKNWVAPLGENV

SEQ ID NO: 2068696 - protein, 33 aa, Staphylococcus
GTELTWMRQPHYYMGLYSYTYSAGLTIGTVVSQ

SEQ ID NO: 2068697 - protein, 24 aa, Staphylococcus
GTENLAQIVGFAKAIELAQQHRDD

SEQ ID NO: 2068698 - protein, 25 aa, Staphylococcus
GTENLVLLGIKTRGAYLAYRIQEKI

SEQ ID NO: 2068699 - protein, 24 aa, Staphylococcus
GTENVPQIVGFTKALELANNALNE

SEQ ID NO: 2068700 - protein, 22 aa, Staphylococcus
GTEPKLKFYLSLNVDDFEQVSH

SEQ ID NO: 2068701 - protein, 21 aa, Staphylococcus
GTEPKLKFYLSLNVDNFEQVS

SEQ ID NO: 2068702 - protein, 25 aa, Staphylococcus
GTEREPEVLPSRFPNLLVNGASGIA

SEQ ID NO: 2068703 - protein, 26 aa, Staphylococcus
GTEREPEVLPSRFPNLLVNGASGIAV

SEQ ID NO: 2068704 - protein, 22 aa, Staphylococcus
GTFKEFNLFLLMVEGKTYKDMA

SEQ ID NO: 2068705 - protein, 25 aa, Staphylococcus
GTFKKMHVRMMPGQEPPYTRLIDSA

SEQ ID NO: 2068706 - protein, 25 aa, Staphylococcus
GTFKKMHVRMMPGQEPPYTRLINSA

SEQ ID NO: 2068707 - protein, 21 aa, Staphylococcus
GTFVAFRSDWSKRWPNIEAFE

SEQ ID NO: 2068708 - protein, 31 aa, Staphylococcus
GTGDLSYRKLLPSIFNLYKKGHFKKLVIIST

SEQ ID NO: 2068709 - protein, 26 aa, Staphylococcus
GTGKSHAFLLPLIDKIDVENKEPQSI

SEQ ID NO: 2068710 - protein, 25 aa, Staphylococcus
GTGKSHAFLLPLIERIDPSIQEPQA

SEQ ID NO: 2068711 - protein, 28 aa, Staphylococcus
GTGKSHAFLLPLMHLIDIDLQEPQVIVV

SEQ ID NO: 2068712 - protein, 24 aa, Staphylococcus
GTGKTFLAVVYAAKQLRKGKVKRI

SEQ ID NO: 2068713 - protein, 25 aa, Staphylococcus
GTGKTFLAVVYAAKQLRKGNVKRIV

SEQ ID NO: 2068714 - protein, 25 aa, Staphylococcus
GTGKTFLAVVYAAKQLRKGSVKRIV

SEQ ID NO: 2068715 - protein, 24 aa, Staphylococcus
GTGKTFLAVVYAAKQLRKGTVKRI

SEQ ID NO: 2068716 - protein, 26 aa, Staphylococcus
GTGKTHSFLLPLIQMIDVDLQEPQAI

SEQ ID NO: 2068717 - protein, 22 aa, Staphylococcus
GTGLPKLFGFQAEGASPIVQNK

SEQ ID NO: 2068718 - protein, 26 aa, Staphylococcus
GTGTTIELLVPKIAQLIKEKHYNIIG

SEQ ID NO: 2068719 - protein, 22 aa, Staphylococcus
GTHKLLAKDVKYKDLGLLVVDE

SEQ ID NO: 2068720 - protein, 20 aa, Staphylococcus
GTHLWSGYPTGTIYSRPGAI

SEQ ID NO: 2068721 - protein, 23 aa, Staphylococcus
GTHSGLMYYTIGQRHGLGIGGDG

SEQ ID NO: 2068722 - protein, 26 aa, Staphylococcus
GTHSSKALLLYRLIEGLISENSNAIS

SEQ ID NO: 2068723 - protein, 27 aa, Staphylococcus
GTHYPKQFIQTLFKEGYFKENDLKNNL

SEQ ID NO: 2068724 - protein, 18 aa, Staphylococcus
GTIAKLLYEFKEIANKKS

SEQ ID NO: 2068725 - protein, 29 aa, Staphylococcus
GTIDEDAQFIIWTTTPWTLPSNVAITVHP

SEQ ID NO: 2068726 - protein, 24 aa, Staphylococcus
GTIRAPQWRGGGVVFGPTPRSYGY

SEQ ID NO: 2068727 - protein, 21 aa, Staphylococcus
GTISRAINVISNFETAVQKLK

SEQ ID NO: 2068728 - protein, 22 aa, Staphylococcus
GTIVSIVHRIGPLKISDIAVLI

SEQ ID NO: 2068729 - protein, 20 aa, Staphylococcus
GTKDFEFPNVIRAIQYTATE

SEQ ID NO: 2068730 - protein, 17 aa, Staphylococcus
GTKFDVYFKGEYFDTFL

SEQ ID NO: 2068731 - protein, 23 aa, Staphylococcus
GTKGQLISETFIKNGAKGEKGED

SEQ ID NO: 2068732 - protein, 18 aa, Staphylococcus
GTKILPHSKVMLLTDGDI

SEQ ID NO: 2068733 - protein, 37 aa, Staphylococcus
GTKKRAPLIFRKLNLEWFYRLITDWKRMARMQRLPRF

SEQ ID NO: 2068734 - protein, 17 aa, Staphylococcus
GTKTAIVHRIGPLNISD

SEQ ID NO: 2068735 - protein, 18 aa, Staphylococcus
GTLELLELISHKYDFQYQ

SEQ ID NO: 2068736 - protein, 23 aa, Staphylococcus
GTLGFLVVHIPFISSENFEDFKN

SEQ ID NO: 2068737 - protein, 28 aa, Staphylococcus
GTLIEFDKSWEKIGIRLVDSLLEEYPVA

SEQ ID NO: 2068738 - protein, 19 aa, Staphylococcus
GTLIEYFRTLHLPEIDPKD

SEQ ID NO: 2068739 - protein, 18 aa, Staphylococcus
GTLKEEMLKFSELMQSVG

SEQ ID NO: 2068740 - protein, 21 aa, Staphylococcus
GTLLEAFHKYSYRLSETAFVG

SEQ ID NO: 2068741 - protein, 20 aa, Staphylococcus
GTLLIAGAITRGDVLVNGAI

SEQ ID NO: 2068742 - protein, 20 aa, Staphylococcus
GTLLQAFHQYSHMLSKVAFV

SEQ ID NO: 2068743 - protein, 21 aa, Staphylococcus
GTLLQAFHQYSHMLSKVAFVG

SEQ ID NO: 2068744 - protein, 21 aa, Staphylococcus
GTLLQAFHQYSHMLSNVAFVG

SEQ ID NO: 2068745 - protein, 20 aa, Staphylococcus
GTLLQAFHQYSHMLSQVAFV

SEQ ID NO: 2068746 - protein, 23 aa, Staphylococcus
GTLPHNIVFIFQPAEETGGGAHR

SEQ ID NO: 2068747 - protein, 20 aa, Staphylococcus
GTLSKGAFVAIIEETIRYKM

SEQ ID NO: 2068748 - protein, 24 aa, Staphylococcus
GTLVNGLMYQMKNLSGINGEIRPG

SEQ ID NO: 2068749 - protein, 17 aa, Staphylococcus
GTMFYENRLLKKIKDAA

SEQ ID NO: 2068750 - protein, 23 aa, Staphylococcus
GTMPQTRFVLKKALEQDLKPVVV

SEQ ID NO: 2068751 - protein, 23 aa, Staphylococcus
GTMPQTRFVLKKALEQNLKPVVV

SEQ ID NO: 2068752 - protein, 24 aa, Staphylococcus
GTMPQTRFVLKKALEQNLKPVVVV

SEQ ID NO: 2068753 - protein, 19 aa, Staphylococcus
GTNNIYELALKRDIFFHHP

SEQ ID NO: 2068754 - protein, 27 aa, Staphylococcus
GTNSETFIITSFKHKVILIGGTEYAGE

SEQ ID NO: 2068755 - protein, 17 aa, Staphylococcus
GTNTPFIGYKVYGTPVL

SEQ ID NO: 2068756 - protein, 20 aa, Staphylococcus
GTPIILLNDHYTLGSYPQIG

SEQ ID NO: 2068757 - protein, 17 aa, Staphylococcus
GTPLDSLLRERNIKDIE

SEQ ID NO: 2068758 - protein, 23 aa, Staphylococcus
GTPTALNIVQLEKLLKAINNTFT

SEQ ID NO: 2068759 - protein, 20 aa, Staphylococcus
GTPTGLWLEEASEPYNILTE

SEQ ID NO: 2068760 - protein, 29 aa, Staphylococcus
GTQFDVYIDGKYFDQFLSPQYGDHNILNT

SEQ ID NO: 2068761 - protein, 27 aa, Staphylococcus
GTQFESSVFPLILRGISILGVDSVFTP

SEQ ID NO: 2068762 - protein, 21 aa, Staphylococcus
GTQMFFYYQSYMERERRLTNL

SEQ ID NO: 2068763 - protein, 37 aa, Staphylococcus
GTQMVIVHLYDYIPRLFWPIYYVIQAPLQGLIMRGFE

SEQ ID NO: 2068764 - protein, 20 aa, Staphylococcus
GTRGKLISETFVADGQKGAD

SEQ ID NO: 2068765 - protein, 23 aa, Staphylococcus
GTRMKSKLYKVLHKVADKTMIEH

SEQ ID NO: 2068766 - protein, 19 aa, Staphylococcus
GTRPLLIEVQSLVTPTTFN

SEQ ID NO: 2068767 - protein, 25 aa, Staphylococcus
GTSDFQPLFQKYNIRYSLMGHVHFR

SEQ ID NO: 2068768 - protein, 41 aa, Staphylococcus
GTSFFGAYDLALPKDMTFIGQPLWGSIGYTLPATLGTQMAN

SEQ ID NO: 2068769 - protein, 25 aa, Staphylococcus
GTSFFGAYDLALYKGNKFVGQPLWG

SEQ ID NO: 2068770 - protein, 37 aa, Staphylococcus
GTSFFGAYDLALYKNVDFIGQPLWGSIGYTLPATIGS

SEQ ID NO: 2068771 - protein, 24 aa, Staphylococcus
GTSFQQEVWAYLNTIPYGELTTYG

SEQ ID NO: 2068772 - protein, 28 aa, Staphylococcus
GTSGIEYFTPILNLGETGILGVGALMKE

SEQ ID NO: 2068773 - protein, 28 aa, Staphylococcus
GTSGIEYFTPILNLSETGILGVGALSKE

SEQ ID NO: 2068774 - protein, 25 aa, Staphylococcus
GTSGLQLFDYKFGQTGIHGTEQDNY

SEQ ID NO: 2068775 - protein, 22 aa, Staphylococcus
GTSGLQLFDYKFGQTGVHGTEA

SEQ ID NO: 2068776 - protein, 18 aa, Staphylococcus
GTSHASLIRFPESALRPL

SEQ ID NO: 2068777 - protein, 24 aa, Staphylococcus
GTSIFSMIVLDHPLKRVYPEVDLV

SEQ ID NO: 2068778 - protein, 24 aa, Staphylococcus
GTSIFSMIVLEKPIKDVYPEVDIV

SEQ ID NO: 2068779 - protein, 24 aa, Staphylococcus
GTSIFSMIVLEQPIQRVYPEVDIV

SEQ ID NO: 2068780 - protein, 28 aa, Staphylococcus
GTSIKALRPFYYPLNKLFSISEMIKKAG

SEQ ID NO: 2068781 - protein, 25 aa, Staphylococcus
GTSNDIKHIVVYNPAPLAVKDVSIL

SEQ ID NO: 2068782 - protein, 24 aa, Staphylococcus
GTSQQAILLLHSFTGTVKDVKHLA

SEQ ID NO: 2068783 - protein, 17 aa, Staphylococcus
GTSVIVAIFGHPVEFNP

SEQ ID NO: 2068784 - protein, 28 aa, Staphylococcus
GTSVKKQPPFFYPLDKLVSISNMIEEAG

SEQ ID NO: 2068785 - protein, 27 aa, Staphylococcus
GTSVKSLPPFFYPLNELISITEMIKSA

SEQ ID NO: 2068786 - protein, 22 aa, Staphylococcus
GTSYGIFAPWLNGVTNCIAGDR

SEQ ID NO: 2068787 - protein, 23 aa, Staphylococcus
GTSYGIFAPWLNGVTNCIAGGRF

SEQ ID NO: 2068788 - protein, 20 aa, Staphylococcus
GTTLVVCGDTPLITAETLQA

SEQ ID NO: 2068789 - protein, 20 aa, Staphylococcus
GTTLVVCGDTPLITAHTLQK

SEQ ID NO: 2068790 - protein, 19 aa, Staphylococcus
GTTLVVCGDTPLITSETLQ

SEQ ID NO: 2068791 - protein, 33 aa, Staphylococcus
GTTNEAIFPYIKDLNLHIITNSLFIFEQYKDIE

SEQ ID NO: 2068792 - protein, 26 aa, Staphylococcus
GTTRALLNNMVLGVSQGFEKSLELVG

SEQ ID NO: 2068793 - protein, 25 aa, Staphylococcus
GTTTKQTIFSMKKINDVLGTMKRQL

SEQ ID NO: 2068794 - protein, 21 aa, Staphylococcus
GTTTRLLAGLLSGLNLNCVLS

SEQ ID NO: 2068795 - protein, 20 aa, Staphylococcus
GTTYHLVFNPPKVEGICDID

SEQ ID NO: 2068796 - protein, 20 aa, Staphylococcus
GTTYHLVFNPPKVEGICDLD

SEQ ID NO: 2068797 - protein, 23 aa, Staphylococcus
GTVDYDIPFNFNLNFEESKGHLG

SEQ ID NO: 2068798 - protein, 21 aa, Staphylococcus
GTVIQLWHGTPIKELFLDSKE

SEQ ID NO: 2068799 - protein, 23 aa, Staphylococcus
GTVIQLWHGTPIKKLFLDSKEPD

SEQ ID NO: 2068800 - protein, 26 aa, Staphylococcus
GTVKNFRVTKIFGYFGLKREEIEEAQ

SEQ ID NO: 2068801 - protein, 52 aa, Staphylococcus
GTVKRKMTLDFYLRPFVKTKIKSWVRQLLWMSLYQYIYLDKVPNHAIINEAV

SEQ ID NO: 2068802 - protein, 49 aa, Staphylococcus
GTVKRKYTLDFYLKPFLKTKIKGWVRELLWMSIYQYVYLDKVPNHAIIN

SEQ ID NO: 2068803 - protein, 23 aa, Staphylococcus
GTVNKKLIFTLPGSTGAVNLAMK

SEQ ID NO: 2068804 - protein, 23 aa, Staphylococcus
GTVNLPMDIAIVKAMKSAVNHTQ

SEQ ID NO: 2068805 - protein, 27 aa, Staphylococcus
GTVSDIYASVRLLWSRIGEPFVGYSDA

SEQ ID NO: 2068806 - protein, 28 aa, Staphylococcus
GTVVFDPNLRFPLWDSLDDLRETVLDFI

SEQ ID NO: 2068807 - protein, 24 aa, Staphylococcus
GTVVGFFTPELFHGVGSAGFHVHF

SEQ ID NO: 2068808 - protein, 21 aa, Staphylococcus
GTVYLGIIAGFGVYRGIKYFS

SEQ ID NO: 2068809 - protein, 17 aa, Staphylococcus
GTWTYLGEMLVSIPFEP

SEQ ID NO: 2068810 - protein, 20 aa, Staphylococcus
GTYDFTRTHYPIFGKKVGEK

SEQ ID NO: 2068811 - protein, 21 aa, Staphylococcus
GTYDFTRTHYPIFGKKVGEQV

SEQ ID NO: 2068812 - protein, 18 aa, Staphylococcus
GTYIDIVSPYKLTFSFKM

SEQ ID NO: 2068813 - protein, 19 aa, Staphylococcus
GTYLTTGIKMPNNSRLVGQ

SEQ ID NO: 2068814 - protein, 23 aa, Staphylococcus
GTYRALTKVFTRFGVEVDFVDTT

SEQ ID NO: 2068815 - protein, 23 aa, Staphylococcus
GTYTLFNHTLPKYGIDVSIVDSK

SEQ ID NO: 2068816 - protein, 20 aa, Staphylococcus
GTYTMPCARTLEPVDVPLDV

SEQ ID NO: 2068817 - protein, 20 aa, Staphylococcus
GTYYLLTKFGKKTYSDFDFT

SEQ ID NO: 2068818 - protein, 31 aa, Staphylococcus
GVAFNKDGYRIGYGGGYYDRFLSEHPSHTIS

SEQ ID NO: 2068819 - protein, 18 aa, Staphylococcus
GVAILWITHSNDQSNRHF

SEQ ID NO: 2068820 - protein, 17 aa, Staphylococcus
GVAKELLVVLLKSVEYY

SEQ ID NO: 2068821 - protein, 19 aa, Staphylococcus
GVAPGPIYTPLIPATFDED

SEQ ID NO: 2068822 - protein, 25 aa, Staphylococcus
GVASKAFISLINAGVPFYQTTTSEI

SEQ ID NO: 2068823 - protein, 26 aa, Staphylococcus
GVASKAFITLINANIPFYQTTTSEIS

SEQ ID NO: 2068824 - protein, 25 aa, Staphylococcus
GVASKAFITLINSEIPFYQTTTSEI

SEQ ID NO: 2068825 - protein, 26 aa, Staphylococcus
GVASKAFITLINSNIPFYQTTTSEIS

SEQ ID NO: 2068826 - protein, 32 aa, Staphylococcus
GVAYTAKALNLKAVIFMPVTTPLQKVNQVKFF

SEQ ID NO: 2068827 - protein, 24 aa, Staphylococcus
GVCLNVGCIPSKALLHASHRYDET

SEQ ID NO: 2068828 - protein, 23 aa, Staphylococcus
GVCLNVGCIPSKALLHVSHVFQE

SEQ ID NO: 2068829 - protein, 26 aa, Staphylococcus
GVCNGFQILTEIGLLPGALLHNDSHL

SEQ ID NO: 2068830 - protein, 28 aa, Staphylococcus
GVCNGFQILTEIGLLPGALLHNDSHLFI

SEQ ID NO: 2068831 - protein, 25 aa, Staphylococcus
GVCNGFQVLTEVGLLPGALLHNDMH

SEQ ID NO: 2068832 - protein, 19 aa, Staphylococcus
GVCNPLVNSYKRLVPGYEA

SEQ ID NO: 2068833 - protein, 23 aa, Staphylococcus
GVDALLFETYYDLEELKGIVVST

SEQ ID NO: 2068834 - protein, 23 aa, Staphylococcus
GVDALLFETYYDLNELLQVIRAT

SEQ ID NO: 2068835 - protein, 24 aa, Staphylococcus
GVDDLISLFLLLQMEDVELIGVST

SEQ ID NO: 2068836 - protein, 25 aa, Staphylococcus
GVDFRLIEPAAFYHTLQHFTGSKEH

SEQ ID NO: 2068837 - protein, 20 aa, Staphylococcus
GVDFRLIEPKAFYHTLQHFT

SEQ ID NO: 2068838 - protein, 26 aa, Staphylococcus
GVDFRLIEPVAFYHTLQHFTGSKDHN

SEQ ID NO: 2068839 - protein, 24 aa, Staphylococcus
GVDGIGFFFEPPYLGIDIDDIDDD

SEQ ID NO: 2068840 - protein, 25 aa, Staphylococcus
GVDGIMLITPYYNKTNQRGLIKHFE

SEQ ID NO: 2068841 - protein, 22 aa, Staphylococcus
GVDGLLFETYYDLDELTSVITA

SEQ ID NO: 2068842 - protein, 24 aa, Staphylococcus
GVDIKEVFLKLPIIGTEVFDESNE

SEQ ID NO: 2068843 - protein, 24 aa, Staphylococcus
GVDIKEVFLKLPIIGTEVYDEANE

SEQ ID NO: 2068844 - protein, 25 aa, Staphylococcus
GVDIKEVFLKLPIIGTEVYDEENEI

SEQ ID NO: 2068845 - protein, 24 aa, Staphylococcus
GVDIKEVFLKLPIIGTEVYDESNE

SEQ ID NO: 2068846 - protein, 19 aa, Staphylococcus
GVDPGLVYKTLVLENTNHA

SEQ ID NO: 2068847 - protein, 17 aa, Staphylococcus
GVDPLPLMKEAVEIAHS

SEQ ID NO: 2068848 - protein, 33 aa, Staphylococcus
GVDSVETPMLLRKQIWRRLATDLKPEQLHTIKN

SEQ ID NO: 2068849 - protein, 23 aa, Staphylococcus
GVDVAIEAVGIPKTFDLCQKLIG

SEQ ID NO: 2068850 - protein, 24 aa, Staphylococcus
GVDVATFTLAVNRNFKSKNGEQQA

SEQ ID NO: 2068851 - protein, 23 aa, Staphylococcus
GVDVFRIFDSLNWVDQMKIANEA

SEQ ID NO: 2068852 - protein, 24 aa, Staphylococcus
GVDVFRIFDSLNWVDQMKVANAAV

SEQ ID NO: 2068853 - protein, 27 aa, Staphylococcus
GVDVKGKWFFDRYSPVTNIKAVGNADV

SEQ ID NO: 2068854 - protein, 27 aa, Staphylococcus
GVDVSGKWFFDRFSPVTQIKAIGNADV

SEQ ID NO: 2068855 - protein, 27 aa, Staphylococcus
GVDVSGKWFFDRYSPVTHIKAVGHADV

SEQ ID NO: 2068856 - protein, 27 aa, Staphylococcus
GVDVSGKWFFNRYSPVTNIKAVGNADV

SEQ ID NO: 2068857 - protein, 18 aa, Staphylococcus
GVEFIALGRELLLDPRFI

SEQ ID NO: 2068858 - protein, 17 aa, Staphylococcus
GVEIFIRTKKQLITTTE

SEQ ID NO: 2068859 - protein, 22 aa, Staphylococcus
GVELKNRFVLAPLTHISSNDDG

SEQ ID NO: 2068860 - protein, 32 aa, Staphylococcus; identical to SEQ ID NO: 1819177

SEQ ID NO: 2068861 - protein, 37 aa, Staphylococcus; identical to SEQ ID NO: 1827842

SEQ ID NO: 2068862 - protein, 17 aa, Staphylococcus
GVERSRKALSQADLILF

SEQ ID NO: 2068863 - protein, 20 aa, Staphylococcus
GVFGAAWLNDQLSTELIVDG

SEQ ID NO: 2068864 - protein, 19 aa, Staphylococcus
GVFVYVPKNVVVEHPIHYV

SEQ ID NO: 2068865 - protein, 18 aa, Staphylococcus
GVGFRYYTQRLGNQHHVV

SEQ ID NO: 2068866 - protein, 21 aa, Staphylococcus
GVGMRIIQINDIKLAIINLQG

SEQ ID NO: 2068867 - protein, 17 aa, Staphylococcus
GVGMRYIQINEIKLAII

SEQ ID NO: 2068868 - protein, 24 aa, Staphylococcus
GVGPLTITMVLNNTLLAEKLRRGI

SEQ ID NO: 2068869 - protein, 24 aa, Staphylococcus
GVGPMTITMVLNNTLIAEKMRRGI

SEQ ID NO: 2068870 - protein, 24 aa, Staphylococcus
GVGPMTITMVLNNTLLAEKMRRGL

SEQ ID NO: 2068871 - protein, 22 aa, Staphylococcus
GVGPVIEGGFYYDFDMDEKVSS

SEQ ID NO: 2068872 - protein, 22 aa, Staphylococcus
GVGPVIEGGFYYDFDMEESISS

SEQ ID NO: 2068873 - protein, 23 aa, Staphylococcus
GVGPVIEGGFYYDFDMENKISSD

SEQ ID NO: 2068874 - protein, 20 aa, Staphylococcus
GVGPVIEGGFYYDFDTDEKI

SEQ ID NO: 2068875 - protein, 20 aa, Staphylococcus
GVGPVVEGGFYYDFDMDEKV

SEQ ID NO: 2068876 - protein, 26 aa, Staphylococcus
GVHALTKILEAAVPLLHDYDIELTEA

SEQ ID NO: 2068877 - protein, 24 aa, Staphylococcus
GVHDLPFVCVIINNKYAISVPDSL

SEQ ID NO: 2068878 - protein, 31 aa, Staphylococcus
GVHGENFMILLASRLDAVVYALGLARTRRQA

SEQ ID NO: 2068879 - protein, 29 aa, Staphylococcus
GVHGENFMILLASRLDAVVYSLGLARTRR

SEQ ID NO: 2068880 - protein, 28 aa, Staphylococcus
GVHGLPVQFDIDKLWIKNINVTTGLVSG

SEQ ID NO: 2068881 - protein, 18 aa, Staphylococcus
GVHKRGMKLILDLVVNHT

SEQ ID NO: 2068882 - protein, 24 aa, Staphylococcus
GVHNLPFVCVIINNKYAISVPDSL

SEQ ID NO: 2068883 - protein, 24 aa, Staphylococcus
GVHQLPFVCVIINNKYAISVPDSL

SEQ ID NO: 2068884 - protein, 28 aa, Staphylococcus
GVHSHYKHLFALLDLAKKQGLEKVYVHA

SEQ ID NO: 2068885 - protein, 25 aa, Staphylococcus
GVIDIDMYIIVSYGVKISEVANNVQ

SEQ ID NO: 2068886 - protein, 20 aa, Staphylococcus
GVIKYPILNERMNQLPVLTD

SEQ ID NO: 2068887 - protein, 20 aa, Staphylococcus
GVILSQIFRGFCKNIEDAET

SEQ ID NO: 2068888 - protein, 18 aa, Staphylococcus
GVIMLTKSLAMEWSKYNI

SEQ ID NO: 2068889 - protein, 18 aa, Staphylococcus
GVITGWIIVKSKNTIHDG

SEQ ID NO: 2068890 - protein, 18 aa, Staphylococcus
GVIVLTDPDFPGDRIRNI

SEQ ID NO: 2068891 - protein, 24 aa, Staphylococcus
GVIYIPEFINKAVKFAMISSIDIA

SEQ ID NO: 2068892 - protein, 17 aa, Staphylococcus
GVKAAAKYYFNKDLKDL

SEQ ID NO: 2068893 - protein, 24 aa, Staphylococcus
GVKEMPLTQYLISQLMLSDEERIE

SEQ ID NO: 2068894 - protein, 24 aa, Staphylococcus
GVKGRILTSNYLGFNSPKMYYELL

SEQ ID NO: 2068895 - protein, 25 aa, Staphylococcus
GVKGSLQRLGLDYIDLYQLHGGTID

SEQ ID NO: 2068896 - protein, 20 aa, Staphylococcus
GVKHAIIPDRIEAGTFIIAA

SEQ ID NO: 2068897 - protein, 22 aa, Staphylococcus
GVKHHLLDMSLLSQLTPNALTQ

SEQ ID NO: 2068898 - protein, 18 aa, Staphylococcus
GVKHWYVGDFMTSLDMQG

SEQ ID NO: 2068899 - protein, 23 aa, Staphylococcus
GVKIMGWSPLAGGKLLNLNDDKA

SEQ ID NO: 2068900 - protein, 25 aa, Staphylococcus
GVKLVDFWATWCGPCKMIAPVLEEL

SEQ ID NO: 2068901 - protein, 25 aa, Staphylococcus
GVKMALWYQEMLRNLKRFKAVREEI

SEQ ID NO: 2068902 - protein, 37 aa, Staphylococcus; identical to SEQ ID NO: 1683262

SEQ ID NO: 2068903 - protein, 17 aa, Staphylococcus
GVKPVSLEFYRSHIGGH

SEQ ID NO: 2068904 - protein, 23 aa, Staphylococcus
GVKRMEWMLDRLNNPQLNIRGIH

SEQ ID NO: 2068905 - protein, 24 aa, Staphylococcus
GVKRMEWMLERLNNPQFNINGIHV

SEQ ID NO: 2068906 - protein, 17 aa, Staphylococcus
GVKVSRITALQDDLKMA

SEQ ID NO: 2068907 - protein, 20 aa, Staphylococcus
GVKYILNNPVYKGYVRFNNY

SEQ ID NO: 2068908 - protein, 25 aa, Staphylococcus
GVLARKYHLPIYANEKTWKMIEKKD

SEQ ID NO: 2068909 - protein, 23 aa, Staphylococcus
GVLDARKILKKHKPDLLFSKGGF

SEQ ID NO: 2068910 - protein, 20 aa, Staphylococcus
GVLEKYFNESPEKLDPVYKE

SEQ ID NO: 2068911 - protein, 29 aa, Staphylococcus
GVLGPQDSYLLIRGIKTLGLRMEQINRNV

SEQ ID NO: 2068912 - protein, 28 aa, Staphylococcus
GVLGPQDSYLLIRGIKTLGLRMEQVQRN

SEQ ID NO: 2068913 - protein, 24 aa, Staphylococcus
GVLQPIVLRQTVQGYYIVVGERRF

SEQ ID NO: 2068914 - protein, 21 aa, Staphylococcus
GVLTDILPSIDNIERALQIEG

SEQ ID NO: 2068915 - protein, 21 aa, Staphylococcus
GVLTDILPTIDNIERALQIEG

SEQ ID NO: 2068916 - protein, 22 aa, Staphylococcus
GVLYALQRLDTLIPPQLSHLKK

SEQ ID NO: 2068917 - protein, 19 aa, Staphylococcus
GVMHACGHDIHMASILGVA

SEQ ID NO: 2068918 - protein, 20 aa, Staphylococcus
GVMHACGHDIHMATILAATM

SEQ ID NO: 2068919 - protein, 24 aa, Staphylococcus
GVMKYDLNLPIGIIPGGTFNDFTK

SEQ ID NO: 2068920 - protein, 27 aa, Staphylococcus
GVMLQHYSPFKVIEQFHLISNIAPGRV

SEQ ID NO: 2068921 - protein, 18 aa, Staphylococcus
GVMSKEALELKEKILQEK

SEQ ID NO: 2068922 - protein, 18 aa, Staphylococcus
GVNKFKTIVGNDAFIGCN

SEQ ID NO: 2068923 - protein, 24 aa, Staphylococcus
GVNMAFYDAYLLAKALKENNNLQD

SEQ ID NO: 2068924 - protein, 24 aa, Staphylococcus
GVNMIALINGRPKLINLKEALVEY

SEQ ID NO: 2068925 - protein, 23 aa, Staphylococcus
GVNMIALVNGRPKLINLKEALVE

SEQ ID NO: 2068926 - protein, 22 aa, Staphylococcus
GVNMIALVNGRPKLISLKDALV

SEQ ID NO: 2068927 - protein, 23 aa, Staphylococcus
GVNSLPLNYVLQRGIQLTNTRGV

SEQ ID NO: 2068928 - protein, 23 aa, Staphylococcus
GVNTLIHSLRTWASKKGTALLIS

SEQ ID NO: 2068929 - protein, 22 aa, Staphylococcus
GVPDRIVIMPKGKTYYVEMKQP

SEQ ID NO: 2068930 - protein, 19 aa, Staphylococcus
GVPEELQGAALYLASDASS

SEQ ID NO: 2068931 - protein, 18 aa, Staphylococcus
GVQALILAPTRELAMQVA

SEQ ID NO: 2068932 - protein, 25 aa, Staphylococcus
GVQEVRAWTFRKGMTAPQCAGIIHT

SEQ ID NO: 2068933 - protein, 18 aa, Staphylococcus
GVQIELTTSLRKTFFKNN

SEQ ID NO: 2068934 - protein, 25 aa, Staphylococcus
GVQKRNMPLTRFAEITASEPAKIFG

SEQ ID NO: 2068935 - protein, 23 aa, Staphylococcus
GVQLELTSALRKQLFKNGKYGYH

SEQ ID NO: 2068936 - protein, 18 aa, Staphylococcus
GVRAFTASAGPGLSLMME

SEQ ID NO: 2068937 - protein, 29 aa, Staphylococcus
GVRASHSYKLFIILSPSGAYYGGDTLKST

SEQ ID NO: 2068938 - protein, 34 aa, Staphylococcus
GVRILFVAATAPFTPFYRALDWVVTNPLESIKDE

SEQ ID NO: 2068939 - protein, 23 aa, Staphylococcus
GVRLKAYFNELKYNTQFKNKLEN

SEQ ID NO: 2068940 - protein, 18 aa, Staphylococcus
GVRRIEALTGRAAFLYLE

SEQ ID NO: 2068941 - protein, 23 aa, Staphylococcus
GVRVVSMPNWFAFEQQPEEYKES

SEQ ID NO: 2068942 - protein, 21 aa, Staphylococcus
GVRVVSMPNWFAFEQQSDEYK

SEQ ID NO: 2068943 - protein, 23 aa, Staphylococcus
GVRVVSMPNWFAFEQQSEDYKES

SEQ ID NO: 2068944 - protein, 31 aa, Staphylococcus
GVSAPAVLGIYPHTVFELAKRIIPSEKVASI

SEQ ID NO: 2068945 - protein, 26 aa, Staphylococcus
GVSDMKGGMAALFYVLERLHQEGRLP

SEQ ID NO: 2068946 - protein, 27 aa, Staphylococcus
GVSDMKGGMASLFYVLEKLHQEGRQPK

SEQ ID NO: 2068947 - protein, 27 aa, Staphylococcus
GVSDMKGGMASLFYVLEKLHQEGRRPK

SEQ ID NO: 2068948 - protein, 25 aa, Staphylococcus
GVSKSSLNAFVKYVADEFADQGITA

SEQ ID NO: 2068949 - protein, 22 aa, Staphylococcus
GVSLRTLHYYHDIELLIPHHIE

SEQ ID NO: 2068950 - protein, 27 aa, Staphylococcus
GVSQTQISLPFISAGANGPLHLEISLT

SEQ ID NO: 2068951 - protein, 25 aa, Staphylococcus
GVSQTQISLPFISAGESGPLHLEIT

SEQ ID NO: 2068952 - protein, 21 aa, Staphylococcus
GVTCEFEFKKDYPALYNDPEF

SEQ ID NO: 2068953 - protein, 24 aa, Staphylococcus
GVTHYLLIITTPNNNKRIVWLFNH

SEQ ID NO: 2068954 - protein, 17 aa, Staphylococcus
GVTIMYMAPKLDAGDII

SEQ ID NO: 2068955 - protein, 17 aa, Staphylococcus
GVTKQYLNVKTPGIEGL

SEQ ID NO: 2068956 - protein, 24 aa, Staphylococcus
GVTLAAGYSLNWLKQTFFEHESFE

SEQ ID NO: 2068957 - protein, 24 aa, Staphylococcus
GVTLAAGYSLSWLKHTFFAADSYD

SEQ ID NO: 2068958 - protein, 25 aa, Staphylococcus
GVTLSAGYSLSWFKREFYPDDSFEK

SEQ ID NO: 2068959 - protein, 23 aa, Staphylococcus
GVTPLVPMFKQVIDNDKQSHFIQ

SEQ ID NO: 2068960 - protein, 20 aa, Staphylococcus
GVVAIFTYGLAKADDMFKQA

SEQ ID NO: 2068961 - protein, 17 aa, Staphylococcus
GVVFLQAEQSRIYTRSR

SEQ ID NO: 2068962 - protein, 29 aa, Staphylococcus
GVVFNEQGYRIGYGGGYFDKFLNKHKTKT

SEQ ID NO: 2068963 - protein, 33 aa, Staphylococcus
GVVGAVVAWNFPLLLASWKLAPALAAGNTVVIQ

SEQ ID NO: 2068964 - protein, 27 aa, Staphylococcus
GVVLFENLKLPVIKKTKTGYSTAVDVL

SEQ ID NO: 2068965 - protein, 23 aa, Staphylococcus
GVVMEELRLLARSVFVLDSNDKV

SEQ ID NO: 2068966 - protein, 18 aa, Staphylococcus
GVYAFPEEVAQLKKFFGP

SEQ ID NO: 2068967 - protein, 20 aa, Staphylococcus
GVYGLIIPDLPFELTEKLKE

SEQ ID NO: 2068968 - protein, 24 aa, Staphylococcus
GVYRKLLVFMKFQAGLDVSTQQIA

SEQ ID NO: 2068969 - protein, 27 aa, Staphylococcus
GVYVVPAFVGLGTPYWDADARGAIFGL

SEQ ID NO: 2068970 - protein, 29 aa, Staphylococcus
GVYVVPAFVGLGTPYWDPSARGAIFGITR

SEQ ID NO: 2068971 - protein, 25 aa, Staphylococcus
GVYVVPAFVGLGTPYWDSEARGAIF

SEQ ID NO: 2068972 - protein, 17 aa, Staphylococcus
GWAWLVVNNGNLEIVTT

SEQ ID NO: 2068973 - protein, 17 aa, Staphylococcus
GWAWLVVNNGQLEIVTT

SEQ ID NO: 2068974 - protein, 21 aa, Staphylococcus
GWGEIPMSLGFTYSSNTLMMH

SEQ ID NO: 2068975 - protein, 22 aa, Staphylococcus
GWGEIPMSLGFTYSSNTLMMHL

SEQ ID NO: 2068976 - protein, 19 aa, Staphylococcus
GWKQFTDQITLKRLSKPED

SEQ ID NO: 2068977 - protein, 17 aa, Staphylococcus
GWLLEIVISDTHYDIMQ

SEQ ID NO: 2068978 - protein, 21 aa, Staphylococcus
GWSMSTIFNYFNKLYDNDKKL

SEQ ID NO: 2068979 - protein, 26 aa, Staphylococcus
GYADTGYFMKHGVPAIEFGPSGANWH

SEQ ID NO: 2068980 - protein, 18 aa, Staphylococcus
GYAFSKENWLHLVKEIIK

SEQ ID NO: 2068981 - protein, 24 aa, Staphylococcus
GYAKFAFEKAISYAFDILNMHKIY

SEQ ID NO: 2068982 - protein, 32 aa, Staphylococcus
GYAKKAFKMAIDYAFLVLNLNKVYLYVDVNNE

SEQ ID NO: 2068983 - protein, 23 aa, Staphylococcus
GYANNFLFKKNVAVEATPGNLKQ

SEQ ID NO: 2068984 - protein, 21 aa, Staphylococcus
GYANNFLIKNNYAVEATPGNL

SEQ ID NO: 2068985 - protein, 25 aa, Staphylococcus
GYAPEYLLSINYFEDDPKGFMNFVH

SEQ ID NO: 2068986 - protein, 20 aa, Staphylococcus
GYASTLLGQALDYLKIRNVE

SEQ ID NO: 2068987 - protein, 27 aa, Staphylococcus
GYAYRFKNELWFINFSSNSYRHRKSRN

SEQ ID NO: 2068988 - protein, 18 aa, Staphylococcus
GYCIERHIPVRNKVLIFS

SEQ ID NO: 2068989 - protein, 18 aa, Staphylococcus
GYCTEMMVRFGKDKKPFD

SEQ ID NO: 2068990 - protein, 25 aa, Staphylococcus
GYDPNNPYMNMPDQEWRKNTGDGLS

SEQ ID NO: 2068991 - protein, 17 aa, Staphylococcus
GYEAPCYIAWSGKNRSP

SEQ ID NO: 2068992 - protein, 21 aa, Staphylococcus
GYEGFFHLMNFNGTTEKAQLK

SEQ ID NO: 2068993 - protein, 30 aa, Staphylococcus
GYEQTRAEWLLLDLFKWSRTDYLIHREEQM

SEQ ID NO: 2068994 - protein, 24 aa, Staphylococcus
GYERDRLPILLNKQGEIVAVGTLF

SEQ ID NO: 2068995 - protein, 21 aa, Staphylococcus
GYEVDLQFYSADKTQLINRYQ

SEQ ID NO: 2068996 - protein, 17 aa, Staphylococcus
GYFLSIENDLFSNYQRI

SEQ ID NO: 2068997 - protein, 30 aa, Staphylococcus
GYFNLAPEEFIVWVLGFVKNIADLKQKAAH

SEQ ID NO: 2068998 - protein, 29 aa, Staphylococcus
GYFNMAPEEFIIWVLGFTKSIQDLKHKVK

SEQ ID NO: 2068999 - protein, 19 aa, Staphylococcus
GYFTEVFKSLFGGGQAELR

SEQ ID NO: 2069000 - protein, 22 aa, Staphylococcus
GYGDFFPHRLGHGLGLEEHEYQ

SEQ ID NO: 2069001 - protein, 23 aa, Staphylococcus
GYGEYFPHRLGHGLGLEEHEYQD

SEQ ID NO: 2069002 - protein, 24 aa, Staphylococcus
GYGEYFPHRLGHGLGLEEHEYQDV

SEQ ID NO: 2069003 - protein, 20 aa, Staphylococcus
GYGIINHTFEEFKPRVKGRI

SEQ ID NO: 2069004 - protein, 24 aa, Staphylococcus
GYGKTECWYILDAKDDAEIIYGVN

SEQ ID NO: 2069005 - protein, 25 aa, Staphylococcus
GYGTKMMMFLPQYVQELFPDFNHLY

SEQ ID NO: 2069006 - protein, 32 aa, Staphylococcus
GYGTTMMMHIPQYVQLLFPDFNHLYLVVDTEN

SEQ ID NO: 2069007 - protein, 25 aa, Staphylococcus
GYGTTMMMYLPQYVQDLFPDFNHLY

SEQ ID NO: 2069008 - protein, 21 aa, Staphylococcus
GYHFFKYMRTHYPERPVYYVI

SEQ ID NO: 2069009 - protein, 27 aa, Staphylococcus
GYHPTWKMVLGLFPKEDKIKALEALDR

SEQ ID NO: 2069010 - protein, 27 aa, Staphylococcus
GYHPTWKMVLGLFPKEDKIKAMHALER

SEQ ID NO: 2069011 - protein, 27 aa, Staphylococcus
GYHPTWKMVLGLFPKEDKIKAMNALER

SEQ ID NO: 2069012 - protein, 18 aa, Staphylococcus
GYHVVLASGRPTEGMLPI

SEQ ID NO: 2069013 - protein, 17 aa, Staphylococcus
GYIDMDDNCQFIVAIRS

SEQ ID NO: 2069014 - protein, 19 aa, Staphylococcus
GYINSYGVHAIHGRALPLA

SEQ ID NO: 2069015 - protein, 18 aa, Staphylococcus
GYIQTPYPTYNTLDNVKD

SEQ ID NO: 2069016 - protein, 23 aa, Staphylococcus
GYKIAQRLGGFEAIGPVLQGLNS

SEQ ID NO: 2069017 - protein, 18 aa, Staphylococcus
GYKYLRIRKVDVRKMRCG

SEQ ID NO: 2069018 - protein, 17 aa, Staphylococcus
GYLIEHPKLYDNKTGLY

SEQ ID NO: 2069019 - protein, 21 aa, Staphylococcus
GYLIEHPKLYDNKTGLYNLRL

SEQ ID NO: 2069020 - protein, 19 aa, Staphylococcus
GYLKLKEFLPNNYDFVSNI

SEQ ID NO: 2069021 - protein, 26 aa, Staphylococcus
GYLSKFEIREIRIIKSVLLKGKKSFN

SEQ ID NO: 2069022 - protein, 23 aa, Staphylococcus
GYMQALVDCAIKRQLDLLIIAGD

SEQ ID NO: 2069023 - protein, 32 aa, Staphylococcus
GYMWECPDYFKLDSKDILLFSPQGIEPQGDQF

SEQ ID NO: 2069024 - protein, 23 aa, Staphylococcus
GYNCAQGYFGVTPDITCLGKVIG

SEQ ID NO: 2069025 - protein, 17 aa, Staphylococcus
GYNLQIATNSQFVLSYN

SEQ ID NO: 2069026 - protein, 20 aa, Staphylococcus
GYNNIYQLALERDIFFHHPY

SEQ ID NO: 2069027 - protein, 23 aa, Staphylococcus
GYNPDDILALLEKKLKQYDVYAY

SEQ ID NO: 2069028 - protein, 20 aa, Staphylococcus
GYPLDRYVPVMIVAIGKKAK

SEQ ID NO: 2069029 - protein, 31 aa, Staphylococcus
GYPSATWHNFLLETRFLFFVVKDESEGPVFK

SEQ ID NO: 2069030 - protein, 22 aa, Staphylococcus
GYPVVVRPSYVLGGRAMEIVNS

SEQ ID NO: 2069031 - protein, 26 aa, Staphylococcus
GYPVVVRPSYVLGGRAMEIVYNDAEL

SEQ ID NO: 2069032 - protein, 23 aa, Staphylococcus
GYQIVKRLFDDGFKVAIVDFNGE

SEQ ID NO: 2069033 - protein, 25 aa, Staphylococcus
GYQSARWVLIDLTDVVIHVFHKDER

SEQ ID NO: 2069034 - protein, 24 aa, Staphylococcus
GYRDRTILELLYATGMRVSELIQI

SEQ ID NO: 2069035 - protein, 24 aa, Staphylococcus
GYRDRTILELLYATGMRVTELIHV

SEQ ID NO: 2069036 - protein, 23 aa, Staphylococcus
GYRDRTILELLYATGMRVTELIQ

SEQ ID NO: 2069037 - protein, 34 aa, Staphylococcus
GYRLYSVEDISKLQYILFLRELDLTLKEINDYFK

SEQ ID NO: 2069038 - protein, 24 aa, Staphylococcus
GYRPVMEIQFLGFVFEVFDEVAGQ

SEQ ID NO: 2069039 - protein, 27 aa, Staphylococcus
GYRPVMEIQFLGFVFEVFDSVAGQLAR

SEQ ID NO: 2069040 - protein, 21 aa, Staphylococcus
GYRRVLLELPHEVKSTFIAMQ

SEQ ID NO: 2069041 - protein, 22 aa, Staphylococcus
GYRSLHLVVSIPVFLTDNVEQV

SEQ ID NO: 2069042 - protein, 25 aa, Staphylococcus
GYSMGGRVALYYALYGQCRLSGLIL

SEQ ID NO: 2069043 - protein, 23 aa, Staphylococcus
GYSPLFIELLVTRKDFINRVRKY

SEQ ID NO: 2069044 - protein, 17 aa, Staphylococcus
GYTDYLAGVLFADAHPY

SEQ ID NO: 2069045 - protein, 22 aa, Staphylococcus
GYTFRPQQLYLAETILDQLMHS

SEQ ID NO: 2069046 - protein, 23 aa, Staphylococcus
GYTKGKINYFLGIPYANQPINEH

SEQ ID NO: 2069047 - protein, 18 aa, Staphylococcus
GYTKIKMPVSDKVKQPFG

SEQ ID NO: 2069048 - protein, 25 aa, Staphylococcus
GYTKQLSFDYGLKGIKANAIAPGAV

SEQ ID NO: 2069049 - protein, 19 aa, Staphylococcus
GYTLNVPLFVNEGDVLVIN

SEQ ID NO: 2069050 - protein, 20 aa, Staphylococcus
GYTLNVPLFVNEGDVLVINT

SEQ ID NO: 2069051 - protein, 24 aa, Staphylococcus
GYVAAFVYLFFQQSQQKVTKKQAA

SEQ ID NO: 2069052 - protein, 24 aa, Staphylococcus
GYVFGDGIYEYIRAYDGKLFTVTE

SEQ ID NO: 2069053 - protein, 24 aa, Staphylococcus
GYVFGDGIYEYIRAYKGKLFTVEE

SEQ ID NO: 2069054 - protein, 25 aa, Staphylococcus
GYVFGDGIYEYIRAYNGKLFTVTEH

SEQ ID NO: 2069055 - protein, 19 aa, Staphylococcus
GYVNFHEKLKSLGADIKRV

SEQ ID NO: 2069056 - protein, 18 aa, Staphylococcus
GYYDGVTFHRVINDFMIQ

SEQ ID NO: 2069057 - protein, 21 aa, Staphylococcus
GYYFNIFDYGSFTIGSKNEEM

SEQ ID NO: 2069058 - protein, 25 aa, Staphylococcus
GYYPGNWRELRLPGILSSKKQEKRS

SEQ ID NO: 2069059 - protein, 19 aa, Staphylococcus
GYYVTPRFEAYKTASEKIM

SEQ ID NO: 2069060 - protein, 40 aa, Staphylococcus
HAAAYVLMAVRIAYFKVHYPLYYYASYFTVRASDFDLISM

SEQ ID NO: 2069061 - protein, 17 aa, Staphylococcus
HAAFKDIVKMMDYGEGL

SEQ ID NO: 2069062 - protein, 18 aa, Staphylococcus
HAAHGYLINQFLSPHHNQ

SEQ ID NO: 2069063 - protein, 30 aa, Staphylococcus
HAAPPEEILKSSPYVWFKDVLDGYDYLVEQ

SEQ ID NO: 2069064 - protein, 31 aa, Staphylococcus
HAAPPEEILKSSPYVWFKDVLDGYDYLVEQG

SEQ ID NO: 2069065 - protein, 32 aa, Staphylococcus
HAAPPEEILKSSPYVWFKDVLDGYQYLVDQGY

SEQ ID NO: 2069066 - protein, 31 aa, Staphylococcus
HAAPPEEILSSSPFVWFKDALDGYDFLVDKG

SEQ ID NO: 2069067 - protein, 19 aa, Staphylococcus
HACTVITMYPHLDGVLSLD

SEQ ID NO: 2069068 - protein, 24 aa, Staphylococcus
HADAGLLYISYITNPTTGGVSASF

SEQ ID NO: 2069069 - protein, 22 aa, Staphylococcus
HADNPLNWQYVKPIKTQLTDFG

SEQ ID NO: 2069070 - protein, 26 aa, Staphylococcus
HADTFGHYILISPSVWYPDFVKFMKS

SEQ ID NO: 2069071 - protein, 27 aa, Staphylococcus
HAEAGDIIYFVLKETPFYAVSGGQVAD

SEQ ID NO: 2069072 - protein, 27 aa, Staphylococcus
HAEAILEELGLPYRRVILCTGDIGFGS

SEQ ID NO: 2069073 - protein, 24 aa, Staphylococcus
HAENITFNNVRFRNLISYHCVDAN

SEQ ID NO: 2069074 - protein, 17 aa, Staphylococcus
HAFIAQVDRAFLSSNGT

SEQ ID NO: 2069075 - protein, 23 aa, Staphylococcus
HAFKDRILIPKNDLDRTPKKNKV

SEQ ID NO: 2069076 - protein, 21 aa, Staphylococcus
HAFNEVLLRVQRGELPAEIVC

SEQ ID NO: 2069077 - protein, 17 aa, Staphylococcus
HAFNPRTIFLLQHACRE

SEQ ID NO: 2069078 - protein, 31 aa, Staphylococcus
HAFYTHGHLYRVNQTRMKLAEKAKTVGAQLA

SEQ ID NO: 2069079 - protein, 26 aa, Staphylococcus
HAGLSWLTILKKRPAYREAFYNFDPE

SEQ ID NO: 2069080 - protein, 26 aa, Staphylococcus
HAGSLKGFIWAHYEPQLKIVQIEVLY

SEQ ID NO: 2069081 - protein, 22 aa, Staphylococcus
HAHPSLSEILMELGLKAENRAI

SEQ ID NO: 2069082 - protein, 17 aa, Staphylococcus
HAIAKAVYDFDPTLIYV

SEQ ID NO: 2069083 - protein, 18 aa, Staphylococcus
HAIDNEVLALKRIRIGDL

SEQ ID NO: 2069084 - protein, 18 aa, Staphylococcus
HAIDNEVLNLKRVQIGKL

SEQ ID NO: 2069085 - protein, 25 aa, Staphylococcus
HAIHTARQFIGNEPFAVLLGDDIME

SEQ ID NO: 2069086 - protein, 17 aa, Staphylococcus
HAIVWQSRQTQSICHEL

SEQ ID NO: 2069087 - protein, 23 aa, Staphylococcus
HAIYTARQFIGNEPFAVLLGDDI

SEQ ID NO: 2069088 - protein, 19 aa, Staphylococcus
HAKDHHLTFYGGQTVKSLE

SEQ ID NO: 2069089 - protein, 18 aa, Staphylococcus
HAKLVPILEQSKADYILC

SEQ ID NO: 2069090 - protein, 25 aa, Staphylococcus
HAKQMSEFIFAYILDDYKKMRTSYI

SEQ ID NO: 2069091 - protein, 30 aa, Staphylococcus
HAKQNSLEHLLFGLGIRHLGAKASQILAEK

SEQ ID NO: 2069092 - protein, 17 aa, Staphylococcus
HALMNWLNQHDFNYKDI

SEQ ID NO: 2069093 - protein, 21 aa, Staphylococcus
HALMTTFRQHTPHHIAGLKVT

SEQ ID NO: 2069094 - protein, 24 aa, Staphylococcus
HALTKILETAVPLLQDFDIELTEA

SEQ ID NO: 2069095 - protein, 24 aa, Staphylococcus
HALTKILEVAVPLLQDFDIELTEA

SEQ ID NO: 2069096 - protein, 17 aa, Staphylococcus
HALYLLNQLNDEGHLIA

SEQ ID NO: 2069097 - protein, 23 aa, Staphylococcus
HANIVPWQQLAKRKNAHLKFIPM

SEQ ID NO: 2069098 - protein, 21 aa, Staphylococcus
HANPYMLRFEFNGHRIVSFSG

SEQ ID NO: 2069099 - protein, 23 aa, Staphylococcus
HAPDLIKSAAYPNILPSSTNPTL

SEQ ID NO: 2069100 - protein, 24 aa, Staphylococcus
HAQGKRVFVITHDYALILELCSYV

SEQ ID NO: 2069101 - protein, 24 aa, Staphylococcus
HAQRAMLLHYISGKYVLDFKEDDV

SEQ ID NO: 2069102 - protein, 17 aa, Staphylococcus
HARKSILILQKKKPHVT

SEQ ID NO: 2069103 - protein, 31 aa, Staphylococcus
HARQGTHGFGYDPIFFVPDKKRTMAELTNEE

SEQ ID NO: 2069104 - protein, 17 aa, Staphylococcus
HASFPYLYTHSTSYATL

SEQ ID NO: 2069105 - protein, 24 aa, Staphylococcus
HASKMKFHKLLRDLDLESLQYKQI

SEQ ID NO: 2069106 - protein, 18 aa, Staphylococcus
HASLKRYLLEESFELFEA

SEQ ID NO: 2069107 - protein, 18 aa, Staphylococcus
HASLKRYLLEETFELFEA

SEQ ID NO: 2069108 - protein, 33 aa, Staphylococcus
HASRHHYLQTFWNHLKPIVEVLVLCSMRERMRT

SEQ ID NO: 2069109 - protein, 19 aa, Staphylococcus
HATIFLMNAVYDFDTVRNN

SEQ ID NO: 2069110 - protein, 20 aa, Staphylococcus
HATIFLMNAVYEFDTVREYE

SEQ ID NO: 2069111 - protein, 17 aa, Staphylococcus
HAVPIVDRLTLDLIKQL

SEQ ID NO: 2069112 - protein, 20 aa, Staphylococcus
HAVVYFLQQGTPFIYQGQEI

SEQ ID NO: 2069113 - protein, 21 aa, Staphylococcus
HAYLPIYAIENHLIDSAIAGE

SEQ ID NO: 2069114 - protein, 17 aa, Staphylococcus
HAYNPKTIFLLQHACRD

SEQ ID NO: 2069115 - protein, 23 aa, Staphylococcus
HCAQPLMSWLNVSSTARASFYIY

SEQ ID NO: 2069116 - protein, 19 aa, Staphylococcus
HCDFFSFGTNDLTQLTFGF

SEQ ID NO: 2069117 - protein, 18 aa, Staphylococcus
HCDFFSFGTNDLTQLTYG

SEQ ID NO: 2069118 - protein, 17 aa, Staphylococcus
HCDTPISDLLGPLGVTV

SEQ ID NO: 2069119 - protein, 17 aa, Staphylococcus
HCGIWIEDQLVGVIGLH

SEQ ID NO: 2069120 - protein, 27 aa, Staphylococcus
HCTENRLPFILFSASGGARMQEGIISL

SEQ ID NO: 2069121 - protein, 24 aa, Staphylococcus
HDAHTAYMLVLAETLIEMKDQFSG

SEQ ID NO: 2069122 - protein, 17 aa, Staphylococcus
HDAIDPQFYIFHNDYKK

SEQ ID NO: 2069123 - protein, 18 aa, Staphylococcus
HDAIFIFDEPTTGLHEDD

SEQ ID NO: 2069124 - protein, 28 aa, Staphylococcus
HDALQDKLFPIEYGLKGLPQISIDDEQI

SEQ ID NO: 2069125 - protein, 24 aa, Staphylococcus
HDALYKMIDHFYYLVKRDDRINHL

SEQ ID NO: 2069126 - protein, 21 aa, Staphylococcus
HDAQWLYHHFSESFQEVSSFE

SEQ ID NO: 2069127 - protein, 21 aa, Staphylococcus
HDAQYFSIFSDAVVGFFASLG

SEQ ID NO: 2069128 - protein, 19 aa, Staphylococcus
HDAYYNIIFSDVIDDFNYS

SEQ ID NO: 2069129 - protein, 25 aa, Staphylococcus
HDEKKIKKLILASGKMFIDLKERLQ

SEQ ID NO: 2069130 - protein, 25 aa, Staphylococcus
HDENHFVFNLIYGDDFKYPKELHIG

SEQ ID NO: 2069131 - protein, 17 aa, Staphylococcus
HDFFIFNDRETDGTSIV

SEQ ID NO: 2069132 - protein, 37 aa, Staphylococcus; identical to SEQ ID NO: 1680365

SEQ ID NO: 2069133 - protein, 22 aa, Staphylococcus
HDGQYIAYFQAFTNTHAPVEVL

SEQ ID NO: 2069134 - protein, 23 aa, Staphylococcus
HDGQYIAYFQAFTNTHAPVEVLR

SEQ ID NO: 2069135 - protein, 30 aa, Staphylococcus
HDGTKLGFMSFFTKAAVAALKKYPAVNAEI

SEQ ID NO: 2069136 - protein, 30 aa, Staphylococcus
HDHIVFQYPMYWMNYPPLLQKWFDEVYTNG

SEQ ID NO: 2069137 - protein, 22 aa, Staphylococcus
HDIDCKIPGFGQIGLKSIYVKK

SEQ ID NO: 2069138 - protein, 32 aa, Staphylococcus
HDIKIDKRKMDLPQGIHALGYTNVPVKLDKEV

SEQ ID NO: 2069139 - protein, 31 aa, Staphylococcus
HDITEDQMIDFLFTAALFGRVVANNASVAGA

SEQ ID NO: 2069140 - protein, 17 aa, Staphylococcus
HDKLSFLGADLLKETLP

SEQ ID NO: 2069141 - protein, 25 aa, Staphylococcus
HDKTLLFALPGSTGAIKLAINKLIK

SEQ ID NO: 2069142 - protein, 20 aa, Staphylococcus
HDLAILMIVGEGMNQTVGTA

SEQ ID NO: 2069143 - protein, 23 aa, Staphylococcus
HDLGMEKLKLALNKIDIVAMAEK

SEQ ID NO: 2069144 - protein, 18 aa, Staphylococcus
HDLMLKDEIKYLSTDLPT

SEQ ID NO: 2069145 - protein, 24 aa, Staphylococcus
HDLQFHEALIHASRHHYLQTFWNH

SEQ ID NO: 2069146 - protein, 17 aa, Staphylococcus
HDLQLPVGIIPGGTFND

SEQ ID NO: 2069147 - protein, 30 aa, Staphylococcus
HDLTEEQMIDFLFVSSLFGRVVANNASVAG

SEQ ID NO: 2069148 - protein, 31 aa, Staphylococcus
HDLVTLRKVILHWCDLLLTNKPMALIGIIDL

SEQ ID NO: 2069149 - protein, 24 aa, Staphylococcus
HDNRKWIYNSYPEWQKQFPFWSER

SEQ ID NO: 2069150 - protein, 19 aa, Staphylococcus
HDPLRPRKLLLHKREIEKL

SEQ ID NO: 2069151 - protein, 17 aa, Staphylococcus
HDPRLFEGFSMGNPKIQ

SEQ ID NO: 2069152 - protein, 28 aa, Staphylococcus
HDQQTLHIPSPLWKVMDFMILDKAEEHR

SEQ ID NO: 2069153 - protein, 25 aa, Staphylococcus
HDRPVGRCWLVQASKLKWVFKFEIA

SEQ ID NO: 2069154 - protein, 23 aa, Staphylococcus
HDRYFLDKIVTQIYDVALGDVKR

SEQ ID NO: 2069155 - protein, 22 aa, Staphylococcus
HDRYFLDKIVTQVYDVALGSVK

SEQ ID NO: 2069156 - protein, 18 aa, Staphylococcus
HDRYFLNEVSSRIIELDR

SEQ ID NO: 2069157 - protein, 25 aa, Staphylococcus
HDSEDDFIHLFDDLDLNSSRLGNSN

SEQ ID NO: 2069158 - protein, 22 aa, Staphylococcus
HDSLKRYLLEETFELFEAIDNE

SEQ ID NO: 2069159 - protein, 28 aa, Staphylococcus
HDSNSFVGQFLKRLGFKAAITQADSNKY

SEQ ID NO: 2069160 - protein, 26 aa, Staphylococcus
HDVDMLRMCGYPWKTKQRILSDMGHV

SEQ ID NO: 2069161 - protein, 22 aa, Staphylococcus
HDVDYCIVINFSSRFANVTSEE

SEQ ID NO: 2069162 - protein, 26 aa, Staphylococcus
HDVLVPLQMLVLFNKTIFKDEKQFTN

SEQ ID NO: 2069163 - protein, 30 aa, Staphylococcus
HDVTIAPSPVWMQARLMKAGIRPINNVVDI

SEQ ID NO: 2069164 - protein, 27 aa, Staphylococcus
HDWRTKKPVIFRATPQWFASIDKVRED

SEQ ID NO: 2069165 - protein, 23 aa, Staphylococcus
HDYTAYMLSEVLKGTFEAWGSAY

SEQ ID NO: 2069166 - protein, 25 aa, Staphylococcus
HEAAFQKWGFIDWKQGNYSYKVNDI

SEQ ID NO: 2069167 - protein, 26 aa, Staphylococcus
HEAERLVIHGFLDPVVRELPIEDVKR

SEQ ID NO: 2069168 - protein, 25 aa, Staphylococcus
HEAILQFVQQHHIEWVIIGPEQPLI

SEQ ID NO: 2069169 - protein, 18 aa, Staphylococcus
HEALINGKRYPIRALMMS

SEQ ID NO: 2069170 - protein, 24 aa, Staphylococcus
HEDVSFDTLLVATGRQPNIKVAED

SEQ ID NO: 2069171 - protein, 18 aa, Staphylococcus
HEEENAMVTDLDDLKDLG

SEQ ID NO: 2069172 - protein, 17 aa, Staphylococcus
HEFLQKCVLKAIDQGWI

SEQ ID NO: 2069173 - protein, 30 aa, Staphylococcus
HEGIKLYDVFTILYLIDADLFNVFDANVQI

SEQ ID NO: 2069174 - protein, 26 aa, Staphylococcus
HEGKPFYEKLISFITSAPVFAMVVEG

SEQ ID NO: 2069175 - protein, 23 aa, Staphylococcus
HEGKYIAYFQAFTNTHAPVEILK

SEQ ID NO: 2069176 - protein, 37 aa, Staphylococcus
HEGQFYALPQSPQLFKQLLMISGFDKYYQIVKCFRDE

SEQ ID NO: 2069177 - protein, 30 aa, Staphylococcus
HEHDIITYGDILPLYMDDPNLMIYQRSYEG

SEQ ID NO: 2069178 - protein, 26 aa, Staphylococcus
HEHDTLLEKLFPIEYGLKGIEQILIT

SEQ ID NO: 2069179 - protein, 27 aa, Staphylococcus
HEIDDLFNYLHKLGFKTLLLSNNSDER

SEQ ID NO: 2069180 - protein, 26 aa, Staphylococcus
HEIEEPDFLIVIYHGGLDKISKSNKK

SEQ ID NO: 2069181 - protein, 23 aa, Staphylococcus
HEIENEVLQLKRIKIANLELDTS

SEQ ID NO: 2069182 - protein, 23 aa, Staphylococcus
HEKLKDWHIALPDVVQLQYDFED

SEQ ID NO: 2069183 - protein, 24 aa, Staphylococcus
HEKRKIEFLAGRFAVKEAFSKALG

SEQ ID NO: 2069184 - protein, 24 aa, Staphylococcus
HEKTMHSIRLFGEKVKPIVDKYFE

SEQ ID NO: 2069185 - protein, 29 aa, Staphylococcus
HELDNGLKLFIIPKPGFQKTFVTYTTQFG

SEQ ID NO: 2069186 - protein, 26 aa, Staphylococcus
HELIKDVADIFYLTEEDLLPLERMGK

SEQ ID NO: 2069187 - protein, 25 aa, Staphylococcus
HELMEDYYHYILMKTVEGEEALNYL

SEQ ID NO: 2069188 - protein, 19 aa, Staphylococcus
HELNFFNMAYTSEKWQFGG

SEQ ID NO: 2069189 - protein, 20 aa, Staphylococcus
HELPILGICLGSQALTCYYG

SEQ ID NO: 2069190 - protein, 18 aa, Staphylococcus
HELTSLDQMLPCLKNVHV

SEQ ID NO: 2069191 - protein, 18 aa, Staphylococcus
HELVSHFELPGALAKDNC

SEQ ID NO: 2069192 - protein, 18 aa, Staphylococcus
HEMSLINKLISKSILIIE

SEQ ID NO: 2069193 - protein, 25 aa, Staphylococcus
HENDVFPFELLIKTINEMEIPERAE

SEQ ID NO: 2069194 - protein, 26 aa, Staphylococcus
HENIGFGYIGFDALNYIVHHDAFKDI

SEQ ID NO: 2069195 - protein, 17 aa, Staphylococcus
HENILVTPHIAFFSDEA

SEQ ID NO: 2069196 - protein, 20 aa, Staphylococcus
HENILVTPHIAFFSDEAVRN

SEQ ID NO: 2069197 - protein, 24 aa, Staphylococcus
HENTMKSIRLFGERVKPIVDKYFE

SEQ ID NO: 2069198 - protein, 22 aa, Staphylococcus
HEPFTCISLLLNDNKTISIRWS

SEQ ID NO: 2069199 - protein, 28 aa, Staphylococcus
HEPMYGKTYLPRKFKIGIAVPPSNDIDV

SEQ ID NO: 2069200 - protein, 25 aa, Staphylococcus
HEPYRQHLILEFEKVKILSQKYDAY

SEQ ID NO: 2069201 - protein, 17 aa, Staphylococcus
HEQADILYIGFISSKGA

SEQ ID NO: 2069202 - protein, 29 aa, Staphylococcus
HEQDTLQPHLFPLEYGLKSLPKIYVSDEN

SEQ ID NO: 2069203 - protein, 17 aa, Staphylococcus
HEQLSKVMFPLGGMEKS

SEQ ID NO: 2069204 - protein, 20 aa, Staphylococcus
HERLLALLIKSNGEQVLFCP

SEQ ID NO: 2069205 - protein, 25 aa, Staphylococcus
HERMAVFDLYFRNMPFDSGYAVFNG

SEQ ID NO: 2069206 - protein, 24 aa, Staphylococcus
HERMAVFDLYFRSMPFDSGYAVFN

SEQ ID NO: 2069207 - protein, 22 aa, Staphylococcus
HERNFFNMAYVDEKWNFRGDKY

SEQ ID NO: 2069208 - protein, 24 aa, Staphylococcus
HESFNFFSLFNFTEPIEMVVTHFL

SEQ ID NO: 2069209 - protein, 18 aa, Staphylococcus
HESKATIRKGPNIKLPSL

SEQ ID NO: 2069210 - protein, 26 aa, Staphylococcus
HESLEDYTLVSLLYKGGEEAVTSIAD

SEQ ID NO: 2069211 - protein, 23 aa, Staphylococcus
HESPQAFYFVDGKAVWNASHRDI

SEQ ID NO: 2069212 - protein, 24 aa, Staphylococcus
HESPQAFYFVDGKAVWNASHSDIN

SEQ ID NO: 2069213 - protein, 24 aa, Staphylococcus
HESPQAFYFVKGQAIWNASHSDIN

SEQ ID NO: 2069214 - protein, 27 aa, Staphylococcus
HETGKEDFYFMPLLQFSDDVSEYASLH

SEQ ID NO: 2069215 - protein, 22 aa, Staphylococcus
HETPVKQLYLARKQIEQYAERE

SEQ ID NO: 2069216 - protein, 21 aa, Staphylococcus
HETQELLGFEYIYENSLDAVS

SEQ ID NO: 2069217 - protein, 17 aa, Staphylococcus
HETWVPSLIMRAVLGEM

SEQ ID NO: 2069218 - protein, 24 aa, Staphylococcus
HETYRMLMAICYLVTQGRIQSERS

SEQ ID NO: 2069219 - protein, 22 aa, Staphylococcus
HEVESMMFYTCILDLIRNEETS

SEQ ID NO: 2069220 - protein, 19 aa, Staphylococcus
HEVIERYFPGTPSKLSGLS

SEQ ID NO: 2069221 - protein, 26 aa, Staphylococcus
HEVIIYAANHQYLKTFWNHLKPVMES

SEQ ID NO: 2069222 - protein, 24 aa, Staphylococcus
HEVQRLYVFTKAASSLIGDNATIP

SEQ ID NO: 2069223 - protein, 23 aa, Staphylococcus
HEVQRLYVFTKAASSLTGDESTI

SEQ ID NO: 2069224 - protein, 23 aa, Staphylococcus
HEVQRLYVFTKAASSLTGDNATI

SEQ ID NO: 2069225 - protein, 23 aa, Staphylococcus
HEVQRLYVFTKAASSLTGDNSTI

SEQ ID NO: 2069226 - protein, 23 aa, Staphylococcus
HEVQRLYVFTKAASSLTGDSATI

SEQ ID NO: 2069227 - protein, 18 aa, Staphylococcus
HEVSGLGLDLFAGSGALG

SEQ ID NO: 2069228 - protein, 18 aa, Staphylococcus
HEYFSAHAYMAMAAYCDK

SEQ ID NO: 2069229 - protein, 17 aa, Staphylococcus
HEYIIYTHNDQKVYNEL

SEQ ID NO: 2069230 - protein, 20 aa, Staphylococcus
HEYISYPIQSFLEQHAIVGE

SEQ ID NO: 2069231 - protein, 22 aa, Staphylococcus
HEYLEGPIFISTDKPDPFLGQK

SEQ ID NO: 2069232 - protein, 17 aa, Staphylococcus
HEYLKQHNIHVVPLSLT

SEQ ID NO: 2069233 - protein, 18 aa, Staphylococcus
HFAHNETCFILAQNGYGL

SEQ ID NO: 2069234 - protein, 25 aa, Staphylococcus
HFAIFPASHFVTREEKMKIAIERIE

SEQ ID NO: 2069235 - protein, 18 aa, Staphylococcus
HFDNVKLLTITLYGENNE

SEQ ID NO: 2069236 - protein, 17 aa, Staphylococcus
HFECEYVQTVRIPTGDP

SEQ ID NO: 2069237 - protein, 23 aa, Staphylococcus
HFEIPYKQYCKHEFVLSGIKQKQ

SEQ ID NO: 2069238 - protein, 19 aa, Staphylococcus
HFEKRYAKRSQLREFNVEE

SEQ ID NO: 2069239 - protein, 27 aa, Staphylococcus
HFELSEELALKKCWMLHQMSSFLELRE

SEQ ID NO: 2069240 - protein, 18 aa, Staphylococcus
HFEPIFILGKNNKQKRDS

SEQ ID NO: 2069241 - protein, 20 aa, Staphylococcus
HFFNDLAIDYVSCSPFRVPG

SEQ ID NO: 2069242 - protein, 17 aa, Staphylococcus
HFFNSDVPVHRGASKPL

SEQ ID NO: 2069243 - protein, 32 aa, Staphylococcus
HFGVITPPENVDVFLVAPKGPGHLVRRTFVEG

SEQ ID NO: 2069244 - protein, 28 aa, Staphylococcus
HFIAEKDFFNFFRNFFTRKWEREIDTNM

SEQ ID NO: 2069245 - protein, 28 aa, Staphylococcus
HFIAEKDFFTFFRNFFTKKWEREIDTNM

SEQ ID NO: 2069246 - protein, 27 aa, Staphylococcus
HFIAEKDFFTFFRNFFTKKWEREVDTN

SEQ ID NO: 2069247 - protein, 18 aa, Staphylococcus
HFIHGLSNKVRLMILELL

SEQ ID NO: 2069248 - protein, 17 aa, Staphylococcus
HFIHLMKEFTVQEIKDI

SEQ ID NO: 2069249 - protein, 18 aa, Staphylococcus
HFINHLFTGYEVLNTFTF

SEQ ID NO: 2069250 - protein, 19 aa, Staphylococcus
HFIQQLIYQGFPKSKMMIH

SEQ ID NO: 2069251 - protein, 27 aa, Staphylococcus
HFITSNLPFRIRKPLPNVTFHQVEVNQ

SEQ ID NO: 2069252 - protein, 25 aa, Staphylococcus
HFKDIQSMPTLLMYGTEDKLLELRS

SEQ ID NO: 2069253 - protein, 30 aa, Staphylococcus
HFKHMLKQFKPQDRVLLIFGPEGGLSDEEV

SEQ ID NO: 2069254 - protein, 22 aa, Staphylococcus
HFKHYIQMPPKKYIYNFRQEYY

SEQ ID NO: 2069255 - protein, 18 aa, Staphylococcus
HFKVFSDNIGKYVSEQPV

SEQ ID NO: 2069256 - protein, 18 aa, Staphylococcus
HFLDNYIFANVGTGTSLH

SEQ ID NO: 2069257 - protein, 17 aa, Staphylococcus
HFLNMISENLNYLINDT

SEQ ID NO: 2069258 - protein, 17 aa, Staphylococcus
HFMMDKDVFLNYNRQLE

SEQ ID NO: 2069259 - protein, 17 aa, Staphylococcus
HFMNDKDLFLNYHKQLE

SEQ ID NO: 2069260 - protein, 17 aa, Staphylococcus
HFMSDKLNLYSDIGNII

SEQ ID NO: 2069261 - protein, 17 aa, Staphylococcus
HFNGLLKPSTGKLQIDD

SEQ ID NO: 2069262 - protein, 18 aa, Staphylococcus
HFNKMEVPFIYRVHEQPK

SEQ ID NO: 2069263 - protein, 18 aa, Staphylococcus
HFNPNWHIIGVTYDSLEE

SEQ ID NO: 2069264 - protein, 24 aa, Staphylococcus
HFNQPFKHKAYFNSRLRTTGGRYV

SEQ ID NO: 2069265 - protein, 20 aa, Staphylococcus
HFPDHLTLRDIVRALEKGIE

SEQ ID NO: 2069266 - protein, 17 aa, Staphylococcus
HFPYLNQERQNYATLCG

SEQ ID NO: 2069267 - protein, 21 aa, Staphylococcus
HFQEVAKGLIKIITFAPEVEG

SEQ ID NO: 2069268 - protein, 17 aa, Staphylococcus
HFRELYLPDINPDNPRQ

SEQ ID NO: 2069269 - protein, 17 aa, Staphylococcus
HFRVDHDQRFKCNCGKS

SEQ ID NO: 2069270 - protein, 23 aa, Staphylococcus
HFSNLDVPFIYRVHEQPKSERLR

SEQ ID NO: 2069271 - protein, 27 aa, Staphylococcus
HFTRLVGYPPYRYLLNKRLQNAQRMLK

SEQ ID NO: 2069272 - protein, 29 aa, Staphylococcus
HFVAEKDFFTFFRNFFNIKFNREITVNME

SEQ ID NO: 2069273 - protein, 18 aa, Staphylococcus
HFVALAHAGWRGTVGRIV

SEQ ID NO: 2069274 - protein, 18 aa, Staphylococcus
HFVFVIPVNATLDMKKAA

SEQ ID NO: 2069275 - protein, 17 aa, Staphylococcus
HFVLILARKNVTPTSDY

SEQ ID NO: 2069276 - protein, 20 aa, Staphylococcus
HFVTEIYVETIKFMSSKTKE

SEQ ID NO: 2069277 - protein, 19 aa, Staphylococcus
HFYAENIEHRRWGAPFPVI

SEQ ID NO: 2069278 - protein, 17 aa, Staphylococcus
HFYALVEKDDRINHLFP

SEQ ID NO: 2069279 - protein, 17 aa, Staphylococcus
HFYPSQTNFVFVKTDKP

SEQ ID NO: 2069280 - protein, 26 aa, Staphylococcus
HGAIMTYRIMTMFEPYFREYKMIFIN

SEQ ID NO: 2069281 - protein, 23 aa, Staphylococcus
HGAKYRELGLKDKLKDLTDDEKL

SEQ ID NO: 2069282 - protein, 28 aa, Staphylococcus
HGALGERALRYIIPDTKDFPYTVRIVSE

SEQ ID NO: 2069283 - protein, 28 aa, Staphylococcus
HGAMMTYRIMLLFEPYFRENNLIFVNCP

SEQ ID NO: 2069284 - protein, 26 aa, Staphylococcus
HGDEDREMLRWCKNKYPDVKIIKALP

SEQ ID NO: 2069285 - protein, 21 aa, Staphylococcus
HGDLFVNIKVLTPTKMTERQK

SEQ ID NO: 2069286 - protein, 18 aa, Staphylococcus
HGDLWGGNYMFLSDGRPA

SEQ ID NO: 2069287 - protein, 19 aa, Staphylococcus
HGDLWGGNYMFLTDGRPAL

SEQ ID NO: 2069288 - protein, 21 aa, Staphylococcus
HGDLYVVFRVKPSDKFERDGD

SEQ ID NO: 2069289 - protein, 21 aa, Staphylococcus
HGDLYVVFRVKPSDKFRRDGD

SEQ ID NO: 2069290 - protein, 28 aa, Staphylococcus
HGDQALIRGAKIIALMGLELIENKKLFD

SEQ ID NO: 2069291 - protein, 28 aa, Staphylococcus
HGDQALIRGAKILALMGLELIENEKLFN

SEQ ID NO: 2069292 - protein, 24 aa, Staphylococcus
HGEAEHPFVPHFTIAQGLTSQEFE

SEQ ID NO: 2069293 - protein, 19 aa, Staphylococcus
HGEIIINIHFGLYALPHTS

SEQ ID NO: 2069294 - protein, 29 aa, Staphylococcus
HGENFMQLLAARLDAVVYSLGLARTRRQA

SEQ ID NO: 2069295 - protein, 17 aa, Staphylococcus
HGEWTALMIFKAYHIKN

SEQ ID NO: 2069296 - protein, 29 aa, Staphylococcus
HGGIPDTGFFRFWIQGIFARWTDNPNIED

SEQ ID NO: 2069297 - protein, 30 aa, Staphylococcus
HGGIPDTGFFRFWYQGIVARWPETEIEDLE

SEQ ID NO: 2069298 - protein, 21 aa, Staphylococcus
HGGMIIYLPQEGRGIGLINKL

SEQ ID NO: 2069299 - protein, 26 aa, Staphylococcus
HGGQALIRGAKILSLMGLELLTNQAL

SEQ ID NO: 2069300 - protein, 18 aa, Staphylococcus
HGGYWRQKYDRSLNDKLI

SEQ ID NO: 2069301 - protein, 24 aa, Staphylococcus
HGHRKALSILLKRAKYNPKKDQLV

SEQ ID NO: 2069302 - protein, 19 aa, Staphylococcus
HGIDLKLANALLLKNSGVP

SEQ ID NO: 2069303 - protein, 25 aa, Staphylococcus
HGIGKKLLLHLFDYAKQKGYKEIIV

SEQ ID NO: 2069304 - protein, 23 aa, Staphylococcus
HGILQPIVLRQTVQGYYIVVGER

SEQ ID NO: 2069305 - protein, 28 aa, Staphylococcus
HGIQMDADLVFDVRFLPNPHYVDELRPL

SEQ ID NO: 2069306 - protein, 23 aa, Staphylococcus
HGKDSTPFLLKTIVEKTAGKSLQ

SEQ ID NO: 2069307 - protein, 23 aa, Staphylococcus
HGKYEIKLPKDITLNINDKISIL

SEQ ID NO: 2069308 - protein, 18 aa, Staphylococcus
HGKYSFYTFTHEKSYIYK

SEQ ID NO: 2069309 - protein, 26 aa, Staphylococcus
HGLGTIPYENPLFLGMGGMHGSYAAN

SEQ ID NO: 2069310 - protein, 17 aa, Staphylococcus
HGLITGQALIKFGEPIY

SEQ ID NO: 2069311 - protein, 18 aa, Staphylococcus
HGLIYSSGLGYFKSIASH

SEQ ID NO: 2069312 - protein, 29 aa, Staphylococcus
HGLNVYDVFTILYLLNPNQYHTVSARLQI

SEQ ID NO: 2069313 - protein, 24 aa, Staphylococcus
HGLQERIWNPLQIMNDFGIDVFSP

SEQ ID NO: 2069314 - protein, 31 aa, Staphylococcus
HGLSNIVVHAPYIINIANTVKPHVFELGVEF

SEQ ID NO: 2069315 - protein, 21 aa, Staphylococcus
HGLYTGARYHANEIGYLLYRS

SEQ ID NO: 2069316 - protein, 22 aa, Staphylococcus
HGNEPIEIMKWTKSQYPHIKVI

SEQ ID NO: 2069317 - protein, 22 aa, Staphylococcus
HGNSIRALIKYLENLSSEEIVG

SEQ ID NO: 2069318 - protein, 26 aa, Staphylococcus
HGNSVPRFHITWGTGPGLVEPFSNYV

SEQ ID NO: 2069319 - protein, 17 aa, Staphylococcus
HGPIKLRRGPADNPLFQ

SEQ ID NO: 2069320 - protein, 17 aa, Staphylococcus
HGPVCAALMKAKYGIED

SEQ ID NO: 2069321 - protein, 26 aa, Staphylococcus
HGQDHLMTTILLKDLMKHLIELYKRK

SEQ ID NO: 2069322 - protein, 17 aa, Staphylococcus
HGQKLYDAGLRRINVSL

SEQ ID NO: 2069323 - protein, 18 aa, Staphylococcus
HGQVKDQFGINWLMNCFL

SEQ ID NO: 2069324 - protein, 17 aa, Staphylococcus
HGRLIYIGAGTSGRLGV

SEQ ID NO: 2069325 - protein, 20 aa, Staphylococcus
HGRLLVAAAIGIAKDTDIRA

SEQ ID NO: 2069326 - protein, 19 aa, Staphylococcus
HGRLLVGAAIGIAKDTDIR

SEQ ID NO: 2069327 - protein, 18 aa, Staphylococcus
HGSFSKFLWSYVNDQPID

SEQ ID NO: 2069328 - protein, 22 aa, Staphylococcus
HGSHAVPIWSRVRIAGIELPEF

SEQ ID NO: 2069329 - protein, 17 aa, Staphylococcus
HGSHFHRAPGSVGMASD

SEQ ID NO: 2069330 - protein, 24 aa, Staphylococcus
HGSLLPIMHLYRFVSTFSNESFQI

SEQ ID NO: 2069331 - protein, 21 aa, Staphylococcus
HGTMPLTMFITKKGKQVKVNH

SEQ ID NO: 2069332 - protein, 20 aa, Staphylococcus
HGTMPLTMFITKRGKQVKVN

SEQ ID NO: 2069333 - protein, 18 aa, Staphylococcus
HGVGSAGFHIHFANDDRD

SEQ ID NO: 2069334 - protein, 24 aa, Staphylococcus
HGVKVLARGPVFKGLLTSNSVNVL

SEQ ID NO: 2069335 - protein, 20 aa, Staphylococcus
HGVSLTTLFAPLLEPEIIFE

SEQ ID NO: 2069336 - protein, 26 aa, Staphylococcus
HGVVKFDRYPIFVPNALINEVIAFKV

SEQ ID NO: 2069337 - protein, 21 aa, Staphylococcus
HGVVKIDRYPVFVPNALIEEE

SEQ ID NO: 2069338 - protein, 20 aa, Staphylococcus
HGWGFAHMKMAPKHWLSIKE

SEQ ID NO: 2069339 - protein, 19 aa, Staphylococcus
HGYGHGDLFVNIKVLTPTK

SEQ ID NO: 2069340 - protein, 33 aa, Staphylococcus
HGYGTKMMMYLPQYVQALFPDFNHLFLVVDAEN

SEQ ID NO: 2069341 - protein, 19 aa, Staphylococcus
HGYGYGDLFVNIKVVTPTK

SEQ ID NO: 2069342 - protein, 20 aa, Staphylococcus
HGYIFPTDFSKRDQYLPMGL

SEQ ID NO: 2069343 - protein, 20 aa, Staphylococcus
HGYKNFIYTPVGFVCEHLEV

SEQ ID NO: 2069344 - protein, 23 aa, Staphylococcus
HHAQNFIIGYRFSPEEIEEPGIR

SEQ ID NO: 2069345 - protein, 19 aa, Staphylococcus
HHCHPNPFHLKQFAKYHQY

SEQ ID NO: 2069346 - protein, 26 aa, Staphylococcus
HHFDSTVFPFILRGANILGIDSVFTP

SEQ ID NO: 2069347 - protein, 29 aa, Staphylococcus
HHFKYRANPYQFFKEVLLMYPNEAMIKLS

SEQ ID NO: 2069348 - protein, 21 aa, Staphylococcus
HHFTQLLHDSLRYAFNNNITC

SEQ ID NO: 2069349 - protein, 29 aa, Staphylococcus
HHGYIANQRYIVTWALGHLVTNAQPEHYD

SEQ ID NO: 2069350 - protein, 23 aa, Staphylococcus
HHIEDPLLVKIKANLPPSRGLGS

SEQ ID NO: 2069351 - protein, 19 aa, Staphylococcus
HHIEIISVFRAQDEPYFKI

SEQ ID NO: 2069352 - protein, 22 aa, Staphylococcus
HHIKIIYLETCNLKSILSDIYQ

SEQ ID NO: 2069353 - protein, 22 aa, Staphylococcus
HHIQSPFLYMKALIESIKLEIK

SEQ ID NO: 2069354 - protein, 25 aa, Staphylococcus
HHITRLCHFTKSKNLPFILGEGVDS

SEQ ID NO: 2069355 - protein, 28 aa, Staphylococcus
HHLDYQVLVKVHPYLYKDALKIKRLKPY

SEQ ID NO: 2069356 - protein, 19 aa, Staphylococcus
HHLIATEVLPLTNYVRSAE

SEQ ID NO: 2069357 - protein, 22 aa, Staphylococcus
HHMTIVFDPNFRKKLWNENDLK

SEQ ID NO: 2069358 - protein, 17 aa, Staphylococcus
HHRAKYYFPGGKIDALI

SEQ ID NO: 2069359 - protein, 34 aa, Staphylococcus
HHRIANFETASPLWYRAEPVGCTATILYKMYKER

SEQ ID NO: 2069360 - protein, 22 aa, Staphylococcus
HHSRRGLLKMVGRRRHLLNYLR

SEQ ID NO: 2069361 - protein, 25 aa, Staphylococcus
HHTAHYPFFKIDFARFARYCRENNA

SEQ ID NO: 2069362 - protein, 19 aa, Staphylococcus
HHTFFEMLGNFSIGDYFKN

SEQ ID NO: 2069363 - protein, 25 aa, Staphylococcus
HHTSFNFFSLFTFSEPIEQVVTHFL

SEQ ID NO: 2069364 - protein, 28 aa, Staphylococcus
HHVKHYYYQPKFLEFWTNQIDDTLKQIP

SEQ ID NO: 2069365 - protein, 21 aa, Staphylococcus
HHVTAIFPKLVFSIKKGTNFS

SEQ ID NO: 2069366 - protein, 18 aa, Staphylococcus
HHYPTAEDFQFFKQINQA

SEQ ID NO: 2069367 - protein, 25 aa, Staphylococcus
HIADSQMQLFSRLKLALTEEHPSAP

SEQ ID NO: 2069368 - protein, 19 aa, Staphylococcus
HIAGLVAAGLHPNPVEHAD

SEQ ID NO: 2069369 - protein, 18 aa, Staphylococcus
HIAGLVAAGLHPNPVEYA

SEQ ID NO: 2069370 - protein, 18 aa, Staphylococcus
HIAGLVAVGLHPNPVEYA

SEQ ID NO: 2069371 - protein, 26 aa, Staphylococcus
HIAGYKIPRLYLKLTHIPLNSTSKPD

SEQ ID NO: 2069372 - protein, 17 aa, Staphylococcus
HIALPHYSKKLNPNLHD

SEQ ID NO: 2069373 - protein, 17 aa, Staphylococcus
HIAVFSATIPKSLHPFL

SEQ ID NO: 2069374 - protein, 18 aa, Staphylococcus
HIDAIGFIHYPKSKRHQS

SEQ ID NO: 2069375 - protein, 17 aa, Staphylococcus
HIDFGIELQSLLFFMKN

SEQ ID NO: 2069376 - protein, 17 aa, Staphylococcus
HIDLKVKHIYKDTPPPI

SEQ ID NO: 2069377 - protein, 17 aa, Staphylococcus
HIDVLPTDKFKTTMITF

SEQ ID NO: 2069378 - protein, 22 aa, Staphylococcus
HIEIFDRSWYGRVLVERVEGFA

SEQ ID NO: 2069379 - protein, 17 aa, Staphylococcus
HIEILYEDTYLIIVSKP

SEQ ID NO: 2069380 - protein, 20 aa, Staphylococcus
HIEIYAPITGKFVDIEDIPD

SEQ ID NO: 2069381 - protein, 30 aa, Staphylococcus
HIEKHNRKRVLLSHLGMAGGFFIVNHLSEI

SEQ ID NO: 2069382 - protein, 18 aa, Staphylococcus
HIEKRPLIVVKKDGTREQ

SEQ ID NO: 2069383 - protein, 24 aa, Staphylococcus
HIELFDRSWYGRVLVERIEGFATV

SEQ ID NO: 2069384 - protein, 23 aa, Staphylococcus
HIELFDRSWYGRVLVERVEGFAT

SEQ ID NO: 2069385 - protein, 18 aa, Staphylococcus
HIELPEHAYLSCYPNASL

SEQ ID NO: 2069386 - protein, 20 aa, Staphylococcus
HIEPYVIDYSELGMFCTEHD

SEQ ID NO: 2069387 - protein, 18 aa, Staphylococcus
HIFAFNEKVTRQLGYKAL

SEQ ID NO: 2069388 - protein, 31 aa, Staphylococcus; identical to SEQ ID NO: 1828007

SEQ ID NO: 2069389 - protein, 18 aa, Staphylococcus
HIFKLDPAKPISDEDLMK

SEQ ID NO: 2069390 - protein, 17 aa, Staphylococcus
HIFKLDPAKSISDDDLE

SEQ ID NO: 2069391 - protein, 21 aa, Staphylococcus
HIGGFPIIGQFIACTNPEVIE

SEQ ID NO: 2069392 - protein, 19 aa, Staphylococcus
HIGGFPVSGIFLVCQDPEI

SEQ ID NO: 2069393 - protein, 24 aa, Staphylococcus
HIGQKLYILFQKVGVVPVEFISEA

SEQ ID NO: 2069394 - protein, 23 aa, Staphylococcus
HIGVDLLVIRHPQNAYYKELADI

SEQ ID NO: 2069395 - protein, 21 aa, Staphylococcus
HIHHLLKLNPEFFKFSYTDQI

SEQ ID NO: 2069396 - protein, 26 aa, Staphylococcus
HIHKILLQHLTDQALVLGPSPAALSR

SEQ ID NO: 2069397 - protein, 23 aa, Staphylococcus
HIHLTMQDIYQYKTIRHLSAHLE

SEQ ID NO: 2069398 - protein, 21 aa, Staphylococcus
HIHQILLQHLSEKALVLGPSP

SEQ ID NO: 2069399 - protein, 18 aa, Staphylococcus
HIHVLPTEKFKTTMITFK

SEQ ID NO: 2069400 - protein, 27 aa, Staphylococcus
HIHVRQLIRLSRYFVDTLRQSENGRII

SEQ ID NO: 2069401 - protein, 35 aa, Staphylococcus
HIIKNYASWSDMFKALLHIVFKEYGVLLIDAQDPK

SEQ ID NO: 2069402 - protein, 19 aa, Staphylococcus
HIIPGFIDIHMHGGYGEDA

SEQ ID NO: 2069403 - protein, 22 aa, Staphylococcus
HIITEKVLIDFIKKLADLYEVT

SEQ ID NO: 2069404 - protein, 17 aa, Staphylococcus
HIIVGEIKTYLSEHTSG

SEQ ID NO: 2069405 - protein, 17 aa, Staphylococcus
HIKIIGQNPFYRHVLED

SEQ ID NO: 2069406 - protein, 22 aa, Staphylococcus
HIKNMELLIKRETDWLAAHANE

SEQ ID NO: 2069407 - protein, 17 aa, Staphylococcus
HILELFIKGYLTDYHSF

SEQ ID NO: 2069408 - protein, 25 aa, Staphylococcus
HILENTALVYLTYPNNPTGSTATKA

SEQ ID NO: 2069409 - protein, 17 aa, Staphylococcus
HILRTLQPDAKIIKTTQ

SEQ ID NO: 2069410 - protein, 19 aa, Staphylococcus
HIMIWEGIEILPVTTRNKK

SEQ ID NO: 2069411 - protein, 19 aa, Staphylococcus
HIMKSLFEKANIPTAKSIQ

SEQ ID NO: 2069412 - protein, 27 aa, Staphylococcus
HINANSQRLLGMRYFAAFSRQTHINQP

SEQ ID NO: 2069413 - protein, 18 aa, Staphylococcus
HINDLDCLIYTSGTALYG

SEQ ID NO: 2069414 - protein, 24 aa, Staphylococcus
HINHNYVVMAVLNSILKDVDAIEE

SEQ ID NO: 2069415 - protein, 17 aa, Staphylococcus
HINNLLIGYSTPITKEI

SEQ ID NO: 2069416 - protein, 20 aa, Staphylococcus
HINNRIESLILIHACWLANI

SEQ ID NO: 2069417 - protein, 20 aa, Staphylococcus
HINTYRTFIGNFITSMEMGG

SEQ ID NO: 2069418 - protein, 17 aa, Staphylococcus
HIPFCVRICTYCDFNKY

SEQ ID NO: 2069419 - protein, 20 aa, Staphylococcus
HIPFCVRICTYCDFNKYFIN

SEQ ID NO: 2069420 - protein, 20 aa, Staphylococcus
HIPFCVRICTYCDFNKYFIQ

SEQ ID NO: 2069421 - protein, 17 aa, Staphylococcus
HIPIVTTELNKFIEQFD

SEQ ID NO: 2069422 - protein, 18 aa, Staphylococcus
HIPLFATGYAKQDMKWIK

SEQ ID NO: 2069423 - protein, 18 aa, Staphylococcus
HIPTNKAPKLLLKGDGDF

SEQ ID NO: 2069424 - protein, 27 aa, Staphylococcus
HIQGCAGDVWYPQPAPATHPWRTMPRN

SEQ ID NO: 2069425 - protein, 25 aa, Staphylococcus
HIQHPIKVILFATEEKTFKALKQWF

SEQ ID NO: 2069426 - protein, 20 aa, Staphylococcus
HIQIRQLHPFPSETIQKEVD

SEQ ID NO: 2069427 - protein, 33 aa, Staphylococcus
HIQPIRKMMDGPTIFNILGPMIHPYKLDYQVVG

SEQ ID NO: 2069428 - protein, 20 aa, Staphylococcus
HIQSPFLYMKALMQTIQLEI

SEQ ID NO: 2069429 - protein, 17 aa, Staphylococcus
HIRHCYKADPDYGKGVA

SEQ ID NO: 2069430 - protein, 33 aa, Staphylococcus
HISSYGLILEPKTQFYNLYRKGKLKLPNEDLGA

SEQ ID NO: 2069431 - protein, 32 aa, Staphylococcus; identical to SEQ ID NO: 1828026

SEQ ID NO: 2069432 - protein, 17 aa, Staphylococcus
HITGITAGLNQELLLFL

SEQ ID NO: 2069433 - protein, 17 aa, Staphylococcus
HITIFPKIENQEGIDNI

SEQ ID NO: 2069434 - protein, 18 aa, Staphylococcus
HIVDGDQIMFIIGQEMHK

SEQ ID NO: 2069435 - protein, 21 aa, Staphylococcus
HIVGQPISKLLLQANATVTIL

SEQ ID NO: 2069436 - protein, 23 aa, Staphylococcus
HIVPYPPGIPVFWKGEKVTKNMI

SEQ ID NO: 2069437 - protein, 26 aa, Staphylococcus
HIVSIDFFTIVKWEISGTLNYMKPRE

SEQ ID NO: 2069438 - protein, 20 aa, Staphylococcus
HIYCKKFFDSSVDKRIDFIQ

SEQ ID NO: 2069439 - protein, 17 aa, Staphylococcus
HIYHQFINSKSIEWDYY

SEQ ID NO: 2069440 - protein, 17 aa, Staphylococcus
HIYLNRYGELMLNYIDS

SEQ ID NO: 2069441 - protein, 17 aa, Staphylococcus
HIYSAFSTLKIGIDLLK

SEQ ID NO: 2069442 - protein, 25 aa, Staphylococcus
HKDGRLFICYLGDFKSTGGIFATTD

SEQ ID NO: 2069443 - protein, 24 aa, Staphylococcus
HKDGRLFTCYLGDFKTTGGIFATD

SEQ ID NO: 2069444 - protein, 24 aa, Staphylococcus
HKDGRLFVCYLGDFESTGGIFMVD

SEQ ID NO: 2069445 - protein, 25 aa, Staphylococcus
HKDHLSRDIALLDELYELNKNYFDD

SEQ ID NO: 2069446 - protein, 29 aa, Staphylococcus
HKDIEMISLIQCFSLLNMPLKQIKQNVDK

SEQ ID NO: 2069447 - protein, 25 aa, Staphylococcus
HKDIIDIVPSYRAILITFDNMNIDG

SEQ ID NO: 2069448 - protein, 19 aa, Staphylococcus
HKDITVDFLFVILNADKAS

SEQ ID NO: 2069449 - protein, 20 aa, Staphylococcus
HKDNFIYIKTDDLIFDEFDF

SEQ ID NO: 2069450 - protein, 27 aa, Staphylococcus
HKDNPFDLTKVWYKGDYPLIEVGEWEL

SEQ ID NO: 2069451 - protein, 22 aa, Staphylococcus
HKDPFLCGLKTYVPEQLDIEKM

SEQ ID NO: 2069452 - protein, 19 aa, Staphylococcus
HKEDILPMDIIVIARQPAK

SEQ ID NO: 2069453 - protein, 17 aa, Staphylococcus
HKFERGFIQIKLDVKKG

SEQ ID NO: 2069454 - protein, 17 aa, Staphylococcus
HKFLFTDNKFKAMRAKS

SEQ ID NO: 2069455 - protein, 27 aa, Staphylococcus
HKFNGLKGQGLLITRTAHNIEPIIHGG

SEQ ID NO: 2069456 - protein, 21 aa, Staphylococcus
HKGHLLKQLPDQWYSGIVNPI

SEQ ID NO: 2069457 - protein, 23 aa, Staphylococcus
HKGRMSLFYYAELTYQPTHCENC

SEQ ID NO: 2069458 - protein, 23 aa, Staphylococcus
HKGSYIRIYEMNPDGTRGKLISE

SEQ ID NO: 2069459 - protein, 20 aa, Staphylococcus
HKIEYYRRDGDYAEVTKLKR

SEQ ID NO: 2069460 - protein, 26 aa, Staphylococcus
HKIKPDEFYFLPSYMAPLKDHKDFLE

SEQ ID NO: 2069461 - protein, 29 aa, Staphylococcus
HKILCIAILHIFAVNHVYTRHKGWSMIGP

SEQ ID NO: 2069462 - protein, 27 aa, Staphylococcus
HKIRKMKHPPYIIFATAHDTFAVKAFE

SEQ ID NO: 2069463 - protein, 32 aa, Staphylococcus
HKKAPLREDILKYLTYFQSSSPSYLLMSSLEL

SEQ ID NO: 2069464 - protein, 20 aa, Staphylococcus
HKKHIYTTVFYDKHEKNGVT

SEQ ID NO: 2069465 - protein, 24 aa, Staphylococcus
HKKKPSIMLVMKIAKALNVEIDQI

SEQ ID NO: 2069466 - protein, 23 aa, Staphylococcus
HKKVIPKFPQKIAVLTAGTGAAI

SEQ ID NO: 2069467 - protein, 21 aa, Staphylococcus
HKLCPNGYYVTPRFEAYKTAS

SEQ ID NO: 2069468 - protein, 22 aa, Staphylococcus
HKNKKILLLTAHRRENLGEPME

SEQ ID NO: 2069469 - protein, 24 aa, Staphylococcus
HKNLDLFLGIPYAYPPIGHRRFKH

SEQ ID NO: 2069470 - protein, 29 aa, Staphylococcus
HKNNTFIGQPLWGSIGYTLPATLGTQIAD

SEQ ID NO: 2069471 - protein, 26 aa, Staphylococcus
HKPLATHLPLLIQPDTSRFIITGHFA

SEQ ID NO: 2069472 - protein, 19 aa, Staphylococcus
HKPLLILSDLFRQKEDYEA

SEQ ID NO: 2069473 - protein, 25 aa, Staphylococcus
HKPPDFFEKIFKGTGLKFKVPDNLF

SEQ ID NO: 2069474 - protein, 22 aa, Staphylococcus
HKPYEHLILNEIDHTLNIPLVK

SEQ ID NO: 2069475 - protein, 18 aa, Staphylococcus
HKRELAYTRYTWPKTESD

SEQ ID NO: 2069476 - protein, 17 aa, Staphylococcus
HKRIIFSLLRKYNIRYD

SEQ ID NO: 2069477 - protein, 31 aa, Staphylococcus
HKRLDALIVLSDFNRRYLSGFTGTSGALIIT

SEQ ID NO: 2069478 - protein, 21 aa, Staphylococcus
HKRTKFLPELQFAILDEVDSI

SEQ ID NO: 2069479 - protein, 20 aa, Staphylococcus
HKSAVIWFTGLSGSGKSTVS

SEQ ID NO: 2069480 - protein, 17 aa, Staphylococcus
HKSYRHEKWFEISKKLE

SEQ ID NO: 2069481 - protein, 24 aa, Staphylococcus
HKTIVYKGWLRSDQIKKLYLDLNH

SEQ ID NO: 2069482 - protein, 23 aa, Staphylococcus
HKTIVYKGWLRSDQIKTLYLDLN

SEQ ID NO: 2069483 - protein, 19 aa, Staphylococcus
HKTLIKREDIFKYLSGVKG

SEQ ID NO: 2069484 - protein, 18 aa, Staphylococcus
HKTRLTMLIELSSGISLP

SEQ ID NO: 2069485 - protein, 19 aa, Staphylococcus
HKVLPIYGVQYHPESILSE

SEQ ID NO: 2069486 - protein, 17 aa, Staphylococcus
HKVMLLSGTLHSDSPLT

SEQ ID NO: 2069487 - protein, 25 aa, Staphylococcus
HKYPDESELLIYFIEGLMAENQTDE

SEQ ID NO: 2069488 - protein, 25 aa, Staphylococcus
HKYPDESELLIYFIEGLMSENHTDE

SEQ ID NO: 2069489 - protein, 24 aa, Staphylococcus
HKYPDESELLIYFIEGLMSENQTD

SEQ ID NO: 2069490 - protein, 36 aa, Staphylococcus
HKYPRLFESVHRALLQTWPDFTFPDSEIAFIVLHFG

SEQ ID NO: 2069491 - protein, 19 aa, Staphylococcus
HKYYRVNIPTIEVVNPVGS

SEQ ID NO: 2069492 - protein, 22 aa, Staphylococcus
HLAARKGLPYVFAGHFAPQQMK

SEQ ID NO: 2069493 - protein, 23 aa, Staphylococcus
HLAARKGLPYVFAGHFAPQQMKE

SEQ ID NO: 2069494 - protein, 24 aa, Staphylococcus
HLAIDLLKLCHDYQVPFIVNDDVD

SEQ ID NO: 2069495 - protein, 26 aa, Staphylococcus
HLAKKLQIPYIDYMSDLIGIIQQQTQ

SEQ ID NO: 2069496 - protein, 17 aa, Staphylococcus
HLASYYKFKQPSLLYDQ

SEQ ID NO: 2069497 - protein, 19 aa, Staphylococcus
HLDDKASVAMIIELLKKIK

SEQ ID NO: 2069498 - protein, 17 aa, Staphylococcus
HLDGIKKYGILNEHRKT

SEQ ID NO: 2069499 - protein, 27 aa, Staphylococcus
HLDKHALQDIINLLLDDVQVTLDKKDI

SEQ ID NO: 2069500 - protein, 39 aa, Staphylococcus
HLDLETTKWLEDYLKYFKGAIIIISHDRYFLDKIVTQIY

SEQ ID NO: 2069501 - protein, 49 aa, Staphylococcus
HLDLETTKWLEDYLKYFKGAIIIISHDRYFLDKIVTQIYDVALGDVKRY

SEQ ID NO: 2069502 - protein, 28 aa, Staphylococcus
HLDLETTKWLEDYLKYFKGAIVIISHDR

SEQ ID NO: 2069503 - protein, 29 aa, Staphylococcus
HLDMETTQWLESYLNYFNGAIVIISHDRY

SEQ ID NO: 2069504 - protein, 17 aa, Staphylococcus
HLDTRFVNGERALLFGP

SEQ ID NO: 2069505 - protein, 17 aa, Staphylococcus
HLEKNRVVIFAAGIGNP

SEQ ID NO: 2069506 - protein, 23 aa, Staphylococcus
HLENGLVWSIPITLPVTETQANE

SEQ ID NO: 2069507 - protein, 17 aa, Staphylococcus
HLERMGAQVLPFGEQEK

SEQ ID NO: 2069508 - protein, 17 aa, Staphylococcus
HLFEALKSWLEEEAVAD

SEQ ID NO: 2069509 - protein, 25 aa, Staphylococcus
HLFNDKHYFIYPKGKRDTVADMPFI

SEQ ID NO: 2069510 - protein, 18 aa, Staphylococcus
HLFPLIAQDNGVLSRRGH

SEQ ID NO: 2069511 - protein, 17 aa, Staphylococcus
HLGAPFDTFGGFKSYRL

SEQ ID NO: 2069512 - protein, 24 aa, Staphylococcus
HLGELLDIEITFGSLNLADNYSAS

SEQ ID NO: 2069513 - protein, 17 aa, Staphylococcus
HLGFGNYELRLPLLPLE

SEQ ID NO: 2069514 - protein, 17 aa, Staphylococcus
HLGFKHEGFTKGFDPIK

SEQ ID NO: 2069515 - protein, 19 aa, Staphylococcus
HLGIGYAVIPRFYYQSFNT

SEQ ID NO: 2069516 - protein, 18 aa, Staphylococcus
HLGVIWRKDTYLSHVTRE

SEQ ID NO: 2069517 - protein, 31 aa, Staphylococcus
HLHLKTHNLIEARQFYIDQLGFEHISNLPQS

SEQ ID NO: 2069518 - protein, 17 aa, Staphylococcus
HLIDNYSIGIIALNDTD

SEQ ID NO: 2069519 - protein, 19 aa, Staphylococcus
HLIHLPFDYMFFTGSDKVG

SEQ ID NO: 2069520 - protein, 24 aa, Staphylococcus
HLIKYMLSMFIPEDAIMTKLVSTI

SEQ ID NO: 2069521 - protein, 18 aa, Staphylococcus
HLINLLKDGEKVGFIGIE

SEQ ID NO: 2069522 - protein, 18 aa, Staphylococcus
HLKAMIPWEGLNDMYREA

SEQ ID NO: 2069523 - protein, 18 aa, Staphylococcus
HLKAMIPWEGLNDMYREI

SEQ ID NO: 2069524 - protein, 17 aa, Staphylococcus
HLKHRLFNQKLAEPIVD

SEQ ID NO: 2069525 - protein, 24 aa, Staphylococcus
HLKLTTRFIPTQFIRFDEATITTK

SEQ ID NO: 2069526 - protein, 23 aa, Staphylococcus
HLKNGLVWSIPITLPVTEDKANE

SEQ ID NO: 2069527 - protein, 18 aa, Staphylococcus
HLKNLKNITFIPAGNKNV

SEQ ID NO: 2069528 - protein, 19 aa, Staphylococcus
HLKPYFISKAIQKLKERGL

SEQ ID NO: 2069529 - protein, 18 aa, Staphylococcus
HLKQLFPNTLALSNITFE

SEQ ID NO: 2069530 - protein, 28 aa, Staphylococcus
HLKTIRISEIKSYYLNYFGLEESAYIDD

SEQ ID NO: 2069531 - protein, 18 aa, Staphylococcus
HLKVEKYYTPLEFGKLRK

SEQ ID NO: 2069532 - protein, 28 aa, Staphylococcus
HLKVEKYYTPLEFGKLRKIAMEKGFKHC

SEQ ID NO: 2069533 - protein, 19 aa, Staphylococcus
HLKVEKYYTPLEFGKLRKV

SEQ ID NO: 2069534 - protein, 29 aa, Staphylococcus
HLKVQKYYSPLEFGKLRKVAMEKGFKHCQ

SEQ ID NO: 2069535 - protein, 19 aa, Staphylococcus
HLKVQKYYTPLEFGKLRKA

SEQ ID NO: 2069536 - protein, 17 aa, Staphylococcus
HLKYIVDDDFNYASNLS

SEQ ID NO: 2069537 - protein, 28 aa, Staphylococcus
HLLERSNQLFVPLYKSWRLNERHYGGLQ

SEQ ID NO: 2069538 - protein, 17 aa, Staphylococcus
HLLIKDKIDNFKQKSVF

SEQ ID NO: 2069539 - protein, 18 aa, Staphylococcus
HLLLKNEIQLKNLKAILN

SEQ ID NO: 2069540 - protein, 24 aa, Staphylococcus
HLLNHVVGILIDHFRELYLPEINP

SEQ ID NO: 2069541 - protein, 17 aa, Staphylococcus
HLLQTVWGYDYFGDVRT

SEQ ID NO: 2069542 - protein, 17 aa, Staphylococcus
HLLYCSSAGHEPGYVFR

SEQ ID NO: 2069543 - protein, 24 aa, Staphylococcus
HLMNLKELFLVSLQERAIPFELNG

SEQ ID NO: 2069544 - protein, 24 aa, Staphylococcus
HLMNLKNLFLVSLQERSVPFELNG

SEQ ID NO: 2069545 - protein, 17 aa, Staphylococcus
HLNDKFWKYMKNNDLTD

SEQ ID NO: 2069546 - protein, 18 aa, Staphylococcus
HLNGIMFYDHIDDANPLA

SEQ ID NO: 2069547 - protein, 18 aa, Staphylococcus
HLNGIMFYDYIDKDHPLT

SEQ ID NO: 2069548 - protein, 19 aa, Staphylococcus
HLNHSLFWELLSPNSEEKG

SEQ ID NO: 2069549 - protein, 19 aa, Staphylococcus
HLNHSLFWELLTPNSEEKG

SEQ ID NO: 2069550 - protein, 19 aa, Staphylococcus
HLNIDPARILFGAGLDEVI

SEQ ID NO: 2069551 - protein, 18 aa, Staphylococcus
HLNIDYPRLFEHKNNIVH

SEQ ID NO: 2069552 - protein, 25 aa, Staphylococcus
HLNKMRKIYKEKLQFILNALSPYEN

SEQ ID NO: 2069553 - protein, 26 aa, Staphylococcus
HLNPIKRLGVWYMSRNVRKLMKKYDV

SEQ ID NO: 2069554 - protein, 27 aa, Staphylococcus
HLNQLKAFNYIPYFQNFEMHLLNIDEP

SEQ ID NO: 2069555 - protein, 29 aa, Staphylococcus
HLPLESMEMIQFHPTLLGKPYEAYSLVSE

SEQ ID NO: 2069556 - protein, 23 aa, Staphylococcus
HLQTLLPIPVIGVIEPGARTAIM

SEQ ID NO: 2069557 - protein, 22 aa, Staphylococcus
HLREQPLDYLHASLFDIHSKTR

SEQ ID NO: 2069558 - protein, 25 aa, Staphylococcus
HLRFPTDHELYILKKVKRWLDDYFL

SEQ ID NO: 2069559 - protein, 25 aa, Staphylococcus
HLRKIKADVPIYYYGLEKNEDIYAD

SEQ ID NO: 2069560 - protein, 19 aa, Staphylococcus
HLRLEYYNEADLKEIIIRT

SEQ ID NO: 2069561 - protein, 23 aa, Staphylococcus
HLRLNVTFIPTQQIRFEEATINT

SEQ ID NO: 2069562 - protein, 19 aa, Staphylococcus
HLRNSGLTYTIVHPGGLED

SEQ ID NO: 2069563 - protein, 22 aa, Staphylococcus
HLRQKMGMVFQNFNLFPHKTVK

SEQ ID NO: 2069564 - protein, 26 aa, Staphylococcus
HLRQLKADVPIYYYGLNKNDDIYADN

SEQ ID NO: 2069565 - protein, 17 aa, Staphylococcus
HLRYTYNKYLTNGIQSF

SEQ ID NO: 2069566 - protein, 17 aa, Staphylococcus
HLSFQTEDMKRQSKIFR

SEQ ID NO: 2069567 - protein, 18 aa, Staphylococcus
HLSPDEIFPYAPPQGIET

SEQ ID NO: 2069568 - protein, 23 aa, Staphylococcus
HLSPDEVFPYAPPQGLEALRDLW

SEQ ID NO: 2069569 - protein, 23 aa, Staphylococcus
HLSRPAVSYHLRVLKEANVVTVE

SEQ ID NO: 2069570 - protein, 24 aa, Staphylococcus
HLTAIYRPYTKFFQPVFEEFDVYP

SEQ ID NO: 2069571 - protein, 19 aa, Staphylococcus
HLTLKLLKLDKNKIVHLWM

SEQ ID NO: 2069572 - protein, 26 aa, Staphylococcus
HLTQEKFIALFLNSKNIIIKQKTIFM

SEQ ID NO: 2069573 - protein, 23 aa, Staphylococcus
HLVGPTGIIRRMVDTKRLSSMIF

SEQ ID NO: 2069574 - protein, 17 aa, Staphylococcus
HLVIIGGGYIALEFASM

SEQ ID NO: 2069575 - protein, 27 aa, Staphylococcus
HLVIQTYFERVNLKFLSSLPVGGLGLD

SEQ ID NO: 2069576 - protein, 20 aa, Staphylococcus
HLVNFIKKSTQIGIPIVAHL

SEQ ID NO: 2069577 - protein, 24 aa, Staphylococcus
HLVRRTFVEGSAVPALFGVQQDAT

SEQ ID NO: 2069578 - protein, 23 aa, Staphylococcus
HLYDSAGIMDLPFKPKQLVIVGA

SEQ ID NO: 2069579 - protein, 20 aa, Staphylococcus
HLYHHDIVYTTNGRLGFDYL

SEQ ID NO: 2069580 - protein, 24 aa, Staphylococcus
HLYIKNSITFCPHYSFNGTNVIEN

SEQ ID NO: 2069581 - protein, 19 aa, Staphylococcus
HLYITMKHCNNFLKRQDDY

SEQ ID NO: 2069582 - protein, 22 aa, Staphylococcus
HLYLRDYLSNFYVKDLKEICRI

SEQ ID NO: 2069583 - protein, 19 aa, Staphylococcus
HMDGWLFYAQPFQDQKKLV

SEQ ID NO: 2069584 - protein, 21 aa, Staphylococcus
HMDGWLFYAQPFQGQKKLVEA

SEQ ID NO: 2069585 - protein, 21 aa, Staphylococcus
HMDLDIESGYFYTLLGPSGCG

SEQ ID NO: 2069586 - protein, 19 aa, Staphylococcus
HMEQKILNIWRAEFNDYTI

SEQ ID NO: 2069587 - protein, 31 aa, Staphylococcus
HMFDESPIPINYNLMPKCIYTYPEIASIGKN

SEQ ID NO: 2069588 - protein, 17 aa, Staphylococcus
HMFFGAERLIEMRRFIL

SEQ ID NO: 2069589 - protein, 24 aa, Staphylococcus
HMHPQDIVQLLYEAILKIQNPNKR

SEQ ID NO: 2069590 - protein, 29 aa, Staphylococcus
HMIDDLIYFATYHTMPWPSYSPQTPYCYI

SEQ ID NO: 2069591 - protein, 24 aa, Staphylococcus
HMIEQLYSPVQFIDSTEWLIEQGV

SEQ ID NO: 2069592 - protein, 24 aa, Staphylococcus
HMIQLGLFNHIPFFESIDMNKFIV

SEQ ID NO: 2069593 - protein, 17 aa, Staphylococcus
HMKSYIFKSTRLDSSII

SEQ ID NO: 2069594 - protein, 20 aa, Staphylococcus
HMLNHGIPSFGYRIEAPYTS

SEQ ID NO: 2069595 - protein, 18 aa, Staphylococcus
HMMIWEGIELLPVTTPSK

SEQ ID NO: 2069596 - protein, 20 aa, Staphylococcus
HMNDPIVIEYIKVPKGIDIG

SEQ ID NO: 2069597 - protein, 18 aa, Staphylococcus
HMNMQQFKILLFIKDYST

SEQ ID NO: 2069598 - protein, 28 aa, Staphylococcus
HMTIRENIVLVPKLLKWSKEKKDAKAKE

SEQ ID NO: 2069599 - protein, 29 aa, Staphylococcus
HMTIRENIVLVPKLLKWSKEKKDAKAKEL

SEQ ID NO: 2069600 - protein, 29 aa, Staphylococcus
HMTIRENIVLVPKLLKWSKEKKDARAKEL

SEQ ID NO: 2069601 - protein, 28 aa, Staphylococcus
HMTIRENIVLVPKLLKWSKEKKDQKAEE

SEQ ID NO: 2069602 - protein, 28 aa, Staphylococcus
HMTIRENIVLVPKLLKWSKEKKDSKAKE

SEQ ID NO: 2069603 - protein, 27 aa, Staphylococcus
HMTIRENIVLVPKLLKWSQEKKEKKAK

SEQ ID NO: 2069604 - protein, 17 aa, Staphylococcus
HMTPSINFDPILKSIIR

SEQ ID NO: 2069605 - protein, 20 aa, Staphylococcus
HMTSLVYKLEEMGVQLAFDE

SEQ ID NO: 2069606 - protein, 17 aa, Staphylococcus
HNAVPGKLFAVCGDGLA

SEQ ID NO: 2069607 - protein, 25 aa, Staphylococcus
HNEPSWMTELRKKALKLTETLEMPK

SEQ ID NO: 2069608 - protein, 23 aa, Staphylococcus
HNERLSRGLQYLTSALTFDNKTI

SEQ ID NO: 2069609 - protein, 19 aa, Staphylococcus
HNFGPFLHEMIDFTQIKND

SEQ ID NO: 2069610 - protein, 18 aa, Staphylococcus
HNGLLLEALKSYGTLIDF

SEQ ID NO: 2069611 - protein, 17 aa, Staphylococcus
HNGYIITYTGFILKFNV

SEQ ID NO: 2069612 - protein, 23 aa, Staphylococcus
HNHIRGLSPWPVAYTIMDDKNLK

SEQ ID NO: 2069613 - protein, 18 aa, Staphylococcus
HNHIVINAVNLETGKKFN

SEQ ID NO: 2069614 - protein, 18 aa, Staphylococcus
HNHIVINSIDLETGKKFN

SEQ ID NO: 2069615 - protein, 18 aa, Staphylococcus
HNHPVGVFMLLGTTGVGK

SEQ ID NO: 2069616 - protein, 18 aa, Staphylococcus
HNHQLSTQLLNNTLTKLD

SEQ ID NO: 2069617 - protein, 21 aa, Staphylococcus
HNHWYKWLQHNLELEGYDVQL

SEQ ID NO: 2069618 - protein, 22 aa, Staphylococcus
HNKINFINKYYIKIINSINQLI

SEQ ID NO: 2069619 - protein, 21 aa, Staphylococcus
HNKKEIYFRLTPKGQQVYHTH

SEQ ID NO: 2069620 - protein, 18 aa, Staphylococcus
HNKSAHFKVFSDNIGKYV

SEQ ID NO: 2069621 - protein, 23 aa, Staphylococcus
HNKVYWFNEEYYGFGAGASGYVE

SEQ ID NO: 2069622 - protein, 22 aa, Staphylococcus
HNKVYWLNEEYYGFGAGASGYT

SEQ ID NO: 2069623 - protein, 25 aa, Staphylococcus
HNLDYILFGHLFKTKSKPGKAPRTN

SEQ ID NO: 2069624 - protein, 17 aa, Staphylococcus
HNLLNTMKRERLIILTT

SEQ ID NO: 2069625 - protein, 17 aa, Staphylococcus
HNLSIMCEADWIIDVGP

SEQ ID NO: 2069626 - protein, 17 aa, Staphylococcus
HNNLIHHTLTDISKHQL

SEQ ID NO: 2069627 - protein, 23 aa, Staphylococcus
HNNPFHMSPYFGYAERLLASSGI

SEQ ID NO: 2069628 - protein, 24 aa, Staphylococcus
HNNQMFDLFHLYIKQFDELIQKFH

SEQ ID NO: 2069629 - protein, 24 aa, Staphylococcus
HNPDALFMTLNKKAYRIPQNIKAR

SEQ ID NO: 2069630 - protein, 25 aa, Staphylococcus
HNPNAVFMTLNKKAYRIPKSIQDRT

SEQ ID NO: 2069631 - protein, 23 aa, Staphylococcus
HNQKALVSLLQNSIPVAASEKSV

SEQ ID NO: 2069632 - protein, 18 aa, Staphylococcus
HNQKGIITQAWSPLGRAS

SEQ ID NO: 2069633 - protein, 25 aa, Staphylococcus
HNQKIRERLLKFLNLQLSDNQKGRY

SEQ ID NO: 2069634 - protein, 23 aa, Staphylococcus
HNSLYVEVYPFDISFDDPFCKIQ

SEQ ID NO: 2069635 - protein, 17 aa, Staphylococcus
HNSYLFVLESQDSIFFS

SEQ ID NO: 2069636 - protein, 18 aa, Staphylococcus
HNVCVVVTRYFGGIKLGG

SEQ ID NO: 2069637 - protein, 17 aa, Staphylococcus
HNVDFDLNFIKKAFQNC

SEQ ID NO: 2069638 - protein, 23 aa, Staphylococcus
HNWTNMFKVLLHEIFKDYGVLFI

SEQ ID NO: 2069639 - protein, 35 aa, Staphylococcus
HPAAIKTAFRMKGNQHFYLITDAMRAKGMPDGEYD

SEQ ID NO: 2069640 - protein, 18 aa, Staphylococcus
HPADFLYHLPDSVTYEQA

SEQ ID NO: 2069641 - protein, 23 aa, Staphylococcus
HPAKRIFQAIRIAVNDELSAFED

SEQ ID NO: 2069642 - protein, 17 aa, Staphylococcus
HPALAQYLLAQHRGFIL

SEQ ID NO: 2069643 - protein, 17 aa, Staphylococcus
HPANCLMARIGKRITLS

SEQ ID NO: 2069644 - protein, 17 aa, Staphylococcus
HPANCLMARIGSRISLD

SEQ ID NO: 2069645 - protein, 24 aa, Staphylococcus
HPANGFVCYMIGRLVLEYCKDVDE

SEQ ID NO: 2069646 - protein, 24 aa, Staphylococcus
HPDADYKVQVFRIGEGGLGGELHL

SEQ ID NO: 2069647 - protein, 19 aa, Staphylococcus
HPDGIYLSGALLMFAGNKS

SEQ ID NO: 2069648 - protein, 28 aa, Staphylococcus
HPDGLYLSGALLMFCGKKAYYLYGASSN

SEQ ID NO: 2069649 - protein, 26 aa, Staphylococcus
HPDMTRYFMTIPEASRLVLQAGALAK

SEQ ID NO: 2069650 - protein, 26 aa, Staphylococcus
HPDNPFDLTKVWYKGDYPLIEVGEFE

SEQ ID NO: 2069651 - protein, 23 aa, Staphylococcus
HPEDYLFHIPDTLSYEQATLNEP

SEQ ID NO: 2069652 - protein, 29 aa, Staphylococcus
HPEFREAGLFHIAYLLPSRQDLANFLYHM

SEQ ID NO: 2069653 - protein, 26 aa, Staphylococcus
HPEMTRYFMTIPEAARLVLQAGALAT

SEQ ID NO: 2069654 - protein, 17 aa, Staphylococcus
HPEPKEEKKGFFARLFN

SEQ ID NO: 2069655 - protein, 17 aa, Staphylococcus
HPEYIVTRRGVGYFLQQ

SEQ ID NO: 2069656 - protein, 17 aa, Staphylococcus
HPFDFLSDVVYQWERFA

SEQ ID NO: 2069657 - protein, 17 aa, Staphylococcus
HPFEKVRTKKRAFNTLE

SEQ ID NO: 2069658 - protein, 18 aa, Staphylococcus
HPGAKLRKGLTPEMNLLY

SEQ ID NO: 2069659 - protein, 30 aa, Staphylococcus
HPGFPTDMQSQIMALLLTAEGHKVITETVF

SEQ ID NO: 2069660 - protein, 30 aa, Staphylococcus
HPGFPTDMQSQMIALLLTAEGHKVITETVF

SEQ ID NO: 2069661 - protein, 30 aa, Staphylococcus
HPGFPTDMQSQMIALLLTANGHKVITETVF

SEQ ID NO: 2069662 - protein, 30 aa, Staphylococcus
HPGFPTDMQSQMMALLLTAEGHKVITETVF

SEQ ID NO: 2069663 - protein, 25 aa, Staphylococcus
HPGFPTDMQSQMMALLLTAEGHKVV

SEQ ID NO: 2069664 - protein, 30 aa, Staphylococcus
HPGFPTDMQSQMMALLLTAEGHKVVTETVF

SEQ ID NO: 2069665 - protein, 26 aa, Staphylococcus
HPGFPTDMQSQMMALLLTANGHKVIT

SEQ ID NO: 2069666 - protein, 18 aa, Staphylococcus
HPHCRSSTIPFAPTRRKD

SEQ ID NO: 2069667 - protein, 28 aa, Staphylococcus
HPIRGNIVKAFIILKEGYKPSDDLVKEL

SEQ ID NO: 2069668 - protein, 17 aa, Staphylococcus
HPKLKNLYYLQENAKQA

SEQ ID NO: 2069669 - protein, 23 aa, Staphylococcus
HPKMMLKVILYAYTQSVFSGRKI

SEQ ID NO: 2069670 - protein, 24 aa, Staphylococcus
HPKMMLKVILYVYTQSVFSGRKIE

SEQ ID NO: 2069671 - protein, 20 aa, Staphylococcus
HPLEFFSSSPIFYSNNNPFG

SEQ ID NO: 2069672 - protein, 18 aa, Staphylococcus
HPLIQHKLSYIRDKNTGT

SEQ ID NO: 2069673 - protein, 18 aa, Staphylococcus
HPLIQHKLSYIRDMNTGT

SEQ ID NO: 2069674 - protein, 17 aa, Staphylococcus
HPLIQHKLSYIRDVHTG

SEQ ID NO: 2069675 - protein, 17 aa, Staphylococcus
HPLIQHKLSYIRDVNTG

SEQ ID NO: 2069676 - protein, 17 aa, Staphylococcus
HPLLSMPNAVILPHIGS

SEQ ID NO: 2069677 - protein, 28 aa, Staphylococcus
HPMHPEYEYPFHFLCGAGVAYKLSQVLL

SEQ ID NO: 2069678 - protein, 18 aa, Staphylococcus
HPNGIYLSGALLMFAGNK

SEQ ID NO: 2069679 - protein, 27 aa, Staphylococcus
HPNGIYLSGALLMFAGSKSYYLYGASS

SEQ ID NO: 2069680 - protein, 27 aa, Staphylococcus
HPNGTIIQLWHGSPIKRLFLDSAEPYE

SEQ ID NO: 2069681 - protein, 20 aa, Staphylococcus
HPNIRFSLISDGKTMLKTNG

SEQ ID NO: 2069682 - protein, 23 aa, Staphylococcus
HPNVITTYDLLYRAGLDLDVDFV

SEQ ID NO: 2069683 - protein, 19 aa, Staphylococcus
HPPLNSFELFTLMAYSGCR

SEQ ID NO: 2069684 - protein, 23 aa, Staphylococcus
HPQFVVPTPHRIFDFFNAFIGTQ

SEQ ID NO: 2069685 - protein, 22 aa, Staphylococcus
HPQLFIYRRNYDNQTWLVIANF

SEQ ID NO: 2069686 - protein, 22 aa, Staphylococcus
HPQLFIYRRNYKNDSWLIIANF

SEQ ID NO: 2069687 - protein, 18 aa, Staphylococcus
HPQVIRVVALSGGYSRDE

SEQ ID NO: 2069688 - protein, 24 aa, Staphylococcus
HPREPAPRRAGLPGPASPTSTAAS

SEQ ID NO: 2069689 - protein, 24 aa, Staphylococcus
HPRFGEIAVLLYTGSIELEYQTVR

SEQ ID NO: 2069690 - protein, 17 aa, Staphylococcus
HPRLILQSNIQTQVLRN

SEQ ID NO: 2069691 - protein, 25 aa, Staphylococcus
HPRMAERAFVLIPLQEIAPEAINPR

SEQ ID NO: 2069692 - protein, 25 aa, Staphylococcus
HPRMTERAFVLIPLNDIASTKIEPH

SEQ ID NO: 2069693 - protein, 23 aa, Staphylococcus
HPSEILSCILLEAPHLDNEASMQ

SEQ ID NO: 2069694 - protein, 29 aa, Staphylococcus
HPSFREAGLFHIAFLLPSRADLANFLYHV

SEQ ID NO: 2069695 - protein, 17 aa, Staphylococcus
HPSLLPKYKGKDAIGQA

SEQ ID NO: 2069696 - protein, 17 aa, Staphylococcus
HPSTYPPLHYTFDHIII

SEQ ID NO: 2069697 - protein, 28 aa, Staphylococcus
HPTGSSLKPFLAYGPAIENMQWATNHAL

SEQ ID NO: 2069698 - protein, 28 aa, Staphylococcus
HPTGSSLKPFLAYGPAIENMSWATNHAI

SEQ ID NO: 2069699 - protein, 21 aa, Staphylococcus
HPTYLSLLRWSEELKRVGIES

SEQ ID NO: 2069700 - protein, 25 aa, Staphylococcus
HPVNNYILNGITRKVIKWVAEDYNI

SEQ ID NO: 2069701 - protein, 23 aa, Staphylococcus
HPVRNYLNSLTWDGEPRLERLFI

SEQ ID NO: 2069702 - protein, 27 aa, Staphylococcus
HPYETPVYDFIPLTKKLNRGLGVIGEL

SEQ ID NO: 2069703 - protein, 21 aa, Staphylococcus
HQAIAIIQFKLEIPIIKRRPN

SEQ ID NO: 2069704 - protein, 25 aa, Staphylococcus
HQCREAGLPCYFTMDAGPNVKVLVE

SEQ ID NO: 2069705 - protein, 30 aa, Staphylococcus
HQDFPLEPKTLFYNWIYINALNQNEEVAKE

SEQ ID NO: 2069706 - protein, 29 aa, Staphylococcus
HQEMLATVIGFPREQWVFPIQTHENKVVK

SEQ ID NO: 2069707 - protein, 30 aa, Staphylococcus
HQEQLAELIGYPREQWVFPIQTHETKVVEV

SEQ ID NO: 2069708 - protein, 22 aa, Staphylococcus
HQETTIKPFILLVVDKKEEGLK

SEQ ID NO: 2069709 - protein, 19 aa, Staphylococcus
HQFLLLAKEDWHEGVLGIV

SEQ ID NO: 2069710 - protein, 22 aa, Staphylococcus
HQFNQWSIDYVSCSPFRVSGAI

SEQ ID NO: 2069711 - protein, 22 aa, Staphylococcus
HQGRDYFVKFNCPEFTSLCPIT

SEQ ID NO: 2069712 - protein, 18 aa, Staphylococcus
HQHIFVFDEPTTGLHEDD

SEQ ID NO: 2069713 - protein, 19 aa, Staphylococcus
HQHSIYFEGMPDKKTFKAC

SEQ ID NO: 2069714 - protein, 23 aa, Staphylococcus
HQHYFLCHDILEELWKSNPNFSK

SEQ ID NO: 2069715 - protein, 19 aa, Staphylococcus
HQIMSVPVLMLMNKDKEVK

SEQ ID NO: 2069716 - protein, 22 aa, Staphylococcus
HQKAQITYFGGMREEMSLDGSI

SEQ ID NO: 2069717 - protein, 35 aa, Staphylococcus
HQKQIIVSYHNFLETPPLEELKFTYYKMQKLNPEY

SEQ ID NO: 2069718 - protein, 23 aa, Staphylococcus
HQKQYEYLINRYLLNIERKNEIS

SEQ ID NO: 2069719 - protein, 20 aa, Staphylococcus
HQLALPINIIGIIASAENMI

SEQ ID NO: 2069720 - protein, 25 aa, Staphylococcus
HQLKKGEFFIARTLSPKAPELKTDK

SEQ ID NO: 2069721 - protein, 19 aa, Staphylococcus
HQLKSLPDQWYLGIIKPIV

SEQ ID NO: 2069722 - protein, 17 aa, Staphylococcus
HQLLIKEDLRMSTSIVA

SEQ ID NO: 2069723 - protein, 17 aa, Staphylococcus
HQLLIREGLRMDTSLVA

SEQ ID NO: 2069724 - protein, 28 aa, Staphylococcus
HQLNITEFAVLELLFHKGPQQVQHIRKR

SEQ ID NO: 2069725 - protein, 23 aa, Staphylococcus
HQLPHNVVFIFQPAEETGGGANR

SEQ ID NO: 2069726 - protein, 24 aa, Staphylococcus
HQMMRVVLIEQIYRAFKIMRGEAY

SEQ ID NO: 2069727 - protein, 25 aa, Staphylococcus
HQQIDLLLNLELPLARILSEMEETG

SEQ ID NO: 2069728 - protein, 32 aa, Staphylococcus
HQQILKFAQAHQIEWIIIGPEQPLIDGLSDLL

SEQ ID NO: 2069729 - protein, 30 aa, Staphylococcus
HQQLEILNRLYIPLIGFKAIGVYHFMNQFI

SEQ ID NO: 2069730 - protein, 24 aa, Staphylococcus
HQQLLAAAIDFPRAHWVFPIQTHE

SEQ ID NO: 2069731 - protein, 23 aa, Staphylococcus
HQQQFVANLFFENSTRTKCSFEV

SEQ ID NO: 2069732 - protein, 17 aa, Staphylococcus
HQSIDNAALLKSSTKYS

SEQ ID NO: 2069733 - protein, 17 aa, Staphylococcus
HQSLFGKSYLKLLTERI

SEQ ID NO: 2069734 - protein, 27 aa, Staphylococcus
HQTILANMIGFPRNEWVFPIQTHENKI

SEQ ID NO: 2069735 - protein, 24 aa, Staphylococcus
HQTKIALFESLKAWLDDELVAETW

SEQ ID NO: 2069736 - protein, 34 aa, Staphylococcus
HQVIFATARPIRDLLPVIPEFKDFTLIGGNGSII

SEQ ID NO: 2069737 - protein, 25 aa, Staphylococcus
HQVISHGYVRRFQMLEPSLKDIFID

SEQ ID NO: 2069738 - protein, 17 aa, Staphylococcus
HQVMLLSGTLHLDSHLL

SEQ ID NO: 2069739 - protein, 19 aa, Staphylococcus
HQVVIRCILVYLGELNKED

SEQ ID NO: 2069740 - protein, 24 aa, Staphylococcus
HQYKKKVMMVKFNNLIDLKQEVRL

SEQ ID NO: 2069741 - protein, 17 aa, Staphylococcus
HQYPEPSFEETWTHNYI

SEQ ID NO: 2069742 - protein, 29 aa, Staphylococcus
HRDRAELLLRVAAIIRRRKEEISAVMVYE

SEQ ID NO: 2069743 - protein, 28 aa, Staphylococcus
HRDVTGKWSWLAPPLSPTLTANYHHGYK

SEQ ID NO: 2069744 - protein, 26 aa, Staphylococcus
HRENYEALLLYYKDSVENPFIDGACY

SEQ ID NO: 2069745 - protein, 17 aa, Staphylococcus
HREPGVFGAAWLNDQLS

SEQ ID NO: 2069746 - protein, 20 aa, Staphylococcus
HRHERWFDICKKLEGLPRHT

SEQ ID NO: 2069747 - protein, 33 aa, Staphylococcus
HRIANFHTAAPLYYRAEPLGCTATILYKMFKEQ

SEQ ID NO: 2069748 - protein, 17 aa, Staphylococcus
HRIAQQSELFYQWLQDG

SEQ ID NO: 2069749 - protein, 17 aa, Staphylococcus
HRKIFRRDALTPSEITN

SEQ ID NO: 2069750 - protein, 23 aa, Staphylococcus
HRKPGVFGAAWTNSGLNTEVIVD

SEQ ID NO: 2069751 - protein, 20 aa, Staphylococcus
HRKRPATAKPVLLGITKASL

SEQ ID NO: 2069752 - protein, 23 aa, Staphylococcus
HRKRVRDILLTPLKNHHFDPSTY

SEQ ID NO: 2069753 - protein, 18 aa, Staphylococcus
HRKSLWVWTGFLYEYLSH

SEQ ID NO: 2069754 - protein, 28 aa, Staphylococcus
HRKVTGKWSWLVPSLSPTLVPNYHHGYS

SEQ ID NO: 2069755 - protein, 23 aa, Staphylococcus
HRLSIEEFVILYKVYEAKKMSGK

SEQ ID NO: 2069756 - protein, 24 aa, Staphylococcus
HRLTALHAALINGGVFVYVPKNVV

SEQ ID NO: 2069757 - protein, 24 aa, Staphylococcus
HRLTALHTALINGGVFVYVPKNVV

SEQ ID NO: 2069758 - protein, 23 aa, Staphylococcus
HRLTALHTALLNGGMFVYVPKNV

SEQ ID NO: 2069759 - protein, 24 aa, Staphylococcus
HRLTALHTALMNGGIFVYVPKNVV

SEQ ID NO: 2069760 - protein, 24 aa, Staphylococcus
HRLTALHTALVNGGVFVYVPKNVV

SEQ ID NO: 2069761 - protein, 17 aa, Staphylococcus
HRMVTVVLDRAAADGLP

SEQ ID NO: 2069762 - protein, 18 aa, Staphylococcus
HRNHRNELWFEMSKKLEG

SEQ ID NO: 2069763 - protein, 23 aa, Staphylococcus
HRNKKFILLTAHRRENIGQPMIN

SEQ ID NO: 2069764 - protein, 17 aa, Staphylococcus
HRQKMEHIFDWIDITFP

SEQ ID NO: 2069765 - protein, 22 aa, Staphylococcus
HRQPFLLIDRVVEYEVGTRCVA

SEQ ID NO: 2069766 - protein, 19 aa, Staphylococcus
HRRFGEIAVLIYVGNQELD

SEQ ID NO: 2069767 - protein, 24 aa, Staphylococcus
HRSNLVMMGVLPLQFQEGESADSL

SEQ ID NO: 2069768 - protein, 25 aa, Staphylococcus
HRSNLVMMGVLPLQFQQGDSAESLG

SEQ ID NO: 2069769 - protein, 17 aa, Staphylococcus
HRTCEVLIIIDPQFANR

SEQ ID NO: 2069770 - protein, 30 aa, Staphylococcus
HSATGIRIGFLLGPAYLIEKLTFMHAYNCI

SEQ ID NO: 2069771 - protein, 19 aa, Staphylococcus
HSCKILLKQINLFLENQIN

SEQ ID NO: 2069772 - protein, 25 aa, Staphylococcus
HSDAGLLYVSYLTHPTTGGVSASFA

SEQ ID NO: 2069773 - protein, 24 aa, Staphylococcus
HSDDHYYIYLKSKNKPLAIFKKVL

SEQ ID NO: 2069774 - protein, 23 aa, Staphylococcus
HSDIQFQIKHLMVSKVKGTFSQY

SEQ ID NO: 2069775 - protein, 21 aa, Staphylococcus
HSDSDVFFRKTRRQHSKHQLN

SEQ ID NO: 2069776 - protein, 19 aa, Staphylococcus
HSDVFNVLLQILEEGRLTD

SEQ ID NO: 2069777 - protein, 24 aa, Staphylococcus
HSEDLSIKVYLFESFISGEHIFRG

SEQ ID NO: 2069778 - protein, 24 aa, Staphylococcus
HSELQPYYLTKALQKLIKMNFLSK

SEQ ID NO: 2069779 - protein, 21 aa, Staphylococcus
HSERIGFFATLPLPLVDQSVQ

SEQ ID NO: 2069780 - protein, 22 aa, Staphylococcus
HSFEGLFTWQLKHYNNLLNSGE

SEQ ID NO: 2069781 - protein, 20 aa, Staphylococcus
HSFLKTLTFDEGLNAFRSSK

SEQ ID NO: 2069782 - protein, 18 aa, Staphylococcus
HSFLLPLVNEIDTEIHEP

SEQ ID NO: 2069783 - protein, 23 aa, Staphylococcus
HSFPFGVVTLTRMFFENKAHNNK

SEQ ID NO: 2069784 - protein, 29 aa, Staphylococcus
HSGDYKALLHKLYTHLNPGGMLILVDFDK

SEQ ID NO: 2069785 - protein, 18 aa, Staphylococcus
HSGFLINFAYLKKQIHEQ

SEQ ID NO: 2069786 - protein, 20 aa, Staphylococcus
HSGLMYYTIGQRHGLGIGGD

SEQ ID NO: 2069787 - protein, 34 aa, Staphylococcus
HSGNNPAWMILDVLPIIPPEIRPMVQLDGGRFAT

SEQ ID NO: 2069788 - protein, 23 aa, Staphylococcus
HSHGWGFAHMKMAPEHWLCIKED

SEQ ID NO: 2069789 - protein, 18 aa, Staphylococcus
HSHPTAVKLAYQLKGHEH

SEQ ID NO: 2069790 - protein, 24 aa, Staphylococcus
HSHSFPFGVVTLTRKFFGDAAHDD

SEQ ID NO: 2069791 - protein, 19 aa, Staphylococcus
HSHTTSIASLPLILPTKGS

SEQ ID NO: 2069792 - protein, 25 aa, Staphylococcus
HSHYKHLFAILELAKKQGLDKVYVH

SEQ ID NO: 2069793 - protein, 24 aa, Staphylococcus
HSHYKHLFAILELAKKQGVDKVYV

SEQ ID NO: 2069794 - protein, 24 aa, Staphylococcus
HSHYKHLFAILELAKKQGVEKVYV

SEQ ID NO: 2069795 - protein, 23 aa, Staphylococcus
HSIKVCPLIYWSEDDVWQYIKQH

SEQ ID NO: 2069796 - protein, 19 aa, Staphylococcus
HSILNAHTPYFSKTSYQIN

SEQ ID NO: 2069797 - protein, 20 aa, Staphylococcus
HSKGGIYSWLRTPPGYNSEQ

SEQ ID NO: 2069798 - protein, 26 aa, Staphylococcus
HSKLTILKQYLLQIPVCQYSQALNMT

SEQ ID NO: 2069799 - protein, 21 aa, Staphylococcus
HSKVYYAWLSTLSEALHSGEI

SEQ ID NO: 2069800 - protein, 23 aa, Staphylococcus
HSLKEPYIFIGQDAKKLSARLDG

SEQ ID NO: 2069801 - protein, 19 aa, Staphylococcus
HSLKINDKAMRWQLGVIWK

SEQ ID NO: 2069802 - protein, 25 aa, Staphylococcus
HSLSLYACIYALFTGRTFVGQIEFN

SEQ ID NO: 2069803 - protein, 25 aa, Staphylococcus
HSLSLYTCIYALYSGRTFIGQRQFD

SEQ ID NO: 2069804 - protein, 33 aa, Staphylococcus
HSLTVITNCLPVYKILLEKQTTNFRVYLLGGEM

SEQ ID NO: 2069805 - protein, 26 aa, Staphylococcus
HSMDDLPLGVYRFLKQQQSVYARTLE

SEQ ID NO: 2069806 - protein, 28 aa, Staphylococcus
HSMDIPHDLFTPIFAVSRTAGWTAHILE

SEQ ID NO: 2069807 - protein, 29 aa, Staphylococcus
HSMDIPHDLFTPIFAVSRTSGWIAHILEQ

SEQ ID NO: 2069808 - protein, 27 aa, Staphylococcus
HSMDIPHDLFTPIFAVSRTSGWTAHIL

SEQ ID NO: 2069809 - protein, 28 aa, Staphylococcus
HSMGGQMIRLLEHYLRFGNQEEIDYQKE

SEQ ID NO: 2069810 - protein, 30 aa, Staphylococcus; identical to SEQ ID NO: 1821628

SEQ ID NO: 2069811 - protein, 24 aa, Staphylococcus
HSNDLIYCFLLDNVFPERMKVKEI

SEQ ID NO: 2069812 - protein, 17 aa, Staphylococcus
HSPYIILATFVVTAENE

SEQ ID NO: 2069813 - protein, 20 aa, Staphylococcus
HSQFQVFMKTKNRKIAPFTA

SEQ ID NO: 2069814 - protein, 23 aa, Staphylococcus
HSQSLYNVFAAIPGVKVVVPSNP

SEQ ID NO: 2069815 - protein, 17 aa, Staphylococcus
HSRELMVIFVTNGKKFK

SEQ ID NO: 2069816 - protein, 18 aa, Staphylococcus
HSRFPVVDKDWRLVGIVT

SEQ ID NO: 2069817 - protein, 28 aa, Staphylococcus
HSRKYAKRQLTWFKNKMNVRWLDKEKMS

SEQ ID NO: 2069818 - protein, 17 aa, Staphylococcus
HSRLLERAAKLNDTLGG

SEQ ID NO: 2069819 - protein, 19 aa, Staphylococcus
HSRNYAKRQMTWFKNKMDV

SEQ ID NO: 2069820 - protein, 32 aa, Staphylococcus
HSRSQQLITTDLFLNVFGIEKLEDLPTTQEDE

SEQ ID NO: 2069821 - protein, 20 aa, Staphylococcus
HSRYPVYFITSEATGPHFIQ

SEQ ID NO: 2069822 - protein, 17 aa, Staphylococcus
HSSFIMSKMALAAYQGG

SEQ ID NO: 2069823 - protein, 18 aa, Staphylococcus
HSSFIMSKMALAAYQGGA

SEQ ID NO: 2069824 - protein, 19 aa, Staphylococcus
HSSFIMSKMALAAYQGGAV

SEQ ID NO: 2069825 - protein, 25 aa, Staphylococcus
HSSIEFQIKHLMVSKVKGTFNDIDV

SEQ ID NO: 2069826 - protein, 24 aa, Staphylococcus
HSSMPIFGVNAIKPLIEFIQDIDN

SEQ ID NO: 2069827 - protein, 17 aa, Staphylococcus
HSSVEFRRDLLDKIVQE

SEQ ID NO: 2069828 - protein, 23 aa, Staphylococcus
HSTINVVIVCYYGLGVSTLLAER

SEQ ID NO: 2069829 - protein, 26 aa, Staphylococcus
HSTPFTPNVALFRALNRYSALIENEG

SEQ ID NO: 2069830 - protein, 17 aa, Staphylococcus
HSVAMLLAMARNIPNAH

SEQ ID NO: 2069831 - protein, 23 aa, Staphylococcus
HSVERLYVFTKAASSLTGDESTI

SEQ ID NO: 2069832 - protein, 26 aa, Staphylococcus
HSVLNFYKKLIQLKKSHDIYMYGQFD

SEQ ID NO: 2069833 - protein, 23 aa, Staphylococcus
HSVQIMQTLRRLAKELDKTIVVV

SEQ ID NO: 2069834 - protein, 17 aa, Staphylococcus
HSYFEFYSKDQVDFGTG

SEQ ID NO: 2069835 - protein, 21 aa, Staphylococcus
HSYYMIAIPDMFWSVELNAQL

SEQ ID NO: 2069836 - protein, 17 aa, Staphylococcus
HTALIEQIHAGAIGLKV

SEQ ID NO: 2069837 - protein, 24 aa, Staphylococcus
HTDFDVLPLIFQIPGKRVTYHELP

SEQ ID NO: 2069838 - protein, 26 aa, Staphylococcus
HTDKPFYGKLISFITSAPVFAMVVEG

SEQ ID NO: 2069839 - protein, 21 aa, Staphylococcus
HTDQRLKYIKLTEKGKQFNRE

SEQ ID NO: 2069840 - protein, 18 aa, Staphylococcus
HTDYRHEGIAFNLLSYAI

SEQ ID NO: 2069841 - protein, 25 aa, Staphylococcus
HTEKPFFHKLVSFLTSGPVFAMVVE

SEQ ID NO: 2069842 - protein, 21 aa, Staphylococcus
HTEKSGGFDWFKKKPNKQAHE

SEQ ID NO: 2069843 - protein, 28 aa, Staphylococcus
HTENRGMIPYTVFIDPPLSRVGMTALEA

SEQ ID NO: 2069844 - protein, 17 aa, Staphylococcus
HTFKENLYKDTWFTSSI

SEQ ID NO: 2069845 - protein, 34 aa, Staphylococcus
HTFKHTFIIENPQLWWPIGYGEQPLYTVDVELYT

SEQ ID NO: 2069846 - protein, 26 aa, Staphylococcus
HTFSGGMKRRLSLAITLLSKPELIIL

SEQ ID NO: 2069847 - protein, 24 aa, Staphylococcus
HTGHLGFYADWLPHESDKLIREII

SEQ ID NO: 2069848 - protein, 26 aa, Staphylococcus
HTIDQLNGIFFTEKAKRILSEEEMEA

SEQ ID NO: 2069849 - protein, 17 aa, Staphylococcus
HTIHALRRNMNLTYIVM

SEQ ID NO: 2069850 - protein, 20 aa, Staphylococcus
HTISFNYIYYEIYTQMIEMT

SEQ ID NO: 2069851 - protein, 26 aa, Staphylococcus
HTKDGSIGFLIIQFAVANSEKFEKFK

SEQ ID NO: 2069852 - protein, 17 aa, Staphylococcus
HTLKDLGRRRAIVLHGA

SEQ ID NO: 2069853 - protein, 17 aa, Staphylococcus
HTLLKPESTRNQIDKII

SEQ ID NO: 2069854 - protein, 17 aa, Staphylococcus
HTLLKPESTRQQIDQII

SEQ ID NO: 2069855 - protein, 22 aa, Staphylococcus
HTLNEWIPQLIDKEFNSFKEWS

SEQ ID NO: 2069856 - protein, 26 aa, Staphylococcus
HTLVSDIVYIPYKTPILLEAESKGNP

SEQ ID NO: 2069857 - protein, 18 aa, Staphylococcus
HTMMSKKTSGLFLCGEVL

SEQ ID NO: 2069858 - protein, 18 aa, Staphylococcus
HTNGMGKALFAAAFVMHF

SEQ ID NO: 2069859 - protein, 21 aa, Staphylococcus
HTNIAVIKYWGKKDEALIIPM

SEQ ID NO: 2069860 - protein, 27 aa, Staphylococcus
HTNKGDMTFKLFPDIAPKTVENFVTHA

SEQ ID NO: 2069861 - protein, 26 aa, Staphylococcus
HTNKGDMTFKLLPDVAPKTVENFVTH

SEQ ID NO: 2069862 - protein, 24 aa, Staphylococcus
HTPGTALYLWDNGEHRYLFTGDFL

SEQ ID NO: 2069863 - protein, 26 aa, Staphylococcus
HTPLNKKVIIFPKRGAAILLNKIRII

SEQ ID NO: 2069864 - protein, 24 aa, Staphylococcus
HTQMVDEAWFQQIDDLLNFAKEQE

SEQ ID NO: 2069865 - protein, 23 aa, Staphylococcus
HTREYIPVLMYSPKINHGHELSS

SEQ ID NO: 2069866 - protein, 26 aa, Staphylococcus
HTRSQKLWAWSKLIDEHKEELAELIT

SEQ ID NO: 2069867 - protein, 22 aa, Staphylococcus
HTTYFESFVAHAIYFNDPSGNI

SEQ ID NO: 2069868 - protein, 24 aa, Staphylococcus
HTVEHRYVTLKKPVSLFKGKEITK

SEQ ID NO: 2069869 - protein, 27 aa, Staphylococcus
HTVKVKPGDFFYVPAGTVHAIGSGILI

SEQ ID NO: 2069870 - protein, 30 aa, Staphylococcus
HTVQYQRFIRHIQFLIRRLNKKEYIYAQDV

SEQ ID NO: 2069871 - protein, 24 aa, Staphylococcus
HTVRLLHAVELERLTLGRKLGFEL

SEQ ID NO: 2069872 - protein, 30 aa, Staphylococcus
HTVRLLHAVELERLTLGRKLGFELSTAKEA

SEQ ID NO: 2069873 - protein, 17 aa, Staphylococcus
HTWNYHLKNKFGQKIFK

SEQ ID NO: 2069874 - protein, 17 aa, Staphylococcus
HTWNYHLKNKFGRKIFK

SEQ ID NO: 2069875 - protein, 19 aa, Staphylococcus
HTYIEMNRDLDWINRIDFS

SEQ ID NO: 2069876 - protein, 29 aa, Staphylococcus
HTYQQIKSPMVGTFFLQDEKELTNPIIQV

SEQ ID NO: 2069877 - protein, 23 aa, Staphylococcus
HVADRLMEALWREALHIVNDGIA

SEQ ID NO: 2069878 - protein, 24 aa, Staphylococcus
HVASALIKWFNTNYHYIVPEWDNV

SEQ ID NO: 2069879 - protein, 31 aa, Staphylococcus; identical to SEQ ID NO: 1748050

SEQ ID NO: 2069880 - protein, 21 aa, Staphylococcus
HVCRGNYRSTWFAEGAYDSVA

SEQ ID NO: 2069881 - protein, 25 aa, Staphylococcus
HVDKSHLLSHYGIVNVPLAEFNVSN

SEQ ID NO: 2069882 - protein, 18 aa, Staphylococcus
HVDPGAMSAYLMLDTFKA

SEQ ID NO: 2069883 - protein, 18 aa, Staphylococcus
HVDYIGVGPIYQTPSKSD

SEQ ID NO: 2069884 - protein, 24 aa, Staphylococcus
HVDYYNAFVKWTQSRYGYHFPQEQ

SEQ ID NO: 2069885 - protein, 26 aa, Staphylococcus
HVEKVRYMTTLAGYIHWYLTDEKVLG

SEQ ID NO: 2069886 - protein, 22 aa, Staphylococcus
HVEMVEVPIKPSDRLRARDMLG

SEQ ID NO: 2069887 - protein, 25 aa, Staphylococcus
HVEVGRILINILKDVDTRAIIVGGA

SEQ ID NO: 2069888 - protein, 24 aa, Staphylococcus
HVGGFPVSGLFLRCKNKDVIERHY

SEQ ID NO: 2069889 - protein, 19 aa, Staphylococcus
HVGIKKRKLDLGWIVSECP

SEQ ID NO: 2069890 - protein, 26 aa, Staphylococcus
HVGKVLTYQVLLKSLYGYVNHTEMAA

SEQ ID NO: 2069891 - protein, 18 aa, Staphylococcus
HVGPIKLHIVPFTEVQKQ

SEQ ID NO: 2069892 - protein, 24 aa, Staphylococcus
HVHLEFENLLHRSGLRSLDEFKEV

SEQ ID NO: 2069893 - protein, 26 aa, Staphylococcus
HVIDIPKRVFEKLGIPANTAPIRGGT

SEQ ID NO: 2069894 - protein, 19 aa, Staphylococcus
HVIFEHCLPSFHNTDTTIG

SEQ ID NO: 2069895 - protein, 17 aa, Staphylococcus
HVIGTYTMPCARTLVPV

SEQ ID NO: 2069896 - protein, 25 aa, Staphylococcus
HVIKYIRRLDFSGIHPKLAEANIQV

SEQ ID NO: 2069897 - protein, 18 aa, Staphylococcus
HVINLLKDNEKVGFIAIE

SEQ ID NO: 2069898 - protein, 19 aa, Staphylococcus
HVIQQYLPDKLKNKIYYEP

SEQ ID NO: 2069899 - protein, 17 aa, Staphylococcus
HVKILGGKSFIDDIFVA

SEQ ID NO: 2069900 - protein, 30 aa, Staphylococcus
HVLAQALTRLYPQVLLTIGPVIDNGFYYDI

SEQ ID NO: 2069901 - protein, 19 aa, Staphylococcus
HVLGFRSKKDVFYAEQFEK

SEQ ID NO: 2069902 - protein, 19 aa, Staphylococcus
HVLQYQFINQKNNAPFICA

SEQ ID NO: 2069903 - protein, 21 aa, Staphylococcus
HVLTDILPTIDNIERALQIEG

SEQ ID NO: 2069904 - protein, 20 aa, Staphylococcus
HVLTGLEFACGIPGSIGGAV

SEQ ID NO: 2069905 - protein, 17 aa, Staphylococcus
HVLTMLEIAKSLCNIYP

SEQ ID NO: 2069906 - protein, 19 aa, Staphylococcus
HVMHTHLLINLVTQPAGTA

SEQ ID NO: 2069907 - protein, 17 aa, Staphylococcus
HVMIIRGNKMMNLSNTH

SEQ ID NO: 2069908 - protein, 17 aa, Staphylococcus
HVMNLLMHVDQVSYVRF

SEQ ID NO: 2069909 - protein, 17 aa, Staphylococcus
HVPIMQVISFEHDYLKE

SEQ ID NO: 2069910 - protein, 18 aa, Staphylococcus
HVQRQMLATIPGLEKADM

SEQ ID NO: 2069911 - protein, 18 aa, Staphylococcus
HVQTVGKGGLLITLAKIS

SEQ ID NO: 2069912 - protein, 34 aa, Staphylococcus
HVQTVGKGGLLITLARFSAFYGLGVDAKLDVTDA

SEQ ID NO: 2069913 - protein, 32 aa, Staphylococcus
HVQTVGKGGLLLTLARISAHYQLGLQAKLSVT

SEQ ID NO: 2069914 - protein, 27 aa, Staphylococcus
HVRIASPEFMFPSFYGIDVSTTAELIS

SEQ ID NO: 2069915 - protein, 18 aa, Staphylococcus
HVSLLFDTFQAHELPRET

SEQ ID NO: 2069916 - protein, 26 aa, Staphylococcus
HVSLVPQTLQWLMDAGLTQPYKLEKI

SEQ ID NO: 2069917 - protein, 24 aa, Staphylococcus
HVSYELCRLLNEDGVKLIVTDINK

SEQ ID NO: 2069918 - protein, 25 aa, Staphylococcus
HVTDILEIHFPKSKLYLYAPVTGQH

SEQ ID NO: 2069919 - protein, 25 aa, Staphylococcus
HVTKDDMYYLLNVRPNPNQNATQFW

SEQ ID NO: 2069920 - protein, 30 aa, Staphylococcus
HVTPLFEEKYHMYAPKDHPITLTTQPLLTQ

SEQ ID NO: 2069921 - protein, 27 aa, Staphylococcus
HVTTPEWMLLPMHKGGTFGKFSTAIGL

SEQ ID NO: 2069922 - protein, 27 aa, Staphylococcus
HVTTPEWMLLPMHKGGTFGKFTTAIGL

SEQ ID NO: 2069923 - protein, 26 aa, Staphylococcus
HVTTPEWMLLPMHKGGTFGKFTTNIG

SEQ ID NO: 2069924 - protein, 26 aa, Staphylococcus
HVTTPEWMLLPMHKGGTFGKFTTNLG

SEQ ID NO: 2069925 - protein, 22 aa, Staphylococcus
HVTTTPVLRPLLTLDKEDIVIK

SEQ ID NO: 2069926 - protein, 20 aa, Staphylococcus
HVYCGTIGLLLPNGKAIFNV

SEQ ID NO: 2069927 - protein, 18 aa, Staphylococcus
HVYGLVAPLYEQGKVLAD

SEQ ID NO: 2069928 - protein, 18 aa, Staphylococcus
HWEIMGLNIMQPFKVYPD

SEQ ID NO: 2069929 - protein, 23 aa, Staphylococcus
HWEIMGLNIMQPFKVYPEGFPEE

SEQ ID NO: 2069930 - protein, 26 aa, Staphylococcus
HWEQELAMIFVVINNKTKKVSSRAGM

SEQ ID NO: 2069931 - protein, 25 aa, Staphylococcus
HWGEFIPFFLERMDETLFADHLKHP

SEQ ID NO: 2069932 - protein, 21 aa, Staphylococcus
HYAPVLTAFLDPRGQYILEVI

SEQ ID NO: 2069933 - protein, 21 aa, Staphylococcus
HYAQTMAPFVKKEQLIFFNIA

SEQ ID NO: 2069934 - protein, 22 aa, Staphylococcus
HYCYEHELTSILNPAPYRDISD

SEQ ID NO: 2069935 - protein, 18 aa, Staphylococcus
HYDFIMLNSDGLTDYVRG

SEQ ID NO: 2069936 - protein, 19 aa, Staphylococcus
HYDMNRDISPLRKAEDAIT

SEQ ID NO: 2069937 - protein, 23 aa, Staphylococcus
HYDMNREISPLRKADDAITVNTT

SEQ ID NO: 2069938 - protein, 18 aa, Staphylococcus
HYDYLISDSMFSFGNLIA

SEQ ID NO: 2069939 - protein, 29 aa, Staphylococcus
HYEHLLSEYGVWHPNAWHYAPEPKYMAPS

SEQ ID NO: 2069940 - protein, 19 aa, Staphylococcus
HYEKYFNLDLFVYSGDSYD

SEQ ID NO: 2069941 - protein, 28 aa, Staphylococcus
HYEPRIFNLYLRHELPIIHLIQQREYEL

SEQ ID NO: 2069942 - protein, 25 aa, Staphylococcus
HYEQLMPILGVCLGFQLIVEYYGGR

SEQ ID NO: 2069943 - protein, 19 aa, Staphylococcus
HYETEAIWQLFKEADYDRV

SEQ ID NO: 2069944 - protein, 19 aa, Staphylococcus
HYETEAIWQLFKEADYERV

SEQ ID NO: 2069945 - protein, 21 aa, Staphylococcus
HYETEAIWQLFKEANYERVDF

SEQ ID NO: 2069946 - protein, 17 aa, Staphylococcus
HYFIYPKDKRAEVDKLP

SEQ ID NO: 2069947 - protein, 21 aa, Staphylococcus
HYFLCHDILEEAWKSNINFSK

SEQ ID NO: 2069948 - protein, 17 aa, Staphylococcus
HYFYANILSNVVGNEQK

SEQ ID NO: 2069949 - protein, 27 aa, Staphylococcus
HYGKSNYYAFIVFNIMFGGDPSSVLFN

SEQ ID NO: 2069950 - protein, 24 aa, Staphylococcus
HYGLEFAVRQFLRAGINTFSTTSL

SEQ ID NO: 2069951 - protein, 25 aa, Staphylococcus
HYGVVMKEMRLLARSVFVLDENNHV

SEQ ID NO: 2069952 - protein, 23 aa, Staphylococcus
HYHDELIQFPYMNKEKLEMLVKH

SEQ ID NO: 2069953 - protein, 18 aa, Staphylococcus
HYHPMIHEEPLLDKIWDI

SEQ ID NO: 2069954 - protein, 17 aa, Staphylococcus
HYHTPLDVVAMRFKCCD

SEQ ID NO: 2069955 - protein, 17 aa, Staphylococcus
HYLYEHDAIARKILIAS

SEQ ID NO: 2069956 - protein, 19 aa, Staphylococcus
HYMIARKYHFMGYRQMKTL

SEQ ID NO: 2069957 - protein, 17 aa, Staphylococcus
HYNGPFLIEMWSENYDT

SEQ ID NO: 2069958 - protein, 31 aa, Staphylococcus
HYPKLKALNLKWYAVPIISNMNLVIGGITYT

SEQ ID NO: 2069959 - protein, 22 aa, Staphylococcus
HYPYQYLKRDFGIKGIDMHLHA

SEQ ID NO: 2069960 - protein, 18 aa, Staphylococcus
HYQDYELIGRLAKELGIA

SEQ ID NO: 2069961 - protein, 19 aa, Staphylococcus
HYRLGINMAIQYLSYKKRT

SEQ ID NO: 2069962 - protein, 20 aa, Staphylococcus
HYRLYGIFLLNQLNGKEIFM

SEQ ID NO: 2069963 - protein, 21 aa, Staphylococcus
HYRLYGIFLLNQLNGKEILIT

SEQ ID NO: 2069964 - protein, 19 aa, Staphylococcus
HYSDFYLSPNDYLQTLYEE

SEQ ID NO: 2069965 - protein, 24 aa, Staphylococcus
HYSDYFEGAQKYLSYLKSTVDVNF

SEQ ID NO: 2069966 - protein, 26 aa, Staphylococcus
HYSGTLVNGLMYQIKDLSGINGEIRP

SEQ ID NO: 2069967 - protein, 26 aa, Staphylococcus
HYSGTTFIETYLYDVDYNYPKTAQEV

SEQ ID NO: 2069968 - protein, 17 aa, Staphylococcus
HYSPVLTTFLDPRGQYI

SEQ ID NO: 2069969 - protein, 27 aa, Staphylococcus
HYTGTLVNGLMYQIKDLSGINGEIRPG

SEQ ID NO: 2069970 - protein, 23 aa, Staphylococcus
HYTKALFTSLKQRQIKRYVNTEV

SEQ ID NO: 2069971 - protein, 25 aa, Staphylococcus
HYTSDKVIMILNYPNNPTGYTPTKQ

SEQ ID NO: 2069972 - protein, 37 aa, Staphylococcus
HYVNQFDAHFLMFKYRKLHQVIILGPFLLQRPSENKC

SEQ ID NO: 2069973 - protein, 25 aa, Staphylococcus
HYVQDRLLLNINRLKIYQNDRIGLI

SEQ ID NO: 2069974 - protein, 20 aa, Staphylococcus
IAAARYRSYQNKAKIERVVV

SEQ ID NO: 2069975 - protein, 17 aa, Staphylococcus
IAACRIYGDFFGQGNIH

SEQ ID NO: 2069976 - protein, 37 aa, Staphylococcus
IAAEQGIKLTFLPYVVKALVSALKKYPALNTSFNEEA

SEQ ID NO: 2069977 - protein, 20 aa, Staphylococcus
IAAYGLGWYQSFEDCVNDFI

SEQ ID NO: 2069978 - protein, 24 aa, Staphylococcus
IACDYLYCKAFGKTATNIEKFTSQ

SEQ ID NO: 2069979 - protein, 26 aa, Staphylococcus
IADECRLWITVHYLPNERYEDVVAEI

SEQ ID NO: 2069980 - protein, 26 aa, Staphylococcus
IADECRLWITVHYLPNERYEDVVEEI

SEQ ID NO: 2069981 - protein, 17 aa, Staphylococcus
IADIFLQQILTRPSDHD

SEQ ID NO: 2069982 - protein, 18 aa, Staphylococcus
IADIFLQQILTRPSEHEV

SEQ ID NO: 2069983 - protein, 24 aa, Staphylococcus
IADKCRLWVTVHFLPNEDYHEVVT

SEQ ID NO: 2069984 - protein, 19 aa, Staphylococcus
IADLERLFKTLKDLQLDVQ

SEQ ID NO: 2069985 - protein, 22 aa, Staphylococcus
IADNFGVKLPEFGKSYLKEMGV

SEQ ID NO: 2069986 - protein, 23 aa, Staphylococcus
IADNFNVELPKFGKSYLKEMGVE

SEQ ID NO: 2069987 - protein, 22 aa, Staphylococcus
IADNFNVELPKYGKSYLTEMGV

SEQ ID NO: 2069988 - protein, 19 aa, Staphylococcus
IADNFRMDLLRPLFEEYGI

SEQ ID NO: 2069989 - protein, 19 aa, Staphylococcus
IAEALLALEALGYSKREIS

SEQ ID NO: 2069990 - protein, 22 aa, Staphylococcus
IAEDLYPELKPLGKPNPFSYLA

SEQ ID NO: 2069991 - protein, 23 aa, Staphylococcus
IAEELVIIEKPMRAFSENSDQML

SEQ ID NO: 2069992 - protein, 22 aa, Staphylococcus
IAEELVIIEKPMRVFSKESDQM

SEQ ID NO: 2069993 - protein, 19 aa, Staphylococcus
IAEIDGMLIGFAIVSSREY

SEQ ID NO: 2069994 - protein, 31 aa, Staphylococcus
IAEKTAHLDSPFFIGIMPITSYRNAQFLHNE

SEQ ID NO: 2069995 - protein, 25 aa, Staphylococcus
IAEKYNGLKPIQIIDMKGLMGDSSD

SEQ ID NO: 2069996 - protein, 17 aa, Staphylococcus
IAEKYNGLLPKQIIDMK

SEQ ID NO: 2069997 - protein, 25 aa, Staphylococcus
IAELKLVRFEFIPFEADIVKLISTL

SEQ ID NO: 2069998 - protein, 22 aa, Staphylococcus
IAELSEIIQPHPALLEAIGEGA

SEQ ID NO: 2069999 - protein, 25 aa, Staphylococcus
IAEQFRGYGLGQLLLKYVMNYARHR

SEQ ID NO: 2070000 - protein, 18 aa, Staphylococcus
IAEQKVIDFLLKSEIDIP

SEQ ID NO: 2070001 - protein, 23 aa, Staphylococcus
IAEVKDYVFINNHDPRLFEGFSM

SEQ ID NO: 2070002 - protein, 24 aa, Staphylococcus
IAEVKDYVFINNHDPRLFEGFSMG

SEQ ID NO: 2070003 - protein, 19 aa, Staphylococcus
IAEWLPLMMEDRTSPIPVA

SEQ ID NO: 2070004 - protein, 41 aa, Staphylococcus
IAEYSVSIALQLVRKFPLIEKRVQAHNFKWAAPIMSTPVKN

SEQ ID NO: 2070005 - protein, 20 aa, Staphylococcus
IAEYSVSIALQLVRRFPAIE

SEQ ID NO: 2070006 - protein, 24 aa, Staphylococcus
IAEYSVSIALQLVRRFPAIEKRVQ

SEQ ID NO: 2070007 - protein, 20 aa, Staphylococcus
IAEYTVSIALQLVRKFPAIE

SEQ ID NO: 2070008 - protein, 25 aa, Staphylococcus
IAFHEPPINTFLPDSKYWKDKNDEI

SEQ ID NO: 2070009 - protein, 26 aa, Staphylococcus
IAFHEPPINTFLPNAKYWQDKNAEII

SEQ ID NO: 2070010 - protein, 27 aa, Staphylococcus
IAFKRNPYIIQFQYKGYRIVSFKGGRM

SEQ ID NO: 2070011 - protein, 26 aa, Staphylococcus
IAFNDIEFLPPVTPPNNVIAFGRNYQ

SEQ ID NO: 2070012 - protein, 22 aa, Staphylococcus
IAFNINIPKESIGKATKFLLAL

SEQ ID NO: 2070013 - protein, 18 aa, Staphylococcus
IAFPKRQAISISGDGAFQ

SEQ ID NO: 2070014 - protein, 20 aa, Staphylococcus
IAFYVAEWPTSRLNHWRSLL

SEQ ID NO: 2070015 - protein, 18 aa, Staphylococcus
IAGFDFTYGKFGKGNMSV

SEQ ID NO: 2070016 - protein, 17 aa, Staphylococcus
IAGFNYEGQLAATIEIS

SEQ ID NO: 2070017 - protein, 21 aa, Staphylococcus
IAGLDFIMEIPGVIAVIPLKE

SEQ ID NO: 2070018 - protein, 24 aa, Staphylococcus
IAGLDTLFPIPEKFVYLAHCDTPI

SEQ ID NO: 2070019 - protein, 27 aa, Staphylococcus
IAGLMFSNLIIPNRRLLKTWKLHHFSS

SEQ ID NO: 2070020 - protein, 22 aa, Staphylococcus
IAGLMVSAIISDSLLFKSPTCT

SEQ ID NO: 2070021 - protein, 20 aa, Staphylococcus
IAGLRIMCQFVDDIEIVVNL

SEQ ID NO: 2070022 - protein, 17 aa, Staphylococcus
IAGLVAAGLHQNPVDYA

SEQ ID NO: 2070023 - protein, 26 aa, Staphylococcus
IAGSALRQLPTYVRKHFKEIRSIGIT

SEQ ID NO: 2070024 - protein, 19 aa, Staphylococcus
IAHANAMIMLPGGTRGFKQ

SEQ ID NO: 2070025 - protein, 17 aa, Staphylococcus
IAHIPQFSQWTSHLSGG

SEQ ID NO: 2070026 - protein, 19 aa, Staphylococcus
IAHLFKSFTFTVNGTLSIE

SEQ ID NO: 2070027 - protein, 25 aa, Staphylococcus
IAHQKACINLLRKLIEIKPGSRIKV

SEQ ID NO: 2070028 - protein, 19 aa, Staphylococcus
IAHSNAMIMLPGGTRGFKA

SEQ ID NO: 2070029 - protein, 19 aa, Staphylococcus
IAHSNSMIMLPGGTRGFKA

SEQ ID NO: 2070030 - protein, 24 aa, Staphylococcus
IAHTCSYLCHPLARSITGTVQKIN

SEQ ID NO: 2070031 - protein, 17 aa, Staphylococcus
IAHYRNFKQIVPGKAEE

SEQ ID NO: 2070032 - protein, 24 aa, Staphylococcus
IAIKDIRMREVISYFATYVFEKNA

SEQ ID NO: 2070033 - protein, 17 aa, Staphylococcus
IAIKLRAAGLPADELTI

SEQ ID NO: 2070034 - protein, 22 aa, Staphylococcus
IAIKLRHHGLPLENLTIIDPYA

SEQ ID NO: 2070035 - protein, 22 aa, Staphylococcus
IAILPIGYADGYLRSMQGAFVN

SEQ ID NO: 2070036 - protein, 17 aa, Staphylococcus
IAILPQTPTVTDSITVE

SEQ ID NO: 2070037 - protein, 19 aa, Staphylococcus
IAIPGTPPDLLHPPVGDAF

SEQ ID NO: 2070038 - protein, 17 aa, Staphylococcus
IAITEWMADDTINFMAK

SEQ ID NO: 2070039 - protein, 19 aa, Staphylococcus
IAIVVSRFNDFITNRLLEG

SEQ ID NO: 2070040 - protein, 21 aa, Staphylococcus
IAKFGKIDIFVNCAGINLSSK

SEQ ID NO: 2070041 - protein, 25 aa, Staphylococcus
IAKHNLNFDLLVDEDFQLSKAIGVY

SEQ ID NO: 2070042 - protein, 17 aa, Staphylococcus
IAKMISRYMIINETDKI

SEQ ID NO: 2070043 - protein, 26 aa, Staphylococcus
IAKNINLLYELINNGALSQITASSLT

SEQ ID NO: 2070044 - protein, 26 aa, Staphylococcus
IAKNPYLLYELICNGALSQLTASSLL

SEQ ID NO: 2070045 - protein, 30 aa, Staphylococcus
IAKQILIEIISRLTFLNNVGLDYLTLNRSS

SEQ ID NO: 2070046 - protein, 23 aa, Staphylococcus
IAKQLEKWGVDIIEAGFPASSSG

SEQ ID NO: 2070047 - protein, 23 aa, Staphylococcus
IAKQLLNAFEGFSPLITNEITNR

SEQ ID NO: 2070048 - protein, 17 aa, Staphylococcus
IAKRIELIVPTNAYNQD

SEQ ID NO: 2070049 - protein, 27 aa, Staphylococcus
IAKYKPDFLIMIPTMYYSTIRQDNFNP

SEQ ID NO: 2070050 - protein, 25 aa, Staphylococcus
IAKYYDFIEVQPPALYQDLIDRELI

SEQ ID NO: 2070051 - protein, 24 aa, Staphylococcus
IAKYYDFIEVQPPALYQDLMDREL

SEQ ID NO: 2070052 - protein, 19 aa, Staphylococcus
IAKYYDYIEVQPPALYQDL

SEQ ID NO: 2070053 - protein, 18 aa, Staphylococcus
IALAYQLKGNKNCYLITD

SEQ ID NO: 2070054 - protein, 18 aa, Staphylococcus
IALDYGLNRFTNIVERLT

SEQ ID NO: 2070055 - protein, 32 aa, Staphylococcus
IALEHGALDIYYTPIFMKKGRPSTQLTLICKT

SEQ ID NO: 2070056 - protein, 17 aa, Staphylococcus
IALFLVPTMLHQLLNVD

SEQ ID NO: 2070057 - protein, 20 aa, Staphylococcus
IALGLDRLVMLLTNRTNLRD

SEQ ID NO: 2070058 - protein, 17 aa, Staphylococcus
IALMIHPGNATYPTIDT

SEQ ID NO: 2070059 - protein, 26 aa, Staphylococcus
IAMEFRKEFHKDFVIDLVGYRRYGHN

SEQ ID NO: 2070060 - protein, 18 aa, Staphylococcus
IAMETSRRVAKEEGILAG

SEQ ID NO: 2070061 - protein, 20 aa, Staphylococcus
IAMETSRRVAKEEGILAGIS

SEQ ID NO: 2070062 - protein, 29 aa, Staphylococcus
IANELECKYIPIFSFYIPKEDNFDDYESD

SEQ ID NO: 2070063 - protein, 23 aa, Staphylococcus
IANEVELPVVLYNVPSRTNMTIE

SEQ ID NO: 2070064 - protein, 31 aa, Staphylococcus
IANFETAAPLYYRAEPVGCTATILYKMYKER

SEQ ID NO: 2070065 - protein, 18 aa, Staphylococcus
IANFSKEPVLLPEDLDVS

SEQ ID NO: 2070066 - protein, 27 aa, Staphylococcus
IANGNHVLAIPFYKQQLLFTQHKVRGI

SEQ ID NO: 2070067 - protein, 26 aa, Staphylococcus
IANHEINIVGIFRYANTYDMGLEMLA

SEQ ID NO: 2070068 - protein, 26 aa, Staphylococcus
IANHEINIVGVFRYANTYPQGIQILS

SEQ ID NO: 2070069 - protein, 33 aa, Staphylococcus
IANQILKEIISRLTFLYNVGLEYLTLNRASGTL

SEQ ID NO: 2070070 - protein, 25 aa, Staphylococcus
IANQKACINLLRKLIAIKLGSRIKV

SEQ ID NO: 2070071 - protein, 43 aa, Staphylococcus
IANRLDKGLLDFGILIQPVSLNKYKTLYLPTSDHWGVVVKKGD

SEQ ID NO: 2070072 - protein, 26 aa, Staphylococcus
IAPAIMVAYKFGVPCLFAKKAKPNTL

SEQ ID NO: 2070073 - protein, 20 aa, Staphylococcus
IAPYKAAVLPLSKKLSEEAI

SEQ ID NO: 2070074 - protein, 27 aa, Staphylococcus
IAQDVNLLFELINIGALSQLTASSLTG

SEQ ID NO: 2070075 - protein, 18 aa, Staphylococcus
IAQILSQEKVIKKDLLVE

SEQ ID NO: 2070076 - protein, 27 aa, Staphylococcus
IAQIMARYRDEEIQLILNFYRNKTIQD

SEQ ID NO: 2070077 - protein, 20 aa, Staphylococcus
IAQKALFELPNYISCHYSNI

SEQ ID NO: 2070078 - protein, 27 aa, Staphylococcus
IAQLMTVDILFYTYLSKDYQAHVAHLS

SEQ ID NO: 2070079 - protein, 19 aa, Staphylococcus
IAQNEVITWVLGYNKNIDD

SEQ ID NO: 2070080 - protein, 33 aa, Staphylococcus
IAQTAKYLYIHRNTLLYRLEKCKLQTGLNPKKY

SEQ ID NO: 2070081 - protein, 28 aa, Staphylococcus
IAQTCYQFNLPFIITRAISDLADGDAGI

SEQ ID NO: 2070082 - protein, 28 aa, Staphylococcus
IAQVCYQFKVPFIITRAVSDLANGEADM

SEQ ID NO: 2070083 - protein, 23 aa, Staphylococcus
IARLFVMRYPEFANGLILTGTGM

SEQ ID NO: 2070084 - protein, 18 aa, Staphylococcus
IASMIASWKIGASYVPID

SEQ ID NO: 2070085 - protein, 18 aa, Staphylococcus
IASNLEFVTDMYGSPGFS

SEQ ID NO: 2070086 - protein, 18 aa, Staphylococcus
IASSIMSKKIAAGADAIV

SEQ ID NO: 2070087 - protein, 19 aa, Staphylococcus
IASSIMSKKIAAGADAIVL

SEQ ID NO: 2070088 - protein, 18 aa, Staphylococcus
IASWIQWGNFSMQSWKAL

SEQ ID NO: 2070089 - protein, 20 aa, Staphylococcus
IATALLPNDSIQSRGLFAMN

SEQ ID NO: 2070090 - protein, 17 aa, Staphylococcus
IATGSITKRLGFEKGHV

SEQ ID NO: 2070091 - protein, 26 aa, Staphylococcus
IATGSLPTQLPFLPFNHNTVLSSNDI

SEQ ID NO: 2070092 - protein, 18 aa, Staphylococcus
IATKLFNYLISTYPDRKW

SEQ ID NO: 2070093 - protein, 20 aa, Staphylococcus
IATKVLPASTFFEAEEYHQD

SEQ ID NO: 2070094 - protein, 24 aa, Staphylococcus
IATRRVELLLEYAKQIHIVSPQIT

SEQ ID NO: 2070095 - protein, 25 aa, Staphylococcus
IATSGWTDIFIYPGFEFKAIDALIT

SEQ ID NO: 2070096 - protein, 17 aa, Staphylococcus
IAVDGSHEAEWAFNKAV

SEQ ID NO: 2070097 - protein, 19 aa, Staphylococcus
IAVIGPTAMRYQNVIQLLN

SEQ ID NO: 2070098 - protein, 17 aa, Staphylococcus
IAVSLMNKPKYLILDEP

SEQ ID NO: 2070099 - protein, 22 aa, Staphylococcus
IAVSVYSGWLAYSTFDHDWVKQ

SEQ ID NO: 2070100 - protein, 22 aa, Staphylococcus
IAVSVYSGWLAYSTFDHEWVKQ

SEQ ID NO: 2070101 - protein, 33 aa, Staphylococcus
IAVTPSAHTARQLALVWGAYPVIKKGRKTTDDL

SEQ ID NO: 2070102 - protein, 17 aa, Staphylococcus
IAVTPSEKTARQCAIVW

SEQ ID NO: 2070103 - protein, 18 aa, Staphylococcus
IAVTPSPETARQLALVWG

SEQ ID NO: 2070104 - protein, 17 aa, Staphylococcus
IAVYLPDDGNGKSYDLM

SEQ ID NO: 2070105 - protein, 18 aa, Staphylococcus
IAYAQYLATRKVYPNESI

SEQ ID NO: 2070106 - protein, 27 aa, Staphylococcus
IAYFEVLHEMKLIVDLMYEGGMENMRY

SEQ ID NO: 2070107 - protein, 29 aa, Staphylococcus
IAYKQKGNARFFLITDAMRAKGMPDGEYD

SEQ ID NO: 2070108 - protein, 25 aa, Staphylococcus
IAYQYATIRNVLYAKGYDTEMLINY

SEQ ID NO: 2070109 - protein, 24 aa, Staphylococcus
IAYVVEFFEWFNTLETFKNWKKKP

SEQ ID NO: 2070110 - protein, 23 aa, Staphylococcus
ICAPTIQLDALITAVKDGKAKGL

SEQ ID NO: 2070111 - protein, 19 aa, Staphylococcus
ICASYVVNDILKNIPVRRI

SEQ ID NO: 2070112 - protein, 28 aa, Staphylococcus
ICCRDDIMVYLMYNGLEPSLAFKTMEFV

SEQ ID NO: 2070113 - protein, 24 aa, Staphylococcus
ICDHYNLWLHVDGAYGLSHILSDK

SEQ ID NO: 2070114 - protein, 24 aa, Staphylococcus
ICDKQNYRLLLNYTNLNSDLELDA

SEQ ID NO: 2070115 - protein, 20 aa, Staphylococcus
ICEILAEQLTLPKQSYDLII

SEQ ID NO: 2070116 - protein, 21 aa, Staphylococcus
ICESIKYYLGLTEEIPKEFEK

SEQ ID NO: 2070117 - protein, 23 aa, Staphylococcus
ICGFVIEPLIQGATGLYAQPVRF

SEQ ID NO: 2070118 - protein, 18 aa, Staphylococcus
ICGGYQFLGTKYITPDGT

SEQ ID NO: 2070119 - protein, 19 aa, Staphylococcus
ICQSTLELLQPNFSRLRQQ

SEQ ID NO: 2070120 - protein, 20 aa, Staphylococcus
ICREHGLSVPERDTAKLRYT

SEQ ID NO: 2070121 - protein, 17 aa, Staphylococcus
ICRQVCKFAPKKIVLLG

SEQ ID NO: 2070122 - protein, 23 aa, Staphylococcus
ICRRIRQQYTTPIIIITAKSETM

SEQ ID NO: 2070123 - protein, 24 aa, Staphylococcus
ICSSLYYNFTLSNISFYGDMKGNE

SEQ ID NO: 2070124 - protein, 23 aa, Staphylococcus
IDAARYFLTMRSPDSHFDFDLEL

SEQ ID NO: 2070125 - protein, 25 aa, Staphylococcus
IDAFGMRPYIKKKVKKYSMGMKQKL

SEQ ID NO: 2070126 - protein, 18 aa, Staphylococcus
IDALNKKNVKRLIFVAAP

SEQ ID NO: 2070127 - protein, 23 aa, Staphylococcus
IDALTEFVNIYGAKGLAWVKVVD

SEQ ID NO: 2070128 - protein, 25 aa, Staphylococcus
IDASKLKAYQLQYSKAYKGYMEASQ

SEQ ID NO: 2070129 - protein, 26 aa, Staphylococcus
IDASYAKRVLFIKDGRLYHEIYRGEE

SEQ ID NO: 2070130 - protein, 19 aa, Staphylococcus
IDCNIILVEGFKEEPFKKV

SEQ ID NO: 2070131 - protein, 24 aa, Staphylococcus
IDCPYVLMTYYNIVCHYGETLFFK

SEQ ID NO: 2070132 - protein, 20 aa, Staphylococcus
IDDIDIALMIHPGNATYPTI

SEQ ID NO: 2070133 - protein, 21 aa, Staphylococcus
IDDLVTYKLAENHFLLIVNAA

SEQ ID NO: 2070134 - protein, 23 aa, Staphylococcus
IDDNFTPLIIKPASINGITYKME

SEQ ID NO: 2070135 - protein, 25 aa, Staphylococcus
IDDNGDIYFIFTNESLQNILDKSKN

SEQ ID NO: 2070136 - protein, 18 aa, Staphylococcus
IDDYVVGVMLASKGYPGS

SEQ ID NO: 2070137 - protein, 17 aa, Staphylococcus
IDEAKEYHFKSVCINPT

SEQ ID NO: 2070138 - protein, 24 aa, Staphylococcus
IDEAYEHGWVSPKYPRTSRNQSVA

SEQ ID NO: 2070139 - protein, 21 aa, Staphylococcus
IDEDGYFWFEGRRDDIIISSG

SEQ ID NO: 2070140 - protein, 17 aa, Staphylococcus
IDEELALKWLKNGAKPT

SEQ ID NO: 2070141 - protein, 18 aa, Staphylococcus
IDEFIYGEFLAGGILSVI

SEQ ID NO: 2070142 - protein, 18 aa, Staphylococcus
IDEIFKFPETLSGVCTVG

SEQ ID NO: 2070143 - protein, 17 aa, Staphylococcus
IDEIGSFNLVFIQTTYS

SEQ ID NO: 2070144 - protein, 19 aa, Staphylococcus
IDEIMAVSYIYDQDRQFES

SEQ ID NO: 2070145 - protein, 18 aa, Staphylococcus
IDEKYKHLAPLYNSKEDL

SEQ ID NO: 2070146 - protein, 17 aa, Staphylococcus
IDELPIIALLCTQATGT

SEQ ID NO: 2070147 - protein, 28 aa, Staphylococcus
IDELQKCQSFMISVAFITESGLASLKAH

SEQ ID NO: 2070148 - protein, 32 aa, Staphylococcus
IDEMSMVDSWLFHQFLSAVPLDAQIILVGDED

SEQ ID NO: 2070149 - protein, 31 aa, Staphylococcus
IDEMSMVDTWLFHQFLNAVPIDAQVILVGDE

SEQ ID NO: 2070150 - protein, 30 aa, Staphylococcus
IDEMSMVDTWLFHQFLNAVPLDAQIVFVGD

SEQ ID NO: 2070151 - protein, 31 aa, Staphylococcus
IDEMSMVDTWLFHQFLSAVPIDAQIILVGDE

SEQ ID NO: 2070152 - protein, 32 aa, Staphylococcus
IDEMSMVDTWLFHQFLSAVPLDAQIILVGDED

SEQ ID NO: 2070153 - protein, 33 aa, Staphylococcus
IDEMSMVDTWLFHQFLSAVPLDAQIILVGDEDQ

SEQ ID NO: 2070154 - protein, 30 aa, Staphylococcus
IDEMSMVDTWLFHQFLSAVPLDAQIVFVGD

SEQ ID NO: 2070155 - protein, 25 aa, Staphylococcus
IDENASVRVLPYASITVRQAGSELV

SEQ ID NO: 2070156 - protein, 23 aa, Staphylococcus
IDENGFIKFAAAGGWWSQVMLSQ

SEQ ID NO: 2070157 - protein, 27 aa, Staphylococcus
IDENNQLFFFVSEGILKGYLYLQMHPE

SEQ ID NO: 2070158 - protein, 22 aa, Staphylococcus
IDENRMYLSKYLPFIDDTNTVQ

SEQ ID NO: 2070159 - protein, 24 aa, Staphylococcus
IDEPLEFEMWIAIMLAQQPITDTL

SEQ ID NO: 2070160 - protein, 18 aa, Staphylococcus
IDEPPIQLSLDSSLKDII

SEQ ID NO: 2070161 - protein, 25 aa, Staphylococcus
IDEVPPIIDERMMMLRNGKWQMMEE

SEQ ID NO: 2070162 - protein, 22 aa, Staphylococcus
IDFIGNYKNNYLIPIALSGDHS

SEQ ID NO: 2070163 - protein, 28 aa, Staphylococcus
IDFKQEPPWFKVSPTHFVKSWLLDERAP

SEQ ID NO: 2070164 - protein, 20 aa, Staphylococcus
IDFKQVFENQLFLISGKTGS

SEQ ID NO: 2070165 - protein, 17 aa, Staphylococcus
IDFLLKSEIDIPQTMIV

SEQ ID NO: 2070166 - protein, 31 aa, Staphylococcus
IDFNLDIFKNTNTPIWIYTQNEALVTDIEHV

SEQ ID NO: 2070167 - protein, 30 aa, Staphylococcus
IDFSNPELLIPLLDESFNLPLVIATTGEKD

SEQ ID NO: 2070168 - protein, 19 aa, Staphylococcus
IDFYHRYKEDVKLFSEMGL

SEQ ID NO: 2070169 - protein, 19 aa, Staphylococcus
IDFYLNHVNGLDGLIAPIH

SEQ ID NO: 2070170 - protein, 19 aa, Staphylococcus
IDFYSYFRVSKIKMLNAIF

SEQ ID NO: 2070171 - protein, 17 aa, Staphylococcus
IDGLLFRTPMSSDDLFS

SEQ ID NO: 2070172 - protein, 26 aa, Staphylococcus
IDGNEYIDYVLSWGPLILGHENPQVI

SEQ ID NO: 2070173 - protein, 27 aa, Staphylococcus
IDGNEYIDYVLSWGPLILGHKNEQVIK

SEQ ID NO: 2070174 - protein, 31 aa, Staphylococcus
IDGNEYIDYVLSWGPLILGHKNKQVISKLHD

SEQ ID NO: 2070175 - protein, 31 aa, Staphylococcus
IDGNEYIDYVLSWGPLILGHKNKRVIEKLHE

SEQ ID NO: 2070176 - protein, 27 aa, Staphylococcus
IDGNEYIDYVLSWGPLILGHKNPQVIE

SEQ ID NO: 2070177 - protein, 18 aa, Staphylococcus
IDHFINRHDVIMFTICMD

SEQ ID NO: 2070178 - protein, 22 aa, Staphylococcus
IDHGITLLDTAYIYGPERSEEL

SEQ ID NO: 2070179 - protein, 20 aa, Staphylococcus
IDHLDGIMFYDHIDKENPLQ

SEQ ID NO: 2070180 - protein, 19 aa, Staphylococcus
IDHLMGVPIIGQYFENDPN

SEQ ID NO: 2070181 - protein, 27 aa, Staphylococcus
IDHNRLNLLMAVLEKKESYLLQQQDAY

SEQ ID NO: 2070182 - protein, 24 aa, Staphylococcus
IDHRNVLGVLPTGGGKSICYQVPG

SEQ ID NO: 2070183 - protein, 24 aa, Staphylococcus
IDIALTILPFYQGTFKYDVLYSEA

SEQ ID NO: 2070184 - protein, 24 aa, Staphylococcus
IDIDIESGYFYTLLGPSGCGKTTI

SEQ ID NO: 2070185 - protein, 19 aa, Staphylococcus
IDIDTFPNEGLLSLKVSVD

SEQ ID NO: 2070186 - protein, 21 aa, Staphylococcus
IDIGMLLYNYVPKQQWSNWFN

SEQ ID NO: 2070187 - protein, 26 aa, Staphylococcus
IDIGMLLYNYVPQSKWSKWFDTYGLE

SEQ ID NO: 2070188 - protein, 18 aa, Staphylococcus
IDIHDQGLLEYGRIRLLA

SEQ ID NO: 2070189 - protein, 35 aa, Staphylococcus
IDIHTQQAYLIYMLGFMPGFPYLGGLDKRIHTPRR

SEQ ID NO: 2070190 - protein, 18 aa, Staphylococcus
IDIIELRIDQWESHHHEL

SEQ ID NO: 2070191 - protein, 18 aa, Staphylococcus
IDIIHIRADYQRTGFFYP

SEQ ID NO: 2070192 - protein, 17 aa, Staphylococcus
IDIIMPNMTKGQALKRL

SEQ ID NO: 2070193 - protein, 26 aa, Staphylococcus
IDILEQFDNAVILFMGAGDIQKIQRA

SEQ ID NO: 2070194 - protein, 17 aa, Staphylococcus
IDILICDTAGRLQNKSN

SEQ ID NO: 2070195 - protein, 25 aa, Staphylococcus
IDILVERMLYMKLQNPKQVLSMYPH

SEQ ID NO: 2070196 - protein, 18 aa, Staphylococcus
IDISYIVNWFLQQQSKYN

SEQ ID NO: 2070197 - protein, 26 aa, Staphylococcus
IDITDKWIIQIAYDTLIIMANTEMSD

SEQ ID NO: 2070198 - protein, 22 aa, Staphylococcus
IDIVSPYKLTFSFKMPQFSELE

SEQ ID NO: 2070199 - protein, 21 aa, Staphylococcus
IDIYSGIEMDILPDGQLDYDD

SEQ ID NO: 2070200 - protein, 17 aa, Staphylococcus
IDKANVPVIIVGQAYPG

SEQ ID NO: 2070201 - protein, 43 aa, Staphylococcus
IDKCFYKYYGLNKLINLLLKEKPDLILLTFPTPVMSVLTEQFN

SEQ ID NO: 2070202 - protein, 22 aa, Staphylococcus
IDKESYWKHLALGPETLCIYMG

SEQ ID NO: 2070203 - protein, 18 aa, Staphylococcus
IDKGVIVTIFPDGSDRYM

SEQ ID NO: 2070204 - protein, 23 aa, Staphylococcus
IDKQHYLDFIDLYQHVIVDYLNK

SEQ ID NO: 2070205 - protein, 36 aa, Staphylococcus
IDKSYALHLRQFIRLSRFFVDILRRSENGRIVVISS

SEQ ID NO: 2070206 - protein, 18 aa, Staphylococcus
IDKYFDLIIRFFKEINEV

SEQ ID NO: 2070207 - protein, 26 aa, Staphylococcus
IDLAEQLVTFIPHSLLTLDNIKYNER

SEQ ID NO: 2070208 - protein, 18 aa, Staphylococcus
IDLALDFGKPSFLDVFHI

SEQ ID NO: 2070209 - protein, 23 aa, Staphylococcus
IDLCVDLGIMGIPSFLVYENGEQ

SEQ ID NO: 2070210 - protein, 25 aa, Staphylococcus
IDLDIRAQFGINIIAIKRGKEIVVS

SEQ ID NO: 2070211 - protein, 18 aa, Staphylococcus
IDLGVGIVLNKKVEDSVK

SEQ ID NO: 2070212 - protein, 21 aa, Staphylococcus
IDLHFIERLNWQQLTQDDLES

SEQ ID NO: 2070213 - protein, 17 aa, Staphylococcus
IDLLEAYNLLKSKNVKF

SEQ ID NO: 2070214 - protein, 18 aa, Staphylococcus
IDLLILNAQENINSKGNH

SEQ ID NO: 2070215 - protein, 20 aa, Staphylococcus
IDLPHLAWCLDKILDGNKDN

SEQ ID NO: 2070216 - protein, 18 aa, Staphylococcus
IDLSHFDARINQCNFTIA

SEQ ID NO: 2070217 - protein, 18 aa, Staphylococcus
IDLTEQFPRMTYAEAMSR

SEQ ID NO: 2070218 - protein, 19 aa, Staphylococcus
IDLTRTWEILGEIIGESAS

SEQ ID NO: 2070219 - protein, 21 aa, Staphylococcus
IDMDDNCQFIVAIRSMLIKKN

SEQ ID NO: 2070220 - protein, 20 aa, Staphylococcus
IDMDTLVHFNLKKGDVLTAA

SEQ ID NO: 2070221 - protein, 25 aa, Staphylococcus
IDMKPRLDLFLQDKSIFLNEPVDVV

SEQ ID NO: 2070222 - protein, 18 aa, Staphylococcus
IDMPLKELKEILALIYEE

SEQ ID NO: 2070223 - protein, 25 aa, Staphylococcus
IDMYTPYMSLIKELFPKAKIILDRF

SEQ ID NO: 2070224 - protein, 24 aa, Staphylococcus
IDNAKFIVGLFNPGTHMTAEQSEQ

SEQ ID NO: 2070225 - protein, 30 aa, Staphylococcus
IDNDDTYIVFTNYGARIVCWKYHDNNIVLG

SEQ ID NO: 2070226 - protein, 19 aa, Staphylococcus
IDNIMLAPKMLLKGDKEQL

SEQ ID NO: 2070227 - protein, 25 aa, Staphylococcus
IDNKMTDILCRIPNLINDDVPQGAS

SEQ ID NO: 2070228 - protein, 28 aa, Staphylococcus
IDNPREFINPLPHISFVRGKNNVKFLKD

SEQ ID NO: 2070229 - protein, 26 aa, Staphylococcus
IDNQQWQYAMNRFLPDDIYVKNVQTV

SEQ ID NO: 2070230 - protein, 26 aa, Staphylococcus
IDNRLDSALIIYGAWLAGIEAVMINT

SEQ ID NO: 2070231 - protein, 31 aa, Staphylococcus
IDNSNMLIFIYPIYWLNVPMLLKGFIDSTFW

SEQ ID NO: 2070232 - protein, 26 aa, Staphylococcus
IDNYDGHFLIQWYSKGIYKFRYNVLS

SEQ ID NO: 2070233 - protein, 26 aa, Staphylococcus
IDNYDGHLLIQWYSKGIYKFRYHILE

SEQ ID NO: 2070234 - protein, 26 aa, Staphylococcus
IDNYDGHLLIQWYSKGIYKFRYNVIE

SEQ ID NO: 2070235 - protein, 38 aa, Staphylococcus
IDNYDSHLLIQWYSKGIYKFRYLIIEAIKTVFGYTSLY

SEQ ID NO: 2070236 - protein, 26 aa, Staphylococcus
IDNYNGHLLIQWYSKGIYKFRYIIIE

SEQ ID NO: 2070237 - protein, 31 aa, Staphylococcus
IDNYNGHLLVQWYSKGIYKFKFEILQAIETV

SEQ ID NO: 2070238 - protein, 19 aa, Staphylococcus
IDPALIPFIMQKTGQNAEE

SEQ ID NO: 2070239 - protein, 24 aa, Staphylococcus
IDPIVILAEFILSAQKIVSRTVDP

SEQ ID NO: 2070240 - protein, 21 aa, Staphylococcus
IDPQFYIFHNDYKKFTMITDT

SEQ ID NO: 2070241 - protein, 29 aa, Staphylococcus
IDPRLRHELQIWIRLNTTTGFRLVNKTTG

SEQ ID NO: 2070242 - protein, 23 aa, Staphylococcus
IDPSTIQQVIFGNVLQSGVGQNP

SEQ ID NO: 2070243 - protein, 23 aa, Staphylococcus
IDQMRGLNNEIIDFIKKLKHVDN

SEQ ID NO: 2070244 - protein, 18 aa, Staphylococcus
IDQPQNFKPLYELNQPLE

SEQ ID NO: 2070245 - protein, 33 aa, Staphylococcus
IDQQPQWIKTVKILFEYFIANDYWKYHDHWLGY

SEQ ID NO: 2070246 - protein, 19 aa, Staphylococcus
IDQRLKFINLSKIGKSYME

SEQ ID NO: 2070247 - protein, 18 aa, Staphylococcus
IDQRLKYVALTEKGRKYT

SEQ ID NO: 2070248 - protein, 19 aa, Staphylococcus
IDQSFLQYEGFENLLKPFA

SEQ ID NO: 2070249 - protein, 28 aa, Staphylococcus
IDQTWPELVFPDSEIAFIVLHFGGSLKS

SEQ ID NO: 2070250 - protein, 24 aa, Staphylococcus
IDQVVSILGVLFAGAAYVPIGIQQ

SEQ ID NO: 2070251 - protein, 19 aa, Staphylococcus
IDQYLTNGKSRSIPIFVFL

SEQ ID NO: 2070252 - protein, 20 aa, Staphylococcus
IDREGAYVIHRLAGSQQYKG

SEQ ID NO: 2070253 - protein, 17 aa, Staphylococcus
IDRGEGVLYIYGNYAGD

SEQ ID NO: 2070254 - protein, 19 aa, Staphylococcus
IDRKHLVLVGQYNGNYYIQ

SEQ ID NO: 2070255 - protein, 18 aa, Staphylococcus
IDRKQFIERLVEASLTKP

SEQ ID NO: 2070256 - protein, 38 aa, Staphylococcus
IDRLTWKDLFRDFEMHFYRYVFPYYDTLYTLEQLTERN

SEQ ID NO: 2070257 - protein, 25 aa, Staphylococcus
IDRNIKEFIVCGLKSAYILKDTSEA

SEQ ID NO: 2070258 - protein, 23 aa, Staphylococcus
IDRPFLTVNPLLPDSDIGYVASF

SEQ ID NO: 2070259 - protein, 17 aa, Staphylococcus
IDRSLFWVNPDCGLKTR

SEQ ID NO: 2070260 - protein, 24 aa, Staphylococcus
IDRYDLSIIVYKVSKRNDLKLVMD

SEQ ID NO: 2070261 - protein, 36 aa, Staphylococcus
IDRYGNLYKYSYIANKFYIYDGMKWKIDDKGSIRKL

SEQ ID NO: 2070262 - protein, 21 aa, Staphylococcus
IDRYLQFIKLINELHFAENVN

SEQ ID NO: 2070263 - protein, 32 aa, Staphylococcus
IDSGGAERLLGYGDMLYLGSGMNKPIRVQGTF

SEQ ID NO: 2070264 - protein, 19 aa, Staphylococcus
IDSPTNQQFFLIDNKKIKE

SEQ ID NO: 2070265 - protein, 28 aa, Staphylococcus
IDSPVVRDLLTKLPIIPGSSIKGKMRSL

SEQ ID NO: 2070266 - protein, 17 aa, Staphylococcus
IDSQALNRSIRLIQKVQ

SEQ ID NO: 2070267 - protein, 29 aa, Staphylococcus
IDSQILEMYHIDYFFLSANGFTLENGLTD

SEQ ID NO: 2070268 - protein, 22 aa, Staphylococcus
IDSSLMAMQFMLTAKAYGYDTN

SEQ ID NO: 2070269 - protein, 21 aa, Staphylococcus
IDTDGRMKALVSITLDEAFVI

SEQ ID NO: 2070270 - protein, 25 aa, Staphylococcus
IDTDMPYVVIYTMNHPETWESQLNI

SEQ ID NO: 2070271 - protein, 25 aa, Staphylococcus
IDTHTLIFFIYCMTRYYDVTYLKES

SEQ ID NO: 2070272 - protein, 20 aa, Staphylococcus
IDTIRGLNGIIIDYLETIDS

SEQ ID NO: 2070273 - protein, 24 aa, Staphylococcus
IDTKQLLEILDITKPQLIELIDNY

SEQ ID NO: 2070274 - protein, 17 aa, Staphylococcus
IDTLEGCMKAEKGDWII

SEQ ID NO: 2070275 - protein, 33 aa, Staphylococcus
IDTLKQLYYLSKHLKYDLFNILFEMVREHHNHD

SEQ ID NO: 2070276 - protein, 18 aa, Staphylococcus
IDTLLTKAIHFPGVFACA

SEQ ID NO: 2070277 - protein, 20 aa, Staphylococcus
IDTLTWIYVPKLTEAARNAY

SEQ ID NO: 2070278 - protein, 18 aa, Staphylococcus
IDTMIAPGPLSHSLSLFV

SEQ ID NO: 2070279 - protein, 26 aa, Staphylococcus
IDTPKVDIIITIPSYKLKTIDARNAL

SEQ ID NO: 2070280 - protein, 19 aa, Staphylococcus
IDTPNFTLRDHKSALRIRV

SEQ ID NO: 2070281 - protein, 19 aa, Staphylococcus
IDTPQNLRYSFSNHSLTVI

SEQ ID NO: 2070282 - protein, 23 aa, Staphylococcus
IDTSHLNPLLQNVEIKVACDVTN

SEQ ID NO: 2070283 - protein, 24 aa, Staphylococcus
IDTSKHFIIKSPHPSPLSAYRGFF

SEQ ID NO: 2070284 - protein, 24 aa, Staphylococcus
IDTSKHYIIKSPHPSPLSAYRGFF

SEQ ID NO: 2070285 - protein, 34 aa, Staphylococcus
IDTTGHILNLYFPFIDVETLLTLLDLANIYVSSG

SEQ ID NO: 2070286 - protein, 31 aa, Staphylococcus
IDTVHEYFNGLYLITPFQKVDYTLELANYSK

SEQ ID NO: 2070287 - protein, 31 aa, Staphylococcus
IDTVHEYFNGLYLITPFQRIDYSLELAAYSK

SEQ ID NO: 2070288 - protein, 31 aa, Staphylococcus
IDTVHQYFNGLYIITPFQRVDYSLELAAYSR

SEQ ID NO: 2070289 - protein, 18 aa, Staphylococcus
IDTWMNMTPMNRPGVPEE

SEQ ID NO: 2070290 - protein, 25 aa, Staphylococcus
IDTYEFEAPYFTFDWTNKKIEDDTL

SEQ ID NO: 2070291 - protein, 18 aa, Staphylococcus
IDVAFTSVLQRAIKTTYH

SEQ ID NO: 2070292 - protein, 17 aa, Staphylococcus
IDVDDLFDMFIFKNERL

SEQ ID NO: 2070293 - protein, 27 aa, Staphylococcus
IDVEPVFGFMKAILGFTRMSVRGLNKV

SEQ ID NO: 2070294 - protein, 17 aa, Staphylococcus
IDVFSPSTFPPLEYTFD

SEQ ID NO: 2070295 - protein, 22 aa, Staphylococcus
IDVFSPSTYPPLSYTFDHIIVK

SEQ ID NO: 2070296 - protein, 24 aa, Staphylococcus
IDVHKKIVLARRRLVKFANNINIA

SEQ ID NO: 2070297 - protein, 17 aa, Staphylococcus
IDVLADMLQYSEGQKQA

SEQ ID NO: 2070298 - protein, 21 aa, Staphylococcus
IDVPGPFPRMTYSEAMSRYGS

SEQ ID NO: 2070299 - protein, 25 aa, Staphylococcus
IDVPKVDIILTIPPYELKTEDSRQA

SEQ ID NO: 2070300 - protein, 22 aa, Staphylococcus
IDVQQLWDHRKKFKEIAAEQGT

SEQ ID NO: 2070301 - protein, 26 aa, Staphylococcus
IDVQSFPTPAVFDWLQKEGNIETEEM

SEQ ID NO: 2070302 - protein, 34 aa, Staphylococcus
IDVSSKARTWLFQITLPHFLSHEDYLLFTHALTE

SEQ ID NO: 2070303 - protein, 22 aa, Staphylococcus
IDVTLELKLLADVGLVGFPSVG

SEQ ID NO: 2070304 - protein, 27 aa, Staphylococcus
IDVTSYVKEILVFKGHFKMFYISEDEY

SEQ ID NO: 2070305 - protein, 26 aa, Staphylococcus
IDVTTSKPFFLEFMARDVSKGNAITA

SEQ ID NO: 2070306 - protein, 20 aa, Staphylococcus
IDVYDDCEFIVAIRSMLIKG

SEQ ID NO: 2070307 - protein, 18 aa, Staphylococcus
IDWNIKKGDKWVLYGLNG

SEQ ID NO: 2070308 - protein, 17 aa, Staphylococcus
IDYIAASFVRRPSDVLD

SEQ ID NO: 2070309 - protein, 20 aa, Staphylococcus
IDYPRLFEHKNNIVHTLTNG

SEQ ID NO: 2070310 - protein, 27 aa, Staphylococcus
IDYTYVRMAMYMDPLKPYLPELMDMHK

SEQ ID NO: 2070311 - protein, 23 aa, Staphylococcus
IEAAMKGMLDPEYEEKVIGQAEV

SEQ ID NO: 2070312 - protein, 26 aa, Staphylococcus
IEAEIEKLVWAIHWGTDTMMDLSTGK

SEQ ID NO: 2070313 - protein, 28 aa, Staphylococcus
IEAFNLAEIYQCPVIVLSDLQLSLGKQT

SEQ ID NO: 2070314 - protein, 31 aa, Staphylococcus
IEAGDLPTIIRRLLVISYEDIGLASPSAGQR

SEQ ID NO: 2070315 - protein, 28 aa, Staphylococcus
IEAGYVYIAQPPLYKLTQGKQKYYVFND

SEQ ID NO: 2070316 - protein, 32 aa, Staphylococcus
IEAHDHIIFQYPLYWYSSPPLMKQYLDEVFTH

SEQ ID NO: 2070317 - protein, 29 aa, Staphylococcus
IEAHNEWVNMLGVVPVIRALREKAMSIQE

SEQ ID NO: 2070318 - protein, 17 aa, Staphylococcus
IEAIHFHSPPFTSEKAK

SEQ ID NO: 2070319 - protein, 17 aa, Staphylococcus
IEALHAIREVTGAVLMV

SEQ ID NO: 2070320 - protein, 18 aa, Staphylococcus
IEALTGKAAFLYLEEIQN

SEQ ID NO: 2070321 - protein, 18 aa, Staphylococcus
IEALTGKSAFLYLEDIQS

SEQ ID NO: 2070322 - protein, 18 aa, Staphylococcus
IEALTGKSAFLYLETIQS

SEQ ID NO: 2070323 - protein, 18 aa, Staphylococcus
IEALTGRAAFLYLEGIQH

SEQ ID NO: 2070324 - protein, 27 aa, Staphylococcus
IEASDLDYTIIRPAWLTFKNESDYEIT

SEQ ID NO: 2070325 - protein, 27 aa, Staphylococcus
IEASNLDYTIIRPAWFTFKNETDYEVT

SEQ ID NO: 2070326 - protein, 27 aa, Staphylococcus
IEASTLDYTIIRPAWLTFKNETDYEVT

SEQ ID NO: 2070327 - protein, 24 aa, Staphylococcus
IEATYEDKLYQAYRYTDKMRVRME

SEQ ID NO: 2070328 - protein, 18 aa, Staphylococcus
IEDAQVSAILTYGKEFDS

SEQ ID NO: 2070329 - protein, 27 aa, Staphylococcus
IEDDIYKDIWFDTKPLKPIKALDINGK

SEQ ID NO: 2070330 - protein, 22 aa, Staphylococcus
IEDEEILLAIKYHTTGRKEMTK

SEQ ID NO: 2070331 - protein, 22 aa, Staphylococcus
IEDHLLVPFHLQALSDYVGLSP

SEQ ID NO: 2070332 - protein, 23 aa, Staphylococcus
IEDIIFKLADEGVAILWITHSND

SEQ ID NO: 2070333 - protein, 27 aa, Staphylococcus
IEDIPGELIMKVLAFNPDLGKMDRVGQ

SEQ ID NO: 2070334 - protein, 20 aa, Staphylococcus
IEDIRHFYTNDVRFLDQFKA

SEQ ID NO: 2070335 - protein, 23 aa, Staphylococcus
IEDISFDIFKGETFGLVGESGCG

SEQ ID NO: 2070336 - protein, 22 aa, Staphylococcus
IEDISFNIYKGETLGLVGESGC

SEQ ID NO: 2070337 - protein, 24 aa, Staphylococcus
IEDKRKLIILYKEIFKKDKEKFFN

SEQ ID NO: 2070338 - protein, 19 aa, Staphylococcus
IEDKYRNIGQGRTFLIKTY

SEQ ID NO: 2070339 - protein, 20 aa, Staphylococcus
IEDLRIISCHIGNGASIAAI

SEQ ID NO: 2070340 - protein, 21 aa, Staphylococcus
IEDLRIISCHIGNGASIAAID

SEQ ID NO: 2070341 - protein, 17 aa, Staphylococcus
IEDNDWEVLLKPAKRIK

SEQ ID NO: 2070342 - protein, 25 aa, Staphylococcus
IEDQTLLELIRNEKILVTPHIAFFS

SEQ ID NO: 2070343 - protein, 24 aa, Staphylococcus
IEDRQILPYIYKGLHDKSPAVRRT

SEQ ID NO: 2070344 - protein, 23 aa, Staphylococcus
IEDVANFCDIFYIGGTKIGALCG

SEQ ID NO: 2070345 - protein, 27 aa, Staphylococcus
IEDYLNIYYSFALPYGKPFAIESVNNA

SEQ ID NO: 2070346 - protein, 29 aa, Staphylococcus
IEDYTVLRGFKPYYIENGAFSGALGAIYL

SEQ ID NO: 2070347 - protein, 18 aa, Staphylococcus
IEEAAMLSAYFSKAGSSA

SEQ ID NO: 2070348 - protein, 21 aa, Staphylococcus
IEEAFVVKQILQHLATKHGIN

SEQ ID NO: 2070349 - protein, 21 aa, Staphylococcus
IEEAFVVKQILQHLATKHGLN

SEQ ID NO: 2070350 - protein, 18 aa, Staphylococcus
IEEAKIQGIAILPPHINH

SEQ ID NO: 2070351 - protein, 29 aa, Staphylococcus
IEEIARIYGYDKIPSTLPVFDQVTHGALT

SEQ ID NO: 2070352 - protein, 19 aa, Staphylococcus
IEEIEQFPKLLFISGKDDE

SEQ ID NO: 2070353 - protein, 26 aa, Staphylococcus
IEEIRYLFLYDKFEKYDFSRTDVIFY

SEQ ID NO: 2070354 - protein, 23 aa, Staphylococcus
IEEKAFIEAFENVGFYGIEIDKR

SEQ ID NO: 2070355 - protein, 26 aa, Staphylococcus
IEEKEILPYLYKGLRDKNPAVRRTAG

SEQ ID NO: 2070356 - protein, 35 aa, Staphylococcus
IEEKNYLDAVIGLPANLFFGTSIPTCVLVFKKCRQ

SEQ ID NO: 2070357 - protein, 36 aa, Staphylococcus
IEEKNYLDAVIGLPANLFFGTSIPTCVLVFKKCRQS

SEQ ID NO: 2070358 - protein, 20 aa, Staphylococcus
IEELAKDIGFPVVLKAASGG

SEQ ID NO: 2070359 - protein, 19 aa, Staphylococcus
IEELMIYLEKFKSKSYEPL

SEQ ID NO: 2070360 - protein, 20 aa, Staphylococcus
IEELRIISCHIGNGASIAAI

SEQ ID NO: 2070361 - protein, 21 aa, Staphylococcus
IEELRIITCHIGNGASIAAID

SEQ ID NO: 2070362 - protein, 21 aa, Staphylococcus
IEELRLISCHIGNGASIAAID

SEQ ID NO: 2070363 - protein, 20 aa, Staphylococcus
IEELSLLQFSTEEDKWKVID

SEQ ID NO: 2070364 - protein, 19 aa, Staphylococcus
IEENINIFDFSLTQAQIAR

SEQ ID NO: 2070365 - protein, 20 aa, Staphylococcus
IEERDAIWFIHEIMGYNTEL

SEQ ID NO: 2070366 - protein, 34 aa, Staphylococcus
IEEREFKFHPLVRQLKPFGFFDYNALQKNAFVVL

SEQ ID NO: 2070367 - protein, 35 aa, Staphylococcus
IEERNFKFHPLVRQLKPFGFFDYNALQKNAFVVLS

SEQ ID NO: 2070368 - protein, 26 aa, Staphylococcus
IEERQWLIIIYICISNEFITINKLME

SEQ ID NO: 2070369 - protein, 23 aa, Staphylococcus
IEERYLLFILEQANIDNETTSHH

SEQ ID NO: 2070370 - protein, 23 aa, Staphylococcus
IEERYLNFILEQAGIEEETTGHH

SEQ ID NO: 2070371 - protein, 27 aa, Staphylococcus
IEESGVKKAIILPNNKNIQMASDQAAE

SEQ ID NO: 2070372 - protein, 24 aa, Staphylococcus
IEEVQPAFFIMSVPHNPTGVQYPT

SEQ ID NO: 2070373 - protein, 21 aa, Staphylococcus
IEEYFPLPEHLTSTHNSDVFI

SEQ ID NO: 2070374 - protein, 20 aa, Staphylococcus
IEEYLIAIKGPLTTPIGGGI

SEQ ID NO: 2070375 - protein, 20 aa, Staphylococcus
IEEYLIAVKGPLTTPIGGGI

SEQ ID NO: 2070376 - protein, 17 aa, Staphylococcus
IEEYRNILDNHDALLNV

SEQ ID NO: 2070377 - protein, 19 aa, Staphylococcus
IEEYYTIVKELEKFDTFTS

SEQ ID NO: 2070378 - protein, 30 aa, Staphylococcus
IEFAWEFLTSDKWMAMEPDKLYVTIHPEDT

SEQ ID NO: 2070379 - protein, 27 aa, Staphylococcus
IEFCRFIPSMPLKRYVYRRFLNMSIGQ

SEQ ID NO: 2070380 - protein, 18 aa, Staphylococcus
IEFFGPGVADLPLADRAT

SEQ ID NO: 2070381 - protein, 27 aa, Staphylococcus
IEFFRDKKIEMIFASPYKRVIETVSPI

SEQ ID NO: 2070382 - protein, 18 aa, Staphylococcus
IEFKHPLTQELISVSLDD

SEQ ID NO: 2070383 - protein, 20 aa, Staphylococcus
IEFKMLCMGFKPKEIKELTP

SEQ ID NO: 2070384 - protein, 23 aa, Staphylococcus
IEFKMLCMGFKRKEIKKLMPQII

SEQ ID NO: 2070385 - protein, 18 aa, Staphylococcus
IEFLVTEDAYYFIEMNAR

SEQ ID NO: 2070386 - protein, 20 aa, Staphylococcus
IEFQVKHLMVSKVKGSFTQF

SEQ ID NO: 2070387 - protein, 17 aa, Staphylococcus
IEFTFTQRNGGTRKRKM

SEQ ID NO: 2070388 - protein, 17 aa, Staphylococcus
IEFYKRSGFKKVTEHKF

SEQ ID NO: 2070389 - protein, 17 aa, Staphylococcus
IEFYLIPTKGEAKIEKT

SEQ ID NO: 2070390 - protein, 26 aa, Staphylococcus
IEGAQKIYELFKPTLEKKDKKLSADI

SEQ ID NO: 2070391 - protein, 24 aa, Staphylococcus
IEGDQITCLYPFSLNPTHFKVTIP

SEQ ID NO: 2070392 - protein, 26 aa, Staphylococcus
IEGIEFVEFLISPNKGEPLKSLNKIA

SEQ ID NO: 2070393 - protein, 29 aa, Staphylococcus
IEGIGSEKWPIFLERSLVDQIITVSDKDG

SEQ ID NO: 2070394 - protein, 17 aa, Staphylococcus
IEGLDEFLTGPTAIATS

SEQ ID NO: 2070395 - protein, 18 aa, Staphylococcus
IEGLLLINQNRMKTLDIR

SEQ ID NO: 2070396 - protein, 17 aa, Staphylococcus
IEGNDWEVLLKPAKRIK

SEQ ID NO: 2070397 - protein, 20 aa, Staphylococcus
IEGNGNWNFTLFIQNGRVKD

SEQ ID NO: 2070398 - protein, 25 aa, Staphylococcus
IEGNSGLFVAMPSKRTPDGEFRDIA

SEQ ID NO: 2070399 - protein, 18 aa, Staphylococcus
IEGPIIWVDDTLLALQEL

SEQ ID NO: 2070400 - protein, 23 aa, Staphylococcus
IEGRDFIDLLNDFPPEELEPEDL

SEQ ID NO: 2070401 - protein, 24 aa, Staphylococcus
IEGRIAYKGLLQDNIYQLMGGVRS

SEQ ID NO: 2070402 - protein, 18 aa, Staphylococcus
IEGSFGVEIFIRTKKQLI

SEQ ID NO: 2070403 - protein, 17 aa, Staphylococcus
IEGSFVIYAIQLVEKGY

SEQ ID NO: 2070404 - protein, 27 aa, Staphylococcus
IEGYHTLLTIGRYPICYLNIEMDPILV

SEQ ID NO: 2070405 - protein, 18 aa, Staphylococcus
IEHAFGVEIFIRTKKQLI

SEQ ID NO: 2070406 - protein, 18 aa, Staphylococcus
IEHLLPKATVVTPNLFEA

SEQ ID NO: 2070407 - protein, 23 aa, Staphylococcus
IEHPKGLILIDTGWHTDNRTKQI

SEQ ID NO: 2070408 - protein, 18 aa, Staphylococcus
IEHSFGVDIFIRTKKQLI

SEQ ID NO: 2070409 - protein, 19 aa, Staphylococcus
IEHWFNYTYQLTMTNQLRF

SEQ ID NO: 2070410 - protein, 28 aa, Staphylococcus
IEIARFIPSLPLKRWIYRACLGMEIGQK

SEQ ID NO: 2070411 - protein, 28 aa, Staphylococcus
IEIDIVYTSLLERAIKTTYHLLNESNQL

SEQ ID NO: 2070412 - protein, 24 aa, Staphylococcus
IEIDVAYTSLLKRALETTNYILKE

SEQ ID NO: 2070413 - protein, 19 aa, Staphylococcus
IEIEALLKAALEENESLFK

SEQ ID NO: 2070414 - protein, 21 aa, Staphylococcus
IEIFDRSWYGRILVERVEGFA

SEQ ID NO: 2070415 - protein, 20 aa, Staphylococcus
IEIFGRVDVLINNAGLIPQS

SEQ ID NO: 2070416 - protein, 17 aa, Staphylococcus
IEIIMWDERLSTMAAER

SEQ ID NO: 2070417 - protein, 19 aa, Staphylococcus
IEIIMWDERLSTMAAERSL

SEQ ID NO: 2070418 - protein, 18 aa, Staphylococcus
IEIPALGFGVFQIPQEQT

SEQ ID NO: 2070419 - protein, 28 aa, Staphylococcus
IEIPDARYIDWFPNFTLADLISDDTATG

SEQ ID NO: 2070420 - protein, 28 aa, Staphylococcus
IEIPDARYKDWFPNFTLGDLISDNTATG

SEQ ID NO: 2070421 - protein, 18 aa, Staphylococcus
IEIPNFKFGERVIDSTGA

SEQ ID NO: 2070422 - protein, 19 aa, Staphylococcus
IEIQFYSPVQYLKEIKLQG

SEQ ID NO: 2070423 - protein, 23 aa, Staphylococcus
IEITEVLKRQYPQVKVLVLTSYV

SEQ ID NO: 2070424 - protein, 20 aa, Staphylococcus
IEIVFFHLSKNFMSRTRWCF

SEQ ID NO: 2070425 - protein, 18 aa, Staphylococcus
IEIYLNKSSVEMDDSFVL

SEQ ID NO: 2070426 - protein, 17 aa, Staphylococcus
IEIYYDRPKAGWIWNDN

SEQ ID NO: 2070427 - protein, 30 aa, Staphylococcus
IEKGITQFRIVPLLIFRAMHYIGDIPNILS

SEQ ID NO: 2070428 - protein, 19 aa, Staphylococcus
IEKGWTHLRLWSLRGYTVN

SEQ ID NO: 2070429 - protein, 20 aa, Staphylococcus
IEKHDIFGVIGYSGAGKSTL

SEQ ID NO: 2070430 - protein, 25 aa, Staphylococcus
IEKKLSRYPQLYSRIGFAHEFDNLS

SEQ ID NO: 2070431 - protein, 27 aa, Staphylococcus
IEKMKLPGITLYPETERFYPNGNFASH

SEQ ID NO: 2070432 - protein, 26 aa, Staphylococcus
IEKMKLPGITLYPETERFYPNGVFAS

SEQ ID NO: 2070433 - protein, 27 aa, Staphylococcus
IEKMNLPGITLYPETERFYPNGNFASH

SEQ ID NO: 2070434 - protein, 26 aa, Staphylococcus
IEKMNLPGVSLYPETERFYPNGNFAS

SEQ ID NO: 2070435 - protein, 24 aa, Staphylococcus
IEKNLENIMFLKKQNIKSVNLINQ

SEQ ID NO: 2070436 - protein, 22 aa, Staphylococcus
IEKNMEFYQLMFTMGKDSNLHE

SEQ ID NO: 2070437 - protein, 25 aa, Staphylococcus
IEKPTFSQWMLLVDNSKFKKKKSTV

SEQ ID NO: 2070438 - protein, 26 aa, Staphylococcus
IEKQCGDMFLLRFNADIFSHTDYLPV

SEQ ID NO: 2070439 - protein, 27 aa, Staphylococcus
IEKTLKLIDILNPYLCIIFCNSRDSAD

SEQ ID NO: 2070440 - protein, 33 aa, Staphylococcus
IEKTSLKFELFYFDIFRYANSFITLQVPRKEEF

SEQ ID NO: 2070441 - protein, 17 aa, Staphylococcus
IEKWFYEGAPKRVQRRK

SEQ ID NO: 2070442 - protein, 29 aa, Staphylococcus
IEKYDSFIGGFVWEWCDHSIQVGIKEGKP

SEQ ID NO: 2070443 - protein, 25 aa, Staphylococcus
IELAEQLITFIPHSLLTLNNTKYNE

SEQ ID NO: 2070444 - protein, 18 aa, Staphylococcus
IELFLNNYDTYLNANEIA

SEQ ID NO: 2070445 - protein, 18 aa, Staphylococcus
IELGDILIMIGHDNDLNR

SEQ ID NO: 2070446 - protein, 17 aa, Staphylococcus
IELGFITSKHDMNYITN

SEQ ID NO: 2070447 - protein, 18 aa, Staphylococcus
IELICDRAIFLRNGKFVQ

SEQ ID NO: 2070448 - protein, 18 aa, Staphylococcus
IELICDRAVFLRDGKFVQ

SEQ ID NO: 2070449 - protein, 18 aa, Staphylococcus
IELICDRAVFLRDGNFVQ

SEQ ID NO: 2070450 - protein, 30 aa, Staphylococcus
IELIKYCSSKYTRSKLRKALPEQFVYIIEE

SEQ ID NO: 2070451 - protein, 18 aa, Staphylococcus
IELKDMSFFKKGELCIVG

SEQ ID NO: 2070452 - protein, 27 aa, Staphylococcus
IELKIPMAYFYLEDAAFFNCHFDAHLL

SEQ ID NO: 2070453 - protein, 17 aa, Staphylococcus
IELLIPKIADKIKRDHL

SEQ ID NO: 2070454 - protein, 17 aa, Staphylococcus
IELLIPKLAERIHKEQL

SEQ ID NO: 2070455 - protein, 26 aa, Staphylococcus
IELLKPAVMMNLLGRDLDLLEDDFGQ

SEQ ID NO: 2070456 - protein, 17 aa, Staphylococcus
IELLLKALELDSSYQEP

SEQ ID NO: 2070457 - protein, 32 aa, Staphylococcus
IELLQREEVEWIILAGYMRLIGPDLLDAYEGK

SEQ ID NO: 2070458 - protein, 18 aa, Staphylococcus
IELLRRPEMDYQAILDIL

SEQ ID NO: 2070459 - protein, 19 aa, Staphylococcus
IELPIDAIGFIHFPNSRRH

SEQ ID NO: 2070460 - protein, 19 aa, Staphylococcus
IELQTVPNGFYYPPDNEAE

SEQ ID NO: 2070461 - protein, 27 aa, Staphylococcus
IELRMHGIKAKILILGVIPPKDINKAI

SEQ ID NO: 2070462 - protein, 21 aa, Staphylococcus
IELRMHGINAQILILGVIPLE

SEQ ID NO: 2070463 - protein, 27 aa, Staphylococcus
IELTPIQFKSDVPLYLVVIGKHLDAIE

SEQ ID NO: 2070464 - protein, 19 aa, Staphylococcus
IEMERLFSKLKSGGAILMP

SEQ ID NO: 2070465 - protein, 25 aa, Staphylococcus
IEMHELMHEYYQYALLKTVEGEEAL

SEQ ID NO: 2070466 - protein, 26 aa, Staphylococcus
IEMHELMQTYYQYALLKTVEGEEALN

SEQ ID NO: 2070467 - protein, 19 aa, Staphylococcus
IEMLKTIKTKPDAIFGLAT

SEQ ID NO: 2070468 - protein, 18 aa, Staphylococcus
IEMLSQYENIRVVGLMTM

SEQ ID NO: 2070469 - protein, 17 aa, Staphylococcus
IEMLYVETTHRNQGVAT

SEQ ID NO: 2070470 - protein, 25 aa, Staphylococcus
IEMNDKKVILLPGPPSEMQPMAKNE

SEQ ID NO: 2070471 - protein, 31 aa, Staphylococcus
IEMNRTLMPFAYIFRCIYGRAMKARWKKWCC

SEQ ID NO: 2070472 - protein, 33 aa, Staphylococcus
IENADIILYDRLVNPFILQYAKPEIEIVDVGKK

SEQ ID NO: 2070473 - protein, 24 aa, Staphylococcus
IENCKRIGFYPKTVANISQINFIE

SEQ ID NO: 2070474 - protein, 24 aa, Staphylococcus
IENEKLFKILIAKLKKQVTVINVV

SEQ ID NO: 2070475 - protein, 24 aa, Staphylococcus
IENEKYIVTWALGHLVTNAQPEHY

SEQ ID NO: 2070476 - protein, 25 aa, Staphylococcus
IENEKYIVTWALGHLVTNATPEQYD

SEQ ID NO: 2070477 - protein, 24 aa, Staphylococcus
IENENLYILQTRSGKRTANAAIHI

SEQ ID NO: 2070478 - protein, 27 aa, Staphylococcus
IENIFAIGDIVPGLPLAHKASYEAKVA

SEQ ID NO: 2070479 - protein, 17 aa, Staphylococcus
IENIFKMLSPEGIIVLV

SEQ ID NO: 2070480 - protein, 25 aa, Staphylococcus
IENIQPFLYHFYDMSVGICHNGNLI

SEQ ID NO: 2070481 - protein, 19 aa, Staphylococcus
IENISFNIYKGETLGLVGE

SEQ ID NO: 2070482 - protein, 23 aa, Staphylococcus
IENKIALRIVPNTNIHLNNVVVK

SEQ ID NO: 2070483 - protein, 21 aa, Staphylococcus
IENLWSLFEIALLYSADKSED

SEQ ID NO: 2070484 - protein, 17 aa, Staphylococcus
IENNDWEVLLKPAKRIK

SEQ ID NO: 2070485 - protein, 26 aa, Staphylococcus
IENQLDKLMKLYNYKEIRTPIFESTD

SEQ ID NO: 2070486 - protein, 23 aa, Staphylococcus
IENRIVQFYTDLNTDGRFLNVGE

SEQ ID NO: 2070487 - protein, 22 aa, Staphylococcus
IENRRMQYLYDDGDMHVFMDNQ

SEQ ID NO: 2070488 - protein, 31 aa, Staphylococcus
IENSVVLRYGLLYGPGTWYGKDGMIYNSFKE

SEQ ID NO: 2070489 - protein, 23 aa, Staphylococcus
IENYSVHLTLRPMGSTPYTLLDY

SEQ ID NO: 2070490 - protein, 17 aa, Staphylococcus
IENYYEKSIIGTELMEQ

SEQ ID NO: 2070491 - protein, 22 aa, Staphylococcus
IEPKQWKYAMNSALPDDIYVKE

SEQ ID NO: 2070492 - protein, 23 aa, Staphylococcus
IEPLEVIDFHNFAHQSYLILTDS

SEQ ID NO: 2070493 - protein, 30 aa, Staphylococcus
IEPNDPIIHFALAELLYFDGQYLRATTEYE

SEQ ID NO: 2070494 - protein, 22 aa, Staphylococcus
IEPPTFVIFVNDVELMHFSYKR

SEQ ID NO: 2070495 - protein, 36 aa, Staphylococcus
IEPQTLKLFKVCRMRGIPIFTFINKLDRVGKEPFEL

SEQ ID NO: 2070496 - protein, 24 aa, Staphylococcus
IEPSKYWPYLSRMARYRPSSPSRS

SEQ ID NO: 2070497 - protein, 17 aa, Staphylococcus
IEQALANQLPIYNSFGM

SEQ ID NO: 2070498 - protein, 18 aa, Staphylococcus
IEQALNVLCIIDSRIKQF

SEQ ID NO: 2070499 - protein, 27 aa, Staphylococcus
IEQATDTMLLITPKFDKPGLLASILNT

SEQ ID NO: 2070500 - protein, 26 aa, Staphylococcus
IEQEDKIYILFYKPTQVITSVSDDRG

SEQ ID NO: 2070501 - protein, 17 aa, Staphylococcus
IEQGLTPEGILNEILGE

SEQ ID NO: 2070502 - protein, 18 aa, Staphylococcus
IEQGLTPEGILNEILGEE

SEQ ID NO: 2070503 - protein, 25 aa, Staphylococcus
IEQKVFALIDYFHRKKYLAYIEELE

SEQ ID NO: 2070504 - protein, 18 aa, Staphylococcus
IEQLLTINTSITAALEKA

SEQ ID NO: 2070505 - protein, 17 aa, Staphylococcus
IEQNGAFDFVFTQAPYS

SEQ ID NO: 2070506 - protein, 17 aa, Staphylococcus
IEQNYELYSTGGTMREL

SEQ ID NO: 2070507 - protein, 17 aa, Staphylococcus
IEQPDLLLLDEPTNHLD

SEQ ID NO: 2070508 - protein, 22 aa, Staphylococcus
IEQYLEKFKPLKSKSHPYLIVN

SEQ ID NO: 2070509 - protein, 17 aa, Staphylococcus
IERASWTHFYVFRDEET

SEQ ID NO: 2070510 - protein, 21 aa, Staphylococcus
IEREYMYHGVKIIYTKEKETA

SEQ ID NO: 2070511 - protein, 21 aa, Staphylococcus
IERIKAIVPIWKKEIWEDGAQ

SEQ ID NO: 2070512 - protein, 24 aa, Staphylococcus
IERIKEIVPIWKKEIWQDGSAWQG

SEQ ID NO: 2070513 - protein, 17 aa, Staphylococcus
IERIYVQVVERLNYKKS

SEQ ID NO: 2070514 - protein, 19 aa, Staphylococcus
IERKWYVIDAAGQTLGRLS

SEQ ID NO: 2070515 - protein, 19 aa, Staphylococcus
IERKWYVIDAEGKTLGRLS

SEQ ID NO: 2070516 - protein, 24 aa, Staphylococcus
IERLARRIFKDPLSTFKKVVAIEI

SEQ ID NO: 2070517 - protein, 25 aa, Staphylococcus
IERLHYLVDHDFYFNVFDKYSEIDL

SEQ ID NO: 2070518 - protein, 21 aa, Staphylococcus
IERLKPFGIDFNKPLFELDDV

SEQ ID NO: 2070519 - protein, 17 aa, Staphylococcus
IERTLFLARKQIENYAN

SEQ ID NO: 2070520 - protein, 25 aa, Staphylococcus
IERYRKYIIRYWTARLSEEVEDFSK

SEQ ID NO: 2070521 - protein, 26 aa, Staphylococcus
IESDNIDVLLLGPQVRFKKDEYTKKC

SEQ ID NO: 2070522 - protein, 27 aa, Staphylococcus
IESEDYLHYQLPPVDVALLRGTYADAQ

SEQ ID NO: 2070523 - protein, 33 aa, Staphylococcus
IESGKLADLVMWDPIFFGVKPELVVKGGLINSA

SEQ ID NO: 2070524 - protein, 25 aa, Staphylococcus
IESIEQLLEMFRGKPVRVFVKQEEN

SEQ ID NO: 2070525 - protein, 18 aa, Staphylococcus
IESIIHVAKKIMKTKKGP

SEQ ID NO: 2070526 - protein, 29 aa, Staphylococcus
IESIQQHIYLKLLTYMKYQAGLDVSKHNV

SEQ ID NO: 2070527 - protein, 23 aa, Staphylococcus
IESKLLNDVYAYAYGYASVEEID

SEQ ID NO: 2070528 - protein, 23 aa, Staphylococcus
IESKPEIMIPLVSTVEEFKTLKD

SEQ ID NO: 2070529 - protein, 19 aa, Staphylococcus
IESLCGRTYLFRYQSSIFE

SEQ ID NO: 2070530 - protein, 20 aa, Staphylococcus
IESLIFKLADEGVAILWITH

SEQ ID NO: 2070531 - protein, 27 aa, Staphylococcus
IESLPIEGKLWLKCDSHLAISGSIKAR

SEQ ID NO: 2070532 - protein, 25 aa, Staphylococcus
IESNLSALSFKYLTSHDALGSIIVG

SEQ ID NO: 2070533 - protein, 28 aa, Staphylococcus
IESTRAEWLMLDLFNWSKANYLMHMDDE

SEQ ID NO: 2070534 - protein, 18 aa, Staphylococcus
IESVKWLNKKLHSHGKSL

SEQ ID NO: 2070535 - protein, 25 aa, Staphylococcus
IETAIHLIRIVLSGTFDKYPDLKIV

SEQ ID NO: 2070536 - protein, 28 aa, Staphylococcus
IETEGNLATFWLLLDERMSLIHDALSYR

SEQ ID NO: 2070537 - protein, 17 aa, Staphylococcus
IETLIQSGFTHFAESRL

SEQ ID NO: 2070538 - protein, 19 aa, Staphylococcus
IETLMSQFNLIDNRPEALL

SEQ ID NO: 2070539 - protein, 18 aa, Staphylococcus
IETREYFWQVIQHLKDQG

SEQ ID NO: 2070540 - protein, 18 aa, Staphylococcus
IEVAKIFQEVLPDGVVNI

SEQ ID NO: 2070541 - protein, 19 aa, Staphylococcus
IEVKNAYFKGMFNETCPRF

SEQ ID NO: 2070542 - protein, 18 aa, Staphylococcus
IEVLFTQINKLKSKGVSF

SEQ ID NO: 2070543 - protein, 18 aa, Staphylococcus
IEVQALVTPTTFNNPRRM

SEQ ID NO: 2070544 - protein, 23 aa, Staphylococcus
IEVTLDWIFHNDIPLAYKTSDLL

SEQ ID NO: 2070545 - protein, 20 aa, Staphylococcus
IEVTLELKLLADVGLVGFPS

SEQ ID NO: 2070546 - protein, 22 aa, Staphylococcus
IEVVYGFAQLKRGAALANHELG

SEQ ID NO: 2070547 - protein, 23 aa, Staphylococcus
IEVVYGFAQLKRGAALANNELGK

SEQ ID NO: 2070548 - protein, 22 aa, Staphylococcus
IEVYIDRPADLWHWENEHVNMD

SEQ ID NO: 2070549 - protein, 17 aa, Staphylococcus
IEVYTEQDIYYLQVKDG

SEQ ID NO: 2070550 - protein, 24 aa, Staphylococcus
IEWLVNEGYTLLTLPKAYGGEGAS

SEQ ID NO: 2070551 - protein, 24 aa, Staphylococcus
IEWSQFIQEFLPEEYLVINITTIN

SEQ ID NO: 2070552 - protein, 17 aa, Staphylococcus
IEWVIIGPEQPLIDGLS

SEQ ID NO: 2070553 - protein, 30 aa, Staphylococcus
IEWVVIGPEQPLIDGLPDLLRNHQIKVFGP

SEQ ID NO: 2070554 - protein, 21 aa, Staphylococcus
IEYALFHYHFKSRISVWILNY

SEQ ID NO: 2070555 - protein, 25 aa, Staphylococcus
IEYDALVPTQLWPTLETKKIKNLYT

SEQ ID NO: 2070556 - protein, 33 aa, Staphylococcus
IEYDVALFSYHKLLEIFFSVIDPLDAGGQFQDR

SEQ ID NO: 2070557 - protein, 27 aa, Staphylococcus
IEYDVALFSYHKLLEIFFSVIDPLDDA

SEQ ID NO: 2070558 - protein, 28 aa, Staphylococcus
IEYDVALFSYHKLLEIFFSVIDPLDEDG

SEQ ID NO: 2070559 - protein, 27 aa, Staphylococcus
IEYDVALFSYNKLLEVFFSVIDPIDDG

SEQ ID NO: 2070560 - protein, 22 aa, Staphylococcus
IEYIEAKFYQLVIQHQILGIEV

SEQ ID NO: 2070561 - protein, 29 aa, Staphylococcus
IEYLDDSYPFYMNPMPNLYFTRDPQASIG

SEQ ID NO: 2070562 - protein, 24 aa, Staphylococcus
IEYRPFIMQSLFEEKRLIKLQPQL

SEQ ID NO: 2070563 - protein, 22 aa, Staphylococcus
IEYVFGIPGAKIDYLFNALEDD

SEQ ID NO: 2070564 - protein, 20 aa, Staphylococcus
IFAGDLMRMYTKYAEANGFR

SEQ ID NO: 2070565 - protein, 17 aa, Staphylococcus
IFAMANPNPEITPDDAK

SEQ ID NO: 2070566 - protein, 19 aa, Staphylococcus
IFASRILIEKLAEQGFEIE

SEQ ID NO: 2070567 - protein, 17 aa, Staphylococcus
IFCFDGLDFFRYGRIHR

SEQ ID NO: 2070568 - protein, 21 aa, Staphylococcus
IFDEVFDVLVDLGLTKVNGGF

SEQ ID NO: 2070569 - protein, 19 aa, Staphylococcus
IFDEVFDVLVDLGLTRVNG

SEQ ID NO: 2070570 - protein, 23 aa, Staphylococcus
IFDFYNHFRISKVKLLNAIYDEN

SEQ ID NO: 2070571 - protein, 17 aa, Staphylococcus
IFDLLVEYDGELPFWDK

SEQ ID NO: 2070572 - protein, 20 aa, Staphylococcus
IFDWAGTMIDFGCFAPVHVF

SEQ ID NO: 2070573 - protein, 22 aa, Staphylococcus
IFEKCLHTYLIKDAIRDGNVLG

SEQ ID NO: 2070574 - protein, 18 aa, Staphylococcus
IFGSGAYRISSREMWRDL

SEQ ID NO: 2070575 - protein, 18 aa, Staphylococcus
IFGYPGGAVLPLYDTFYD

SEQ ID NO: 2070576 - protein, 24 aa, Staphylococcus
IFIDEPTEYLLPESGLIQYNIPTK

SEQ ID NO: 2070577 - protein, 18 aa, Staphylococcus
IFIGFMGTGKSTLAQFMA

SEQ ID NO: 2070578 - protein, 17 aa, Staphylococcus
IFIQEVILLNKKYYLYC

SEQ ID NO: 2070579 - protein, 30 aa, Staphylococcus
IFISHMHGDHIFGLPGLLTSRSFQGGENKP

SEQ ID NO: 2070580 - protein, 17 aa, Staphylococcus
IFISLAVKFSKARLIDN

SEQ ID NO: 2070581 - protein, 26 aa, Staphylococcus
IFITEKVANYIAYLCSILSVTSNPKY

SEQ ID NO: 2070582 - protein, 19 aa, Staphylococcus
IFITEKVANYIGYLCSIIS

SEQ ID NO: 2070583 - protein, 20 aa, Staphylococcus
IFITERVANYIAYLCSILSV

SEQ ID NO: 2070584 - protein, 29 aa, Staphylococcus
IFITHMHGDHIFGLPGLLTSRSFQGGEGK

SEQ ID NO: 2070585 - protein, 29 aa, Staphylococcus
IFITHMHGDHIFGLPGLLTSRSFQGGESK

SEQ ID NO: 2070586 - protein, 18 aa, Staphylococcus
IFKDIKMLQEIGLDLPFS

SEQ ID NO: 2070587 - protein, 20 aa, Staphylococcus
IFKDLIFENIQVGCPSLFKS

SEQ ID NO: 2070588 - protein, 25 aa, Staphylococcus
IFKIERILMDYLDQLPYTLTESSYL

SEQ ID NO: 2070589 - protein, 17 aa, Staphylococcus
IFNIASISGFEVTKSSA

SEQ ID NO: 2070590 - protein, 25 aa, Staphylococcus
IFNINAFFEPLQTLINHMIKEGFID

SEQ ID NO: 2070591 - protein, 24 aa, Staphylococcus
IFNQLVALFKYYFTNVQIVLNVDI

SEQ ID NO: 2070592 - protein, 18 aa, Staphylococcus
IFPTPVVGMVGLIEDIQY

SEQ ID NO: 2070593 - protein, 17 aa, Staphylococcus
IFPYAPPQGIEGLRTLW

SEQ ID NO: 2070594 - protein, 26 aa, Staphylococcus
IFQEYNLLHTLTVKENIMLPLSVQKL

SEQ ID NO: 2070595 - protein, 22 aa, Staphylococcus
IFQGRQYKTYRGMGSLGAMESG

SEQ ID NO: 2070596 - protein, 26 aa, Staphylococcus
IFQVERILMDYLDALPYTLTEASYLT

SEQ ID NO: 2070597 - protein, 17 aa, Staphylococcus
IFRVFIIDSQALNRSIQ

SEQ ID NO: 2070598 - protein, 18 aa, Staphylococcus
IFRVIKRYIYSLFKREHI

SEQ ID NO: 2070599 - protein, 17 aa, Staphylococcus
IFSALSIRDSKIAPTIH

SEQ ID NO: 2070600 - protein, 19 aa, Staphylococcus
IFSYARSLLKTNITIDSGE

SEQ ID NO: 2070601 - protein, 26 aa, Staphylococcus
IFTDEPLDILYPRKGVIQYKVRDNVI

SEQ ID NO: 2070602 - protein, 17 aa, Staphylococcus
IFTLAMYELGKYVTEQL

SEQ ID NO: 2070603 - protein, 19 aa, Staphylococcus
IFVEDIYLKSIPIDAKYRK

SEQ ID NO: 2070604 - protein, 17 aa, Staphylococcus
IFVGFMGTGKTTIGRYL

SEQ ID NO: 2070605 - protein, 19 aa, Staphylococcus
IFVSAYCRYAPFIEQMESI

SEQ ID NO: 2070606 - protein, 18 aa, Staphylococcus
IFVTVVRSFSHFSTVIQP

SEQ ID NO: 2070607 - protein, 17 aa, Staphylococcus
IFYDPKHPYTWGLLSSM

SEQ ID NO: 2070608 - protein, 21 aa, Staphylococcus
IGAAGHFLYLAGIRGDMAMNG

SEQ ID NO: 2070609 - protein, 24 aa, Staphylococcus
IGAAGYYLFKAGVTADMALNGYNH

SEQ ID NO: 2070610 - protein, 26 aa, Staphylococcus
IGADAIMLITPYYNKTNQRGLIAHFT

SEQ ID NO: 2070611 - protein, 24 aa, Staphylococcus
IGAEFLQKYKGGMGILLGGVPGVS

SEQ ID NO: 2070612 - protein, 17 aa, Staphylococcus
IGAFTEREWGFNGIFDK

SEQ ID NO: 2070613 - protein, 20 aa, Staphylococcus
IGAISAVFFLLESGDHLIIP

SEQ ID NO: 2070614 - protein, 18 aa, Staphylococcus
IGAITKMWTITGVAGPED

SEQ ID NO: 2070615 - protein, 18 aa, Staphylococcus
IGANIELIKKYWPKRLGQ

SEQ ID NO: 2070616 - protein, 18 aa, Staphylococcus
IGANRLLYTPYLAGERTP

SEQ ID NO: 2070617 - protein, 20 aa, Staphylococcus
IGAPYEVLKQIKDNGRLPVV

SEQ ID NO: 2070618 - protein, 18 aa, Staphylococcus
IGAVLRFGAYNETVINRL

SEQ ID NO: 2070619 - protein, 19 aa, Staphylococcus
IGAYHFTTIKPNLGVVSTP

SEQ ID NO: 2070620 - protein, 23 aa, Staphylococcus
IGCHNFYPQQYTGLSFNHFQKTS

SEQ ID NO: 2070621 - protein, 22 aa, Staphylococcus
IGCPWDKIQTHQTLKRYLLEET

SEQ ID NO: 2070622 - protein, 32 aa, Staphylococcus
IGCQSYCGPGRRKTFAFVNNRPLAALTEDELL

SEQ ID NO: 2070623 - protein, 31 aa, Staphylococcus
IGCRDDIMVYLMYAGLEPSLAFKIMEAVRKG

SEQ ID NO: 2070624 - protein, 25 aa, Staphylococcus
IGCRDDIMVYLMYAGLEPSMAFKIM

SEQ ID NO: 2070625 - protein, 26 aa, Staphylococcus
IGCRDDIMVYLMYAGLEPSMAFKTME

SEQ ID NO: 2070626 - protein, 27 aa, Staphylococcus
IGDEYVILLRMHYLIANALDLSGYEDF

SEQ ID NO: 2070627 - protein, 28 aa, Staphylococcus
IGDEYVILLRMHYLIANALDLTGYDDFA

SEQ ID NO: 2070628 - protein, 19 aa, Staphylococcus
IGDFIKPIKPVLYHTQQWI

SEQ ID NO: 2070629 - protein, 17 aa, Staphylococcus
IGDFVKPIKPIFYKLKE

SEQ ID NO: 2070630 - protein, 25 aa, Staphylococcus
IGDGQYLVGKFPPGIKYDFAKVFQS

SEQ ID NO: 2070631 - protein, 24 aa, Staphylococcus
IGDIPFSYFMSYVSGAGLSFIRHW

SEQ ID NO: 2070632 - protein, 18 aa, Staphylococcus
IGDLLSAHFYTLLADLNE

SEQ ID NO: 2070633 - protein, 17 aa, Staphylococcus
IGDLPVGYYPVDDRSHE

SEQ ID NO: 2070634 - protein, 17 aa, Staphylococcus
IGDSKIQSLYWQHGEYA

SEQ ID NO: 2070635 - protein, 25 aa, Staphylococcus
IGEDFSHYLKVRPGAFFLTGCGNPD

SEQ ID NO: 2070636 - protein, 25 aa, Staphylococcus
IGEEYSFFIYPNRSGDLFATQNMPD

SEQ ID NO: 2070637 - protein, 25 aa, Staphylococcus
IGEEYSFFVYPNRSGALFATQNMPD

SEQ ID NO: 2070638 - protein, 22 aa, Staphylococcus
IGEGLIRGLAYYDVTKPLYYQH

SEQ ID NO: 2070639 - protein, 17 aa, Staphylococcus
IGELLMCDIIEAFINAE

SEQ ID NO: 2070640 - protein, 19 aa, Staphylococcus
IGENILRAYDKRILNIHPS

SEQ ID NO: 2070641 - protein, 25 aa, Staphylococcus
IGENPNFSIPTWDFKGACLGIDARK

SEQ ID NO: 2070642 - protein, 24 aa, Staphylococcus
IGEQKFGLRLPGEFNREMMKEAVE

SEQ ID NO: 2070643 - protein, 26 aa, Staphylococcus
IGFDLLSYGLNYAFKHYEIKKVHFKI

SEQ ID NO: 2070644 - protein, 19 aa, Staphylococcus
IGFFVLHQYYQHEGYDTPE

SEQ ID NO: 2070645 - protein, 21 aa, Staphylococcus
IGFGHIGFDALNYIVHHEVFE

SEQ ID NO: 2070646 - protein, 17 aa, Staphylococcus
IGFGNFEVRERAARKGR

SEQ ID NO: 2070647 - protein, 18 aa, Staphylococcus
IGGIIYPTAPFNGWYMVT

SEQ ID NO: 2070648 - protein, 17 aa, Staphylococcus
IGGKYKFDFGTVKFVQA

SEQ ID NO: 2070649 - protein, 18 aa, Staphylococcus
IGGLALGLAVEGFRPVME

SEQ ID NO: 2070650 - protein, 18 aa, Staphylococcus
IGGLALGLAVTGYRPVME

SEQ ID NO: 2070651 - protein, 25 aa, Staphylococcus
IGGLTLARVLYVNGIPSKIYEADAS

SEQ ID NO: 2070652 - protein, 24 aa, Staphylococcus
IGGLTLARVLYVNGIPSKVYEIDT

SEQ ID NO: 2070653 - protein, 20 aa, Staphylococcus
IGGMYEYGLSRYFTAMLAQY

SEQ ID NO: 2070654 - protein, 17 aa, Staphylococcus
IGGPTMLRAAAKNFKHV

SEQ ID NO: 2070655 - protein, 18 aa, Staphylococcus
IGGPTMLRAAAKNFKHVT

SEQ ID NO: 2070656 - protein, 18 aa, Staphylococcus
IGIANRIMMLENSTYSVI

SEQ ID NO: 2070657 - protein, 24 aa, Staphylococcus
IGICLGMQLFYRWSAEGDVEGLNI

SEQ ID NO: 2070658 - protein, 24 aa, Staphylococcus
IGIDRLVMLLTNSPSIRDVLLFPY

SEQ ID NO: 2070659 - protein, 20 aa, Staphylococcus
IGIFNLNGFFNPLQTLIDHM

SEQ ID NO: 2070660 - protein, 20 aa, Staphylococcus
IGIHAFKLGFIMSAVDRELP

SEQ ID NO: 2070661 - protein, 17 aa, Staphylococcus
IGIPNKGEWTHKPLRFT

SEQ ID NO: 2070662 - protein, 27 aa, Staphylococcus
IGIYSYELYHFFDVDTIIRVGSCGALQ

SEQ ID NO: 2070663 - protein, 24 aa, Staphylococcus
IGKDIKGLKIALPKEYLGEGVNEE

SEQ ID NO: 2070664 - protein, 24 aa, Staphylococcus
IGKDIRGMKIALPKEYLGEGVNDE

SEQ ID NO: 2070665 - protein, 17 aa, Staphylococcus
IGKILLRQEQLPDAIFT

SEQ ID NO: 2070666 - protein, 18 aa, Staphylococcus
IGKLKLDSNLPKGSYREL

SEQ ID NO: 2070667 - protein, 30 aa, Staphylococcus
IGKLYIDQQTFVPCTPLGIMELLNHADIDL

SEQ ID NO: 2070668 - protein, 30 aa, Staphylococcus
IGKMESLLLSARHFLWSTASLYSNTHSDKA

SEQ ID NO: 2070669 - protein, 20 aa, Staphylococcus
IGKMFKSTLLSSVKNKLAAL

SEQ ID NO: 2070670 - protein, 25 aa, Staphylococcus
IGKQIMEPLIYHKKLNKKDAKNRAL

SEQ ID NO: 2070671 - protein, 24 aa, Staphylococcus
IGKRPMDRILKPLQLMQANISSVD

SEQ ID NO: 2070672 - protein, 26 aa, Staphylococcus
IGKRPMDRIMKPLRYMNANITGINDN

SEQ ID NO: 2070673 - protein, 18 aa, Staphylococcus
IGLAEAIRYIEKLGFEAI

SEQ ID NO: 2070674 - protein, 19 aa, Staphylococcus
IGLAFVCAAKGYKAVFTMP

SEQ ID NO: 2070675 - protein, 17 aa, Staphylococcus
IGLGEAIRYIEKLGFDA

SEQ ID NO: 2070676 - protein, 19 aa, Staphylococcus
IGLLLPDDKMIFNIPIRTV

SEQ ID NO: 2070677 - protein, 26 aa, Staphylococcus
IGLLLPNDKMIFNIPIRTIEYRHQQA

SEQ ID NO: 2070678 - protein, 30 aa, Staphylococcus
IGLLQEKERLLPGGYLFLSDLMGNPELLNK

SEQ ID NO: 2070679 - protein, 20 aa, Staphylococcus
IGLSRFLLKQHKTPSAVIHY

SEQ ID NO: 2070680 - protein, 20 aa, Staphylococcus
IGMLLYNYVPERKWSQWFKI

SEQ ID NO: 2070681 - protein, 18 aa, Staphylococcus
IGMPLKELNEVLALIYEE

SEQ ID NO: 2070682 - protein, 17 aa, Staphylococcus
IGMVFQDFALWPHMSVF

SEQ ID NO: 2070683 - protein, 23 aa, Staphylococcus
IGNGIIMWLLSQGSKVKVLSPQS

SEQ ID NO: 2070684 - protein, 26 aa, Staphylococcus
IGNHEFNFGLNYLKDTLADLDYPVLS

SEQ ID NO: 2070685 - protein, 18 aa, Staphylococcus
IGNMNHFLTLNQINMGRE

SEQ ID NO: 2070686 - protein, 26 aa, Staphylococcus
IGPLLPGIHHIPFPDSYRGMFNSTEP

SEQ ID NO: 2070687 - protein, 18 aa, Staphylococcus
IGPVEAVRQALKRSNKSV

SEQ ID NO: 2070688 - protein, 19 aa, Staphylococcus
IGPWKVMEGLPTLEDHRDL

SEQ ID NO: 2070689 - protein, 20 aa, Staphylococcus
IGQIFIVDITLKVDLHDAGQ

SEQ ID NO: 2070690 - protein, 21 aa, Staphylococcus
IGQLFFNLFSLEEDGDFNDSE

SEQ ID NO: 2070691 - protein, 17 aa, Staphylococcus
IGQSRHYYLDELGLDHV

SEQ ID NO: 2070692 - protein, 19 aa, Staphylococcus
IGQTLLPDVLSLYNTQFPN

SEQ ID NO: 2070693 - protein, 19 aa, Staphylococcus
IGQTLLPEVLSLYNSQFPN

SEQ ID NO: 2070694 - protein, 18 aa, Staphylococcus
IGRGFIGYILADNNIKVT

SEQ ID NO: 2070695 - protein, 19 aa, Staphylococcus
IGRGFIGYILADNNIKVTF

SEQ ID NO: 2070696 - protein, 27 aa, Staphylococcus
IGRGMSINRMYWRARRRESIFMTYILK

SEQ ID NO: 2070697 - protein, 19 aa, Staphylococcus
IGRGSFIESFPLFGYNLND

SEQ ID NO: 2070698 - protein, 17 aa, Staphylococcus
IGRLFDITGLKDLMHVN

SEQ ID NO: 2070699 - protein, 19 aa, Staphylococcus
IGRLKNILDDHSALLNVIK

SEQ ID NO: 2070700 - protein, 28 aa, Staphylococcus
IGRPNYIAFHLQLVPKIGVFRGRNALKK

SEQ ID NO: 2070701 - protein, 32 aa, Staphylococcus
IGRVKPFYGNFGIYLRAYTYIRTMGAEGLREV

SEQ ID NO: 2070702 - protein, 32 aa, Staphylococcus
IGRVKPFYGNFGIYLRAYTYIRTMGAKGLKEV

SEQ ID NO: 2070703 - protein, 31 aa, Staphylococcus
IGRVKPFYGNFGIYLRAYTYIRTMGAQGLKE

SEQ ID NO: 2070704 - protein, 30 aa, Staphylococcus
IGRVKPFYGNFGIYLRAYTYIRTMGNIGLK

SEQ ID NO: 2070705 - protein, 32 aa, Staphylococcus
IGRVKPFYGNFGIYLRAYTYIRTMGNKGLEEV

SEQ ID NO: 2070706 - protein, 25 aa, Staphylococcus
IGSEKWPVFLKRNLVDDIITVSDVD

SEQ ID NO: 2070707 - protein, 25 aa, Staphylococcus
IGSGMFIPGFEEQLVGLKTGDEKDV

SEQ ID NO: 2070708 - protein, 18 aa, Staphylococcus
IGSNIWFGASVTVTPGVS

SEQ ID NO: 2070709 - protein, 26 aa, Staphylococcus
IGSNTIRLVIFKFSKTAGLNEILNIK

SEQ ID NO: 2070710 - protein, 26 aa, Staphylococcus
IGSNTIRLVIFRFSKDAGLNELLNIK

SEQ ID NO: 2070711 - protein, 25 aa, Staphylococcus
IGSTDQRLLIKERFPQALAVEMEAT

SEQ ID NO: 2070712 - protein, 18 aa, Staphylococcus
IGTFYPFVEDESVKLYGV

SEQ ID NO: 2070713 - protein, 21 aa, Staphylococcus
IGTYTMPCARTLVPVDVPLDV

SEQ ID NO: 2070714 - protein, 23 aa, Staphylococcus
IGVDLLVIRHSQNAYYEELENLN

SEQ ID NO: 2070715 - protein, 18 aa, Staphylococcus
IGVERSRKALGEADLILF

SEQ ID NO: 2070716 - protein, 18 aa, Staphylococcus
IGVERSRKALSEADLILF

SEQ ID NO: 2070717 - protein, 33 aa, Staphylococcus; identical to SEQ ID NO: 1824356

SEQ ID NO: 2070718 - protein, 34 aa, Staphylococcus
IGVERSRKALSEADLILFVLNNNEPLTEEDRTLY

SEQ ID NO: 2070719 - protein, 34 aa, Staphylococcus
IGVERSRKALSEADLILFVLNYNEGLTEEDRKLY

SEQ ID NO: 2070720 - protein, 18 aa, Staphylococcus
IGVFFNEEEAKRLEEMNG

SEQ ID NO: 2070721 - protein, 17 aa, Staphylococcus
IGVKYLTLYAFSTENWS

SEQ ID NO: 2070722 - protein, 30 aa, Staphylococcus
IGVKYTAPNFFLLERIRKAFPNKLILSGFD

SEQ ID NO: 2070723 - protein, 28 aa, Staphylococcus
IGVNAGLYLLNFLATLNLDKTAANFVAF

SEQ ID NO: 2070724 - protein, 24 aa, Staphylococcus
IGVRVWSYKDAAGTPWTLQISVLG

SEQ ID NO: 2070725 - protein, 17 aa, Staphylococcus
IGYILADNNIKVTFADV

SEQ ID NO: 2070726 - protein, 19 aa, Staphylococcus
IGYLGELVDVANAVLFLAS

SEQ ID NO: 2070727 - protein, 18 aa, Staphylococcus
IGYLIEHPKLYDNKSGLD

SEQ ID NO: 2070728 - protein, 18 aa, Staphylococcus
IHAAIQKAKELGKGKTVL

SEQ ID NO: 2070729 - protein, 18 aa, Staphylococcus
IHAAIQKAKQLGKGKTVV

SEQ ID NO: 2070730 - protein, 19 aa, Staphylococcus
IHAKPFYKLLGYSTVGQPF

SEQ ID NO: 2070731 - protein, 25 aa, Staphylococcus
IHAKQFMVWQLLSSMKNKYGYKKDN

SEQ ID NO: 2070732 - protein, 26 aa, Staphylococcus
IHANDFDVLLMVYLSGYKNANIIFDA

SEQ ID NO: 2070733 - protein, 18 aa, Staphylococcus
IHATREYLLRNSPVPVGT

SEQ ID NO: 2070734 - protein, 30 aa, Staphylococcus
IHDACVVVTRYFGGIKLGGGGLIRAYSGAV

SEQ ID NO: 2070735 - protein, 23 aa, Staphylococcus
IHDPQSILQFYKDLIQLKKSDEI

SEQ ID NO: 2070736 - protein, 18 aa, Staphylococcus
IHDQFDHYLLNDLVQFKG

SEQ ID NO: 2070737 - protein, 17 aa, Staphylococcus
IHDYRRNQDYRLNNNDI

SEQ ID NO: 2070738 - protein, 18 aa, Staphylococcus
IHEEPLLDKIWDINLIIQ

SEQ ID NO: 2070739 - protein, 18 aa, Staphylococcus
IHEGQIHSLYLYGEDTGI

SEQ ID NO: 2070740 - protein, 27 aa, Staphylococcus
IHEMTKIDYFFLHKFQNIINIEHELKA

SEQ ID NO: 2070741 - protein, 26 aa, Staphylococcus
IHEMTKIDYFFLNKFQHIIDIEHDLK

SEQ ID NO: 2070742 - protein, 26 aa, Staphylococcus
IHEMTQIDYFFLNKFQHIIDIEHELK

SEQ ID NO: 2070743 - protein, 25 aa, Staphylococcus
IHERMAVFDLYFRSMPFNGGYAVFN

SEQ ID NO: 2070744 - protein, 26 aa, Staphylococcus
IHERNAVFDLYFRNMPFGSGYAVFNG

SEQ ID NO: 2070745 - protein, 26 aa, Staphylococcus
IHERTAIFDLYFRNMPFNSGYAVFNG

SEQ ID NO: 2070746 - protein, 18 aa, Staphylococcus
IHEVVLPIYPKAPDYHIE

SEQ ID NO: 2070747 - protein, 19 aa, Staphylococcus
IHFAWEFLTSENWMGMEPE

SEQ ID NO: 2070748 - protein, 18 aa, Staphylococcus
IHFDTRFLSKAFSQEMAS

SEQ ID NO: 2070749 - protein, 17 aa, Staphylococcus
IHFFDHSVPNTYYAMGV

SEQ ID NO: 2070750 - protein, 18 aa, Staphylococcus
IHFKLRNMSHITDPIINL

SEQ ID NO: 2070751 - protein, 20 aa, Staphylococcus
IHFPYLTIDDIMKIYQGYPD

SEQ ID NO: 2070752 - protein, 19 aa, Staphylococcus
IHFQFASYMSASKFYKDYA

SEQ ID NO: 2070753 - protein, 31 aa, Staphylococcus
IHFRELCQLLSQYSITFIIDVNPSLLNHHFY

SEQ ID NO: 2070754 - protein, 24 aa, Staphylococcus
IHGANHYLIHQFVSPYYNRRDDEW

SEQ ID NO: 2070755 - protein, 26 aa, Staphylococcus
IHGANHYLIHQFVSPYYNRRNDIWAE

SEQ ID NO: 2070756 - protein, 25 aa, Staphylococcus
IHGANHYLIHQFVSPYYNRRNDVWA

SEQ ID NO: 2070757 - protein, 20 aa, Staphylococcus
IHGANTYLLQQFFSPHSNRR

SEQ ID NO: 2070758 - protein, 18 aa, Staphylococcus
IHHILLQHLTSKSYVLGP

SEQ ID NO: 2070759 - protein, 18 aa, Staphylococcus
IHHLFSKVKFEKEYICLA

SEQ ID NO: 2070760 - protein, 24 aa, Staphylococcus
IHHRYPSIPFYLQVGNPYLEDEVE

SEQ ID NO: 2070761 - protein, 20 aa, Staphylococcus
IHHRYPTVPFYLQVGNPYLD

SEQ ID NO: 2070762 - protein, 20 aa, Staphylococcus
IHIDILPTEKFKTTMITFKF

SEQ ID NO: 2070763 - protein, 26 aa, Staphylococcus
IHIEPYTLDYLEKGQLLSLADSGKYY

SEQ ID NO: 2070764 - protein, 19 aa, Staphylococcus
IHILITNEIYLIIDAFIKK

SEQ ID NO: 2070765 - protein, 20 aa, Staphylococcus
IHKVFALPQDFTIVALTATA

SEQ ID NO: 2070766 - protein, 17 aa, Staphylococcus
IHLIQANSHLVILVMVF

SEQ ID NO: 2070767 - protein, 17 aa, Staphylococcus
IHLIRANTHLVIMVIVF

SEQ ID NO: 2070768 - protein, 18 aa, Staphylococcus
IHLKKIYPNTLALTNISY

SEQ ID NO: 2070769 - protein, 17 aa, Staphylococcus
IHLKYEHATLTIKVIKQ

SEQ ID NO: 2070770 - protein, 24 aa, Staphylococcus
IHLMSRVRRYPLPLVLEISNIESI

SEQ ID NO: 2070771 - protein, 19 aa, Staphylococcus
IHLVPMLDEHLFLNGGEKV

SEQ ID NO: 2070772 - protein, 18 aa, Staphylococcus
IHMNIPTIALETLELTNN

SEQ ID NO: 2070773 - protein, 20 aa, Staphylococcus
IHNHIRGLAPWPVAYTTMDD

SEQ ID NO: 2070774 - protein, 23 aa, Staphylococcus
IHNHIRGLSPWPVAYTTMDDKNL

SEQ ID NO: 2070775 - protein, 25 aa, Staphylococcus
IHNKQFEYLLNRYLLNIERDNDISM

SEQ ID NO: 2070776 - protein, 27 aa, Staphylococcus
IHNMTKIDYFFLNKFQNIINIEHELKA

SEQ ID NO: 2070777 - protein, 29 aa, Staphylococcus
IHNTTFQHPKFFQQLFKLLEDQRILNAIA

SEQ ID NO: 2070778 - protein, 27 aa, Staphylococcus
IHPDDPPWNIFGLPRIITNKDNLERFI

SEQ ID NO: 2070779 - protein, 27 aa, Staphylococcus
IHPDDPPWNIFGLPRIITNKENLERFI

SEQ ID NO: 2070780 - protein, 24 aa, Staphylococcus
IHPREIFAAALRYTSNSLIVVHNH

SEQ ID NO: 2070781 - protein, 25 aa, Staphylococcus
IHQEQYHYLLKRYLLNVERENDISM

SEQ ID NO: 2070782 - protein, 17 aa, Staphylococcus
IHQHTVILGIHDSRLPF

SEQ ID NO: 2070783 - protein, 26 aa, Staphylococcus
IHQLSTYIKHFYPHINEIVLTVNIDN

SEQ ID NO: 2070784 - protein, 19 aa, Staphylococcus
IHQTYNINYIAFTQRKIFN

SEQ ID NO: 2070785 - protein, 25 aa, Staphylococcus
IHRERKLQITADSIKFILVKGSDVP

SEQ ID NO: 2070786 - protein, 18 aa, Staphylococcus
IHRFRRSFLLNDNFEKIN

SEQ ID NO: 2070787 - protein, 24 aa, Staphylococcus
IHRMLEVAEALPINVGFTGKGQAV

SEQ ID NO: 2070788 - protein, 28 aa, Staphylococcus
IHRSNLVMMGVLPLQFLDGESADSLGLD

SEQ ID NO: 2070789 - protein, 18 aa, Staphylococcus
IHRTCEVLIIVDPQFANR

SEQ ID NO: 2070790 - protein, 19 aa, Staphylococcus
IHRVFSLPQDFTIVALTAT

SEQ ID NO: 2070791 - protein, 21 aa, Staphylococcus
IHSGLMYYTIGQRHGLGIGGD

SEQ ID NO: 2070792 - protein, 27 aa, Staphylococcus
IHTGRYYVQRFLARKFGFEVDDIKEMS

SEQ ID NO: 2070793 - protein, 18 aa, Staphylococcus
IHTKPKPLSLYLFSEDEN

SEQ ID NO: 2070794 - protein, 30 aa, Staphylococcus
IHTMPISIIMSRMPNIVYLKEEDLVIYAAS

SEQ ID NO: 2070795 - protein, 18 aa, Staphylococcus
IHTNAILGFAKLLEKIIR

SEQ ID NO: 2070796 - protein, 18 aa, Staphylococcus
IHTNAIYGFAMLLEKILK

SEQ ID NO: 2070797 - protein, 18 aa, Staphylococcus
IHTNAVYGFAMLLEKILK

SEQ ID NO: 2070798 - protein, 32 aa, Staphylococcus
IHTTNEYLVYMLGFMPGFPFLGGLDERIHTPR

SEQ ID NO: 2070799 - protein, 31 aa, Staphylococcus
IHVKQLIRCCRYFIDILRKSTNGRIIVISSI

SEQ ID NO: 2070800 - protein, 23 aa, Staphylococcus
IHVLTKLLEVAVPLLEGYDIELI

SEQ ID NO: 2070801 - protein, 29 aa, Staphylococcus
IHYDADHRPILFSFNYFKSEVVKFKTVRE

SEQ ID NO: 2070802 - protein, 22 aa, Staphylococcus
IHYHSFLDIIAIKFKCCDKYYP

SEQ ID NO: 2070803 - protein, 17 aa, Staphylococcus
IHYIDQLEQFKFPGEVV

SEQ ID NO: 2070804 - protein, 17 aa, Staphylococcus
IHYLLKRYQITYNYDEF

SEQ ID NO: 2070805 - protein, 17 aa, Staphylococcus
IHYTPAYMYHESAVKLS

SEQ ID NO: 2070806 - protein, 18 aa, Staphylococcus
IIAAFKKRIPILGVCLGF

SEQ ID NO: 2070807 - protein, 25 aa, Staphylococcus
IIAAPVLALSLSFDHRQIDGATGQN

SEQ ID NO: 2070808 - protein, 24 aa, Staphylococcus
IIADLSVRYPGYVSSLTFVNPTSV

SEQ ID NO: 2070809 - protein, 33 aa, Staphylococcus
IIALLAERSIEMVIGMLGILKAGAGYLPIDPDY

SEQ ID NO: 2070810 - protein, 18 aa, Staphylococcus
IIALRQRAKLRNIQLNVV

SEQ ID NO: 2070811 - protein, 25 aa, Staphylococcus
IIAQDVEVYLLSDVLSKINHSEIPV

SEQ ID NO: 2070812 - protein, 17 aa, Staphylococcus
IIARYPTRRLHLEHHHL

SEQ ID NO: 2070813 - protein, 34 aa, Staphylococcus
IIAVTPSEHTARQLALVWGAYPVIKKGRKTTDDL

SEQ ID NO: 2070814 - protein, 34 aa, Staphylococcus
IIAVTPSEHTARQLALVWGAYPVVKKGRKTTDDL

SEQ ID NO: 2070815 - protein, 17 aa, Staphylococcus
IICFDGLDFLRFGRIQR

SEQ ID NO: 2070816 - protein, 17 aa, Staphylococcus
IICFDGLDFLRFGRLQR

SEQ ID NO: 2070817 - protein, 17 aa, Staphylococcus
IICKPAVKTPLTTIKLV

SEQ ID NO: 2070818 - protein, 26 aa, Staphylococcus
IICYDLRFPELLRYPARSGAKVAFYV

SEQ ID NO: 2070819 - protein, 26 aa, Staphylococcus
IIDAFGMRPYIKKKVKKYSMGMKQKL

SEQ ID NO: 2070820 - protein, 20 aa, Staphylococcus
IIDAYCESDFKPDAFYILAT

SEQ ID NO: 2070821 - protein, 21 aa, Staphylococcus
IIDDLITYKLDNQKYLLVVNA

SEQ ID NO: 2070822 - protein, 17 aa, Staphylococcus
IIDEHVARVLYLGIVGD

SEQ ID NO: 2070823 - protein, 25 aa, Staphylococcus
IIDEIKNFKKIKLIIGKEPLNYNNK

SEQ ID NO: 2070824 - protein, 20 aa, Staphylococcus
IIDFVNFYLKKDEKPLYLSN

SEQ ID NO: 2070825 - protein, 18 aa, Staphylococcus
IIDGFILRDPGNYKDVID

SEQ ID NO: 2070826 - protein, 34 aa, Staphylococcus
IIDKLDYIQYLGVDYIWLTPIYESPMNDNGYDIS

SEQ ID NO: 2070827 - protein, 25 aa, Staphylococcus
IIDKYVLTRLNTMGKLALLMLKDLN

SEQ ID NO: 2070828 - protein, 19 aa, Staphylococcus
IIDLVKKNEVKKFKYKDFE

SEQ ID NO: 2070829 - protein, 17 aa, Staphylococcus
IIDNSGLVGGYYKDYFK

SEQ ID NO: 2070830 - protein, 22 aa, Staphylococcus
IIDNTFLTPYLSTPLEDGADIV

SEQ ID NO: 2070831 - protein, 23 aa, Staphylococcus
IIDNTFLTPYLSTPLEDGADIVL

SEQ ID NO: 2070832 - protein, 23 aa, Staphylococcus
IIDNTFLTPYLSTPLEQGADIVL

SEQ ID NO: 2070833 - protein, 17 aa, Staphylococcus
IIDQMNGIAFTNKAQKI

SEQ ID NO: 2070834 - protein, 27 aa, Staphylococcus
IIDRTQLILEIFALRAKSKEGKLQVEL

SEQ ID NO: 2070835 - protein, 20 aa, Staphylococcus
IIDYIQPEKQAFIPVERDEA

SEQ ID NO: 2070836 - protein, 29 aa, Staphylococcus
IIEARVEEIFFNVFDILQELGLTKVNGGF

SEQ ID NO: 2070837 - protein, 18 aa, Staphylococcus
IIEEAKAFNFKSICINPT

SEQ ID NO: 2070838 - protein, 26 aa, Staphylococcus
IIEETLTLPFFSEKKAILVKNAYVFT

SEQ ID NO: 2070839 - protein, 27 aa, Staphylococcus
IIEINCHGGILTINRILELTMTYGARM

SEQ ID NO: 2070840 - protein, 23 aa, Staphylococcus
IIEINCHGGILTINRVLELTMTH

SEQ ID NO: 2070841 - protein, 18 aa, Staphylococcus
IIEKLDYIKYLGVDYIWL

SEQ ID NO: 2070842 - protein, 18 aa, Staphylococcus
IIEKYQIPVAPLSVTFDD

SEQ ID NO: 2070843 - protein, 28 aa, Staphylococcus
IIELAEQLITFIPHSLLTLDNPKYNDRQ

SEQ ID NO: 2070844 - protein, 18 aa, Staphylococcus
IIELIKSLQQTILTIANQ

SEQ ID NO: 2070845 - protein, 17 aa, Staphylococcus
IIELITFITFTNAQQQF

SEQ ID NO: 2070846 - protein, 18 aa, Staphylococcus
IIELPITSSFREGLTVLE

SEQ ID NO: 2070847 - protein, 17 aa, Staphylococcus
IIELWKMRKDRLQYQFH

SEQ ID NO: 2070848 - protein, 18 aa, Staphylococcus
IIETIQPFNLKLIRKDRT

SEQ ID NO: 2070849 - protein, 25 aa, Staphylococcus
IIEVTLDWIFHNNIPLAYKTSDLLK

SEQ ID NO: 2070850 - protein, 17 aa, Staphylococcus
IIEYAYQIGIDSIGFTT

SEQ ID NO: 2070851 - protein, 18 aa, Staphylococcus
IIFAFIPGSEFRGPLYCG

SEQ ID NO: 2070852 - protein, 18 aa, Staphylococcus
IIFCAKRLSGYDSEIFHY

SEQ ID NO: 2070853 - protein, 20 aa, Staphylococcus
IIFEYLAHHGIASHFIKQLS

SEQ ID NO: 2070854 - protein, 20 aa, Staphylococcus
IIFGHNHRLHMFDDKNKMYF

SEQ ID NO: 2070855 - protein, 18 aa, Staphylococcus
IIFIDGPVIKAMREGHIL

SEQ ID NO: 2070856 - protein, 26 aa, Staphylococcus
IIGINPNWLTKPIMGKVFAPIVEDAR

SEQ ID NO: 2070857 - protein, 25 aa, Staphylococcus
IIGTHNWAQIMLPIAPKICVEFQHD

SEQ ID NO: 2070858 - protein, 30 aa, Staphylococcus
IIGVKYTAPNFFLLERLRKAYPDKLIFSGF

SEQ ID NO: 2070859 - protein, 19 aa, Staphylococcus
IIGYLGLWMVIDQAQITTI

SEQ ID NO: 2070860 - protein, 17 aa, Staphylococcus
IIHAKADELFFGLPEEQ

SEQ ID NO: 2070861 - protein, 18 aa, Staphylococcus
IIHDYQSIKLKFLHPMYR

SEQ ID NO: 2070862 - protein, 18 aa, Staphylococcus
IIHKLNMTLEFFNGMSHK

SEQ ID NO: 2070863 - protein, 18 aa, Staphylococcus
IIHVAKKIMKTKKGPVVK

SEQ ID NO: 2070864 - protein, 18 aa, Staphylococcus
IIIAGDLFDKENRTLRAE

SEQ ID NO: 2070865 - protein, 25 aa, Staphylococcus
IIIDAIGQLIGMRASSDFVRHGEKK

SEQ ID NO: 2070866 - protein, 20 aa, Staphylococcus
IIIDAIGQLIGMRASSDYVR

SEQ ID NO: 2070867 - protein, 21 aa, Staphylococcus
IIIDAIGQLIGMRASSNYVRH

SEQ ID NO: 2070868 - protein, 17 aa, Staphylococcus
IIIEENFSFYNVDLDDG

SEQ ID NO: 2070869 - protein, 18 aa, Staphylococcus
IIIGGGMAYTFLKAQGKE

SEQ ID NO: 2070870 - protein, 22 aa, Staphylococcus
IIIKDSYILIKTSPGFAQCINY

SEQ ID NO: 2070871 - protein, 19 aa, Staphylococcus
IIIQPGETFSFWNLVGKID

SEQ ID NO: 2070872 - protein, 17 aa, Staphylococcus
IIIVSAPGKRHKDDVKT

SEQ ID NO: 2070873 - protein, 17 aa, Staphylococcus
IIIVSAPGKRHSEDVKT

SEQ ID NO: 2070874 - protein, 19 aa, Staphylococcus
IIIYPLKNCTRIIPFSSIS

SEQ ID NO: 2070875 - protein, 20 aa, Staphylococcus
IIIYPLKNCTRIIPFSSISY

SEQ ID NO: 2070876 - protein, 29 aa, Staphylococcus
IIKASNVQYLFKQNNYIPSNVFLEDTYKK

SEQ ID NO: 2070877 - protein, 34 aa, Staphylococcus
IIKDFIVRYKTMQGYYAPFVPGWDTHGLPIEQAL

SEQ ID NO: 2070878 - protein, 19 aa, Staphylococcus
IIKDFPILDQKVNGKRLAY

SEQ ID NO: 2070879 - protein, 28 aa, Staphylococcus
IIKDSIADIFLQQILTRPAEYDVVATMN

SEQ ID NO: 2070880 - protein, 18 aa, Staphylococcus
IIKHLGTDQFKRIRIGVG

SEQ ID NO: 2070881 - protein, 22 aa, Staphylococcus
IIKINETHFKVLWVMHHLICDN

SEQ ID NO: 2070882 - protein, 27 aa, Staphylococcus
IIKKDGSYTYFLPDVAYHYDKFHRDGG

SEQ ID NO: 2070883 - protein, 18 aa, Staphylococcus
IIKKEFSISFEEFAVLTF

SEQ ID NO: 2070884 - protein, 23 aa, Staphylococcus
IIKKRMMIFGNGPNIELFEFKDA

SEQ ID NO: 2070885 - protein, 18 aa, Staphylococcus
IIKKRMMVFGHGPNIEMF

SEQ ID NO: 2070886 - protein, 25 aa, Staphylococcus
IIKMTHIQLIGIAFNFMCFKSSAPT

SEQ ID NO: 2070887 - protein, 27 aa, Staphylococcus
IIKNTESRLLSRLPINLERVPDNLSFI

SEQ ID NO: 2070888 - protein, 21 aa, Staphylococcus
IIKNTFLKERLGTVITTAGAS

SEQ ID NO: 2070889 - protein, 18 aa, Staphylococcus
IIKQALRTALKALDLDLL

SEQ ID NO: 2070890 - protein, 17 aa, Staphylococcus
IIKTMHFTGERYQYTAQ

SEQ ID NO: 2070891 - protein, 26 aa, Staphylococcus
IILAHAGGTLPYLTWRINQCYELIEQ

SEQ ID NO: 2070892 - protein, 18 aa, Staphylococcus
IILALIKEKELCVCDLSI

SEQ ID NO: 2070893 - protein, 18 aa, Staphylococcus
IILELPQVSIDHLGLTKE

SEQ ID NO: 2070894 - protein, 18 aa, Staphylococcus
IILLKKGLQKYDELMIYY

SEQ ID NO: 2070895 - protein, 17 aa, Staphylococcus
IILLKQGLNKYDELMIY

SEQ ID NO: 2070896 - protein, 19 aa, Staphylococcus
IILNLLEKTELPIEGILLL

SEQ ID NO: 2070897 - protein, 17 aa, Staphylococcus
IILNRLKSMGLNSNWDM

SEQ ID NO: 2070898 - protein, 18 aa, Staphylococcus
IILYALIQAKHAIKQFSL

SEQ ID NO: 2070899 - protein, 17 aa, Staphylococcus
IILYALIQSKHAVKQYS

SEQ ID NO: 2070900 - protein, 18 aa, Staphylococcus
IILYALIQSKHAVKQYSL

SEQ ID NO: 2070901 - protein, 18 aa, Staphylococcus
IILYFHGGGLIFGTYDNL

SEQ ID NO: 2070902 - protein, 17 aa, Staphylococcus
IIMAKLEDNIYIKQNIM

SEQ ID NO: 2070903 - protein, 17 aa, Staphylococcus
IINAFRKISRETQVFIT

SEQ ID NO: 2070904 - protein, 20 aa, Staphylococcus
IINEPTAAALAYGLDKTDQD

SEQ ID NO: 2070905 - protein, 22 aa, Staphylococcus
IINNKWIGYNTDGIGYVMGLKQ

SEQ ID NO: 2070906 - protein, 17 aa, Staphylococcus
IINNVHLIRANSSIIIM

SEQ ID NO: 2070907 - protein, 23 aa, Staphylococcus
IINQIYHDPFIQGMLHGNLPTEA

SEQ ID NO: 2070908 - protein, 19 aa, Staphylococcus
IINQLGIPTVILGVGYENI

SEQ ID NO: 2070909 - protein, 20 aa, Staphylococcus
IIPIGYADGYLRIMQGHFVN

SEQ ID NO: 2070910 - protein, 29 aa, Staphylococcus
IIPVDYELDYFAGLSFRTLMPELPETLPH

SEQ ID NO: 2070911 - protein, 17 aa, Staphylococcus
IIPVHHIAGHIYANHLE

SEQ ID NO: 2070912 - protein, 17 aa, Staphylococcus
IIQAGITTIYYAQDYHN

SEQ ID NO: 2070913 - protein, 17 aa, Staphylococcus
IIQFRNVNEKTIDIYYA

SEQ ID NO: 2070914 - protein, 27 aa, Staphylococcus
IIQGMIDLIFIKDNQYYFVDYKTDAFN

SEQ ID NO: 2070915 - protein, 21 aa, Staphylococcus
IIQGMIDLIFQKDGKYYFVDY

SEQ ID NO: 2070916 - protein, 18 aa, Staphylococcus
IIQHLGTDNFKRIRIGIG

SEQ ID NO: 2070917 - protein, 17 aa, Staphylococcus
IIQHLGTEQFKRIRIGV

SEQ ID NO: 2070918 - protein, 25 aa, Staphylococcus
IIQVNELLLTTSILSQVFGLEHFAE

SEQ ID NO: 2070919 - protein, 28 aa, Staphylococcus
IIRGTDDGIWRRLVLIPFDVQIPEEKVD

SEQ ID NO: 2070920 - protein, 17 aa, Staphylococcus
IIRIEGNFWDIGEGPSG

SEQ ID NO: 2070921 - protein, 19 aa, Staphylococcus
IIRKHLIDILNYTVEEKSF

SEQ ID NO: 2070922 - protein, 33 aa, Staphylococcus
IIRNADVILYDRLVNPLILQYSSFQTELIDVGK

SEQ ID NO: 2070923 - protein, 21 aa, Staphylococcus
IIRNLCLSILTFDKSDDMVIH

SEQ ID NO: 2070924 - protein, 19 aa, Staphylococcus
IISGIQYLNQFDIVIDERC

SEQ ID NO: 2070925 - protein, 17 aa, Staphylococcus
IISGIWTHFGYADEFDV

SEQ ID NO: 2070926 - protein, 18 aa, Staphylococcus
IISGLWTHFGYADEFDVP

SEQ ID NO: 2070927 - protein, 21 aa, Staphylococcus
IISKLFVSIAYYLENVQNACK

SEQ ID NO: 2070928 - protein, 27 aa, Staphylococcus
IISSFPDTYIIGFTATPYRLNGQGFKE

SEQ ID NO: 2070929 - protein, 19 aa, Staphylococcus
IISTLKDKPLRLYDAILSC

SEQ ID NO: 2070930 - protein, 20 aa, Staphylococcus
IISTQPLNRLFNKIIYIENV

SEQ ID NO: 2070931 - protein, 20 aa, Staphylococcus
IISVMLYLEINKAYKIMKSK

SEQ ID NO: 2070932 - protein, 17 aa, Staphylococcus
IISVMSNPKYIILGGGM

SEQ ID NO: 2070933 - protein, 17 aa, Staphylococcus
IITDGTLLDLAAALFIY

SEQ ID NO: 2070934 - protein, 17 aa, Staphylococcus
IIVFHKLSKDELKQIVT

SEQ ID NO: 2070935 - protein, 17 aa, Staphylococcus
IIVFHKLTKDELKEIVT

SEQ ID NO: 2070936 - protein, 18 aa, Staphylococcus
IIVFLVNGFQMKGTIEDY

SEQ ID NO: 2070937 - protein, 20 aa, Staphylococcus
IIVGMLPWKRINTVNEEKIS

SEQ ID NO: 2070938 - protein, 17 aa, Staphylococcus
IIVITHDYELLLSCADE

SEQ ID NO: 2070939 - protein, 18 aa, Staphylococcus
IIVQPPGKKLQHLSLLSG

SEQ ID NO: 2070940 - protein, 25 aa, Staphylococcus
IIVVPDYMDIYDFTPIQFPADDQSA

SEQ ID NO: 2070941 - protein, 26 aa, Staphylococcus
IIWVDDTLIALQQLAKAYLKHVNPKV

SEQ ID NO: 2070942 - protein, 17 aa, Staphylococcus
IIYKANYKHRIVERVEW

SEQ ID NO: 2070943 - protein, 18 aa, Staphylococcus
IIYVYADEILNDLSPTIK

SEQ ID NO: 2070944 - protein, 17 aa, Staphylococcus
IKAFEKFEQLPLDTLKQ

SEQ ID NO: 2070945 - protein, 17 aa, Staphylococcus
IKAIRKLNPTIKIFKAI

SEQ ID NO: 2070946 - protein, 26 aa, Staphylococcus
IKAIYKRDYLCILGETVKEKLSYEMQ

SEQ ID NO: 2070947 - protein, 25 aa, Staphylococcus
IKALHQLIDIGFTRLLTHGGPSDTN

SEQ ID NO: 2070948 - protein, 22 aa, Staphylococcus
IKALIFAIPCETYKFKVIGPFI

SEQ ID NO: 2070949 - protein, 17 aa, Staphylococcus
IKALKKGPQIVVGTPGR

SEQ ID NO: 2070950 - protein, 17 aa, Staphylococcus
IKARLYPELPRTEYICF

SEQ ID NO: 2070951 - protein, 25 aa, Staphylococcus
IKARPYRLLRIGSFLLSKEGYKIFV

SEQ ID NO: 2070952 - protein, 18 aa, Staphylococcus
IKASNLLQQGTIRLLATA

SEQ ID NO: 2070953 - protein, 25 aa, Staphylococcus
IKATKRKYDIPIIAQITALNTNYLR

SEQ ID NO: 2070954 - protein, 25 aa, Staphylococcus
IKDDDVLVLVGFGGGLTWGAITLRW

SEQ ID NO: 2070955 - protein, 25 aa, Staphylococcus
IKDDDVLVLVGFGGGLTWGAVTLRW

SEQ ID NO: 2070956 - protein, 25 aa, Staphylococcus
IKDIANLADIFYIGGTKIGALCGEA

SEQ ID NO: 2070957 - protein, 24 aa, Staphylococcus
IKDKLFELEGDLPLFPGHGPYTTV

SEQ ID NO: 2070958 - protein, 32 aa, Staphylococcus
IKDKMKRDPLGDPIILIAPTQSTFQFEQAFVN

SEQ ID NO: 2070959 - protein, 17 aa, Staphylococcus
IKDLKEKGYLVVVNEQM

SEQ ID NO: 2070960 - protein, 27 aa, Staphylococcus
IKDLRRLGLRVYFNIKNALVSLSEEKR

SEQ ID NO: 2070961 - protein, 18 aa, Staphylococcus
IKDLWRVTSWNQAKALGI

SEQ ID NO: 2070962 - protein, 27 aa, Staphylococcus
IKDPRDFIHPLPHISFVRGKNNVQFLK

SEQ ID NO: 2070963 - protein, 27 aa, Staphylococcus
IKDSDGRIILFIDELHMLVGAGKTDGA

SEQ ID NO: 2070964 - protein, 21 aa, Staphylococcus
IKDVGDLYYLTKDDLLPLERM

SEQ ID NO: 2070965 - protein, 27 aa, Staphylococcus
IKDVKSIFHVIDFLAIDKYPKANWEEV

SEQ ID NO: 2070966 - protein, 25 aa, Staphylococcus
IKEDVAMAFGFFDGMHRGHHKVFEA

SEQ ID NO: 2070967 - protein, 26 aa, Staphylococcus
IKEDVAMAFGFFDGMHRGHSKVFEAL

SEQ ID NO: 2070968 - protein, 21 aa, Staphylococcus
IKEFELLWYLGKHENEVISKS

SEQ ID NO: 2070969 - protein, 23 aa, Staphylococcus
IKEFQFEIPQFRFILDAKDNGEL

SEQ ID NO: 2070970 - protein, 17 aa, Staphylococcus
IKEHDLFIIISGSGSTE

SEQ ID NO: 2070971 - protein, 18 aa, Staphylococcus
IKEHDLFVILSGSGSTEH

SEQ ID NO: 2070972 - protein, 40 aa, Staphylococcus
IKEIEDVRFLFVAATAPFTPFYRALDWIVTDPLEAIKDEI

SEQ ID NO: 2070973 - protein, 17 aa, Staphylococcus
IKEIVFDRGGYLYHGRV

SEQ ID NO: 2070974 - protein, 17 aa, Staphylococcus
IKEIVPIWKKEIWEDGA

SEQ ID NO: 2070975 - protein, 20 aa, Staphylococcus
IKEIVPIWKKEIWEDGEEWQ

SEQ ID NO: 2070976 - protein, 17 aa, Staphylococcus
IKEIVPIWKKEIWEDGS

SEQ ID NO: 2070977 - protein, 26 aa, Staphylococcus
IKEKEVIKVFYNYLKRFDLEKYEVTQ

SEQ ID NO: 2070978 - protein, 17 aa, Staphylococcus
IKELFPKAKIILDRFHI

SEQ ID NO: 2070979 - protein, 18 aa, Staphylococcus
IKELGFIFNNLNINKIKA

SEQ ID NO: 2070980 - protein, 19 aa, Staphylococcus
IKELILPKSTDRPLKGAEL

SEQ ID NO: 2070981 - protein, 24 aa, Staphylococcus
IKELLQLLQFISDLNMHPIFKVST

SEQ ID NO: 2070982 - protein, 19 aa, Staphylococcus
IKELMDYLKQRHIPMAIAT

SEQ ID NO: 2070983 - protein, 25 aa, Staphylococcus
IKELMSYLFEVIDPYSLNKQGQDVG

SEQ ID NO: 2070984 - protein, 20 aa, Staphylococcus
IKELQLIKVPAPSGHYVYSL

SEQ ID NO: 2070985 - protein, 33 aa, Staphylococcus
IKELTLDGIFVQIGLVPNTAWLGNAVELNERKE

SEQ ID NO: 2070986 - protein, 17 aa, Staphylococcus
IKELVSKWLYYGEMSID

SEQ ID NO: 2070987 - protein, 19 aa, Staphylococcus
IKELWPQAGDYLLVTLRID

SEQ ID NO: 2070988 - protein, 26 aa, Staphylococcus
IKENAQVRVLPYASITIRQAGKEHVD

SEQ ID NO: 2070989 - protein, 24 aa, Staphylococcus
IKEQMEEEMFLGLRMNKGVNIIRF

SEQ ID NO: 2070990 - protein, 25 aa, Staphylococcus
IKERGHDIFLDLKLHDIPNTVQKAM

SEQ ID NO: 2070991 - protein, 25 aa, Staphylococcus
IKETAQVRVLPYAAITVRQAGKEHV

SEQ ID NO: 2070992 - protein, 17 aa, Staphylococcus
IKFDYRAGQIQGLHPGR

SEQ ID NO: 2070993 - protein, 22 aa, Staphylococcus
IKFGIKEDIDYIAASFVRRPSD

SEQ ID NO: 2070994 - protein, 19 aa, Staphylococcus
IKFIKKYKKIIIKPQIGLM

SEQ ID NO: 2070995 - protein, 20 aa, Staphylococcus
IKFSQLIEKPTFSQWMLLVD

SEQ ID NO: 2070996 - protein, 24 aa, Staphylococcus
IKGDANVFIFPSLEAGNIGYKIAQ

SEQ ID NO: 2070997 - protein, 19 aa, Staphylococcus
IKGFEMLPQMKAVDLRIEY

SEQ ID NO: 2070998 - protein, 20 aa, Staphylococcus
IKGFEMLPQMKAVDLRIEYD

SEQ ID NO: 2070999 - protein, 21 aa, Staphylococcus
IKGFRYYVDQLLENTSPRTEF

SEQ ID NO: 2071000 - protein, 23 aa, Staphylococcus
IKGKKAVLYFYPRDNTPTCTTEA

SEQ ID NO: 2071001 - protein, 20 aa, Staphylococcus
IKGKWSYLYRAIDAEGHTLD

SEQ ID NO: 2071002 - protein, 21 aa, Staphylococcus
IKGKWSYLYRAIDAEGYTLDI

SEQ ID NO: 2071003 - protein, 19 aa, Staphylococcus
IKGNFLVVGMKLIATILGK

SEQ ID NO: 2071004 - protein, 24 aa, Staphylococcus
IKGSKTIIYFYPRDNTPTCTTEAC

SEQ ID NO: 2071005 - protein, 19 aa, Staphylococcus
IKGSLRIFEGMLNTLTVNT

SEQ ID NO: 2071006 - protein, 24 aa, Staphylococcus
IKGVGLYKALTLKAAFELGERMHS

SEQ ID NO: 2071007 - protein, 33 aa, Staphylococcus
IKGVGQLLFKKIPKLPFTLCYVSRGFVADYNDR

SEQ ID NO: 2071008 - protein, 32 aa, Staphylococcus
IKGVGQLLFKKIPKLPFTLCYVSRGFVTDYSD

SEQ ID NO: 2071009 - protein, 33 aa, Staphylococcus
IKGVGQLLFKKIPKLPFTLCYVSRGFVTEYDNK

SEQ ID NO: 2071010 - protein, 20 aa, Staphylococcus
IKHDPGICILGHIINYMDDE

SEQ ID NO: 2071011 - protein, 27 aa, Staphylococcus
IKHENQIVGFNIFDFSKVYSVNSNGHI

SEQ ID NO: 2071012 - protein, 17 aa, Staphylococcus
IKHHDYLKDIAIKIEQG

SEQ ID NO: 2071013 - protein, 25 aa, Staphylococcus
IKHKIKQLLDEGLEWVLIQGQMGIE

SEQ ID NO: 2071014 - protein, 19 aa, Staphylococcus
IKHWIPCEIDEQYLSHSIN

SEQ ID NO: 2071015 - protein, 21 aa, Staphylococcus
IKIADYIIDLGPLAGKYGGDI

SEQ ID NO: 2071016 - protein, 20 aa, Staphylococcus
IKIAHGIYPVPAPATAEILK

SEQ ID NO: 2071017 - protein, 26 aa, Staphylococcus
IKIAISHYYFGYIHPFYDGNGRTSRF

SEQ ID NO: 2071018 - protein, 28 aa, Staphylococcus
IKIIDRTQLILEIFALRARSREGKLQVE

SEQ ID NO: 2071019 - protein, 29 aa, Staphylococcus
IKIIDRTQLILEIFALRARSREGKLQVEL

SEQ ID NO: 2071020 - protein, 29 aa, Staphylococcus
IKIIDRTQLILEIFALRASSREGKLQVEL

SEQ ID NO: 2071021 - protein, 19 aa, Staphylococcus
IKIQQLYVVDADRIHDDMI

SEQ ID NO: 2071022 - protein, 25 aa, Staphylococcus
IKKASLYYYFPSKAAIYRECAQRCF

SEQ ID NO: 2071023 - protein, 24 aa, Staphylococcus
IKKGWPSMMRKIWKNPEKYDSYFI

SEQ ID NO: 2071024 - protein, 25 aa, Staphylococcus
IKKHLHYLRPKLLIDFEKQLFIFKD

SEQ ID NO: 2071025 - protein, 24 aa, Staphylococcus
IKKIDAPIVEGSFTAAVKLSVGGT

SEQ ID NO: 2071026 - protein, 21 aa, Staphylococcus
IKKLMPQIIEFSELGEFIYQP

SEQ ID NO: 2071027 - protein, 29 aa, Staphylococcus
IKKQYRGYGLGQLLLKYVKNYASHTCEVM

SEQ ID NO: 2071028 - protein, 27 aa, Staphylococcus
IKKSELELFKTTRFNKPLIAMKLKDND

SEQ ID NO: 2071029 - protein, 17 aa, Staphylococcus
IKKVSLELGGKSPYIVL

SEQ ID NO: 2071030 - protein, 18 aa, Staphylococcus
IKKYGILNEHRKTFEPIK

SEQ ID NO: 2071031 - protein, 23 aa, Staphylococcus
IKLDHPLLKMEKAVILPHIGSAS

SEQ ID NO: 2071032 - protein, 26 aa, Staphylococcus
IKLEQKFELLFVRWVPRNQNKEANHH

SEQ ID NO: 2071033 - protein, 26 aa, Staphylococcus
IKLETYLTPHFIPLDVLYESVDIMAE

SEQ ID NO: 2071034 - protein, 35 aa, Staphylococcus
IKLHTENTYLIYMLGFMPGFPFLGGLNKQLHTPRR

SEQ ID NO: 2071035 - protein, 19 aa, Staphylococcus
IKLKNAPYDLYIRNRPNAP

SEQ ID NO: 2071036 - protein, 17 aa, Staphylococcus
IKLKRGPAKNPLFQAFF

SEQ ID NO: 2071037 - protein, 18 aa, Staphylococcus
IKLKRGPATNPLFKSFFN

SEQ ID NO: 2071038 - protein, 17 aa, Staphylococcus
IKLLIPSPKLCTDNAAM

SEQ ID NO: 2071039 - protein, 27 aa, Staphylococcus
IKLYPLDIFSLFNEEDWIIAYDVYFKS

SEQ ID NO: 2071040 - protein, 17 aa, Staphylococcus
IKMDLVLGEFRLQDRYV

SEQ ID NO: 2071041 - protein, 29 aa, Staphylococcus
IKMGIMEVKIFRQPILHSKAYIFGELESD

SEQ ID NO: 2071042 - protein, 19 aa, Staphylococcus
IKMHALRAGVTLIKDQGKT

SEQ ID NO: 2071043 - protein, 18 aa, Staphylococcus
IKNAHKRELAYTRYTWPK

SEQ ID NO: 2071044 - protein, 19 aa, Staphylococcus
IKNEIIFDDYTIAELCLIG

SEQ ID NO: 2071045 - protein, 17 aa, Staphylococcus
IKNGMIQTIYKIINLIG

SEQ ID NO: 2071046 - protein, 27 aa, Staphylococcus
IKNIFAIGDIVPGLPLAHKASYEGKVA

SEQ ID NO: 2071047 - protein, 17 aa, Staphylococcus
IKNIRKKLNIVNQSLIN

SEQ ID NO: 2071048 - protein, 17 aa, Staphylococcus
IKNKRLKGLSLKNVALS

SEQ ID NO: 2071049 - protein, 21 aa, Staphylococcus
IKNLTYPVLIDQFQTAGTFSF

SEQ ID NO: 2071050 - protein, 17 aa, Staphylococcus
IKNNQILELLKLIDSVV

SEQ ID NO: 2071051 - protein, 24 aa, Staphylococcus
IKNPIFEIKQLRPTASRIKNLLKG

SEQ ID NO: 2071052 - protein, 19 aa, Staphylococcus
IKPDLLVVDSIQTIFHPEI

SEQ ID NO: 2071053 - protein, 21 aa, Staphylococcus
IKPEIVLMYELLRPGEYGTEE

SEQ ID NO: 2071054 - protein, 19 aa, Staphylococcus
IKPINKPMYAIYNALKKLK

SEQ ID NO: 2071055 - protein, 28 aa, Staphylococcus
IKPKEIYNLVVYQLGALNGFCKIHGTRI

SEQ ID NO: 2071056 - protein, 27 aa, Staphylococcus
IKPNPDPYLVAVQKLNYAPGHCLAIED

SEQ ID NO: 2071057 - protein, 23 aa, Staphylococcus
IKPTHLLVDAMTLDIDIPQTSLI

SEQ ID NO: 2071058 - protein, 17 aa, Staphylococcus
IKQLPFKQRIALETKMN

SEQ ID NO: 2071059 - protein, 19 aa, Staphylococcus
IKQNYIVSSTLQAIRTDIE

SEQ ID NO: 2071060 - protein, 17 aa, Staphylococcus
IKQQYLPDALKNKIYYE

SEQ ID NO: 2071061 - protein, 18 aa, Staphylococcus
IKQWLPTFNNVDSHLLHD

SEQ ID NO: 2071062 - protein, 25 aa, Staphylococcus
IKQYAPEFEKIIGLPIMLIHKQHCV

SEQ ID NO: 2071063 - protein, 18 aa, Staphylococcus
IKRHYSIRNALRTALKSL

SEQ ID NO: 2071064 - protein, 17 aa, Staphylococcus
IKRIFQEWQIPIIFVTH

SEQ ID NO: 2071065 - protein, 23 aa, Staphylococcus
IKRINFEFLYIDNAQLKMPYLIE

SEQ ID NO: 2071066 - protein, 51 aa, Staphylococcus
IKRKMTLDFYLKPFVKTRIKGWVRQLLWMSLYQYVFLDKIPNHAIINEAVN

SEQ ID NO: 2071067 - protein, 24 aa, Staphylococcus
IKRLKFEYLFIDNAKLKTSYLIDE

SEQ ID NO: 2071068 - protein, 17 aa, Staphylococcus
IKRLNYIINQIRRYTKE

SEQ ID NO: 2071069 - protein, 20 aa, Staphylococcus
IKRPLLEQGGTLFKLEMLLL

SEQ ID NO: 2071070 - protein, 19 aa, Staphylococcus
IKRSGFFYAPTILDHINLE

SEQ ID NO: 2071071 - protein, 18 aa, Staphylococcus
IKRVIAHLPNFESDTDTF

SEQ ID NO: 2071072 - protein, 20 aa, Staphylococcus
IKRYIAKYTINPAITHGISD

SEQ ID NO: 2071073 - protein, 19 aa, Staphylococcus
IKSEEEFLTILNLAKQRNA

SEQ ID NO: 2071074 - protein, 28 aa, Staphylococcus
IKSELGSRMRLRIIPELSFEYDESIEYG

SEQ ID NO: 2071075 - protein, 26 aa, Staphylococcus
IKSLNFDVLVPWVSIKEGPVAYFVEN

SEQ ID NO: 2071076 - protein, 25 aa, Staphylococcus
IKSRGHDIFLDLKLHDIPNTVEKAM

SEQ ID NO: 2071077 - protein, 26 aa, Staphylococcus
IKSSNLLKDLILQLALKRISQDNQEM

SEQ ID NO: 2071078 - protein, 19 aa, Staphylococcus
IKSTHLVIAFGCNHDPFIP

SEQ ID NO: 2071079 - protein, 21 aa, Staphylococcus
IKSYLLDLHDDLKLNLIDMNQ

SEQ ID NO: 2071080 - protein, 27 aa, Staphylococcus
IKTADVFISTILLPGQKPPKLVTRDMV

SEQ ID NO: 2071081 - protein, 33 aa, Staphylococcus
IKTFKQLLHLYFDDYLLIWAPNHHHLKQLHRVE

SEQ ID NO: 2071082 - protein, 19 aa, Staphylococcus
IKTGFGTGGWQLAALNLCS

SEQ ID NO: 2071083 - protein, 26 aa, Staphylococcus
IKTSQYPHFLTKIKAKKAYKLSPEVE

SEQ ID NO: 2071084 - protein, 29 aa, Staphylococcus
IKTSVTLDFVLLKKYFKNAIPRVGDVVKV

SEQ ID NO: 2071085 - protein, 25 aa, Staphylococcus
IKTYTGFILKFNVLEKSFSFFNTSN

SEQ ID NO: 2071086 - protein, 29 aa, Staphylococcus
IKVAQIFNYLWGYIISHLSKKSKVTFGLV

SEQ ID NO: 2071087 - protein, 27 aa, Staphylococcus
IKVMVADYQFDPLKNQITHIDFLAINM

SEQ ID NO: 2071088 - protein, 27 aa, Staphylococcus
IKVMVSDYQFDPLKNQITHIDFLAINM

SEQ ID NO: 2071089 - protein, 17 aa, Staphylococcus
IKVNEPLKRYTYTKTGG

SEQ ID NO: 2071090 - protein, 19 aa, Staphylococcus
IKVSPMEITFIPRGNRIIF

SEQ ID NO: 2071091 - protein, 25 aa, Staphylococcus
IKVTAWMPLMRNRGLLDDPTIVDIA

SEQ ID NO: 2071092 - protein, 18 aa, Staphylococcus
IKVTKPYFASKQKKLRKT

SEQ ID NO: 2071093 - protein, 25 aa, Staphylococcus
IKVVKAVKWNIIRDGKLLYNLEVLF

SEQ ID NO: 2071094 - protein, 19 aa, Staphylococcus
IKVYVGNYDFWYQSSELAM

SEQ ID NO: 2071095 - protein, 19 aa, Staphylococcus
IKYLPCPCKIKYDEARFDS

SEQ ID NO: 2071096 - protein, 24 aa, Staphylococcus
IKYRPKRVLDTLELFKIAFPTDKS

SEQ ID NO: 2071097 - protein, 22 aa, Staphylococcus
ILAHHNVLGVLPTGGGKSICYQ

SEQ ID NO: 2071098 - protein, 17 aa, Staphylococcus
ILAKFKPIIEEFNTVLT

SEQ ID NO: 2071099 - protein, 17 aa, Staphylococcus
ILAKLLNDNLDSFTALT

SEQ ID NO: 2071100 - protein, 27 aa, Staphylococcus
ILAQSPGLKVIIPSGPYDAKGLLISAI

SEQ ID NO: 2071101 - protein, 17 aa, Staphylococcus
ILDAFNFRHATKRFDAN

SEQ ID NO: 2071102 - protein, 23 aa, Staphylococcus
ILDENPYQLVYDIKGIGFNKADQ

SEQ ID NO: 2071103 - protein, 19 aa, Staphylococcus
ILDIEIPGMTGLEILAQIR

SEQ ID NO: 2071104 - protein, 20 aa, Staphylococcus
ILDQGGRLVLFSHLGKVKEE

SEQ ID NO: 2071105 - protein, 21 aa, Staphylococcus
ILDQQKIAIPSLYYSELKSVQ

SEQ ID NO: 2071106 - protein, 34 aa, Staphylococcus
ILDSGGAERLLGYGDMLYLGGGMNKPIRVQGTFV

SEQ ID NO: 2071107 - protein, 34 aa, Staphylococcus
ILDSGGAERLLGYGDMLYLGNGMNKPIRVQGSFV

SEQ ID NO: 2071108 - protein, 34 aa, Staphylococcus; identical to SEQ ID NO: 1696514

SEQ ID NO: 2071109 - protein, 25 aa, Staphylococcus
ILDTSLLFNIIPERFQGRDIDDDLL

SEQ ID NO: 2071110 - protein, 24 aa, Staphylococcus
ILDTSLLFNIIPERFQGREVNDDL

SEQ ID NO: 2071111 - protein, 25 aa, Staphylococcus
ILDTSLLFNIIPKRFQGREVDDDLL

SEQ ID NO: 2071112 - protein, 25 aa, Staphylococcus
ILDTSLLFNIIPQRFQGREVNDDLL

SEQ ID NO: 2071113 - protein, 28 aa, Staphylococcus
ILDVMVEPFFEWVIEKDAWYGEELEHIK

SEQ ID NO: 2071114 - protein, 21 aa, Staphylococcus
ILDYSLSMTILKDIKETLSIS

SEQ ID NO: 2071115 - protein, 20 aa, Staphylococcus
ILDYVWDQYPTMPEKDVRAV

SEQ ID NO: 2071116 - protein, 31 aa, Staphylococcus
ILEDHIETTIWYKLLVNLGINSITALGGNTA

SEQ ID NO: 2071117 - protein, 26 aa, Staphylococcus
ILEELKLPYRRVILCTGDIGFSAAKT

SEQ ID NO: 2071118 - protein, 28 aa, Staphylococcus
ILEGYHTLLTIGRYPICYINIEMDPILV

SEQ ID NO: 2071119 - protein, 19 aa, Staphylococcus
ILEKVPDYFVTFVQKLLNE

SEQ ID NO: 2071120 - protein, 18 aa, Staphylococcus
ILEKVPTYFVTLVKKLLN

SEQ ID NO: 2071121 - protein, 18 aa, Staphylococcus
ILELAPSKLTSPLLTAEW

SEQ ID NO: 2071122 - protein, 21 aa, Staphylococcus
ILELLLKIRKEQDLTIVIITH

SEQ ID NO: 2071123 - protein, 18 aa, Staphylococcus
ILENVSIPLIYNGMSSKD

SEQ ID NO: 2071124 - protein, 24 aa, Staphylococcus
ILEQDFDLLFVKWVPRDQNKEANQ

SEQ ID NO: 2071125 - protein, 24 aa, Staphylococcus
ILEQSFDLMFVKWVPRDKNKEANQ

SEQ ID NO: 2071126 - protein, 19 aa, Staphylococcus
ILERDITLSIYLPEDFTEL

SEQ ID NO: 2071127 - protein, 29 aa, Staphylococcus
ILESDIQNKIWYKLLVNLGINSITAIGHQ

SEQ ID NO: 2071128 - protein, 22 aa, Staphylococcus
ILFGHNHRLHLFDDKSTIYFNP

SEQ ID NO: 2071129 - protein, 20 aa, Staphylococcus
ILFKSVYIKKEIIIKVIDKQ

SEQ ID NO: 2071130 - protein, 18 aa, Staphylococcus
ILFYHQAAGQGNLYKSLG

SEQ ID NO: 2071131 - protein, 22 aa, Staphylococcus
ILGAKRVIPLAVSGPFHSSMMQ

SEQ ID NO: 2071132 - protein, 19 aa, Staphylococcus
ILGETLYNFGLTPQGLEVF

SEQ ID NO: 2071133 - protein, 24 aa, Staphylococcus
ILGKQALLELYRNGFEAYELAGAL

SEQ ID NO: 2071134 - protein, 34 aa, Staphylococcus
ILGMVQDEIKYPAIPSVLYSLPRLSQIGVTVEEA

SEQ ID NO: 2071135 - protein, 19 aa, Staphylococcus
ILGNVTHKIASNVDIPVLI

SEQ ID NO: 2071136 - protein, 19 aa, Staphylococcus
ILGQMRDAFFLAQDIQTTG

SEQ ID NO: 2071137 - protein, 24 aa, Staphylococcus
ILGQMRDAFFLAQDLKTTGTIFNH

SEQ ID NO: 2071138 - protein, 22 aa, Staphylococcus
ILGQMRDAFFLAQETGTTGTIF

SEQ ID NO: 2071139 - protein, 27 aa, Staphylococcus
ILHEDHSIHLLLFNAPYQRSSTQDVQK

SEQ ID NO: 2071140 - protein, 24 aa, Staphylococcus
ILHERGILLVPDVLASAGGVTVSY

SEQ ID NO: 2071141 - protein, 17 aa, Staphylococcus
ILHFCSVDLVDSPMKMA

SEQ ID NO: 2071142 - protein, 17 aa, Staphylococcus
ILHTMPLTMEDFKLYNI

SEQ ID NO: 2071143 - protein, 20 aa, Staphylococcus
ILHVLKRFKAMLIQKNESVE

SEQ ID NO: 2071144 - protein, 20 aa, Staphylococcus
ILHVLKRFKAMLIQKNETVE

SEQ ID NO: 2071145 - protein, 17 aa, Staphylococcus
ILIGFMGTGKSTIGEYL

SEQ ID NO: 2071146 - protein, 18 aa, Staphylococcus
ILIGFMGTGKTTLGQFLA

SEQ ID NO: 2071147 - protein, 18 aa, Staphylococcus
ILIGFMGTGKTTVGQYLM

SEQ ID NO: 2071148 - protein, 18 aa, Staphylococcus
ILIGGGMAYTFLKAQGKE

SEQ ID NO: 2071149 - protein, 19 aa, Staphylococcus
ILIGLITRANLVDIVYDSI

SEQ ID NO: 2071150 - protein, 17 aa, Staphylococcus
ILIIQFSSILVTKAGMD

SEQ ID NO: 2071151 - protein, 18 aa, Staphylococcus
ILISPNKGEPLKSLGKIA

SEQ ID NO: 2071152 - protein, 18 aa, Staphylococcus
ILKAIRIIKNLDDAKLLD

SEQ ID NO: 2071153 - protein, 17 aa, Staphylococcus
ILKDIITRYKSMLGYYA

SEQ ID NO: 2071154 - protein, 19 aa, Staphylococcus
ILKDLYQRGIGKLLVEAGP

SEQ ID NO: 2071155 - protein, 25 aa, Staphylococcus
ILKERKLLITIAYKLLMDHHTYTLS

SEQ ID NO: 2071156 - protein, 20 aa, Staphylococcus
ILKFRYKSTTILLKNFDYTL

SEQ ID NO: 2071157 - protein, 22 aa, Staphylococcus
ILKGHDWFHITGITAGLNQELL

SEQ ID NO: 2071158 - protein, 17 aa, Staphylococcus
ILKGLRDRYEAHHRINI

SEQ ID NO: 2071159 - protein, 25 aa, Staphylococcus
ILKHHFSELHVFPYSARTGTPAARM

SEQ ID NO: 2071160 - protein, 19 aa, Staphylococcus
ILKIKNIIYTKSSTPRLVT

SEQ ID NO: 2071161 - protein, 26 aa, Staphylococcus
ILKIRNDIALFKPLFKNWHKYNREDS

SEQ ID NO: 2071162 - protein, 24 aa, Staphylococcus
ILKPAVMMNLLGRDLDLLEDKFAN

SEQ ID NO: 2071163 - protein, 20 aa, Staphylococcus
ILKYVFANGISRDIIYPLLV

SEQ ID NO: 2071164 - protein, 20 aa, Staphylococcus
ILLGQQFNSLLPPQEVPERT

SEQ ID NO: 2071165 - protein, 17 aa, Staphylococcus
ILLMIKAGSPTDNMINA

SEQ ID NO: 2071166 - protein, 17 aa, Staphylococcus
ILLPEAYGEAIEETKIN

SEQ ID NO: 2071167 - protein, 20 aa, Staphylococcus
ILLPTHNWGNYKLVFNTRHK

SEQ ID NO: 2071168 - protein, 21 aa, Staphylococcus
ILLQHLSERALVLGPSPAAIA

SEQ ID NO: 2071169 - protein, 17 aa, Staphylococcus
ILLQLIVQAQSAGLKVV

SEQ ID NO: 2071170 - protein, 19 aa, Staphylococcus
ILLQVLLHTSIGKKEGYMD

SEQ ID NO: 2071171 - protein, 19 aa, Staphylococcus
ILLQYVMLNNDMQLPKSYI

SEQ ID NO: 2071172 - protein, 28 aa, Staphylococcus
ILLTKKPIGVTAGIVPWNAPIMVLMRKV

SEQ ID NO: 2071173 - protein, 18 aa, Staphylococcus
ILMDWQIGIFEGGGWNAI

SEQ ID NO: 2071174 - protein, 17 aa, Staphylococcus
ILMEATFAKEHGFEILG

SEQ ID NO: 2071175 - protein, 17 aa, Staphylococcus
ILMEWQLGIYEGGGWNA

SEQ ID NO: 2071176 - protein, 17 aa, Staphylococcus
ILMMKKAFEIIKPDIVH

SEQ ID NO: 2071177 - protein, 29 aa, Staphylococcus
ILMPKTEMPPFREFAWVQDKFGVSFQLAL

SEQ ID NO: 2071178 - protein, 29 aa, Staphylococcus
ILMPKTEMPPYKQFAWVQDKYGVSFQLAQ

SEQ ID NO: 2071179 - protein, 24 aa, Staphylococcus
ILMSHQFLKLMQNVKFNKIANSDI

SEQ ID NO: 2071180 - protein, 18 aa, Staphylococcus
ILMVIRQNRKNHQLLLSI

SEQ ID NO: 2071181 - protein, 18 aa, Staphylococcus
ILNERFEQWLSPNNFDEA

SEQ ID NO: 2071182 - protein, 23 aa, Staphylococcus
ILNGTLKLLQYISHKYQFDYQVT

SEQ ID NO: 2071183 - protein, 21 aa, Staphylococcus
ILNIHPALLPKYKGIDAIGQA

SEQ ID NO: 2071184 - protein, 19 aa, Staphylococcus
ILNIHPSLLPKYKGKDAIG

SEQ ID NO: 2071185 - protein, 21 aa, Staphylococcus
ILNIHPSLLPKYKGKDAIGQA

SEQ ID NO: 2071186 - protein, 23 aa, Staphylococcus
ILNIHPSLLPKYKGKDAIGQAFN

SEQ ID NO: 2071187 - protein, 27 aa, Staphylococcus
ILNKFEVETIFDLALFTILKGHVAVEG

SEQ ID NO: 2071188 - protein, 21 aa, Staphylococcus
ILNLEMSIPLIMINGNHDSKE

SEQ ID NO: 2071189 - protein, 24 aa, Staphylococcus
ILNNTKLIYLTYPNNPTGSTATKS

SEQ ID NO: 2071190 - protein, 17 aa, Staphylococcus
ILNPAPYRDISDDILEQ

SEQ ID NO: 2071191 - protein, 25 aa, Staphylococcus
ILNTFALFNINLSWIESRPLKTELG

SEQ ID NO: 2071192 - protein, 25 aa, Staphylococcus
ILNTFALFNINLSWIESRPLKTKLG

SEQ ID NO: 2071193 - protein, 19 aa, Staphylococcus
ILNVDMAGEFYYRNIGYNE

SEQ ID NO: 2071194 - protein, 17 aa, Staphylococcus
ILNWLVTKSNEFEMEPL

SEQ ID NO: 2071195 - protein, 18 aa, Staphylococcus
ILPGGESTTLRRLMDLYG

SEQ ID NO: 2071196 - protein, 19 aa, Staphylococcus
ILPIIAKSFAPYLKEKENH

SEQ ID NO: 2071197 - protein, 32 aa, Staphylococcus
ILPKVQFNLLNSSAYYRYLSRRIGAIVETTLN

SEQ ID NO: 2071198 - protein, 18 aa, Staphylococcus
ILPPDMIIHRITGDGPID

SEQ ID NO: 2071199 - protein, 20 aa, Staphylococcus
ILQAISLLKRNLANGIAFAS

SEQ ID NO: 2071200 - protein, 34 aa, Staphylococcus
ILQATNLVPFLTIKQQFHLLKSYKKDVLSTEEYD

SEQ ID NO: 2071201 - protein, 18 aa, Staphylococcus
ILQLARQYSKILLIELKV

SEQ ID NO: 2071202 - protein, 18 aa, Staphylococcus
ILQLPHGFKGICAISFFM

SEQ ID NO: 2071203 - protein, 18 aa, Staphylococcus
ILQMLKYLYQHHWILKER

SEQ ID NO: 2071204 - protein, 21 aa, Staphylococcus
ILQPIVIRETIQGYYIVVGER

SEQ ID NO: 2071205 - protein, 22 aa, Staphylococcus
ILQPIVVRKTVQGYYIVVGERR

SEQ ID NO: 2071206 - protein, 22 aa, Staphylococcus
ILQPLYRRGKFLSIQMYNALSY

SEQ ID NO: 2071207 - protein, 20 aa, Staphylococcus
ILQRDITLSIYLPETYTNLS

SEQ ID NO: 2071208 - protein, 26 aa, Staphylococcus
ILQTFPDDFVFYGALNSLHRQIGNAV

SEQ ID NO: 2071209 - protein, 18 aa, Staphylococcus
ILQYTLRDDFVAAKPSGI

SEQ ID NO: 2071210 - protein, 17 aa, Staphylococcus
ILRHIFKSDLPTLETIK

SEQ ID NO: 2071211 - protein, 19 aa, Staphylococcus
ILRKRFRGTYGKMKRIPQN

SEQ ID NO: 2071212 - protein, 33 aa, Staphylococcus
ILRSSITQLLKPHFGHRANLINALVLLKEQEIN

SEQ ID NO: 2071213 - protein, 18 aa, Staphylococcus
ILRTFVKRPDLLERYPMT

SEQ ID NO: 2071214 - protein, 24 aa, Staphylococcus
ILRTLFNSLRFEQIQDILADEVKN

SEQ ID NO: 2071215 - protein, 18 aa, Staphylococcus
ILSFIQRQNQIALSYCDV

SEQ ID NO: 2071216 - protein, 37 aa, Staphylococcus
ILSFNQYFEAPYLFKLIVIHYLFEYLHPFYDGNGRVG

SEQ ID NO: 2071217 - protein, 25 aa, Staphylococcus
ILSGFDPIRREIARTALVNLVSDGR

SEQ ID NO: 2071218 - protein, 24 aa, Staphylococcus
ILSIAAHLLGVKRIKALDVDEMAV

SEQ ID NO: 2071219 - protein, 25 aa, Staphylococcus
ILSIASHLLGVKRIKALDIDELAVN

SEQ ID NO: 2071220 - protein, 21 aa, Staphylococcus
ILSLVATDKLVLSDVLVFIES

SEQ ID NO: 2071221 - protein, 26 aa, Staphylococcus
ILSNPVLEGFTLTKLLWIKDNEPNNW

SEQ ID NO: 2071222 - protein, 19 aa, Staphylococcus
ILTDTFALNKPAQNLFEKF

SEQ ID NO: 2071223 - protein, 17 aa, Staphylococcus
ILTELNIRLLDQRISIE

SEQ ID NO: 2071224 - protein, 17 aa, Staphylococcus
ILTLFNKNKHISLSYRN

SEQ ID NO: 2071225 - protein, 25 aa, Staphylococcus
ILTRFIKEYTGLPAERVIGSGTVLD

SEQ ID NO: 2071226 - protein, 26 aa, Staphylococcus
ILTTEYYWHWDLKNSKLDVYEYKKLM

SEQ ID NO: 2071227 - protein, 17 aa, Staphylococcus
ILTVLHAGGKFGGGGYK

SEQ ID NO: 2071228 - protein, 26 aa, Staphylococcus
ILTVQSIPMAIKYYKIFKQLKDAGQH

SEQ ID NO: 2071229 - protein, 17 aa, Staphylococcus
ILVAFDLYGGTFRLFDF

SEQ ID NO: 2071230 - protein, 17 aa, Staphylococcus
ILVAFDLYGGTFRLFDY

SEQ ID NO: 2071231 - protein, 17 aa, Staphylococcus
ILVGDTIQFVLTKQLES

SEQ ID NO: 2071232 - protein, 17 aa, Staphylococcus
ILVKGNVPGPKKGFVEI

SEQ ID NO: 2071233 - protein, 17 aa, Staphylococcus
ILVKGNVPGPKKGLVEI

SEQ ID NO: 2071234 - protein, 18 aa, Staphylococcus
ILVKGNVPGPKKGLVEIT

SEQ ID NO: 2071235 - protein, 19 aa, Staphylococcus
ILVQVPLPDQVSEQKVLES

SEQ ID NO: 2071236 - protein, 20 aa, Staphylococcus
ILVQVPLPEQVSEQKVLESI

SEQ ID NO: 2071237 - protein, 19 aa, Staphylococcus
ILVQVPLPKQVSEQKILEA

SEQ ID NO: 2071238 - protein, 20 aa, Staphylococcus
ILVQVPLPKQVSEQKILEAI

SEQ ID NO: 2071239 - protein, 18 aa, Staphylococcus
ILVSIMFVNNEIGTVEPM

SEQ ID NO: 2071240 - protein, 18 aa, Staphylococcus
ILVSIMFVNNEVGTVEPI

SEQ ID NO: 2071241 - protein, 22 aa, Staphylococcus
ILVSSASFLAAGMSGLCNHWLS

SEQ ID NO: 2071242 - protein, 17 aa, Staphylococcus
ILVTPHIAFFSDEAVRN

SEQ ID NO: 2071243 - protein, 18 aa, Staphylococcus
ILVYKKWQESILLAYLIN

SEQ ID NO: 2071244 - protein, 27 aa, Staphylococcus
ILYGHMSPYMIVGMLGAIKAGCGYVPI

SEQ ID NO: 2071245 - protein, 22 aa, Staphylococcus
ILYIHQALPFQNKLWELSNNPI

SEQ ID NO: 2071246 - protein, 35 aa, Staphylococcus
ILYKNYEDILNNKFLFFIDFIPKKTNVYDISPINK

SEQ ID NO: 2071247 - protein, 18 aa, Staphylococcus
ILYLEGFNFEDKKANFYP

SEQ ID NO: 2071248 - protein, 17 aa, Staphylococcus
ILYLIVELSHFENTDHP

SEQ ID NO: 2071249 - protein, 17 aa, Staphylococcus
ILYQIWKKKHKKANYKW

SEQ ID NO: 2071250 - protein, 21 aa, Staphylococcus
ILYRSHDLLSWDYIGPVDMSN

SEQ ID NO: 2071251 - protein, 17 aa, Staphylococcus
ILYSTRAGVAYMATGGM

SEQ ID NO: 2071252 - protein, 31 aa, Staphylococcus
IMAIYVQTVASYIFKHILLEVYKAQCEKKTF

SEQ ID NO: 2071253 - protein, 24 aa, Staphylococcus
IMASLHFDVPCLFAKKAKPSTLKD

SEQ ID NO: 2071254 - protein, 17 aa, Staphylococcus
IMAYQRIKTRTSFNTPK

SEQ ID NO: 2071255 - protein, 17 aa, Staphylococcus
IMDLLQYDSGSISILGD

SEQ ID NO: 2071256 - protein, 29 aa, Staphylococcus
IMDMLKDLKTPVFLVLNKIDLVHPDALMP

SEQ ID NO: 2071257 - protein, 23 aa, Staphylococcus
IMDNALTLAVPLLVDSSYGATWY

SEQ ID NO: 2071258 - protein, 29 aa, Staphylococcus
IMDQIDDGLFIITGHYRNGILLSPIIGQD

SEQ ID NO: 2071259 - protein, 24 aa, Staphylococcus
IMEDEMVYIYKKSLQPRMDICFVR

SEQ ID NO: 2071260 - protein, 28 aa, Staphylococcus
IMEDKKYMAALSFLTFVALDDNGKPKQV

SEQ ID NO: 2071261 - protein, 22 aa, Staphylococcus
IMEEEIFGPILPIIEYDDFNEA

SEQ ID NO: 2071262 - protein, 20 aa, Staphylococcus
IMEHALQLDVPLKVDSNYGS

SEQ ID NO: 2071263 - protein, 17 aa, Staphylococcus
IMFEFNIGKVPMKQIKT

SEQ ID NO: 2071264 - protein, 17 aa, Staphylococcus
IMFIIGQAMSKNQELNN

SEQ ID NO: 2071265 - protein, 18 aa, Staphylococcus
IMFYDYIDKDHPLTPLPD

SEQ ID NO: 2071266 - protein, 18 aa, Staphylococcus
IMGPIFAPIVNDARSARA

SEQ ID NO: 2071267 - protein, 20 aa, Staphylococcus
IMIQQSQLSYLLADSSKRDA

SEQ ID NO: 2071268 - protein, 34 aa, Staphylococcus
IMKEEPIKLLALITSNFRLYYQCKILANKGYSQQ

SEQ ID NO: 2071269 - protein, 36 aa, Staphylococcus
IMKEEPIKLLALITSNYRLYYQCKILAQKGYSGQQI

SEQ ID NO: 2071270 - protein, 35 aa, Staphylococcus
IMKEEPIKLLALITSNYRLYYQCKILSQKGYSAQQ

SEQ ID NO: 2071271 - protein, 25 aa, Staphylococcus
IMKTIQLFERIPDALEYYQNKFQYI

SEQ ID NO: 2071272 - protein, 18 aa, Staphylococcus
IMLPLSVQKLSAAEMEQN

SEQ ID NO: 2071273 - protein, 26 aa, Staphylococcus
IMMPRAIATYELYIAALKLGIAIIPS

SEQ ID NO: 2071274 - protein, 27 aa, Staphylococcus
IMMPRAIATYELYIAALKLGIAIIPSS

SEQ ID NO: 2071275 - protein, 28 aa, Staphylococcus
IMMPRAIITYELYIAALKLGIAIIPSSE

SEQ ID NO: 2071276 - protein, 31 aa, Staphylococcus
IMMPRAIMTYELYLAALKLGIAIIPSSEMLR

SEQ ID NO: 2071277 - protein, 24 aa, Staphylococcus
IMNNHSILLYPLNIEDLYDIEDWI

SEQ ID NO: 2071278 - protein, 26 aa, Staphylococcus
IMNNHSILLYPLNIESLFPIEDWIVA

SEQ ID NO: 2071279 - protein, 18 aa, Staphylococcus
IMNWIEQQTGRFSNLSVL

SEQ ID NO: 2071280 - protein, 19 aa, Staphylococcus
IMPLSFELYINFLNEMFQS

SEQ ID NO: 2071281 - protein, 25 aa, Staphylococcus
IMPNMTKGQALKRLLKKWEMSPSEL

SEQ ID NO: 2071282 - protein, 24 aa, Staphylococcus
IMQAIIYDVIGYEVKPLFITEDEL

SEQ ID NO: 2071283 - protein, 22 aa, Staphylococcus
IMQDEIFGPILPIITYDDFNEA

SEQ ID NO: 2071284 - protein, 22 aa, Staphylococcus
IMQEEIFGPLLPIISYDQFDEA

SEQ ID NO: 2071285 - protein, 17 aa, Staphylococcus
IMQKGEFVILIEGAKPL

SEQ ID NO: 2071286 - protein, 18 aa, Staphylococcus
IMQYSLDIFLAFKTDKSD

SEQ ID NO: 2071287 - protein, 26 aa, Staphylococcus
IMRAKRIILLAFGEKKIDAIQRLAAG

SEQ ID NO: 2071288 - protein, 24 aa, Staphylococcus
IMRFRYWECPIGCYEWQDIADYFG

SEQ ID NO: 2071289 - protein, 19 aa, Staphylococcus
IMRLHYEGILQERLDELGE

SEQ ID NO: 2071290 - protein, 25 aa, Staphylococcus
IMSAKRIILLAFGEKKKDAITKLAS

SEQ ID NO: 2071291 - protein, 18 aa, Staphylococcus
IMSELKINLLEFRKEMDL

SEQ ID NO: 2071292 - protein, 18 aa, Staphylococcus
IMSIVREAKFLIADEPTS

SEQ ID NO: 2071293 - protein, 28 aa, Staphylococcus
IMSKEEIMYIYLNIVPFGRDYNGDNITG

SEQ ID NO: 2071294 - protein, 19 aa, Staphylococcus
IMSTPYRKSDAGLSGRLEV

SEQ ID NO: 2071295 - protein, 23 aa, Staphylococcus
IMTEIPFEFFKKHTHFDLPNEGE

SEQ ID NO: 2071296 - protein, 33 aa, Staphylococcus
IMTEIPFKFFEQLHDLPLPKEGEYAVGLFFSKE

SEQ ID NO: 2071297 - protein, 23 aa, Staphylococcus
IMTFKQIYELWLEQYRNTVKEST

SEQ ID NO: 2071298 - protein, 17 aa, Staphylococcus
IMTLFREINDNTQTILM

SEQ ID NO: 2071299 - protein, 17 aa, Staphylococcus
IMTMLDAKDIDSLTHKD

SEQ ID NO: 2071300 - protein, 20 aa, Staphylococcus
IMTTTKYKWLGSLIKVIPRQ

SEQ ID NO: 2071301 - protein, 17 aa, Staphylococcus
IMVHPHLLRHTHATIFY

SEQ ID NO: 2071302 - protein, 17 aa, Staphylococcus
IMWDERLSTMAAEKSLL

SEQ ID NO: 2071303 - protein, 26 aa, Staphylococcus
INAAKALAFAYDKPIIPVHHIAGHIY

SEQ ID NO: 2071304 - protein, 26 aa, Staphylococcus
INAAKALAFAYDKPLIPVHHIAGHVY

SEQ ID NO: 2071305 - protein, 26 aa, Staphylococcus
INAAKALAFAYDKPLVPVHHIAGHIY

SEQ ID NO: 2071306 - protein, 25 aa, Staphylococcus
INAAKALAFAYNKPVIPVHHIAGHI

SEQ ID NO: 2071307 - protein, 18 aa, Staphylococcus
INAFIERDTLRGYLNQVY

SEQ ID NO: 2071308 - protein, 24 aa, Staphylococcus
INAGRHLIDILKGTDTRAIIVGGA

SEQ ID NO: 2071309 - protein, 17 aa, Staphylococcus
INAMKRNDLVFGIGPAG

SEQ ID NO: 2071310 - protein, 19 aa, Staphylococcus
INAQILILGVIPLEDINKA

SEQ ID NO: 2071311 - protein, 31 aa, Staphylococcus
INCDFSSSIFVNINFFKTLMSKVNYSVTTFD

SEQ ID NO: 2071312 - protein, 18 aa, Staphylococcus
INCLKQLIELHPILKSRF

SEQ ID NO: 2071313 - protein, 23 aa, Staphylococcus
INDALLTYPTGFEVLKKLNKVLE

SEQ ID NO: 2071314 - protein, 24 aa, Staphylococcus
INDDYVFTRLKTMGKLAMLMLEDL

SEQ ID NO: 2071315 - protein, 22 aa, Staphylococcus
INDFKVIFPEYNVIGIGELIEG

SEQ ID NO: 2071316 - protein, 24 aa, Staphylococcus
INDGDAVIFFNFRPDRAAQLSEVF

SEQ ID NO: 2071317 - protein, 25 aa, Staphylococcus
INDIKLAIINLQGRSFMPVIDDPFK

SEQ ID NO: 2071318 - protein, 23 aa, Staphylococcus
INDKISILLEDDSIRQLSASMLS

SEQ ID NO: 2071319 - protein, 17 aa, Staphylococcus
INDLFYATFTKYNDNVN

SEQ ID NO: 2071320 - protein, 25 aa, Staphylococcus
INDNERTLYDWACKQTYIALGNMMT

SEQ ID NO: 2071321 - protein, 19 aa, Staphylococcus
INDNWAIIGSTAWYDYSYA

SEQ ID NO: 2071322 - protein, 25 aa, Staphylococcus
INDQPLFNFVPLTIGDTGLLTQWTM

SEQ ID NO: 2071323 - protein, 24 aa, Staphylococcus
INDQPLYKYAPLTLGDTGLLTQWT

SEQ ID NO: 2071324 - protein, 23 aa, Staphylococcus
INDQPLYNYAPLTLGDTGLLTQW

SEQ ID NO: 2071325 - protein, 37 aa, Staphylococcus
INDTTFYPFFSKREGQKYYIIWHGTPLKNMGKDMEVV

SEQ ID NO: 2071326 - protein, 23 aa, Staphylococcus
INDVADIFYLTEDDLLPLERMGS

SEQ ID NO: 2071327 - protein, 24 aa, Staphylococcus
INDVKTIIFTPFEGHKWSTRLWSD

SEQ ID NO: 2071328 - protein, 25 aa, Staphylococcus
INDVQIGSYILLDDGLVELQVKDID

SEQ ID NO: 2071329 - protein, 19 aa, Staphylococcus
INDYAYQQNIPWIYGGVVQ

SEQ ID NO: 2071330 - protein, 18 aa, Staphylococcus
INDYQFLTFNVIGSPFGS

SEQ ID NO: 2071331 - protein, 18 aa, Staphylococcus
INDYQFLTFNVIGSPYGS

SEQ ID NO: 2071332 - protein, 24 aa, Staphylococcus
INEAELVILIKLLHASESSNKQPS

SEQ ID NO: 2071333 - protein, 25 aa, Staphylococcus
INEDVAMAFGFFDGMHKGHLKVFET

SEQ ID NO: 2071334 - protein, 24 aa, Staphylococcus
INEEALINYIYKNLSFVFNETVSN

SEQ ID NO: 2071335 - protein, 26 aa, Staphylococcus
INEELGITILINLHFVDLAKEYGSRI

SEQ ID NO: 2071336 - protein, 18 aa, Staphylococcus
INEFDTWTDIFKALLHAV

SEQ ID NO: 2071337 - protein, 24 aa, Staphylococcus
INEFKNLTFLSRQLTPGLKKVDID

SEQ ID NO: 2071338 - protein, 20 aa, Staphylococcus
INEIYGKYFSNHQPARSCVE

SEQ ID NO: 2071339 - protein, 31 aa, Staphylococcus
INEKFARPFSYNFYKAIDHLKRTINAGVTTV

SEQ ID NO: 2071340 - protein, 23 aa, Staphylococcus
INEKILAFLKQNKQDILKLLLKH

SEQ ID NO: 2071341 - protein, 23 aa, Staphylococcus
INEKKVIPIRRKSNHPSIPVQKD

SEQ ID NO: 2071342 - protein, 17 aa, Staphylococcus
INELFQFVFNDYYDIDL

SEQ ID NO: 2071343 - protein, 19 aa, Staphylococcus
INELLPIFQNIIHMVDEHF

SEQ ID NO: 2071344 - protein, 23 aa, Staphylococcus
INELRRLVCRPIGVNLEPVDKTA

SEQ ID NO: 2071345 - protein, 23 aa, Staphylococcus
INELSVLFDYMKINDYKKLANDT

SEQ ID NO: 2071346 - protein, 34 aa, Staphylococcus
INELYNGWYGANLFLPFAIAIKYYSIDQLIDAYK

SEQ ID NO: 2071347 - protein, 24 aa, Staphylococcus
INENVAMAFGFFDGMHKGHDKVFQ

SEQ ID NO: 2071348 - protein, 25 aa, Staphylococcus
INENVAMAFGFFDGMHRGHDKVFQA

SEQ ID NO: 2071349 - protein, 18 aa, Staphylococcus
INEPFMYRLVDIVADIME

SEQ ID NO: 2071350 - protein, 20 aa, Staphylococcus
INEPTAAALAYGLDKTEKDQ

SEQ ID NO: 2071351 - protein, 18 aa, Staphylococcus
INEPTAAALAYGLDKTEQ

SEQ ID NO: 2071352 - protein, 20 aa, Staphylococcus
INEQFQISKQFWAYLVRTGH

SEQ ID NO: 2071353 - protein, 17 aa, Staphylococcus
INEQRPHILSADKEKLL

SEQ ID NO: 2071354 - protein, 22 aa, Staphylococcus
INERCHHFMGYRQMKTLASELI

SEQ ID NO: 2071355 - protein, 22 aa, Staphylococcus
INESHWYYRATSKGIYLSLGAV

SEQ ID NO: 2071356 - protein, 25 aa, Staphylococcus
INESPNEPYLPFGGYKQSGIGREWG

SEQ ID NO: 2071357 - protein, 21 aa, Staphylococcus
INEVIAFKVIKVKKNFAIGKL

SEQ ID NO: 2071358 - protein, 25 aa, Staphylococcus
INFCHKRLMYIDKAPNTVHQWIAQL

SEQ ID NO: 2071359 - protein, 23 aa, Staphylococcus
INFDGLLRKLLAEPTINMLFNAI

SEQ ID NO: 2071360 - protein, 19 aa, Staphylococcus
INFFKSHLAKYKIPKAFHQ

SEQ ID NO: 2071361 - protein, 18 aa, Staphylococcus
INGDFENITFPSDFKVFG

SEQ ID NO: 2071362 - protein, 26 aa, Staphylococcus
INGKDAFKLYDTYGFPIELTEEIADN

SEQ ID NO: 2071363 - protein, 26 aa, Staphylococcus
INGKDAFKLYDTYGFPIELTEELATQ

SEQ ID NO: 2071364 - protein, 19 aa, Staphylococcus
INGKRYPIKALMMSHMFVA

SEQ ID NO: 2071365 - protein, 18 aa, Staphylococcus
INGKYYDHFLTPQYGNHN

SEQ ID NO: 2071366 - protein, 19 aa, Staphylococcus
INGLPLVQIELKRSGVAIT

SEQ ID NO: 2071367 - protein, 28 aa, Staphylococcus
INGNKKYYFKILISSVNEFKFTKEVGYN

SEQ ID NO: 2071368 - protein, 18 aa, Staphylococcus
INGVLPPVIYQVASIQVS

SEQ ID NO: 2071369 - protein, 22 aa, Staphylococcus
INGVQFFALPFATISEVQHFFE

SEQ ID NO: 2071370 - protein, 17 aa, Staphylococcus
INHALELGAQKIILGIG

SEQ ID NO: 2071371 - protein, 24 aa, Staphylococcus
INHFKPQTYYTMKLNAAGLTFHCT

SEQ ID NO: 2071372 - protein, 25 aa, Staphylococcus
INHKGHRLIQLPDKWYKGIVMPTIQ

SEQ ID NO: 2071373 - protein, 25 aa, Staphylococcus
INIERNLINYLAGKIGYKIKPAGGV

SEQ ID NO: 2071374 - protein, 26 aa, Staphylococcus
INIERNLINYLVGKIGYEIKPAGGVF

SEQ ID NO: 2071375 - protein, 17 aa, Staphylococcus
INIFDNQIYDKGVKAKE

SEQ ID NO: 2071376 - protein, 17 aa, Staphylococcus
INILSQNFTLISASYRL

SEQ ID NO: 2071377 - protein, 24 aa, Staphylococcus
INIPKVDIILTIPPYELRTEDARR

SEQ ID NO: 2071378 - protein, 23 aa, Staphylococcus
INISQTEVLVWALGYNRTIEELI

SEQ ID NO: 2071379 - protein, 22 aa, Staphylococcus
INKAAKFLVSLYNVFIEKDCSI

SEQ ID NO: 2071380 - protein, 17 aa, Staphylococcus
INKHEIISWEGKLRPSL

SEQ ID NO: 2071381 - protein, 18 aa, Staphylococcus
INKHHLNFDLLVDKDYEL

SEQ ID NO: 2071382 - protein, 36 aa, Staphylococcus
INKISKYTFFLTTFYYTLLHITGEDYFRLGIPFSTR

SEQ ID NO: 2071383 - protein, 23 aa, Staphylococcus
INKKMRWLSRRFTDLFEELFKTK

SEQ ID NO: 2071384 - protein, 24 aa, Staphylococcus
INKLPYSIRVLLESVLRQEDGFVI

SEQ ID NO: 2071385 - protein, 23 aa, Staphylococcus
INKPLKAIILTHAHFDHIGALDE

SEQ ID NO: 2071386 - protein, 29 aa, Staphylococcus
INKRDIQFDFIFLDPPYNKGLIDKALDQI

SEQ ID NO: 2071387 - protein, 23 aa, Staphylococcus
INKVDIIMLLRVQHERHGITDEA

SEQ ID NO: 2071388 - protein, 21 aa, Staphylococcus
INKYTTLIKYLRNEDYIAFGN

SEQ ID NO: 2071389 - protein, 20 aa, Staphylococcus
INLACRLIQSRAGSIYLAGG

SEQ ID NO: 2071390 - protein, 26 aa, Staphylococcus
INLDIRAQYGINIIAIKRAKEFIVSP

SEQ ID NO: 2071391 - protein, 24 aa, Staphylococcus
INLETPITIDVLPKAINILTFSND

SEQ ID NO: 2071392 - protein, 17 aa, Staphylococcus
INLIMGFVRVFGKGNKE

SEQ ID NO: 2071393 - protein, 18 aa, Staphylococcus
INLLKWVHHHIAYFGGNP

SEQ ID NO: 2071394 - protein, 17 aa, Staphylococcus
INLLNQSRFIFLSPEFI

SEQ ID NO: 2071395 - protein, 33 aa, Staphylococcus
INLMLRPEAPFKKALLYAPLYPVDVTLTRDMSN

SEQ ID NO: 2071396 - protein, 24 aa, Staphylococcus
INLNIEFIAPMRTFYLLARECLIS

SEQ ID NO: 2071397 - protein, 29 aa, Staphylococcus
INLPNKEFQLLFLLVSNPKHIFTRNDIIE

SEQ ID NO: 2071398 - protein, 27 aa, Staphylococcus
INLTEVYNLIVYQLGALEGFCKVHQTR

SEQ ID NO: 2071399 - protein, 22 aa, Staphylococcus
INLTMQDIYQYKSIRHLAEVFE

SEQ ID NO: 2071400 - protein, 20 aa, Staphylococcus
INMDKPFKKLTDRQQNILLN

SEQ ID NO: 2071401 - protein, 31 aa, Staphylococcus
INMIKGILGKIPFFGICLGHQLFALSQGASS

SEQ ID NO: 2071402 - protein, 19 aa, Staphylococcus
INMIRQIKSYLPETFVIAG

SEQ ID NO: 2071403 - protein, 22 aa, Staphylococcus
INNIAVKAVFFNQPYLKKKINL

SEQ ID NO: 2071404 - protein, 27 aa, Staphylococcus
INNLKEFIQEFLDRCRIAKMISRYMIT

SEQ ID NO: 2071405 - protein, 24 aa, Staphylococcus
INNLVDLPFGDCHFALAAKPETSS

SEQ ID NO: 2071406 - protein, 18 aa, Staphylococcus
INNMIQGVKEGYQKTLEL

SEQ ID NO: 2071407 - protein, 22 aa, Staphylococcus
INNNITPVYKMVDTCAAEFEST

SEQ ID NO: 2071408 - protein, 20 aa, Staphylococcus
INNQILELLSKRGELAQKIG

SEQ ID NO: 2071409 - protein, 18 aa, Staphylococcus
INPDWRDKFFEEREGRYF

SEQ ID NO: 2071410 - protein, 17 aa, Staphylococcus
INPKPLQIKDAERYRLT

SEQ ID NO: 2071411 - protein, 27 aa, Staphylococcus
INPKYKKAFRNMIALDREVMIMFKQKD

SEQ ID NO: 2071412 - protein, 18 aa, Staphylococcus
INPNIQGQLFKLLEFSNM

SEQ ID NO: 2071413 - protein, 18 aa, Staphylococcus
INQALSYRKSKLLLLDIA

SEQ ID NO: 2071414 - protein, 23 aa, Staphylococcus
INQKNIPYTLFSSKKELGEYVGI

SEQ ID NO: 2071415 - protein, 23 aa, Staphylococcus
INQKVFDAFYKSLKGKQILVYSG

SEQ ID NO: 2071416 - protein, 22 aa, Staphylococcus
INQLGYPFIVKTRFGGYDGKGQ

SEQ ID NO: 2071417 - protein, 25 aa, Staphylococcus
INQLNQFEFPGKLLKLHNGGKHHQF

SEQ ID NO: 2071418 - protein, 24 aa, Staphylococcus
INQLSIQPTHLLIDAMKLDNDIPQ

SEQ ID NO: 2071419 - protein, 28 aa, Staphylococcus
INQPSTDTGWIPLPLVNGAAPDVYSDVY

SEQ ID NO: 2071420 - protein, 19 aa, Staphylococcus
INQRLVRLITVGLGNLKTL

SEQ ID NO: 2071421 - protein, 26 aa, Staphylococcus
INQVEFHPYLLQESLRRYLEVQNIHM

SEQ ID NO: 2071422 - protein, 25 aa, Staphylococcus
INQVIKKIYKNQFTISFVGHFSAGK

SEQ ID NO: 2071423 - protein, 24 aa, Staphylococcus
INQVIKKVYLNQFTISFVGHFSAG

SEQ ID NO: 2071424 - protein, 17 aa, Staphylococcus
INRAKRALARAENRLRV

SEQ ID NO: 2071425 - protein, 23 aa, Staphylococcus
INRDEVIYRFISSLPQRHVVPDE

SEQ ID NO: 2071426 - protein, 18 aa, Staphylococcus
INRDPMCLYNSGDYIKFY

SEQ ID NO: 2071427 - protein, 20 aa, Staphylococcus
INREYRFQILVKYKSEPELH

SEQ ID NO: 2071428 - protein, 28 aa, Staphylococcus
INRLIPLSEGYIYFKDKPISDYPVYEMR

SEQ ID NO: 2071429 - protein, 35 aa, Staphylococcus
INRLNLFKENKYPSKVILLAWNRYLTDTASNYLMH

SEQ ID NO: 2071430 - protein, 31 aa, Staphylococcus
INRSTFYRYFQDKYDLLFSLPDYIATQFHHE

SEQ ID NO: 2071431 - protein, 34 aa, Staphylococcus
INRYEFLKLLLENIKNRYMQFLTVPFESIREEYI

SEQ ID NO: 2071432 - protein, 27 aa, Staphylococcus
INSKPPILLTPLFPTYFFPTHSDRQEE

SEQ ID NO: 2071433 - protein, 19 aa, Staphylococcus
INSKYLIATTAAKRARELD

SEQ ID NO: 2071434 - protein, 29 aa, Staphylococcus
INSLPEEIIPIIWIAFKTGLRISDVLTLK

SEQ ID NO: 2071435 - protein, 24 aa, Staphylococcus
INSPFDTDYGWNVKLGKNVFVNSN

SEQ ID NO: 2071436 - protein, 22 aa, Staphylococcus
INSPFLYVYPDIGNISAWNNNL

SEQ ID NO: 2071437 - protein, 24 aa, Staphylococcus
INSPTFNIIKSYKGTHLKLHHMDC

SEQ ID NO: 2071438 - protein, 35 aa, Staphylococcus
INSQIATHFLLDLVSYILLGDPYMHKLYQQTRQVV

SEQ ID NO: 2071439 - protein, 24 aa, Staphylococcus
INSTQEVLLPESFYRGAHQHIFRA

SEQ ID NO: 2071440 - protein, 28 aa, Staphylococcus
INSVEYPYFDLEWLLNQERFELFLGRTD

SEQ ID NO: 2071441 - protein, 19 aa, Staphylococcus
INSYKRFAPNSWAPVSIAW

SEQ ID NO: 2071442 - protein, 26 aa, Staphylococcus
INSYPDLEFYFFKKAVDIPTELKNEL

SEQ ID NO: 2071443 - protein, 17 aa, Staphylococcus
INTISNYKPLKSSYIPF

SEQ ID NO: 2071444 - protein, 24 aa, Staphylococcus
INTNPKFKAITFLTSKNASISFPQ

SEQ ID NO: 2071445 - protein, 23 aa, Staphylococcus
INTRVDIMLERGLLSEVKQLVEN

SEQ ID NO: 2071446 - protein, 26 aa, Staphylococcus
INTRVIIVTTFKRPGYFEKAVANDVD

SEQ ID NO: 2071447 - protein, 20 aa, Staphylococcus
INTSFFKRLFEKALAEREYY

SEQ ID NO: 2071448 - protein, 30 aa, Staphylococcus
INVFSENLRNLLLQPPMKGKQILGVDPAFR

SEQ ID NO: 2071449 - protein, 23 aa, Staphylococcus
INVHASLLPKYRGGAPIHQAIID

SEQ ID NO: 2071450 - protein, 20 aa, Staphylococcus
INVKNWKQKTFYHFTADTTN

SEQ ID NO: 2071451 - protein, 33 aa, Staphylococcus
INYAKKYYKLLYDPTLPVTPIPRTKPQAKFITR

SEQ ID NO: 2071452 - protein, 32 aa, Staphylococcus
INYDTLTHAIYKKLLVYMKFKSGLDVSTQQLA

SEQ ID NO: 2071453 - protein, 24 aa, Staphylococcus
INYEPSMQYFNEWWKQLFGESEGK

SEQ ID NO: 2071454 - protein, 26 aa, Staphylococcus
INYEPSMQYFNEWWKQLFGESEGKDF

SEQ ID NO: 2071455 - protein, 25 aa, Staphylococcus
INYEPSMQYFNEWWKQLYGESEGKD

SEQ ID NO: 2071456 - protein, 19 aa, Staphylococcus
INYIIHYADQKNLETILTS

SEQ ID NO: 2071457 - protein, 25 aa, Staphylococcus
IPAAMRIFEYVMKPSQLDMKVLVED

SEQ ID NO: 2071458 - protein, 27 aa, Staphylococcus
IPCKPDHPFVYWATFSNAADLLDSGVK

SEQ ID NO: 2071459 - protein, 17 aa, Staphylococcus
IPDFWEDVHTMKLDERL

SEQ ID NO: 2071460 - protein, 17 aa, Staphylococcus
IPDFWEDVTSMGLDCRL

SEQ ID NO: 2071461 - protein, 20 aa, Staphylococcus
IPDLIDKMYRRFSILTTISN

SEQ ID NO: 2071462 - protein, 25 aa, Staphylococcus
IPDMPDHPFVYWATYYHAAELLDAG

SEQ ID NO: 2071463 - protein, 17 aa, Staphylococcus
IPEALVPFMGGKTKISK

SEQ ID NO: 2071464 - protein, 25 aa, Staphylococcus
IPEATYLAWVDLSYYIKAKHIDEPI

SEQ ID NO: 2071465 - protein, 24 aa, Staphylococcus
IPEATYLAWVDLSYYIKEKDIDES

SEQ ID NO: 2071466 - protein, 27 aa, Staphylococcus
IPEDDYAKIYLFTPNLEKITTFRDELI

SEQ ID NO: 2071467 - protein, 26 aa, Staphylococcus
IPEDWGGETIFVPLSALSGEGIDDLL

SEQ ID NO: 2071468 - protein, 18 aa, Staphylococcus
IPEIGKTLTLQQFPEDIQ

SEQ ID NO: 2071469 - protein, 18 aa, Staphylococcus
IPERWSIAQLYQSALDQE

SEQ ID NO: 2071470 - protein, 19 aa, Staphylococcus
IPERWSIAQLYQSALEDAP

SEQ ID NO: 2071471 - protein, 19 aa, Staphylococcus
IPETIFSSQQGLLDIGLDL

SEQ ID NO: 2071472 - protein, 28 aa, Staphylococcus
IPETKFSKIYMFTPDLEKITAFREHLID

SEQ ID NO: 2071473 - protein, 21 aa, Staphylococcus
IPFCVRICTYCDFNKYFIAKQ

SEQ ID NO: 2071474 - protein, 17 aa, Staphylococcus
IPFNIGCGDCFYCNNHM

SEQ ID NO: 2071475 - protein, 17 aa, Staphylococcus
IPGFFGISKQNYIVTFP

SEQ ID NO: 2071476 - protein, 21 aa, Staphylococcus
IPGHFAPIADFDLITKAKKAA

SEQ ID NO: 2071477 - protein, 20 aa, Staphylococcus
IPGHFAPIADFDLVTKAKQA

SEQ ID NO: 2071478 - protein, 19 aa, Staphylococcus
IPGTELRGPIFKGLPTIEV

SEQ ID NO: 2071479 - protein, 19 aa, Staphylococcus
IPHGHAIMFGIIYQFIVAN

SEQ ID NO: 2071480 - protein, 32 aa, Staphylococcus
IPHMKDDLILRPLILITILNESLGMQSTQNDL

SEQ ID NO: 2071481 - protein, 25 aa, Staphylococcus
IPHYDELIIFYIKALIGLNQNYEAI

SEQ ID NO: 2071482 - protein, 20 aa, Staphylococcus
IPIEASLINKPTLFYVYDEK

SEQ ID NO: 2071483 - protein, 28 aa, Staphylococcus
IPIHKLTALCEFLNISPSYIFKHNNVTE

SEQ ID NO: 2071484 - protein, 19 aa, Staphylococcus
IPIKALTAHLGFGNYELRL

SEQ ID NO: 2071485 - protein, 19 aa, Staphylococcus
IPIKALTSHLGFGNYELRL

SEQ ID NO: 2071486 - protein, 18 aa, Staphylococcus
IPIWLATGGTPESSIRAA

SEQ ID NO: 2071487 - protein, 25 aa, Staphylococcus
IPKCTPLTEGYIYVASLYSVTQTDF

SEQ ID NO: 2071488 - protein, 22 aa, Staphylococcus
IPKDFLSFKYILPSQRQNFNLL

SEQ ID NO: 2071489 - protein, 21 aa, Staphylococcus
IPKSLHPFLNKYLENPEFVEI

SEQ ID NO: 2071490 - protein, 21 aa, Staphylococcus
IPKSLHPFLNKYLNQPELIEV

SEQ ID NO: 2071491 - protein, 20 aa, Staphylococcus
IPLPTFTSLRKVSVKIPISL

SEQ ID NO: 2071492 - protein, 17 aa, Staphylococcus
IPLTIITESVFARFISS

SEQ ID NO: 2071493 - protein, 20 aa, Staphylococcus
IPLTIITESVFARFISSIKA

SEQ ID NO: 2071494 - protein, 17 aa, Staphylococcus
IPLVVRTVHGAGASAAA

SEQ ID NO: 2071495 - protein, 20 aa, Staphylococcus
IPMAIKYYKIFKEMKEEGLH

SEQ ID NO: 2071496 - protein, 24 aa, Staphylococcus
IPMDQKFIFNPYETKSIAGFDIES

SEQ ID NO: 2071497 - protein, 25 aa, Staphylococcus
IPMDQKFIFNPYETKSLAGFDIESF

SEQ ID NO: 2071498 - protein, 24 aa, Staphylococcus
IPMDQKFIFNPYETQSIAGFDIES

SEQ ID NO: 2071499 - protein, 25 aa, Staphylococcus
IPMEQKFIFNPYETKSIAGFDIESF

SEQ ID NO: 2071500 - protein, 27 aa, Staphylococcus
IPNDAYSKIYLFNKKLNKIKTFRDELI

SEQ ID NO: 2071501 - protein, 24 aa, Staphylococcus
IPNKVVEYIAFDMGALGDGQTSDE

SEQ ID NO: 2071502 - protein, 29 aa, Staphylococcus
IPNSGLVDRFYFEALYARIGHILLEISTD

SEQ ID NO: 2071503 - protein, 25 aa, Staphylococcus
IPNTFVPARNLLFLSFAGALAYQTN

SEQ ID NO: 2071504 - protein, 18 aa, Staphylococcus
IPPFIAVPGLGENVAKRI

SEQ ID NO: 2071505 - protein, 19 aa, Staphylococcus
IPPTIISRAQRFDFKAINS

SEQ ID NO: 2071506 - protein, 19 aa, Staphylococcus
IPPTIISRAQRFDFKAISM

SEQ ID NO: 2071507 - protein, 19 aa, Staphylococcus
IPQMLYRDFGRINELRIGE

SEQ ID NO: 2071508 - protein, 21 aa, Staphylococcus
IPREDLFITSKLWNDYQGYDR

SEQ ID NO: 2071509 - protein, 30 aa, Staphylococcus
IPREKRIVISLTYVYGIGTSTAKKIVEEAN

SEQ ID NO: 2071510 - protein, 27 aa, Staphylococcus
IPREKRIVISLTYVYGIGTSTANKIVE

SEQ ID NO: 2071511 - protein, 27 aa, Staphylococcus
IPREKRIVISLTYVYGIGTTTANKIAE

SEQ ID NO: 2071512 - protein, 27 aa, Staphylococcus
IPREKRVVISLTYIYGIGTSTAQKIVE

SEQ ID NO: 2071513 - protein, 26 aa, Staphylococcus
IPREKRVVISLTYIYGVGKSTAAKIL

SEQ ID NO: 2071514 - protein, 18 aa, Staphylococcus
IPREVLIDAIEAALITAY

SEQ ID NO: 2071515 - protein, 20 aa, Staphylococcus
IPREYLNARIPKGRGMVKWQ

SEQ ID NO: 2071516 - protein, 24 aa, Staphylococcus
IPREYLNPRIPQGRGMVKWQPFKT

SEQ ID NO: 2071517 - protein, 19 aa, Staphylococcus
IPRIVHEAFYLANSGRKGP

SEQ ID NO: 2071518 - protein, 19 aa, Staphylococcus
IPRIVHEAFYLANTGRKGP

SEQ ID NO: 2071519 - protein, 17 aa, Staphylococcus
IPRLRDKFYDLTVNTEP

SEQ ID NO: 2071520 - protein, 17 aa, Staphylococcus
IPSFLVFKDGDMLGSYI

SEQ ID NO: 2071521 - protein, 17 aa, Staphylococcus
IPSFLVYKNGELMGSYI

SEQ ID NO: 2071522 - protein, 19 aa, Staphylococcus
IPSFLVYKNGKLEGSYIGK

SEQ ID NO: 2071523 - protein, 18 aa, Staphylococcus
IPSKFKFSRLVIDADQEK

SEQ ID NO: 2071524 - protein, 21 aa, Staphylococcus
IPTCVLVFKKCRQSDDDVVFI

SEQ ID NO: 2071525 - protein, 17 aa, Staphylococcus
IPTSYIEVYTEQDIYYL

SEQ ID NO: 2071526 - protein, 21 aa, Staphylococcus
IPVAKELKLDHYQSYIISYNG

SEQ ID NO: 2071527 - protein, 17 aa, Staphylococcus
IPVALRLNPDYNVLSVK

SEQ ID NO: 2071528 - protein, 23 aa, Staphylococcus
IPVCGFPWIHWAVANVSVNSDTI

SEQ ID NO: 2071529 - protein, 28 aa, Staphylococcus
IPVGSMPHERIMKAIKLYGKRVKPIIED

SEQ ID NO: 2071530 - protein, 25 aa, Staphylococcus
IPVRDKILIFSGRISSEILIKAAKI

SEQ ID NO: 2071531 - protein, 25 aa, Staphylococcus
IPVRDKVLIFSGRISSEILIKAAKI

SEQ ID NO: 2071532 - protein, 18 aa, Staphylococcus
IPVVLKKDGLAAGKGVII

SEQ ID NO: 2071533 - protein, 28 aa, Staphylococcus
IPYFMHHNYWFLFYHDENYFAAKYQDDF

SEQ ID NO: 2071534 - protein, 20 aa, Staphylococcus
IPYTVSIIDEAYQRGLKILT

SEQ ID NO: 2071535 - protein, 18 aa, Staphylococcus
IQALLRRTYDLTVSNNEI

SEQ ID NO: 2071536 - protein, 20 aa, Staphylococcus
IQAMLDLYQDIGYPTQFISK

SEQ ID NO: 2071537 - protein, 23 aa, Staphylococcus
IQAQLIETMLLNIVNFHTLITTK

SEQ ID NO: 2071538 - protein, 24 aa, Staphylococcus
IQAQVVNLLLKLQKERGITFLFIA

SEQ ID NO: 2071539 - protein, 17 aa, Staphylococcus
IQASQIICYDLRYPEVA

SEQ ID NO: 2071540 - protein, 29 aa, Staphylococcus
IQDDLATDLVWYLWTGKYSSLFGKRAMTT

SEQ ID NO: 2071541 - protein, 23 aa, Staphylococcus
IQDETICYLWLRFEHDAQFSRDT

SEQ ID NO: 2071542 - protein, 17 aa, Staphylococcus
IQDIYTTLGTTVGDKAT

SEQ ID NO: 2071543 - protein, 21 aa, Staphylococcus
IQDPEWLKTVAEKYPGRIYIS

SEQ ID NO: 2071544 - protein, 31 aa, Staphylococcus
IQDVIKAIKHAKFPVLLVGMRSSSEKVTEAI

SEQ ID NO: 2071545 - protein, 18 aa, Staphylococcus
IQDYILEYCNFGCPYFVL

SEQ ID NO: 2071546 - protein, 17 aa, Staphylococcus
IQDYLLEYCNFGCPYFI

SEQ ID NO: 2071547 - protein, 18 aa, Staphylococcus
IQEVYEDFGFKDYTFRLS

SEQ ID NO: 2071548 - protein, 19 aa, Staphylococcus
IQFERFCRDNALWDSMRTC

SEQ ID NO: 2071549 - protein, 19 aa, Staphylococcus
IQFERFCRDNALWESMETC

SEQ ID NO: 2071550 - protein, 30 aa, Staphylococcus
IQFKQAIDLIIKYRVPVCCFTFGIPDEETI

SEQ ID NO: 2071551 - protein, 34 aa, Staphylococcus
IQFLYVAPERFESNYFLKLLSQIDINLIAFDEAH

SEQ ID NO: 2071552 - protein, 26 aa, Staphylococcus
IQGEHNWNFTLFIQNGRIKDLEDYKL

SEQ ID NO: 2071553 - protein, 17 aa, Staphylococcus
IQGFGNAGSFLAKFLND

SEQ ID NO: 2071554 - protein, 26 aa, Staphylococcus
IQGKLLGQINLVLIGQHYLNENGSFT

SEQ ID NO: 2071555 - protein, 25 aa, Staphylococcus
IQGMIDLIFVKEGQYYFVDYKTDAF

SEQ ID NO: 2071556 - protein, 25 aa, Staphylococcus
IQHKVRNYDFRWEPSILSQSIRDLT

SEQ ID NO: 2071557 - protein, 23 aa, Staphylococcus
IQHLEGHVFIFGGQTLFEEMIDK

SEQ ID NO: 2071558 - protein, 17 aa, Staphylococcus
IQHLLQQITFETSQLSP

SEQ ID NO: 2071559 - protein, 20 aa, Staphylococcus
IQIDTTNILFVLGGAFDGID

SEQ ID NO: 2071560 - protein, 24 aa, Staphylococcus
IQIEQLMIHLILIMKRHQSNAQSW

SEQ ID NO: 2071561 - protein, 24 aa, Staphylococcus
IQIESLYISVDPYMRGRMTQADSY

SEQ ID NO: 2071562 - protein, 18 aa, Staphylococcus
IQIGDGIALVPRIKRRYG

SEQ ID NO: 2071563 - protein, 18 aa, Staphylococcus
IQIGEKLTRGLGAGANPE

SEQ ID NO: 2071564 - protein, 27 aa, Staphylococcus
IQIHINFKDMMLRRAYVIFYETISNVY

SEQ ID NO: 2071565 - protein, 18 aa, Staphylococcus
IQKDTLLNLIKKYKHMHP

SEQ ID NO: 2071566 - protein, 26 aa, Staphylococcus
IQKEKFYQLPKVFFTNPKYVNLSNDA

SEQ ID NO: 2071567 - protein, 20 aa, Staphylococcus
IQKFPYYDPINNELIASVFW

SEQ ID NO: 2071568 - protein, 20 aa, Staphylococcus
IQKFPYYDPINNTLITSWFW

SEQ ID NO: 2071569 - protein, 25 aa, Staphylococcus
IQKGKIRYWGVSNYSGWNLAQTHTY

SEQ ID NO: 2071570 - protein, 18 aa, Staphylococcus
IQKLPTTLIAAFKSTLEE

SEQ ID NO: 2071571 - protein, 28 aa, Staphylococcus
IQKVEKYNNTPIFYSLGNTTSDDFLSKN

SEQ ID NO: 2071572 - protein, 33 aa, Staphylococcus
IQKVVLKALMKWPIPRRMLWLRKVQSTIKDSLF

SEQ ID NO: 2071573 - protein, 28 aa, Staphylococcus
IQKYEHFRFGLHLAIQYLSYRKRTEQEV

SEQ ID NO: 2071574 - protein, 18 aa, Staphylococcus
IQLALDKAKELNKNKVWL

SEQ ID NO: 2071575 - protein, 18 aa, Staphylococcus
IQLALDYQSRDNISVILA

SEQ ID NO: 2071576 - protein, 18 aa, Staphylococcus
IQLDALITLVKEGKATGL

SEQ ID NO: 2071577 - protein, 19 aa, Staphylococcus
IQLDIQVPGAFPKFGTRDG

SEQ ID NO: 2071578 - protein, 20 aa, Staphylococcus
IQLILNFYRNKTIQDVLNDI

SEQ ID NO: 2071579 - protein, 17 aa, Staphylococcus
IQLIPGLENVDIVRYGV

SEQ ID NO: 2071580 - protein, 19 aa, Staphylococcus
IQLKHSISEIPNIKSLLEQ

SEQ ID NO: 2071581 - protein, 20 aa, Staphylococcus
IQLKHSISEIPNIKSLLESM

SEQ ID NO: 2071582 - protein, 25 aa, Staphylococcus
IQLKRAPFFELYPEGDTQDDNYITE

SEQ ID NO: 2071583 - protein, 19 aa, Staphylococcus
IQLLAPVISHRKGSHEKLI

SEQ ID NO: 2071584 - protein, 19 aa, Staphylococcus
IQLLAPVVSHRKGTHEKLI

SEQ ID NO: 2071585 - protein, 18 aa, Staphylococcus
IQLLHADNKFNKQYIKLV

SEQ ID NO: 2071586 - protein, 17 aa, Staphylococcus
IQLLINNAQTYISGNEV

SEQ ID NO: 2071587 - protein, 19 aa, Staphylococcus
IQLMDEMDLQLVDFKIEFG

SEQ ID NO: 2071588 - protein, 17 aa, Staphylococcus
IQLMLQSSPITAGPTQI

SEQ ID NO: 2071589 - protein, 26 aa, Staphylococcus
IQLMSRVRRYPLPLVLEISNLESTMP

SEQ ID NO: 2071590 - protein, 24 aa, Staphylococcus
IQLRKQYEIIVYGSFKAIDRNNSK

SEQ ID NO: 2071591 - protein, 18 aa, Staphylococcus
IQMLIGGFAYDAHHYKMV

SEQ ID NO: 2071592 - protein, 26 aa, Staphylococcus
IQNKLTAFVVLPKDLQDFGPAWIEQF

SEQ ID NO: 2071593 - protein, 30 aa, Staphylococcus
IQNREKALKVLKARLFDMKLQEEQQKYAAQ

SEQ ID NO: 2071594 - protein, 23 aa, Staphylococcus
IQNWQYPFVIKPGDDLPTAGGYG

SEQ ID NO: 2071595 - protein, 18 aa, Staphylococcus
IQPILDKYDLHTAQFLVL

SEQ ID NO: 2071596 - protein, 20 aa, Staphylococcus
IQPILKKKFEELGLNVTEDH

SEQ ID NO: 2071597 - protein, 24 aa, Staphylococcus
IQPKTMMSKIVPGLFLCGEVLDIH

SEQ ID NO: 2071598 - protein, 44 aa, Staphylococcus
IQQELNIWPNLTVLENLFLGKEPTKFLGIINHKVMRKQALEIFN

SEQ ID NO: 2071599 - protein, 21 aa, Staphylococcus
IQQHVFLLRNAKGEYLIEQRQ

SEQ ID NO: 2071600 - protein, 21 aa, Staphylococcus
IQQIVNVLKDYPKAHFHVDAV

SEQ ID NO: 2071601 - protein, 31 aa, Staphylococcus
IQQLYHHQLIKDVGDIFYLTKEDLLPLERMG

SEQ ID NO: 2071602 - protein, 24 aa, Staphylococcus
IQQQGLDLQTYFQISGQDESQMRE

SEQ ID NO: 2071603 - protein, 25 aa, Staphylococcus
IQQRFTLNMLYPYIDEIHINKNKTL

SEQ ID NO: 2071604 - protein, 25 aa, Staphylococcus
IQQRFTLNMLYPYIDEINISKNKSL

SEQ ID NO: 2071605 - protein, 28 aa, Staphylococcus
IQQVFIDIRLIETPAKPLYIARKQIEQY

SEQ ID NO: 2071606 - protein, 18 aa, Staphylococcus
IQQVPSSPSYALFKGTEL

SEQ ID NO: 2071607 - protein, 17 aa, Staphylococcus
IQRFTAYGSGNLFHVVN

SEQ ID NO: 2071608 - protein, 27 aa, Staphylococcus
IQRKLKDYDFRWEPSILSRSISDLTVA

SEQ ID NO: 2071609 - protein, 19 aa, Staphylococcus
IQRLTQIYGIKSVSPVLKT

SEQ ID NO: 2071610 - protein, 18 aa, Staphylococcus
IQRLYQALDPKGDSKPDW

SEQ ID NO: 2071611 - protein, 17 aa, Staphylococcus
IQRNQVELLLIAGDISN

SEQ ID NO: 2071612 - protein, 19 aa, Staphylococcus
IQRSFNISFYQGQKQAIEA

SEQ ID NO: 2071613 - protein, 19 aa, Staphylococcus
IQSAIFNSIKTMTAIELNQ

SEQ ID NO: 2071614 - protein, 24 aa, Staphylococcus
IQSEVPAHVQASWMLTTISSIGEL

SEQ ID NO: 2071615 - protein, 27 aa, Staphylococcus
IQSIEKYKHASIFYSLGNLTSADFLSK

SEQ ID NO: 2071616 - protein, 18 aa, Staphylococcus
IQSIRPIARLGYYDYTVV

SEQ ID NO: 2071617 - protein, 28 aa, Staphylococcus
IQSKSVDGFILLYSLKDDPIEHLLNEFK

SEQ ID NO: 2071618 - protein, 26 aa, Staphylococcus
IQSLFKGNVAVVIYTKGPKGAQAFTK

SEQ ID NO: 2071619 - protein, 22 aa, Staphylococcus
IQSLMSKIKFDTSQLPQGMKAR

SEQ ID NO: 2071620 - protein, 22 aa, Staphylococcus
IQSQFQPIQTLLDALAVDVNPI

SEQ ID NO: 2071621 - protein, 30 aa, Staphylococcus
IQSVVPLKILQDAYGLKRVAYTTYQAVSGS

SEQ ID NO: 2071622 - protein, 21 aa, Staphylococcus
IQTDGRMKALVSITLDEAFVI

SEQ ID NO: 2071623 - protein, 19 aa, Staphylococcus
IQTPFPRMTYDEAMKRYGS

SEQ ID NO: 2071624 - protein, 24 aa, Staphylococcus
IQTQQFIEVLNPKLAYKNLAQVID

SEQ ID NO: 2071625 - protein, 25 aa, Staphylococcus
IQTSDWGWAIDPVGLRFTLNVLYNR

SEQ ID NO: 2071626 - protein, 24 aa, Staphylococcus
IQTWEKFNHNVLFTGIYNSKKEAN

SEQ ID NO: 2071627 - protein, 28 aa, Staphylococcus
IQVRPILESKYNILYITPSHQFPTGHVT

SEQ ID NO: 2071628 - protein, 19 aa, Staphylococcus
IQVYVGNYDFWYQSSQLAQ

SEQ ID NO: 2071629 - protein, 34 aa, Staphylococcus
IQWMQSYAQALIDLALPLYVKYGIALEAHLQNSI

SEQ ID NO: 2071630 - protein, 18 aa, Staphylococcus
IQYHYHSHQLNLTTDAGV

SEQ ID NO: 2071631 - protein, 19 aa, Staphylococcus
IQYIDFNKGKIARQLLDHF

SEQ ID NO: 2071632 - protein, 20 aa, Staphylococcus
IRAGICDLSSVIGCRDDIMV

SEQ ID NO: 2071633 - protein, 35 aa, Staphylococcus
IRAKERLIPYFIYHNYWFLYYHDHQYFACKFQSNP

SEQ ID NO: 2071634 - protein, 25 aa, Staphylococcus
IRANSSIIIMVIIYNSGHVEHLHLS

SEQ ID NO: 2071635 - protein, 18 aa, Staphylococcus
IRDHDRERFEARKACLLE

SEQ ID NO: 2071636 - protein, 25 aa, Staphylococcus
IRDIAKELVIIEKPMRAFSENSDQM

SEQ ID NO: 2071637 - protein, 27 aa, Staphylococcus
IRDIKARGHDIFLDLKLHDIPHTVNKA

SEQ ID NO: 2071638 - protein, 19 aa, Staphylococcus
IRDKFLLRIVEYDLFNNCN

SEQ ID NO: 2071639 - protein, 26 aa, Staphylococcus
IRDVATKAWYNTYLAIYAASTVNELL

SEQ ID NO: 2071640 - protein, 31 aa, Staphylococcus
IRDVATKAWYNTYLNIYAARTVNELLAASYN

SEQ ID NO: 2071641 - protein, 28 aa, Staphylococcus
IREGGIRGIVISLLSLDYIDVSDDAIIS

SEQ ID NO: 2071642 - protein, 19 aa, Staphylococcus
IREGGIRGIVISLLSLNHI

SEQ ID NO: 2071643 - protein, 26 aa, Staphylococcus
IREGGIRGIVLSLLSLDHIDVSDDAI

SEQ ID NO: 2071644 - protein, 26 aa, Staphylococcus
IREGGIRGIVLSLLSLKHIEVSDDAI

SEQ ID NO: 2071645 - protein, 20 aa, Staphylococcus
IREGGIRGIVLSLLSMDYIK

SEQ ID NO: 2071646 - protein, 35 aa, Staphylococcus
IREKERLIPYFILNDYWFLFYHDADYFAVKFDKKD

SEQ ID NO: 2071647 - protein, 24 aa, Staphylococcus
IRELMFREFYYVLMTQYPNTAHEA

SEQ ID NO: 2071648 - protein, 18 aa, Staphylococcus
IREMGVIDLIITAHQHQT

SEQ ID NO: 2071649 - protein, 25 aa, Staphylococcus
IREVSNTPILFLSSRDNPMDQVMSM

SEQ ID NO: 2071650 - protein, 26 aa, Staphylococcus
IRFGIDEHVDFIAASFVRRPSDVLDI

SEQ ID NO: 2071651 - protein, 18 aa, Staphylococcus
IRHAILWNDTRNSEQCAQ

SEQ ID NO: 2071652 - protein, 25 aa, Staphylococcus
IRHLGLRVYFNLEHALVSLSEDDKN

SEQ ID NO: 2071653 - protein, 27 aa, Staphylococcus
IRIGFLMGPEYLIEKLTFMHAYNCICA

SEQ ID NO: 2071654 - protein, 17 aa, Staphylococcus
IRIGNPASWKKATVALE

SEQ ID NO: 2071655 - protein, 35 aa, Staphylococcus
IRIHTQNEYLVYMLGFMPGFPFLGGLDSRLHTPRR

SEQ ID NO: 2071656 - protein, 25 aa, Staphylococcus
IRIKDGTMILSPRFRDYLLELVDTF

SEQ ID NO: 2071657 - protein, 33 aa, Staphylococcus
IRIKDGTMLLRPTFRDYLLDLAKQYDIKHQYYI

SEQ ID NO: 2071658 - protein, 21 aa, Staphylococcus
IRIRPEFFEVYRDDTLLELTP

SEQ ID NO: 2071659 - protein, 25 aa, Staphylococcus
IRIWETLNFDFINKVPQSKKSKIIL

SEQ ID NO: 2071660 - protein, 28 aa, Staphylococcus
IRKDFRGYGLGQLLLKYVMDYASHSCEV

SEQ ID NO: 2071661 - protein, 18 aa, Staphylococcus
IRKLKLIGHYIGMSFQII

SEQ ID NO: 2071662 - protein, 22 aa, Staphylococcus
IRKRVPHIADLRPSGKYVMAHL

SEQ ID NO: 2071663 - protein, 18 aa, Staphylococcus
IRKWFKRYLSESEHIYVD

SEQ ID NO: 2071664 - protein, 21 aa, Staphylococcus
IRLIAADLVDFDWLDGFDIEC

SEQ ID NO: 2071665 - protein, 18 aa, Staphylococcus
IRLIPGLENVDIVRYGVM

SEQ ID NO: 2071666 - protein, 25 aa, Staphylococcus
IRLKSKKGTLLWLMDETKTPMGARR

SEQ ID NO: 2071667 - protein, 17 aa, Staphylococcus
IRLLPPLTISSQEINRA

SEQ ID NO: 2071668 - protein, 20 aa, Staphylococcus
IRLRWAQIVHTDYNLLILDE

SEQ ID NO: 2071669 - protein, 20 aa, Staphylococcus
IRLVKVLDEAKLLDALSGGI

SEQ ID NO: 2071670 - protein, 32 aa, Staphylococcus
IRMGTVWINDFHPYFAQAPWGGYKQSGIGREL

SEQ ID NO: 2071671 - protein, 17 aa, Staphylococcus
IRNLCLSILTFDKDQDL

SEQ ID NO: 2071672 - protein, 21 aa, Staphylococcus
IRNQLKPIIFVINNDGYTVER

SEQ ID NO: 2071673 - protein, 28 aa, Staphylococcus
IRNRTPVETWWRWYRNGESYRFSQHVGK

SEQ ID NO: 2071674 - protein, 18 aa, Staphylococcus
IRNRYQWSKTFLKKVNRL

SEQ ID NO: 2071675 - protein, 19 aa, Staphylococcus
IRPEDLQAYGLIPEFIGRV

SEQ ID NO: 2071676 - protein, 31 aa, Staphylococcus
IRPEDLQAYGLIPEFIGRVPIVANLETLDVE

SEQ ID NO: 2071677 - protein, 20 aa, Staphylococcus
IRPFLTKIHQTYNINYIAFT

SEQ ID NO: 2071678 - protein, 17 aa, Staphylococcus
IRPKGFGAIDKALRTAE

SEQ ID NO: 2071679 - protein, 17 aa, Staphylococcus
IRQKLKKDGIKKGVPVV

SEQ ID NO: 2071680 - protein, 22 aa, Staphylococcus
IRQKYFQNVMPFSQTNFYIDTS

SEQ ID NO: 2071681 - protein, 24 aa, Staphylococcus
IRQKYLDFFVEKGHMIEPSAPLVP

SEQ ID NO: 2071682 - protein, 24 aa, Staphylococcus
IRQQDAMTFIYIPKKYQKQLHINE

SEQ ID NO: 2071683 - protein, 19 aa, Staphylococcus
IRQVSNVPILFLSSRDNPM

SEQ ID NO: 2071684 - protein, 21 aa, Staphylococcus
IRRHYAIRDALRQALTALDLN

SEQ ID NO: 2071685 - protein, 22 aa, Staphylococcus
IRRRIIENGYKPTYFIARPINA

SEQ ID NO: 2071686 - protein, 20 aa, Staphylococcus
IRSDLIVQAPTGQKFKIVVD

SEQ ID NO: 2071687 - protein, 20 aa, Staphylococcus
IRSGICDLSSVIGCRDDIMV

SEQ ID NO: 2071688 - protein, 28 aa, Staphylococcus
IRSRAQIFELYPLYDNDIRLALNRALED

SEQ ID NO: 2071689 - protein, 18 aa, Staphylococcus
IRSYFQRINMEYCWLVKE

SEQ ID NO: 2071690 - protein, 33 aa, Staphylococcus
IRTADIILYDRLVNPFILQLAPPEIEIIDVGKK

SEQ ID NO: 2071691 - protein, 18 aa, Staphylococcus
IRTALLDAGLTLIDDTHV

SEQ ID NO: 2071692 - protein, 21 aa, Staphylococcus
IRTFSNIIERLTGEKYDKVEV

SEQ ID NO: 2071693 - protein, 18 aa, Staphylococcus
IRTLHKRPDLLEKYQLSD

SEQ ID NO: 2071694 - protein, 25 aa, Staphylococcus
IRVHMKYIGFPLVGDPKYGPRKTLD

SEQ ID NO: 2071695 - protein, 19 aa, Staphylococcus
IRVHMKYIGYPLVGDPKYG

SEQ ID NO: 2071696 - protein, 27 aa, Staphylococcus
IRVNCVAPGPFWSPLQISGGQPQSKIP

SEQ ID NO: 2071697 - protein, 24 aa, Staphylococcus
IRVNCVAPGPFWSPLQITGGQPQR

SEQ ID NO: 2071698 - protein, 28 aa, Staphylococcus
IRVNCVAPGPFWSPLQITGGQPQSAIPT

SEQ ID NO: 2071699 - protein, 26 aa, Staphylococcus
IRVNSVAPGPFWSPLQISGGQPQSAI

SEQ ID NO: 2071700 - protein, 26 aa, Staphylococcus
IRVVCNYLEDIYVIEKLLLKQEDVKL

SEQ ID NO: 2071701 - protein, 18 aa, Staphylococcus
IRVVSPNDIYFYQSIQNY

SEQ ID NO: 2071702 - protein, 20 aa, Staphylococcus
IRYAFKDRILIPQNDLDRTP

SEQ ID NO: 2071703 - protein, 19 aa, Staphylococcus
IRYAQYLNELSEQTQFIVI

SEQ ID NO: 2071704 - protein, 30 aa, Staphylococcus
IRYLINEVCHKLNIPWIYGAAVGSKGTVYG

SEQ ID NO: 2071705 - protein, 43 aa, Staphylococcus
ISAGYTLEQLAVQDFFFQPDYDRPWNYLNVLAQQALGDTFGSD

SEQ ID NO: 2071706 - protein, 25 aa, Staphylococcus
ISAKRIIDFLSGTVYAIGGDIQRVG

SEQ ID NO: 2071707 - protein, 30 aa, Staphylococcus
ISATDSYPIMKYIQPIRKQIKSPTIFNLVG

SEQ ID NO: 2071708 - protein, 24 aa, Staphylococcus
ISDGSIYPVLLRLSKKGYVEATVR

SEQ ID NO: 2071709 - protein, 24 aa, Staphylococcus
ISDGSIYPVLLRLSKKGYVQSEMR

SEQ ID NO: 2071710 - protein, 25 aa, Staphylococcus
ISDIYASVRLLWSRIGKPFVGYSDI

SEQ ID NO: 2071711 - protein, 24 aa, Staphylococcus
ISDWNRVGWGRIPMTQGFTYSSNT

SEQ ID NO: 2071712 - protein, 31 aa, Staphylococcus
ISEAIIDIEVLFPYITLAHFGKKVDKYALFY

SEQ ID NO: 2071713 - protein, 25 aa, Staphylococcus
ISEALKIPIFTYKNELPYINGELPY

SEQ ID NO: 2071714 - protein, 18 aa, Staphylococcus
ISEDDFIRLVNEDKLAVI

SEQ ID NO: 2071715 - protein, 23 aa, Staphylococcus
ISEDIVEFIALDMGALGDGQSSN

SEQ ID NO: 2071716 - protein, 23 aa, Staphylococcus
ISEDYDVPLLMKFEVQGTNNDVI

SEQ ID NO: 2071717 - protein, 24 aa, Staphylococcus
ISEEQLLALFLTLNESQSYSSLPY

SEQ ID NO: 2071718 - protein, 17 aa, Staphylococcus
ISEIPHIKQLLLEMDQT

SEQ ID NO: 2071719 - protein, 23 aa, Staphylococcus
ISEKYQVPLLMKFEVQGTQNDIS

SEQ ID NO: 2071720 - protein, 18 aa, Staphylococcus
ISELFIDRVLTKILQHID

SEQ ID NO: 2071721 - protein, 23 aa, Staphylococcus
ISEQYNVPLLMKFEVQGSNSDVK

SEQ ID NO: 2071722 - protein, 27 aa, Staphylococcus
ISETNGIFKHYFVIEYVKNSESPDPNF

SEQ ID NO: 2071723 - protein, 29 aa, Staphylococcus
ISFAHHIMTYFWMLERDKGRFTDSLKRID

SEQ ID NO: 2071724 - protein, 29 aa, Staphylococcus
ISFAHHIMTYFWMLERDYTRFADSLKRID

SEQ ID NO: 2071725 - protein, 30 aa, Staphylococcus
ISFAHHVMTYFWMLERDKGRFKDSLKRIDI

SEQ ID NO: 2071726 - protein, 25 aa, Staphylococcus
ISFDTIYRNLHLFKDLGIVEGTELD

SEQ ID NO: 2071727 - protein, 22 aa, Staphylococcus
ISGIPFSYFMSYVSGAGLSFLR

SEQ ID NO: 2071728 - protein, 24 aa, Staphylococcus
ISGLMRQRYILGKAYVINEESPIV

SEQ ID NO: 2071729 - protein, 23 aa, Staphylococcus
ISGMMHGYLPFDDNDDLLVPFRT

SEQ ID NO: 2071730 - protein, 23 aa, Staphylococcus
ISGMMHGYLVFDEHDDLLVPFRT

SEQ ID NO: 2071731 - protein, 21 aa, Staphylococcus
ISHHPDMWLLSISQRSAKMAA

SEQ ID NO: 2071732 - protein, 28 aa, Staphylococcus
ISHKMDMIFTHFGISGPAALRCSQFIYK

SEQ ID NO: 2071733 - protein, 27 aa, Staphylococcus
ISHKMDMIFTHFGISGPAALRCSQFVY

SEQ ID NO: 2071734 - protein, 17 aa, Staphylococcus
ISHLPQVASMSNHHLLI

SEQ ID NO: 2071735 - protein, 26 aa, Staphylococcus
ISHQMDMIFTHFGVSGPAALRCSQFV

SEQ ID NO: 2071736 - protein, 18 aa, Staphylococcus
ISIDHRILDGVQTGKFMS

SEQ ID NO: 2071737 - protein, 17 aa, Staphylococcus
ISIFPEVATLKTQIVTD

SEQ ID NO: 2071738 - protein, 17 aa, Staphylococcus
ISIKDIVIYPDAYSIKK

SEQ ID NO: 2071739 - protein, 24 aa, Staphylococcus
ISIVEWSQFIQDLLPEEHLTIDIH

SEQ ID NO: 2071740 - protein, 17 aa, Staphylococcus
ISIYPFLCYLDKELVAI

SEQ ID NO: 2071741 - protein, 17 aa, Staphylococcus
ISKAELDTLWQLRNLFT

SEQ ID NO: 2071742 - protein, 20 aa, Staphylococcus
ISKIDIPRVRFTTSHPWDFT

SEQ ID NO: 2071743 - protein, 17 aa, Staphylococcus
ISKKLHITDDKPVLLYA

SEQ ID NO: 2071744 - protein, 23 aa, Staphylococcus
ISKLKMACVAAASMYNCEFFYFT

SEQ ID NO: 2071745 - protein, 17 aa, Staphylococcus
ISKLKYLKLGQSGYDIA

SEQ ID NO: 2071746 - protein, 21 aa, Staphylococcus
ISKLPYSIRVLLESVLRQEDD

SEQ ID NO: 2071747 - protein, 23 aa, Staphylococcus
ISKLPYSIRVLLESVLRQEDDFV

SEQ ID NO: 2071748 - protein, 24 aa, Staphylococcus
ISKLPYSIRVLLESVLRQEDDFVI

SEQ ID NO: 2071749 - protein, 23 aa, Staphylococcus
ISKLPYSIRVLLESVLRQEDEFV

SEQ ID NO: 2071750 - protein, 24 aa, Staphylococcus
ISKLSILKQYLLRIPLCHHVKAQK

SEQ ID NO: 2071751 - protein, 40 aa, Staphylococcus
ISKMKEEPQWMLDFRLKALKLFYKMPMPQWGGDLSELNFD

SEQ ID NO: 2071752 - protein, 18 aa, Staphylococcus
ISKQFWGHLVKSGNIDNP

SEQ ID NO: 2071753 - protein, 20 aa, Staphylococcus
ISKRFSTIQDYILEYCNFGC

SEQ ID NO: 2071754 - protein, 23 aa, Staphylococcus
ISKTKGLIGNIMKIKPIGTLNEG

SEQ ID NO: 2071755 - protein, 30 aa, Staphylococcus
ISKTKGLIGNIMKIKPIGTLREGYLEIVHN

SEQ ID NO: 2071756 - protein, 23 aa, Staphylococcus
ISKTKGLIGNIMKIKPVGTLVDG

SEQ ID NO: 2071757 - protein, 18 aa, Staphylococcus
ISLAVKFSKARLIDNIIL

SEQ ID NO: 2071758 - protein, 26 aa, Staphylococcus
ISLDPDIFYPLIKKLKENNDYVVVNV

SEQ ID NO: 2071759 - protein, 26 aa, Staphylococcus
ISLEDYFVILVHPWQYNHTIYDKFAN

SEQ ID NO: 2071760 - protein, 25 aa, Staphylococcus
ISLEEMLSVLPKQLSKRKILNANAQ

SEQ ID NO: 2071761 - protein, 18 aa, Staphylococcus
ISLGGDGAIYIDKTRSIK

SEQ ID NO: 2071762 - protein, 19 aa, Staphylococcus
ISLGHQFHSLLPAGEVPER

SEQ ID NO: 2071763 - protein, 21 aa, Staphylococcus
ISLINKMISKCVLIIENDIGY

SEQ ID NO: 2071764 - protein, 18 aa, Staphylococcus
ISLKFEQHILTIKAYKKI

SEQ ID NO: 2071765 - protein, 34 aa, Staphylococcus
ISLNMRKYYGPMLPGFYHIPFPDNYRGMFGSNQP

SEQ ID NO: 2071766 - protein, 32 aa, Staphylococcus
ISLTEKWIIQIAYDKFIILAKNEPSLLDNQIV

SEQ ID NO: 2071767 - protein, 19 aa, Staphylococcus
ISLTMIHLSRFAEEIIFWS

SEQ ID NO: 2071768 - protein, 21 aa, Staphylococcus
ISMPGMMDTILNLGLNDENVE

SEQ ID NO: 2071769 - protein, 19 aa, Staphylococcus
ISNFDGHPGNLALPRKQEF

SEQ ID NO: 2071770 - protein, 22 aa, Staphylococcus
ISNFLTDNYYKSQFDFNKKLKQ

SEQ ID NO: 2071771 - protein, 20 aa, Staphylococcus
ISNHLLPRTGAYHEIWLDGE

SEQ ID NO: 2071772 - protein, 23 aa, Staphylococcus
ISNKIVEFIAFDMGALGEGQSSD

SEQ ID NO: 2071773 - protein, 17 aa, Staphylococcus
ISNLLKKRGIRHDVLNA

SEQ ID NO: 2071774 - protein, 23 aa, Staphylococcus
ISNYLRRINRKTALLIQLATEVG

SEQ ID NO: 2071775 - protein, 22 aa, Staphylococcus
ISNYVLIEYGQPLHMFDQDQIG

SEQ ID NO: 2071776 - protein, 17 aa, Staphylococcus
ISPVIDLDIKYIKSIFY

SEQ ID NO: 2071777 - protein, 17 aa, Staphylococcus
ISPVTYWVAAMSKEQRE

SEQ ID NO: 2071778 - protein, 19 aa, Staphylococcus
ISQFTLYADVRKGNRPGFS

SEQ ID NO: 2071779 - protein, 23 aa, Staphylococcus
ISQKDLMHFFDRKGSTVSNILKN

SEQ ID NO: 2071780 - protein, 19 aa, Staphylococcus
ISQLFPIPMIMGCEGVSAA

SEQ ID NO: 2071781 - protein, 18 aa, Staphylococcus
ISQLGYLYDYQKPNNYNK

SEQ ID NO: 2071782 - protein, 30 aa, Staphylococcus
ISQQIVRYCPKAFVIVLTNPVDAMTYTVLQ

SEQ ID NO: 2071783 - protein, 24 aa, Staphylococcus
ISQQQNILITDFRYIKQATEQATD

SEQ ID NO: 2071784 - protein, 27 aa, Staphylococcus
ISQSTPFDILIHFPLHVGPDAKLEQLI

SEQ ID NO: 2071785 - protein, 25 aa, Staphylococcus
ISQTEVLTWVLGYNKTIEELIEQAD

SEQ ID NO: 2071786 - protein, 24 aa, Staphylococcus
ISQWKFIEDLLIAHLGVSILPKSI

SEQ ID NO: 2071787 - protein, 17 aa, Staphylococcus
ISRDLKVIANETGAIII

SEQ ID NO: 2071788 - protein, 20 aa, Staphylococcus
ISRFIPFLNVKRYVYIHFLK

SEQ ID NO: 2071789 - protein, 17 aa, Staphylococcus
ISRLFDITGLKDLMHVN

SEQ ID NO: 2071790 - protein, 20 aa, Staphylococcus
ISRMLATFDWKYNNNPPKDE

SEQ ID NO: 2071791 - protein, 28 aa, Staphylococcus
ISRSETYKKVLFMPYNRHRIYSRNMMGE

SEQ ID NO: 2071792 - protein, 19 aa, Staphylococcus
ISRYMIINETDKILMALRP

SEQ ID NO: 2071793 - protein, 24 aa, Staphylococcus
ISSDYLLCKAFGKTATNIEKYTSQ

SEQ ID NO: 2071794 - protein, 17 aa, Staphylococcus
ISSFNVVLVKLAEEIMP

SEQ ID NO: 2071795 - protein, 25 aa, Staphylococcus
ISSGAAIYAAIQKAKELGKGKTVVT

SEQ ID NO: 2071796 - protein, 19 aa, Staphylococcus
ISSHILNELQQLAYRFVFI

SEQ ID NO: 2071797 - protein, 29 aa, Staphylococcus
ISSKPPILFTPLFPTYFFPTHSDRKEENT

SEQ ID NO: 2071798 - protein, 27 aa, Staphylococcus
ISSKPPILLTPLFPTYFFPTHSDRQDE

SEQ ID NO: 2071799 - protein, 27 aa, Staphylococcus
ISSKPPILLTPLFPTYFFPTHSDRQEE

SEQ ID NO: 2071800 - protein, 26 aa, Staphylococcus
ISSTIVYLPEFIRTLKGGFKDGSFEK

SEQ ID NO: 2071801 - protein, 25 aa, Staphylococcus
ISTDKPDPLLGQKAPVTLGHEFAGV

SEQ ID NO: 2071802 - protein, 25 aa, Staphylococcus
ISTDKPDPLLGQKAPVTLGHEFSGV

SEQ ID NO: 2071803 - protein, 26 aa, Staphylococcus
ISTFELSKILMWNTISFYSSGNKVSM

SEQ ID NO: 2071804 - protein, 25 aa, Staphylococcus
ISTFSEVLSLFKKYSKTLLIEIKKP

SEQ ID NO: 2071805 - protein, 19 aa, Staphylococcus
ISTGLIVPSKFFDLAKEGK

SEQ ID NO: 2071806 - protein, 25 aa, Staphylococcus
ISTIGEKLSLRRFAIRTKGDNDSFG

SEQ ID NO: 2071807 - protein, 18 aa, Staphylococcus
ISTLRIMIDLNTEPDLFL

SEQ ID NO: 2071808 - protein, 19 aa, Staphylococcus
ISTMYPVQPYYGGAMCVCG

SEQ ID NO: 2071809 - protein, 24 aa, Staphylococcus
ISTTLLINRFHPDLIINTGSAGAL

SEQ ID NO: 2071810 - protein, 24 aa, Staphylococcus
ISVAQRLLIQTFFSTFSNQRHDQY

SEQ ID NO: 2071811 - protein, 17 aa, Staphylococcus
ISVATIYNNLRVFKNIG

SEQ ID NO: 2071812 - protein, 17 aa, Staphylococcus
ISVATIYNNLRVFKSIG

SEQ ID NO: 2071813 - protein, 20 aa, Staphylococcus
ISVDNGIWKVIDFQHVKPGK

SEQ ID NO: 2071814 - protein, 25 aa, Staphylococcus
ISVDNGIWKVLDFQHVKPGKGSAFV

SEQ ID NO: 2071815 - protein, 32 aa, Staphylococcus
ISVIKQPVGVCALITPWNFPGAMVARKVSPAL

SEQ ID NO: 2071816 - protein, 18 aa, Staphylococcus
ISVIRLNGHFEPTVTHAY

SEQ ID NO: 2071817 - protein, 25 aa, Staphylococcus
ISVKAKSFTLLSKSLRPLPDKFHGL

SEQ ID NO: 2071818 - protein, 31 aa, Staphylococcus
ISVRRNFIDKFKFPYLLGKADYIFVDDFHPL

SEQ ID NO: 2071819 - protein, 27 aa, Staphylococcus
ISVSQLMKYIQGPDFPTGGIIQGVDGI

SEQ ID NO: 2071820 - protein, 24 aa, Staphylococcus
ISYDNDIYTLTFTNGLITQSETEP

SEQ ID NO: 2071821 - protein, 18 aa, Staphylococcus
ISYDSLYKYIYNALESER

SEQ ID NO: 2071822 - protein, 22 aa, Staphylococcus
ISYIPKVGYYDKITHAHAYGGP

SEQ ID NO: 2071823 - protein, 17 aa, Staphylococcus
ISYVFSLVGRDDDNKHA

SEQ ID NO: 2071824 - protein, 36 aa, Staphylococcus
ITAENVIFIGLLCRNGQWFAIVYEIGFGRTRELSIL

SEQ ID NO: 2071825 - protein, 21 aa, Staphylococcus
ITAGHMPGMKGAEATVKGAYK

SEQ ID NO: 2071826 - protein, 17 aa, Staphylococcus
ITAKQYIQSGDYHNILV

SEQ ID NO: 2071827 - protein, 28 aa, Staphylococcus
ITAQRPIDMIYPILAKYQSSSLPNELRF

SEQ ID NO: 2071828 - protein, 29 aa, Staphylococcus
ITDDISTDLVWYLWTGKYSSLFGKRAMTT

SEQ ID NO: 2071829 - protein, 24 aa, Staphylococcus
ITDDYVLTRLKTMGKLAMLMLQDL

SEQ ID NO: 2071830 - protein, 27 aa, Staphylococcus
ITDGEFRRSWWHFDFLENINGVEGYTP

SEQ ID NO: 2071831 - protein, 28 aa, Staphylococcus
ITDGEFRRSWWHFDFLENLDGVEGYTPD

SEQ ID NO: 2071832 - protein, 28 aa, Staphylococcus
ITDGEFRRSWWHFDFLENLNGVEGYTSD

SEQ ID NO: 2071833 - protein, 36 aa, Staphylococcus
ITDKVQILMNYFWPGPISFILPLKRGYLCEKVTGGL

SEQ ID NO: 2071834 - protein, 22 aa, Staphylococcus
ITDLIELLDLRPHLDKKIHELS

SEQ ID NO: 2071835 - protein, 17 aa, Staphylococcus
ITEDIVLTYPKYLDGQH

SEQ ID NO: 2071836 - protein, 27 aa, Staphylococcus
ITEDLVLPNMIIFLDAELSVLKQRIAQ

SEQ ID NO: 2071837 - protein, 32 aa, Staphylococcus
ITEWRYHDIPDKLWRISPLKSFWGINKKTEIK

SEQ ID NO: 2071838 - protein, 19 aa, Staphylococcus
ITFEAFLEKAAIASSQIVD

SEQ ID NO: 2071839 - protein, 17 aa, Staphylococcus
ITFIPRGNRIIFRGAQN

SEQ ID NO: 2071840 - protein, 20 aa, Staphylococcus
ITFLDTPGHAAFTTMRARGA

SEQ ID NO: 2071841 - protein, 21 aa, Staphylococcus
ITFLDTPGHAAFTTMRARGAQ

SEQ ID NO: 2071842 - protein, 22 aa, Staphylococcus
ITFLDTPGHAAFTTMRARGAQV

SEQ ID NO: 2071843 - protein, 17 aa, Staphylococcus
ITFLQELPHRSSFSYIV

SEQ ID NO: 2071844 - protein, 18 aa, Staphylococcus
ITFYINESDEWFFKGLDL

SEQ ID NO: 2071845 - protein, 25 aa, Staphylococcus
ITGAQAWIGTLLQMKPVLKFEEDGK

SEQ ID NO: 2071846 - protein, 27 aa, Staphylococcus
ITGAQAWVGTLLKMKPVLKFDDGKIVP

SEQ ID NO: 2071847 - protein, 26 aa, Staphylococcus
ITGGEPLLRRDLDKLIYQLNQLEGVE

SEQ ID NO: 2071848 - protein, 26 aa, Staphylococcus
ITGGEPLLRRNLYQLIARLNKIEGIE

SEQ ID NO: 2071849 - protein, 25 aa, Staphylococcus
ITGGEPLLRRNLYQLIEQLNEIEGI

SEQ ID NO: 2071850 - protein, 26 aa, Staphylococcus
ITGHYRNGILLSPIIGRDIANWLLSG

SEQ ID NO: 2071851 - protein, 17 aa, Staphylococcus
ITGITAALNDALFEYLK

SEQ ID NO: 2071852 - protein, 17 aa, Staphylococcus
ITGKPIVLGGSQGRDRA

SEQ ID NO: 2071853 - protein, 26 aa, Staphylococcus
ITGQKADILLWYLRPEMKELNEIENE

SEQ ID NO: 2071854 - protein, 27 aa, Staphylococcus
ITGQKADLLLWFLRPEMKDLNKIENDF

SEQ ID NO: 2071855 - protein, 27 aa, Staphylococcus
ITGQKADLLLWFLRPEMKELNSIENEL

SEQ ID NO: 2071856 - protein, 17 aa, Staphylococcus
ITHASALDFVDKIKSTF

SEQ ID NO: 2071857 - protein, 25 aa, Staphylococcus
ITHDYALILELCSYVMHFAAGQVID

SEQ ID NO: 2071858 - protein, 18 aa, Staphylococcus
ITHEMQVIRRICDAVAVM

SEQ ID NO: 2071859 - protein, 36 aa, Staphylococcus
ITHQMDMLFTHFGISGPAALRCSQFVYKEQKNQKKQ

SEQ ID NO: 2071860 - protein, 17 aa, Staphylococcus
ITHRGRVPIIVGGTGLY

SEQ ID NO: 2071861 - protein, 28 aa, Staphylococcus
ITHSKKGVKLLWASCRELFNVIQADEIG

SEQ ID NO: 2071862 - protein, 30 aa, Staphylococcus
ITHVSLVPQTLKWLMDAGLEKPYQLEKILL

SEQ ID NO: 2071863 - protein, 24 aa, Staphylococcus
ITIIEWSQFIQDLLPKEHLIINIE

SEQ ID NO: 2071864 - protein, 17 aa, Staphylococcus
ITIKDIVIYPDAYSIKK

SEQ ID NO: 2071865 - protein, 17 aa, Staphylococcus
ITIMYMVKKLDAGNIIS

SEQ ID NO: 2071866 - protein, 21 aa, Staphylococcus
ITKAIDYWLKRFDITENREKK

SEQ ID NO: 2071867 - protein, 22 aa, Staphylococcus
ITKDNLLMRMKEQEWDDVINTN

SEQ ID NO: 2071868 - protein, 27 aa, Staphylococcus
ITKEKFYELLYIDKIFNKNLASLQSSI

SEQ ID NO: 2071869 - protein, 18 aa, Staphylococcus
ITKKIDEYVNWIAPITVY

SEQ ID NO: 2071870 - protein, 22 aa, Staphylococcus
ITKKQLFNATSIYLEAIYSLCV

SEQ ID NO: 2071871 - protein, 24 aa, Staphylococcus
ITKKVLVDFLIALDIRYHENQYML

SEQ ID NO: 2071872 - protein, 29 aa, Staphylococcus
ITKNKQTHHDAKFEKGVITHQHQPSQSNS

SEQ ID NO: 2071873 - protein, 19 aa, Staphylococcus
ITKQYLIDIQNQGIKVILA

SEQ ID NO: 2071874 - protein, 22 aa, Staphylococcus
ITLAKISAYYNLGLEAKVELSD

SEQ ID NO: 2071875 - protein, 20 aa, Staphylococcus
ITLDNCDIFFIGGGSDREQA

SEQ ID NO: 2071876 - protein, 34 aa, Staphylococcus
ITLPKANVLKIYFKEGFIALRPSGTEPKIKLYVS

SEQ ID NO: 2071877 - protein, 34 aa, Staphylococcus
ITLPTANVIKIYFNDGFIALRPSGTEPKIKLYVS

SEQ ID NO: 2071878 - protein, 28 aa, Staphylococcus
ITLRIKEFDLLWYLATHENVALSKTDLL

SEQ ID NO: 2071879 - protein, 23 aa, Staphylococcus
ITLSHFEMPLHLAREYGGFKNRK

SEQ ID NO: 2071880 - protein, 23 aa, Staphylococcus
ITLSHFEMPLHLAREYGGFRNRK

SEQ ID NO: 2071881 - protein, 26 aa, Staphylococcus
ITLTVQQYLLFVEQLYEVQHSCFALD

SEQ ID NO: 2071882 - protein, 25 aa, Staphylococcus
ITNDQLELLRILYSYDRLSQYDLTM

SEQ ID NO: 2071883 - protein, 26 aa, Staphylococcus
ITNEIYLIIDAFIKKYQLKNPHIGIS

SEQ ID NO: 2071884 - protein, 27 aa, Staphylococcus
ITNETLKLFNPSKLFLATPAIDLEKGI

SEQ ID NO: 2071885 - protein, 19 aa, Staphylococcus
ITNYLRRINRKTALLIQLS

SEQ ID NO: 2071886 - protein, 17 aa, Staphylococcus
ITPDSIGLILGFLAERF

SEQ ID NO: 2071887 - protein, 20 aa, Staphylococcus
ITPEGMKGLILKSLTSGQRI

SEQ ID NO: 2071888 - protein, 17 aa, Staphylococcus
ITPLIKSLVDKKYIYKE

SEQ ID NO: 2071889 - protein, 25 aa, Staphylococcus
ITPQRQAILKFLIASHTHPTADEIY

SEQ ID NO: 2071890 - protein, 27 aa, Staphylococcus
ITQALDYFLLSLKNWNYSYASSIKLVD

SEQ ID NO: 2071891 - protein, 24 aa, Staphylococcus
ITQDYGLASLLLKKARIIMHHKGF

SEQ ID NO: 2071892 - protein, 20 aa, Staphylococcus
ITQDYGLASLLLSKVKIVMH

SEQ ID NO: 2071893 - protein, 22 aa, Staphylococcus
ITQVKYSLEFLGASLGGYIIGT

SEQ ID NO: 2071894 - protein, 25 aa, Staphylococcus
ITRAKRIILLAFGDKKHDALQRLID

SEQ ID NO: 2071895 - protein, 21 aa, Staphylococcus
ITRDNLLMRMKEHEWDDVINT

SEQ ID NO: 2071896 - protein, 18 aa, Staphylococcus
ITRDNLLMRMKEQEWDDV

SEQ ID NO: 2071897 - protein, 27 aa, Staphylococcus
ITRIYKAHVKALLPIKPQTIDKPIGKD

SEQ ID NO: 2071898 - protein, 25 aa, Staphylococcus
ITRLARAYNLVIPPSGRTLSGGLDP

SEQ ID NO: 2071899 - protein, 19 aa, Staphylococcus
ITSAFIMQISKDTKIAIIE

SEQ ID NO: 2071900 - protein, 32 aa, Staphylococcus
ITSEFLQSNYLDHLIIYYAPKIIGGIGKNQFY

SEQ ID NO: 2071901 - protein, 17 aa, Staphylococcus
ITSELDNIPFYFPDPHS

SEQ ID NO: 2071902 - protein, 24 aa, Staphylococcus
ITSEQLELLRILYNYDRLSQYDLT

SEQ ID NO: 2071903 - protein, 25 aa, Staphylococcus
ITSFTRTMMNLGVATNLTADEAATE

SEQ ID NO: 2071904 - protein, 31 aa, Staphylococcus
ITSKPPILLTPLFPTYFFPTHSDRLEENIWI

SEQ ID NO: 2071905 - protein, 31 aa, Staphylococcus
ITSKPPILLTPLFPTYFFPTHSDRLEENMWI

SEQ ID NO: 2071906 - protein, 20 aa, Staphylococcus
ITSKYLIATTAAKRARELDE

SEQ ID NO: 2071907 - protein, 19 aa, Staphylococcus
ITSLLTYKNIRSNCGIGFK

SEQ ID NO: 2071908 - protein, 27 aa, Staphylococcus
ITSLTNYKWLGILLRFVPNIIRDFGYQ

SEQ ID NO: 2071909 - protein, 27 aa, Staphylococcus
ITSLTTFKWLGILLKLVPKPLRDCGYH

SEQ ID NO: 2071910 - protein, 32 aa, Staphylococcus
ITSMFYTFKLMKHNVLPSLLLPELSGPFLSIN

SEQ ID NO: 2071911 - protein, 24 aa, Staphylococcus
ITSRRIWHDIKNLTPLNTTKFNLN

SEQ ID NO: 2071912 - protein, 24 aa, Staphylococcus
ITTHSFRYTHCALLIEAGVHIKEI

SEQ ID NO: 2071913 - protein, 26 aa, Staphylococcus
ITTIDPIEYNLLFERFLNPERVTMPD

SEQ ID NO: 2071914 - protein, 17 aa, Staphylococcus
ITTLWKIANGLKVSFTE

SEQ ID NO: 2071915 - protein, 26 aa, Staphylococcus
ITTNDDIYFLLVQRNRKSSFYAAEMA

SEQ ID NO: 2071916 - protein, 24 aa, Staphylococcus
ITTNKLLHRIPQEKLPHLKKIIIV

SEQ ID NO: 2071917 - protein, 20 aa, Staphylococcus
ITVFDGTLTLILADEQFIIK

SEQ ID NO: 2071918 - protein, 18 aa, Staphylococcus
ITVGLGNLKTLSYASFLK

SEQ ID NO: 2071919 - protein, 19 aa, Staphylococcus
ITVNAYCPGIVKTPMMEDI

SEQ ID NO: 2071920 - protein, 17 aa, Staphylococcus
ITVPQDRLKLRKQTRQL

SEQ ID NO: 2071921 - protein, 27 aa, Staphylococcus
ITVQDVMFQLLYAIKDLGGRLNMNPIT

SEQ ID NO: 2071922 - protein, 25 aa, Staphylococcus
ITVSYPLEKLVFWIIQQKEELDRFK

SEQ ID NO: 2071923 - protein, 23 aa, Staphylococcus
ITYFIKAIIFKTLQQAKQIGVGP

SEQ ID NO: 2071924 - protein, 19 aa, Staphylococcus
ITYGHLDIIERSADRFDEI

SEQ ID NO: 2071925 - protein, 33 aa, Staphylococcus
ITYIKNATLILIKLYLYKLSKNKARYGKAISKN

SEQ ID NO: 2071926 - protein, 18 aa, Staphylococcus
ITYTGFILKFNVSENAFT

SEQ ID NO: 2071927 - protein, 17 aa, Staphylococcus
ITYVLENKARLKGIFLT

SEQ ID NO: 2071928 - protein, 17 aa, Staphylococcus
IVAGFLHDVIEDTPYTF

SEQ ID NO: 2071929 - protein, 17 aa, Staphylococcus
IVAILTGNGLKDPDTAI

SEQ ID NO: 2071930 - protein, 18 aa, Staphylococcus
IVAIRSMLIKGDQATLFA

SEQ ID NO: 2071931 - protein, 19 aa, Staphylococcus
IVAIRSMLIKGDQATLFAG

SEQ ID NO: 2071932 - protein, 23 aa, Staphylococcus
IVAIRSMLIKKNQATLFAGCGIV

SEQ ID NO: 2071933 - protein, 18 aa, Staphylococcus
IVAIRSMLIKKNQATLYA

SEQ ID NO: 2071934 - protein, 28 aa, Staphylococcus
IVALDRKEPIRFQWIDDYVVGVMLASKG

SEQ ID NO: 2071935 - protein, 24 aa, Staphylococcus
IVALGDFNDFQWSQPLKTLEGNQM

SEQ ID NO: 2071936 - protein, 25 aa, Staphylococcus
IVASTNMIFKYAYDTRLIKAMPSEG

SEQ ID NO: 2071937 - protein, 18 aa, Staphylococcus
IVATYDIPRFNKSPYDGF

SEQ ID NO: 2071938 - protein, 18 aa, Staphylococcus
IVCKPAVQTPLTTIRLVE

SEQ ID NO: 2071939 - protein, 25 aa, Staphylococcus
IVDAIYHYPTHQTFFSSSDKLSIGD

SEQ ID NO: 2071940 - protein, 19 aa, Staphylococcus
IVDETFEYILTVAKAGMTE

SEQ ID NO: 2071941 - protein, 19 aa, Staphylococcus
IVDGDQIMFIIGQAMSKNQ

SEQ ID NO: 2071942 - protein, 23 aa, Staphylococcus
IVDHPELLPQAQYKIELPAQKTG

SEQ ID NO: 2071943 - protein, 18 aa, Staphylococcus
IVDIVVAQYFYKKALESD

SEQ ID NO: 2071944 - protein, 18 aa, Staphylococcus
IVDKLTLDMIKQLIRIHH

SEQ ID NO: 2071945 - protein, 23 aa, Staphylococcus
IVDKTYEYILSIAKVGMSEREIK

SEQ ID NO: 2071946 - protein, 23 aa, Staphylococcus
IVDKTYEYILSIAKVGMTEQELK

SEQ ID NO: 2071947 - protein, 17 aa, Staphylococcus
IVDNSGLVGGYYKDYFK

SEQ ID NO: 2071948 - protein, 19 aa, Staphylococcus
IVDRLSLEMIKQLIRIHRA

SEQ ID NO: 2071949 - protein, 20 aa, Staphylococcus
IVDRLTLEMIKQLIRLHKPQ

SEQ ID NO: 2071950 - protein, 19 aa, Staphylococcus
IVDSLTKNWIKFLQENFLI

SEQ ID NO: 2071951 - protein, 33 aa, Staphylococcus
IVDYCRQNNFFAMTYQDGYIIYDDDHEYMNIES

SEQ ID NO: 2071952 - protein, 23 aa, Staphylococcus
IVEAQILDLITPRPSVINRNFVE

SEQ ID NO: 2071953 - protein, 22 aa, Staphylococcus
IVEDFVIIEKPMRAYSDNSNQM

SEQ ID NO: 2071954 - protein, 18 aa, Staphylococcus
IVEDSGLKLLFYAEKHLS

SEQ ID NO: 2071955 - protein, 19 aa, Staphylococcus
IVEDSIYSDLWFNTEKQVP

SEQ ID NO: 2071956 - protein, 18 aa, Staphylococcus
IVEFQVLNGMRIGELLAI

SEQ ID NO: 2071957 - protein, 22 aa, Staphylococcus
IVEINCHGGILTINHVLELTMS

SEQ ID NO: 2071958 - protein, 27 aa, Staphylococcus
IVEINCHGGILTINRILELTMTYGARM

SEQ ID NO: 2071959 - protein, 18 aa, Staphylococcus
IVEKLKHAEPGIGYNAAT

SEQ ID NO: 2071960 - protein, 27 aa, Staphylococcus
IVELAEQLITFIPHSLLTLNNVKYNER

SEQ ID NO: 2071961 - protein, 23 aa, Staphylococcus
IVELAEQLVTFIPHSLLVMNNEK

SEQ ID NO: 2071962 - protein, 25 aa, Staphylococcus
IVENLLGNTIIIDNLKHANDLARQI

SEQ ID NO: 2071963 - protein, 17 aa, Staphylococcus
IVEPYHNGSFKILAEIN

SEQ ID NO: 2071964 - protein, 17 aa, Staphylococcus
IVEVWILDIDKNKGKVS

SEQ ID NO: 2071965 - protein, 17 aa, Staphylococcus
IVEWYKKNNFDTSFEDL

SEQ ID NO: 2071966 - protein, 18 aa, Staphylococcus
IVFDSLTINLPTALYTPN

SEQ ID NO: 2071967 - protein, 18 aa, Staphylococcus
IVFSLKKMSKGGMLDLYF

SEQ ID NO: 2071968 - protein, 17 aa, Staphylococcus
IVGAILFEQTMDREVEG

SEQ ID NO: 2071969 - protein, 23 aa, Staphylococcus
IVGEGAMYALSPGKGFVAHREAN

SEQ ID NO: 2071970 - protein, 18 aa, Staphylococcus
IVGMNFGSLFDATQTRVI

SEQ ID NO: 2071971 - protein, 20 aa, Staphylococcus
IVGNKKVILAANKIDLLPKQ

SEQ ID NO: 2071972 - protein, 24 aa, Staphylococcus
IVGPGNQFVAYAKKYLFGQVGIDQ

SEQ ID NO: 2071973 - protein, 20 aa, Staphylococcus
IVGRIKGVERPALVVTLPTV

SEQ ID NO: 2071974 - protein, 30 aa, Staphylococcus
IVGRIKGVSRPALVVTLPTIDGKGFVFLDV

SEQ ID NO: 2071975 - protein, 29 aa, Staphylococcus
IVGSETAFPLLYTHFVKKGDWSLQQLVDY

SEQ ID NO: 2071976 - protein, 20 aa, Staphylococcus
IVGSFLRPEALKKARAQFEQ

SEQ ID NO: 2071977 - protein, 17 aa, Staphylococcus
IVHEAGGLLYYDGANLN

SEQ ID NO: 2071978 - protein, 24 aa, Staphylococcus
IVHKHYWNIGIAADTERGLLVPVV

SEQ ID NO: 2071979 - protein, 20 aa, Staphylococcus
IVHKLDEAYFKKIEAIEFAV

SEQ ID NO: 2071980 - protein, 18 aa, Staphylococcus
IVHPIVHQLMDKEKSHYL

SEQ ID NO: 2071981 - protein, 30 aa, Staphylococcus
IVHPMHPEFNYPFKYLSGAGVALKIAQALL

SEQ ID NO: 2071982 - protein, 19 aa, Staphylococcus
IVIEENFTFYNVDLDDGLM

SEQ ID NO: 2071983 - protein, 19 aa, Staphylococcus
IVIEENFTFYNVDLNDGLM

SEQ ID NO: 2071984 - protein, 20 aa, Staphylococcus
IVIEMINQIKFPLSDLQVVI

SEQ ID NO: 2071985 - protein, 23 aa, Staphylococcus
IVIEYIKVPKGIDIGQTLIGMHI

SEQ ID NO: 2071986 - protein, 17 aa, Staphylococcus
IVIGGMYEYGLSRYFTA

SEQ ID NO: 2071987 - protein, 17 aa, Staphylococcus
IVIGKTSKQFKTVKSLI

SEQ ID NO: 2071988 - protein, 35 aa, Staphylococcus
IVISDITRPTPNHILVPLILETLSHVPPENFVIIN

SEQ ID NO: 2071989 - protein, 19 aa, Staphylococcus
IVITHRKGTMEFSDRLYGV

SEQ ID NO: 2071990 - protein, 19 aa, Staphylococcus
IVITHRKGTMEYSDRLYGV

SEQ ID NO: 2071991 - protein, 25 aa, Staphylococcus
IVIYQGVTEFPFADLTSFREVQRGL

SEQ ID NO: 2071992 - protein, 24 aa, Staphylococcus
IVIYQGVTEFPFSKLTSFKEVQER

SEQ ID NO: 2071993 - protein, 20 aa, Staphylococcus
IVKGSPLIRRRFIDMELGQI

SEQ ID NO: 2071994 - protein, 38 aa, Staphylococcus
IVKKFPVGVVGAITPWNFPAAMITRKIAPALAAGCTIV

SEQ ID NO: 2071995 - protein, 26 aa, Staphylococcus
IVKKYQFLEKQVIAVLNLLEENNTVP

SEQ ID NO: 2071996 - protein, 27 aa, Staphylococcus
IVKNTPESWYFSKRLLYGKLNEIKEEF

SEQ ID NO: 2071997 - protein, 32 aa, Staphylococcus
IVKSTPLYQGLPNHFKIMRYHSLISNPKTFPS

SEQ ID NO: 2071998 - protein, 25 aa, Staphylococcus
IVKVDAPIVEGSFTAAVKLSIGGNL

SEQ ID NO: 2071999 - protein, 20 aa, Staphylococcus
IVKYSPDCKIIVLTNPVDAM

SEQ ID NO: 2072000 - protein, 17 aa, Staphylococcus
IVLFGMIESKEILPYLY

SEQ ID NO: 2072001 - protein, 18 aa, Staphylococcus
IVLGQLITSLQSIVSRNI

SEQ ID NO: 2072002 - protein, 18 aa, Staphylococcus
IVLLKRGIQAYDELMLYY

SEQ ID NO: 2072003 - protein, 17 aa, Staphylococcus
IVLLLNDNHDKFWDITK

SEQ ID NO: 2072004 - protein, 25 aa, Staphylococcus
IVLNGTWHCTQAVGKEWIKNGQRGR

SEQ ID NO: 2072005 - protein, 18 aa, Staphylococcus
IVLPKKWTLSQLVDYFMT

SEQ ID NO: 2072006 - protein, 23 aa, Staphylococcus
IVMSRIPYIKYGAADPKGGCSGS

SEQ ID NO: 2072007 - protein, 18 aa, Staphylococcus
IVNAILRHIFKSDLPTLE

SEQ ID NO: 2072008 - protein, 25 aa, Staphylococcus
IVNIDSSLMAMQFMLVAKSHGYDTN

SEQ ID NO: 2072009 - protein, 18 aa, Staphylococcus
IVNIVKIVFSSNGTPRLK

SEQ ID NO: 2072010 - protein, 26 aa, Staphylococcus
IVNNYDWLSSLTLLDFLRSYGKDFNI

SEQ ID NO: 2072011 - protein, 22 aa, Staphylococcus
IVPCWYCRFCNRGQYWMCEKHD

SEQ ID NO: 2072012 - protein, 20 aa, Staphylococcus
IVPEYRYKLKAFLDVHDLEL

SEQ ID NO: 2072013 - protein, 24 aa, Staphylococcus
IVPNLIDLPLKYDALEVDPSSGVI

SEQ ID NO: 2072014 - protein, 28 aa, Staphylococcus
IVPNNEKWIYDLLDMDATSPNDIINALP

SEQ ID NO: 2072015 - protein, 18 aa, Staphylococcus
IVPVSASVLRTLIWTPDA

SEQ ID NO: 2072016 - protein, 28 aa, Staphylococcus
IVPWNAPIMVLMRKVIPAVITGCSVVIK

SEQ ID NO: 2072017 - protein, 20 aa, Staphylococcus
IVPWQQLAKRKQATLKFIPM

SEQ ID NO: 2072018 - protein, 19 aa, Staphylococcus
IVQAIKTLQPLLLYAVTGA

SEQ ID NO: 2072019 - protein, 23 aa, Staphylococcus
IVQPHSMAFNYIYYDIYTQMVEM

SEQ ID NO: 2072020 - protein, 25 aa, Staphylococcus
IVQRVSVPVIIKEVGFGMSKELLQS

SEQ ID NO: 2072021 - protein, 17 aa, Staphylococcus
IVQTVPKSKLDNLANAP

SEQ ID NO: 2072022 - protein, 17 aa, Staphylococcus
IVRELTGGLYFGEPREL

SEQ ID NO: 2072023 - protein, 17 aa, Staphylococcus
IVRELTSGIYFGEPRHL

SEQ ID NO: 2072024 - protein, 26 aa, Staphylococcus
IVRHNRIHMTLPSLQYYYANKSNLYD

SEQ ID NO: 2072025 - protein, 17 aa, Staphylococcus
IVRPQIISGTHAITLAL

SEQ ID NO: 2072026 - protein, 26 aa, Staphylococcus
IVRQLNQYLPKYMIPKTVTAIDVIPL

SEQ ID NO: 2072027 - protein, 28 aa, Staphylococcus
IVRYKTMQGFYAPYVPGWDTHGLPIEQA

SEQ ID NO: 2072028 - protein, 27 aa, Staphylococcus
IVSALDYFLVHLKKWNYSYAYSMRLVD

SEQ ID NO: 2072029 - protein, 18 aa, Staphylococcus
IVSIFAHAVDFDPMLLTN

SEQ ID NO: 2072030 - protein, 18 aa, Staphylococcus
IVSIFAHEVNFDPMLLTN

SEQ ID NO: 2072031 - protein, 22 aa, Staphylococcus
IVSNIVYIRWFEDLRTDFINQY

SEQ ID NO: 2072032 - protein, 23 aa, Staphylococcus
IVSNIVYVRWFEDLRTIFVNKHL

SEQ ID NO: 2072033 - protein, 18 aa, Staphylococcus
IVSWKYHDNNIILGNVVE

SEQ ID NO: 2072034 - protein, 18 aa, Staphylococcus
IVTLLKYNLEQAGYIVEV

SEQ ID NO: 2072035 - protein, 18 aa, Staphylococcus
IVTTTRRKYDIPIIAQLT

SEQ ID NO: 2072036 - protein, 24 aa, Staphylococcus
IVTTYLDKDILLPAIGQGALGIEC

SEQ ID NO: 2072037 - protein, 26 aa, Staphylococcus
IVVGIAFIIELKYLHGIDKLDGYDVL

SEQ ID NO: 2072038 - protein, 25 aa, Staphylococcus
IVVGIAFIIELKYLHGIEKIKDYDV

SEQ ID NO: 2072039 - protein, 25 aa, Staphylococcus
IVVGIAFIIELKYLNGIEKIKDYDV

SEQ ID NO: 2072040 - protein, 21 aa, Staphylococcus
IVVNINYALAPEYKYPTPLVQ

SEQ ID NO: 2072041 - protein, 24 aa, Staphylococcus
IVVPDYMDIYDFTPIQYPADDQNS

SEQ ID NO: 2072042 - protein, 17 aa, Staphylococcus
IVVPDYMDIYDFTPVQF

SEQ ID NO: 2072043 - protein, 17 aa, Staphylococcus
IVVPRKVLFNDEKNAFN

SEQ ID NO: 2072044 - protein, 17 aa, Staphylococcus
IVVPRSILFDNNKNAFN

SEQ ID NO: 2072045 - protein, 24 aa, Staphylococcus
IVVSTKRKHHIPIIAQLTASNTNY

SEQ ID NO: 2072046 - protein, 27 aa, Staphylococcus
IVVVAHQILIRCALVYLGVLKREDAKQ

SEQ ID NO: 2072047 - protein, 17 aa, Staphylococcus
IVVWRLDRLGRNMEDLI

SEQ ID NO: 2072048 - protein, 19 aa, Staphylococcus
IVWATAAPGWQKWVWSPFL

SEQ ID NO: 2072049 - protein, 18 aa, Staphylococcus
IVWLAQYNQVACLLSQAG

SEQ ID NO: 2072050 - protein, 17 aa, Staphylococcus
IVYACDRILKGELDEHF

SEQ ID NO: 2072051 - protein, 30 aa, Staphylococcus
IVYEDIYFTMKSFSLAKKINIIPTVTYVWR

SEQ ID NO: 2072052 - protein, 27 aa, Staphylococcus
IVYGHMSPYMIVGMLASLKAGCGYVPI

SEQ ID NO: 2072053 - protein, 35 aa, Staphylococcus
IVYMTHYLMSHPNKLIPLTHFVKKFKQAKSSISED

SEQ ID NO: 2072054 - protein, 17 aa, Staphylococcus
IVYNGPLRIMAEYKYKM

SEQ ID NO: 2072055 - protein, 26 aa, Staphylococcus
IVYNKFKPYFNWTIEKLCENFNIAVD

SEQ ID NO: 2072056 - protein, 17 aa, Staphylococcus
IVYSTQNLDLWYGENHA

SEQ ID NO: 2072057 - protein, 31 aa, Staphylococcus
IVYVRIDRTRKLPLTVLLRALGFSSDQEIID

SEQ ID NO: 2072058 - protein, 32 aa, Staphylococcus
IVYVRIDRTRKLPLTVLLRALGYSTDQSIIDL

SEQ ID NO: 2072059 - protein, 18 aa, Staphylococcus
IWDGLLENENLVPAGLGA

SEQ ID NO: 2072060 - protein, 26 aa, Staphylococcus
IWKNVDYFMLPKDYLRYRLTGNIHME

SEQ ID NO: 2072061 - protein, 22 aa, Staphylococcus
IWPKTMMSKIQPGLFLCGEVLD

SEQ ID NO: 2072062 - protein, 18 aa, Staphylococcus
IWPKTMMSKLEPGLFLCG

SEQ ID NO: 2072063 - protein, 23 aa, Staphylococcus
IWPKTMMSKLQPGLFLCGEVLDI

SEQ ID NO: 2072064 - protein, 17 aa, Staphylococcus
IWQLFKDAGYDRVEFDT

SEQ ID NO: 2072065 - protein, 21 aa, Staphylococcus
IWRAPIDNDAYIKKEWLYSGY

SEQ ID NO: 2072066 - protein, 18 aa, Staphylococcus
IWRSVYEHGDWDISINGL

SEQ ID NO: 2072067 - protein, 20 aa, Staphylococcus
IWRVVPRAWSHVFLSLIGEP

SEQ ID NO: 2072068 - protein, 19 aa, Staphylococcus
IWTVVPRAWSHVYLALTRQ

SEQ ID NO: 2072069 - protein, 25 aa, Staphylococcus
IWVDDTLLALQELAKAYLKHVNPKV

SEQ ID NO: 2072070 - protein, 19 aa, Staphylococcus
IWVDDTLTALQQLAKAYLK

SEQ ID NO: 2072071 - protein, 19 aa, Staphylococcus
IYADTSFVLEYLKYAERFV

SEQ ID NO: 2072072 - protein, 21 aa, Staphylococcus
IYAHVMHTHLLINFVTRTEGV

SEQ ID NO: 2072073 - protein, 19 aa, Staphylococcus
IYASVRLLWSRIGKPFVGY

SEQ ID NO: 2072074 - protein, 27 aa, Staphylococcus
IYATDKWNIQIVYDKFIIMGYTDTDLT

SEQ ID NO: 2072075 - protein, 18 aa, Staphylococcus
IYCGTIGLLLPNDKMIFN

SEQ ID NO: 2072076 - protein, 18 aa, Staphylococcus
IYCGTIGMLLPEGRMIFN

SEQ ID NO: 2072077 - protein, 18 aa, Staphylococcus
IYCTIGIGSNLLLSKVAM

SEQ ID NO: 2072078 - protein, 17 aa, Staphylococcus
IYDCATEARKFGKAIIA

SEQ ID NO: 2072079 - protein, 24 aa, Staphylococcus
IYDDDVIQWIPLKSLYHPDHDVLV

SEQ ID NO: 2072080 - protein, 19 aa, Staphylococcus
IYDGVTDGILFYRMKNFDN

SEQ ID NO: 2072081 - protein, 18 aa, Staphylococcus
IYDIVKQYGFVKRFQVVE

SEQ ID NO: 2072082 - protein, 17 aa, Staphylococcus
IYECHTPIISAVGHETD

SEQ ID NO: 2072083 - protein, 19 aa, Staphylococcus
IYELALKRDIFFHHPYESF

SEQ ID NO: 2072084 - protein, 18 aa, Staphylococcus
IYELSEIIQPHPALLEAI

SEQ ID NO: 2072085 - protein, 20 aa, Staphylococcus
IYERPKGKFRFPMNISDNEV

SEQ ID NO: 2072086 - protein, 18 aa, Staphylococcus
IYESLNVFNFYRVPQRMC

SEQ ID NO: 2072087 - protein, 26 aa, Staphylococcus
IYEYTNSPMFYKWDDIVIYMRLERVG

SEQ ID NO: 2072088 - protein, 18 aa, Staphylococcus
IYFEGMPDKKTFKACFKI

SEQ ID NO: 2072089 - protein, 27 aa, Staphylococcus
IYFPEFDDYLLLWKLEVLDNYKNKGYG

SEQ ID NO: 2072090 - protein, 24 aa, Staphylococcus
IYGDFQRFYRPAIKALHHLGATDV

SEQ ID NO: 2072091 - protein, 18 aa, Staphylococcus
IYHHVMKSVYQFYNVGDT

SEQ ID NO: 2072092 - protein, 17 aa, Staphylococcus
IYHLAQVLGKRLPDDLK

SEQ ID NO: 2072093 - protein, 27 aa, Staphylococcus
IYHNGKYYVSHQWFPLGAVHGLKYWFN

SEQ ID NO: 2072094 - protein, 19 aa, Staphylococcus
IYHQAYKKGVPQFDLKEIG

SEQ ID NO: 2072095 - protein, 20 aa, Staphylococcus
IYHSPIRLLVVIQAPDQYIK

SEQ ID NO: 2072096 - protein, 20 aa, Staphylococcus
IYHSPIRLLVVIQAPDTHIQ

SEQ ID NO: 2072097 - protein, 17 aa, Staphylococcus
IYHVLMKMFENLNALDS

SEQ ID NO: 2072098 - protein, 17 aa, Staphylococcus
IYHVYSPHVLTMKNVLE

SEQ ID NO: 2072099 - protein, 17 aa, Staphylococcus
IYIAMKRTAKEKFDDES

SEQ ID NO: 2072100 - protein, 17 aa, Staphylococcus
IYIPLNNDALENGNMGA

SEQ ID NO: 2072101 - protein, 18 aa, Staphylococcus
IYIRKFAIEKLPKILNEE

SEQ ID NO: 2072102 - protein, 18 aa, Staphylococcus
IYISTFSKSLFPSCRIAY

SEQ ID NO: 2072103 - protein, 18 aa, Staphylococcus
IYISTFSKSLYPSCRIAY

SEQ ID NO: 2072104 - protein, 19 aa, Staphylococcus
IYISTFSKSLYPSCRMAYI

SEQ ID NO: 2072105 - protein, 25 aa, Staphylococcus
IYKLRNYKEKLIIPGFFGISKQNYI

SEQ ID NO: 2072106 - protein, 23 aa, Staphylococcus
IYKPYIEGFVKMLAPIAPHIGEE

SEQ ID NO: 2072107 - protein, 23 aa, Staphylococcus
IYKPYVEGFVKMLAPIAPHVSEE

SEQ ID NO: 2072108 - protein, 20 aa, Staphylococcus
IYKQKLYQLGIEPKIIDHYT

SEQ ID NO: 2072109 - protein, 17 aa, Staphylococcus
IYKTYFQDVGTFSQTNY

SEQ ID NO: 2072110 - protein, 18 aa, Staphylococcus
IYLKEAGIKVNYLHSEIK

SEQ ID NO: 2072111 - protein, 18 aa, Staphylococcus
IYLPGGHGTVFDFANNEK

SEQ ID NO: 2072112 - protein, 18 aa, Staphylococcus
IYLVVPPQHHLYKRIQQN

SEQ ID NO: 2072113 - protein, 19 aa, Staphylococcus
IYMLVAERFIASLMEPYQY

SEQ ID NO: 2072114 - protein, 18 aa, Staphylococcus
IYNAFFHLRLMKQSGSDY

SEQ ID NO: 2072115 - protein, 36 aa, Staphylococcus
IYNDYKYDLFKFNNAFIIGLKYKSGFIRGFNKTIIF

SEQ ID NO: 2072116 - protein, 18 aa, Staphylococcus
IYNGLDMFILQGAASFNI

SEQ ID NO: 2072117 - protein, 23 aa, Staphylococcus
IYNHIRGLSPWPVAYTVMDDGNM

SEQ ID NO: 2072118 - protein, 33 aa, Staphylococcus
IYNHLYQIPCTCLRFFNIYGPRQNPTSDYSGVI

SEQ ID NO: 2072119 - protein, 17 aa, Staphylococcus
IYNIVLEANLKGIEAAK

SEQ ID NO: 2072120 - protein, 18 aa, Staphylococcus
IYNIVLNSQIKAINEIKA

SEQ ID NO: 2072121 - protein, 18 aa, Staphylococcus
IYNIYDLEWDQELLDILE

SEQ ID NO: 2072122 - protein, 25 aa, Staphylococcus
IYNLNGFFEPLHQLIIHMIQEGFID

SEQ ID NO: 2072123 - protein, 22 aa, Staphylococcus
IYNLPGHVFIFGGQSLFDKMID

SEQ ID NO: 2072124 - protein, 22 aa, Staphylococcus
IYNPNIKKVIFASSAAIYGHLP

SEQ ID NO: 2072125 - protein, 18 aa, Staphylococcus
IYNYPTHQTFFSSSDKLS

SEQ ID NO: 2072126 - protein, 18 aa, Staphylococcus
IYPHHHPKFNINESSMLV

SEQ ID NO: 2072127 - protein, 19 aa, Staphylococcus
IYPHHHPKFNISESSMLVA

SEQ ID NO: 2072128 - protein, 18 aa, Staphylococcus
IYPVVPPKVEYRLTSVGL

SEQ ID NO: 2072129 - protein, 24 aa, Staphylococcus
IYQLEALQLQFVSNGLQSAVVVIK

SEQ ID NO: 2072130 - protein, 20 aa, Staphylococcus
IYQLKHQFTHLTWNIKVYEI

SEQ ID NO: 2072131 - protein, 23 aa, Staphylococcus
IYQPYAEGFVKMLAPIAPHIGEE

SEQ ID NO: 2072132 - protein, 20 aa, Staphylococcus
IYQSFIDCPVYVDNDANVAA

SEQ ID NO: 2072133 - protein, 17 aa, Staphylococcus
IYRGVCNVGVKPTFHDP

SEQ ID NO: 2072134 - protein, 17 aa, Staphylococcus
IYRKDNQYYFVDYKTDT

SEQ ID NO: 2072135 - protein, 31 aa, Staphylococcus
IYRLGVEYLDLYLIHWPNPKQGKYVEAWQAM

SEQ ID NO: 2072136 - protein, 17 aa, Staphylococcus
IYRLILKIQNKQFGLRF

SEQ ID NO: 2072137 - protein, 24 aa, Staphylococcus
IYRMKGFIQFIDQPHTYLVQYMQG

SEQ ID NO: 2072138 - protein, 17 aa, Staphylococcus
IYRQLYTQLKEDILAFK

SEQ ID NO: 2072139 - protein, 19 aa, Staphylococcus
IYSSLDELLDRFYDARGER

SEQ ID NO: 2072140 - protein, 26 aa, Staphylococcus
IYSYELYNFFDVDTIIRIGSCGALQE

SEQ ID NO: 2072141 - protein, 17 aa, Staphylococcus
IYTARKGLRTGIVADRI

SEQ ID NO: 2072142 - protein, 25 aa, Staphylococcus
IYTGSLYLSLISLLEHHDLHAGQTI

SEQ ID NO: 2072143 - protein, 26 aa, Staphylococcus
IYTGSLYLSLISLLENRSLKGGQTIG

SEQ ID NO: 2072144 - protein, 22 aa, Staphylococcus
IYTGSLYLSLISLLENRTLTPG

SEQ ID NO: 2072145 - protein, 26 aa, Staphylococcus
IYTGSLYLSLISLLETRDLKGGQTIG

SEQ ID NO: 2072146 - protein, 17 aa, Staphylococcus
IYTHPINNYILNGITRQ

SEQ ID NO: 2072147 - protein, 21 aa, Staphylococcus
IYVCGGKSFIQSMIKSLKELN

SEQ ID NO: 2072148 - protein, 30 aa, Staphylococcus
IYVNVEGNIVFVFKDGTTCICKCEPNKPNE

SEQ ID NO: 2072149 - protein, 21 aa, Staphylococcus
IYVPKNIKLDTPLQAYFRINS

SEQ ID NO: 2072150 - protein, 18 aa, Staphylococcus
IYVSEGQYYFVDYKTDAF

SEQ ID NO: 2072151 - protein, 28 aa, Staphylococcus
IYVSRSHPGLLKRLFEQEVPEIFDGTVI

SEQ ID NO: 2072152 - protein, 28 aa, Staphylococcus
IYVSRSHPGLLKRLFEQEVPEIYDGTVI

SEQ ID NO: 2072153 - protein, 17 aa, Staphylococcus
IYWNTLDSRNGYILQSN

SEQ ID NO: 2072154 - protein, 17 aa, Staphylococcus
IYYDRPKAGWIWNDNKV

SEQ ID NO: 2072155 - protein, 22 aa, Staphylococcus
IYYESRVIPLNLPQSLDLDEAY

SEQ ID NO: 2072156 - protein, 25 aa, Staphylococcus
KAAAKYYFNKDLKDLNLAESAYLAG

SEQ ID NO: 2072157 - protein, 18 aa, Staphylococcus
KAAAPKYIKFQLNRNGKS

SEQ ID NO: 2072158 - protein, 23 aa, Staphylococcus
KAAFIEYLLFHYQFKSRISVWVL

SEQ ID NO: 2072159 - protein, 24 aa, Staphylococcus
KAAHPNTILFLTADAFGVLPPISK

SEQ ID NO: 2072160 - protein, 17 aa, Staphylococcus
KAALAMALAHDTKLLIL

SEQ ID NO: 2072161 - protein, 21 aa, Staphylococcus
KAALIGFTRNIAAELGQYGIT

SEQ ID NO: 2072162 - protein, 17 aa, Staphylococcus
KAARRWAYDVKNIQPDK

SEQ ID NO: 2072163 - protein, 18 aa, Staphylococcus
KAARRWAYEHKDIEPDKA

SEQ ID NO: 2072164 - protein, 22 aa, Staphylococcus
KAAVRGLHKYSNDTKIIAVTQL

SEQ ID NO: 2072165 - protein, 27 aa, Staphylococcus
KACAMITFRLLKHYDDLPSMLNIYGKD

SEQ ID NO: 2072166 - protein, 26 aa, Staphylococcus
KACAMITFRLLKNYDSLNDMLAVYGK

SEQ ID NO: 2072167 - protein, 22 aa, Staphylococcus
KACKHGFLRYPYIETFKDIDEV

SEQ ID NO: 2072168 - protein, 30 aa, Staphylococcus
KACVDLSIQYIPQRLLPDKALDILDITAAH

SEQ ID NO: 2072169 - protein, 22 aa, Staphylococcus
KADILYIGFISSKGAIEEGSKR

SEQ ID NO: 2072170 - protein, 23 aa, Staphylococcus
KADTVVIPTTSIPQGIAALFQYD

SEQ ID NO: 2072171 - protein, 26 aa, Staphylococcus
KADVILYDRLVNKALLEYAKPNTRLI

SEQ ID NO: 2072172 - protein, 24 aa, Staphylococcus
KADYQVMILHPWQYDEILHRDYQD

SEQ ID NO: 2072173 - protein, 24 aa, Staphylococcus
KAEDKLILLFTGPLTDLAKALKTD

SEQ ID NO: 2072174 - protein, 26 aa, Staphylococcus
KAEEYFDRILLLNQTLRYIGPPKEAL

SEQ ID NO: 2072175 - protein, 26 aa, Staphylococcus
KAEGYDYFGLLYIGAILTSEGPKVIE

SEQ ID NO: 2072176 - protein, 26 aa, Staphylococcus
KAEGYPAIFVHCYTEFFNHIGYVDAK

SEQ ID NO: 2072177 - protein, 34 aa, Staphylococcus
KAEISKRFSSIQDYLLEYCNFGCPYFVVKHLSKN

SEQ ID NO: 2072178 - protein, 28 aa, Staphylococcus
KAEISKRFSTIQDYLLEYCNFGCAYFVL

SEQ ID NO: 2072179 - protein, 26 aa, Staphylococcus
KAELDQRLPIKAALKQLSFFIQQDCS

SEQ ID NO: 2072180 - protein, 26 aa, Staphylococcus
KAELNYAGNFLYMLRGELPTDIEVEA

SEQ ID NO: 2072181 - protein, 21 aa, Staphylococcus
KAELVNFAIKSVDKAAHSNLI

SEQ ID NO: 2072182 - protein, 26 aa, Staphylococcus
KAEQTEITVFFLNGFQMKGVIEDFDK

SEQ ID NO: 2072183 - protein, 19 aa, Staphylococcus
KAESVAICWAMGVTQQDIG

SEQ ID NO: 2072184 - protein, 19 aa, Staphylococcus
KAESVSICWAMGITQQDIG

SEQ ID NO: 2072185 - protein, 23 aa, Staphylococcus
KAEVLMFKGIPYQIKLSTGHDEK

SEQ ID NO: 2072186 - protein, 24 aa, Staphylococcus
KAEVLVFKGIPYQIKLSTTEKEER

SEQ ID NO: 2072187 - protein, 22 aa, Staphylococcus
KAFDDLKRLYLSRLSRYNEIAF

SEQ ID NO: 2072188 - protein, 21 aa, Staphylococcus
KAFELDAIDYILKPFELERIE

SEQ ID NO: 2072189 - protein, 18 aa, Staphylococcus
KAFFPSHFEDGIQVVIDY

SEQ ID NO: 2072190 - protein, 25 aa, Staphylococcus
KAFLDQIHQRLYLEQSLLVERIKKY

SEQ ID NO: 2072191 - protein, 20 aa, Staphylococcus
KAFNFKSICINPTHVKYAAE

SEQ ID NO: 2072192 - protein, 23 aa, Staphylococcus
KAFNGMSFLNLVDFDALYGHRRD

SEQ ID NO: 2072193 - protein, 17 aa, Staphylococcus
KAFRNLFTGENFGKQIV

SEQ ID NO: 2072194 - protein, 18 aa, Staphylococcus
KAFTLDILKSMKAYQLKW

SEQ ID NO: 2072195 - protein, 31 aa, Staphylococcus
KAFVEAYRLLSKLVLRMKAFDEFEFTSSSVG

SEQ ID NO: 2072196 - protein, 20 aa, Staphylococcus
KAFVLPIEGANLPSVIGWRT

SEQ ID NO: 2072197 - protein, 19 aa, Staphylococcus
KAFYQVENLPYTSTGKLQR

SEQ ID NO: 2072198 - protein, 17 aa, Staphylococcus
KAGANVTVIYRGDHYPK

SEQ ID NO: 2072199 - protein, 39 aa, Staphylococcus
KAGANVTVIYRGERYPKAIKPWILPNFESLVNHEKITME

SEQ ID NO: 2072200 - protein, 18 aa, Staphylococcus
KAGDIIRLLEGPISFVES

SEQ ID NO: 2072201 - protein, 23 aa, Staphylococcus
KAGKLEYYAPIQNITLCCGDRVV

SEQ ID NO: 2072202 - protein, 19 aa, Staphylococcus
KAHAIFNHGMTPIICVGES

SEQ ID NO: 2072203 - protein, 26 aa, Staphylococcus
KAHELQPDLILMDLLMDDMDGVEATT

SEQ ID NO: 2072204 - protein, 32 aa, Staphylococcus
KAHGTALTYAERYFLMKFFNIPTDEDDADAKE

SEQ ID NO: 2072205 - protein, 25 aa, Staphylococcus
KAHPDVFNILLQVLDDGFLTDTKGR

SEQ ID NO: 2072206 - protein, 25 aa, Staphylococcus
KAHPKIFDILLQVFDDARLTNSLGE

SEQ ID NO: 2072207 - protein, 41 aa, Staphylococcus
KAHVQRGIVFLIMRFKVLDEVYLLPYSKFEYFWKRYKADVK

SEQ ID NO: 2072208 - protein, 17 aa, Staphylococcus
KAIDMSILFTNKLSLIK

SEQ ID NO: 2072209 - protein, 21 aa, Staphylococcus
KAIDRPLHFETYISLTCQKCP

SEQ ID NO: 2072210 - protein, 23 aa, Staphylococcus
KAIDYLREKGIAKAAKKADRIAA

SEQ ID NO: 2072211 - protein, 19 aa, Staphylococcus
KAIFECQTPIISAVGHETD

SEQ ID NO: 2072212 - protein, 20 aa, Staphylococcus
KAIGVITRNDVLKAMQLIGR

SEQ ID NO: 2072213 - protein, 21 aa, Staphylococcus
KAIHFWSNDAELLMLLISDNG

SEQ ID NO: 2072214 - protein, 22 aa, Staphylococcus
KAILDITGPLADYIHFANSAVD

SEQ ID NO: 2072215 - protein, 21 aa, Staphylococcus
KAIPRFPKKIAILTADTGAAI

SEQ ID NO: 2072216 - protein, 20 aa, Staphylococcus
KAISSPLLETSIVGAQGVLM

SEQ ID NO: 2072217 - protein, 26 aa, Staphylococcus
KAITDKTLIKPIPTLSTGTFDGSSLA

SEQ ID NO: 2072218 - protein, 18 aa, Staphylococcus
KAKASLLTVLPLDKERLA

SEQ ID NO: 2072219 - protein, 20 aa, Staphylococcus
KAKAYFKKVLPIHKAKTLVQ

SEQ ID NO: 2072220 - protein, 30 aa, Staphylococcus
KAKDNSLEHLLFGLGIRHLGVKASQVLAEK

SEQ ID NO: 2072221 - protein, 18 aa, Staphylococcus
KAKEILNYKEQHGQFTSV

SEQ ID NO: 2072222 - protein, 32 aa, Staphylococcus
KAKKTFGSWKSWLDKTLGWIKNIKKDFGSAAS

SEQ ID NO: 2072223 - protein, 17 aa, Staphylococcus
KAKLAVFTYPNYYGECF

SEQ ID NO: 2072224 - protein, 19 aa, Staphylococcus
KAKPIIDILPVVQDINKID

SEQ ID NO: 2072225 - protein, 17 aa, Staphylococcus
KAKSEITLGLKPGGLFI

SEQ ID NO: 2072226 - protein, 30 aa, Staphylococcus
KAKSNSLEHLLFGLGIRHLGAKASYVLAEK

SEQ ID NO: 2072227 - protein, 30 aa, Staphylococcus
KAKSNSLEQLLFGLGIRHLGVKASQVIAEK

SEQ ID NO: 2072228 - protein, 29 aa, Staphylococcus
KAKSVASTIVYLPEYIRTLKSGFRDGSYE

SEQ ID NO: 2072229 - protein, 23 aa, Staphylococcus
KAKTGALLKFSILSAADIANVNK

SEQ ID NO: 2072230 - protein, 23 aa, Staphylococcus
KALAIIEPVPLFNKTKQDIKETL

SEQ ID NO: 2072231 - protein, 18 aa, Staphylococcus
KALAPLYHTKEDLLHGLQ

SEQ ID NO: 2072232 - protein, 24 aa, Staphylococcus
KALDKPLHFETFISLSCHKCPDVV

SEQ ID NO: 2072233 - protein, 20 aa, Staphylococcus
KALESLVSLDKFLLKGIQTK

SEQ ID NO: 2072234 - protein, 17 aa, Staphylococcus
KALFKSLQQHHITRYYH

SEQ ID NO: 2072235 - protein, 20 aa, Staphylococcus
KALFNLNKNILLKGPTGSGK

SEQ ID NO: 2072236 - protein, 21 aa, Staphylococcus
KALFQLEKHSYRLDGDNVRHG

SEQ ID NO: 2072237 - protein, 21 aa, Staphylococcus
KALLRMRMESKVKQYVTIDLR

SEQ ID NO: 2072238 - protein, 19 aa, Staphylococcus
KALNIAHRRKGRQTVYIPA

SEQ ID NO: 2072239 - protein, 33 aa, Staphylococcus
KALNKFYDMQLSNLYIYKLAVIANMKLQSLSSC

SEQ ID NO: 2072240 - protein, 18 aa, Staphylococcus
KALNNISLRFKQGHYYAI

SEQ ID NO: 2072241 - protein, 24 aa, Staphylococcus
KALNPKLKTFAPVREWAWSREEEI

SEQ ID NO: 2072242 - protein, 25 aa, Staphylococcus
KALQDLAKAYLKYVNPKVIAVTGSN

SEQ ID NO: 2072243 - protein, 26 aa, Staphylococcus
KALQLLDTPGILWPKFEDETVGKKLS

SEQ ID NO: 2072244 - protein, 25 aa, Staphylococcus
KALQPYQINMSLIQKIQNPDVKVLH

SEQ ID NO: 2072245 - protein, 21 aa, Staphylococcus
KALSMWMTLKCGIVDLPYGGG

SEQ ID NO: 2072246 - protein, 25 aa, Staphylococcus
KALSSAKVIIIDTYYLMMGGYHKKK

SEQ ID NO: 2072247 - protein, 31 aa, Staphylococcus
KALSSARVILIDTYYLMLGGYRKKRGQTIIQ

SEQ ID NO: 2072248 - protein, 25 aa, Staphylococcus
KALSTDMPVFFSANMSYGVHALTKI

SEQ ID NO: 2072249 - protein, 25 aa, Staphylococcus
KALYEMIDYFYFLVENDQRINHLFP

SEQ ID NO: 2072250 - protein, 24 aa, Staphylococcus
KAMDMWIDPIVEKYKDYEWYTVNR

SEQ ID NO: 2072251 - protein, 29 aa, Staphylococcus
KAMFERFIHLKYWQYHDHWLGYCTNELIQ

SEQ ID NO: 2072252 - protein, 18 aa, Staphylococcus
KAMPSVRKYAREKGVNIK

SEQ ID NO: 2072253 - protein, 25 aa, Staphylococcus
KANDSIMILVIIYNSGHVEHFHLNS

SEQ ID NO: 2072254 - protein, 26 aa, Staphylococcus
KANERWLRLTINSLILQYQYPIGYNY

SEQ ID NO: 2072255 - protein, 34 aa, Staphylococcus
KANIVIWNAPNHEYIPYHFGINHAQKVIKDGRVI

SEQ ID NO: 2072256 - protein, 17 aa, Staphylococcus
KANLPVIPGTDGPIESY

SEQ ID NO: 2072257 - protein, 25 aa, Staphylococcus
KANPFGMILSLAMCLRESFKEIEAA

SEQ ID NO: 2072258 - protein, 17 aa, Staphylococcus
KANYWKGVEAVGGHIVF

SEQ ID NO: 2072259 - protein, 21 aa, Staphylococcus
KAPEIGLATVYRTLELLAELK

SEQ ID NO: 2072260 - protein, 20 aa, Staphylococcus
KAPEIGLATVYRTLELLSEL

SEQ ID NO: 2072261 - protein, 26 aa, Staphylococcus
KAPGFGDRRKAMLEDLAILTGATVIT

SEQ ID NO: 2072262 - protein, 17 aa, Staphylococcus
KAPLFYEMTDQYGFYVM

SEQ ID NO: 2072263 - protein, 23 aa, Staphylococcus
KAPLRRQAIVLIGMIEEKEILPY

SEQ ID NO: 2072264 - protein, 26 aa, Staphylococcus
KAQAATIFEFLKYSPGRYAQEINNPI

SEQ ID NO: 2072265 - protein, 22 aa, Staphylococcus
KAQDKLSTVLILDGLEDPHNLG

SEQ ID NO: 2072266 - protein, 26 aa, Staphylococcus
KAQELKPDLILMDLLMEDMDGVEATT

SEQ ID NO: 2072267 - protein, 21 aa, Staphylococcus
KAQHPFFDRESLVINGLHVTT

SEQ ID NO: 2072268 - protein, 23 aa, Staphylococcus
KAQKLIIQTVPKSKLDNLANAPH

SEQ ID NO: 2072269 - protein, 24 aa, Staphylococcus
KAQKVTLNEFLEYGFKGNKLGYSY

SEQ ID NO: 2072270 - protein, 24 aa, Staphylococcus
KAQLDHSKIYYEWLEQLSESLESG

SEQ ID NO: 2072271 - protein, 24 aa, Staphylococcus
KAQPLIMGCYGIGISRTLSAIVEQ

SEQ ID NO: 2072272 - protein, 21 aa, Staphylococcus
KAQQFYTEKLGFKTKHNIEIG

SEQ ID NO: 2072273 - protein, 17 aa, Staphylococcus
KAQQLDIPFIYLTAKTQ

SEQ ID NO: 2072274 - protein, 25 aa, Staphylococcus
KAQSQKFFELYTPLLKEGGLVIIDN

SEQ ID NO: 2072275 - protein, 25 aa, Staphylococcus
KAQSVLTDILPTIDNIERALQIEGN

SEQ ID NO: 2072276 - protein, 17 aa, Staphylococcus
KARACGIHMLVATQRPS

SEQ ID NO: 2072277 - protein, 24 aa, Staphylococcus
KARDYSLTGLEFACGIPGSIGGAV

SEQ ID NO: 2072278 - protein, 18 aa, Staphylococcus
KARFIYISTISVGTVFDS

SEQ ID NO: 2072279 - protein, 17 aa, Staphylococcus
KARHLSFQTEDMKRQSK

SEQ ID NO: 2072280 - protein, 20 aa, Staphylococcus
KARHLSFQTEDMKRQSKIFR

SEQ ID NO: 2072281 - protein, 21 aa, Staphylococcus
KARIDTIRKVADRLGKTIGIL

SEQ ID NO: 2072282 - protein, 22 aa, Staphylococcus
KARIDTIRKVAKKLGKTIGILL

SEQ ID NO: 2072283 - protein, 23 aa, Staphylococcus
KARKGYLWFHTKDIPGSHVVIFA

SEQ ID NO: 2072284 - protein, 25 aa, Staphylococcus
KARLDKGVIVTIFPDGSDRYMSKSI

SEQ ID NO: 2072285 - protein, 19 aa, Staphylococcus
KARLKLNDTHFTIGTFDSG

SEQ ID NO: 2072286 - protein, 24 aa, Staphylococcus
KARYGEHTVLIPSGTYYISKALII

SEQ ID NO: 2072287 - protein, 25 aa, Staphylococcus
KASFNFFSLFTFTEPIEQVVTHFLA

SEQ ID NO: 2072288 - protein, 20 aa, Staphylococcus
KASHDILAKERGWPMYDENS

SEQ ID NO: 2072289 - protein, 20 aa, Staphylococcus
KASLPIFKQTRSWLDTYFKG

SEQ ID NO: 2072290 - protein, 26 aa, Staphylococcus
KASYEDGILVVILPKEVSAQDQSTTI

SEQ ID NO: 2072291 - protein, 24 aa, Staphylococcus
KASYTLHRRVYVSKLDKVKMYKTI

SEQ ID NO: 2072292 - protein, 20 aa, Staphylococcus
KATIFISDMNDFQYINEVYG

SEQ ID NO: 2072293 - protein, 27 aa, Staphylococcus
KATIRKGPNIKLPSLELLEDPEIHQID

SEQ ID NO: 2072294 - protein, 23 aa, Staphylococcus
KATLLTGANFWNTARVPGVNEIL

SEQ ID NO: 2072295 - protein, 25 aa, Staphylococcus
KATSFAKLIKYENYEFTLFKDGRMN

SEQ ID NO: 2072296 - protein, 36 aa, Staphylococcus
KATTVTPGPWHLHRMLLAAESLPLNIGFTGKGQAVN

SEQ ID NO: 2072297 - protein, 28 aa, Staphylococcus
KATTVTPGPWYIHRMLEAAEDLPINVGF

SEQ ID NO: 2072298 - protein, 17 aa, Staphylococcus
KATVDSMLFRGVHYEIC

SEQ ID NO: 2072299 - protein, 38 aa, Staphylococcus
KAVEKFDFNKGFKFSTYATWWIRQAITRAIADQARTIR

SEQ ID NO: 2072300 - protein, 25 aa, Staphylococcus
KAVELMLLKYDVIQDMLYNLDYSKF

SEQ ID NO: 2072301 - protein, 20 aa, Staphylococcus
KAVILGKQLIQLGEAKVVAV

SEQ ID NO: 2072302 - protein, 22 aa, Staphylococcus
KAVITVPAYFNDAERQATKDAG

SEQ ID NO: 2072303 - protein, 26 aa, Staphylococcus
KAVLDIETLFPFITISHFTDIEISQY

SEQ ID NO: 2072304 - protein, 17 aa, Staphylococcus
KAVLYFYPRDNTPTCTT

SEQ ID NO: 2072305 - protein, 24 aa, Staphylococcus
KAVYKLLEKGIYPKDIMTKEAFEN

SEQ ID NO: 2072306 - protein, 18 aa, Staphylococcus
KAWIPIDGTYDLGPGPRI

SEQ ID NO: 2072307 - protein, 17 aa, Staphylococcus
KAWMVKVELSDESQLEE

SEQ ID NO: 2072308 - protein, 26 aa, Staphylococcus
KAYENIKIVGLMTMAPFTDDTQYIQE

SEQ ID NO: 2072309 - protein, 21 aa, Staphylococcus
KAYFEPFVELAKRKDPQKRPV

SEQ ID NO: 2072310 - protein, 18 aa, Staphylococcus
KAYFFHSKIQFVNFYLEV

SEQ ID NO: 2072311 - protein, 20 aa, Staphylococcus
KAYFNELKFDDSLRNKIKTA

SEQ ID NO: 2072312 - protein, 18 aa, Staphylococcus
KAYGFKFLGPVTVFSFME

SEQ ID NO: 2072313 - protein, 32 aa, Staphylococcus
KAYHDSLLKFYELGARYIQLDDVYWANLTSGT

SEQ ID NO: 2072314 - protein, 20 aa, Staphylococcus
KAYILALTELFENKKDELCE

SEQ ID NO: 2072315 - protein, 23 aa, Staphylococcus
KAYKAWRQWSHKDRAELLLRVAA

SEQ ID NO: 2072316 - protein, 25 aa, Staphylococcus
KAYKEWKLEDLPIIPKRMQTVVIGK

SEQ ID NO: 2072317 - protein, 18 aa, Staphylococcus
KAYQISQFDEPIGEHGYI

SEQ ID NO: 2072318 - protein, 18 aa, Staphylococcus
KAYQISQFDEPIGENGYI

SEQ ID NO: 2072319 - protein, 24 aa, Staphylococcus
KCERYHVPFIVNDDIELAKDIDAD

SEQ ID NO: 2072320 - protein, 25 aa, Staphylococcus
KCESYHVPFRIFSTRAELGQSLGKS

SEQ ID NO: 2072321 - protein, 30 aa, Staphylococcus
KCFAHLFKMIIHKPIWLISERKDSASDNSY

SEQ ID NO: 2072322 - protein, 17 aa, Staphylococcus
KCFSLGAKDYIAKPFYM

SEQ ID NO: 2072323 - protein, 24 aa, Staphylococcus
KCGTTYHLVFNPPKVDGICDIDGG

SEQ ID NO: 2072324 - protein, 31 aa, Staphylococcus
KCLMDEFWPGPISFILPLRQGYLCEKVTGGL

SEQ ID NO: 2072325 - protein, 23 aa, Staphylococcus
KCMTKYDFANFLKLLYQEYTKLD

SEQ ID NO: 2072326 - protein, 17 aa, Staphylococcus
KCNLSERLGFIFRTSTN

SEQ ID NO: 2072327 - protein, 17 aa, Staphylococcus
KCRPAINYYLNMVYPHE

SEQ ID NO: 2072328 - protein, 27 aa, Staphylococcus
KDAATFKAWLQLFLDEQLTYSDGLAMR

SEQ ID NO: 2072329 - protein, 28 aa, Staphylococcus
KDADLVFDVRFLPNPYYVEDLRPMTGED

SEQ ID NO: 2072330 - protein, 24 aa, Staphylococcus
KDADSALALVKKFKEPAAVAVKHM

SEQ ID NO: 2072331 - protein, 24 aa, Staphylococcus
KDADVPVWLDRDCPFNIEGGDELV

SEQ ID NO: 2072332 - protein, 20 aa, Staphylococcus
KDAHFYYHQLEEIDSFQPLP

SEQ ID NO: 2072333 - protein, 23 aa, Staphylococcus
KDAKKPVLLVGAGVRHSQSGPQL

SEQ ID NO: 2072334 - protein, 20 aa, Staphylococcus
KDALKIKRLKPYLIPDYFDT

SEQ ID NO: 2072335 - protein, 25 aa, Staphylococcus
KDALLKNGKPYIFYHEYRGNSHIHI

SEQ ID NO: 2072336 - protein, 25 aa, Staphylococcus
KDARNYLSFLYSHNLKRTTVSRKIS

SEQ ID NO: 2072337 - protein, 24 aa, Staphylococcus
KDARRKREILGRKLHIGHSNGKQL

SEQ ID NO: 2072338 - protein, 26 aa, Staphylococcus
KDAVKPVIHVFIATSPIHLTHKLKMT

SEQ ID NO: 2072339 - protein, 24 aa, Staphylococcus
KDAVQIVPLIIKYASQLKNEGKML

SEQ ID NO: 2072340 - protein, 17 aa, Staphylococcus
KDAYNNYQFTKTAFTDL

SEQ ID NO: 2072341 - protein, 23 aa, Staphylococcus
KDCKYVLSVASPVFFDIPEDETE

SEQ ID NO: 2072342 - protein, 25 aa, Staphylococcus
KDDDGKYFYYLGTANYIKGTEEEDI

SEQ ID NO: 2072343 - protein, 20 aa, Staphylococcus
KDDFNIVDHYTYVLASDGDL

SEQ ID NO: 2072344 - protein, 22 aa, Staphylococcus
KDDVYYQIYTNRGIYTEDPTKD

SEQ ID NO: 2072345 - protein, 18 aa, Staphylococcus
KDEALKPFILLVVGQHDE

SEQ ID NO: 2072346 - protein, 21 aa, Staphylococcus
KDEDGYFWFEGRRDDIIISSG

SEQ ID NO: 2072347 - protein, 17 aa, Staphylococcus
KDEEEFLNILNLAKEHN

SEQ ID NO: 2072348 - protein, 33 aa, Staphylococcus; identical to SEQ ID NO: 1828863

SEQ ID NO: 2072349 - protein, 25 aa, Staphylococcus
KDEFTTMILMFLESWYLNVASFIDM

SEQ ID NO: 2072350 - protein, 25 aa, Staphylococcus
KDEGKYFTDFSFIKPYKNGEGIINK

SEQ ID NO: 2072351 - protein, 23 aa, Staphylococcus
KDELLKAFKSLYSSHAMLRAVIL

SEQ ID NO: 2072352 - protein, 22 aa, Staphylococcus
KDENGKQIGITIIVKDGNGKEV

SEQ ID NO: 2072353 - protein, 27 aa, Staphylococcus
KDEPAFINILEILALEYAKDKGYELYN

SEQ ID NO: 2072354 - protein, 25 aa, Staphylococcus
KDEPAFINILEILALEYAKQENMKL

SEQ ID NO: 2072355 - protein, 24 aa, Staphylococcus
KDEPAFINVLEILAIEYAKDKGYE

SEQ ID NO: 2072356 - protein, 21 aa, Staphylococcus
KDEQLTLHLITQILGKYKVEC

SEQ ID NO: 2072357 - protein, 23 aa, Staphylococcus
KDERVLNIILKLFETSQPLTSSD

SEQ ID NO: 2072358 - protein, 23 aa, Staphylococcus
KDESLIPKQYYIEQQPKLDKKEL

SEQ ID NO: 2072359 - protein, 24 aa, Staphylococcus
KDETGYINHLLQLVGPSISQQQAY

SEQ ID NO: 2072360 - protein, 26 aa, Staphylococcus
KDEVGYPLIVRPAFTMGGTGGGICYN

SEQ ID NO: 2072361 - protein, 25 aa, Staphylococcus
KDEVRKEFQFLDYAEIAFVSAKEKQ

SEQ ID NO: 2072362 - protein, 25 aa, Staphylococcus
KDEVRKYARKLLKKGADNIKLMASG

SEQ ID NO: 2072363 - protein, 22 aa, Staphylococcus
KDEWIQMPILERQQLEKTFRKY

SEQ ID NO: 2072364 - protein, 20 aa, Staphylococcus
KDFAAVGLLFREGDDYIWKS

SEQ ID NO: 2072365 - protein, 24 aa, Staphylococcus
KDFANIFFMMMNYYSIERSMQIAK

SEQ ID NO: 2072366 - protein, 24 aa, Staphylococcus
KDFANTFFMMMNYYSIERSMEIAK

SEQ ID NO: 2072367 - protein, 17 aa, Staphylococcus
KDFAVVGDTLFKQGIGR

SEQ ID NO: 2072368 - protein, 24 aa, Staphylococcus
KDFFTFFGNFFSQKRNREIKLNLE

SEQ ID NO: 2072369 - protein, 17 aa, Staphylococcus
KDFIVRYKSMQGYYSPY

SEQ ID NO: 2072370 - protein, 24 aa, Staphylococcus
KDFKDLEIILFGDKQQYTLNHERI

SEQ ID NO: 2072371 - protein, 22 aa, Staphylococcus
KDFNQREAFYIMATRNGMIKKS

SEQ ID NO: 2072372 - protein, 25 aa, Staphylococcus
KDFYSYVRVFSEYYAPYDNYAKLYM

SEQ ID NO: 2072373 - protein, 21 aa, Staphylococcus
KDGDHLDLLSKIAITFSEEEN

SEQ ID NO: 2072374 - protein, 27 aa, Staphylococcus
KDGDPFATARIRPIKEKLGKVERVAII

SEQ ID NO: 2072375 - protein, 18 aa, Staphylococcus
KDGDYHFLIFNKINDRYL

SEQ ID NO: 2072376 - protein, 20 aa, Staphylococcus
KDGEHLDLLSKIAITFSEEE

SEQ ID NO: 2072377 - protein, 21 aa, Staphylococcus
KDGEHLDLLSKIAITFSEEEN

SEQ ID NO: 2072378 - protein, 24 aa, Staphylococcus
KDGNYHFILFNKINDRYLSDSKQH

SEQ ID NO: 2072379 - protein, 24 aa, Staphylococcus
KDGNYHVILFNKINDRYLSDSQQH

SEQ ID NO: 2072380 - protein, 17 aa, Staphylococcus
KDGSYIVNCARGKIVNK

SEQ ID NO: 2072381 - protein, 21 aa, Staphylococcus
KDGTMILKPSFRDYLLQLCDK

SEQ ID NO: 2072382 - protein, 31 aa, Staphylococcus
KDGTMILRPSFRDYLLQLVNQYDIPHQYYMS

SEQ ID NO: 2072383 - protein, 24 aa, Staphylococcus
KDGYYNGITFHRVINDFMVQGGDP

SEQ ID NO: 2072384 - protein, 24 aa, Staphylococcus
KDHDTYYQIYTNRGIYTENPDKDL

SEQ ID NO: 2072385 - protein, 24 aa, Staphylococcus
KDHFRHKLLKDIKRTEYQKFLNEY

SEQ ID NO: 2072386 - protein, 19 aa, Staphylococcus
KDHGRLPVVNFAAGGVATP

SEQ ID NO: 2072387 - protein, 22 aa, Staphylococcus
KDICERFKTIYLEEARKPFPQE

SEQ ID NO: 2072388 - protein, 20 aa, Staphylococcus
KDIDKVIFPGIQGGPLQHVI

SEQ ID NO: 2072389 - protein, 20 aa, Staphylococcus
KDIELDILKKYKPLERKWYQ

SEQ ID NO: 2072390 - protein, 25 aa, Staphylococcus
KDIETRIYPVGRLDYDTSGLLLLTN

SEQ ID NO: 2072391 - protein, 18 aa, Staphylococcus
KDIGFIFQEYNLLHTLTV

SEQ ID NO: 2072392 - protein, 23 aa, Staphylococcus
KDIGMIFQHFNLLNSATVFKNVA

SEQ ID NO: 2072393 - protein, 25 aa, Staphylococcus
KDIKFEMPYDEAVDWMLKALEPMGD

SEQ ID NO: 2072394 - protein, 24 aa, Staphylococcus
KDIKFPEIMTFIQSDLYLEIAEAE

SEQ ID NO: 2072395 - protein, 24 aa, Staphylococcus
KDIKPLPALIMYGTEDKILETDAI

SEQ ID NO: 2072396 - protein, 24 aa, Staphylococcus
KDIKPLPTLLMYGTEDKILETSSI

SEQ ID NO: 2072397 - protein, 21 aa, Staphylococcus
KDILTQYLAIRLTMECILLDT

SEQ ID NO: 2072398 - protein, 22 aa, Staphylococcus
KDIREILKQALEAGITLFQFRE

SEQ ID NO: 2072399 - protein, 25 aa, Staphylococcus
KDIYSKMLWEGFQPFKIEKIEQLSS

SEQ ID NO: 2072400 - protein, 24 aa, Staphylococcus
KDKDGLPTLVILDGLEDPHNLGSI

SEQ ID NO: 2072401 - protein, 22 aa, Staphylococcus
KDKFEKALIERVGKIKLGNGFD

SEQ ID NO: 2072402 - protein, 27 aa, Staphylococcus
KDKGCHAGYLIKVLNNWAKENVKTKED

SEQ ID NO: 2072403 - protein, 36 aa, Staphylococcus
KDKIQWVETLPDKDYSKIYLFDTNLDKITNFRDELK

SEQ ID NO: 2072404 - protein, 24 aa, Staphylococcus
KDKKVIMYAPTWRDDEFVKKGQYL

SEQ ID NO: 2072405 - protein, 26 aa, Staphylococcus
KDKLDQFELQLLLNGPYDANNAILEL

SEQ ID NO: 2072406 - protein, 25 aa, Staphylococcus
KDKMLIKNLIIFFKNIDGGSQNLYI

SEQ ID NO: 2072407 - protein, 25 aa, Staphylococcus
KDKNKKIFIPSNLFLLGTVNTSDQN

SEQ ID NO: 2072408 - protein, 26 aa, Staphylococcus
KDKNNYLYLGFLLNRAPSQYPECNLI

SEQ ID NO: 2072409 - protein, 26 aa, Staphylococcus
KDKPISRPWIQDFTASYLGAGNYIDY

SEQ ID NO: 2072410 - protein, 25 aa, Staphylococcus
KDKTLLKEGLVIAVEPFISSKATFV

SEQ ID NO: 2072411 - protein, 23 aa, Staphylococcus
KDKTLLKEGLVIAVEPFISSRAT

SEQ ID NO: 2072412 - protein, 25 aa, Staphylococcus
KDKYITNWHIALPDIVKLQKDIEDK

SEQ ID NO: 2072413 - protein, 20 aa, Staphylococcus
KDLALKFNLMPMVEHNTDGF

SEQ ID NO: 2072414 - protein, 18 aa, Staphylococcus
KDLDIYLDIAKQAGQEAD

SEQ ID NO: 2072415 - protein, 19 aa, Staphylococcus
KDLELFANSQLVGAGLPLW

SEQ ID NO: 2072416 - protein, 19 aa, Staphylococcus
KDLELFTNSQLVGAGLPLW

SEQ ID NO: 2072417 - protein, 26 aa, Staphylococcus
KDLEMTLFFELVFGEETDFYQSLLND

SEQ ID NO: 2072418 - protein, 23 aa, Staphylococcus
KDLERFIEVLANKAKNYKYTLMM

SEQ ID NO: 2072419 - protein, 20 aa, Staphylococcus
KDLFAVVMDAKTGEILAFSQ

SEQ ID NO: 2072420 - protein, 18 aa, Staphylococcus
KDLFAVVMDAKTGEILAY

SEQ ID NO: 2072421 - protein, 19 aa, Staphylococcus
KDLFAVVMDAKTGEILAYS

SEQ ID NO: 2072422 - protein, 17 aa, Staphylococcus
KDLFERYPQIKDKQFQI

SEQ ID NO: 2072423 - protein, 21 aa, Staphylococcus
KDLFTYFFNHIFEDGDTVFDD

SEQ ID NO: 2072424 - protein, 30 aa, Staphylococcus
KDLFVIAGHYRNGILLSPLIGELMSQWIIS

SEQ ID NO: 2072425 - protein, 18 aa, Staphylococcus
KDLIRKCNKLGKPVITAT

SEQ ID NO: 2072426 - protein, 18 aa, Staphylococcus
KDLIVLIKLIYASETSNK

SEQ ID NO: 2072427 - protein, 17 aa, Staphylococcus
KDLKKVEDLFIVTATHG

SEQ ID NO: 2072428 - protein, 17 aa, Staphylococcus
KDLKNIPIHFAIYVQSS

SEQ ID NO: 2072429 - protein, 25 aa, Staphylococcus
KDLKYDLYHILFEMVRQHNNVALDS

SEQ ID NO: 2072430 - protein, 20 aa, Staphylococcus
KDLLKQVCSLKYVLRVNDLL

SEQ ID NO: 2072431 - protein, 21 aa, Staphylococcus
KDLLTQYLAIRLTMECILLDT

SEQ ID NO: 2072432 - protein, 25 aa, Staphylococcus
KDLNYAGNFLYMLRGELPSDIEIEA

SEQ ID NO: 2072433 - protein, 17 aa, Staphylococcus
KDLPHIRVVMLTSFIED

SEQ ID NO: 2072434 - protein, 17 aa, Staphylococcus
KDLRRARSCGESIIPTS

SEQ ID NO: 2072435 - protein, 29 aa, Staphylococcus
KDLVETVLEYQPLFIKPNKDELEVMFNTS

SEQ ID NO: 2072436 - protein, 18 aa, Staphylococcus
KDLVILIKLIYAAEVSNK

SEQ ID NO: 2072437 - protein, 20 aa, Staphylococcus
KDLYFIARNIIKNSKGIVFL

SEQ ID NO: 2072438 - protein, 25 aa, Staphylococcus
KDMDMYKLAFAIRDAAAEKKKRGGK

SEQ ID NO: 2072439 - protein, 20 aa, Staphylococcus
KDMIPGVNAPPQKYYSTTCV

SEQ ID NO: 2072440 - protein, 17 aa, Staphylococcus
KDMYRLLGLAKYEDRFV

SEQ ID NO: 2072441 - protein, 19 aa, Staphylococcus
KDNDDLIDLLILNAQENIN

SEQ ID NO: 2072442 - protein, 25 aa, Staphylococcus
KDNFPFLNPTFKHMSKPALIIAGDK

SEQ ID NO: 2072443 - protein, 28 aa, Staphylococcus
KDNGNNVLIYRLPNLFGKWCKPNYNSVI

SEQ ID NO: 2072444 - protein, 28 aa, Staphylococcus
KDNLEDYLTIYKHFALPFGHRFADESVK

SEQ ID NO: 2072445 - protein, 24 aa, Staphylococcus
KDNPFDLTKVWYHDDYPLIEVGEF

SEQ ID NO: 2072446 - protein, 24 aa, Staphylococcus
KDNPKRDWYIWADPKPDGSEPNNW

SEQ ID NO: 2072447 - protein, 23 aa, Staphylococcus
KDNPKRDWYIWKKPKSDGSEPNN

SEQ ID NO: 2072448 - protein, 21 aa, Staphylococcus
KDNPQLIKWINKNYIHKCDLN

SEQ ID NO: 2072449 - protein, 24 aa, Staphylococcus
KDNPYRDFYFFKTSPDGPPTNWES

SEQ ID NO: 2072450 - protein, 23 aa, Staphylococcus
KDNRPIFLYGLSAGGMETYHVAA

SEQ ID NO: 2072451 - protein, 24 aa, Staphylococcus
KDNRTALNFYIKNGFKIYSESQKD

SEQ ID NO: 2072452 - protein, 18 aa, Staphylococcus
KDNYIAEALLALEALGYS

SEQ ID NO: 2072453 - protein, 18 aa, Staphylococcus
KDPDFLQGYYYLQQLYEH

SEQ ID NO: 2072454 - protein, 17 aa, Staphylococcus
KDPIYIQLYSYIKQEIK

SEQ ID NO: 2072455 - protein, 24 aa, Staphylococcus
KDQFEGKLFGIPMGIKDNIITKDV

SEQ ID NO: 2072456 - protein, 25 aa, Staphylococcus
KDQIKIGATVLAGFGPRIVRINDFS

SEQ ID NO: 2072457 - protein, 25 aa, Staphylococcus
KDQKLIVQTVPKSKLDFLSTAPHQG

SEQ ID NO: 2072458 - protein, 22 aa, Staphylococcus
KDQKVLVFDLGGGTFDVSILEL

SEQ ID NO: 2072459 - protein, 20 aa, Staphylococcus
KDQTPLFEKGVALLKEIIWN

SEQ ID NO: 2072460 - protein, 22 aa, Staphylococcus
KDQVVNQWRDWFDMEVKASDED

SEQ ID NO: 2072461 - protein, 28 aa, Staphylococcus
KDRAELLLRVAAIIRRRKEEISAVMVYE

SEQ ID NO: 2072462 - protein, 21 aa, Staphylococcus
KDRAELMLRVAAIIRRRKEEI

SEQ ID NO: 2072463 - protein, 17 aa, Staphylococcus
KDREYLPEILTSQLSIV

SEQ ID NO: 2072464 - protein, 36 aa, Staphylococcus
KDRFGSFIRYNYTSKNWMFYDSKRWRIDDAGKMKGL

SEQ ID NO: 2072465 - protein, 22 aa, Staphylococcus
KDRGFQLGILEFYIIEGTELAQ

SEQ ID NO: 2072466 - protein, 19 aa, Staphylococcus
KDRILIPQNDLDRTPKKNK

SEQ ID NO: 2072467 - protein, 24 aa, Staphylococcus
KDRKYYFYEKGVALYVILNDEDHY

SEQ ID NO: 2072468 - protein, 23 aa, Staphylococcus
KDRNDQIIYVGKAKRLRNRLRSY

SEQ ID NO: 2072469 - protein, 23 aa, Staphylococcus
KDRPLALCAALLHDLGHGPFSHS

SEQ ID NO: 2072470 - protein, 23 aa, Staphylococcus
KDRPLVCVGILKGSVMFMADLIK

SEQ ID NO: 2072471 - protein, 22 aa, Staphylococcus
KDRTVYLPNAYHPLLNKDTVVA

SEQ ID NO: 2072472 - protein, 36 aa, Staphylococcus
KDRVKLALLASFKNKSLLKFYCKETDWFSNKEIETI

SEQ ID NO: 2072473 - protein, 36 aa, Staphylococcus
KDRVKLALLASFKNKSLLKFYCKETDWFSNKEVDTI

SEQ ID NO: 2072474 - protein, 36 aa, Staphylococcus
KDRVKLALLASFKNKSLLKFYCKETHWFGSKETETI

SEQ ID NO: 2072475 - protein, 34 aa, Staphylococcus
KDRVKLALLASFKNKSLLKFYCTETNWFGNKEID

SEQ ID NO: 2072476 - protein, 35 aa, Staphylococcus
KDRVKLALLASFKNKSLLKFYVKETEWFSGKEVDT

SEQ ID NO: 2072477 - protein, 20 aa, Staphylococcus
KDRYALIPENDIIAGANAAA

SEQ ID NO: 2072478 - protein, 24 aa, Staphylococcus
KDSAQIRVLPYASITTRQAGKELV

SEQ ID NO: 2072479 - protein, 26 aa, Staphylococcus
KDSDGRIILFIDEIHILVGAGKTEGA

SEQ ID NO: 2072480 - protein, 26 aa, Staphylococcus
KDSDGRIILFIDEIHMLVGAGKTDGA

SEQ ID NO: 2072481 - protein, 22 aa, Staphylococcus
KDSEHYGLWAFKKTWGTYLSEK

SEQ ID NO: 2072482 - protein, 21 aa, Staphylococcus
KDSFHYFFKDEQKVVGYLKLN

SEQ ID NO: 2072483 - protein, 26 aa, Staphylococcus
KDSFYHFNPNWHIVAITYDSLNEIKQ

SEQ ID NO: 2072484 - protein, 20 aa, Staphylococcus
KDSIFISLAVKFSKARLIDN

SEQ ID NO: 2072485 - protein, 24 aa, Staphylococcus
KDSLELYINAYRLAERYANLSSNA

SEQ ID NO: 2072486 - protein, 24 aa, Staphylococcus
KDSLKLYINAYRLAERYANIATNC

SEQ ID NO: 2072487 - protein, 24 aa, Staphylococcus
KDSRFPFSIMWIEELGEFKTEDEV

SEQ ID NO: 2072488 - protein, 34 aa, Staphylococcus
KDSSLNYTIIKPSFFMDNFLRITKVENGEIMIPE

SEQ ID NO: 2072489 - protein, 21 aa, Staphylococcus
KDSWNMSPIALKKAFEKYAEK

SEQ ID NO: 2072490 - protein, 17 aa, Staphylococcus
KDSYTGTYLKPVLERDS

SEQ ID NO: 2072491 - protein, 20 aa, Staphylococcus
KDTFIAHNHFISCAGGIRFL

SEQ ID NO: 2072492 - protein, 20 aa, Staphylococcus
KDTFISLWQARDDRYSDERT

SEQ ID NO: 2072493 - protein, 25 aa, Staphylococcus
KDTIQYQRFIRHIQFLIKRLRNGES

SEQ ID NO: 2072494 - protein, 18 aa, Staphylococcus
KDTKLYRNIPEYSEIMRY

SEQ ID NO: 2072495 - protein, 25 aa, Staphylococcus
KDTLINLGLIVGPGARHKREVLGRK

SEQ ID NO: 2072496 - protein, 18 aa, Staphylococcus
KDTLLKLNPSDGKKVVNN

SEQ ID NO: 2072497 - protein, 33 aa, Staphylococcus
KDTTPLLEKGLDLLYEVIWNPLIHDKAFHNTYV

SEQ ID NO: 2072498 - protein, 25 aa, Staphylococcus
KDTYEWLQPLLKRKFPEHHFEFTYI

SEQ ID NO: 2072499 - protein, 22 aa, Staphylococcus
KDTYTIVIPPPNVTGKLHLGHA

SEQ ID NO: 2072500 - protein, 23 aa, Staphylococcus
KDVELVSFLNKELGLPGINPEIV

SEQ ID NO: 2072501 - protein, 18 aa, Staphylococcus
KDVFAVVMDAKTGEILAF

SEQ ID NO: 2072502 - protein, 25 aa, Staphylococcus
KDVFRKQIALAKRVNLPIIIHNREA

SEQ ID NO: 2072503 - protein, 26 aa, Staphylococcus
KDVIGKKVILPIIGRELPILADEYVD

SEQ ID NO: 2072504 - protein, 25 aa, Staphylococcus
KDVIGKKVILPIVGRELPILADEYV

SEQ ID NO: 2072505 - protein, 25 aa, Staphylococcus
KDVIGKTVILPIVGRELPILADEYV

SEQ ID NO: 2072506 - protein, 18 aa, Staphylococcus
KDVKGIDLTEQFPRMTYA

SEQ ID NO: 2072507 - protein, 33 aa, Staphylococcus
KDVKLTVTALLAKAVVLALKDYGAMNARYDNGE

SEQ ID NO: 2072508 - protein, 21 aa, Staphylococcus
KDVNYFGTMLVYTGKAEGLVS

SEQ ID NO: 2072509 - protein, 20 aa, Staphylococcus
KDVPVGYANNFLIKNNYAVE

SEQ ID NO: 2072510 - protein, 26 aa, Staphylococcus
KDVRSFYEFYSYLMEPWDGPTMISFC

SEQ ID NO: 2072511 - protein, 23 aa, Staphylococcus
KDVTYLIKILKQRFPNAYIHMIG

SEQ ID NO: 2072512 - protein, 26 aa, Staphylococcus
KDYAYRLLMQLGFERDIMEKSPFQMS

SEQ ID NO: 2072513 - protein, 24 aa, Staphylococcus
KDYDLKRTYVFELNFDKLMSVSVG

SEQ ID NO: 2072514 - protein, 24 aa, Staphylococcus
KDYDNFIMISYIKNHVNAMYSNQN

SEQ ID NO: 2072515 - protein, 18 aa, Staphylococcus
KDYFEIPYEQYCKHEFVL

SEQ ID NO: 2072516 - protein, 25 aa, Staphylococcus
KDYFTSLKVIYAIKLLLSTDDSINA

SEQ ID NO: 2072517 - protein, 22 aa, Staphylococcus
KDYITYGPYSGEEDLLVYGVGY

SEQ ID NO: 2072518 - protein, 27 aa, Staphylococcus
KDYNVPDFCQLILITSPQHLKIQHDKL

SEQ ID NO: 2072519 - protein, 24 aa, Staphylococcus
KDYWKYHDHWLGYCTNELVQINPE

SEQ ID NO: 2072520 - protein, 18 aa, Staphylococcus
KEAAMLAGYFSKAGNSGQ

SEQ ID NO: 2072521 - protein, 25 aa, Staphylococcus
KEADVILYDRLINKDILDYAKPNTK

SEQ ID NO: 2072522 - protein, 18 aa, Staphylococcus
KEAIKLYQQAMKYNIEPV

SEQ ID NO: 2072523 - protein, 24 aa, Staphylococcus
KEAILSVILPQYVESLIYGTILDA

SEQ ID NO: 2072524 - protein, 34 aa, Staphylococcus
KEAINMIIKYNVPICSFTFGIPDALTIEKLKEHQ

SEQ ID NO: 2072525 - protein, 25 aa, Staphylococcus
KEALADYDFYYYFGDIDKDEIIKLM

SEQ ID NO: 2072526 - protein, 17 aa, Staphylococcus
KEALLALAALGYSKREL

SEQ ID NO: 2072527 - protein, 27 aa, Staphylococcus
KEALPDDAIMHFIGTLQSRKVKEVVDD

SEQ ID NO: 2072528 - protein, 18 aa, Staphylococcus
KEAMMLVPEIALTPQMVL

SEQ ID NO: 2072529 - protein, 19 aa, Staphylococcus
KEAMMLVPEIALTPQMVLR

SEQ ID NO: 2072530 - protein, 17 aa, Staphylococcus
KEASQYIPLENLALSTQ

SEQ ID NO: 2072531 - protein, 19 aa, Staphylococcus
KEAVRIRKLAPKATIFLMN

SEQ ID NO: 2072532 - protein, 18 aa, Staphylococcus
KECKHEFLRYPYIETKED

SEQ ID NO: 2072533 - protein, 22 aa, Staphylococcus
KEDALRILRGLRFQSQLNFTIE

SEQ ID NO: 2072534 - protein, 26 aa, Staphylococcus
KEDEEAFYRALGRYVHTLNGRYYTAE

SEQ ID NO: 2072535 - protein, 22 aa, Staphylococcus
KEDFAFYGYLTDKNGGMIKNTF

SEQ ID NO: 2072536 - protein, 19 aa, Staphylococcus
KEDFYFMKLKQFSDDIVIY

SEQ ID NO: 2072537 - protein, 23 aa, Staphylococcus
KEDGLWFIQGRIDFQIKLNGYRM

SEQ ID NO: 2072538 - protein, 26 aa, Staphylococcus
KEDGSLLKLEFITHSYPHDWRTKKPV

SEQ ID NO: 2072539 - protein, 22 aa, Staphylococcus
KEDIISFVKFYLKKDDKPLHEK

SEQ ID NO: 2072540 - protein, 23 aa, Staphylococcus
KEDIPIEWLKRYANHLIIIFKGV

SEQ ID NO: 2072541 - protein, 22 aa, Staphylococcus
KEDKYPFEILINKIQSMVIPHV

SEQ ID NO: 2072542 - protein, 21 aa, Staphylococcus
KEDLIYPIFVVEKDNVRSEIK

SEQ ID NO: 2072543 - protein, 20 aa, Staphylococcus
KEDLLVYNDYFETILANVSA

SEQ ID NO: 2072544 - protein, 27 aa, Staphylococcus
KEDPLGDPIVLIAPTQSTFQLEQAFVN

SEQ ID NO: 2072545 - protein, 32 aa, Staphylococcus
KEDRNLVGILTNRDLRFIEDFSIKISDVMTKE

SEQ ID NO: 2072546 - protein, 32 aa, Staphylococcus
KEDRQFVGIITNRDLRFIEDFSIKISDVMTKE

SEQ ID NO: 2072547 - protein, 22 aa, Staphylococcus
KEDVSKIYFTSHMDTVVPGINI

SEQ ID NO: 2072548 - protein, 25 aa, Staphylococcus
KEEAPWFKVSPTHFVKSWLLDERAP

SEQ ID NO: 2072549 - protein, 22 aa, Staphylococcus
KEEDIELFKDIADKVKQTNSYD

SEQ ID NO: 2072550 - protein, 19 aa, Staphylococcus
KEEGIYVKSIVFPTVPKGT

SEQ ID NO: 2072551 - protein, 19 aa, Staphylococcus
KEEGIYVKSIVFPTVPRGT

SEQ ID NO: 2072552 - protein, 21 aa, Staphylococcus
KEEGLDFKASKFPYAANGRAL

SEQ ID NO: 2072553 - protein, 33 aa, Staphylococcus
KEEGLILDFSIQDNMVLPSLFSFSKHGIVDDKS

SEQ ID NO: 2072554 - protein, 17 aa, Staphylococcus
KEEGRLPVVNFAAGGVA

SEQ ID NO: 2072555 - protein, 18 aa, Staphylococcus
KEEGVYVKSIVFPTVPKG

SEQ ID NO: 2072556 - protein, 26 aa, Staphylococcus
KEEGYDYFGLLYIGAILTKEGPKVIE

SEQ ID NO: 2072557 - protein, 24 aa, Staphylococcus
KEEHLDFVIIDTAGRLHIDETLMN

SEQ ID NO: 2072558 - protein, 24 aa, Staphylococcus
KEEHLDFVIIDTAGRLHVDEALMQ

SEQ ID NO: 2072559 - protein, 19 aa, Staphylococcus
KEEILERIGQFYYGSDDTL

SEQ ID NO: 2072560 - protein, 18 aa, Staphylococcus
KEEKLLPETVIERVFDDL

SEQ ID NO: 2072561 - protein, 22 aa, Staphylococcus
KEELIIEVLQNRLIRHAYLDVF

SEQ ID NO: 2072562 - protein, 33 aa, Staphylococcus
KEEPIKLLALVTSNYRLYYQCKILSQKGYSGQQ

SEQ ID NO: 2072563 - protein, 18 aa, Staphylococcus
KEERVAGTAGGGMVTVTV

SEQ ID NO: 2072564 - protein, 17 aa, Staphylococcus
KEESYFFNISKYADRLL

SEQ ID NO: 2072565 - protein, 26 aa, Staphylococcus
KEEVGYPLIVRPAFTMGGTGGGICHN

SEQ ID NO: 2072566 - protein, 19 aa, Staphylococcus
KEFFFCGEILPHRTAKALV

SEQ ID NO: 2072567 - protein, 24 aa, Staphylococcus
KEFFFCGEILPHRTAKTLLQRFPS

SEQ ID NO: 2072568 - protein, 18 aa, Staphylococcus
KEFGTLDIMINNAGFEKP

SEQ ID NO: 2072569 - protein, 17 aa, Staphylococcus
KEFGTRGLYGSPVGFID

SEQ ID NO: 2072570 - protein, 17 aa, Staphylococcus
KEFGYDLPSDYIGEVWG

SEQ ID NO: 2072571 - protein, 19 aa, Staphylococcus
KEFHSILFKNTLNTFADKL

SEQ ID NO: 2072572 - protein, 21 aa, Staphylococcus
KEFIDIPVLFDDEGNFRKKQV

SEQ ID NO: 2072573 - protein, 18 aa, Staphylococcus
KEFKLDTKVIIVTTFKRP

SEQ ID NO: 2072574 - protein, 18 aa, Staphylococcus
KEFLTLQELIKMTGCSAS

SEQ ID NO: 2072575 - protein, 26 aa, Staphylococcus
KEGKQNGIIVIIKDGDGKEISRQNIY

SEQ ID NO: 2072576 - protein, 21 aa, Staphylococcus
KEGKYVALYMTYEAAQYFNPD

SEQ ID NO: 2072577 - protein, 18 aa, Staphylococcus
KEGLLVLDHSEYLDTEDY

SEQ ID NO: 2072578 - protein, 28 aa, Staphylococcus
KEGQSYFVKFHWKPKQGLESLVWDEAQI

SEQ ID NO: 2072579 - protein, 25 aa, Staphylococcus
KEGTTLKILFHAGLGTMNCLRYLID

SEQ ID NO: 2072580 - protein, 17 aa, Staphylococcus
KEGYTILVLDDSALINT

SEQ ID NO: 2072581 - protein, 21 aa, Staphylococcus
KEHDIHVIPLNLTIDGKSYID

SEQ ID NO: 2072582 - protein, 28 aa, Staphylococcus
KEHMPIEVIYGFAQLKRGAALANHELGK

SEQ ID NO: 2072583 - protein, 20 aa, Staphylococcus
KEHVSKIYFTSHMDTVVPGI

SEQ ID NO: 2072584 - protein, 25 aa, Staphylococcus
KEIADVFYFTEFDFPKAITADEFKD

SEQ ID NO: 2072585 - protein, 24 aa, Staphylococcus
KEIAKKIAILPQSPDVADGLTAGE

SEQ ID NO: 2072586 - protein, 19 aa, Staphylococcus
KEIARELKLIRVELQKQNE

SEQ ID NO: 2072587 - protein, 22 aa, Staphylococcus
KEICEHFKAVYLDEAYKPFPQE

SEQ ID NO: 2072588 - protein, 18 aa, Staphylococcus
KEIDGVRILFVAATAPFT

SEQ ID NO: 2072589 - protein, 17 aa, Staphylococcus
KEIEGVRILFVAATAPF

SEQ ID NO: 2072590 - protein, 23 aa, Staphylococcus
KEIENFKFFVQYANFKDINDYKN

SEQ ID NO: 2072591 - protein, 24 aa, Staphylococcus
KEIENFKFFVQYGKFKDLNDYKGG

SEQ ID NO: 2072592 - protein, 27 aa, Staphylococcus
KEIEPLFDHALPYYKQFINEVVQFLNN

SEQ ID NO: 2072593 - protein, 18 aa, Staphylococcus
KEIFGDDFVFLPKEELLT

SEQ ID NO: 2072594 - protein, 18 aa, Staphylococcus
KEIFSMYYDYSEPVKRVA

SEQ ID NO: 2072595 - protein, 20 aa, Staphylococcus
KEIGWFRRPTQRIKKRLDDL

SEQ ID NO: 2072596 - protein, 21 aa, Staphylococcus
KEIIDELPTLLDKLGVDHINE

SEQ ID NO: 2072597 - protein, 19 aa, Staphylococcus
KEIKDLLSYLRIIANSNDD

SEQ ID NO: 2072598 - protein, 19 aa, Staphylococcus
KEIKDLLSYLRLVANSNDD

SEQ ID NO: 2072599 - protein, 18 aa, Staphylococcus
KEIKRYHYGLTDTLLLEK

SEQ ID NO: 2072600 - protein, 25 aa, Staphylococcus
KEIKSLLQMLLLHAIPEPVITDSEA

SEQ ID NO: 2072601 - protein, 27 aa, Staphylococcus
KEIKSSMVGTFFLQDSKELTDPQIKVG

SEQ ID NO: 2072602 - protein, 29 aa, Staphylococcus
KEIMKIAEDLAEPFPFCRVDFLVSENDVK

SEQ ID NO: 2072603 - protein, 26 aa, Staphylococcus
KEIMSMSHIQLVGLAFNFMCFKSKAP

SEQ ID NO: 2072604 - protein, 22 aa, Staphylococcus
KEINKDIKIYAPLTGEYVKIED

SEQ ID NO: 2072605 - protein, 28 aa, Staphylococcus
KEINSRLEFLYNVGLEYLTLNRASGSLS

SEQ ID NO: 2072606 - protein, 24 aa, Staphylococcus
KEIRRLFDMIHNLKAKGVSFVYIS

SEQ ID NO: 2072607 - protein, 25 aa, Staphylococcus
KEISIGLIFTLMDGIAYLKEHPSHF

SEQ ID NO: 2072608 - protein, 27 aa, Staphylococcus
KEISSPMVGTFFLQDSKELTDPQIKVG

SEQ ID NO: 2072609 - protein, 25 aa, Staphylococcus
KEITEALPHIDYFVAGAGSGGTFTG

SEQ ID NO: 2072610 - protein, 25 aa, Staphylococcus
KEIYDYPLVLFYKGDEKLFLSSQTL

SEQ ID NO: 2072611 - protein, 32 aa, Staphylococcus
KEIYEELSEIAPTILFKSFDAGYQETLEVFQR

SEQ ID NO: 2072612 - protein, 32 aa, Staphylococcus
KEKATYLPNANLIRLIFDEGFIAIRPSGTEPK

SEQ ID NO: 2072613 - protein, 18 aa, Staphylococcus
KEKFGQIDILVNSAGLML

SEQ ID NO: 2072614 - protein, 19 aa, Staphylococcus
KEKFLYDKIIYLYENREDY

SEQ ID NO: 2072615 - protein, 27 aa, Staphylococcus
KEKFNTYSGDYLLLPTKDGKKPNNDFV

SEQ ID NO: 2072616 - protein, 23 aa, Staphylococcus
KEKIEHFLSNIKTIGMAITAPMV

SEQ ID NO: 2072617 - protein, 25 aa, Staphylococcus
KEKIGKFLSLFIRTNKDIYFEKFSK

SEQ ID NO: 2072618 - protein, 30 aa, Staphylococcus
KEKIKDAILYIETIFPMITIQNFKPQSDMR

SEQ ID NO: 2072619 - protein, 28 aa, Staphylococcus
KEKINYLYRYIGQHIMNMIPVSWENVYA

SEQ ID NO: 2072620 - protein, 17 aa, Staphylococcus
KEKLLKPKVRLKEERLK

SEQ ID NO: 2072621 - protein, 23 aa, Staphylococcus
KEKMAQIEFRLILVGGDCPKIKA

SEQ ID NO: 2072622 - protein, 17 aa, Staphylococcus
KEKNKWEALLPEIAEHT

SEQ ID NO: 2072623 - protein, 35 aa, Staphylococcus
KEKNYLDAVIGLPANLFFGTSIPTSILVFKKCRED

SEQ ID NO: 2072624 - protein, 25 aa, Staphylococcus
KEKPLKLFHPVHTFKMKFIKSFEAI

SEQ ID NO: 2072625 - protein, 26 aa, Staphylococcus
KEKQLDHLLKAYIEFLKSGHQTKLAL

SEQ ID NO: 2072626 - protein, 27 aa, Staphylococcus
KEKQRPLPSKLYLFSPLLDAQLDNEGI

SEQ ID NO: 2072627 - protein, 24 aa, Staphylococcus
KEKRNFKIILPSPSAYEKVIELID

SEQ ID NO: 2072628 - protein, 24 aa, Staphylococcus
KEKSNYLPSYRYAQIAYEDNDLAI

SEQ ID NO: 2072629 - protein, 26 aa, Staphylococcus
KEKSYQLLLDLGFSRDIMSLSPFQMS

SEQ ID NO: 2072630 - protein, 23 aa, Staphylococcus
KEKVEIALLHLRRLVELKGEKIG

SEQ ID NO: 2072631 - protein, 18 aa, Staphylococcus
KEKYSLFDITHQPELCAY

SEQ ID NO: 2072632 - protein, 17 aa, Staphylococcus
KEKYSLFEITHQAELCA

SEQ ID NO: 2072633 - protein, 18 aa, Staphylococcus
KEKYSLFEITHQPELCAY

SEQ ID NO: 2072634 - protein, 17 aa, Staphylococcus
KELALIRNYEDMNWYEN

SEQ ID NO: 2072635 - protein, 33 aa, Staphylococcus
KELDLFMNSQLVGAGLPLWLPNGATIRREIERY

SEQ ID NO: 2072636 - protein, 23 aa, Staphylococcus
KELDYFATTIRKEMKRLGLENED

SEQ ID NO: 2072637 - protein, 26 aa, Staphylococcus
KELEKWEGFFKEQGFFPVAVDAKHGK

SEQ ID NO: 2072638 - protein, 26 aa, Staphylococcus
KELGAPYEILKQIKDNGRLPVVNFAA

SEQ ID NO: 2072639 - protein, 22 aa, Staphylococcus
KELGAPYNVLKQIKEEGRLPVV

SEQ ID NO: 2072640 - protein, 23 aa, Staphylococcus
KELGYPFIVKTRFGGYDGKGQIL

SEQ ID NO: 2072641 - protein, 18 aa, Staphylococcus
KELILPKSTERPLKGKEL

SEQ ID NO: 2072642 - protein, 19 aa, Staphylococcus
KELIRPKFMQDEIPVHMKI

SEQ ID NO: 2072643 - protein, 20 aa, Staphylococcus
KELIVNYNLSYIVDDAWDYA

SEQ ID NO: 2072644 - protein, 18 aa, Staphylococcus
KELKRYHYGLTDTLLLEK

SEQ ID NO: 2072645 - protein, 39 aa, Staphylococcus
KELKSHLINLCKINDIPYKVDIYPYYSSDASAALKAGAD

SEQ ID NO: 2072646 - protein, 22 aa, Staphylococcus
KELLEQWLYDESIDFPIDASNI

SEQ ID NO: 2072647 - protein, 23 aa, Staphylococcus
KELLFRIRAVLRRYQINTQNKIE

SEQ ID NO: 2072648 - protein, 17 aa, Staphylococcus
KELLREGVDFMTMGNHT

SEQ ID NO: 2072649 - protein, 18 aa, Staphylococcus
KELMYLKIKKELYNSSKY

SEQ ID NO: 2072650 - protein, 18 aa, Staphylococcus
KELNIKPIAILDGFGTSG

SEQ ID NO: 2072651 - protein, 25 aa, Staphylococcus
KELPFEFKVLITYRSNSQGGKGHVN

SEQ ID NO: 2072652 - protein, 25 aa, Staphylococcus
KELQRIFEYIIRKNLNISFKLEDLN

SEQ ID NO: 2072653 - protein, 23 aa, Staphylococcus
KELRSVVEKLITLGKKGDLASRR

SEQ ID NO: 2072654 - protein, 25 aa, Staphylococcus
KELYDLRIMLESFAFSRIKNLNHEQ

SEQ ID NO: 2072655 - protein, 18 aa, Staphylococcus
KELYILGVSDRIGRLFDI

SEQ ID NO: 2072656 - protein, 24 aa, Staphylococcus
KEMADYVTIERLPLQWRSFFTNGK

SEQ ID NO: 2072657 - protein, 32 aa, Staphylococcus
KEMEYRKIGKYPPYYFLINFTISHKNMKKVME

SEQ ID NO: 2072658 - protein, 19 aa, Staphylococcus
KEMFLEDLGIEEPGLDRLI

SEQ ID NO: 2072659 - protein, 33 aa, Staphylococcus
KEMKYRQIGKYPPYYFLINFTISHVNMKEVMQA

SEQ ID NO: 2072660 - protein, 23 aa, Staphylococcus
KEMLDAIFFGHEEIKRLVDFQQE

SEQ ID NO: 2072661 - protein, 24 aa, Staphylococcus
KEMLEAIFFGHDEIKRLVAFQEEV

SEQ ID NO: 2072662 - protein, 23 aa, Staphylococcus
KEMLGYALDILKTKQIKYVLMTC

SEQ ID NO: 2072663 - protein, 33 aa, Staphylococcus
KEMNFRKLGKYPPYYFLINFTISHRDMKKVMEA

SEQ ID NO: 2072664 - protein, 21 aa, Staphylococcus
KEMYDLRLMLESFAFAKIKDK

SEQ ID NO: 2072665 - protein, 20 aa, Staphylococcus
KEMYDPRKYLGPAREAIKAT

SEQ ID NO: 2072666 - protein, 26 aa, Staphylococcus
KENAKQLLFFIDEPETFLHPKAQAKI

SEQ ID NO: 2072667 - protein, 24 aa, Staphylococcus
KENDLRYQFLQKYWNSLPKKGGIN

SEQ ID NO: 2072668 - protein, 26 aa, Staphylococcus
KENDPIFQLLVNLGIPFVVIGKNYNK

SEQ ID NO: 2072669 - protein, 25 aa, Staphylococcus
KENDYLFDETLFNEFKPGSVFINCA

SEQ ID NO: 2072670 - protein, 24 aa, Staphylococcus
KENFAISIGIYRNGKPYAGFVYDV

SEQ ID NO: 2072671 - protein, 28 aa, Staphylococcus
KENGNKVLIYRLPNLFGKWCKPNYNSVI

SEQ ID NO: 2072672 - protein, 23 aa, Staphylococcus
KENIMLAPKLLKKNDHSTLNEQA

SEQ ID NO: 2072673 - protein, 17 aa, Staphylococcus
KENLIVFGAIEEKLQSF

SEQ ID NO: 2072674 - protein, 21 aa, Staphylococcus
KENMDGWMFYPQGFQQQKALL

SEQ ID NO: 2072675 - protein, 22 aa, Staphylococcus
KENSDEELLRRKSKRRNGDLTQ

SEQ ID NO: 2072676 - protein, 33 aa, Staphylococcus
KENVIFIGLICRKADWHVVIFDIGRGNTKEISI

SEQ ID NO: 2072677 - protein, 29 aa, Staphylococcus
KEPEAYPHPIYNNVLPHIDVFLEDGYTKE

SEQ ID NO: 2072678 - protein, 22 aa, Staphylococcus
KEPMSVTYEFKLNNQIFKIHRE

SEQ ID NO: 2072679 - protein, 22 aa, Staphylococcus
KEPVIIKFEADWCPDCKAMDMW

SEQ ID NO: 2072680 - protein, 24 aa, Staphylococcus
KEPYNDIRMWDYKALPAVFGGDNV

SEQ ID NO: 2072681 - protein, 24 aa, Staphylococcus
KEQELYQYMKPLPLHKRIELQNEV

SEQ ID NO: 2072682 - protein, 17 aa, Staphylococcus
KEQFGNVSLLDTPTFFF

SEQ ID NO: 2072683 - protein, 17 aa, Staphylococcus
KEQFNSPHYLEKLIKRK

SEQ ID NO: 2072684 - protein, 26 aa, Staphylococcus
KEQINTLNRLLENQQILALESNKKIQ

SEQ ID NO: 2072685 - protein, 32 aa, Staphylococcus
KEQIPESYLRKFDYLVFPDNVAIVLGIAQAVG

SEQ ID NO: 2072686 - protein, 24 aa, Staphylococcus
KEQKEIFLLTEILSGKNSHKLTLE

SEQ ID NO: 2072687 - protein, 21 aa, Staphylococcus
KEQLDPVYKEIIRLIYREEIP

SEQ ID NO: 2072688 - protein, 19 aa, Staphylococcus
KEQLPDLAFTILDNAGAIC

SEQ ID NO: 2072689 - protein, 32 aa, Staphylococcus
KEQLQFFKINALRSIFWKVLDQEFYLIDNSQK

SEQ ID NO: 2072690 - protein, 24 aa, Staphylococcus
KEQMLPIVLENYKNRTRQSMNDIV

SEQ ID NO: 2072691 - protein, 23 aa, Staphylococcus
KEQNLLITDFRYIEQATAQAPDF

SEQ ID NO: 2072692 - protein, 24 aa, Staphylococcus
KEQPDFISVFLGTNDWGLVGDKIR

SEQ ID NO: 2072693 - protein, 17 aa, Staphylococcus
KEQRQPEYLFEEKELLK

SEQ ID NO: 2072694 - protein, 22 aa, Staphylococcus
KEQSIQDVLLALELDPKRVIVE

SEQ ID NO: 2072695 - protein, 32 aa, Staphylococcus
KEQYGNLSLLDTPTFFFGMRHGETVEIEIDTG

SEQ ID NO: 2072696 - protein, 25 aa, Staphylococcus
KEQYKGIGIMYKNHQWYFVVANIES

SEQ ID NO: 2072697 - protein, 29 aa, Staphylococcus
KEQYPLCFNIALKIMRLLQQELKIKVYEA

SEQ ID NO: 2072698 - protein, 26 aa, Staphylococcus
KERAFDLLLELGFPRNVMSLSPFQMS

SEQ ID NO: 2072699 - protein, 37 aa, Staphylococcus
KEREDLIEDLKKFFRPEFLNRFDGIVEFTHLDKDALQ

SEQ ID NO: 2072700 - protein, 20 aa, Staphylococcus
KERFNLYLDNEFEMGIDIDT

SEQ ID NO: 2072701 - protein, 17 aa, Staphylococcus
KERHNLKMITIESLIEY

SEQ ID NO: 2072702 - protein, 23 aa, Staphylococcus
KERKNVILFFDEIHQIIGSGSTG

SEQ ID NO: 2072703 - protein, 20 aa, Staphylococcus
KERLRMLKAFPTPTERDFPL

SEQ ID NO: 2072704 - protein, 17 aa, Staphylococcus
KERTKFQILAPVVSHRK

SEQ ID NO: 2072705 - protein, 20 aa, Staphylococcus
KERTVYLPNAYHPILNKDTV

SEQ ID NO: 2072706 - protein, 21 aa, Staphylococcus
KESEEIINLIKLAIDQHIPYQ

SEQ ID NO: 2072707 - protein, 26 aa, Staphylococcus
KESEGRIILFIDEIHMLVGAGKTDGA

SEQ ID NO: 2072708 - protein, 18 aa, Staphylococcus
KESFYNVLNHRKSTREFT

SEQ ID NO: 2072709 - protein, 25 aa, Staphylococcus
KESILNIILPQYVEGLIYGTILNAK

SEQ ID NO: 2072710 - protein, 25 aa, Staphylococcus
KESKHIGGFPVSGLFLVCRDEAITK

SEQ ID NO: 2072711 - protein, 24 aa, Staphylococcus
KESLELYINAYRLAERYANISTNC

SEQ ID NO: 2072712 - protein, 26 aa, Staphylococcus
KESNIKLIYWLKGSGRVILNLKKFQM

SEQ ID NO: 2072713 - protein, 25 aa, Staphylococcus
KESRELVGILTNRDLRFIEDFSIKI

SEQ ID NO: 2072714 - protein, 24 aa, Staphylococcus
KESVDAFVDLLNGMVKTQVKEALR

SEQ ID NO: 2072715 - protein, 22 aa, Staphylococcus
KETDTLRIKWIEKGKIESYDDF

SEQ ID NO: 2072716 - protein, 22 aa, Staphylococcus
KETDTLRIKWVEKGSIESYDDF

SEQ ID NO: 2072717 - protein, 30 aa, Staphylococcus
KETEIFFEKLMDLLKFMIPGYKKEGKSQLV

SEQ ID NO: 2072718 - protein, 30 aa, Staphylococcus
KETFETNVYPIFWTVQKALEYLQPGASITT

SEQ ID NO: 2072719 - protein, 30 aa, Staphylococcus
KETFETNVYPVFWTIQKALDYLQPGASITT

SEQ ID NO: 2072720 - protein, 28 aa, Staphylococcus
KETFQTNIFGMIFLSQAAVPYLNDGDSI

SEQ ID NO: 2072721 - protein, 22 aa, Staphylococcus
KETHDTVIRFAPPLIITKEEID

SEQ ID NO: 2072722 - protein, 22 aa, Staphylococcus
KETHDTVIRFAPPLVISKEELD

SEQ ID NO: 2072723 - protein, 23 aa, Staphylococcus
KETHDTVIRFAPPLVITKEELDE

SEQ ID NO: 2072724 - protein, 25 aa, Staphylococcus
KETHDTVIRFAPPLVITKEELDLAI

SEQ ID NO: 2072725 - protein, 28 aa, Staphylococcus
KETHDTVIRFAPPLVITKEELDLALDKI

SEQ ID NO: 2072726 - protein, 22 aa, Staphylococcus
KETIDFFVAKGIVDRIAEKLDI

SEQ ID NO: 2072727 - protein, 25 aa, Staphylococcus
KETIDPVIGLSPFQARRIAFNINIP

SEQ ID NO: 2072728 - protein, 25 aa, Staphylococcus
KETIDPVVGLAPYQARRIAFNINIP

SEQ ID NO: 2072729 - protein, 22 aa, Staphylococcus
KETIHHYKFMKDYYLAEVLASK

SEQ ID NO: 2072730 - protein, 21 aa, Staphylococcus
KETLEPVYKEIIRLIYREEIP

SEQ ID NO: 2072731 - protein, 30 aa, Staphylococcus
KETNIFYEKLIDLLKFMVPGYKKEGKSQLV

SEQ ID NO: 2072732 - protein, 19 aa, Staphylococcus
KETPFAKLIHYQNYRMTLF

SEQ ID NO: 2072733 - protein, 23 aa, Staphylococcus
KETPKLEALKHLFYKMQQLESDY

SEQ ID NO: 2072734 - protein, 25 aa, Staphylococcus
KETRKMYLFNKQRTLKRLYDEHLKI

SEQ ID NO: 2072735 - protein, 25 aa, Staphylococcus
KETSRFYQYWLDYVEQDLADAKAAI

SEQ ID NO: 2072736 - protein, 25 aa, Staphylococcus
KETYPQLGRLIGFIPKDQAVDVCEK

SEQ ID NO: 2072737 - protein, 20 aa, Staphylococcus
KEVDFIIIAGDLFDKENRTL

SEQ ID NO: 2072738 - protein, 20 aa, Staphylococcus
KEVDLTLPLVVRLEGTNVEL

SEQ ID NO: 2072739 - protein, 25 aa, Staphylococcus
KEVFRKQIALAKRVKLPIIIHNREA

SEQ ID NO: 2072740 - protein, 25 aa, Staphylococcus
KEVFRKQIALAKRVKLPIVIHNREA

SEQ ID NO: 2072741 - protein, 25 aa, Staphylococcus
KEVFRKQIALAKRVQLPIIIHNREA

SEQ ID NO: 2072742 - protein, 18 aa, Staphylococcus
KEVGRIISLALKNPNNDT

SEQ ID NO: 2072743 - protein, 25 aa, Staphylococcus
KEVKSLLQMLLLHAIPEPVISDAKA

SEQ ID NO: 2072744 - protein, 25 aa, Staphylococcus
KEVKSLLQMLLLHAIPEPVISDKKA

SEQ ID NO: 2072745 - protein, 25 aa, Staphylococcus
KEVKSLLQMLLLHAVPEPVISDKKA

SEQ ID NO: 2072746 - protein, 20 aa, Staphylococcus
KEVLFAPTMKVKSLMRMRME

SEQ ID NO: 2072747 - protein, 27 aa, Staphylococcus
KEVNRLINDLIYFVRDTIMNKTAQRET

SEQ ID NO: 2072748 - protein, 27 aa, Staphylococcus
KEVPEGLVPLLKIQGLGSKKIAKLYKE

SEQ ID NO: 2072749 - protein, 19 aa, Staphylococcus
KEVPIFHDQYPKLAHLNLK

SEQ ID NO: 2072750 - protein, 28 aa, Staphylococcus
KEVSDPYLKRRFLQKSFLKAIDSEWIEQ

SEQ ID NO: 2072751 - protein, 17 aa, Staphylococcus
KEVYDPRKYLGPAREAI

SEQ ID NO: 2072752 - protein, 17 aa, Staphylococcus
KEVYQIFSDVLGVPLEG

SEQ ID NO: 2072753 - protein, 22 aa, Staphylococcus
KEWKLEDLPIIPKHMKTIVIGK

SEQ ID NO: 2072754 - protein, 25 aa, Staphylococcus
KEWVPNTTLFLFNNEKIIGSVNIRH

SEQ ID NO: 2072755 - protein, 17 aa, Staphylococcus
KEYAPILYQIWKKKHKK

SEQ ID NO: 2072756 - protein, 24 aa, Staphylococcus
KEYEDLLIQFDRLGNYAELRLSVD

SEQ ID NO: 2072757 - protein, 20 aa, Staphylococcus
KEYLTYIRMYHASQLLINTN

SEQ ID NO: 2072758 - protein, 28 aa, Staphylococcus
KFADIKTYIFYQLFDKYVIDYSMASATG

SEQ ID NO: 2072759 - protein, 17 aa, Staphylococcus
KFAGIVFGDANYYLKNM

SEQ ID NO: 2072760 - protein, 18 aa, Staphylococcus
KFALTQPDKFSKAAPLSA

SEQ ID NO: 2072761 - protein, 19 aa, Staphylococcus
KFALTQSHLFSKAAPLSAV

SEQ ID NO: 2072762 - protein, 22 aa, Staphylococcus
KFARYFVMEFEKEIIGYIGMWT

SEQ ID NO: 2072763 - protein, 18 aa, Staphylococcus
KFDMPYEEAKSWMLKALE

SEQ ID NO: 2072764 - protein, 26 aa, Staphylococcus
KFDNATYLPRFVFGHYMKSYLEKFDQ

SEQ ID NO: 2072765 - protein, 26 aa, Staphylococcus
KFDTIEATPLPKLFSDILIYSAERNV

SEQ ID NO: 2072766 - protein, 27 aa, Staphylococcus
KFDVYFKGEYFDTFLSPQFGDHNILNA

SEQ ID NO: 2072767 - protein, 17 aa, Staphylococcus
KFEDIFNNKGSKFDKQM

SEQ ID NO: 2072768 - protein, 20 aa, Staphylococcus
KFEEFKYHRGATSYHPKITK

SEQ ID NO: 2072769 - protein, 25 aa, Staphylococcus
KFEGLIHRFRRSFLLNDNFEKKRFK

SEQ ID NO: 2072770 - protein, 22 aa, Staphylococcus
KFEILPYHQLGVHKWKNLGIPY

SEQ ID NO: 2072771 - protein, 22 aa, Staphylococcus
KFEILPYHQLGVHKWKTLGVHY

SEQ ID NO: 2072772 - protein, 26 aa, Staphylococcus
KFELTFEKLFIDSYIQQLILKMEAKM

SEQ ID NO: 2072773 - protein, 17 aa, Staphylococcus
KFEMPYEEAKDWMVKAL

SEQ ID NO: 2072774 - protein, 17 aa, Staphylococcus
KFEMPYEEAKSWMLKAL

SEQ ID NO: 2072775 - protein, 20 aa, Staphylococcus
KFEPVLHVFAQDGSIFTNEP

SEQ ID NO: 2072776 - protein, 20 aa, Staphylococcus
KFEQHILTIKAYKKINNENY

SEQ ID NO: 2072777 - protein, 20 aa, Staphylococcus
KFEVMSIPTLIVFKDGEPVD

SEQ ID NO: 2072778 - protein, 19 aa, Staphylococcus
KFFLDYCKYFEALVAYSKY

SEQ ID NO: 2072779 - protein, 19 aa, Staphylococcus
KFFNAVDVPPFWEISGDGQ

SEQ ID NO: 2072780 - protein, 18 aa, Staphylococcus
KFGGPKGAGILLVKDHTP

SEQ ID NO: 2072781 - protein, 19 aa, Staphylococcus
KFGLRLPGEFNREDIKQAV

SEQ ID NO: 2072782 - protein, 19 aa, Staphylococcus
KFGLSIRHGLAIQAVEKVK

SEQ ID NO: 2072783 - protein, 24 aa, Staphylococcus
KFGRPIFTFIDTKGAYPGKAAEER

SEQ ID NO: 2072784 - protein, 40 aa, Staphylococcus
KFHETVIFATNHQYLKTFWHHLKPVMEALILLSMRQRMQQ

SEQ ID NO: 2072785 - protein, 18 aa, Staphylococcus
KFHNLVIEGYRQIMENGD

SEQ ID NO: 2072786 - protein, 26 aa, Staphylococcus
KFIDIDYLLDFIHKYKDLHPQDIVQL

SEQ ID NO: 2072787 - protein, 19 aa, Staphylococcus
KFIDLVIPVLQARGVFRKE

SEQ ID NO: 2072788 - protein, 18 aa, Staphylococcus
KFIKVLLEKELITFTTGN

SEQ ID NO: 2072789 - protein, 18 aa, Staphylococcus
KFILEKLKPYEDQLQIDG

SEQ ID NO: 2072790 - protein, 18 aa, Staphylococcus
KFIYLSPEFILQPQNFKL

SEQ ID NO: 2072791 - protein, 28 aa, Staphylococcus
KFKEEVGYPLIVRPAFTMGGTGGGICYN

SEQ ID NO: 2072792 - protein, 31 aa, Staphylococcus
KFKHPIPWKQHDVKLVFFLAIAKKDAQMMKN

SEQ ID NO: 2072793 - protein, 29 aa, Staphylococcus
KFKHWLKQDYIYLIEYARLFAIGAAKATD

SEQ ID NO: 2072794 - protein, 19 aa, Staphylococcus
KFKILHKTIILPELSQNAF

SEQ ID NO: 2072795 - protein, 31 aa, Staphylococcus
KFKKEEGYNLTFFAFFVKAAAEALKEFPMLN

SEQ ID NO: 2072796 - protein, 25 aa, Staphylococcus
KFKKMHVRMMPKQEPPYTRLIDSAR

SEQ ID NO: 2072797 - protein, 19 aa, Staphylococcus
KFKNANVLVQKLISEFPNI

SEQ ID NO: 2072798 - protein, 20 aa, Staphylococcus
KFKNCKGGIRFLGVKDGKNA

SEQ ID NO: 2072799 - protein, 17 aa, Staphylococcus
KFKSLTFISGTLTFNHS

SEQ ID NO: 2072800 - protein, 18 aa, Staphylococcus
KFKSLTFISGTLTFNHSF

SEQ ID NO: 2072801 - protein, 19 aa, Staphylococcus
KFKSLTFISGTLTFNHSFE

SEQ ID NO: 2072802 - protein, 17 aa, Staphylococcus
KFKTYIQYIYDLKIYKD

SEQ ID NO: 2072803 - protein, 19 aa, Staphylococcus
KFLEEVWSWKDEYASFIRQ

SEQ ID NO: 2072804 - protein, 19 aa, Staphylococcus
KFLEHAWSWKEEYASFIRK

SEQ ID NO: 2072805 - protein, 17 aa, Staphylococcus
KFLRAPSIRQFSNRMKH

SEQ ID NO: 2072806 - protein, 19 aa, Staphylococcus
KFLSKQFDQLTWLKDQEVA

SEQ ID NO: 2072807 - protein, 18 aa, Staphylococcus
KFLSSLPVGGLGLDFVHD

SEQ ID NO: 2072808 - protein, 24 aa, Staphylococcus
KFMNHFDYACYLTLLDVLDSHDVD

SEQ ID NO: 2072809 - protein, 23 aa, Staphylococcus
KFNGKNILNFKNDIGYLSQHTDF

SEQ ID NO: 2072810 - protein, 28 aa, Staphylococcus
KFNGLKGQGILFVRNIHQLEPIVHGGGQ

SEQ ID NO: 2072811 - protein, 18 aa, Staphylococcus
KFNKLLVESAHLTLQRQR

SEQ ID NO: 2072812 - protein, 20 aa, Staphylococcus
KFNLDGLKKYLFPEHSDDYI

SEQ ID NO: 2072813 - protein, 26 aa, Staphylococcus
KFNQVYFARVPLLDGTKIITSQKALK

SEQ ID NO: 2072814 - protein, 20 aa, Staphylococcus
KFNSLTFISGTLTFNHKFDA

SEQ ID NO: 2072815 - protein, 17 aa, Staphylococcus
KFPGIGKKTARQIILDL

SEQ ID NO: 2072816 - protein, 22 aa, Staphylococcus
KFPHVTYFMSGGRNAEFEGERR

SEQ ID NO: 2072817 - protein, 18 aa, Staphylococcus
KFPKPVISAPPFGYTQHF

SEQ ID NO: 2072818 - protein, 20 aa, Staphylococcus
KFQGDTFFPPYTFENWEVES

SEQ ID NO: 2072819 - protein, 17 aa, Staphylococcus
KFQLIRMPEETLVTKGL

SEQ ID NO: 2072820 - protein, 22 aa, Staphylococcus
KFQPRIRTIPVGSLDQLTMPSV

SEQ ID NO: 2072821 - protein, 18 aa, Staphylococcus
KFQSIFQYSFEEKLAIED

SEQ ID NO: 2072822 - protein, 30 aa, Staphylococcus
KFQSILELAKENLNWIWNSLSRTDQKHFLS

SEQ ID NO: 2072823 - protein, 25 aa, Staphylococcus
KFRAKQIFEWLYEKRVDDIDDMTNL

SEQ ID NO: 2072824 - protein, 25 aa, Staphylococcus
KFRAKQIFEWLYQKRVDTIDEMTNL

SEQ ID NO: 2072825 - protein, 25 aa, Staphylococcus
KFRAKQIYEWLYQKRVNSFEEMTNL

SEQ ID NO: 2072826 - protein, 18 aa, Staphylococcus
KFRQADPTLFMDKYHRFT

SEQ ID NO: 2072827 - protein, 17 aa, Staphylococcus
KFRYDLNERFIITRGLD

SEQ ID NO: 2072828 - protein, 21 aa, Staphylococcus
KFSDSPGIIRPLQALADTGLN

SEQ ID NO: 2072829 - protein, 25 aa, Staphylococcus
KFSFEDLPQFTPELFMKVSAKNVMK

SEQ ID NO: 2072830 - protein, 21 aa, Staphylococcus
KFSLALDRMLLGEPIQYIVGF

SEQ ID NO: 2072831 - protein, 18 aa, Staphylococcus
KFSLMVDGLLRQLGSLQE

SEQ ID NO: 2072832 - protein, 34 aa, Staphylococcus
KFSLPVLDLYHDSNLKVWIDYVNKTYFSYEPGKE

SEQ ID NO: 2072833 - protein, 20 aa, Staphylococcus
KFSNWMNQLFHGIEFRMQLE

SEQ ID NO: 2072834 - protein, 21 aa, Staphylococcus
KFSTITLLRIMERPAYLKLKK

SEQ ID NO: 2072835 - protein, 21 aa, Staphylococcus
KFTAKFLHYKNKPFKLKTKKD

SEQ ID NO: 2072836 - protein, 21 aa, Staphylococcus
KFTAKFLHYKNKPFKLQNKDD

SEQ ID NO: 2072837 - protein, 17 aa, Staphylococcus
KFTEGAFKQWGYDVAHN

SEQ ID NO: 2072838 - protein, 26 aa, Staphylococcus
KFTQKNAFLLPFVNKLFTYEHPSLSQ

SEQ ID NO: 2072839 - protein, 20 aa, Staphylococcus
KFVGQPLWGSIGYTLPATIG

SEQ ID NO: 2072840 - protein, 18 aa, Staphylococcus
KFVLEHHPYLQYHSVANI

SEQ ID NO: 2072841 - protein, 20 aa, Staphylococcus
KFVRPKLTVANRSMDRFESW

SEQ ID NO: 2072842 - protein, 18 aa, Staphylococcus
KFWKYMKNNDLTDTTFAI

SEQ ID NO: 2072843 - protein, 19 aa, Staphylococcus
KFYEHHQWIESHLDEDYYD

SEQ ID NO: 2072844 - protein, 17 aa, Staphylococcus
KFYIISYHNQKLSIKTD

SEQ ID NO: 2072845 - protein, 19 aa, Staphylococcus
KFYNNPHAYVKLWKHHGAQ

SEQ ID NO: 2072846 - protein, 17 aa, Staphylococcus
KFYPGILVEIATDGPGF

SEQ ID NO: 2072847 - protein, 22 aa, Staphylococcus
KGAATALFDFAVKRALDHDIHV

SEQ ID NO: 2072848 - protein, 24 aa, Staphylococcus
KGAIARTMFMTERPFREIIKQSLE

SEQ ID NO: 2072849 - protein, 25 aa, Staphylococcus
KGALSYIHDIWGYIAPNSKHEIAPQ

SEQ ID NO: 2072850 - protein, 24 aa, Staphylococcus
KGALSYIHDIWGYIAPNTKKEQTP

SEQ ID NO: 2072851 - protein, 24 aa, Staphylococcus
KGALSYIQDIWGYIAPNTKHESSP

SEQ ID NO: 2072852 - protein, 24 aa, Staphylococcus
KGANPYFVSFMGDAPKKHPRVIVY

SEQ ID NO: 2072853 - protein, 24 aa, Staphylococcus
KGARGYITFGQPLDIPIIADSYST

SEQ ID NO: 2072854 - protein, 24 aa, Staphylococcus
KGARGYLFFGHPLDVPEVAGSYST

SEQ ID NO: 2072855 - protein, 26 aa, Staphylococcus
KGCDETFIKTLLKLNPKRIVYISCNP

SEQ ID NO: 2072856 - protein, 27 aa, Staphylococcus
KGCDQVFIETLLELAPKRIIYISCNPS

SEQ ID NO: 2072857 - protein, 18 aa, Staphylococcus
KGCLLIQGDNLKLTTQFY

SEQ ID NO: 2072858 - protein, 23 aa, Staphylococcus
KGDDLQYTMTLEFEEAVFGTKKE

SEQ ID NO: 2072859 - protein, 25 aa, Staphylococcus
KGDEVLPITFIEDGIAKTGAYITQE

SEQ ID NO: 2072860 - protein, 26 aa, Staphylococcus
KGDEVLPITFIEGGIAKTGAYITQEE

SEQ ID NO: 2072861 - protein, 25 aa, Staphylococcus
KGDFFNDLYALLLKMTRIYTRPLGK

SEQ ID NO: 2072862 - protein, 23 aa, Staphylococcus
KGDINVYFRSWYSHYLDYRENEI

SEQ ID NO: 2072863 - protein, 22 aa, Staphylococcus
KGDKEYLIPYIADVVKDIDVEG

SEQ ID NO: 2072864 - protein, 22 aa, Staphylococcus
KGDKEYLIPYIADVVKDVDVEN

SEQ ID NO: 2072865 - protein, 33 aa, Staphylococcus
KGDKILIMMPRSISTYRIYIAALKLGIAIIPSS

SEQ ID NO: 2072866 - protein, 21 aa, Staphylococcus
KGDKPVIYLGGLDTPLKEAIK

SEQ ID NO: 2072867 - protein, 34 aa, Staphylococcus
KGDKQYIILIEDIITYFINDLFSGYTVLNTFTFR

SEQ ID NO: 2072868 - protein, 21 aa, Staphylococcus
KGDLPLFQKVTQWLEKYFEGN

SEQ ID NO: 2072869 - protein, 25 aa, Staphylococcus
KGDMEAFWKIFHQRMAIMHDALVYR

SEQ ID NO: 2072870 - protein, 25 aa, Staphylococcus
KGDMITLDFGAYYRGYCSDITRTFA

SEQ ID NO: 2072871 - protein, 26 aa, Staphylococcus
KGDMITLDFGAYYRGYCSDITRTFAI

SEQ ID NO: 2072872 - protein, 38 aa, Staphylococcus
KGDRVFVFMPRTPELYFALFGTLKIGAIVGPLFEAFME

SEQ ID NO: 2072873 - protein, 21 aa, Staphylococcus
KGDRVVIPFNIGCGDCFYCNN

SEQ ID NO: 2072874 - protein, 22 aa, Staphylococcus
KGDSWLPIGTRFTYNSPFKKQD

SEQ ID NO: 2072875 - protein, 21 aa, Staphylococcus
KGDVALFFGLSGTGKTTLSAA

SEQ ID NO: 2072876 - protein, 22 aa, Staphylococcus
KGDVALFFGLSGTGKTTLSAAA

SEQ ID NO: 2072877 - protein, 22 aa, Staphylococcus
KGDVALFFGLSGTGKTTLSAAP

SEQ ID NO: 2072878 - protein, 21 aa, Staphylococcus
KGDVALFFGLSGTGKTTLSAD

SEQ ID NO: 2072879 - protein, 22 aa, Staphylococcus
KGDVALFFGLSGTGKTTLSADP

SEQ ID NO: 2072880 - protein, 23 aa, Staphylococcus
KGDVALFFGLSGTGKTTLSADPE

SEQ ID NO: 2072881 - protein, 21 aa, Staphylococcus
KGEIFPSFTIPLEHPGFKQLQ

SEQ ID NO: 2072882 - protein, 21 aa, Staphylococcus
KGEIIEYLDKPPSAWVVVAKP

SEQ ID NO: 2072883 - protein, 38 aa, Staphylococcus
KGEIQFLYVAPERFDNVYFIRLLQQLSIHLVAFDEAHC

SEQ ID NO: 2072884 - protein, 25 aa, Staphylococcus
KGEKQIVNRVAPWNFKRTKFPQVNH

SEQ ID NO: 2072885 - protein, 27 aa, Staphylococcus
KGELDEHFPLVVWQTGSGTQSNMNVNE

SEQ ID NO: 2072886 - protein, 23 aa, Staphylococcus
KGELNYFINNFLSFIKEGQENLI

SEQ ID NO: 2072887 - protein, 24 aa, Staphylococcus
KGENPYFVSFIGDAPKKNPKVIVY

SEQ ID NO: 2072888 - protein, 19 aa, Staphylococcus
KGFAFLRPEEEDMDDIFIP

SEQ ID NO: 2072889 - protein, 17 aa, Staphylococcus
KGFEMLPQMKAVDLRIE

SEQ ID NO: 2072890 - protein, 17 aa, Staphylococcus
KGFGINPIIIKSVAKQI

SEQ ID NO: 2072891 - protein, 17 aa, Staphylococcus
KGFGINPMIIKSVAKQV

SEQ ID NO: 2072892 - protein, 20 aa, Staphylococcus
KGFRRISFEKLVLETPIPDD

SEQ ID NO: 2072893 - protein, 32 aa, Staphylococcus
KGFTVINIKKYLMNRQVGFTRKILAVLEEFNI

SEQ ID NO: 2072894 - protein, 20 aa, Staphylococcus
KGFVWGHYELQTKTVIIELL

SEQ ID NO: 2072895 - protein, 23 aa, Staphylococcus
KGGKLLFEGLPNKLLEVDQSVTA

SEQ ID NO: 2072896 - protein, 23 aa, Staphylococcus
KGGLQFTYISLDDFRILKSTLYG

SEQ ID NO: 2072897 - protein, 26 aa, Staphylococcus
KGGWQELKIVPYAPFEISPAAQSLHY

SEQ ID NO: 2072898 - protein, 17 aa, Staphylococcus
KGHIFTHSFPKDTPSNN

SEQ ID NO: 2072899 - protein, 17 aa, Staphylococcus
KGHILYENDFEFLKEVL

SEQ ID NO: 2072900 - protein, 27 aa, Staphylococcus
KGHLTNELLQRFKFDKAFISCGSFDKN

SEQ ID NO: 2072901 - protein, 28 aa, Staphylococcus
KGIAVYDAYTILYLLHPENFTVEDAAVN

SEQ ID NO: 2072902 - protein, 28 aa, Staphylococcus
KGIDLIDIVVVNLYPFKETVANPDVTEM

SEQ ID NO: 2072903 - protein, 26 aa, Staphylococcus
KGIDTVIFIPSIIHPSFKRLPEVENL

SEQ ID NO: 2072904 - protein, 38 aa, Staphylococcus; identical to SEQ ID NO: 1820263

SEQ ID NO: 2072905 - protein, 17 aa, Staphylococcus
KGIFLTHGHEHAIGAVS

SEQ ID NO: 2072906 - protein, 17 aa, Staphylococcus
KGIFLTHGHLDHINGAK

SEQ ID NO: 2072907 - protein, 23 aa, Staphylococcus
KGIFSVINYLLPKDDIMSMHCSA

SEQ ID NO: 2072908 - protein, 22 aa, Staphylococcus
KGIFSVMNYLLPMQDIMSMHCS

SEQ ID NO: 2072909 - protein, 23 aa, Staphylococcus
KGIFSVMNYLLPQQDIMSMHCSA

SEQ ID NO: 2072910 - protein, 22 aa, Staphylococcus
KGIGLHKAVILKAAFELGERMN

SEQ ID NO: 2072911 - protein, 20 aa, Staphylococcus
KGIGLNKAIILKAAFELGER

SEQ ID NO: 2072912 - protein, 20 aa, Staphylococcus
KGIGLYKAIILQAAFELGER

SEQ ID NO: 2072913 - protein, 18 aa, Staphylococcus
KGIGTRYIKLIFEFLKKE

SEQ ID NO: 2072914 - protein, 19 aa, Staphylococcus
KGIHIGILHGTYSKSNTND

SEQ ID NO: 2072915 - protein, 25 aa, Staphylococcus
KGIKKNLDFDWVVAIKIIAKKNKTY

SEQ ID NO: 2072916 - protein, 25 aa, Staphylococcus
KGIRDRVIIELLYATGIRVSELVNI

SEQ ID NO: 2072917 - protein, 25 aa, Staphylococcus
KGISTLLIEKLYAKAINKYFNDVKF

SEQ ID NO: 2072918 - protein, 25 aa, Staphylococcus
KGIVATNHLLLLGALQAIKESEKEI

SEQ ID NO: 2072919 - protein, 18 aa, Staphylococcus
KGIVGFKIKVNDIQGAYK

SEQ ID NO: 2072920 - protein, 24 aa, Staphylococcus
KGIYKFRYHILEAIKIVFEYQSIY

SEQ ID NO: 2072921 - protein, 39 aa, Staphylococcus
KGIYNFKIIYYQNQVYIHFIIHHLVIDGVSWRIILNDFS

SEQ ID NO: 2072922 - protein, 26 aa, Staphylococcus
KGKFISLQLFHALSYNYYFLGNKEES

SEQ ID NO: 2072923 - protein, 22 aa, Staphylococcus
KGKNIALIFEKDSTRTRCAFET

SEQ ID NO: 2072924 - protein, 22 aa, Staphylococcus
KGKNIALIFEKDSTRTRCAFEV

SEQ ID NO: 2072925 - protein, 22 aa, Staphylococcus
KGKNIALIFEKNSTRTRCAFET

SEQ ID NO: 2072926 - protein, 23 aa, Staphylococcus
KGKQILELAPQKLTSPLLTAEWE

SEQ ID NO: 2072927 - protein, 27 aa, Staphylococcus
KGKSEAFPFLMIGPGQGPHQIDECVNK

SEQ ID NO: 2072928 - protein, 19 aa, Staphylococcus
KGKSFILTSEDLDNIFKGD

SEQ ID NO: 2072929 - protein, 26 aa, Staphylococcus
KGKSLLLMRRNIGMIFQHFNLVKRST

SEQ ID NO: 2072930 - protein, 17 aa, Staphylococcus
KGLGVLARKYNLPIYAN

SEQ ID NO: 2072931 - protein, 28 aa, Staphylococcus
KGLGVLARKYNLPIYANEKTWQAIEKKD

SEQ ID NO: 2072932 - protein, 19 aa, Staphylococcus
KGLITIKDIEKVHEYPFAA

SEQ ID NO: 2072933 - protein, 25 aa, Staphylococcus
KGLKKLLEEWLEQPKFQILASKINT

SEQ ID NO: 2072934 - protein, 25 aa, Staphylococcus
KGLKQVYPDLSNAYILILGAGGASK

SEQ ID NO: 2072935 - protein, 17 aa, Staphylococcus
KGLKSLYYTRNKLLSVE

SEQ ID NO: 2072936 - protein, 18 aa, Staphylococcus
KGLKVALPKEYLGEGINE

SEQ ID NO: 2072937 - protein, 19 aa, Staphylococcus
KGLKVALPKEYLGEGVSEE

SEQ ID NO: 2072938 - protein, 22 aa, Staphylococcus
KGLLCVYEGFLKGLKGEQVEAQ

SEQ ID NO: 2072939 - protein, 26 aa, Staphylococcus
KGLLGSKLFVYYNNHEWYKFSHFSKE

SEQ ID NO: 2072940 - protein, 17 aa, Staphylococcus
KGLLHEIFKEYGVLFLD

SEQ ID NO: 2072941 - protein, 24 aa, Staphylococcus
KGLQPNMPAMHSLFIGNPGTGKTT

SEQ ID NO: 2072942 - protein, 25 aa, Staphylococcus
KGLRDRVILELLYATGIRVSELVNI

SEQ ID NO: 2072943 - protein, 25 aa, Staphylococcus
KGLRDRVILELLYGTGIRVSELVNI

SEQ ID NO: 2072944 - protein, 25 aa, Staphylococcus
KGLRDRVILELLYSTGIRVSELVHI

SEQ ID NO: 2072945 - protein, 17 aa, Staphylococcus
KGLRVPGAFNGFELGVR

SEQ ID NO: 2072946 - protein, 24 aa, Staphylococcus
KGLWMSIVLRPDVPYAMIPKFNLF

SEQ ID NO: 2072947 - protein, 17 aa, Staphylococcus
KGLWMSLVLRPNVPFSM

SEQ ID NO: 2072948 - protein, 24 aa, Staphylococcus
KGMDSLLSIVQMPGGIPVATTAIG

SEQ ID NO: 2072949 - protein, 23 aa, Staphylococcus
KGMILTAPPFYYDRVNNTYIPNQ

SEQ ID NO: 2072950 - protein, 20 aa, Staphylococcus
KGMLNEKIKWNFTKFLVDRE

SEQ ID NO: 2072951 - protein, 21 aa, Staphylococcus
KGMLSEKIKWNFTKFLVDREG

SEQ ID NO: 2072952 - protein, 25 aa, Staphylococcus
KGMRDKVILELLYATGIRVSELVHI

SEQ ID NO: 2072953 - protein, 26 aa, Staphylococcus
KGNAQWTHLWSGQSPRLVQHMSAWAL

SEQ ID NO: 2072954 - protein, 25 aa, Staphylococcus
KGNIQLPRYFFLSETEKFEPDTHYT

SEQ ID NO: 2072955 - protein, 21 aa, Staphylococcus
KGNMIKPWYVNSIDNPVNDKT

SEQ ID NO: 2072956 - protein, 34 aa, Staphylococcus
KGNPFSISAVTYILSNPFYIGKIQFAKYKDWNDK

SEQ ID NO: 2072957 - protein, 19 aa, Staphylococcus
KGNQQWRTLNNNKSILVIF

SEQ ID NO: 2072958 - protein, 31 aa, Staphylococcus
KGNTDVLPVIYYIHGAGWVFGSPETHDKLVR

SEQ ID NO: 2072959 - protein, 19 aa, Staphylococcus
KGNWKIPIKTLNKTLTKIT

SEQ ID NO: 2072960 - protein, 21 aa, Staphylococcus
KGPEQIKVFFKDNWAIAHMTG

SEQ ID NO: 2072961 - protein, 25 aa, Staphylococcus
KGQCNYLLLRPTSKNRYTQLIKSVK

SEQ ID NO: 2072962 - protein, 19 aa, Staphylococcus
KGQDIFDTLSKYEIKRRGD

SEQ ID NO: 2072963 - protein, 28 aa, Staphylococcus
KGQERVQLLLEWMDGRMPLIGIGSIFTA

SEQ ID NO: 2072964 - protein, 24 aa, Staphylococcus
KGQISQILEYTLGDGFYAAKPTGI

SEQ ID NO: 2072965 - protein, 30 aa, Staphylococcus
KGQLAAYITPRLQPWDFAGGLIILNEVGGK

SEQ ID NO: 2072966 - protein, 24 aa, Staphylococcus
KGQMEGKLFGIPMGIKDNIITKDV

SEQ ID NO: 2072967 - protein, 26 aa, Staphylococcus
KGREIPYDICIFATGSKAFVLPIPGH

SEQ ID NO: 2072968 - protein, 35 aa, Staphylococcus
KGRGEKIRFLKKPPSAWVVLAKPNLGISSADVFKA

SEQ ID NO: 2072969 - protein, 28 aa, Staphylococcus
KGRLQKNLLNWFIDDQYKLFYKKQDLSQ

SEQ ID NO: 2072970 - protein, 25 aa, Staphylococcus
KGRLQRDLINWFIDDQYKMFYKKQD

SEQ ID NO: 2072971 - protein, 21 aa, Staphylococcus
KGRMSLFYYAELTYQPTHCEN

SEQ ID NO: 2072972 - protein, 21 aa, Staphylococcus
KGRMSLFYYAELTYQPTYCEN

SEQ ID NO: 2072973 - protein, 23 aa, Staphylococcus
KGRRLKVFYATQVAVEPPTFVVF

SEQ ID NO: 2072974 - protein, 22 aa, Staphylococcus
KGRYSIVAFDYYGTVKLNDNEL

SEQ ID NO: 2072975 - protein, 26 aa, Staphylococcus
KGSDFDVLPLIYQLPNSPIKYHEFPA

SEQ ID NO: 2072976 - protein, 30 aa, Staphylococcus
KGSIVGFFTPELFHGIGSAGFHVHFANDDR

SEQ ID NO: 2072977 - protein, 26 aa, Staphylococcus
KGSIVGFFTPELFHGVGSAGFHIHFA

SEQ ID NO: 2072978 - protein, 20 aa, Staphylococcus
KGSIYAIDFTGPCLRCLMQE

SEQ ID NO: 2072979 - protein, 24 aa, Staphylococcus
KGSLSYIHDIWGYIAPNSKNEKAP

SEQ ID NO: 2072980 - protein, 23 aa, Staphylococcus
KGSRIYFPVFVDGAKLSVGDLHF

SEQ ID NO: 2072981 - protein, 23 aa, Staphylococcus
KGSRIYFPVFVEGAKLSVGDLHF

SEQ ID NO: 2072982 - protein, 25 aa, Staphylococcus
KGSVMFMADLIKYIDTHLAIDFMDV

SEQ ID NO: 2072983 - protein, 24 aa, Staphylococcus
KGTDFIIVRELTSGLYFGEPRHID

SEQ ID NO: 2072984 - protein, 26 aa, Staphylococcus
KGTDNLILLGIKTRGAFLARRIQQKI

SEQ ID NO: 2072985 - protein, 18 aa, Staphylococcus
KGTEITSYFYNRMFNQHP

SEQ ID NO: 2072986 - protein, 17 aa, Staphylococcus
KGTFSYLASQKLILEND

SEQ ID NO: 2072987 - protein, 22 aa, Staphylococcus
KGTNPEQLFAAGYASCFNGAFD

SEQ ID NO: 2072988 - protein, 38 aa, Staphylococcus
KGTRLVIVHLYDYIPKLLWPIYYFVQAPLQGLIMRGFE

SEQ ID NO: 2072989 - protein, 39 aa, Staphylococcus
KGTRLVIVQLYDYIPKLLWPLYYFFQAPVQGLIMRGFEI

SEQ ID NO: 2072990 - protein, 26 aa, Staphylococcus
KGVERPALVVTLPTVSGKGFVFMDVG

SEQ ID NO: 2072991 - protein, 18 aa, Staphylococcus
KGVEYYHKLFKECHKRHV

SEQ ID NO: 2072992 - protein, 25 aa, Staphylococcus
KGVKVLARGPVFKGLLTSNSIDALD

SEQ ID NO: 2072993 - protein, 31 aa, Staphylococcus
KGVLGNIPFFGICLGHQLFALSQGAKAFKMK

SEQ ID NO: 2072994 - protein, 23 aa, Staphylococcus
KGVQLELTTALRKSLFVNEKLSA

SEQ ID NO: 2072995 - protein, 27 aa, Staphylococcus
KGVRVVSMPNWFAFDKQSDDYKESVLP

SEQ ID NO: 2072996 - protein, 25 aa, Staphylococcus
KGVSRPALVVTLPTMDGKGFVFLDV

SEQ ID NO: 2072997 - protein, 20 aa, Staphylococcus
KGVVGKFVEFFGPGVQHLPL

SEQ ID NO: 2072998 - protein, 20 aa, Staphylococcus
KGWMCIQVFFIRQGNMIKRD

SEQ ID NO: 2072999 - protein, 21 aa, Staphylococcus
KGWMCIQVFFIRQGNMIKRDT

SEQ ID NO: 2073000 - protein, 19 aa, Staphylococcus
KGWMCIQVFFIRQGNMIQR

SEQ ID NO: 2073001 - protein, 20 aa, Staphylococcus
KGWMCVQVFFIRQGNMIKRD

SEQ ID NO: 2073002 - protein, 19 aa, Staphylococcus
KGWMCVQVFFIRQGNMIQR

SEQ ID NO: 2073003 - protein, 19 aa, Staphylococcus
KGWPSMMVSIWKNPEKYDS

SEQ ID NO: 2073004 - protein, 34 aa, Staphylococcus
KGYGDYLALPDWNTLKVIPWMSRTAMVFADVYTV

SEQ ID NO: 2073005 - protein, 33 aa, Staphylococcus
KGYKLGVLISKKKYWYRLPKFKQISKYAQYINP

SEQ ID NO: 2073006 - protein, 18 aa, Staphylococcus
KGYNYDKIKIKLAESGIL

SEQ ID NO: 2073007 - protein, 23 aa, Staphylococcus
KGYRTIHFTAIEKNPMDGYDISG

SEQ ID NO: 2073008 - protein, 18 aa, Staphylococcus
KGYVRFRDTPETTYLFQF

SEQ ID NO: 2073009 - protein, 25 aa, Staphylococcus
KHAAKPLVHVFIATSPIDLEHKLKM

SEQ ID NO: 2073010 - protein, 23 aa, Staphylococcus
KHADIYIDGFYNFSTLEYQIIKA

SEQ ID NO: 2073011 - protein, 24 aa, Staphylococcus
KHALNLYRNLRLWTLRGHTISEYE

SEQ ID NO: 2073012 - protein, 17 aa, Staphylococcus
KHALQEILLPLADVATP

SEQ ID NO: 2073013 - protein, 21 aa, Staphylococcus
KHCDFFSFGTNDLTQLSFGFS

SEQ ID NO: 2073014 - protein, 17 aa, Staphylococcus
KHCLLSGDFISVGLAKL

SEQ ID NO: 2073015 - protein, 21 aa, Staphylococcus
KHDIHVIPLSITIDGNSYTDQ

SEQ ID NO: 2073016 - protein, 19 aa, Staphylococcus
KHDNIWIDPGIGFAKSRAE

SEQ ID NO: 2073017 - protein, 27 aa, Staphylococcus
KHDPLGDPIVLIAPTQSTFQLEQAFVN

SEQ ID NO: 2073018 - protein, 28 aa, Staphylococcus
KHDRHVTGKWSWLAPPLSPTLTSNYHHG

SEQ ID NO: 2073019 - protein, 25 aa, Staphylococcus
KHDTYFVTHGFGTLAGLKYLDIHTE

SEQ ID NO: 2073020 - protein, 17 aa, Staphylococcus
KHDVEEIVLLNGWGKTQ

SEQ ID NO: 2073021 - protein, 17 aa, Staphylococcus
KHEHVYLHYYLQGYDEA

SEQ ID NO: 2073022 - protein, 22 aa, Staphylococcus
KHELCHYFLHLAGKGYQHRDTD

SEQ ID NO: 2073023 - protein, 17 aa, Staphylococcus
KHELCHYHLHIQRKGYK

SEQ ID NO: 2073024 - protein, 19 aa, Staphylococcus
KHEYQVITYFLNIKSKMNV

SEQ ID NO: 2073025 - protein, 33 aa, Staphylococcus
KHFEGTIIFVSHDRYFINQLANKVFDLNHEGGQ

SEQ ID NO: 2073026 - protein, 18 aa, Staphylococcus
KHFEVSFYLTTHSIPEAY

SEQ ID NO: 2073027 - protein, 20 aa, Staphylococcus
KHFFDSQTNFIFVNTKRPKE

SEQ ID NO: 2073028 - protein, 23 aa, Staphylococcus
KHFSKLWFQQVQGKTFHSFLEIQ

SEQ ID NO: 2073029 - protein, 20 aa, Staphylococcus
KHFYNEVPVIEYLNDQFKQG

SEQ ID NO: 2073030 - protein, 22 aa, Staphylococcus
KHGLNVFVVQLPKNMDPDEYIV

SEQ ID NO: 2073031 - protein, 17 aa, Staphylococcus
KHGPHWCRSRIVNPLTL

SEQ ID NO: 2073032 - protein, 18 aa, Staphylococcus
KHGQCKVLLGIARGKKLH

SEQ ID NO: 2073033 - protein, 18 aa, Staphylococcus
KHGQCKVLLGVARGKKIH

SEQ ID NO: 2073034 - protein, 17 aa, Staphylococcus
KHHFVALAHAGWRGTVG

SEQ ID NO: 2073035 - protein, 20 aa, Staphylococcus
KHHYIGLAHAGWRGTYGEIV

SEQ ID NO: 2073036 - protein, 20 aa, Staphylococcus
KHIDYYLKNIPNYEGILSYG

SEQ ID NO: 2073037 - protein, 19 aa, Staphylococcus
KHIELMKSFMLNKQEKQRA

SEQ ID NO: 2073038 - protein, 25 aa, Staphylococcus
KHIGGFPVSGLFLRCTNKDVIEKHH

SEQ ID NO: 2073039 - protein, 20 aa, Staphylococcus
KHIGGFPVSGLFLRCTNPDV

SEQ ID NO: 2073040 - protein, 26 aa, Staphylococcus
KHIHKILLQHLTDKALVLGPSPAALS

SEQ ID NO: 2073041 - protein, 27 aa, Staphylococcus
KHIHQILLQHLTDRALVLGPSPAAIAR

SEQ ID NO: 2073042 - protein, 21 aa, Staphylococcus
KHIKKGVIVTIFPDGSDRYMS

SEQ ID NO: 2073043 - protein, 27 aa, Staphylococcus
KHINKQIFLMFNPVSKLNWVYKYFFEH

SEQ ID NO: 2073044 - protein, 17 aa, Staphylococcus
KHIQFDELVLFSSARSA

SEQ ID NO: 2073045 - protein, 21 aa, Staphylococcus
KHIVFDVMLASYIIDPSRTID

SEQ ID NO: 2073046 - protein, 23 aa, Staphylococcus
KHKFSELHVFPYSSRIGTPAARM

SEQ ID NO: 2073047 - protein, 19 aa, Staphylococcus
KHKHLKVFGLTASPDYILN

SEQ ID NO: 2073048 - protein, 18 aa, Staphylococcus
KHLAPLYNSKEDLINGLL

SEQ ID NO: 2073049 - protein, 31 aa, Staphylococcus
KHLEAAVILSDFNRRYLSGFTGTSGALIITK

SEQ ID NO: 2073050 - protein, 26 aa, Staphylococcus
KHLEYSQLYLVLHHQHSIYFEGLPSS

SEQ ID NO: 2073051 - protein, 19 aa, Staphylococcus
KHLKQVKFMLIFDSASMTP

SEQ ID NO: 2073052 - protein, 17 aa, Staphylococcus
KHLLDNVLVVLKAQSLN

SEQ ID NO: 2073053 - protein, 26 aa, Staphylococcus
KHLSDMDIVISAPFYPAYMTKERIEK

SEQ ID NO: 2073054 - protein, 32 aa, Staphylococcus
KHMMHVTISYPLPDNRLLTQLFTALEEGSVNV

SEQ ID NO: 2073055 - protein, 31 aa, Staphylococcus
KHNHVPPWIIILPHNFGLTIKWLSILKKSHK

SEQ ID NO: 2073056 - protein, 21 aa, Staphylococcus
KHNLRLIIQYDNKPVGFISLV

SEQ ID NO: 2073057 - protein, 18 aa, Staphylococcus
KHPEKYYFFVLQRVTEQS

SEQ ID NO: 2073058 - protein, 25 aa, Staphylococcus
KHPKFFHQLFKLLEDIRIFNEIKLQ

SEQ ID NO: 2073059 - protein, 23 aa, Staphylococcus
KHPKLKNLYFLQENTKQAIASMS

SEQ ID NO: 2073060 - protein, 24 aa, Staphylococcus
KHPSLFRQYGIYPSDYYQVIICGI

SEQ ID NO: 2073061 - protein, 23 aa, Staphylococcus
KHQADLPYLYQEDKKRILAKFEP

SEQ ID NO: 2073062 - protein, 24 aa, Staphylococcus
KHQFSELHVFPYSPRIGTPAARMD

SEQ ID NO: 2073063 - protein, 23 aa, Staphylococcus
KHQFSELHVFPYSSRIGTPAARM

SEQ ID NO: 2073064 - protein, 24 aa, Staphylococcus
KHQKLKNLYFLQENAKQAIASMSQ

SEQ ID NO: 2073065 - protein, 23 aa, Staphylococcus
KHQLNFDLLVDEDFKLADEAGVY

SEQ ID NO: 2073066 - protein, 20 aa, Staphylococcus
KHQLWFHTKDIPGSHVVILS

SEQ ID NO: 2073067 - protein, 23 aa, Staphylococcus
KHSKPFLTQFPTSGEHVLMGPGE

SEQ ID NO: 2073068 - protein, 26 aa, Staphylococcus
KHTDFHAQLLLQVHDELIFELPKDEV

SEQ ID NO: 2073069 - protein, 28 aa, Staphylococcus
KHTKYSYTIPIKEPCLVYWGGDNELTND

SEQ ID NO: 2073070 - protein, 26 aa, Staphylococcus
KHTVRLLHAIELERLTLGRKLGFELL

SEQ ID NO: 2073071 - protein, 21 aa, Staphylococcus
KHTVRLLHGIELERLNLGRKL

SEQ ID NO: 2073072 - protein, 28 aa, Staphylococcus
KHVEEPLLIKIQANLPPSRGLGSSAAVA

SEQ ID NO: 2073073 - protein, 32 aa, Staphylococcus
KHVIQQFGIIIPLQIFIKTHPIEWQLQFRLLE

SEQ ID NO: 2073074 - protein, 18 aa, Staphylococcus
KHVVIEGAIFDPVSIRHT

SEQ ID NO: 2073075 - protein, 21 aa, Staphylococcus
KHVYAIGDLVKGYQLAHAASA

SEQ ID NO: 2073076 - protein, 25 aa, Staphylococcus
KHWNSDQFFNLIQSFELPKNNQIST

SEQ ID NO: 2073077 - protein, 29 aa, Staphylococcus
KHYDLKLNDLLFLKHLLACDSTCIPLYQV

SEQ ID NO: 2073078 - protein, 24 aa, Staphylococcus
KHYEKLFDKYQKLHDLLGREHPEL

SEQ ID NO: 2073079 - protein, 25 aa, Staphylococcus
KHYGPLLNGFYHIPFPDKYRGMFEQ

SEQ ID NO: 2073080 - protein, 26 aa, Staphylococcus
KHYGPLLNGFYHIPFPDKYRGMFEQP

SEQ ID NO: 2073081 - protein, 27 aa, Staphylococcus
KHYGPLLNGFYHIPFPDNYRGMFEQPT

SEQ ID NO: 2073082 - protein, 22 aa, Staphylococcus
KHYPHLNYIWVFSKPENNNIPG

SEQ ID NO: 2073083 - protein, 25 aa, Staphylococcus
KHYSDDYLRNSGLNYTIVHPGRLTD

SEQ ID NO: 2073084 - protein, 17 aa, Staphylococcus
KHYSPDTPVAMLTNLNT

SEQ ID NO: 2073085 - protein, 21 aa, Staphylococcus
KIADFLIPTYSYVSIIELGNY

SEQ ID NO: 2073086 - protein, 18 aa, Staphylococcus
KIAERLFKDGFNLAIVDY

SEQ ID NO: 2073087 - protein, 33 aa, Staphylococcus
KIAFYVAQWPSARLNHWLALLKARAIENDMYVV

SEQ ID NO: 2073088 - protein, 19 aa, Staphylococcus
KIAIVMNLCNTTKSDAQSR

SEQ ID NO: 2073089 - protein, 25 aa, Staphylococcus
KIAKQLETWGVDILEAGFPASSAGS

SEQ ID NO: 2073090 - protein, 17 aa, Staphylococcus
KIAKSLCDIYPLLNRSL

SEQ ID NO: 2073091 - protein, 28 aa, Staphylococcus
KIANNDYFKLRFFQKAILKAIDVEWINQ

SEQ ID NO: 2073092 - protein, 30 aa, Staphylococcus
KIAVESDFIIWLIYKFYNSLNVYSINEDNQ

SEQ ID NO: 2073093 - protein, 23 aa, Staphylococcus
KIAYTMAYLKVHYPNYFYANILT

SEQ ID NO: 2073094 - protein, 30 aa, Staphylococcus
KIDFGSDLLVTTFLKAYPPGPTKKIIDVGC

SEQ ID NO: 2073095 - protein, 20 aa, Staphylococcus
KIDFNQLKPVARLAGNNYSK

SEQ ID NO: 2073096 - protein, 27 aa, Staphylococcus
KIDFVNKVYLMLNKPKDYISATTDEQH

SEQ ID NO: 2073097 - protein, 26 aa, Staphylococcus
KIDFVTYYFMYVLQSYQNYHKTINKD

SEQ ID NO: 2073098 - protein, 41 aa, Staphylococcus
KIDKCIRFIDKWYFPVQPFQKFIIAFLFLMDEELDTPYFTE

SEQ ID NO: 2073099 - protein, 20 aa, Staphylococcus
KIDLETMLNALPKGLTKKTI

SEQ ID NO: 2073100 - protein, 17 aa, Staphylococcus
KIDNEFTIVRRGKKKYF

SEQ ID NO: 2073101 - protein, 30 aa, Staphylococcus
KIDNNGFIKFQPIGGWWNQVMLSQKVTITT

SEQ ID NO: 2073102 - protein, 31 aa, Staphylococcus
KIDNNGFLKFTPIGGWWNQVMLSQKVTITTD

SEQ ID NO: 2073103 - protein, 18 aa, Staphylococcus
KIDQRLKYIVLTEKGRQY

SEQ ID NO: 2073104 - protein, 24 aa, Staphylococcus
KIDSPFKVDLFIKSNIELTKDIYP

SEQ ID NO: 2073105 - protein, 24 aa, Staphylococcus
KIDVTQFPTPAIFDWLQEQGNIST

SEQ ID NO: 2073106 - protein, 21 aa, Staphylococcus
KIDWLLPQLNETGPTIIYVSS

SEQ ID NO: 2073107 - protein, 17 aa, Staphylococcus
KIDYTAKKDGFISEMVA

SEQ ID NO: 2073108 - protein, 22 aa, Staphylococcus
KIEALQGFHKIEVWKVTRDHEN

SEQ ID NO: 2073109 - protein, 31 aa, Staphylococcus
KIEIAGPGFINFYLNNQYLTAVIPEALEKDK

SEQ ID NO: 2073110 - protein, 17 aa, Staphylococcus
KIEIAPEVLTVIASIAT

SEQ ID NO: 2073111 - protein, 25 aa, Staphylococcus
KIEIDVAYTSLLTRALETTQYLLAE

SEQ ID NO: 2073112 - protein, 20 aa, Staphylococcus
KIEIRYYESFAETHQGHGTD

SEQ ID NO: 2073113 - protein, 25 aa, Staphylococcus
KIEKPNYIEYLDFFATLEGDKDPNM

SEQ ID NO: 2073114 - protein, 25 aa, Staphylococcus
KIEPHPYIIDIPKKVFNDLNIEPNT

SEQ ID NO: 2073115 - protein, 18 aa, Staphylococcus
KIESELTGLPMKQVDDIK

SEQ ID NO: 2073116 - protein, 20 aa, Staphylococcus
KIEWLLKFIESSGPTIIYVS

SEQ ID NO: 2073117 - protein, 20 aa, Staphylococcus
KIEWVVVGPEQPLIDGLPDK

SEQ ID NO: 2073118 - protein, 25 aa, Staphylococcus
KIEYNALLERFKYAQSLNINAHPVI

SEQ ID NO: 2073119 - protein, 17 aa, Staphylococcus
KIFAYTRTLGDKTVVVA

SEQ ID NO: 2073120 - protein, 18 aa, Staphylococcus
KIFDLPYGTLEEGKTADI

SEQ ID NO: 2073121 - protein, 20 aa, Staphylococcus
KIFELEGDLPLFPGHGPYTT

SEQ ID NO: 2073122 - protein, 22 aa, Staphylococcus
KIFKLTVDWKNVLKYLAKVEDD

SEQ ID NO: 2073123 - protein, 26 aa, Staphylococcus
KIFPDNEKLIRWLDLAQEKIAFQGLP

SEQ ID NO: 2073124 - protein, 20 aa, Staphylococcus
KIGATVIAGFGARIVRINDY

SEQ ID NO: 2073125 - protein, 26 aa, Staphylococcus
KIGDIPFPYFMSYVSGAGLSLIRHWV

SEQ ID NO: 2073126 - protein, 20 aa, Staphylococcus
KIGFIYSELYLNDKWNVKKI

SEQ ID NO: 2073127 - protein, 22 aa, Staphylococcus
KIGQLFFNLFSLEEDGDFNNND

SEQ ID NO: 2073128 - protein, 18 aa, Staphylococcus
KIGVIKNLVNIADKIIIG

SEQ ID NO: 2073129 - protein, 18 aa, Staphylococcus
KIGVIKNLVNIADKILIG

SEQ ID NO: 2073130 - protein, 32 aa, Staphylococcus
KIGVITNLLKIADKVLIGGGMSYTFFKAQGKE

SEQ ID NO: 2073131 - protein, 27 aa, Staphylococcus
KIHEGNLFIQQLLGVNAEQFRQLFILP

SEQ ID NO: 2073132 - protein, 24 aa, Staphylococcus
KIHGIIFDGAWLWEEYIDTLIHED

SEQ ID NO: 2073133 - protein, 18 aa, Staphylococcus
KIHHQLAYRYPYQDDTLK

SEQ ID NO: 2073134 - protein, 22 aa, Staphylococcus
KIHKSTFMYGTKLKFKNNFVSM

SEQ ID NO: 2073135 - protein, 17 aa, Staphylococcus
KIHLFEALKSWLEEEAV

SEQ ID NO: 2073136 - protein, 27 aa, Staphylococcus
KIIDRTQLILEIFAMRASSKEGKLQVE

SEQ ID NO: 2073137 - protein, 18 aa, Staphylococcus
KIIEFGLSKVIYAVKDTT

SEQ ID NO: 2073138 - protein, 19 aa, Staphylococcus
KIIEKVHFVGTFTVEFFID

SEQ ID NO: 2073139 - protein, 26 aa, Staphylococcus
KIIESRPYRVLKVGSFLLSKDGYKIF

SEQ ID NO: 2073140 - protein, 25 aa, Staphylococcus
KIIEYINHVYIMLNKPKGYVSATYD

SEQ ID NO: 2073141 - protein, 18 aa, Staphylococcus
KIIFKRTFKAPINDVFDA

SEQ ID NO: 2073142 - protein, 37 aa, Staphylococcus
KIIGKVGVPLTILTTIFGVAYEKMDWFRKGFDNMGKL

SEQ ID NO: 2073143 - protein, 36 aa, Staphylococcus
KIIGVKYTAPNFFLLERIRKAFPDKLILSGFDEMLV

SEQ ID NO: 2073144 - protein, 18 aa, Staphylococcus
KIIHTYDIDNRWSIEYYA

SEQ ID NO: 2073145 - protein, 20 aa, Staphylococcus
KIIIEQDVATVFKLLSTTEG

SEQ ID NO: 2073146 - protein, 28 aa, Staphylococcus
KIIKKLNQINKPLKAILLTHAHYDHIGA

SEQ ID NO: 2073147 - protein, 25 aa, Staphylococcus
KIIKVKKNFAIGKLLQVIKPSEQRV

SEQ ID NO: 2073148 - protein, 19 aa, Staphylococcus
KIILALIKEKELCVCDLSI

SEQ ID NO: 2073149 - protein, 22 aa, Staphylococcus
KIILGNTYHLWLQPGNDIIKHA

SEQ ID NO: 2073150 - protein, 20 aa, Staphylococcus
KIILGNTYHLWLQPGNDIIR

SEQ ID NO: 2073151 - protein, 20 aa, Staphylococcus
KIILGNTYHLWLQPGNELIK

SEQ ID NO: 2073152 - protein, 26 aa, Staphylococcus
KIINELAWHNLFAQNMFIRPESIEEA

SEQ ID NO: 2073153 - protein, 20 aa, Staphylococcus
KIINTLINILQYLSTNKRNE

SEQ ID NO: 2073154 - protein, 20 aa, Staphylococcus
KIINYPHIGILLNDDQKRAC

SEQ ID NO: 2073155 - protein, 21 aa, Staphylococcus
KIIRHNINLIALHTNLDNYVY

SEQ ID NO: 2073156 - protein, 19 aa, Staphylococcus
KIIYLTPSEPLKYDTNKWF

SEQ ID NO: 2073157 - protein, 36 aa, Staphylococcus
KIKASRLDFTIIKPSFFMDNFLRITKVSDGEIKIPE

SEQ ID NO: 2073158 - protein, 24 aa, Staphylococcus
KIKDQTFDMLFIDAAKAQSKKFFE

SEQ ID NO: 2073159 - protein, 22 aa, Staphylococcus
KIKDVADIFYLTKEDLLPLDRM

SEQ ID NO: 2073160 - protein, 24 aa, Staphylococcus
KIKEKLTFEYLYQKDIEKPSKQSV

SEQ ID NO: 2073161 - protein, 25 aa, Staphylococcus
KIKGGFTFAVLTKDALYGAVDPNAI

SEQ ID NO: 2073162 - protein, 23 aa, Staphylococcus
KIKHDASLPFGDYYRRLMQDQLN

SEQ ID NO: 2073163 - protein, 19 aa, Staphylococcus
KIKIYFSLNVNNIDSLIKE

SEQ ID NO: 2073164 - protein, 20 aa, Staphylococcus
KIKLYVGNYDFWYQSSQLAQ

SEQ ID NO: 2073165 - protein, 25 aa, Staphylococcus
KIKPLQHIIDIPKRVFAKLDIEPNT

SEQ ID NO: 2073166 - protein, 26 aa, Staphylococcus
KIKQLVIHLILIMKRKEPEKISGKID

SEQ ID NO: 2073167 - protein, 17 aa, Staphylococcus
KIKRQFSEAMAVEMEAT

SEQ ID NO: 2073168 - protein, 30 aa, Staphylococcus; identical to SEQ ID NO: 1820282

SEQ ID NO: 2073169 - protein, 20 aa, Staphylococcus
KIKVLLAQSLFGDPDVLLLD

SEQ ID NO: 2073170 - protein, 20 aa, Staphylococcus
KIKVYVGNYDFWYQSSQLAQ

SEQ ID NO: 2073171 - protein, 23 aa, Staphylococcus
KILDEDYFLTSLVPKISNEIARK

SEQ ID NO: 2073172 - protein, 20 aa, Staphylococcus
KILEELIYNNRIIGGVTPNC

SEQ ID NO: 2073173 - protein, 25 aa, Staphylococcus
KILEPSFDLLFVKWIPREQNKEANH

SEQ ID NO: 2073174 - protein, 19 aa, Staphylococcus
KILITQIATLYGLTPEAMK

SEQ ID NO: 2073175 - protein, 22 aa, Staphylococcus
KILKQHHIPFDGIVSELFEPDD

SEQ ID NO: 2073176 - protein, 27 aa, Staphylococcus
KILLTQNAIAILYPYIRSLVSDLTSKA

SEQ ID NO: 2073177 - protein, 19 aa, Staphylococcus
KILMDWQLGIYEGGGWNAI

SEQ ID NO: 2073178 - protein, 17 aa, Staphylococcus
KILPLLLDDDSHYRLYG

SEQ ID NO: 2073179 - protein, 22 aa, Staphylococcus
KILTELNIRLMAQRISINVSDE

SEQ ID NO: 2073180 - protein, 28 aa, Staphylococcus
KILTSSDLILYVSYFNHSFTDNDKAFIE

SEQ ID NO: 2073181 - protein, 19 aa, Staphylococcus
KILVTPHIAFFSDEAVQNL

SEQ ID NO: 2073182 - protein, 23 aa, Staphylococcus
KIMEEEIFGPLLPIIVYDDFNEA

SEQ ID NO: 2073183 - protein, 22 aa, Staphylococcus
KIMIHLHDLGFGPKLSMAIYQF

SEQ ID NO: 2073184 - protein, 23 aa, Staphylococcus
KINDFKAIFPNDNVIGISELLKD

SEQ ID NO: 2073185 - protein, 22 aa, Staphylococcus
KINDFKAIFPNHNVIGISELIK

SEQ ID NO: 2073186 - protein, 22 aa, Staphylococcus
KINDFKSIFPNDNVIGISELIK

SEQ ID NO: 2073187 - protein, 22 aa, Staphylococcus
KINDFKTIFPNDNVIGISEIIK

SEQ ID NO: 2073188 - protein, 23 aa, Staphylococcus
KINDFKVIFPDFNVIGIAEIIED

SEQ ID NO: 2073189 - protein, 27 aa, Staphylococcus
KINDIPYKVDIYPYYSSDASAALKAGS

SEQ ID NO: 2073190 - protein, 26 aa, Staphylococcus
KINEHIHLIILDIKMPYSDGFEVAQS

SEQ ID NO: 2073191 - protein, 27 aa, Staphylococcus
KINEQFQISKQFWAYLVRTGQLENPEN

SEQ ID NO: 2073192 - protein, 24 aa, Staphylococcus
KINGINIALLSYTFGTNGIKPKHQ

SEQ ID NO: 2073193 - protein, 27 aa, Staphylococcus
KINGPLPFLQLVYFLLAFGEFSGTGIK

SEQ ID NO: 2073194 - protein, 19 aa, Staphylococcus
KINIIPTVTYVWRIRTGES

SEQ ID NO: 2073195 - protein, 30 aa, Staphylococcus
KINILPPNINYSHWFYKATKKGIYLSIGAI

SEQ ID NO: 2073196 - protein, 27 aa, Staphylococcus
KINTKVIIVTTFKRPGYFERAVANDVD

SEQ ID NO: 2073197 - protein, 21 aa, Staphylococcus
KIPEFINPEVKFSMISSIDIA

SEQ ID NO: 2073198 - protein, 19 aa, Staphylococcus
KIPIMTLDRELESTSLPSI

SEQ ID NO: 2073199 - protein, 24 aa, Staphylococcus
KIPMDQKFIFNPYETHSLGGFDIE

SEQ ID NO: 2073200 - protein, 20 aa, Staphylococcus
KIPPTIISRAQRFDFKAISQ

SEQ ID NO: 2073201 - protein, 19 aa, Staphylococcus
KIQALLRRTYDLSVSNDEL

SEQ ID NO: 2073202 - protein, 30 aa, Staphylococcus
KIQGVNYSKYLLIELPSHKVPHFTQRLIYE

SEQ ID NO: 2073203 - protein, 21 aa, Staphylococcus
KIQILAPLVSHRKGSHEKLIE

SEQ ID NO: 2073204 - protein, 21 aa, Staphylococcus
KIQKFPYYDPINNTLITSSFW

SEQ ID NO: 2073205 - protein, 22 aa, Staphylococcus
KIQKFPYYDPINNTLITSWFWS

SEQ ID NO: 2073206 - protein, 27 aa, Staphylococcus
KIQKMKHPPYIIFATAHDTFAVKAFEL

SEQ ID NO: 2073207 - protein, 19 aa, Staphylococcus
KIQPILKEKFESLGLKVEE

SEQ ID NO: 2073208 - protein, 25 aa, Staphylococcus
KIQQDYSQLLKLLAQRHVYPTFIES

SEQ ID NO: 2073209 - protein, 35 aa, Staphylococcus
KIQSSILTSIPLWKNQMAIALTLLRQRHAVRSQRA

SEQ ID NO: 2073210 - protein, 24 aa, Staphylococcus
KIQTDGRMKALVSITLDDAFVVHD

SEQ ID NO: 2073211 - protein, 23 aa, Staphylococcus
KIQTDGRMKALVSITLDESFVVH

SEQ ID NO: 2073212 - protein, 19 aa, Staphylococcus
KIRDILIRIPNLIADDVPQ

SEQ ID NO: 2073213 - protein, 27 aa, Staphylococcus
KIRDKDTWMLFGTLPIYPCIQDEDDKA

SEQ ID NO: 2073214 - protein, 20 aa, Staphylococcus
KIRESNVLINYFKRQKVVNK

SEQ ID NO: 2073215 - protein, 19 aa, Staphylococcus
KIREVKSTPIIIITAKGDT

SEQ ID NO: 2073216 - protein, 25 aa, Staphylococcus
KIREVRPLHQIIENISAHSKKLDEL

SEQ ID NO: 2073217 - protein, 20 aa, Staphylococcus
KIRGIQQPKISLLNIGTEPA

SEQ ID NO: 2073218 - protein, 19 aa, Staphylococcus
KIRKWFKRHLSECEHIYVD

SEQ ID NO: 2073219 - protein, 19 aa, Staphylococcus
KIRLAIDAMIYQTAKLIGE

SEQ ID NO: 2073220 - protein, 19 aa, Staphylococcus
KIRQAHLKKVPYTLVVGDN

SEQ ID NO: 2073221 - protein, 25 aa, Staphylococcus
KIRVEFKFNELLKPLTTDYLKRSET

SEQ ID NO: 2073222 - protein, 29 aa, Staphylococcus
KIRVTFRFDELLKPLTIDFLKRSEALDYR

SEQ ID NO: 2073223 - protein, 20 aa, Staphylococcus
KIRYLINEVCHKYQIPWVYG

SEQ ID NO: 2073224 - protein, 17 aa, Staphylococcus
KIRYLPCPCKIKHDEEK

SEQ ID NO: 2073225 - protein, 25 aa, Staphylococcus
KISGARFVYLTKDGALLERALMNYM

SEQ ID NO: 2073226 - protein, 21 aa, Staphylococcus
KISNAKFPVLLAGMRSSSEAE

SEQ ID NO: 2073227 - protein, 29 aa, Staphylococcus
KISNTDVPLYLYLSTLGMTGQTAYHGLLE

SEQ ID NO: 2073228 - protein, 19 aa, Staphylococcus
KISTSIIFITHDLGVVANI

SEQ ID NO: 2073229 - protein, 21 aa, Staphylococcus
KISVDLDYLFNKFIYQHRGGF

SEQ ID NO: 2073230 - protein, 18 aa, Staphylococcus
KITAPFTDDALLRISLEE

SEQ ID NO: 2073231 - protein, 19 aa, Staphylococcus
KITNFFKNGGKYTEEEIDF

SEQ ID NO: 2073232 - protein, 23 aa, Staphylococcus
KITYLPIRIEKLINQYKLNAKNV

SEQ ID NO: 2073233 - protein, 17 aa, Staphylococcus
KIVGRSWNGLIINYLSR

SEQ ID NO: 2073234 - protein, 17 aa, Staphylococcus
KIVQHLEERGYQLSKTE

SEQ ID NO: 2073235 - protein, 25 aa, Staphylococcus
KIVQPHAMAFNYVYYEIYTQMIEMT

SEQ ID NO: 2073236 - protein, 24 aa, Staphylococcus
KIVQPHPIAFNYIYYDIYTQMVEM

SEQ ID NO: 2073237 - protein, 27 aa, Staphylococcus
KIVQPHTMAFNYIYYDIYTQMIEMTRD

SEQ ID NO: 2073238 - protein, 25 aa, Staphylococcus
KIVRKRGLLMAQAFPNGVGSMAAVL

SEQ ID NO: 2073239 - protein, 31 aa, Staphylococcus
KIVSESLVTYYYRTPRIPRSLLDEYREGLLI

SEQ ID NO: 2073240 - protein, 32 aa, Staphylococcus
KIVSESLVTYYYRTPRIPRSLLNEYREGLLVG

SEQ ID NO: 2073241 - protein, 20 aa, Staphylococcus
KIVSSYPMIPGIDLAGVVEH

SEQ ID NO: 2073242 - protein, 24 aa, Staphylococcus
KIVTGFIEPHFFAGFSGGPKGIMP

SEQ ID NO: 2073243 - protein, 21 aa, Staphylococcus
KIYDFYTDVLGLRLVKKTVNQ

SEQ ID NO: 2073244 - protein, 17 aa, Staphylococcus
KIYFTSHMDTVIPGINV

SEQ ID NO: 2073245 - protein, 24 aa, Staphylococcus
KIYHAPIRLLVVIQAPDRYIQRLL

SEQ ID NO: 2073246 - protein, 25 aa, Staphylococcus
KIYLDQIHQRLYLEQSLLVERIKKY

SEQ ID NO: 2073247 - protein, 19 aa, Staphylococcus
KIYLEDELNIIYLTPSDPM

SEQ ID NO: 2073248 - protein, 21 aa, Staphylococcus
KIYNQAYKRGIPQYDLKVIGE

SEQ ID NO: 2073249 - protein, 20 aa, Staphylococcus
KIYTNLKPWDRVQIARLQER

SEQ ID NO: 2073250 - protein, 17 aa, Staphylococcus
KIYVFDLSEERLAKAKE

SEQ ID NO: 2073251 - protein, 26 aa, Staphylococcus
KKAAFMKKVIDTRAIFKIGGVGLAFK

SEQ ID NO: 2073252 - protein, 31 aa, Staphylococcus
KKADVILYDRLINKEILEFASPSTKFFYCGK

SEQ ID NO: 2073253 - protein, 22 aa, Staphylococcus
KKAKDFIALSIKYTPEIGQGRG

SEQ ID NO: 2073254 - protein, 17 aa, Staphylococcus
KKALLFEWSRINEMLDK

SEQ ID NO: 2073255 - protein, 26 aa, Staphylococcus
KKASDPYFILRYIQKSIIKAIDMAWI

SEQ ID NO: 2073256 - protein, 17 aa, Staphylococcus
KKCDMLYQMRAFLELRE

SEQ ID NO: 2073257 - protein, 40 aa, Staphylococcus
KKDAIVYACDLILKGELDEHFPLVVWQTGSGTQSNMNVNE

SEQ ID NO: 2073258 - protein, 24 aa, Staphylococcus
KKDGHWWVRFKYVQPGSSDKDFYC

SEQ ID NO: 2073259 - protein, 23 aa, Staphylococcus
KKDIGFIFQDYNVLHTLTVKENI

SEQ ID NO: 2073260 - protein, 32 aa, Staphylococcus
KKDKIGYEIPFTRLFYKYTPPEPSETISERIK

SEQ ID NO: 2073261 - protein, 19 aa, Staphylococcus
KKDLSPHAIFGFGGDPMTQ

SEQ ID NO: 2073262 - protein, 20 aa, Staphylococcus
KKDRFIYMGRFAPEKQITHI

SEQ ID NO: 2073263 - protein, 24 aa, Staphylococcus
KKDSRHKAYYEKRYKQLIADLDDI

SEQ ID NO: 2073264 - protein, 25 aa, Staphylococcus
KKDTYFVTHGFGTIATLKFIETLEQ

SEQ ID NO: 2073265 - protein, 19 aa, Staphylococcus
KKDVLDGKFLVITRKDASS

SEQ ID NO: 2073266 - protein, 23 aa, Staphylococcus
KKDWPFDMVVIDELSTFKNPSSQ

SEQ ID NO: 2073267 - protein, 21 aa, Staphylococcus
KKEFIYIPLTMNDQTRFKFKA

SEQ ID NO: 2073268 - protein, 23 aa, Staphylococcus
KKEGKGIYRFVLDEAKAAIEKVE

SEQ ID NO: 2073269 - protein, 20 aa, Staphylococcus
KKEHYLPHFFYEEEMEALFD

SEQ ID NO: 2073270 - protein, 24 aa, Staphylococcus
KKEIENFKFFVQYGNFKDFKDYKN

SEQ ID NO: 2073271 - protein, 26 aa, Staphylococcus
KKEIENFKFFVQYGSFKDFKDYKNGD

SEQ ID NO: 2073272 - protein, 17 aa, Staphylococcus
KKELDSLWQLRNMFRDT

SEQ ID NO: 2073273 - protein, 17 aa, Staphylococcus
KKELLKAIKDGLELKGV

SEQ ID NO: 2073274 - protein, 26 aa, Staphylococcus
KKELQEPLSFYYFFTEDDDIVGYTKF

SEQ ID NO: 2073275 - protein, 28 aa, Staphylococcus
KKELYDLRLMLESFAFSKIKHIDRAPIT

SEQ ID NO: 2073276 - protein, 24 aa, Staphylococcus
KKELYDLRLMLESFAFSKLKHMDR

SEQ ID NO: 2073277 - protein, 25 aa, Staphylococcus
KKEQIVLFLNRRGYASFMLCRDCGY

SEQ ID NO: 2073278 - protein, 22 aa, Staphylococcus
KKESFLIYAVEDTNIYPVQINE

SEQ ID NO: 2073279 - protein, 21 aa, Staphylococcus
KKEVDFIIIAGDLFDNENRTL

SEQ ID NO: 2073280 - protein, 24 aa, Staphylococcus
KKEYYVGFVIDRATDRVTLMASEE

SEQ ID NO: 2073281 - protein, 25 aa, Staphylococcus
KKFGAFVELPEGKSGLVHISEVADK

SEQ ID NO: 2073282 - protein, 17 aa, Staphylococcus
KKFISLSIKYTPEIGQG

SEQ ID NO: 2073283 - protein, 20 aa, Staphylococcus
KKFMHYLIKAQEHYQMTIVF

SEQ ID NO: 2073284 - protein, 27 aa, Staphylococcus
KKFPINKLPSDLGNGLYLFIDRKNMVG

SEQ ID NO: 2073285 - protein, 24 aa, Staphylococcus
KKGDINIYFRSWYSHYLDYRENKI

SEQ ID NO: 2073286 - protein, 26 aa, Staphylococcus
KKGDLFCLFITERVANYIAYACSIIS

SEQ ID NO: 2073287 - protein, 34 aa, Staphylococcus
KKGDWSLQQLVDYLTIKPAQIFDLPYGKLEEGSY

SEQ ID NO: 2073288 - protein, 28 aa, Staphylococcus
KKGEKIRWKLLYIADPDYMVRPPFFIEW

SEQ ID NO: 2073289 - protein, 35 aa, Staphylococcus
KKGEKITWRLLYIADPSYMVKPPFFIQWDQGDANR

SEQ ID NO: 2073290 - protein, 21 aa, Staphylococcus
KKGFAFLRPELEDMDDIFIPP

SEQ ID NO: 2073291 - protein, 21 aa, Staphylococcus
KKGFAFLRPENEEFEDIFIPP

SEQ ID NO: 2073292 - protein, 22 aa, Staphylococcus
KKGFAYVLDRPLTGRIASIMKS

SEQ ID NO: 2073293 - protein, 24 aa, Staphylococcus
KKGIFSVMNYLLPMQDIMSMHCSA

SEQ ID NO: 2073294 - protein, 36 aa, Staphylococcus
KKGNPFSISAVTYILSNPFYIGKIQFAKYKDWNDKR

SEQ ID NO: 2073295 - protein, 25 aa, Staphylococcus
KKGSQLPQLFGFQAAGAAPIVHNKV

SEQ ID NO: 2073296 - protein, 34 aa, Staphylococcus
KKGTDILVESLFYNTPARLKYVKSLYTELGKITD

SEQ ID NO: 2073297 - protein, 25 aa, Staphylococcus
KKGVKVLARGPVFKGLLTASSNQVL

SEQ ID NO: 2073298 - protein, 25 aa, Staphylococcus
KKHAQAIIERAIELGITYFDTADMY

SEQ ID NO: 2073299 - protein, 26 aa, Staphylococcus
KKHGTEIFFKDKEYRLGIGTPAMATG

SEQ ID NO: 2073300 - protein, 22 aa, Staphylococcus
KKHINKGVIVTIFPDGSDRYMS

SEQ ID NO: 2073301 - protein, 26 aa, Staphylococcus
KKHLEHLSSYYKFKQPSLLYDQQIQK

SEQ ID NO: 2073302 - protein, 20 aa, Staphylococcus
KKHMQLLKQQGIELGIDYPE

SEQ ID NO: 2073303 - protein, 18 aa, Staphylococcus
KKHNCLYVLVDPYILENL

SEQ ID NO: 2073304 - protein, 18 aa, Staphylococcus
KKHQVALPVSAYLIEHPK

SEQ ID NO: 2073305 - protein, 22 aa, Staphylococcus
KKIIESLQFLVTGRIHKINQPE

SEQ ID NO: 2073306 - protein, 17 aa, Staphylococcus
KKIIKFNEDLRTMSKQG

SEQ ID NO: 2073307 - protein, 20 aa, Staphylococcus
KKIIRYQIRKGLLGHKLLIY

SEQ ID NO: 2073308 - protein, 18 aa, Staphylococcus
KKIKRWHPFLRELSAVEV

SEQ ID NO: 2073309 - protein, 23 aa, Staphylococcus
KKINSKLPILLISGKEDPFGDYG

SEQ ID NO: 2073310 - protein, 24 aa, Staphylococcus
KKIQKYITLFNKLPDIKTKKALKV

SEQ ID NO: 2073311 - protein, 17 aa, Staphylococcus
KKIRGIIGSKPPHVLSP

SEQ ID NO: 2073312 - protein, 21 aa, Staphylococcus
KKISSFQDILPLLEQIVQSNR

SEQ ID NO: 2073313 - protein, 23 aa, Staphylococcus
KKITLIIGDLAFYHDMNGLLMAK

SEQ ID NO: 2073314 - protein, 21 aa, Staphylococcus
KKIVYSTKNLDLWYGENHALK

SEQ ID NO: 2073315 - protein, 19 aa, Staphylococcus
KKIYFIYSKLDKAAQTIVV

SEQ ID NO: 2073316 - protein, 26 aa, Staphylococcus
KKIYLEKLLLYEYVQLHTQLKRIVSL

SEQ ID NO: 2073317 - protein, 24 aa, Staphylococcus
KKIYLNTYKQIYDLISKINPKDLQ

SEQ ID NO: 2073318 - protein, 21 aa, Staphylococcus
KKIYTNLKPWDRVQIARLQER

SEQ ID NO: 2073319 - protein, 26 aa, Staphylococcus
KKKAHQLVSIIYIKLYININQNEGTN

SEQ ID NO: 2073320 - protein, 26 aa, Staphylococcus
KKKEQIVLFLNRRGYASFMLCRDCGH

SEQ ID NO: 2073321 - protein, 23 aa, Staphylococcus
KKKHLEHVASYYKFKQPSLLYDQ

SEQ ID NO: 2073322 - protein, 20 aa, Staphylococcus
KKKMTLFGKGKEATYRCICG

SEQ ID NO: 2073323 - protein, 20 aa, Staphylococcus
KKLEFFLPKEISEQEKIGNF

SEQ ID NO: 2073324 - protein, 21 aa, Staphylococcus
KKLGYPAHMSRLTRVSSGGFQ

SEQ ID NO: 2073325 - protein, 25 aa, Staphylococcus
KKLIGVITRKDVLTAMQLLSRQPQV

SEQ ID NO: 2073326 - protein, 23 aa, Staphylococcus
KKLKDGVLEYAYGLASPEEIDEL

SEQ ID NO: 2073327 - protein, 20 aa, Staphylococcus
KKLKDLSRYHYQDFINEFSK

SEQ ID NO: 2073328 - protein, 23 aa, Staphylococcus
KKLKEIYNIVLQSQIKAIEEIKP

SEQ ID NO: 2073329 - protein, 22 aa, Staphylococcus
KKLKGLCLKWVSPGTRGVPDRI

SEQ ID NO: 2073330 - protein, 22 aa, Staphylococcus
KKLKIILSLIKENELCVCDISL

SEQ ID NO: 2073331 - protein, 27 aa, Staphylococcus
KKLLKKLHDNNIYPIARIVTFKDTKLA

SEQ ID NO: 2073332 - protein, 20 aa, Staphylococcus
KKLLLNPRFKKDIEKYVHEP

SEQ ID NO: 2073333 - protein, 20 aa, Staphylococcus
KKLNLMLASSEYRAVHFPKV

SEQ ID NO: 2073334 - protein, 26 aa, Staphylococcus
KKLSEIHPLFYLLAVKKETLKRHIQN

SEQ ID NO: 2073335 - protein, 19 aa, Staphylococcus
KKLSSVLELSWYEKQFDLM

SEQ ID NO: 2073336 - protein, 21 aa, Staphylococcus
KKMIISGIWTHFGYADEFDVP

SEQ ID NO: 2073337 - protein, 34 aa, Staphylococcus
KKMKQNVLPSLLLPELSGPWLSLQMFTRSFIPKS

SEQ ID NO: 2073338 - protein, 18 aa, Staphylococcus
KKMVEALQFLVSGRIHKV

SEQ ID NO: 2073339 - protein, 24 aa, Staphylococcus
KKNHPKTLFVWRSNLISSSAKGQE

SEQ ID NO: 2073340 - protein, 23 aa, Staphylococcus
KKNIIFSPEFLREGNALYDNLYP

SEQ ID NO: 2073341 - protein, 26 aa, Staphylococcus
KKNIPILGICRGAQILNVYFGGTLYQ

SEQ ID NO: 2073342 - protein, 24 aa, Staphylococcus
KKNKERFNLYLDGEFEMGIDIDTL

SEQ ID NO: 2073343 - protein, 21 aa, Staphylococcus
KKNVMVALREPALGPTFGIKG

SEQ ID NO: 2073344 - protein, 17 aa, Staphylococcus
KKNYEIVQLLQQKLKAK

SEQ ID NO: 2073345 - protein, 20 aa, Staphylococcus
KKNYKALHYISEGTDLTVGL

SEQ ID NO: 2073346 - protein, 23 aa, Staphylococcus
KKPLLAWELNMGGLMNALEAARE

SEQ ID NO: 2073347 - protein, 18 aa, Staphylococcus
KKQAMMRGFLVAEFANDF

SEQ ID NO: 2073348 - protein, 27 aa, Staphylococcus
KKQELNDAFYYFNVPAEVQNVTVGPSV

SEQ ID NO: 2073349 - protein, 26 aa, Staphylococcus
KKQELNEAFYYFNVPAEVQNVTEGPS

SEQ ID NO: 2073350 - protein, 28 aa, Staphylococcus
KKQFDQIFDLLAIRIIVNSINDCYAILG

SEQ ID NO: 2073351 - protein, 28 aa, Staphylococcus
KKQFDQIFDLLAIRIIVNSINDCYAVLG

SEQ ID NO: 2073352 - protein, 28 aa, Staphylococcus
KKQFDQIFDLLAIRIIVNTINDCYAILG

SEQ ID NO: 2073353 - protein, 23 aa, Staphylococcus
KKQGYFVTLWTKDSMSVNQPFEY

SEQ ID NO: 2073354 - protein, 19 aa, Staphylococcus
KKQLINATSIYLEAIYALC

SEQ ID NO: 2073355 - protein, 26 aa, Staphylococcus
KKQLKKTFPGYVLVELVMTDESWYVV

SEQ ID NO: 2073356 - protein, 26 aa, Staphylococcus
KKQLKKVLIMPTWRDWLNSNEAFEKS

SEQ ID NO: 2073357 - protein, 25 aa, Staphylococcus
KKQLVKHHFVVKIAPTYLGGDLKEN

SEQ ID NO: 2073358 - protein, 22 aa, Staphylococcus
KKRALDILNLVGLPNADKRFNA

SEQ ID NO: 2073359 - protein, 37 aa, Staphylococcus
KKRAPKFFRKLNIEWIYRLLIDWKRLGRLKSIPKFMF

SEQ ID NO: 2073360 - protein, 35 aa, Staphylococcus
KKRAPKLFIKLNIEWVYRLLIDWKRIGRMRSIPKF

SEQ ID NO: 2073361 - protein, 22 aa, Staphylococcus
KKRGIPHPYLKGKNLAFLFEKP

SEQ ID NO: 2073362 - protein, 19 aa, Staphylococcus
KKRGPWIKTVLRMIEVAIV

SEQ ID NO: 2073363 - protein, 30 aa, Staphylococcus
KKRHAKRRLTYHSFLALYKAILKDEGEIHF

SEQ ID NO: 2073364 - protein, 31 aa, Staphylococcus
KKRHAKRRLTYHTYLALYKQILVEDGEIHFK

SEQ ID NO: 2073365 - protein, 29 aa, Staphylococcus
KKRHAKRRLTYRTFLALYEQILKEDGEIH

SEQ ID NO: 2073366 - protein, 30 aa, Staphylococcus
KKRIALEYSLPKWLVNHWVTHYGLVTTEEI

SEQ ID NO: 2073367 - protein, 21 aa, Staphylococcus
KKRIQILSELLGYETENVVIN

SEQ ID NO: 2073368 - protein, 21 aa, Staphylococcus
KKRLEFKKFYIYEDGKIVLKN

SEQ ID NO: 2073369 - protein, 21 aa, Staphylococcus
KKRLFSISDLLLYEDIRKIML

SEQ ID NO: 2073370 - protein, 24 aa, Staphylococcus
KKRNCLYVLVDPYLLENLRNADGE

SEQ ID NO: 2073371 - protein, 28 aa, Staphylococcus
KKRNEILQLMMLEPKFAILDEIDSGLDI

SEQ ID NO: 2073372 - protein, 18 aa, Staphylococcus
KKRPHFQALTPLYPEERI

SEQ ID NO: 2073373 - protein, 21 aa, Staphylococcus
KKSIRLHDLPGAGAAGGLGGA

SEQ ID NO: 2073374 - protein, 18 aa, Staphylococcus
KKSKFNAKFLHYKNKPYK

SEQ ID NO: 2073375 - protein, 18 aa, Staphylococcus
KKSKFTAKFLHYKNKPFK

SEQ ID NO: 2073376 - protein, 17 aa, Staphylococcus
KKSLIGINPNWVTKPKM

SEQ ID NO: 2073377 - protein, 18 aa, Staphylococcus
KKSYIVAHRLDIAIKHIV

SEQ ID NO: 2073378 - protein, 23 aa, Staphylococcus
KKTDVLIRNLEILDIDHLFTEVI

SEQ ID NO: 2073379 - protein, 25 aa, Staphylococcus
KKTESNFISLLKKLSKTKTIILTSH

SEQ ID NO: 2073380 - protein, 22 aa, Staphylococcus
KKTFAMYYDYVEPIKNVANHRV

SEQ ID NO: 2073381 - protein, 24 aa, Staphylococcus
KKTKFTAKFLHFKNKPFKLTEKAD

SEQ ID NO: 2073382 - protein, 24 aa, Staphylococcus
KKTMYLLVNEGELSTFGPGGRFGD

SEQ ID NO: 2073383 - protein, 23 aa, Staphylococcus
KKTSKICHSLNGNVFKFKDMIPG

SEQ ID NO: 2073384 - protein, 28 aa, Staphylococcus
KKVHDQIPSKLLLLGDGPELMEMKKLAK

SEQ ID NO: 2073385 - protein, 23 aa, Staphylococcus
KKVHVRMMPKQEPPYQRLMESVN

SEQ ID NO: 2073386 - protein, 22 aa, Staphylococcus
KKVICYMPTWRGSVGKVKKSSH

SEQ ID NO: 2073387 - protein, 21 aa, Staphylococcus
KKVIIFDLPLFFPEYTETNKS

SEQ ID NO: 2073388 - protein, 22 aa, Staphylococcus
KKVISYMPTWRGTVGKVKKSTE

SEQ ID NO: 2073389 - protein, 17 aa, Staphylococcus
KKVIVKDKQIGIFLTEN

SEQ ID NO: 2073390 - protein, 22 aa, Staphylococcus
KKVKLNMILNAKSGICPEDCGY

SEQ ID NO: 2073391 - protein, 23 aa, Staphylococcus
KKVKLTKMSIEELGPVNLNAIEQ

SEQ ID NO: 2073392 - protein, 18 aa, Staphylococcus
KKVLPNSKVLLLTDGDIT

SEQ ID NO: 2073393 - protein, 17 aa, Staphylococcus
KKVRLFKEWKTEKGIID

SEQ ID NO: 2073394 - protein, 23 aa, Staphylococcus
KKVRQFMKYVLELQIYKNKSKCI

SEQ ID NO: 2073395 - protein, 31 aa, Staphylococcus
KKVSFKLIATELLWFIKGDTNIKYLLQYNNN

SEQ ID NO: 2073396 - protein, 23 aa, Staphylococcus
KKVTLLIGDLAFYHDMNGLLMAK

SEQ ID NO: 2073397 - protein, 24 aa, Staphylococcus
KKVTLLIGDLAFYHDMNGLLMAKL

SEQ ID NO: 2073398 - protein, 46 aa, Staphylococcus
KKVVKQINVPGFRKGKVPRPIFEQRFGVEALYQDAVDILLPEAYGE

SEQ ID NO: 2073399 - protein, 54 aa, Staphylococcus
KKVVKQINVPGFRKGKVPRPIFEQRFGVEALYQDAVDILLPEAYGEAIDETGIN

SEQ ID NO: 2073400 - protein, 21 aa, Staphylococcus
KKVYTNLKPWDRVQIARLQER

SEQ ID NO: 2073401 - protein, 25 aa, Staphylococcus
KKWNGVIINYLFEAPSFYNELHRSI

SEQ ID NO: 2073402 - protein, 29 aa, Staphylococcus
KKYEHANPTSLIFALKNRLPHKYRDKVEQ

SEQ ID NO: 2073403 - protein, 26 aa, Staphylococcus
KKYGFKFMGPVTMFSFLEAAGLYDAH

SEQ ID NO: 2073404 - protein, 28 aa, Staphylococcus
KKYGPLLNGFYHIPFPDNYRGLFEQPTP

SEQ ID NO: 2073405 - protein, 30 aa, Staphylococcus
KKYIKESVKSSLKRLGLEQLDLYQLHGGTI

SEQ ID NO: 2073406 - protein, 17 aa, Staphylococcus
KKYILYCPTWRRNERET

SEQ ID NO: 2073407 - protein, 23 aa, Staphylococcus
KKYKIHALFKSNISVRRNFIDKF

SEQ ID NO: 2073408 - protein, 17 aa, Staphylococcus
KKYNKKPMLVAADIYRP

SEQ ID NO: 2073409 - protein, 27 aa, Staphylococcus
KKYNLNEIYLIAHAFLESGYGTSYFSS

SEQ ID NO: 2073410 - protein, 23 aa, Staphylococcus
KKYNNEFFVYPAASSIHHNFASG

SEQ ID NO: 2073411 - protein, 24 aa, Staphylococcus
KKYSKTLLIEIKKPEQYPGIEKAL

SEQ ID NO: 2073412 - protein, 17 aa, Staphylococcus
KKYWHRLPNFEDISQYA

SEQ ID NO: 2073413 - protein, 27 aa, Staphylococcus
KLAAKRKLSIFLYSINDFTDFEATTQS

SEQ ID NO: 2073414 - protein, 28 aa, Staphylococcus
KLAAKRRLSIFLYSVNDFTNFHAESQSE

SEQ ID NO: 2073415 - protein, 24 aa, Staphylococcus
KLAEKEFFDLYSKIVIQIPTSNPV

SEQ ID NO: 2073416 - protein, 19 aa, Staphylococcus
KLAESLLSQLLKRSDLKLS

SEQ ID NO: 2073417 - protein, 19 aa, Staphylococcus
KLAIATLAVREGATFISTN

SEQ ID NO: 2073418 - protein, 40 aa, Staphylococcus
KLAIEYKLAFPLHPEFRTMPMVWYCPPLSPIMSYFEGKNA

SEQ ID NO: 2073419 - protein, 40 aa, Staphylococcus
KLAIEYKLAFPLHPEFRTMPMVWYCPPLSPIMSYFEGKNS

SEQ ID NO: 2073420 - protein, 40 aa, Staphylococcus
KLAIEYKLAFPLHPEYRTLPMVWYCPPLSPIMNYFEGKDS

SEQ ID NO: 2073421 - protein, 41 aa, Staphylococcus
KLAIEYKLAFPLHPEYRTMPMVWYCPPLSPIMSYFEGKGAK

SEQ ID NO: 2073422 - protein, 40 aa, Staphylococcus
KLAIEYKLAFPLHPEYRTMPMVWYCPPLSPIMSYFEGKNS

SEQ ID NO: 2073423 - protein, 20 aa, Staphylococcus
KLAIVTYPNYYGECFDIRAF

SEQ ID NO: 2073424 - protein, 20 aa, Staphylococcus
KLALEEAKKAERIGEVPIGA

SEQ ID NO: 2073425 - protein, 25 aa, Staphylococcus
KLAQEEIFGPVLTIIKVKDDDEAIK

SEQ ID NO: 2073426 - protein, 24 aa, Staphylococcus
KLASNELYFKAWNGLYHEIHNEPE

SEQ ID NO: 2073427 - protein, 20 aa, Staphylococcus
KLAVFTYPNYYGECFDVAST

SEQ ID NO: 2073428 - protein, 25 aa, Staphylococcus
KLCEKDMLYRTLSISLTQFVPEGIQ

SEQ ID NO: 2073429 - protein, 24 aa, Staphylococcus
KLCLTLAQLIYDSGFLTGIYHGDL

SEQ ID NO: 2073430 - protein, 32 aa, Staphylococcus
KLDESFLKQCPNLNWIAWYATGVNNLPLEYIS

SEQ ID NO: 2073431 - protein, 27 aa, Staphylococcus
KLDFNQQLFHDYASPIWIYTENKNLKV

SEQ ID NO: 2073432 - protein, 30 aa, Staphylococcus
KLDGSIKNFRVTKIFGFFGLKREEVNEAYA

SEQ ID NO: 2073433 - protein, 17 aa, Staphylococcus
KLDIEVSIMDFDRDEWA

SEQ ID NO: 2073434 - protein, 28 aa, Staphylococcus
KLDKMDLPGITLYPETERFYPNGNFASH

SEQ ID NO: 2073435 - protein, 21 aa, Staphylococcus
KLDKSIFKRGILKAASYKYQR

SEQ ID NO: 2073436 - protein, 24 aa, Staphylococcus
KLDMKGFIAYFHFLNDDELQRNII

SEQ ID NO: 2073437 - protein, 26 aa, Staphylococcus
KLDTKVIIVTTFKRPGYFEKAVANDV

SEQ ID NO: 2073438 - protein, 17 aa, Staphylococcus
KLDTPLQAYFRINSENM

SEQ ID NO: 2073439 - protein, 20 aa, Staphylococcus
KLDVIKYHDFLGHIIDQYTS

SEQ ID NO: 2073440 - protein, 18 aa, Staphylococcus
KLDVIRYHDFLGHVIDQY

SEQ ID NO: 2073441 - protein, 18 aa, Staphylococcus
KLDVIRYHDFLGHVINQY

SEQ ID NO: 2073442 - protein, 20 aa, Staphylococcus
KLDVLINHAIDHLNDVYQLT

SEQ ID NO: 2073443 - protein, 20 aa, Staphylococcus
KLDWPVKREGAYVIHRLAGN

SEQ ID NO: 2073444 - protein, 31 aa, Staphylococcus
KLDYIKYLGVDYIWLTPIYESPMNDNGYDIS

SEQ ID NO: 2073445 - protein, 23 aa, Staphylococcus
KLEDISLIYQYFEERINGEFITS

SEQ ID NO: 2073446 - protein, 18 aa, Staphylococcus
KLEEGCFADLTIINLDEE

SEQ ID NO: 2073447 - protein, 25 aa, Staphylococcus
KLEIDVAYTSLLTRALETTQYILAG

SEQ ID NO: 2073448 - protein, 26 aa, Staphylococcus
KLEKEFKMRILPTLTPLGIDAYHPFP

SEQ ID NO: 2073449 - protein, 28 aa, Staphylococcus
KLEKKNLPGITLYPETERFYPNGNFASH

SEQ ID NO: 2073450 - protein, 28 aa, Staphylococcus
KLEKMDLPGITLYPETERFYPNGNFASH

SEQ ID NO: 2073451 - protein, 26 aa, Staphylococcus
KLEKVAAPFPRITYDDAVKFLKEEGF

SEQ ID NO: 2073452 - protein, 25 aa, Staphylococcus
KLEPAYSFMIRVRLPGGTATPEQWL

SEQ ID NO: 2073453 - protein, 19 aa, Staphylococcus
KLEPLFQKQFKIHKIIIDS

SEQ ID NO: 2073454 - protein, 22 aa, Staphylococcus
KLEVLLVRFLNFKNTHKDLLRC

SEQ ID NO: 2073455 - protein, 21 aa, Staphylococcus
KLEVMIEILNIMYIKTVQIES

SEQ ID NO: 2073456 - protein, 26 aa, Staphylococcus
KLEYYTAPFYNQWDTKCFNDYLRQFH

SEQ ID NO: 2073457 - protein, 19 aa, Staphylococcus
KLFEALSITNKIPMNVGSA

SEQ ID NO: 2073458 - protein, 17 aa, Staphylococcus
KLFRRYDEWIYNFNACP

SEQ ID NO: 2073459 - protein, 18 aa, Staphylococcus
KLFTLEEDLPLFPGHGPY

SEQ ID NO: 2073460 - protein, 19 aa, Staphylococcus
KLFVYDYSDYYILKVLNIY

SEQ ID NO: 2073461 - protein, 22 aa, Staphylococcus
KLGAQVGWYIPNRFTEGYGPNE

SEQ ID NO: 2073462 - protein, 30 aa, Staphylococcus
KLGDDYVILLRMHYLIAIALNLEGYEDFAI

SEQ ID NO: 2073463 - protein, 23 aa, Staphylococcus
KLGEKEFFDLYSKLVVEIPTNHP

SEQ ID NO: 2073464 - protein, 19 aa, Staphylococcus
KLGFFGVAGFDLLLDKNDD

SEQ ID NO: 2073465 - protein, 18 aa, Staphylococcus
KLGFIMSAVDRELPYHLA

SEQ ID NO: 2073466 - protein, 23 aa, Staphylococcus
KLGGKMQIYPEKIIWDIGGVAPK

SEQ ID NO: 2073467 - protein, 28 aa, Staphylococcus
KLGGKMQLYPEKIIWDIGGIAPKPCYQI

SEQ ID NO: 2073468 - protein, 24 aa, Staphylococcus
KLGGKMQVYPEKIIWDIGGVAPKP

SEQ ID NO: 2073469 - protein, 29 aa, Staphylococcus
KLGSGFQWYSWIHIDDLVRAILFTIDEPD

SEQ ID NO: 2073470 - protein, 18 aa, Staphylococcus
KLGYPFMVKTRFGGYDGK

SEQ ID NO: 2073471 - protein, 21 aa, Staphylococcus
KLHGMALRVPTKNVSLVDLVV

SEQ ID NO: 2073472 - protein, 25 aa, Staphylococcus
KLHIKHLINRLIFNIKLENNVSAEM

SEQ ID NO: 2073473 - protein, 20 aa, Staphylococcus
KLHITDDKPVLLYAPTWHKD

SEQ ID NO: 2073474 - protein, 17 aa, Staphylococcus
KLHIVPFTDLQKQINKS

SEQ ID NO: 2073475 - protein, 21 aa, Staphylococcus
KLHLKHRLFNQRLAEPIVNSE

SEQ ID NO: 2073476 - protein, 28 aa, Staphylococcus
KLHLPQGFNIRVDSLLYPGYQVSPYYDS

SEQ ID NO: 2073477 - protein, 25 aa, Staphylococcus
KLHLPQGFNIRVDSLLYSGYQVSPY

SEQ ID NO: 2073478 - protein, 32 aa, Staphylococcus
KLIDAVKPFVKRKLIFLVGMAGERDLTKTPEM

SEQ ID NO: 2073479 - protein, 20 aa, Staphylococcus
KLIDEPLELIGLMGNISHID

SEQ ID NO: 2073480 - protein, 18 aa, Staphylococcus
KLIDFNIRKLRLKNIKAY

SEQ ID NO: 2073481 - protein, 17 aa, Staphylococcus
KLIEQFVSTMGYVGQID

SEQ ID NO: 2073482 - protein, 17 aa, Staphylococcus
KLILYLIVELSHFENTD

SEQ ID NO: 2073483 - protein, 18 aa, Staphylococcus
KLINLKEALIHYLEHQKT

SEQ ID NO: 2073484 - protein, 31 aa, Staphylococcus; identical to SEQ ID NO: 1681494

SEQ ID NO: 2073485 - protein, 25 aa, Staphylococcus
KLISDELLMLYLKNTNVAPYITGAV

SEQ ID NO: 2073486 - protein, 19 aa, Staphylococcus
KLITEGIQFLYVAPERFES

SEQ ID NO: 2073487 - protein, 17 aa, Staphylococcus
KLIYEAGFLTGIYHGDL

SEQ ID NO: 2073488 - protein, 25 aa, Staphylococcus
KLKAELRKIIEIKPLSQLYNQRNTK

SEQ ID NO: 2073489 - protein, 20 aa, Staphylococcus
KLKASQFNYGQAFKGYMEGS

SEQ ID NO: 2073490 - protein, 21 aa, Staphylococcus
KLKDGILAIDLLRRPEMTYDT

SEQ ID NO: 2073491 - protein, 24 aa, Staphylococcus
KLKDLHLKWYGVPIISNMDLKIGG

SEQ ID NO: 2073492 - protein, 23 aa, Staphylococcus
KLKDLNLKWYGVPIISNMDLKIG

SEQ ID NO: 2073493 - protein, 17 aa, Staphylococcus
KLKDYFIKQIRAYMKGD

SEQ ID NO: 2073494 - protein, 21 aa, Staphylococcus
KLKEGLIYFNPPKININALSV

SEQ ID NO: 2073495 - protein, 33 aa, Staphylococcus
KLKEQRYAMPILLAISHIHQLLIREGLRMDTSL

SEQ ID NO: 2073496 - protein, 17 aa, Staphylococcus
KLKEQYQDIFRSYKQKQ

SEQ ID NO: 2073497 - protein, 17 aa, Staphylococcus
KLKGKILRIGHLGTIDT

SEQ ID NO: 2073498 - protein, 20 aa, Staphylococcus
KLKHLPFVSGFIGTCSFDLI

SEQ ID NO: 2073499 - protein, 19 aa, Staphylococcus
KLKHYCPMFLEKIQTYKAK

SEQ ID NO: 2073500 - protein, 19 aa, Staphylococcus
KLKKLFKYDKKEALSFTKE

SEQ ID NO: 2073501 - protein, 18 aa, Staphylococcus
KLKLYVYQERQNKNIKQD

SEQ ID NO: 2073502 - protein, 24 aa, Staphylococcus
KLKQLPFISGFMGTCSFDLVRHEF

SEQ ID NO: 2073503 - protein, 33 aa, Staphylococcus
KLKRHMAFLMQKGKLYLPYNGNLLIHGCIPVDD

SEQ ID NO: 2073504 - protein, 33 aa, Staphylococcus
KLKRHMSFLMKKGKLYLPYNGNLLIHGCIPVDE

SEQ ID NO: 2073505 - protein, 33 aa, Staphylococcus
KLKRHMTFLMDKGCLYLPYNGNLLIHGCIPIDE

SEQ ID NO: 2073506 - protein, 33 aa, Staphylococcus
KLKRHMTFLMQKGTLYLPYNGNLLIHGCIPVDE

SEQ ID NO: 2073507 - protein, 18 aa, Staphylococcus
KLKSIVGSFAYYIKGFEM

SEQ ID NO: 2073508 - protein, 18 aa, Staphylococcus
KLKSLKDHFYRYSLKLRQ

SEQ ID NO: 2073509 - protein, 21 aa, Staphylococcus
KLKVKQLLFDQIKATLSYYVE

SEQ ID NO: 2073510 - protein, 17 aa, Staphylococcus
KLKVTLSFYFKAPKSWS

SEQ ID NO: 2073511 - protein, 21 aa, Staphylococcus
KLKYQTFERLLNKNDIKELNV

SEQ ID NO: 2073512 - protein, 20 aa, Staphylococcus
KLLCDLYSGVLTELLRQWLE

SEQ ID NO: 2073513 - protein, 24 aa, Staphylococcus
KLLDRIYPFRKCDKMPDKLCLYYH

SEQ ID NO: 2073514 - protein, 25 aa, Staphylococcus
KLLDRIYPFRKCDKMPDKLCLYYHI

SEQ ID NO: 2073515 - protein, 25 aa, Staphylococcus
KLLDRIYPFRKCDKMPNKLCLYYHI

SEQ ID NO: 2073516 - protein, 17 aa, Staphylococcus
KLLFDKLTEQQPDESIF

SEQ ID NO: 2073517 - protein, 20 aa, Staphylococcus
KLLHLGDILHKRVVGQDKAV

SEQ ID NO: 2073518 - protein, 17 aa, Staphylococcus
KLLHYYDSEIKSIIIKD

SEQ ID NO: 2073519 - protein, 32 aa, Staphylococcus
KLLKEEDVEWIVLAGYMRLIGADLLDAYERRI

SEQ ID NO: 2073520 - protein, 22 aa, Staphylococcus
KLLKLFGKLSIFNKLYGNLVYS

SEQ ID NO: 2073521 - protein, 24 aa, Staphylococcus
KLLLHKREIFKLGDRTREIGYSII

SEQ ID NO: 2073522 - protein, 18 aa, Staphylococcus
KLLLYDDFTQLKTWIKSQ

SEQ ID NO: 2073523 - protein, 17 aa, Staphylococcus
KLLMDAFREIAKEKKLQ

SEQ ID NO: 2073524 - protein, 20 aa, Staphylococcus
KLLSKDIQYKDLGLLIVDEE

SEQ ID NO: 2073525 - protein, 21 aa, Staphylococcus
KLLSKDIRYKDLGLLIVDEEQ

SEQ ID NO: 2073526 - protein, 17 aa, Staphylococcus
KLMDYKIGGLEPTQLVV

SEQ ID NO: 2073527 - protein, 24 aa, Staphylococcus
KLMMKTIEALMRKGYKYDKIKSKL

SEQ ID NO: 2073528 - protein, 20 aa, Staphylococcus
KLMVDMAHIAGLVAAGLHPN

SEQ ID NO: 2073529 - protein, 20 aa, Staphylococcus
KLMVDMAHIAGLVAVGLHPN

SEQ ID NO: 2073530 - protein, 23 aa, Staphylococcus
KLNAQFVPTQFIRFEKATIESDK

SEQ ID NO: 2073531 - protein, 21 aa, Staphylococcus
KLNDYLTFYQKEMNFRKLGKY

SEQ ID NO: 2073532 - protein, 32 aa, Staphylococcus
KLNIESSDIIKKLFLLGIVANINQSLDEETLE

SEQ ID NO: 2073533 - protein, 33 aa, Staphylococcus
KLNIESSGIIKKLFLLGIVANINQALDEETLEL

SEQ ID NO: 2073534 - protein, 21 aa, Staphylococcus
KLNIMFPMVATINEFRDAKAI

SEQ ID NO: 2073535 - protein, 21 aa, Staphylococcus
KLNIMFPMVATINEFRDAKAL

SEQ ID NO: 2073536 - protein, 18 aa, Staphylococcus
KLNLLKKIIRRYTPREQK

SEQ ID NO: 2073537 - protein, 17 aa, Staphylococcus
KLNMILNAKSGICPEDC

SEQ ID NO: 2073538 - protein, 19 aa, Staphylococcus
KLNQINKPLQAVLLTHAHF

SEQ ID NO: 2073539 - protein, 22 aa, Staphylococcus
KLNQLHVFINTDFSIMPNFTEK

SEQ ID NO: 2073540 - protein, 24 aa, Staphylococcus
KLNQNPGWILQPYPVAIPHMKDDL

SEQ ID NO: 2073541 - protein, 19 aa, Staphylococcus
KLNSFIFDKQSFTILNDVF

SEQ ID NO: 2073542 - protein, 21 aa, Staphylococcus
KLNSYFYSHYFDHEVLASAKR

SEQ ID NO: 2073543 - protein, 17 aa, Staphylococcus
KLNVFASGGLRTPLDAV

SEQ ID NO: 2073544 - protein, 17 aa, Staphylococcus
KLNYFQNPLLFEGREGE

SEQ ID NO: 2073545 - protein, 20 aa, Staphylococcus
KLPAIIFVTESKKVFIHCLK

SEQ ID NO: 2073546 - protein, 30 aa, Staphylococcus
KLPEGWKIVLNRPSTVPRKGWIAVFTDGTY

SEQ ID NO: 2073547 - protein, 19 aa, Staphylococcus
KLPGIGPKTAQRLAFHTLN

SEQ ID NO: 2073548 - protein, 19 aa, Staphylococcus
KLPGIGPKTAQRLSFHTLD

SEQ ID NO: 2073549 - protein, 20 aa, Staphylococcus
KLPGLKAMYFYKDGVSPSEL

SEQ ID NO: 2073550 - protein, 22 aa, Staphylococcus
KLPIWIADYVLSSYGTGAVMAV

SEQ ID NO: 2073551 - protein, 17 aa, Staphylococcus
KLPTFVMGVGLGGLIIL

SEQ ID NO: 2073552 - protein, 30 aa, Staphylococcus
KLPVEVDKFNWLLVAKRIKAYDELKVTRRM

SEQ ID NO: 2073553 - protein, 22 aa, Staphylococcus
KLPVEVDKFNWLLVSKKITKDT

SEQ ID NO: 2073554 - protein, 20 aa, Staphylococcus
KLQEKIGVKTLIYLDNAATT

SEQ ID NO: 2073555 - protein, 18 aa, Staphylococcus
KLQELIDLGIDPFGHRFD

SEQ ID NO: 2073556 - protein, 19 aa, Staphylococcus
KLQLMPLDNLKQVTGYIRG

SEQ ID NO: 2073557 - protein, 24 aa, Staphylococcus
KLQNHPRLILQSNIQTITLRQALS

SEQ ID NO: 2073558 - protein, 20 aa, Staphylococcus
KLQRIEFGPLNLKGLNAGEG

SEQ ID NO: 2073559 - protein, 25 aa, Staphylococcus
KLRDAYRLMIYYDKDNHIKLSIIYK

SEQ ID NO: 2073560 - protein, 25 aa, Staphylococcus
KLRDEPLDHVLLFGPPGLGKTTLSN

SEQ ID NO: 2073561 - protein, 26 aa, Staphylococcus
KLREEPLDHVLLFGPPGLGKTTLSNI

SEQ ID NO: 2073562 - protein, 25 aa, Staphylococcus
KLREPIEDFVTRIIEFIHRTQLSYI

SEQ ID NO: 2073563 - protein, 19 aa, Staphylococcus
KLRGNSLPEDTVIDSWFYI

SEQ ID NO: 2073564 - protein, 20 aa, Staphylococcus
KLRKKYLDSFREGFKKQLEN

SEQ ID NO: 2073565 - protein, 22 aa, Staphylococcus
KLRLKGYPAIIFQHEIDHLNGV

SEQ ID NO: 2073566 - protein, 17 aa, Staphylococcus
KLRQKMGMVFQNFNLFP

SEQ ID NO: 2073567 - protein, 17 aa, Staphylococcus
KLRRPDLTFATLDHNVP

SEQ ID NO: 2073568 - protein, 24 aa, Staphylococcus
KLRSIDIMGPLMGYLKDAFEENPY

SEQ ID NO: 2073569 - protein, 20 aa, Staphylococcus
KLRYTQAEKALIEKDQYSWK

SEQ ID NO: 2073570 - protein, 25 aa, Staphylococcus
KLSETMYVVPPSRLINEIPFAMKQL

SEQ ID NO: 2073571 - protein, 20 aa, Staphylococcus
KLSFKYIDRILLNWKKNNVK

SEQ ID NO: 2073572 - protein, 22 aa, Staphylococcus
KLSFKYIDRILLNWKKNNVKTI

SEQ ID NO: 2073573 - protein, 20 aa, Staphylococcus
KLSFKYMDRILLNWKKNNVK

SEQ ID NO: 2073574 - protein, 20 aa, Staphylococcus
KLSFLGADLLKETLPSILDG

SEQ ID NO: 2073575 - protein, 21 aa, Staphylococcus
KLSGMILGGYVIYAAERVEAG

SEQ ID NO: 2073576 - protein, 18 aa, Staphylococcus
KLSHLRPAFKKNGSVTAG

SEQ ID NO: 2073577 - protein, 26 aa, Staphylococcus
KLSMIYVDTGAMYRAITYKYLKQDAP

SEQ ID NO: 2073578 - protein, 28 aa, Staphylococcus
KLSMIYVDTGAMYRAITYKYLQQNKPED

SEQ ID NO: 2073579 - protein, 24 aa, Staphylococcus
KLSRTQGFDGWAPLFFRGREVSGK

SEQ ID NO: 2073580 - protein, 32 aa, Staphylococcus
KLSSVIQPLYDIGAVGMRLLTKFMNEEDIAEP

SEQ ID NO: 2073581 - protein, 31 aa, Staphylococcus
KLSSVIQPLYDIGAVGMRLLTKYMNEEEIEE

SEQ ID NO: 2073582 - protein, 19 aa, Staphylococcus
KLSYIYDYAHKIIYKAIEG

SEQ ID NO: 2073583 - protein, 18 aa, Staphylococcus
KLSYYHNVSRKKQEIFLK

SEQ ID NO: 2073584 - protein, 29 aa, Staphylococcus
KLTDKDIIKLRKLLAKHDLYHPVVTKSVR

SEQ ID NO: 2073585 - protein, 21 aa, Staphylococcus
KLTEPMIQLMLQSSPITAGPT

SEQ ID NO: 2073586 - protein, 19 aa, Staphylococcus
KLTIMLPDETPSSYLIPSR

SEQ ID NO: 2073587 - protein, 25 aa, Staphylococcus
KLTKKTFPGYVLVELVMTDESWYVV

SEQ ID NO: 2073588 - protein, 34 aa, Staphylococcus
KLTLPKTNLIRFIFENGFIALRPSGTEPKIKLYF

SEQ ID NO: 2073589 - protein, 21 aa, Staphylococcus
KLTRIQFGSLNLKGLNAGEGR

SEQ ID NO: 2073590 - protein, 28 aa, Staphylococcus
KLTVERARRIQFFLSQNFHVAEQFTGQK

SEQ ID NO: 2073591 - protein, 18 aa, Staphylococcus
KLVAMNIGISFTPKQALR

SEQ ID NO: 2073592 - protein, 25 aa, Staphylococcus
KLVDSNRKYLAEFLPFVEYTKKAED

SEQ ID NO: 2073593 - protein, 18 aa, Staphylococcus
KLVHDKLEYPVFVKPANL

SEQ ID NO: 2073594 - protein, 31 aa, Staphylococcus; identical to SEQ ID NO: 1697154

SEQ ID NO: 2073595 - protein, 26 aa, Staphylococcus
KLVKDKLEFPVFVKPANLGSSVGISK

SEQ ID NO: 2073596 - protein, 26 aa, Staphylococcus
KLVKHYRKLIESLAYKYSKGQSHHED

SEQ ID NO: 2073597 - protein, 25 aa, Staphylococcus
KLVKKTFPGYVLVELVMTDESWYVV

SEQ ID NO: 2073598 - protein, 29 aa, Staphylococcus
KLVKKTFPGYVLVELVMTDQSWYVVRNTP

SEQ ID NO: 2073599 - protein, 19 aa, Staphylococcus
KLVKLLVPSMKKKAAQNNN

SEQ ID NO: 2073600 - protein, 19 aa, Staphylococcus
KLVKLLVPSMKKKANNNTN

SEQ ID NO: 2073601 - protein, 20 aa, Staphylococcus
KLVQILLKSNLPIDKAAVEL

SEQ ID NO: 2073602 - protein, 19 aa, Staphylococcus
KLYALRDVTGTVNSIPLIA

SEQ ID NO: 2073603 - protein, 17 aa, Staphylococcus
KLYEYMTLNPRVYKHFE

SEQ ID NO: 2073604 - protein, 17 aa, Staphylococcus
KLYFEGVSLFNMLDIVD

SEQ ID NO: 2073605 - protein, 18 aa, Staphylococcus
KLYGLRDVTGTVNSIPLI

SEQ ID NO: 2073606 - protein, 17 aa, Staphylococcus
KLYNYKSLLEIDGRLDP

SEQ ID NO: 2073607 - protein, 19 aa, Staphylococcus
KLYVPVIKHADEKSIKGIA

SEQ ID NO: 2073608 - protein, 17 aa, Staphylococcus
KLYVSLTIDHFDDVAQQ

SEQ ID NO: 2073609 - protein, 17 aa, Staphylococcus
KMAKEGIAILWITHSDD

SEQ ID NO: 2073610 - protein, 17 aa, Staphylococcus
KMALWYTEMKRNLERFK

SEQ ID NO: 2073611 - protein, 23 aa, Staphylococcus
KMDYYAKRNLELTESIRLKSKKG

SEQ ID NO: 2073612 - protein, 29 aa, Staphylococcus
KMEADLERPYILVTDKKISSFQDILPLLE

SEQ ID NO: 2073613 - protein, 20 aa, Staphylococcus
KMEFLAGRFATKEAFSKALG

SEQ ID NO: 2073614 - protein, 22 aa, Staphylococcus
KMESLLLSARHFLWSTARGYNQ

SEQ ID NO: 2073615 - protein, 20 aa, Staphylococcus
KMFIDLKEHLAKNPDDSILL

SEQ ID NO: 2073616 - protein, 19 aa, Staphylococcus
KMFRGRKILKNISFNISEG

SEQ ID NO: 2073617 - protein, 20 aa, Staphylococcus
KMFTALFAFSPAKTKVIFLH

SEQ ID NO: 2073618 - protein, 18 aa, Staphylococcus
KMGLSFVELFPNIEEMLT

SEQ ID NO: 2073619 - protein, 39 aa, Staphylococcus
KMGMVFQNFNLFPHKTVLNNIILAPKLLNKSDLNQLKQE

SEQ ID NO: 2073620 - protein, 22 aa, Staphylococcus
KMGYFDIPKDLLIPINEVENYP

SEQ ID NO: 2073621 - protein, 18 aa, Staphylococcus
KMGYFDIPKDLLIPISEV

SEQ ID NO: 2073622 - protein, 22 aa, Staphylococcus
KMGYMDASYLNQFITKDTEIYV

SEQ ID NO: 2073623 - protein, 25 aa, Staphylococcus
KMHQVEIRFLLGDTLMPLIEHGIKV

SEQ ID NO: 2073624 - protein, 29 aa, Staphylococcus
KMHSCIHKRFYLFVALMTEFQALNGMRIG

SEQ ID NO: 2073625 - protein, 19 aa, Staphylococcus
KMHVRMMPGQEPPYTRLID

SEQ ID NO: 2073626 - protein, 17 aa, Staphylococcus
KMIGIINDTLVSIRFSV

SEQ ID NO: 2073627 - protein, 27 aa, Staphylococcus
KMIHHRYPTIPFYLQVGNPYLDDDVDN

SEQ ID NO: 2073628 - protein, 31 aa, Staphylococcus
KMITKPTIFNLVGPLINPFKLTYQTMGIYDR

SEQ ID NO: 2073629 - protein, 38 aa, Staphylococcus
KMKEEPEWMLNFRLKALKLFYKIPMPQWGGDLSELNFD

SEQ ID NO: 2073630 - protein, 19 aa, Staphylococcus
KMKHTVKKVPKFDWLNGEK

SEQ ID NO: 2073631 - protein, 18 aa, Staphylococcus
KMKIVFLPESTKTQEWLI

SEQ ID NO: 2073632 - protein, 17 aa, Staphylococcus
KMKSIIKKEFSISFEEF

SEQ ID NO: 2073633 - protein, 22 aa, Staphylococcus
KMKSWYEKFGFGKKTGGLFDGE

SEQ ID NO: 2073634 - protein, 17 aa, Staphylococcus
KMKYIKSFDAIDLHHVI

SEQ ID NO: 2073635 - protein, 17 aa, Staphylococcus
KMLGASMAGLHDDVPKA

SEQ ID NO: 2073636 - protein, 18 aa, Staphylococcus
KMLGIKYPIIQAGMAGST

SEQ ID NO: 2073637 - protein, 23 aa, Staphylococcus
KMLKNQLLIKRNLFLESLKKYFS

SEQ ID NO: 2073638 - protein, 27 aa, Staphylococcus
KMLNNPQELLRFLKMKRKDILENAYIM

SEQ ID NO: 2073639 - protein, 34 aa, Staphylococcus
KMLQEIGLDLPFSMKINQLLGFDDHFITYEGLVE

SEQ ID NO: 2073640 - protein, 21 aa, Staphylococcus
KMLQRIYGTAFFDKKDLKAHL

SEQ ID NO: 2073641 - protein, 19 aa, Staphylococcus
KMLSPEGIIVLVIYPGHPE

SEQ ID NO: 2073642 - protein, 36 aa, Staphylococcus
KMLTNFFVEVKWGELDYLLLDLPPGTGDVALDVHSM

SEQ ID NO: 2073643 - protein, 20 aa, Staphylococcus
KMMMAGDKLTIMLPDETPSS

SEQ ID NO: 2073644 - protein, 23 aa, Staphylococcus
KMNNRYFINLAAGGKITQVSYET

SEQ ID NO: 2073645 - protein, 18 aa, Staphylococcus
KMNPDLPVLLISGKEDPF

SEQ ID NO: 2073646 - protein, 22 aa, Staphylococcus
KMNPMVYCGLFPIDNRDYNDLR

SEQ ID NO: 2073647 - protein, 23 aa, Staphylococcus
KMNSRYFINLAAGGRITEVSYET

SEQ ID NO: 2073648 - protein, 24 aa, Staphylococcus
KMPKKMRRLALRSALSFKVQENGF

SEQ ID NO: 2073649 - protein, 18 aa, Staphylococcus
KMPLKRNILKSRSQNYAM

SEQ ID NO: 2073650 - protein, 21 aa, Staphylococcus
KMPQTRNILRRRSQNYALITL

SEQ ID NO: 2073651 - protein, 26 aa, Staphylococcus
KMPVHLKAWRKFSKKLKHNEAVGFYH

SEQ ID NO: 2073652 - protein, 33 aa, Staphylococcus
KMQLMHDALVYRIKRLKDAIPNNAPILYKSGAF

SEQ ID NO: 2073653 - protein, 26 aa, Staphylococcus
KMQPHFQIGLFENQLFVMYGVMHEAK

SEQ ID NO: 2073654 - protein, 28 aa, Staphylococcus
KMRFADSWLVTTKFKLPKWLYNMMHQHA

SEQ ID NO: 2073655 - protein, 29 aa, Staphylococcus
KMRKDRLQYQFHPFIWEVGGKYTYPEDKD

SEQ ID NO: 2073656 - protein, 22 aa, Staphylococcus
KMRKIYRDKLTYILNQLAPYSN

SEQ ID NO: 2073657 - protein, 21 aa, Staphylococcus
KMRKVYRYKLTYIIDALSSYK

SEQ ID NO: 2073658 - protein, 25 aa, Staphylococcus
KMRQEPLDHVLLFGPPGLGKTTLSN

SEQ ID NO: 2073659 - protein, 23 aa, Staphylococcus
KMRQVSNVPILFLSSRDNPMDQV

SEQ ID NO: 2073660 - protein, 24 aa, Staphylococcus
KMRQVSNVPILFLSSRDNPMDQVM

SEQ ID NO: 2073661 - protein, 27 aa, Staphylococcus
KMSPSKDLFWRLILSIAQIGCCPQEFL

SEQ ID NO: 2073662 - protein, 23 aa, Staphylococcus
KMTLYAIACFISGATYIPITEEI

SEQ ID NO: 2073663 - protein, 29 aa, Staphylococcus
KMVDTNIKGLLYGLNAVLPHFEEQSSGHI

SEQ ID NO: 2073664 - protein, 24 aa, Staphylococcus
KMVEGLLHDLKITVPVAIHLDHGS

SEQ ID NO: 2073665 - protein, 22 aa, Staphylococcus
KMWTDEGAILLKFFLCLDKDEQ

SEQ ID NO: 2073666 - protein, 18 aa, Staphylococcus
KMYDKILVDAPCSGLGVL

SEQ ID NO: 2073667 - protein, 36 aa, Staphylococcus
KMYKERGFEIKPHIAGLMISAIISDSLLFKSPTCTD

SEQ ID NO: 2073668 - protein, 28 aa, Staphylococcus
KMYNDPSIELRYFETGYIKTKVGYIHKV

SEQ ID NO: 2073669 - protein, 31 aa, Staphylococcus
KNAFKMAIDYAFLVLNLHKIYLFVDVNNEKA

SEQ ID NO: 2073670 - protein, 17 aa, Staphylococcus
KNAFRPEFLNRVDDIIV

SEQ ID NO: 2073671 - protein, 24 aa, Staphylococcus
KNAGYTLNVWTVNKSLRANQLANW

SEQ ID NO: 2073672 - protein, 17 aa, Staphylococcus
KNAHKRELAYTRYTWPK

SEQ ID NO: 2073673 - protein, 21 aa, Staphylococcus
KNAHKRELAYTRYTWPKHSST

SEQ ID NO: 2073674 - protein, 19 aa, Staphylococcus
KNAILPIALDRKEREYLSE

SEQ ID NO: 2073675 - protein, 19 aa, Staphylococcus
KNAKWFKNVLVALQKEYQF

SEQ ID NO: 2073676 - protein, 19 aa, Staphylococcus
KNALPWHIPNDLKHVKQLS

SEQ ID NO: 2073677 - protein, 20 aa, Staphylococcus
KNAMGWYLDGRASAVVGTHT

SEQ ID NO: 2073678 - protein, 24 aa, Staphylococcus
KNARAELSALIRMNGALSLSNQQF

SEQ ID NO: 2073679 - protein, 24 aa, Staphylococcus
KNAVKYFYEYLKSVKVNKVAVIGE

SEQ ID NO: 2073680 - protein, 20 aa, Staphylococcus
KNAYFKGMFNETCPSFDDIF

SEQ ID NO: 2073681 - protein, 22 aa, Staphylococcus
KNAYLRYRAHIPNLICVYSEDV

SEQ ID NO: 2073682 - protein, 24 aa, Staphylococcus
KNDEVLEFFGLKVLVDKHDAPVLN

SEQ ID NO: 2073683 - protein, 22 aa, Staphylococcus
KNDGTFKLTLEVALQLGDDVVR

SEQ ID NO: 2073684 - protein, 28 aa, Staphylococcus
KNDIIKKPFILITILNEPIVLKSNQNGN

SEQ ID NO: 2073685 - protein, 18 aa, Staphylococcus
KNDLNSILFLMTPASDEA

SEQ ID NO: 2073686 - protein, 25 aa, Staphylococcus
KNEGTHALDVHPFIDEFFGDQVDDK

SEQ ID NO: 2073687 - protein, 19 aa, Staphylococcus
KNELIAYGLIEVKPSKRAD

SEQ ID NO: 2073688 - protein, 22 aa, Staphylococcus
KNENMGFKLKSGIFKTFCEKAI

SEQ ID NO: 2073689 - protein, 23 aa, Staphylococcus
KNERYHITIYLYDYNEKSVHFFS

SEQ ID NO: 2073690 - protein, 24 aa, Staphylococcus
KNETYYIICAAGMRSAKVVKYLED

SEQ ID NO: 2073691 - protein, 20 aa, Staphylococcus
KNFDLIVDFCREHNFLILTY

SEQ ID NO: 2073692 - protein, 25 aa, Staphylococcus
KNFGFYSYIYLIKEVDKNDYKSYQT

SEQ ID NO: 2073693 - protein, 23 aa, Staphylococcus
KNFIRSIEMFKYLFTLPTEGENS

SEQ ID NO: 2073694 - protein, 21 aa, Staphylococcus
KNFMPSPGKITQYLAPGGYGV

SEQ ID NO: 2073695 - protein, 25 aa, Staphylococcus
KNFRDIFNKIAWLNKGKMEEALKGN

SEQ ID NO: 2073696 - protein, 20 aa, Staphylococcus
KNFRKSFYHLAPAGRMMKSS

SEQ ID NO: 2073697 - protein, 29 aa, Staphylococcus
KNGDWSLQQLVDYLTIKPAQTFDLPYGKL

SEQ ID NO: 2073698 - protein, 29 aa, Staphylococcus
KNGDWSLQQLVDYLTIKPAQTFDLPYGRL

SEQ ID NO: 2073699 - protein, 34 aa, Staphylococcus
KNGDWSLQQLVEYLTIKPSKIFDLPYGTLEEGKT

SEQ ID NO: 2073700 - protein, 25 aa, Staphylococcus
KNGHKSVVLWFTGLSGSGKSTISVA

SEQ ID NO: 2073701 - protein, 21 aa, Staphylococcus
KNGMFLRMSVITHILAEKEEG

SEQ ID NO: 2073702 - protein, 29 aa, Staphylococcus
KNGSYALSRPLFIYVKDKSLKDNKVMSEF

SEQ ID NO: 2073703 - protein, 20 aa, Staphylococcus
KNHDYVFFDYKYSVNLIKSI

SEQ ID NO: 2073704 - protein, 25 aa, Staphylococcus
KNHIQFPEMIFGEDLQFFAEVFFNT

SEQ ID NO: 2073705 - protein, 19 aa, Staphylococcus
KNHIWFHTKDIPGSHVVIL

SEQ ID NO: 2073706 - protein, 19 aa, Staphylococcus
KNHLDPNRPTILMSAGAFG

SEQ ID NO: 2073707 - protein, 19 aa, Staphylococcus
KNHQLLLSIHPSFARMHLT

SEQ ID NO: 2073708 - protein, 21 aa, Staphylococcus
KNIALMIALAKMNIPFLHLNN

SEQ ID NO: 2073709 - protein, 20 aa, Staphylococcus
KNIDFYLIPTKGAAKVDKTK

SEQ ID NO: 2073710 - protein, 59 aa, Staphylococcus
KNIDIESFFQQKLNSYYLNQLPQFNFTIYQFLDEAYLLLDFHSMIFNDNQLQIFLSELN

SEQ ID NO: 2073711 - protein, 26 aa, Staphylococcus
KNIDKTINGLLYLYKNSKKLLSEIPK

SEQ ID NO: 2073712 - protein, 19 aa, Staphylococcus
KNIDNPHKDLRRARSCNES

SEQ ID NO: 2073713 - protein, 21 aa, Staphylococcus
KNIEFYLIPTKGTAKVDKTLN

SEQ ID NO: 2073714 - protein, 21 aa, Staphylococcus
KNIEFYLIPTKGTAKVEKTLK

SEQ ID NO: 2073715 - protein, 21 aa, Staphylococcus
KNIEFYLIPTKGTAKVEKTLQ

SEQ ID NO: 2073716 - protein, 20 aa, Staphylococcus
KNIFFRFQNEYLNLEFKYIC

SEQ ID NO: 2073717 - protein, 18 aa, Staphylococcus
KNIILAAGRLEYEKGFDL

SEQ ID NO: 2073718 - protein, 20 aa, Staphylococcus
KNILKQVGFKNIRTLYDFDS

SEQ ID NO: 2073719 - protein, 18 aa, Staphylococcus
KNIPIHFAIYVQSSQDAI

SEQ ID NO: 2073720 - protein, 25 aa, Staphylococcus
KNIPKGKWNYLPTNKINNLKKNEVI

SEQ ID NO: 2073721 - protein, 20 aa, Staphylococcus
KNIRIIPLGGVGEIAKNMYI

SEQ ID NO: 2073722 - protein, 33 aa, Staphylococcus
KNIRKVPELDVPAYLFLGVLGMTGQTAYNGLLE

SEQ ID NO: 2073723 - protein, 25 aa, Staphylococcus
KNITWYPNKELLINDLKYLCNEDSL

SEQ ID NO: 2073724 - protein, 17 aa, Staphylococcus
KNIVDLALKKEVDFIII

SEQ ID NO: 2073725 - protein, 21 aa, Staphylococcus
KNIVFDVMLASYIIDPSRTID

SEQ ID NO: 2073726 - protein, 24 aa, Staphylococcus
KNIVIKQSWIFKGTLNSSIIHPRE

SEQ ID NO: 2073727 - protein, 26 aa, Staphylococcus
KNIYAIGDIVPGLPLAHKASYEGKVA

SEQ ID NO: 2073728 - protein, 28 aa, Staphylococcus
KNKAKAIHALFLWLDQHHFDYNGIVTQY

SEQ ID NO: 2073729 - protein, 26 aa, Staphylococcus
KNKDFHAHLLLQVHDELIFELPEEEV

SEQ ID NO: 2073730 - protein, 25 aa, Staphylococcus
KNKDGFSTILILDGLEDPHNLGSIL

SEQ ID NO: 2073731 - protein, 20 aa, Staphylococcus
KNKFLPDFDKQSIYSLRFDE

SEQ ID NO: 2073732 - protein, 31 aa, Staphylococcus
KNKFLPNFDKQSIYSLRYDEMQQWLIDHGQQ

SEQ ID NO: 2073733 - protein, 17 aa, Staphylococcus
KNKIHILLKKDLTLLNN

SEQ ID NO: 2073734 - protein, 18 aa, Staphylococcus
KNKKAIEFYKRSGFKKVT

SEQ ID NO: 2073735 - protein, 22 aa, Staphylococcus
KNKKEIWLTKQGIDKASNYFKV

SEQ ID NO: 2073736 - protein, 21 aa, Staphylococcus
KNKLLVPIFDARREAVYAGIY

SEQ ID NO: 2073737 - protein, 22 aa, Staphylococcus
KNKLVNFKAPKSMIGKIVNVYI

SEQ ID NO: 2073738 - protein, 17 aa, Staphylococcus
KNKTFTQVKSGFEPKEV

SEQ ID NO: 2073739 - protein, 20 aa, Staphylococcus
KNKTLLKFYNNETGWLDSDE

SEQ ID NO: 2073740 - protein, 25 aa, Staphylococcus
KNKVAPPFRIAEVDIMYGQGISKEG

SEQ ID NO: 2073741 - protein, 20 aa, Staphylococcus
KNLGIMFQKTNFPDLIKVKE

SEQ ID NO: 2073742 - protein, 24 aa, Staphylococcus
KNLIGAFYRPKAVIYDLNFLATLP

SEQ ID NO: 2073743 - protein, 25 aa, Staphylococcus
KNLIGAFYRPKAVIYDLNFLETLPY

SEQ ID NO: 2073744 - protein, 25 aa, Staphylococcus
KNLIGAFYRPKAVIYDLNFLKTLPY

SEQ ID NO: 2073745 - protein, 25 aa, Staphylococcus
KNLIGAFYRPSAVLYDLDFLTTLPY

SEQ ID NO: 2073746 - protein, 25 aa, Staphylococcus
KNLIHYFAIHRVGGIPCFFSSKWNK

SEQ ID NO: 2073747 - protein, 20 aa, Staphylococcus
KNLLAMCYLYLSKYDIAKDM

SEQ ID NO: 2073748 - protein, 22 aa, Staphylococcus
KNLLEHLATLIAKRINSHYNRV

SEQ ID NO: 2073749 - protein, 20 aa, Staphylococcus
KNLLTEMIGVYQVEIDINTG

SEQ ID NO: 2073750 - protein, 25 aa, Staphylococcus
KNLNHSIIIMYWHQPSKQSPSPTDF

SEQ ID NO: 2073751 - protein, 20 aa, Staphylococcus
KNLPILGVCLGAQALTCYYG

SEQ ID NO: 2073752 - protein, 29 aa, Staphylococcus
KNLPSEESYFLFYVNRPSIIVGKNQNTIE

SEQ ID NO: 2073753 - protein, 26 aa, Staphylococcus
KNLRDKFMIQLLYETGLRIGELLSLY

SEQ ID NO: 2073754 - protein, 17 aa, Staphylococcus
KNLVYPVKIDQFQTAGT

SEQ ID NO: 2073755 - protein, 21 aa, Staphylococcus
KNMGAQHWWPAQSPIEMMLGA

SEQ ID NO: 2073756 - protein, 18 aa, Staphylococcus
KNMSLLKYSFDQIIMTKE

SEQ ID NO: 2073757 - protein, 17 aa, Staphylococcus
KNNDYPLPTIGIEPGRS

SEQ ID NO: 2073758 - protein, 18 aa, Staphylococcus
KNNGWDNYPICMAKTQYS

SEQ ID NO: 2073759 - protein, 26 aa, Staphylococcus
KNNIRFPEMIFGEDLQFFAEVFFNTK

SEQ ID NO: 2073760 - protein, 25 aa, Staphylococcus
KNNKLMPNLLYRIINKDVLEAKFYK

SEQ ID NO: 2073761 - protein, 22 aa, Staphylococcus
KNNLQTVASLLRLQMRRGIPDE

SEQ ID NO: 2073762 - protein, 23 aa, Staphylococcus
KNNPLLEMLNFVSIFSSNLDEFF

SEQ ID NO: 2073763 - protein, 24 aa, Staphylococcus
KNNVPPYYIALASIGTIADLVSLT

SEQ ID NO: 2073764 - protein, 21 aa, Staphylococcus
KNNVWYFVTVNVKTKIVRLFN

SEQ ID NO: 2073765 - protein, 22 aa, Staphylococcus
KNNWRYRISLGKNAETGKYEYI

SEQ ID NO: 2073766 - protein, 22 aa, Staphylococcus
KNNWRYRISLGKNPQTGKYEYI

SEQ ID NO: 2073767 - protein, 26 aa, Staphylococcus
KNPELLYEKVLWIKSNYRNPLMTECT

SEQ ID NO: 2073768 - protein, 20 aa, Staphylococcus
KNPLCLFCPVQENCEAFRKG

SEQ ID NO: 2073769 - protein, 32 aa, Staphylococcus
KNPNKSILLVAVERLYPFPADEIDALLSELPN

SEQ ID NO: 2073770 - protein, 25 aa, Staphylococcus
KNPTPLIKLLIIEELIIPCIKTLPF

SEQ ID NO: 2073771 - protein, 27 aa, Staphylococcus
KNQKITDKFIPLKPLRQLEVIEGNYED

SEQ ID NO: 2073772 - protein, 17 aa, Staphylococcus
KNQLAFIDAIEKHYDMY

SEQ ID NO: 2073773 - protein, 25 aa, Staphylococcus
KNQQQQLQLLFNNFNLKTFKQRIKR

SEQ ID NO: 2073774 - protein, 24 aa, Staphylococcus
KNRDATYAAPLRVKVRLINKETGE

SEQ ID NO: 2073775 - protein, 24 aa, Staphylococcus
KNRDATYAAPLRVKVRLVIKETGE

SEQ ID NO: 2073776 - protein, 20 aa, Staphylococcus
KNRFLPDFDKQSIYSLRYEE

SEQ ID NO: 2073777 - protein, 18 aa, Staphylococcus
KNRFYKHRNELVDKQIIS

SEQ ID NO: 2073778 - protein, 33 aa, Staphylococcus
KNRHAKRRLTYKTFLALYRQILVKDGEIHFKTD

SEQ ID NO: 2073779 - protein, 18 aa, Staphylococcus
KNRLSSGWGFDDAIQAPI

SEQ ID NO: 2073780 - protein, 26 aa, Staphylococcus
KNRPEHGLLKLRKALNLYANIRPTIV

SEQ ID NO: 2073781 - protein, 28 aa, Staphylococcus
KNRTWEFQISLPRFLSHEDYLLFTHAIE

SEQ ID NO: 2073782 - protein, 29 aa, Staphylococcus
KNRTWEFQITLPYFLSHEDYLIFTNAITE

SEQ ID NO: 2073783 - protein, 30 aa, Staphylococcus
KNRYLTEDIAYGLVLWSSLGREIGVETPNI

SEQ ID NO: 2073784 - protein, 23 aa, Staphylococcus
KNSDVRLYELGSVFFANGEDELP

SEQ ID NO: 2073785 - protein, 22 aa, Staphylococcus
KNSFRPEFLNRVDDIIVFHKLT

SEQ ID NO: 2073786 - protein, 20 aa, Staphylococcus
KNSIVGTSSLRRGAQILSKY

SEQ ID NO: 2073787 - protein, 17 aa, Staphylococcus
KNSIYFHSLTWDVDYIK

SEQ ID NO: 2073788 - protein, 24 aa, Staphylococcus
KNSKNKRFIGLVSQYLFLQTKNNY

SEQ ID NO: 2073789 - protein, 18 aa, Staphylococcus
KNSKVDFGFGQWGLKQRE

SEQ ID NO: 2073790 - protein, 24 aa, Staphylococcus
KNSLKYWFHLATAKYFIQNTNMPI

SEQ ID NO: 2073791 - protein, 23 aa, Staphylococcus
KNSLYVEIYPFDLSFEDPFTKIQ

SEQ ID NO: 2073792 - protein, 29 aa, Staphylococcus
KNSSYLIDLLENFALERGVYGKRWLDEEV

SEQ ID NO: 2073793 - protein, 26 aa, Staphylococcus
KNSSYLIDLLENFVLERGITGKRWFD

SEQ ID NO: 2073794 - protein, 19 aa, Staphylococcus
KNSVALNKRLTAGTFFIKL

SEQ ID NO: 2073795 - protein, 23 aa, Staphylococcus
KNSYELLHFVLDKIRQGISAQLM

SEQ ID NO: 2073796 - protein, 29 aa, Staphylococcus
KNTADIIPMCHQLPLTGIDVTFDWQENEQ

SEQ ID NO: 2073797 - protein, 30 aa, Staphylococcus
KNTSTIIPMCHPLPLTGIDIEFSWNQANTQ

SEQ ID NO: 2073798 - protein, 27 aa, Staphylococcus
KNTSTIIPMCHPLPLTGIDVNFEWDTS

SEQ ID NO: 2073799 - protein, 27 aa, Staphylococcus
KNTSTIIPMCHPLPLTGIDVQFNWQIN

SEQ ID NO: 2073800 - protein, 28 aa, Staphylococcus
KNTSTIIPMCHPLSLTGIDIAFEWDTTS

SEQ ID NO: 2073801 - protein, 28 aa, Staphylococcus
KNTSTMIPMCHPLPLTGIDITFSWSDLD

SEQ ID NO: 2073802 - protein, 25 aa, Staphylococcus
KNTYEWLKPLLERKYPNIHFEYTYI

SEQ ID NO: 2073803 - protein, 25 aa, Staphylococcus
KNTYEWLQPLLKRKYPQIDFQFTYI

SEQ ID NO: 2073804 - protein, 29 aa, Staphylococcus
KNVFSKYPNIKWIVPHCGALLPIIAQRVA

SEQ ID NO: 2073805 - protein, 20 aa, Staphylococcus
KNVIVILNNKEKFKGFVIDY

SEQ ID NO: 2073806 - protein, 19 aa, Staphylococcus
KNVMVALREPALGPTFGIK

SEQ ID NO: 2073807 - protein, 20 aa, Staphylococcus
KNVMVALREPALGPTFGIKG

SEQ ID NO: 2073808 - protein, 30 aa, Staphylococcus
KNVRIAPSPIWMQARLIKAGIRPINNVVDI

SEQ ID NO: 2073809 - protein, 25 aa, Staphylococcus
KNVRVVIVPIVNPWGFANRERENVN

SEQ ID NO: 2073810 - protein, 30 aa, Staphylococcus
KNVSIEPSPIWVQARLIKAGIRPINNVVDI

SEQ ID NO: 2073811 - protein, 20 aa, Staphylococcus
KNVSLIIDAMSSFGGIPIKV

SEQ ID NO: 2073812 - protein, 30 aa, Staphylococcus
KNVTIAPSPEWMQMRLIKAGIRPINNVVDI

SEQ ID NO: 2073813 - protein, 20 aa, Staphylococcus
KNVWFGVREFAMGAAVNGMA

SEQ ID NO: 2073814 - protein, 21 aa, Staphylococcus
KNWHGAFIIVSHDRAFLDNLC

SEQ ID NO: 2073815 - protein, 23 aa, Staphylococcus
KNWIPKIKEMVPSFGLKLTEHED

SEQ ID NO: 2073816 - protein, 20 aa, Staphylococcus
KNWMSRESEDRLKRISSELL

SEQ ID NO: 2073817 - protein, 22 aa, Staphylococcus
KNYIDAVIGLPANLFFGTNIPT

SEQ ID NO: 2073818 - protein, 24 aa, Staphylococcus
KNYKERFNLFLDEAFEMGIDIDTL

SEQ ID NO: 2073819 - protein, 28 aa, Staphylococcus
KNYLDAVIGLPNNLFFGTPISTCILVFK

SEQ ID NO: 2073820 - protein, 25 aa, Staphylococcus
KNYPEYNYIWVFKNPDKNIIPGNAK

SEQ ID NO: 2073821 - protein, 17 aa, Staphylococcus
KPAAILHDYAASKAAII

SEQ ID NO: 2073822 - protein, 23 aa, Staphylococcus
KPANGFVCYMVGRLILELCKNVD

SEQ ID NO: 2073823 - protein, 24 aa, Staphylococcus
KPATLTVKIKYALLQEKPKIKSVE

SEQ ID NO: 2073824 - protein, 25 aa, Staphylococcus
KPDDGMYTPIYFDGQKWIGQSKEVF

SEQ ID NO: 2073825 - protein, 24 aa, Staphylococcus
KPDKTVLHRVQLKKPVLTEAQLEA

SEQ ID NO: 2073826 - protein, 26 aa, Staphylococcus
KPDPELYLTAVQRLNYSPAHCLAIED

SEQ ID NO: 2073827 - protein, 23 aa, Staphylococcus
KPEDYDALLIPGGFSPDHLRGDA

SEQ ID NO: 2073828 - protein, 22 aa, Staphylococcus
KPEDYDGLLIPGGFAPDHLRGD

SEQ ID NO: 2073829 - protein, 26 aa, Staphylococcus
KPEHYYKLLNLPENVLFYPITGEVNG

SEQ ID NO: 2073830 - protein, 27 aa, Staphylococcus
KPEHYYRLLNLPENVLFYPTTGELNGN

SEQ ID NO: 2073831 - protein, 20 aa, Staphylococcus
KPEIVLMYELLDPIDYHQLP

SEQ ID NO: 2073832 - protein, 19 aa, Staphylococcus
KPELVEYAMKKKLLEFQSP

SEQ ID NO: 2073833 - protein, 23 aa, Staphylococcus
KPENYDALLIPGGFSPDNLRGDA

SEQ ID NO: 2073834 - protein, 26 aa, Staphylococcus
KPEQRDRIFISPLARNMAKDKDLDIT

SEQ ID NO: 2073835 - protein, 24 aa, Staphylococcus
KPETKMLYIETPSNPLLRVTDIKA

SEQ ID NO: 2073836 - protein, 21 aa, Staphylococcus
KPEYFIPVNGEFKMQISHAKL

SEQ ID NO: 2073837 - protein, 17 aa, Staphylococcus
KPFGIDVIIIEPGLIQT

SEQ ID NO: 2073838 - protein, 18 aa, Staphylococcus
KPFSVFGVKYILNNPVYK

SEQ ID NO: 2073839 - protein, 18 aa, Staphylococcus
KPFVGYSDIFSFNNPKGM

SEQ ID NO: 2073840 - protein, 20 aa, Staphylococcus
KPFYDGLISFITSAPVFAMV

SEQ ID NO: 2073841 - protein, 24 aa, Staphylococcus
KPGAIFKLPKVAGILRGYLNTDIP

SEQ ID NO: 2073842 - protein, 17 aa, Staphylococcus
KPGAMTSAVDRFAIRIQ

SEQ ID NO: 2073843 - protein, 18 aa, Staphylococcus
KPGGLLYFHVHDERLSFK

SEQ ID NO: 2073844 - protein, 19 aa, Staphylococcus
KPGPTIGFLAEYDALPGLG

SEQ ID NO: 2073845 - protein, 27 aa, Staphylococcus
KPGSDIPYLYYYMGPSGKFIKRSLIIE

SEQ ID NO: 2073846 - protein, 19 aa, Staphylococcus
KPHPLINLINVMLLEKSGA

SEQ ID NO: 2073847 - protein, 19 aa, Staphylococcus
KPHQLSYEVEKTLAALSPT

SEQ ID NO: 2073848 - protein, 18 aa, Staphylococcus
KPIGLFYDKETADKVSEE

SEQ ID NO: 2073849 - protein, 17 aa, Staphylococcus
KPIGLFYTKEQAEQTME

SEQ ID NO: 2073850 - protein, 17 aa, Staphylococcus
KPIIPVHHIAGHIYANH

SEQ ID NO: 2073851 - protein, 20 aa, Staphylococcus
KPIKKSKYWLFNTLNNVRKK

SEQ ID NO: 2073852 - protein, 20 aa, Staphylococcus
KPILVHTVEKFLLTSEFDKI

SEQ ID NO: 2073853 - protein, 24 aa, Staphylococcus
KPKATYYDLVLQNKSLLSVSKIAK

SEQ ID NO: 2073854 - protein, 22 aa, Staphylococcus
KPKHLKTYRTIFNHISVETMNS

SEQ ID NO: 2073855 - protein, 21 aa, Staphylococcus
KPKIGAYHFTTIKPNLGVVST

SEQ ID NO: 2073856 - protein, 17 aa, Staphylococcus
KPKMEGRQMFIMLAPIN

SEQ ID NO: 2073857 - protein, 18 aa, Staphylococcus
KPKMEGRQMFLMLSPINE

SEQ ID NO: 2073858 - protein, 20 aa, Staphylococcus
KPLEDTFGLKRVAYTTYQAV

SEQ ID NO: 2073859 - protein, 29 aa, Staphylococcus
KPLIIYGHMSPYMVVGMIGAIKAGCGYVP

SEQ ID NO: 2073860 - protein, 29 aa, Staphylococcus
KPLIVYGHMSPYMLVGMIGAIKAGCGYVP

SEQ ID NO: 2073861 - protein, 19 aa, Staphylococcus
KPLLKEMFLKHQEIDEAFR

SEQ ID NO: 2073862 - protein, 29 aa, Staphylococcus
KPLPVENQILIIFALTKGYLDDIPVEDIT

SEQ ID NO: 2073863 - protein, 20 aa, Staphylococcus
KPLSILYMHYDYWFTYEEDH

SEQ ID NO: 2073864 - protein, 25 aa, Staphylococcus
KPLSILYMHYDYWFTYEFQHKIHTV

SEQ ID NO: 2073865 - protein, 23 aa, Staphylococcus
KPNFDRYYNTYPTTQIEASGLDV

SEQ ID NO: 2073866 - protein, 19 aa, Staphylococcus
KPNFTIISAPHFKADPSID

SEQ ID NO: 2073867 - protein, 24 aa, Staphylococcus
KPNSRYMVFYNDELTLYTKTNINS

SEQ ID NO: 2073868 - protein, 24 aa, Staphylococcus
KPNSRYMVFYNDGLNLYTKTSNKS

SEQ ID NO: 2073869 - protein, 20 aa, Staphylococcus
KPPYRFEIEMLKSQIFDPKL

SEQ ID NO: 2073870 - protein, 18 aa, Staphylococcus
KPQIIAAGRLEYEKGFDL

SEQ ID NO: 2073871 - protein, 26 aa, Staphylococcus
KPQPNGWILHIPSVYLGIAQAARDYA

SEQ ID NO: 2073872 - protein, 22 aa, Staphylococcus
KPQRFETGFRRKPHEDELMAES

SEQ ID NO: 2073873 - protein, 19 aa, Staphylococcus
KPRGLFRKKKFSPIVGDIV

SEQ ID NO: 2073874 - protein, 18 aa, Staphylococcus
KPRGLFRKKKFSPVVGDI

SEQ ID NO: 2073875 - protein, 21 aa, Staphylococcus
KPRLPHIRDKLVKHLCVELGY

SEQ ID NO: 2073876 - protein, 17 aa, Staphylococcus
KPRSEALPINRGDLSRF

SEQ ID NO: 2073877 - protein, 31 aa, Staphylococcus
KPSEETTLLTLRLAELFRASTIPAGLVQIVP

SEQ ID NO: 2073878 - protein, 31 aa, Staphylococcus
KPSEETTLLTLRLAQLFKASTIPAGLVQIVP

SEQ ID NO: 2073879 - protein, 20 aa, Staphylococcus
KPSRLIEHLAERIAKRINSH

SEQ ID NO: 2073880 - protein, 17 aa, Staphylococcus
KPSVFFLKDGKAREVIK

SEQ ID NO: 2073881 - protein, 29 aa, Staphylococcus
KPTFKKERTVYLPNAFHPLLDKETVVSNT

SEQ ID NO: 2073882 - protein, 28 aa, Staphylococcus
KPTHFNAILANRIRKYTPLLKPKHLSQY

SEQ ID NO: 2073883 - protein, 22 aa, Staphylococcus
KPTIEELLINNGMKYYMVGSTY

SEQ ID NO: 2073884 - protein, 18 aa, Staphylococcus
KPTPEGIELLNYIKRIFT

SEQ ID NO: 2073885 - protein, 21 aa, Staphylococcus
KPTQHYIFNKNNIKGLSNVII

SEQ ID NO: 2073886 - protein, 18 aa, Staphylococcus
KPVIREKMSRRKKTAAKK

SEQ ID NO: 2073887 - protein, 18 aa, Staphylococcus
KPVIREKMSRRKKTAANK

SEQ ID NO: 2073888 - protein, 20 aa, Staphylococcus
KPVKDLGIKALNKYKLQVKL

SEQ ID NO: 2073889 - protein, 20 aa, Staphylococcus
KPVLLYAPTWHKDTVQQHLT

SEQ ID NO: 2073890 - protein, 17 aa, Staphylococcus
KPVPINGFRYYDGGSYS

SEQ ID NO: 2073891 - protein, 18 aa, Staphylococcus
KPWDIAAQFLFAKELNLK

SEQ ID NO: 2073892 - protein, 18 aa, Staphylococcus
KPWDIAAQFLFASELGLK

SEQ ID NO: 2073893 - protein, 18 aa, Staphylococcus
KPYFLNDEQIQWVEETLS

SEQ ID NO: 2073894 - protein, 19 aa, Staphylococcus
KPYIEGFVTMLAPIAPHIG

SEQ ID NO: 2073895 - protein, 17 aa, Staphylococcus
KPYITIFSKDNPPQIYN

SEQ ID NO: 2073896 - protein, 19 aa, Staphylococcus
KPYLKDWSIERLLKSDRII

SEQ ID NO: 2073897 - protein, 28 aa, Staphylococcus
KPYQQPLNILFEDDYLIVVSKPPYQNCA

SEQ ID NO: 2073898 - protein, 21 aa, Staphylococcus
KPYTIAKHYADEYLKQADVGY

SEQ ID NO: 2073899 - protein, 19 aa, Staphylococcus
KPYTIAKHYSDDYLRNSGL

SEQ ID NO: 2073900 - protein, 19 aa, Staphylococcus
KPYYFNYFGLEESAYMDDY

SEQ ID NO: 2073901 - protein, 25 aa, Staphylococcus
KQADVILYDRLVNRELLDYATAGTK

SEQ ID NO: 2073902 - protein, 24 aa, Staphylococcus
KQAENVNNYLFKGSLAGVDGRLQS

SEQ ID NO: 2073903 - protein, 24 aa, Staphylococcus
KQCKNEFLRYPYIESFENIDEVIQ

SEQ ID NO: 2073904 - protein, 29 aa, Staphylococcus
KQCLGLPQTRLRKLLKKMDYYIKFEDSNN

SEQ ID NO: 2073905 - protein, 26 aa, Staphylococcus
KQDDLRYQFLQKYWNTLPKKGDINIY

SEQ ID NO: 2073906 - protein, 21 aa, Staphylococcus
KQDGLMLRKVTYKWYNILLET

SEQ ID NO: 2073907 - protein, 18 aa, Staphylococcus
KQDILDNKILVVARRDRN

SEQ ID NO: 2073908 - protein, 28 aa, Staphylococcus
KQDVYFLNGPLDLTFIFGLVDHLSHKLN

SEQ ID NO: 2073909 - protein, 26 aa, Staphylococcus
KQEHGLDMIMIDYLQLIQGSGSRLSD

SEQ ID NO: 2073910 - protein, 27 aa, Staphylococcus
KQEHGLDMIVIDYLQLISGSGSRFSDN

SEQ ID NO: 2073911 - protein, 29 aa, Staphylococcus
KQEMFYGEKFGHFYQLELAIQNYIIFYND

SEQ ID NO: 2073912 - protein, 17 aa, Staphylococcus
KQEQQALRQDYLAMIRG

SEQ ID NO: 2073913 - protein, 23 aa, Staphylococcus
KQEVRLHIIQLDTPLFEQYQKVD

SEQ ID NO: 2073914 - protein, 27 aa, Staphylococcus
KQFDQIFDLLAIRVIVNSINDCYAILG

SEQ ID NO: 2073915 - protein, 25 aa, Staphylococcus
KQFDQIFDLLAVRIIVDSIKDCYAV

SEQ ID NO: 2073916 - protein, 25 aa, Staphylococcus
KQFFNDPMLSVYLYKEVDKKRFQEL

SEQ ID NO: 2073917 - protein, 20 aa, Staphylococcus
KQFHRDVVPYVKKIDGLTEE

SEQ ID NO: 2073918 - protein, 20 aa, Staphylococcus
KQFIRVCRYFVDQLRQSQSG

SEQ ID NO: 2073919 - protein, 24 aa, Staphylococcus
KQFQAMYMMLNALKYPYPNSNKKF

SEQ ID NO: 2073920 - protein, 30 aa, Staphylococcus
KQFSEQIYNGLWFSPLTDSLKIFVDSTQAH

SEQ ID NO: 2073921 - protein, 29 aa, Staphylococcus
KQFSEQIYNGLWFSPLTDSLKLFIDSTQQ

SEQ ID NO: 2073922 - protein, 17 aa, Staphylococcus
KQGDILTERLKQHFPAI

SEQ ID NO: 2073923 - protein, 31 aa, Staphylococcus
KQGEYKNKYPLILVHGFFGGVGENRPVFYPN

SEQ ID NO: 2073924 - protein, 17 aa, Staphylococcus
KQGTKFLLLAQADWHEG

SEQ ID NO: 2073925 - protein, 19 aa, Staphylococcus
KQHKIQYALLKILKKQILT

SEQ ID NO: 2073926 - protein, 25 aa, Staphylococcus
KQIDKGIIVTIFPDGSDRYMSKQIF

SEQ ID NO: 2073927 - protein, 23 aa, Staphylococcus
KQIDKTIFPGIQGGPLEHVIAAK

SEQ ID NO: 2073928 - protein, 17 aa, Staphylococcus
KQILVYSGLFKEARKKL

SEQ ID NO: 2073929 - protein, 20 aa, Staphylococcus
KQIMTDACKILVVAGKQVKL

SEQ ID NO: 2073930 - protein, 24 aa, Staphylococcus
KQIRKMIGYLPQDFDFYPNMKVKE

SEQ ID NO: 2073931 - protein, 22 aa, Staphylococcus
KQISRLHIIQMSHPIFKQYQTI

SEQ ID NO: 2073932 - protein, 22 aa, Staphylococcus
KQKALYKQELAWMRTGAKARTT

SEQ ID NO: 2073933 - protein, 23 aa, Staphylococcus
KQKDMPLMLLNWNTLTGNSNLTN

SEQ ID NO: 2073934 - protein, 24 aa, Staphylococcus
KQKETEIITPQYTQQAPLAPATST

SEQ ID NO: 2073935 - protein, 20 aa, Staphylococcus
KQKFNFQDLPQFTPEIFMKV

SEQ ID NO: 2073936 - protein, 25 aa, Staphylococcus
KQKIKQLLSLLQLLNKIKSKQDLRL

SEQ ID NO: 2073937 - protein, 17 aa, Staphylococcus
KQKLAIAVSLMNKPKYL

SEQ ID NO: 2073938 - protein, 24 aa, Staphylococcus
KQKLRYLYGITERQFHNTFIEAGK

SEQ ID NO: 2073939 - protein, 17 aa, Staphylococcus
KQKPRVVILNKKDITNL

SEQ ID NO: 2073940 - protein, 26 aa, Staphylococcus
KQKYQTLPIFITYHKKEDISETTAYE

SEQ ID NO: 2073941 - protein, 19 aa, Staphylococcus
KQLDHLASYYKFKQPSLLY

SEQ ID NO: 2073942 - protein, 23 aa, Staphylococcus
KQLDKWYKIEKLKQLITFVIVNR

SEQ ID NO: 2073943 - protein, 27 aa, Staphylococcus
KQLDSASHFMLIFARKNVTSQSPYVQN

SEQ ID NO: 2073944 - protein, 20 aa, Staphylococcus
KQLDTASHFVLIFARKNVTS

SEQ ID NO: 2073945 - protein, 25 aa, Staphylococcus
KQLDYLSSYYKFKQPTLLYEQQIQR

SEQ ID NO: 2073946 - protein, 23 aa, Staphylococcus
KQLEALSYIGLNYLTLARETTSL

SEQ ID NO: 2073947 - protein, 27 aa, Staphylococcus
KQLEENVHNYLIKLSLDKVKAARHRVK

SEQ ID NO: 2073948 - protein, 23 aa, Staphylococcus
KQLESFIINLLEFESRKPRLPHI

SEQ ID NO: 2073949 - protein, 22 aa, Staphylococcus
KQLFMNGPSQELLKRAFNISYY

SEQ ID NO: 2073950 - protein, 24 aa, Staphylococcus
KQLGAMALFGEKYGEIVRVVNMAP

SEQ ID NO: 2073951 - protein, 30 aa, Staphylococcus
KQLGIVLFETLKLPIIKKTKTGYSTAVDVL

SEQ ID NO: 2073952 - protein, 25 aa, Staphylococcus
KQLKDKSLPLIVTTIQKMSKAIQNN

SEQ ID NO: 2073953 - protein, 24 aa, Staphylococcus
KQLLDIRVVITRPANDPALFDATV

SEQ ID NO: 2073954 - protein, 17 aa, Staphylococcus
KQLLKHSYMVFQDVNTQ

SEQ ID NO: 2073955 - protein, 20 aa, Staphylococcus
KQLLVDMIAVQDLEKSAKEL

SEQ ID NO: 2073956 - protein, 27 aa, Staphylococcus
KQLNDFAINGLYPDLTIYLDITAEVGR

SEQ ID NO: 2073957 - protein, 21 aa, Staphylococcus
KQLNSASHFVLILARKNVTPT

SEQ ID NO: 2073958 - protein, 28 aa, Staphylococcus
KQLPSEESYFLFYVNRPSIIVGKNQNTI

SEQ ID NO: 2073959 - protein, 23 aa, Staphylococcus
KQLQHISSYYKFKQPSLLYDQQI

SEQ ID NO: 2073960 - protein, 24 aa, Staphylococcus
KQLSEFIIAFILDDYKKMKTSFIN

SEQ ID NO: 2073961 - protein, 20 aa, Staphylococcus
KQLTQYLPKYMIPNTFTAID

SEQ ID NO: 2073962 - protein, 25 aa, Staphylococcus
KQLYNQMNIDWIKVEDIKAPSYWYY

SEQ ID NO: 2073963 - protein, 23 aa, Staphylococcus
KQLYSPVQFIKSTEWLIDQGVDH

SEQ ID NO: 2073964 - protein, 25 aa, Staphylococcus
KQMGFQITSVLPKALFLSEQKYHHH

SEQ ID NO: 2073965 - protein, 26 aa, Staphylococcus
KQNDKQRALYKQELAWMRAGAKARST

SEQ ID NO: 2073966 - protein, 19 aa, Staphylococcus
KQNFSFQDLPQFTPEIFMK

SEQ ID NO: 2073967 - protein, 17 aa, Staphylococcus
KQNLYAHDIIYTTNGRL

SEQ ID NO: 2073968 - protein, 23 aa, Staphylococcus
KQNNYILSFIKDGATIAVSYCDV

SEQ ID NO: 2073969 - protein, 22 aa, Staphylococcus
KQPMLMDFIRQNSVDPSVIFSK

SEQ ID NO: 2073970 - protein, 19 aa, Staphylococcus
KQQDLHPIIIHGGGPFINQ

SEQ ID NO: 2073971 - protein, 26 aa, Staphylococcus
KQQDNHLPLEIYVELVYGIQQEMVYK

SEQ ID NO: 2073972 - protein, 22 aa, Staphylococcus
KQQEDYCIIIAYFVDGEPKLSY

SEQ ID NO: 2073973 - protein, 21 aa, Staphylococcus
KQQEDYCIILGYFVDGEPKLS

SEQ ID NO: 2073974 - protein, 21 aa, Staphylococcus
KQQEDYCIILGYFVEGEPMLS

SEQ ID NO: 2073975 - protein, 20 aa, Staphylococcus
KQQERTILNDKLTELKEQRQ

SEQ ID NO: 2073976 - protein, 25 aa, Staphylococcus
KQQFDTLTYFQIKLMIVGIERGDLV

SEQ ID NO: 2073977 - protein, 18 aa, Staphylococcus
KQQFNKWKNGETGYPIVD

SEQ ID NO: 2073978 - protein, 31 aa, Staphylococcus
KQQMKENPLGDPIILIAPTQSTFQLEQSFVN

SEQ ID NO: 2073979 - protein, 28 aa, Staphylococcus
KQQPGESYISYLLRVKNSKLWQSKDNGF

SEQ ID NO: 2073980 - protein, 24 aa, Staphylococcus
KQQTDYCIILSYFADGEAQLSYIY

SEQ ID NO: 2073981 - protein, 21 aa, Staphylococcus
KQQVLPILMNIIELECFNKAD

SEQ ID NO: 2073982 - protein, 30 aa, Staphylococcus
KQQYGDLSLLDTPTFFFGMRNGETVEIEID

SEQ ID NO: 2073983 - protein, 24 aa, Staphylococcus
KQRIAIARALIAQPKLLLADEPTG

SEQ ID NO: 2073984 - protein, 22 aa, Staphylococcus
KQRLRIVDFYNKKGFKFAEAIY

SEQ ID NO: 2073985 - protein, 23 aa, Staphylococcus
KQRRSDLTAIRNSGKVPAVMYGY

SEQ ID NO: 2073986 - protein, 25 aa, Staphylococcus
KQRVAIARALITHPKLLLADEPTGA

SEQ ID NO: 2073987 - protein, 24 aa, Staphylococcus
KQSFIEYLLFHYEFKSRISVWVLN

SEQ ID NO: 2073988 - protein, 34 aa, Staphylococcus
KQSFLEYLLFQYRFKSRITVWVLNYLKANHDKLN

SEQ ID NO: 2073989 - protein, 23 aa, Staphylococcus
KQSGLAYNISYASKAFTCLQMVK

SEQ ID NO: 2073990 - protein, 17 aa, Staphylococcus
KQSHAYIFSGPRGTGKT

SEQ ID NO: 2073991 - protein, 20 aa, Staphylococcus
KQSIYSLRYEEMQDWLVEHG

SEQ ID NO: 2073992 - protein, 22 aa, Staphylococcus
KQSQLIFDQQLLSWMEQRHIDI

SEQ ID NO: 2073993 - protein, 23 aa, Staphylococcus
KQSTSGIYSYLPLAARVLNNIEA

SEQ ID NO: 2073994 - protein, 20 aa, Staphylococcus
KQSYDLIIPIPSPVERDINR

SEQ ID NO: 2073995 - protein, 32 aa, Staphylococcus
KQSYHNLLSLKIFNYIPFFNELDMTCVYINEP

SEQ ID NO: 2073996 - protein, 23 aa, Staphylococcus
KQTDITFMLTWRPWDLVGEISSN

SEQ ID NO: 2073997 - protein, 30 aa, Staphylococcus
KQTFVNLLAFIEQFPHYFIGSNADIPLVGG

SEQ ID NO: 2073998 - protein, 23 aa, Staphylococcus
KQTKEILFQLLDSPVQFTQHIGG

SEQ ID NO: 2073999 - protein, 26 aa, Staphylococcus
KQTRDFVYIDDLVAALWMVLNHSCTN

SEQ ID NO: 2074000 - protein, 40 aa, Staphylococcus
KQTTRSVLSYVLDKIMKMLHPFMPFVTETIWQSLPHEGET

SEQ ID NO: 2074001 - protein, 17 aa, Staphylococcus
KQTYDLPIKDEWLIYWG

SEQ ID NO: 2074002 - protein, 24 aa, Staphylococcus
KQVDTPLYLFPTKSYIKKDPYGTV

SEQ ID NO: 2074003 - protein, 21 aa, Staphylococcus
KQVILFAPTFRGSGHHTAHYP

SEQ ID NO: 2074004 - protein, 25 aa, Staphylococcus
KQVKELMELLPRYKYDNIFNSNKFK

SEQ ID NO: 2074005 - protein, 26 aa, Staphylococcus
KQVKKTFPGYVLVELIMTDESWYVVR

SEQ ID NO: 2074006 - protein, 19 aa, Staphylococcus
KQVLLIDRIQDPGNLGTLI

SEQ ID NO: 2074007 - protein, 20 aa, Staphylococcus
KQVNPLKLDLTNEASIKTAI

SEQ ID NO: 2074008 - protein, 25 aa, Staphylococcus
KQVNTPLYLFPAKSYIKKEPLGTVL

SEQ ID NO: 2074009 - protein, 26 aa, Staphylococcus
KQVSRIPLSLTFDHQILDGAGAAEFL

SEQ ID NO: 2074010 - protein, 27 aa, Staphylococcus
KQVSRIPLSLTFDHQILDGASAADFLK

SEQ ID NO: 2074011 - protein, 21 aa, Staphylococcus
KQVVVHINGGKFNGIIPISQL

SEQ ID NO: 2074012 - protein, 20 aa, Staphylococcus
KQVVVHINGGKYNGIIPISQ

SEQ ID NO: 2074013 - protein, 20 aa, Staphylococcus
KQYAFDLKLINEKRPHVLTA

SEQ ID NO: 2074014 - protein, 29 aa, Staphylococcus
KQYDKNQILSFYLNNIYFGDNQYTVEGAA

SEQ ID NO: 2074015 - protein, 19 aa, Staphylococcus
KQYGFVKRFQVVEPSLNEI

SEQ ID NO: 2074016 - protein, 17 aa, Staphylococcus
KQYNEILGAFIVGPHAT

SEQ ID NO: 2074017 - protein, 26 aa, Staphylococcus
KQYPHTVLFVTHDRYFLNEIASRIIE

SEQ ID NO: 2074018 - protein, 24 aa, Staphylococcus
KQYPHTVLFVTHDRYFLNEVSSRI

SEQ ID NO: 2074019 - protein, 26 aa, Staphylococcus
KQYPHTVLFVTHDRYFLNEVSTRIIE

SEQ ID NO: 2074020 - protein, 19 aa, Staphylococcus
KQYTDMPFLLMFDEHEGGY

SEQ ID NO: 2074021 - protein, 31 aa, Staphylococcus
KRAELYEMLTDREMEILLLIAKGYSNQEIAS

SEQ ID NO: 2074022 - protein, 20 aa, Staphylococcus
KRAFLDKTLERKAVWDKWMD

SEQ ID NO: 2074023 - protein, 25 aa, Staphylococcus
KRAGAWFDRLKFLMKSLEESMVIPD

SEQ ID NO: 2074024 - protein, 17 aa, Staphylococcus
KRAIGHLYKNKIITIES

SEQ ID NO: 2074025 - protein, 27 aa, Staphylococcus
KRAKSFGMKIIAFDPYLTAEKAQELDI

SEQ ID NO: 2074026 - protein, 18 aa, Staphylococcus
KRALSRVLNSYGLNSKII

SEQ ID NO: 2074027 - protein, 28 aa, Staphylococcus
KRARRDIEMLLGSKVYLELWVKVQKDWR

SEQ ID NO: 2074028 - protein, 22 aa, Staphylococcus
KRAWKWRQLFNKHSSRFIAGYK

SEQ ID NO: 2074029 - protein, 26 aa, Staphylococcus
KRCINKVIILLPLNKPCKINLNGSTI

SEQ ID NO: 2074030 - protein, 24 aa, Staphylococcus
KRDGQILTKEEIEFFIEGYTNGDT

SEQ ID NO: 2074031 - protein, 19 aa, Staphylococcus
KRDIFFHHPYESFQPIVDF

SEQ ID NO: 2074032 - protein, 31 aa, Staphylococcus
KRDKLYYSTLYINNKLFYIGANKNKDKAALM

SEQ ID NO: 2074033 - protein, 22 aa, Staphylococcus
KRDRMYIELFEEADIDEIIHRL

SEQ ID NO: 2074034 - protein, 25 aa, Staphylococcus
KRDYDFDYIFIDVPPTINSDFTNNA

SEQ ID NO: 2074035 - protein, 19 aa, Staphylococcus
KREHLKLKPAYFPVKDEEG

SEQ ID NO: 2074036 - protein, 22 aa, Staphylococcus
KREHMVFPGMVYISHPTEYGTL

SEQ ID NO: 2074037 - protein, 34 aa, Staphylococcus
KRELRNHFRDILYSPYITGIELPFTDQYNHKLKF

SEQ ID NO: 2074038 - protein, 30 aa, Staphylococcus
KRELRNHFRDVLYSPYITSIELPFTDKFKD

SEQ ID NO: 2074039 - protein, 19 aa, Staphylococcus
KREPIEDYTLVSLLQKVGE

SEQ ID NO: 2074040 - protein, 19 aa, Staphylococcus
KREYEIKTFTRQKKLKLIK

SEQ ID NO: 2074041 - protein, 18 aa, Staphylococcus
KRFDTTPSIVLLTCYMLT

SEQ ID NO: 2074042 - protein, 19 aa, Staphylococcus
KRFIREFRNVNVDEYEVGQ

SEQ ID NO: 2074043 - protein, 25 aa, Staphylococcus
KRFSKLIIVPMFLYDGRLVNKVKKL

SEQ ID NO: 2074044 - protein, 24 aa, Staphylococcus
KRFSYTYMHLLNEIYVDDALVTFD

SEQ ID NO: 2074045 - protein, 26 aa, Staphylococcus
KRGGKVWIKIFPHTPYTQKPLEVRMG

SEQ ID NO: 2074046 - protein, 24 aa, Staphylococcus
KRGIEPFIINTIIKSVTFSSKVID

SEQ ID NO: 2074047 - protein, 21 aa, Staphylococcus
KRGIFTIGDLAQYPYRYLKRD

SEQ ID NO: 2074048 - protein, 24 aa, Staphylococcus
KRGTAQRILYSAFDLVEERSGRQA

SEQ ID NO: 2074049 - protein, 36 aa, Staphylococcus
KRGTDILVESLFYNTPARLKYIKSLYTELGKITDIV

SEQ ID NO: 2074050 - protein, 31 aa, Staphylococcus
KRHAKRRLTYHTFLALYKQILKDDGEIHFKT

SEQ ID NO: 2074051 - protein, 29 aa, Staphylococcus
KRHAKRRLTYHTFLALYQQILKEDGEIHF

SEQ ID NO: 2074052 - protein, 23 aa, Staphylococcus
KRHTKRRLTYQTYLALYKQVLKD

SEQ ID NO: 2074053 - protein, 20 aa, Staphylococcus
KRIAIEYSLPKWLVDHWTTH

SEQ ID NO: 2074054 - protein, 24 aa, Staphylococcus
KRILGKFSYVFTTLKVIANPKIYQ

SEQ ID NO: 2074055 - protein, 21 aa, Staphylococcus
KRIQFLNHLAAELGLTQVSFV

SEQ ID NO: 2074056 - protein, 19 aa, Staphylococcus
KRIQRFNPDYLFVGMGVPK

SEQ ID NO: 2074057 - protein, 17 aa, Staphylococcus
KRKDVDLAIQFIKDIRP

SEQ ID NO: 2074058 - protein, 20 aa, Staphylococcus
KRKERILLTGDLPSPANPPT

SEQ ID NO: 2074059 - protein, 29 aa, Staphylococcus
KRKGLEPFVDWLLLPKLDVDITTKAASFL

SEQ ID NO: 2074060 - protein, 20 aa, Staphylococcus
KRKGLEPLAKWLKQSEINEK

SEQ ID NO: 2074061 - protein, 24 aa, Staphylococcus
KRKINILIGLLSQPKILILDEPTV

SEQ ID NO: 2074062 - protein, 21 aa, Staphylococcus
KRKLDLGWIVSECPSSVAYVQ

SEQ ID NO: 2074063 - protein, 21 aa, Staphylococcus
KRKLIDMIFVIEYDENQDEEE

SEQ ID NO: 2074064 - protein, 20 aa, Staphylococcus
KRKLQTLVDVGLGYVKLGQP

SEQ ID NO: 2074065 - protein, 17 aa, Staphylococcus
KRLEGIGWNALFIENHD

SEQ ID NO: 2074066 - protein, 20 aa, Staphylococcus
KRLKPYLIPDYFDTNEILAI

SEQ ID NO: 2074067 - protein, 24 aa, Staphylococcus
KRLNKTVAILLDTKGPEIRTHNMK

SEQ ID NO: 2074068 - protein, 17 aa, Staphylococcus
KRLQNNPIRTFMCDDCK

SEQ ID NO: 2074069 - protein, 30 aa, Staphylococcus
KRLRELQFALYDRKIPLILVFEGMDAAGKG

SEQ ID NO: 2074070 - protein, 26 aa, Staphylococcus
KRLSEICGLLIKYGKPIDTPVALIHL

SEQ ID NO: 2074071 - protein, 27 aa, Staphylococcus
KRLTAGTFFIKLNEKQVPEFKNKHLRL

SEQ ID NO: 2074072 - protein, 30 aa, Staphylococcus
KRMEGYQDARWILLDLANVVVHIFHKDERP

SEQ ID NO: 2074073 - protein, 19 aa, Staphylococcus
KRMETIAKLFKIDMKNFHN

SEQ ID NO: 2074074 - protein, 30 aa, Staphylococcus
KRMREIQFALYDRKIPLILVFEGMDAAGKG

SEQ ID NO: 2074075 - protein, 30 aa, Staphylococcus
KRMREIQFALYERKIPLILTFEGMDAAGKG

SEQ ID NO: 2074076 - protein, 17 aa, Staphylococcus
KRMTFIGVGIISVEFAS

SEQ ID NO: 2074077 - protein, 26 aa, Staphylococcus
KRNEMSLLLYISSDWFHERGYSFFEY

SEQ ID NO: 2074078 - protein, 19 aa, Staphylococcus
KRNIVYKVFFCLTKEIGIK

SEQ ID NO: 2074079 - protein, 27 aa, Staphylococcus
KRPAFFTSAFYRKLFDQVLYQSENCMV

SEQ ID NO: 2074080 - protein, 25 aa, Staphylococcus
KRPEAGLLALRKNLELYANLRPTKV

SEQ ID NO: 2074081 - protein, 17 aa, Staphylococcus
KRPHFQALTPLYPEERI

SEQ ID NO: 2074082 - protein, 17 aa, Staphylococcus
KRPIVPYHSYNVAKSAL

SEQ ID NO: 2074083 - protein, 20 aa, Staphylococcus
KRPMHSALNKTMFSGKMWLS

SEQ ID NO: 2074084 - protein, 22 aa, Staphylococcus
KRPQDLIFLSDMKKEFEKSVTA

SEQ ID NO: 2074085 - protein, 22 aa, Staphylococcus
KRQEKLLNGMWQFPMVDADNAE

SEQ ID NO: 2074086 - protein, 42 aa, Staphylococcus
KRQKVSMIFQHFNLLWSRTVISNIMFPLEIAGVARTEAKKRA

SEQ ID NO: 2074087 - protein, 29 aa, Staphylococcus
KRQKVSMIFQHFNLLWSRTVLDNITFPLE

SEQ ID NO: 2074088 - protein, 33 aa, Staphylococcus
KRQKVSMIFQHFNLLWSRTVLKNITFPLEIAGL

SEQ ID NO: 2074089 - protein, 34 aa, Staphylococcus; identical to SEQ ID NO: 1829415

SEQ ID NO: 2074090 - protein, 32 aa, Staphylococcus
KRQKVSMIFQHFNLLWSRTVLNNITFPLEIAG

SEQ ID NO: 2074091 - protein, 25 aa, Staphylococcus
KRRGDFEKVIPLIDLYDNAQSDTAN

SEQ ID NO: 2074092 - protein, 20 aa, Staphylococcus
KRRVDELTSALLTKGYKAEG

SEQ ID NO: 2074093 - protein, 23 aa, Staphylococcus
KRSLNLVSPIRYIGSIKKENVFL

SEQ ID NO: 2074094 - protein, 28 aa, Staphylococcus
KRTDGIPAGLLTYPPLMAADIVLYNTNI

SEQ ID NO: 2074095 - protein, 20 aa, Staphylococcus
KRVGFKIISVQHDNGWVCIV

SEQ ID NO: 2074096 - protein, 22 aa, Staphylococcus
KRVGFNIISINHDNGWACIVGE

SEQ ID NO: 2074097 - protein, 21 aa, Staphylococcus
KRVLDMNDRALRYVNVGLGGS

SEQ ID NO: 2074098 - protein, 18 aa, Staphylococcus
KRVLKPQGVYYATFADLT

SEQ ID NO: 2074099 - protein, 20 aa, Staphylococcus
KRVLTPPPVKKLALEHDIAV

SEQ ID NO: 2074100 - protein, 27 aa, Staphylococcus
KRVTDGILLLFPLKDAVEVQHFITNVE

SEQ ID NO: 2074101 - protein, 18 aa, Staphylococcus
KRWTLTQLTGPNDKREYV

SEQ ID NO: 2074102 - protein, 25 aa, Staphylococcus
KRYDKNLIIIFKDIDNTHKQIIEAF

SEQ ID NO: 2074103 - protein, 21 aa, Staphylococcus
KRYEFDLKLINEKRPHILDAE

SEQ ID NO: 2074104 - protein, 19 aa, Staphylococcus
KRYEPKDLFAVVMDAKTGE

SEQ ID NO: 2074105 - protein, 20 aa, Staphylococcus
KRYFIFIGKINSYSGNLNHL

SEQ ID NO: 2074106 - protein, 18 aa, Staphylococcus
KRYLLEESFELFEAIDNE

SEQ ID NO: 2074107 - protein, 18 aa, Staphylococcus
KRYLLEETFELFEAIDNK

SEQ ID NO: 2074108 - protein, 26 aa, Staphylococcus
KRYPNYEFIWVFKNPSKVQIPGLAKK

SEQ ID NO: 2074109 - protein, 23 aa, Staphylococcus
KRYQLTRQFKSFEKAAYAWIQDY

SEQ ID NO: 2074110 - protein, 19 aa, Staphylococcus
KRYQPKDLFAVVMDAKTGE

SEQ ID NO: 2074111 - protein, 21 aa, Staphylococcus
KSAIIKPYTPVIYAVKNDEAL

SEQ ID NO: 2074112 - protein, 20 aa, Staphylococcus
KSAQKLLNAMDVNESKRINK

SEQ ID NO: 2074113 - protein, 24 aa, Staphylococcus
KSAVTMITLQYAKGLPHIQINAAD

SEQ ID NO: 2074114 - protein, 21 aa, Staphylococcus
KSAVTMLTVQYAKGLPNMQVN

SEQ ID NO: 2074115 - protein, 25 aa, Staphylococcus
KSAVTMLTVQYAKGLPQMQINAADP

SEQ ID NO: 2074116 - protein, 24 aa, Staphylococcus
KSCHYTEFELKFGPVLLENKNECF

SEQ ID NO: 2074117 - protein, 18 aa, Staphylococcus
KSCVLLDMHIGHLKSVME

SEQ ID NO: 2074118 - protein, 26 aa, Staphylococcus
KSDAFDLLMQLGFPRNIMSLSPFQMS

SEQ ID NO: 2074119 - protein, 25 aa, Staphylococcus
KSDEKILLDQMVSHFKKFEGEFKNA

SEQ ID NO: 2074120 - protein, 25 aa, Staphylococcus
KSDELNRLLIQKFGAGRLITDSEGK

SEQ ID NO: 2074121 - protein, 20 aa, Staphylococcus
KSDERFVIVVQSLEEKNGQL

SEQ ID NO: 2074122 - protein, 22 aa, Staphylococcus
KSDERFVIVVQSLEERNGQLLK

SEQ ID NO: 2074123 - protein, 17 aa, Staphylococcus
KSDEYYLHLFDVTQADL

SEQ ID NO: 2074124 - protein, 26 aa, Staphylococcus
KSDRDYLLFKLAIHTGIRLTDLLNLK

SEQ ID NO: 2074125 - protein, 28 aa, Staphylococcus
KSEDEDIIHLPFIKIKPLSFNEALLNHH

SEQ ID NO: 2074126 - protein, 23 aa, Staphylococcus
KSEDIDMFVPHQANIRIMESARE

SEQ ID NO: 2074127 - protein, 26 aa, Staphylococcus
KSEDKLWHLIRYRKADGRVKIIDEDY

SEQ ID NO: 2074128 - protein, 27 aa, Staphylococcus
KSEKKHIFLYLMYVYKQMMIDDIDRIE

SEQ ID NO: 2074129 - protein, 25 aa, Staphylococcus
KSEKPMTIIAIGPLTNIAILLSTYP

SEQ ID NO: 2074130 - protein, 29 aa, Staphylococcus
KSELATRMRLRIIPELSFEYDKSIDYGNK

SEQ ID NO: 2074131 - protein, 30 aa, Staphylococcus
KSELFFEKRKHFIKVLKKKGFNIGEPDDAV

SEQ ID NO: 2074132 - protein, 27 aa, Staphylococcus
KSELGSRMRLRIIPDLTFEYDESIEYG

SEQ ID NO: 2074133 - protein, 19 aa, Staphylococcus
KSEMKRQPLGDPIVLIAPT

SEQ ID NO: 2074134 - protein, 26 aa, Staphylococcus
KSERLRQFFDFVTNFGLMIKGTGEDI

SEQ ID NO: 2074135 - protein, 27 aa, Staphylococcus
KSESKLTLLALFEKLLSISSYHSIMVP

SEQ ID NO: 2074136 - protein, 28 aa, Staphylococcus
KSEWLKRAEIFIDGFYNFSTLEYRIIEA

SEQ ID NO: 2074137 - protein, 21 aa, Staphylococcus
KSFDEPDASKLPWGDLDIDVV

SEQ ID NO: 2074138 - protein, 21 aa, Staphylococcus
KSFEEPDASKLPWGDLDIDVV

SEQ ID NO: 2074139 - protein, 25 aa, Staphylococcus
KSFGMTVLAYDPFLTKEKAEQLGIE

SEQ ID NO: 2074140 - protein, 20 aa, Staphylococcus
KSFIKNYVLSHSFIKSLVLG

SEQ ID NO: 2074141 - protein, 21 aa, Staphylococcus
KSFINIKDLGFALLETDELDG

SEQ ID NO: 2074142 - protein, 22 aa, Staphylococcus
KSFINIMRVVRTDGYWAMTIAD

SEQ ID NO: 2074143 - protein, 20 aa, Staphylococcus
KSFKSIIEQITGERFDKLEV

SEQ ID NO: 2074144 - protein, 21 aa, Staphylococcus
KSFNIFDFVMLGHLHHPFSIN

SEQ ID NO: 2074145 - protein, 34 aa, Staphylococcus
KSFNNLKHFMAFKYIPFFKHYDITKFTLRNAMPF

SEQ ID NO: 2074146 - protein, 18 aa, Staphylococcus
KSFRSEHHIAPQIELITA

SEQ ID NO: 2074147 - protein, 20 aa, Staphylococcus
KSFSQIISQLTGLKFDKVEA

SEQ ID NO: 2074148 - protein, 26 aa, Staphylococcus
KSFYQQPKFIQYWVKQINKTLSDIPE

SEQ ID NO: 2074149 - protein, 23 aa, Staphylococcus
KSFYTRIDILSRKYPQLMDEMRT

SEQ ID NO: 2074150 - protein, 25 aa, Staphylococcus
KSGELTYQMFLNGMPVFNKDELSTI

SEQ ID NO: 2074151 - protein, 17 aa, Staphylococcus
KSHAGLFKTTRYTKPLV

SEQ ID NO: 2074152 - protein, 18 aa, Staphylococcus
KSHFPDIKVLVLTSYVDD

SEQ ID NO: 2074153 - protein, 25 aa, Staphylococcus
KSHHQLIFFGRYHCIARKPKCDICP

SEQ ID NO: 2074154 - protein, 20 aa, Staphylococcus
KSHIIIFKNKKDIKWKQYNV

SEQ ID NO: 2074155 - protein, 19 aa, Staphylococcus
KSHIWFHTKDIPGSHVVIL

SEQ ID NO: 2074156 - protein, 30 aa, Staphylococcus
KSHLRPFNVEPLPYKVSLQQAITHLEEKLK

SEQ ID NO: 2074157 - protein, 22 aa, Staphylococcus
KSIHYIATVVSVYRKVIDAYAE

SEQ ID NO: 2074158 - protein, 20 aa, Staphylococcus
KSIIKHLGTDQFKRIRIGVG

SEQ ID NO: 2074159 - protein, 17 aa, Staphylococcus
KSIIKKEFSISFEEFAV

SEQ ID NO: 2074160 - protein, 25 aa, Staphylococcus
KSIKNIVKPLLKYAKDRGIYVQMNS

SEQ ID NO: 2074161 - protein, 28 aa, Staphylococcus
KSIKNVVKPLLKYAFDRGIYVQMNSNLT

SEQ ID NO: 2074162 - protein, 27 aa, Staphylococcus
KSIKNVVKPLLKYAYQRGIYVQMNSNL

SEQ ID NO: 2074163 - protein, 21 aa, Staphylococcus
KSILDLPKTMEYLETKGVPVI

SEQ ID NO: 2074164 - protein, 18 aa, Staphylococcus
KSILILQKKKADVTKPVE

SEQ ID NO: 2074165 - protein, 19 aa, Staphylococcus
KSILILQKKKPHVTKSVEV

SEQ ID NO: 2074166 - protein, 20 aa, Staphylococcus
KSILINMIKCVEACGVDVLD

SEQ ID NO: 2074167 - protein, 21 aa, Staphylococcus
KSILINMIKCVEACGVDVLDV

SEQ ID NO: 2074168 - protein, 20 aa, Staphylococcus
KSILINMIKCVESCGVDVLD

SEQ ID NO: 2074169 - protein, 21 aa, Staphylococcus
KSILINMIKCVESCGVDVLDV

SEQ ID NO: 2074170 - protein, 28 aa, Staphylococcus
KSINEFAINGLYPDITIYLDVSVAVGRE

SEQ ID NO: 2074171 - protein, 18 aa, Staphylococcus
KSINKLKQLMLKIAINYI

SEQ ID NO: 2074172 - protein, 22 aa, Staphylococcus
KSINPNLKGQLFKLLEFSNMEE

SEQ ID NO: 2074173 - protein, 23 aa, Staphylococcus
KSISFGLGYQIKYLSEIINKGYS

SEQ ID NO: 2074174 - protein, 24 aa, Staphylococcus
KSISFSHEFMFARPVHQTRDMIKH

SEQ ID NO: 2074175 - protein, 20 aa, Staphylococcus
KSISVPLQYLIAAALEVTDV

SEQ ID NO: 2074176 - protein, 24 aa, Staphylococcus
KSITLNPWGISDLELIGIGGFSPL

SEQ ID NO: 2074177 - protein, 17 aa, Staphylococcus
KSIVFPTVPRGTGRVRN

SEQ ID NO: 2074178 - protein, 24 aa, Staphylococcus
KSIWVWSGFLFETLMHDSGKRRSI

SEQ ID NO: 2074179 - protein, 21 aa, Staphylococcus
KSKEAIYNYVLFEVDKAEKEK

SEQ ID NO: 2074180 - protein, 22 aa, Staphylococcus
KSKFEQWFHPKGASTEVYDFDA

SEQ ID NO: 2074181 - protein, 17 aa, Staphylococcus
KSKHIIYVLLKKYNIKY

SEQ ID NO: 2074182 - protein, 29 aa, Staphylococcus
KSKHVPSTIVYLPEYIRILKGGFKDGSYN

SEQ ID NO: 2074183 - protein, 25 aa, Staphylococcus
KSKKPYTIVIPPPNVTGKLHLGHAW

SEQ ID NO: 2074184 - protein, 21 aa, Staphylococcus
KSKLQHMLSISELERSEYNND

SEQ ID NO: 2074185 - protein, 17 aa, Staphylococcus
KSKLYEYMTLNPRVYKH

SEQ ID NO: 2074186 - protein, 26 aa, Staphylococcus
KSKRDYLFFKFAIHTGVKLSELLNLC

SEQ ID NO: 2074187 - protein, 26 aa, Staphylococcus
KSKRDYLFFKLAIHTGIRLTDLLKLE

SEQ ID NO: 2074188 - protein, 19 aa, Staphylococcus
KSKTVIISTGARFKNLDIP

SEQ ID NO: 2074189 - protein, 26 aa, Staphylococcus
KSKVTFDLPIVWAQSTRYLNSQDSDT

SEQ ID NO: 2074190 - protein, 17 aa, Staphylococcus
KSKYYISVLCAGTSDLP

SEQ ID NO: 2074191 - protein, 28 aa, Staphylococcus
KSLAEEAILTQFFILLNRIFIKNESPTH

SEQ ID NO: 2074192 - protein, 24 aa, Staphylococcus
KSLARFISTIRSFHQFALRERYAA

SEQ ID NO: 2074193 - protein, 31 aa, Staphylococcus
KSLCDIYPLLNRSLLYSAIILHDIGKVRELS

SEQ ID NO: 2074194 - protein, 25 aa, Staphylococcus
KSLDKKILRKILKYSFVEYKEFMDK

SEQ ID NO: 2074195 - protein, 21 aa, Staphylococcus
KSLEIRYYESFAKTHQGHGTD

SEQ ID NO: 2074196 - protein, 21 aa, Staphylococcus
KSLFNSIPKLDPNYEKTRINN

SEQ ID NO: 2074197 - protein, 24 aa, Staphylococcus
KSLIEEGLEWVLIQGQLGIEMWTA

SEQ ID NO: 2074198 - protein, 17 aa, Staphylococcus
KSLINRSLSFFNQIGEV

SEQ ID NO: 2074199 - protein, 31 aa, Staphylococcus
KSLKKGVQMIHESLLRALKDNGLEEIESEGQ

SEQ ID NO: 2074200 - protein, 20 aa, Staphylococcus
KSLKKWQMLFDGWFYDYTWK

SEQ ID NO: 2074201 - protein, 24 aa, Staphylococcus
KSLLEDQIYILKQFIDQMLIEKPD

SEQ ID NO: 2074202 - protein, 20 aa, Staphylococcus
KSLLQYVSGLSSAIAQNIID

SEQ ID NO: 2074203 - protein, 20 aa, Staphylococcus
KSLLQYVSGLSSTIAQNIID

SEQ ID NO: 2074204 - protein, 27 aa, Staphylococcus
KSLQLLDTPGILWPKFEDQTVGKKLSL

SEQ ID NO: 2074205 - protein, 19 aa, Staphylococcus
KSLQPFLNKYLSQPEFVEV

SEQ ID NO: 2074206 - protein, 19 aa, Staphylococcus
KSLSFSHEFMFARPLNQTD

SEQ ID NO: 2074207 - protein, 24 aa, Staphylococcus
KSLSKEEIEFFIKGYTNGDIPDYQ

SEQ ID NO: 2074208 - protein, 29 aa, Staphylococcus
KSLSTAKIILIDTYYLIMGAYHKKAQQTV

SEQ ID NO: 2074209 - protein, 23 aa, Staphylococcus
KSLTLTHEFMFARPVFNTDDMIK

SEQ ID NO: 2074210 - protein, 26 aa, Staphylococcus
KSLTNNFTYFFPHKIRDFLAEKTNKI

SEQ ID NO: 2074211 - protein, 19 aa, Staphylococcus
KSMLGWRPIGTQEEAILEA

SEQ ID NO: 2074212 - protein, 22 aa, Staphylococcus
KSNDSIYIFKYNDASILNVETL

SEQ ID NO: 2074213 - protein, 24 aa, Staphylococcus
KSNEFEMEPLLLTLKPGASYKTFN

SEQ ID NO: 2074214 - protein, 24 aa, Staphylococcus
KSNFNDLSYFNYGNLYKARDIELN

SEQ ID NO: 2074215 - protein, 23 aa, Staphylococcus
KSNIYPFILYYQKQLIAIGFIDE

SEQ ID NO: 2074216 - protein, 31 aa, Staphylococcus
KSNKTILNYLWDQFPNMNEKDIRAVLGRFLF

SEQ ID NO: 2074217 - protein, 18 aa, Staphylococcus
KSNLKSILMMKKAFEIIK

SEQ ID NO: 2074218 - protein, 24 aa, Staphylococcus
KSNQSLFKTTRFNKPLIATKLKNE

SEQ ID NO: 2074219 - protein, 21 aa, Staphylococcus
KSNYHLSSEPTYHRSSFKTSE

SEQ ID NO: 2074220 - protein, 17 aa, Staphylococcus
KSNYILKYVFANGISRD

SEQ ID NO: 2074221 - protein, 24 aa, Staphylococcus
KSNYILKYVFANGISREIIYPLLE

SEQ ID NO: 2074222 - protein, 25 aa, Staphylococcus
KSNYILKYVFANRISRSVIYPLLEQ

SEQ ID NO: 2074223 - protein, 26 aa, Staphylococcus
KSPQHTRIFISPLARNMAEDKALDIN

SEQ ID NO: 2074224 - protein, 19 aa, Staphylococcus
KSPWASFKKGKWSSEVDVR

SEQ ID NO: 2074225 - protein, 20 aa, Staphylococcus
KSPYIILDDSDIDGAAEAAV

SEQ ID NO: 2074226 - protein, 25 aa, Staphylococcus
KSQEAFVIYYLKQLNVDLDVIIFNS

SEQ ID NO: 2074227 - protein, 28 aa, Staphylococcus
KSQKVASTIVYLPEYIRSLKNGFKDGSY

SEQ ID NO: 2074228 - protein, 22 aa, Staphylococcus
KSQLDAYFNLLQSYFCEINNIS

SEQ ID NO: 2074229 - protein, 18 aa, Staphylococcus
KSQRVLVFAKGDKAAEAE

SEQ ID NO: 2074230 - protein, 22 aa, Staphylococcus
KSRIATQYPYKAWLAKHKIDLH

SEQ ID NO: 2074231 - protein, 23 aa, Staphylococcus
KSRLTIKQLFIVEPERFDIELIE

SEQ ID NO: 2074232 - protein, 20 aa, Staphylococcus
KSSILPLIKDNKVTAKAVFD

SEQ ID NO: 2074233 - protein, 18 aa, Staphylococcus
KSSILPLIKENKVTAKAV

SEQ ID NO: 2074234 - protein, 23 aa, Staphylococcus
KSSLAFDTIYAEGQRRYVESLSA

SEQ ID NO: 2074235 - protein, 25 aa, Staphylococcus
KSSLVNEILYKSLAQKINKSKIKPG

SEQ ID NO: 2074236 - protein, 25 aa, Staphylococcus
KSSTMRVDAIIKKRLSQMALDKDTS

SEQ ID NO: 2074237 - protein, 21 aa, Staphylococcus
KSSTRLMLTAALAPLKVQENR

SEQ ID NO: 2074238 - protein, 24 aa, Staphylococcus
KSSVTMIIGLLKKLKHNDATTYNT

SEQ ID NO: 2074239 - protein, 24 aa, Staphylococcus
KSTLINIIGFIDRGYQGDYLFNGK

SEQ ID NO: 2074240 - protein, 24 aa, Staphylococcus
KSTLLKALSRLLSIKEGAIHLDGK

SEQ ID NO: 2074241 - protein, 26 aa, Staphylococcus
KSTLLKALSRLLSIKKGQIILDGESI

SEQ ID NO: 2074242 - protein, 21 aa, Staphylococcus
KSTLLKALSRLLTIKNGEIQL

SEQ ID NO: 2074243 - protein, 25 aa, Staphylococcus
KSTLLKVILGLLPLQKGEIFVEGKM

SEQ ID NO: 2074244 - protein, 25 aa, Staphylococcus
KSTLLKVILGLLPLQRGEIYIDGKS

SEQ ID NO: 2074245 - protein, 24 aa, Staphylococcus
KSTLLKVMLGLLPLQTGEMFIDGI

SEQ ID NO: 2074246 - protein, 17 aa, Staphylococcus
KSTLLNILGGLLSPSSG

SEQ ID NO: 2074247 - protein, 20 aa, Staphylococcus
KSTLLRCMNLLETPSNGKVI

SEQ ID NO: 2074248 - protein, 21 aa, Staphylococcus
KSTLLRCMNLLETPTKGQVIF

SEQ ID NO: 2074249 - protein, 21 aa, Staphylococcus
KSTLLRCMNLLETPTNGRVIF

SEQ ID NO: 2074250 - protein, 26 aa, Staphylococcus
KSTPEKSLLQPLPKKAGRNNQGKLTV

SEQ ID NO: 2074251 - protein, 23 aa, Staphylococcus
KSTTIKHMLGLLTPMQGALSISN

SEQ ID NO: 2074252 - protein, 24 aa, Staphylococcus
KSTTIKIILGLLKPTNGNVKLFGQ

SEQ ID NO: 2074253 - protein, 17 aa, Staphylococcus
KSVDEFLKKTLMFPIID

SEQ ID NO: 2074254 - protein, 26 aa, Staphylococcus
KSVDFKFDYIIPERLQSFVQIGVRVI

SEQ ID NO: 2074255 - protein, 29 aa, Staphylococcus
KSVEAYFNCHLFYRTSKGIFLNEEGKLVF

SEQ ID NO: 2074256 - protein, 28 aa, Staphylococcus
KSVGFMMDLNFLGTFIPSQVFATDMLDK

SEQ ID NO: 2074257 - protein, 17 aa, Staphylococcus
KSVLKFAQKRYNISDIS

SEQ ID NO: 2074258 - protein, 25 aa, Staphylococcus
KSVLLELGLIIGKDARRKREVIGRK

SEQ ID NO: 2074259 - protein, 25 aa, Staphylococcus
KSVSFTHEFMFTRPIFQTEDMIKHH

SEQ ID NO: 2074260 - protein, 27 aa, Staphylococcus
KSWEKIGVRLVDKLLETFPVHDKEVAH

SEQ ID NO: 2074261 - protein, 20 aa, Staphylococcus
KSYDLYYDGDKFYQLTTDMF

SEQ ID NO: 2074262 - protein, 20 aa, Staphylococcus
KSYELMLINPKIVSYSVQEA

SEQ ID NO: 2074263 - protein, 19 aa, Staphylococcus
KSYGLALENSASIYKYLVL

SEQ ID NO: 2074264 - protein, 17 aa, Staphylococcus
KSYGRPFEELENGIFAV

SEQ ID NO: 2074265 - protein, 24 aa, Staphylococcus
KTAEYDFRWQPDILSRSIRDLKVA

SEQ ID NO: 2074266 - protein, 35 aa, Staphylococcus
KTAIHHILDIRDPNLWMLFGTLPIYPCIKDENDQA

SEQ ID NO: 2074267 - protein, 18 aa, Staphylococcus
KTAIPNIALTTDIIVGYP

SEQ ID NO: 2074268 - protein, 22 aa, Staphylococcus
KTALHIPVLFVPGNHDYWKVED

SEQ ID NO: 2074269 - protein, 31 aa, Staphylococcus
KTALSKEYDLYLLDLMLPHMDGLEICRKIRE

SEQ ID NO: 2074270 - protein, 25 aa, Staphylococcus
KTAMPPFREFAWVQDKFGVSFQLAL

SEQ ID NO: 2074271 - protein, 19 aa, Staphylococcus
KTAQWLKQTPLLENREREW

SEQ ID NO: 2074272 - protein, 20 aa, Staphylococcus
KTARNFNPLCAMAAKTTVVE

SEQ ID NO: 2074273 - protein, 24 aa, Staphylococcus
KTARRPMILPVIMKVNEDKGNNKP

SEQ ID NO: 2074274 - protein, 22 aa, Staphylococcus
KTDAQIVEILKNQIDTLNNQIE

SEQ ID NO: 2074275 - protein, 29 aa, Staphylococcus
KTDDLSTDLVWYLWTGKYSSLFGKRAMTT

SEQ ID NO: 2074276 - protein, 18 aa, Staphylococcus
KTDEYYLHLFDVTQADLN

SEQ ID NO: 2074277 - protein, 21 aa, Staphylococcus
KTDEYYLHLFDVTQADLNWDN

SEQ ID NO: 2074278 - protein, 17 aa, Staphylococcus
KTDIIFLDEPTTYLDIC

SEQ ID NO: 2074279 - protein, 25 aa, Staphylococcus
KTDILRDMIIINLQGILTPAEYRVC

SEQ ID NO: 2074280 - protein, 27 aa, Staphylococcus
KTEAYFDRVLLLNKTLRYLGPTKSVVN

SEQ ID NO: 2074281 - protein, 24 aa, Staphylococcus
KTEKGIIDYLLTFDSQLFNTYLYV

SEQ ID NO: 2074282 - protein, 19 aa, Staphylococcus
KTELPIEGILLLSPMLELK

SEQ ID NO: 2074283 - protein, 23 aa, Staphylococcus
KTELSKRFSTIQDYLLEYCNFGC

SEQ ID NO: 2074284 - protein, 35 aa, Staphylococcus
KTELTKPFFEQGGAMIDDWMGFTPMGRPGLPEELG

SEQ ID NO: 2074285 - protein, 19 aa, Staphylococcus
KTESCFFSIFVSPDYQEHG

SEQ ID NO: 2074286 - protein, 23 aa, Staphylococcus
KTESYYLNLPDLINPKTFYNQNQ

SEQ ID NO: 2074287 - protein, 38 aa, Staphylococcus
KTETPLRHVLPFNKHNRYLVMPALSDELKIVGLKTVSF

SEQ ID NO: 2074288 - protein, 34 aa, Staphylococcus
KTETPLRYVLPFNKENRYLVMPALSDELNIVGIK

SEQ ID NO: 2074289 - protein, 22 aa, Staphylococcus
KTEYDLLYLLATNRNHVLQREQ

SEQ ID NO: 2074290 - protein, 17 aa, Staphylococcus
KTFCNMLEHVMRSLAIQ

SEQ ID NO: 2074291 - protein, 17 aa, Staphylococcus
KTFFSLPEPKVSQIDVE

SEQ ID NO: 2074292 - protein, 18 aa, Staphylococcus
KTFNILKQSPYKEAFEFI

SEQ ID NO: 2074293 - protein, 28 aa, Staphylococcus
KTFQIRLPRYRLLIGGYFRIIDNERGIK

SEQ ID NO: 2074294 - protein, 20 aa, Staphylococcus
KTGAFGIPLIEKVVGEQGVQ

SEQ ID NO: 2074295 - protein, 17 aa, Staphylococcus
KTGAFGIPLIEKVVGKS

SEQ ID NO: 2074296 - protein, 20 aa, Staphylococcus
KTGAFGIPLIEKVVNKSGVQ

SEQ ID NO: 2074297 - protein, 21 aa, Staphylococcus
KTGAGFIVALTGAIMTMPGLP

SEQ ID NO: 2074298 - protein, 21 aa, Staphylococcus
KTGITIMYMVKKLDAGNIISQ

SEQ ID NO: 2074299 - protein, 20 aa, Staphylococcus
KTGLALIEGYHLIEEAYKSK

SEQ ID NO: 2074300 - protein, 21 aa, Staphylococcus
KTGLTYMTLGQPLSTLSGGEM

SEQ ID NO: 2074301 - protein, 22 aa, Staphylococcus
KTGNWLDSLKFLTKSLEESMVI

SEQ ID NO: 2074302 - protein, 24 aa, Staphylococcus
KTGSIIVYKLFFIETYHTVHQMTS

SEQ ID NO: 2074303 - protein, 21 aa, Staphylococcus
KTGTVKVYKPFHIETYSTVFQ

SEQ ID NO: 2074304 - protein, 17 aa, Staphylococcus
KTHLMHAIGHYVLDNNP

SEQ ID NO: 2074305 - protein, 22 aa, Staphylococcus
KTHTLNFLPGRTLYINVDKSER

SEQ ID NO: 2074306 - protein, 20 aa, Staphylococcus
KTIIRGLRAVSDFEYELRLT

SEQ ID NO: 2074307 - protein, 21 aa, Staphylococcus
KTIIRGLRAVSDFEYELRLTS

SEQ ID NO: 2074308 - protein, 17 aa, Staphylococcus
KTIKVMVADYQFDPLKN

SEQ ID NO: 2074309 - protein, 17 aa, Staphylococcus
KTIKVMVSDYQFDPLKN

SEQ ID NO: 2074310 - protein, 25 aa, Staphylococcus
KTINAPMVGTFYKSPSPEEGAYVQV

SEQ ID NO: 2074311 - protein, 21 aa, Staphylococcus
KTINQEGCLIAMHLNKALSED

SEQ ID NO: 2074312 - protein, 27 aa, Staphylococcus
KTITSPMVGTFFLQDSKELTDPIIQVG

SEQ ID NO: 2074313 - protein, 27 aa, Staphylococcus
KTIYEISKRTVLFLIDKDITVYGATIA

SEQ ID NO: 2074314 - protein, 29 aa, Staphylococcus
KTIYEISKRTVLFLIQKDITVYGATIACL

SEQ ID NO: 2074315 - protein, 27 aa, Staphylococcus
KTIYEISKRTVLFLISKDITVYGSTIE

SEQ ID NO: 2074316 - protein, 28 aa, Staphylococcus
KTIYEISKRTVLFLISKDITVYGTTISC

SEQ ID NO: 2074317 - protein, 30 aa, Staphylococcus
KTKALIALIDAVRITLRNALSLVGVNAPET

SEQ ID NO: 2074318 - protein, 29 aa, Staphylococcus
KTKDKFIRPIRQKVGLVFQFPESQLFEDN

SEQ ID NO: 2074319 - protein, 24 aa, Staphylococcus
KTKDKYLRPIRKKVGMVFQFPESQ

SEQ ID NO: 2074320 - protein, 24 aa, Staphylococcus
KTKDLFENILGFNSSKKGENALRF

SEQ ID NO: 2074321 - protein, 25 aa, Staphylococcus
KTKHPHIRLYILGDGPLKETLVNMI

SEQ ID NO: 2074322 - protein, 25 aa, Staphylococcus
KTKKYKVISLILKIGIMTKLTMNTF

SEQ ID NO: 2074323 - protein, 25 aa, Staphylococcus
KTKLYKFFLIVTKYIKRKEAFYRAI

SEQ ID NO: 2074324 - protein, 25 aa, Staphylococcus
KTKNKWRAYITIQKKRKHLGYFNYE

SEQ ID NO: 2074325 - protein, 26 aa, Staphylococcus
KTKQVDTPLFMFPAKSYIKQEPYGTV

SEQ ID NO: 2074326 - protein, 28 aa, Staphylococcus
KTKQVETPLYLFPTKSYIKNEPYGTVLI

SEQ ID NO: 2074327 - protein, 28 aa, Staphylococcus
KTKTLYTDLLFLYLEHAFIEQNFYDIPS

SEQ ID NO: 2074328 - protein, 26 aa, Staphylococcus
KTKTTFTDLLFLHLEASFITEDFYDI

SEQ ID NO: 2074329 - protein, 31 aa, Staphylococcus
KTKTVFTDLLFLNLERAFLSQNFYDVPSIHP

SEQ ID NO: 2074330 - protein, 31 aa, Staphylococcus
KTKTVYTDLLFLYLEKAFLSQNFFDIPMMHS

SEQ ID NO: 2074331 - protein, 32 aa, Staphylococcus
KTKTVYTDLLFLYLERAFLSQNFFDIPTIHPQ

SEQ ID NO: 2074332 - protein, 32 aa, Staphylococcus
KTKTVYTDLLFLYLERAFLTQNFFEIPTIHAQ

SEQ ID NO: 2074333 - protein, 23 aa, Staphylococcus
KTKVGPFAQLRPGSNLGSDVKVG

SEQ ID NO: 2074334 - protein, 22 aa, Staphylococcus
KTKVGPFAQLRPGSNLGTEVKV

SEQ ID NO: 2074335 - protein, 24 aa, Staphylococcus
KTLAYALNCKLYGVSSLKALAATV

SEQ ID NO: 2074336 - protein, 31 aa, Staphylococcus
KTLDEVYLLPYVPFEYFWKRYQQEIKKSITV

SEQ ID NO: 2074337 - protein, 25 aa, Staphylococcus
KTLEDPGMRWELGVIWKKDKYLSHA

SEQ ID NO: 2074338 - protein, 24 aa, Staphylococcus
KTLEELLVLNALHIPLHAGKIEEM

SEQ ID NO: 2074339 - protein, 25 aa, Staphylococcus
KTLEQEFDFIIFDTAPTGHTLRMLE

SEQ ID NO: 2074340 - protein, 17 aa, Staphylococcus
KTLERKATWDSWMAKDM

SEQ ID NO: 2074341 - protein, 29 aa, Staphylococcus
KTLKLQTKIIIVTTFKRPGYFEKAVANDV

SEQ ID NO: 2074342 - protein, 19 aa, Staphylococcus
KTLKTALIEMLYVETTHRN

SEQ ID NO: 2074343 - protein, 22 aa, Staphylococcus
KTLNELLVLNAIHVPLHAGKIE

SEQ ID NO: 2074344 - protein, 28 aa, Staphylococcus
KTLPETSYSKIYLFTTDLAQITQFRQSL

SEQ ID NO: 2074345 - protein, 22 aa, Staphylococcus
KTLQFCKNWLEQEGLEPVRLSN

SEQ ID NO: 2074346 - protein, 18 aa, Staphylococcus
KTLQQKLGKTFIFVTHDM

SEQ ID NO: 2074347 - protein, 24 aa, Staphylococcus
KTLSAIACRGGLLKPIVGGTYYIN

SEQ ID NO: 2074348 - protein, 28 aa, Staphylococcus
KTLTATLPLYLNALTGKSVFLLTTNDYL

SEQ ID NO: 2074349 - protein, 20 aa, Staphylococcus
KTLTIKLRKNAKWSNGDPVT

SEQ ID NO: 2074350 - protein, 29 aa, Staphylococcus
KTMASITFQNYFRMYNKLSGMTGTAKTEE

SEQ ID NO: 2074351 - protein, 20 aa, Staphylococcus
KTMSLSFLKFIWDFPKINDE

SEQ ID NO: 2074352 - protein, 32 aa, Staphylococcus
KTNIEDAILEDLPFISGFVGSCSFDLVRHAFP

SEQ ID NO: 2074353 - protein, 24 aa, Staphylococcus
KTNIPFLINVIRNKHFQNGDYTTK

SEQ ID NO: 2074354 - protein, 24 aa, Staphylococcus
KTNIPFLINVMRNDKFRSGDYTTK

SEQ ID NO: 2074355 - protein, 24 aa, Staphylococcus
KTNIPFLINVMRNDQFRSGDYTTK

SEQ ID NO: 2074356 - protein, 23 aa, Staphylococcus
KTNIPFLINVMRNEQFRSGDYTT

SEQ ID NO: 2074357 - protein, 21 aa, Staphylococcus
KTNLLESIYVLALAKSHRTAN

SEQ ID NO: 2074358 - protein, 23 aa, Staphylococcus
KTNNTMLLITPKYDKAGLLASIL

SEQ ID NO: 2074359 - protein, 23 aa, Staphylococcus
KTNPLLEQLNFIAIFASNLDEFF

SEQ ID NO: 2074360 - protein, 26 aa, Staphylococcus
KTPILCIDVWEHAYYLKYQNKRPDYI

SEQ ID NO: 2074361 - protein, 23 aa, Staphylococcus
KTPSNAFFLKTTTIKDPKYAGYN

SEQ ID NO: 2074362 - protein, 34 aa, Staphylococcus
KTPSQLFQFFMSYTIGRFDVSLITLLGVHQGLGH

SEQ ID NO: 2074363 - protein, 17 aa, Staphylococcus
KTQFIVITHRKGTMEYS

SEQ ID NO: 2074364 - protein, 18 aa, Staphylococcus
KTQRVLVFAKGDKASEAE

SEQ ID NO: 2074365 - protein, 23 aa, Staphylococcus
KTQSAFLSDYYYYLIEIGYKEKA

SEQ ID NO: 2074366 - protein, 22 aa, Staphylococcus
KTQSAFLSDYYYYLLEIGDKNH

SEQ ID NO: 2074367 - protein, 17 aa, Staphylococcus
KTRDVWQALHEQNWYYT

SEQ ID NO: 2074368 - protein, 27 aa, Staphylococcus
KTRLSLAQMLLNEPDLLLLDEPTNHLD

SEQ ID NO: 2074369 - protein, 32 aa, Staphylococcus
KTRLSLAQMLLNEPNLLLLDEPTNHLDLETTK

SEQ ID NO: 2074370 - protein, 32 aa, Staphylococcus
KTRLSLAQMLLNNPDLLLLDEPTNHLDMETTQ

SEQ ID NO: 2074371 - protein, 24 aa, Staphylococcus
KTRRHLIEFWMIEPEMAFCEHAQS

SEQ ID NO: 2074372 - protein, 26 aa, Staphylococcus
KTSIATMIHLIYRGLDKNSAYLGTNG

SEQ ID NO: 2074373 - protein, 26 aa, Staphylococcus
KTSIATMIHLIYRKLHKNSAYLGTNG

SEQ ID NO: 2074374 - protein, 26 aa, Staphylococcus
KTSIATMIHLIYRKLNKNSAYLGTNG

SEQ ID NO: 2074375 - protein, 26 aa, Staphylococcus
KTSIATMIHLIYRKLNKSSAYLGTNG

SEQ ID NO: 2074376 - protein, 25 aa, Staphylococcus
KTSIIGINPNWLTKPRLGEMFKPIV

SEQ ID NO: 2074377 - protein, 24 aa, Staphylococcus
KTSKQIMRLFQKINQRQQTILMVT

SEQ ID NO: 2074378 - protein, 18 aa, Staphylococcus
KTTHGHMMTFHYDQTFKS

SEQ ID NO: 2074379 - protein, 18 aa, Staphylococcus
KTTIFGAMKCSNFGKEIS

SEQ ID NO: 2074380 - protein, 24 aa, Staphylococcus
KTTLIKLLRNPFISEKSITFIENL

SEQ ID NO: 2074381 - protein, 18 aa, Staphylococcus
KTTLLRLIAGLETPDNGV

SEQ ID NO: 2074382 - protein, 24 aa, Staphylococcus
KTTLLRMMNALEIPSDGTVYVNGK

SEQ ID NO: 2074383 - protein, 24 aa, Staphylococcus
KTTLLRMMNALEIPTEGTVFVNGK

SEQ ID NO: 2074384 - protein, 23 aa, Staphylococcus
KTTLLRMMNALEIPTEGTVSVNG

SEQ ID NO: 2074385 - protein, 23 aa, Staphylococcus
KTTLLRMMNALELPTEGQVWVNG

SEQ ID NO: 2074386 - protein, 21 aa, Staphylococcus
KTTLLTILGGLLSPTSGKLIY

SEQ ID NO: 2074387 - protein, 17 aa, Staphylococcus
KTTLMAHTIRLLKQHNL

SEQ ID NO: 2074388 - protein, 26 aa, Staphylococcus
KTTPEKSLLQPLPKKAGRNNQGKLTV

SEQ ID NO: 2074389 - protein, 41 aa, Staphylococcus
KTTTAGKLALLMRKKYNKKPLLVAADIYRPAAIDQLETVGK

SEQ ID NO: 2074390 - protein, 24 aa, Staphylococcus
KTTTITFKFMTPLNYETITQRSVL

SEQ ID NO: 2074391 - protein, 30 aa, Staphylococcus
KTTTQYQRFIRHIQFLIYRLTKGENVDAQD

SEQ ID NO: 2074392 - protein, 25 aa, Staphylococcus
KTTTTERILYYTGRIHKIGETHEGA

SEQ ID NO: 2074393 - protein, 28 aa, Staphylococcus
KTVDNPLQDIYLVGLMRSVIYQFTEDEL

SEQ ID NO: 2074394 - protein, 24 aa, Staphylococcus
KTVIDYYHKFIDRFPTIADLSNAQ

SEQ ID NO: 2074395 - protein, 24 aa, Staphylococcus
KTVIDYYHKFISRFPTIEDLSQAN

SEQ ID NO: 2074396 - protein, 25 aa, Staphylococcus
KTVIDYYHRFIQRFPTIKELSDAHE

SEQ ID NO: 2074397 - protein, 23 aa, Staphylococcus
KTVIDYYNKFIHRFPTIEALSEA

SEQ ID NO: 2074398 - protein, 18 aa, Staphylococcus
KTVIGDDSFIGCNTNLVA

SEQ ID NO: 2074399 - protein, 20 aa, Staphylococcus
KTVIISTGASWRKLNIPGED

SEQ ID NO: 2074400 - protein, 27 aa, Staphylococcus
KTVKRLSPEYFYYLSRAKYWINNQNFP

SEQ ID NO: 2074401 - protein, 31 aa, Staphylococcus
KTVLDLIEDYRYLDLFPVGRLDKDTEGLLLI

SEQ ID NO: 2074402 - protein, 26 aa, Staphylococcus
KTVNAPMVGTFFLQDTKDLTEPLVKV

SEQ ID NO: 2074403 - protein, 23 aa, Staphylococcus
KTVNYLIGTMIETPRACLIAGQL

SEQ ID NO: 2074404 - protein, 25 aa, Staphylococcus
KTVPEDLFFIISLSGETYQLTEVTQ

SEQ ID NO: 2074405 - protein, 19 aa, Staphylococcus
KTVPTVLKGGLSAGSTGSA

SEQ ID NO: 2074406 - protein, 20 aa, Staphylococcus
KTWNKFDKQVLFTGIFNSEK

SEQ ID NO: 2074407 - protein, 17 aa, Staphylococcus
KTWSHDVTPLPFDLFNK

SEQ ID NO: 2074408 - protein, 27 aa, Staphylococcus
KTYDDVEFKLYLGLKHISPYIEEAVEK

SEQ ID NO: 2074409 - protein, 21 aa, Staphylococcus
KTYDILRRLNFDYYLIDIENI

SEQ ID NO: 2074410 - protein, 21 aa, Staphylococcus
KTYDLEVWLPSYDNYKEISSC

SEQ ID NO: 2074411 - protein, 17 aa, Staphylococcus
KTYIQYIYDLKIYKDNR

SEQ ID NO: 2074412 - protein, 17 aa, Staphylococcus
KTYLWQKLEEKLNHLNL

SEQ ID NO: 2074413 - protein, 31 aa, Staphylococcus
KTYMDPMAKIIRNKLRRLGIKKGIPVVFSDE

SEQ ID NO: 2074414 - protein, 29 aa, Staphylococcus
KTYPSNEIIIPKFPPVIGAYVLSLIENNQ

SEQ ID NO: 2074415 - protein, 17 aa, Staphylococcus
KVAAMDFIFKDDPAELK

SEQ ID NO: 2074416 - protein, 33 aa, Staphylococcus
KVAFYVAQWPTVRLNHWLALLKARAIENDMFII

SEQ ID NO: 2074417 - protein, 25 aa, Staphylococcus
KVAGELLCQYYFEKFGVDTRSVRFP

SEQ ID NO: 2074418 - protein, 18 aa, Staphylococcus
KVAINNLRKREIEGLVVI

SEQ ID NO: 2074419 - protein, 22 aa, Staphylococcus
KVAKLPYSIRVLLESVLRQEDG

SEQ ID NO: 2074420 - protein, 22 aa, Staphylococcus
KVAPPFRVAEVDIMYGKGISKE

SEQ ID NO: 2074421 - protein, 22 aa, Staphylococcus
KVAQEYWYIHDGYMEKIKGTFE

SEQ ID NO: 2074422 - protein, 18 aa, Staphylococcus
KVARLICDIYKTDGTPFE

SEQ ID NO: 2074423 - protein, 17 aa, Staphylococcus
KVARLICDVFKTDGTPF

SEQ ID NO: 2074424 - protein, 31 aa, Staphylococcus
KVDDLLDALHLWLLRINYLNQPKSYPSINTA

SEQ ID NO: 2074425 - protein, 31 aa, Staphylococcus
KVDIAGPGFINFYLDNQYLTDIIPEAIQKGD

SEQ ID NO: 2074426 - protein, 23 aa, Staphylococcus
KVDKFAQLLEEIKQQLNSTADAV

SEQ ID NO: 2074427 - protein, 19 aa, Staphylococcus
KVDKIGLVGLKSSLVKKLK

SEQ ID NO: 2074428 - protein, 24 aa, Staphylococcus
KVDKKAKELLATTVQRLAADHTTE

SEQ ID NO: 2074429 - protein, 23 aa, Staphylococcus
KVDQQLYLIFDLMHEGQFGFTDT

SEQ ID NO: 2074430 - protein, 25 aa, Staphylococcus
KVDRPKYLEYFDYFATPEGEKDTRL

SEQ ID NO: 2074431 - protein, 27 aa, Staphylococcus
KVEEPLLIKIQANLPPSRGLGSSAAVA

SEQ ID NO: 2074432 - protein, 25 aa, Staphylococcus
KVEEYVDIVEIGTPIVINEGLPSVQ

SEQ ID NO: 2074433 - protein, 20 aa, Staphylococcus
KVEIKWPNDIYINDKKVCGF

SEQ ID NO: 2074434 - protein, 31 aa, Staphylococcus
KVEINKPLWMNPLLKLYQLAPRKIEKYFTSL

SEQ ID NO: 2074435 - protein, 26 aa, Staphylococcus
KVELFIRAYHKYYRQYEIHNIKEFAG

SEQ ID NO: 2074436 - protein, 29 aa, Staphylococcus
KVERYINLLRLFYALDVYIEQSGPITIVK

SEQ ID NO: 2074437 - protein, 22 aa, Staphylococcus
KVESIWNFINKIWNAARFSIMN

SEQ ID NO: 2074438 - protein, 17 aa, Staphylococcus
KVESLFYNTPARLKYIK

SEQ ID NO: 2074439 - protein, 24 aa, Staphylococcus
KVESVWNFINKIWNAARFSIMNIG

SEQ ID NO: 2074440 - protein, 25 aa, Staphylococcus
KVESVWNFINKIWNAARFSLMNIGE

SEQ ID NO: 2074441 - protein, 20 aa, Staphylococcus
KVEVWLIDDEADYDQMYINT

SEQ ID NO: 2074442 - protein, 17 aa, Staphylococcus
KVEWVKYAGLPTSEYYD

SEQ ID NO: 2074443 - protein, 32 aa, Staphylococcus
KVEYDVALFSYHKLLEIFFSVIDPTDAEGQYQ

SEQ ID NO: 2074444 - protein, 17 aa, Staphylococcus
KVFGLTASPDYILNIRN

SEQ ID NO: 2074445 - protein, 21 aa, Staphylococcus
KVFNIPLTAFAPHISQTFDLR

SEQ ID NO: 2074446 - protein, 18 aa, Staphylococcus
KVFNLCQKNLRTLTVSHD

SEQ ID NO: 2074447 - protein, 28 aa, Staphylococcus
KVFSNIKGLFLISGFNEPLHNLPELNQF

SEQ ID NO: 2074448 - protein, 18 aa, Staphylococcus
KVFTNIYNTWNSDKFFSL

SEQ ID NO: 2074449 - protein, 20 aa, Staphylococcus
KVFVDLYNKGIIYRGERIIN

SEQ ID NO: 2074450 - protein, 17 aa, Staphylococcus
KVFWRSFDRNGLNYRDQ

SEQ ID NO: 2074451 - protein, 26 aa, Staphylococcus
KVGGRLPGGIKIKRAKLRGERSEGMI

SEQ ID NO: 2074452 - protein, 25 aa, Staphylococcus
KVGNALPLQFIPVGTVIHNIELKPG

SEQ ID NO: 2074453 - protein, 26 aa, Staphylococcus
KVGWGKIPMSLGFTYSSNTLMMHLQD

SEQ ID NO: 2074454 - protein, 23 aa, Staphylococcus
KVHEYPFAAKDSLGRLLCAAAIG

SEQ ID NO: 2074455 - protein, 36 aa, Staphylococcus
KVHIPKCNLPYFISFLSFHNYPIYQVLPLSQKEFIF

SEQ ID NO: 2074456 - protein, 22 aa, Staphylococcus
KVHYLKFIDYYIELLLTYLNEN

SEQ ID NO: 2074457 - protein, 27 aa, Staphylococcus
KVICIDKCYLKDILKDIYKRGIGSLLI

SEQ ID NO: 2074458 - protein, 18 aa, Staphylococcus
KVIDGVRILFVAATAPFT

SEQ ID NO: 2074459 - protein, 19 aa, Staphylococcus
KVIDLVDYRLKPQNISGII

SEQ ID NO: 2074460 - protein, 19 aa, Staphylococcus
KVIFLNIKSHHFSEIAQHL

SEQ ID NO: 2074461 - protein, 22 aa, Staphylococcus
KVIGPFIETNFTLTPELFQQLF

SEQ ID NO: 2074462 - protein, 18 aa, Staphylococcus
KVIGRSWNGLIINYLSRC

SEQ ID NO: 2074463 - protein, 18 aa, Staphylococcus
KVIILTTNLPVQTPYALD

SEQ ID NO: 2074464 - protein, 23 aa, Staphylococcus
KVIITTNALLPRIPKENLPHLET

SEQ ID NO: 2074465 - protein, 17 aa, Staphylococcus
KVIKILETLDHQVKLIG

SEQ ID NO: 2074466 - protein, 19 aa, Staphylococcus
KVILAANKIDLLPKQINKR

SEQ ID NO: 2074467 - protein, 24 aa, Staphylococcus
KVILVKQFRKPAEKPLLEIPAGKL

SEQ ID NO: 2074468 - protein, 17 aa, Staphylococcus
KVINRNKQWRRKIKMIE

SEQ ID NO: 2074469 - protein, 21 aa, Staphylococcus
KVITLNPWSISDLELIGIGGF

SEQ ID NO: 2074470 - protein, 19 aa, Staphylococcus
KVIVIDTYYLMLGGYHKKK

SEQ ID NO: 2074471 - protein, 24 aa, Staphylococcus
KVKELYQLFAHLYTDAITLKEFSE

SEQ ID NO: 2074472 - protein, 35 aa, Staphylococcus
KVKGKHITWYRNAQLLLQDLRLLINQDALVLMKSS

SEQ ID NO: 2074473 - protein, 18 aa, Staphylococcus
KVKHIYKDTPPPIPGELT

SEQ ID NO: 2074474 - protein, 25 aa, Staphylococcus
KVKIPNKPIFSKILLIDVNIGGQYF

SEQ ID NO: 2074475 - protein, 29 aa, Staphylococcus
KVKKNIGMIFQHFNLLNSKTVFSNVAMPL

SEQ ID NO: 2074476 - protein, 20 aa, Staphylococcus
KVKLIKRLSFASGHLGMVGG

SEQ ID NO: 2074477 - protein, 18 aa, Staphylococcus
KVKLTKMSIEELGPVNIN

SEQ ID NO: 2074478 - protein, 19 aa, Staphylococcus
KVKLTKMSIEELGPVNLNA

SEQ ID NO: 2074479 - protein, 18 aa, Staphylococcus
KVKNLLINQIKRSLTYYE

SEQ ID NO: 2074480 - protein, 17 aa, Staphylococcus
KVKNWMSRESEDRLKRI

SEQ ID NO: 2074481 - protein, 23 aa, Staphylococcus
KVKQKVMHSLIQKGYTIETAQNV

SEQ ID NO: 2074482 - protein, 27 aa, Staphylococcus
KVKQTNSYDLAFDELEKEKDFLQVIVK

SEQ ID NO: 2074483 - protein, 28 aa, Staphylococcus
KVKQTNSYDLAFEELEKEKDFLQVLVKD

SEQ ID NO: 2074484 - protein, 29 aa, Staphylococcus
KVKQYALLFDRYKALHDLLGKEYPQLSYI

SEQ ID NO: 2074485 - protein, 25 aa, Staphylococcus
KVKRELGFVLMALNIRKVVAQGAEN

SEQ ID NO: 2074486 - protein, 24 aa, Staphylococcus
KVKRELGFVLMALNIRKVVAQRVE

SEQ ID NO: 2074487 - protein, 29 aa, Staphylococcus
KVKRLHLPQGFNIRVDSLLYAGYQVSPYY

SEQ ID NO: 2074488 - protein, 23 aa, Staphylococcus
KVKTPFPRITYDDAIEYLKEQGF

SEQ ID NO: 2074489 - protein, 21 aa, Staphylococcus
KVKVLLAQSLFGKPDVLLLDE

SEQ ID NO: 2074490 - protein, 20 aa, Staphylococcus
KVLAPLFEAFDVKPEAVTII

SEQ ID NO: 2074491 - protein, 17 aa, Staphylococcus
KVLDLAKERISKISFDT

SEQ ID NO: 2074492 - protein, 18 aa, Staphylococcus
KVLDPLFAGYTFQKSMDI

SEQ ID NO: 2074493 - protein, 20 aa, Staphylococcus
KVLFIHYEIPNEKLEVGIEG

SEQ ID NO: 2074494 - protein, 19 aa, Staphylococcus
KVLFIHYEIPNEQLTTPID

SEQ ID NO: 2074495 - protein, 17 aa, Staphylococcus
KVLFNKVAMRPGSVTTV

SEQ ID NO: 2074496 - protein, 22 aa, Staphylococcus
KVLIARALMGHPKLLILDEPAS

SEQ ID NO: 2074497 - protein, 24 aa, Staphylococcus
KVLKSHVLIFKHSEGFYWQEHEVK

SEQ ID NO: 2074498 - protein, 25 aa, Staphylococcus
KVLLEKGYIVCPYISNDVVLAKRLE

SEQ ID NO: 2074499 - protein, 18 aa, Staphylococcus
KVLLYDDFANLKKWIKTE

SEQ ID NO: 2074500 - protein, 33 aa, Staphylococcus
KVLNEFYGLELSNLYIYKLAVISNMKLQSLSSC

SEQ ID NO: 2074501 - protein, 26 aa, Staphylococcus
KVLQLLDTPGILWPKFEDELVGKKLS

SEQ ID NO: 2074502 - protein, 18 aa, Staphylococcus
KVLQRLAYASGHLGMVGG

SEQ ID NO: 2074503 - protein, 19 aa, Staphylococcus
KVLTMGFIDDLLYPDDQVL

SEQ ID NO: 2074504 - protein, 21 aa, Staphylococcus
KVLTMGFIDDLLYPDDQVRAV

SEQ ID NO: 2074505 - protein, 27 aa, Staphylococcus
KVLTSSDLILYVSYFNHSFTENDKRFI

SEQ ID NO: 2074506 - protein, 17 aa, Staphylococcus
KVLVFDLGGGTFDVSIL

SEQ ID NO: 2074507 - protein, 18 aa, Staphylococcus
KVMAMGRLSPEKGFDILI

SEQ ID NO: 2074508 - protein, 21 aa, Staphylococcus
KVMAWSPLAGGKLFDPSDDKA

SEQ ID NO: 2074509 - protein, 20 aa, Staphylococcus
KVMDLIKMLNTLDVKIVIGG

SEQ ID NO: 2074510 - protein, 18 aa, Staphylococcus
KVMLMPFYSLTNEDDKEL

SEQ ID NO: 2074511 - protein, 18 aa, Staphylococcus
KVMLQEEGNFDYLVAPLT

SEQ ID NO: 2074512 - protein, 19 aa, Staphylococcus
KVMRPVYLNQSKIPTFYIV

SEQ ID NO: 2074513 - protein, 24 aa, Staphylococcus
KVNDNYVLNFVGLGLMVQNAENVQ

SEQ ID NO: 2074514 - protein, 19 aa, Staphylococcus
KVNDVIQRLNYRPNAVARG

SEQ ID NO: 2074515 - protein, 23 aa, Staphylococcus
KVNELPITASILTNVFGLNIFAE

SEQ ID NO: 2074516 - protein, 24 aa, Staphylococcus
KVNGTYVLNFVGLGLIVQNAENVQ

SEQ ID NO: 2074517 - protein, 18 aa, Staphylococcus
KVNLLDFRKTMDYLEGIG

SEQ ID NO: 2074518 - protein, 27 aa, Staphylococcus
KVNQSALPVTLLFTGPLTDLAKALKTE

SEQ ID NO: 2074519 - protein, 26 aa, Staphylococcus
KVNQTEVTVFFLNGFQMKGVIEDFDK

SEQ ID NO: 2074520 - protein, 21 aa, Staphylococcus
KVNVSLIKSVLKFAQKRYNIS

SEQ ID NO: 2074521 - protein, 30 aa, Staphylococcus
KVNYKLRDWLFSRQRYWGEPIPIIHWEDGT

SEQ ID NO: 2074522 - protein, 37 aa, Staphylococcus
KVNYKLRDWLFSRQRYWGEPIPIIHWGDGSMTTVPEE

SEQ ID NO: 2074523 - protein, 27 aa, Staphylococcus
KVNYKLRDWLFSRQRYWGEPIPVIHWE

SEQ ID NO: 2074524 - protein, 20 aa, Staphylococcus
KVNYLTETLGFDAGIDYKKD

SEQ ID NO: 2074525 - protein, 29 aa, Staphylococcus
KVPESYLRKFDYLVFPDNVAITLGVAQAL

SEQ ID NO: 2074526 - protein, 28 aa, Staphylococcus
KVPKLEEELKFLLIPKDPNDDKDVIVEI

SEQ ID NO: 2074527 - protein, 24 aa, Staphylococcus
KVPQQIHDILPKLAEVIKVTTEQF

SEQ ID NO: 2074528 - protein, 22 aa, Staphylococcus
KVPVLMCAQLWPHFDLFSQFLN

SEQ ID NO: 2074529 - protein, 24 aa, Staphylococcus
KVPVYHLDMYFWKPNWQMMRYDEQ

SEQ ID NO: 2074530 - protein, 19 aa, Staphylococcus
KVPWIYGGVVQSTYIEAAF

SEQ ID NO: 2074531 - protein, 20 aa, Staphylococcus
KVQDLVDYRLKPTHFNAILA

SEQ ID NO: 2074532 - protein, 31 aa, Staphylococcus
KVQSLMEAFWPGPISFILPLKSGYLCPKVTG

SEQ ID NO: 2074533 - protein, 19 aa, Staphylococcus
KVQTLLPLYKEVLSSLIQA

SEQ ID NO: 2074534 - protein, 20 aa, Staphylococcus
KVRARVMDTLLLRESRIYYS

SEQ ID NO: 2074535 - protein, 23 aa, Staphylococcus
KVRFHNGSEYLAVSGGFVEVRQH

SEQ ID NO: 2074536 - protein, 21 aa, Staphylococcus
KVRLALKRGTKVERAGRDGLK

SEQ ID NO: 2074537 - protein, 20 aa, Staphylococcus
KVRLALRRGTQVEHAGREGL

SEQ ID NO: 2074538 - protein, 19 aa, Staphylococcus
KVRLMILELLKSKEMTVNE

SEQ ID NO: 2074539 - protein, 31 aa, Staphylococcus
KVSEEEIRFARFRPFPFWKRVHDSFISDGRD

SEQ ID NO: 2074540 - protein, 30 aa, Staphylococcus
KVSFKLIATELLWFIKGDTNIKYLLKYNNN

SEQ ID NO: 2074541 - protein, 30 aa, Staphylococcus; identical to SEQ ID NO: 1829576

SEQ ID NO: 2074542 - protein, 30 aa, Staphylococcus; identical to SEQ ID NO: 1682025

SEQ ID NO: 2074543 - protein, 21 aa, Staphylococcus
KVSHLFKIKVSPMEITFIPRG

SEQ ID NO: 2074544 - protein, 28 aa, Staphylococcus
KVSMVFQHFNLLWSRTVLRNITFPLEIA

SEQ ID NO: 2074545 - protein, 33 aa, Staphylococcus
KVSQIQPGQWIGIFGIGGLGNLALQYAKNVFNA

SEQ ID NO: 2074546 - protein, 22 aa, Staphylococcus
KVSQIYPYLVKEENLWKTNLEN

SEQ ID NO: 2074547 - protein, 23 aa, Staphylococcus
KVSSKYLIATVAAKRARELYDKP

SEQ ID NO: 2074548 - protein, 18 aa, Staphylococcus
KVSVKIPISLLTTPKRKK

SEQ ID NO: 2074549 - protein, 35 aa, Staphylococcus
KVTARFLYAEEFEYTPKFKIWVSTNHKPIIRGTDD

SEQ ID NO: 2074550 - protein, 17 aa, Staphylococcus
KVTLLFTGPLTDLAKAM

SEQ ID NO: 2074551 - protein, 20 aa, Staphylococcus
KVTLLLITHNLSHVLDFSDW

SEQ ID NO: 2074552 - protein, 33 aa, Staphylococcus
KVTSLFLQQQLVNQLIIYFAPKLIGGSGTNQFF

SEQ ID NO: 2074553 - protein, 24 aa, Staphylococcus
KVTTPFPRITYADAVIFLKEQGFD

SEQ ID NO: 2074554 - protein, 17 aa, Staphylococcus
KVVAQLKLTYRPQQLYL

SEQ ID NO: 2074555 - protein, 21 aa, Staphylococcus
KVVAYDPFPNTALAKFVDYKD

SEQ ID NO: 2074556 - protein, 21 aa, Staphylococcus
KVVDLLAPYIKGGKVGLFGGA

SEQ ID NO: 2074557 - protein, 30 aa, Staphylococcus
KVVEDYTVLRGFKPFYIEHGAFSGALGSVY

SEQ ID NO: 2074558 - protein, 17 aa, Staphylococcus
KVVEWLNEYFSGNRPQI

SEQ ID NO: 2074559 - protein, 26 aa, Staphylococcus
KVVFVKQYRKPVEKVLLEIPAGKLEE

SEQ ID NO: 2074560 - protein, 26 aa, Staphylococcus
KVVKKTFPGYVLVELIMTDESWYVVR

SEQ ID NO: 2074561 - protein, 24 aa, Staphylococcus
KVVKTDIAINLPYGYEAQVRPRSG

SEQ ID NO: 2074562 - protein, 28 aa, Staphylococcus
KVVLARRRLIKFDKPISIPYVLNRALNN

SEQ ID NO: 2074563 - protein, 19 aa, Staphylococcus
KVVQFFKKEFTNHGNVICT

SEQ ID NO: 2074564 - protein, 22 aa, Staphylococcus
KVVTGYLRDSGLQKYLDDLGFN

SEQ ID NO: 2074565 - protein, 19 aa, Staphylococcus
KVVTLLHGSYALGLLDEQD

SEQ ID NO: 2074566 - protein, 27 aa, Staphylococcus
KVVVLAADLPVLTPFSLSELIEKMEER

SEQ ID NO: 2074567 - protein, 20 aa, Staphylococcus
KVYDHIIIDTPPINTVTDAQ

SEQ ID NO: 2074568 - protein, 24 aa, Staphylococcus
KVYHETLQAFYDLGARYIQLDDVY

SEQ ID NO: 2074569 - protein, 19 aa, Staphylococcus
KVYIEPLTHDFIARIIRKE

SEQ ID NO: 2074570 - protein, 20 aa, Staphylococcus
KVYIEPLTHDFIARIIRKEQ

SEQ ID NO: 2074571 - protein, 35 aa, Staphylococcus
KVYKEGKPNFIFLNTQYLVEIGLDLPFAMKMNQKL

SEQ ID NO: 2074572 - protein, 19 aa, Staphylococcus
KVYLFKEWKTEKGIINYLL

SEQ ID NO: 2074573 - protein, 34 aa, Staphylococcus
KVYNTNVFGIVRMMNTFIPLLEKSEQPVVVNVSS

SEQ ID NO: 2074574 - protein, 20 aa, Staphylococcus
KVYPIKDLDKALRSADIVVN

SEQ ID NO: 2074575 - protein, 33 aa, Staphylococcus
KVYQTNVYGIVRMMNTFIPLLEQSEQPVVVNVT

SEQ ID NO: 2074576 - protein, 24 aa, Staphylococcus
KVYRHFFFNHQQLEILNRLYIPLI

SEQ ID NO: 2074577 - protein, 22 aa, Staphylococcus
KVYTNLKPWDRVQIARLPDRPT

SEQ ID NO: 2074578 - protein, 26 aa, Staphylococcus
KVYVNGVLGQVTFPDSFKVFGSENSK

SEQ ID NO: 2074579 - protein, 29 aa, Staphylococcus
KWESEILYPDITMLPKLAKLFNISVDDLL

SEQ ID NO: 2074580 - protein, 19 aa, Staphylococcus
KWFLQDFEVLINGQRETRR

SEQ ID NO: 2074581 - protein, 26 aa, Staphylococcus
KWGERSGLTLFLPHSYEGQGPEHSSA

SEQ ID NO: 2074582 - protein, 20 aa, Staphylococcus
KWITNKLVKKDVFKLRHHHD

SEQ ID NO: 2074583 - protein, 18 aa, Staphylococcus
KWKIGVIPSFSLTNKYKN

SEQ ID NO: 2074584 - protein, 19 aa, Staphylococcus
KWLCEQYKKDWPFDMVVID

SEQ ID NO: 2074585 - protein, 18 aa, Staphylococcus
KWMGMEPEKLYVTIHPED

SEQ ID NO: 2074586 - protein, 18 aa, Staphylococcus
KWQESILLAYLINKTTSF

SEQ ID NO: 2074587 - protein, 22 aa, Staphylococcus
KWRKVIDDFYNSFKLDVARAEK

SEQ ID NO: 2074588 - protein, 25 aa, Staphylococcus
KWRQTLIDVGIGRPGYFRFQAQVMP

SEQ ID NO: 2074589 - protein, 22 aa, Staphylococcus
KWRRMFHQYPELSKYEYKTTQR

SEQ ID NO: 2074590 - protein, 18 aa, Staphylococcus
KWRRTFHQFPEVSQKEYE

SEQ ID NO: 2074591 - protein, 27 aa, Staphylococcus
KWSFQTEMFFLCNRYKQFKDIESLHKG

SEQ ID NO: 2074592 - protein, 25 aa, Staphylococcus
KWSFQTEMFFLCNRYKQIQDIEALE

SEQ ID NO: 2074593 - protein, 26 aa, Staphylococcus
KWSFQTEMFFLCNRYKQLNDLKTLQH

SEQ ID NO: 2074594 - protein, 19 aa, Staphylococcus
KWSQWFKIYGEQESLDLNK

SEQ ID NO: 2074595 - protein, 26 aa, Staphylococcus
KWTNEKYDFLKLKKILMEWQVGIYNG

SEQ ID NO: 2074596 - protein, 24 aa, Staphylococcus
KWVNQAQLLTSKKMLYIANVGEDE

SEQ ID NO: 2074597 - protein, 24 aa, Staphylococcus
KWYKQQFQHIPQYSYVGLLIEDPL

SEQ ID NO: 2074598 - protein, 29 aa, Staphylococcus
KYAAENNITFIPYFPLASGILAGKYEENQ

SEQ ID NO: 2074599 - protein, 17 aa, Staphylococcus
KYCDIFYIGGTKIGALC

SEQ ID NO: 2074600 - protein, 35 aa, Staphylococcus; identical to SEQ ID NO: 1692790

SEQ ID NO: 2074601 - protein, 26 aa, Staphylococcus
KYCPNCGRLLAYDYIHYNQIGHYHCV

SEQ ID NO: 2074602 - protein, 25 aa, Staphylococcus
KYCPNCGRLLQYDYIHYNQIGHYHC

SEQ ID NO: 2074603 - protein, 27 aa, Staphylococcus
KYDCKVYLKREDLQWVRSFKLRGAYNA

SEQ ID NO: 2074604 - protein, 28 aa, Staphylococcus
KYDCKVYLKREDLQWVRSFKLRGAYNAI

SEQ ID NO: 2074605 - protein, 37 aa, Staphylococcus
KYDCKVYLKREDLQWVRSFKLRGAYNAIIALDEADRQ

SEQ ID NO: 2074606 - protein, 26 aa, Staphylococcus
KYDKELLYITSLFHDLGLTETYSSDD

SEQ ID NO: 2074607 - protein, 21 aa, Staphylococcus
KYDLFVLVVTDIINSDSKILV

SEQ ID NO: 2074608 - protein, 23 aa, Staphylococcus
KYDLSYIALDGDIGCMVNGAGLA

SEQ ID NO: 2074609 - protein, 21 aa, Staphylococcus
KYDLYHILFEMVRQYKNALPG

SEQ ID NO: 2074610 - protein, 31 aa, Staphylococcus
KYDNPFNPPMFARVFRKHLEGGFIENIRQIG

SEQ ID NO: 2074611 - protein, 18 aa, Staphylococcus
KYDPSLVLAFKLAKQFSV

SEQ ID NO: 2074612 - protein, 23 aa, Staphylococcus
KYDPTLTLAFKLAKLFDTTVDEL

SEQ ID NO: 2074613 - protein, 17 aa, Staphylococcus
KYDSMIILYGGQGVGKS

SEQ ID NO: 2074614 - protein, 25 aa, Staphylococcus
KYDSQRVMIIAKRPDRFVELVNQGV

SEQ ID NO: 2074615 - protein, 27 aa, Staphylococcus
KYDSTETFLFIWGWNEGKEIFSNNINK

SEQ ID NO: 2074616 - protein, 24 aa, Staphylococcus
KYDTNKWFYKEMPALEQWFKDMTS

SEQ ID NO: 2074617 - protein, 20 aa, Staphylococcus
KYDWEVLLPKVTATLSDESE

SEQ ID NO: 2074618 - protein, 18 aa, Staphylococcus
KYEGKIFGIVGEPVDQGG

SEQ ID NO: 2074619 - protein, 27 aa, Staphylococcus
KYEHANPTSLIFALKNRLPNKYRDKVE

SEQ ID NO: 2074620 - protein, 25 aa, Staphylococcus
KYELLNFNFQVILLDLNLKSEDGYQ

SEQ ID NO: 2074621 - protein, 18 aa, Staphylococcus
KYEMELVTPIFIDDVPEE

SEQ ID NO: 2074622 - protein, 26 aa, Staphylococcus
KYERQRLFEYIIINELNVVFRLEDLT

SEQ ID NO: 2074623 - protein, 18 aa, Staphylococcus
KYFGPYPNAYAAVETKKL

SEQ ID NO: 2074624 - protein, 18 aa, Staphylococcus
KYFYDIKCYTNDDIKTYV

SEQ ID NO: 2074625 - protein, 23 aa, Staphylococcus
KYGAFVEIFSGKDALLHISQISK

SEQ ID NO: 2074626 - protein, 23 aa, Staphylococcus
KYGDELMYITGSPYDTLLEVIGV

SEQ ID NO: 2074627 - protein, 19 aa, Staphylococcus
KYGITFNQALETGGVMIGK

SEQ ID NO: 2074628 - protein, 30 aa, Staphylococcus
KYGLSNIVVHAPYIINIANTTKPEVFELGV

SEQ ID NO: 2074629 - protein, 29 aa, Staphylococcus
KYHLNKEEVLILLTLWEKGPMTLKEMDQY

SEQ ID NO: 2074630 - protein, 23 aa, Staphylococcus
KYHPDIAILDIEMPGLTGLEVLV

SEQ ID NO: 2074631 - protein, 24 aa, Staphylococcus
KYHRFIHYLLKRYYVKYNYDEFYQ

SEQ ID NO: 2074632 - protein, 20 aa, Staphylococcus
KYIGYPLVGDPKYGPKKTLD

SEQ ID NO: 2074633 - protein, 17 aa, Staphylococcus
KYILGDEKVESIIKDKF

SEQ ID NO: 2074634 - protein, 18 aa, Staphylococcus
KYILNNPVYKGYVRFNNH

SEQ ID NO: 2074635 - protein, 26 aa, Staphylococcus
KYINASERLNFFTWLEKLKKDNDIDD

SEQ ID NO: 2074636 - protein, 21 aa, Staphylococcus
KYINYATREYIDYMKSALTTD

SEQ ID NO: 2074637 - protein, 18 aa, Staphylococcus
KYIVFYINRDSEQRILIS

SEQ ID NO: 2074638 - protein, 19 aa, Staphylococcus
KYIVKEPTGYLAGRDKRNV

SEQ ID NO: 2074639 - protein, 30 aa, Staphylococcus
KYKARYDVTLLINGLPLVQIELKRSGIAIS

SEQ ID NO: 2074640 - protein, 18 aa, Staphylococcus
KYKDQDFIILGFPCNQFG

SEQ ID NO: 2074641 - protein, 19 aa, Staphylococcus
KYKDQGFIVLGFPCNQFGG

SEQ ID NO: 2074642 - protein, 27 aa, Staphylococcus
KYKESLNVPIFIKLTSDLSLDGLGAML

SEQ ID NO: 2074643 - protein, 18 aa, Staphylococcus
KYKIPKAFHQVEHLPYTS

SEQ ID NO: 2074644 - protein, 21 aa, Staphylococcus
KYKKDILDGKFLVIANKDNSS

SEQ ID NO: 2074645 - protein, 28 aa, Staphylococcus
KYKLQVKLERPVPYINELLALNTFNPQN

SEQ ID NO: 2074646 - protein, 20 aa, Staphylococcus
KYKLSPIIKKVLESKHIVNE

SEQ ID NO: 2074647 - protein, 19 aa, Staphylococcus
KYKQIYIIGPYMEQRPNER

SEQ ID NO: 2074648 - protein, 20 aa, Staphylococcus
KYKTTIYAPQKTFKPHTQQT

SEQ ID NO: 2074649 - protein, 18 aa, Staphylococcus
KYLDLLSQRFDSAEKLAT

SEQ ID NO: 2074650 - protein, 18 aa, Staphylococcus
KYLFGLSGNPSACFTGFE

SEQ ID NO: 2074651 - protein, 21 aa, Staphylococcus
KYLFNHFIKRNPMVDTYFITD

SEQ ID NO: 2074652 - protein, 19 aa, Staphylococcus
KYLKQRHIPMAIATSSYRE

SEQ ID NO: 2074653 - protein, 17 aa, Staphylococcus
KYLPHLQKEVNIAGTYN

SEQ ID NO: 2074654 - protein, 21 aa, Staphylococcus
KYLQDAHDFCPYSKATRGNID

SEQ ID NO: 2074655 - protein, 26 aa, Staphylococcus
KYLRKLKCIYVLVDPYLLESIRETDG

SEQ ID NO: 2074656 - protein, 18 aa, Staphylococcus
KYMVIVVQNFRDSNGEYV

SEQ ID NO: 2074657 - protein, 28 aa, Staphylococcus
KYNCNVYLKREDLQWVRSFKLRGAYNAI

SEQ ID NO: 2074658 - protein, 19 aa, Staphylococcus
KYNDNNILIPFRSNSERIS

SEQ ID NO: 2074659 - protein, 24 aa, Staphylococcus
KYNINEIYLIAHALLESGNGTSNF

SEQ ID NO: 2074660 - protein, 27 aa, Staphylococcus
KYNISSISVLKLWLRNYKKGKSNKHTG

SEQ ID NO: 2074661 - protein, 24 aa, Staphylococcus
KYNKKYQIVWATNTLYPFNDPNVK

SEQ ID NO: 2074662 - protein, 23 aa, Staphylococcus
KYNQRILIPSSKQARPLLRDTLA

SEQ ID NO: 2074663 - protein, 19 aa, Staphylococcus
KYNQYVLGGKYRPLTPLDD

SEQ ID NO: 2074664 - protein, 23 aa, Staphylococcus
KYNTKPRGLFRKKKFSPVVGDIV

SEQ ID NO: 2074665 - protein, 24 aa, Staphylococcus
KYNYDLLYFVLSKIAEGTSAQLMS

SEQ ID NO: 2074666 - protein, 20 aa, Staphylococcus
KYPDIPYVIDPVMLAKSGDS

SEQ ID NO: 2074667 - protein, 17 aa, Staphylococcus
KYPRLFETIHKALHMVW

SEQ ID NO: 2074668 - protein, 28 aa, Staphylococcus
KYQCNVYLKREDLQWVRSFKLRGAYNAI

SEQ ID NO: 2074669 - protein, 27 aa, Staphylococcus
KYQFKSYKLFNEIIRLIIENKSFETCY

SEQ ID NO: 2074670 - protein, 19 aa, Staphylococcus
KYQIPVAPLSVIFDDGETF

SEQ ID NO: 2074671 - protein, 19 aa, Staphylococcus
KYRKPSEIIALTRSKEKAQ

SEQ ID NO: 2074672 - protein, 17 aa, Staphylococcus
KYRTWDWNYGKNPKYNF

SEQ ID NO: 2074673 - protein, 18 aa, Staphylococcus
KYSNWLNQLFHGIEYRMQ

SEQ ID NO: 2074674 - protein, 21 aa, Staphylococcus
KYTGFAFGMGPDRIAMLKYGI

SEQ ID NO: 2074675 - protein, 23 aa, Staphylococcus
KYTGFAFGMGPDRIAMLKYGIED

SEQ ID NO: 2074676 - protein, 21 aa, Staphylococcus
KYTIAKFYKLYMERSNAGQPE

SEQ ID NO: 2074677 - protein, 21 aa, Staphylococcus
KYTIAKFYKLYMERSNDGQTE

SEQ ID NO: 2074678 - protein, 23 aa, Staphylococcus
KYTPLIKPIYLSKHEPGLNQFSK

SEQ ID NO: 2074679 - protein, 18 aa, Staphylococcus
KYTVAKFYKLYMERSNEG

SEQ ID NO: 2074680 - protein, 21 aa, Staphylococcus
KYTVAKFYKLYMERSNSGQTE

SEQ ID NO: 2074681 - protein, 17 aa, Staphylococcus
KYTVDRLGLERVKTELN

SEQ ID NO: 2074682 - protein, 25 aa, Staphylococcus
KYTYVRMAMYMDPLKPYLPELADMQ

SEQ ID NO: 2074683 - protein, 17 aa, Staphylococcus
KYTYYLKKHDLTYTSFM

SEQ ID NO: 2074684 - protein, 24 aa, Staphylococcus
KYVKQAQLLTSKPMIYIANVGEDE

SEQ ID NO: 2074685 - protein, 21 aa, Staphylococcus
KYYDIAFSLLYKKVKFRATVV

SEQ ID NO: 2074686 - protein, 18 aa, Staphylococcus
KYYLLNVHNNFLLNDDHM

SEQ ID NO: 2074687 - protein, 17 aa, Staphylococcus
KYYRPEMPNTNPLFIGA

SEQ ID NO: 2074688 - protein, 23 aa, Staphylococcus
KYYYELLHFVLTKITAGTSAQLM

SEQ ID NO: 2074689 - protein, 24 aa, Staphylococcus
LAAKPQVHVFIATSPIHLEHKLKM

SEQ ID NO: 2074690 - protein, 23 aa, Staphylococcus
LAAKRKLSVFLYSVNDFSDFNAT

SEQ ID NO: 2074691 - protein, 25 aa, Staphylococcus
LAAKRKLSVFLYSVNDFTDFDATTQ

SEQ ID NO: 2074692 - protein, 24 aa, Staphylococcus
LAAKRKLSVFLYSVNDFTDFSATT

SEQ ID NO: 2074693 - protein, 25 aa, Staphylococcus
LAAKRKLSVFLYSVNDFTQFNADTQ

SEQ ID NO: 2074694 - protein, 22 aa, Staphylococcus
LAALLTAQFYSPSKIIMLDLDD

SEQ ID NO: 2074695 - protein, 24 aa, Staphylococcus
LAAQKGLPFVIAFMGQSQTKINSL

SEQ ID NO: 2074696 - protein, 29 aa, Staphylococcus
LADDYQVLLVLPLWHKGDQFPFDDLLARI

SEQ ID NO: 2074697 - protein, 17 aa, Staphylococcus
LADFLTAKEVLKKPYHE

SEQ ID NO: 2074698 - protein, 23 aa, Staphylococcus
LADHGLYFKLPKDSFIFDTGGYK

SEQ ID NO: 2074699 - protein, 21 aa, Staphylococcus
LADMEVWMAFRNDIHEYGQST

SEQ ID NO: 2074700 - protein, 23 aa, Staphylococcus
LADTELLLEVLAASLADVEVDSE

SEQ ID NO: 2074701 - protein, 21 aa, Staphylococcus
LADVLIYSYMLADNLDFDIND

SEQ ID NO: 2074702 - protein, 17 aa, Staphylococcus
LAEAGLLDEFKALARFE

SEQ ID NO: 2074703 - protein, 18 aa, Staphylococcus
LAEFNIYCDPEAAHIVFN

SEQ ID NO: 2074704 - protein, 21 aa, Staphylococcus
LAEKMYVVPPSRLISEIPHAM

SEQ ID NO: 2074705 - protein, 23 aa, Staphylococcus
LAELMPWNMAIQDYLFKTIQELN

SEQ ID NO: 2074706 - protein, 17 aa, Staphylococcus
LAEMKRLGLPVPDGFTI

SEQ ID NO: 2074707 - protein, 18 aa, Staphylococcus
LAEMKRLGLPVPDGFTIT

SEQ ID NO: 2074708 - protein, 19 aa, Staphylococcus
LAEPLYLQRRPYTAYISTS

SEQ ID NO: 2074709 - protein, 20 aa, Staphylococcus
LAERAILSLDAPIARVAAAD

SEQ ID NO: 2074710 - protein, 20 aa, Staphylococcus
LAESGIGGLALGLAVEGFRP

SEQ ID NO: 2074711 - protein, 19 aa, Staphylococcus
LAESKCHILNLAIGGTAVG

SEQ ID NO: 2074712 - protein, 17 aa, Staphylococcus
LAETLHSIFLEVVIAPL

SEQ ID NO: 2074713 - protein, 26 aa, Staphylococcus
LAEVLHGIFLEVVIAPKFTQEALEVL

SEQ ID NO: 2074714 - protein, 19 aa, Staphylococcus
LAEWFAENDYFYIMHRFNE

SEQ ID NO: 2074715 - protein, 21 aa, Staphylococcus
LAEWLMEMQLDRKAGGMLKAD

SEQ ID NO: 2074716 - protein, 19 aa, Staphylococcus
LAFAHGFNIHFEVIKPPKD

SEQ ID NO: 2074717 - protein, 20 aa, Staphylococcus
LAFDTIYAEGQRRYVESLSA

SEQ ID NO: 2074718 - protein, 25 aa, Staphylococcus
LAFGTAGIRGLLGLGPGRLNAFTVR

SEQ ID NO: 2074719 - protein, 24 aa, Staphylococcus
LAGDRFVIFKDEKQARRIGEARHE

SEQ ID NO: 2074720 - protein, 24 aa, Staphylococcus
LAGDRFVVFSDEKQARRIGEARHE

SEQ ID NO: 2074721 - protein, 17 aa, Staphylococcus
LAGLPWQSVMAADNKIY

SEQ ID NO: 2074722 - protein, 17 aa, Staphylococcus
LAGLVAEGTTQVTELKH

SEQ ID NO: 2074723 - protein, 30 aa, Staphylococcus
LAGSILKMNDGLYNLIEYTHDSLENLWRVT

SEQ ID NO: 2074724 - protein, 19 aa, Staphylococcus
LAGTFYFTEFDFHKALSKQ

SEQ ID NO: 2074725 - protein, 22 aa, Staphylococcus
LAHGEFGKWLKSINLNQNVANK

SEQ ID NO: 2074726 - protein, 30 aa, Staphylococcus
LAHGEKGLFIVPLNGLKKWLTPVEMWRNHQ

SEQ ID NO: 2074727 - protein, 19 aa, Staphylococcus
LAHLLKYDTMQGRFTEEVE

SEQ ID NO: 2074728 - protein, 40 aa, Staphylococcus
LAHNKKGLFIVPLNGLKKWLTPFELWKDHQITLRVGEDID

SEQ ID NO: 2074729 - protein, 23 aa, Staphylococcus
LAHPYPMSTLSLRLAEALFKDQK

SEQ ID NO: 2074730 - protein, 19 aa, Staphylococcus
LAHSLTLYALMYAHHHSVP

SEQ ID NO: 2074731 - protein, 19 aa, Staphylococcus
LAHTLFDYPSQQLTTFGVT

SEQ ID NO: 2074732 - protein, 19 aa, Staphylococcus
LAINLKRKCERYHVPFIVN

SEQ ID NO: 2074733 - protein, 19 aa, Staphylococcus
LAISLSNLLGLVCDPVAGL

SEQ ID NO: 2074734 - protein, 18 aa, Staphylococcus
LAIVFGRTKRRVDELTSA

SEQ ID NO: 2074735 - protein, 19 aa, Staphylococcus
LAIVPILRAGLGMTEGILS

SEQ ID NO: 2074736 - protein, 23 aa, Staphylococcus
LAKEFPVYFQKGYDYELDALGLD

SEQ ID NO: 2074737 - protein, 35 aa, Staphylococcus
LAKGAYERLEFYRLYLLMIHLLKFGGMYASSVNRS

SEQ ID NO: 2074738 - protein, 27 aa, Staphylococcus
LAKGLNIIGLINIQFVIAHDGVYVLEV

SEQ ID NO: 2074739 - protein, 25 aa, Staphylococcus
LAKKGAVKLITKRDFFLEPDRDPST

SEQ ID NO: 2074740 - protein, 22 aa, Staphylococcus
LAKKVFGKLKYKQAVIIGAGEM

SEQ ID NO: 2074741 - protein, 18 aa, Staphylococcus
LAKLARKISIAAGKKGTD

SEQ ID NO: 2074742 - protein, 26 aa, Staphylococcus
LAKLDADGYFWFEGRKDDIIISSGYT

SEQ ID NO: 2074743 - protein, 25 aa, Staphylococcus
LAKQLAIDLFGNKEALIRLDMSEYS

SEQ ID NO: 2074744 - protein, 25 aa, Staphylococcus
LAKQLSIDLFGNKEALIKLDMSEYM

SEQ ID NO: 2074745 - protein, 29 aa, Staphylococcus
LAKRDIQFDYIFLDPPYKKGLIDEALKSI

SEQ ID NO: 2074746 - protein, 29 aa, Staphylococcus
LAKREIQFDIIFLDPPYQKGLIDDALAKI

SEQ ID NO: 2074747 - protein, 27 aa, Staphylococcus
LAKVKEEWIVPLPKGLTLEEAMIYGTA

SEQ ID NO: 2074748 - protein, 21 aa, Staphylococcus
LAKVPTIIYSAHGFYFHEGMS

SEQ ID NO: 2074749 - protein, 24 aa, Staphylococcus
LAKVSPLIHRANIGGVLNVTELNV

SEQ ID NO: 2074750 - protein, 20 aa, Staphylococcus
LALINDIFSSFQKLYNKKYN

SEQ ID NO: 2074751 - protein, 18 aa, Staphylococcus
LALKIKYLNQLIKDYETN

SEQ ID NO: 2074752 - protein, 24 aa, Staphylococcus
LALNEEIDFMIISGDLFDQHNRTL

SEQ ID NO: 2074753 - protein, 18 aa, Staphylococcus
LALPHLINAGLIPESPSE

SEQ ID NO: 2074754 - protein, 25 aa, Staphylococcus
LAMDHNYACILLDLMLPEMDGIEVA

SEQ ID NO: 2074755 - protein, 25 aa, Staphylococcus
LAMDNNYACILLDLMLPEMDGIEVA

SEQ ID NO: 2074756 - protein, 36 aa, Staphylococcus
LAMEEYVLKHLPADDSYFLFYVNEPSIIVGKNQNTI

SEQ ID NO: 2074757 - protein, 18 aa, Staphylococcus
LANCKLCNALRLGISLYG

SEQ ID NO: 2074758 - protein, 25 aa, Staphylococcus
LANEGMTMVIVTHAMRFAKEVSNKV

SEQ ID NO: 2074759 - protein, 19 aa, Staphylococcus
LANELKKFVRPKLTVANRS

SEQ ID NO: 2074760 - protein, 35 aa, Staphylococcus
LANIDKTFGLIYSQRVLLALINKGLAREAAYDKVQ

SEQ ID NO: 2074761 - protein, 23 aa, Staphylococcus
LANLEGLWYARNIKSLPLAMKEC

SEQ ID NO: 2074762 - protein, 24 aa, Staphylococcus
LANLMKTHIFSAFSTLKIGIDLLK

SEQ ID NO: 2074763 - protein, 27 aa, Staphylococcus
LANNQKVIVFWNPWDSDVSLQPVDSNI

SEQ ID NO: 2074764 - protein, 23 aa, Staphylococcus
LANPFGMILSLAMCLRESFNFED

SEQ ID NO: 2074765 - protein, 33 aa, Staphylococcus
LANQLLDERLAHIPYILLSLGKNGALLRYKDEV

SEQ ID NO: 2074766 - protein, 17 aa, Staphylococcus
LANQPPVKAMADAAPKI

SEQ ID NO: 2074767 - protein, 17 aa, Staphylococcus
LANRPADKPLKGYKKMN

SEQ ID NO: 2074768 - protein, 29 aa, Staphylococcus
LANVDLYRTSGHWAHYRDDMFPPMKLDEN

SEQ ID NO: 2074769 - protein, 31 aa, Staphylococcus
LANVTNKILYLANHQLKLFNEDYAHFVKTLE

SEQ ID NO: 2074770 - protein, 27 aa, Staphylococcus
LANYDHDLQYFLFQHMAVLLTADTKLR

SEQ ID NO: 2074771 - protein, 23 aa, Staphylococcus
LAPAYVFLASYADSSYITGQIIH

SEQ ID NO: 2074772 - protein, 19 aa, Staphylococcus
LAPILVHTAEEVWSHIPHV

SEQ ID NO: 2074773 - protein, 25 aa, Staphylococcus
LAPMKARGIRFAFCTGKQVERVEAV

SEQ ID NO: 2074774 - protein, 20 aa, Staphylococcus
LAPYKAAVLPLSKKLSEEAI

SEQ ID NO: 2074775 - protein, 24 aa, Staphylococcus
LAQALLENVPNYFKAYAAIGTIAD

SEQ ID NO: 2074776 - protein, 23 aa, Staphylococcus
LAQALTRLYPDVKLTIGPVIEHG

SEQ ID NO: 2074777 - protein, 24 aa, Staphylococcus
LAQDLSNRLVRMRKRRGEIDFDIN

SEQ ID NO: 2074778 - protein, 24 aa, Staphylococcus
LAQEEIFGPVLTVIKVRDDDEAVR

SEQ ID NO: 2074779 - protein, 26 aa, Staphylococcus
LAQEKIAFQGLPSRIAWLGYEERAKM

SEQ ID NO: 2074780 - protein, 17 aa, Staphylococcus
LAQFRYDHYIQLYNEIS

SEQ ID NO: 2074781 - protein, 17 aa, Staphylococcus
LAQLLRDLDEIEGLERI

SEQ ID NO: 2074782 - protein, 21 aa, Staphylococcus
LAQLMKLYNYQEIRTPIFEST

SEQ ID NO: 2074783 - protein, 27 aa, Staphylococcus
LAQNEKGLFIVPLNGLKKWQTPIDIWQ

SEQ ID NO: 2074784 - protein, 22 aa, Staphylococcus
LAQYHPDYFHISANSYKRTSIV

SEQ ID NO: 2074785 - protein, 28 aa, Staphylococcus
LAQYLLAQHRGFILAPDYQRLTVSSLDY

SEQ ID NO: 2074786 - protein, 24 aa, Staphylococcus
LAQYQRILKQKNNYLKQLQLGQKT

SEQ ID NO: 2074787 - protein, 28 aa, Staphylococcus
LAREYYYEYKKFGILPEKEYAINKVKKV

SEQ ID NO: 2074788 - protein, 18 aa, Staphylococcus
LARFPWLSANIEYNMTRE

SEQ ID NO: 2074789 - protein, 27 aa, Staphylococcus
LARLQVDYIDLYYIHFPDESTPKDQAV

SEQ ID NO: 2074790 - protein, 21 aa, Staphylococcus
LARNELHYLLNEISGFNVIDE

SEQ ID NO: 2074791 - protein, 21 aa, Staphylococcus
LARNELHYLLNEISSFEIIDE

SEQ ID NO: 2074792 - protein, 30 aa, Staphylococcus
LARRFINRDLFKYIPFDGSIITITELQDLF

SEQ ID NO: 2074793 - protein, 23 aa, Staphylococcus
LARTSLVYLTYPNNPTGSTATKA

SEQ ID NO: 2074794 - protein, 19 aa, Staphylococcus
LARYIQSLHKKRVGLFIKN

SEQ ID NO: 2074795 - protein, 24 aa, Staphylococcus
LASDGMLVKRPLAVSGDKITLGFN

SEQ ID NO: 2074796 - protein, 17 aa, Staphylococcus
LASGALAGSILKMNDGL

SEQ ID NO: 2074797 - protein, 28 aa, Staphylococcus
LASILNTFVLFNINLSWIESRPLKTQLG

SEQ ID NO: 2074798 - protein, 17 aa, Staphylococcus
LASSKLWRKTVEEVSHD

SEQ ID NO: 2074799 - protein, 18 aa, Staphylococcus
LASYLLKKNRGYVLAPQY

SEQ ID NO: 2074800 - protein, 23 aa, Staphylococcus
LATLLTAQFFSPSKIIMIDLDDN

SEQ ID NO: 2074801 - protein, 18 aa, Staphylococcus
LATVYRTLELLAELKIVD

SEQ ID NO: 2074802 - protein, 18 aa, Staphylococcus
LATVYRTLELLAELKVVD

SEQ ID NO: 2074803 - protein, 39 aa, Staphylococcus; identical to SEQ ID NO: 1829655

SEQ ID NO: 2074804 - protein, 21 aa, Staphylococcus
LAYALQTRLYGVSSLKALAAT

SEQ ID NO: 2074805 - protein, 23 aa, Staphylococcus
LAYEINDFKEGFYNIVRIKSDNN

SEQ ID NO: 2074806 - protein, 23 aa, Staphylococcus
LAYEINDFKEGFYNIVRIKTDNN

SEQ ID NO: 2074807 - protein, 20 aa, Staphylococcus
LAYEINDFSEGYYNIVRIQT

SEQ ID NO: 2074808 - protein, 24 aa, Staphylococcus
LAYFARFSRMPWLPYQVGHTTPHI

SEQ ID NO: 2074809 - protein, 22 aa, Staphylococcus
LAYLTHYLWQEAHGSEPLNYPT

SEQ ID NO: 2074810 - protein, 18 aa, Staphylococcus
LCCATFLGDFEPVSIKMA

SEQ ID NO: 2074811 - protein, 19 aa, Staphylococcus
LCCSTFLGDFEPVSIKMAK

SEQ ID NO: 2074812 - protein, 19 aa, Staphylococcus
LCDDDMPIYLTNHKGDMIE

SEQ ID NO: 2074813 - protein, 23 aa, Staphylococcus
LCDKKVLYRTLSVSLTQLVPEDQ

SEQ ID NO: 2074814 - protein, 29 aa, Staphylococcus
LCETNKIPYKVDIYPYYGSDASAALRSGA

SEQ ID NO: 2074815 - protein, 17 aa, Staphylococcus
LCFLFYVSSKEIIKRYS

SEQ ID NO: 2074816 - protein, 18 aa, Staphylococcus
LCHDILEDAWKKQPFFSK

SEQ ID NO: 2074817 - protein, 32 aa, Staphylococcus; identical to SEQ ID NO: 1829660

SEQ ID NO: 2074818 - protein, 44 aa, Staphylococcus
LCLDQPDIFRPQLRALLRASAFGKLNIMFPMVATIQEFRDAKAL

SEQ ID NO: 2074819 - protein, 45 aa, Staphylococcus
LCLDQPEIFRPQLRALLRASVFGKLNIMFPMVATIQEFRDAKALL

SEQ ID NO: 2074820 - protein, 17 aa, Staphylococcus
LCMGFKPKEIKELTPKI

SEQ ID NO: 2074821 - protein, 23 aa, Staphylococcus
LCPKYRHLHLGGLLIATSLSSNE

SEQ ID NO: 2074822 - protein, 35 aa, Staphylococcus
LCQYLNIKPNILKFILKVFLDLSFIYEENGIIKIN

SEQ ID NO: 2074823 - protein, 20 aa, Staphylococcus
LCTEIYFKHKRALDLIFEYK

SEQ ID NO: 2074824 - protein, 18 aa, Staphylococcus
LCVKVGMELFYQTGPGLI

SEQ ID NO: 2074825 - protein, 27 aa, Staphylococcus
LCVSIREFFPFIELKAFDDYSKNIDIE

SEQ ID NO: 2074826 - protein, 20 aa, Staphylococcus
LCVYEGFLKGLTGQTIEAKK

SEQ ID NO: 2074827 - protein, 24 aa, Staphylococcus
LCYQLPTYLIEKPTLVISPLISLM

SEQ ID NO: 2074828 - protein, 26 aa, Staphylococcus
LDADGVFIYIGMKPLTVPFQDLGITN

SEQ ID NO: 2074829 - protein, 18 aa, Staphylococcus
LDADIIFMQGDVLKPLIQ

SEQ ID NO: 2074830 - protein, 24 aa, Staphylococcus
LDAFTTRGMIKRLITSIITASPAT

SEQ ID NO: 2074831 - protein, 19 aa, Staphylococcus
LDAIANYNALIADEIVCVF

SEQ ID NO: 2074832 - protein, 34 aa, Staphylococcus
LDAILKHSRPIKIGLAALVDRGHRELPIRADFVG

SEQ ID NO: 2074833 - protein, 22 aa, Staphylococcus
LDAILLHSRPQKIGLAALVDRG

SEQ ID NO: 2074834 - protein, 20 aa, Staphylococcus
LDAIYIYVEVIQGSGGLPVG

SEQ ID NO: 2074835 - protein, 19 aa, Staphylococcus
LDALAYPIQIIKELHFDDI

SEQ ID NO: 2074836 - protein, 25 aa, Staphylococcus
LDALNYYMERFMLTVPFENISVQNK

SEQ ID NO: 2074837 - protein, 27 aa, Staphylococcus
LDALREKFYHYMTLNPRVYKHFEEYAT

SEQ ID NO: 2074838 - protein, 17 aa, Staphylococcus
LDALSYYQFVILKMVVG

SEQ ID NO: 2074839 - protein, 22 aa, Staphylococcus
LDAVRRAFLADMLIFAYAETAH

SEQ ID NO: 2074840 - protein, 20 aa, Staphylococcus
LDCDILIPAAIENQITKENA

SEQ ID NO: 2074841 - protein, 20 aa, Staphylococcus
LDCTQFPFRIARPGSITQAM

SEQ ID NO: 2074842 - protein, 20 aa, Staphylococcus
LDCTQFPFRIARPGSITQTM

SEQ ID NO: 2074843 - protein, 19 aa, Staphylococcus
LDCTQYPFRIARPGSITKK

SEQ ID NO: 2074844 - protein, 21 aa, Staphylococcus
LDCVHICLPHYLHVSATTTCV

SEQ ID NO: 2074845 - protein, 25 aa, Staphylococcus
LDDDKRLLLLNQELERFRATLFRQT

SEQ ID NO: 2074846 - protein, 18 aa, Staphylococcus
LDDELNQLLLYKEEKHTG

SEQ ID NO: 2074847 - protein, 20 aa, Staphylococcus
LDDFRILKAKLFGNKDRTTE

SEQ ID NO: 2074848 - protein, 21 aa, Staphylococcus
LDDGFLTDTKGRRVDFRNTVI

SEQ ID NO: 2074849 - protein, 17 aa, Staphylococcus
LDDINPLYIVTIHVDKE

SEQ ID NO: 2074850 - protein, 19 aa, Staphylococcus
LDDKASVAMILDLLERIKN

SEQ ID NO: 2074851 - protein, 31 aa, Staphylococcus
LDDKNVVIIQDFKHYCALLFEKGAIMEDPYQ

SEQ ID NO: 2074852 - protein, 27 aa, Staphylococcus
LDDLGLDAAFRSYFKQFEKNYGIHVNY

SEQ ID NO: 2074853 - protein, 17 aa, Staphylococcus
LDDLGLEAAFKSYFKQF

SEQ ID NO: 2074854 - protein, 32 aa, Staphylococcus
LDDLKEMKVIYSYMITMIKAAQKMPIVKAIQT

SEQ ID NO: 2074855 - protein, 24 aa, Staphylococcus
LDDNLYEIILINDGSLDGSGEIIN

SEQ ID NO: 2074856 - protein, 28 aa, Staphylococcus
LDDQLETIFYRLFSGRATRSRLGMSYLT

SEQ ID NO: 2074857 - protein, 26 aa, Staphylococcus
LDDQLETIFYRLFTGRSTRSTLGIDV

SEQ ID NO: 2074858 - protein, 25 aa, Staphylococcus
LDDRELVGILTNRDLRFIEDFSIKI

SEQ ID NO: 2074859 - protein, 24 aa, Staphylococcus
LDDRYVLCLFDWRIIENEATNENY

SEQ ID NO: 2074860 - protein, 20 aa, Staphylococcus
LDDSVRRDPIHRLAPKFDEL

SEQ ID NO: 2074861 - protein, 24 aa, Staphylococcus
LDDYDRLFVEKLELLKEINQHEVV

SEQ ID NO: 2074862 - protein, 19 aa, Staphylococcus
LDDYRWQFGVPPKGNANYA

SEQ ID NO: 2074863 - protein, 24 aa, Staphylococcus
LDDYVYLTFISNGMVRLIDLYLSA

SEQ ID NO: 2074864 - protein, 31 aa, Staphylococcus
LDEANVIRYAQFLKELSIQTQFIVITHRKGT

SEQ ID NO: 2074865 - protein, 21 aa, Staphylococcus
LDEAVVLYYLKAWVKEEDPIL

SEQ ID NO: 2074866 - protein, 22 aa, Staphylococcus
LDECLLFLMNHQIHLSIRLRLP

SEQ ID NO: 2074867 - protein, 18 aa, Staphylococcus
LDEDFGVIELPTLKFELF

SEQ ID NO: 2074868 - protein, 18 aa, Staphylococcus
LDEDFGVVELPTLKFELF

SEQ ID NO: 2074869 - protein, 27 aa, Staphylococcus
LDEETFGYVVYFFELACSMSGYQLGVN

SEQ ID NO: 2074870 - protein, 17 aa, Staphylococcus
LDEGFDLNYLYPDAKQS

SEQ ID NO: 2074871 - protein, 17 aa, Staphylococcus
LDEGYIYSKPRSGYYVS

SEQ ID NO: 2074872 - protein, 26 aa, Staphylococcus
LDEISKMILLDRLFEMLQLNKSFSEK

SEQ ID NO: 2074873 - protein, 30 aa, Staphylococcus
LDEKDRLLPGGYLFLSDLVGNPTLLNKVGK

SEQ ID NO: 2074874 - protein, 26 aa, Staphylococcus
LDEKRLNYLGFYRLHHPYKKKVMMAK

SEQ ID NO: 2074875 - protein, 25 aa, Staphylococcus
LDELPSMYQGFFLAPHVVSQSLKGA

SEQ ID NO: 2074876 - protein, 29 aa, Staphylococcus
LDELVATDYPILLATSRKRFIKEMIGGDT

SEQ ID NO: 2074877 - protein, 28 aa, Staphylococcus
LDELVATEYPILLATSRKRFIKEMIGTD

SEQ ID NO: 2074878 - protein, 30 aa, Staphylococcus
LDENIAYQYATIRNILYSKGYTTEMLINYE

SEQ ID NO: 2074879 - protein, 31 aa, Staphylococcus
LDETFLEDCPNLKWIAWYATGVNSLPLNYIN

SEQ ID NO: 2074880 - protein, 24 aa, Staphylococcus
LDETLALIKCDMLYHLNSFLELRE

SEQ ID NO: 2074881 - protein, 23 aa, Staphylococcus
LDFDALYQLLRSLQERMNQNAAG

SEQ ID NO: 2074882 - protein, 30 aa, Staphylococcus
LDFDDLIMKTIRLFERVPDALEYYQNKFQY

SEQ ID NO: 2074883 - protein, 24 aa, Staphylococcus
LDFGKIKLYVGNYDFWYQSSQLAQ

SEQ ID NO: 2074884 - protein, 21 aa, Staphylococcus
LDFLAREQLLYLLENLNKTYA

SEQ ID NO: 2074885 - protein, 18 aa, Staphylococcus
LDFLGFKHDELILSGLSM

SEQ ID NO: 2074886 - protein, 26 aa, Staphylococcus
LDGATKEFFAWGFRVGFITFGVEDAS

SEQ ID NO: 2074887 - protein, 26 aa, Staphylococcus
LDGATKEFFAWGFRVGFMTFGTKNEI

SEQ ID NO: 2074888 - protein, 18 aa, Staphylococcus
LDGNFEWLKQFLQQELPN

SEQ ID NO: 2074889 - protein, 29 aa, Staphylococcus
LDGSVKNFRVTKLFGFFGLKREEIQEAHA

SEQ ID NO: 2074890 - protein, 22 aa, Staphylococcus
LDGWSLSIVLNDVNRLYYQLFN

SEQ ID NO: 2074891 - protein, 18 aa, Staphylococcus
LDHDGLLSFGTNLQQNMS

SEQ ID NO: 2074892 - protein, 22 aa, Staphylococcus
LDHIDKIYFTSHMDTVVPGLNV

SEQ ID NO: 2074893 - protein, 23 aa, Staphylococcus
LDHLIHAFQQYLAKGYNSQLHIY

SEQ ID NO: 2074894 - protein, 23 aa, Staphylococcus
LDHNIHVLLTDTFALNKRAQGLF

SEQ ID NO: 2074895 - protein, 28 aa, Staphylococcus
LDHPEAFIKPVPHMSFVQGIKNVDFLKR

SEQ ID NO: 2074896 - protein, 23 aa, Staphylococcus
LDHPSPYYTALAAIGTIADLVSL

SEQ ID NO: 2074897 - protein, 23 aa, Staphylococcus
LDHRNTLGVLPTGGGKSICYQVP

SEQ ID NO: 2074898 - protein, 18 aa, Staphylococcus
LDIAGIRVVCNYLEDIYV

SEQ ID NO: 2074899 - protein, 18 aa, Staphylococcus
LDIGFDLNYLYPDAKHSI

SEQ ID NO: 2074900 - protein, 21 aa, Staphylococcus
LDIHTELPLYVTICSGLIKAD

SEQ ID NO: 2074901 - protein, 18 aa, Staphylococcus
LDILRRMKDFQYQWTKQY

SEQ ID NO: 2074902 - protein, 19 aa, Staphylococcus
LDILSFVAPIKTIITDLIY

SEQ ID NO: 2074903 - protein, 18 aa, Staphylococcus
LDIPVHITLPKTFNSKKE

SEQ ID NO: 2074904 - protein, 28 aa, Staphylococcus
LDIRDENVWMLFGTLPIYPCINDENDQA

SEQ ID NO: 2074905 - protein, 28 aa, Staphylococcus
LDIRHDDVWMLFGTLPIYPCINDEDDQL

SEQ ID NO: 2074906 - protein, 18 aa, Staphylococcus
LDIRIESLNFELVKATEE

SEQ ID NO: 2074907 - protein, 18 aa, Staphylococcus
LDIRVVITRPANDPALFD

SEQ ID NO: 2074908 - protein, 26 aa, Staphylococcus
LDKCFYKYYGLNKLINLLIKEKPDLI

SEQ ID NO: 2074909 - protein, 26 aa, Staphylococcus
LDKCFYKYYGLNKLINLLLKEKPDLI

SEQ ID NO: 2074910 - protein, 43 aa, Staphylococcus
LDKCFYKYYGLNKLINLLLKEKPDLILLTFPTPVMSVLTEQFN

SEQ ID NO: 2074911 - protein, 43 aa, Staphylococcus
LDKCFYKYYGLNKLMNLLLKEKPDLILLTFPTPVMSVLTEQFD

SEQ ID NO: 2074912 - protein, 21 aa, Staphylococcus
LDKCLDYLREGDILVIYKLDG

SEQ ID NO: 2074913 - protein, 18 aa, Staphylococcus
LDKFKACYKALLAKNEVN

SEQ ID NO: 2074914 - protein, 17 aa, Staphylococcus
LDKGFTGHIIRRGTADA

SEQ ID NO: 2074915 - protein, 17 aa, Staphylococcus
LDKGYFARPTIFINVDN

SEQ ID NO: 2074916 - protein, 23 aa, Staphylococcus
LDKGYIVCPYISNDLVLAKKLEA

SEQ ID NO: 2074917 - protein, 20 aa, Staphylococcus
LDKLEHILRTLQPDAKIIKT

SEQ ID NO: 2074918 - protein, 22 aa, Staphylococcus
LDKNPYQLVYDIKGIGFNKADQ

SEQ ID NO: 2074919 - protein, 24 aa, Staphylococcus
LDKPYLFGEDFSFYSQIAPSYFAF

SEQ ID NO: 2074920 - protein, 30 aa, Staphylococcus
LDKTIYEISKRTVLYLINKDINVYDATIAC

SEQ ID NO: 2074921 - protein, 19 aa, Staphylococcus
LDKVLPELNSDWSRSQIQD

SEQ ID NO: 2074922 - protein, 26 aa, Staphylococcus
LDKYGEFFKGFTAVPADKVANAFVKS

SEQ ID NO: 2074923 - protein, 28 aa, Staphylococcus
LDLDYLDLYLMHWPGMNEALMIDTWQGM

SEQ ID NO: 2074924 - protein, 18 aa, Staphylococcus
LDLFRLHLELFEKYSNEE

SEQ ID NO: 2074925 - protein, 32 aa, Staphylococcus
LDLIDESKLNFLWVTDWPLLEYDEDLKRYTAA

SEQ ID NO: 2074926 - protein, 18 aa, Staphylococcus
LDLILVKMAKSLYVIGKE

SEQ ID NO: 2074927 - protein, 30 aa, Staphylococcus
LDLIQFVAPIKTIITDILYTIKTDYLPDID

SEQ ID NO: 2074928 - protein, 22 aa, Staphylococcus
LDLIVSLDFRMTATPLYSDIVL

SEQ ID NO: 2074929 - protein, 17 aa, Staphylococcus
LDLLEIFEKNDVSFRSA

SEQ ID NO: 2074930 - protein, 19 aa, Staphylococcus
LDLLLKIKERENLTIVIIT

SEQ ID NO: 2074931 - protein, 32 aa, Staphylococcus
LDLLSPTKCLRILALFRLINPTKEIRIAGGRE

SEQ ID NO: 2074932 - protein, 22 aa, Staphylococcus
LDLLVSLDFRMTATPLYSDIVL

SEQ ID NO: 2074933 - protein, 17 aa, Staphylococcus
LDLMNGGIRGRQVIINK

SEQ ID NO: 2074934 - protein, 25 aa, Staphylococcus
LDLPEYAFPLFGMAVGEPADDENGA

SEQ ID NO: 2074935 - protein, 17 aa, Staphylococcus
LDLPFKSKEAIYNYVLF

SEQ ID NO: 2074936 - protein, 27 aa, Staphylococcus
LDLQQFVKYLLCLQQLPHAIITSDAML

SEQ ID NO: 2074937 - protein, 22 aa, Staphylococcus
LDLYLSVLGMPGQTAYHGLLDI

SEQ ID NO: 2074938 - protein, 30 aa, Staphylococcus
LDMDFKGRPFEPMPQLLAVSELVTKLQAVC

SEQ ID NO: 2074939 - protein, 21 aa, Staphylococcus
LDMDYGWNVKLGKNIFVNSNC

SEQ ID NO: 2074940 - protein, 28 aa, Staphylococcus
LDMETTQWLEDYLKYFQGAIVIISHDRY

SEQ ID NO: 2074941 - protein, 19 aa, Staphylococcus
LDMFILQGAASFNIWTGQT

SEQ ID NO: 2074942 - protein, 27 aa, Staphylococcus
LDMQGFSITLLPNNEELLKALQAPTTS

SEQ ID NO: 2074943 - protein, 24 aa, Staphylococcus
LDMRKLARHLGIDSDVLFLGKQDQ

SEQ ID NO: 2074944 - protein, 34 aa, Staphylococcus
LDNFKGTILFVSHDRYFINQLANKVYDLNYDGGT

SEQ ID NO: 2074945 - protein, 21 aa, Staphylococcus
LDNGAWLVTIKDLATNHITTY

SEQ ID NO: 2074946 - protein, 26 aa, Staphylococcus
LDNGLRLFIIPKKGFQKTFVTYTTQF

SEQ ID NO: 2074947 - protein, 25 aa, Staphylococcus
LDNLMLYHQHHWLAKLNFKEISTSS

SEQ ID NO: 2074948 - protein, 26 aa, Staphylococcus
LDNNYLLQIIETYKNLPILGVCLGAQ

SEQ ID NO: 2074949 - protein, 24 aa, Staphylococcus
LDNVNYFGTMLVYTGKAAGLVSGA

SEQ ID NO: 2074950 - protein, 20 aa, Staphylococcus
LDNYIKYANKVRFILESHAR

SEQ ID NO: 2074951 - protein, 26 aa, Staphylococcus
LDPQSRFQIMTLLKKFQLEDNKTIIL

SEQ ID NO: 2074952 - protein, 24 aa, Staphylococcus
LDPSKMAILFQKTQFPKMIKVKEL

SEQ ID NO: 2074953 - protein, 25 aa, Staphylococcus
LDQDKSYDLYFDGANYYQLTTDMFQ

SEQ ID NO: 2074954 - protein, 28 aa, Staphylococcus
LDQFVRKHIILKLRAKPNRLHQQAKRYV

SEQ ID NO: 2074955 - protein, 24 aa, Staphylococcus
LDQGILNISLIFKGKTEVSIDKAF

SEQ ID NO: 2074956 - protein, 21 aa, Staphylococcus
LDQGILNISLIFKGQTETTID

SEQ ID NO: 2074957 - protein, 24 aa, Staphylococcus
LDQGVLNISLLFKGKHDITIDEAF

SEQ ID NO: 2074958 - protein, 18 aa, Staphylococcus
LDQHPKVTWVNYPGLENN

SEQ ID NO: 2074959 - protein, 24 aa, Staphylococcus
LDQHVRAYIVLKLKAKPNRLHQEA

SEQ ID NO: 2074960 - protein, 26 aa, Staphylococcus
LDQHVRAYIVLKLRSKPNRLHQAAKR

SEQ ID NO: 2074961 - protein, 25 aa, Staphylococcus
LDQINWVGFYLIENEELILGPFQGH

SEQ ID NO: 2074962 - protein, 18 aa, Staphylococcus
LDQLPIRPETHKNIRLYI

SEQ ID NO: 2074963 - protein, 25 aa, Staphylococcus
LDQVNWVGFYLIENNELILGPFQGH

SEQ ID NO: 2074964 - protein, 18 aa, Staphylococcus
LDRAGFFYEPTILDNVKK

SEQ ID NO: 2074965 - protein, 17 aa, Staphylococcus
LDRDVTLSIYLPKDFTE

SEQ ID NO: 2074966 - protein, 23 aa, Staphylococcus
LDRIYRSLGILQNSRMISMEEAS

SEQ ID NO: 2074967 - protein, 19 aa, Staphylococcus
LDRKFSEGIFDYTYPELGE

SEQ ID NO: 2074968 - protein, 24 aa, Staphylococcus
LDRVYRSLGILKYSRLISMEEASL

SEQ ID NO: 2074969 - protein, 22 aa, Staphylococcus
LDRVYRSLGILQNSRLITMEEA

SEQ ID NO: 2074970 - protein, 26 aa, Staphylococcus
LDRWTPKFLSIPVLSGLKKADHEIVD

SEQ ID NO: 2074971 - protein, 26 aa, Staphylococcus
LDSFKQPIIWLCGGLDRGNDFDELIP

SEQ ID NO: 2074972 - protein, 24 aa, Staphylococcus
LDSINLRLVDFKIEFGRTEDGDIL

SEQ ID NO: 2074973 - protein, 18 aa, Staphylococcus
LDSKFSKIYGLRTYGYNL

SEQ ID NO: 2074974 - protein, 17 aa, Staphylococcus
LDSLTYIREEIERIVRV

SEQ ID NO: 2074975 - protein, 18 aa, Staphylococcus
LDSPFKSRSYLSQSIFDD

SEQ ID NO: 2074976 - protein, 22 aa, Staphylococcus
LDSPLTRLQIFVDTSSIEIFCN

SEQ ID NO: 2074977 - protein, 17 aa, Staphylococcus
LDSRSFKSFSKPKWSKL

SEQ ID NO: 2074978 - protein, 24 aa, Staphylococcus
LDTLKQLYYLSKNLKYDLYHILFE

SEQ ID NO: 2074979 - protein, 22 aa, Staphylococcus
LDTLPHSIAIIGAGVIGLEFAS

SEQ ID NO: 2074980 - protein, 25 aa, Staphylococcus
LDTLYQLFVLDKLPTQRIFTGSEES

SEQ ID NO: 2074981 - protein, 25 aa, Staphylococcus
LDTQNPFDLYPQTFTTLLIESEHLT

SEQ ID NO: 2074982 - protein, 22 aa, Staphylococcus
LDTSLLFNIIPERFQGRTVDDD

SEQ ID NO: 2074983 - protein, 23 aa, Staphylococcus
LDTSVAVKWLIDKGYDVVACCLD

SEQ ID NO: 2074984 - protein, 21 aa, Staphylococcus
LDTSVAVKWLIDKGYDVVAVC

SEQ ID NO: 2074985 - protein, 17 aa, Staphylococcus
LDTYALQREVGGAILKN

SEQ ID NO: 2074986 - protein, 25 aa, Staphylococcus
LDVEMPIVLPRMKITYLPIRIEKLI

SEQ ID NO: 2074987 - protein, 17 aa, Staphylococcus
LDVIKYHDFLGHVINQY

SEQ ID NO: 2074988 - protein, 20 aa, Staphylococcus
LDVINKINVPVILVGQEHSG

SEQ ID NO: 2074989 - protein, 27 aa, Staphylococcus
LDVKRMPWIGLQWIFARKGAAASNHFE

SEQ ID NO: 2074990 - protein, 25 aa, Staphylococcus
LDVKVIIVTTFKRPGYFESAVANDV

SEQ ID NO: 2074991 - protein, 35 aa, Staphylococcus
LDVLNKVHLIQANPLLVILIMIFSSGHVENVHIAT

SEQ ID NO: 2074992 - protein, 28 aa, Staphylococcus
LDVLVEPFFEWVVEADAWYGPQLEHIKY

SEQ ID NO: 2074993 - protein, 26 aa, Staphylococcus
LDVMVEPFFEWVVEKDAWYGEELEHI

SEQ ID NO: 2074994 - protein, 26 aa, Staphylococcus
LDVMVEPFFEWVVEKDAWYGQELDHI

SEQ ID NO: 2074995 - protein, 33 aa, Staphylococcus
LDVQQLDALVILSDYNRRYLSDFTGTSGALIIS

SEQ ID NO: 2074996 - protein, 22 aa, Staphylococcus
LDVTLELKLLADVGLVGFPSVG

SEQ ID NO: 2074997 - protein, 26 aa, Staphylococcus
LDVYQKLLVFMKFKSGLDVSSHQSAQ

SEQ ID NO: 2074998 - protein, 18 aa, Staphylococcus
LDYEAIRQLAVQHQPKLI

SEQ ID NO: 2074999 - protein, 25 aa, Staphylococcus
LDYEENWLKLPLDEDIRKYGTPLPV

SEQ ID NO: 2075000 - protein, 22 aa, Staphylococcus
LDYLDLYLVHWPGTNEAVMIDT

SEQ ID NO: 2075001 - protein, 19 aa, Staphylococcus
LDYSTLYQVLRTLQENMKQ

SEQ ID NO: 2075002 - protein, 21 aa, Staphylococcus
LDYTTLRRYLRQTLSRYEIPS

SEQ ID NO: 2075003 - protein, 19 aa, Staphylococcus
LDYVWDQYPMMNEKDVRAV

SEQ ID NO: 2075004 - protein, 25 aa, Staphylococcus
LEAARTYELQFFTPSSIGAFGASTP

SEQ ID NO: 2075005 - protein, 21 aa, Staphylococcus
LEAFKEALPFLMTAAEKDDND

SEQ ID NO: 2075006 - protein, 21 aa, Staphylococcus
LEAFKEALPFLMTAAEQDDRH

SEQ ID NO: 2075007 - protein, 28 aa, Staphylococcus
LEAGGKRIRPVLLLLTLEMLTDQYKKGF

SEQ ID NO: 2075008 - protein, 29 aa, Staphylococcus
LEAGRSDYFWDLFIQMPAALMFPSGNPFY

SEQ ID NO: 2075009 - protein, 34 aa, Staphylococcus
LEAGRSDYFWDLFIQMPAALMFPSGNPLYDWIYQ

SEQ ID NO: 2075010 - protein, 35 aa, Staphylococcus
LEAGRSDYFWDLFIQMPAALMFPSGNRFYDWIYST

SEQ ID NO: 2075011 - protein, 17 aa, Staphylococcus
LEAHLPFVSSKGGIYEW

SEQ ID NO: 2075012 - protein, 27 aa, Staphylococcus
LEAKKEMIQFDYLFAAIGGGGLISGVS

SEQ ID NO: 2075013 - protein, 19 aa, Staphylococcus
LEALAKLNIYPKYIETRKS

SEQ ID NO: 2075014 - protein, 17 aa, Staphylococcus
LEALGVHAVMPLASPIG

SEQ ID NO: 2075015 - protein, 18 aa, Staphylococcus
LEALLKYYRLSKEEFIQL

SEQ ID NO: 2075016 - protein, 23 aa, Staphylococcus
LEANVRYLALDLGGENIRVNSIS

SEQ ID NO: 2075017 - protein, 29 aa, Staphylococcus
LEAQLFATQLLFQFLFSQGRLNDARAYIL

SEQ ID NO: 2075018 - protein, 23 aa, Staphylococcus
LEARPYRVLRVGSFLLSTEGYKI

SEQ ID NO: 2075019 - protein, 18 aa, Staphylococcus
LEASMKYINDHGGLIIYL

SEQ ID NO: 2075020 - protein, 23 aa, Staphylococcus
LECPSIISQVKFYHVPAGITIET

SEQ ID NO: 2075021 - protein, 19 aa, Staphylococcus
LECPSIISQVKFYHVPEGI

SEQ ID NO: 2075022 - protein, 24 aa, Staphylococcus
LEDDALCFFDLGSAEMNLDMAIEM

SEQ ID NO: 2075023 - protein, 17 aa, Staphylococcus
LEDELQVKLFKRQGRNI

SEQ ID NO: 2075024 - protein, 26 aa, Staphylococcus
LEDERFYKHHGFDFKGTSRALFSTLS

SEQ ID NO: 2075025 - protein, 18 aa, Staphylococcus
LEDFHFREKIMHFDHERI

SEQ ID NO: 2075026 - protein, 27 aa, Staphylococcus
LEDLDLKELVLPLIVLDFSKEAADNND

SEQ ID NO: 2075027 - protein, 27 aa, Staphylococcus
LEDLDLKELVLPLIVLDFSKEAAENAD

SEQ ID NO: 2075028 - protein, 26 aa, Staphylococcus
LEDLDLKELVLPLIVLDYSKEVKNND

SEQ ID NO: 2075029 - protein, 19 aa, Staphylococcus
LEDLNAYRFIIHSSGSTRE

SEQ ID NO: 2075030 - protein, 25 aa, Staphylococcus
LEDLNSRLYHYWALGHIHEREQLSD

SEQ ID NO: 2075031 - protein, 21 aa, Staphylococcus
LEDMDLYTAKQFLYAEPDDNK

SEQ ID NO: 2075032 - protein, 17 aa, Staphylococcus
LEDMFYLTKLVITDTET

SEQ ID NO: 2075033 - protein, 21 aa, Staphylococcus
LEDNHVLTTFLKPVTQSASGT

SEQ ID NO: 2075034 - protein, 28 aa, Staphylococcus
LEDSNYLKDNILKFGLYTGEHHVVINAD

SEQ ID NO: 2075035 - protein, 19 aa, Staphylococcus
LEDWYRKGAFAVGIGSALM

SEQ ID NO: 2075036 - protein, 23 aa, Staphylococcus
LEDYIAIYRRFAEPYGLAYAQES

SEQ ID NO: 2075037 - protein, 29 aa, Staphylococcus
LEDYIHFLHQIQVDRIIFGDPAVVMFVKK

SEQ ID NO: 2075038 - protein, 24 aa, Staphylococcus
LEDYRVMIVHPWQYDHTIGGKFSQ

SEQ ID NO: 2075039 - protein, 26 aa, Staphylococcus
LEEALANYNLYYYFGDIDKNEILRLM

SEQ ID NO: 2075040 - protein, 22 aa, Staphylococcus
LEEFFEMYSWAQIGIHQKPIGI

SEQ ID NO: 2075041 - protein, 23 aa, Staphylococcus
LEEFFEMYSWAQIGIHQKPIGVF

SEQ ID NO: 2075042 - protein, 23 aa, Staphylococcus
LEEFFEMYSWAQIGIHQKPIGVY

SEQ ID NO: 2075043 - protein, 24 aa, Staphylococcus
LEEGAIVPWEPKSSDFYPTLLKRV

SEQ ID NO: 2075044 - protein, 23 aa, Staphylococcus
LEEKFKGFYSPSPGSVYPILQML

SEQ ID NO: 2075045 - protein, 24 aa, Staphylococcus
LEEKGILYAPDYIVNSGGVINTAD

SEQ ID NO: 2075046 - protein, 24 aa, Staphylococcus
LEELCALGIQIGTDIPFCILGKTA

SEQ ID NO: 2075047 - protein, 27 aa, Staphylococcus
LEELDLKELVLPLIVLDFSQEVAQNSD

SEQ ID NO: 2075048 - protein, 27 aa, Staphylococcus
LEELDLKELVLPLIVLDYSKEVADNAD

SEQ ID NO: 2075049 - protein, 25 aa, Staphylococcus
LEELELPYRRVILCTGDLGFSSSKT

SEQ ID NO: 2075050 - protein, 18 aa, Staphylococcus
LEELGVHAIMPLASPIGT

SEQ ID NO: 2075051 - protein, 22 aa, Staphylococcus
LEELSQTSFKRWFVDFEFPDED

SEQ ID NO: 2075052 - protein, 17 aa, Staphylococcus
LEELYILGLLIINNEPS

SEQ ID NO: 2075053 - protein, 29 aa, Staphylococcus
LEENIEEKIWYKLLVNLGINSITALGRDT

SEQ ID NO: 2075054 - protein, 24 aa, Staphylococcus
LEEPFEFPLMALIVSGGHTELVYM

SEQ ID NO: 2075055 - protein, 25 aa, Staphylococcus
LEEPIDIEAFKQIILKHIFGEHEVE

SEQ ID NO: 2075056 - protein, 32 aa, Staphylococcus
LEEQFKGFYSPSPGSVYPILQMLEDREFVSVT

SEQ ID NO: 2075057 - protein, 17 aa, Staphylococcus
LEEQLAPVVKQLNQLHI

SEQ ID NO: 2075058 - protein, 23 aa, Staphylococcus
LEERGYHLNKTEYRGREATDFQE

SEQ ID NO: 2075059 - protein, 17 aa, Staphylococcus
LEERKYYLLNVHNNFLL

SEQ ID NO: 2075060 - protein, 24 aa, Staphylococcus
LEERYPILMLFDDYNRIDLTLLSK

SEQ ID NO: 2075061 - protein, 26 aa, Staphylococcus
LEESLELYQRGMKLSATCDATLKDAE

SEQ ID NO: 2075062 - protein, 25 aa, Staphylococcus
LEFGSPKAIIPKKLATDVDADLIMC

SEQ ID NO: 2075063 - protein, 26 aa, Staphylococcus
LEFKYLKKCLNTFEIISTGGGIIENK

SEQ ID NO: 2075064 - protein, 19 aa, Staphylococcus
LEFPFVIYSGLSKSFNRSD

SEQ ID NO: 2075065 - protein, 25 aa, Staphylococcus
LEGALTRLLAYSKLQGRPITTELAA

SEQ ID NO: 2075066 - protein, 25 aa, Staphylococcus
LEGALTRLLAYSQLQGKPITTELAA

SEQ ID NO: 2075067 - protein, 25 aa, Staphylococcus
LEGALTRLLAYSQLQGRPITTELTA

SEQ ID NO: 2075068 - protein, 24 aa, Staphylococcus
LEGALTRVLAFSKLQGQPITTELT

SEQ ID NO: 2075069 - protein, 29 aa, Staphylococcus
LEGFTLPKMMWVSTHEPELWKKVDVFVLP

SEQ ID NO: 2075070 - protein, 20 aa, Staphylococcus
LEGGGITRLLYSKEWTRAVN

SEQ ID NO: 2075071 - protein, 19 aa, Staphylococcus
LEGITNYLKHEFPEHDILM

SEQ ID NO: 2075072 - protein, 24 aa, Staphylococcus
LEGKNIHTLLTYGKDAKYISDIGG

SEQ ID NO: 2075073 - protein, 18 aa, Staphylococcus
LEGLEFMGIYWDPKKNET

SEQ ID NO: 2075074 - protein, 18 aa, Staphylococcus
LEGLEFMGVYWDAKKNES

SEQ ID NO: 2075075 - protein, 18 aa, Staphylococcus
LEGLEFMGVYWDPKKNEG

SEQ ID NO: 2075076 - protein, 18 aa, Staphylococcus
LEGLEFMGVYWDPKKNES

SEQ ID NO: 2075077 - protein, 17 aa, Staphylococcus
LEGLYQKMGYEGSNIIF

SEQ ID NO: 2075078 - protein, 17 aa, Staphylococcus
LEGMRTIGMALTPPLVP

SEQ ID NO: 2075079 - protein, 25 aa, Staphylococcus
LEGTNYLKDNILKFGFYADDSHVVI

SEQ ID NO: 2075080 - protein, 28 aa, Staphylococcus
LEGTRKIIPTHELGEPLDIGYAVTFFAS

SEQ ID NO: 2075081 - protein, 20 aa, Staphylococcus
LEGVLYNLYTVYLALIEVMG

SEQ ID NO: 2075082 - protein, 21 aa, Staphylococcus
LEGVLYNLYTVYLALIEVMNE

SEQ ID NO: 2075083 - protein, 17 aa, Staphylococcus
LEGYYQGNLPLGYNNIP

SEQ ID NO: 2075084 - protein, 32 aa, Staphylococcus
LEHLRFAHDFNPLYFKKLWLEAWEETHERELV

SEQ ID NO: 2075085 - protein, 20 aa, Staphylococcus
LEHNVFLLGHQRNPFYLLKR

SEQ ID NO: 2075086 - protein, 26 aa, Staphylococcus
LEHTTKNLIIPIYGKAESLNVAIAGS

SEQ ID NO: 2075087 - protein, 24 aa, Staphylococcus
LEIERLYILKNYQNYGYGKKLMNF

SEQ ID NO: 2075088 - protein, 18 aa, Staphylococcus
LEIFSLYENHSEGLAELM

SEQ ID NO: 2075089 - protein, 21 aa, Staphylococcus
LEIGATLHIVSLPGAGTRIEV

SEQ ID NO: 2075090 - protein, 19 aa, Staphylococcus
LEIGSGSFIPGFEEQLEGL

SEQ ID NO: 2075091 - protein, 18 aa, Staphylococcus
LEIHEKPMLAKTAKTKLV

SEQ ID NO: 2075092 - protein, 19 aa, Staphylococcus
LEIKSLIEKGFNLKGIKQI

SEQ ID NO: 2075093 - protein, 20 aa, Staphylococcus
LEILDLLSCGELCACDLLAY

SEQ ID NO: 2075094 - protein, 17 aa, Staphylococcus
LEILNMVGLPNAKERFK

SEQ ID NO: 2075095 - protein, 19 aa, Staphylococcus
LEINFYPHYRAQQFFQEYL

SEQ ID NO: 2075096 - protein, 22 aa, Staphylococcus
LEIPSIISQVKFYHVPEGITIE

SEQ ID NO: 2075097 - protein, 21 aa, Staphylococcus
LEIYAPLAHRLGINTIKWELE

SEQ ID NO: 2075098 - protein, 18 aa, Staphylococcus
LEIYLAPNTATLIDLHQR

SEQ ID NO: 2075099 - protein, 30 aa, Staphylococcus
LEKALSNTYDLILLDLMLPNINGLEICRQI

SEQ ID NO: 2075100 - protein, 19 aa, Staphylococcus
LEKDELFQFLKVAKYHHSP

SEQ ID NO: 2075101 - protein, 32 aa, Staphylococcus
LEKDNNAPFLPRFGLLITLPSTYEQINYYGNG

SEQ ID NO: 2075102 - protein, 26 aa, Staphylococcus
LEKEGFHILAIKDMAGLLKPKAAFEL

SEQ ID NO: 2075103 - protein, 25 aa, Staphylococcus
LEKEKDFLQVIVKEDQQQLPADQGV

SEQ ID NO: 2075104 - protein, 26 aa, Staphylococcus
LEKEKDFLQVLVKDDGNHLPTDQNVS

SEQ ID NO: 2075105 - protein, 18 aa, Staphylococcus
LEKELQVPLFDRQGRNIY

SEQ ID NO: 2075106 - protein, 25 aa, Staphylococcus
LEKFNIETIFDLALVTILKGQLAVD

SEQ ID NO: 2075107 - protein, 17 aa, Staphylococcus
LEKILKEEQPNHFLVAF

SEQ ID NO: 2075108 - protein, 23 aa, Staphylococcus
LEKLGINFICMTGNPGTGVTNDK

SEQ ID NO: 2075109 - protein, 22 aa, Staphylococcus
LEKPYQLEKILLGGAKLSSNLI

SEQ ID NO: 2075110 - protein, 25 aa, Staphylococcus
LEKQKLFFDYYLKKEDNDWKDTPTV

SEQ ID NO: 2075111 - protein, 23 aa, Staphylococcus
LEKQNVLGVLPTGGGKSLCYQVP

SEQ ID NO: 2075112 - protein, 21 aa, Staphylococcus
LEKRLMGLTLDFDKFPGFKCY

SEQ ID NO: 2075113 - protein, 17 aa, Staphylococcus
LEKSIVIYLLNDFKPKE

SEQ ID NO: 2075114 - protein, 33 aa, Staphylococcus
LEKSKAFEFIIEGDTLIPPFIAVPGLGENVAQR

SEQ ID NO: 2075115 - protein, 17 aa, Staphylococcus
LEKVFNIDVVLSTDPRT

SEQ ID NO: 2075116 - protein, 22 aa, Staphylococcus
LEKVSVPFPRISYDDAIKFLKE

SEQ ID NO: 2075117 - protein, 25 aa, Staphylococcus
LELAIQNYIIFYNDERIKSKLKGLS

SEQ ID NO: 2075118 - protein, 19 aa, Staphylococcus
LELFKIAFPTDKSYQLSEL

SEQ ID NO: 2075119 - protein, 18 aa, Staphylococcus
LELFQWKTPEEVVQKKQE

SEQ ID NO: 2075120 - protein, 25 aa, Staphylococcus
LELGGKSPYIILDDADIDGAASAAA

SEQ ID NO: 2075121 - protein, 17 aa, Staphylococcus
LELIGLMGNISHIDEQP

SEQ ID NO: 2075122 - protein, 17 aa, Staphylococcus
LELIIVKMARSLHIVGK

SEQ ID NO: 2075123 - protein, 17 aa, Staphylococcus
LELIKSYDITKELGFLN

SEQ ID NO: 2075124 - protein, 26 aa, Staphylococcus
LELKYHVKIFEFKSPYLKLTRDGEKL

SEQ ID NO: 2075125 - protein, 19 aa, Staphylococcus
LELLLKIKEERNLTIVIIT

SEQ ID NO: 2075126 - protein, 29 aa, Staphylococcus
LELPIRQIVFNFAHYRFTPIKKDSGCTVF

SEQ ID NO: 2075127 - protein, 19 aa, Staphylococcus
LELTYETDITRWSELEELK

SEQ ID NO: 2075128 - protein, 20 aa, Staphylococcus
LEMIKQLIRLHKPQNILEIG

SEQ ID NO: 2075129 - protein, 17 aa, Staphylococcus
LEMIPYIDAKDIIVVTN

SEQ ID NO: 2075130 - protein, 18 aa, Staphylococcus
LEMKARLDKGVIVTIFPD

SEQ ID NO: 2075131 - protein, 18 aa, Staphylococcus
LEMKTIEALLRKGYEYDT

SEQ ID NO: 2075132 - protein, 18 aa, Staphylococcus
LEMMEIKVHALHAGVTLI

SEQ ID NO: 2075133 - protein, 19 aa, Staphylococcus
LEMTFFYELILGEETEFYQ

SEQ ID NO: 2075134 - protein, 18 aa, Staphylococcus
LENDENITLLNFKAQFKS

SEQ ID NO: 2075135 - protein, 25 aa, Staphylococcus
LENDNLIKMFLPMLRADFVIDEEYQ

SEQ ID NO: 2075136 - protein, 29 aa, Staphylococcus
LENEISVWKQFKSVFYFGTFDSPKQHDTI

SEQ ID NO: 2075137 - protein, 21 aa, Staphylococcus
LENGLVWSIPITLPVSEEEAN

SEQ ID NO: 2075138 - protein, 22 aa, Staphylococcus
LENGLVWSIPITLPVTEEEADK

SEQ ID NO: 2075139 - protein, 32 aa, Staphylococcus
LENGSQLPYGTLLFATGRRPNLQAFESLNLTM

SEQ ID NO: 2075140 - protein, 21 aa, Staphylococcus
LENIIAGPALVAQWINLQYYA

SEQ ID NO: 2075141 - protein, 23 aa, Staphylococcus
LENLPFGIAVMDSRFRMGSMGSV

SEQ ID NO: 2075142 - protein, 26 aa, Staphylococcus
LENLRTRLLEMIGVNEVVINFDERAV

SEQ ID NO: 2075143 - protein, 32 aa, Staphylococcus
LENNKRKFPTIRTLFLLLVGFKNSKLNDQSKS

SEQ ID NO: 2075144 - protein, 24 aa, Staphylococcus
LENPEKCLSLALLSPALGGWKGSS

SEQ ID NO: 2075145 - protein, 20 aa, Staphylococcus
LENPKLDKPFILCEYAHAMG

SEQ ID NO: 2075146 - protein, 25 aa, Staphylococcus
LENRIVQFYTDLNTDGRFLNVGENN

SEQ ID NO: 2075147 - protein, 19 aa, Staphylococcus
LENSWIPVDERLNRMLKGE

SEQ ID NO: 2075148 - protein, 19 aa, Staphylococcus
LENTLFDLSDTLKMHLIEL

SEQ ID NO: 2075149 - protein, 28 aa, Staphylococcus
LENVPGFKALRFLRPKTVGRHYIIVTLW

SEQ ID NO: 2075150 - protein, 22 aa, Staphylococcus
LEPAYSFMIRVRAPGGASTAEQ

SEQ ID NO: 2075151 - protein, 27 aa, Staphylococcus
LEPEILKPRLIPLLQMSNKEFKNTYGH

SEQ ID NO: 2075152 - protein, 18 aa, Staphylococcus
LEPLDLIKNLALKSIVKD

SEQ ID NO: 2075153 - protein, 30 aa, Staphylococcus
LEPNDPIIHFALAEILYYDGQYLRATHEYQ

SEQ ID NO: 2075154 - protein, 30 aa, Staphylococcus
LEPNDPIIHFALAELLYFDGQYLRATREYE

SEQ ID NO: 2075155 - protein, 30 aa, Staphylococcus
LEPNDPIIHFALAEMLYFDGQYLRATREYE

SEQ ID NO: 2075156 - protein, 30 aa, Staphylococcus
LEPNDPILHFALAELLYFDGQYLRATTEYE

SEQ ID NO: 2075157 - protein, 26 aa, Staphylococcus
LEPNDPVLHFALAELMYFDGQYLRAS

SEQ ID NO: 2075158 - protein, 25 aa, Staphylococcus
LEPNGLIRIYLQHIDYTYSSRRYLK

SEQ ID NO: 2075159 - protein, 31 aa, Staphylococcus
LEPSPMTADLYYLLQLLYCNNYTYETLIERH

SEQ ID NO: 2075160 - protein, 19 aa, Staphylococcus
LEPTPKWSISRYKGLGEMN

SEQ ID NO: 2075161 - protein, 18 aa, Staphylococcus
LEPWRFVVIQNREIRDKL

SEQ ID NO: 2075162 - protein, 18 aa, Staphylococcus
LEQCIYRSLLECVTVLEY

SEQ ID NO: 2075163 - protein, 25 aa, Staphylococcus
LEQEDKIYILFNKPAQVITSVSDDR

SEQ ID NO: 2075164 - protein, 18 aa, Staphylococcus
LEQGLNVFVVQLPSDMDP

SEQ ID NO: 2075165 - protein, 24 aa, Staphylococcus
LEQLFNIEIELIYTRLPGAVINDV

SEQ ID NO: 2075166 - protein, 18 aa, Staphylococcus
LEQLTAIDKIALSDKEKR

SEQ ID NO: 2075167 - protein, 17 aa, Staphylococcus
LEQNWVGGAYWTPPEVT

SEQ ID NO: 2075168 - protein, 27 aa, Staphylococcus
LEQRTAIKEGLFRKGLRRRYKLIGQIM

SEQ ID NO: 2075169 - protein, 19 aa, Staphylococcus
LEQTYDAIILCTGAQKARD

SEQ ID NO: 2075170 - protein, 18 aa, Staphylococcus
LEQVILNLNIEQINKLQF

SEQ ID NO: 2075171 - protein, 20 aa, Staphylococcus
LERAGAHIVPFLSINNIDDL

SEQ ID NO: 2075172 - protein, 18 aa, Staphylococcus
LERALMNYMLTKHTTQHG

SEQ ID NO: 2075173 - protein, 17 aa, Staphylococcus
LERFIDVLAQKAKDYKY

SEQ ID NO: 2075174 - protein, 18 aa, Staphylococcus
LERNINVALLTVSDTRDF

SEQ ID NO: 2075175 - protein, 18 aa, Staphylococcus
LERPRKILLMVKAGPATD

SEQ ID NO: 2075176 - protein, 25 aa, Staphylococcus
LESDDIDMFIPHQANIRIMESARER

SEQ ID NO: 2075177 - protein, 26 aa, Staphylococcus
LESEEHYLVFATKRGIVKRSALSNFS

SEQ ID NO: 2075178 - protein, 20 aa, Staphylococcus
LESFISFINTHKPVFKHLLV

SEQ ID NO: 2075179 - protein, 17 aa, Staphylococcus
LESGEIFKYFPIPENNY

SEQ ID NO: 2075180 - protein, 25 aa, Staphylococcus
LESHQQMNLLKDLELPLARILSKME

SEQ ID NO: 2075181 - protein, 27 aa, Staphylococcus
LESIGVNLLVIRHPQNAYYEELENLNI

SEQ ID NO: 2075182 - protein, 19 aa, Staphylococcus
LESILRKLQPTARFIRTVN

SEQ ID NO: 2075183 - protein, 25 aa, Staphylococcus
LESKALLSIFLSNSDNWNLHMSEII

SEQ ID NO: 2075184 - protein, 17 aa, Staphylococcus
LESKTVIISTGASWRKL

SEQ ID NO: 2075185 - protein, 18 aa, Staphylococcus
LESLFIQFYSQCVKQNLI

SEQ ID NO: 2075186 - protein, 34 aa, Staphylococcus
LESLTVNDFYRILTEPKLSLIKQYEALLKTEEVT

SEQ ID NO: 2075187 - protein, 33 aa, Staphylococcus
LESLTVNDFYRILTEPKLSLVKQYEALLKTEEV

SEQ ID NO: 2075188 - protein, 21 aa, Staphylococcus
LESVVALEYSFVEALAKLEMN

SEQ ID NO: 2075189 - protein, 22 aa, Staphylococcus
LETAAGFLMEKEIKFIGGVVND

SEQ ID NO: 2075190 - protein, 23 aa, Staphylococcus
LETALDTLINLKSSGRMVGIISH

SEQ ID NO: 2075191 - protein, 23 aa, Staphylococcus
LETALDTLLSLKSTGRMVGIISH

SEQ ID NO: 2075192 - protein, 27 aa, Staphylococcus
LETARMYDLHFFMPSSIGAFGASTPKK

SEQ ID NO: 2075193 - protein, 26 aa, Staphylococcus
LETARTYELHFFTPSSIGAFGDSTPK

SEQ ID NO: 2075194 - protein, 25 aa, Staphylococcus
LETASYFVIILARKNLKADSEHFRH

SEQ ID NO: 2075195 - protein, 28 aa, Staphylococcus
LETGIKVIDLLAPYIKGGKIGLFGGAGV

SEQ ID NO: 2075196 - protein, 18 aa, Staphylococcus
LETIRIGLYAALEAIVES

SEQ ID NO: 2075197 - protein, 22 aa, Staphylococcus
LETLRRYCFDKSFIGMNGIDVK

SEQ ID NO: 2075198 - protein, 23 aa, Staphylococcus
LETLSHYWGHVRDYYNDFESDIK

SEQ ID NO: 2075199 - protein, 24 aa, Staphylococcus
LETLYEIPYIINKLAHKFTDGKVL

SEQ ID NO: 2075200 - protein, 18 aa, Staphylococcus
LETQLFGELPLEQPTWDP

SEQ ID NO: 2075201 - protein, 34 aa, Staphylococcus
LETTQYILAQSKQQWIPVYKSWRLNERHYGALQG

SEQ ID NO: 2075202 - protein, 17 aa, Staphylococcus
LETVLRRFIYQVSAEIG

SEQ ID NO: 2075203 - protein, 17 aa, Staphylococcus
LETYLENPKLDKPFILC

SEQ ID NO: 2075204 - protein, 24 aa, Staphylococcus
LETYQKILNLPFAKESTELFEGPS

SEQ ID NO: 2075205 - protein, 20 aa, Staphylococcus
LEVDFIFKARKPMGKAFIKA

SEQ ID NO: 2075206 - protein, 21 aa, Staphylococcus
LEVIEKLNVPVILVGQSYPNL

SEQ ID NO: 2075207 - protein, 24 aa, Staphylococcus
LEVLDPSLPIDLIIDYAHTADGMD

SEQ ID NO: 2075208 - protein, 20 aa, Staphylococcus
LEVMRYLEEDGFVLKYVDVN

SEQ ID NO: 2075209 - protein, 18 aa, Staphylococcus
LEVNHAYIRAVAASGNRN

SEQ ID NO: 2075210 - protein, 18 aa, Staphylococcus
LEVPIAYPNEVFVTSPKI

SEQ ID NO: 2075211 - protein, 17 aa, Staphylococcus
LEVPLFELDHNEDMFNN

SEQ ID NO: 2075212 - protein, 26 aa, Staphylococcus
LEVPVPAIIQAFKIAREAGVTTVLNP

SEQ ID NO: 2075213 - protein, 26 aa, Staphylococcus
LEVVEKPLPFLFGEDFSFYGQQLAPA

SEQ ID NO: 2075214 - protein, 21 aa, Staphylococcus
LEVVESFRHSGNNPAWMILDV

SEQ ID NO: 2075215 - protein, 17 aa, Staphylococcus
LEWIRIANEYKIPTYVL

SEQ ID NO: 2075216 - protein, 18 aa, Staphylococcus
LEYIGLSYLTLNRVTTTL

SEQ ID NO: 2075217 - protein, 19 aa, Staphylococcus
LEYIKYWTAHREELPYDID

SEQ ID NO: 2075218 - protein, 25 aa, Staphylococcus
LEYLDLFLIHWPCEENGLFIESYKA

SEQ ID NO: 2075219 - protein, 18 aa, Staphylococcus
LEYLKYAERFVRITNFPF

SEQ ID NO: 2075220 - protein, 35 aa, Staphylococcus
LEYMKYVNKFMRIFNFPFYFRGEVYDPFETVTLSE

SEQ ID NO: 2075221 - protein, 18 aa, Staphylococcus
LEYNSLIKGIVYQDTETP

SEQ ID NO: 2075222 - protein, 18 aa, Staphylococcus
LEYTVGNPVLDASKFTEP

SEQ ID NO: 2075223 - protein, 23 aa, Staphylococcus
LFAATFINHFAGETPHMHFDIAG

SEQ ID NO: 2075224 - protein, 26 aa, Staphylococcus
LFAEYFERFLFEHPAVGRIIVEKGVM

SEQ ID NO: 2075225 - protein, 19 aa, Staphylococcus
LFAPLLEPEIIFELTADLP

SEQ ID NO: 2075226 - protein, 21 aa, Staphylococcus
LFDAIHTIKGSLKIFEGMLDT

SEQ ID NO: 2075227 - protein, 20 aa, Staphylococcus
LFDALHTIKGSLRIFEGMIA

SEQ ID NO: 2075228 - protein, 18 aa, Staphylococcus
LFDEFRETQLSFQQKQMQ

SEQ ID NO: 2075229 - protein, 17 aa, Staphylococcus
LFDIIKNHDDSYLRSEQ

SEQ ID NO: 2075230 - protein, 17 aa, Staphylococcus
LFDLSDTLKMHLIELNE

SEQ ID NO: 2075231 - protein, 25 aa, Staphylococcus
LFDRRKKHIILTDIGQIFYDKCVEA

SEQ ID NO: 2075232 - protein, 33 aa, Staphylococcus
LFDSYWKARQVPLPQIRIPLFTCASWSTQGLHN

SEQ ID NO: 2075233 - protein, 20 aa, Staphylococcus
LFDWFQLAQQKESRMVQVRR

SEQ ID NO: 2075234 - protein, 24 aa, Staphylococcus
LFEDKDADLILFGHNHRLHLFDDK

SEQ ID NO: 2075235 - protein, 23 aa, Staphylococcus
LFEDSYVLYVPKQDPLASATHPP

SEQ ID NO: 2075236 - protein, 20 aa, Staphylococcus
LFEGFSMGNPKIKTGNLLNS

SEQ ID NO: 2075237 - protein, 19 aa, Staphylococcus
LFEGFSMGNPKIQTGNLLE

SEQ ID NO: 2075238 - protein, 27 aa, Staphylococcus
LFEHSDDPKFKRWVIGSILSRTYYHNM

SEQ ID NO: 2075239 - protein, 17 aa, Staphylococcus
LFELDGDLPLFPGHGQY

SEQ ID NO: 2075240 - protein, 19 aa, Staphylococcus
LFEQFKQMLQPLIDHHKLA

SEQ ID NO: 2075241 - protein, 19 aa, Staphylococcus
LFEQFRLMISPLVEADKLA

SEQ ID NO: 2075242 - protein, 27 aa, Staphylococcus
LFFGTPISTCILVFKKCREIDDNVLFI

SEQ ID NO: 2075243 - protein, 20 aa, Staphylococcus
LFFIDKVPGITIRDLLKSME

SEQ ID NO: 2075244 - protein, 17 aa, Staphylococcus
LFFIISLSGEATQLPEI

SEQ ID NO: 2075245 - protein, 17 aa, Staphylococcus
LFGINYVLLTDDQDFRE

SEQ ID NO: 2075246 - protein, 18 aa, Staphylococcus
LFHASRLNVPVGGGDHLV

SEQ ID NO: 2075247 - protein, 19 aa, Staphylococcus
LFHGIGSAGFHIHFANDDR

SEQ ID NO: 2075248 - protein, 18 aa, Staphylococcus
LFHGVGTAGFHLHFVDQE

SEQ ID NO: 2075249 - protein, 18 aa, Staphylococcus
LFIGVELHENARPFCEAL

SEQ ID NO: 2075250 - protein, 17 aa, Staphylococcus
LFIKGYITHYFDFISED

SEQ ID NO: 2075251 - protein, 24 aa, Staphylococcus
LFKATVDSLLFRGVHYEICCVDRK

SEQ ID NO: 2075252 - protein, 24 aa, Staphylococcus
LFKDDYIRNLISRHKTEQLPRLEM

SEQ ID NO: 2075253 - protein, 17 aa, Staphylococcus
LFKGTELKHFIPREHIE

SEQ ID NO: 2075254 - protein, 18 aa, Staphylococcus
LFKGTELKHFIPREHIEG

SEQ ID NO: 2075255 - protein, 25 aa, Staphylococcus
LFKHYIQKFNLPLNKKIKTFSTGMK

SEQ ID NO: 2075256 - protein, 36 aa, Staphylococcus
LFKIVSASLVKYYYRTPRIPRSLLDEFREGLLIGTA

SEQ ID NO: 2075257 - protein, 32 aa, Staphylococcus
LFKIVSASLVQYYYRTPRIPRSLLDEYREGIL

SEQ ID NO: 2075258 - protein, 17 aa, Staphylococcus
LFKLDPEKAHGLTIDAL

SEQ ID NO: 2075259 - protein, 17 aa, Staphylococcus
LFKQFKAIADKKKSVTD

SEQ ID NO: 2075260 - protein, 19 aa, Staphylococcus
LFKQFKQGAVFINAARGSL

SEQ ID NO: 2075261 - protein, 18 aa, Staphylococcus
LFKQFKTVADKKKAVTDR

SEQ ID NO: 2075262 - protein, 26 aa, Staphylococcus
LFLPYIDCHRWFVKYLYSNASTLKYF

SEQ ID NO: 2075263 - protein, 18 aa, Staphylococcus
LFNAITKAGALAANYPFA

SEQ ID NO: 2075264 - protein, 30 aa, Staphylococcus
LFNDFEMHFYRYVFPYYDTLYTLEKLSQNN

SEQ ID NO: 2075265 - protein, 26 aa, Staphylococcus
LFNDPKFEIYSKLFKSWSGTIHTSMY

SEQ ID NO: 2075266 - protein, 25 aa, Staphylococcus
LFNDPQYEIYSKLFRSWSGTIHTSM

SEQ ID NO: 2075267 - protein, 20 aa, Staphylococcus
LFNFLYSKFTDLGVPVIRTS

SEQ ID NO: 2075268 - protein, 31 aa, Staphylococcus
LFNRHGSLLPIMHLYQFIAAFIDVPIHISNN

SEQ ID NO: 2075269 - protein, 20 aa, Staphylococcus
LFPDNEKLIRWLDLAEEKIS

SEQ ID NO: 2075270 - protein, 19 aa, Staphylococcus
LFQFLKVAKYHHSPQNSFE

SEQ ID NO: 2075271 - protein, 17 aa, Staphylococcus
LFREYFATVIPAADNKF

SEQ ID NO: 2075272 - protein, 25 aa, Staphylococcus
LFSAREVILIITGSDKKEVVHKLYE

SEQ ID NO: 2075273 - protein, 24 aa, Staphylococcus
LFSELFERFLYEHPQVGRIVVEKG

SEQ ID NO: 2075274 - protein, 19 aa, Staphylococcus
LFSFLEKLIAAGFPKDKII

SEQ ID NO: 2075275 - protein, 18 aa, Staphylococcus
LFSFNKLWIKANKDTFET

SEQ ID NO: 2075276 - protein, 26 aa, Staphylococcus
LFSNTYLAMRVSFFNELDMYAEINDL

SEQ ID NO: 2075277 - protein, 24 aa, Staphylococcus
LFSTAEGFNIKKLLRSGISNSELK

SEQ ID NO: 2075278 - protein, 19 aa, Staphylococcus
LFSTHYHELTSLDQMLPCL

SEQ ID NO: 2075279 - protein, 20 aa, Staphylococcus
LFVDEIHMLGKYKGITDILK

SEQ ID NO: 2075280 - protein, 17 aa, Staphylococcus
LFVLESQDSIFFSQTPE

SEQ ID NO: 2075281 - protein, 26 aa, Staphylococcus
LFYNTPARLKYIKSLYTELGKITDIV

SEQ ID NO: 2075282 - protein, 20 aa, Staphylococcus
LFYVNPGLIPLELPIEKLPK

SEQ ID NO: 2075283 - protein, 26 aa, Staphylococcus
LGAEEFGFATAPLVVLGCIMMRVCHK

SEQ ID NO: 2075284 - protein, 21 aa, Staphylococcus
LGAEVGWYIPNRFSEGYGPNE

SEQ ID NO: 2075285 - protein, 23 aa, Staphylococcus
LGAEVGWYIPNRFSEGYGPNKYA

SEQ ID NO: 2075286 - protein, 20 aa, Staphylococcus
LGAEVGWYIPNRFTEGYGPN

SEQ ID NO: 2075287 - protein, 21 aa, Staphylococcus
LGAFKEAMPFLMRASELDDKN

SEQ ID NO: 2075288 - protein, 23 aa, Staphylococcus
LGAGILAFFNASLSNGIDIVLKE

SEQ ID NO: 2075289 - protein, 22 aa, Staphylococcus
LGAGILTFFNASLSNGIDIVLK

SEQ ID NO: 2075290 - protein, 23 aa, Staphylococcus
LGAHVGWYIPNRFSEGYGPNEMA

SEQ ID NO: 2075291 - protein, 22 aa, Staphylococcus
LGAKRVLPLAVSGPFHSSMMQV

SEQ ID NO: 2075292 - protein, 22 aa, Staphylococcus
LGAKRVLPLNVSGPFHSSMMQV

SEQ ID NO: 2075293 - protein, 19 aa, Staphylococcus
LGAKRVMPLAVSGPFHSSM

SEQ ID NO: 2075294 - protein, 21 aa, Staphylococcus
LGAQVGWYIPNRFSEGYGPNE

SEQ ID NO: 2075295 - protein, 21 aa, Staphylococcus
LGASPHEGLMLLKLVHYDKDD

SEQ ID NO: 2075296 - protein, 19 aa, Staphylococcus
LGAVHGLKYWFNYTSDDLV

SEQ ID NO: 2075297 - protein, 25 aa, Staphylococcus
LGAVHGLKYWFNYTSKDLVTFEPNG

SEQ ID NO: 2075298 - protein, 22 aa, Staphylococcus
LGDDFTYYFAKSEQVPSSVGLG

SEQ ID NO: 2075299 - protein, 27 aa, Staphylococcus
LGDLAMIWREGCIIRAQFLQKIKDAYD

SEQ ID NO: 2075300 - protein, 17 aa, Staphylococcus
LGDLAPTLLDLLNVEQP

SEQ ID NO: 2075301 - protein, 21 aa, Staphylococcus
LGDNLFVLLCIANSLGIDMTE

SEQ ID NO: 2075302 - protein, 20 aa, Staphylococcus
LGDRVNLVNSLFLLNEQNVV

SEQ ID NO: 2075303 - protein, 17 aa, Staphylococcus
LGEGQFDIHLIPETKRA

SEQ ID NO: 2075304 - protein, 24 aa, Staphylococcus
LGEHYIIQLFIYNYDDKRIHFFLK

SEQ ID NO: 2075305 - protein, 19 aa, Staphylococcus
LGEKLSLPPFLEEQREAIE

SEQ ID NO: 2075306 - protein, 26 aa, Staphylococcus
LGELAMIWREGCIIRAQFLQKIKEAY

SEQ ID NO: 2075307 - protein, 18 aa, Staphylococcus
LGFGQYFTDYMLSYDYDS

SEQ ID NO: 2075308 - protein, 20 aa, Staphylococcus
LGFKKAGFNIIWANDFEKDA

SEQ ID NO: 2075309 - protein, 20 aa, Staphylococcus
LGFKLGVLEFYLIEGHDLAQ

SEQ ID NO: 2075310 - protein, 17 aa, Staphylococcus
LGFPRLGRKREWKKAIE

SEQ ID NO: 2075311 - protein, 18 aa, Staphylococcus
LGFTLMLTVARRIVEAEK

SEQ ID NO: 2075312 - protein, 23 aa, Staphylococcus
LGFTQKSPRWAIAYKFPAEEVVT

SEQ ID NO: 2075313 - protein, 24 aa, Staphylococcus
LGGDDIPFSGFKRFNTPSQVAGDI

SEQ ID NO: 2075314 - protein, 21 aa, Staphylococcus
LGGGERLGTLVLGRVKDDFNE

SEQ ID NO: 2075315 - protein, 17 aa, Staphylococcus
LGGGGQYGIAWEIGLLK

SEQ ID NO: 2075316 - protein, 17 aa, Staphylococcus
LGGIGLNAIIGAKLAGA

SEQ ID NO: 2075317 - protein, 24 aa, Staphylococcus
LGGTFAHVLAIQYSLDPVIKELGA

SEQ ID NO: 2075318 - protein, 25 aa, Staphylococcus
LGGYKLDREGFFYAPTILDHVKTTD

SEQ ID NO: 2075319 - protein, 17 aa, Staphylococcus
LGHQLFALSQGGTSFKM

SEQ ID NO: 2075320 - protein, 25 aa, Staphylococcus
LGHVKGYFIYPYKEEMKNRNIKLFN

SEQ ID NO: 2075321 - protein, 20 aa, Staphylococcus
LGIDIEMIIDYYLYQNVSAL

SEQ ID NO: 2075322 - protein, 29 aa, Staphylococcus
LGIDTTIPFHIRLLNNDIFRSGVFNTKFL

SEQ ID NO: 2075323 - protein, 26 aa, Staphylococcus
LGIDTTIPFHIRLLQNDVFRGGEYST

SEQ ID NO: 2075324 - protein, 27 aa, Staphylococcus
LGIDTTIPFHLRLLNNEIFRSGEFNTK

SEQ ID NO: 2075325 - protein, 21 aa, Staphylococcus
LGIDVIWLSPMYQSPNDDNGY

SEQ ID NO: 2075326 - protein, 17 aa, Staphylococcus
LGIELLDHIIIGDQKFT

SEQ ID NO: 2075327 - protein, 17 aa, Staphylococcus
LGILFNQGEVCSAGSRL

SEQ ID NO: 2075328 - protein, 19 aa, Staphylococcus
LGILLRVTPLPIRNLGYRL

SEQ ID NO: 2075329 - protein, 28 aa, Staphylococcus
LGINAGLYLLEFLATLNLNKSAKDFVDF

SEQ ID NO: 2075330 - protein, 20 aa, Staphylococcus
LGINEPFMYKLVDIVAEIME

SEQ ID NO: 2075331 - protein, 21 aa, Staphylococcus
LGINEPFMYKLVDIVAEIMEP

SEQ ID NO: 2075332 - protein, 22 aa, Staphylococcus
LGINRHEVITRFITSLPQRHVV

SEQ ID NO: 2075333 - protein, 17 aa, Staphylococcus
LGINYYMSDWMKAYDGE

SEQ ID NO: 2075334 - protein, 17 aa, Staphylococcus
LGINYYMSDWMRGYDGE

SEQ ID NO: 2075335 - protein, 18 aa, Staphylococcus
LGINYYMSDWMRGYDGES

SEQ ID NO: 2075336 - protein, 18 aa, Staphylococcus
LGINYYMSDWMRGYEGES

SEQ ID NO: 2075337 - protein, 19 aa, Staphylococcus
LGINYYMSDWMRGYEGESE

SEQ ID NO: 2075338 - protein, 42 aa, Staphylococcus
LGIQGKKGVLFWQIIRFIQNTYPKYLLLENVDRLLKSPSSQR

SEQ ID NO: 2075339 - protein, 24 aa, Staphylococcus
LGIQLLDHVIIGDHTYLSMVEEGY

SEQ ID NO: 2075340 - protein, 18 aa, Staphylococcus
LGISLLDHIIIGNNKFTS

SEQ ID NO: 2075341 - protein, 18 aa, Staphylococcus
LGKDIHYKDLGLLIVDEE

SEQ ID NO: 2075342 - protein, 19 aa, Staphylococcus
LGKDIHYKDLGLLIVDEEQ

SEQ ID NO: 2075343 - protein, 21 aa, Staphylococcus
LGKELLVQVRKRQLKAKIVKK

SEQ ID NO: 2075344 - protein, 25 aa, Staphylococcus
LGKGKTVLTVLPSNGERYLSTPLYS

SEQ ID NO: 2075345 - protein, 21 aa, Staphylococcus
LGKISSTLLPLKDSSKRLITV

SEQ ID NO: 2075346 - protein, 20 aa, Staphylococcus
LGKLMYYPKGILSQSAEAKS

SEQ ID NO: 2075347 - protein, 17 aa, Staphylococcus
LGKLSGKHAFAEKLKQL

SEQ ID NO: 2075348 - protein, 28 aa, Staphylococcus
LGKNRITAIFPKLVFTIKKGVNFSEEDP

SEQ ID NO: 2075349 - protein, 24 aa, Staphylococcus
LGKNRYFISPYFLNDYNHFILNHK

SEQ ID NO: 2075350 - protein, 24 aa, Staphylococcus
LGKSILHILLQKQVYVTALVRDVN

SEQ ID NO: 2075351 - protein, 33 aa, Staphylococcus
LGKSVKWLIEKKRLAPYKYFSIDLINHEKLKKQ

SEQ ID NO: 2075352 - protein, 29 aa, Staphylococcus
LGLAVTGYRPVMEIQFLGFVFEVFDEVAG

SEQ ID NO: 2075353 - protein, 19 aa, Staphylococcus
LGLDRLVMLLTGRTNLRDT

SEQ ID NO: 2075354 - protein, 26 aa, Staphylococcus
LGLDYLDLYLVHWPGKDEAVMIDTWK

SEQ ID NO: 2075355 - protein, 24 aa, Staphylococcus
LGLDYLDLYLVHWPGMDEEVMIDT

SEQ ID NO: 2075356 - protein, 25 aa, Staphylococcus
LGLEAAFKSYFKQLEYNYGLNVVYQ

SEQ ID NO: 2075357 - protein, 24 aa, Staphylococcus
LGLEPWRFLVIQNKTLREKLIPYS

SEQ ID NO: 2075358 - protein, 29 aa, Staphylococcus
LGLIDENKLNFLWVTDWPLLEYDEDAKRY

SEQ ID NO: 2075359 - protein, 29 aa, Staphylococcus
LGLIDESKLNFLWVTDWPLLEYDDESKRY

SEQ ID NO: 2075360 - protein, 29 aa, Staphylococcus
LGLIDESKLNFLWVTDWPLLEYDEDAKRY

SEQ ID NO: 2075361 - protein, 29 aa, Staphylococcus
LGLIDETKLNFLWVTDWPLLEYDEDAKRY

SEQ ID NO: 2075362 - protein, 17 aa, Staphylococcus
LGLIRNKLEEHNLLRIA

SEQ ID NO: 2075363 - protein, 23 aa, Staphylococcus
LGLKNYLKLKFPDKKIFAVGETE

SEQ ID NO: 2075364 - protein, 19 aa, Staphylococcus
LGLLRLHLDLFDQYTENEP

SEQ ID NO: 2075365 - protein, 17 aa, Staphylococcus
LGLLSKRGKIAQKIGEE

SEQ ID NO: 2075366 - protein, 29 aa, Staphylococcus
LGLNSNWDMLFIVFSIHLIDLAKQLDQSH

SEQ ID NO: 2075367 - protein, 17 aa, Staphylococcus
LGLVAPQVKHRLDKFKK

SEQ ID NO: 2075368 - protein, 18 aa, Staphylococcus
LGLYVRRDHYGIETNLKL

SEQ ID NO: 2075369 - protein, 18 aa, Staphylococcus
LGMPTFDSTVNPLHQIQG

SEQ ID NO: 2075370 - protein, 18 aa, Staphylococcus
LGMVFQDFALWPHMTVFQ

SEQ ID NO: 2075371 - protein, 23 aa, Staphylococcus
LGNEAFVRQLALDYAKFKGNKNS

SEQ ID NO: 2075372 - protein, 27 aa, Staphylococcus
LGNEALVRQVVFDLGKRLGNKNSRVDF

SEQ ID NO: 2075373 - protein, 23 aa, Staphylococcus
LGNEEIFASRTLIDKLKENDFDI

SEQ ID NO: 2075374 - protein, 17 aa, Staphylococcus
LGNGSAYYAPASAVFEM

SEQ ID NO: 2075375 - protein, 24 aa, Staphylococcus
LGNPIESIKWLNKKLHSHGKRLEK

SEQ ID NO: 2075376 - protein, 17 aa, Staphylococcus
LGPFLLQRPSENKCLEM

SEQ ID NO: 2075377 - protein, 17 aa, Staphylococcus
LGPKRMNHLLAISSPEA

SEQ ID NO: 2075378 - protein, 27 aa, Staphylococcus
LGPQDSYLLVRGIKTLGLRMEQINRNV

SEQ ID NO: 2075379 - protein, 25 aa, Staphylococcus
LGPQDSYLLVRGVKTLGLRMEQINR

SEQ ID NO: 2075380 - protein, 23 aa, Staphylococcus
LGPSILTMPHIFENLFYHSNKEM

SEQ ID NO: 2075381 - protein, 30 aa, Staphylococcus
LGPVLLKVNELLLTQSILDKVFGLTHFAEY

SEQ ID NO: 2075382 - protein, 26 aa, Staphylococcus
LGQKRPFLLPIMHKIFNYEDPSLTQT

SEQ ID NO: 2075383 - protein, 21 aa, Staphylococcus
LGQLHVVINPAYFTDKTQFKA

SEQ ID NO: 2075384 - protein, 18 aa, Staphylococcus
LGQMRDAFFLAQETGTTG

SEQ ID NO: 2075385 - protein, 20 aa, Staphylococcus
LGQPSYFPIPEVIGVRLSNA

SEQ ID NO: 2075386 - protein, 20 aa, Staphylococcus
LGQQVIMKQTARKVRRLYEG

SEQ ID NO: 2075387 - protein, 26 aa, Staphylococcus
LGRDRKFQAILPLRGKVINTEKAKLE

SEQ ID NO: 2075388 - protein, 26 aa, Staphylococcus
LGRDRKFQAILPLRGKVINTEKARLE

SEQ ID NO: 2075389 - protein, 19 aa, Staphylococcus
LGREPNFTEIGIFSVMWSE

SEQ ID NO: 2075390 - protein, 17 aa, Staphylococcus
LGRIGVGRVFRGTMRVG

SEQ ID NO: 2075391 - protein, 28 aa, Staphylococcus
LGRKLDERLWLLNRAGKIPFVVSGQGQE

SEQ ID NO: 2075392 - protein, 27 aa, Staphylococcus
LGRKLDERMWLLNRAGKIPFVISCQGQ

SEQ ID NO: 2075393 - protein, 23 aa, Staphylococcus
LGSELLYQHLIKGFSVYTVIRAE

SEQ ID NO: 2075394 - protein, 29 aa, Staphylococcus
LGSGFQWYSWIHINDLVRAILFTIDNPNA

SEQ ID NO: 2075395 - protein, 23 aa, Staphylococcus
LGSQPPFTYLVQESYDAMAIVHE

SEQ ID NO: 2075396 - protein, 25 aa, Staphylococcus
LGSRGSVIPLFKKQIEAGGPVTVTH

SEQ ID NO: 2075397 - protein, 32 aa, Staphylococcus
LGSTPYTLLDYFGDDWLIMIDESHVTLPQVRG

SEQ ID NO: 2075398 - protein, 28 aa, Staphylococcus
LGTDYLDLYLIHWPCEADGLFIETYKAM

SEQ ID NO: 2075399 - protein, 24 aa, Staphylococcus
LGTDYLDTLLLHRPSPLMNPDEVR

SEQ ID NO: 2075400 - protein, 25 aa, Staphylococcus
LGTMGFGIPAAIGAKLAAPDKTVVV

SEQ ID NO: 2075401 - protein, 21 aa, Staphylococcus
LGTRIDYFKYKYFGELPEQQR

SEQ ID NO: 2075402 - protein, 30 aa, Staphylococcus
LGTVDMYTFGRYFPILKGKSIDYIMPQFLR

SEQ ID NO: 2075403 - protein, 30 aa, Staphylococcus
LGTVDMYTFGRYFPMLKDQAIDYLMPEFLR

SEQ ID NO: 2075404 - protein, 29 aa, Staphylococcus
LGVAKRAQSFGMKILAFDPYLTEDKAKSL

SEQ ID NO: 2075405 - protein, 28 aa, Staphylococcus
LGVCNGFQILTEIGLLPGALLHNDSHLF

SEQ ID NO: 2075406 - protein, 34 aa, Staphylococcus
LGVDSVFTPIKLRKLVWRRLAKDLKPKQLHDIKE

SEQ ID NO: 2075407 - protein, 20 aa, Staphylococcus
LGVFLNQHKIAFKRNPYIIQ

SEQ ID NO: 2075408 - protein, 30 aa, Staphylococcus
LGVHPAHNYKLLIILSPSGSYYGGDSLKPT

SEQ ID NO: 2075409 - protein, 17 aa, Staphylococcus
LGVIWKKDKYLSHATKQ

SEQ ID NO: 2075410 - protein, 28 aa, Staphylococcus
LGVKDLLTILVTEKIRIHTPSQMGIRKP

SEQ ID NO: 2075411 - protein, 20 aa, Staphylococcus
LGVKVWIYRGEVLPTTKNTS

SEQ ID NO: 2075412 - protein, 27 aa, Staphylococcus
LGVLARKYKLPIYANEKTWKAIEKKDS

SEQ ID NO: 2075413 - protein, 26 aa, Staphylococcus
LGVLARKYNLPIYANENTWKAIEKKD

SEQ ID NO: 2075414 - protein, 17 aa, Staphylococcus
LGVLPTGGGKSICYQVP

SEQ ID NO: 2075415 - protein, 26 aa, Staphylococcus
LGVNAGLHLLHFLGSLNLNKTAKDFV

SEQ ID NO: 2075416 - protein, 27 aa, Staphylococcus
LGVNAGLYLLDFISTLNLNQTAREFVD

SEQ ID NO: 2075417 - protein, 20 aa, Staphylococcus
LGVPEGQIFNVSFGEDTESF

SEQ ID NO: 2075418 - protein, 19 aa, Staphylococcus
LGVPFERPLETGAIAYLEG

SEQ ID NO: 2075419 - protein, 30 aa, Staphylococcus
LGVRPSHQYKLLIILSPSGAYYGGDTLKST

SEQ ID NO: 2075420 - protein, 23 aa, Staphylococcus
LGYDMIFTSLQLSKLSLRQQLAY

SEQ ID NO: 2075421 - protein, 28 aa, Staphylococcus
LGYFCVDNLPPILLPKFVELMEQGNPSL

SEQ ID NO: 2075422 - protein, 20 aa, Staphylococcus
LGYLARRYHFEQEGISGMNN

SEQ ID NO: 2075423 - protein, 24 aa, Staphylococcus
LGYNNIFDLALKRDIFFHHPYESF

SEQ ID NO: 2075424 - protein, 21 aa, Staphylococcus
LGYQIQDWFEKMSVFVELADD

SEQ ID NO: 2075425 - protein, 23 aa, Staphylococcus
LGYTQKSPRWAIAYKFPAEEVVT

SEQ ID NO: 2075426 - protein, 26 aa, Staphylococcus
LHAPQIQGFFDIPIDHLMGVPIIGQH

SEQ ID NO: 2075427 - protein, 17 aa, Staphylococcus
LHAVWSHLVAHKLYNKQ

SEQ ID NO: 2075428 - protein, 22 aa, Staphylococcus
LHDLRLIMQELLDIHGQHETQS

SEQ ID NO: 2075429 - protein, 17 aa, Staphylococcus
LHDMNYLRYTLNDALSA

SEQ ID NO: 2075430 - protein, 19 aa, Staphylococcus
LHDVLVQYKIPGISGVDTR

SEQ ID NO: 2075431 - protein, 19 aa, Staphylococcus
LHEAPSHVMNYYEPKDKTL

SEQ ID NO: 2075432 - protein, 19 aa, Staphylococcus
LHEIFKDYGVLFIDAQNHA

SEQ ID NO: 2075433 - protein, 21 aa, Staphylococcus
LHEIFKEYGVLFLDAQFTELR

SEQ ID NO: 2075434 - protein, 22 aa, Staphylococcus
LHEKLYGLLTNYLNSFTNLDGD

SEQ ID NO: 2075435 - protein, 18 aa, Staphylococcus
LHEPWLLSDMTKAIERIN

SEQ ID NO: 2075436 - protein, 20 aa, Staphylococcus
LHEVLVQYQIPGISGVDTRS

SEQ ID NO: 2075437 - protein, 17 aa, Staphylococcus
LHEVRVDRIIFGDPAVV

SEQ ID NO: 2075438 - protein, 19 aa, Staphylococcus
LHEYLEGPIFISTDKPDPL

SEQ ID NO: 2075439 - protein, 21 aa, Staphylococcus
LHEYLIHLTGVLETGFFLDIA

SEQ ID NO: 2075440 - protein, 17 aa, Staphylococcus
LHFAAIYVDVQAKKKFE

SEQ ID NO: 2075441 - protein, 18 aa, Staphylococcus
LHFDQMSDYLMIYVNDQA

SEQ ID NO: 2075442 - protein, 17 aa, Staphylococcus
LHGKPLSRQGIWKLIKQ

SEQ ID NO: 2075443 - protein, 19 aa, Staphylococcus
LHGTKMYLLQNEEGQIGLA

SEQ ID NO: 2075444 - protein, 17 aa, Staphylococcus
LHGTYGIGKSHLAMSIV

SEQ ID NO: 2075445 - protein, 23 aa, Staphylococcus
LHHIENQSFYLKKGEILGVSGLM

SEQ ID NO: 2075446 - protein, 37 aa, Staphylococcus
LHHKYDWIIFSSKNAVRIFYKYLNQLDVKYVAVIGQK

SEQ ID NO: 2075447 - protein, 19 aa, Staphylococcus
LHHNFVGTEHILLGLIREN

SEQ ID NO: 2075448 - protein, 21 aa, Staphylococcus
LHIGILIFGSGHHQAAWLMPD

SEQ ID NO: 2075449 - protein, 25 aa, Staphylococcus
LHIVDQMNGIPFTKRAQHLLTDEEV

SEQ ID NO: 2075450 - protein, 19 aa, Staphylococcus
LHKYPESHIFCLTLGTGIG

SEQ ID NO: 2075451 - protein, 19 aa, Staphylococcus
LHLADWLMEMQLDAKAGAL

SEQ ID NO: 2075452 - protein, 18 aa, Staphylococcus
LHLGAPFDSFAGFKSYRL

SEQ ID NO: 2075453 - protein, 18 aa, Staphylococcus
LHLKHRLFNQKLAEPIVN

SEQ ID NO: 2075454 - protein, 19 aa, Staphylococcus
LHLKHRLFNQKLAEPIVNT

SEQ ID NO: 2075455 - protein, 25 aa, Staphylococcus
LHLMNNHAILFYPLDIERIAHIDVW

SEQ ID NO: 2075456 - protein, 17 aa, Staphylococcus
LHLPGLSIMKRMNRIAQ

SEQ ID NO: 2075457 - protein, 32 aa, Staphylococcus
LHMDQMMIQLIEMLVKFIPYQSRQELIHEHNK

SEQ ID NO: 2075458 - protein, 17 aa, Staphylococcus
LHNLIQFTHDSLDHLWR

SEQ ID NO: 2075459 - protein, 20 aa, Staphylococcus
LHPAVHGGILADRDKPEHLQ

SEQ ID NO: 2075460 - protein, 31 aa, Staphylococcus
LHPEWHKFVYALNFVCHYLAKSIAKDGEGAT

SEQ ID NO: 2075461 - protein, 24 aa, Staphylococcus
LHPGQWLILRDIASTSPTTLVHIS

SEQ ID NO: 2075462 - protein, 24 aa, Staphylococcus
LHQDISFQTALLYAPLYPVNDAND

SEQ ID NO: 2075463 - protein, 18 aa, Staphylococcus
LHQHQCLYVKIDPYWIYQ

SEQ ID NO: 2075464 - protein, 25 aa, Staphylococcus
LHQIQGLGPVIIKVNELLVTTSIFK

SEQ ID NO: 2075465 - protein, 24 aa, Staphylococcus
LHQIQGLGPVILKVNELPITASIL

SEQ ID NO: 2075466 - protein, 20 aa, Staphylococcus
LHQIQGLGPVILKVNELSIT

SEQ ID NO: 2075467 - protein, 19 aa, Staphylococcus
LHQTEVVLDPSLKSWVEQR

SEQ ID NO: 2075468 - protein, 18 aa, Staphylococcus
LHQVQGLGPVILQVNELS

SEQ ID NO: 2075469 - protein, 17 aa, Staphylococcus
LHQVTILMTDRGIPRGF

SEQ ID NO: 2075470 - protein, 17 aa, Staphylococcus
LHRQVMQTQYDPALSGH

SEQ ID NO: 2075471 - protein, 18 aa, Staphylococcus
LHRVRKIRWGPRTLDVDI

SEQ ID NO: 2075472 - protein, 26 aa, Staphylococcus
LHSDTPITLIALGPLTNIALLISTFP

SEQ ID NO: 2075473 - protein, 17 aa, Staphylococcus
LHSGEIFDYFPIPNQTS

SEQ ID NO: 2075474 - protein, 25 aa, Staphylococcus
LHSKYPYTFIHMIGFSRGGLQGLLT

SEQ ID NO: 2075475 - protein, 18 aa, Staphylococcus
LHSSFIMSKMALAAYEGG

SEQ ID NO: 2075476 - protein, 18 aa, Staphylococcus
LHTLTVKENILLPLSVQK

SEQ ID NO: 2075477 - protein, 17 aa, Staphylococcus
LHVFAQDGSIFTNEPLE

SEQ ID NO: 2075478 - protein, 18 aa, Staphylococcus
LHVGKMDAKLFLANDKDS

SEQ ID NO: 2075479 - protein, 39 aa, Staphylococcus
LHYLARLIEAGDLPTIARRLLVISYEDIGLASPGAGQRT

SEQ ID NO: 2075480 - protein, 20 aa, Staphylococcus
LHYLARLIEAGDLPTIIRRL

SEQ ID NO: 2075481 - protein, 20 aa, Staphylococcus
LHYLARLIEAGDLPTIVRRL

SEQ ID NO: 2075482 - protein, 38 aa, Staphylococcus
LHYLARLIEAGDLPTIVRRLLVISFEDVGLASPSAGQR

SEQ ID NO: 2075483 - protein, 38 aa, Staphylococcus
LHYLARLIEAGDLPTIVRRLLVISYEDVGLASPNAGQR

SEQ ID NO: 2075484 - protein, 20 aa, Staphylococcus
LHYLARLIESGDLPTIVRRL

SEQ ID NO: 2075485 - protein, 18 aa, Staphylococcus
LHYVVQKLSRFSGKKVVI

SEQ ID NO: 2075486 - protein, 26 aa, Staphylococcus
LIADYRHLDLFPVGRLDKDTEGLLLI

SEQ ID NO: 2075487 - protein, 19 aa, Staphylococcus
LIAEIIDRGKGFDPNLKPQ

SEQ ID NO: 2075488 - protein, 30 aa, Staphylococcus
LIAESVMGQIDFLIAKARYARSIKGTKPTF

SEQ ID NO: 2075489 - protein, 17 aa, Staphylococcus
LIAGLISIGAEVMRLGV

SEQ ID NO: 2075490 - protein, 18 aa, Staphylococcus
LIAPVKEEILKRIGKYYY

SEQ ID NO: 2075491 - protein, 20 aa, Staphylococcus
LIASSIMSKKIAAGADAIVL

SEQ ID NO: 2075492 - protein, 18 aa, Staphylococcus
LICAGYVINDILKDIPVT

SEQ ID NO: 2075493 - protein, 19 aa, Staphylococcus
LICMKADTFRPIRLDRYFA

SEQ ID NO: 2075494 - protein, 17 aa, Staphylococcus
LIDAINYMFPDVHVTDA

SEQ ID NO: 2075495 - protein, 18 aa, Staphylococcus
LIDCAIFNLGYLPKGDKS

SEQ ID NO: 2075496 - protein, 25 aa, Staphylococcus
LIDDETKFFINPTGRFVIGGPQGDA

SEQ ID NO: 2075497 - protein, 18 aa, Staphylococcus
LIDEFDELAYLFLKDGQQ

SEQ ID NO: 2075498 - protein, 25 aa, Staphylococcus
LIDEVDVHIIKWSKLYLDQFQSSWT

SEQ ID NO: 2075499 - protein, 20 aa, Staphylococcus
LIDEWMLHMPVQSHKLRMNT

SEQ ID NO: 2075500 - protein, 20 aa, Staphylococcus
LIDFLQEHLAKYKVPKIYQR

SEQ ID NO: 2075501 - protein, 18 aa, Staphylococcus
LIDIMYDVPSSDGVVKVV

SEQ ID NO: 2075502 - protein, 17 aa, Staphylococcus
LIDLFRKEQLKIDCLDI

SEQ ID NO: 2075503 - protein, 19 aa, Staphylococcus
LIDLLEIYPFENISIKMIC

SEQ ID NO: 2075504 - protein, 19 aa, Staphylococcus
LIDMELEGLLQLINPVIKS

SEQ ID NO: 2075505 - protein, 26 aa, Staphylococcus
LIDNETKFFINPTGRFVIGGPQGDAG

SEQ ID NO: 2075506 - protein, 24 aa, Staphylococcus
LIDNIRQYGHLKAGIYPVNPPERK

SEQ ID NO: 2075507 - protein, 38 aa, Staphylococcus
LIDNKEFDKLFKTVKVKPGDFYYVPAGAVHAIGAGIMI

SEQ ID NO: 2075508 - protein, 17 aa, Staphylococcus
LIDNKILRQSDLVVTLC

SEQ ID NO: 2075509 - protein, 17 aa, Staphylococcus
LIDSNIEVGIKSKVIDI

SEQ ID NO: 2075510 - protein, 31 aa, Staphylococcus; identical to SEQ ID NO: 1820413

SEQ ID NO: 2075511 - protein, 26 aa, Staphylococcus
LIEELRPSLIISFYPGYAVHPDHEAT

SEQ ID NO: 2075512 - protein, 23 aa, Staphylococcus
LIEERYLLFLIEQAHISDDLTAH

SEQ ID NO: 2075513 - protein, 24 aa, Staphylococcus
LIEERYLLFMLNQAQIDENTTYHH

SEQ ID NO: 2075514 - protein, 18 aa, Staphylococcus
LIEGIPVTKLFVLELNNL

SEQ ID NO: 2075515 - protein, 18 aa, Staphylococcus
LIEHNLSIMCEADWIIDV

SEQ ID NO: 2075516 - protein, 23 aa, Staphylococcus
LIEHNLSIMCEADWIIDVGPGPG

SEQ ID NO: 2075517 - protein, 30 aa, Staphylococcus
LIEHPKLYDNKTGLFNLKLFANVLGNGFDK

SEQ ID NO: 2075518 - protein, 17 aa, Staphylococcus
LIEHVNWAEMIAHGKPS

SEQ ID NO: 2075519 - protein, 20 aa, Staphylococcus
LIEIPNDYVFAMIGYHPDYD

SEQ ID NO: 2075520 - protein, 17 aa, Staphylococcus
LIEKGRYNSRHFIDEMK

SEQ ID NO: 2075521 - protein, 17 aa, Staphylococcus
LIEKPLDYLHVSLMDIH

SEQ ID NO: 2075522 - protein, 18 aa, Staphylococcus
LIELAKIFQEVLPKGVVN

SEQ ID NO: 2075523 - protein, 19 aa, Staphylococcus
LIELAKIFQEVLPKGVVNV

SEQ ID NO: 2075524 - protein, 19 aa, Staphylococcus
LIELQTVPNGFYYPYDSEA

SEQ ID NO: 2075525 - protein, 17 aa, Staphylococcus
LIELYKVADTPEAVDRL

SEQ ID NO: 2075526 - protein, 18 aa, Staphylococcus
LIEPELVFILTEDLTVDA

SEQ ID NO: 2075527 - protein, 19 aa, Staphylococcus
LIEQGLTPEGILNEILGED

SEQ ID NO: 2075528 - protein, 25 aa, Staphylococcus
LIEQPDLLLLDEPTNHLDFESINWL

SEQ ID NO: 2075529 - protein, 17 aa, Staphylococcus
LIERPDVIVSPHIAFYT

SEQ ID NO: 2075530 - protein, 26 aa, Staphylococcus
LIERSNIPSVLYYYKSNKFLKKQLSV

SEQ ID NO: 2075531 - protein, 23 aa, Staphylococcus
LIESELLVEVLILISVDSLNESE

SEQ ID NO: 2075532 - protein, 32 aa, Staphylococcus
LIESGDLPTIVRRLLVISYEDVGLASPSAGQR

SEQ ID NO: 2075533 - protein, 20 aa, Staphylococcus
LIESPLKHIPFMQNTLTNIE

SEQ ID NO: 2075534 - protein, 20 aa, Staphylococcus
LIETIRNSHFISLLSSSAVN

SEQ ID NO: 2075535 - protein, 25 aa, Staphylococcus
LIETLIQAKLNPDKLFIICFDEMNL

SEQ ID NO: 2075536 - protein, 19 aa, Staphylococcus
LIEVTDRLYQRIEAQGLEV

SEQ ID NO: 2075537 - protein, 17 aa, Staphylococcus
LIFERSREGRYAYSLPQ

SEQ ID NO: 2075538 - protein, 18 aa, Staphylococcus
LIFERSREGRYAYSLPQS

SEQ ID NO: 2075539 - protein, 20 aa, Staphylococcus
LIFHFKRYDFIKEEELFNII

SEQ ID NO: 2075540 - protein, 24 aa, Staphylococcus
LIGCSFTFEHALLEAGIPIRHLEE

SEQ ID NO: 2075541 - protein, 24 aa, Staphylococcus
LIGCSFTFEHALLEAGIPLRHLEE

SEQ ID NO: 2075542 - protein, 23 aa, Staphylococcus
LIGCSFTFEHALLEAGLPVRHIE

SEQ ID NO: 2075543 - protein, 22 aa, Staphylococcus
LIGDLLSAHFYTLLANLNDPTY

SEQ ID NO: 2075544 - protein, 19 aa, Staphylococcus
LIGDLSFYHDMNGLLMAKL

SEQ ID NO: 2075545 - protein, 20 aa, Staphylococcus
LIGKRFFIMSRKNIKNQASQ

SEQ ID NO: 2075546 - protein, 17 aa, Staphylococcus
LIGLLQYVDEEDLDPVF

SEQ ID NO: 2075547 - protein, 17 aa, Staphylococcus
LIGMRASSDFVRHGEKK

SEQ ID NO: 2075548 - protein, 23 aa, Staphylococcus
LIGNVLHFYLPTYEYNFNFNKRQ

SEQ ID NO: 2075549 - protein, 25 aa, Staphylococcus
LIGSTQEVLLPESFYRGAHQHIFRA

SEQ ID NO: 2075550 - protein, 21 aa, Staphylococcus
LIGVTVPSWFLKSVTNSTVLG

SEQ ID NO: 2075551 - protein, 24 aa, Staphylococcus
LIHDQFDHYLLNDLPQFKDKSPST

SEQ ID NO: 2075552 - protein, 17 aa, Staphylococcus
LIHGFEVTKLYLKNKEI

SEQ ID NO: 2075553 - protein, 17 aa, Staphylococcus
LIHPDTPKHHLKVCGGF

SEQ ID NO: 2075554 - protein, 34 aa, Staphylococcus
LIHTLDIIKRHRLLELFLIEVLKYNWEEVHQEAE

SEQ ID NO: 2075555 - protein, 20 aa, Staphylococcus
LIINKLGITILPATISELLN

SEQ ID NO: 2075556 - protein, 19 aa, Staphylococcus
LIIPGFFGVSKHNFIVTFP

SEQ ID NO: 2075557 - protein, 19 aa, Staphylococcus
LIIPGFFGVSRQNYIVTFP

SEQ ID NO: 2075558 - protein, 20 aa, Staphylococcus
LIIPKYKGSLLFTKHKIRGI

SEQ ID NO: 2075559 - protein, 25 aa, Staphylococcus
LIITHYQRLLNYITPDFVHVMYNGK

SEQ ID NO: 2075560 - protein, 17 aa, Staphylococcus
LIITPLFEDSYVLYVPK

SEQ ID NO: 2075561 - protein, 18 aa, Staphylococcus
LIKAILDKSPHAQIVMIC

SEQ ID NO: 2075562 - protein, 24 aa, Staphylococcus
LIKDVADIFYLEEEDLLPLERMGS

SEQ ID NO: 2075563 - protein, 23 aa, Staphylococcus
LIKDVADIFYLKEEDLLPLERMG

SEQ ID NO: 2075564 - protein, 26 aa, Staphylococcus
LIKHHQFPHILAANPPLYDSSTFPTE

SEQ ID NO: 2075565 - protein, 27 aa, Staphylococcus
LIKKDGNYTYFLPDIAYHFDKVQRGND

SEQ ID NO: 2075566 - protein, 17 aa, Staphylococcus
LIKKLKKYTTVLISTHI

SEQ ID NO: 2075567 - protein, 24 aa, Staphylococcus
LIKLVDLPVEYLDRYPAELSGGQQ

SEQ ID NO: 2075568 - protein, 27 aa, Staphylococcus
LIKNDGNYTYFLPDIAYHFDKIKRGND

SEQ ID NO: 2075569 - protein, 35 aa, Staphylococcus
LIKNKKTLFIVYTNPLSLGLLTPPGDFGADIVVGD

SEQ ID NO: 2075570 - protein, 19 aa, Staphylococcus
LIKQLKHFLNKSAMHHIII

SEQ ID NO: 2075571 - protein, 19 aa, Staphylococcus
LIKQNKLLPIPDKKLSKQI

SEQ ID NO: 2075572 - protein, 30 aa, Staphylococcus
LIKQQLSMPRKLYLLSPLLDATLSNPEITE

SEQ ID NO: 2075573 - protein, 18 aa, Staphylococcus
LIKTMYKEQPIYEGSMCI

SEQ ID NO: 2075574 - protein, 19 aa, Staphylococcus
LIKVYLKENDFEVLDVTEG

SEQ ID NO: 2075575 - protein, 22 aa, Staphylococcus
LIKYSNWLNQLFHGIEYRMQLE

SEQ ID NO: 2075576 - protein, 20 aa, Staphylococcus
LILIHACWLANIEIAMINTR

SEQ ID NO: 2075577 - protein, 18 aa, Staphylococcus
LILNMIKQFKGQVLIVTH

SEQ ID NO: 2075578 - protein, 18 aa, Staphylococcus
LILNVGYSHPVEIKADDG

SEQ ID NO: 2075579 - protein, 33 aa, Staphylococcus
LILPGGESTTLRRLMDLYGFKEALQQSDLPMFG

SEQ ID NO: 2075580 - protein, 19 aa, Staphylococcus
LILPGGESTTLRRLMNLYG

SEQ ID NO: 2075581 - protein, 33 aa, Staphylococcus
LILPGGESTTLRRLMNLYGFKEALQQSTLPMFG

SEQ ID NO: 2075582 - protein, 20 aa, Staphylococcus
LILQELKKKDFLSLQELIER

SEQ ID NO: 2075583 - protein, 19 aa, Staphylococcus
LILQELRKKDFLTLQELIE

SEQ ID NO: 2075584 - protein, 19 aa, Staphylococcus
LILQYQYPIGYNYSKTRRG

SEQ ID NO: 2075585 - protein, 29 aa, Staphylococcus
LILTGTGQFPLWKAIPAAVSLKLIALCLG

SEQ ID NO: 2075586 - protein, 19 aa, Staphylococcus
LIMGCYGIGVSRTLSAIVE

SEQ ID NO: 2075587 - protein, 20 aa, Staphylococcus
LIMKPSEITPLTTIRVFELM

SEQ ID NO: 2075588 - protein, 18 aa, Staphylococcus
LIMNKLQRLKAQGKLILI

SEQ ID NO: 2075589 - protein, 19 aa, Staphylococcus
LIMYGQMTAGSWIYIGSQG

SEQ ID NO: 2075590 - protein, 19 aa, Staphylococcus
LINDIWNFDVKDLLTFKKE

SEQ ID NO: 2075591 - protein, 26 aa, Staphylococcus
LINEKPDLILLTFPTPVMSVLTEQFN

SEQ ID NO: 2075592 - protein, 20 aa, Staphylococcus
LINFAYLKKQIHEQFDHYLL

SEQ ID NO: 2075593 - protein, 23 aa, Staphylococcus
LINGALEVLAPKGTLLLCTNSSV

SEQ ID NO: 2075594 - protein, 22 aa, Staphylococcus
LINGALSILAPNGSLLLCTNSS

SEQ ID NO: 2075595 - protein, 17 aa, Staphylococcus
LINKPTLFYVYDEKEYE

SEQ ID NO: 2075596 - protein, 17 aa, Staphylococcus
LINLGSRFDDRLASNPN

SEQ ID NO: 2075597 - protein, 20 aa, Staphylococcus
LINLNQLRNALTEETILVSI

SEQ ID NO: 2075598 - protein, 18 aa, Staphylococcus
LINPFKLTYQVLGVYDPS

SEQ ID NO: 2075599 - protein, 25 aa, Staphylococcus
LINQKVFDVFYKSLKGKQVLVYSGL

SEQ ID NO: 2075600 - protein, 30 aa, Staphylococcus
LINRIKERGHHLFLDLKLHDIPNTVKQAMA

SEQ ID NO: 2075601 - protein, 18 aa, Staphylococcus
LINRLRCDLYKAIHSHKV

SEQ ID NO: 2075602 - protein, 21 aa, Staphylococcus
LINVQYILDLLNQIDLTNKEE

SEQ ID NO: 2075603 - protein, 19 aa, Staphylococcus
LIPDHLSGLLFDDIPYLKV

SEQ ID NO: 2075604 - protein, 29 aa, Staphylococcus
LIPEDWGGDTIFVPLSALSGDGIDSLLEM

SEQ ID NO: 2075605 - protein, 25 aa, Staphylococcus
LIPEYQHLEIFPVGRLDKDTEGLLL

SEQ ID NO: 2075606 - protein, 26 aa, Staphylococcus
LIPEYQHLNIFPVGRLDKDTEGLLLI

SEQ ID NO: 2075607 - protein, 28 aa, Staphylococcus
LIPGPVYSGYIPLIKTLGGVPVYIDTTE

SEQ ID NO: 2075608 - protein, 21 aa, Staphylococcus
LIPIYINRDTILFPLTQKRAS

SEQ ID NO: 2075609 - protein, 17 aa, Staphylococcus
LIPVHHIAGHIYANHLE

SEQ ID NO: 2075610 - protein, 18 aa, Staphylococcus
LIPVVLQDVRNKQVLMLG

SEQ ID NO: 2075611 - protein, 17 aa, Staphylococcus
LIQIDRLGNYAELRLSV

SEQ ID NO: 2075612 - protein, 25 aa, Staphylococcus
LIQIDTTNILFILGGAFDGIEEVIK

SEQ ID NO: 2075613 - protein, 18 aa, Staphylococcus
LIQILDESSLTEINIEDN

SEQ ID NO: 2075614 - protein, 17 aa, Staphylococcus
LIQKFEIDIYDIPMKAL

SEQ ID NO: 2075615 - protein, 17 aa, Staphylococcus
LIQKFEIDIYDIPMKSL

SEQ ID NO: 2075616 - protein, 17 aa, Staphylococcus
LIQKLMLIMPEGPALAL

SEQ ID NO: 2075617 - protein, 17 aa, Staphylococcus
LIQLDRLGNYAELRLSV

SEQ ID NO: 2075618 - protein, 21 aa, Staphylococcus
LIQLKHSISEIPHIKQLLLEM

SEQ ID NO: 2075619 - protein, 20 aa, Staphylococcus
LIQLMNEMDLRLVDFKVEFG

SEQ ID NO: 2075620 - protein, 22 aa, Staphylococcus
LIQNPEYRPYFENPLMSDFRHS

SEQ ID NO: 2075621 - protein, 19 aa, Staphylococcus
LIQPIKEEILERIGQFYYG

SEQ ID NO: 2075622 - protein, 20 aa, Staphylococcus
LIQRFHIEAFLSQPIKQCSK

SEQ ID NO: 2075623 - protein, 20 aa, Staphylococcus
LIQRHFQIGYNRAARIVDQL

SEQ ID NO: 2075624 - protein, 18 aa, Staphylococcus
LIQTLFPNDAHKICQIVD

SEQ ID NO: 2075625 - protein, 18 aa, Staphylococcus
LIQYFYDIVNNGPATIIQ

SEQ ID NO: 2075626 - protein, 27 aa, Staphylococcus
LIRANTHLVIMVIVFSSGHVENVHLTS

SEQ ID NO: 2075627 - protein, 32 aa, Staphylococcus
LIREADIILYDRLVNPLILQYASEKAVFVNVG

SEQ ID NO: 2075628 - protein, 26 aa, Staphylococcus
LIRLIAADLVDFDWIDGFDIECRNEE

SEQ ID NO: 2075629 - protein, 21 aa, Staphylococcus
LIRLIAADLVDFEWIDGFDIE

SEQ ID NO: 2075630 - protein, 22 aa, Staphylococcus
LIRLIAADLVEFDWIEGFDIEC

SEQ ID NO: 2075631 - protein, 20 aa, Staphylococcus
LIRLMLINRNQFLNADEIAR

SEQ ID NO: 2075632 - protein, 29 aa, Staphylococcus
LIRQADVILYDRLVNPLILQYAKSTTEII

SEQ ID NO: 2075633 - protein, 20 aa, Staphylococcus
LIRRRFIDMELGQISAVYLN

SEQ ID NO: 2075634 - protein, 17 aa, Staphylococcus
LIRVIPKPVVAMVRGYA

SEQ ID NO: 2075635 - protein, 25 aa, Staphylococcus
LISHDHFIILKDRYGLKQIINKVLE

SEQ ID NO: 2075636 - protein, 17 aa, Staphylococcus
LISLVNDGKAKGLKIGA

SEQ ID NO: 2075637 - protein, 17 aa, Staphylococcus
LITALWDDEAFVSDNTL

SEQ ID NO: 2075638 - protein, 31 aa, Staphylococcus
LITDYSSIFFDFLPLKRPIHFFMPDKMEYES

SEQ ID NO: 2075639 - protein, 19 aa, Staphylococcus
LITIDTWHIDFKAMNVDIL

SEQ ID NO: 2075640 - protein, 20 aa, Staphylococcus
LITLSHYEMPLYLVEKFNGW

SEQ ID NO: 2075641 - protein, 17 aa, Staphylococcus
LITQLAVLYGITPEGMK

SEQ ID NO: 2075642 - protein, 20 aa, Staphylococcus
LITVMPIERAIKRTIIDKLE

SEQ ID NO: 2075643 - protein, 27 aa, Staphylococcus
LIVDNTFASPYLFRPIEHGANIVVHSA

SEQ ID NO: 2075644 - protein, 25 aa, Staphylococcus
LIVEGRLFIMGTPQELKDKFGVDSI

SEQ ID NO: 2075645 - protein, 17 aa, Staphylococcus
LIVFKDGEPVDKVVGFQ

SEQ ID NO: 2075646 - protein, 20 aa, Staphylococcus
LIVLNLLEKAELPIEGVMLL

SEQ ID NO: 2075647 - protein, 17 aa, Staphylococcus
LIVLYDDLDLEQGQVRL

SEQ ID NO: 2075648 - protein, 17 aa, Staphylococcus
LIVLYDDLDLNQGQVRL

SEQ ID NO: 2075649 - protein, 17 aa, Staphylococcus
LIVMSHVGIFFDEKLCQ

SEQ ID NO: 2075650 - protein, 17 aa, Staphylococcus
LIVMSHVGVFFDEKLCQ

SEQ ID NO: 2075651 - protein, 18 aa, Staphylococcus
LIVNPLLPEHEVSYVASF

SEQ ID NO: 2075652 - protein, 20 aa, Staphylococcus
LIVVDMFLTGFDSKKLNTLY

SEQ ID NO: 2075653 - protein, 17 aa, Staphylococcus
LIYILRGYEGENLKEFM

SEQ ID NO: 2075654 - protein, 17 aa, Staphylococcus
LIYISQKGKFDAVVEDV

SEQ ID NO: 2075655 - protein, 21 aa, Staphylococcus
LKAARRWAYDVKGIEPNKAEI

SEQ ID NO: 2075656 - protein, 23 aa, Staphylococcus
LKAARRWAYDVKGLEPDKAEIIA

SEQ ID NO: 2075657 - protein, 20 aa, Staphylococcus
LKADIVLPAATWYEKHDLSS

SEQ ID NO: 2075658 - protein, 20 aa, Staphylococcus
LKAFLKFRQMYLNTISMDCV

SEQ ID NO: 2075659 - protein, 17 aa, Staphylococcus
LKAINIISTLDDAKLLD

SEQ ID NO: 2075660 - protein, 17 aa, Staphylococcus
LKALEPMGEEYLDVVKE

SEQ ID NO: 2075661 - protein, 19 aa, Staphylococcus
LKANQISYSQAFKGYMEGS

SEQ ID NO: 2075662 - protein, 26 aa, Staphylococcus
LKARYKIQMYYYRSALETILQKEVKG

SEQ ID NO: 2075663 - protein, 34 aa, Staphylococcus
LKASSLNFAIIKPSFFMDNFLRIAKKENQQIVIP

SEQ ID NO: 2075664 - protein, 25 aa, Staphylococcus
LKAYFDEQPLIKPFNKNFLGNVIAE

SEQ ID NO: 2075665 - protein, 29 aa, Staphylococcus
LKCDNAPKRRVMLDFLIGSALVDKDKLQA

SEQ ID NO: 2075666 - protein, 20 aa, Staphylococcus
LKDDILKFGFYDKERYIVVD

SEQ ID NO: 2075667 - protein, 34 aa, Staphylococcus
LKDFEGTILFVSHDRYFINQLANKVFDLNKDGGQ

SEQ ID NO: 2075668 - protein, 35 aa, Staphylococcus
LKDFEGTILFVSHDRYFINQLANKVFDLNYDGGQM

SEQ ID NO: 2075669 - protein, 24 aa, Staphylococcus
LKDHVVFIGFDYGYRGNSKYLFSY

SEQ ID NO: 2075670 - protein, 19 aa, Staphylococcus
LKDHYHITFIMVLHDINQA

SEQ ID NO: 2075671 - protein, 19 aa, Staphylococcus
LKDIFAHLVVERAKAFAAL

SEQ ID NO: 2075672 - protein, 19 aa, Staphylococcus
LKDIGYICALVRDEMQSAT

SEQ ID NO: 2075673 - protein, 18 aa, Staphylococcus
LKDKCEVIYLNRTEGIST

SEQ ID NO: 2075674 - protein, 17 aa, Staphylococcus
LKDLLGIQLLRNSDSET

SEQ ID NO: 2075675 - protein, 25 aa, Staphylococcus
LKDLTLPEEAYLAGLPQVPNLYNVY

SEQ ID NO: 2075676 - protein, 24 aa, Staphylococcus
LKDMDVVISAPFYPAYMTAERIEK

SEQ ID NO: 2075677 - protein, 24 aa, Staphylococcus
LKDNGVNEFLLWNAGNDYTEGVNY

SEQ ID NO: 2075678 - protein, 21 aa, Staphylococcus
LKDQKQMLLITNNLYQADKLE

SEQ ID NO: 2075679 - protein, 22 aa, Staphylococcus
LKDQMLEQIPLARFGEDTDIAN

SEQ ID NO: 2075680 - protein, 25 aa, Staphylococcus
LKDSHFDYVLTNPPIRAGKEVVHRI

SEQ ID NO: 2075681 - protein, 25 aa, Staphylococcus
LKDVKSLPLLLMYGTEDRVADISAM

SEQ ID NO: 2075682 - protein, 24 aa, Staphylococcus
LKDYGFNIIIAGSFSDIFFMNCTK

SEQ ID NO: 2075683 - protein, 23 aa, Staphylococcus
LKDYKVILVHPWQYEHTIRNKYK

SEQ ID NO: 2075684 - protein, 18 aa, Staphylococcus
LKDYVGRATPLTYADSYT

SEQ ID NO: 2075685 - protein, 20 aa, Staphylococcus
LKEAVRIRKIAPEATIFLMN

SEQ ID NO: 2075686 - protein, 24 aa, Staphylococcus
LKEAVRIRKLAPHATIFLMNAVYD

SEQ ID NO: 2075687 - protein, 25 aa, Staphylococcus
LKEEGIYYQIYTNRGIYTEDPQRDL

SEQ ID NO: 2075688 - protein, 20 aa, Staphylococcus
LKEFANLYALLIPKVHNMDD

SEQ ID NO: 2075689 - protein, 24 aa, Staphylococcus
LKEFDNAVILFMGAGDIQKLLKAY

SEQ ID NO: 2075690 - protein, 25 aa, Staphylococcus
LKEFTNLYALLIPKAPTMKEVKFLV

SEQ ID NO: 2075691 - protein, 19 aa, Staphylococcus
LKEFTNLYALLIPKVHTMQ

SEQ ID NO: 2075692 - protein, 19 aa, Staphylococcus
LKEHIASELIKWKEYIRDQ

SEQ ID NO: 2075693 - protein, 22 aa, Staphylococcus
LKEIIHVYNIFKPPTPFCERCE

SEQ ID NO: 2075694 - protein, 30 aa, Staphylococcus
LKEIRDNVAIIFVIHEFYAEWLNSNYKEVI

SEQ ID NO: 2075695 - protein, 26 aa, Staphylococcus
LKEIYDFPYVIFYKGNKQLFNCPHTL

SEQ ID NO: 2075696 - protein, 25 aa, Staphylococcus
LKEKCRIPILFVPGNHDYWTSEASL

SEQ ID NO: 2075697 - protein, 25 aa, Staphylococcus
LKEKDIYYQVYTNRGIYTENPQRDL

SEQ ID NO: 2075698 - protein, 24 aa, Staphylococcus
LKEKLNIPILFVPGNHDLWSDGTD

SEQ ID NO: 2075699 - protein, 22 aa, Staphylococcus
LKEKQFIVIESLAKSMSKEAKT

SEQ ID NO: 2075700 - protein, 19 aa, Staphylococcus
LKELIWNPLIIDEQFNENY

SEQ ID NO: 2075701 - protein, 28 aa, Staphylococcus
LKELSYQRLLKVWGYTFQYLKQEHINEA

SEQ ID NO: 2075702 - protein, 19 aa, Staphylococcus
LKENGWILDESRQELWDYP

SEQ ID NO: 2075703 - protein, 25 aa, Staphylococcus
LKEQGHYIMIATGRPFRASKPYYEQ

SEQ ID NO: 2075704 - protein, 17 aa, Staphylococcus
LKEQMLGQIPLARFGED

SEQ ID NO: 2075705 - protein, 18 aa, Staphylococcus
LKEWEYHFDKKTAALNLI

SEQ ID NO: 2075706 - protein, 25 aa, Staphylococcus
LKEYNQVELLKDLELPLAKILSEME

SEQ ID NO: 2075707 - protein, 17 aa, Staphylococcus
LKFQFIKVKGNPSMINI

SEQ ID NO: 2075708 - protein, 28 aa, Staphylococcus
LKGDAVRYQIAYFINKYGKDPDAVHLCV

SEQ ID NO: 2075709 - protein, 22 aa, Staphylococcus
LKGIECIYALYKKNRRSLQIYG

SEQ ID NO: 2075710 - protein, 22 aa, Staphylococcus
LKGIKCIYALYKKNRRSLQIYG

SEQ ID NO: 2075711 - protein, 24 aa, Staphylococcus
LKGLLTKWHIKPSELMAFGDANND

SEQ ID NO: 2075712 - protein, 18 aa, Staphylococcus
LKGLLTPREYELAKQRFS

SEQ ID NO: 2075713 - protein, 25 aa, Staphylococcus
LKGMDSLLSIVQMPGGIPVATTAIG

SEQ ID NO: 2075714 - protein, 17 aa, Staphylococcus
LKGNVVFIFQYGEEIMP

SEQ ID NO: 2075715 - protein, 17 aa, Staphylococcus
LKGTLYAINAVLPHFQQ

SEQ ID NO: 2075716 - protein, 17 aa, Staphylococcus
LKHFIPREHIEGRDIQD

SEQ ID NO: 2075717 - protein, 20 aa, Staphylococcus
LKHIDIDIPKHLITVFTGRS

SEQ ID NO: 2075718 - protein, 28 aa, Staphylococcus
LKHLEPEQLLKPLFNYFQAEYPGAMEYL

SEQ ID NO: 2075719 - protein, 27 aa, Staphylococcus
LKHLEPETLLMPLFEEMNSTFPKIIPD

SEQ ID NO: 2075720 - protein, 24 aa, Staphylococcus
LKHPVSYYFKNNFYMTPSGMLTKP

SEQ ID NO: 2075721 - protein, 33 aa, Staphylococcus
LKHTLDIIKRHRLLELFLIEVLQYNWEEVHQEA

SEQ ID NO: 2075722 - protein, 23 aa, Staphylococcus
LKIATIPTLFNKIIPKALSTFKK

SEQ ID NO: 2075723 - protein, 19 aa, Staphylococcus
LKIDLVELTGSYKLLHCHH

SEQ ID NO: 2075724 - protein, 26 aa, Staphylococcus
LKIDNIYDWLADYKLLEKPKTKSLLH

SEQ ID NO: 2075725 - protein, 23 aa, Staphylococcus
LKIQKRVYIKLSTTEREPFPYRL

SEQ ID NO: 2075726 - protein, 31 aa, Staphylococcus
LKKALNHQLFKGIEWIIVSLGANGAFAKHNN

SEQ ID NO: 2075727 - protein, 24 aa, Staphylococcus
LKKDEKPLYLSNDKYYYVYKENKY

SEQ ID NO: 2075728 - protein, 27 aa, Staphylococcus
LKKDWGSFFMPKFQFEIDGRNNYFIDQ

SEQ ID NO: 2075729 - protein, 32 aa, Staphylococcus; identical to SEQ ID NO: 1829929

SEQ ID NO: 2075730 - protein, 17 aa, Staphylococcus
LKKIELLNNIKFLKGAD

SEQ ID NO: 2075731 - protein, 27 aa, Staphylococcus
LKKKEDLLMWIVIHDHKEYKIITSNQT

SEQ ID NO: 2075732 - protein, 22 aa, Staphylococcus
LKKNVMVALREPALGPTFGIKG

SEQ ID NO: 2075733 - protein, 24 aa, Staphylococcus
LKKQNCLFVLVDPYILENLRNADG

SEQ ID NO: 2075734 - protein, 17 aa, Staphylococcus
LKKRKPHQLSYEVEKTL

SEQ ID NO: 2075735 - protein, 25 aa, Staphylococcus
LKKVAKLLPIIPNIHNYRSALYIKH

SEQ ID NO: 2075736 - protein, 17 aa, Staphylococcus
LKKYLNQSSLNEDLYPI

SEQ ID NO: 2075737 - protein, 29 aa, Staphylococcus
LKLIDESKLNFLWVTDWPLLEYDEDAKRY

SEQ ID NO: 2075738 - protein, 27 aa, Staphylococcus
LKLLQKAPFIFPIVKKLFVYEDPSLKQ

SEQ ID NO: 2075739 - protein, 17 aa, Staphylococcus
LKLTYLLNTYQVDEIMI

SEQ ID NO: 2075740 - protein, 31 aa, Staphylococcus
LKLVETFSPAYFQKLWLYAWEETHENELVEK

SEQ ID NO: 2075741 - protein, 30 aa, Staphylococcus
LKMIYVDTGAMYRALTYKYLKLNKTEDFED

SEQ ID NO: 2075742 - protein, 19 aa, Staphylococcus
LKMKTIEALMRKGYNYDKI

SEQ ID NO: 2075743 - protein, 24 aa, Staphylococcus
LKNAFRPEFLNRVDDIIVFHKLNK

SEQ ID NO: 2075744 - protein, 18 aa, Staphylococcus
LKNFANIEFLIQGGAAPL

SEQ ID NO: 2075745 - protein, 24 aa, Staphylococcus
LKNHVVFLGFDYGYRGNSKYLFNY

SEQ ID NO: 2075746 - protein, 19 aa, Staphylococcus
LKNHYGMAPGMFIEMNDKK

SEQ ID NO: 2075747 - protein, 19 aa, Staphylococcus
LKNITAPTLLMYGGQDDPS

SEQ ID NO: 2075748 - protein, 24 aa, Staphylococcus
LKNKNIALLFEKDSTRTRCSFEVA

SEQ ID NO: 2075749 - protein, 17 aa, Staphylococcus
LKNKYVVPGLINAHTHI

SEQ ID NO: 2075750 - protein, 28 aa, Staphylococcus
LKNLNKYYGIPLYYKKGKHFKLTEAGEL

SEQ ID NO: 2075751 - protein, 30 aa, Staphylococcus; identical to SEQ ID NO: 1686173

SEQ ID NO: 2075752 - protein, 30 aa, Staphylococcus
LKNMPKDDSYFLFYVNRPSIIIGKNQNTIE

SEQ ID NO: 2075753 - protein, 26 aa, Staphylococcus
LKNNSKLLDYYPFQLSGGMAQRIALI

SEQ ID NO: 2075754 - protein, 25 aa, Staphylococcus
LKNSDTVAVLLPGTTFYLGKESYAD

SEQ ID NO: 2075755 - protein, 23 aa, Staphylococcus
LKNYVAITPYRPSAKQFNDVELT

SEQ ID NO: 2075756 - protein, 17 aa, Staphylococcus
LKPVDIKTLPHPGFPTD

SEQ ID NO: 2075757 - protein, 22 aa, Staphylococcus
LKPYLPELVKMKKLIYPVGDGR

SEQ ID NO: 2075758 - protein, 17 aa, Staphylococcus
LKPYRRAFNIEEPVINM

SEQ ID NO: 2075759 - protein, 20 aa, Staphylococcus
LKQDKPIYCRTLYGDITFKN

SEQ ID NO: 2075760 - protein, 24 aa, Staphylococcus
LKQERLLLVPLMQEQISPVEWAQI

SEQ ID NO: 2075761 - protein, 28 aa, Staphylococcus
LKQKLNIPSWQLLYDTLLVIENFPEVEE

SEQ ID NO: 2075762 - protein, 17 aa, Staphylococcus
LKQLHVNTLPYTNYFVP

SEQ ID NO: 2075763 - protein, 20 aa, Staphylococcus
LKQQQLILQKIKTLHQLSKD

SEQ ID NO: 2075764 - protein, 30 aa, Staphylococcus
LKQQYPDKFKSFALIPLPFVKESIKEIKYA

SEQ ID NO: 2075765 - protein, 28 aa, Staphylococcus
LKQSLFSTLLGLFRLYASKHFNKETLSI

SEQ ID NO: 2075766 - protein, 18 aa, Staphylococcus
LKQTILIEIARFIPSLPL

SEQ ID NO: 2075767 - protein, 19 aa, Staphylococcus
LKRAKTIYVFGYGASYVCA

SEQ ID NO: 2075768 - protein, 20 aa, Staphylococcus
LKRDELNIFLDLYRETEART

SEQ ID NO: 2075769 - protein, 18 aa, Staphylococcus
LKRDIDILEGAFQAYGHE

SEQ ID NO: 2075770 - protein, 20 aa, Staphylococcus
LKREQIFVYLCHGNHDPLSA

SEQ ID NO: 2075771 - protein, 31 aa, Staphylococcus
LKRHMSFLMQKGTLYLPYNGNLLIHGCIPVD

SEQ ID NO: 2075772 - protein, 25 aa, Staphylococcus
LKRLDKKIIKIGVFGTFSAGKSSLI

SEQ ID NO: 2075773 - protein, 18 aa, Staphylococcus
LKRLDYGGSLALIGLTGG

SEQ ID NO: 2075774 - protein, 18 aa, Staphylococcus
LKRLIMPSIEREIRSDLT

SEQ ID NO: 2075775 - protein, 18 aa, Staphylococcus
LKRLYGEVHFGVGPVIEG

SEQ ID NO: 2075776 - protein, 22 aa, Staphylococcus
LKRSDLFITSKLWLDDYGRKNV

SEQ ID NO: 2075777 - protein, 17 aa, Staphylococcus
LKRYTYTETGGEADFYL

SEQ ID NO: 2075778 - protein, 17 aa, Staphylococcus
LKRYTYTETGGNADFYL

SEQ ID NO: 2075779 - protein, 27 aa, Staphylococcus
LKSEDIYYQVYTNLGIYTENPQRDLEI

SEQ ID NO: 2075780 - protein, 20 aa, Staphylococcus
LKSIFGERAMYFVAENGAVI

SEQ ID NO: 2075781 - protein, 20 aa, Staphylococcus
LKSLPLVSIDHLGLSKEGLP

SEQ ID NO: 2075782 - protein, 17 aa, Staphylococcus
LKSLSNHITIEVTALAA

SEQ ID NO: 2075783 - protein, 27 aa, Staphylococcus
LKSNLQALLRGHYYLRELSTPDTSIKY

SEQ ID NO: 2075784 - protein, 18 aa, Staphylococcus
LKSNLWQLAKDTYQEWYL

SEQ ID NO: 2075785 - protein, 23 aa, Staphylococcus
LKSQALHYIPDLKNGKIINQWSG

SEQ ID NO: 2075786 - protein, 20 aa, Staphylococcus
LKSQMLEQIPLSRFGEDKDI

SEQ ID NO: 2075787 - protein, 22 aa, Staphylococcus
LKSQMLEQIPLSRFGEDTDIAN

SEQ ID NO: 2075788 - protein, 18 aa, Staphylococcus
LKSWDIFTLEDKADFIQM

SEQ ID NO: 2075789 - protein, 26 aa, Staphylococcus
LKTARTYDLHFFTPSSIGAFGDSTPK

SEQ ID NO: 2075790 - protein, 25 aa, Staphylococcus
LKTFWNHLKPVMESLILLSMRHRMA

SEQ ID NO: 2075791 - protein, 24 aa, Staphylococcus
LKTHIAHKYPYKDWIDQYKIDLEL

SEQ ID NO: 2075792 - protein, 18 aa, Staphylococcus
LKTIQFPYFDSQGDGIFE

SEQ ID NO: 2075793 - protein, 25 aa, Staphylococcus
LKTLDVSSTALGFAGGFPGEFISSI

SEQ ID NO: 2075794 - protein, 24 aa, Staphylococcus
LKTLDVSSTALGFAGGFPGQFIAE

SEQ ID NO: 2075795 - protein, 30 aa, Staphylococcus
LKTLSYASFLKVFGTLFQYLKKERVTEANV

SEQ ID NO: 2075796 - protein, 19 aa, Staphylococcus
LKTNQFLHVGLQELLDFEA

SEQ ID NO: 2075797 - protein, 22 aa, Staphylococcus
LKTQLGMYRFFVQADTGLSDNL

SEQ ID NO: 2075798 - protein, 18 aa, Staphylococcus
LKTTFDSVKKIPFENIKS

SEQ ID NO: 2075799 - protein, 31 aa, Staphylococcus
LKVALEQPIFEGIEWIIVSLGSKGAFAKHHH

SEQ ID NO: 2075800 - protein, 26 aa, Staphylococcus
LKVEGLYPYHIYTYIINELMGTPIEK

SEQ ID NO: 2075801 - protein, 21 aa, Staphylococcus
LKVHYPHYFYANILSNVVGNE

SEQ ID NO: 2075802 - protein, 19 aa, Staphylococcus
LKVHYPNYFYANILSNVIG

SEQ ID NO: 2075803 - protein, 19 aa, Staphylococcus
LKVIANETGAIIILLSQLS

SEQ ID NO: 2075804 - protein, 19 aa, Staphylococcus
LKVPDYVKTSLAPGSKVVT

SEQ ID NO: 2075805 - protein, 18 aa, Staphylococcus
LKVPEYVKTSLAPGSKVV

SEQ ID NO: 2075806 - protein, 19 aa, Staphylococcus
LKVPEYVKTSLAPGSKVVT

SEQ ID NO: 2075807 - protein, 17 aa, Staphylococcus
LKVVIPSGPYDAKGLLI

SEQ ID NO: 2075808 - protein, 18 aa, Staphylococcus
LKVVVAEDDLWYFKDDII

SEQ ID NO: 2075809 - protein, 27 aa, Staphylococcus
LKVYANGIFEGVTFPESFKVFGSEHSK

SEQ ID NO: 2075810 - protein, 25 aa, Staphylococcus
LKVYVNGNFDGVTFPDSFKVFGSDN

SEQ ID NO: 2075811 - protein, 21 aa, Staphylococcus
LKWDDELLELLDIPKAILPEV

SEQ ID NO: 2075812 - protein, 17 aa, Staphylococcus
LKWRGLIYQQTDEAGIE

SEQ ID NO: 2075813 - protein, 20 aa, Staphylococcus
LKWRGLIYQQTDEEGIEELL

SEQ ID NO: 2075814 - protein, 17 aa, Staphylococcus
LKWRGLIYQQTDEQGIE

SEQ ID NO: 2075815 - protein, 17 aa, Staphylococcus
LKWRGLIYQQTDESGIE

SEQ ID NO: 2075816 - protein, 17 aa, Staphylococcus
LKYEKTKEFYQKQAFLL

SEQ ID NO: 2075817 - protein, 30 aa, Staphylococcus
LLAESIMGHLDFLIAKARYARAIKGTKPTF

SEQ ID NO: 2075818 - protein, 34 aa, Staphylococcus
LLAKGRLVGIQFLELFTNNLYFDISRHAIHMANK

SEQ ID NO: 2075819 - protein, 23 aa, Staphylococcus
LLAKIGITYLRKGKFHQLHMDQM

SEQ ID NO: 2075820 - protein, 29 aa, Staphylococcus
LLASDGMLVKRPLAILGDKITLGFKEEEY

SEQ ID NO: 2075821 - protein, 17 aa, Staphylococcus
LLCEVFGGTIFHVNLPD

SEQ ID NO: 2075822 - protein, 17 aa, Staphylococcus
LLCLDATTGQNALSQAR

SEQ ID NO: 2075823 - protein, 26 aa, Staphylococcus
LLDDETKFFINPTGRFVIGGPQGDAG

SEQ ID NO: 2075824 - protein, 24 aa, Staphylococcus
LLDDETVLLRYSKDALLKNGKPYI

SEQ ID NO: 2075825 - protein, 28 aa, Staphylococcus
LLDDGESYSYLIFVQETWSLLHENRDKK

SEQ ID NO: 2075826 - protein, 18 aa, Staphylococcus
LLDEGFIYSKPRSGYYVS

SEQ ID NO: 2075827 - protein, 18 aa, Staphylococcus
LLDEGYIYSKPRSGYFVS

SEQ ID NO: 2075828 - protein, 25 aa, Staphylococcus
LLDEQTKFYINPTGRFVIGGPQGDA

SEQ ID NO: 2075829 - protein, 20 aa, Staphylococcus
LLDGKVIITLPQAHKMKSLI

SEQ ID NO: 2075830 - protein, 18 aa, Staphylococcus
LLDIIGDYEGLIVRSQTQ

SEQ ID NO: 2075831 - protein, 29 aa, Staphylococcus
LLDIRDEDIWMLFGTLPIYPCINDENDQK

SEQ ID NO: 2075832 - protein, 17 aa, Staphylococcus
LLDLLECDYTPISWKEE

SEQ ID NO: 2075833 - protein, 19 aa, Staphylococcus
LLDPVIGRDTEIQKTAEVL

SEQ ID NO: 2075834 - protein, 23 aa, Staphylococcus
LLDRIYPFRKCDKMPDKLCLYYH

SEQ ID NO: 2075835 - protein, 22 aa, Staphylococcus
LLDRIYPFRKCDTMPDKLCLYY

SEQ ID NO: 2075836 - protein, 17 aa, Staphylococcus
LLDYIPHIFDAFIEFHG

SEQ ID NO: 2075837 - protein, 17 aa, Staphylococcus
LLDYLYVTQASLIGHEL

SEQ ID NO: 2075838 - protein, 19 aa, Staphylococcus
LLEALICVGAFDSFGKTRS

SEQ ID NO: 2075839 - protein, 19 aa, Staphylococcus
LLEAREIFLVVTGSNKREV

SEQ ID NO: 2075840 - protein, 24 aa, Staphylococcus
LLEDMRVFNFIKVDRPSTAKQIDL

SEQ ID NO: 2075841 - protein, 27 aa, Staphylococcus
LLEEIKFIYYKMQKLAPQYLKLAVMPN

SEQ ID NO: 2075842 - protein, 18 aa, Staphylococcus
LLEGTSILHYGKLIHSET

SEQ ID NO: 2075843 - protein, 18 aa, Staphylococcus
LLEIVISDTHYDIMQKYY

SEQ ID NO: 2075844 - protein, 24 aa, Staphylococcus
LLEKGYIVCPYISNDLVLAKRLEE

SEQ ID NO: 2075845 - protein, 20 aa, Staphylococcus
LLEKGYIVCPYISNDVVLAK

SEQ ID NO: 2075846 - protein, 17 aa, Staphylococcus
LLEKIAIYMELNGENTF

SEQ ID NO: 2075847 - protein, 17 aa, Staphylococcus
LLELFKRANVIAMSGSL

SEQ ID NO: 2075848 - protein, 19 aa, Staphylococcus
LLELIKHENILVTPHIAFF

SEQ ID NO: 2075849 - protein, 17 aa, Staphylococcus
LLELLYDLNDELKVNLI

SEQ ID NO: 2075850 - protein, 20 aa, Staphylococcus
LLELQTVPQGFYYPKDSEAT

SEQ ID NO: 2075851 - protein, 26 aa, Staphylococcus
LLELTPKEFELLLYLIERQGRVITRE

SEQ ID NO: 2075852 - protein, 32 aa, Staphylococcus
LLENDVIYSLILKPLYYFKDKWTKQTYDLPIK

SEQ ID NO: 2075853 - protein, 23 aa, Staphylococcus
LLEPEIMFIAKEDLPYDADLQTI

SEQ ID NO: 2075854 - protein, 17 aa, Staphylococcus
LLEQIRTLDKKRLKEKL

SEQ ID NO: 2075855 - protein, 18 aa, Staphylococcus
LLEQIRTLDKKRLKEKLT

SEQ ID NO: 2075856 - protein, 18 aa, Staphylococcus
LLEQIRTLDKNRLKEKLT

SEQ ID NO: 2075857 - protein, 17 aa, Staphylococcus
LLEQPFDYIFFTGSEKV

SEQ ID NO: 2075858 - protein, 19 aa, Staphylococcus
LLESLILVGAFDIFGKNRA

SEQ ID NO: 2075859 - protein, 18 aa, Staphylococcus
LLESMMQLIKYEGQMYIN

SEQ ID NO: 2075860 - protein, 22 aa, Staphylococcus
LLESMMQLIKYHGKMSYRGQRL

SEQ ID NO: 2075861 - protein, 17 aa, Staphylococcus
LLETELLNIINFHTLIA

SEQ ID NO: 2075862 - protein, 27 aa, Staphylococcus
LLFEEMKHYFILNFPQRPGALREFVND

SEQ ID NO: 2075863 - protein, 24 aa, Staphylococcus
LLFGTIDSWLVWKLSGGQAHITDY

SEQ ID NO: 2075864 - protein, 19 aa, Staphylococcus
LLFKLVDSNREYLSEFLPF

SEQ ID NO: 2075865 - protein, 22 aa, Staphylococcus
LLFYLLFYKAVDELLKYSKNLN

SEQ ID NO: 2075866 - protein, 17 aa, Staphylococcus
LLGDFKAPMGCRSFLPA

SEQ ID NO: 2075867 - protein, 19 aa, Staphylococcus
LLGDGPELLDMRKLARHLG

SEQ ID NO: 2075868 - protein, 26 aa, Staphylococcus
LLGEPIQYIVGFQSFYGYPFKVNENC

SEQ ID NO: 2075869 - protein, 24 aa, Staphylococcus
LLGEPIQYIVGFQSFYGYQFQVNE

SEQ ID NO: 2075870 - protein, 19 aa, Staphylococcus
LLGIDKYRPHIAIITNIYS

SEQ ID NO: 2075871 - protein, 17 aa, Staphylococcus
LLGKGSAYYAPATAIYE

SEQ ID NO: 2075872 - protein, 19 aa, Staphylococcus
LLGLLRLHLSLFQKYDKDE

SEQ ID NO: 2075873 - protein, 25 aa, Staphylococcus
LLGQKEGWVYMLSCLKVYLEHGVTI

SEQ ID NO: 2075874 - protein, 19 aa, Staphylococcus
LLGQQFNALLPQNEVPERT

SEQ ID NO: 2075875 - protein, 26 aa, Staphylococcus
LLGQRSNPFYIMKHSDLLALTSYYEG

SEQ ID NO: 2075876 - protein, 23 aa, Staphylococcus
LLHAVELERLSLGRRLGFELQTA

SEQ ID NO: 2075877 - protein, 28 aa, Staphylococcus
LLHIGYRLIWIIPNPYYDKLRHILILTK

SEQ ID NO: 2075878 - protein, 19 aa, Staphylococcus
LLHRRRYIPDITSRNFNRR

SEQ ID NO: 2075879 - protein, 26 aa, Staphylococcus
LLIDFEKQLFIFKDKKYALSHIELQI

SEQ ID NO: 2075880 - protein, 20 aa, Staphylococcus
LLIGDLAFYHDMNGLLMSKI

SEQ ID NO: 2075881 - protein, 18 aa, Staphylococcus
LLIYGSRITNCNFTNSDL

SEQ ID NO: 2075882 - protein, 21 aa, Staphylococcus
LLKAADYVFLGTKPYDFESLA

SEQ ID NO: 2075883 - protein, 20 aa, Staphylococcus
LLKAIKKPENLYGDYVVPFG

SEQ ID NO: 2075884 - protein, 33 aa, Staphylococcus
LLKARRTYAFTELFLFELRMQWLNRLEKASDEA

SEQ ID NO: 2075885 - protein, 23 aa, Staphylococcus
LLKDRYEVILQYYQSDISSLEKK

SEQ ID NO: 2075886 - protein, 17 aa, Staphylococcus
LLKKQTFNFIKYNILSR

SEQ ID NO: 2075887 - protein, 19 aa, Staphylococcus
LLKKTITNVLFLNMHGRPL

SEQ ID NO: 2075888 - protein, 18 aa, Staphylococcus
LLKMFLRPTEDDGETTSQ

SEQ ID NO: 2075889 - protein, 19 aa, Staphylococcus
LLKNADYVFLGTKPHDFEA

SEQ ID NO: 2075890 - protein, 24 aa, Staphylococcus
LLKNDKVFLYWSTVNRNCVICGKT

SEQ ID NO: 2075891 - protein, 20 aa, Staphylococcus
LLKQFGFIIYFKDKQDMLEM

SEQ ID NO: 2075892 - protein, 17 aa, Staphylococcus
LLKQQVIKLTWWDKENL

SEQ ID NO: 2075893 - protein, 30 aa, Staphylococcus
LLKRDITFSIYLPEDYTPLFKYKVIFCFDG

SEQ ID NO: 2075894 - protein, 17 aa, Staphylococcus
LLKRIIDNTEKRLISLL

SEQ ID NO: 2075895 - protein, 18 aa, Staphylococcus
LLKRLEDQLFLVVEEDEN

SEQ ID NO: 2075896 - protein, 18 aa, Staphylococcus
LLKSELYAMLDSQPYFYV

SEQ ID NO: 2075897 - protein, 18 aa, Staphylococcus
LLKSLAQKDLYPKYIETR

SEQ ID NO: 2075898 - protein, 18 aa, Staphylococcus
LLKTDRIILRMATFELLH

SEQ ID NO: 2075899 - protein, 26 aa, Staphylococcus
LLKTKRFSKMFFSCNAIKGSNVLTST

SEQ ID NO: 2075900 - protein, 23 aa, Staphylococcus
LLKTWKLHHFSSENPLSIVATQA

SEQ ID NO: 2075901 - protein, 18 aa, Staphylococcus
LLLHKREIIKLGERTREI

SEQ ID NO: 2075902 - protein, 18 aa, Staphylococcus
LLLKKHGQKLYDAGLRRI

SEQ ID NO: 2075903 - protein, 18 aa, Staphylococcus
LLLKKHGQNLYNAGLRRI

SEQ ID NO: 2075904 - protein, 21 aa, Staphylococcus
LLLSDIILGMKFRNASKDYSN

SEQ ID NO: 2075905 - protein, 26 aa, Staphylococcus
LLLYDDYDVIFLDINLMDESGLDLAN

SEQ ID NO: 2075906 - protein, 21 aa, Staphylococcus
LLMMRRNIGMIFQHFNLVKRS

SEQ ID NO: 2075907 - protein, 17 aa, Staphylococcus
LLMRMKEQEWDDVIDTN

SEQ ID NO: 2075908 - protein, 28 aa, Staphylococcus
LLNESNQLFIPIIKSWRLNERHYGGLQG

SEQ ID NO: 2075909 - protein, 20 aa, Staphylococcus
LLNEVFKAYGLLLIDANNTE

SEQ ID NO: 2075910 - protein, 17 aa, Staphylococcus
LLNGLMTISYKNKSEFP

SEQ ID NO: 2075911 - protein, 18 aa, Staphylococcus
LLNGVNVDYYGAPTPVQQ

SEQ ID NO: 2075912 - protein, 25 aa, Staphylococcus
LLNHDYDWLIFSSKNAVKYFYEYLK

SEQ ID NO: 2075913 - protein, 25 aa, Staphylococcus
LLNHHYDWIIFSSKNAVKYFRDYFQ

SEQ ID NO: 2075914 - protein, 31 aa, Staphylococcus
LLNIEMPIVLPRMRITYLYHRTQKLLSQYHL

SEQ ID NO: 2075915 - protein, 22 aa, Staphylococcus
LLNIINFHTLIATKASRIRQVA

SEQ ID NO: 2075916 - protein, 18 aa, Staphylococcus
LLNIQTIDYIRLLMNQYD

SEQ ID NO: 2075917 - protein, 17 aa, Staphylococcus
LLNMTHWKRGVATMGIG

SEQ ID NO: 2075918 - protein, 26 aa, Staphylococcus
LLNNPDQLLSFLKQKRKDILDNAYIM

SEQ ID NO: 2075919 - protein, 19 aa, Staphylococcus
LLNPLSLAYMGDAVLDQFV

SEQ ID NO: 2075920 - protein, 25 aa, Staphylococcus
LLNRAPTLHRLGIQAFEPTLVEGRA

SEQ ID NO: 2075921 - protein, 17 aa, Staphylococcus
LLNSLRFGELSNKQNQR

SEQ ID NO: 2075922 - protein, 18 aa, Staphylococcus
LLNSLRFGELTEKQNRRL

SEQ ID NO: 2075923 - protein, 19 aa, Staphylococcus
LLNVLEKTELPIEGMLLLS

SEQ ID NO: 2075924 - protein, 18 aa, Staphylococcus
LLNYIKASDKMLSQIHFV

SEQ ID NO: 2075925 - protein, 36 aa, Staphylococcus
LLPAFKRLSPMIFTEARLPLIRGINQKLIRPYKDES

SEQ ID NO: 2075926 - protein, 21 aa, Staphylococcus
LLPAQVDLMNAWLSPYRRALN

SEQ ID NO: 2075927 - protein, 20 aa, Staphylococcus
LLPEHNWGNYKLVFNTRHNA

SEQ ID NO: 2075928 - protein, 25 aa, Staphylococcus
LLPFATVHDLPILAGPLSGLRQSEH

SEQ ID NO: 2075929 - protein, 18 aa, Staphylococcus
LLPGIPHVAVFDTSFHQT

SEQ ID NO: 2075930 - protein, 18 aa, Staphylococcus
LLPIPDKKLSKQIEKGWT

SEQ ID NO: 2075931 - protein, 17 aa, Staphylococcus
LLPITPKLLAHYNFIYK

SEQ ID NO: 2075932 - protein, 18 aa, Staphylococcus
LLPNIPHVAVFDTSFHQS

SEQ ID NO: 2075933 - protein, 18 aa, Staphylococcus
LLPNIPHVVVFDTSFHQT

SEQ ID NO: 2075934 - protein, 31 aa, Staphylococcus
LLPQNNDIYHRPKGKFRFPMEGFESGNAESE

SEQ ID NO: 2075935 - protein, 18 aa, Staphylococcus
LLPSHNWGNYKLIFNTRH

SEQ ID NO: 2075936 - protein, 19 aa, Staphylococcus
LLPTHNWGNYKLIFNTRHK

SEQ ID NO: 2075937 - protein, 18 aa, Staphylococcus
LLPTHNWGNYKLVYSTRH

SEQ ID NO: 2075938 - protein, 17 aa, Staphylococcus
LLPVVNKIDLPAAEPDR

SEQ ID NO: 2075939 - protein, 17 aa, Staphylococcus
LLPYLIPDYFDTNELLS

SEQ ID NO: 2075940 - protein, 18 aa, Staphylococcus
LLQAFHQYSYMLSRCAFV

SEQ ID NO: 2075941 - protein, 20 aa, Staphylococcus
LLQDIFLRICRSIDRYKLSA

SEQ ID NO: 2075942 - protein, 32 aa, Staphylococcus
LLQEKERLLPGGYLFLSDLVGNPSLLNKVGKL

SEQ ID NO: 2075943 - protein, 18 aa, Staphylococcus
LLQLFREQYRQLETTYLC

SEQ ID NO: 2075944 - protein, 20 aa, Staphylococcus
LLQMMIKTMEDRLNEHNKRE

SEQ ID NO: 2075945 - protein, 17 aa, Staphylococcus
LLQNFEGFSPLITKEIT

SEQ ID NO: 2075946 - protein, 19 aa, Staphylococcus
LLQQGFNVFVVQLPKNMDP

SEQ ID NO: 2075947 - protein, 18 aa, Staphylococcus
LLQQIKQYQFTLTRHIKQ

SEQ ID NO: 2075948 - protein, 20 aa, Staphylococcus
LLQYIDEGLEWVLIQGQLGI

SEQ ID NO: 2075949 - protein, 29 aa, Staphylococcus
LLRGKDEHFPFLMFGPGIGPHQVDECVEK

SEQ ID NO: 2075950 - protein, 28 aa, Staphylococcus
LLRGKDESFPFLVFGPGEKPHQVDERVE

SEQ ID NO: 2075951 - protein, 26 aa, Staphylococcus
LLRNFELCNAVRLGISLYGYYPSAYV

SEQ ID NO: 2075952 - protein, 20 aa, Staphylococcus
LLSAKRWIRYIHETEKIDFL

SEQ ID NO: 2075953 - protein, 19 aa, Staphylococcus
LLSLFRLHLTLFDKHSSDE

SEQ ID NO: 2075954 - protein, 25 aa, Staphylococcus
LLSNSVLVPKWANWDHFHELDKKGL

SEQ ID NO: 2075955 - protein, 18 aa, Staphylococcus
LLSRIRLLDQHLGIQNKI

SEQ ID NO: 2075956 - protein, 25 aa, Staphylococcus
LLSSTQEVLLPESFYRGAHQHIFRA

SEQ ID NO: 2075957 - protein, 19 aa, Staphylococcus
LLTALTYPTIFSQVAMLSP

SEQ ID NO: 2075958 - protein, 21 aa, Staphylococcus
LLTALTYPTIFSQVAMLSPHS

SEQ ID NO: 2075959 - protein, 28 aa, Staphylococcus
LLTDKGALLKLDFITHSYPHDWRTKKPV

SEQ ID NO: 2075960 - protein, 19 aa, Staphylococcus
LLTEILGKENVKFLETVPV

SEQ ID NO: 2075961 - protein, 29 aa, Staphylococcus
LLTEKDALLKLNFITHSYPHDWRTKKPVI

SEQ ID NO: 2075962 - protein, 28 aa, Staphylococcus
LLTEKDALLKLSFITHSYPHDWRTKKPV

SEQ ID NO: 2075963 - protein, 18 aa, Staphylococcus
LLTFKKEMIFYENCIINI

SEQ ID NO: 2075964 - protein, 19 aa, Staphylococcus
LLTGVQLAAIIKSSGKTLS

SEQ ID NO: 2075965 - protein, 17 aa, Staphylococcus
LLTHCKSLLYQKTYNIP

SEQ ID NO: 2075966 - protein, 20 aa, Staphylococcus
LLTHPKFEKLLKKQGIVHYP

SEQ ID NO: 2075967 - protein, 19 aa, Staphylococcus
LLTIYEWPEKLMNKELKKL

SEQ ID NO: 2075968 - protein, 18 aa, Staphylococcus
LLTLLDLANIYVSSGSAC

SEQ ID NO: 2075969 - protein, 17 aa, Staphylococcus
LLTLPKAYGGEGGTIED

SEQ ID NO: 2075970 - protein, 17 aa, Staphylococcus
LLTLWEEGSMTLKQMDK

SEQ ID NO: 2075971 - protein, 20 aa, Staphylococcus
LLTNKLGSNFLKVTPGIRPQ

SEQ ID NO: 2075972 - protein, 26 aa, Staphylococcus
LLTNKNIAIIFEKPSTRTRAAFSVAA

SEQ ID NO: 2075973 - protein, 28 aa, Staphylococcus
LLTNKPMALIGIIDLLKNAKNRKLQLLT

SEQ ID NO: 2075974 - protein, 26 aa, Staphylococcus
LLTSNRKLRRGLIFYGTANNGKSVYI

SEQ ID NO: 2075975 - protein, 17 aa, Staphylococcus
LLTTLQPHFSRMPTIVG

SEQ ID NO: 2075976 - protein, 22 aa, Staphylococcus
LLTYLDIFDDVRSFFSQHTGLK

SEQ ID NO: 2075977 - protein, 18 aa, Staphylococcus
LLTYLDIFDEVRSFFSQH

SEQ ID NO: 2075978 - protein, 19 aa, Staphylococcus
LLVEALLHEDVDFIFGYPG

SEQ ID NO: 2075979 - protein, 19 aa, Staphylococcus
LLVEYDGELPFWDKSSPEA

SEQ ID NO: 2075980 - protein, 25 aa, Staphylococcus
LLVPNNPIIPFIIGDGIGPDIWRAS

SEQ ID NO: 2075981 - protein, 27 aa, Staphylococcus
LLVTTSIFKNVFNLTHYAEYESTEFPD

SEQ ID NO: 2075982 - protein, 18 aa, Staphylococcus
LLVVIRQNRKNHQLLLSI

SEQ ID NO: 2075983 - protein, 19 aa, Staphylococcus
LLVVYHNLFEDYHNLLFGL

SEQ ID NO: 2075984 - protein, 27 aa, Staphylococcus
LLVYADGEKRYIIAPKGLQVGQTIENG

SEQ ID NO: 2075985 - protein, 17 aa, Staphylococcus
LLYDFNFKRFDHLTDFK

SEQ ID NO: 2075986 - protein, 28 aa, Staphylococcus
LLYEKMKHYFIFNFPQRPGALKEFVNDV

SEQ ID NO: 2075987 - protein, 17 aa, Staphylococcus
LLYFHVHDERLSFKDWG

SEQ ID NO: 2075988 - protein, 17 aa, Staphylococcus
LLYGFINEEEKEMFLNL

SEQ ID NO: 2075989 - protein, 17 aa, Staphylococcus
LLYITGNPYDTLLEVIG

SEQ ID NO: 2075990 - protein, 21 aa, Staphylococcus
LLYITGNPYDTLLEVIGINGN

SEQ ID NO: 2075991 - protein, 19 aa, Staphylococcus
LLYQYDKIHLVPMLDEHLF

SEQ ID NO: 2075992 - protein, 30 aa, Staphylococcus; identical to SEQ ID NO: 2027379

SEQ ID NO: 2075993 - protein, 22 aa, Staphylococcus
LMALHWHEETFYIPKNAQLLFS

SEQ ID NO: 2075994 - protein, 33 aa, Staphylococcus
LMANYLFNHSEDPRFKRWVIGSILSRTYYHNMV

SEQ ID NO: 2075995 - protein, 18 aa, Staphylococcus
LMCQLVCHDDKLQLKQGN

SEQ ID NO: 2075996 - protein, 19 aa, Staphylococcus
LMDAAIKHNLRKVIAQSIA

SEQ ID NO: 2075997 - protein, 17 aa, Staphylococcus
LMDAFREIAKEKKLQTI

SEQ ID NO: 2075998 - protein, 18 aa, Staphylococcus
LMDAVHRAGVDKIFGVPG

SEQ ID NO: 2075999 - protein, 23 aa, Staphylococcus
LMDRFNKLFAQRGYNQKIGDILP

SEQ ID NO: 2076000 - protein, 22 aa, Staphylococcus
LMEKMVWTRILDQRSISLNRQG

SEQ ID NO: 2076001 - protein, 18 aa, Staphylococcus
LMEPWDGPTMIAFCNGDK

SEQ ID NO: 2076002 - protein, 19 aa, Staphylococcus
LMEPWDGPTMISFCNGDKI

SEQ ID NO: 2076003 - protein, 18 aa, Staphylococcus
LMGCYGIGVSRTLSAIVE

SEQ ID NO: 2076004 - protein, 17 aa, Staphylococcus
LMHALRNPVTRGHYQWG

SEQ ID NO: 2076005 - protein, 19 aa, Staphylococcus
LMHDALVYRIERLKEATVN

SEQ ID NO: 2076006 - protein, 17 aa, Staphylococcus
LMHILMQQKQKLVEKQS

SEQ ID NO: 2076007 - protein, 19 aa, Staphylococcus
LMHVKSFYQQPKFIQYWVK

SEQ ID NO: 2076008 - protein, 30 aa, Staphylococcus
LMIVSEYSIPYYAGLSFRTLVPELPNKAPH

SEQ ID NO: 2076009 - protein, 17 aa, Staphylococcus
LMKCDNLSEFLPSLQLT

SEQ ID NO: 2076010 - protein, 17 aa, Staphylococcus
LMKCFDDLMSRNNTVIL

SEQ ID NO: 2076011 - protein, 27 aa, Staphylococcus
LMKKNFIEYLLFQYKFKSRISVWLLNL

SEQ ID NO: 2076012 - protein, 17 aa, Staphylococcus
LMKLKYVLHIDGSPYKN

SEQ ID NO: 2076013 - protein, 17 aa, Staphylococcus
LMKTLNQTDFKQYEISN

SEQ ID NO: 2076014 - protein, 18 aa, Staphylococcus
LMLLKQIHYDADHRPILF

SEQ ID NO: 2076015 - protein, 18 aa, Staphylococcus
LMMYGQMTAGSWIYIGSQ

SEQ ID NO: 2076016 - protein, 29 aa, Staphylococcus
LMNHPNELIPLTFFVKKFKQAKSSISEDV

SEQ ID NO: 2076017 - protein, 25 aa, Staphylococcus
LMNHQIHLSIRLRLPHSAIAFQAYC

SEQ ID NO: 2076018 - protein, 20 aa, Staphylococcus
LMNHYKRFKEIVPSKAEEKQ

SEQ ID NO: 2076019 - protein, 27 aa, Staphylococcus
LMNKNYNLLYTWYVEFNKSNFDFIFSD

SEQ ID NO: 2076020 - protein, 23 aa, Staphylococcus
LMNRQIGFTVKILQILEDFNISF

SEQ ID NO: 2076021 - protein, 17 aa, Staphylococcus
LMRKFVCYLNEGYMTPF

SEQ ID NO: 2076022 - protein, 28 aa, Staphylococcus
LMSIIVLLKCMNRFGFTAFFNHSAISNS

SEQ ID NO: 2076023 - protein, 19 aa, Staphylococcus
LMSPTYPNAFEKFIDLVIP

SEQ ID NO: 2076024 - protein, 22 aa, Staphylococcus
LMSSFRDLFNKIGWLNKDKMEQ

SEQ ID NO: 2076025 - protein, 25 aa, Staphylococcus
LMSVGKHVIWLLQGLQFSRNQLTLT

SEQ ID NO: 2076026 - protein, 23 aa, Staphylococcus
LMTALTYPTIFSQAAMLSPMYDD

SEQ ID NO: 2076027 - protein, 18 aa, Staphylococcus
LMTIYEEYGKFEGLNVLI

SEQ ID NO: 2076028 - protein, 23 aa, Staphylococcus
LMTLLEKDPFWYKGLISNYTIEE

SEQ ID NO: 2076029 - protein, 18 aa, Staphylococcus
LMVALTDHILFAYKRIKQ

SEQ ID NO: 2076030 - protein, 19 aa, Staphylococcus
LMVDMAHIAGLVAVGLHPN

SEQ ID NO: 2076031 - protein, 17 aa, Staphylococcus
LMVSKVKGTFNDIDVTV

SEQ ID NO: 2076032 - protein, 19 aa, Staphylococcus
LMYQILRPKLVKHAHIIGI

SEQ ID NO: 2076033 - protein, 34 aa, Staphylococcus
LNAAPFSFFNVVCSAPPMIMISTARSQGKRKDTS

SEQ ID NO: 2076034 - protein, 28 aa, Staphylococcus
LNAGGKRIRPVLLLLTLDMLNEDYRQGM

SEQ ID NO: 2076035 - protein, 18 aa, Staphylococcus
LNALKPKSLSFSHEFMFA

SEQ ID NO: 2076036 - protein, 18 aa, Staphylococcus
LNALNCVKAFLKAGYDAG

SEQ ID NO: 2076037 - protein, 20 aa, Staphylococcus
LNALYQEKALPNLSLQYKDY

SEQ ID NO: 2076038 - protein, 24 aa, Staphylococcus
LNAREIILVITGHNKKEVVEKLYN

SEQ ID NO: 2076039 - protein, 18 aa, Staphylococcus
LNAVNSVLPYLKKGDTII

SEQ ID NO: 2076040 - protein, 26 aa, Staphylococcus
LNCGLHPEWLYNAKANMILVPAYTGE

SEQ ID NO: 2076041 - protein, 17 aa, Staphylococcus
LNDAGMLFNLYDQQHFK

SEQ ID NO: 2076042 - protein, 25 aa, Staphylococcus
LNDAYFIRIYLYNYDYKRVHFFLMM

SEQ ID NO: 2076043 - protein, 27 aa, Staphylococcus
LNDENQILLIKSPLRGWEIPGGQIENG

SEQ ID NO: 2076044 - protein, 17 aa, Staphylococcus
LNDEPIQYILGKQTFYG

SEQ ID NO: 2076045 - protein, 22 aa, Staphylococcus
LNDIGFIFQASHLIPYLTVEEQ

SEQ ID NO: 2076046 - protein, 35 aa, Staphylococcus
LNDKQLAQFRKTDLGFIFQDYSVLPTLTVKENIML

SEQ ID NO: 2076047 - protein, 25 aa, Staphylococcus
LNDKQTFIIEIQSALRIGDTCPICG

SEQ ID NO: 2076048 - protein, 17 aa, Staphylococcus
LNDLRSRVKLETDGKLL

SEQ ID NO: 2076049 - protein, 26 aa, Staphylococcus
LNDPEKLLNYLKYQRKKILDNAYLMP

SEQ ID NO: 2076050 - protein, 24 aa, Staphylococcus
LNDYEDLFNEKLQLLLKINEHEVV

SEQ ID NO: 2076051 - protein, 25 aa, Staphylococcus
LNEDAIKFPSFRPDSWRGKRYLYSG

SEQ ID NO: 2076052 - protein, 25 aa, Staphylococcus
LNEDAIKFPSFRPDSWRGKRYLYTG

SEQ ID NO: 2076053 - protein, 25 aa, Staphylococcus
LNEDAINFPSFRPDSWRGKRYLYTG

SEQ ID NO: 2076054 - protein, 31 aa, Staphylococcus
LNEFYDMQLSNLYIYKLAVIANMKLQSLSSC

SEQ ID NO: 2076055 - protein, 31 aa, Staphylococcus
LNEFYDMQLSNLYIYKLAVISNMRLQSLSSC

SEQ ID NO: 2076056 - protein, 19 aa, Staphylococcus
LNEGTPLPDLIIVDGGKGH

SEQ ID NO: 2076057 - protein, 18 aa, Staphylococcus
LNEIASRIIELDRGKLKS

SEQ ID NO: 2076058 - protein, 25 aa, Staphylococcus
LNEIDHTLNIPLVKAYMGMNSDVLT

SEQ ID NO: 2076059 - protein, 31 aa, Staphylococcus
LNEIGFIFQSSHLVPYLKVKAQLTTIGKEAG

SEQ ID NO: 2076060 - protein, 25 aa, Staphylococcus
LNEKMEEEMFLGLRMNQGVNRERFK

SEQ ID NO: 2076061 - protein, 22 aa, Staphylococcus
LNEKTFMIYTGAPQNTRRKAIE

SEQ ID NO: 2076062 - protein, 17 aa, Staphylococcus
LNEMHIPTFIDTPSRRN

SEQ ID NO: 2076063 - protein, 17 aa, Staphylococcus
LNEMLVNTPINAWVSTP

SEQ ID NO: 2076064 - protein, 17 aa, Staphylococcus
LNEMLVQTPINAWVSTP

SEQ ID NO: 2076065 - protein, 26 aa, Staphylococcus
LNEMQKWEHFFTDKGFYPVAVDAKHG

SEQ ID NO: 2076066 - protein, 26 aa, Staphylococcus
LNEMQKWESFFIDKGYYPVSVDAKHG

SEQ ID NO: 2076067 - protein, 25 aa, Staphylococcus
LNENDIPDIILLDLVMPEMNGIEVT

SEQ ID NO: 2076068 - protein, 27 aa, Staphylococcus
LNEQPQSLFNYFKQLFAQVTNPPIDAY

SEQ ID NO: 2076069 - protein, 24 aa, Staphylococcus
LNEQYYVELYIYDYDYKRVHFFLR

SEQ ID NO: 2076070 - protein, 27 aa, Staphylococcus
LNERPESLFNYFKQLFAQVTNPPIDAY

SEQ ID NO: 2076071 - protein, 19 aa, Staphylococcus
LNEVSSRIIELDRGKLKTY

SEQ ID NO: 2076072 - protein, 17 aa, Staphylococcus
LNEYYYLPQKLYEDIQA

SEQ ID NO: 2076073 - protein, 18 aa, Staphylococcus
LNFDAKYTHFIATQSPRK

SEQ ID NO: 2076074 - protein, 28 aa, Staphylococcus
LNFDKFAGFKSYRFLKPVQGTTYKVYFG

SEQ ID NO: 2076075 - protein, 32 aa, Staphylococcus
LNFQFIKRMNDVGIPVIFIINQIDKHNEDEIT

SEQ ID NO: 2076076 - protein, 17 aa, Staphylococcus
LNFYKKLIKLKKSDDIY

SEQ ID NO: 2076077 - protein, 28 aa, Staphylococcus
LNGELDEHFPLVVWQTGSGTQSNMNVNE

SEQ ID NO: 2076078 - protein, 20 aa, Staphylococcus
LNGKQLWLTAAKKLKHIYQV

SEQ ID NO: 2076079 - protein, 28 aa, Staphylococcus
LNGLKKWQTPIDIWQAHQIHLHIGQDID

SEQ ID NO: 2076080 - protein, 24 aa, Staphylococcus
LNGNLYDRMLVKKYLWDENYSAKA

SEQ ID NO: 2076081 - protein, 31 aa, Staphylococcus
LNGNPILEGFTLPKMLWMKQNEPSLWEQVSV

SEQ ID NO: 2076082 - protein, 30 aa, Staphylococcus
LNGNPILEGFTLPKMLWMQQHEPELWKHVD

SEQ ID NO: 2076083 - protein, 26 aa, Staphylococcus
LNGTIIQLWHGTPIKKLFLDSKEPFQ

SEQ ID NO: 2076084 - protein, 17 aa, Staphylococcus
LNGVLDYRRRITNPFTG

SEQ ID NO: 2076085 - protein, 28 aa, Staphylococcus
LNHADYLIALAQYYPYGPEYFVFGGLYK

SEQ ID NO: 2076086 - protein, 23 aa, Staphylococcus
LNHFFFCGEILPHRTAKALLDRY

SEQ ID NO: 2076087 - protein, 22 aa, Staphylococcus
LNHFFFCGEILPHRTAKALVSR

SEQ ID NO: 2076088 - protein, 21 aa, Staphylococcus
LNHHNVLGVLPTGGGKSICYQ

SEQ ID NO: 2076089 - protein, 23 aa, Staphylococcus
LNHLNSYYKFKQPSLLYDQQIQK

SEQ ID NO: 2076090 - protein, 24 aa, Staphylococcus
LNHQYIHPLHYQGKYFQVAGAINI

SEQ ID NO: 2076091 - protein, 25 aa, Staphylococcus
LNHSRYLLIEFPSRGVPHYANRLFF

SEQ ID NO: 2076092 - protein, 35 aa, Staphylococcus
LNHTLDIIKRHRLLELFLIEILKYNWEEVHQEAEI

SEQ ID NO: 2076093 - protein, 19 aa, Staphylococcus
LNHWRVLLQARAIENDMFV

SEQ ID NO: 2076094 - protein, 19 aa, Staphylococcus
LNIADKILIGGGMAYTFLK

SEQ ID NO: 2076095 - protein, 18 aa, Staphylococcus
LNIAFNELDWDRLIQSIQ

SEQ ID NO: 2076096 - protein, 24 aa, Staphylococcus
LNIDAMGFIHFTESKRFVDIQTIK

SEQ ID NO: 2076097 - protein, 18 aa, Staphylococcus
LNIELKVSTPFLQEKMNL

SEQ ID NO: 2076098 - protein, 18 aa, Staphylococcus
LNIHPSLLPKYKGKDAIG

SEQ ID NO: 2076099 - protein, 24 aa, Staphylococcus
LNIHTIEDLVLYLPTRYEDNTVVD

SEQ ID NO: 2076100 - protein, 24 aa, Staphylococcus
LNIHTVEDLILYLPTRYEDNTVID

SEQ ID NO: 2076101 - protein, 25 aa, Staphylococcus
LNIHYLTGYVFAQNVPCNKLFEKQG

SEQ ID NO: 2076102 - protein, 17 aa, Staphylococcus
LNIIHYMHDKYSYERIE

SEQ ID NO: 2076103 - protein, 25 aa, Staphylococcus
LNIKQLEKLLKAINKLFTISGEYTF

SEQ ID NO: 2076104 - protein, 24 aa, Staphylococcus
LNINTVEDLILYLPTRYEDNTVID

SEQ ID NO: 2076105 - protein, 22 aa, Staphylococcus
LNISTNFRLIVPKKSKLSLQDT

SEQ ID NO: 2076106 - protein, 20 aa, Staphylococcus
LNIVPPLQFMITDKTGHTAT

SEQ ID NO: 2076107 - protein, 19 aa, Staphylococcus
LNIVTKYLKDLFDKKHYGV

SEQ ID NO: 2076108 - protein, 28 aa, Staphylococcus
LNKELDEHFPLVVWQTGSGTQSNMNVNE

SEQ ID NO: 2076109 - protein, 25 aa, Staphylococcus
LNKELVIDQPSLRYIESYFADQGQV

SEQ ID NO: 2076110 - protein, 27 aa, Staphylococcus
LNKGHNVIMDIPLLFENELQDTVDEVW

SEQ ID NO: 2076111 - protein, 21 aa, Staphylococcus
LNKGIITLISIRDAIDKIREV

SEQ ID NO: 2076112 - protein, 23 aa, Staphylococcus
LNKIAFYQVCPIHKITALITDHH

SEQ ID NO: 2076113 - protein, 18 aa, Staphylococcus
LNKKSLKFGPILLNNKNG

SEQ ID NO: 2076114 - protein, 30 aa, Staphylococcus; identical to SEQ ID NO: 1830027

SEQ ID NO: 2076115 - protein, 17 aa, Staphylococcus
LNKLNLDNVELTKYLFF

SEQ ID NO: 2076116 - protein, 30 aa, Staphylococcus
LNKLNLNNIELTKYLFFTGKGGVGKTTISS

SEQ ID NO: 2076117 - protein, 19 aa, Staphylococcus
LNKLTIFRVFIIDSQALSR

SEQ ID NO: 2076118 - protein, 29 aa, Staphylococcus
LNKNITLIKIPIKLSYYSALLANKVLPKF

SEQ ID NO: 2076119 - protein, 30 aa, Staphylococcus
LNKREIQFDYIFLDPPYNKGLIDKALEQIA

SEQ ID NO: 2076120 - protein, 24 aa, Staphylococcus
LNKSRYLLIELPFGDVPDNANRLC

SEQ ID NO: 2076121 - protein, 17 aa, Staphylococcus
LNKVAQEYWYIHDGKME

SEQ ID NO: 2076122 - protein, 17 aa, Staphylococcus
LNKVYDHIIIDTPPINT

SEQ ID NO: 2076123 - protein, 26 aa, Staphylococcus
LNKYDSDVLFILLQDKIFGSKYSRIT

SEQ ID NO: 2076124 - protein, 28 aa, Staphylococcus
LNLDNVELTKYLFFTGKGGVGKTTISSS

SEQ ID NO: 2076125 - protein, 20 aa, Staphylococcus
LNLFFSYRLEEGHTGRMLAF

SEQ ID NO: 2076126 - protein, 17 aa, Staphylococcus
LNLFSYTGAFSVIAANH

SEQ ID NO: 2076127 - protein, 18 aa, Staphylococcus
LNLGPEPEFFLFKLDEKG

SEQ ID NO: 2076128 - protein, 28 aa, Staphylococcus
LNLIDILNPYLCIIFCNSRENANELADS

SEQ ID NO: 2076129 - protein, 24 aa, Staphylococcus
LNLKQAYWEFYQSLKAQGKKAKWI

SEQ ID NO: 2076130 - protein, 17 aa, Staphylococcus
LNLLRNNEVINIARLAY

SEQ ID NO: 2076131 - protein, 17 aa, Staphylococcus
LNLMPLEQLKKVTGYIR

SEQ ID NO: 2076132 - protein, 34 aa, Staphylococcus
LNLNHIGVLFQKTSFPRLIKVKELYKLFCQLYKD

SEQ ID NO: 2076133 - protein, 31 aa, Staphylococcus
LNLNHQPWGFQFSPYAYFPEHSIVLSEAHEP

SEQ ID NO: 2076134 - protein, 19 aa, Staphylococcus
LNLPNKLLNLPIFNGINEY

SEQ ID NO: 2076135 - protein, 18 aa, Staphylococcus
LNLQFFAEDGEGDSVKDN

SEQ ID NO: 2076136 - protein, 31 aa, Staphylococcus
LNLQQGGHIIVWFGLTWSLELYQQANARLYR

SEQ ID NO: 2076137 - protein, 19 aa, Staphylococcus
LNLSFLPNYYSIIKDELNI

SEQ ID NO: 2076138 - protein, 22 aa, Staphylococcus
LNLTTQFYPTQFIKFEEATIDT

SEQ ID NO: 2076139 - protein, 17 aa, Staphylococcus
LNMISENLNYLINDTRT

SEQ ID NO: 2076140 - protein, 21 aa, Staphylococcus
LNMTINNFTFNMKIAGDFNAF

SEQ ID NO: 2076141 - protein, 25 aa, Staphylococcus
LNNAKKWFGQLPGRVSGWFESTKKH

SEQ ID NO: 2076142 - protein, 22 aa, Staphylococcus
LNNATLPYAQQLASKGYLKALQ

SEQ ID NO: 2076143 - protein, 18 aa, Staphylococcus
LNNDVLCQFYILIDNEMN

SEQ ID NO: 2076144 - protein, 27 aa, Staphylococcus
LNNGLKLFIIPKKGFQKTFVTYTTKFG

SEQ ID NO: 2076145 - protein, 22 aa, Staphylococcus
LNNGLPAFLSPEPGLQSGAMIM

SEQ ID NO: 2076146 - protein, 24 aa, Staphylococcus
LNNGLPAFLSPQPGLQSGAMIMQY

SEQ ID NO: 2076147 - protein, 25 aa, Staphylococcus
LNNGLRLFVIPKKGFQKTYVTYTTQ

SEQ ID NO: 2076148 - protein, 21 aa, Staphylococcus
LNNGRFSPVVFKLASEHQIDL

SEQ ID NO: 2076149 - protein, 22 aa, Staphylococcus
LNNIDNVLVKVLDPLFAGYTVS

SEQ ID NO: 2076150 - protein, 18 aa, Staphylococcus
LNNKEVLEYVLYKAINLD

SEQ ID NO: 2076151 - protein, 24 aa, Staphylococcus
LNNNYDHNWKYYSKSFNLSSFEKD

SEQ ID NO: 2076152 - protein, 27 aa, Staphylococcus
LNNPIFNDIEWVIVSLGAKGMFAKHHN

SEQ ID NO: 2076153 - protein, 25 aa, Staphylococcus
LNNSNYLLIELPSNSVPHYTKRLFF

SEQ ID NO: 2076154 - protein, 26 aa, Staphylococcus
LNNTKKWFGQLPGKTSSWFKSTKKHT

SEQ ID NO: 2076155 - protein, 20 aa, Staphylococcus
LNNVNYFGTMLVYAGKADGL

SEQ ID NO: 2076156 - protein, 23 aa, Staphylococcus
LNNVNYFGTMLVYTGKADGLVSG

SEQ ID NO: 2076157 - protein, 20 aa, Staphylococcus
LNPNLKAFAPVREWAWSREE

SEQ ID NO: 2076158 - protein, 18 aa, Staphylococcus
LNPNLKTFAPVREWGWSR

SEQ ID NO: 2076159 - protein, 20 aa, Staphylococcus
LNPTPKWQISRYKGLGEMNA

SEQ ID NO: 2076160 - protein, 19 aa, Staphylococcus
LNPTPKWSISRYKGLGEMN

SEQ ID NO: 2076161 - protein, 27 aa, Staphylococcus
LNQAIETLSYPFIVKTRFGGYDGKGQI

SEQ ID NO: 2076162 - protein, 19 aa, Staphylococcus
LNQAPFSFDLSVMAIYPCL

SEQ ID NO: 2076163 - protein, 29 aa, Staphylococcus
LNQAPFSFDLSVMAIYPCLATAGTLNLVD

SEQ ID NO: 2076164 - protein, 32 aa, Staphylococcus
LNQAPFSFDLSVMAIYPCLFTGGTLNLVDKDM

SEQ ID NO: 2076165 - protein, 20 aa, Staphylococcus
LNQDVYFIHSFYVQTDAPII

SEQ ID NO: 2076166 - protein, 24 aa, Staphylococcus
LNQELLLFLKKAVKVAKELGLFVS

SEQ ID NO: 2076167 - protein, 27 aa, Staphylococcus
LNQGYDVIMDIPLLFENELQNTVDEVW

SEQ ID NO: 2076168 - protein, 25 aa, Staphylococcus
LNQKFNIITIFCDSLNYLSSSKEVK

SEQ ID NO: 2076169 - protein, 26 aa, Staphylococcus
LNQSKIPTFYIVNVGGGYLDGDRYRM

SEQ ID NO: 2076170 - protein, 23 aa, Staphylococcus
LNQSLMLVTALNPHIGYEKAAQI

SEQ ID NO: 2076171 - protein, 24 aa, Staphylococcus
LNQSLMLVTALNPHIGYEKAAQIA

SEQ ID NO: 2076172 - protein, 30 aa, Staphylococcus
LNQSTYDVIFLSLVLLHSGDYKALLHKLYT

SEQ ID NO: 2076173 - protein, 17 aa, Staphylococcus
LNQSYGLGMAYYDVESN

SEQ ID NO: 2076174 - protein, 21 aa, Staphylococcus
LNRDIQLLNGLYDQNKDYFDE

SEQ ID NO: 2076175 - protein, 25 aa, Staphylococcus
LNREDIFVTSKLFFEDFGRENVAQA

SEQ ID NO: 2076176 - protein, 19 aa, Staphylococcus
LNRLRIMELLEFGEASVGH

SEQ ID NO: 2076177 - protein, 17 aa, Staphylococcus
LNRLRKLNFVNTKIDAV

SEQ ID NO: 2076178 - protein, 35 aa, Staphylococcus
LNSDEPITLVPIGPLTNIALLLKTYPEVTDHIKEI

SEQ ID NO: 2076179 - protein, 24 aa, Staphylococcus
LNSELLGQLPLAQPTWDPKDFAPS

SEQ ID NO: 2076180 - protein, 17 aa, Staphylococcus
LNSFEGFSPLITNEIVS

SEQ ID NO: 2076181 - protein, 25 aa, Staphylococcus
LNSFNQPIIWLCGGLDRGNDFDELI

SEQ ID NO: 2076182 - protein, 19 aa, Staphylococcus
LNSHKIEFKHPLTQELISV

SEQ ID NO: 2076183 - protein, 18 aa, Staphylococcus
LNSIIKKIDFMLNSANSD

SEQ ID NO: 2076184 - protein, 27 aa, Staphylococcus
LNSNWDMLFVVFSIHFIHLLKQLDSET

SEQ ID NO: 2076185 - protein, 28 aa, Staphylococcus
LNSNWDMLYIVFSLHYIQILKALPSDEV

SEQ ID NO: 2076186 - protein, 30 aa, Staphylococcus
LNSPETPIFQKRRLLYNLDNARKHIRKNDE

SEQ ID NO: 2076187 - protein, 18 aa, Staphylococcus
LNSSAYYRYMSVRIGAIV

SEQ ID NO: 2076188 - protein, 27 aa, Staphylococcus
LNSVHVLIQPHFKITAPFTDDALLRIS

SEQ ID NO: 2076189 - protein, 23 aa, Staphylococcus
LNSYKIEFTHPLTQELISVSLDD

SEQ ID NO: 2076190 - protein, 24 aa, Staphylococcus
LNTDYACILLDLMLPELDGIEVAN

SEQ ID NO: 2076191 - protein, 23 aa, Staphylococcus
LNTFALFNINLSWIESRPLKTQL

SEQ ID NO: 2076192 - protein, 23 aa, Staphylococcus
LNTLTVKENIMLPLSIQKMSKEE

SEQ ID NO: 2076193 - protein, 21 aa, Staphylococcus
LNTLYQIPYIIKSLADTYTNG

SEQ ID NO: 2076194 - protein, 18 aa, Staphylococcus
LNTQLLGELPLEQPSWNP

SEQ ID NO: 2076195 - protein, 20 aa, Staphylococcus
LNTQLLGELPLEQPSWNPND

SEQ ID NO: 2076196 - protein, 22 aa, Staphylococcus
LNTQLLGELPLEQPTWNPKDFS

SEQ ID NO: 2076197 - protein, 23 aa, Staphylococcus
LNTRPRKRFDWKTPAELFNDKVL

SEQ ID NO: 2076198 - protein, 33 aa, Staphylococcus
LNVALRQTLDLFACLRPVRWFKGVPSPVKRPED

SEQ ID NO: 2076199 - protein, 31 aa, Staphylococcus
LNVDSSGIIKKLFLLGIMANINQSLDDETLE

SEQ ID NO: 2076200 - protein, 31 aa, Staphylococcus
LNVESSGIIKKLFLLGIMANINQSLDEETLE

SEQ ID NO: 2076201 - protein, 17 aa, Staphylococcus
LNVFSYTGAFSVIAAEN

SEQ ID NO: 2076202 - protein, 18 aa, Staphylococcus
LNVFYTTQVAIEPPTFVV

SEQ ID NO: 2076203 - protein, 18 aa, Staphylococcus
LNVFYTTQVANEPPTFVV

SEQ ID NO: 2076204 - protein, 22 aa, Staphylococcus
LNVGLGPRILRAETAPLYALSA

SEQ ID NO: 2076205 - protein, 29 aa, Staphylococcus
LNVKEIMPLFDKSLPYYKEFIKEVAQFLE

SEQ ID NO: 2076206 - protein, 17 aa, Staphylococcus
LNVLIDEQKFEEAALVR

SEQ ID NO: 2076207 - protein, 23 aa, Staphylococcus
LNVPLIGFVGAPFTLASYMIEGG

SEQ ID NO: 2076208 - protein, 26 aa, Staphylococcus
LNVPNEPIIPFIIGDGIGPDIWKAAS

SEQ ID NO: 2076209 - protein, 26 aa, Staphylococcus
LNVTEFAVLELLYSKGPQPIQRIRDR

SEQ ID NO: 2076210 - protein, 18 aa, Staphylococcus
LNYIKLEEYVREIGLISS

SEQ ID NO: 2076211 - protein, 18 aa, Staphylococcus
LNYILHHLKKYKDQLQIE

SEQ ID NO: 2076212 - protein, 17 aa, Staphylococcus
LNYLINGSNFTTGWIFF

SEQ ID NO: 2076213 - protein, 30 aa, Staphylococcus
LNYNPILEGFTLPKMLWVQQHEPEIWEQVN

SEQ ID NO: 2076214 - protein, 30 aa, Staphylococcus
LNYYEALLTEYGVWHPKAWHSAPKALNFSD

SEQ ID NO: 2076215 - protein, 26 aa, Staphylococcus
LPADGVFVYIGMKPLTAPFIDLGITN

SEQ ID NO: 2076216 - protein, 21 aa, Staphylococcus
LPADYLEYELNFLKANMEVQI

SEQ ID NO: 2076217 - protein, 30 aa, Staphylococcus
LPANEGRGYVLRRLLRRAVRFSQTLDINEP

SEQ ID NO: 2076218 - protein, 29 aa, Staphylococcus
LPANEGRGYVLRRLLRRAVRFSQTLGINE

SEQ ID NO: 2076219 - protein, 26 aa, Staphylococcus
LPARFHKHPLPVPNFTYFKLNVKHIQ

SEQ ID NO: 2076220 - protein, 28 aa, Staphylococcus
LPARFHRQPLPVPRFKYFKLNTTRVQTQ

SEQ ID NO: 2076221 - protein, 20 aa, Staphylococcus
LPASQIANYIRRDIYEKTHL

SEQ ID NO: 2076222 - protein, 21 aa, Staphylococcus
LPDDKMIFNIPIRTVEYRNNM

SEQ ID NO: 2076223 - protein, 17 aa, Staphylococcus
LPDKLKNRIYYEPKTTS

SEQ ID NO: 2076224 - protein, 29 aa, Staphylococcus
LPDQINHMNAWLKPYRRAFNLEEPVVNVT

SEQ ID NO: 2076225 - protein, 23 aa, Staphylococcus
LPDVFNHWLATPLAQSLNCHCSE

SEQ ID NO: 2076226 - protein, 19 aa, Staphylococcus
LPEDAVMHFIGSLQSRKVK

SEQ ID NO: 2076227 - protein, 26 aa, Staphylococcus
LPEDYTITLIDRMPYHGLKPEYYALA

SEQ ID NO: 2076228 - protein, 26 aa, Staphylococcus
LPEGKSIFNVPIRTIQYLNDEAIYGV

SEQ ID NO: 2076229 - protein, 27 aa, Staphylococcus
LPEMEEELKILLIPKDPNDEKDVIVEI

SEQ ID NO: 2076230 - protein, 28 aa, Staphylococcus
LPERDTIITLWVKLLTLAGKYNEQGYIM

SEQ ID NO: 2076231 - protein, 17 aa, Staphylococcus
LPETYTNLSKYQVIICF

SEQ ID NO: 2076232 - protein, 17 aa, Staphylococcus
LPEVLLEKPKYGAINVH

SEQ ID NO: 2076233 - protein, 17 aa, Staphylococcus
LPEVLSLYNTQFPNVEI

SEQ ID NO: 2076234 - protein, 19 aa, Staphylococcus
LPFIAQAYDPKKDEFKEVS

SEQ ID NO: 2076235 - protein, 18 aa, Staphylococcus
LPGITRKTVIELAQNLGY

SEQ ID NO: 2076236 - protein, 27 aa, Staphylococcus
LPGLEEELKMLLIPKDPNDDKNVVVEI

SEQ ID NO: 2076237 - protein, 20 aa, Staphylococcus
LPHAEPFLASWFAEIIAEID

SEQ ID NO: 2076238 - protein, 20 aa, Staphylococcus
LPHIRVVMLTSFIEDKEVYR

SEQ ID NO: 2076239 - protein, 18 aa, Staphylococcus
LPHLQKEVNIAGTYNGVL

SEQ ID NO: 2076240 - protein, 19 aa, Staphylococcus
LPIEASLLDKPTLFYVYDE

SEQ ID NO: 2076241 - protein, 20 aa, Staphylococcus
LPIEASLLNKPTLFYVFDEK

SEQ ID NO: 2076242 - protein, 26 aa, Staphylococcus
LPIEVDKFNWLLVSKKIEAYHDISVE

SEQ ID NO: 2076243 - protein, 27 aa, Staphylococcus
LPIEVQAKHLLMTGLIDDIIISNAYAT

SEQ ID NO: 2076244 - protein, 17 aa, Staphylococcus
LPIKNIQKIFPIAGGYV

SEQ ID NO: 2076245 - protein, 20 aa, Staphylococcus
LPILIECFNHLIDQGNTVIL

SEQ ID NO: 2076246 - protein, 17 aa, Staphylococcus
LPILLISGKDDPFGDYG

SEQ ID NO: 2076247 - protein, 23 aa, Staphylococcus
LPILNGVLDYRRKLTNPFTGEVI

SEQ ID NO: 2076248 - protein, 23 aa, Staphylococcus
LPILNGVLDYRRKLTNPFTGEVV

SEQ ID NO: 2076249 - protein, 25 aa, Staphylococcus
LPISAAYFIINPYEVVYYAGGTSNE

SEQ ID NO: 2076250 - protein, 19 aa, Staphylococcus
LPIVIKKDGLAAGKGVIIA

SEQ ID NO: 2076251 - protein, 18 aa, Staphylococcus
LPIVKGKQVILFAPTFRG

SEQ ID NO: 2076252 - protein, 31 aa, Staphylococcus
LPKDFTELFKYKIIFCFDGADFFSFGRIHRT

SEQ ID NO: 2076253 - protein, 28 aa, Staphylococcus
LPKDLQEFIKSRYILADSISIINKIMQA

SEQ ID NO: 2076254 - protein, 18 aa, Staphylococcus
LPKFIIGFGGIPNHKLKE

SEQ ID NO: 2076255 - protein, 29 aa, Staphylococcus
LPKGVYAKDIILYLINQFGVDFGTGYALE

SEQ ID NO: 2076256 - protein, 29 aa, Staphylococcus
LPKGVYAKDIILYLINQYGVDFGTGYALE

SEQ ID NO: 2076257 - protein, 28 aa, Staphylococcus
LPKGVYAKDIILYLISQYGVDFGTGYAI

SEQ ID NO: 2076258 - protein, 36 aa, Staphylococcus
LPKKEFQLLYMLTSHPKQVFLRDTLIEKVWGFDYEG

SEQ ID NO: 2076259 - protein, 21 aa, Staphylococcus
LPKQNWGNYKLIFNTRHGAEL

SEQ ID NO: 2076260 - protein, 28 aa, Staphylococcus
LPKQQLPYFITFLSFHNFTIYQILSPKH

SEQ ID NO: 2076261 - protein, 28 aa, Staphylococcus
LPKQQLPYLISFLSFHNYAIYQILESAH

SEQ ID NO: 2076262 - protein, 26 aa, Staphylococcus
LPKQQLPYLISFLSFHNYSIYQILSP

SEQ ID NO: 2076263 - protein, 26 aa, Staphylococcus
LPKVQFNLLNSTAYYRYLSQRIGAII

SEQ ID NO: 2076264 - protein, 18 aa, Staphylococcus
LPLGMRARTKYQGTTINI

SEQ ID NO: 2076265 - protein, 20 aa, Staphylococcus
LPLHQTAIQWIWQTVAQEGG

SEQ ID NO: 2076266 - protein, 20 aa, Staphylococcus
LPLNWINKWKHYSSVTLPKR

SEQ ID NO: 2076267 - protein, 27 aa, Staphylococcus
LPLTGLTAYETLFDAFKISFNPEENKG

SEQ ID NO: 2076268 - protein, 21 aa, Staphylococcus
LPLTILELDLDTEISILEMGM

SEQ ID NO: 2076269 - protein, 20 aa, Staphylococcus
LPLTMIGLDLAREAIFTHDY

SEQ ID NO: 2076270 - protein, 20 aa, Staphylococcus
LPMHQKAIQLVWKTVESEGG

SEQ ID NO: 2076271 - protein, 23 aa, Staphylococcus
LPNACFNVTLYYESSLIGMGRIV

SEQ ID NO: 2076272 - protein, 19 aa, Staphylococcus
LPNTRVRKLLKRMDKYIKF

SEQ ID NO: 2076273 - protein, 31 aa, Staphylococcus
LPQEYTLTLIDRMPFHGLKPEFYALAAGTKS

SEQ ID NO: 2076274 - protein, 27 aa, Staphylococcus
LPQNDPALVDLLISTLGWDPNDQVQIS

SEQ ID NO: 2076275 - protein, 27 aa, Staphylococcus
LPQNDPALVDLLVSTLGWSPDTQVLIN

SEQ ID NO: 2076276 - protein, 27 aa, Staphylococcus
LPQNDPALVELLISTLGWDPGDQIQIS

SEQ ID NO: 2076277 - protein, 21 aa, Staphylococcus
LPREVLIPWEDLPKVKSLWPQ

SEQ ID NO: 2076278 - protein, 27 aa, Staphylococcus
LPREVLIPWEDLPKVKSLWPQSGDYVL

SEQ ID NO: 2076279 - protein, 22 aa, Staphylococcus
LPREVLIPWEDLPKVKTLWPEA

SEQ ID NO: 2076280 - protein, 19 aa, Staphylococcus
LPRMKKWDYLLVSSDLNKK

SEQ ID NO: 2076281 - protein, 20 aa, Staphylococcus
LPRPFFVLAPMEDVTDVVFR

SEQ ID NO: 2076282 - protein, 19 aa, Staphylococcus
LPRTGAYHEIWLDGEKVLD

SEQ ID NO: 2076283 - protein, 32 aa, Staphylococcus
LPRYIEKTICGKKVLFIHYEIANDKLSSSIDE

SEQ ID NO: 2076284 - protein, 18 aa, Staphylococcus
LPSELFGVSSKRALETKD

SEQ ID NO: 2076285 - protein, 26 aa, Staphylococcus
LPSFTYTFLGFLPRKDKEKQNILSER

SEQ ID NO: 2076286 - protein, 26 aa, Staphylococcus
LPSFTYTFLGFLPRKEKEKLDVLQER

SEQ ID NO: 2076287 - protein, 27 aa, Staphylococcus
LPSFTYTFLGFLPRKEKEKVNILSQRM

SEQ ID NO: 2076288 - protein, 32 aa, Staphylococcus
LPSHDGLVSMLLSVLQAPVRNFAYAVKAVGED

SEQ ID NO: 2076289 - protein, 18 aa, Staphylococcus
LPSIAYLEGEYGFSDICL

SEQ ID NO: 2076290 - protein, 25 aa, Staphylococcus
LPSKDNLAMLYKEGFHICKGELFGK

SEQ ID NO: 2076291 - protein, 24 aa, Staphylococcus
LPSKDNLAVLYSEGFHICNGELFG

SEQ ID NO: 2076292 - protein, 19 aa, Staphylococcus
LPSLSGLTEVKPLIHRAKI

SEQ ID NO: 2076293 - protein, 28 aa, Staphylococcus
LPTLEQKVFFKLLFYSGARKGEVRALTW

SEQ ID NO: 2076294 - protein, 21 aa, Staphylococcus
LPVAAFVNWFSLVEYGNIKAG

SEQ ID NO: 2076295 - protein, 18 aa, Staphylococcus
LPVEGLMLISPLLEFKQS

SEQ ID NO: 2076296 - protein, 26 aa, Staphylococcus
LPVENQVLIIYALTKGYLDDIPVEDI

SEQ ID NO: 2076297 - protein, 24 aa, Staphylococcus
LPVEYQVLTIYALTKGYLDDIPVE

SEQ ID NO: 2076298 - protein, 31 aa, Staphylococcus
LPVFKQVYKLYFKFVMPIFGKLFAKSREEYE

SEQ ID NO: 2076299 - protein, 20 aa, Staphylococcus
LPVILDPKWTSEQFKEILNH

SEQ ID NO: 2076300 - protein, 25 aa, Staphylococcus
LPVLCKDFMIEPIQIDVAYKAGASV

SEQ ID NO: 2076301 - protein, 18 aa, Staphylococcus
LPVLTISAKKGWLNQKER

SEQ ID NO: 2076302 - protein, 17 aa, Staphylococcus
LPVNHVPRILGFDAAGI

SEQ ID NO: 2076303 - protein, 26 aa, Staphylococcus
LPVQNEVLIIYALVNGFLDDIPVEDV

SEQ ID NO: 2076304 - protein, 18 aa, Staphylococcus
LPVSILEHQLISTLVENQ

SEQ ID NO: 2076305 - protein, 27 aa, Staphylococcus
LPVTVQRCFVTLRLKNILDYQIKMMSE

SEQ ID NO: 2076306 - protein, 18 aa, Staphylococcus
LPYHLAVKQLAQLDEDFD

SEQ ID NO: 2076307 - protein, 18 aa, Staphylococcus
LPYLLELGAIELSKSYRH

SEQ ID NO: 2076308 - protein, 20 aa, Staphylococcus
LQAAFFGTKAVIPYMKEQQY

SEQ ID NO: 2076309 - protein, 17 aa, Staphylococcus
LQALSYIGLNYLTLSRE

SEQ ID NO: 2076310 - protein, 19 aa, Staphylococcus
LQATAFPKIKFGFIHVPFV

SEQ ID NO: 2076311 - protein, 29 aa, Staphylococcus
LQATRYPDIKFGFIHVPFIPEQVVDKPDK

SEQ ID NO: 2076312 - protein, 25 aa, Staphylococcus
LQAYGLIPEFIGRVPVVANLETLDV

SEQ ID NO: 2076313 - protein, 23 aa, Staphylococcus
LQAYKTLPSIQTEKLLDAIPDFE

SEQ ID NO: 2076314 - protein, 34 aa, Staphylococcus
LQDEPGYAIPILLAISYLHQALIIENLRQETSLV

SEQ ID NO: 2076315 - protein, 24 aa, Staphylococcus
LQDKQYDPATWPLFDIGITQRHEQ

SEQ ID NO: 2076316 - protein, 22 aa, Staphylococcus
LQDLLTQYYLNTNEKMVFLNST

SEQ ID NO: 2076317 - protein, 27 aa, Staphylococcus
LQDVPGFKALRFLRPQAKHKHYIIVTL

SEQ ID NO: 2076318 - protein, 26 aa, Staphylococcus
LQEEFDNAFLLRTFSKAYGLAGLRVG

SEQ ID NO: 2076319 - protein, 22 aa, Staphylococcus
LQEGLAILNNLLAKAKSSNNEI

SEQ ID NO: 2076320 - protein, 24 aa, Staphylococcus
LQEGLSILDQLIAKAKLTTKEING

SEQ ID NO: 2076321 - protein, 33 aa, Staphylococcus
LQEKDRLLPGGYLFLSDLMGNPTLLNRVGKLIA

SEQ ID NO: 2076322 - protein, 28 aa, Staphylococcus
LQEKERLLPGGYLFLSDLVGNPTLLNKV

SEQ ID NO: 2076323 - protein, 26 aa, Staphylococcus
LQEKFPNAFLMRTFSKAYGLAGLRVG

SEQ ID NO: 2076324 - protein, 24 aa, Staphylococcus
LQEKKIGIFGFGRIGQLTAQRLKP

SEQ ID NO: 2076325 - protein, 18 aa, Staphylococcus
LQERAILSLEAPIARVAA

SEQ ID NO: 2076326 - protein, 29 aa, Staphylococcus
LQEREELDLTGKTWLFFGNQHFTTDFLYQ

SEQ ID NO: 2076327 - protein, 26 aa, Staphylococcus
LQETFDNAFLLRTFSKAYGLAGLRVG

SEQ ID NO: 2076328 - protein, 17 aa, Staphylococcus
LQFDYVFSAIGGGGLIS

SEQ ID NO: 2076329 - protein, 20 aa, Staphylococcus
LQFQTALLDYSDYLGRIGVG

SEQ ID NO: 2076330 - protein, 26 aa, Staphylococcus
LQGNLDPALLLAPWPVIEERLKNILD

SEQ ID NO: 2076331 - protein, 26 aa, Staphylococcus
LQGPLLNELLPNESIYYFKPILIYSN

SEQ ID NO: 2076332 - protein, 24 aa, Staphylococcus
LQGVWQPIPINNHLYYDGGSYSME

SEQ ID NO: 2076333 - protein, 29 aa, Staphylococcus
LQHFEGTLIFVSHDRYFINQLANKIFDMD

SEQ ID NO: 2076334 - protein, 23 aa, Staphylococcus
LQHSNVKRFLFASSAAVYGQLEG

SEQ ID NO: 2076335 - protein, 18 aa, Staphylococcus
LQIAKSLCDIYPLLNRSL

SEQ ID NO: 2076336 - protein, 23 aa, Staphylococcus
LQIESLYISVDPYMRGRMTPSDS

SEQ ID NO: 2076337 - protein, 20 aa, Staphylococcus
LQIFYSFIILKNNEVYFNLP

SEQ ID NO: 2076338 - protein, 19 aa, Staphylococcus
LQIISMNKLKPFLSIISHP

SEQ ID NO: 2076339 - protein, 23 aa, Staphylococcus
LQIKTIGIFGFGRIGQLVAERLA

SEQ ID NO: 2076340 - protein, 17 aa, Staphylococcus
LQIPKCTPLTEGYIYVA

SEQ ID NO: 2076341 - protein, 17 aa, Staphylococcus
LQIPSVRYVGCSNTTIN

SEQ ID NO: 2076342 - protein, 23 aa, Staphylococcus
LQITDLMCHMLIMLKRGSGVGYE

SEQ ID NO: 2076343 - protein, 23 aa, Staphylococcus
LQKEKIHFLFSELLEIISSNQLI

SEQ ID NO: 2076344 - protein, 18 aa, Staphylococcus
LQKGVQMVYESLLRALEE

SEQ ID NO: 2076345 - protein, 26 aa, Staphylococcus
LQKKQYKALHYLSEGTDLVVGLPKGH

SEQ ID NO: 2076346 - protein, 19 aa, Staphylococcus
LQKKYVNIQPSNEGYLLPI

SEQ ID NO: 2076347 - protein, 26 aa, Staphylococcus
LQKNIKLYVVIGQLNQLIKGGRISKT

SEQ ID NO: 2076348 - protein, 19 aa, Staphylococcus
LQKSHAPVTLLFTGPLTDL

SEQ ID NO: 2076349 - protein, 17 aa, Staphylococcus
LQKSNFQVFMKTKDNKI

SEQ ID NO: 2076350 - protein, 20 aa, Staphylococcus
LQKVNQVKFFGSKNVKIILT

SEQ ID NO: 2076351 - protein, 23 aa, Staphylococcus
LQKYLDDLGFNLVGYGCTTCIGN

SEQ ID NO: 2076352 - protein, 28 aa, Staphylococcus
LQLDYIDLVLIHQPYNDVYGSWKALEEL

SEQ ID NO: 2076353 - protein, 20 aa, Staphylococcus
LQLKALNPHGILLPATYGQV

SEQ ID NO: 2076354 - protein, 18 aa, Staphylococcus
LQLMISTMENRLNEHHTD

SEQ ID NO: 2076355 - protein, 19 aa, Staphylococcus
LQMDEAFVCYIAMSRATSK

SEQ ID NO: 2076356 - protein, 19 aa, Staphylococcus
LQMDEAFVCYIAMTRASTH

SEQ ID NO: 2076357 - protein, 17 aa, Staphylococcus
LQMFKNEIGNFVVEAPV

SEQ ID NO: 2076358 - protein, 20 aa, Staphylococcus
LQMIFQWEHMSLDYDPIRGK

SEQ ID NO: 2076359 - protein, 17 aa, Staphylococcus
LQMMINTMADRLNAAHQ

SEQ ID NO: 2076360 - protein, 34 aa, Staphylococcus
LQNFEGTIIFVSHDRYFINQLANKVFDLNHDGGK

SEQ ID NO: 2076361 - protein, 33 aa, Staphylococcus
LQNKGPRRVSPFFVPMLIPDMATGQVSIDLGAK

SEQ ID NO: 2076362 - protein, 25 aa, Staphylococcus
LQNKTIGIFGFGRIGQLVAERLKPF

SEQ ID NO: 2076363 - protein, 24 aa, Staphylococcus
LQNKTIGIFGLGRIGRLVGERLKP

SEQ ID NO: 2076364 - protein, 36 aa, Staphylococcus
LQNSPLNYTIIKPAFFMDNFLRIITVEDGVIYIPEF

SEQ ID NO: 2076365 - protein, 21 aa, Staphylococcus
LQNTDFDLTLLARNKSKLPDY

SEQ ID NO: 2076366 - protein, 20 aa, Staphylococcus
LQPIVVRPIEENMYEIIAGE

SEQ ID NO: 2076367 - protein, 17 aa, Staphylococcus
LQPVDIKTLPHPGFPTD

SEQ ID NO: 2076368 - protein, 25 aa, Staphylococcus
LQQEFENAFLLRTFSKAYGLAGMRI

SEQ ID NO: 2076369 - protein, 24 aa, Staphylococcus
LQQFQSGNRILIVFGPEGGLSEEE

SEQ ID NO: 2076370 - protein, 27 aa, Staphylococcus
LQQGYDVIMDIPLLFENDLHDTVDEVW

SEQ ID NO: 2076371 - protein, 23 aa, Staphylococcus
LQQIALFPHMTIKENIAQVPQMK

SEQ ID NO: 2076372 - protein, 20 aa, Staphylococcus
LQQIALFPHMTIKENVAQVP

SEQ ID NO: 2076373 - protein, 24 aa, Staphylococcus
LQQLAYRFVFIEKGEIIEDISKEQ

SEQ ID NO: 2076374 - protein, 17 aa, Staphylococcus
LQQLLPIPVIGVIEPGA

SEQ ID NO: 2076375 - protein, 20 aa, Staphylococcus
LQQMIRYLKQQGTTVIIIDH

SEQ ID NO: 2076376 - protein, 25 aa, Staphylococcus
LQQSDLPIFGTCAGLIVLAKDVEGE

SEQ ID NO: 2076377 - protein, 26 aa, Staphylococcus
LQQSDLPMFGTCAGLIVLAKHVEGET

SEQ ID NO: 2076378 - protein, 25 aa, Staphylococcus
LQQSDLPMFGTCAGLIVLASDVEGE

SEQ ID NO: 2076379 - protein, 17 aa, Staphylococcus
LQQTQISQIYLVFQHKT

SEQ ID NO: 2076380 - protein, 18 aa, Staphylococcus
LQQYAELLVKIGMNVQPK

SEQ ID NO: 2076381 - protein, 25 aa, Staphylococcus
LQRDDLFITSKLWLEDYGRNNVAQA

SEQ ID NO: 2076382 - protein, 26 aa, Staphylococcus
LQREKNITFLFIAHDLSMVKYISDRI

SEQ ID NO: 2076383 - protein, 19 aa, Staphylococcus
LQRIFNKDDIYFKDIFESS

SEQ ID NO: 2076384 - protein, 28 aa, Staphylococcus
LQRLVPEGLISLMKIQGLGSKKIAKLYK

SEQ ID NO: 2076385 - protein, 19 aa, Staphylococcus
LQRVFNINVFGMVYGTQAA

SEQ ID NO: 2076386 - protein, 18 aa, Staphylococcus
LQRYNLTLRVLLHPQFDK

SEQ ID NO: 2076387 - protein, 24 aa, Staphylococcus
LQSDDIDMFIPHQANIRIMESARE

SEQ ID NO: 2076388 - protein, 28 aa, Staphylococcus
LQSECVQTLIIYYAPKVIGGSGKYQFYQ

SEQ ID NO: 2076389 - protein, 22 aa, Staphylococcus
LQSFGMKVLAYDPYLTEDKAQQ

SEQ ID NO: 2076390 - protein, 25 aa, Staphylococcus
LQSFVQIGVRVIVPFGPRTIQGYVM

SEQ ID NO: 2076391 - protein, 23 aa, Staphylococcus
LQSHLLGLSLLGINEILAITGDP

SEQ ID NO: 2076392 - protein, 29 aa, Staphylococcus
LQSRLNTESIFLWLRGYNLKLNYNSVGHM

SEQ ID NO: 2076393 - protein, 19 aa, Staphylococcus
LQTIQFPYFDSKGDGVFKR

SEQ ID NO: 2076394 - protein, 18 aa, Staphylococcus
LQTIQFPYFDSQGDGIFE

SEQ ID NO: 2076395 - protein, 37 aa, Staphylococcus
LQTLTQLTHLPVLCKDFIIDPLQIDLAKRAGASIILL

SEQ ID NO: 2076396 - protein, 23 aa, Staphylococcus
LQTMKLPYKFFVGGKLGSGFQWY

SEQ ID NO: 2076397 - protein, 19 aa, Staphylococcus
LQTSFGVNMIALINGRPKL

SEQ ID NO: 2076398 - protein, 17 aa, Staphylococcus
LQWRGLIYQQTDEQGIE

SEQ ID NO: 2076399 - protein, 17 aa, Staphylococcus
LQWTSYRVKYIETVGIN

SEQ ID NO: 2076400 - protein, 17 aa, Staphylococcus
LRADAWLKNQLINNTEY

SEQ ID NO: 2076401 - protein, 21 aa, Staphylococcus
LRAGADIRHGLFGAGIESSHA

SEQ ID NO: 2076402 - protein, 25 aa, Staphylococcus
LRAGAFGLPITYAIIGGNPKRFARN

SEQ ID NO: 2076403 - protein, 22 aa, Staphylococcus
LRAGAFGLPITYAIIGGNPRRF

SEQ ID NO: 2076404 - protein, 20 aa, Staphylococcus
LRCDSNKPVLLYAPTWVSDH

SEQ ID NO: 2076405 - protein, 17 aa, Staphylococcus
LRCINLLEQPDSGEIIF

SEQ ID NO: 2076406 - protein, 24 aa, Staphylococcus
LRDIQPTLHFLKNDLRYSLRENVD

SEQ ID NO: 2076407 - protein, 26 aa, Staphylococcus
LRDKDEHFSFLMFGPGTAPHQINEYV

SEQ ID NO: 2076408 - protein, 26 aa, Staphylococcus
LRDKDEHFSFLMFGPGTVPHQVNEHV

SEQ ID NO: 2076409 - protein, 25 aa, Staphylococcus
LRDLNITFTLLRPTTEFETMISTVK

SEQ ID NO: 2076410 - protein, 18 aa, Staphylococcus
LRDMIIVNLQGILTPAEY

SEQ ID NO: 2076411 - protein, 26 aa, Staphylococcus
LRDNIQLFVVIGQLNQLIKGGRISKT

SEQ ID NO: 2076412 - protein, 24 aa, Staphylococcus
LRDSGLFHTIVHPGALENGPGTGN

SEQ ID NO: 2076413 - protein, 22 aa, Staphylococcus
LREDKAIEGIPQELALKNAKET

SEQ ID NO: 2076414 - protein, 24 aa, Staphylococcus
LREDKAIEGIPQELALKNAKVTED

SEQ ID NO: 2076415 - protein, 24 aa, Staphylococcus
LREDKAIPGIPQSLALKNAKETED

SEQ ID NO: 2076416 - protein, 28 aa, Staphylococcus
LREDMQLLIKRLIKTYGMTAIFVTHDQY

SEQ ID NO: 2076417 - protein, 26 aa, Staphylococcus
LREDMQLLIQRLIKTYDMTAIFVTHD

SEQ ID NO: 2076418 - protein, 26 aa, Staphylococcus
LREDMRLLIQRLVKQYGMTAIFVTHD

SEQ ID NO: 2076419 - protein, 24 aa, Staphylococcus
LREEPLDHVLLFGPPGLGKTTLSN

SEQ ID NO: 2076420 - protein, 22 aa, Staphylococcus
LREEPLDHVLLYGPPGLGKTTL

SEQ ID NO: 2076421 - protein, 17 aa, Staphylococcus
LREGKITERHARAVLVL

SEQ ID NO: 2076422 - protein, 38 aa, Staphylococcus
LRERKQTRLYLFYGLVFKRYFDEALSALTLYRSRRYWY

SEQ ID NO: 2076423 - protein, 26 aa, Staphylococcus
LRESGLFHIAYLLPSRVDLANFLYHA

SEQ ID NO: 2076424 - protein, 30 aa, Staphylococcus
LRESKINSGNQFIKALLGVNAEQFRQLFIL

SEQ ID NO: 2076425 - protein, 18 aa, Staphylococcus
LRESLKALDLKLLVTKDS

SEQ ID NO: 2076426 - protein, 18 aa, Staphylococcus
LRFQPPLVISYDQLDYAL

SEQ ID NO: 2076427 - protein, 20 aa, Staphylococcus
LRGEIILGNLKYSSGPNHQL

SEQ ID NO: 2076428 - protein, 29 aa, Staphylococcus
LRGELDEGLFYKFYFSYNPAKRKQHWANK

SEQ ID NO: 2076429 - protein, 20 aa, Staphylococcus
LRGGIVDIYPLIGKPVRIEF

SEQ ID NO: 2076430 - protein, 19 aa, Staphylococcus
LRGPIFKGLPTIEVHRNQH

SEQ ID NO: 2076431 - protein, 20 aa, Staphylococcus
LRGPRGGLILCKEEYKKDID

SEQ ID NO: 2076432 - protein, 20 aa, Staphylococcus
LRGYTSYTKGHILFEDDFAF

SEQ ID NO: 2076433 - protein, 25 aa, Staphylococcus
LRHKQLPAFSVQYHPEARPGPSDSN

SEQ ID NO: 2076434 - protein, 28 aa, Staphylococcus
LRHLEPEALLLPLFQNLKQTFPEVMDQV

SEQ ID NO: 2076435 - protein, 17 aa, Staphylococcus
LRHLVIRTGYYSDDKMV

SEQ ID NO: 2076436 - protein, 29 aa, Staphylococcus
LRHSFCSILIHHGFSILYISKHLGHSNPA

SEQ ID NO: 2076437 - protein, 19 aa, Staphylococcus
LRILAYKGELPVGILDLIV

SEQ ID NO: 2076438 - protein, 18 aa, Staphylococcus
LRILRRLVRDTKERGRSM

SEQ ID NO: 2076439 - protein, 17 aa, Staphylococcus
LRINKPLTFEVRGEAYM

SEQ ID NO: 2076440 - protein, 17 aa, Staphylococcus
LRIRDDVPFITDNGNYI

SEQ ID NO: 2076441 - protein, 25 aa, Staphylococcus
LRKELLGIDDLKMYDIYTPLVKDVK

SEQ ID NO: 2076442 - protein, 25 aa, Staphylococcus
LRKESACNILFKNAIIKAHQIQFNE

SEQ ID NO: 2076443 - protein, 24 aa, Staphylococcus
LRKGEIQFLYIAPERFENNQFMKL

SEQ ID NO: 2076444 - protein, 25 aa, Staphylococcus
LRKHTVCNILFRTAIIKAHHIRFNE

SEQ ID NO: 2076445 - protein, 25 aa, Staphylococcus
LRKKQIYSFIRKSITGQYVIVMTDY

SEQ ID NO: 2076446 - protein, 24 aa, Staphylococcus
LRKKYTFPVVTFTATAIVGGPEDM

SEQ ID NO: 2076447 - protein, 24 aa, Staphylococcus
LRKLEADVPIYYYGFNETDDVYAK

SEQ ID NO: 2076448 - protein, 22 aa, Staphylococcus
LRKLFYKGPTKSLYSLASKIKI

SEQ ID NO: 2076449 - protein, 25 aa, Staphylococcus
LRKLNVDIPIYYYGLSDKDDVYAND

SEQ ID NO: 2076450 - protein, 23 aa, Staphylococcus
LRKPDWLKIKLNTNENYIGLKKM

SEQ ID NO: 2076451 - protein, 20 aa, Staphylococcus
LRKPDWLKIKLNTNENYTGL

SEQ ID NO: 2076452 - protein, 20 aa, Staphylococcus
LRKQIKQLAAIYLASGIDPD

SEQ ID NO: 2076453 - protein, 18 aa, Staphylococcus
LRKRYHIPTNKAPKLLLK

SEQ ID NO: 2076454 - protein, 30 aa, Staphylococcus
LRKYCEINDYILMPFVFTSGLGIHALNSQN

SEQ ID NO: 2076455 - protein, 25 aa, Staphylococcus
LRLEKADLVIWLKAPRWKCILNVIK

SEQ ID NO: 2076456 - protein, 24 aa, Staphylococcus
LRLKRATVVIWLKEPRWKCIYRVI

SEQ ID NO: 2076457 - protein, 18 aa, Staphylococcus
LRLKRDLLREFIDDVIPE

SEQ ID NO: 2076458 - protein, 19 aa, Staphylococcus
LRLKSDLIRTFLDKVVPNL

SEQ ID NO: 2076459 - protein, 19 aa, Staphylococcus
LRLMKQAEKFNRPIFTFID

SEQ ID NO: 2076460 - protein, 20 aa, Staphylococcus
LRLNKAFSVAKFLENLDICI

SEQ ID NO: 2076461 - protein, 22 aa, Staphylococcus
LRNLGFKVYYSIECAVASLSKE

SEQ ID NO: 2076462 - protein, 25 aa, Staphylococcus
LRNLKADVPIYYYGLSKNDDVYADN

SEQ ID NO: 2076463 - protein, 17 aa, Staphylococcus
LRNNLHVFMFSDNVPKD

SEQ ID NO: 2076464 - protein, 29 aa, Staphylococcus
LRPDVPFDTITKFNLFMALGIRDAIQQFS

SEQ ID NO: 2076465 - protein, 20 aa, Staphylococcus
LRPYAIEHAVPIVDRLTLDL

SEQ ID NO: 2076466 - protein, 30 aa, Staphylococcus
LRQELDLFTCLRPVRWFKGVPSPVKRPQDV

SEQ ID NO: 2076467 - protein, 30 aa, Staphylococcus; identical to SEQ ID NO: 1830127

SEQ ID NO: 2076468 - protein, 30 aa, Staphylococcus
LRQELDLFTCLRPVRWFQGVPSPVKRPQDV

SEQ ID NO: 2076469 - protein, 17 aa, Staphylococcus
LRQFRHFQTVKFGDLTK

SEQ ID NO: 2076470 - protein, 21 aa, Staphylococcus
LRQLEAMLIVMNKDAILVVSG

SEQ ID NO: 2076471 - protein, 19 aa, Staphylococcus
LRQSFNIPALKAWQQTKQD

SEQ ID NO: 2076472 - protein, 20 aa, Staphylococcus
LRQVGYKVFIATGRSFDEIK

SEQ ID NO: 2076473 - protein, 20 aa, Staphylococcus
LRRARSCGESIIPTSTGAAK

SEQ ID NO: 2076474 - protein, 18 aa, Staphylococcus
LRREAIVLLGMIEDKAVL

SEQ ID NO: 2076475 - protein, 18 aa, Staphylococcus
LRRINRKTALLIQLSTEV

SEQ ID NO: 2076476 - protein, 28 aa, Staphylococcus
LRSEGRECKFIAVKLPYGVQKDADEVED

SEQ ID NO: 2076477 - protein, 17 aa, Staphylococcus
LRSLAHQMKNYADRRLD

SEQ ID NO: 2076478 - protein, 19 aa, Staphylococcus
LRTDLPSFRPGDTLRVHVR

SEQ ID NO: 2076479 - protein, 19 aa, Staphylococcus
LRTIEIFKLLGVNIELAEE

SEQ ID NO: 2076480 - protein, 22 aa, Staphylococcus
LRTIHAIPLKIKEPLNFEVRGE

SEQ ID NO: 2076481 - protein, 18 aa, Staphylococcus
LRTLFEESFLIKATLKEG

SEQ ID NO: 2076482 - protein, 23 aa, Staphylococcus
LRTLFNSIRFEEMQNLLLNQVKD

SEQ ID NO: 2076483 - protein, 26 aa, Staphylococcus
LRTNHPKSLFIWRSNLLSSSAKGQEY

SEQ ID NO: 2076484 - protein, 17 aa, Staphylococcus
LRTQTAFNFFSLFTFHE

SEQ ID NO: 2076485 - protein, 23 aa, Staphylococcus
LRTTHPQFIPGTNQLLICTNDIE

SEQ ID NO: 2076486 - protein, 27 aa, Staphylococcus
LRVALNYFINNLKNWNYSFAHSIKLSD

SEQ ID NO: 2076487 - protein, 28 aa, Staphylococcus
LRVASLLAHTLYDFPSHQLTTIGVTGTN

SEQ ID NO: 2076488 - protein, 25 aa, Staphylococcus
LRVASLLANTLYNYPSKQLITYGVT

SEQ ID NO: 2076489 - protein, 18 aa, Staphylococcus
LRVCSFLKEGTLADIGSD

SEQ ID NO: 2076490 - protein, 38 aa, Staphylococcus
LRVEAPLIQAQLIETILLNIVNFHTLITTKASRIRQVA

SEQ ID NO: 2076491 - protein, 30 aa, Staphylococcus
LRVEAPLIQAQLIETILLNVVNFHTLISTK

SEQ ID NO: 2076492 - protein, 17 aa, Staphylococcus
LRVFKDHLSKIDLKQYE

SEQ ID NO: 2076493 - protein, 21 aa, Staphylococcus
LRVILTSLFQYIQQKDHFKLK

SEQ ID NO: 2076494 - protein, 30 aa, Staphylococcus
LRVKITDHYVLTRLKTMGKLALLMLEDLNT

SEQ ID NO: 2076495 - protein, 29 aa, Staphylococcus
LRVKITDHYVLTRLKTMGKLAMLMLEDLN

SEQ ID NO: 2076496 - protein, 29 aa, Staphylococcus
LRVKITDHYVLTRLKTMGKLAMLMLQDLN

SEQ ID NO: 2076497 - protein, 31 aa, Staphylococcus
LRVLAEPAPIRMLVMFGLKLSDLVKFVEKCN

SEQ ID NO: 2076498 - protein, 17 aa, Staphylococcus
LRVTDIKGAVAIAKKHN

SEQ ID NO: 2076499 - protein, 19 aa, Staphylococcus
LRYKILKADAFRSSNKLQE

SEQ ID NO: 2076500 - protein, 20 aa, Staphylococcus
LRYTISLIRKEELAFMKAEF

SEQ ID NO: 2076501 - protein, 23 aa, Staphylococcus
LRYVQKNFRKDFFNSLKGALDSA

SEQ ID NO: 2076502 - protein, 18 aa, Staphylococcus
LSAAYVRDFYQTEISISL

SEQ ID NO: 2076503 - protein, 32 aa, Staphylococcus
LSADKYVFVSPMWNLSFPPVLKAYIDAITVAG

SEQ ID NO: 2076504 - protein, 24 aa, Staphylococcus
LSAHDSWTLAKHLKTLPVRFKQST

SEQ ID NO: 2076505 - protein, 24 aa, Staphylococcus
LSAHDSWTLAKHLKTLPVRFRQST

SEQ ID NO: 2076506 - protein, 20 aa, Staphylococcus
LSAKENLIFFGHLAGIKGKQ

SEQ ID NO: 2076507 - protein, 37 aa, Staphylococcus
LSAKRWIRYIHESEHPDFLIVIYHGGLYKINQTNTRH

SEQ ID NO: 2076508 - protein, 18 aa, Staphylococcus
LSALIQHDYVLAGKLMEM

SEQ ID NO: 2076509 - protein, 22 aa, Staphylococcus
LSALSFEYLKSHDALGAIIVGA

SEQ ID NO: 2076510 - protein, 21 aa, Staphylococcus
LSALSFNYLVSHDALGSIIVG

SEQ ID NO: 2076511 - protein, 24 aa, Staphylococcus
LSAQDSWTLAKHLKTLPVRFKQAT

SEQ ID NO: 2076512 - protein, 24 aa, Staphylococcus
LSAQDSWTLAKHLKTLPVRFNQSV

SEQ ID NO: 2076513 - protein, 20 aa, Staphylococcus
LSARIPFDHFLNRLIKTSKY

SEQ ID NO: 2076514 - protein, 26 aa, Staphylococcus
LSASMLSASIYRASEKWCHGFSDVPA

SEQ ID NO: 2076515 - protein, 18 aa, Staphylococcus
LSAWLLVESLQPGEVKYD

SEQ ID NO: 2076516 - protein, 23 aa, Staphylococcus
LSDAATLVDLLVLADIESLIDVD

SEQ ID NO: 2076517 - protein, 21 aa, Staphylococcus
LSDAATLVDLLVLAEIESLID

SEQ ID NO: 2076518 - protein, 29 aa, Staphylococcus
LSDALTRHFEITKLTKPLLQQAAAIFDND

SEQ ID NO: 2076519 - protein, 21 aa, Staphylococcus
LSDASEFIDTVPLGKDKVESG

SEQ ID NO: 2076520 - protein, 22 aa, Staphylococcus
LSDDRLLTQLFTALDKGAINVD

SEQ ID NO: 2076521 - protein, 19 aa, Staphylococcus
LSDEPVYVLGSSSGAIVAM

SEQ ID NO: 2076522 - protein, 17 aa, Staphylococcus
LSDIHGYIFPTDFKQTK

SEQ ID NO: 2076523 - protein, 32 aa, Staphylococcus
LSDLARRFINRDLFKFLPFDGSIITMNELREL

SEQ ID NO: 2076524 - protein, 22 aa, Staphylococcus
LSDMEKLIRLPGKFKYFEHNVA

SEQ ID NO: 2076525 - protein, 18 aa, Staphylococcus
LSDPLNDVLALVESLSLV

SEQ ID NO: 2076526 - protein, 26 aa, Staphylococcus
LSDQIAVLKWVAHFIKYFGGDPDNVT

SEQ ID NO: 2076527 - protein, 19 aa, Staphylococcus
LSDYLPLMLEFLYAAQWQN

SEQ ID NO: 2076528 - protein, 18 aa, Staphylococcus
LSDYRKMNYIGKGMKAYM

SEQ ID NO: 2076529 - protein, 26 aa, Staphylococcus
LSEARALKIFKYFYSHKGPVLDYNNK

SEQ ID NO: 2076530 - protein, 24 aa, Staphylococcus
LSEDDSLFKKYWPADLHLMAKEIV

SEQ ID NO: 2076531 - protein, 21 aa, Staphylococcus
LSEGYIYFKDKPISDYPVYEM

SEQ ID NO: 2076532 - protein, 21 aa, Staphylococcus
LSEGYIYFKDKPVSDYPVYEM

SEQ ID NO: 2076533 - protein, 17 aa, Staphylococcus
LSEIILDQLMHSDKAMI

SEQ ID NO: 2076534 - protein, 17 aa, Staphylococcus
LSEIILEQLMHNDKAMI

SEQ ID NO: 2076535 - protein, 24 aa, Staphylococcus
LSEIKAIYTDTFDFSKKAPLYMTY

SEQ ID NO: 2076536 - protein, 25 aa, Staphylococcus
LSEISKWKDYFRSKGYYPVAVDAKH

SEQ ID NO: 2076537 - protein, 24 aa, Staphylococcus
LSEKMYVVPPSKLINQIPYVMKEL

SEQ ID NO: 2076538 - protein, 17 aa, Staphylococcus
LSEMQLERLLQAINSKF

SEQ ID NO: 2076539 - protein, 19 aa, Staphylococcus
LSENIVDFIALDMGALGDG

SEQ ID NO: 2076540 - protein, 18 aa, Staphylococcus
LSERAILSLEAPIARVAA

SEQ ID NO: 2076541 - protein, 23 aa, Staphylococcus
LSERKFYKTFNQYLSKNWEEERA

SEQ ID NO: 2076542 - protein, 26 aa, Staphylococcus
LSERLQESAFLLKNLKIKLTDLRSGK

SEQ ID NO: 2076543 - protein, 28 aa, Staphylococcus
LSERLQESAFLLKRLKITLKDLRAGKER

SEQ ID NO: 2076544 - protein, 23 aa, Staphylococcus
LSERMPVFFSANMSYGVHALTKI

SEQ ID NO: 2076545 - protein, 34 aa, Staphylococcus
LSESEWGWPVDPQGLRYILNQFYDRYQLPLFIVE

SEQ ID NO: 2076546 - protein, 24 aa, Staphylococcus
LSESMYVVPPSRLISEIPYVMKEL

SEQ ID NO: 2076547 - protein, 30 aa, Staphylococcus
LSETLPQYMIPVHFMKIDKIPITINGKLDK

SEQ ID NO: 2076548 - protein, 24 aa, Staphylococcus
LSEYHLMIVHPWQLDNVLLSQYEE

SEQ ID NO: 2076549 - protein, 22 aa, Staphylococcus
LSEYILTFILDDHKKMETSFIN

SEQ ID NO: 2076550 - protein, 18 aa, Staphylococcus
LSFKNKIHILLKKDLTLL

SEQ ID NO: 2076551 - protein, 17 aa, Staphylococcus
LSFLKSTVDVNLEGMKI

SEQ ID NO: 2076552 - protein, 19 aa, Staphylococcus
LSFMGLPTPNIFTGCGNFH

SEQ ID NO: 2076553 - protein, 21 aa, Staphylococcus
LSFPSLVFDLTYFAIKQRKNE

SEQ ID NO: 2076554 - protein, 25 aa, Staphylococcus
LSGEPIQYIVGFQSFYGYRFTVSDR

SEQ ID NO: 2076555 - protein, 28 aa, Staphylococcus
LSGERPTIIRLLDPPLHEFLPNSNNEKA

SEQ ID NO: 2076556 - protein, 28 aa, Staphylococcus
LSGERPTIVRLLDPPLHEFLPNSAEDIQ

SEQ ID NO: 2076557 - protein, 28 aa, Staphylococcus
LSGERPTIVRLLDPPLHEFLPNSDEDVE

SEQ ID NO: 2076558 - protein, 28 aa, Staphylococcus
LSGGQFQRLWIAKALIMEPQILILDEAT

SEQ ID NO: 2076559 - protein, 26 aa, Staphylococcus
LSGGQFQRLWIAKALLVEPDVLILDE

SEQ ID NO: 2076560 - protein, 26 aa, Staphylococcus
LSGGQFQRLWIAKALLVEPEVLILDE

SEQ ID NO: 2076561 - protein, 18 aa, Staphylococcus
LSGHKFNGLKGQGLLITR

SEQ ID NO: 2076562 - protein, 30 aa, Staphylococcus
LSGHKFNGLKGQGLLLIDNVRKLTPIIQGG

SEQ ID NO: 2076563 - protein, 24 aa, Staphylococcus
LSGKPLFERNLKLVKYAYQQTKGK

SEQ ID NO: 2076564 - protein, 24 aa, Staphylococcus
LSGRPLFERNLKLVKLAYQETKGE

SEQ ID NO: 2076565 - protein, 19 aa, Staphylococcus
LSGSIIPRPIAFVTSSDIE

SEQ ID NO: 2076566 - protein, 17 aa, Staphylococcus
LSGVVSRKKQVVPQITD

SEQ ID NO: 2076567 - protein, 17 aa, Staphylococcus
LSGVVSRKKQVVPQITE

SEQ ID NO: 2076568 - protein, 17 aa, Staphylococcus
LSHAELLAILINTGRKG

SEQ ID NO: 2076569 - protein, 32 aa, Staphylococcus
LSHDKKGLFIVPLNGLKKWLTPVELWKHHQMT

SEQ ID NO: 2076570 - protein, 24 aa, Staphylococcus
LSHDQRFLYISNRGHDSIAVFAVN

SEQ ID NO: 2076571 - protein, 17 aa, Staphylococcus
LSHEVIERYFPGTPSKL

SEQ ID NO: 2076572 - protein, 19 aa, Staphylococcus
LSHILPDKLPEDYTITLID

SEQ ID NO: 2076573 - protein, 19 aa, Staphylococcus
LSHKLSYLTYDKYTPQVPR

SEQ ID NO: 2076574 - protein, 20 aa, Staphylococcus
LSHNNYIKRLPVSTYRAQNR

SEQ ID NO: 2076575 - protein, 21 aa, Staphylococcus
LSHNNYIKRLPVSTYRAQNRG

SEQ ID NO: 2076576 - protein, 21 aa, Staphylococcus
LSHNNYIKRLPVSTYRSQHRG

SEQ ID NO: 2076577 - protein, 20 aa, Staphylococcus
LSHRKLFPSLFHLYQQDNLD

SEQ ID NO: 2076578 - protein, 34 aa, Staphylococcus
LSHTLDIIKRHRLLEQFLIEVLNYNWEEVHQEAE

SEQ ID NO: 2076579 - protein, 18 aa, Staphylococcus
LSHYWSTVRPYYVDFESD

SEQ ID NO: 2076580 - protein, 22 aa, Staphylococcus
LSIASHLVGVKRIKALDIDEMA

SEQ ID NO: 2076581 - protein, 17 aa, Staphylococcus
LSIENRYQDIKAEQSRL

SEQ ID NO: 2076582 - protein, 25 aa, Staphylococcus
LSIESLPEHLAIIGGGVIGLEFASL

SEQ ID NO: 2076583 - protein, 32 aa, Staphylococcus
LSIKNNWIDQNGDIYFIFTNENLQEVLDKSKN

SEQ ID NO: 2076584 - protein, 18 aa, Staphylococcus
LSIMCDADWIIDVGPGPG

SEQ ID NO: 2076585 - protein, 17 aa, Staphylococcus
LSISQFTLYADVRKGNR

SEQ ID NO: 2076586 - protein, 18 aa, Staphylococcus
LSIVNHFAGKKHSILDIG

SEQ ID NO: 2076587 - protein, 18 aa, Staphylococcus
LSIYIVTGFLGSGKTSFL

SEQ ID NO: 2076588 - protein, 21 aa, Staphylococcus
LSIYTDWSFTLEYMKYVNKFM

SEQ ID NO: 2076589 - protein, 27 aa, Staphylococcus
LSKAINTLGYPFIVKTRFGGYDGKGQI

SEQ ID NO: 2076590 - protein, 19 aa, Staphylococcus
LSKDLKAYGFKFLGPVTVF

SEQ ID NO: 2076591 - protein, 24 aa, Staphylococcus
LSKKKYLMRMPNFNKIAKFCEYVN

SEQ ID NO: 2076592 - protein, 21 aa, Staphylococcus
LSKLIVLGPVGYLAHIKIVNT

SEQ ID NO: 2076593 - protein, 25 aa, Staphylococcus
LSKNQLPIMGFYRQRSHDIIDMDSC

SEQ ID NO: 2076594 - protein, 19 aa, Staphylococcus
LSKSLKSYGFKFLGPVTVF

SEQ ID NO: 2076595 - protein, 18 aa, Staphylococcus
LSKVMHYFKEAHPYFDQN

SEQ ID NO: 2076596 - protein, 25 aa, Staphylococcus
LSKVSPLIHRAKIGGVLNVTELNVI

SEQ ID NO: 2076597 - protein, 24 aa, Staphylococcus
LSKVSPLLHRAKIGSVLNVTELNQ

SEQ ID NO: 2076598 - protein, 23 aa, Staphylococcus
LSLDWECLIISKTDMLLDGVPKE

SEQ ID NO: 2076599 - protein, 28 aa, Staphylococcus
LSLEDIKAFPFILYDRNFYKKNIQKFEA

SEQ ID NO: 2076600 - protein, 24 aa, Staphylococcus
LSLGDVCIALPGGPGTLEEISEVV

SEQ ID NO: 2076601 - protein, 30 aa, Staphylococcus
LSLLSAEGVQWIVLAGYMRLIGEDILTAYP

SEQ ID NO: 2076602 - protein, 23 aa, Staphylococcus
LSLLSLIDRNGIVKRLPISLNSD

SEQ ID NO: 2076603 - protein, 17 aa, Staphylococcus
LSLQMFTRSFIPKSVGS

SEQ ID NO: 2076604 - protein, 17 aa, Staphylococcus
LSLSSFIDKSKVPARDT

SEQ ID NO: 2076605 - protein, 26 aa, Staphylococcus
LSMIYVDTGAMYRAITYKYLQNDKPE

SEQ ID NO: 2076606 - protein, 30 aa, Staphylococcus
LSNATLPLATLFHALFPCGSITGAPKLNTM

SEQ ID NO: 2076607 - protein, 23 aa, Staphylococcus
LSNDEIYSLVKKASQFKSGEVNV

SEQ ID NO: 2076608 - protein, 25 aa, Staphylococcus
LSNDQKLWLSGYLTANMQGGAARTV

SEQ ID NO: 2076609 - protein, 21 aa, Staphylococcus
LSNELLLNFDAKYTRFITTQS

SEQ ID NO: 2076610 - protein, 29 aa, Staphylococcus
LSNGRPTIVRLLDPPLHEFLPKSEEEIQI

SEQ ID NO: 2076611 - protein, 24 aa, Staphylococcus
LSNIDERFFRCHNSFVINLNNIEE

SEQ ID NO: 2076612 - protein, 25 aa, Staphylococcus
LSNKQIPKLYFTSHMDTVVPGVNIR

SEQ ID NO: 2076613 - protein, 25 aa, Staphylococcus
LSNKTLYLLDILQKLPINQMSSLSI

SEQ ID NO: 2076614 - protein, 26 aa, Staphylococcus
LSNKTLYLLDVLYKLPIEKMNELNIH

SEQ ID NO: 2076615 - protein, 21 aa, Staphylococcus
LSNMAQMVFLLGDLNVKDLSE

SEQ ID NO: 2076616 - protein, 20 aa, Staphylococcus
LSPDMTYAYIFGMFDQNELV

SEQ ID NO: 2076617 - protein, 20 aa, Staphylococcus
LSPHIVLELAKRIIPNEKVP

SEQ ID NO: 2076618 - protein, 20 aa, Staphylococcus
LSPKLIPNNLFKEIIANSID

SEQ ID NO: 2076619 - protein, 20 aa, Staphylococcus
LSPMTIIASLLPTGTVSGAP

SEQ ID NO: 2076620 - protein, 21 aa, Staphylococcus
LSPNDLFTWSSGIKSPIYCDN

SEQ ID NO: 2076621 - protein, 22 aa, Staphylococcus
LSPNDLFTWSSGIKSPIYCDNR

SEQ ID NO: 2076622 - protein, 21 aa, Staphylococcus
LSPNDLYTWSSGIKSPIYCDN

SEQ ID NO: 2076623 - protein, 21 aa, Staphylococcus
LSQDLIDKYDIPVAPLSVTFD

SEQ ID NO: 2076624 - protein, 28 aa, Staphylococcus
LSQDRPTIVRLLDPPLHEFLPSSDEDIA

SEQ ID NO: 2076625 - protein, 26 aa, Staphylococcus
LSQEKINFKYIDRILLNWKKNNVKTV

SEQ ID NO: 2076626 - protein, 29 aa, Staphylococcus
LSQFLAHKRYKVMNIPIVPEINPPEALFE

SEQ ID NO: 2076627 - protein, 23 aa, Staphylococcus
LSQIPPNLLTPQYFAELVVQHFK

SEQ ID NO: 2076628 - protein, 17 aa, Staphylococcus
LSQLWDLCAGVKTDRDL

SEQ ID NO: 2076629 - protein, 21 aa, Staphylococcus
LSQMHVSRLQRTAIKKLQQAA

SEQ ID NO: 2076630 - protein, 18 aa, Staphylococcus
LSQMLPLSENIYAKLHEF

SEQ ID NO: 2076631 - protein, 19 aa, Staphylococcus
LSQRLIQMRRRRGEIDFDI

SEQ ID NO: 2076632 - protein, 18 aa, Staphylococcus
LSRDRVDIILPAVSVFKT

SEQ ID NO: 2076633 - protein, 28 aa, Staphylococcus
LSRDRVDIILPAVSVFKTLFKKIDATQF

SEQ ID NO: 2076634 - protein, 30 aa, Staphylococcus
LSRDRVDIILPAVSVFKTLYKIVDAKQFTF

SEQ ID NO: 2076635 - protein, 26 aa, Staphylococcus
LSRDRVDIILPAVSVFKVLFNKIEAS

SEQ ID NO: 2076636 - protein, 25 aa, Staphylococcus
LSREDLFITSKLYFEDFGRENVAQA

SEQ ID NO: 2076637 - protein, 23 aa, Staphylococcus
LSRLESKGYIRRDPTKPRAIEIV

SEQ ID NO: 2076638 - protein, 27 aa, Staphylococcus
LSRLVAPFVPFISEKIHYNLTGKSVHL

SEQ ID NO: 2076639 - protein, 18 aa, Staphylococcus
LSRQGIWKLIKQYGVKAN

SEQ ID NO: 2076640 - protein, 25 aa, Staphylococcus
LSRQYRHLIVVPMFLYDGRLVNKVK

SEQ ID NO: 2076641 - protein, 20 aa, Staphylococcus
LSRTKIFIDDTPGIRINDLR

SEQ ID NO: 2076642 - protein, 17 aa, Staphylococcus
LSRYFTAMLAQYADYPS

SEQ ID NO: 2076643 - protein, 27 aa, Staphylococcus
LSSGRPTIVRLLDPPLHEFLPSTEEDI

SEQ ID NO: 2076644 - protein, 24 aa, Staphylococcus
LSSGYYDAYYKKSQKVRTLIRQDF

SEQ ID NO: 2076645 - protein, 23 aa, Staphylococcus
LSSKLGIEKLLSKYPYQVSGGEQ

SEQ ID NO: 2076646 - protein, 20 aa, Staphylococcus
LSSLTFNYLTSHDALGSIIV

SEQ ID NO: 2076647 - protein, 17 aa, Staphylococcus
LSSMFEAVGAFKGGSMT

SEQ ID NO: 2076648 - protein, 25 aa, Staphylococcus
LSSPHPFIQLLHDSLHLAYVNNITC

SEQ ID NO: 2076649 - protein, 33 aa, Staphylococcus
LSSSASIEILMGWLLKALFNLEVERLELIELGR

SEQ ID NO: 2076650 - protein, 26 aa, Staphylococcus
LSTAQLDFLLPERFELTYIGSDGEYH

SEQ ID NO: 2076651 - protein, 18 aa, Staphylococcus
LSTIIILDGLEDPHNLGS

SEQ ID NO: 2076652 - protein, 24 aa, Staphylococcus
LSTIKLLSSYLYKIFGKDISIEAI

SEQ ID NO: 2076653 - protein, 26 aa, Staphylococcus
LSTPFITLYHQSIAQQVVLFWQEQSQ

SEQ ID NO: 2076654 - protein, 17 aa, Staphylococcus
LSTVIILDGLEDPHNLG

SEQ ID NO: 2076655 - protein, 21 aa, Staphylococcus
LSVALLHPFFDVKMISTVNGN

SEQ ID NO: 2076656 - protein, 31 aa, Staphylococcus
LSVDDFVNILKEPKLSLIKQYEALLQTEEVT

SEQ ID NO: 2076657 - protein, 31 aa, Staphylococcus; identical to SEQ ID NO: 1830173

SEQ ID NO: 2076658 - protein, 30 aa, Staphylococcus
LSVEDFVRILKEPKLSLVKQYEALLQTEEV

SEQ ID NO: 2076659 - protein, 31 aa, Staphylococcus
LSVEDFVRILTEPKLSLIKQYEALLQTEQVT

SEQ ID NO: 2076660 - protein, 22 aa, Staphylococcus
LSVELSERIKLNIPVISAGMDT

SEQ ID NO: 2076661 - protein, 25 aa, Staphylococcus
LSVETLKLFKGIDVYTFIAGRSLTE

SEQ ID NO: 2076662 - protein, 28 aa, Staphylococcus
LSVKAKSFTLLSKALRPLPDKFHGLQDI

SEQ ID NO: 2076663 - protein, 25 aa, Staphylococcus
LSVKAKSFTLLSKSLRPLPDKFHGL

SEQ ID NO: 2076664 - protein, 28 aa, Staphylococcus
LSVKAKSFTLLTKALRPLPDKFHGLQDI

SEQ ID NO: 2076665 - protein, 29 aa, Staphylococcus
LSVKAQSFTLLTKALRPLPDKFHGLQDIE

SEQ ID NO: 2076666 - protein, 27 aa, Staphylococcus
LSVNLPDFSMSSPLYINAMTGGSEWTK

SEQ ID NO: 2076667 - protein, 17 aa, Staphylococcus
LSYIFITHDIQAATYLC

SEQ ID NO: 2076668 - protein, 19 aa, Staphylococcus
LSYIYDYPHKVLYKAIKGV

SEQ ID NO: 2076669 - protein, 19 aa, Staphylococcus
LSYIYDYPHQHLYKAIENE

SEQ ID NO: 2076670 - protein, 17 aa, Staphylococcus
LSYLKSTIDINLDGLKI

SEQ ID NO: 2076671 - protein, 17 aa, Staphylococcus
LSYLLADSSKRDARASY

SEQ ID NO: 2076672 - protein, 27 aa, Staphylococcus
LSYQEIYNAIIYQLGALNGFCKLYNTK

SEQ ID NO: 2076673 - protein, 20 aa, Staphylococcus
LSYSRFMTHLKFFSQRLINH

SEQ ID NO: 2076674 - protein, 19 aa, Staphylococcus
LTAFGFKVVDADTAAREAV

SEQ ID NO: 2076675 - protein, 24 aa, Staphylococcus
LTAKNSFKFIYSILSKHQSASLPD

SEQ ID NO: 2076676 - protein, 19 aa, Staphylococcus
LTALIQNFMTLIYSLKNES

SEQ ID NO: 2076677 - protein, 17 aa, Staphylococcus
LTALMASGLPSFTYTFL

SEQ ID NO: 2076678 - protein, 20 aa, Staphylococcus
LTALNFRDYVCYLNQLKQTE

SEQ ID NO: 2076679 - protein, 17 aa, Staphylococcus
LTALQQLAKAYLKHVNP

SEQ ID NO: 2076680 - protein, 27 aa, Staphylococcus
LTALQQLAKAYLNYVQPKVIAVTGSNG

SEQ ID NO: 2076681 - protein, 22 aa, Staphylococcus
LTAMNFIISIFPEVATLKTQIV

SEQ ID NO: 2076682 - protein, 25 aa, Staphylococcus
LTANGGFVTVLPYNVQIVSSEFVPT

SEQ ID NO: 2076683 - protein, 21 aa, Staphylococcus
LTARDIQLLPLIIYGYNEQEG

SEQ ID NO: 2076684 - protein, 26 aa, Staphylococcus
LTARELDLLYFFISNKNQILSKEQIY

SEQ ID NO: 2076685 - protein, 24 aa, Staphylococcus
LTATMPLYLNALTGKRAFLITTND

SEQ ID NO: 2076686 - protein, 26 aa, Staphylococcus
LTATMPLYLNGLTGKGAYLITTNEYL

SEQ ID NO: 2076687 - protein, 23 aa, Staphylococcus
LTAVIAIPLWYQQQVYGVMLFGQ

SEQ ID NO: 2076688 - protein, 27 aa, Staphylococcus
LTDARIFKVFKYFYTHRGPVMDFTNLA

SEQ ID NO: 2076689 - protein, 24 aa, Staphylococcus
LTDCDLLINFGSRFDDRLASDPES

SEQ ID NO: 2076690 - protein, 26 aa, Staphylococcus
LTDDDMLAHLLKYDTMQGRFTGEVEV

SEQ ID NO: 2076691 - protein, 26 aa, Staphylococcus
LTDDDMLAHLLKYDTMQGRFTSEVEV

SEQ ID NO: 2076692 - protein, 25 aa, Staphylococcus
LTDDEMLAHLLKYDTMQGRFNGDVE

SEQ ID NO: 2076693 - protein, 21 aa, Staphylococcus
LTDDEMLAHLLKYDTMQGRFT

SEQ ID NO: 2076694 - protein, 19 aa, Staphylococcus
LTDFIKKSTQIGIPIVAHL

SEQ ID NO: 2076695 - protein, 28 aa, Staphylococcus
LTDILVDGLFMYQLYKPNLPYKGSLNQR

SEQ ID NO: 2076696 - protein, 27 aa, Staphylococcus
LTDKKVLEYVLHKAINLNFNKFIVPRA

SEQ ID NO: 2076697 - protein, 26 aa, Staphylococcus
LTDKPFGVNLFVPSKNRYLPDQINHM

SEQ ID NO: 2076698 - protein, 25 aa, Staphylococcus
LTDKQRNYLELFYLQDYALSEIADT

SEQ ID NO: 2076699 - protein, 21 aa, Staphylococcus
LTDTLPNIDYFVAGVGSGGTF

SEQ ID NO: 2076700 - protein, 26 aa, Staphylococcus
LTEARSLKFFKYFYTHRGPVMDYNNQ

SEQ ID NO: 2076701 - protein, 27 aa, Staphylococcus
LTEARTLKFFKYFYTHRGPVMDYNNLS

SEQ ID NO: 2076702 - protein, 26 aa, Staphylococcus
LTEARVLKIFKYFYSHRGPVMDYNDL

SEQ ID NO: 2076703 - protein, 20 aa, Staphylococcus
LTEDYKWMHPCYTLDDKNVV

SEQ ID NO: 2076704 - protein, 26 aa, Staphylococcus
LTEEDLKMMYKWMDLGRKVDERLWLL

SEQ ID NO: 2076705 - protein, 25 aa, Staphylococcus
LTEEEAIIFATAKFKPFHNRLEEDT

SEQ ID NO: 2076706 - protein, 19 aa, Staphylococcus
LTEEKLNVPLIGFTGAPFT

SEQ ID NO: 2076707 - protein, 20 aa, Staphylococcus
LTEIDEVRALLREHLESQGI

SEQ ID NO: 2076708 - protein, 27 aa, Staphylococcus
LTEKDALLKLDFITHSYPHDWRTKKPV

SEQ ID NO: 2076709 - protein, 27 aa, Staphylococcus
LTEKDALLKLNFITHSYPHDWRTKKPV

SEQ ID NO: 2076710 - protein, 20 aa, Staphylococcus
LTEKITIEEFKQIILKTIFG

SEQ ID NO: 2076711 - protein, 29 aa, Staphylococcus
LTEKQIIRFINYLMYNVYLIMTTAPSEAK

SEQ ID NO: 2076712 - protein, 20 aa, Staphylococcus
LTELQIIKLLFQNEGKFVNR

SEQ ID NO: 2076713 - protein, 17 aa, Staphylococcus
LTEMIKFKYPRLFETIH

SEQ ID NO: 2076714 - protein, 23 aa, Staphylococcus
LTEQRLNRLRPLLANGTVTVGNS

SEQ ID NO: 2076715 - protein, 22 aa, Staphylococcus
LTERDILLVPDVLASAGGVTVS

SEQ ID NO: 2076716 - protein, 17 aa, Staphylococcus
LTESIRLKSKKGTLLWL

SEQ ID NO: 2076717 - protein, 18 aa, Staphylococcus
LTFFKKEGTTLKILFHAG

SEQ ID NO: 2076718 - protein, 24 aa, Staphylococcus
LTGFDPILQIRFHSVLDLAGKTAK

SEQ ID NO: 2076719 - protein, 20 aa, Staphylococcus
LTGIISCPQCSAPMAASNTT

SEQ ID NO: 2076720 - protein, 17 aa, Staphylococcus
LTGIVYQDKETPSYESQ

SEQ ID NO: 2076721 - protein, 18 aa, Staphylococcus
LTGLIDRVDHRYVYVNLG

SEQ ID NO: 2076722 - protein, 19 aa, Staphylococcus
LTGLKKEKLAKELQALCQS

SEQ ID NO: 2076723 - protein, 22 aa, Staphylococcus
LTGPVTILNWSFERVDIPRQEV

SEQ ID NO: 2076724 - protein, 18 aa, Staphylococcus
LTGRELLIANQLPVIVHE

SEQ ID NO: 2076725 - protein, 18 aa, Staphylococcus
LTGRFRVKERQSFTVSDL

SEQ ID NO: 2076726 - protein, 33 aa, Staphylococcus
LTGTGMFPKWKGIPTLVLLKLITMILGKRRRVK

SEQ ID NO: 2076727 - protein, 24 aa, Staphylococcus
LTGTGMFPKWKGVPATFALKLITM

SEQ ID NO: 2076728 - protein, 22 aa, Staphylococcus
LTGVDLVVELPLIASLSSGDTF

SEQ ID NO: 2076729 - protein, 23 aa, Staphylococcus
LTHATSRMLFGRPQSNMPSRFLR

SEQ ID NO: 2076730 - protein, 21 aa, Staphylococcus
LTHDWLNFGYTFMDKSNTSRA

SEQ ID NO: 2076731 - protein, 24 aa, Staphylococcus
LTHFVTNSTYFLWDVLTTAYVGNP

SEQ ID NO: 2076732 - protein, 25 aa, Staphylococcus
LTHIKHYYHQPKFIKYWTDKINETL

SEQ ID NO: 2076733 - protein, 33 aa, Staphylococcus
LTHVIPNYMIPAHIYFLNVFPLNKNGKIDQKKL

SEQ ID NO: 2076734 - protein, 22 aa, Staphylococcus
LTHYSDFYLSPSDYLRTLFQES

SEQ ID NO: 2076735 - protein, 21 aa, Staphylococcus
LTICGGYQFLGTKYITPDGTE

SEQ ID NO: 2076736 - protein, 17 aa, Staphylococcus
LTIILPTEIPSANLQAF

SEQ ID NO: 2076737 - protein, 26 aa, Staphylococcus
LTISEDLPFAQKRWCAASGLDNVILL

SEQ ID NO: 2076738 - protein, 25 aa, Staphylococcus
LTKELFIDWTWGENYFKNLLIDYDA

SEQ ID NO: 2076739 - protein, 25 aa, Staphylococcus
LTKKQRNYLELFYLQDYSLSEIADT

SEQ ID NO: 2076740 - protein, 25 aa, Staphylococcus
LTKKQRNYLELFYLQDYSLSEIANT

SEQ ID NO: 2076741 - protein, 23 aa, Staphylococcus
LTKQKHLFQWFNKKDVQKVKDIL

SEQ ID NO: 2076742 - protein, 26 aa, Staphylococcus
LTKQLESYIILELTKIKGASVKLNSI

SEQ ID NO: 2076743 - protein, 22 aa, Staphylococcus
LTKSLAIQFRPKGIRTNAISPG

SEQ ID NO: 2076744 - protein, 20 aa, Staphylococcus
LTLCHDFIKQLELDMRLVNC

SEQ ID NO: 2076745 - protein, 18 aa, Staphylococcus
LTLDEWYELFNQTGFKLL

SEQ ID NO: 2076746 - protein, 25 aa, Staphylococcus
LTLIDRMPFHGLKPEFYALAAGTKS

SEQ ID NO: 2076747 - protein, 19 aa, Staphylococcus
LTLKPVANALTEKLGEEVT

SEQ ID NO: 2076748 - protein, 17 aa, Staphylococcus
LTLLDLANIYISSGSAC

SEQ ID NO: 2076749 - protein, 17 aa, Staphylococcus
LTLMISLAKREGQGCVS

SEQ ID NO: 2076750 - protein, 18 aa, Staphylococcus
LTLTNNKVLIGKVIDFDD

SEQ ID NO: 2076751 - protein, 19 aa, Staphylococcus
LTLVDRMPYHGLKPEFYAL

SEQ ID NO: 2076752 - protein, 17 aa, Staphylococcus
LTMAEYFRDVKGQDVLL

SEQ ID NO: 2076753 - protein, 17 aa, Staphylococcus
LTMGFIDDLLYPDDLVQ

SEQ ID NO: 2076754 - protein, 25 aa, Staphylococcus
LTMLHHQCIPCILDYRWSEEQIKTL

SEQ ID NO: 2076755 - protein, 30 aa, Staphylococcus
LTNEIFQFPKHPYTQALIRSIPKLDERTEK

SEQ ID NO: 2076756 - protein, 18 aa, Staphylococcus
LTNGFMKHLDLKTPLKKF

SEQ ID NO: 2076757 - protein, 32 aa, Staphylococcus
LTNPNTLGFVNIISWKLVKLYMMLVVYCITME

SEQ ID NO: 2076758 - protein, 26 aa, Staphylococcus
LTNRSMALIGIIDLLKQAKNRKLQLL

SEQ ID NO: 2076759 - protein, 30 aa, Staphylococcus; identical to SEQ ID NO: 1697951

SEQ ID NO: 2076760 - protein, 24 aa, Staphylococcus
LTPELAFKLGRYGGYVLAHNEDKK

SEQ ID NO: 2076761 - protein, 23 aa, Staphylococcus
LTPELAFKLGRYGGYVLAHNEGA

SEQ ID NO: 2076762 - protein, 24 aa, Staphylococcus
LTPELAFKLGRYGGYVLAHNEGEK

SEQ ID NO: 2076763 - protein, 24 aa, Staphylococcus
LTPELAFKLGRYGGYVLAHNENEA

SEQ ID NO: 2076764 - protein, 23 aa, Staphylococcus
LTPEQQTWLSGYLMANQSSNATS

SEQ ID NO: 2076765 - protein, 17 aa, Staphylococcus
LTPFINLNIGSKTFNMK

SEQ ID NO: 2076766 - protein, 22 aa, Staphylococcus
LTPISYSTWFEPPKTELIDIQE

SEQ ID NO: 2076767 - protein, 21 aa, Staphylococcus
LTPLIGKKVFVNDKEIGLFLT

SEQ ID NO: 2076768 - protein, 21 aa, Staphylococcus
LTPLIGKKVIVKDKQIGIFLT

SEQ ID NO: 2076769 - protein, 19 aa, Staphylococcus
LTPLYPEERILLETEPKNY

SEQ ID NO: 2076770 - protein, 17 aa, Staphylococcus
LTPVELWKHHQMTLEVG

SEQ ID NO: 2076771 - protein, 24 aa, Staphylococcus
LTPVIQNFISLIYNVNFGEAPNQR

SEQ ID NO: 2076772 - protein, 21 aa, Staphylococcus
LTPYPYNNKKLQHPTFLIGFG

SEQ ID NO: 2076773 - protein, 18 aa, Staphylococcus
LTQEKLNVPLIGFTGAPF

SEQ ID NO: 2076774 - protein, 19 aa, Staphylococcus
LTQEKLNVPLIGFTGAPFT

SEQ ID NO: 2076775 - protein, 20 aa, Staphylococcus
LTQIAFYERGELVDADSIEM

SEQ ID NO: 2076776 - protein, 24 aa, Staphylococcus
LTQKEMVFFPLKQEIQFTPLKNTK

SEQ ID NO: 2076777 - protein, 22 aa, Staphylococcus
LTQPFSIEKILLGGAKLSSNLI

SEQ ID NO: 2076778 - protein, 19 aa, Staphylococcus
LTRFDLILMSINKTISELL

SEQ ID NO: 2076779 - protein, 23 aa, Staphylococcus
LTRSIPMIFLNPAPGQELENAYY

SEQ ID NO: 2076780 - protein, 23 aa, Staphylococcus
LTRSLPMIFLNPAPGQELENALY

SEQ ID NO: 2076781 - protein, 17 aa, Staphylococcus
LTRTLPMVFLNPAPGQE

SEQ ID NO: 2076782 - protein, 28 aa, Staphylococcus
LTSADYLCGFGQLFQYLRKEMIAEAELL

SEQ ID NO: 2076783 - protein, 24 aa, Staphylococcus
LTSEPFAVNLFIPSDYQYSEAEVA

SEQ ID NO: 2076784 - protein, 21 aa, Staphylococcus
LTSHDVVFKLRKILKTKKIGH

SEQ ID NO: 2076785 - protein, 22 aa, Staphylococcus
LTSIFVRRQFNIVTLSATPTLE

SEQ ID NO: 2076786 - protein, 19 aa, Staphylococcus
LTSIINKGDVIALAALSTA

SEQ ID NO: 2076787 - protein, 17 aa, Staphylococcus
LTSLVPKISNEIARKSI

SEQ ID NO: 2076788 - protein, 25 aa, Staphylococcus
LTSQPFAVNLFVPNKQRLLPAQVDL

SEQ ID NO: 2076789 - protein, 23 aa, Staphylococcus
LTSYYYVILHLSKHPLIPIKQGD

SEQ ID NO: 2076790 - protein, 23 aa, Staphylococcus
LTTEYYWHWDLKYAQLDVFEYKR

SEQ ID NO: 2076791 - protein, 29 aa, Staphylococcus
LTTKFVHQQLAIISYWRSGYIHSISGYIK

SEQ ID NO: 2076792 - protein, 17 aa, Staphylococcus
LTTKKVSFKLLATELVW

SEQ ID NO: 2076793 - protein, 19 aa, Staphylococcus
LTTLDLPNNIKSLMLEYLR

SEQ ID NO: 2076794 - protein, 18 aa, Staphylococcus
LTTLILKELGVKKVTAKA

SEQ ID NO: 2076795 - protein, 19 aa, Staphylococcus
LTTLILKELGVKKVTAKAQ

SEQ ID NO: 2076796 - protein, 26 aa, Staphylococcus
LTTNQINYHLLYRCFDKLFERHIGLA

SEQ ID NO: 2076797 - protein, 35 aa, Staphylococcus
LTVAMGYRINNEPLLMDIAKTPHALIAGATGSGKS

SEQ ID NO: 2076798 - protein, 27 aa, Staphylococcus
LTVERARRIQFFLSQNFHVAEQFTGQK

SEQ ID NO: 2076799 - protein, 27 aa, Staphylococcus
LTVINELAWHNLFAHNMFIRPESKDEA

SEQ ID NO: 2076800 - protein, 27 aa, Staphylococcus
LTVINELAWHNLFAHNMFIRPESKEEA

SEQ ID NO: 2076801 - protein, 28 aa, Staphylococcus
LTVKAKTFTLLSKALRPLPDKFHGLQDI

SEQ ID NO: 2076802 - protein, 19 aa, Staphylococcus
LTVKENIMLPLSVQKIQKS

SEQ ID NO: 2076803 - protein, 18 aa, Staphylococcus
LTVKENIMLPLSVQQHSK

SEQ ID NO: 2076804 - protein, 25 aa, Staphylococcus
LTVNDVMFKLLHSLKDLGATLNMDP

SEQ ID NO: 2076805 - protein, 28 aa, Staphylococcus
LTVPNNPIIPFIIGDGIGPDIWKAASRV

SEQ ID NO: 2076806 - protein, 25 aa, Staphylococcus
LTVQSIPMAIQYYRVFQKLKEQGVH

SEQ ID NO: 2076807 - protein, 17 aa, Staphylococcus
LTYLGVFDSVRSFFSKE

SEQ ID NO: 2076808 - protein, 20 aa, Staphylococcus
LTYNQLYSAAYQLSKKLLSL

SEQ ID NO: 2076809 - protein, 20 aa, Staphylococcus
LTYRESHFALEFLHNSNLVT

SEQ ID NO: 2076810 - protein, 24 aa, Staphylococcus
LTYRKCIIINLEKQIFSRSSIVQR

SEQ ID NO: 2076811 - protein, 17 aa, Staphylococcus
LTYYLKEYVGRETSLTY

SEQ ID NO: 2076812 - protein, 20 aa, Staphylococcus
LVAMIDLIKKSEPGYGPLLA

SEQ ID NO: 2076813 - protein, 36 aa, Staphylococcus
LVARLILDKVKNKKPIKRLWISSVTKKAIQQGFKHL

SEQ ID NO: 2076814 - protein, 25 aa, Staphylococcus
LVATGYPVLLATSRKRFIKEMIEQE

SEQ ID NO: 2076815 - protein, 28 aa, Staphylococcus
LVATVHKYLPLLHKYTQLRKELLGIDDL

SEQ ID NO: 2076816 - protein, 28 aa, Staphylococcus
LVCDISLRYFKIPFKHNAYFNKRLRTTG

SEQ ID NO: 2076817 - protein, 19 aa, Staphylococcus
LVCVGILKGSVMFMADLIK

SEQ ID NO: 2076818 - protein, 19 aa, Staphylococcus
LVDAGTIAITAFISPYRAD

SEQ ID NO: 2076819 - protein, 27 aa, Staphylococcus
LVDEHQILLVLPLWHENDVFPFELLIK

SEQ ID NO: 2076820 - protein, 18 aa, Staphylococcus
LVDGIRLTAFTDSEEKAM

SEQ ID NO: 2076821 - protein, 25 aa, Staphylococcus
LVDGRPKLINLKEALVQYLEHQKVV

SEQ ID NO: 2076822 - protein, 29 aa, Staphylococcus
LVDQSRSYLAEWLPFVAYTNQVEDSRKFI

SEQ ID NO: 2076823 - protein, 20 aa, Staphylococcus
LVDRVWPRGISKEDANLDFW

SEQ ID NO: 2076824 - protein, 17 aa, Staphylococcus
LVDVAVTEAFDIPKTWK

SEQ ID NO: 2076825 - protein, 23 aa, Staphylococcus
LVDYFEQGLIKHAINAPTLDFSN

SEQ ID NO: 2076826 - protein, 27 aa, Staphylococcus
LVEAGRVFIALPPLYKLEKGKGASRKI

SEQ ID NO: 2076827 - protein, 21 aa, Staphylococcus
LVEAVVNYARENNLKIIASCP

SEQ ID NO: 2076828 - protein, 18 aa, Staphylococcus
LVEFFYKNDELNDPLITE

SEQ ID NO: 2076829 - protein, 24 aa, Staphylococcus
LVEKMYRRFSILTTIAKHQPVGRR

SEQ ID NO: 2076830 - protein, 31 aa, Staphylococcus
LVELCKIKQIPYKVDIYPYYSSDASAALKAG

SEQ ID NO: 2076831 - protein, 19 aa, Staphylococcus
LVELIKMGIMEVKIFRQPI

SEQ ID NO: 2076832 - protein, 19 aa, Staphylococcus
LVEQLMAKSVKRKYTALVH

SEQ ID NO: 2076833 - protein, 17 aa, Staphylococcus
LVERFMTKLRSHKTYRD

SEQ ID NO: 2076834 - protein, 33 aa, Staphylococcus
LVERGPRRVSPFFVPMLIPDMATGQVSIDLGAK

SEQ ID NO: 2076835 - protein, 18 aa, Staphylococcus
LVERIKSILDKDDVYYQI

SEQ ID NO: 2076836 - protein, 29 aa, Staphylococcus
LVESDKTAYFILGGLWLALNEEKDIPRNE

SEQ ID NO: 2076837 - protein, 20 aa, Staphylococcus
LVESIKFYRDVLKGELLVSG

SEQ ID NO: 2076838 - protein, 17 aa, Staphylococcus
LVESLVEILLLSEVEVL

SEQ ID NO: 2076839 - protein, 24 aa, Staphylococcus
LVEVGDIVIIMTYAQLNEKEVKNH

SEQ ID NO: 2076840 - protein, 19 aa, Staphylococcus
LVEYAGHRKIFGFHGLVNG

SEQ ID NO: 2076841 - protein, 18 aa, Staphylococcus
LVEYEGELPFWDKSSPEA

SEQ ID NO: 2076842 - protein, 32 aa, Staphylococcus
LVEYMDDRYPFYLDPIPNLYFTRDPQASVGRG

SEQ ID NO: 2076843 - protein, 32 aa, Staphylococcus
LVEYMDDRYPFYLDPMPNLYFTRDPQASVGRG

SEQ ID NO: 2076844 - protein, 17 aa, Staphylococcus
LVFEKTARNFNPLCAMA

SEQ ID NO: 2076845 - protein, 22 aa, Staphylococcus
LVFLDSVVLPLMEAFHINEETM

SEQ ID NO: 2076846 - protein, 25 aa, Staphylococcus
LVFNSKQPFFIPEFQREFVWEKKDV

SEQ ID NO: 2076847 - protein, 17 aa, Staphylococcus
LVFQFPESQLFEDNIER

SEQ ID NO: 2076848 - protein, 18 aa, Staphylococcus
LVGAKFVKLFTDVNLEDD

SEQ ID NO: 2076849 - protein, 29 aa, Staphylococcus
LVGNNAPVFFIQDAIKFPDFVHALKPEPH

SEQ ID NO: 2076850 - protein, 18 aa, Staphylococcus
LVGPLRNAGLIRSVRGAK

SEQ ID NO: 2076851 - protein, 19 aa, Staphylococcus
LVGPLRNAGLIRSVRGAKG

SEQ ID NO: 2076852 - protein, 20 aa, Staphylococcus
LVGPLRNAGLIRSVRGAKGG

SEQ ID NO: 2076853 - protein, 20 aa, Staphylococcus
LVGTLRNAGLIRSVRGAKGG

SEQ ID NO: 2076854 - protein, 17 aa, Staphylococcus
LVGYEFYASWLNQKYSA

SEQ ID NO: 2076855 - protein, 18 aa, Staphylococcus
LVHACWLAQIEIAMINTR

SEQ ID NO: 2076856 - protein, 24 aa, Staphylococcus
LVHDQFDHYLLNELPQFKDKSPST

SEQ ID NO: 2076857 - protein, 18 aa, Staphylococcus
LVHEGQRVHPGTKLGISG

SEQ ID NO: 2076858 - protein, 19 aa, Staphylococcus
LVHGGLRYLKQLQVGVVAE

SEQ ID NO: 2076859 - protein, 19 aa, Staphylococcus
LVHYMNQLPIEGRYKVYII

SEQ ID NO: 2076860 - protein, 19 aa, Staphylococcus
LVIFANKIQLNDLILLGKG

SEQ ID NO: 2076861 - protein, 19 aa, Staphylococcus
LVIFANKIQLNQLILLGKG

SEQ ID NO: 2076862 - protein, 18 aa, Staphylococcus
LVIGLAKSGYEAAKLLNK

SEQ ID NO: 2076863 - protein, 18 aa, Staphylococcus
LVIQTYFERANVKFLSTL

SEQ ID NO: 2076864 - protein, 18 aa, Staphylococcus
LVKAFRKCGFDIDKVVFE

SEQ ID NO: 2076865 - protein, 19 aa, Staphylococcus
LVKALQAWDIDHIYGIPGD

SEQ ID NO: 2076866 - protein, 24 aa, Staphylococcus
LVKDKLEYPVFVKPANLGSSVGIS

SEQ ID NO: 2076867 - protein, 26 aa, Staphylococcus
LVKDNVLHHALFRTLAFTGIRRGELM

SEQ ID NO: 2076868 - protein, 19 aa, Staphylococcus
LVKEDLVLKEYGGIRINKE

SEQ ID NO: 2076869 - protein, 26 aa, Staphylococcus
LVKEKCDFYIKIPMVGHINSLNASVA

SEQ ID NO: 2076870 - protein, 17 aa, Staphylococcus
LVKFNLEYISNNAKSVI

SEQ ID NO: 2076871 - protein, 17 aa, Staphylococcus
LVKFTFGTEPNSAEIFN

SEQ ID NO: 2076872 - protein, 25 aa, Staphylococcus
LVKHYRKLIESLAYKYSKGQSHHED

SEQ ID NO: 2076873 - protein, 17 aa, Staphylococcus
LVKLDFIHRGMLALYEN

SEQ ID NO: 2076874 - protein, 18 aa, Staphylococcus
LVKLLVPSMKKKANQNAG

SEQ ID NO: 2076875 - protein, 17 aa, Staphylococcus
LVKLQLKVAMGEALPFT

SEQ ID NO: 2076876 - protein, 25 aa, Staphylococcus
LVKMSTELLLYQNYFTYELEGQLRS

SEQ ID NO: 2076877 - protein, 29 aa, Staphylococcus
LVKNPDEQILLIAVERLYPFPEDEIKAIF

SEQ ID NO: 2076878 - protein, 21 aa, Staphylococcus
LVKRVVEYAKENNLKIIPSCP

SEQ ID NO: 2076879 - protein, 28 aa, Staphylococcus
LVKTVHKYLPLLHRYTALRKEVLGLDDM

SEQ ID NO: 2076880 - protein, 38 aa, Staphylococcus
LVKTVHKYLPLLHRYTKLRKELLAVDELKMYDLYTPMV

SEQ ID NO: 2076881 - protein, 31 aa, Staphylococcus
LVKTVHKYLPLLHRYTKLRKELLGIEDLKMY

SEQ ID NO: 2076882 - protein, 43 aa, Staphylococcus
LVKTVHKYLPLLHRYTRLRQELLGIDDLKMYDLYTPLVKDVKF

SEQ ID NO: 2076883 - protein, 26 aa, Staphylococcus
LVLGGHKLDRPGYFYAPTVLDHVKQT

SEQ ID NO: 2076884 - protein, 32 aa, Staphylococcus
LVLGIDTTIPFHLKLLTNDIFQSGLFNTKFLE

SEQ ID NO: 2076885 - protein, 29 aa, Staphylococcus
LVLGIDTTIPFHLKLLTNDIFRSGEFNTK

SEQ ID NO: 2076886 - protein, 18 aa, Staphylococcus
LVLGLAKSGYEAAKLLTK

SEQ ID NO: 2076887 - protein, 17 aa, Staphylococcus
LVLHWLSENEIKVELLN

SEQ ID NO: 2076888 - protein, 25 aa, Staphylococcus
LVLQDSIIENISLPALKSFSKGGFL

SEQ ID NO: 2076889 - protein, 34 aa, Staphylococcus
LVLSFLRTVDNPLQDIYLVGLMRSVIYQFTEDEL

SEQ ID NO: 2076890 - protein, 31 aa, Staphylococcus
LVMKQLFEHRGLPQLPYISFLRSEFEKYENN

SEQ ID NO: 2076891 - protein, 30 aa, Staphylococcus; identical to SEQ ID NO: 1830235

SEQ ID NO: 2076892 - protein, 30 aa, Staphylococcus
LVMKQLFEHRGLPQLPYISFLRSEYEKYQG

SEQ ID NO: 2076893 - protein, 25 aa, Staphylococcus
LVMNINVKGIFLMTKYVIPVMEKQE

SEQ ID NO: 2076894 - protein, 18 aa, Staphylococcus
LVNESWYHQIEDLLNFAK

SEQ ID NO: 2076895 - protein, 20 aa, Staphylococcus
LVNEVLYKSLAKQINKSKVK

SEQ ID NO: 2076896 - protein, 25 aa, Staphylococcus
LVNHYRKLIESLAYKYSKGQSHHED

SEQ ID NO: 2076897 - protein, 29 aa, Staphylococcus
LVNIAFHEYLLPHLALTPKVEDLPKEERF

SEQ ID NO: 2076898 - protein, 31 aa, Staphylococcus
LVNLCKFNHIPYKIDIYPYYTSDASATLKAG

SEQ ID NO: 2076899 - protein, 17 aa, Staphylococcus
LVNLFYVRQKEQKGLGD

SEQ ID NO: 2076900 - protein, 22 aa, Staphylococcus
LVNLLVFIINQRMTAQDLNQLI

SEQ ID NO: 2076901 - protein, 26 aa, Staphylococcus
LVNNKDWLSQISLISFLRDYGKHVGV

SEQ ID NO: 2076902 - protein, 26 aa, Staphylococcus
LVNNRDWLSQISLISFLRDHGKHVGV

SEQ ID NO: 2076903 - protein, 25 aa, Staphylococcus
LVNQKVFDAFYKALKGKQVLVYSGL

SEQ ID NO: 2076904 - protein, 24 aa, Staphylococcus
LVNSDLPMFGTCAGLIVLAQDIVG

SEQ ID NO: 2076905 - protein, 20 aa, Staphylococcus
LVPEYLGELLFDDIPYLKVA

SEQ ID NO: 2076906 - protein, 18 aa, Staphylococcus
LVPMLQQTLRIASDEGIQ

SEQ ID NO: 2076907 - protein, 17 aa, Staphylococcus
LVPVVKHADRKSMFEIS

SEQ ID NO: 2076908 - protein, 17 aa, Staphylococcus
LVQAMIQTMYPVQPVYP

SEQ ID NO: 2076909 - protein, 21 aa, Staphylococcus
LVQIIGSMIVLYKESNENKQI

SEQ ID NO: 2076910 - protein, 27 aa, Staphylococcus
LVQYDYLVEDLLKSLGIPYSHEDRKVN

SEQ ID NO: 2076911 - protein, 31 aa, Staphylococcus
LVQYDYLVEDLLKSLGIPYTREDRKVNKAFR

SEQ ID NO: 2076912 - protein, 23 aa, Staphylococcus
LVQYDYLVESLLKDLGIPYEHED

SEQ ID NO: 2076913 - protein, 21 aa, Staphylococcus
LVRDFASVGLLFRDNDEYYWL

SEQ ID NO: 2076914 - protein, 24 aa, Staphylococcus
LVRDILRAPGFFRNLTVMPHAQEV

SEQ ID NO: 2076915 - protein, 18 aa, Staphylococcus
LVRDVVISGIFNSIGVFK

SEQ ID NO: 2076916 - protein, 27 aa, Staphylococcus
LVREILNAPGFFRQLPVLPAAQEVVEK

SEQ ID NO: 2076917 - protein, 22 aa, Staphylococcus
LVRHEFPILKRVAIKSMKTISD

SEQ ID NO: 2076918 - protein, 25 aa, Staphylococcus
LVRHYRKLIESLAYKYSKGQSHHED

SEQ ID NO: 2076919 - protein, 20 aa, Staphylococcus
LVRIINLSLRAKYLFKYNLD

SEQ ID NO: 2076920 - protein, 20 aa, Staphylococcus
LVRNAIRDGLARLIDEHFSE

SEQ ID NO: 2076921 - protein, 18 aa, Staphylococcus
LVRPQIISGTHAITIALQ

SEQ ID NO: 2076922 - protein, 19 aa, Staphylococcus
LVRPQIISGTHAITIALQS

SEQ ID NO: 2076923 - protein, 19 aa, Staphylococcus
LVRPQIISGTHAITLALQS

SEQ ID NO: 2076924 - protein, 18 aa, Staphylococcus
LVRSLIQTMYPVQPSYPG

SEQ ID NO: 2076925 - protein, 27 aa, Staphylococcus
LVSAASSCYIISLAAALERARFDNITI

SEQ ID NO: 2076926 - protein, 24 aa, Staphylococcus
LVSAASSCYIISLAATLERAGYKD

SEQ ID NO: 2076927 - protein, 25 aa, Staphylococcus
LVSAASSCYIISLAATLERAGYKDI

SEQ ID NO: 2076928 - protein, 17 aa, Staphylococcus
LVSALSRPLIAKKLVEI

SEQ ID NO: 2076929 - protein, 34 aa, Staphylococcus
LVSFLLGITTIDPIRFNLLFERFLNPERVTMPDI

SEQ ID NO: 2076930 - protein, 20 aa, Staphylococcus
LVSLFEALFPCGSITGAPKI

SEQ ID NO: 2076931 - protein, 18 aa, Staphylococcus
LVSLFLLLQMEEVDLIGV

SEQ ID NO: 2076932 - protein, 17 aa, Staphylococcus
LVSLLQNSIPVAASEKR

SEQ ID NO: 2076933 - protein, 17 aa, Staphylococcus
LVSLLQNSIPVAASRKR

SEQ ID NO: 2076934 - protein, 26 aa, Staphylococcus
LVSVVTMQLISYYAALHRDLDVDKPR

SEQ ID NO: 2076935 - protein, 23 aa, Staphylococcus
LVTDPKILLCDEATSALDPATTD

SEQ ID NO: 2076936 - protein, 25 aa, Staphylococcus
LVTHYRKLIESLAYKYSKGQSHHED

SEQ ID NO: 2076937 - protein, 17 aa, Staphylococcus
LVTIKDLATNHITTYES

SEQ ID NO: 2076938 - protein, 19 aa, Staphylococcus
LVVDSIQTIFHPEISSAPG

SEQ ID NO: 2076939 - protein, 17 aa, Staphylococcus
LVVELPAYAALSAGEYF

SEQ ID NO: 2076940 - protein, 18 aa, Staphylococcus
LVVGMKLIATILGKRRRL

SEQ ID NO: 2076941 - protein, 31 aa, Staphylococcus
LVVQTYFERVNLSFLNSLPIRGIGLDFVHDH

SEQ ID NO: 2076942 - protein, 17 aa, Staphylococcus
LVVTRRLYRSGESEYYL

SEQ ID NO: 2076943 - protein, 19 aa, Staphylococcus
LVWATAAPGWQKWVWSPFL

SEQ ID NO: 2076944 - protein, 33 aa, Staphylococcus
LVWATAAPGWQKWVWSPFLSILGTGATAFVYNG

SEQ ID NO: 2076945 - protein, 33 aa, Staphylococcus
LVWATAAPGWQKWVWSPFLSIMGSGATAFVYNG

SEQ ID NO: 2076946 - protein, 32 aa, Staphylococcus
LVWATAAPGWQKWVWTPFLSIMGSGATAFVYN

SEQ ID NO: 2076947 - protein, 24 aa, Staphylococcus
LVYADGEKRYIIAPKGLEVGQVVE

SEQ ID NO: 2076948 - protein, 32 aa, Staphylococcus
LVYDTNKWVYKRMPTLNSWKLDMAYQQFMHKQ

SEQ ID NO: 2076949 - protein, 17 aa, Staphylococcus
LVYHDMLNYGVDRYAKF

SEQ ID NO: 2076950 - protein, 18 aa, Staphylococcus
LVYIFERVEFIPDHYTRR

SEQ ID NO: 2076951 - protein, 19 aa, Staphylococcus
LVYQAWTTASLLKQWFMTS

SEQ ID NO: 2076952 - protein, 27 aa, Staphylococcus
LVYSAWTDINLLKQWFMTSQRTNKLFD

SEQ ID NO: 2076953 - protein, 18 aa, Staphylococcus
LWASCREVINVIQADEVG

SEQ ID NO: 2076954 - protein, 21 aa, Staphylococcus
LWDNARYLKDGLAKLGFNTGE

SEQ ID NO: 2076955 - protein, 21 aa, Staphylococcus
LWDSGKFLVGFGGEHGVTYPI

SEQ ID NO: 2076956 - protein, 25 aa, Staphylococcus
LWESEQAFIDWLQSDVFKKAHKNVR

SEQ ID NO: 2076957 - protein, 19 aa, Staphylococcus
LWFIQGRIDFQIKLNGYRM

SEQ ID NO: 2076958 - protein, 19 aa, Staphylococcus
LWINSGVATLKKYFDGREI

SEQ ID NO: 2076959 - protein, 25 aa, Staphylococcus
LWKHVDTFVLPKDYIRYGLTGQIHM

SEQ ID NO: 2076960 - protein, 21 aa, Staphylococcus
LWKKVDVFVLPKDYVRYCLTG

SEQ ID NO: 2076961 - protein, 17 aa, Staphylococcus
LYADVRKGNRPGFTQSM

SEQ ID NO: 2076962 - protein, 27 aa, Staphylococcus
LYCAKLWPEFTLFQPFQKKEIKLRETQ

SEQ ID NO: 2076963 - protein, 18 aa, Staphylococcus
LYDEPYVLITPKGAIQET

SEQ ID NO: 2076964 - protein, 27 aa, Staphylococcus
LYDKDEFELIRLFGKRGRGLYNKARGI

SEQ ID NO: 2076965 - protein, 17 aa, Staphylococcus
LYDKILVDAPCSGLGVL

SEQ ID NO: 2076966 - protein, 27 aa, Staphylococcus
LYDKTEFELIRWFGKRGRGLYLKARGI

SEQ ID NO: 2076967 - protein, 25 aa, Staphylococcus
LYDNKSGLYNLKLFAQVLGKGFDKE

SEQ ID NO: 2076968 - protein, 25 aa, Staphylococcus
LYDNKTGLYNLKLFAQVLGKGFDKE

SEQ ID NO: 2076969 - protein, 29 aa, Staphylococcus
LYDNKTGLYNLRLFAQVLGQGFDKAYSDK

SEQ ID NO: 2076970 - protein, 24 aa, Staphylococcus
LYDSKALFKLLALESQHAGLSWLT

SEQ ID NO: 2076971 - protein, 19 aa, Staphylococcus
LYDTKPRGLFRKKKFSPIV

SEQ ID NO: 2076972 - protein, 26 aa, Staphylococcus
LYDTYVGLWIDQLPKHELRVILTSLF

SEQ ID NO: 2076973 - protein, 19 aa, Staphylococcus
LYDYFKTWCETFKKSTVTP

SEQ ID NO: 2076974 - protein, 26 aa, Staphylococcus
LYEAHHYKHFIYAPVGFVCEHLEVLY

SEQ ID NO: 2076975 - protein, 18 aa, Staphylococcus
LYEALLKVGCITRPFPTG

SEQ ID NO: 2076976 - protein, 19 aa, Staphylococcus
LYEELFGAKTLYIQRIKDR

SEQ ID NO: 2076977 - protein, 20 aa, Staphylococcus
LYEHDAIARKILIASQPGNP

SEQ ID NO: 2076978 - protein, 19 aa, Staphylococcus
LYEKFGFISTEPHSKGMYI

SEQ ID NO: 2076979 - protein, 20 aa, Staphylococcus
LYEKFGFKTTEPKSGGMYIV

SEQ ID NO: 2076980 - protein, 27 aa, Staphylococcus
LYENEFEFVPQLKLWMATNHKPYVRGT

SEQ ID NO: 2076981 - protein, 19 aa, Staphylococcus
LYENNYQFLKDVLAHVNAK

SEQ ID NO: 2076982 - protein, 18 aa, Staphylococcus
LYEPPTEYINETLIKKYQ

SEQ ID NO: 2076983 - protein, 19 aa, Staphylococcus
LYEQFQSQMLLDIEQRFGS

SEQ ID NO: 2076984 - protein, 18 aa, Staphylococcus
LYERHKLLTYPRTDSNYL

SEQ ID NO: 2076985 - protein, 25 aa, Staphylococcus
LYESDRSLWDWASKQTYIALGNMMT

SEQ ID NO: 2076986 - protein, 18 aa, Staphylococcus
LYETPHLLKKQTFNFIKY

SEQ ID NO: 2076987 - protein, 25 aa, Staphylococcus
LYETYDVIFLDINLMDESGLDLAEK

SEQ ID NO: 2076988 - protein, 20 aa, Staphylococcus
LYFEHKKAYRLLKEEVPEEY

SEQ ID NO: 2076989 - protein, 19 aa, Staphylococcus
LYFEHKKAYRLLKEEVPES

SEQ ID NO: 2076990 - protein, 21 aa, Staphylococcus
LYGFCLERRIPVRNKVLIFSG

SEQ ID NO: 2076991 - protein, 22 aa, Staphylococcus
LYGFCLKRRIPVRDKILIFSGR

SEQ ID NO: 2076992 - protein, 17 aa, Staphylococcus
LYGFMEWIRDNDIQLSA

SEQ ID NO: 2076993 - protein, 19 aa, Staphylococcus
LYHLGHRHILFLQESGHYA

SEQ ID NO: 2076994 - protein, 24 aa, Staphylococcus
LYHQGRLPVNELLTDTLPLEHINE

SEQ ID NO: 2076995 - protein, 23 aa, Staphylococcus
LYIDEQTFVPCTPLGIMELLKNA

SEQ ID NO: 2076996 - protein, 17 aa, Staphylococcus
LYILMEQLNISSAHILG

SEQ ID NO: 2076997 - protein, 19 aa, Staphylococcus
LYIQSLIYDYPFDKEEISP

SEQ ID NO: 2076998 - protein, 20 aa, Staphylococcus
LYIQSLLYNYAFEDETISEE

SEQ ID NO: 2076999 - protein, 17 aa, Staphylococcus
LYKAIIKRFHIDRLSWK

SEQ ID NO: 2077000 - protein, 22 aa, Staphylococcus
LYKALLKHMGPQGWWPADTREE

SEQ ID NO: 2077001 - protein, 23 aa, Staphylococcus
LYKPVILNQKYGMGMTYFDVEKD

SEQ ID NO: 2077002 - protein, 23 aa, Staphylococcus
LYKPYVEGFVKMLAPIAPHLGEE

SEQ ID NO: 2077003 - protein, 34 aa, Staphylococcus
LYKRKSKLIGLLLPDMSNPFFTLIARGVEDVALA

SEQ ID NO: 2077004 - protein, 19 aa, Staphylococcus
LYLNIWRRHHSQNKHRPVI

SEQ ID NO: 2077005 - protein, 18 aa, Staphylococcus
LYLNTFQAYFINPIDRTL

SEQ ID NO: 2077006 - protein, 17 aa, Staphylococcus
LYMLKVERHFSDHTLKS

SEQ ID NO: 2077007 - protein, 18 aa, Staphylococcus
LYNAGLRRINISLDAIDD

SEQ ID NO: 2077008 - protein, 26 aa, Staphylococcus
LYNAIEELGYPFIIKTRFGGYDGKGQ

SEQ ID NO: 2077009 - protein, 25 aa, Staphylococcus
LYNEHKYEHFIYTPVGFVCEHLEVL

SEQ ID NO: 2077010 - protein, 26 aa, Staphylococcus
LYNEHQYKHFIYTPVGFVCEHLEVLY

SEQ ID NO: 2077011 - protein, 20 aa, Staphylococcus
LYNGYDYWIDLGWKEADKKE

SEQ ID NO: 2077012 - protein, 27 aa, Staphylococcus
LYNKDEFELIRLFGKRGRGLYNKARGI

SEQ ID NO: 2077013 - protein, 22 aa, Staphylococcus
LYPAMEDFFLDIIIGKGDEARS

SEQ ID NO: 2077014 - protein, 20 aa, Staphylococcus
LYQASKELGYPFIVKTRFGG

SEQ ID NO: 2077015 - protein, 22 aa, Staphylococcus
LYQIVNYWIDFGVDGFRFDVIN

SEQ ID NO: 2077016 - protein, 27 aa, Staphylococcus
LYQKLIPEVDDYYPPYLKMYQAADVHQ

SEQ ID NO: 2077017 - protein, 35 aa, Staphylococcus
LYQLGYLADTQFTGLLFGFIHVPFIPEQVTTKPET

SEQ ID NO: 2077018 - protein, 19 aa, Staphylococcus
LYQQFLRKAVLKAIDTSWI

SEQ ID NO: 2077019 - protein, 17 aa, Staphylococcus
LYQQWRDTLLKVGIGRP

SEQ ID NO: 2077020 - protein, 19 aa, Staphylococcus
LYQTFVDSGAKIVEFGGWA

SEQ ID NO: 2077021 - protein, 17 aa, Staphylococcus
LYRIKTYKHKLKEIEQS

SEQ ID NO: 2077022 - protein, 18 aa, Staphylococcus
LYRSVIMDHYKNPRNKGK

SEQ ID NO: 2077023 - protein, 19 aa, Staphylococcus
LYRSVIMDHYKSPRNKGTL

SEQ ID NO: 2077024 - protein, 26 aa, Staphylococcus
LYRTYTELYKTLPFDFLSEVVYQWER

SEQ ID NO: 2077025 - protein, 22 aa, Staphylococcus
LYRVRMPVKKGWHTIPLHAIAP

SEQ ID NO: 2077026 - protein, 24 aa, Staphylococcus
LYRWKRKNLIPDEWFIRKSTFTGQ

SEQ ID NO: 2077027 - protein, 24 aa, Staphylococcus
LYSHFSRTYLRLTKNIYLNNPLVN

SEQ ID NO: 2077028 - protein, 28 aa, Staphylococcus
LYSKSEFELIRWFGKKGRGLYQKVRGID

SEQ ID NO: 2077029 - protein, 19 aa, Staphylococcus
LYTETWCFKLLIECDKNKL

SEQ ID NO: 2077030 - protein, 26 aa, Staphylococcus
LYTGMNLPMIIAYINAQMIGQPADIA

SEQ ID NO: 2077031 - protein, 34 aa, Staphylococcus
LYTTDKWIIHIAYDKFIIMANYDVKHFPIQITHP

SEQ ID NO: 2077032 - protein, 26 aa, Staphylococcus
LYVDANTCYWFHPSEYIEWHCGNAFA

SEQ ID NO: 2077033 - protein, 17 aa, Staphylococcus
LYYIHFPDEETPKDKAV

SEQ ID NO: 2077034 - protein, 18 aa, Staphylococcus
LYYREGFITNLMPRKDKS

SEQ ID NO: 2077035 - protein, 19 aa, Staphylococcus
LYYREGFITQLMPTKDKNY

SEQ ID NO: 2077036 - protein, 21 aa, Staphylococcus
MAADFLVLGTPNYHGSYSGIL

SEQ ID NO: 2077037 - protein, 22 aa, Staphylococcus
MAALHFDVPCLFAKKAKPSTLK

SEQ ID NO: 2077038 - protein, 23 aa, Staphylococcus
MAAMHFDVPCLFAKKAKPSTLKK

SEQ ID NO: 2077039 - protein, 23 aa, Staphylococcus
MADDPIIFAMANPNPEIKPDDAK

SEQ ID NO: 2077040 - protein, 24 aa, Staphylococcus
MADDPIIFAMANPNPEIKPDVAKA

SEQ ID NO: 2077041 - protein, 23 aa, Staphylococcus
MAEKGLIYKGKKPVYWSPSSESS

SEQ ID NO: 2077042 - protein, 21 aa, Staphylococcus
MAETLYDLKRKRAIVLHGANG

SEQ ID NO: 2077043 - protein, 18 aa, Staphylococcus
MAFGKVYDLLIKKVEKKD

SEQ ID NO: 2077044 - protein, 17 aa, Staphylococcus
MAFRYMQAFHKNDYSGH

SEQ ID NO: 2077045 - protein, 26 aa, Staphylococcus
MAGDEIAIPLLLGLGLDEFSMSATSV

SEQ ID NO: 2077046 - protein, 26 aa, Staphylococcus
MAGDQTAIPLLLGLGLDEFSMSATSI

SEQ ID NO: 2077047 - protein, 17 aa, Staphylococcus
MAGIPQSKIWLDPGIGF

SEQ ID NO: 2077048 - protein, 17 aa, Staphylococcus
MAGSHMALIVQINQEKY

SEQ ID NO: 2077049 - protein, 26 aa, Staphylococcus
MAGTNFPYANYLPKKNIKAIQIDTNP

SEQ ID NO: 2077050 - protein, 17 aa, Staphylococcus
MAGVCNSAFRLTVKEFG

SEQ ID NO: 2077051 - protein, 24 aa, Staphylococcus
MAHATYTFYFKAPGNFTVEVYCEV

SEQ ID NO: 2077052 - protein, 19 aa, Staphylococcus
MAHGSHFHRAPGSVGMASD

SEQ ID NO: 2077053 - protein, 32 aa, Staphylococcus
MAHLVENIRFAAVLLRPFLTHAPKEIFKQLNI

SEQ ID NO: 2077054 - protein, 24 aa, Staphylococcus
MAHRDLSIQRRYWLQQFEDGVPVL

SEQ ID NO: 2077055 - protein, 24 aa, Staphylococcus
MAKGLQEGLLFKGIKKSFDGLDKM

SEQ ID NO: 2077056 - protein, 24 aa, Staphylococcus
MAKRLLDFGVHPPTIYFPLNVEEG

SEQ ID NO: 2077057 - protein, 20 aa, Staphylococcus
MALECGCDILMGTVFFDSIN

SEQ ID NO: 2077058 - protein, 17 aa, Staphylococcus
MALPVRKSNESPFEFQF

SEQ ID NO: 2077059 - protein, 25 aa, Staphylococcus
MALREPALGPVFGIKGGATGGGYAQ

SEQ ID NO: 2077060 - protein, 21 aa, Staphylococcus
MALSKFLGIQPNTLKFMLKVF

SEQ ID NO: 2077061 - protein, 25 aa, Staphylococcus
MALVNATEAWSINHDIRRIEASVVP

SEQ ID NO: 2077062 - protein, 19 aa, Staphylococcus
MAMILSMARNIPQAHQSLK

SEQ ID NO: 2077063 - protein, 20 aa, Staphylococcus
MAMRVYPPWEVNLNPSAQKA

SEQ ID NO: 2077064 - protein, 25 aa, Staphylococcus
MAMSHPYIRISLISDGKTLLKTNGS

SEQ ID NO: 2077065 - protein, 19 aa, Staphylococcus
MANQNYGLVFGGGKVGLMG

SEQ ID NO: 2077066 - protein, 24 aa, Staphylococcus
MANQYIIGNCCILKFIYTHGKFEF

SEQ ID NO: 2077067 - protein, 17 aa, Staphylococcus
MANTLESILDFAKQNDS

SEQ ID NO: 2077068 - protein, 31 aa, Staphylococcus
MANVSRAMHLLPFNVFFVPARGGLGENMVYQ

SEQ ID NO: 2077069 - protein, 31 aa, Staphylococcus
MANVSRAMHLLPFNVFFVPARGGLGENVIYQ

SEQ ID NO: 2077070 - protein, 18 aa, Staphylococcus
MAPCPYVYEVIAKWGLED

SEQ ID NO: 2077071 - protein, 23 aa, Staphylococcus
MAQEFSYRYPLVDGQGNFGSMDG

SEQ ID NO: 2077072 - protein, 17 aa, Staphylococcus
MAQIFKTSSFYVNSFHH

SEQ ID NO: 2077073 - protein, 27 aa, Staphylococcus
MAQMIFDNFLFSSRAKWGERSGLTLFL

SEQ ID NO: 2077074 - protein, 28 aa, Staphylococcus
MAQMMFDNFLFSSYAKWGERSGLTLFLP

SEQ ID NO: 2077075 - protein, 26 aa, Staphylococcus
MAQRVAFILSLIRNPQCLILDEPTSA

SEQ ID NO: 2077076 - protein, 27 aa, Staphylococcus
MAQRVAFIMSLIRRPDYLFLDEPTSAL

SEQ ID NO: 2077077 - protein, 25 aa, Staphylococcus
MAQRVALMMALISKPQCLVLDEPTS

SEQ ID NO: 2077078 - protein, 17 aa, Staphylococcus
MAQSHLLALRSTCQRLS

SEQ ID NO: 2077079 - protein, 18 aa, Staphylococcus
MAQSHLLALRSTCQRLSV

SEQ ID NO: 2077080 - protein, 17 aa, Staphylococcus
MAQSHLLSLRSTCTRLS

SEQ ID NO: 2077081 - protein, 26 aa, Staphylococcus
MAQYQPNFLIQIPTMYYAMLVADNFD

SEQ ID NO: 2077082 - protein, 17 aa, Staphylococcus
MARLDELVATDYPILLA

SEQ ID NO: 2077083 - protein, 31 aa, Staphylococcus
MARVSEAMHLLPFNVFFVPARGGLGENMVYQ

SEQ ID NO: 2077084 - protein, 34 aa, Staphylococcus
MASEKIAFQGLPSRIAWLGYGDRAKMGLKLNELV

SEQ ID NO: 2077085 - protein, 30 aa, Staphylococcus
MASGLPSYIYTFLGFLPRKSKEKTAVLEKR

SEQ ID NO: 2077086 - protein, 19 aa, Staphylococcus
MAVNYKYLQKFKLNIMQQW

SEQ ID NO: 2077087 - protein, 20 aa, Staphylococcus
MAVVLPHGVLFRGAAEGVIR

SEQ ID NO: 2077088 - protein, 22 aa, Staphylococcus
MAVVLPHGVLFRGAAEGVIRKY

SEQ ID NO: 2077089 - protein, 25 aa, Staphylococcus
MCKDYHIFRQCYCGCVFAAMKQGID

SEQ ID NO: 2077090 - protein, 25 aa, Staphylococcus
MCKDYHIFRQCYCGCVFAAMRQGID

SEQ ID NO: 2077091 - protein, 17 aa, Staphylococcus
MCLYNSGDYIKFYAINE

SEQ ID NO: 2077092 - protein, 26 aa, Staphylococcus
MCNDYHIFRQCYCGCVFAAMAQGIDF

SEQ ID NO: 2077093 - protein, 24 aa, Staphylococcus
MCQSDPMVVPFGGTEPYFGTNPIA

SEQ ID NO: 2077094 - protein, 28 aa, Staphylococcus
MCYADCVPVYFYSKKHHFVALAHAGWRG

SEQ ID NO: 2077095 - protein, 17 aa, Staphylococcus
MCYLYLSEYEIAKELFE

SEQ ID NO: 2077096 - protein, 23 aa, Staphylococcus
MDAAEYKNVALGLIFLKYVSDSF

SEQ ID NO: 2077097 - protein, 29 aa, Staphylococcus
MDADLVFDVRFLPNPYYVEELRPLTGLDD

SEQ ID NO: 2077098 - protein, 30 aa, Staphylococcus
MDASEFRNYILGLIFYRFLSEKAEAEVAEA

SEQ ID NO: 2077099 - protein, 30 aa, Staphylococcus; identical to SEQ ID NO: 2029415

SEQ ID NO: 2077100 - protein, 23 aa, Staphylococcus
MDCGTPFCQTGLPFGRETIGCPI

SEQ ID NO: 2077101 - protein, 23 aa, Staphylococcus
MDDFDLKFGPILLRQKNNLFTKK

SEQ ID NO: 2077102 - protein, 25 aa, Staphylococcus
MDDKTKFYINPTGRFVIGGPQGDAG

SEQ ID NO: 2077103 - protein, 30 aa, Staphylococcus
MDDLTPMKCLRILSIFRLINPTKEIRVAGG

SEQ ID NO: 2077104 - protein, 17 aa, Staphylococcus
MDEDRIWEIGYPRNDVL

SEQ ID NO: 2077105 - protein, 44 aa, Staphylococcus
MDEDYYDQLNLLPRYIEKTICGKKLLFIHYEIENQKLETGIEGQ

SEQ ID NO: 2077106 - protein, 31 aa, Staphylococcus
MDELTPMKCLRIIAIFRLVNPTKEIRIAGGR

SEQ ID NO: 2077107 - protein, 39 aa, Staphylococcus
MDEVGFLVTKIDKDGYLSFNPIGGWWNQVMLSQKVTVTT

SEQ ID NO: 2077108 - protein, 17 aa, Staphylococcus
MDFRKEFNKDVVIDLVG

SEQ ID NO: 2077109 - protein, 30 aa, Staphylococcus
MDFTNLALVEFFFKKLTHYVSMRRGVFILV

SEQ ID NO: 2077110 - protein, 20 aa, Staphylococcus
MDHHNVLGVLPTGGGKSICY

SEQ ID NO: 2077111 - protein, 21 aa, Staphylococcus
MDKAFDRLKLNIFISLAELES

SEQ ID NO: 2077112 - protein, 23 aa, Staphylococcus
MDKSQLKALYLTVIDRIDIRKDE

SEQ ID NO: 2077113 - protein, 17 aa, Staphylococcus
MDKVQLKALYLTVIDRI

SEQ ID NO: 2077114 - protein, 24 aa, Staphylococcus
MDKYGLSNLVVHAPYIINIANTTK

SEQ ID NO: 2077115 - protein, 19 aa, Staphylococcus
MDLWIDPIIEKYNAYQWYS

SEQ ID NO: 2077116 - protein, 26 aa, Staphylococcus
MDNGLKLFIIPKKGFQKTFVTYTTQF

SEQ ID NO: 2077117 - protein, 25 aa, Staphylococcus
MDNNAILLRGWGGGFFMNGPSEDAF

SEQ ID NO: 2077118 - protein, 22 aa, Staphylococcus
MDNYWNLTFLPEEINANAFVRP

SEQ ID NO: 2077119 - protein, 18 aa, Staphylococcus
MDPIYLDQVTVLGKVVGL

SEQ ID NO: 2077120 - protein, 25 aa, Staphylococcus
MDPMAKIIRNKLKKFGIKKGVPVVF

SEQ ID NO: 2077121 - protein, 18 aa, Staphylococcus
MDPRVAMLSFSTKGSAKS

SEQ ID NO: 2077122 - protein, 18 aa, Staphylococcus
MDQFIFKGIKTKLNIIIK

SEQ ID NO: 2077123 - protein, 27 aa, Staphylococcus
MDRDFVIHTPLMWLDKAQTWELSDELG

SEQ ID NO: 2077124 - protein, 20 aa, Staphylococcus
MDRWQAWLKDKGVDSKISGL

SEQ ID NO: 2077125 - protein, 37 aa, Staphylococcus
MDRYPNIKFILGHAGGALPYLRWRIDQSYSWMIENLE

SEQ ID NO: 2077126 - protein, 17 aa, Staphylococcus
MDRYPNIKIILAHAGGT

SEQ ID NO: 2077127 - protein, 18 aa, Staphylococcus
MDSIDRKLPGLSERERKI

SEQ ID NO: 2077128 - protein, 24 aa, Staphylococcus
MDSLHAYFKPEILNRMDDIVLFKP

SEQ ID NO: 2077129 - protein, 22 aa, Staphylococcus
MDTLELFKIAFPTDKSYQLSEL

SEQ ID NO: 2077130 - protein, 22 aa, Staphylococcus
MDTWDFAHCLPYFKRLEKTFGA

SEQ ID NO: 2077131 - protein, 19 aa, Staphylococcus
MDYLKQRHIPMAIATSSYR

SEQ ID NO: 2077132 - protein, 44 aa, Staphylococcus
MDYNDLSLVKFFFKHLTRYLKKQRGLFVLIDPYILENIRNAEGE

SEQ ID NO: 2077133 - protein, 31 aa, Staphylococcus
MDYNNLSLVHFFFKSLTSYLKKHHCLYVLVD

SEQ ID NO: 2077134 - protein, 25 aa, Staphylococcus
MDYRLKGIAFDLLEYALKYAFEHYT

SEQ ID NO: 2077135 - protein, 30 aa, Staphylococcus
MDYSNIELVHFFFKSLTSYLKKHNCLYVLV

SEQ ID NO: 2077136 - protein, 23 aa, Staphylococcus
MEADFLIFGTPNYHGSYSGILKN

SEQ ID NO: 2077137 - protein, 28 aa, Staphylococcus
MEAQLFAVQLLFQYLFAQGRLQEARTYI

SEQ ID NO: 2077138 - protein, 34 aa, Staphylococcus
MEARAHQLIIKFSSAWSFLVPEILQLDEKTIQTF

SEQ ID NO: 2077139 - protein, 17 aa, Staphylococcus
MEAREIFLVVTGSNKRE

SEQ ID NO: 2077140 - protein, 33 aa, Staphylococcus
MEASQKNQFPWCVAAFPSKAWAQRVYPDLTETE

SEQ ID NO: 2077141 - protein, 25 aa, Staphylococcus
MEAVRYLIGVGFSKQLITLDVFNVS

SEQ ID NO: 2077142 - protein, 18 aa, Staphylococcus
MEDFKKANPFTRFIRSKA

SEQ ID NO: 2077143 - protein, 24 aa, Staphylococcus
MEDGSQEWFGLSKGVFTRPNKEGQ

SEQ ID NO: 2077144 - protein, 28 aa, Staphylococcus
MEDLGFTDFNLGPEPEFFLFKLDDKGEP

SEQ ID NO: 2077145 - protein, 17 aa, Staphylococcus
MEDLLKKYYETTNEKIV

SEQ ID NO: 2077146 - protein, 17 aa, Staphylococcus
MEELGVIDLIITAHQHQ

SEQ ID NO: 2077147 - protein, 23 aa, Staphylococcus
MEELLTIYEWPEKLLNKELKKLM

SEQ ID NO: 2077148 - protein, 17 aa, Staphylococcus
MEELVLGFLASEGALLK

SEQ ID NO: 2077149 - protein, 24 aa, Staphylococcus
MEETRKIFIYDKQKTMTKLLEEHE

SEQ ID NO: 2077150 - protein, 25 aa, Staphylococcus
MEGGAIGWTPAFYRQWREALNKVGI

SEQ ID NO: 2077151 - protein, 28 aa, Staphylococcus
MEGYNDARWVLIDLANVVVHIFHKDERN

SEQ ID NO: 2077152 - protein, 17 aa, Staphylococcus
MEGYQSARWVLIDLADV

SEQ ID NO: 2077153 - protein, 17 aa, Staphylococcus
MEHALDLDVPLKVDSNY

SEQ ID NO: 2077154 - protein, 18 aa, Staphylococcus
MEHFLRFGNQEEIDYQRT

SEQ ID NO: 2077155 - protein, 23 aa, Staphylococcus
MEKEIYWIDYYDSFKRGYNLTIG

SEQ ID NO: 2077156 - protein, 23 aa, Staphylococcus
MEKHAVSRLVGAPPGYVGHDEGG

SEQ ID NO: 2077157 - protein, 17 aa, Staphylococcus
MEKRYKGPIAFEYTHIN

SEQ ID NO: 2077158 - protein, 23 aa, Staphylococcus
MEKYEQVPLPRPERWGLLVSEDS

SEQ ID NO: 2077159 - protein, 24 aa, Staphylococcus
MELIDQYEFIYGIIGWHPVDAIDC

SEQ ID NO: 2077160 - protein, 26 aa, Staphylococcus
MELIEQYDFIYGIIGWHPVGAIDFTD

SEQ ID NO: 2077161 - protein, 23 aa, Staphylococcus
MELIESPPLLMSMFKKARGNFFG

SEQ ID NO: 2077162 - protein, 17 aa, Staphylococcus
MENLKGYPHAIGHVRYA

SEQ ID NO: 2077163 - protein, 29 aa, Staphylococcus
MEPEKAAMLLIPEPWLYNKANDKNVRAFY

SEQ ID NO: 2077164 - protein, 28 aa, Staphylococcus
MEPEKAAMLLIPEPWLYNKSNNKDVRSF

SEQ ID NO: 2077165 - protein, 18 aa, Staphylococcus
MEPKVAMLSFSTKGSAKS

SEQ ID NO: 2077166 - protein, 25 aa, Staphylococcus
MEQEDKIYILFHKPAQVITSVSDDR

SEQ ID NO: 2077167 - protein, 20 aa, Staphylococcus
MERFVAFLTEETKGAFPTWL

SEQ ID NO: 2077168 - protein, 19 aa, Staphylococcus
MERIKTLSIPYYLEGKNYR

SEQ ID NO: 2077169 - protein, 23 aa, Staphylococcus
MERRYKVFAKYHVRNITAFNKKA

SEQ ID NO: 2077170 - protein, 17 aa, Staphylococcus
MERSMEMIVAILGILKS

SEQ ID NO: 2077171 - protein, 28 aa, Staphylococcus
MESGVDLVKLFPGDLLGANFIKNVHGPI

SEQ ID NO: 2077172 - protein, 22 aa, Staphylococcus
MESLLLSARHFLFSTARGYQML

SEQ ID NO: 2077173 - protein, 25 aa, Staphylococcus
MESLLLSARHFLWSTAHGYQLYEKD

SEQ ID NO: 2077174 - protein, 26 aa, Staphylococcus
MESWDFAHCLPYFKKLEKTFGAAPHD

SEQ ID NO: 2077175 - protein, 22 aa, Staphylococcus
MESWDFAHCLPYFKRLEKTYGA

SEQ ID NO: 2077176 - protein, 22 aa, Staphylococcus
METFLNILEVLGTSPSDFFKEK

SEQ ID NO: 2077177 - protein, 25 aa, Staphylococcus
METFLSILEVLGTTPSDFFKEKAKE

SEQ ID NO: 2077178 - protein, 27 aa, Staphylococcus
METWDFAHCLPYFKKLEKTFGAAPYDK

SEQ ID NO: 2077179 - protein, 25 aa, Staphylococcus
METWDFAHCLPYFKKLETTYGSAPY

SEQ ID NO: 2077180 - protein, 24 aa, Staphylococcus
MEVEGLLQLFNPKIKSESNDKIID

SEQ ID NO: 2077181 - protein, 17 aa, Staphylococcus
MEVTVIHLAEWLMEMQL

SEQ ID NO: 2077182 - protein, 25 aa, Staphylococcus
MFADIKTYILYQLYETYVIDQSMAS

SEQ ID NO: 2077183 - protein, 24 aa, Staphylococcus
MFDKSPLPLDYNKMPKCVYTQPEV

SEQ ID NO: 2077184 - protein, 18 aa, Staphylococcus
MFDNEYFMYGLETFAESN

SEQ ID NO: 2077185 - protein, 25 aa, Staphylococcus
MFDTKPRGLFRKKKFSPIVGDIVDF

SEQ ID NO: 2077186 - protein, 17 aa, Staphylococcus
MFDVIEPARAAVAAGES

SEQ ID NO: 2077187 - protein, 21 aa, Staphylococcus
MFDYGVLKRPQFFFAYDLDKY

SEQ ID NO: 2077188 - protein, 25 aa, Staphylococcus
MFEHNPIPIDYQLMPKCVYTYPEIA

SEQ ID NO: 2077189 - protein, 25 aa, Staphylococcus
MFIENDTYIVPTLAAPWAINQNTEI

SEQ ID NO: 2077190 - protein, 18 aa, Staphylococcus
MFIKMFKTMRKHKKNMNY

SEQ ID NO: 2077191 - protein, 18 aa, Staphylococcus
MFIRDFEGLRIDEAQLNR

SEQ ID NO: 2077192 - protein, 19 aa, Staphylococcus
MFKALLNEVFKAYGLLLID

SEQ ID NO: 2077193 - protein, 18 aa, Staphylococcus
MFLEGYLLKTSNTIKLSL

SEQ ID NO: 2077194 - protein, 21 aa, Staphylococcus
MFMADLIKRIDTHLSIDFMDV

SEQ ID NO: 2077195 - protein, 23 aa, Staphylococcus
MFNEIDVPFYTLSNYNELIEVAR

SEQ ID NO: 2077196 - protein, 17 aa, Staphylococcus
MFNETIKWAQRKGLRRL

SEQ ID NO: 2077197 - protein, 17 aa, Staphylococcus
MFNLFMEMPEHYTSFKA

SEQ ID NO: 2077198 - protein, 17 aa, Staphylococcus
MFPIIDKVIQKESKKFF

SEQ ID NO: 2077199 - protein, 36 aa, Staphylococcus
MFQTVLEIIKMKKLKSLKIILSNFKKIYSLITMDEG

SEQ ID NO: 2077200 - protein, 24 aa, Staphylococcus
MFREDGIYYYCNLSSPFVSDEEAL

SEQ ID NO: 2077201 - protein, 20 aa, Staphylococcus
MFVFEDNILYGKQALIACFL

SEQ ID NO: 2077202 - protein, 20 aa, Staphylococcus
MFVTTLPFRIDFRDCQTIKE

SEQ ID NO: 2077203 - protein, 17 aa, Staphylococcus
MFYENRLLKKIKDAAQN

SEQ ID NO: 2077204 - protein, 17 aa, Staphylococcus
MGDIMGDVTSRRGRVDG

SEQ ID NO: 2077205 - protein, 18 aa, Staphylococcus
MGDRFIVESIDRLGRNYD

SEQ ID NO: 2077206 - protein, 24 aa, Staphylococcus
MGEAEKFYEFLDKTQKESAKDEPD

SEQ ID NO: 2077207 - protein, 29 aa, Staphylococcus
MGEKSRLQFVLLFFSNANLLILDEPTNYF

SEQ ID NO: 2077208 - protein, 17 aa, Staphylococcus
MGELYNIKITTPYDLKV

SEQ ID NO: 2077209 - protein, 23 aa, Staphylococcus
MGFEDYFLIVSDLIHFAKTHDVM

SEQ ID NO: 2077210 - protein, 23 aa, Staphylococcus
MGFEDYFLIVSDLIHYAKTHDVM

SEQ ID NO: 2077211 - protein, 21 aa, Staphylococcus
MGFGIHFAMDYLTEQTQYLNG

SEQ ID NO: 2077212 - protein, 18 aa, Staphylococcus
MGFSFRFEDLFSEEELLN

SEQ ID NO: 2077213 - protein, 18 aa, Staphylococcus
MGGAIMLAARACVYSGSG

SEQ ID NO: 2077214 - protein, 28 aa, Staphylococcus
MGGEMLSFYDWYADLPPASPQIWGEQTD

SEQ ID NO: 2077215 - protein, 19 aa, Staphylococcus
MGGPLIASIIEKGKSKLQN

SEQ ID NO: 2077216 - protein, 26 aa, Staphylococcus
MGHEAYYPKFGFKKASHWGIQAPFEV

SEQ ID NO: 2077217 - protein, 26 aa, Staphylococcus
MGHEFNSLVLALLQVSGRPPKEEQAI

SEQ ID NO: 2077218 - protein, 19 aa, Staphylococcus
MGIDIDTLVKFNLKKDQML

SEQ ID NO: 2077219 - protein, 20 aa, Staphylococcus
MGIDRILYAADYPYIEPERL

SEQ ID NO: 2077220 - protein, 21 aa, Staphylococcus
MGIINYPQAAILQVESIVKKP

SEQ ID NO: 2077221 - protein, 28 aa, Staphylococcus
MGIQVKRFYDVGVSGIHRLFNHIHEIRQ

SEQ ID NO: 2077222 - protein, 20 aa, Staphylococcus
MGIQVQRFYDVGVSGIHRLF

SEQ ID NO: 2077223 - protein, 19 aa, Staphylococcus
MGISSPPLVDPCYYGIDVS

SEQ ID NO: 2077224 - protein, 20 aa, Staphylococcus
MGITVKRYYDVGVSGIHRLF

SEQ ID NO: 2077225 - protein, 25 aa, Staphylococcus
MGIVSNIVFIKWFEDLRTIFINQYM

SEQ ID NO: 2077226 - protein, 23 aa, Staphylococcus
MGKDLTLEKALFKGLTASGVEVK

SEQ ID NO: 2077227 - protein, 23 aa, Staphylococcus
MGKDLTLEKALFKGLTSSGVEVK

SEQ ID NO: 2077228 - protein, 23 aa, Staphylococcus
MGKDLTLEKALYKGLTGSGVEVK

SEQ ID NO: 2077229 - protein, 22 aa, Staphylococcus
MGKGDILHFCSVDLVDSPMKQA

SEQ ID NO: 2077230 - protein, 28 aa, Staphylococcus
MGKLAALRKGIMLTTPPFYYDRVDNKFV

SEQ ID NO: 2077231 - protein, 18 aa, Staphylococcus
MGLELLTNQALFDEIIEQ

SEQ ID NO: 2077232 - protein, 29 aa, Staphylococcus
MGLSTILKAHRIILLAFGEKKRAAIEKLA

SEQ ID NO: 2077233 - protein, 18 aa, Staphylococcus
MGMTFHLVCPKELRPKDE

SEQ ID NO: 2077234 - protein, 23 aa, Staphylococcus
MGNDLYYIELSDKNYRIVYKNKE

SEQ ID NO: 2077235 - protein, 31 aa, Staphylococcus
MGNRINNEPLLMDIAKTPHALIAGATGSGKS

SEQ ID NO: 2077236 - protein, 30 aa, Staphylococcus
MGPDCGTGIIHSLPLAFTNIVNKGDIGIVG

SEQ ID NO: 2077237 - protein, 26 aa, Staphylococcus
MGRAAYTSIYFLLTYHNISHFHRIDA

SEQ ID NO: 2077238 - protein, 26 aa, Staphylococcus
MGSHLGPYCYPLVIDGIQKDDFPTDG

SEQ ID NO: 2077239 - protein, 38 aa, Staphylococcus
MGTDKLVIPDIYVKRMKFYDYLLLNSDGLSDFVRPKII

SEQ ID NO: 2077240 - protein, 17 aa, Staphylococcus
MGTLYRHFKDKSALCTT

SEQ ID NO: 2077241 - protein, 18 aa, Staphylococcus
MGTSFFTNPGGKGANQAV

SEQ ID NO: 2077242 - protein, 22 aa, Staphylococcus
MGTYDVIVGINLLREGIDIPEV

SEQ ID NO: 2077243 - protein, 18 aa, Staphylococcus
MGVQTFDQSLLKILGRTH

SEQ ID NO: 2077244 - protein, 25 aa, Staphylococcus
MGVTLAAGYSLNWLKHTFFEEESFD

SEQ ID NO: 2077245 - protein, 26 aa, Staphylococcus
MGVTLAAGYSLNWLKRTFFDNDTFDE

SEQ ID NO: 2077246 - protein, 17 aa, Staphylococcus
MGWYLDGRVSAVVGTHT

SEQ ID NO: 2077247 - protein, 24 aa, Staphylococcus
MGYEDYFLIVSDLIHYAKTHNVMV

SEQ ID NO: 2077248 - protein, 17 aa, Staphylococcus
MGYGIHFAMDYLTEQTQ

SEQ ID NO: 2077249 - protein, 17 aa, Staphylococcus
MGYNFMHRKHPGDGFVC

SEQ ID NO: 2077250 - protein, 30 aa, Staphylococcus; identical to SEQ ID NO: 1683787

SEQ ID NO: 2077251 - protein, 19 aa, Staphylococcus
MHEFLIHITGVLETGYFLD

SEQ ID NO: 2077252 - protein, 20 aa, Staphylococcus
MHEYLIHLTGVLETGYFLDV

SEQ ID NO: 2077253 - protein, 19 aa, Staphylococcus
MHGFIRTKLILTENQPNVC

SEQ ID NO: 2077254 - protein, 17 aa, Staphylococcus
MHKNIIILYDEHELKMV

SEQ ID NO: 2077255 - protein, 25 aa, Staphylococcus
MHLEKNWMKLDLPEKVRDIGTPLPL

SEQ ID NO: 2077256 - protein, 18 aa, Staphylococcus
MHLKNLLKNGLNGAPQGP

SEQ ID NO: 2077257 - protein, 36 aa, Staphylococcus
MHMERNMRMPALPRFGMIWKLQKEYEKIRYYGNGPF

SEQ ID NO: 2077258 - protein, 17 aa, Staphylococcus
MHMLPNLYEHVLKKNKV

SEQ ID NO: 2077259 - protein, 28 aa, Staphylococcus
MHPDFDYPFKYLCGAGVAYKLSQALLSH

SEQ ID NO: 2077260 - protein, 28 aa, Staphylococcus
MHPEFDYPFKYLCGAGVAYKLAQALLEN

SEQ ID NO: 2077261 - protein, 27 aa, Staphylococcus
MHPEFDYPFKYLCGAGVAYKLAQNLLD

SEQ ID NO: 2077262 - protein, 28 aa, Staphylococcus
MHPEFEYPFKYLCGAGVAYKLSQCLIDH

SEQ ID NO: 2077263 - protein, 23 aa, Staphylococcus
MHPQDIVQLLYEAILKIQNPDKR

SEQ ID NO: 2077264 - protein, 28 aa, Staphylococcus
MHQNGRPINPIKWLKAHPGKKGGKSSAP

SEQ ID NO: 2077265 - protein, 18 aa, Staphylococcus
MHRMNFDFYFVDIENIDT

SEQ ID NO: 2077266 - protein, 21 aa, Staphylococcus
MIAFKNLPQYILKKSFHNKNN

SEQ ID NO: 2077267 - protein, 18 aa, Staphylococcus
MIAPSYFQPDAEAFEIVL

SEQ ID NO: 2077268 - protein, 31 aa, Staphylococcus
MIATRLLKFNTLPISHLIYLNSAAKITPDGS

SEQ ID NO: 2077269 - protein, 30 aa, Staphylococcus
MIATRLLKFNTLPITHLVYLNSAARITPNT

SEQ ID NO: 2077270 - protein, 17 aa, Staphylococcus
MIAVWSKGIPFETIVEA

SEQ ID NO: 2077271 - protein, 21 aa, Staphylococcus
MIDAISRLQLPINIVGVIASA

SEQ ID NO: 2077272 - protein, 27 aa, Staphylococcus
MIDERSFIDMTYTLLHEKGATMNLYDI

SEQ ID NO: 2077273 - protein, 19 aa, Staphylococcus
MIDFQIVGMPLPKNDRSQR

SEQ ID NO: 2077274 - protein, 18 aa, Staphylococcus
MIDIDVTPYYVLSKKHDL

SEQ ID NO: 2077275 - protein, 21 aa, Staphylococcus
MIDLAQYLEQVGYERYWIAEH

SEQ ID NO: 2077276 - protein, 35 aa, Staphylococcus
MIDVNVKGTLYTVQAALPKLLEQSSGHIINIASIS

SEQ ID NO: 2077277 - protein, 26 aa, Staphylococcus
MIEAILKDQKRLLPSIAYLEGEYGFS

SEQ ID NO: 2077278 - protein, 18 aa, Staphylococcus
MIEDAYNTLFEEGYFITS

SEQ ID NO: 2077279 - protein, 25 aa, Staphylococcus
MIEDPKILPYIYQGLHDKSPAVRRT

SEQ ID NO: 2077280 - protein, 20 aa, Staphylococcus
MIEIDVEPYYVLSKKHNLLT

SEQ ID NO: 2077281 - protein, 17 aa, Staphylococcus
MIEIDVTLYYDLSQRHG

SEQ ID NO: 2077282 - protein, 18 aa, Staphylococcus
MIEIRRYLHEHPELSFHE

SEQ ID NO: 2077283 - protein, 21 aa, Staphylococcus
MIEIRRYLHQHPELSFKEVET

SEQ ID NO: 2077284 - protein, 23 aa, Staphylococcus
MIESLNIIYLKTVPIETGVDVKY

SEQ ID NO: 2077285 - protein, 25 aa, Staphylococcus
MIETANIVINWLKANDIKVDLINLG

SEQ ID NO: 2077286 - protein, 29 aa, Staphylococcus
MIEVDVDPFYILSKKFNLLTIIDNTFLTP

SEQ ID NO: 2077287 - protein, 24 aa, Staphylococcus
MIGAAGYYLYRAGITSGLDLNGKN

SEQ ID NO: 2077288 - protein, 26 aa, Staphylococcus
MIGEDFSHYLKVRPGAFFLTGCGNAD

SEQ ID NO: 2077289 - protein, 26 aa, Staphylococcus
MIGEDFSHYLKVRPGAFFLTGCGNED

SEQ ID NO: 2077290 - protein, 26 aa, Staphylococcus
MIGEDFSHYLKVRPGAFFLTGCGNPE

SEQ ID NO: 2077291 - protein, 26 aa, Staphylococcus
MIGEDFSHYLKVRPGAFFLTGCGNQD

SEQ ID NO: 2077292 - protein, 26 aa, Staphylococcus
MIGEDFSHYLKVRPGAFFLTGCGNVD

SEQ ID NO: 2077293 - protein, 30 aa, Staphylococcus
MIGREALGNPWMIYRTVHYLETGELMDEPT

SEQ ID NO: 2077294 - protein, 20 aa, Staphylococcus
MIGRGSFIESFPLFGYNLND

SEQ ID NO: 2077295 - protein, 22 aa, Staphylococcus
MIGTRLLKFNTLPISHLVYLNS

SEQ ID NO: 2077296 - protein, 28 aa, Staphylococcus
MIGTRLLKFNTLPISHLVYLSSAAKITP

SEQ ID NO: 2077297 - protein, 26 aa, Staphylococcus
MIHHRYPDIPFYLQVGNPYLADDVAN

SEQ ID NO: 2077298 - protein, 26 aa, Staphylococcus
MIHHRYPNIPFYLQVGNPYLDDDVDN

SEQ ID NO: 2077299 - protein, 17 aa, Staphylococcus
MIHLSRFAEEIIFWSTD

SEQ ID NO: 2077300 - protein, 21 aa, Staphylococcus
MIIKRTIYPVVPPKVEYRLTS

SEQ ID NO: 2077301 - protein, 17 aa, Staphylococcus
MIIPSKFRYDLNERFII

SEQ ID NO: 2077302 - protein, 18 aa, Staphylococcus
MIIYAIPDLTGVNISINQ

SEQ ID NO: 2077303 - protein, 33 aa, Staphylococcus
MIKGILGKIPFFGICLGHQLFALSQGATSFKMK

SEQ ID NO: 2077304 - protein, 31 aa, Staphylococcus
MIKQGVTRFRIVPLLIFRAMHYIGDIPEILK

SEQ ID NO: 2077305 - protein, 17 aa, Staphylococcus
MILELLKSKEMTVNEIV

SEQ ID NO: 2077306 - protein, 19 aa, Staphylococcus
MILVLDFGSQYNQLITRRI

SEQ ID NO: 2077307 - protein, 19 aa, Staphylococcus
MINDYKWMLNIIESQVYDA

SEQ ID NO: 2077308 - protein, 17 aa, Staphylococcus
MINEILEKSPHSQIVMI

SEQ ID NO: 2077309 - protein, 39 aa, Staphylococcus
MINHHKMAILFQKTNFPKFFKVKELFKLHQSFYANSIST

SEQ ID NO: 2077310 - protein, 25 aa, Staphylococcus
MINHVPVPVIIKEVGFGFSKETFKA

SEQ ID NO: 2077311 - protein, 25 aa, Staphylococcus
MINTINFDFQLIEKYLKTEDFSNIS

SEQ ID NO: 2077312 - protein, 21 aa, Staphylococcus
MINVQYILDLLNNIDLTDKAQ

SEQ ID NO: 2077313 - protein, 28 aa, Staphylococcus
MIPCKPDHPFVYWATFANAAQLLESGVH

SEQ ID NO: 2077314 - protein, 30 aa, Staphylococcus
MIQDSQLEMRALLLHLRPLGLKDRSLGEGI

SEQ ID NO: 2077315 - protein, 21 aa, Staphylococcus
MIQGLGYLLSGLSDYTELTDT

SEQ ID NO: 2077316 - protein, 22 aa, Staphylococcus
MIQGLGYLLTQISDYEALTTLA

SEQ ID NO: 2077317 - protein, 19 aa, Staphylococcus
MIQIRRHLHQYPELSFEES

SEQ ID NO: 2077318 - protein, 20 aa, Staphylococcus
MIQLKNFLPRMKKWDYLLVS

SEQ ID NO: 2077319 - protein, 25 aa, Staphylococcus
MIQMRRYMHQYPEPSFEETWTHNYI

SEQ ID NO: 2077320 - protein, 29 aa, Staphylococcus
MIQTIYKIINLIGFVPYKIDTYMHQFYGK

SEQ ID NO: 2077321 - protein, 26 aa, Staphylococcus
MIREKIKPIIFVINNDGYTVERKIHG

SEQ ID NO: 2077322 - protein, 18 aa, Staphylococcus
MIRGGHIDLAILGGMEVS

SEQ ID NO: 2077323 - protein, 19 aa, Staphylococcus
MIRGLGYLLTEISDYETLT

SEQ ID NO: 2077324 - protein, 26 aa, Staphylococcus
MIRQDIKPIIFVINNDGYTVERLIHG

SEQ ID NO: 2077325 - protein, 21 aa, Staphylococcus
MIRQQLKPIIFVVNNDGYTVE

SEQ ID NO: 2077326 - protein, 23 aa, Staphylococcus
MIRTDLDIPPFIQALTSIEDTML

SEQ ID NO: 2077327 - protein, 23 aa, Staphylococcus
MIRTDLDIPPFIQALTSIEETML

SEQ ID NO: 2077328 - protein, 17 aa, Staphylococcus
MISDILERSPETQIVMI

SEQ ID NO: 2077329 - protein, 17 aa, Staphylococcus
MISIFHIKRFDSELFVF

SEQ ID NO: 2077330 - protein, 18 aa, Staphylococcus
MITAKQYIQSGDYHNILV

SEQ ID NO: 2077331 - protein, 19 aa, Staphylococcus
MITAKQYIQSGDYKNILVV

SEQ ID NO: 2077332 - protein, 19 aa, Staphylococcus
MITFRLLKHYDNLQSMLQI

SEQ ID NO: 2077333 - protein, 17 aa, Staphylococcus
MITKLRDYVGELPIVAI

SEQ ID NO: 2077334 - protein, 20 aa, Staphylococcus
MITKQFYDIGIAVSTDDGLL

SEQ ID NO: 2077335 - protein, 17 aa, Staphylococcus
MITPDIPEKVLINASVS

SEQ ID NO: 2077336 - protein, 17 aa, Staphylococcus
MKAIRLVKVLDEAKLLD

SEQ ID NO: 2077337 - protein, 25 aa, Staphylococcus
MKAPRFGSKLQGFIHLVWDVRDEIN

SEQ ID NO: 2077338 - protein, 32 aa, Staphylococcus
MKAYLTRDQHRLYKLIWERFVASQMAPAILDT

SEQ ID NO: 2077339 - protein, 31 aa, Staphylococcus
MKDALKVRRRVMELLLLIEEKTYYSYRMDNL

SEQ ID NO: 2077340 - protein, 37 aa, Staphylococcus
MKDEPEWMLDFRLKALKLFYKMPMPQWGGDLSELDFD

SEQ ID NO: 2077341 - protein, 30 aa, Staphylococcus
MKDINKKTILLFCRLPLALAHKSLKAMQNG

SEQ ID NO: 2077342 - protein, 31 aa, Staphylococcus
MKDNYEHILLIPVFFYDGFLVNKIKKKINDI

SEQ ID NO: 2077343 - protein, 30 aa, Staphylococcus
MKDYSHALLGLVVPLLTKYGIALEAHLQNA

SEQ ID NO: 2077344 - protein, 37 aa, Staphylococcus
MKEEPEWMLDFRLKALKLFYKMPMPQWGGDLSELNFD

SEQ ID NO: 2077345 - protein, 31 aa, Staphylococcus
MKEEPEWMLNYRLKSLKQFYKMPMPQWGGDL

SEQ ID NO: 2077346 - protein, 35 aa, Staphylococcus
MKEEPIKLLALITSNYRLFYQSKILSQKGYSGQQI

SEQ ID NO: 2077347 - protein, 27 aa, Staphylococcus
MKEEPIKLLALITSNYRLYYQCKILSR

SEQ ID NO: 2077348 - protein, 31 aa, Staphylococcus
MKEEPIKLLALITSNYRLYYQSKILEQKGYS

SEQ ID NO: 2077349 - protein, 24 aa, Staphylococcus
MKEIDAFKHIPFFNSFNMQRVHID

SEQ ID NO: 2077350 - protein, 24 aa, Staphylococcus
MKEKQMTMIFITHDLNLVEDYATH

SEQ ID NO: 2077351 - protein, 33 aa, Staphylococcus
MKELSLDGIFVQIGLVPNTKWIGDAVELNNRGE

SEQ ID NO: 2077352 - protein, 32 aa, Staphylococcus
MKELSLDGIFVQIGLVPNTSWIGDAVELNNRG

SEQ ID NO: 2077353 - protein, 21 aa, Staphylococcus
MKELYFDLAGKVLPYQLPNIA

SEQ ID NO: 2077354 - protein, 23 aa, Staphylococcus
MKELYFDLAGKVLPYQLPTLLEM

SEQ ID NO: 2077355 - protein, 32 aa, Staphylococcus; identical to SEQ ID NO: 1830350

SEQ ID NO: 2077356 - protein, 17 aa, Staphylococcus
MKFALTQSHLFSKAAPM

SEQ ID NO: 2077357 - protein, 17 aa, Staphylococcus
MKFLPEDGSLELTSGWT

SEQ ID NO: 2077358 - protein, 19 aa, Staphylococcus
MKFTEGAFKQWGYDVAHNE

SEQ ID NO: 2077359 - protein, 18 aa, Staphylococcus
MKHSPTALRFLKAAMNAD

SEQ ID NO: 2077360 - protein, 19 aa, Staphylococcus
MKIIGITDLRKMGLRDKTV

SEQ ID NO: 2077361 - protein, 21 aa, Staphylococcus
MKILKPEIIVWVKGDVINYRG

SEQ ID NO: 2077362 - protein, 24 aa, Staphylococcus
MKKFEEIFQKFNNLSLHKVNARNA

SEQ ID NO: 2077363 - protein, 28 aa, Staphylococcus
MKKYDVYYEFFLMHPSEEQLRVIGNLIE

SEQ ID NO: 2077364 - protein, 26 aa, Staphylococcus
MKLIADRHPVDICFVPIGDNFTMGIE

SEQ ID NO: 2077365 - protein, 17 aa, Staphylococcus
MKLILDLVVNHTSDEHP

SEQ ID NO: 2077366 - protein, 24 aa, Staphylococcus
MKLKGIARQTPLIQSMYLSNNTTG

SEQ ID NO: 2077367 - protein, 24 aa, Staphylococcus
MKLKKNNIYICRIKARAREILDDL

SEQ ID NO: 2077368 - protein, 23 aa, Staphylococcus
MKLRQLDIPFIYLSAKTQEQDTI

SEQ ID NO: 2077369 - protein, 18 aa, Staphylococcus
MKLSFAIAFSHHAELYIL

SEQ ID NO: 2077370 - protein, 18 aa, Staphylococcus
MKLSLAIAFSHHAELFIL

SEQ ID NO: 2077371 - protein, 20 aa, Staphylococcus
MKMDFYAKRNLELTESIRLK

SEQ ID NO: 2077372 - protein, 21 aa, Staphylococcus
MKMDFYAKRNLELTESIRLKS

SEQ ID NO: 2077373 - protein, 23 aa, Staphylococcus
MKNNMYHRYFHDPNYKDFRHSFI

SEQ ID NO: 2077374 - protein, 21 aa, Staphylococcus
MKPREFCLVTILDGEGTLVTD

SEQ ID NO: 2077375 - protein, 32 aa, Staphylococcus
MKPYLTRDQHRLYKLIWERFVASQMAPAILDT

SEQ ID NO: 2077376 - protein, 28 aa, Staphylococcus
MKQDPLGDPIIIIAPTQSTFQLEQDFVK

SEQ ID NO: 2077377 - protein, 31 aa, Staphylococcus
MKQGLKLLLEDWLFEYKDMFPIEASNIDTDP

SEQ ID NO: 2077378 - protein, 21 aa, Staphylococcus
MKQISVPIQYLIAAALEVTDV

SEQ ID NO: 2077379 - protein, 25 aa, Staphylococcus
MKQKLGIAIAFLNDPKLIILDEPMN

SEQ ID NO: 2077380 - protein, 27 aa, Staphylococcus
MKQKTTIPLKWLQKYSYHLAIVFKDAN

SEQ ID NO: 2077381 - protein, 17 aa, Staphylococcus
MKRGVYIEAIHFHSPPF

SEQ ID NO: 2077382 - protein, 25 aa, Staphylococcus
MKRNQVINLFHRKGKYTDTIINETI

SEQ ID NO: 2077383 - protein, 47 aa, Staphylococcus
MKRQSKIFRSRFRMLVEAQLDLLKNDDWDYLLNYDFDAEQVTQENIQ

SEQ ID NO: 2077384 - protein, 43 aa, Staphylococcus
MKRQSKIFRSRFRMLVEAQLDLLKNDDWDYLLNYDIDAEKVTQ

SEQ ID NO: 2077385 - protein, 48 aa, Staphylococcus
MKRQSKIFRSRFRMLVEAQLDLLKNDDWDYLLNYDLDAQQVTEENVQH

SEQ ID NO: 2077386 - protein, 47 aa, Staphylococcus
MKRQSKIFRSRFRMLVEAQLDLLKSEDWDYLLNYDLDSEQVTQENIN

SEQ ID NO: 2077387 - protein, 48 aa, Staphylococcus
MKRQSKVFRSRFRMLVEAQLDLLKNDDWDYLLNYDLDAEQITRENVQH

SEQ ID NO: 2077388 - protein, 48 aa, Staphylococcus
MKRQSKVFRSRFRMLVEAQLDLLKNEDWDYLLNYDLDAEQVTLEDIHH

SEQ ID NO: 2077389 - protein, 47 aa, Staphylococcus; identical to SEQ ID NO: 1819295

SEQ ID NO: 2077390 - protein, 35 aa, Staphylococcus
MKSIQPIRKMMTNPTIFNITGPIINPFKLDYQVMG

SEQ ID NO: 2077391 - protein, 28 aa, Staphylococcus
MKSKKVDVGFLPPTAYTLAHDQKAADLL

SEQ ID NO: 2077392 - protein, 24 aa, Staphylococcus
MKSNEFEMEPLILSLKPGASYKHF

SEQ ID NO: 2077393 - protein, 32 aa, Staphylococcus
MKSYLSRDQHRLYKLIWERFVASQMAPAILDT

SEQ ID NO: 2077394 - protein, 18 aa, Staphylococcus
MKVILGYSIYQEGNFEVI

SEQ ID NO: 2077395 - protein, 24 aa, Staphylococcus
MKVKETLHYLGILSGIPKANLKIN

SEQ ID NO: 2077396 - protein, 25 aa, Staphylococcus
MKVNDTFVLNFVGLGLIVQNAENVQ

SEQ ID NO: 2077397 - protein, 19 aa, Staphylococcus
MKVPKEKFNTYSGDYLLLP

SEQ ID NO: 2077398 - protein, 19 aa, Staphylococcus
MKVTLKKSTQWLENLKFLV

SEQ ID NO: 2077399 - protein, 19 aa, Staphylococcus
MKVTLTKSKQWLDNLKFLV

SEQ ID NO: 2077400 - protein, 29 aa, Staphylococcus
MKYGEDKLFFFQLFGKVDDITMSTIPMYH

SEQ ID NO: 2077401 - protein, 27 aa, Staphylococcus
MLAAKHKAWLMYTWSDYTKEAHAGLAE

SEQ ID NO: 2077402 - protein, 18 aa, Staphylococcus
MLAAYGYKLMDEKIVNEV

SEQ ID NO: 2077403 - protein, 18 aa, Staphylococcus
MLAAYHRYQAVLSSLTYV

SEQ ID NO: 2077404 - protein, 30 aa, Staphylococcus; identical to SEQ ID NO: 1682395

SEQ ID NO: 2077405 - protein, 17 aa, Staphylococcus
MLCALIQHNYGLAGKMM

SEQ ID NO: 2077406 - protein, 24 aa, Staphylococcus
MLDAVIDYLPSPLDVKPIIGHRSE

SEQ ID NO: 2077407 - protein, 22 aa, Staphylococcus
MLDAVIDYLPSPLDVKPIVGHH

SEQ ID NO: 2077408 - protein, 25 aa, Staphylococcus
MLDKTEGWVYMLTCLKSYLEFNAII

SEQ ID NO: 2077409 - protein, 17 aa, Staphylococcus
MLDMLTTDNGLTRLIFM

SEQ ID NO: 2077410 - protein, 20 aa, Staphylococcus
MLENEKLFLRTYITEINGEP

SEQ ID NO: 2077411 - protein, 21 aa, Staphylococcus
MLERGNVCLALPGGPGTLEEI

SEQ ID NO: 2077412 - protein, 18 aa, Staphylococcus
MLESIRYVDLVIPENDWG

SEQ ID NO: 2077413 - protein, 17 aa, Staphylococcus
MLESIRYVDLVIPESGW

SEQ ID NO: 2077414 - protein, 19 aa, Staphylococcus
MLFDFFTPKQSYEEKEELS

SEQ ID NO: 2077415 - protein, 17 aa, Staphylococcus
MLGHFLGIDIEMIIDYY

SEQ ID NO: 2077416 - protein, 17 aa, Staphylococcus
MLGHLHHPFSIESNFIN

SEQ ID NO: 2077417 - protein, 17 aa, Staphylococcus
MLGLLGFDIQPTADGLI

SEQ ID NO: 2077418 - protein, 18 aa, Staphylococcus
MLGVNIRICTPQALSPKD

SEQ ID NO: 2077419 - protein, 23 aa, Staphylococcus
MLHDPELLILDEPFSGLDPVNVE

SEQ ID NO: 2077420 - protein, 26 aa, Staphylococcus
MLINYEPSLQYFNEWWKQLYGESEGK

SEQ ID NO: 2077421 - protein, 18 aa, Staphylococcus
MLKKLMYSIKYYSVSSRR

SEQ ID NO: 2077422 - protein, 21 aa, Staphylococcus
MLKLYEMDYFKKDTSLFIDWI

SEQ ID NO: 2077423 - protein, 34 aa, Staphylococcus
MLLCQHLNVKPNILKFMLKVFYELGFVTEENGII

SEQ ID NO: 2077424 - protein, 27 aa, Staphylococcus
MLMNEFWPGPISFIVPLKKGYLCESVS

SEQ ID NO: 2077425 - protein, 18 aa, Staphylococcus
MLNASTDAFPILRELNDR

SEQ ID NO: 2077426 - protein, 22 aa, Staphylococcus
MLNAVIDYLPSPLDVKPIVGHH

SEQ ID NO: 2077427 - protein, 22 aa, Staphylococcus
MLNDSIRMMWLSQNQKPSYKTI

SEQ ID NO: 2077428 - protein, 24 aa, Staphylococcus
MLNIDVELRLLKYKFQDETVVEST

SEQ ID NO: 2077429 - protein, 26 aa, Staphylococcus
MLNIDVQLRLLKYQQDKEKILNDVKN

SEQ ID NO: 2077430 - protein, 24 aa, Staphylococcus
MLNKVTYYWYKQIIEIMKETVNHL

SEQ ID NO: 2077431 - protein, 17 aa, Staphylococcus
MLNLNHQLGYDDSHIRM

SEQ ID NO: 2077432 - protein, 18 aa, Staphylococcus
MLNQLVLSALYELNITIP

SEQ ID NO: 2077433 - protein, 20 aa, Staphylococcus
MLNTILEGITAYLKNELKDV

SEQ ID NO: 2077434 - protein, 17 aa, Staphylococcus
MLNYMWEDIQENGEYDM

SEQ ID NO: 2077435 - protein, 20 aa, Staphylococcus
MLNYVLCSNLYRFLREVSLG

SEQ ID NO: 2077436 - protein, 17 aa, Staphylococcus
MLPIARSLKLNEHDSYV

SEQ ID NO: 2077437 - protein, 32 aa, Staphylococcus
MLQEKERLLPGGYLFLSDLVGNPSLLNKVGKL

SEQ ID NO: 2077438 - protein, 17 aa, Staphylococcus
MLQQIPLARFGQDTDIA

SEQ ID NO: 2077439 - protein, 21 aa, Staphylococcus
MLSDKILQSRLYKAYKTAEQT

SEQ ID NO: 2077440 - protein, 26 aa, Staphylococcus
MLSGEPIQYIVGFQSFYGYTFEVDNN

SEQ ID NO: 2077441 - protein, 18 aa, Staphylococcus
MLTLLDLANIYVSSGSAC

SEQ ID NO: 2077442 - protein, 26 aa, Staphylococcus
MLTTGAFNALLKTLEEPPSHAIFILA

SEQ ID NO: 2077443 - protein, 29 aa, Staphylococcus
MLVAAASSCYIISLAAALERARFTSVSIN

SEQ ID NO: 2077444 - protein, 17 aa, Staphylococcus
MLYAELKDPETPIRLIG

SEQ ID NO: 2077445 - protein, 27 aa, Staphylococcus
MLYQMRAFLELREEAIILLKQGLNKYD

SEQ ID NO: 2077446 - protein, 19 aa, Staphylococcus
MMALLLTAEGHKVVTETVF

SEQ ID NO: 2077447 - protein, 19 aa, Staphylococcus
MMALLLTANGHKVITETVF

SEQ ID NO: 2077448 - protein, 17 aa, Staphylococcus
MMEAAIKGLRQHNKHTR

SEQ ID NO: 2077449 - protein, 32 aa, Staphylococcus
MMEGNLIVTLQFLFIPPLSWSNKKRLAMVGQY

SEQ ID NO: 2077450 - protein, 25 aa, Staphylococcus
MMELIRSYLEKYPDIPYVIDPVMLA

SEQ ID NO: 2077451 - protein, 17 aa, Staphylococcus
MMNEVIGNPLLDKFMKD

SEQ ID NO: 2077452 - protein, 18 aa, Staphylococcus
MMNNLRSRVRLETDGKLL

SEQ ID NO: 2077453 - protein, 22 aa, Staphylococcus
MMQDKGFIMIQMADPLKLTVQH

SEQ ID NO: 2077454 - protein, 20 aa, Staphylococcus
MMRVILIEQVYRTFKIMRGE

SEQ ID NO: 2077455 - protein, 17 aa, Staphylococcus
MMSKLEPGLFLCGEVLD

SEQ ID NO: 2077456 - protein, 24 aa, Staphylococcus
MMTQADWLIDIGPYAGDKGGQLLY

SEQ ID NO: 2077457 - protein, 17 aa, Staphylococcus
MMVFTNFFRDQMDRFGE

SEQ ID NO: 2077458 - protein, 17 aa, Staphylococcus
MMYGQMTAGSWIYIGSQ

SEQ ID NO: 2077459 - protein, 24 aa, Staphylococcus
MNANFGLLPSLDRRIKDKKERYEA

SEQ ID NO: 2077460 - protein, 17 aa, Staphylococcus
MNDFGIDVFSPSTFPPL

SEQ ID NO: 2077461 - protein, 28 aa, Staphylococcus
MNDIPYKVDIYPYYTSDATTALRAGADI

SEQ ID NO: 2077462 - protein, 27 aa, Staphylococcus
MNDLERLLEIKALLEKGFNIKAIKQII

SEQ ID NO: 2077463 - protein, 17 aa, Staphylococcus
MNELKVNLLDFRKTMDY

SEQ ID NO: 2077464 - protein, 33 aa, Staphylococcus
MNEMLMSNYLFKNSDDPKFKRWVIGSIISRTYY

SEQ ID NO: 2077465 - protein, 22 aa, Staphylococcus
MNERSFVLIPLNDIASNQIEPR

SEQ ID NO: 2077466 - protein, 17 aa, Staphylococcus
MNETLAEWFAENDYFYI

SEQ ID NO: 2077467 - protein, 29 aa, Staphylococcus
MNEYSKALLGLVIPLYSKYGIALEAHLQN

SEQ ID NO: 2077468 - protein, 27 aa, Staphylococcus
MNFDPSIFDLLMPIISGCSMYIPEKRL

SEQ ID NO: 2077469 - protein, 28 aa, Staphylococcus
MNFGVINILLQFVMLKEDMKLPKSYIFE

SEQ ID NO: 2077470 - protein, 20 aa, Staphylococcus
MNHFLTLNQINMGREPLTSE

SEQ ID NO: 2077471 - protein, 18 aa, Staphylococcus
MNIDDLTRILPVVKEIAF

SEQ ID NO: 2077472 - protein, 21 aa, Staphylococcus
MNIFVFKNHNMSLIKDFFQVK

SEQ ID NO: 2077473 - protein, 26 aa, Staphylococcus
MNKIDKTGFYYLYNPTNSPDPDNQSG

SEQ ID NO: 2077474 - protein, 23 aa, Staphylococcus
MNKLIDAVKPFVKQKLIFLIGMA

SEQ ID NO: 2077475 - protein, 24 aa, Staphylococcus
MNLDIESGYFYTLLGPSGCGKTTI

SEQ ID NO: 2077476 - protein, 19 aa, Staphylococcus
MNLISSIAFLLESRKLTSI

SEQ ID NO: 2077477 - protein, 22 aa, Staphylococcus
MNLKYLTYFDKHYPQLLKEIYD

SEQ ID NO: 2077478 - protein, 29 aa, Staphylococcus
MNLPNKEFQLLFLLASNPRQVFNRDALIE

SEQ ID NO: 2077479 - protein, 19 aa, Staphylococcus
MNLVPLRKFNNTEVNLFFT

SEQ ID NO: 2077480 - protein, 18 aa, Staphylococcus
MNLYDIIDEFKSLGGYEY

SEQ ID NO: 2077481 - protein, 25 aa, Staphylococcus
MNMGFIDDMRFIMDHLPSEDRQTML

SEQ ID NO: 2077482 - protein, 24 aa, Staphylococcus
MNMGFIDDMRFIMDKIPAEQRQTM

SEQ ID NO: 2077483 - protein, 19 aa, Staphylococcus
MNMTYIVMDNQIYGLTKGQ

SEQ ID NO: 2077484 - protein, 21 aa, Staphylococcus
MNNLIALKILNPTTGLPVKAI

SEQ ID NO: 2077485 - protein, 20 aa, Staphylococcus
MNNRYFINLAAGGKLTQVSY

SEQ ID NO: 2077486 - protein, 20 aa, Staphylococcus
MNNRYFINLAAGGRLTQVSY

SEQ ID NO: 2077487 - protein, 24 aa, Staphylococcus
MNNVKFIKPVYPGNTLYVIAEITN

SEQ ID NO: 2077488 - protein, 27 aa, Staphylococcus
MNRKGYYLYGYRHFSSRIMGGHTNNKI

SEQ ID NO: 2077489 - protein, 18 aa, Staphylococcus
MNRPGVPEELQGAALYLA

SEQ ID NO: 2077490 - protein, 27 aa, Staphylococcus
MNRPTGLWLGEVVHFADVLYKNGYDID

SEQ ID NO: 2077491 - protein, 27 aa, Staphylococcus
MNSETLLPSILAYNFAMLWNGNNVAYE

SEQ ID NO: 2077492 - protein, 18 aa, Staphylococcus
MNTQPREEKKGFFARLFN

SEQ ID NO: 2077493 - protein, 31 aa, Staphylococcus
MNVESAEIIKKLFLLGIVANINQSLDEDTLE

SEQ ID NO: 2077494 - protein, 23 aa, Staphylococcus
MNVSMNPTWLGDTQPRIFKLEGH

SEQ ID NO: 2077495 - protein, 20 aa, Staphylococcus
MNYCKLTYLITIYKVLNKIE

SEQ ID NO: 2077496 - protein, 21 aa, Staphylococcus
MPAITLNPWSLSDLELIGIGG

SEQ ID NO: 2077497 - protein, 17 aa, Staphylococcus
MPDTGHIIAYRSSGGFG

SEQ ID NO: 2077498 - protein, 22 aa, Staphylococcus
MPESSYLYSLPYNYYEDFGIRK

SEQ ID NO: 2077499 - protein, 27 aa, Staphylococcus
MPETMSLERRNLLKAYGAEVVLTPGSE

SEQ ID NO: 2077500 - protein, 17 aa, Staphylococcus
MPFISEKKVIVVKNSFI

SEQ ID NO: 2077501 - protein, 17 aa, Staphylococcus
MPFLLMFDEHEGGYKAG

SEQ ID NO: 2077502 - protein, 18 aa, Staphylococcus
MPGFDFYFAPMVLNSRDV

SEQ ID NO: 2077503 - protein, 25 aa, Staphylococcus
MPGLTICGGYQFLGSKYITPDGTEL

SEQ ID NO: 2077504 - protein, 25 aa, Staphylococcus
MPGLTICGGYQFLGTKYITPDGTEL

SEQ ID NO: 2077505 - protein, 25 aa, Staphylococcus
MPIEKAILIEPYACSLHAIQRANIK

SEQ ID NO: 2077506 - protein, 24 aa, Staphylococcus
MPIEVIYGFAQLKRAAALANHELG

SEQ ID NO: 2077507 - protein, 19 aa, Staphylococcus
MPILIHGDAAYPGQGINFE

SEQ ID NO: 2077508 - protein, 23 aa, Staphylococcus
MPKAIITYHITLQSDLPLIKMEE

SEQ ID NO: 2077509 - protein, 26 aa, Staphylococcus
MPKEIFGDDFVFLPKDELLSFSEMER

SEQ ID NO: 2077510 - protein, 21 aa, Staphylococcus
MPKEIFGDDYVFLPKDELLTF

SEQ ID NO: 2077511 - protein, 18 aa, Staphylococcus
MPKFPSTLPHIKLSTNVH

SEQ ID NO: 2077512 - protein, 17 aa, Staphylococcus
MPKTEFPMRGGLPNKEP

SEQ ID NO: 2077513 - protein, 19 aa, Staphylococcus
MPLMRNRGLLDDSVITKLA

SEQ ID NO: 2077514 - protein, 21 aa, Staphylococcus
MPLTILQLDIDTEISILEMGM

SEQ ID NO: 2077515 - protein, 18 aa, Staphylococcus
MPNAYLKSAFEINIDKLA

SEQ ID NO: 2077516 - protein, 18 aa, Staphylococcus
MPNGRYIYGYFPHFDKTI

SEQ ID NO: 2077517 - protein, 17 aa, Staphylococcus
MPNLTYLEEDELIIYAA

SEQ ID NO: 2077518 - protein, 24 aa, Staphylococcus
MPNMTKGQALRRLLTEWGMSSTEL

SEQ ID NO: 2077519 - protein, 28 aa, Staphylococcus
MPNRDKGLFYAWRRLVAYDPALTKDQRA

SEQ ID NO: 2077520 - protein, 26 aa, Staphylococcus
MPNTFVPARNLLFLSFAGALAYQLNA

SEQ ID NO: 2077521 - protein, 36 aa, Staphylococcus
MPQTREHILLSRNVGVPALVVFLNKADMVDDEELLE

SEQ ID NO: 2077522 - protein, 23 aa, Staphylococcus
MPRTQPRMKWYTDDKISNYKVTM

SEQ ID NO: 2077523 - protein, 19 aa, Staphylococcus
MPSGIDSISIILRTYQLKG

SEQ ID NO: 2077524 - protein, 25 aa, Staphylococcus
MPSHPIGRAILKYVDLPIAAPSANT

SEQ ID NO: 2077525 - protein, 32 aa, Staphylococcus
MPSHPIGRQILKYVDMPIAAPSANLSGRPSPT

SEQ ID NO: 2077526 - protein, 24 aa, Staphylococcus
MPSTARVNDLIKKAKLKSNADISH

SEQ ID NO: 2077527 - protein, 25 aa, Staphylococcus
MPWRETTNPYYIWISEVMLQQTQVK

SEQ ID NO: 2077528 - protein, 17 aa, Staphylococcus
MQAIMGTKLSSLGYKEG

SEQ ID NO: 2077529 - protein, 18 aa, Staphylococcus
MQDAYFLEQMSHFDREVI

SEQ ID NO: 2077530 - protein, 20 aa, Staphylococcus
MQDKLQDVVKVYRKMIENKN

SEQ ID NO: 2077531 - protein, 19 aa, Staphylococcus
MQDMNLLYELVSSGALSQL

SEQ ID NO: 2077532 - protein, 22 aa, Staphylococcus
MQDVYLLEQLAHFDREVIPERR

SEQ ID NO: 2077533 - protein, 21 aa, Staphylococcus
MQEEIFGPILPLMTYTELDTA

SEQ ID NO: 2077534 - protein, 19 aa, Staphylococcus
MQEEIFGPVVGFVKGKDFE

SEQ ID NO: 2077535 - protein, 20 aa, Staphylococcus
MQEEIFGPVVGFVKVKDFDE

SEQ ID NO: 2077536 - protein, 36 aa, Staphylococcus
MQELTEYGLFPEDWGGDTIFVPLSALSGDGIDDLLE

SEQ ID NO: 2077537 - protein, 17 aa, Staphylococcus
MQKFLEKEFSSLSWINN

SEQ ID NO: 2077538 - protein, 24 aa, Staphylococcus
MQNMGMIPKLSKGSIPRFAKGSFK

SEQ ID NO: 2077539 - protein, 21 aa, Staphylococcus
MQQISVPIQYLIAAALEVTDV

SEQ ID NO: 2077540 - protein, 27 aa, Staphylococcus
MQQNIKLFVVIGQLNQLIRGGRISKTK

SEQ ID NO: 2077541 - protein, 22 aa, Staphylococcus
MQQTAMAFAKLILCNDNEICQA

SEQ ID NO: 2077542 - protein, 19 aa, Staphylococcus
MQRALAMSLIQVYSNIVNK

SEQ ID NO: 2077543 - protein, 18 aa, Staphylococcus
MQRLLELYHSKRPVLLIT

SEQ ID NO: 2077544 - protein, 19 aa, Staphylococcus
MQRTATNIARLIKLNLKLK

SEQ ID NO: 2077545 - protein, 18 aa, Staphylococcus
MQRYITFDDLTKDALRYT

SEQ ID NO: 2077546 - protein, 22 aa, Staphylococcus
MQSISVPLQYLIAAALEVTDVT

SEQ ID NO: 2077547 - protein, 17 aa, Staphylococcus
MQSLLKSTGMTLMSHIG

SEQ ID NO: 2077548 - protein, 23 aa, Staphylococcus
MQTVLYQILVDMTKLLAPILAHT

SEQ ID NO: 2077549 - protein, 24 aa, Staphylococcus
MQYIAQYTVYHPNGKRWFTKDVFA

SEQ ID NO: 2077550 - protein, 17 aa, Staphylococcus
MQYLLSVDNISMVHNSR

SEQ ID NO: 2077551 - protein, 17 aa, Staphylococcus
MQYLYADGDTHVFMDNE

SEQ ID NO: 2077552 - protein, 32 aa, Staphylococcus
MQYYRETGIYAERTAPWLKRLGFDHVKEVLLD

SEQ ID NO: 2077553 - protein, 33 aa, Staphylococcus
MQYYRETGIYAERTAPWLNRLGFENVKEVLLDP

SEQ ID NO: 2077554 - protein, 19 aa, Staphylococcus
MRADFDQRFNCNCGKAGCI

SEQ ID NO: 2077555 - protein, 28 aa, Staphylococcus
MRADRDLLQAQLYLLQYGELPFQQEDIV

SEQ ID NO: 2077556 - protein, 18 aa, Staphylococcus
MRAFFYRQDVVSKTLNEL

SEQ ID NO: 2077557 - protein, 25 aa, Staphylococcus
MRAFRDTLQFYPVPQHAFVTLMDYV

SEQ ID NO: 2077558 - protein, 19 aa, Staphylococcus
MRAKLGFSINVTIDPDILV

SEQ ID NO: 2077559 - protein, 19 aa, Staphylococcus
MRAKLGFSINVTINPDILV

SEQ ID NO: 2077560 - protein, 17 aa, Staphylococcus
MRAKLGFSINVTVNPDI

SEQ ID NO: 2077561 - protein, 17 aa, Staphylococcus
MRALGADVKRTVKAEGM

SEQ ID NO: 2077562 - protein, 25 aa, Staphylococcus
MRAMNKLFDLQLSLDELSALGADVG

SEQ ID NO: 2077563 - protein, 22 aa, Staphylococcus
MRDIINNYPFPNTFKVIELTGR

SEQ ID NO: 2077564 - protein, 18 aa, Staphylococcus
MREDTILVSIMFVNNEVG

SEQ ID NO: 2077565 - protein, 18 aa, Staphylococcus
MREPYIALGTRKVILRRA

SEQ ID NO: 2077566 - protein, 26 aa, Staphylococcus
MRESGLFHMALLLPTRQDLGNFLYHA

SEQ ID NO: 2077567 - protein, 18 aa, Staphylococcus
MRFKTYVDTLKLSVSIGP

SEQ ID NO: 2077568 - protein, 25 aa, Staphylococcus
MRHMLKQFGPALKKPWTKLVAPELT

SEQ ID NO: 2077569 - protein, 26 aa, Staphylococcus
MRHQVDDYIIITFADHYVYKCKLVNI

SEQ ID NO: 2077570 - protein, 21 aa, Staphylococcus
MRKEMCYLFYITSKEVVNRFN

SEQ ID NO: 2077571 - protein, 29 aa, Staphylococcus
MRKRDIGFIFQDYNLLHTLTVKENILLPL

SEQ ID NO: 2077572 - protein, 17 aa, Staphylococcus
MRLVNLEGKLKDIVNTF

SEQ ID NO: 2077573 - protein, 25 aa, Staphylococcus
MRNYTRQLVTPLLALIQDYGIALEA

SEQ ID NO: 2077574 - protein, 23 aa, Staphylococcus
MRQESNVPILFLSSRDNPMDQVM

SEQ ID NO: 2077575 - protein, 17 aa, Staphylococcus
MRQLLTFKDNQFYLSKS

SEQ ID NO: 2077576 - protein, 25 aa, Staphylococcus
MRQRKHIWRRLAKDLKPDNLHDIKK

SEQ ID NO: 2077577 - protein, 20 aa, Staphylococcus
MRRNIGMIFQHFNLVKRSTV

SEQ ID NO: 2077578 - protein, 23 aa, Staphylococcus
MRSEFQRFIHNDYAIVVLVETET

SEQ ID NO: 2077579 - protein, 23 aa, Staphylococcus
MRSEFQRFIQNDYTIVVLAETET

SEQ ID NO: 2077580 - protein, 28 aa, Staphylococcus
MRTIGMALTPPLVPSTGQLGFDLAGDEI

SEQ ID NO: 2077581 - protein, 17 aa, Staphylococcus
MRVVLIEQVYRAFKIMR

SEQ ID NO: 2077582 - protein, 36 aa, Staphylococcus
MSAGLFIVGRIKGVARPALVVTLPTINGKGFVFLDV

SEQ ID NO: 2077583 - protein, 19 aa, Staphylococcus
MSDKVGLVTCMYVNNIMGQ

SEQ ID NO: 2077584 - protein, 17 aa, Staphylococcus
MSDLIKRIDTHLSIDFM

SEQ ID NO: 2077585 - protein, 24 aa, Staphylococcus
MSDTWDFPYIAHALDEVLSQYSMY

SEQ ID NO: 2077586 - protein, 26 aa, Staphylococcus
MSDVILYDRLVNKDILDLAKPGTKFF

SEQ ID NO: 2077587 - protein, 25 aa, Staphylococcus
MSEDMNFYLSLYELNKKYSQSIAYN

SEQ ID NO: 2077588 - protein, 25 aa, Staphylococcus
MSEKNPRLMPFQGYVLQNFELHSDG

SEQ ID NO: 2077589 - protein, 17 aa, Staphylococcus
MSELDWKYYQDKDFMTR

SEQ ID NO: 2077590 - protein, 23 aa, Staphylococcus
MSELMIMLYREYAGMFFKSQKLI

SEQ ID NO: 2077591 - protein, 21 aa, Staphylococcus
MSELSLLNLLGAGLTNITVVN

SEQ ID NO: 2077592 - protein, 21 aa, Staphylococcus
MSFAYYMNNYGNDKYLPHLQK

SEQ ID NO: 2077593 - protein, 28 aa, Staphylococcus
MSFHQALEVLFIVLRQFNHFQLGFLIEE

SEQ ID NO: 2077594 - protein, 19 aa, Staphylococcus
MSHIGGASGPLYGFSFVKM

SEQ ID NO: 2077595 - protein, 28 aa, Staphylococcus
MSHYQKIDFFTIDSLRFLQSLGKRLVFI

SEQ ID NO: 2077596 - protein, 43 aa, Staphylococcus
MSHYQRVDFFTIDSLRFLQSLKKRLVFLAWETNFENYTPAGQQ

SEQ ID NO: 2077597 - protein, 19 aa, Staphylococcus
MSILFTNKLSLIKSEIRTC

SEQ ID NO: 2077598 - protein, 22 aa, Staphylococcus
MSKELYKDLIDVGVTYVDVSGK

SEQ ID NO: 2077599 - protein, 18 aa, Staphylococcus
MSKLLQKEYRRDASIIKS

SEQ ID NO: 2077600 - protein, 24 aa, Staphylococcus
MSKNFDGIGFMLGDGIFGIDIDGV

SEQ ID NO: 2077601 - protein, 17 aa, Staphylococcus
MSKPDARILGMIGTGGM

SEQ ID NO: 2077602 - protein, 18 aa, Staphylococcus
MSKSNHLPVWNKPALCSF

SEQ ID NO: 2077603 - protein, 23 aa, Staphylococcus
MSKWEHYFVEQGFYPVAVDAKHG

SEQ ID NO: 2077604 - protein, 21 aa, Staphylococcus
MSLNRFLEVFDIGLEQLEFVM

SEQ ID NO: 2077605 - protein, 18 aa, Staphylococcus
MSLSPFQMSGGQMRKIAI

SEQ ID NO: 2077606 - protein, 20 aa, Staphylococcus
MSLSPFQMSGGQMRKIAIVS

SEQ ID NO: 2077607 - protein, 21 aa, Staphylococcus
MSLSRFLEVFDIGLEQLEFVM

SEQ ID NO: 2077608 - protein, 35 aa, Staphylococcus
MSLVLRPNVPFAMIPKFNLFIALGIRDAIQQFSND

SEQ ID NO: 2077609 - protein, 26 aa, Staphylococcus
MSMAEWQKVLDINLTGAFIGSREAVK

SEQ ID NO: 2077610 - protein, 26 aa, Staphylococcus
MSNNSYRWLLRFDWARPEHVHFASAY

SEQ ID NO: 2077611 - protein, 23 aa, Staphylococcus
MSPELFFQRGPFKNKADVLLSKP

SEQ ID NO: 2077612 - protein, 25 aa, Staphylococcus
MSPKKLQKMLYYAQAWCVTLSNETS

SEQ ID NO: 2077613 - protein, 27 aa, Staphylococcus
MSQSPMLMKNARFGFKMGNQALVDSMV

SEQ ID NO: 2077614 - protein, 19 aa, Staphylococcus
MSRDIQLVPFIVYGYNERE

SEQ ID NO: 2077615 - protein, 21 aa, Staphylococcus
MSRLLKVPVLLFNPFKRVETE

SEQ ID NO: 2077616 - protein, 23 aa, Staphylococcus
MSRLTTFLEHQLARSTSLHGVLV

SEQ ID NO: 2077617 - protein, 21 aa, Staphylococcus
MSRYEFVGPITFRCGTNIMEV

SEQ ID NO: 2077618 - protein, 19 aa, Staphylococcus
MSTFPIIRDLQVDRSRMFD

SEQ ID NO: 2077619 - protein, 18 aa, Staphylococcus
MSVPAFVKKKAQGARLVA

SEQ ID NO: 2077620 - protein, 31 aa, Staphylococcus
MSVTFEFEINQRQFKIFRQGSYIKEGNKTKT

SEQ ID NO: 2077621 - protein, 28 aa, Staphylococcus
MTAELERPYILVTDKKISSFQDILPLLE

SEQ ID NO: 2077622 - protein, 23 aa, Staphylococcus
MTDILSMFYDFAYCVYSTHKHRE

SEQ ID NO: 2077623 - protein, 27 aa, Staphylococcus
MTDSPYAVFLYLLSNKNYKHLKHIWVA

SEQ ID NO: 2077624 - protein, 29 aa, Staphylococcus
MTFARLPEALNFFTWLQHLADNGVTQDLM

SEQ ID NO: 2077625 - protein, 28 aa, Staphylococcus
MTFSMLPDTINFFTWLQHIKDNGATNDL

SEQ ID NO: 2077626 - protein, 24 aa, Staphylococcus
MTGFRVGYHCAQGYFNVIPDLTCL

SEQ ID NO: 2077627 - protein, 17 aa, Staphylococcus
MTGHLLGATGGIEAIFS

SEQ ID NO: 2077628 - protein, 17 aa, Staphylococcus
MTHLKFFSQRLINHESL

SEQ ID NO: 2077629 - protein, 26 aa, Staphylococcus
MTIDDTIMNPFDWYKAHDINLIIDDP

SEQ ID NO: 2077630 - protein, 21 aa, Staphylococcus
MTIELYYENIEIYKAAWEKII

SEQ ID NO: 2077631 - protein, 36 aa, Staphylococcus
MTINRMYWRARRRESLFMTYILKYHPRFKDADVPVW

SEQ ID NO: 2077632 - protein, 17 aa, Staphylococcus
MTLFGRGKDATYRCVCG

SEQ ID NO: 2077633 - protein, 17 aa, Staphylococcus
MTLFGRGKDAVYRCVCG

SEQ ID NO: 2077634 - protein, 27 aa, Staphylococcus
MTLGDSNLPALFWQNGAYATQLETGQP

SEQ ID NO: 2077635 - protein, 21 aa, Staphylococcus
MTLKRFLEVFDIGLEQLEFVM

SEQ ID NO: 2077636 - protein, 17 aa, Staphylococcus
MTLMHDALVYRIERLKE

SEQ ID NO: 2077637 - protein, 29 aa, Staphylococcus
MTLPNKEFHLLFLLVSHPKQIFSREECIE

SEQ ID NO: 2077638 - protein, 18 aa, Staphylococcus
MTPGQIRYYFPNHSELLN

SEQ ID NO: 2077639 - protein, 19 aa, Staphylococcus
MTPGQIRYYFPNHSELLNA

SEQ ID NO: 2077640 - protein, 17 aa, Staphylococcus
MTPKEWKDWIIGGQDKY

SEQ ID NO: 2077641 - protein, 18 aa, Staphylococcus
MTQIVSPIIRTIQFNYYE

SEQ ID NO: 2077642 - protein, 19 aa, Staphylococcus
MTQLNGEPLDFAKSGPFII

SEQ ID NO: 2077643 - protein, 25 aa, Staphylococcus
MTQSKCLVLFTSYKMMHMVQDMLNE

SEQ ID NO: 2077644 - protein, 33 aa, Staphylococcus
MTQYLMNHPNQLIPLTFFVKKFKQAKSSISEDV

SEQ ID NO: 2077645 - protein, 32 aa, Staphylococcus
MTQYLMNNPNKLIPLTYFVQKFKQAKSSISED

SEQ ID NO: 2077646 - protein, 18 aa, Staphylococcus
MTRGILSTIYIKLNHAFT

SEQ ID NO: 2077647 - protein, 26 aa, Staphylococcus
MTSRSLLSKLLVRATKKWPTDKAFNR

SEQ ID NO: 2077648 - protein, 18 aa, Staphylococcus
MTVELIAPIAIEDGTRFS

SEQ ID NO: 2077649 - protein, 29 aa, Staphylococcus
MTVNRMFWRARRRESIFISYILKHHPRFK

SEQ ID NO: 2077650 - protein, 30 aa, Staphylococcus
MVATGYFDDFDFIYGHHLWTQLELGLIDIK

SEQ ID NO: 2077651 - protein, 26 aa, Staphylococcus
MVDEKSFIDMAYTLLHDKGSTMNLYD

SEQ ID NO: 2077652 - protein, 17 aa, Staphylococcus
MVDMAHIAGLVATGLHP

SEQ ID NO: 2077653 - protein, 27 aa, Staphylococcus
MVEDVITYFINYLFTGYEVLNTFTFRI

SEQ ID NO: 2077654 - protein, 24 aa, Staphylococcus
MVEMRRYLHAHPELSFKEVETPKY

SEQ ID NO: 2077655 - protein, 34 aa, Staphylococcus
MVETTGHILNLYFPFIDVETMLTLLDLANIYISS

SEQ ID NO: 2077656 - protein, 25 aa, Staphylococcus
MVFKPTDFLIRRSGKLYFNINEVKQ

SEQ ID NO: 2077657 - protein, 24 aa, Staphylococcus
MVFKPTDFLVRRSGKLYFNIDDVL

SEQ ID NO: 2077658 - protein, 23 aa, Staphylococcus
MVFQNYNLFPHKSALENVMEGLV

SEQ ID NO: 2077659 - protein, 23 aa, Staphylococcus
MVFQSYNLFPHKSALENVMEGLV

SEQ ID NO: 2077660 - protein, 23 aa, Staphylococcus
MVFQSYNLFPHKTALENVMEGLV

SEQ ID NO: 2077661 - protein, 18 aa, Staphylococcus
MVGLIDDVNYLANFKPQS

SEQ ID NO: 2077662 - protein, 23 aa, Staphylococcus
MVGSAFATMNLIDGHQAFAASET

SEQ ID NO: 2077663 - protein, 26 aa, Staphylococcus
MVIAILKDQKRVLPTIAFLDGEYGYR

SEQ ID NO: 2077664 - protein, 27 aa, Staphylococcus
MVKHHVIKPMYITFSELYFYVVGVNEK

SEQ ID NO: 2077665 - protein, 24 aa, Staphylococcus
MVKLAMELYDAPWIQWYHEQMNLK

SEQ ID NO: 2077666 - protein, 24 aa, Staphylococcus
MVKLAMELYDSPWIKWYHQQMKDK

SEQ ID NO: 2077667 - protein, 25 aa, Staphylococcus
MVKQLYSPVQFIKSTEWLIEQGVDH

SEQ ID NO: 2077668 - protein, 29 aa, Staphylococcus
MVKQLYSPVQFIQSIEWLLAQGVDHFIEI

SEQ ID NO: 2077669 - protein, 18 aa, Staphylococcus
MVLGDSQLQAIFWQNGHL

SEQ ID NO: 2077670 - protein, 19 aa, Staphylococcus
MVLIDLIHQIKPNAKIVFL

SEQ ID NO: 2077671 - protein, 20 aa, Staphylococcus
MVLIDLIYQIKPDAQIVFLD

SEQ ID NO: 2077672 - protein, 19 aa, Staphylococcus
MVLLHELITRLKDSYAKLT

SEQ ID NO: 2077673 - protein, 18 aa, Staphylococcus
MVLLHKYTRQDDLVIGSV

SEQ ID NO: 2077674 - protein, 32 aa, Staphylococcus
MVMSDGPERFWPADLVLLSIGFIGTETTIPHA

SEQ ID NO: 2077675 - protein, 19 aa, Staphylococcus
MVNAILLGQQFNSLLPPQE

SEQ ID NO: 2077676 - protein, 24 aa, Staphylococcus
MVNEKIRIHTPSQMGIRKPEFTSA

SEQ ID NO: 2077677 - protein, 17 aa, Staphylococcus
MVPALTEERRKELVKDV

SEQ ID NO: 2077678 - protein, 18 aa, Staphylococcus
MVPVITQADTKSVGALAN

SEQ ID NO: 2077679 - protein, 18 aa, Staphylococcus
MVQNMNDLEALGKEMEQI

SEQ ID NO: 2077680 - protein, 17 aa, Staphylococcus
MVQQIIRPTGLLDPKIE

SEQ ID NO: 2077681 - protein, 27 aa, Staphylococcus
MVREQLPFGVINILLQYVMLNNDMQLP

SEQ ID NO: 2077682 - protein, 23 aa, Staphylococcus
MVRIVHYFMVHQLGGIPVMMNSQ

SEQ ID NO: 2077683 - protein, 17 aa, Staphylococcus
MVRLSQDWKLRHVLVEM

SEQ ID NO: 2077684 - protein, 17 aa, Staphylococcus
MVRPKLSSVIQPLYDIG

SEQ ID NO: 2077685 - protein, 24 aa, Staphylococcus
MVSDYQFDPLKNQITHIDFLAINM

SEQ ID NO: 2077686 - protein, 17 aa, Staphylococcus
MVSHFKKFEGEFKNAAQ

SEQ ID NO: 2077687 - protein, 31 aa, Staphylococcus
MVVSQFLTKDLFIDWAWGEDYFRKKLIDYDA

SEQ ID NO: 2077688 - protein, 30 aa, Staphylococcus; identical to SEQ ID NO: 1830432

SEQ ID NO: 2077689 - protein, 26 aa, Staphylococcus
MVYKPTDFLIRRTGKLYFDINTVKQY

SEQ ID NO: 2077690 - protein, 25 aa, Staphylococcus
MVYKPTDFLVRRSGKLYFNIQDVLD

SEQ ID NO: 2077691 - protein, 33 aa, Staphylococcus
MVYKPTDFLVRRTGKLYFNIQDVLAYKAGVIEV

SEQ ID NO: 2077692 - protein, 17 aa, Staphylococcus
MWNFSPDLSNIESQDNK

SEQ ID NO: 2077693 - protein, 18 aa, Staphylococcus
MYAAMKQAAKVKKPIVAH

SEQ ID NO: 2077694 - protein, 17 aa, Staphylococcus
MYAAMKQAARVKKPIVA

SEQ ID NO: 2077695 - protein, 25 aa, Staphylococcus
MYDELYHFLIRIMNIYQTHLGRAVI

SEQ ID NO: 2077696 - protein, 29 aa, Staphylococcus
MYDEPKGFGPLLASMYKAGEMGLLDQSSN

SEQ ID NO: 2077697 - protein, 20 aa, Staphylococcus
MYDGITAFAEACILAFSQTK

SEQ ID NO: 2077698 - protein, 24 aa, Staphylococcus
MYDTKPRGLFRKNKFSPIVGDVVD

SEQ ID NO: 2077699 - protein, 21 aa, Staphylococcus
MYHSPIRLLVVIQAPDAHIQR

SEQ ID NO: 2077700 - protein, 20 aa, Staphylococcus
MYIKQGYTFIGFRYQILKEN

SEQ ID NO: 2077701 - protein, 22 aa, Staphylococcus
MYINAMYRNDLVFGIGPAGTGK

SEQ ID NO: 2077702 - protein, 21 aa, Staphylococcus
MYIVNFIRQRGLNKAFEKWLY

SEQ ID NO: 2077703 - protein, 24 aa, Staphylococcus
MYKERGFEIKPEIAGLMISAIISD

SEQ ID NO: 2077704 - protein, 27 aa, Staphylococcus
MYKGKYHIYKVNAPIVEGSFTAAMSLS

SEQ ID NO: 2077705 - protein, 21 aa, Staphylococcus
MYKLPILYLEYSGTYGDKDIV

SEQ ID NO: 2077706 - protein, 21 aa, Staphylococcus
MYKVHLMKECLDRGISVISSM

SEQ ID NO: 2077707 - protein, 17 aa, Staphylococcus
MYNIHELKWDDELLELL

SEQ ID NO: 2077708 - protein, 24 aa, Staphylococcus
MYNTKPRGLFRKKKFSPIVGDIVD

SEQ ID NO: 2077709 - protein, 20 aa, Staphylococcus
MYPHLDGVLSLDLTTVLILN

SEQ ID NO: 2077710 - protein, 25 aa, Staphylococcus
MYPHLDGVLSLDLTTVLILNQLANS

SEQ ID NO: 2077711 - protein, 27 aa, Staphylococcus
MYREMAKEGIFLPPSQFEGTFLSTAHT

SEQ ID NO: 2077712 - protein, 17 aa, Staphylococcus
MYRLIEDDALINRMGFN

SEQ ID NO: 2077713 - protein, 17 aa, Staphylococcus
MYRLVDIVADIMEPYYP

SEQ ID NO: 2077714 - protein, 23 aa, Staphylococcus
MYSQYLNRTFLFNVSSTFEERSD

SEQ ID NO: 2077715 - protein, 17 aa, Staphylococcus
MYYMNKDIPIVVGSSPE

SEQ ID NO: 2077716 - protein, 31 aa, Staphylococcus
NAAKALAFAYDIPLIPVHHIAGHIYANHLET

SEQ ID NO: 2077717 - protein, 17 aa, Staphylococcus
NAALHYLARLIEAGDLP

SEQ ID NO: 2077718 - protein, 25 aa, Staphylococcus
NAAPFSFFNIVNNAPPMIAISAQRA

SEQ ID NO: 2077719 - protein, 27 aa, Staphylococcus
NAAPFSFFNVVSSNPPMIMISTGRLNG

SEQ ID NO: 2077720 - protein, 18 aa, Staphylococcus
NADFITINAAYNPDLHHL

SEQ ID NO: 2077721 - protein, 23 aa, Staphylococcus
NADFITINAAYNPDLHHLIDSEQ

SEQ ID NO: 2077722 - protein, 32 aa, Staphylococcus
NADLLIMVGTNYPYVDYLPKKNIKAVQIDVDP

SEQ ID NO: 2077723 - protein, 17 aa, Staphylococcus
NAEAILEELGLPYRRVI

SEQ ID NO: 2077724 - protein, 29 aa, Staphylococcus
NAEAILEELGLPYRRVILCTGDIGFSASK

SEQ ID NO: 2077725 - protein, 28 aa, Staphylococcus
NAEDFNRPGHLFPLIAKDNGVLERNGHT

SEQ ID NO: 2077726 - protein, 17 aa, Staphylococcus
NAEDLILKVPPGTIIKN

SEQ ID NO: 2077727 - protein, 18 aa, Staphylococcus
NAELADELVFLDISRTEN

SEQ ID NO: 2077728 - protein, 17 aa, Staphylococcus
NAESILEELGLPYRRVI

SEQ ID NO: 2077729 - protein, 30 aa, Staphylococcus
NAETARQCALVWGIFPVVKEGRKTTDALLN

SEQ ID NO: 2077730 - protein, 23 aa, Staphylococcus
NAEWQKVIDINLTGAFTGSREAI

SEQ ID NO: 2077731 - protein, 19 aa, Staphylococcus
NAFADYFRYEVPYSFEEAR

SEQ ID NO: 2077732 - protein, 26 aa, Staphylococcus
NAFDLKIEKAPFYATPRKPAVHHTMG

SEQ ID NO: 2077733 - protein, 22 aa, Staphylococcus
NAFDMLLELGFSRNVMSLSPFQ

SEQ ID NO: 2077734 - protein, 28 aa, Staphylococcus
NAFDQIVLPLMKKLNLDTLLLNRYPDQI

SEQ ID NO: 2077735 - protein, 21 aa, Staphylococcus
NAFELTIAVLLSAQCTDNLVN

SEQ ID NO: 2077736 - protein, 22 aa, Staphylococcus
NAFELTIAVLLSAQCTDNLVNR

SEQ ID NO: 2077737 - protein, 26 aa, Staphylococcus
NAFIKPDVFYFIPSFISPLKEHTDYL

SEQ ID NO: 2077738 - protein, 19 aa, Staphylococcus
NAFLDQFDEPLFVKVGMEL

SEQ ID NO: 2077739 - protein, 17 aa, Staphylococcus
NAGINLPRLLTDSKKEK

SEQ ID NO: 2077740 - protein, 17 aa, Staphylococcus
NAGLMPQSFLEKNKQDE

SEQ ID NO: 2077741 - protein, 20 aa, Staphylococcus
NAGLRLKFLKSETSGVAVWG

SEQ ID NO: 2077742 - protein, 17 aa, Staphylococcus
NAGLRRINVSLDAIDDE

SEQ ID NO: 2077743 - protein, 42 aa, Staphylococcus
NAGWTLEDLALVDFFFQPDFDRPWNYLNVLAQSALGDDVFPE

SEQ ID NO: 2077744 - protein, 20 aa, Staphylococcus
NAHKRELAYTRYSWPKSDMN

SEQ ID NO: 2077745 - protein, 26 aa, Staphylococcus
NAHNHWYEWLGHNLTLEGYKVSLFNL

SEQ ID NO: 2077746 - protein, 17 aa, Staphylococcus
NAHNNVIFASARPIRDL

SEQ ID NO: 2077747 - protein, 17 aa, Staphylococcus
NAIFIMLRSNQPYKRQY

SEQ ID NO: 2077748 - protein, 18 aa, Staphylococcus
NAIFKMNPPLRSKEDREA

SEQ ID NO: 2077749 - protein, 24 aa, Staphylococcus
NAIGTFYPFIQDDVKLYGVEAAGK

SEQ ID NO: 2077750 - protein, 26 aa, Staphylococcus
NAIKSPMVGTFFLQDSKELTEPQIKV

SEQ ID NO: 2077751 - protein, 23 aa, Staphylococcus
NAIQNYLIQNMIPVISSIGTHQD

SEQ ID NO: 2077752 - protein, 20 aa, Staphylococcus
NAITAWYDLAKLANKYVLEN

SEQ ID NO: 2077753 - protein, 19 aa, Staphylococcus
NAITFLLQNIQPHQKLIVD

SEQ ID NO: 2077754 - protein, 19 aa, Staphylococcus
NAITFLLQNIQPHQNLIVD

SEQ ID NO: 2077755 - protein, 19 aa, Staphylococcus
NAIVLFKMHPFVKNKLNIP

SEQ ID NO: 2077756 - protein, 35 aa, Staphylococcus
NAIVLVHLYDYIPKMFWPVYYFVQAPLQGIMMRGF

SEQ ID NO: 2077757 - protein, 18 aa, Staphylococcus
NAKFLHYKNKPYKLNTKE

SEQ ID NO: 2077758 - protein, 23 aa, Staphylococcus
NAKLDFHKLKDILMEWQLGIYEG

SEQ ID NO: 2077759 - protein, 29 aa, Staphylococcus
NAKNHWYEWLKHNLTLEGYYVQLFNLHSS

SEQ ID NO: 2077760 - protein, 23 aa, Staphylococcus
NAKPPVARIMDYGKFKFEQQKKE

SEQ ID NO: 2077761 - protein, 24 aa, Staphylococcus
NAKRVITPLSPISIFAARNPWEGL

SEQ ID NO: 2077762 - protein, 17 aa, Staphylococcus
NALDAMISFFNGIAQLR

SEQ ID NO: 2077763 - protein, 18 aa, Staphylococcus
NALGIPTVILGIGYENIH

SEQ ID NO: 2077764 - protein, 18 aa, Staphylococcus
NALGQALLAKRMGKNKLV

SEQ ID NO: 2077765 - protein, 18 aa, Staphylococcus
NALGQALLAKRMGKRKLV

SEQ ID NO: 2077766 - protein, 18 aa, Staphylococcus
NALGQALLAKRMGKTKLV

SEQ ID NO: 2077767 - protein, 23 aa, Staphylococcus
NALKLKSFFNSEVPIHRGASQPL

SEQ ID NO: 2077768 - protein, 23 aa, Staphylococcus
NALKLKSFFNSNVPVHRGAAHPL

SEQ ID NO: 2077769 - protein, 22 aa, Staphylococcus
NALKYLMRASRKNGLEDLKKAR

SEQ ID NO: 2077770 - protein, 22 aa, Staphylococcus
NALQLKAFFNSDVPVHQGAATP

SEQ ID NO: 2077771 - protein, 20 aa, Staphylococcus
NALTTNLTKPFLIFVGNSNG

SEQ ID NO: 2077772 - protein, 21 aa, Staphylococcus
NALTVMMNYFRHHLIDNHKSL

SEQ ID NO: 2077773 - protein, 20 aa, Staphylococcus
NALVPNVYKSFRPKPNNVSD

SEQ ID NO: 2077774 - protein, 28 aa, Staphylococcus
NALVTGYDIIFFWVARMIFQGLEFTGER

SEQ ID NO: 2077775 - protein, 28 aa, Staphylococcus
NALVTGYDIIFFWVARMIFQGLEFTGKR

SEQ ID NO: 2077776 - protein, 19 aa, Staphylococcus
NAMFKMNPPLRSKEDRDAL

SEQ ID NO: 2077777 - protein, 19 aa, Staphylococcus
NAMGWYLDGRASAVVGTHT

SEQ ID NO: 2077778 - protein, 24 aa, Staphylococcus
NAMTFYDIINLYSDTIKLGGSNIK

SEQ ID NO: 2077779 - protein, 19 aa, Staphylococcus
NAMVTDLDDLKDLGKEMEQ

SEQ ID NO: 2077780 - protein, 27 aa, Staphylococcus
NAMYNDIKMWDYKLLPTVFGGKDEVQV

SEQ ID NO: 2077781 - protein, 27 aa, Staphylococcus
NANKLPKYIPLLLQVKFDLEKIQSELI

SEQ ID NO: 2077782 - protein, 21 aa, Staphylococcus
NANRIGVWIGSGIGGMETFEV

SEQ ID NO: 2077783 - protein, 23 aa, Staphylococcus
NANVILNNLYKQTPLQTSFGVNM

SEQ ID NO: 2077784 - protein, 28 aa, Staphylococcus
NANVRAFYEFYSYLMEPWDGPTMISFCN

SEQ ID NO: 2077785 - protein, 18 aa, Staphylococcus
NAPILYKSGAFKYKLNAS

SEQ ID NO: 2077786 - protein, 41 aa, Staphylococcus
NAPNKILLRSFSEVLTFAPFTYIDELLTQPFLAIAGTEADT

SEQ ID NO: 2077787 - protein, 28 aa, Staphylococcus
NAPTWMHQLLKLYQLAPRFLEKHFSHLF

SEQ ID NO: 2077788 - protein, 22 aa, Staphylococcus
NAQGEYYLPDVISLIINENGRA

SEQ ID NO: 2077789 - protein, 24 aa, Staphylococcus
NAQPKALKTLLLLHGLSSDETSYM

SEQ ID NO: 2077790 - protein, 32 aa, Staphylococcus
NARKEILAKCKYIKPFLPEKVNGKKWSDAPTE

SEQ ID NO: 2077791 - protein, 17 aa, Staphylococcus
NASCHLAIGSAYGFNIE

SEQ ID NO: 2077792 - protein, 17 aa, Staphylococcus
NASFIFAVCEYLKYGQF

SEQ ID NO: 2077793 - protein, 22 aa, Staphylococcus
NASIAGLIKLKRVGRLPQGKKV

SEQ ID NO: 2077794 - protein, 29 aa, Staphylococcus
NASMKGMEELLLHDAPIAPIYQKGEAHLT

SEQ ID NO: 2077795 - protein, 23 aa, Staphylococcus
NASPITEFPKFKKSINTFISSDN

SEQ ID NO: 2077796 - protein, 24 aa, Staphylococcus
NASPNRWYRGIINKVLESNHLVSK

SEQ ID NO: 2077797 - protein, 19 aa, Staphylococcus
NASSILYPILKRPDEKSVT

SEQ ID NO: 2077798 - protein, 17 aa, Staphylococcus
NASVILNNLYKQTPLQT

SEQ ID NO: 2077799 - protein, 23 aa, Staphylococcus
NATIFLMNAVYEFDKIRENQIQM

SEQ ID NO: 2077800 - protein, 20 aa, Staphylococcus
NATIHRFTRKLGFDGYSDFK

SEQ ID NO: 2077801 - protein, 17 aa, Staphylococcus
NATIPQVVLAWLRDRPN

SEQ ID NO: 2077802 - protein, 24 aa, Staphylococcus
NATNHWYEWLKHNLTLEGYHVTLF

SEQ ID NO: 2077803 - protein, 22 aa, Staphylococcus
NATNPEQLFAAGYASCFNGAFD

SEQ ID NO: 2077804 - protein, 17 aa, Staphylococcus
NATPIIYHVYSPHVLTM

SEQ ID NO: 2077805 - protein, 29 aa, Staphylococcus
NATSDLWQRLIKLWKDQTVLIVEHKVEHI

SEQ ID NO: 2077806 - protein, 20 aa, Staphylococcus
NAVAPGPIYTPLIPATFDEE

SEQ ID NO: 2077807 - protein, 21 aa, Staphylococcus
NAVAPGPIYTPLIPATFSEDK

SEQ ID NO: 2077808 - protein, 25 aa, Staphylococcus
NAVHLFYKYLEYVNVKHIAVVGAKT

SEQ ID NO: 2077809 - protein, 24 aa, Staphylococcus
NAVKFFLPYMHVVNFKKIAVVGEK

SEQ ID NO: 2077810 - protein, 26 aa, Staphylococcus
NAVNEMRALIWQLKPVGLEHGLIHAL

SEQ ID NO: 2077811 - protein, 26 aa, Staphylococcus
NAVNEMRALIWQLKPVGLEQGMLHAL

SEQ ID NO: 2077812 - protein, 19 aa, Staphylococcus
NAVSQPIFVSLYAPIEGDK

SEQ ID NO: 2077813 - protein, 18 aa, Staphylococcus
NAYFKGMFNETCPTFDEI

SEQ ID NO: 2077814 - protein, 18 aa, Staphylococcus
NAYSAVFPLLHGPNGEDG

SEQ ID NO: 2077815 - protein, 18 aa, Staphylococcus
NCDKITPGMILAAVRTNV

SEQ ID NO: 2077816 - protein, 30 aa, Staphylococcus
NCEHLLTEFGVWHPHAWDYAPKPITFPSNE

SEQ ID NO: 2077817 - protein, 24 aa, Staphylococcus
NCGMCSSGLYVLFDGDIVEGDSPD

SEQ ID NO: 2077818 - protein, 18 aa, Staphylococcus
NCIAGDRFSPEAWYGMIE

SEQ ID NO: 2077819 - protein, 19 aa, Staphylococcus
NCILVVIPDINWSAELDIK

SEQ ID NO: 2077820 - protein, 17 aa, Staphylococcus
NCKKKMTLFGKGKEATY

SEQ ID NO: 2077821 - protein, 17 aa, Staphylococcus
NCKKKMTLFGRGKDATY

SEQ ID NO: 2077822 - protein, 20 aa, Staphylococcus
NCKRLGFYPKTVANISQISF

SEQ ID NO: 2077823 - protein, 19 aa, Staphylococcus
NCKVLIDHGYLEGQLTADR

SEQ ID NO: 2077824 - protein, 18 aa, Staphylococcus
NCLPYYDKVMLMDCLLQY

SEQ ID NO: 2077825 - protein, 29 aa, Staphylococcus
NCNFDKSIFENVNFFKTLISKSNLTVTSF

SEQ ID NO: 2077826 - protein, 29 aa, Staphylococcus
NCPGHMLIFKNELRSYKDLPLRIAEFGQV

SEQ ID NO: 2077827 - protein, 23 aa, Staphylococcus
NCPGHMLIFKNELRSYKDLPLRM

SEQ ID NO: 2077828 - protein, 17 aa, Staphylococcus
NCPIKVRYFYNGRILMM

SEQ ID NO: 2077829 - protein, 34 aa, Staphylococcus
NCSTIQSVVPLKVLYDAFGLKRVAYTTYQAVSGS

SEQ ID NO: 2077830 - protein, 27 aa, Staphylococcus
NCVYCYNYCIWLIQNGLPKSYEFATLK

SEQ ID NO: 2077831 - protein, 26 aa, Staphylococcus
NDAFGAYLHMGGRIGVLTVIEGTTDE

SEQ ID NO: 2077832 - protein, 22 aa, Staphylococcus
NDAFIHEDFMIGSSDLTIYGIT

SEQ ID NO: 2077833 - protein, 23 aa, Staphylococcus
NDAFKEYFIGDSYLNMLSTEGIT

SEQ ID NO: 2077834 - protein, 24 aa, Staphylococcus
NDAKKKVAIALRNRYRRSQLDEEM

SEQ ID NO: 2077835 - protein, 30 aa, Staphylococcus
NDARFAYDCYRRLLQMFGDVVYGVAMTHFD

SEQ ID NO: 2077836 - protein, 22 aa, Staphylococcus
NDASKFVQYLLSNDTNNLTDNK

SEQ ID NO: 2077837 - protein, 23 aa, Staphylococcus
NDASKFVQYLLSNDTNNLTDTKA

SEQ ID NO: 2077838 - protein, 22 aa, Staphylococcus
NDAVRRILGLKAKIHLPKKQAQ

SEQ ID NO: 2077839 - protein, 18 aa, Staphylococcus
NDCEGALLRLLEMGISPQ

SEQ ID NO: 2077840 - protein, 24 aa, Staphylococcus
NDDAQLILQAMLVSLQTIEDEYNE

SEQ ID NO: 2077841 - protein, 24 aa, Staphylococcus
NDDISPFHYKLLHFVLEKISNGDS

SEQ ID NO: 2077842 - protein, 29 aa, Staphylococcus
NDDKESFIDFYHKRLLIADKKPNIVHQWI

SEQ ID NO: 2077843 - protein, 26 aa, Staphylococcus
NDDKPLYVKFLLDQLSEYPHGKLEPI

SEQ ID NO: 2077844 - protein, 24 aa, Staphylococcus
NDDKQLVIALTDHIIFAYKRLKQN

SEQ ID NO: 2077845 - protein, 17 aa, Staphylococcus
NDDLHINQLIKPNSKWN

SEQ ID NO: 2077846 - protein, 18 aa, Staphylococcus
NDDLLRRNKKRRQGTQSQ

SEQ ID NO: 2077847 - protein, 24 aa, Staphylococcus
NDDNAARIGVWIGSGIGGMETFEY

SEQ ID NO: 2077848 - protein, 23 aa, Staphylococcus
NDDNLFMHSLSSESVKRIVSLAQ

SEQ ID NO: 2077849 - protein, 25 aa, Staphylococcus
NDDTWGQVPVLYYIAQDYVDKNDLQ

SEQ ID NO: 2077850 - protein, 28 aa, Staphylococcus
NDEHVRAFYEFYSYLMEPWDGPTMISFC

SEQ ID NO: 2077851 - protein, 24 aa, Staphylococcus
NDEIAFFKAVKAGLVKLLQPPKEG

SEQ ID NO: 2077852 - protein, 19 aa, Staphylococcus
NDEILVYQRLSGGGEERLH

SEQ ID NO: 2077853 - protein, 24 aa, Staphylococcus
NDEIQSIFRQLGFETTLKGETLTV

SEQ ID NO: 2077854 - protein, 17 aa, Staphylococcus
NDELGERIGFISNSTGG

SEQ ID NO: 2077855 - protein, 20 aa, Staphylococcus
NDELIQFKSLNSMQTKDIIK

SEQ ID NO: 2077856 - protein, 23 aa, Staphylococcus
NDETANRIGVWIGSGIGGMETFE

SEQ ID NO: 2077857 - protein, 22 aa, Staphylococcus
NDEVLEFYGLKVLVDKDDAPVL

SEQ ID NO: 2077858 - protein, 24 aa, Staphylococcus
NDEVLEFYGLKVLVDKYDVPVLNG

SEQ ID NO: 2077859 - protein, 21 aa, Staphylococcus
NDFDELIPYMNNVRVMIVFGE

SEQ ID NO: 2077860 - protein, 24 aa, Staphylococcus
NDFKDTGWINLPLVNGAYANTEYT

SEQ ID NO: 2077861 - protein, 17 aa, Staphylococcus
NDFRKESMLNKKQLKMF

SEQ ID NO: 2077862 - protein, 22 aa, Staphylococcus
NDFTINLYGIRLSFGRVGGYNT

SEQ ID NO: 2077863 - protein, 19 aa, Staphylococcus
NDFYNELKPLADMYNAKKL

SEQ ID NO: 2077864 - protein, 24 aa, Staphylococcus
NDGAALILVLEKQLAKRFGFSEGL

SEQ ID NO: 2077865 - protein, 26 aa, Staphylococcus
NDGGALPMMKLPYDFYLGGKLGSGRQ

SEQ ID NO: 2077866 - protein, 26 aa, Staphylococcus
NDGKNAIIESLKRKIKKLEKENKALK

SEQ ID NO: 2077867 - protein, 26 aa, Staphylococcus
NDGKSAIIESLKRKIKKLEKENKSLK

SEQ ID NO: 2077868 - protein, 18 aa, Staphylococcus
NDGLTYLLSALTYDNQTV

SEQ ID NO: 2077869 - protein, 20 aa, Staphylococcus
NDGMIIYLPQEGRGIGLINK

SEQ ID NO: 2077870 - protein, 24 aa, Staphylococcus
NDGMLLMDGVIFPDKFKKYETSIS

SEQ ID NO: 2077871 - protein, 29 aa, Staphylococcus
NDGTKRYMRVDRMKGIFAWGKILHSSQKE

SEQ ID NO: 2077872 - protein, 24 aa, Staphylococcus
NDHDTYYFICAAGVRSGRIVEYLN

SEQ ID NO: 2077873 - protein, 35 aa, Staphylococcus
NDHFFNTILKYVKKGVLYPLSYYDGDWYGKNKVGS

SEQ ID NO: 2077874 - protein, 20 aa, Staphylococcus
NDHPLYEYAPLTLGDTGLLT

SEQ ID NO: 2077875 - protein, 27 aa, Staphylococcus
NDIASNRKFIIYYDNFGKLNGVYGDIS

SEQ ID NO: 2077876 - protein, 18 aa, Staphylococcus
NDICCYFLDIQLDADING

SEQ ID NO: 2077877 - protein, 18 aa, Staphylococcus
NDIDLFKAAKYKVAMDNA

SEQ ID NO: 2077878 - protein, 19 aa, Staphylococcus
NDIHMWDYKALPAVFGGDN

SEQ ID NO: 2077879 - protein, 23 aa, Staphylococcus
NDIIATYDIPRFDKSPYDGFAIR

SEQ ID NO: 2077880 - protein, 25 aa, Staphylococcus
NDIKEKFEAALIERVKNIKLGNGFD

SEQ ID NO: 2077881 - protein, 17 aa, Staphylococcus
NDIKIAIVMNLCNTTKS

SEQ ID NO: 2077882 - protein, 24 aa, Staphylococcus
NDIKVKLIQRLAFASGHLGMVGGQ

SEQ ID NO: 2077883 - protein, 22 aa, Staphylococcus
NDIPTIIHEAFHIANTGRKGPV

SEQ ID NO: 2077884 - protein, 23 aa, Staphylococcus
NDIQFDYLFAAIGGGGLISGVGT

SEQ ID NO: 2077885 - protein, 22 aa, Staphylococcus
NDIQGQFPFENIKWLVDEGYTK

SEQ ID NO: 2077886 - protein, 19 aa, Staphylococcus
NDIQNIEFIGAVNIIEPFN

SEQ ID NO: 2077887 - protein, 18 aa, Staphylococcus
NDIRLKCALIDILKEHRT

SEQ ID NO: 2077888 - protein, 24 aa, Staphylococcus
NDISPFELFVISCPLDSGLEIFVG

SEQ ID NO: 2077889 - protein, 25 aa, Staphylococcus
NDIYEKLLIYMKFKANLDVSTHQVA

SEQ ID NO: 2077890 - protein, 18 aa, Staphylococcus
NDIYIINPSMRKYLNVSI

SEQ ID NO: 2077891 - protein, 26 aa, Staphylococcus
NDKAMRWQLGVIWKKEKYINYATREY

SEQ ID NO: 2077892 - protein, 24 aa, Staphylococcus
NDKGIKAIVFDRGGYLYHGRVKAL

SEQ ID NO: 2077893 - protein, 32 aa, Staphylococcus
NDKKPYLLEISYFKFLNKFLNKIGIIRKVYGN

SEQ ID NO: 2077894 - protein, 24 aa, Staphylococcus
NDKLDQFELQLLLDGPHDANNAIL

SEQ ID NO: 2077895 - protein, 25 aa, Staphylococcus
NDKNIIQLVWKEKGNWKIPIKTLNK

SEQ ID NO: 2077896 - protein, 31 aa, Staphylococcus
NDKNVITIHGFKHYVALLFHKGAIIEDKYET

SEQ ID NO: 2077897 - protein, 28 aa, Staphylococcus
NDKNVRAFYEYYSYLMEPWDGPTMISFC

SEQ ID NO: 2077898 - protein, 24 aa, Staphylococcus
NDKRKLEFLAGRFATKEAFSKALG

SEQ ID NO: 2077899 - protein, 17 aa, Staphylococcus
NDLDLPIGIIPGGTFND

SEQ ID NO: 2077900 - protein, 25 aa, Staphylococcus
NDLERLLEIKALIEKGFNLKGIKQI

SEQ ID NO: 2077901 - protein, 32 aa, Staphylococcus
NDLFEKIVKLISDYDLKYIIDGDFDYAANVSE

SEQ ID NO: 2077902 - protein, 20 aa, Staphylococcus
NDLGLVDFYLRELDTYLQQH

SEQ ID NO: 2077903 - protein, 21 aa, Staphylococcus
NDLGVELVIDQALRNVRKEKL

SEQ ID NO: 2077904 - protein, 22 aa, Staphylococcus
NDLHGLWLGDLILIKRNLPETR

SEQ ID NO: 2077905 - protein, 17 aa, Staphylococcus
NDLILNVGYSHPVEIKA

SEQ ID NO: 2077906 - protein, 20 aa, Staphylococcus
NDLLAIDGVKSIFYVMDFLA

SEQ ID NO: 2077907 - protein, 17 aa, Staphylococcus
NDLLQMMIKTMEDRLNE

SEQ ID NO: 2077908 - protein, 21 aa, Staphylococcus
NDLTIPLLMAGGTLVLQRYFN

SEQ ID NO: 2077909 - protein, 26 aa, Staphylococcus
NDLTKHIFNIIYNGPLRIMIQNHYKR

SEQ ID NO: 2077910 - protein, 22 aa, Staphylococcus
NDLVIAIYYKEILKSLFQSWFD

SEQ ID NO: 2077911 - protein, 18 aa, Staphylococcus
NDMSMLERVGYPVAMANA

SEQ ID NO: 2077912 - protein, 26 aa, Staphylococcus
NDNAQGEYYLPDVLSLILEEGGKAEV

SEQ ID NO: 2077913 - protein, 28 aa, Staphylococcus
NDNAQSEYYLPDVLSLILEDRGIVEVFH

SEQ ID NO: 2077914 - protein, 28 aa, Staphylococcus
NDNEEKYLRLYAEFENYKRRIQKENETN

SEQ ID NO: 2077915 - protein, 29 aa, Staphylococcus
NDNEEKYLRLYAEFENYKRRIQNENQINK

SEQ ID NO: 2077916 - protein, 25 aa, Staphylococcus
NDNELEVCKYLKSLLSKYDIDSKIQ

SEQ ID NO: 2077917 - protein, 24 aa, Staphylococcus
NDNERTLLDWASKQTYIALANMMT

SEQ ID NO: 2077918 - protein, 24 aa, Staphylococcus
NDNERTLYDWASKQTYIALGNMMT

SEQ ID NO: 2077919 - protein, 27 aa, Staphylococcus
NDNGTKRLIFVTALNTLHEVPGKFGKW

SEQ ID NO: 2077920 - protein, 24 aa, Staphylococcus
NDNINLYISLYQSADARADRADKR

SEQ ID NO: 2077921 - protein, 26 aa, Staphylococcus
NDNKESFIDFYHKRLLVADKKPNIVH

SEQ ID NO: 2077922 - protein, 28 aa, Staphylococcus
NDNKESFIDFYHKRLLVADKKPNIVHEW

SEQ ID NO: 2077923 - protein, 24 aa, Staphylococcus
NDNKSQLAFLKLMENMFGNQPYSY

SEQ ID NO: 2077924 - protein, 29 aa, Staphylococcus
NDNLDQINWLGFYLIENNELILGPFQGHP

SEQ ID NO: 2077925 - protein, 23 aa, Staphylococcus
NDNLKKMVLLGPAGPSFVQRDGY

SEQ ID NO: 2077926 - protein, 21 aa, Staphylococcus
NDNVVFLRKWEDFGIRYGNVE

SEQ ID NO: 2077927 - protein, 26 aa, Staphylococcus
NDNYLKPVIIYFYGGGFINGHGTAEL

SEQ ID NO: 2077928 - protein, 18 aa, Staphylococcus
NDPALFDATIKHIVNFET

SEQ ID NO: 2077929 - protein, 17 aa, Staphylococcus
NDPELGKYWASLGDVFV

SEQ ID NO: 2077930 - protein, 23 aa, Staphylococcus
NDPFNVVYLVSKGKMYAHVLIKD

SEQ ID NO: 2077931 - protein, 32 aa, Staphylococcus
NDPNGLIFYNGTYYVSHQWFPLGAVHGLKYWF

SEQ ID NO: 2077932 - protein, 33 aa, Staphylococcus
NDPNGLIYFNGKYYVSHQWFPLGAVHGLKYWFN

SEQ ID NO: 2077933 - protein, 26 aa, Staphylococcus
NDQFEGFTFDYYISNPPFGVDWKKDQ

SEQ ID NO: 2077934 - protein, 22 aa, Staphylococcus
NDQKNIDNPHKDLRRARSCNES

SEQ ID NO: 2077935 - protein, 21 aa, Staphylococcus
NDQQIVVDKILLSVGRKPNTS

SEQ ID NO: 2077936 - protein, 31 aa, Staphylococcus
NDQSTTYDYIKYPFTYLSVGAANAFTTVQNT

SEQ ID NO: 2077937 - protein, 20 aa, Staphylococcus
NDRAMFAFGGYSVAMKNARQ

SEQ ID NO: 2077938 - protein, 29 aa, Staphylococcus
NDRARLKDIIDLFLDSGLGKEAFSIISQG

SEQ ID NO: 2077939 - protein, 29 aa, Staphylococcus
NDRARLKDIIEIFLDSGLGKEAFSIISQG

SEQ ID NO: 2077940 - protein, 24 aa, Staphylococcus
NDRPLALCAALLHDLGHGPFSHSF

SEQ ID NO: 2077941 - protein, 21 aa, Staphylococcus
NDRRYHPLEKLGRYLMDSFVN

SEQ ID NO: 2077942 - protein, 19 aa, Staphylococcus
NDRVLIIDDFLANGDASLG

SEQ ID NO: 2077943 - protein, 24 aa, Staphylococcus
NDSDKLLNYLKQKRKDILDNAYIM

SEQ ID NO: 2077944 - protein, 24 aa, Staphylococcus
NDSERTLLDWASKQTYIALANMMT

SEQ ID NO: 2077945 - protein, 17 aa, Staphylococcus
NDSIQSRGLFAMNGQSI

SEQ ID NO: 2077946 - protein, 20 aa, Staphylococcus
NDSIRMMWLSQNQKPSYKTI

SEQ ID NO: 2077947 - protein, 24 aa, Staphylococcus
NDSYSQLLEFAYPTDKSEVYLNDY

SEQ ID NO: 2077948 - protein, 29 aa, Staphylococcus
NDTEFGLASYFFTNDYRTGLKLFNELEYG

SEQ ID NO: 2077949 - protein, 25 aa, Staphylococcus
NDTEQRLFEEATYIYYLGRFIDSDS

SEQ ID NO: 2077950 - protein, 24 aa, Staphylococcus
NDTNANRIGVWIGSGIGGMETFEV

SEQ ID NO: 2077951 - protein, 31 aa, Staphylococcus
NDVALLDLLFASFKLGAVYLPINWRLKTQEI

SEQ ID NO: 2077952 - protein, 24 aa, Staphylococcus
NDVEIGSFILLDDGLVELEVKAKD

SEQ ID NO: 2077953 - protein, 19 aa, Staphylococcus
NDVFIPGKLVDYVVVNTNP

SEQ ID NO: 2077954 - protein, 18 aa, Staphylococcus
NDVFMINKFISAVEKEIG

SEQ ID NO: 2077955 - protein, 21 aa, Staphylococcus
NDVLDIYYSPIIMKKNRPATQ

SEQ ID NO: 2077956 - protein, 18 aa, Staphylococcus
NDVLVLVESLTLVDVDSL

SEQ ID NO: 2077957 - protein, 19 aa, Staphylococcus
NDVMGIPSILIFQNGEKLA

SEQ ID NO: 2077958 - protein, 21 aa, Staphylococcus
NDVMGIPSLLVFENGNKLAHL

SEQ ID NO: 2077959 - protein, 23 aa, Staphylococcus
NDVPDWYLDSCLKIKYMFPKAHA

SEQ ID NO: 2077960 - protein, 23 aa, Staphylococcus
NDVQVGSYILLDDGLVELEVKEI

SEQ ID NO: 2077961 - protein, 24 aa, Staphylococcus
NDVRIQKVIDLLRDNAKLVEAKSE

SEQ ID NO: 2077962 - protein, 25 aa, Staphylococcus
NDVRIQKVIDLLRDNAKYVDSAKDD

SEQ ID NO: 2077963 - protein, 25 aa, Staphylococcus
NDVRIQKVIDLLRDNAKYVESTKED

SEQ ID NO: 2077964 - protein, 25 aa, Staphylococcus
NDVTIISVFVNPLQFGPNEDYDAYP

SEQ ID NO: 2077965 - protein, 30 aa, Staphylococcus
NDVYERPKGKFRFPMRVLEEANDSLKTDDE

SEQ ID NO: 2077966 - protein, 28 aa, Staphylococcus
NDVYFVDGPLDLTMLFGLVGRLTPELSN

SEQ ID NO: 2077967 - protein, 30 aa, Staphylococcus
NDYEDLFNEKLQLLLKINQQPVISWEGTLR

SEQ ID NO: 2077968 - protein, 22 aa, Staphylococcus
NDYEDLFNEKLQMLLKINKHEI

SEQ ID NO: 2077969 - protein, 35 aa, Staphylococcus
NDYEHLLTEYGVWHPKAWNYAPRPIKLDIQPSNSL

SEQ ID NO: 2077970 - protein, 27 aa, Staphylococcus
NDYEKLYLTYLIQDLKLNKLDFIHKGM

SEQ ID NO: 2077971 - protein, 19 aa, Staphylococcus
NDYIFVIYKGKRKGMPYTQ

SEQ ID NO: 2077972 - protein, 20 aa, Staphylococcus
NDYLIVNQLIDLLNQRLNDI

SEQ ID NO: 2077973 - protein, 24 aa, Staphylococcus
NDYLKNMMFVLANNRHLALINDIF

SEQ ID NO: 2077974 - protein, 25 aa, Staphylococcus
NDYQMKFIFRDINGISIHMPSLCQQ

SEQ ID NO: 2077975 - protein, 23 aa, Staphylococcus
NDYSLMFVHPWQYEKVIPHQFAE

SEQ ID NO: 2077976 - protein, 18 aa, Staphylococcus
NDYWKYHDHWLGYCTNEL

SEQ ID NO: 2077977 - protein, 23 aa, Staphylococcus
NEADLLYIGFISTKGAINEGAER

SEQ ID NO: 2077978 - protein, 22 aa, Staphylococcus
NEADLNLYQFIEGYYKEHQAYY

SEQ ID NO: 2077979 - protein, 18 aa, Staphylococcus
NEAEKFILALGLNHVRVR

SEQ ID NO: 2077980 - protein, 26 aa, Staphylococcus
NEAQRAPFSSIYFLLNTGDISHFHRI

SEQ ID NO: 2077981 - protein, 33 aa, Staphylococcus
NEAVDVPYYFMAYSWWGNILNITRDYYKVGKID

SEQ ID NO: 2077982 - protein, 23 aa, Staphylococcus
NEAYIIRKHFFGKKVKLNMILNA

SEQ ID NO: 2077983 - protein, 24 aa, Staphylococcus
NEDAIKFPSFRPDSWRGKRYLYTG

SEQ ID NO: 2077984 - protein, 19 aa, Staphylococcus
NEDDIIVGMLPWKRINTVN

SEQ ID NO: 2077985 - protein, 18 aa, Staphylococcus
NEDFYLNDKIIAAAKNAG

SEQ ID NO: 2077986 - protein, 26 aa, Staphylococcus
NEDGTFSMQVPKLKPGTYTIAIESPN

SEQ ID NO: 2077987 - protein, 17 aa, Staphylococcus
NEDLGADMYQYLMKRLE

SEQ ID NO: 2077988 - protein, 24 aa, Staphylococcus
NEDNFDLWKKGMTGFPIIDAAMGE

SEQ ID NO: 2077989 - protein, 22 aa, Staphylococcus
NEDPHLYMIGNDAIGLGAISAG

SEQ ID NO: 2077990 - protein, 17 aa, Staphylococcus
NEDSIIFAMANPNPEIT

SEQ ID NO: 2077991 - protein, 31 aa, Staphylococcus
NEEAYELTLRDKVCWFYSRSKGRLWKKGESS

SEQ ID NO: 2077992 - protein, 20 aa, Staphylococcus
NEEDYEAIIQLLTFVDEEDL

SEQ ID NO: 2077993 - protein, 28 aa, Staphylococcus
NEEEDFVVEGPLWIQVHAFEKGVEVTIS

SEQ ID NO: 2077994 - protein, 26 aa, Staphylococcus
NEEEDFVVEGPLWIQVHAFEKGVEVV

SEQ ID NO: 2077995 - protein, 27 aa, Staphylococcus
NEEEKEMFLNLIKVTGIGPKSALAILA

SEQ ID NO: 2077996 - protein, 17 aa, Staphylococcus
NEELGCCLIYKTNDKQL

SEQ ID NO: 2077997 - protein, 33 aa, Staphylococcus
NEETGITFAGIPLGHEFNSLVLAILQVSGRAPK

SEQ ID NO: 2077998 - protein, 30 aa, Staphylococcus
NEFAEGYYLTKEGMEWFWNQYTTSEQERNE

SEQ ID NO: 2077999 - protein, 17 aa, Staphylococcus
NEFAFLKDVLNSVSAKV

SEQ ID NO: 2078000 - protein, 20 aa, Staphylococcus
NEFALQSCINCYLDTTKPND

SEQ ID NO: 2078001 - protein, 24 aa, Staphylococcus
NEFANIYALLIPKMGNLNDVRFLV

SEQ ID NO: 2078002 - protein, 26 aa, Staphylococcus
NEFDATYLIDGDWDYAYTGPQNHSIL

SEQ ID NO: 2078003 - protein, 20 aa, Staphylococcus
NEFEEWYKWLQKHNVNILEG

SEQ ID NO: 2078004 - protein, 29 aa, Staphylococcus
NEFEMGIDIDTLVKFNLKKGQVLEPSDME

SEQ ID NO: 2078005 - protein, 24 aa, Staphylococcus
NEFGPYIVIAPEIAIAHARPNGDV

SEQ ID NO: 2078006 - protein, 19 aa, Staphylococcus
NEFSIIHAHTLYTDGYQAY

SEQ ID NO: 2078007 - protein, 25 aa, Staphylococcus
NEFTETFLRPCHIAKMISRYMILNE

SEQ ID NO: 2078008 - protein, 24 aa, Staphylococcus
NEFTYDSALFRLALESRAMFPDLA

SEQ ID NO: 2078009 - protein, 30 aa, Staphylococcus
NEFYETHLSNLYIYKLAVIANMKLQSLSSC

SEQ ID NO: 2078010 - protein, 25 aa, Staphylococcus
NEGDIVVGMLPWKKINTVSTEHIDK

SEQ ID NO: 2078011 - protein, 26 aa, Staphylococcus
NEGQTLFFGGLARIDYISGGKRPLVC

SEQ ID NO: 2078012 - protein, 35 aa, Staphylococcus
NEHFFNTILKFVKKGVLYPLSYYDGDWFGKNAVNS

SEQ ID NO: 2078013 - protein, 35 aa, Staphylococcus
NEHFFNTILKFVKKGVLYPLSYYDGDWYGKNKVNS

SEQ ID NO: 2078014 - protein, 26 aa, Staphylococcus
NEHKKPIPRFPKKIAILTASTGAAIR

SEQ ID NO: 2078015 - protein, 24 aa, Staphylococcus
NEHLSLDLQILLWNMVKERDNQPH

SEQ ID NO: 2078016 - protein, 25 aa, Staphylococcus
NEHLSLDLQILLWNMVKERDNQPHT

SEQ ID NO: 2078017 - protein, 20 aa, Staphylococcus
NEHMYLITDAMRAKGMPESE

SEQ ID NO: 2078018 - protein, 29 aa, Staphylococcus
NEHNDWVNMLGVVPVIRALREKAMHIQQD

SEQ ID NO: 2078019 - protein, 25 aa, Staphylococcus
NEHRELFGDFPSKDFPLLCKIVDAR

SEQ ID NO: 2078020 - protein, 17 aa, Staphylococcus
NEHTIVIGPYYRGNNGS

SEQ ID NO: 2078021 - protein, 25 aa, Staphylococcus
NEHVELIEVPIKPSDRLKARDMLGK

SEQ ID NO: 2078022 - protein, 33 aa, Staphylococcus
NEIFNKVINFTILKKQFTLVYGSKHLTYIYQGI

SEQ ID NO: 2078023 - protein, 21 aa, Staphylococcus
NEIFRHIAYERPKFDIKINLT

SEQ ID NO: 2078024 - protein, 31 aa, Staphylococcus
NEIIKFIKFNIYHMAPILLYVKDKTFSTFYN

SEQ ID NO: 2078025 - protein, 44 aa, Staphylococcus
NEIIQITKKPIGVTAGIVPWNAPIMVLMRKVIPAVVTGCSVVIK

SEQ ID NO: 2078026 - protein, 26 aa, Staphylococcus
NEIIRDYLEFMAFLGVLPTYYKGKNR

SEQ ID NO: 2078027 - protein, 25 aa, Staphylococcus
NEILYMHHVSIVGLAFNFMCFQSVI

SEQ ID NO: 2078028 - protein, 27 aa, Staphylococcus
NEIMHMKYICLAGLAFNFMCFQDIAPT

SEQ ID NO: 2078029 - protein, 20 aa, Staphylococcus
NEITDIRWFDKSDTTLIAPA

SEQ ID NO: 2078030 - protein, 23 aa, Staphylococcus
NEITINDAFLYPKPQHFNYDMYG

SEQ ID NO: 2078031 - protein, 19 aa, Staphylococcus
NEITMDTLMAIAHYRNVGM

SEQ ID NO: 2078032 - protein, 40 aa, Staphylococcus
NEKDGRQAIKFLKQRGLGRATFLPLNVIRARSLSHHIQNV

SEQ ID NO: 2078033 - protein, 27 aa, Staphylococcus
NEKDIRAILGRFLFVQDDVKKVINDLS

SEQ ID NO: 2078034 - protein, 27 aa, Staphylococcus
NEKDIRAVLGRFLFVQDDVKKIINDLS

SEQ ID NO: 2078035 - protein, 35 aa, Staphylococcus
NEKGLLLLSAGIKGNVIRFLPPLVITDQELNKGLN

SEQ ID NO: 2078036 - protein, 26 aa, Staphylococcus
NEKIIGYIGIWLVIDQAQITTIAIDE

SEQ ID NO: 2078037 - protein, 23 aa, Staphylococcus
NEKIRKLLAFQTLYIGIDPKQGP

SEQ ID NO: 2078038 - protein, 22 aa, Staphylococcus
NEKKLQLMPLEQLKQVTGYVRG

SEQ ID NO: 2078039 - protein, 21 aa, Staphylococcus
NEKLIYNYEKALAAPGPLAHS

SEQ ID NO: 2078040 - protein, 24 aa, Staphylococcus
NEKNLWLHVKLDTGMGRLGIKSLE

SEQ ID NO: 2078041 - protein, 24 aa, Staphylococcus
NEKPLFILESLMLMVNKRKSAFKI

SEQ ID NO: 2078042 - protein, 23 aa, Staphylococcus
NEKRLWLHIKLDTGMGRLGIKNQ

SEQ ID NO: 2078043 - protein, 18 aa, Staphylococcus
NEKRYTLVFFNNIELMVE

SEQ ID NO: 2078044 - protein, 27 aa, Staphylococcus
NEKVKGLYLYGPFGTGKSFILGAVANQ

SEQ ID NO: 2078045 - protein, 17 aa, Staphylococcus
NEKVSIPSLYYSELKSV

SEQ ID NO: 2078046 - protein, 32 aa, Staphylococcus
NEKWNDVVFIFPISMKYLLPENAQFIPLCDDE

SEQ ID NO: 2078047 - protein, 24 aa, Staphylococcus
NEKWTKIRKQIRLKRTKIKKYKKQ

SEQ ID NO: 2078048 - protein, 24 aa, Staphylococcus
NEKYDLFVLVVTDIINSNSKILVV

SEQ ID NO: 2078049 - protein, 17 aa, Staphylococcus
NEKYRTWDWNYGKNPKY

SEQ ID NO: 2078050 - protein, 25 aa, Staphylococcus
NELDQFELQLLLDGPYDANNAIMEL

SEQ ID NO: 2078051 - protein, 24 aa, Staphylococcus
NELKQLNQWVLWRAEWNESRQEYK

SEQ ID NO: 2078052 - protein, 19 aa, Staphylococcus
NELLPLLIDNDNTIFSEQL

SEQ ID NO: 2078053 - protein, 17 aa, Staphylococcus
NELLRYVQKNFRKDFFN

SEQ ID NO: 2078054 - protein, 18 aa, Staphylococcus
NELMVAIQSPFLLDDEDD

SEQ ID NO: 2078055 - protein, 28 aa, Staphylococcus
NELPISAGFFIINPFEVVYYAGGTANEF

SEQ ID NO: 2078056 - protein, 19 aa, Staphylococcus
NELQFNDGLNFFVGNNNCG

SEQ ID NO: 2078057 - protein, 19 aa, Staphylococcus
NELQRIHPMLRCRFIDNHQ

SEQ ID NO: 2078058 - protein, 17 aa, Staphylococcus
NELRIGEALFRGIDTTT

SEQ ID NO: 2078059 - protein, 26 aa, Staphylococcus
NELSDYLPLMLQFLQTIEWRGDERAE

SEQ ID NO: 2078060 - protein, 26 aa, Staphylococcus
NELSDYLPLMLQFLQVARWENDVRAE

SEQ ID NO: 2078061 - protein, 30 aa, Staphylococcus
NELSITTSILTRVFGLDLFAEYLPSEDANE

SEQ ID NO: 2078062 - protein, 25 aa, Staphylococcus
NELSPDEIFPYAPPQGIEELRDLWQ

SEQ ID NO: 2078063 - protein, 20 aa, Staphylococcus
NELYRFPIMYLEYSGEYGDV

SEQ ID NO: 2078064 - protein, 23 aa, Staphylococcus
NEMEPLIITIKPGSSYKSFEPSE

SEQ ID NO: 2078065 - protein, 22 aa, Staphylococcus
NENEFNISLPFTNQFILKMERD

SEQ ID NO: 2078066 - protein, 29 aa, Staphylococcus
NENIDFLREGGLGLFLIESLMDEVTVCKE

SEQ ID NO: 2078067 - protein, 17 aa, Staphylococcus
NENIQVFKIGEGGLGGE

SEQ ID NO: 2078068 - protein, 40 aa, Staphylococcus
NENKSTILLPVPKTIYPLLNKVKFITKLYGNLVYGKDLYL

SEQ ID NO: 2078069 - protein, 28 aa, Staphylococcus
NENPVLEGFTLPKMLWVQQHEPNIWKNV

SEQ ID NO: 2078070 - protein, 21 aa, Staphylococcus
NENQFVFIEDLNIKYVQNDES

SEQ ID NO: 2078071 - protein, 25 aa, Staphylococcus
NENYKPEEEWWNWKGHRAHLDTFRN

SEQ ID NO: 2078072 - protein, 24 aa, Staphylococcus
NEPAFINILEFLAIEYAKNKGYHL

SEQ ID NO: 2078073 - protein, 34 aa, Staphylococcus
NEPFNTIILNYNPLLRLFLHRHELYEMNYWSLFD

SEQ ID NO: 2078074 - protein, 22 aa, Staphylococcus
NEPKHMLPYGLQAKIDCNKKQF

SEQ ID NO: 2078075 - protein, 18 aa, Staphylococcus
NEPKRLITVGLGNLKTLS

SEQ ID NO: 2078076 - protein, 24 aa, Staphylococcus
NEPPGARMRVALSGLTMAEHFRDV

SEQ ID NO: 2078077 - protein, 24 aa, Staphylococcus
NEPPGARMRVALSGLTMAEYFRDE

SEQ ID NO: 2078078 - protein, 25 aa, Staphylococcus
NEPPGARMRVALSGLTMAEYFRDEQ

SEQ ID NO: 2078079 - protein, 24 aa, Staphylococcus
NEPPGARMRVALSGLTMAEYFRDV

SEQ ID NO: 2078080 - protein, 25 aa, Staphylococcus
NEPSWMTDLRKEALKLTETLEMPKP

SEQ ID NO: 2078081 - protein, 24 aa, Staphylococcus
NEQAQLILQAMLVSLQTIEEEYKE

SEQ ID NO: 2078082 - protein, 24 aa, Staphylococcus
NEQERIWLNLKLYGYKQFEIQQLM

SEQ ID NO: 2078083 - protein, 25 aa, Staphylococcus
NEQGLLKNRYIGRTFITPDQSVREK

SEQ ID NO: 2078084 - protein, 19 aa, Staphylococcus
NEQHLLKRLEDQLFLVVEE

SEQ ID NO: 2078085 - protein, 21 aa, Staphylococcus
NEQIVLFLNQRGYSSFVLCRD

SEQ ID NO: 2078086 - protein, 17 aa, Staphylococcus
NEQLFLGSGIGVTPLVP

SEQ ID NO: 2078087 - protein, 23 aa, Staphylococcus
NEQMEEEMFLGLRMNQGVNKARF

SEQ ID NO: 2078088 - protein, 27 aa, Staphylococcus
NEQQFEKHMYAIHTLTSIYANNESKTA

SEQ ID NO: 2078089 - protein, 26 aa, Staphylococcus
NEQQFEKHMYAIHTLTSLYSDVSKRP

SEQ ID NO: 2078090 - protein, 28 aa, Staphylococcus
NEQQMIHQLTFKYPFIKNTQKPSKQSVS

SEQ ID NO: 2078091 - protein, 25 aa, Staphylococcus
NEREPSVLPARFPNLLVNGASGIAV

SEQ ID NO: 2078092 - protein, 30 aa, Staphylococcus
NERFIKSCPNLKWIAWYATGVNNLPLEYIK

SEQ ID NO: 2078093 - protein, 19 aa, Staphylococcus
NERFLEVWNLVFSEFNHNK

SEQ ID NO: 2078094 - protein, 23 aa, Staphylococcus
NERHLAALSFLTFVALDENGKPT

SEQ ID NO: 2078095 - protein, 18 aa, Staphylococcus
NESEHLQMFKNEIGNFVV

SEQ ID NO: 2078096 - protein, 18 aa, Staphylococcus
NESGALYYREGFITQLMP

SEQ ID NO: 2078097 - protein, 23 aa, Staphylococcus
NESGAYILSIRQLEQEKSYEYLQ

SEQ ID NO: 2078098 - protein, 22 aa, Staphylococcus
NESGAYILSKRQLETEKSYEYL

SEQ ID NO: 2078099 - protein, 17 aa, Staphylococcus
NESVIYLGTFSKTLMPS

SEQ ID NO: 2078100 - protein, 30 aa, Staphylococcus
NETDKILMALRPYQVYAVEALLNRAIETNN

SEQ ID NO: 2078101 - protein, 25 aa, Staphylococcus
NETDKLLMALRPYQVYAVESLLNRA

SEQ ID NO: 2078102 - protein, 25 aa, Staphylococcus
NETDTYMPTPIYFSHQLAKRLSDVR

SEQ ID NO: 2078103 - protein, 17 aa, Staphylococcus
NETGALYYREGFITQLM

SEQ ID NO: 2078104 - protein, 23 aa, Staphylococcus
NETGAYILSKRQLETEKSYEFLQ

SEQ ID NO: 2078105 - protein, 28 aa, Staphylococcus
NETIKGQVTILYFYPRDNTPTCTTEACD

SEQ ID NO: 2078106 - protein, 24 aa, Staphylococcus
NETKGVFFHERKALSHFEKRYAKR

SEQ ID NO: 2078107 - protein, 26 aa, Staphylococcus
NETLIKKYQLTPIIKKLLESKSITDD

SEQ ID NO: 2078108 - protein, 25 aa, Staphylococcus
NETLIRTILARMHFFRDDVYKPISV

SEQ ID NO: 2078109 - protein, 28 aa, Staphylococcus
NETLKGCKAILYFYPRDNTPTCTTEACD

SEQ ID NO: 2078110 - protein, 20 aa, Staphylococcus
NETMKLLKLLHLEAIKNQHP

SEQ ID NO: 2078111 - protein, 25 aa, Staphylococcus
NETMSELLLDFAYDTFKYEYERNNT

SEQ ID NO: 2078112 - protein, 26 aa, Staphylococcus
NETSGITFAGLPMGHEFNSLVLALLQ

SEQ ID NO: 2078113 - protein, 21 aa, Staphylococcus
NETYYIICKAGGRSAQVVQYL

SEQ ID NO: 2078114 - protein, 27 aa, Staphylococcus
NEVIGNPLLDKFIKDLIVQILAMVSEQ

SEQ ID NO: 2078115 - protein, 30 aa, Staphylococcus
NEVIGNPLLDKFMKDLIIQILAMVSEQERN

SEQ ID NO: 2078116 - protein, 19 aa, Staphylococcus
NEVLNLKRVQIGKLKLDSN

SEQ ID NO: 2078117 - protein, 31 aa, Staphylococcus
NEVLQAIKDAKFPVLLAGMRSSSEKETEAIR

SEQ ID NO: 2078118 - protein, 24 aa, Staphylococcus
NEVLYRKILEFYHPEFKKEYVILS

SEQ ID NO: 2078119 - protein, 26 aa, Staphylococcus
NEVNKIIKAIHFIGTFTVEFFIDQQN

SEQ ID NO: 2078120 - protein, 24 aa, Staphylococcus
NEVPDWYLDSCRKIKYMFPKAHAA

SEQ ID NO: 2078121 - protein, 27 aa, Staphylococcus
NEVQDLLIPLTFHFSKDEQLIIDQYRE

SEQ ID NO: 2078122 - protein, 26 aa, Staphylococcus
NEVQDLLIPLTFHFSKDEQMIIDQYQ

SEQ ID NO: 2078123 - protein, 23 aa, Staphylococcus
NEVRNMFGYTGTYKGKEISVMGS

SEQ ID NO: 2078124 - protein, 18 aa, Staphylococcus
NEVRNMFGYTGTYKGKEV

SEQ ID NO: 2078125 - protein, 18 aa, Staphylococcus
NEVSSRIIELDRGKLTTY

SEQ ID NO: 2078126 - protein, 20 aa, Staphylococcus
NEVTDIRWFNKSDTQYIAPA

SEQ ID NO: 2078127 - protein, 18 aa, Staphylococcus
NEWDIDLQHIYYVSKFDH

SEQ ID NO: 2078128 - protein, 24 aa, Staphylococcus
NEWDLDILRTFYVSKFDYPENQID

SEQ ID NO: 2078129 - protein, 17 aa, Staphylococcus
NEWNKEQFGDKLNLYRK

SEQ ID NO: 2078130 - protein, 20 aa, Staphylococcus
NEYDVFYKDHIYTTAFYDKH

SEQ ID NO: 2078131 - protein, 25 aa, Staphylococcus
NEYGTQWHTYYSDDYRAFVMVSYID

SEQ ID NO: 2078132 - protein, 22 aa, Staphylococcus
NEYLDDLGFNLVGYGCTTCIGN

SEQ ID NO: 2078133 - protein, 22 aa, Staphylococcus
NEYLIPLVIQLDEGIKKEDVES

SEQ ID NO: 2078134 - protein, 17 aa, Staphylococcus
NEYQGELIFLHKVKDGA

SEQ ID NO: 2078135 - protein, 20 aa, Staphylococcus
NEYRIYVRTLAQKIARKIDE

SEQ ID NO: 2078136 - protein, 24 aa, Staphylococcus
NEYSFLLSIIALLMNHIYYAENEE

SEQ ID NO: 2078137 - protein, 20 aa, Staphylococcus
NEYSMIAHIKPYSFKIEKGD

SEQ ID NO: 2078138 - protein, 19 aa, Staphylococcus
NFATEKPEYSFYNGVGIAF

SEQ ID NO: 2078139 - protein, 22 aa, Staphylococcus
NFATEPKILKQRSALAARLEPT

SEQ ID NO: 2078140 - protein, 25 aa, Staphylococcus
NFDDDLRYFLMQHTAVLLTSNRKLR

SEQ ID NO: 2078141 - protein, 17 aa, Staphylococcus
NFDDLIEPLGLIDLSEV

SEQ ID NO: 2078142 - protein, 17 aa, Staphylococcus
NFDEKVLIYVANYYEQL

SEQ ID NO: 2078143 - protein, 21 aa, Staphylococcus
NFDRYYNKYPTTQIEASGLDV

SEQ ID NO: 2078144 - protein, 27 aa, Staphylococcus
NFDSDLQYFLFQHIAVLLTANTKYRRA

SEQ ID NO: 2078145 - protein, 18 aa, Staphylococcus
NFDTLYQVLRTLQTNMKQ

SEQ ID NO: 2078146 - protein, 18 aa, Staphylococcus
NFDVKDLLTFKKEMIFYE

SEQ ID NO: 2078147 - protein, 22 aa, Staphylococcus
NFDYTDVIPLPTFTSLRKVSVK

SEQ ID NO: 2078148 - protein, 34 aa, Staphylococcus
NFEGRIHPLVKGNYLASPPLVVAYALAGTVDIDL

SEQ ID NO: 2078149 - protein, 24 aa, Staphylococcus
NFEKQSIYSLRYDEMQDWLVQNGQ

SEQ ID NO: 2078150 - protein, 34 aa, Staphylococcus
NFELNVFKPVILHNILQSIYLLADGMQTFNDNCA

SEQ ID NO: 2078151 - protein, 28 aa, Staphylococcus
NFELNVFKPVILHNTLQSIYLLADGMET

SEQ ID NO: 2078152 - protein, 33 aa, Staphylococcus
NFELNVFKPVILHNTLQSIYLLADGMQTFNDNC

SEQ ID NO: 2078153 - protein, 22 aa, Staphylococcus
NFELNVFKPVIMNDTLQSIYLL

SEQ ID NO: 2078154 - protein, 20 aa, Staphylococcus
NFEQYLDEWKPKIKKMIPSY

SEQ ID NO: 2078155 - protein, 17 aa, Staphylococcus
NFETAGPLYYRAEPVGC

SEQ ID NO: 2078156 - protein, 18 aa, Staphylococcus
NFFALGAYAQNLMLLLHE

SEQ ID NO: 2078157 - protein, 20 aa, Staphylococcus
NFFNIDEQLIFVDVPGYGYA

SEQ ID NO: 2078158 - protein, 17 aa, Staphylococcus
NFFNYLSGYSIKPEYNK

SEQ ID NO: 2078159 - protein, 19 aa, Staphylococcus
NFGAFVEIKPGVQGLVHIS

SEQ ID NO: 2078160 - protein, 20 aa, Staphylococcus
NFGMFIELPNTIEGMVHVSN

SEQ ID NO: 2078161 - protein, 26 aa, Staphylococcus
NFGVVIEEMRLLNRAVFVLDKNNKVV

SEQ ID NO: 2078162 - protein, 52 aa, Staphylococcus
NFIKFTEKWYFPLQPFQKFIVPFIFLFEKEGNFLYFEQFFITLGRGGGKNGF

SEQ ID NO: 2078163 - protein, 21 aa, Staphylococcus
NFIQELLVGTLPKQAVRQYLR

SEQ ID NO: 2078164 - protein, 18 aa, Staphylococcus
NFIYLITGPNMSGKSTYM

SEQ ID NO: 2078165 - protein, 26 aa, Staphylococcus
NFKAVELNLFFAICSLLKHCGSERMI

SEQ ID NO: 2078166 - protein, 25 aa, Staphylococcus
NFKELFQYIEQLFSRPLSPYEIETL

SEQ ID NO: 2078167 - protein, 27 aa, Staphylococcus
NFKEQIEEQMFLGLRMNKGVSKKTFEN

SEQ ID NO: 2078168 - protein, 24 aa, Staphylococcus
NFKGVNWSTRLWQDMALVQKEVET

SEQ ID NO: 2078169 - protein, 20 aa, Staphylococcus
NFKIGKFYAFKYDSKLVIHD

SEQ ID NO: 2078170 - protein, 19 aa, Staphylococcus
NFKIHKEDILPMDIIVIAR

SEQ ID NO: 2078171 - protein, 19 aa, Staphylococcus
NFKIKPEIAGLMISAIISD

SEQ ID NO: 2078172 - protein, 17 aa, Staphylococcus
NFKLIRNIDFGLIVLDE

SEQ ID NO: 2078173 - protein, 17 aa, Staphylococcus
NFKMKIVFLPESTKTQE

SEQ ID NO: 2078174 - protein, 19 aa, Staphylococcus
NFKNLRYTSSNFRNSMYDE

SEQ ID NO: 2078175 - protein, 25 aa, Staphylococcus
NFKQDKAIIILNYPNNPTGYTPTKE

SEQ ID NO: 2078176 - protein, 23 aa, Staphylococcus
NFKTKFMPFLESTHIYKIIVPAG

SEQ ID NO: 2078177 - protein, 24 aa, Staphylococcus
NFKVRFLINEVCHKYEIPWVYGAA

SEQ ID NO: 2078178 - protein, 33 aa, Staphylococcus
NFLDLFDEPLYIKIGMELYYQTGPELINRIKER

SEQ ID NO: 2078179 - protein, 24 aa, Staphylococcus
NFLEIPFDVYPQDAIMPLPFEEAD

SEQ ID NO: 2078180 - protein, 17 aa, Staphylococcus
NFLNAYVDYAPMPNARQ

SEQ ID NO: 2078181 - protein, 18 aa, Staphylococcus
NFLSSARAKWGERSGLTL

SEQ ID NO: 2078182 - protein, 18 aa, Staphylococcus
NFLSSSRAKWGERSGLTL

SEQ ID NO: 2078183 - protein, 19 aa, Staphylococcus
NFMPSPGQITQYLAPGGFG

SEQ ID NO: 2078184 - protein, 24 aa, Staphylococcus
NFNAIRTAHYPKAPLFYEMTDQYG

SEQ ID NO: 2078185 - protein, 32 aa, Staphylococcus
NFNAIRTAHYPKSPYFYELADKYGFYVMSEAD

SEQ ID NO: 2078186 - protein, 17 aa, Staphylococcus
NFNIFDKVLLGHLHHPF

SEQ ID NO: 2078187 - protein, 25 aa, Staphylococcus
NFNKDKVIMILNYPNNPTGYTPKAE

SEQ ID NO: 2078188 - protein, 26 aa, Staphylococcus
NFNQDKVILILNYPNNPTGYTPNNDE

SEQ ID NO: 2078189 - protein, 21 aa, Staphylococcus
NFNVNLFLRNAHRIPDYASNR

SEQ ID NO: 2078190 - protein, 17 aa, Staphylococcus
NFPFENIEWLIKEGYSL

SEQ ID NO: 2078191 - protein, 19 aa, Staphylococcus
NFRKALMIKVFAHTNEYDH

SEQ ID NO: 2078192 - protein, 23 aa, Staphylococcus
NFSKKLLIEIKTPSQYPGIEEMI

SEQ ID NO: 2078193 - protein, 17 aa, Staphylococcus
NFSKKLLIEIKVPHQYP

SEQ ID NO: 2078194 - protein, 26 aa, Staphylococcus
NFSTQLLDRFLVIAHSYNLSPSILVT

SEQ ID NO: 2078195 - protein, 25 aa, Staphylococcus
NFTEQQLLSLYLTLIESQSYSTLPY

SEQ ID NO: 2078196 - protein, 20 aa, Staphylococcus
NFTETGIFSVMWSEHCSYKH

SEQ ID NO: 2078197 - protein, 28 aa, Staphylococcus
NFTGDTLDHLWRVTSLNQAIALNIDTQT

SEQ ID NO: 2078198 - protein, 24 aa, Staphylococcus
NFTGNAYALFRKLIESYPEYKCHI

SEQ ID NO: 2078199 - protein, 29 aa, Staphylococcus
NFTKSIFIEEKLFKFVKRNKKAITKKFNN

SEQ ID NO: 2078200 - protein, 24 aa, Staphylococcus
NFVTNDIMLTWKNKAYFFHSKIQF

SEQ ID NO: 2078201 - protein, 19 aa, Staphylococcus
NFWECATAYLGKNAPSRDE

SEQ ID NO: 2078202 - protein, 17 aa, Staphylococcus
NFWLQLQADVFNAEIYK

SEQ ID NO: 2078203 - protein, 18 aa, Staphylococcus
NFWLQLQADVFNAEVTPL

SEQ ID NO: 2078204 - protein, 30 aa, Staphylococcus
NFYIISIEIVFFSLIQELYVPDSSFLFILN

SEQ ID NO: 2078205 - protein, 27 aa, Staphylococcus
NFYIISIEIVFFSLIQELYVPDSSLLG

SEQ ID NO: 2078206 - protein, 28 aa, Staphylococcus
NFYIISIEIVFFSLIQELYVPDSYSFII

SEQ ID NO: 2078207 - protein, 21 aa, Staphylococcus
NFYIPNFYVDMAELAEARGVD

SEQ ID NO: 2078208 - protein, 20 aa, Staphylococcus
NFYIPNYFIDMVKLAQARQV

SEQ ID NO: 2078209 - protein, 21 aa, Staphylococcus
NFYMLHKALFVNEKYKKLSDS

SEQ ID NO: 2078210 - protein, 19 aa, Staphylococcus
NFYNVLRHASSTYALIEGL

SEQ ID NO: 2078211 - protein, 21 aa, Staphylococcus
NFYVPKFYVDMAKLAEARQVD

SEQ ID NO: 2078212 - protein, 20 aa, Staphylococcus
NFYVPKYYVDMAKLAEARQV

SEQ ID NO: 2078213 - protein, 22 aa, Staphylococcus
NFYVPRFYVDMAKLAESRQVDP

SEQ ID NO: 2078214 - protein, 20 aa, Staphylococcus
NGADYIIYSIEELPGLIEEI

SEQ ID NO: 2078215 - protein, 22 aa, Staphylococcus
NGASFISYLSENQPPDIVLLDL

SEQ ID NO: 2078216 - protein, 25 aa, Staphylococcus
NGAVVFLGFDYGFRGNSRYLFNYFA

SEQ ID NO: 2078217 - protein, 25 aa, Staphylococcus
NGAVYYNLANLYYEQSRFQEAIKLY

SEQ ID NO: 2078218 - protein, 17 aa, Staphylococcus
NGDGRIVVYVAYELDRD

SEQ ID NO: 2078219 - protein, 25 aa, Staphylococcus
NGDIGIIVGIFWAKENALNKDVIIV

SEQ ID NO: 2078220 - protein, 25 aa, Staphylococcus
NGDIGIIVGIFWAKENALNKDVMVV

SEQ ID NO: 2078221 - protein, 24 aa, Staphylococcus
NGDIGVIQGIFWARENELNKDVLV

SEQ ID NO: 2078222 - protein, 25 aa, Staphylococcus
NGDIGVIVGIFWAKENALNKDVIVV

SEQ ID NO: 2078223 - protein, 25 aa, Staphylococcus
NGDIGVIVGIFWAKENALNKDVLII

SEQ ID NO: 2078224 - protein, 25 aa, Staphylococcus
NGDIGVIVGIFWAKENALNKDVLVV

SEQ ID NO: 2078225 - protein, 22 aa, Staphylococcus
NGDLELINKCLASRNGTGCYIQ

SEQ ID NO: 2078226 - protein, 28 aa, Staphylococcus
NGDLLFGTIDSWLVWKLSGKAAHITDYT

SEQ ID NO: 2078227 - protein, 28 aa, Staphylococcus
NGDLLFGTIDSWLVWKLSGKEAHITDYT

SEQ ID NO: 2078228 - protein, 28 aa, Staphylococcus
NGDLLFGTIDTWLVWKLSGGEAHITDYS

SEQ ID NO: 2078229 - protein, 20 aa, Staphylococcus
NGDLYVVFRVRPSKKFERDG

SEQ ID NO: 2078230 - protein, 37 aa, Staphylococcus
NGDNTKFFRTIMKYVRQGKIYPLSYYDGDWYGKNKVN

SEQ ID NO: 2078231 - protein, 22 aa, Staphylococcus
NGDVYFRTRQFKDYGKLSHQSI

SEQ ID NO: 2078232 - protein, 24 aa, Staphylococcus
NGEFAVLLMAGGQGTRLGYKGPKG

SEQ ID NO: 2078233 - protein, 26 aa, Staphylococcus
NGEHRYLFTGDFLCFEGDTWRTVILG

SEQ ID NO: 2078234 - protein, 26 aa, Staphylococcus
NGEHRYLFTGDFLCYEGDEWRTVILP

SEQ ID NO: 2078235 - protein, 33 aa, Staphylococcus
NGEIKGVAQLLFKKVPKLPYTLCYVSRGFVADY

SEQ ID NO: 2078236 - protein, 22 aa, Staphylococcus
NGEKILGAILFEQTMDREVEGK

SEQ ID NO: 2078237 - protein, 17 aa, Staphylococcus
NGELFGKHRYGEDCLLC

SEQ ID NO: 2078238 - protein, 18 aa, Staphylococcus
NGEPYLKATPQNFKMYKL

SEQ ID NO: 2078239 - protein, 23 aa, Staphylococcus
NGEQLRVWLYERNKRDDGKYHGV

SEQ ID NO: 2078240 - protein, 17 aa, Staphylococcus
NGEVRCEILNTGELKNK

SEQ ID NO: 2078241 - protein, 18 aa, Staphylococcus
NGFEIKGLNRATSTYKFA

SEQ ID NO: 2078242 - protein, 30 aa, Staphylococcus
NGFGFNPEFIRDAKYLEYTVGNPVLDASKF

SEQ ID NO: 2078243 - protein, 26 aa, Staphylococcus
NGFVGREITMQWANRFPEADIYITSR

SEQ ID NO: 2078244 - protein, 25 aa, Staphylococcus
NGGDFDVLPLIYQINDGPIKYYEYP

SEQ ID NO: 2078245 - protein, 20 aa, Staphylococcus
NGGKFNGIIPISQLSTHHIE

SEQ ID NO: 2078246 - protein, 28 aa, Staphylococcus
NGGYVKGPFPYFVSFIGHAPSKNPKVIV

SEQ ID NO: 2078247 - protein, 24 aa, Staphylococcus
NGHKSAVIWFTGLSGSGKSTISVA

SEQ ID NO: 2078248 - protein, 19 aa, Staphylococcus
NGHTIIVITHDYELLLSCA

SEQ ID NO: 2078249 - protein, 17 aa, Staphylococcus
NGIEIYYDRPKAGWIWN

SEQ ID NO: 2078250 - protein, 23 aa, Staphylococcus
NGIHKRWATLLSSLPVEAYNRTM

SEQ ID NO: 2078251 - protein, 22 aa, Staphylococcus
NGIIWPKSVTPFDLHLITINPK

SEQ ID NO: 2078252 - protein, 24 aa, Staphylococcus
NGIIWPKSVTPFDLHLITINPKKD

SEQ ID NO: 2078253 - protein, 17 aa, Staphylococcus
NGISRDIIYPLLEKMNL

SEQ ID NO: 2078254 - protein, 18 aa, Staphylococcus
NGISRDIIYPLLVKMNLR

SEQ ID NO: 2078255 - protein, 17 aa, Staphylococcus
NGKATPSFTLLTSDELN

SEQ ID NO: 2078256 - protein, 28 aa, Staphylococcus
NGKDVREYLPFESLILDLNQPFEVTETK

SEQ ID NO: 2078257 - protein, 22 aa, Staphylococcus
NGKGIYRFELEDLKGTIKEVQT

SEQ ID NO: 2078258 - protein, 22 aa, Staphylococcus
NGKIKIAHGIYPIPAPATAEIL

SEQ ID NO: 2078259 - protein, 20 aa, Staphylococcus
NGKIVPIDYILQTGDIIEIR

SEQ ID NO: 2078260 - protein, 24 aa, Staphylococcus
NGKMIIISYPLYKENKKLFYAAYE

SEQ ID NO: 2078261 - protein, 23 aa, Staphylococcus
NGKPLLYKLCLISPMLDATMTNP

SEQ ID NO: 2078262 - protein, 24 aa, Staphylococcus
NGKPLVCIGILKGSVMFMADLIKY

SEQ ID NO: 2078263 - protein, 25 aa, Staphylococcus
NGKPYDAIFPLLHGPNGEDGTIQGL

SEQ ID NO: 2078264 - protein, 19 aa, Staphylococcus
NGKPYIFYHEYRGNGHIHI

SEQ ID NO: 2078265 - protein, 24 aa, Staphylococcus
NGKQLINKLNAFGYTEEDVRSALS

SEQ ID NO: 2078266 - protein, 23 aa, Staphylococcus
NGKQLLKKLNAFGYTEADVRDAL

SEQ ID NO: 2078267 - protein, 23 aa, Staphylococcus
NGKRWFTKDVFAVNVKKIESKQD

SEQ ID NO: 2078268 - protein, 26 aa, Staphylococcus
NGKSRSIPIFVFMNSAYEQITVWGPR

SEQ ID NO: 2078269 - protein, 28 aa, Staphylococcus
NGKSVKGLYIYGPFGTGKSFILGAMANQ

SEQ ID NO: 2078270 - protein, 17 aa, Staphylococcus
NGKTLTIKLRKNAKWSN

SEQ ID NO: 2078271 - protein, 25 aa, Staphylococcus
NGKVIQLWHGTPIKRLFLDSKEPHQ

SEQ ID NO: 2078272 - protein, 22 aa, Staphylococcus
NGLALLGLMVKIKSLTPILHVD

SEQ ID NO: 2078273 - protein, 25 aa, Staphylococcus
NGLDNLIAGMRYAKARYGGRMLSTI

SEQ ID NO: 2078274 - protein, 18 aa, Staphylococcus
NGLFLKNGEWTRMVTEFP

SEQ ID NO: 2078275 - protein, 17 aa, Staphylococcus
NGLKRVIEYINSFHFSK

SEQ ID NO: 2078276 - protein, 26 aa, Staphylococcus
NGLLLKKHGQKLYDAGLRRINVSLDA

SEQ ID NO: 2078277 - protein, 24 aa, Staphylococcus
NGLYINQCKFLGFNDPDGTRFFSE

SEQ ID NO: 2078278 - protein, 24 aa, Staphylococcus
NGMKSIIQMLGTDQFKRIRIGVDR

SEQ ID NO: 2078279 - protein, 32 aa, Staphylococcus
NGMLNPKTLLDLIRYFVLFQDDGKGHISKILA

SEQ ID NO: 2078280 - protein, 31 aa, Staphylococcus; identical to SEQ ID NO: 1682271

SEQ ID NO: 2078281 - protein, 31 aa, Staphylococcus
NGMPIVVNGVMKPIPTLYKPLNSVDINTKES

SEQ ID NO: 2078282 - protein, 25 aa, Staphylococcus
NGMQTLGVALPWAISAALVRPNTQV

SEQ ID NO: 2078283 - protein, 26 aa, Staphylococcus
NGNEIGLILLKLRYENIKSKNKNTPL

SEQ ID NO: 2078284 - protein, 24 aa, Staphylococcus
NGNHVLTIPIYNHQLLFTRHKVRG

SEQ ID NO: 2078285 - protein, 30 aa, Staphylococcus
NGNKKLCFYSIRAPQSGLFKKIAGLDFIME

SEQ ID NO: 2078286 - protein, 27 aa, Staphylococcus
NGNLDNHFPLVVWQTGSGTQSNMNVNE

SEQ ID NO: 2078287 - protein, 22 aa, Staphylococcus
NGNLLVLDKSRYLDFEDFELEF

SEQ ID NO: 2078288 - protein, 19 aa, Staphylococcus
NGNPILEGFTLPKMMWVST

SEQ ID NO: 2078289 - protein, 17 aa, Staphylococcus
NGPFKVVNWQVEDKIQL

SEQ ID NO: 2078290 - protein, 17 aa, Staphylococcus
NGPGKWTKAFNIPRAID

SEQ ID NO: 2078291 - protein, 19 aa, Staphylococcus
NGPLHLEISLTRSKFEELA

SEQ ID NO: 2078292 - protein, 17 aa, Staphylococcus
NGQFYYRNIPYNEIESI

SEQ ID NO: 2078293 - protein, 23 aa, Staphylococcus
NGQIFIALAVKFSKARLIDNIIL

SEQ ID NO: 2078294 - protein, 24 aa, Staphylococcus
NGQTPFVTLGFGLGIDTLSRKIQQ

SEQ ID NO: 2078295 - protein, 25 aa, Staphylococcus
NGRFNYDILVVGLGFVSETFGIKGM

SEQ ID NO: 2078296 - protein, 22 aa, Staphylococcus
NGRFSPVVFKLASENQIDLSQV

SEQ ID NO: 2078297 - protein, 27 aa, Staphylococcus
NGRHELMDSVFLWQSGSKYRVAAHDAD

SEQ ID NO: 2078298 - protein, 27 aa, Staphylococcus
NGRHELMDSVFLWQSGTKYREMVHNAD

SEQ ID NO: 2078299 - protein, 26 aa, Staphylococcus
NGRHELMDSVFLWQSGTKYRVPTHDA

SEQ ID NO: 2078300 - protein, 23 aa, Staphylococcus
NGRINLCFEILENQIKIVISDQG

SEQ ID NO: 2078301 - protein, 20 aa, Staphylococcus
NGRKIIVLGDVLELGDNSQR

SEQ ID NO: 2078302 - protein, 24 aa, Staphylococcus
NGRPKHIYSIYRKMVKQKKQFDQI

SEQ ID NO: 2078303 - protein, 20 aa, Staphylococcus
NGRYVALYLTYEAAKFFNQE

SEQ ID NO: 2078304 - protein, 24 aa, Staphylococcus
NGSDAFKLYDTYGFPIELTEEIAT

SEQ ID NO: 2078305 - protein, 24 aa, Staphylococcus
NGSDAFKLYDTYGFPIELTEELAS

SEQ ID NO: 2078306 - protein, 25 aa, Staphylococcus
NGSDAFKLYDTYGFPIELTEELASQ

SEQ ID NO: 2078307 - protein, 24 aa, Staphylococcus
NGSGKIPYICYKTSNSRWVNIRTT

SEQ ID NO: 2078308 - protein, 23 aa, Staphylococcus
NGSKITYNYLIKDNPNLGDYVSE

SEQ ID NO: 2078309 - protein, 27 aa, Staphylococcus
NGSTSMLLLEPLLQQGYHKFYSYISPG

SEQ ID NO: 2078310 - protein, 25 aa, Staphylococcus
NGTAQIPRYFFLAENKEFEPGETYT

SEQ ID NO: 2078311 - protein, 26 aa, Staphylococcus
NGTARSIPIFVFLNDNFEQETVWGPR

SEQ ID NO: 2078312 - protein, 17 aa, Staphylococcus
NGTFDGVNFPESFKVFG

SEQ ID NO: 2078313 - protein, 24 aa, Staphylococcus
NGTGDIFMPLAQQLKDHFTVVAVD

SEQ ID NO: 2078314 - protein, 26 aa, Staphylococcus
NGTIVGFFTPELFHGVGTAGFHLHFV

SEQ ID NO: 2078315 - protein, 24 aa, Staphylococcus
NGTKSDHKYWSKVHPRAYVDFYKS

SEQ ID NO: 2078316 - protein, 20 aa, Staphylococcus
NGTQLPNMYGFQAEGASPIV

SEQ ID NO: 2078317 - protein, 26 aa, Staphylococcus
NGTVIGFFTPELFHGIGSGGFHIHFA

SEQ ID NO: 2078318 - protein, 24 aa, Staphylococcus
NGTYVIIDAIKDSLKRLIMPSIER

SEQ ID NO: 2078319 - protein, 18 aa, Staphylococcus
NGVDFHVHLFNSGQYGRK

SEQ ID NO: 2078320 - protein, 23 aa, Staphylococcus
NGVELRNRFVLAPLTHISSNDDG

SEQ ID NO: 2078321 - protein, 18 aa, Staphylococcus
NGVELWQRNTKDGKFWRI

SEQ ID NO: 2078322 - protein, 24 aa, Staphylococcus
NGVTLFEANSWFFGEGGIKLTIDQ

SEQ ID NO: 2078323 - protein, 17 aa, Staphylococcus
NGVYLAVPVFNDTYYIK

SEQ ID NO: 2078324 - protein, 17 aa, Staphylococcus
NGYDVIIGIRPGCSFDK

SEQ ID NO: 2078325 - protein, 23 aa, Staphylococcus
NGYHFFKYMRTYHPDKPVYYIIE

SEQ ID NO: 2078326 - protein, 23 aa, Staphylococcus
NGYKYKVLVLNYSPNLRLFLHRH

SEQ ID NO: 2078327 - protein, 25 aa, Staphylococcus
NGYRSLHIVVSIPVFLSNKVEKLPV

SEQ ID NO: 2078328 - protein, 24 aa, Staphylococcus
NGYRSLHIVVTIPVYLVHSVEIVP

SEQ ID NO: 2078329 - protein, 26 aa, Staphylococcus
NGYRSLHLVVTIPVFLSDSVQITPVE

SEQ ID NO: 2078330 - protein, 17 aa, Staphylococcus
NGYSLVRKLIKESGINL

SEQ ID NO: 2078331 - protein, 22 aa, Staphylococcus
NGYYIVVGERRFRASKLAGLEE

SEQ ID NO: 2078332 - protein, 24 aa, Staphylococcus
NHAHFVFVIPVRESLDMKAAAHAV

SEQ ID NO: 2078333 - protein, 21 aa, Staphylococcus
NHAPFANYWMHNGFINIDNEK

SEQ ID NO: 2078334 - protein, 18 aa, Staphylococcus
NHDAIWIGAYAGSKVCLA

SEQ ID NO: 2078335 - protein, 24 aa, Staphylococcus
NHEKNAFNGFLSKNVPMGEKIFDT

SEQ ID NO: 2078336 - protein, 26 aa, Staphylococcus
NHFETSVFPFILRGVSVVGLDSVMTP

SEQ ID NO: 2078337 - protein, 21 aa, Staphylococcus
NHFFFCGEILPHRTAKALVDR

SEQ ID NO: 2078338 - protein, 21 aa, Staphylococcus
NHFISCAGGIRFLAVKDGKNA

SEQ ID NO: 2078339 - protein, 22 aa, Staphylococcus
NHFISNLKGFRFNVNGTLPIDK

SEQ ID NO: 2078340 - protein, 24 aa, Staphylococcus
NHFKKNIFILTNSDDIPFLSEIVD

SEQ ID NO: 2078341 - protein, 20 aa, Staphylococcus
NHFYSAIFIPTAENYAYQLE

SEQ ID NO: 2078342 - protein, 18 aa, Staphylococcus
NHGHLYMTPIEELKQLRK

SEQ ID NO: 2078343 - protein, 17 aa, Staphylococcus
NHHALLFKDMDGLEILL

SEQ ID NO: 2078344 - protein, 18 aa, Staphylococcus
NHIDILLISEVNKVIFAI

SEQ ID NO: 2078345 - protein, 20 aa, Staphylococcus
NHINLYDALFAFATQIMAIY

SEQ ID NO: 2078346 - protein, 23 aa, Staphylococcus
NHIQPKLFIKFKSYGIQNEDIED

SEQ ID NO: 2078347 - protein, 33 aa, Staphylococcus
NHISSYGLILEPKTQFYNMYRKGKLKLPNEDLG

SEQ ID NO: 2078348 - protein, 18 aa, Staphylococcus
NHIVGTLIEYFRTLHLPE

SEQ ID NO: 2078349 - protein, 21 aa, Staphylococcus
NHIYAIGDLVKGYQLAHTASA

SEQ ID NO: 2078350 - protein, 17 aa, Staphylococcus
NHKKQFYVTLKLNNEII

SEQ ID NO: 2078351 - protein, 25 aa, Staphylococcus
NHKNLYDQTYYWVSNHKANGVFFSL

SEQ ID NO: 2078352 - protein, 36 aa, Staphylococcus
NHKVHDLLFSYLAIRIAMEWAIVEPYLPVSQPEDLN

SEQ ID NO: 2078353 - protein, 39 aa, Staphylococcus
NHLDFESINWLINYVKQYPYTVLFVTHDRYFLNEVSTRI

SEQ ID NO: 2078354 - protein, 37 aa, Staphylococcus
NHLDLETTKWLEDYLRYFKGAIVIISHDRYFLDKIVT

SEQ ID NO: 2078355 - protein, 24 aa, Staphylococcus
NHLEILNRLFTPMIGMNAIGLYHY

SEQ ID NO: 2078356 - protein, 19 aa, Staphylococcus
NHLHTMFGGILMANVDEIS

SEQ ID NO: 2078357 - protein, 24 aa, Staphylococcus
NHLLIAIPDVFWSFEISLATHINK

SEQ ID NO: 2078358 - protein, 19 aa, Staphylococcus
NHMLTLFTFHSGLSIIIEA

SEQ ID NO: 2078359 - protein, 33 aa, Staphylococcus
NHNIPLIVDNTFPTPYLLRPFEFGADIIVHSAT

SEQ ID NO: 2078360 - protein, 19 aa, Staphylococcus
NHNMSLIKDFFQVKDSLRW

SEQ ID NO: 2078361 - protein, 19 aa, Staphylococcus
NHQLLFTRHKVRGIEFPGG

SEQ ID NO: 2078362 - protein, 20 aa, Staphylococcus
NHQLLLSIHPSFSRLQLTNK

SEQ ID NO: 2078363 - protein, 21 aa, Staphylococcus
NHQLPSITLADNLRQLGFDVV

SEQ ID NO: 2078364 - protein, 17 aa, Staphylococcus
NHQNVLGVLPTGGGKSI

SEQ ID NO: 2078365 - protein, 17 aa, Staphylococcus
NHQPVIYCLDKIAEDYL

SEQ ID NO: 2078366 - protein, 20 aa, Staphylococcus
NHRDYHVMIIRGNKMMNLSN

SEQ ID NO: 2078367 - protein, 37 aa, Staphylococcus
NHRIIRLKLDGKSWGFQYSPYAYFPEHSIVLSEHHVP

SEQ ID NO: 2078368 - protein, 18 aa, Staphylococcus
NHRPIAAARYRSYQNKAK

SEQ ID NO: 2078369 - protein, 28 aa, Staphylococcus
NHRVDVAHIVLAFYLTKPSLDIVIPGAK

SEQ ID NO: 2078370 - protein, 18 aa, Staphylococcus
NHSDIQFDRLLNIDIDTF

SEQ ID NO: 2078371 - protein, 34 aa, Staphylococcus
NHSGIIDRYFFKSLYYRHNSIMFEFATAAPGFTV

SEQ ID NO: 2078372 - protein, 25 aa, Staphylococcus
NHSYRLYVDVLSPIGDYGLGLDFNE

SEQ ID NO: 2078373 - protein, 34 aa, Staphylococcus
NHTLEIIKRHRLLELFLIEILKYNWEEVHQEAEV

SEQ ID NO: 2078374 - protein, 20 aa, Staphylococcus
NHVHPLMFPSEQDGFRVINE

SEQ ID NO: 2078375 - protein, 20 aa, Staphylococcus
NHVHPLMFPTEQDGFRVINE

SEQ ID NO: 2078376 - protein, 19 aa, Staphylococcus
NHVKPHGALYNMGARDKDI

SEQ ID NO: 2078377 - protein, 20 aa, Staphylococcus
NHVYAIGDLVKGYQLAHSAS

SEQ ID NO: 2078378 - protein, 22 aa, Staphylococcus
NHYDLPVFITNYPTKIKPFYMQ

SEQ ID NO: 2078379 - protein, 23 aa, Staphylococcus
NHYDLPVFITNYPTQIKPFYMQP

SEQ ID NO: 2078380 - protein, 22 aa, Staphylococcus
NHYETEAIWQLFKDAGYDRVEF

SEQ ID NO: 2078381 - protein, 25 aa, Staphylococcus
NHYETEAIWQLFKDANYDRVNFETN

SEQ ID NO: 2078382 - protein, 25 aa, Staphylococcus
NHYETEAIWQLFKDANYERVDFETN

SEQ ID NO: 2078383 - protein, 20 aa, Staphylococcus
NHYLIHQFVSPYYNRRDDEW

SEQ ID NO: 2078384 - protein, 19 aa, Staphylococcus
NHYTICRPLLEVSKEDIRD

SEQ ID NO: 2078385 - protein, 31 aa, Staphylococcus
NIADDQLKHLPFISGFIGTCSFDLVRHEFPK

SEQ ID NO: 2078386 - protein, 18 aa, Staphylococcus
NIADKILIGGGMAYTFLK

SEQ ID NO: 2078387 - protein, 24 aa, Staphylococcus
NIAEMLSLRIAQGEQLIVVVSAMG

SEQ ID NO: 2078388 - protein, 18 aa, Staphylococcus
NIAHGIYPVPAPATAEIL

SEQ ID NO: 2078389 - protein, 20 aa, Staphylococcus
NIAKGYHFMVITDHSQSLKV

SEQ ID NO: 2078390 - protein, 21 aa, Staphylococcus
NIAKKILLHHQGRTYFFNNDT

SEQ ID NO: 2078391 - protein, 20 aa, Staphylococcus
NIALLFEKNSTRTRAAFTVA

SEQ ID NO: 2078392 - protein, 19 aa, Staphylococcus
NIAMVFQNYALYPHMTVYK

SEQ ID NO: 2078393 - protein, 22 aa, Staphylococcus
NIAQLILPKKTDKPLKGKELDQ

SEQ ID NO: 2078394 - protein, 18 aa, Staphylococcus
NIATGSITKRLGFEKGHV

SEQ ID NO: 2078395 - protein, 17 aa, Staphylococcus
NIAVFSATIPKSLHPFL

SEQ ID NO: 2078396 - protein, 20 aa, Staphylococcus
NIAVFSATIPKSLHPFLNKY

SEQ ID NO: 2078397 - protein, 23 aa, Staphylococcus
NIAVHPLYRRKGLGTYLMTWLFA

SEQ ID NO: 2078398 - protein, 19 aa, Staphylococcus
NIAYMLYAELKDPETPIRL

SEQ ID NO: 2078399 - protein, 19 aa, Staphylococcus
NIAYTLYNDLKDPDIPIRL

SEQ ID NO: 2078400 - protein, 22 aa, Staphylococcus
NIDFLREGGLGLFLIESLMDEV

SEQ ID NO: 2078401 - protein, 26 aa, Staphylococcus
NIDFLREGGLGLFLIESLMDEVKVFK

SEQ ID NO: 2078402 - protein, 26 aa, Staphylococcus
NIDFLREGGLGLFLIESLMDEVKVSK

SEQ ID NO: 2078403 - protein, 24 aa, Staphylococcus
NIDIDEDFLLVKREIFSSGKSICR

SEQ ID NO: 2078404 - protein, 24 aa, Staphylococcus
NIDIRTEALLFAASRREHLVEKVI

SEQ ID NO: 2078405 - protein, 20 aa, Staphylococcus
NIDKIDYIFCTFNTDLYYEK

SEQ ID NO: 2078406 - protein, 29 aa, Staphylococcus
NIDKIIKLQLEPNGLIRMYLEGCDYTYSS

SEQ ID NO: 2078407 - protein, 19 aa, Staphylococcus
NIDLYDGYSFIGLGSDGGF

SEQ ID NO: 2078408 - protein, 17 aa, Staphylococcus
NIDNPHKDLRRARSCGE

SEQ ID NO: 2078409 - protein, 23 aa, Staphylococcus
NIDNVLVKVLDPLFAGFTVVNDC

SEQ ID NO: 2078410 - protein, 20 aa, Staphylococcus
NIDNVLVKVLDPMFAGFTVS

SEQ ID NO: 2078411 - protein, 20 aa, Staphylococcus
NIDNYNFVAHSMGNLSFAYF

SEQ ID NO: 2078412 - protein, 24 aa, Staphylococcus
NIDPNIIQQVIFGNVLQSGVGQNP

SEQ ID NO: 2078413 - protein, 25 aa, Staphylococcus
NIDPNRLMVIKFFPYQTGHAAGIPK

SEQ ID NO: 2078414 - protein, 33 aa, Staphylococcus
NIDQFYQYILNPKVSKYQLFKNLFRNFVEQSQI

SEQ ID NO: 2078415 - protein, 19 aa, Staphylococcus
NIDQLLYTIADKLEEVKDI

SEQ ID NO: 2078416 - protein, 21 aa, Staphylococcus
NIDRSFVFVDKHNTLFHLFRK

SEQ ID NO: 2078417 - protein, 25 aa, Staphylococcus
NIDTYPMNWPIGMGQNFFGIIDRDS

SEQ ID NO: 2078418 - protein, 25 aa, Staphylococcus
NIDTYPMNWPIGMGQNFFGIIDRET

SEQ ID NO: 2078419 - protein, 26 aa, Staphylococcus
NIDTYPMNWPIGMGQNFFGIIDRKTK

SEQ ID NO: 2078420 - protein, 26 aa, Staphylococcus
NIDTYPMNWPVGMGQNFFGIIDRKSK

SEQ ID NO: 2078421 - protein, 17 aa, Staphylococcus
NIDYCIVINFSSRFADV

SEQ ID NO: 2078422 - protein, 25 aa, Staphylococcus
NIEFKMLCMGFTRKQIKKLTPEIIE

SEQ ID NO: 2078423 - protein, 27 aa, Staphylococcus
NIEGIEFVEFLISPNKGEPLKSLNKIA

SEQ ID NO: 2078424 - protein, 29 aa, Staphylococcus
NIEHRRWGAPFPVIEIVKRGINKARGIEQ

SEQ ID NO: 2078425 - protein, 30 aa, Staphylococcus
NIEHRRWGAPFPVIEIVKRGINKARGIKCV

SEQ ID NO: 2078426 - protein, 28 aa, Staphylococcus
NIEHRRWGAPFPVIEIVKRGISKARGID

SEQ ID NO: 2078427 - protein, 30 aa, Staphylococcus
NIEHRRWGAPFPVIEIVKRGISKARGIDVV

SEQ ID NO: 2078428 - protein, 30 aa, Staphylococcus
NIEHRRWGAPFPVIEIVKRGISKARGIDYV

SEQ ID NO: 2078429 - protein, 26 aa, Staphylococcus
NIEHRRWGSPFPVIEIVKQGISKARG

SEQ ID NO: 2078430 - protein, 19 aa, Staphylococcus
NIEIYPLANGGFDLVYDAN

SEQ ID NO: 2078431 - protein, 18 aa, Staphylococcus
NIELGPRDLLKSKEEIIT

SEQ ID NO: 2078432 - protein, 25 aa, Staphylococcus
NIELILNNQILIKLAFAFLEKQYEI

SEQ ID NO: 2078433 - protein, 27 aa, Staphylococcus
NIENGTILTFFNWPNAHKGRKGNGQVE

SEQ ID NO: 2078434 - protein, 31 aa, Staphylococcus
NIENIIFDFAKKGVAILWITHSDDQSMRHFK

SEQ ID NO: 2078435 - protein, 18 aa, Staphylococcus
NIEQLLYAIADKLDEVKD

SEQ ID NO: 2078436 - protein, 20 aa, Staphylococcus
NIERKWYVIDAEGQTLGRLS

SEQ ID NO: 2078437 - protein, 27 aa, Staphylococcus
NIESLFPIEDWIVAYDVYFKSMLGIDD

SEQ ID NO: 2078438 - protein, 30 aa, Staphylococcus
NIESSNIVKKLFLLGIMANINQSLDDETVE

SEQ ID NO: 2078439 - protein, 27 aa, Staphylococcus
NIETWEGSIYLRPWAGGRVGANEFSFY

SEQ ID NO: 2078440 - protein, 26 aa, Staphylococcus
NIETYPMNWPVGMGQNFFGIIDRATK

SEQ ID NO: 2078441 - protein, 24 aa, Staphylococcus
NIEYYRNIVANLALKRRLIQTADS

SEQ ID NO: 2078442 - protein, 17 aa, Staphylococcus
NIFFMMDLHFEEDPYHP

SEQ ID NO: 2078443 - protein, 17 aa, Staphylococcus
NIFFVENGKLVTPALNG

SEQ ID NO: 2078444 - protein, 26 aa, Staphylococcus
NIFKTAFWMDEARIWEIGYPRNDVLV

SEQ ID NO: 2078445 - protein, 23 aa, Staphylococcus
NIGFGYIGFDALNYVVHHDTFKD

SEQ ID NO: 2078446 - protein, 19 aa, Staphylococcus
NIGFRFPTYYGRPDYYTFV

SEQ ID NO: 2078447 - protein, 18 aa, Staphylococcus
NIGIIGLTTQYIPHWERP

SEQ ID NO: 2078448 - protein, 18 aa, Staphylococcus
NIGIMLPSLSDLADLLVQ

SEQ ID NO: 2078449 - protein, 25 aa, Staphylococcus
NIGVPLDLPALFKGYYKDEARTKAA

SEQ ID NO: 2078450 - protein, 21 aa, Staphylococcus
NIHDGYYGLLLRPENVCTSHK

SEQ ID NO: 2078451 - protein, 23 aa, Staphylococcus
NIHDIKILKPFGTDFEKPLFELD

SEQ ID NO: 2078452 - protein, 17 aa, Staphylococcus
NIHFEVIKPPKDVDVFL

SEQ ID NO: 2078453 - protein, 34 aa, Staphylococcus
NIHFGVIQPPENVDVFLVAPKGPGHLVRRTFAEG

SEQ ID NO: 2078454 - protein, 17 aa, Staphylococcus
NIHFGVITPPENVDVFL

SEQ ID NO: 2078455 - protein, 18 aa, Staphylococcus
NIHHSFLPSFIGANPYKQ

SEQ ID NO: 2078456 - protein, 18 aa, Staphylococcus
NIHTLRHSYASYLANNGV

SEQ ID NO: 2078457 - protein, 32 aa, Staphylococcus
NIHVKQLIRCCRYFIDLIRQSEFGRIIVISSI

SEQ ID NO: 2078458 - protein, 29 aa, Staphylococcus
NIIEFEMIPLLKEYWFDDLSKVDSWKVRL

SEQ ID NO: 2078459 - protein, 19 aa, Staphylococcus
NIIELFKDKDADLIAFGHN

SEQ ID NO: 2078460 - protein, 22 aa, Staphylococcus
NIIKNFLSSDILLSPNPHTSKI

SEQ ID NO: 2078461 - protein, 19 aa, Staphylococcus
NIIPDFTHARFYTRATTRK

SEQ ID NO: 2078462 - protein, 19 aa, Staphylococcus
NIIPDYTHARFYTRATSRK

SEQ ID NO: 2078463 - protein, 28 aa, Staphylococcus
NIKANSLKFMLKVFLELGFINEDDGIIT

SEQ ID NO: 2078464 - protein, 25 aa, Staphylococcus
NIKCIRRIMRILGLQAQIRKKRPNW

SEQ ID NO: 2078465 - protein, 36 aa, Staphylococcus
NIKDYLHPFQYQNALSLLRKLYLNKVAMLSDSVGLG

SEQ ID NO: 2078466 - protein, 30 aa, Staphylococcus
NIKELTYADYLIIWGNVFQFLKQEHITEAE

SEQ ID NO: 2078467 - protein, 19 aa, Staphylococcus
NIKFQMPLFPMIDDTCATP

SEQ ID NO: 2078468 - protein, 17 aa, Staphylococcus
NIKGSIVGFFTPELFHG

SEQ ID NO: 2078469 - protein, 22 aa, Staphylococcus
NIKGYTRRDSAYWRDIAFGVSE

SEQ ID NO: 2078470 - protein, 20 aa, Staphylococcus
NIKIYKGDFLAIVGPNGAGK

SEQ ID NO: 2078471 - protein, 24 aa, Staphylococcus
NIKQAWWKKFISQSPYNVGLDAAI

SEQ ID NO: 2078472 - protein, 25 aa, Staphylococcus
NIKTYPMNWPVGMGQNFFGIIDREQ

SEQ ID NO: 2078473 - protein, 28 aa, Staphylococcus
NIKVLVDYRFKAKNFKAIVANRVKSYTP

SEQ ID NO: 2078474 - protein, 24 aa, Staphylococcus
NIKWQLGHLILLNDFLVFETINGD

SEQ ID NO: 2078475 - protein, 21 aa, Staphylococcus
NIKYILYVRQQLDDVPICVEF

SEQ ID NO: 2078476 - protein, 26 aa, Staphylococcus
NIKYTVVPMWVFKIGSLFNKQVKELM

SEQ ID NO: 2078477 - protein, 17 aa, Staphylococcus
NILFVLGGAFDGIDEVI

SEQ ID NO: 2078478 - protein, 17 aa, Staphylococcus
NILGLNVATKRQALRFG

SEQ ID NO: 2078479 - protein, 25 aa, Staphylococcus
NILGLSYVQAILKSAPTIQPFSIQR

SEQ ID NO: 2078480 - protein, 17 aa, Staphylococcus
NILLIGDGSFQLTVQEL

SEQ ID NO: 2078481 - protein, 21 aa, Staphylococcus
NILPIIAKSFAPYLKEKKNHV

SEQ ID NO: 2078482 - protein, 26 aa, Staphylococcus
NILQIRRFMSLLETDLYFINLDLISL

SEQ ID NO: 2078483 - protein, 29 aa, Staphylococcus
NILRDLNEIYDFILIDTPPVISVTDAQVY

SEQ ID NO: 2078484 - protein, 17 aa, Staphylococcus
NILTGIISCPQCSAPMA

SEQ ID NO: 2078485 - protein, 17 aa, Staphylococcus
NILVKDINNLEKHITSQ

SEQ ID NO: 2078486 - protein, 18 aa, Staphylococcus
NILYGKQALIACFLEKLH

SEQ ID NO: 2078487 - protein, 22 aa, Staphylococcus
NILYQHGTLGTLMAGLLKGTAS

SEQ ID NO: 2078488 - protein, 19 aa, Staphylococcus
NIMIIFAGYPKEMDELMRI

SEQ ID NO: 2078489 - protein, 19 aa, Staphylococcus
NIMKIKPVGTLVDGSLEIV

SEQ ID NO: 2078490 - protein, 17 aa, Staphylococcus
NIMPVWSDYKSAEKVRD

SEQ ID NO: 2078491 - protein, 24 aa, Staphylococcus
NINISKRNMLLNQLLTHCKSLLYQ

SEQ ID NO: 2078492 - protein, 25 aa, Staphylococcus
NINLALRARYLFEVDIDYYVLKGEI

SEQ ID NO: 2078493 - protein, 21 aa, Staphylococcus
NINNLYKGQMLAHEINLGDGN

SEQ ID NO: 2078494 - protein, 30 aa, Staphylococcus
NINNNYLYYYLSLQNNHFLKYAVGSTVKSL

SEQ ID NO: 2078495 - protein, 23 aa, Staphylococcus
NINSFPFSPTWGEINYLAFDIVN

SEQ ID NO: 2078496 - protein, 31 aa, Staphylococcus
NINSLPEEIIPIIWIAFKTGLRISDVLTLKD

SEQ ID NO: 2078497 - protein, 18 aa, Staphylococcus
NINSPTFNIIKSYKGKEL

SEQ ID NO: 2078498 - protein, 21 aa, Staphylococcus
NINYILYVRQQLEDIPMCVEF

SEQ ID NO: 2078499 - protein, 23 aa, Staphylococcus
NINYRYRMIVLRPGKGLAGLVIR

SEQ ID NO: 2078500 - protein, 17 aa, Staphylococcus
NIPFITNHEINLVGIFR

SEQ ID NO: 2078501 - protein, 20 aa, Staphylococcus
NIPFRIRKPLPNITIHQVEV

SEQ ID NO: 2078502 - protein, 19 aa, Staphylococcus
NIPIATVMTDYRLHKNWVT

SEQ ID NO: 2078503 - protein, 19 aa, Staphylococcus
NIPLNVFSIMEEGNIKRAV

SEQ ID NO: 2078504 - protein, 19 aa, Staphylococcus
NIPTFYIVNVGGGYLDGDR

SEQ ID NO: 2078505 - protein, 24 aa, Staphylococcus
NIQIPRLMLGFKNIPPEGSKEMFM

SEQ ID NO: 2078506 - protein, 24 aa, Staphylococcus
NIQKAVAEMKLAIGLLVEKKLSHM

SEQ ID NO: 2078507 - protein, 23 aa, Staphylococcus
NIQKAVAEMKLAVGLLVEKKLSH

SEQ ID NO: 2078508 - protein, 20 aa, Staphylococcus
NIQQIFPKQSLPYNIEILAN

SEQ ID NO: 2078509 - protein, 18 aa, Staphylococcus
NIQVFKIGEGGLGGELHL

SEQ ID NO: 2078510 - protein, 20 aa, Staphylococcus
NIQVYILSGMQLCGVGVSGE

SEQ ID NO: 2078511 - protein, 23 aa, Staphylococcus
NIQYRILNALIKENIWQEQTIIT

SEQ ID NO: 2078512 - protein, 20 aa, Staphylococcus
NIRLDIMSGRRYQLKRRESI

SEQ ID NO: 2078513 - protein, 25 aa, Staphylococcus
NIRQYGHLLADIYPVNRPQRENVPK

SEQ ID NO: 2078514 - protein, 17 aa, Staphylococcus
NISLIFKGQTETTIDEA

SEQ ID NO: 2078515 - protein, 21 aa, Staphylococcus
NISLINIYVLIDIANAHLSED

SEQ ID NO: 2078516 - protein, 17 aa, Staphylococcus
NISLIPQVADAVSIPIV

SEQ ID NO: 2078517 - protein, 18 aa, Staphylococcus
NISNVYFKLKDHYKWFIF

SEQ ID NO: 2078518 - protein, 17 aa, Staphylococcus
NISPFIDNLPGKKDTTH

SEQ ID NO: 2078519 - protein, 28 aa, Staphylococcus
NISVNQLMKYIKGPDFPTGGIIQGIDGI

SEQ ID NO: 2078520 - protein, 18 aa, Staphylococcus
NITFFENLFKKALEEREY

SEQ ID NO: 2078521 - protein, 18 aa, Staphylococcus
NITFLPEEINVNAFVRPS

SEQ ID NO: 2078522 - protein, 24 aa, Staphylococcus
NITFPSDFKVFGSSDSKVIFCEAD

SEQ ID NO: 2078523 - protein, 20 aa, Staphylococcus
NITIHGIGDALKMARRRQSP

SEQ ID NO: 2078524 - protein, 20 aa, Staphylococcus
NITIHGIGDALKMAYRRQSS

SEQ ID NO: 2078525 - protein, 17 aa, Staphylococcus
NITILRPTMIYGSSRDR

SEQ ID NO: 2078526 - protein, 24 aa, Staphylococcus
NITNYLRRINRKTALLIQLATEVG

SEQ ID NO: 2078527 - protein, 17 aa, Staphylococcus
NITTLLASAVKNLPLIK

SEQ ID NO: 2078528 - protein, 19 aa, Staphylococcus
NITYIRYVREQLKDFPICV

SEQ ID NO: 2078529 - protein, 29 aa, Staphylococcus
NIVEKMVEGRLRKYLQEICAVDQNFVKDP

SEQ ID NO: 2078530 - protein, 26 aa, Staphylococcus
NIVELRIPLVYFYMKDTQFFYHYFDR

SEQ ID NO: 2078531 - protein, 19 aa, Staphylococcus
NIVFDAMLASYIFDPSRTI

SEQ ID NO: 2078532 - protein, 18 aa, Staphylococcus
NIVKLDVLRFTSGAPSKV

SEQ ID NO: 2078533 - protein, 18 aa, Staphylococcus
NIVNFHTLITTKASRIRQ

SEQ ID NO: 2078534 - protein, 31 aa, Staphylococcus
NIVNWCQLLLSNRSMALIALVDLMKTAKNKK

SEQ ID NO: 2078535 - protein, 20 aa, Staphylococcus
NIVPWQQLAKRKKASLKFIP

SEQ ID NO: 2078536 - protein, 18 aa, Staphylococcus
NIVSLMIEYLRFAQSESI

SEQ ID NO: 2078537 - protein, 17 aa, Staphylococcus
NIVTKYCSLYLEKQNRD

SEQ ID NO: 2078538 - protein, 26 aa, Staphylococcus
NIYDRHQFIYYIPQVKQRIIPRESQY

SEQ ID NO: 2078539 - protein, 22 aa, Staphylococcus
NIYIQNQLLRILNAIGIDVDNE

SEQ ID NO: 2078540 - protein, 17 aa, Staphylococcus
NIYMTLITIVNQIFRFK

SEQ ID NO: 2078541 - protein, 26 aa, Staphylococcus
NIYNTWNSDKFFSLVKEFELPTHNQI

SEQ ID NO: 2078542 - protein, 19 aa, Staphylococcus
NIYNVEDLVLYLPVRYEDN

SEQ ID NO: 2078543 - protein, 20 aa, Staphylococcus
NIYQEDFFFYAQTVSRIDQN

SEQ ID NO: 2078544 - protein, 22 aa, Staphylococcus
NIYQQLVTIFINLSRTLEDRYE

SEQ ID NO: 2078545 - protein, 22 aa, Staphylococcus
NIYTGSLYLSLISLLENHELSS

SEQ ID NO: 2078546 - protein, 18 aa, Staphylococcus
NKAFDGFKVERVNDLFYA

SEQ ID NO: 2078547 - protein, 21 aa, Staphylococcus
NKAIIDGASFIRSHYFDQGQV

SEQ ID NO: 2078548 - protein, 26 aa, Staphylococcus
NKAKTILALLSWLHQYDFDYKAIADK

SEQ ID NO: 2078549 - protein, 29 aa, Staphylococcus
NKAQYSFLNLLKYMFKDEPYRHLATGQIE

SEQ ID NO: 2078550 - protein, 23 aa, Staphylococcus
NKAQYTLVKMLASKFKNLCVVGD

SEQ ID NO: 2078551 - protein, 18 aa, Staphylococcus
NKARLKGIFLTHGHEHAI

SEQ ID NO: 2078552 - protein, 25 aa, Staphylococcus
NKDERELIRIFGKRGHGLYQKARGI

SEQ ID NO: 2078553 - protein, 23 aa, Staphylococcus
NKDETYYIICAAGARSAKVVEYL

SEQ ID NO: 2078554 - protein, 23 aa, Staphylococcus
NKDIQALLSTYLPSDLKIKTNQL

SEQ ID NO: 2078555 - protein, 21 aa, Staphylococcus
NKDKEVIGFFVLHQYYQHEGY

SEQ ID NO: 2078556 - protein, 25 aa, Staphylococcus
NKDNDLEFATINPVAMLGPSLDSHV

SEQ ID NO: 2078557 - protein, 21 aa, Staphylococcus
NKDNFDIVNHYTYVLASDGDL

SEQ ID NO: 2078558 - protein, 24 aa, Staphylococcus
NKEAQLILQAMLVSLQTIEEEYNE

SEQ ID NO: 2078559 - protein, 24 aa, Staphylococcus
NKEDIQLLKKHWLEVVDYAKKNDK

SEQ ID NO: 2078560 - protein, 17 aa, Staphylococcus
NKEELIASWIQWGNFSM

SEQ ID NO: 2078561 - protein, 20 aa, Staphylococcus
NKEFSTFDAWLPYLNQLNAA

SEQ ID NO: 2078562 - protein, 27 aa, Staphylococcus
NKEIIELITFTLFTTAQQHLGAILKLS

SEQ ID NO: 2078563 - protein, 25 aa, Staphylococcus
NKEKYPMILNDIVKYELYLLDGCNN

SEQ ID NO: 2078564 - protein, 17 aa, Staphylococcus
NKELMINDLKYLCNEDS

SEQ ID NO: 2078565 - protein, 23 aa, Staphylococcus
NKELRHNPMPFKQGVNSFKMSKD

SEQ ID NO: 2078566 - protein, 24 aa, Staphylococcus
NKELYILGVTDRISRLFDITGLKD

SEQ ID NO: 2078567 - protein, 24 aa, Staphylococcus
NKENLYSRFLTLASYNLENAEKEF

SEQ ID NO: 2078568 - protein, 22 aa, Staphylococcus
NKERTWLKRRIETPYRANINND

SEQ ID NO: 2078569 - protein, 21 aa, Staphylococcus
NKERVWLKRRIETPYKANLNN

SEQ ID NO: 2078570 - protein, 19 aa, Staphylococcus
NKERVWLKRRIETPYKATL

SEQ ID NO: 2078571 - protein, 23 aa, Staphylococcus
NKETQQVIFIDYLQLMQTDSKLD

SEQ ID NO: 2078572 - protein, 22 aa, Staphylococcus
NKFINCVGGIRFLGVKDGKNAA

SEQ ID NO: 2078573 - protein, 19 aa, Staphylococcus
NKFLPNFEKQSIYSLRYDE

SEQ ID NO: 2078574 - protein, 26 aa, Staphylococcus
NKFSTVDLGFVQWGFHQRANESYIEY

SEQ ID NO: 2078575 - protein, 18 aa, Staphylococcus
NKGELTFFISSMLDLIYE

SEQ ID NO: 2078576 - protein, 19 aa, Staphylococcus
NKGIYLLDVPLEDYQSHHE

SEQ ID NO: 2078577 - protein, 24 aa, Staphylococcus
NKGKAIHALFQWLNQFNFDYENIA

SEQ ID NO: 2078578 - protein, 25 aa, Staphylococcus
NKGWELAKPIHIGSNIWFGASVTVT

SEQ ID NO: 2078579 - protein, 27 aa, Staphylococcus
NKHAVLYICRKLGITFYLLVEQKANIS

SEQ ID NO: 2078580 - protein, 21 aa, Staphylococcus
NKIGFVYSETYFNEKWTIKKL

SEQ ID NO: 2078581 - protein, 27 aa, Staphylococcus
NKIIGFAYCYTLLRPDGKTMFYLHSIG

SEQ ID NO: 2078582 - protein, 24 aa, Staphylococcus
NKILDDILPEAFALVREGSKRVFN

SEQ ID NO: 2078583 - protein, 17 aa, Staphylococcus
NKIWIQEGIRKQQINDI

SEQ ID NO: 2078584 - protein, 18 aa, Staphylococcus
NKKAPYEQRMPKIVIVID

SEQ ID NO: 2078585 - protein, 21 aa, Staphylococcus
NKKARAIFNHGMTPIICVGES

SEQ ID NO: 2078586 - protein, 23 aa, Staphylococcus
NKKARLSEFKKYKDYVAKSVVKQ

SEQ ID NO: 2078587 - protein, 33 aa, Staphylococcus
NKKAVQWEIMYVDRGFIFTSHRGNSLPLTSINR

SEQ ID NO: 2078588 - protein, 22 aa, Staphylococcus
NKKFSLLFIAQGKGFISKGGIE

SEQ ID NO: 2078589 - protein, 21 aa, Staphylococcus
NKKILLEYVSANPTGDLHIGH

SEQ ID NO: 2078590 - protein, 18 aa, Staphylococcus
NKKKVIYYSYWGDQYSCS

SEQ ID NO: 2078591 - protein, 25 aa, Staphylococcus
NKKNVKRLIFVAAPGIYDELPDKFN

SEQ ID NO: 2078592 - protein, 25 aa, Staphylococcus
NKKPMLVAGDIYRPAAIDQLQTVGK

SEQ ID NO: 2078593 - protein, 18 aa, Staphylococcus
NKKQYLYTYKRLVNFNIP

SEQ ID NO: 2078594 - protein, 23 aa, Staphylococcus
NKKTIPRFPKKIAVLTASTGAAI

SEQ ID NO: 2078595 - protein, 23 aa, Staphylococcus
NKLDELMKLYNYKEIRTPIFEST

SEQ ID NO: 2078596 - protein, 23 aa, Staphylococcus
NKLDQLMEIYNYQEIRTPIFEST

SEQ ID NO: 2078597 - protein, 33 aa, Staphylococcus; identical to SEQ ID NO: 1681196

SEQ ID NO: 2078598 - protein, 32 aa, Staphylococcus
NKLINLLLKEKPDLILMTFPTPVMSVLTEQFN

SEQ ID NO: 2078599 - protein, 34 aa, Staphylococcus
NKLKMGTVWINDFHPYFAQAPWGGYKQSGIGREL

SEQ ID NO: 2078600 - protein, 23 aa, Staphylococcus
NKLSPDAIITYAIYLSRYEYSVF

SEQ ID NO: 2078601 - protein, 21 aa, Staphylococcus
NKMLQRIYGTAFFDKKDLKAH

SEQ ID NO: 2078602 - protein, 22 aa, Staphylococcus
NKMRRIYKNKLTFILEKLTPYK

SEQ ID NO: 2078603 - protein, 21 aa, Staphylococcus
NKMTEGIKHLPAKKITIETDP

SEQ ID NO: 2078604 - protein, 27 aa, Staphylococcus
NKNDYEHMLFYFAYKTFTLTANEIIEQ

SEQ ID NO: 2078605 - protein, 24 aa, Staphylococcus
NKNELVSFAIKQLDKAAQSNLIHS

SEQ ID NO: 2078606 - protein, 20 aa, Staphylococcus
NKNFAIGKLLQIFEESPERV

SEQ ID NO: 2078607 - protein, 22 aa, Staphylococcus
NKNFDIFSFLEEKLKLVVHKNH

SEQ ID NO: 2078608 - protein, 21 aa, Staphylococcus
NKNFRIDYELPMNFISQSQGG

SEQ ID NO: 2078609 - protein, 23 aa, Staphylococcus
NKNIENIMFLKKQNIKSINLINS

SEQ ID NO: 2078610 - protein, 24 aa, Staphylococcus
NKNIQYTQIYTEPIYLVVPPQHHL

SEQ ID NO: 2078611 - protein, 17 aa, Staphylococcus
NKNMTKPVIGFIGGQTA

SEQ ID NO: 2078612 - protein, 21 aa, Staphylococcus
NKNNYFTYSLPKDITSYKVRK

SEQ ID NO: 2078613 - protein, 25 aa, Staphylococcus
NKNPKRMIISGLWTHFGYADEFGVT

SEQ ID NO: 2078614 - protein, 30 aa, Staphylococcus
NKNRSWEFQITLPYFLSNEDYLIFTHAIKE

SEQ ID NO: 2078615 - protein, 17 aa, Staphylococcus
NKNVLLERFNYAKSLNV

SEQ ID NO: 2078616 - protein, 25 aa, Staphylococcus
NKPKPRYLTGFAAKPLEFLHAILPT

SEQ ID NO: 2078617 - protein, 21 aa, Staphylococcus
NKPLTLIGPKGIQNYIETSLK

SEQ ID NO: 2078618 - protein, 17 aa, Staphylococcus
NKPLVCVGILKGSVMFM

SEQ ID NO: 2078619 - protein, 25 aa, Staphylococcus
NKPMAMIGIIDLLKQAKNRKLQLLT

SEQ ID NO: 2078620 - protein, 17 aa, Staphylococcus
NKPMYSLYTTLKKIKKR

SEQ ID NO: 2078621 - protein, 25 aa, Staphylococcus
NKPNSRYMVFYNDDLTLYTKTSINS

SEQ ID NO: 2078622 - protein, 19 aa, Staphylococcus
NKPVIREKMSRRKKTAAKK

SEQ ID NO: 2078623 - protein, 20 aa, Staphylococcus
NKPVIREKMSRRKKTAAKKL

SEQ ID NO: 2078624 - protein, 21 aa, Staphylococcus
NKPVPLMVKRVKCGGFKSIAI

SEQ ID NO: 2078625 - protein, 25 aa, Staphylococcus
NKQIAKLYYLIWKDMELDIVKEISK

SEQ ID NO: 2078626 - protein, 18 aa, Staphylococcus
NKQPSYLDFFLQAKFDLE

SEQ ID NO: 2078627 - protein, 24 aa, Staphylococcus
NKQSLHFRVYLLGGEMRDLTEAFV

SEQ ID NO: 2078628 - protein, 17 aa, Staphylococcus
NKQSRIKRIFRRTKASI

SEQ ID NO: 2078629 - protein, 24 aa, Staphylococcus
NKQVFVFTHSSFDFHNFAFKGKNN

SEQ ID NO: 2078630 - protein, 19 aa, Staphylococcus
NKQWRRKIKMIEKMQFIDE

SEQ ID NO: 2078631 - protein, 21 aa, Staphylococcus
NKQYDRLFIYELLKSSKINNK

SEQ ID NO: 2078632 - protein, 18 aa, Staphylococcus
NKRAKLYPLTFDNFFKQD

SEQ ID NO: 2078633 - protein, 18 aa, Staphylococcus
NKRDIKVGLLPSINPHNI

SEQ ID NO: 2078634 - protein, 33 aa, Staphylococcus
NKRDIQFDYIFLDPPYNKGLIDKALIQIETFNL

SEQ ID NO: 2078635 - protein, 24 aa, Staphylococcus
NKRIQFLNHLAAELGLQDVSFVHD

SEQ ID NO: 2078636 - protein, 23 aa, Staphylococcus
NKRIQFLNHLAVELGLTQVSFVH

SEQ ID NO: 2078637 - protein, 20 aa, Staphylococcus
NKRVDIMLRHGLFNEVQHLV

SEQ ID NO: 2078638 - protein, 24 aa, Staphylococcus
NKSIYELYALPPHIKQTLANVVET

SEQ ID NO: 2078639 - protein, 17 aa, Staphylococcus
NKSKRPVMLLGTGAKHA

SEQ ID NO: 2078640 - protein, 24 aa, Staphylococcus
NKTGLLLDPYFAGTKVKWILDNVE

SEQ ID NO: 2078641 - protein, 27 aa, Staphylococcus
NKTGLLLDPYFSGTKVRWILDNVKGAR

SEQ ID NO: 2078642 - protein, 21 aa, Staphylococcus
NKTIEGLMRKGYKYDKIKAKL

SEQ ID NO: 2078643 - protein, 21 aa, Staphylococcus
NKTLYLLDVLQKLPIDKMNQF

SEQ ID NO: 2078644 - protein, 21 aa, Staphylococcus
NKTLYLMDILQKLPIDNMNHL

SEQ ID NO: 2078645 - protein, 26 aa, Staphylococcus
NKTSDLPIGVIPVDSLYSPVERVNYT

SEQ ID NO: 2078646 - protein, 26 aa, Staphylococcus
NKTVPQDLFFIISLSGETYQLKEVTQ

SEQ ID NO: 2078647 - protein, 19 aa, Staphylococcus
NKVAIFFRSFSIDKNQRGK

SEQ ID NO: 2078648 - protein, 22 aa, Staphylococcus
NKVELDNRFVLAPLTHVSSNDD

SEQ ID NO: 2078649 - protein, 32 aa, Staphylococcus
NKVFKKYNLTYPQFLVLSILWEESPVNVKKVV

SEQ ID NO: 2078650 - protein, 20 aa, Staphylococcus
NKVKAAPLILNKRTIQTTGK

SEQ ID NO: 2078651 - protein, 26 aa, Staphylococcus
NKVKDYINIVEIGTPIVINEGLPAVQ

SEQ ID NO: 2078652 - protein, 25 aa, Staphylococcus
NKVKDYVDIVEIGTPIVINEGLPAV

SEQ ID NO: 2078653 - protein, 18 aa, Staphylococcus
NKVKPLYEDYDVSTILIV

SEQ ID NO: 2078654 - protein, 17 aa, Staphylococcus
NKVLIQLMNEMDLRLVD

SEQ ID NO: 2078655 - protein, 27 aa, Staphylococcus
NKVTGELLCQYYFKKFGVDTRSVRFPG

SEQ ID NO: 2078656 - protein, 23 aa, Staphylococcus
NKVVILTTNLPVATPYRLNDIFT

SEQ ID NO: 2078657 - protein, 22 aa, Staphylococcus
NKVYDLNYDGGTMYLGDYQYFI

SEQ ID NO: 2078658 - protein, 21 aa, Staphylococcus
NKVYWLNEEYYGFGAGASGYV

SEQ ID NO: 2078659 - protein, 20 aa, Staphylococcus
NKWLEIIHKYNVTVWDSVPI

SEQ ID NO: 2078660 - protein, 24 aa, Staphylococcus
NKYDELMIYYIKSLNGLEQYYESV

SEQ ID NO: 2078661 - protein, 21 aa, Staphylococcus
NKYDPTLQLAFKLAKQFNTTV

SEQ ID NO: 2078662 - protein, 26 aa, Staphylococcus
NKYGADSLRWALISDSAPWNNKRFSE

SEQ ID NO: 2078663 - protein, 27 aa, Staphylococcus
NKYKEWLQDYILISTPFQVPSKATSSF

SEQ ID NO: 2078664 - protein, 23 aa, Staphylococcus
NKYKKRMHIILQKIIKKDENIFL

SEQ ID NO: 2078665 - protein, 20 aa, Staphylococcus
NKYQEIVGMSLLPIGHNHNA

SEQ ID NO: 2078666 - protein, 21 aa, Staphylococcus
NLADLRPFYETILGFEVITET

SEQ ID NO: 2078667 - protein, 24 aa, Staphylococcus
NLAESAYLAGLPQVPNTYNIYDHP

SEQ ID NO: 2078668 - protein, 25 aa, Staphylococcus
NLAIKSLGYVMFVSIDDVAAASKKF

SEQ ID NO: 2078669 - protein, 21 aa, Staphylococcus
NLAIMGRYILTPEIFDYLETQ

SEQ ID NO: 2078670 - protein, 25 aa, Staphylococcus
NLAIMGRYILTPEIFDYLKTQKEGA

SEQ ID NO: 2078671 - protein, 33 aa, Staphylococcus
NLAVKHPLFEQLRSFDYIVITDKGLLNIDVKNW

SEQ ID NO: 2078672 - protein, 24 aa, Staphylococcus
NLDDYIKVFEQRPIYHEELNKLEK

SEQ ID NO: 2078673 - protein, 25 aa, Staphylococcus
NLDHTKVVAPYIRLAGTMEGINGDV

SEQ ID NO: 2078674 - protein, 17 aa, Staphylococcus
NLDIKNIHYLHHAYPLT

SEQ ID NO: 2078675 - protein, 17 aa, Staphylococcus
NLDLFKKGLERYSLEYE

SEQ ID NO: 2078676 - protein, 19 aa, Staphylococcus
NLDLYDGYTFIGLGSDGGF

SEQ ID NO: 2078677 - protein, 19 aa, Staphylococcus
NLDNHVHPLMFTSDIEGQK

SEQ ID NO: 2078678 - protein, 27 aa, Staphylococcus
NLDQINWVGFYLIDNQELILGPFQGHP

SEQ ID NO: 2078679 - protein, 26 aa, Staphylococcus
NLEFKYICLKLITTEYWSLNSLFNGG

SEQ ID NO: 2078680 - protein, 20 aa, Staphylococcus
NLEIKWIRGNIDTRLKKLEI

SEQ ID NO: 2078681 - protein, 19 aa, Staphylococcus
NLEPDEIFPYAPPQGIESL

SEQ ID NO: 2078682 - protein, 24 aa, Staphylococcus
NLEPEEFIMWFLGMNESIADVKEN

SEQ ID NO: 2078683 - protein, 27 aa, Staphylococcus
NLEVIDKPTPFLFGEDFSFYGQQLAPA

SEQ ID NO: 2078684 - protein, 24 aa, Staphylococcus
NLEVLLRGLQVDHLVLTGVSTSGV

SEQ ID NO: 2078685 - protein, 32 aa, Staphylococcus
NLEYELGVLLSKKKYWYKLPDFKEIAKIVDYA

SEQ ID NO: 2078686 - protein, 18 aa, Staphylococcus
NLFSQHLGLMFQIKDDLL

SEQ ID NO: 2078687 - protein, 25 aa, Staphylococcus
NLGAQPPFTYLVQESYDAMAVVHQC

SEQ ID NO: 2078688 - protein, 22 aa, Staphylococcus
NLGIAIDKFGAGSFMVATKVKG

SEQ ID NO: 2078689 - protein, 17 aa, Staphylococcus
NLGIYTENPQRDLEIYI

SEQ ID NO: 2078690 - protein, 26 aa, Staphylococcus
NLGKMESLLLSARHFLWSTAQGYQIY

SEQ ID NO: 2078691 - protein, 29 aa, Staphylococcus
NLGLDYLDLYLIHWPGTDNDLMIDTWKGM

SEQ ID NO: 2078692 - protein, 28 aa, Staphylococcus
NLGLVYIDLFLIHWPCEKDGLYIESYKA

SEQ ID NO: 2078693 - protein, 18 aa, Staphylococcus
NLGRKIFINYLNKRKHSE

SEQ ID NO: 2078694 - protein, 27 aa, Staphylococcus
NLGSALFIYRGLWLLKSDLDKTTICEN

SEQ ID NO: 2078695 - protein, 24 aa, Staphylococcus
NLIFNKTARNFNPLCAMAAQTTVV

SEQ ID NO: 2078696 - protein, 26 aa, Staphylococcus
NLIGLQSHLLGLSLIGVSEILAITGD

SEQ ID NO: 2078697 - protein, 21 aa, Staphylococcus
NLIIYAIPDLTGVNISIEQFG

SEQ ID NO: 2078698 - protein, 24 aa, Staphylococcus
NLINGGTLAIYMGIKRLGRIIDQI

SEQ ID NO: 2078699 - protein, 29 aa, Staphylococcus
NLIQINFDKIAKAKPEVIYISGRTATVKN

SEQ ID NO: 2078700 - protein, 22 aa, Staphylococcus
NLISNEYLTKINPDKIFVINRT

SEQ ID NO: 2078701 - protein, 26 aa, Staphylococcus
NLISNQLGIAILPYSITQLMNENVRV

SEQ ID NO: 2078702 - protein, 27 aa, Staphylococcus
NLIVSYLIQNYLLKYPKIDITVIEAII

SEQ ID NO: 2078703 - protein, 19 aa, Staphylococcus
NLKDYIVVGFSVGGALALK

SEQ ID NO: 2078704 - protein, 30 aa, Staphylococcus
NLKELKLLSIHDLLKIKGIGLHKAVTLKAA

SEQ ID NO: 2078705 - protein, 26 aa, Staphylococcus
NLKGSWSVVCFYPADFSFVCPTELED

SEQ ID NO: 2078706 - protein, 20 aa, Staphylococcus
NLKGYPHAIGHVRYATSGNK

SEQ ID NO: 2078707 - protein, 22 aa, Staphylococcus
NLKHHILDMSLLSQLTPNALTQ

SEQ ID NO: 2078708 - protein, 18 aa, Staphylococcus
NLKHLKRDRPDCLIGVCG

SEQ ID NO: 2078709 - protein, 21 aa, Staphylococcus
NLKIIASCPFAKDVLEKDDHA

SEQ ID NO: 2078710 - protein, 20 aa, Staphylococcus
NLKIIASCPFAKDVLEKNDD

SEQ ID NO: 2078711 - protein, 25 aa, Staphylococcus
NLKKDQYVMLKLTIPTKVNAYSELI

SEQ ID NO: 2078712 - protein, 22 aa, Staphylococcus
NLKKRLIEWLLLKNALLVTEKD

SEQ ID NO: 2078713 - protein, 22 aa, Staphylococcus
NLKNVELYLLNSNLAIHNNIPN

SEQ ID NO: 2078714 - protein, 30 aa, Staphylococcus
NLKSEQLIILTAVDYIYINFGKDNQEVLTE

SEQ ID NO: 2078715 - protein, 23 aa, Staphylococcus
NLKTIHAIPLKINESRTFEVRGE

SEQ ID NO: 2078716 - protein, 17 aa, Staphylococcus
NLKWKRWIYIHLLNMTI

SEQ ID NO: 2078717 - protein, 21 aa, Staphylococcus
NLKYDLFNVLFEMVRQHENSP

SEQ ID NO: 2078718 - protein, 17 aa, Staphylococcus
NLKYDLYHILFEMVRQY

SEQ ID NO: 2078719 - protein, 17 aa, Staphylococcus
NLLAMCYLYLSEYDIAK

SEQ ID NO: 2078720 - protein, 19 aa, Staphylococcus
NLLAMCYLYLSEYEIAKEL

SEQ ID NO: 2078721 - protein, 27 aa, Staphylococcus
NLLDEPPAYFLGLVAIGTVADLVSLTD

SEQ ID NO: 2078722 - protein, 19 aa, Staphylococcus
NLLEAGMVITIEPGIYVPN

SEQ ID NO: 2078723 - protein, 21 aa, Staphylococcus
NLLEAGMVITIEPGIYVPNVA

SEQ ID NO: 2078724 - protein, 19 aa, Staphylococcus
NLLMHVDQVSYVRFASVYK

SEQ ID NO: 2078725 - protein, 18 aa, Staphylococcus
NLLNLKRMVRPVHGIRNL

SEQ ID NO: 2078726 - protein, 26 aa, Staphylococcus
NLLQLRQKYFFSVTTLKDNTLAQKAN

SEQ ID NO: 2078727 - protein, 19 aa, Staphylococcus
NLLSLFQKRVAQGQTIVMV

SEQ ID NO: 2078728 - protein, 20 aa, Staphylococcus
NLLTYLNIFDDVRSYFSEVT

SEQ ID NO: 2078729 - protein, 18 aa, Staphylococcus
NLLVCPMCGHEWSETENK

SEQ ID NO: 2078730 - protein, 18 aa, Staphylococcus
NLMAAMIAVWSKGIPFET

SEQ ID NO: 2078731 - protein, 17 aa, Staphylococcus
NLMIYQRSYEGKKWLVI

SEQ ID NO: 2078732 - protein, 20 aa, Staphylococcus
NLMNGGTLAIYMGIKRLGAI

SEQ ID NO: 2078733 - protein, 28 aa, Staphylococcus
NLNAAPFAFFNVVCPEPPMLMISVGKQD

SEQ ID NO: 2078734 - protein, 23 aa, Staphylococcus
NLNDQIMINLLLNVLKSSMEYSI

SEQ ID NO: 2078735 - protein, 18 aa, Staphylococcus
NLNHDRIDFRHCSEKIEM

SEQ ID NO: 2078736 - protein, 34 aa, Staphylococcus
NLNLDFSQFAGFKSYRFLRPEEGTTYKIYFGFAS

SEQ ID NO: 2078737 - protein, 25 aa, Staphylococcus
NLNLTIREYLRFLSKFNSYKQSRKQ

SEQ ID NO: 2078738 - protein, 20 aa, Staphylococcus
NLNMIIGHWGEFIPFFLERM

SEQ ID NO: 2078739 - protein, 25 aa, Staphylococcus
NLNNELGIPLYFKKGKCFNLTDAGD

SEQ ID NO: 2078740 - protein, 25 aa, Staphylococcus
NLNNKSMLYRLGALGLKKGSLVSIK

SEQ ID NO: 2078741 - protein, 23 aa, Staphylococcus
NLNNLGHITLKFDGSTEAEQSGT

SEQ ID NO: 2078742 - protein, 23 aa, Staphylococcus
NLNNRYKLIVLRKGRGLAGTVMK

SEQ ID NO: 2078743 - protein, 21 aa, Staphylococcus
NLNYEEIYILNYIVKSKKDEI

SEQ ID NO: 2078744 - protein, 21 aa, Staphylococcus
NLPGTKWAKLIINSALSGMSA

SEQ ID NO: 2078745 - protein, 27 aa, Staphylococcus
NLPIKQELLNDFKPFSKILALKEIHAK

SEQ ID NO: 2078746 - protein, 18 aa, Staphylococcus
NLPINQRIDIYIGVTGEL

SEQ ID NO: 2078747 - protein, 29 aa, Staphylococcus
NLPKLKIYNPWHKFKIELAYKIASIYKMM

SEQ ID NO: 2078748 - protein, 17 aa, Staphylococcus
NLPSQLSPLLKKLLLKS

SEQ ID NO: 2078749 - protein, 25 aa, Staphylococcus
NLPSQPFWEFPARPYTHHVQDLMPS

SEQ ID NO: 2078750 - protein, 26 aa, Staphylococcus
NLPSYAVPNFIKYIEDFPITINGKID

SEQ ID NO: 2078751 - protein, 31 aa, Staphylococcus
NLPTKEFQLLFLLCTHPRQIYTRESIIEKIW

SEQ ID NO: 2078752 - protein, 27 aa, Staphylococcus
NLPTRQMILNFAHYRFTPLKNSGCTVY

SEQ ID NO: 2078753 - protein, 17 aa, Staphylococcus
NLPVIPGTDGPIESYEA

SEQ ID NO: 2078754 - protein, 24 aa, Staphylococcus
NLQDYLDIYYQFSLPFGKKYAEQS

SEQ ID NO: 2078755 - protein, 45 aa, Staphylococcus
NLQHLSLLSGGERALSAIALLFAILKVRSAPFVILDEVEAALDEA

SEQ ID NO: 2078756 - protein, 25 aa, Staphylococcus
NLQNSIKITLLRLSKHKFIEKDSFK

SEQ ID NO: 2078757 - protein, 25 aa, Staphylococcus
NLQRITRHLLKKYQDKFFTYPAASS

SEQ ID NO: 2078758 - protein, 26 aa, Staphylococcus
NLQSLGKWLVPQTKHYSWLKAADIIG

SEQ ID NO: 2078759 - protein, 26 aa, Staphylococcus
NLRDLKESLFKWQEKLQGIGWNSLYW

SEQ ID NO: 2078760 - protein, 22 aa, Staphylococcus
NLRELGFDIVRFKTGTPPRVNA

SEQ ID NO: 2078761 - protein, 17 aa, Staphylococcus
NLRMLGFKHKGFKEGLS

SEQ ID NO: 2078762 - protein, 21 aa, Staphylococcus
NLRNRIIITSRLFASTTKKEI

SEQ ID NO: 2078763 - protein, 30 aa, Staphylococcus
NLSARMRHDMTWDFIYNNGLDVAYLSFAEV

SEQ ID NO: 2078764 - protein, 22 aa, Staphylococcus
NLSFDLITIFCDSLNYLPETND

SEQ ID NO: 2078765 - protein, 27 aa, Staphylococcus
NLSIYTKLLTFMKFQAGLDVSTHQIAQ

SEQ ID NO: 2078766 - protein, 27 aa, Staphylococcus
NLSKECGLPLYFKKGKHFNLTEAGELL

SEQ ID NO: 2078767 - protein, 24 aa, Staphylococcus
NLSKQIFDLILKFADYGFARAHAV

SEQ ID NO: 2078768 - protein, 27 aa, Staphylococcus
NLSLRAKYLFKYNLDYFIFDGEIVLID

SEQ ID NO: 2078769 - protein, 26 aa, Staphylococcus
NLSNINWLGFYLIEDGQLILGPFQGR

SEQ ID NO: 2078770 - protein, 17 aa, Staphylococcus
NLTKYLVSQLMLSNEER

SEQ ID NO: 2078771 - protein, 21 aa, Staphylococcus
NLTVLIIGGFAQKGSNALTGR

SEQ ID NO: 2078772 - protein, 20 aa, Staphylococcus
NLTYPVLIDQYQTAGLFSFS

SEQ ID NO: 2078773 - protein, 25 aa, Staphylococcus
NLVARLVTIQKYHLGNKLMAAIGIG

SEQ ID NO: 2078774 - protein, 22 aa, Staphylococcus
NLVFKYALDMNLLKKLPNEGIK

SEQ ID NO: 2078775 - protein, 26 aa, Staphylococcus
NLVGAFYRPTAVLYDLDFLNTLPYTE

SEQ ID NO: 2078776 - protein, 18 aa, Staphylococcus
NLVHFMPREHIEGRDIND

SEQ ID NO: 2078777 - protein, 24 aa, Staphylococcus
NLVKEDWFTQIDKLLTFAKEQENI

SEQ ID NO: 2078778 - protein, 17 aa, Staphylococcus
NLVLRYLTPHGKWNIHS

SEQ ID NO: 2078779 - protein, 30 aa, Staphylococcus
NLVNKYRIKRIIIAIPTLKPDRLKEINNIC

SEQ ID NO: 2078780 - protein, 17 aa, Staphylococcus
NLVPFLTVKQQFQLLKK

SEQ ID NO: 2078781 - protein, 27 aa, Staphylococcus
NLVPNYLQRLLFDDIPFLKEAQAEHDQ

SEQ ID NO: 2078782 - protein, 25 aa, Staphylococcus
NLYEDLYHFLVKIKDIYKTKLGSAV

SEQ ID NO: 2078783 - protein, 18 aa, Staphylococcus
NLYEKGIGRLLVEAGPTV

SEQ ID NO: 2078784 - protein, 28 aa, Staphylococcus
NLYGGTYNLLNITFKKLGIKVHFVDPSH

SEQ ID NO: 2078785 - protein, 27 aa, Staphylococcus
NMALSDCDLLINLGSRFDDRLASNPEE

SEQ ID NO: 2078786 - protein, 23 aa, Staphylococcus
NMALTECDLLINLGSRFDDRLAS

SEQ ID NO: 2078787 - protein, 24 aa, Staphylococcus
NMALTECDLLINLGSRFDDRLASN

SEQ ID NO: 2078788 - protein, 26 aa, Staphylococcus
NMALTECDLLINLGSRFDDRLASNPN

SEQ ID NO: 2078789 - protein, 18 aa, Staphylococcus
NMDLKIGGIIYPTAPFNG

SEQ ID NO: 2078790 - protein, 24 aa, Staphylococcus
NMESRGMVLYINRNTRTTKGYYFI

SEQ ID NO: 2078791 - protein, 22 aa, Staphylococcus
NMGFIDDMRFIMDKIPSDQRQT

SEQ ID NO: 2078792 - protein, 22 aa, Staphylococcus
NMGVVPPLEGFLQGLRDITNEY

SEQ ID NO: 2078793 - protein, 24 aa, Staphylococcus
NMHPDLVKVLGRLNYRTSYGQNVL

SEQ ID NO: 2078794 - protein, 18 aa, Staphylococcus
NMIIFLDADLATLKSRIA

SEQ ID NO: 2078795 - protein, 38 aa, Staphylococcus
NMKDKRNFLYLELLKVIELKKPKFFVAENVKGLLSMEK

SEQ ID NO: 2078796 - protein, 18 aa, Staphylococcus
NMLGHDMTMPRVSGTSGL

SEQ ID NO: 2078797 - protein, 26 aa, Staphylococcus
NMLKFYVDYPLEDWLYRTHLHSMHIK

SEQ ID NO: 2078798 - protein, 17 aa, Staphylococcus
NMLQERLGLGKVATMDQ

SEQ ID NO: 2078799 - protein, 20 aa, Staphylococcus
NMPNLWPELNELSIPVCIIV

SEQ ID NO: 2078800 - protein, 30 aa, Staphylococcus
NMQETVEYFFKLGISTVLITLGEQGTYYAT

SEQ ID NO: 2078801 - protein, 20 aa, Staphylococcus
NMQPFIDLFDVPPYVTCIRQ

SEQ ID NO: 2078802 - protein, 24 aa, Staphylococcus
NMRDKISKLLFENTKRRPMIIPII

SEQ ID NO: 2078803 - protein, 22 aa, Staphylococcus
NMRIMSHILPNALPADYTLTLV

SEQ ID NO: 2078804 - protein, 19 aa, Staphylococcus
NMSRMPNLTYLEEDELIIY

SEQ ID NO: 2078805 - protein, 18 aa, Staphylococcus
NMTINHFTFNMKIAGDFN

SEQ ID NO: 2078806 - protein, 22 aa, Staphylococcus
NMTIYRKFIKWYGANHSTETVR

SEQ ID NO: 2078807 - protein, 22 aa, Staphylococcus
NMTRMPNLTYLEESELIIYAAN

SEQ ID NO: 2078808 - protein, 17 aa, Staphylococcus
NMTYIVMDNQIYGLTKG

SEQ ID NO: 2078809 - protein, 17 aa, Staphylococcus
NMTYRPQQLYLSEIILD

SEQ ID NO: 2078810 - protein, 32 aa, Staphylococcus
NMVFEDYNLVEYLYYYLNYIRDKGVLEKLMGT

SEQ ID NO: 2078811 - protein, 21 aa, Staphylococcus
NMYEIIAGERRFRALQSLHKS

SEQ ID NO: 2078812 - protein, 21 aa, Staphylococcus
NMYEIIAGERRFRALQSLHQS

SEQ ID NO: 2078813 - protein, 21 aa, Staphylococcus
NNALGQALLAKRMGKKKLVAE

SEQ ID NO: 2078814 - protein, 29 aa, Staphylococcus
NNANKTFLHRFYFETFKIPNIINNIKPDL

SEQ ID NO: 2078815 - protein, 24 aa, Staphylococcus
NNATLPFAQILANKGYREAFKSNH

SEQ ID NO: 2078816 - protein, 17 aa, Staphylococcus
NNATLPYAQLLANKGYK

SEQ ID NO: 2078817 - protein, 18 aa, Staphylococcus
NNATLPYAQLLASKGYRE

SEQ ID NO: 2078818 - protein, 18 aa, Staphylococcus
NNAYMQYASTSPFYPMFA

SEQ ID NO: 2078819 - protein, 25 aa, Staphylococcus
NNDEAQLILKAMLVSLQTIEEEYNE

SEQ ID NO: 2078820 - protein, 25 aa, Staphylococcus
NNDFDLIILDLMLPNINGLEICRRV

SEQ ID NO: 2078821 - protein, 28 aa, Staphylococcus
NNDFPWCVVVYPNKPWAQRVYPELSEEE

SEQ ID NO: 2078822 - protein, 22 aa, Staphylococcus
NNDKDMLALAHYSYVMANSNDS

SEQ ID NO: 2078823 - protein, 18 aa, Staphylococcus
NNDLPWHLPNDLKHVKKL

SEQ ID NO: 2078824 - protein, 31 aa, Staphylococcus
NNDRPLYNKYKRYWKLLLKPYEQLEMFEYNK

SEQ ID NO: 2078825 - protein, 25 aa, Staphylococcus
NNDRWKGTPFYIRTGKRLNKKAIEV

SEQ ID NO: 2078826 - protein, 22 aa, Staphylococcus
NNDRYKLIILRKGRGLAGNVMK

SEQ ID NO: 2078827 - protein, 26 aa, Staphylococcus
NNDVFKPFMHPLVIDLSLNPNELVKP

SEQ ID NO: 2078828 - protein, 29 aa, Staphylococcus
NNDVYFVNGPLDLTFLFGLVDHLSHKLKF

SEQ ID NO: 2078829 - protein, 21 aa, Staphylococcus
NNDWNCPITIRAPFGGGVHGG

SEQ ID NO: 2078830 - protein, 20 aa, Staphylococcus
NNEDTFVKIFKLLRREEQVC

SEQ ID NO: 2078831 - protein, 17 aa, Staphylococcus
NNEFPSLLITKLARDDQ

SEQ ID NO: 2078832 - protein, 25 aa, Staphylococcus
NNEIEVCYYLKELLQRYDIESKIIE

SEQ ID NO: 2078833 - protein, 26 aa, Staphylococcus
NNEIGMPLTILDLDKNTDISILEMGM

SEQ ID NO: 2078834 - protein, 25 aa, Staphylococcus
NNEIISITPYFTMKGRNLSFRINRY

SEQ ID NO: 2078835 - protein, 17 aa, Staphylococcus
NNEINVPIFLKLTSDMD

SEQ ID NO: 2078836 - protein, 25 aa, Staphylococcus
NNEPVPRQLYLISPLLDATLSNKDI

SEQ ID NO: 2078837 - protein, 25 aa, Staphylococcus
NNEQIVLFLNRRGYASFMLCRDCGH

SEQ ID NO: 2078838 - protein, 24 aa, Staphylococcus
NNEVRIQWRVADIKIPTNEIKNIS

SEQ ID NO: 2078839 - protein, 24 aa, Staphylococcus
NNEVRIQWRVADIKIPTQDIKNIS

SEQ ID NO: 2078840 - protein, 25 aa, Staphylococcus
NNEVRIQWRVADIKIPTSEIKNISQ

SEQ ID NO: 2078841 - protein, 25 aa, Staphylococcus
NNEYRFQILVKYKREPELLTALQYL

SEQ ID NO: 2078842 - protein, 23 aa, Staphylococcus
NNFGPFLNETIDFRNIDQNQLFL

SEQ ID NO: 2078843 - protein, 38 aa, Staphylococcus
NNFKEKEGYNLTFFAFFVKAVADALKANPILNSSWDGE

SEQ ID NO: 2078844 - protein, 23 aa, Staphylococcus
NNFSNYINQNKLPKGYDKYAHKI

SEQ ID NO: 2078845 - protein, 19 aa, Staphylococcus
NNFYPEFDKIFVSLGKPNI

SEQ ID NO: 2078846 - protein, 20 aa, Staphylococcus
NNGGVVLRWLRDELLASEVE

SEQ ID NO: 2078847 - protein, 23 aa, Staphylococcus
NNGKDVWLPVRTWDKNTDSLGKL

SEQ ID NO: 2078848 - protein, 25 aa, Staphylococcus
NNGKDVWLPVRTWDKSTDSKGILWG

SEQ ID NO: 2078849 - protein, 25 aa, Staphylococcus
NNGKPYLWGAWILLAAMNEEHMRRG

SEQ ID NO: 2078850 - protein, 24 aa, Staphylococcus
NNGPSLEYTIIGPTLQFNKDNTFI

SEQ ID NO: 2078851 - protein, 23 aa, Staphylococcus
NNGRFSPVVFKLASENNIDLTQV

SEQ ID NO: 2078852 - protein, 36 aa, Staphylococcus
NNGSGTLYIPAGKYLIGKRLIIYENTTVKMDNNAIL

SEQ ID NO: 2078853 - protein, 19 aa, Staphylococcus
NNHDGIQMVLLKSLGNAVV

SEQ ID NO: 2078854 - protein, 33 aa, Staphylococcus
NNHGIYEPLMYLYQFVKPFISKYTAIHQNYIIL

SEQ ID NO: 2078855 - protein, 17 aa, Staphylococcus
NNHMIIHNISFNIPKNS

SEQ ID NO: 2078856 - protein, 23 aa, Staphylococcus
NNHSKLPDLLLKQLDVELDALSK

SEQ ID NO: 2078857 - protein, 29 aa, Staphylococcus
NNIDFEKVLILLQVIPKRLPQKEIKKPYN

SEQ ID NO: 2078858 - protein, 20 aa, Staphylococcus
NNIDILIENGKFKKIKNNLN

SEQ ID NO: 2078859 - protein, 34 aa, Staphylococcus
NNIDKTFGLIFSQRVLLALINKGMVREEAYDRVQ

SEQ ID NO: 2078860 - protein, 31 aa, Staphylococcus; identical to SEQ ID NO: 1830806

SEQ ID NO: 2078861 - protein, 25 aa, Staphylococcus
NNIKSLMLEYLRFAGYQRTIDINKY

SEQ ID NO: 2078862 - protein, 25 aa, Staphylococcus
NNIMSYLSEIDLPILIIASQHGERT

SEQ ID NO: 2078863 - protein, 27 aa, Staphylococcus
NNINKTFGLIFSQRVLLALINKGMVRE

SEQ ID NO: 2078864 - protein, 26 aa, Staphylococcus
NNIRDKFMIQLLYETGLRIGELLSLY

SEQ ID NO: 2078865 - protein, 30 aa, Staphylococcus
NNISKFNLCLKLYSQFLLNYFNEDAVYVGT

SEQ ID NO: 2078866 - protein, 22 aa, Staphylococcus
NNITNIKVIFKLQIQSKEDGYP

SEQ ID NO: 2078867 - protein, 18 aa, Staphylococcus
NNIVGRTILPTYGLFRSI

SEQ ID NO: 2078868 - protein, 26 aa, Staphylococcus
NNIYAIGDIVPGLPLAHKASYEAKVA

SEQ ID NO: 2078869 - protein, 23 aa, Staphylococcus
NNKERFNLFLDEVFEMGIDIDTL

SEQ ID NO: 2078870 - protein, 23 aa, Staphylococcus
NNKFIISSWLGTMGCALPGAMAS

SEQ ID NO: 2078871 - protein, 24 aa, Staphylococcus
NNKFIISSWLGTMGCGLPGAMAAK

SEQ ID NO: 2078872 - protein, 29 aa, Staphylococcus
NNKFNKLKIPILLNRFIKKIKPDIVQTWM

SEQ ID NO: 2078873 - protein, 21 aa, Staphylococcus
NNKIKCIYPISSKKTNKLVYT

SEQ ID NO: 2078874 - protein, 23 aa, Staphylococcus
NNKLKIYTIAFAFQSFTEQIGGK

SEQ ID NO: 2078875 - protein, 31 aa, Staphylococcus
NNKNVVLIHGFKHYVALLFHKGAILEDKYHT

SEQ ID NO: 2078876 - protein, 32 aa, Staphylococcus
NNKNVVLIHGFKHYVALLFHKGALLEDQYGTL

SEQ ID NO: 2078877 - protein, 33 aa, Staphylococcus
NNKNVVLIHGFKTYVALLFFKGALIEDSKNTLI

SEQ ID NO: 2078878 - protein, 23 aa, Staphylococcus
NNKQDLNLLKPKSITFTHEFMSA

SEQ ID NO: 2078879 - protein, 20 aa, Staphylococcus
NNKRLLDEPTKIVIWRAPTD

SEQ ID NO: 2078880 - protein, 23 aa, Staphylococcus
NNKVLQFYVRYGGEFQLKQGFSP

SEQ ID NO: 2078881 - protein, 24 aa, Staphylococcus
NNKVLQFYVRYGGEFQLKQGFSPA

SEQ ID NO: 2078882 - protein, 25 aa, Staphylococcus
NNKYDPTLMLAFKLAKQFDTTVDDL

SEQ ID NO: 2078883 - protein, 20 aa, Staphylococcus
NNKYLGLYPFNYSFDEIESF

SEQ ID NO: 2078884 - protein, 20 aa, Staphylococcus
NNKYYTNIFISKNTFHQTGD

SEQ ID NO: 2078885 - protein, 23 aa, Staphylococcus
NNLGIKYLTLYAFSTENWSRPES

SEQ ID NO: 2078886 - protein, 21 aa, Staphylococcus
NNLPIILQQQLWKLVAQRENE

SEQ ID NO: 2078887 - protein, 21 aa, Staphylococcus
NNLVQMMFALENDKQFPILTQ

SEQ ID NO: 2078888 - protein, 20 aa, Staphylococcus
NNMYMYLHNFFYNQSSEDNM

SEQ ID NO: 2078889 - protein, 31 aa, Staphylococcus
NNNKRIVWLFNHILFDGWSLSILINEMWNKK

SEQ ID NO: 2078890 - protein, 20 aa, Staphylococcus
NNNPLLRKVIEDYTVLRGCH

SEQ ID NO: 2078891 - protein, 21 aa, Staphylococcus
NNNPLLRKVVEDYTVLRGFKP

SEQ ID NO: 2078892 - protein, 20 aa, Staphylococcus
NNNYFKHSLPKDINTYQVGK

SEQ ID NO: 2078893 - protein, 31 aa, Staphylococcus
NNPDTQIYLYSYWFYITANLGTKLKYDYYGD

SEQ ID NO: 2078894 - protein, 18 aa, Staphylococcus
NNPEELYDFLKQKRKAII

SEQ ID NO: 2078895 - protein, 28 aa, Staphylococcus
NNPFDPPMFTRVFRKHLDGGIIQDIRQI

SEQ ID NO: 2078896 - protein, 18 aa, Staphylococcus
NNPLLRKVIEDYTVLRGF

SEQ ID NO: 2078897 - protein, 23 aa, Staphylococcus
NNPRAYILLGYNDTKQRSFVEID

SEQ ID NO: 2078898 - protein, 22 aa, Staphylococcus
NNQFYKVNIPSIKVLNPVGSGD

SEQ ID NO: 2078899 - protein, 26 aa, Staphylococcus
NNQITSRIFNYLKAKGLNSHFIEQIS

SEQ ID NO: 2078900 - protein, 18 aa, Staphylococcus
NNQKLAIVTYPNYYGECF

SEQ ID NO: 2078901 - protein, 24 aa, Staphylococcus
NNQRIILSHLGMAGGFFIVDKLSD

SEQ ID NO: 2078902 - protein, 19 aa, Staphylococcus
NNQYMIFPNVKRFFRSIMI

SEQ ID NO: 2078903 - protein, 19 aa, Staphylococcus
NNRDIYRKRLYSENFMVIY

SEQ ID NO: 2078904 - protein, 20 aa, Staphylococcus
NNRERVWLKRRIETPYKATL

SEQ ID NO: 2078905 - protein, 17 aa, Staphylococcus
NNRHLALINDIFSSFQK

SEQ ID NO: 2078906 - protein, 17 aa, Staphylococcus
NNRSSLALFIMICTGCR

SEQ ID NO: 2078907 - protein, 26 aa, Staphylococcus
NNSELQNLLLDPYFTDVVTNYQSALR

SEQ ID NO: 2078908 - protein, 23 aa, Staphylococcus
NNTAFLPGVVSRKKQIVPPITAA

SEQ ID NO: 2078909 - protein, 28 aa, Staphylococcus
NNTIHRHYLIRDGLRESLKALDLKLLVT

SEQ ID NO: 2078910 - protein, 17 aa, Staphylococcus
NNTLQLSYQLYQNLKRR

SEQ ID NO: 2078911 - protein, 24 aa, Staphylococcus
NNTSLLLNIFIYDVANGEWIFRLD

SEQ ID NO: 2078912 - protein, 18 aa, Staphylococcus
NNVDILKRISNLEKAVFG

SEQ ID NO: 2078913 - protein, 34 aa, Staphylococcus
NNVDYQLMILSFSPYLRTFLHRYDLFETNYWSVF

SEQ ID NO: 2078914 - protein, 21 aa, Staphylococcus
NNVEAYFWCDDDEIIGFSGTN

SEQ ID NO: 2078915 - protein, 18 aa, Staphylococcus
NNVKWKSLVTHYENGEPY

SEQ ID NO: 2078916 - protein, 22 aa, Staphylococcus
NNVLFEAINLQRASLRQGTHAV

SEQ ID NO: 2078917 - protein, 23 aa, Staphylococcus
NNVPDWYLDSCLKIKYMFPKAHA

SEQ ID NO: 2078918 - protein, 33 aa, Staphylococcus
NNVPDWYLDSCLKIKYMFPKAHAAAYVLMAVRI

SEQ ID NO: 2078919 - protein, 21 aa, Staphylococcus
NNVVQIGKTVTFIEIPDGEEE

SEQ ID NO: 2078920 - protein, 22 aa, Staphylococcus
NNWDDFLYDFANALATALDKVE

SEQ ID NO: 2078921 - protein, 32 aa, Staphylococcus
NNWDHKIFMSYLQFFQLPYKKKIKTFSTGMKM

SEQ ID NO: 2078922 - protein, 25 aa, Staphylococcus
NNWNKIATFLLPKDYVRFKLTGKIN

SEQ ID NO: 2078923 - protein, 21 aa, Staphylococcus
NNYDINNIFDLALISLMQDDV

SEQ ID NO: 2078924 - protein, 24 aa, Staphylococcus
NNYEYMFNHVDYIDFFITATDAQK

SEQ ID NO: 2078925 - protein, 17 aa, Staphylococcus
NNYILSFIKQDSNYALS

SEQ ID NO: 2078926 - protein, 18 aa, Staphylococcus
NNYSEHLGLIFQIKDDLL

SEQ ID NO: 2078927 - protein, 24 aa, Staphylococcus
NNYSEIDKIAAYNSAVANGVIPQG

SEQ ID NO: 2078928 - protein, 25 aa, Staphylococcus
NNYYEYQFNHVPYIDFYIVATDLQN

SEQ ID NO: 2078929 - protein, 25 aa, Staphylococcus
NPANLMGIRAFRKLLPEIPHVAVFD

SEQ ID NO: 2078930 - protein, 28 aa, Staphylococcus
NPANLMGIRAFRKLLPGIPHVAVFDTSF

SEQ ID NO: 2078931 - protein, 26 aa, Staphylococcus
NPANLMGIRAFRKLLPNIPHVAVFDT

SEQ ID NO: 2078932 - protein, 20 aa, Staphylococcus
NPARQIAIKAGVPDTTPAMT

SEQ ID NO: 2078933 - protein, 18 aa, Staphylococcus
NPATLSVGYFQRLKKEID

SEQ ID NO: 2078934 - protein, 19 aa, Staphylococcus
NPCIFYNINNYYDHIQHFY

SEQ ID NO: 2078935 - protein, 25 aa, Staphylococcus
NPDDSILLVAVDRLYPFPEGEIKEV

SEQ ID NO: 2078936 - protein, 23 aa, Staphylococcus
NPDLDIFKKVVEWLNEYFSGNRP

SEQ ID NO: 2078937 - protein, 25 aa, Staphylococcus
NPDLEFEFISWLVTGVKDHEVVLDE

SEQ ID NO: 2078938 - protein, 24 aa, Staphylococcus
NPDLVEEYKWMKPCYTYEGHNVVL

SEQ ID NO: 2078939 - protein, 19 aa, Staphylococcus
NPDPFQWLNQLSAPYDDER

SEQ ID NO: 2078940 - protein, 23 aa, Staphylococcus
NPEAKYFEFGIKNVSTHLDYIKN

SEQ ID NO: 2078941 - protein, 26 aa, Staphylococcus
NPEELRTHLINEYSIGIIALNDSDIR

SEQ ID NO: 2078942 - protein, 22 aa, Staphylococcus
NPEKLPIAVHSWGYIAETDEDA

SEQ ID NO: 2078943 - protein, 24 aa, Staphylococcus
NPELSYAANFLYMLRGELPTDTEV

SEQ ID NO: 2078944 - protein, 21 aa, Staphylococcus
NPELYIIDEPFLGLDPLGIQS

SEQ ID NO: 2078945 - protein, 29 aa, Staphylococcus
NPEMRNDIFDFYSLGFGDPYPISGSHGLG

SEQ ID NO: 2078946 - protein, 25 aa, Staphylococcus
NPEMRSDIFDFYSLGFGDPYPISGS

SEQ ID NO: 2078947 - protein, 24 aa, Staphylococcus
NPENLPWKQLDIDVAIEATGKFNH

SEQ ID NO: 2078948 - protein, 17 aa, Staphylococcus
NPEPLFFEIYENSLETI

SEQ ID NO: 2078949 - protein, 20 aa, Staphylococcus
NPEVLKPLFDHYDVKPEDVA

SEQ ID NO: 2078950 - protein, 26 aa, Staphylococcus
NPEYNQFMGAYRLQWEMIKFAKKNHI

SEQ ID NO: 2078951 - protein, 18 aa, Staphylococcus
NPFAMETKYLYSDAYQLA

SEQ ID NO: 2078952 - protein, 25 aa, Staphylococcus
NPFDLTKVWYHGEYPLIEVGEFELN

SEQ ID NO: 2078953 - protein, 25 aa, Staphylococcus
NPFDPPMFARVFRKHIEGGIVKAVR

SEQ ID NO: 2078954 - protein, 26 aa, Staphylococcus
NPFEPPMFARVFRKHLEGGIIKAIRQ

SEQ ID NO: 2078955 - protein, 21 aa, Staphylococcus
NPFHMSPYFGYAERLLASSGL

SEQ ID NO: 2078956 - protein, 23 aa, Staphylococcus
NPFIKGLDIIIPQAGIYTSYVVR

SEQ ID NO: 2078957 - protein, 21 aa, Staphylococcus
NPFLSDFYDDIEKWSFQTEMF

SEQ ID NO: 2078958 - protein, 26 aa, Staphylococcus
NPFNPPMFARVFRKHLEGGIIKAIRQ

SEQ ID NO: 2078959 - protein, 24 aa, Staphylococcus
NPGIPYHLPILIEAQKRGLKIVTE

SEQ ID NO: 2078960 - protein, 23 aa, Staphylococcus
NPGIPYTVPLIEAAVEKGLTILT

SEQ ID NO: 2078961 - protein, 18 aa, Staphylococcus
NPGKLLLVDFLQNKVVEN

SEQ ID NO: 2078962 - protein, 28 aa, Staphylococcus
NPGNTDAMIKYLLPKATVTTPNLFEAGQ

SEQ ID NO: 2078963 - protein, 28 aa, Staphylococcus
NPGNTDAMIQYLLPKATVVTPNLFEAGQ

SEQ ID NO: 2078964 - protein, 18 aa, Staphylococcus
NPHRRNILLIGDGSFQLT

SEQ ID NO: 2078965 - protein, 18 aa, Staphylococcus
NPHYLGIFDGKFAEDNVR

SEQ ID NO: 2078966 - protein, 25 aa, Staphylococcus
NPIANFVVELLEFFKSTYKTHFDMD

SEQ ID NO: 2078967 - protein, 19 aa, Staphylococcus
NPIPLHWDAETLVTNYFQC

SEQ ID NO: 2078968 - protein, 21 aa, Staphylococcus
NPIPLHWDAGALVTNYFQCNY

SEQ ID NO: 2078969 - protein, 24 aa, Staphylococcus
NPISLVKMLLMKYKLIKDIKKSNH

SEQ ID NO: 2078970 - protein, 17 aa, Staphylococcus
NPKEKDTREIEFGDVVF

SEQ ID NO: 2078971 - protein, 17 aa, Staphylococcus
NPKILPVIKQALTSNDY

SEQ ID NO: 2078972 - protein, 20 aa, Staphylococcus
NPKPRMYRLIEDDALINRMG

SEQ ID NO: 2078973 - protein, 18 aa, Staphylococcus
NPKPRMYRLLEDDALINR

SEQ ID NO: 2078974 - protein, 19 aa, Staphylococcus
NPKPRMYRLLEDDALINRM

SEQ ID NO: 2078975 - protein, 22 aa, Staphylococcus
NPKPWDIAAQFLFAKELGLKMT

SEQ ID NO: 2078976 - protein, 21 aa, Staphylococcus
NPKQCKHEFLRYPYIESFEHV

SEQ ID NO: 2078977 - protein, 22 aa, Staphylococcus
NPKQCKHEFLRYPYIESFENVD

SEQ ID NO: 2078978 - protein, 28 aa, Staphylococcus
NPKSLRFEFLKYIWDFPKNHFPSIMEAK

SEQ ID NO: 2078979 - protein, 24 aa, Staphylococcus
NPLDFGIDIVLHSATKYIGGHSDV

SEQ ID NO: 2078980 - protein, 27 aa, Staphylococcus
NPLHQIQGLGPIIIKVNELPVTASILK

SEQ ID NO: 2078981 - protein, 21 aa, Staphylococcus
NPLIPKLHHFAHNETCFILAQ

SEQ ID NO: 2078982 - protein, 33 aa, Staphylococcus
NPLISPIYGIKQGLPPIIMFGGGKEIYYPDMQR

SEQ ID NO: 2078983 - protein, 21 aa, Staphylococcus
NPLLEKLNFISIFSSNLDEFF

SEQ ID NO: 2078984 - protein, 17 aa, Staphylococcus
NPLLPDEVRFILKQMGL

SEQ ID NO: 2078985 - protein, 19 aa, Staphylococcus
NPLLPDEVRFILKQMGMKE

SEQ ID NO: 2078986 - protein, 20 aa, Staphylococcus
NPLMCSCLTMNRIDLPHLAW

SEQ ID NO: 2078987 - protein, 28 aa, Staphylococcus
NPLTGKKLPIWIADYVLSSYGTGAVMAV

SEQ ID NO: 2078988 - protein, 18 aa, Staphylococcus
NPLWQVYKIVRFPKVFKQ

SEQ ID NO: 2078989 - protein, 22 aa, Staphylococcus
NPMQYKHYGLKALKDIIKHELC

SEQ ID NO: 2078990 - protein, 23 aa, Staphylococcus
NPNIFLVIVAPHGPLKSKTINRV

SEQ ID NO: 2078991 - protein, 18 aa, Staphylococcus
NPNIKGKLFKLLEFSNME

SEQ ID NO: 2078992 - protein, 21 aa, Staphylococcus
NPNIKGQLFKLLDFSNMKETD

SEQ ID NO: 2078993 - protein, 23 aa, Staphylococcus
NPNSIFVKQLLITQPQSFGRATM

SEQ ID NO: 2078994 - protein, 19 aa, Staphylococcus
NPNYNENLPYVSRSERPEW

SEQ ID NO: 2078995 - protein, 17 aa, Staphylococcus
NPPFATRESLPYIREKE

SEQ ID NO: 2078996 - protein, 22 aa, Staphylococcus
NPPHLKAMIPWEGLNDMYREVA

SEQ ID NO: 2078997 - protein, 17 aa, Staphylococcus
NPQLFIGAGIGVTPLVS

SEQ ID NO: 2078998 - protein, 20 aa, Staphylococcus
NPQPRMYRLLEDDALINRMG

SEQ ID NO: 2078999 - protein, 23 aa, Staphylococcus
NPQVRRYFPSLLSYRRSALDMKQ

SEQ ID NO: 2079000 - protein, 24 aa, Staphylococcus
NPQVRRYFPSLLSYRRSELDMQQM

SEQ ID NO: 2079001 - protein, 24 aa, Staphylococcus
NPRFIDKMLWNTRFKVPHFITSSV

SEQ ID NO: 2079002 - protein, 23 aa, Staphylococcus
NPRSQFFCLNTTSELAFEPENFG

SEQ ID NO: 2079003 - protein, 25 aa, Staphylococcus
NPRYNPYMGAYRLQWEMIKFAKAHH

SEQ ID NO: 2079004 - protein, 24 aa, Staphylococcus
NPSACFTGFELFVKPAIQHMMGAT

SEQ ID NO: 2079005 - protein, 22 aa, Staphylococcus
NPSACFTGFELFVKPAMNHLMN

SEQ ID NO: 2079006 - protein, 24 aa, Staphylococcus
NPSDYKLLVLGKVGIDFFKNRSIE

SEQ ID NO: 2079007 - protein, 17 aa, Staphylococcus
NPSISFTVLFKKSEIEL

SEQ ID NO: 2079008 - protein, 22 aa, Staphylococcus
NPSLLNPTLYSYLNQLPHGAFS

SEQ ID NO: 2079009 - protein, 17 aa, Staphylococcus
NPSLLNQSFYQFLKQYQ

SEQ ID NO: 2079010 - protein, 24 aa, Staphylococcus
NPSMRRYLEISLEISKIALKYVPR

SEQ ID NO: 2079011 - protein, 27 aa, Staphylococcus
NPSPMTAYGIYIAMKRTALEQFNGESL

SEQ ID NO: 2079012 - protein, 25 aa, Staphylococcus
NPSSEILSAVLMLEHLGWQEAADKI

SEQ ID NO: 2079013 - protein, 29 aa, Staphylococcus
NPTEDDVLMYNYLKHFDIPTLIICTKEDK

SEQ ID NO: 2079014 - protein, 29 aa, Staphylococcus
NPTEDDVLMYNYLKHFDLPTLVICTKEDK

SEQ ID NO: 2079015 - protein, 28 aa, Staphylococcus
NPTFENIRYIGIYNPRFNQIYKYDMTQA

SEQ ID NO: 2079016 - protein, 26 aa, Staphylococcus
NPTKDDFYHFRKVNQSHWEAFQENKL

SEQ ID NO: 2079017 - protein, 18 aa, Staphylococcus
NPTKPIGLFYTKEQAEQT

SEQ ID NO: 2079018 - protein, 29 aa, Staphylococcus
NPTQDDILMYNYLKHFDIPTLVICTKEDK

SEQ ID NO: 2079019 - protein, 22 aa, Staphylococcus
NPTRYLELLQNFKINVLCCTPT

SEQ ID NO: 2079020 - protein, 25 aa, Staphylococcus
NPVELRRKIGYVIQQIGLMPHMTIR

SEQ ID NO: 2079021 - protein, 18 aa, Staphylococcus
NPVRMIQRNGRINRLGSE

SEQ ID NO: 2079022 - protein, 20 aa, Staphylococcus
NPYDTLLEVIGINGNGIESL

SEQ ID NO: 2079023 - protein, 17 aa, Staphylococcus
NPYEFKTILRNKLLNQI

SEQ ID NO: 2079024 - protein, 23 aa, Staphylococcus
NPYHFFQCWVAKEAYLKCIGTGL

SEQ ID NO: 2079025 - protein, 36 aa, Staphylococcus; identical to SEQ ID NO: 1830850

SEQ ID NO: 2079026 - protein, 36 aa, Staphylococcus
NPYLDKFYQDFERWSFHLQIYFLAERFKEQKRMFEY

SEQ ID NO: 2079027 - protein, 21 aa, Staphylococcus
NPYLYIRKSYPNPFIKGLDII

SEQ ID NO: 2079028 - protein, 17 aa, Staphylococcus
NQALFDEIIEQHQFIKG

SEQ ID NO: 2079029 - protein, 19 aa, Staphylococcus
NQALVYYREVVRFHQLNVH

SEQ ID NO: 2079030 - protein, 24 aa, Staphylococcus
NQCMLIAIPDMHWSLEIDSSLNED

SEQ ID NO: 2079031 - protein, 22 aa, Staphylococcus
NQDMFVTMFYGLYEEMNHLLYC

SEQ ID NO: 2079032 - protein, 31 aa, Staphylococcus
NQDPVFGKINLFPMQKWFFSQEFHNIHHWNQ

SEQ ID NO: 2079033 - protein, 34 aa, Staphylococcus
NQDTKLTVTALLAKAIVLALKDYGAMNARYENGQ

SEQ ID NO: 2079034 - protein, 24 aa, Staphylococcus
NQECRVLISHLGMAGGFFIVNHLD

SEQ ID NO: 2079035 - protein, 27 aa, Staphylococcus
NQEEKDMFLSLIKVTGIGPKSALAILA

SEQ ID NO: 2079036 - protein, 31 aa, Staphylococcus
NQEIHLTAPSKYYVWGAGPKANPYFYQIELV

SEQ ID NO: 2079037 - protein, 20 aa, Staphylococcus
NQELPNLQRLGLGNIDSLPV

SEQ ID NO: 2079038 - protein, 29 aa, Staphylococcus
NQEMALLPEYGLNIKIVLINNGTLGMVKQ

SEQ ID NO: 2079039 - protein, 25 aa, Staphylococcus
NQEMALLPEYNLNVKIVLINNGTLG

SEQ ID NO: 2079040 - protein, 37 aa, Staphylococcus
NQEQTFLDAFLKPTRLYVKPVLAVKSSIKIYAMTHIT

SEQ ID NO: 2079041 - protein, 18 aa, Staphylococcus
NQEQVYLGYYDDSVFKYE

SEQ ID NO: 2079042 - protein, 17 aa, Staphylococcus
NQEVWTTCTFILNDEGK

SEQ ID NO: 2079043 - protein, 25 aa, Staphylococcus
NQFAKLQSIFGERDMFFISENGAVI

SEQ ID NO: 2079044 - protein, 22 aa, Staphylococcus
NQFGELIRLKKEAGYLLLEVNQ

SEQ ID NO: 2079045 - protein, 23 aa, Staphylococcus
NQFGVYVIFDNKKPVFVGQTGGY

SEQ ID NO: 2079046 - protein, 22 aa, Staphylococcus
NQFSKMIFSQEGYLICIEDYEH

SEQ ID NO: 2079047 - protein, 23 aa, Staphylococcus
NQGGFLRQLYQKVPFKQGVGIDL

SEQ ID NO: 2079048 - protein, 26 aa, Staphylococcus
NQGKFSMIRIVHKPTIFIDKLQSNRL

SEQ ID NO: 2079049 - protein, 21 aa, Staphylococcus
NQGMYNLKLYSYILSIMINEI

SEQ ID NO: 2079050 - protein, 31 aa, Staphylococcus
NQGQASRYLTWLTTQLLPYVREQYRVSLNNQ

SEQ ID NO: 2079051 - protein, 26 aa, Staphylococcus
NQGYNVVMDIPLLFENELEDTVDEVW

SEQ ID NO: 2079052 - protein, 26 aa, Staphylococcus
NQHLDWVMEVANIHYVAIASWGRNIY

SEQ ID NO: 2079053 - protein, 17 aa, Staphylococcus
NQHNIPVTYLGNGSNII

SEQ ID NO: 2079054 - protein, 18 aa, Staphylococcus
NQHPLFRYLTDAAKGMLN

SEQ ID NO: 2079055 - protein, 19 aa, Staphylococcus
NQHRYLLKKTWDKDKKIIS

SEQ ID NO: 2079056 - protein, 24 aa, Staphylococcus
NQHTQMIPYGYPRISYLLHYQNDK

SEQ ID NO: 2079057 - protein, 35 aa, Staphylococcus
NQIERYRKFNYTGLFRFIQLFVISNKMETRYYANS

SEQ ID NO: 2079058 - protein, 19 aa, Staphylococcus
NQIGALLLNYRIKQTAKMT

SEQ ID NO: 2079059 - protein, 27 aa, Staphylococcus
NQILKEIIARLSFLNNVGLEYLTLNRA

SEQ ID NO: 2079060 - protein, 27 aa, Staphylococcus
NQILKEIISRLSFLNNVGLEYLTLNRA

SEQ ID NO: 2079061 - protein, 28 aa, Staphylococcus
NQILKEIISRLSFLNNVGLEYLTLNRSS

SEQ ID NO: 2079062 - protein, 22 aa, Staphylococcus
NQILKSYPMVPGIDLAGTVVES

SEQ ID NO: 2079063 - protein, 27 aa, Staphylococcus
NQILNQDYLIKPSLISDLYQPQTSISN

SEQ ID NO: 2079064 - protein, 19 aa, Staphylococcus
NQIMLDVYSQFFGDSVKLT

SEQ ID NO: 2079065 - protein, 17 aa, Staphylococcus
NQINVDAYAYYFKLPFH

SEQ ID NO: 2079066 - protein, 21 aa, Staphylococcus
NQITHVHDPLLYVSADTHNAE

SEQ ID NO: 2079067 - protein, 17 aa, Staphylococcus
NQKFSFEDLPQFTPELF

SEQ ID NO: 2079068 - protein, 27 aa, Staphylococcus
NQKFSFQELPQFTPELFMKVSAKNVMK

SEQ ID NO: 2079069 - protein, 24 aa, Staphylococcus
NQKHQIMLMIDWKDRREGVITYDV

SEQ ID NO: 2079070 - protein, 21 aa, Staphylococcus
NQKNYHMLADEPSIDVIDAVA

SEQ ID NO: 2079071 - protein, 23 aa, Staphylococcus
NQKPNIMPVWSIKNRARKVRDKD

SEQ ID NO: 2079072 - protein, 25 aa, Staphylococcus
NQKVKVLLAQSLFGAPDVLLLDEPT

SEQ ID NO: 2079073 - protein, 23 aa, Staphylococcus
NQLDLFESLELPLARILGEMEEL

SEQ ID NO: 2079074 - protein, 26 aa, Staphylococcus
NQLHHDAPIQIIPAPEDLFVEYIEDD

SEQ ID NO: 2079075 - protein, 24 aa, Staphylococcus
NQLRRKLNFLFKPIQRKNKSAYTS

SEQ ID NO: 2079076 - protein, 20 aa, Staphylococcus
NQMLFSLKLTAHAALGMASD

SEQ ID NO: 2079077 - protein, 25 aa, Staphylococcus
NQMRRFHNAFQKSGLKYNISYASKA

SEQ ID NO: 2079078 - protein, 25 aa, Staphylococcus
NQMRRYHKAFQQSGLKYNISYASKA

SEQ ID NO: 2079079 - protein, 25 aa, Staphylococcus
NQMRRYHSAFQKSGLKYNISYASKA

SEQ ID NO: 2079080 - protein, 19 aa, Staphylococcus
NQNLDFALAIRTMLIDDTT

SEQ ID NO: 2079081 - protein, 24 aa, Staphylococcus
NQNVHFEVLLVKIAEMVKSQPDTV

SEQ ID NO: 2079082 - protein, 22 aa, Staphylococcus
NQNYKRLKGIKEWGFGLFEGES

SEQ ID NO: 2079083 - protein, 28 aa, Staphylococcus
NQPIVFNDVHFYVLPFATISEVKEFFKD

SEQ ID NO: 2079084 - protein, 25 aa, Staphylococcus
NQPNSRYMVFYNDELTLYTKTSNES

SEQ ID NO: 2079085 - protein, 26 aa, Staphylococcus
NQPVKLYYNSPMFRYERKQKGRYRQF

SEQ ID NO: 2079086 - protein, 25 aa, Staphylococcus
NQQCRAVLPYHLYIEINKLMTLSHF

SEQ ID NO: 2079087 - protein, 25 aa, Staphylococcus
NQQIVIPEFISPDVKFAMISSIDIA

SEQ ID NO: 2079088 - protein, 23 aa, Staphylococcus
NQQLKQLVDCFKAFTFKVNGTLP

SEQ ID NO: 2079089 - protein, 22 aa, Staphylococcus
NQQLPMGLLYANLLIEQSSKND

SEQ ID NO: 2079090 - protein, 28 aa, Staphylococcus
NQQQSDAFLWQLLADNLQQLNLPLNKKE

SEQ ID NO: 2079091 - protein, 24 aa, Staphylococcus
NQQVRRYFPSLLSYRRSELDMKKM

SEQ ID NO: 2079092 - protein, 23 aa, Staphylococcus
NQREILFKYYKYRKKNILINDMY

SEQ ID NO: 2079093 - protein, 30 aa, Staphylococcus
NQRELPWRETADPYYIWLSEVMLQQTQVKT

SEQ ID NO: 2079094 - protein, 31 aa, Staphylococcus
NQREMPWRETSNPYYIWLSEVMLQQTQVKTV

SEQ ID NO: 2079095 - protein, 25 aa, Staphylococcus
NQRKLDALLLVDIAVPRDIEPGIDA

SEQ ID NO: 2079096 - protein, 18 aa, Staphylococcus
NQRKMMLESIRYVDLVIP

SEQ ID NO: 2079097 - protein, 25 aa, Staphylococcus
NQSERDLIRLFGKRGHGLYNKARGI

SEQ ID NO: 2079098 - protein, 26 aa, Staphylococcus
NQSIFGGIIALNRPVTATLAETLHSI

SEQ ID NO: 2079099 - protein, 24 aa, Staphylococcus
NQSIFGGIIALNRTVDAKLAETLH

SEQ ID NO: 2079100 - protein, 24 aa, Staphylococcus
NQSLFIYELIQPPTAYQFFNDPML

SEQ ID NO: 2079101 - protein, 22 aa, Staphylococcus
NQSLMLVTALNPHIGYEKAASI

SEQ ID NO: 2079102 - protein, 22 aa, Staphylococcus
NQSVHFEVLLVKIAEMIKEKPE

SEQ ID NO: 2079103 - protein, 22 aa, Staphylococcus
NQSVRYLLNMFVPPDDTMSQLV

SEQ ID NO: 2079104 - protein, 23 aa, Staphylococcus
NQTEIFNEWTILGISPEIIDDST

SEQ ID NO: 2079105 - protein, 24 aa, Staphylococcus
NQTGSWIRVYEVNPDGTRGKLISE

SEQ ID NO: 2079106 - protein, 29 aa, Staphylococcus
NQTLASLIGYLLRRYVDVNLVYGLAIAWA

SEQ ID NO: 2079107 - protein, 17 aa, Staphylococcus
NQTLKTYQAQCVLTDIL

SEQ ID NO: 2079108 - protein, 18 aa, Staphylococcus
NQTLRLYPTKNLEDFYDK

SEQ ID NO: 2079109 - protein, 20 aa, Staphylococcus
NQTWLVIANFSKEPVLLPED

SEQ ID NO: 2079110 - protein, 24 aa, Staphylococcus
NQVEFHPYFTQNKLRKYLEVQNIH

SEQ ID NO: 2079111 - protein, 24 aa, Staphylococcus
NQVEFHPYLIQKDLRKYLEAQSIV

SEQ ID NO: 2079112 - protein, 28 aa, Staphylococcus
NQVFQGEALLFLLGLTNSMAGFEKLVPD

SEQ ID NO: 2079113 - protein, 19 aa, Staphylococcus
NQVIKKVYLNQFTASFVGH

SEQ ID NO: 2079114 - protein, 23 aa, Staphylococcus
NQVIKKVYLNQYTLSFVGHFSAG

SEQ ID NO: 2079115 - protein, 26 aa, Staphylococcus
NQVLEMPFYYILQILDERHLNTVDTD

SEQ ID NO: 2079116 - protein, 31 aa, Staphylococcus; identical to SEQ ID NO: 1680589

SEQ ID NO: 2079117 - protein, 24 aa, Staphylococcus
NQYAKLKSIFGERDMYFISENGAV

SEQ ID NO: 2079118 - protein, 27 aa, Staphylococcus
NQYAKLKSIFGVRDMFFISENGAVIYN

SEQ ID NO: 2079119 - protein, 26 aa, Staphylococcus
NQYFQNLLTDFPGFSFPSLTPIEKEG

SEQ ID NO: 2079120 - protein, 24 aa, Staphylococcus
NQYNEKIIPVFWIAGEDHDFDEVN

SEQ ID NO: 2079121 - protein, 23 aa, Staphylococcus
NQYTSYTHPFLKELRSMKRQISI

SEQ ID NO: 2079122 - protein, 26 aa, Staphylococcus
NRARLAIYPAAMRYAGPREAILHAIV

SEQ ID NO: 2079123 - protein, 22 aa, Staphylococcus
NRAYLRALGFEDEDFQKPMIGV

SEQ ID NO: 2079124 - protein, 23 aa, Staphylococcus
NRDARFVCVISMSAPNETTQTFK

SEQ ID NO: 2079125 - protein, 18 aa, Staphylococcus
NRDEVIERFITSLPQRHV

SEQ ID NO: 2079126 - protein, 20 aa, Staphylococcus
NRDEVIERFITSLPQRHVVP

SEQ ID NO: 2079127 - protein, 31 aa, Staphylococcus
NRDQNNIHLMQLKELFLVSLQERAIPFEVNG

SEQ ID NO: 2079128 - protein, 24 aa, Staphylococcus
NRDTTYSAPLRVKVRLIIKETGEV

SEQ ID NO: 2079129 - protein, 18 aa, Staphylococcus
NREEVINRFITSLPQRHV

SEQ ID NO: 2079130 - protein, 20 aa, Staphylococcus
NREKYYFPGGKIDIGETYKQ

SEQ ID NO: 2079131 - protein, 19 aa, Staphylococcus
NRELINYIIHYADQKNLET

SEQ ID NO: 2079132 - protein, 17 aa, Staphylococcus
NRELSWLDFNYRVLQEA

SEQ ID NO: 2079133 - protein, 18 aa, Staphylococcus
NRELSWLDFNYRVLQEAY

SEQ ID NO: 2079134 - protein, 33 aa, Staphylococcus
NREMKIYMLIVERFLESLMPPYEYQHIKVHLAV

SEQ ID NO: 2079135 - protein, 18 aa, Staphylococcus
NRENFFAMGAYAQNLMLL

SEQ ID NO: 2079136 - protein, 22 aa, Staphylococcus
NRENFFAMGAYTQNLMLLLYEK

SEQ ID NO: 2079137 - protein, 34 aa, Staphylococcus
NRENYFAFGAFAQNLMLLLYEAGIGTCWKTPHYI

SEQ ID NO: 2079138 - protein, 21 aa, Staphylococcus
NRFIKDALGLHIKELRKPHYK

SEQ ID NO: 2079139 - protein, 20 aa, Staphylococcus
NRFISIMAGLPINYIQEQLQ

SEQ ID NO: 2079140 - protein, 20 aa, Staphylococcus
NRFISIMAGLSIDYIREQLN

SEQ ID NO: 2079141 - protein, 30 aa, Staphylococcus
NRFLEANVPYIIYLENPTALFHYKLKRYST

SEQ ID NO: 2079142 - protein, 22 aa, Staphylococcus
NRFNNEEFVWIVGGGALISELI

SEQ ID NO: 2079143 - protein, 27 aa, Staphylococcus
NRGAVPYTVFIDPPLARVGLTSKEAKA

SEQ ID NO: 2079144 - protein, 25 aa, Staphylococcus
NRGAVPYTVFIDPPLSRVGMTGDEA

SEQ ID NO: 2079145 - protein, 19 aa, Staphylococcus
NRGGRIIYIGAGTSGRLGV

SEQ ID NO: 2079146 - protein, 26 aa, Staphylococcus
NRGTIPYTVFIDPPFSRVGLTAKEAQ

SEQ ID NO: 2079147 - protein, 21 aa, Staphylococcus
NRHANRLKKIPIRININGIRG

SEQ ID NO: 2079148 - protein, 24 aa, Staphylococcus
NRHFAESLSIPFYYVPNNKEKQEV

SEQ ID NO: 2079149 - protein, 24 aa, Staphylococcus
NRHLSILPEVFKAFEGLYNQYYNQ

SEQ ID NO: 2079150 - protein, 18 aa, Staphylococcus
NRHVDVREFIQLNYSLYE

SEQ ID NO: 2079151 - protein, 17 aa, Staphylococcus
NRIEGFFSIAGFGPDAK

SEQ ID NO: 2079152 - protein, 17 aa, Staphylococcus
NRIIITSRLFASTTKKE

SEQ ID NO: 2079153 - protein, 24 aa, Staphylococcus
NRIKNIWMEYVGTGLQFTHGAGNH

SEQ ID NO: 2079154 - protein, 18 aa, Staphylococcus
NRIQLKRPVMTEAQLNVI

SEQ ID NO: 2079155 - protein, 24 aa, Staphylococcus
NRIVQALPTIEYILDQGGRLVLFS

SEQ ID NO: 2079156 - protein, 25 aa, Staphylococcus
NRKAFRGTELYKKTLGIIGAGRIGL

SEQ ID NO: 2079157 - protein, 26 aa, Staphylococcus
NRKAFRGVELYGKTLGVIGAGRIGLG

SEQ ID NO: 2079158 - protein, 20 aa, Staphylococcus
NRKAFRGVELYQKTLGVIGT

SEQ ID NO: 2079159 - protein, 23 aa, Staphylococcus
NRKAQFVCVISMSAPNEPTHIFK

SEQ ID NO: 2079160 - protein, 31 aa, Staphylococcus
NRKDSEFMLQILPYLLMVSYNSGINAYNYEL

SEQ ID NO: 2079161 - protein, 24 aa, Staphylococcus
NRKEKFFVLMGFTSDELLNLPNKL

SEQ ID NO: 2079162 - protein, 19 aa, Staphylococcus
NRKILHRQFQTIHTTYGAI

SEQ ID NO: 2079163 - protein, 26 aa, Staphylococcus
NRKNHQLLLSIHPSFSRLQITDKKYD

SEQ ID NO: 2079164 - protein, 30 aa, Staphylococcus
NRKRVRRAIQYYLKTKKLLSSRKKVQQFTE

SEQ ID NO: 2079165 - protein, 19 aa, Staphylococcus
NRLFIFVSEGLLKGYLYLQ

SEQ ID NO: 2079166 - protein, 17 aa, Staphylococcus
NRLFNTSPVFSQIPGPN

SEQ ID NO: 2079167 - protein, 18 aa, Staphylococcus
NRLIPLSEGYIYFKDKPI

SEQ ID NO: 2079168 - protein, 19 aa, Staphylococcus
NRLIPLSEGYIYFKDKPIS

SEQ ID NO: 2079169 - protein, 18 aa, Staphylococcus
NRLIPLTEGYIYFKDKPV

SEQ ID NO: 2079170 - protein, 19 aa, Staphylococcus
NRLPKFQPGFYINGKIYIN

SEQ ID NO: 2079171 - protein, 19 aa, Staphylococcus
NRLQLKHPVLTEAQLKAAE

SEQ ID NO: 2079172 - protein, 26 aa, Staphylococcus
NRLTSTFLRRQFNIVTLSVTPSTTPG

SEQ ID NO: 2079173 - protein, 20 aa, Staphylococcus
NRMHVTLTKSKQWLDNLKFL

SEQ ID NO: 2079174 - protein, 30 aa, Staphylococcus
NRMREIQFALYDRKIPLILVFEGMDAAGKG

SEQ ID NO: 2079175 - protein, 33 aa, Staphylococcus
NRMYWPARRRESIFFTYILKHHPRFKDADVPVW

SEQ ID NO: 2079176 - protein, 30 aa, Staphylococcus
NRNLDNLAFIPFKPELYTHCVLVWKKSRIQ

SEQ ID NO: 2079177 - protein, 27 aa, Staphylococcus
NRNSRRSLLWLWYDDDWKLYFHQGTPL

SEQ ID NO: 2079178 - protein, 24 aa, Staphylococcus
NRNTIFYNTLFDENASCHIALGSA

SEQ ID NO: 2079179 - protein, 26 aa, Staphylococcus
NRPEQGLLALRKKLGLFANIRPTKVT

SEQ ID NO: 2079180 - protein, 28 aa, Staphylococcus
NRPYQDAEFPMFLVVNVIDGQRFGQFVF

SEQ ID NO: 2079181 - protein, 17 aa, Staphylococcus
NRQLRRPDLTYATLDHN

SEQ ID NO: 2079182 - protein, 26 aa, Staphylococcus
NRRTIFYNTLFDENASCHLAIGSAYG

SEQ ID NO: 2079183 - protein, 19 aa, Staphylococcus
NRRVPDPLVYAYCYMWNEN

SEQ ID NO: 2079184 - protein, 22 aa, Staphylococcus
NRSDALTYVKTCELPVVIKKDG

SEQ ID NO: 2079185 - protein, 20 aa, Staphylococcus
NRSFVWLNTMRYLNKEDADT

SEQ ID NO: 2079186 - protein, 27 aa, Staphylococcus
NRSNLLTYLNIFDDVRAFFSQQTGLKK

SEQ ID NO: 2079187 - protein, 33 aa, Staphylococcus
NRSTFYRYFQDKYDLLYSLPPYMTGEIMGDPNT

SEQ ID NO: 2079188 - protein, 32 aa, Staphylococcus
NRSTFYRYFQDKYDLLYSLTKYMKEALDLDSL

SEQ ID NO: 2079189 - protein, 24 aa, Staphylococcus
NRSTFYRYFQDKYELLYTLPDFIA

SEQ ID NO: 2079190 - protein, 25 aa, Staphylococcus
NRSTFYRYFQDKYELLYTLPDFITQ

SEQ ID NO: 2079191 - protein, 24 aa, Staphylococcus
NRTHFKLPHWLFKMIQNHFVKKHQ

SEQ ID NO: 2079192 - protein, 20 aa, Staphylococcus
NRTIAMINKYFDGELPAYEG

SEQ ID NO: 2079193 - protein, 22 aa, Staphylococcus
NRTLRAEVFLKEQFERLKREQI

SEQ ID NO: 2079194 - protein, 17 aa, Staphylococcus
NRTPLITYGMFIKDKTK

SEQ ID NO: 2079195 - protein, 18 aa, Staphylococcus
NRVDLYQQAFSHSSFIND

SEQ ID NO: 2079196 - protein, 18 aa, Staphylococcus
NRWHPDIPAVFSVDPGES

SEQ ID NO: 2079197 - protein, 17 aa, Staphylococcus
NRWQKKLENVGWNALFI

SEQ ID NO: 2079198 - protein, 17 aa, Staphylococcus
NRWQKSLEDVGWNALFI

SEQ ID NO: 2079199 - protein, 30 aa, Staphylococcus
NRYGCLLAIEILKLFKDIQLDVDLYVGANV

SEQ ID NO: 2079200 - protein, 17 aa, Staphylococcus
NRYLVEELGFDHAVDYK

SEQ ID NO: 2079201 - protein, 18 aa, Staphylococcus
NRYNVPVVFIGGSIDVDI

SEQ ID NO: 2079202 - protein, 30 aa, Staphylococcus
NRYVGNIYTGSLYLSLISLLETHDLSANDT

SEQ ID NO: 2079203 - protein, 26 aa, Staphylococcus
NSAAMIEMVLINLMHCYLLSNNKKDK

SEQ ID NO: 2079204 - protein, 20 aa, Staphylococcus
NSAANMILALSYQAKHMHSN

SEQ ID NO: 2079205 - protein, 23 aa, Staphylococcus
NSAHFVSTAVLYVLAGHVAYLNQ

SEQ ID NO: 2079206 - protein, 23 aa, Staphylococcus
NSAPLIIETFLKTAELFDGMGVN

SEQ ID NO: 2079207 - protein, 24 aa, Staphylococcus
NSDFITINAAYSPKLHHLIDTEQF

SEQ ID NO: 2079208 - protein, 32 aa, Staphylococcus
NSDGEAFAKFFKLMLNQGINLAPSKFEAWFLT

SEQ ID NO: 2079209 - protein, 29 aa, Staphylococcus
NSDKKYIYNWIKLEKLLFEKLHDFIEVMG

SEQ ID NO: 2079210 - protein, 23 aa, Staphylococcus
NSDLALNLSIYGRAYEIVYRDMK

SEQ ID NO: 2079211 - protein, 26 aa, Staphylococcus
NSDMVLTFFNWPNQYRGRIGSGQIGR

SEQ ID NO: 2079212 - protein, 28 aa, Staphylococcus
NSDNELGFYKFYFNLLDKWCMSNDNYYI

SEQ ID NO: 2079213 - protein, 24 aa, Staphylococcus
NSDRPLALCAALLHDLGHGPFSHS

SEQ ID NO: 2079214 - protein, 23 aa, Staphylococcus
NSDTIYRSILNLVILCGCQGVNG

SEQ ID NO: 2079215 - protein, 25 aa, Staphylococcus
NSEDPKFKRWVIGSILSRTYYHNMV

SEQ ID NO: 2079216 - protein, 19 aa, Staphylococcus
NSFAMRLNQLGKGAHVVGE

SEQ ID NO: 2079217 - protein, 23 aa, Staphylococcus
NSFKAILRCDPDIILIGEIRDAQ

SEQ ID NO: 2079218 - protein, 21 aa, Staphylococcus
NSFKAILRCDPDVILIGEIRD

SEQ ID NO: 2079219 - protein, 23 aa, Staphylococcus
NSFKAILRCDPDVILIGEIRDAY

SEQ ID NO: 2079220 - protein, 24 aa, Staphylococcus
NSFKQPIVWLCGGLDRGNDFDELI

SEQ ID NO: 2079221 - protein, 26 aa, Staphylococcus
NSFVYSRRLPFHAKRFNDWLEQMPQN

SEQ ID NO: 2079222 - protein, 29 aa, Staphylococcus
NSGFVERYYFKSLYSKFYPGILVEIATDG

SEQ ID NO: 2079223 - protein, 18 aa, Staphylococcus
NSGLPLTMIGLDLAREAI

SEQ ID NO: 2079224 - protein, 26 aa, Staphylococcus
NSGLQNLLLDPYFKGIVTEYQDALRE

SEQ ID NO: 2079225 - protein, 23 aa, Staphylococcus
NSGLVDRFYFEALYARIGHILIE

SEQ ID NO: 2079226 - protein, 34 aa, Staphylococcus
NSGNDPAWMILDVLPIIPPEIRPMVQLDGGRFAT

SEQ ID NO: 2079227 - protein, 34 aa, Staphylococcus
NSGNKPEWMILDVLPIIPPEIRPMVQLDGGRFAT

SEQ ID NO: 2079228 - protein, 17 aa, Staphylococcus
NSGVILSQIFRGFCKNI

SEQ ID NO: 2079229 - protein, 23 aa, Staphylococcus
NSGVILSQLFRGFCKNIEDAKVI

SEQ ID NO: 2079230 - protein, 21 aa, Staphylococcus
NSHIDQRLKYIKLSTKGQQYI

SEQ ID NO: 2079231 - protein, 19 aa, Staphylococcus
NSILKEKQFFVIENLAKSM

SEQ ID NO: 2079232 - protein, 19 aa, Staphylococcus
NSILKEKQFFVIENLAKTM

SEQ ID NO: 2079233 - protein, 19 aa, Staphylococcus
NSILKFLEEPPENTIAILL

SEQ ID NO: 2079234 - protein, 25 aa, Staphylococcus
NSIPLIASSIMSKKIAAGADAIVLD

SEQ ID NO: 2079235 - protein, 28 aa, Staphylococcus
NSISLSTLFDPLLEPELIFELTADLPEN

SEQ ID NO: 2079236 - protein, 18 aa, Staphylococcus
NSIVGTSSLRRGAQILAK

SEQ ID NO: 2079237 - protein, 18 aa, Staphylococcus
NSIYAHEGLMNSLGHRKN

SEQ ID NO: 2079238 - protein, 23 aa, Staphylococcus
NSKVIFCEASDWEDFYNDNKNYI

SEQ ID NO: 2079239 - protein, 22 aa, Staphylococcus
NSKYLFSYFVKRNPTIETYFVT

SEQ ID NO: 2079240 - protein, 17 aa, Staphylococcus
NSKYLIATTAAKRAREI

SEQ ID NO: 2079241 - protein, 23 aa, Staphylococcus
NSKYTTMYGMRTYGHNLGGTATD

SEQ ID NO: 2079242 - protein, 26 aa, Staphylococcus
NSLHEVYGLGLDLFAGSGALGIEALS

SEQ ID NO: 2079243 - protein, 24 aa, Staphylococcus
NSLLDLWAQVYLIDRGERLETAFS

SEQ ID NO: 2079244 - protein, 21 aa, Staphylococcus
NSLPEDTVIDSWFYIENCNAV

SEQ ID NO: 2079245 - protein, 23 aa, Staphylococcus
NSLYPFILSEYAIPSVYKGSTDD

SEQ ID NO: 2079246 - protein, 23 aa, Staphylococcus
NSNFIYELIQPPTAYQFFNDPML

SEQ ID NO: 2079247 - protein, 32 aa, Staphylococcus
NSNGEAFAKFFKLMLNQGINLAPSKFEAWFLT

SEQ ID NO: 2079248 - protein, 25 aa, Staphylococcus
NSNRLVLYHKYSRKDFLRIMNWEKD

SEQ ID NO: 2079249 - protein, 28 aa, Staphylococcus
NSNWDMLFVVFCIHFIHLMKEFTVQEIK

SEQ ID NO: 2079250 - protein, 24 aa, Staphylococcus
NSPETPIFQKRKLLYNIDRARRTI

SEQ ID NO: 2079251 - protein, 26 aa, Staphylococcus
NSPETPIFQKRKLLYNLDKARKSIRK

SEQ ID NO: 2079252 - protein, 25 aa, Staphylococcus
NSPETPIFQKRRLLYNLDKARKSIR

SEQ ID NO: 2079253 - protein, 24 aa, Staphylococcus
NSPETPIFQKRRLLYNLDNARKSI

SEQ ID NO: 2079254 - protein, 29 aa, Staphylococcus
NSPETPIFQKRRLLYNLDYARKRIRKNDE

SEQ ID NO: 2079255 - protein, 24 aa, Staphylococcus
NSPETPIFQKRRLLYNVDKARKSI

SEQ ID NO: 2079256 - protein, 17 aa, Staphylococcus
NSPFVRMQLIKIIYFIL

SEQ ID NO: 2079257 - protein, 17 aa, Staphylococcus
NSPTFNIIKSYKGTNMK

SEQ ID NO: 2079258 - protein, 24 aa, Staphylococcus
NSPYRDYYFFRRSANEEPPTNWES

SEQ ID NO: 2079259 - protein, 23 aa, Staphylococcus
NSQFKILHIPVYYGGDRGPDIET

SEQ ID NO: 2079260 - protein, 21 aa, Staphylococcus
NSQHFLLIEAFENYMDNVEVE

SEQ ID NO: 2079261 - protein, 25 aa, Staphylococcus
NSQSTRIVLLLNNKNKQFWDNTKAV

SEQ ID NO: 2079262 - protein, 20 aa, Staphylococcus
NSQVYLMQKAIKYGQELKKQ

SEQ ID NO: 2079263 - protein, 25 aa, Staphylococcus
NSRYLFNHFAKHFSKLPIYFITNDV

SEQ ID NO: 2079264 - protein, 17 aa, Staphylococcus
NSRYPLVEQIHISTLVQ

SEQ ID NO: 2079265 - protein, 23 aa, Staphylococcus
NSSDLMYGLPWQSVMAGDNEMYH

SEQ ID NO: 2079266 - protein, 26 aa, Staphylococcus
NSSFRGLFQFIRFIDELIDRGKDFGE

SEQ ID NO: 2079267 - protein, 26 aa, Staphylococcus
NSSFRGLFQFIRFIDELIDRGRDFGE

SEQ ID NO: 2079268 - protein, 26 aa, Staphylococcus
NSSFRGLYQFIRFIDELIDRGKDFGE

SEQ ID NO: 2079269 - protein, 25 aa, Staphylococcus
NSSFRGLYQFIRFIDELIDRGQDFG

SEQ ID NO: 2079270 - protein, 26 aa, Staphylococcus
NSSFRGLYQFIRFIDELIERGKDFGE

SEQ ID NO: 2079271 - protein, 23 aa, Staphylococcus
NSSKALQVILTPEKTRYLNQATI

SEQ ID NO: 2079272 - protein, 22 aa, Staphylococcus
NSSSKSLKYLLGNSPKSYTENK

SEQ ID NO: 2079273 - protein, 24 aa, Staphylococcus
NSSYLIDLLENFVIERGIYGKKWL

SEQ ID NO: 2079274 - protein, 28 aa, Staphylococcus
NSTAELTFALVLAVARRIPEGDKLCRTT

SEQ ID NO: 2079275 - protein, 21 aa, Staphylococcus
NSTFTLDDFLEQLDQVKNLGP

SEQ ID NO: 2079276 - protein, 22 aa, Staphylococcus
NSVAVIFVRVAFTGEYMEVSPN

SEQ ID NO: 2079277 - protein, 22 aa, Staphylococcus
NSVLFEAINLQRASLRQGTHAV

SEQ ID NO: 2079278 - protein, 22 aa, Staphylococcus
NSVLFEAINLQRASLRQGTHSV

SEQ ID NO: 2079279 - protein, 22 aa, Staphylococcus
NSVLFEAITLQRASLRQGTHAV

SEQ ID NO: 2079280 - protein, 18 aa, Staphylococcus
NSVMSRYEFVGPITFRCG

SEQ ID NO: 2079281 - protein, 23 aa, Staphylococcus
NSWTDSWIELFVARRMDHLRDEL

SEQ ID NO: 2079282 - protein, 25 aa, Staphylococcus
NSWTNSWITLFVEKRLDKLKDRLVQ

SEQ ID NO: 2079283 - protein, 25 aa, Staphylococcus
NSYVKDKLVFKGKFKMFYISEDEFN

SEQ ID NO: 2079284 - protein, 24 aa, Staphylococcus
NTAIIKRIISWLEPRHNEKKALEV

SEQ ID NO: 2079285 - protein, 27 aa, Staphylococcus
NTALEELALALYIRKEHYGLTTHLKLN

SEQ ID NO: 2079286 - protein, 25 aa, Staphylococcus
NTARLLYLGIVGDTGRFFFNNTTPH

SEQ ID NO: 2079287 - protein, 18 aa, Staphylococcus
NTASVHDTIPWPNYVNYA

SEQ ID NO: 2079288 - protein, 18 aa, Staphylococcus
NTDGTYYLLTKFGKKTYS

SEQ ID NO: 2079289 - protein, 19 aa, Staphylococcus
NTDILINGKRIKTISSKID

SEQ ID NO: 2079290 - protein, 22 aa, Staphylococcus
NTDNIQIMPVLRSPSFDKKDKN

SEQ ID NO: 2079291 - protein, 22 aa, Staphylococcus
NTDRNLFLFSTNDSSVIIEESD

SEQ ID NO: 2079292 - protein, 24 aa, Staphylococcus
NTDRPLALCAALLHDLGHGPFSHS

SEQ ID NO: 2079293 - protein, 20 aa, Staphylococcus
NTDYILLDEPLNNLDMKHSV

SEQ ID NO: 2079294 - protein, 26 aa, Staphylococcus
NTELKVVSLIQVHPLNPAPDEIGFSN

SEQ ID NO: 2079295 - protein, 24 aa, Staphylococcus
NTERRIQRLFQALEPKGDSKPDWQ

SEQ ID NO: 2079296 - protein, 23 aa, Staphylococcus
NTEVNVPIFLKLTSDLELDGFKN

SEQ ID NO: 2079297 - protein, 25 aa, Staphylococcus
NTEYDILCLFMLTPEQPISKQKIYE

SEQ ID NO: 2079298 - protein, 28 aa, Staphylococcus
NTFETNVYPIFWTVQKALEYLQPGATIT

SEQ ID NO: 2079299 - protein, 24 aa, Staphylococcus
NTFEWIKPLLERKYPDIQFEYTYI

SEQ ID NO: 2079300 - protein, 25 aa, Staphylococcus
NTFKCIQLLIQTISQYLHHQLKFVP

SEQ ID NO: 2079301 - protein, 20 aa, Staphylococcus
NTFMTPLGQSPLALGADIVV

SEQ ID NO: 2079302 - protein, 20 aa, Staphylococcus
NTFNCVFNHLSHLGMFIFDI

SEQ ID NO: 2079303 - protein, 18 aa, Staphylococcus
NTFPLIEQDPEQFKDAVK

SEQ ID NO: 2079304 - protein, 31 aa, Staphylococcus
NTFSGGMKRRLSLAITLLAHPDLLILDEPTV

SEQ ID NO: 2079305 - protein, 31 aa, Staphylococcus
NTFSGGMKRRLSLAITLLANPNLIILDEPTV

SEQ ID NO: 2079306 - protein, 18 aa, Staphylococcus
NTFVIYDNTIEQNSLIAV

SEQ ID NO: 2079307 - protein, 26 aa, Staphylococcus
NTGALMSAGLFIVGRIKGVERPALVV

SEQ ID NO: 2079308 - protein, 22 aa, Staphylococcus
NTGIGLTIAANHYGLRCVIYAP

SEQ ID NO: 2079309 - protein, 34 aa, Staphylococcus
NTHFYNTIIKYIKKGVLYPLSYYDGDWYGKDKVN

SEQ ID NO: 2079310 - protein, 18 aa, Staphylococcus
NTHIIKWSKLYLDTFQSS

SEQ ID NO: 2079311 - protein, 26 aa, Staphylococcus
NTHYDISHYIQYLKSLNYPLEVIQSF

SEQ ID NO: 2079312 - protein, 21 aa, Staphylococcus
NTIHWQYGHVLTIFESVLSLC

SEQ ID NO: 2079313 - protein, 19 aa, Staphylococcus
NTIISGPALVAQWINLQYY

SEQ ID NO: 2079314 - protein, 17 aa, Staphylococcus
NTIISHHPLIFKGVQSI

SEQ ID NO: 2079315 - protein, 33 aa, Staphylococcus
NTIKQFITVYAHTLIPPLIAYIQDYGIALEAHM

SEQ ID NO: 2079316 - protein, 28 aa, Staphylococcus
NTIKQYHSQLTAFRLFITDIMHDLAHIN

SEQ ID NO: 2079317 - protein, 17 aa, Staphylococcus
NTILENVSIPLIYNGMS

SEQ ID NO: 2079318 - protein, 24 aa, Staphylococcus
NTINAPMVGTFYKSPSPEEEAYVQ

SEQ ID NO: 2079319 - protein, 22 aa, Staphylococcus
NTIYFKIIFLKRNGTEAASYIA

SEQ ID NO: 2079320 - protein, 24 aa, Staphylococcus
NTKAAYQEWLRVLKPNGKLINIDA

SEQ ID NO: 2079321 - protein, 25 aa, Staphylococcus
NTKGESTIPLIKKLSADNVRLNVTA

SEQ ID NO: 2079322 - protein, 24 aa, Staphylococcus
NTKHRIKMIQLVIDILGFGEICYE

SEQ ID NO: 2079323 - protein, 18 aa, Staphylococcus
NTKIGYWNVSDYNNIIKT

SEQ ID NO: 2079324 - protein, 18 aa, Staphylococcus
NTKITENSFRRCYEGVRI

SEQ ID NO: 2079325 - protein, 20 aa, Staphylococcus
NTKLLQNQLLEKDIPAIKKA

SEQ ID NO: 2079326 - protein, 17 aa, Staphylococcus
NTKRSLALFLMAEVDIS

SEQ ID NO: 2079327 - protein, 17 aa, Staphylococcus
NTKWLCEQYKKDWPFDM

SEQ ID NO: 2079328 - protein, 19 aa, Staphylococcus
NTKYRRALLLYGGAKNGKS

SEQ ID NO: 2079329 - protein, 35 aa, Staphylococcus
NTLDTALVFTNKGRYLFIPVHKLAEIKWKELGQHV

SEQ ID NO: 2079330 - protein, 29 aa, Staphylococcus
NTLENNLMFLTTQLLLDYIHHTQKRDLSH

SEQ ID NO: 2079331 - protein, 18 aa, Staphylococcus
NTLFNRFNNEEFVWIVGG

SEQ ID NO: 2079332 - protein, 25 aa, Staphylococcus
NTLIKYISRIVFNGPLRLVAGSHNG

SEQ ID NO: 2079333 - protein, 26 aa, Staphylococcus
NTLLIELCRFIPNLKWKRWIYIHLLN

SEQ ID NO: 2079334 - protein, 17 aa, Staphylococcus
NTLNLLNSIIKKIDFML

SEQ ID NO: 2079335 - protein, 23 aa, Staphylococcus
NTLPITHLIYLHSAAKITPDASM

SEQ ID NO: 2079336 - protein, 18 aa, Staphylococcus
NTLPQKGNINIYFRSWYS

SEQ ID NO: 2079337 - protein, 18 aa, Staphylococcus
NTLQIRQLHPFPTETIQN

SEQ ID NO: 2079338 - protein, 26 aa, Staphylococcus
NTLQPSPFHWRFMDKLALSTLYEVVL

SEQ ID NO: 2079339 - protein, 26 aa, Staphylococcus
NTLQPSPFHWRLLDKLALNTLHEVVL

SEQ ID NO: 2079340 - protein, 25 aa, Staphylococcus
NTLQPSPFHWRLMDKLALNTLYEVV

SEQ ID NO: 2079341 - protein, 27 aa, Staphylococcus
NTLQPSPFHWRLMDKLTLATLYEVVLP

SEQ ID NO: 2079342 - protein, 18 aa, Staphylococcus
NTLRPYETKVYLIDNITS

SEQ ID NO: 2079343 - protein, 26 aa, Staphylococcus
NTLVNQNILPIKPTKVLTYIKHSDLI

SEQ ID NO: 2079344 - protein, 24 aa, Staphylococcus
NTLYEVVLPIYPKAPEFHLKDTFK

SEQ ID NO: 2079345 - protein, 18 aa, Staphylococcus
NTMRYIKQLEEIPRHVYC

SEQ ID NO: 2079346 - protein, 26 aa, Staphylococcus
NTNKTLYGFNFLIKGSLSLSNVNFNN

SEQ ID NO: 2079347 - protein, 24 aa, Staphylococcus
NTPKQLMIYDAFGWEPPRFAHMSL

SEQ ID NO: 2079348 - protein, 24 aa, Staphylococcus
NTPKQLMIYEAFGWEAPRFAHMSL

SEQ ID NO: 2079349 - protein, 23 aa, Staphylococcus
NTPKQLMIYEAFGWEAPRFGHMS

SEQ ID NO: 2079350 - protein, 25 aa, Staphylococcus
NTPKQLMIYEAFGWEPPRFAHMSLI

SEQ ID NO: 2079351 - protein, 25 aa, Staphylococcus
NTPKQLMIYEAFGWEPPRFGHISLI

SEQ ID NO: 2079352 - protein, 25 aa, Staphylococcus
NTPKQLMIYEAFGWEPPRFGHMSLI

SEQ ID NO: 2079353 - protein, 23 aa, Staphylococcus
NTPKQLMIYETFGWEAPRFAHMS

SEQ ID NO: 2079354 - protein, 35 aa, Staphylococcus
NTQDTILVFTNKGRYLFIPVHKLADTRWKELGQHV

SEQ ID NO: 2079355 - protein, 37 aa, Staphylococcus
NTQHIALVFTNKGRYLYLPVHKLPDVKWKDLGQHISQ

SEQ ID NO: 2079356 - protein, 18 aa, Staphylococcus
NTQRFDFEKASESAGWIK

SEQ ID NO: 2079357 - protein, 35 aa, Staphylococcus
NTRFFNVILKYVKQGVLYPLSYYDGDWFGKDEVKS

SEQ ID NO: 2079358 - protein, 27 aa, Staphylococcus
NTRNITYFTLFTTSMPVKLNNIIKFSS

SEQ ID NO: 2079359 - protein, 25 aa, Staphylococcus
NTSDLPIGVIPVDSLYSPVERVNYT

SEQ ID NO: 2079360 - protein, 22 aa, Staphylococcus
NTSSIRIYINWNGQPVNLNTID

SEQ ID NO: 2079361 - protein, 29 aa, Staphylococcus
NTSSVHDKIPWPNYVNYAASKGGLKLMME

SEQ ID NO: 2079362 - protein, 28 aa, Staphylococcus
NTSSVHDTIPWPNYVHYASSKGGLKLMM

SEQ ID NO: 2079363 - protein, 29 aa, Staphylococcus
NTSSVHDTIPWPNYVNYAASKGGLKLMME

SEQ ID NO: 2079364 - protein, 28 aa, Staphylococcus
NTTAENIAIWIWHQFNKHLPENNSLQKL

SEQ ID NO: 2079365 - protein, 26 aa, Staphylococcus
NTTHAQMKMFLTRLGFDSKMVVTGDQ

SEQ ID NO: 2079366 - protein, 24 aa, Staphylococcus
NTTSSLVLLVALTTGGRFSEIAKL

SEQ ID NO: 2079367 - protein, 26 aa, Staphylococcus
NTVASCAHLLIWEGIELLPVTDNNKK

SEQ ID NO: 2079368 - protein, 23 aa, Staphylococcus
NTVPSTTLFYFKNDDIVGAVNIR

SEQ ID NO: 2079369 - protein, 18 aa, Staphylococcus
NTYKLYFGFANRSAYEDF

SEQ ID NO: 2079370 - protein, 20 aa, Staphylococcus
NTYLSFINKAHQKGIQVVLS

SEQ ID NO: 2079371 - protein, 20 aa, Staphylococcus
NTYPQIGRLLGYIPKEEVVD

SEQ ID NO: 2079372 - protein, 26 aa, Staphylococcus
NTYQDSIVLMLLSNKLSAMDGVNKVS

SEQ ID NO: 2079373 - protein, 28 aa, Staphylococcus
NTYQQHGIVFLMIRFKSLDEVYLLPYSK

SEQ ID NO: 2079374 - protein, 19 aa, Staphylococcus
NVALISDGFFPMGDTVEYA

SEQ ID NO: 2079375 - protein, 19 aa, Staphylococcus
NVATKRQALRFGDAELNPG

SEQ ID NO: 2079376 - protein, 22 aa, Staphylococcus
NVCFNCDHHIALPAYKRIEAIS

SEQ ID NO: 2079377 - protein, 27 aa, Staphylococcus
NVDAYAYYFKLPFHETVRRHHLKDETD

SEQ ID NO: 2079378 - protein, 17 aa, Staphylococcus
NVDFYLAKGIIDAIAEK

SEQ ID NO: 2079379 - protein, 25 aa, Staphylococcus
NVDIKTLVYPGFATDLQQPITPLLF

SEQ ID NO: 2079380 - protein, 35 aa, Staphylococcus
NVDLDVIIFNSLAMPFIALYRMNTIGKGILVWQEN

SEQ ID NO: 2079381 - protein, 18 aa, Staphylococcus
NVDLFLRNAHRIPDYRSN

SEQ ID NO: 2079382 - protein, 17 aa, Staphylococcus
NVDLVVELPLIASLSSS

SEQ ID NO: 2079383 - protein, 17 aa, Staphylococcus
NVDMRLHRVIYNVIEEI

SEQ ID NO: 2079384 - protein, 27 aa, Staphylococcus
NVDRTKPILLYAPTWHATKDSTELMSI

SEQ ID NO: 2079385 - protein, 26 aa, Staphylococcus
NVDTLSPTYKLLMGVPGRSNAFDISK

SEQ ID NO: 2079386 - protein, 25 aa, Staphylococcus
NVEIRLERLFKVEPELLYQAWTDER

SEQ ID NO: 2079387 - protein, 19 aa, Staphylococcus
NVELLAILINTGRKGFSSI

SEQ ID NO: 2079388 - protein, 30 aa, Staphylococcus
NVESSGIVKKLFLLGIVANINQSLDQETLE

SEQ ID NO: 2079389 - protein, 29 aa, Staphylococcus
NVETRLEFGPPKLLIPKNLANELDVDLIM

SEQ ID NO: 2079390 - protein, 27 aa, Staphylococcus
NVEVKNQILIIPTWRDWLTSIDRLQTS

SEQ ID NO: 2079391 - protein, 23 aa, Staphylococcus
NVFDKLKEFALTPLKSKNTFISK

SEQ ID NO: 2079392 - protein, 17 aa, Staphylococcus
NVFGMVYGTQAAAEQFK

SEQ ID NO: 2079393 - protein, 18 aa, Staphylococcus
NVFINTNCYLMDGGGITF

SEQ ID NO: 2079394 - protein, 20 aa, Staphylococcus
NVFKFKDMIPGVNAPPQKYY

SEQ ID NO: 2079395 - protein, 17 aa, Staphylococcus
NVFVVQLPKNMDPDEYI

SEQ ID NO: 2079396 - protein, 17 aa, Staphylococcus
NVGCIPSKTLLEHGKKV

SEQ ID NO: 2079397 - protein, 18 aa, Staphylococcus
NVGDAIVVGNTYGRIRAM

SEQ ID NO: 2079398 - protein, 18 aa, Staphylococcus
NVGDPIVVGNTYGRIRAM

SEQ ID NO: 2079399 - protein, 19 aa, Staphylococcus
NVGLGPRILRAETAPLYAL

SEQ ID NO: 2079400 - protein, 21 aa, Staphylococcus
NVHASLLPKYRGGAPIHQAII

SEQ ID NO: 2079401 - protein, 28 aa, Staphylococcus
NVHGYGYGDLFININVVTPTKISDRQKE

SEQ ID NO: 2079402 - protein, 29 aa, Staphylococcus
NVHGYGYGDLFININVVTPTKLNDKQKSI

SEQ ID NO: 2079403 - protein, 19 aa, Staphylococcus
NVHLFLHEDGMRQLLTYQD

SEQ ID NO: 2079404 - protein, 26 aa, Staphylococcus
NVHYKPLPMFTAYKNYGFDIKDFPNA

SEQ ID NO: 2079405 - protein, 19 aa, Staphylococcus
NVIDLAYPGVLPVVNRRAV

SEQ ID NO: 2079406 - protein, 20 aa, Staphylococcus
NVIDLGYPGVLPVVNKRAVD

SEQ ID NO: 2079407 - protein, 27 aa, Staphylococcus
NVIFIGILCKNAEWLAIVFDIGHGCTR

SEQ ID NO: 2079408 - protein, 24 aa, Staphylococcus
NVIKQLFKEIFKASIDLQKADHEK

SEQ ID NO: 2079409 - protein, 29 aa, Staphylococcus
NVKGNIALPLDFPGLFKGYFKDEKRTKDA

SEQ ID NO: 2079410 - protein, 29 aa, Staphylococcus
NVKIAPSPVWMQARLMKAGIRPINNVVDI

SEQ ID NO: 2079411 - protein, 25 aa, Staphylococcus
NVKKAWWQKFITQSPFNVGIDAAIL

SEQ ID NO: 2079412 - protein, 25 aa, Staphylococcus
NVKKAWWQKFITQSPYNVGLDAAIL

SEQ ID NO: 2079413 - protein, 17 aa, Staphylococcus
NVKKFMHYLIKAQEHYQ

SEQ ID NO: 2079414 - protein, 29 aa, Staphylococcus
NVKSLIQLTRGFINQLRRSNNGRIIVISS

SEQ ID NO: 2079415 - protein, 20 aa, Staphylococcus
NVLASSKLWKKIVNKVSLEY

SEQ ID NO: 2079416 - protein, 19 aa, Staphylococcus
NVLASSKLWRKTVTEVSKS

SEQ ID NO: 2079417 - protein, 35 aa, Staphylococcus
NVLFLNLHGRPLTRQGIWKLIKQYGLRANINKTLT

SEQ ID NO: 2079418 - protein, 25 aa, Staphylococcus
NVLIAKLQAIYRRVYQFSLDEKRVL

SEQ ID NO: 2079419 - protein, 17 aa, Staphylococcus
NVLKQIKEEGRLPVVNF

SEQ ID NO: 2079420 - protein, 17 aa, Staphylococcus
NVLLERFNYAKSLNVNA

SEQ ID NO: 2079421 - protein, 17 aa, Staphylococcus
NVLLQILEEGRLTDSKG

SEQ ID NO: 2079422 - protein, 21 aa, Staphylococcus
NVLRFQPPLVITYEQLDYALN

SEQ ID NO: 2079423 - protein, 28 aa, Staphylococcus
NVLVTGYDIIFFWVARMIFQGLEFTGKR

SEQ ID NO: 2079424 - protein, 33 aa, Staphylococcus
NVMAHLVENIRFAAVLLQPFLTHAPREVFKQLN

SEQ ID NO: 2079425 - protein, 23 aa, Staphylococcus
NVMDINLMKWIGANSFRTAHYPY

SEQ ID NO: 2079426 - protein, 22 aa, Staphylococcus
NVMDINLMKWIGANSFRTSHYP

SEQ ID NO: 2079427 - protein, 24 aa, Staphylococcus
NVMEDFYIPKLITGGATSTPTFVR

SEQ ID NO: 2079428 - protein, 19 aa, Staphylococcus
NVNDLLSLLKEYKVTLLKN

SEQ ID NO: 2079429 - protein, 28 aa, Staphylococcus
NVNNKFIISAWLGTMGCGLPGALASNIA

SEQ ID NO: 2079430 - protein, 25 aa, Staphylococcus
NVNQNMFVTMFYGFYEEMNHLLYCS

SEQ ID NO: 2079431 - protein, 28 aa, Staphylococcus
NVNQNMFVTMFYGLYEELNHLLYCSSAG

SEQ ID NO: 2079432 - protein, 29 aa, Staphylococcus
NVNYLIGTMIETPRACLIAQQLAQHCDFF

SEQ ID NO: 2079433 - protein, 24 aa, Staphylococcus
NVPAHFECNCGHDKFLNAIKGLGE

SEQ ID NO: 2079434 - protein, 19 aa, Staphylococcus
NVPFKELKYFYAQSKLNVV

SEQ ID NO: 2079435 - protein, 21 aa, Staphylococcus
NVPILQQAEAWLDCYFSGEKP

SEQ ID NO: 2079436 - protein, 20 aa, Staphylococcus
NVPLIGFTGAPFTLASYMIE

SEQ ID NO: 2079437 - protein, 24 aa, Staphylococcus
NVPNNEFKLYKKVTIVLGKNVSSK

SEQ ID NO: 2079438 - protein, 23 aa, Staphylococcus
NVPTLIINGFYDPLIKDKNNYCV

SEQ ID NO: 2079439 - protein, 32 aa, Staphylococcus
NVPYELGVLISKKKYWYKSPDFKAIAKIANYI

SEQ ID NO: 2079440 - protein, 24 aa, Staphylococcus
NVQDYRYYIKPFMDRLVCGIKEQH

SEQ ID NO: 2079441 - protein, 26 aa, Staphylococcus
NVQKRNVIKIVYFQPQNSDKLYINRF

SEQ ID NO: 2079442 - protein, 23 aa, Staphylococcus
NVQRKDWLELWQSLERQSRIEIK

SEQ ID NO: 2079443 - protein, 26 aa, Staphylococcus
NVQSKELLIFIKYLADKYEVSYLQKS

SEQ ID NO: 2079444 - protein, 21 aa, Staphylococcus
NVRGRIFYREYFKNRIVSFVE

SEQ ID NO: 2079445 - protein, 24 aa, Staphylococcus
NVRQIFSEFINCPVYVDNDANVAA

SEQ ID NO: 2079446 - protein, 24 aa, Staphylococcus
NVRRKVLHQLLKLQETYMINNNPS

SEQ ID NO: 2079447 - protein, 18 aa, Staphylococcus
NVRYIEAPYKPHEFMKMA

SEQ ID NO: 2079448 - protein, 18 aa, Staphylococcus
NVRYVIHYNMPGDLESYY

SEQ ID NO: 2079449 - protein, 26 aa, Staphylococcus
NVSAKRIIDFLSGTVYAIGGDIQRVG

SEQ ID NO: 2079450 - protein, 23 aa, Staphylococcus
NVSFDIMLASYILDPSRSIDDVY

SEQ ID NO: 2079451 - protein, 25 aa, Staphylococcus
NVSFHSLWHQYSNSIFYYYMIDKQA

SEQ ID NO: 2079452 - protein, 26 aa, Staphylococcus
NVSLEESLNLYQRGMKLSATCDETLK

SEQ ID NO: 2079453 - protein, 33 aa, Staphylococcus
NVSQWNFIEYLLLARLGVSILPEHIANMLKDNI

SEQ ID NO: 2079454 - protein, 35 aa, Staphylococcus
NVSQWNFIEYLVIARLGVSILPEHIAKMLKDEIKS

SEQ ID NO: 2079455 - protein, 24 aa, Staphylococcus
NVSRVLKTLGVDSTALGFAGGFPG

SEQ ID NO: 2079456 - protein, 28 aa, Staphylococcus
NVSRVLKTLGVPSTALGFAGGFPGEFIA

SEQ ID NO: 2079457 - protein, 24 aa, Staphylococcus
NVSVIYVPAPFAADAILECADADL

SEQ ID NO: 2079458 - protein, 17 aa, Staphylococcus
NVTAVYTIEQVKAITEA

SEQ ID NO: 2079459 - protein, 25 aa, Staphylococcus
NVTDKIHLVPMLDEPFYLSPGLNQP

SEQ ID NO: 2079460 - protein, 24 aa, Staphylococcus
NVTEFAVMELLYNKGDQPIQRIGN

SEQ ID NO: 2079461 - protein, 17 aa, Staphylococcus
NVTLLIGDLAFYHDMNG

SEQ ID NO: 2079462 - protein, 25 aa, Staphylococcus
NVTPTHLLIDAMELPLDIAQTSIIK

SEQ ID NO: 2079463 - protein, 25 aa, Staphylococcus
NVTQSKCLVLFTSYKMMYHVQELLN

SEQ ID NO: 2079464 - protein, 26 aa, Staphylococcus
NVTTNGIIMAWLDKHPAAIMPVLGTH

SEQ ID NO: 2079465 - protein, 19 aa, Staphylococcus
NVTVIYRGNEYPKAIKPWI

SEQ ID NO: 2079466 - protein, 18 aa, Staphylococcus
NVTVLYRGDRYSAAIKPW

SEQ ID NO: 2079467 - protein, 19 aa, Staphylococcus
NVTVLYRGDRYSAAIKPWI

SEQ ID NO: 2079468 - protein, 23 aa, Staphylococcus
NVTYLRYVRQQLLDLPVCIEFRH

SEQ ID NO: 2079469 - protein, 17 aa, Staphylococcus
NVVDFGAFIDIGVKQDG

SEQ ID NO: 2079470 - protein, 18 aa, Staphylococcus
NVVKATIFISDMNDFQYI

SEQ ID NO: 2079471 - protein, 35 aa, Staphylococcus
NVVLIHGFKDYCALLFHKGVLLPDPEHKLIQQTKN

SEQ ID NO: 2079472 - protein, 18 aa, Staphylococcus
NVVLVKLAEEIMPQYNRA

SEQ ID NO: 2079473 - protein, 25 aa, Staphylococcus
NVVPKSLVFYVFGSVLNAFIDWKKN

SEQ ID NO: 2079474 - protein, 29 aa, Staphylococcus
NVYFKLKDHYKWFIFAMSSAAMSKDVDIR

SEQ ID NO: 2079475 - protein, 26 aa, Staphylococcus
NVYHGNIELPKYKLVKFTWGNVSEIN

SEQ ID NO: 2079476 - protein, 17 aa, Staphylococcus
NVYIIQLPNDMDPDEYI

SEQ ID NO: 2079477 - protein, 21 aa, Staphylococcus
NVYRHLSQDGVFMFDVHTAYK

SEQ ID NO: 2079478 - protein, 26 aa, Staphylococcus
NVYTGSLYLSLISLLENHKLNGGDNI

SEQ ID NO: 2079479 - protein, 23 aa, Staphylococcus
NWAIAYMTGALSKVEQFYLGDKQ

SEQ ID NO: 2079480 - protein, 45 aa, Staphylococcus
NWANKLIILDKGELLYYGSIDQFFSKFYHYALIEIVNQELDHLVK

SEQ ID NO: 2079481 - protein, 18 aa, Staphylococcus
NWAQLPPMKMIRKMAEEF

SEQ ID NO: 2079482 - protein, 17 aa, Staphylococcus
NWGNYKLIFNTRHQANI

SEQ ID NO: 2079483 - protein, 21 aa, Staphylococcus
NWLEIGIVIYDTKFWESGIGS

SEQ ID NO: 2079484 - protein, 20 aa, Staphylococcus
NWLHDWQHDCGYTIKYVEHS

SEQ ID NO: 2079485 - protein, 17 aa, Staphylococcus
NWNFAFAYSVQLVEAYS

SEQ ID NO: 2079486 - protein, 20 aa, Staphylococcus
NWRRTFHQFPEISEKEYETT

SEQ ID NO: 2079487 - protein, 22 aa, Staphylococcus
NWRRTFHQFPELSDKEYETTKR

SEQ ID NO: 2079488 - protein, 19 aa, Staphylococcus
NWRRTFHQYPELSDAEYET

SEQ ID NO: 2079489 - protein, 32 aa, Staphylococcus
NWTVAYTKLHNFHWYVKGPNFFSLHEKFEELY

SEQ ID NO: 2079490 - protein, 27 aa, Staphylococcus
NWVDKNGDIFFIYTNEKLKSILNISSP

SEQ ID NO: 2079491 - protein, 24 aa, Staphylococcus
NWVTKPIIGPIFQPVVNRARSSRA

SEQ ID NO: 2079492 - protein, 23 aa, Staphylococcus
NYAEERVMRPLNFAIIDEVDSIL

SEQ ID NO: 2079493 - protein, 20 aa, Staphylococcus
NYAHIVRRWSSLSQPAAYYI

SEQ ID NO: 2079494 - protein, 23 aa, Staphylococcus
NYAKFMLNTIWGRWGMFEKEVDE

SEQ ID NO: 2079495 - protein, 20 aa, Staphylococcus
NYCVQFAYSEQLGLKYLGTT

SEQ ID NO: 2079496 - protein, 18 aa, Staphylococcus
NYCYLHAKLPKLHQILYN

SEQ ID NO: 2079497 - protein, 23 aa, Staphylococcus
NYDAPYRGLCVESFTGDYPAGLY

SEQ ID NO: 2079498 - protein, 25 aa, Staphylococcus
NYDDDLQYFLFQHTAVLLTADTKYR

SEQ ID NO: 2079499 - protein, 25 aa, Staphylococcus
NYDEFYQLLLIKMWQLTLNYDEQKS

SEQ ID NO: 2079500 - protein, 20 aa, Staphylococcus
NYDMNREISPLKKADDAITL

SEQ ID NO: 2079501 - protein, 31 aa, Staphylococcus
NYDNIEILTYSKLLTFMKFQAGLDVSNYHQA

SEQ ID NO: 2079502 - protein, 24 aa, Staphylococcus
NYDRAVELYYYIKGGTVDYGAAHA

SEQ ID NO: 2079503 - protein, 20 aa, Staphylococcus
NYEIPILKFNEILTLFSEYE

SEQ ID NO: 2079504 - protein, 17 aa, Staphylococcus
NYEPIPRFPGVSRDIAL

SEQ ID NO: 2079505 - protein, 23 aa, Staphylococcus
NYEPSMQYFNEWWKQLYGESEGK

SEQ ID NO: 2079506 - protein, 25 aa, Staphylococcus
NYERLQGFNSLQWPVAPDGTDQPTL

SEQ ID NO: 2079507 - protein, 21 aa, Staphylococcus
NYETYEFLSITDTLITDYSSV

SEQ ID NO: 2079508 - protein, 19 aa, Staphylococcus
NYEVLCNLSKRLPRIYHHN

SEQ ID NO: 2079509 - protein, 23 aa, Staphylococcus
NYEVNILKMQLLTWIIETETGDI

SEQ ID NO: 2079510 - protein, 26 aa, Staphylococcus
NYFKGAIVIISHDRFFLDKTVNQIYD

SEQ ID NO: 2079511 - protein, 18 aa, Staphylococcus
NYFKRYKNPYITEYISQA

SEQ ID NO: 2079512 - protein, 27 aa, Staphylococcus
NYGAEAVEWYIYSVGFRNSFVNGMTKD

SEQ ID NO: 2079513 - protein, 21 aa, Staphylococcus
NYGARIVSWKYDDNNIVLGNV

SEQ ID NO: 2079514 - protein, 18 aa, Staphylococcus
NYGARIVSWKYHDNNIIL

SEQ ID NO: 2079515 - protein, 33 aa, Staphylococcus
NYGFAYILDDGQSYSYLIFVEETWSMLHENKGK

SEQ ID NO: 2079516 - protein, 32 aa, Staphylococcus
NYGFAYILDDGQSYSYLIFVEETWSMLHENRD

SEQ ID NO: 2079517 - protein, 32 aa, Staphylococcus
NYGFAYILDDGQSYSYLIFVKETWSMLHENKG

SEQ ID NO: 2079518 - protein, 25 aa, Staphylococcus
NYGFAYLLDDGQSYDYLIFVQETWS

SEQ ID NO: 2079519 - protein, 37 aa, Staphylococcus
NYGGPLIDSGLNKQWRYHYQIDPKLVPYIGSIELHSY

SEQ ID NO: 2079520 - protein, 32 aa, Staphylococcus
NYGIDELPFGVYKFLKQHPFVYTRTLDHPVIE

SEQ ID NO: 2079521 - protein, 32 aa, Staphylococcus
NYGLDELPLGIYRFLIQQPLVYTRTLDHPVIN

SEQ ID NO: 2079522 - protein, 31 aa, Staphylococcus
NYGLDELPLGVYRYLINTPKVYARTLDHPVI

SEQ ID NO: 2079523 - protein, 19 aa, Staphylococcus
NYGLPYLKDTLNRLNYPVL

SEQ ID NO: 2079524 - protein, 21 aa, Staphylococcus
NYGYFPHFDKKISFYNNLRHS

SEQ ID NO: 2079525 - protein, 17 aa, Staphylococcus
NYHEFLTKNKYIEDTLS

SEQ ID NO: 2079526 - protein, 19 aa, Staphylococcus
NYHLAALEDYIQFLHEIQV

SEQ ID NO: 2079527 - protein, 25 aa, Staphylococcus
NYHRKPKIYTIPVGSLSTLVKPNRR

SEQ ID NO: 2079528 - protein, 17 aa, Staphylococcus
NYIATWFKKHDVTVVPN

SEQ ID NO: 2079529 - protein, 26 aa, Staphylococcus
NYIEQHRGMIIYLPQEGRGIGLMNKL

SEQ ID NO: 2079530 - protein, 20 aa, Staphylococcus
NYIKFRDRPKMHIIEVLSEN

SEQ ID NO: 2079531 - protein, 21 aa, Staphylococcus
NYIMNLPVNFLKTFLPELIEN

SEQ ID NO: 2079532 - protein, 21 aa, Staphylococcus
NYIMNLPVNFLKTFLPELIER

SEQ ID NO: 2079533 - protein, 25 aa, Staphylococcus
NYIMSLPVNFLKTFLPELIEKNVKV

SEQ ID NO: 2079534 - protein, 18 aa, Staphylococcus
NYITQTEWVDLWQKALQV

SEQ ID NO: 2079535 - protein, 32 aa, Staphylococcus
NYIYSHALVNLFYQYLLTCELTDLVYQYTSYK

SEQ ID NO: 2079536 - protein, 29 aa, Staphylococcus
NYKKVIDSLSYYQFFILKLVVGEKRIKEA

SEQ ID NO: 2079537 - protein, 18 aa, Staphylococcus
NYKPLKSSYIPFSLIEGE

SEQ ID NO: 2079538 - protein, 23 aa, Staphylococcus
NYKPLPIVISEAEGIWITDPEGN

SEQ ID NO: 2079539 - protein, 20 aa, Staphylococcus
NYKRFLKKYFNLNITIDRLE

SEQ ID NO: 2079540 - protein, 19 aa, Staphylococcus
NYLFKNSDLQIAYNFNMVA

SEQ ID NO: 2079541 - protein, 24 aa, Staphylococcus
NYLIITFHHIILDGWSLSIVLNDV

SEQ ID NO: 2079542 - protein, 18 aa, Staphylococcus
NYLLKKYGNYSTEEIERI

SEQ ID NO: 2079543 - protein, 21 aa, Staphylococcus
NYLYSKIFFDKEKGIKFINKL

SEQ ID NO: 2079544 - protein, 24 aa, Staphylococcus
NYMEGIFVGYRYYATKDMSVAFPF

SEQ ID NO: 2079545 - protein, 26 aa, Staphylococcus
NYNDLDLQLAWDSIALHTTLGVAEHK

SEQ ID NO: 2079546 - protein, 36 aa, Staphylococcus
NYNFNSLEYQILSSLIKLLKKYPLPTTPNNIDYINA

SEQ ID NO: 2079547 - protein, 27 aa, Staphylococcus
NYNKLKRYWKLLLKKPHDLNRMHYHQF

SEQ ID NO: 2079548 - protein, 27 aa, Staphylococcus
NYNNDKVILLLNYPNNPTGYTPTASEV

SEQ ID NO: 2079549 - protein, 26 aa, Staphylococcus
NYNNKWEIVVILPRIGIEFEKMTPMK

SEQ ID NO: 2079550 - protein, 21 aa, Staphylococcus
NYNTLFGGVLMKKIDNNATLS

SEQ ID NO: 2079551 - protein, 20 aa, Staphylococcus
NYQDDLLHFGFLTLRERDVN

SEQ ID NO: 2079552 - protein, 20 aa, Staphylococcus
NYQFKVNYAVPLKFIQNSQS

SEQ ID NO: 2079553 - protein, 21 aa, Staphylococcus
NYQMQFIIRDLGGSRIDLSTL

SEQ ID NO: 2079554 - protein, 17 aa, Staphylococcus
NYQTLLKAYFGIENIKL

SEQ ID NO: 2079555 - protein, 20 aa, Staphylococcus
NYQVPFIVNDNVALALKVQA

SEQ ID NO: 2079556 - protein, 19 aa, Staphylococcus
NYRHEKWFELCKKLEGLPR

SEQ ID NO: 2079557 - protein, 24 aa, Staphylococcus
NYRKHWHVIFHLSNGKLLVYSDIR

SEQ ID NO: 2079558 - protein, 19 aa, Staphylococcus
NYRLYYQCKILSRKGYSGQ

SEQ ID NO: 2079559 - protein, 17 aa, Staphylococcus
NYRSFETILTTLNVHKK

SEQ ID NO: 2079560 - protein, 34 aa, Staphylococcus
NYRTKLPERYEIEGNPYWPLSMPVFKMDYAHKEA

SEQ ID NO: 2079561 - protein, 27 aa, Staphylococcus
NYSEERVMRPLHFAIIDEVDSILIDEA

SEQ ID NO: 2079562 - protein, 25 aa, Staphylococcus
NYSLPQLFSDILIYCTERNVMLVDY

SEQ ID NO: 2079563 - protein, 21 aa, Staphylococcus
NYSPLKLALAKGRGAKVWDIE

SEQ ID NO: 2079564 - protein, 25 aa, Staphylococcus
NYTKDKVMLILNYPNNPTGYTPTKD

SEQ ID NO: 2079565 - protein, 39 aa, Staphylococcus
NYTLEDLAVQDFFFQPDYDRPWNYLNVLAQQALGETYGS

SEQ ID NO: 2079566 - protein, 20 aa, Staphylococcus
NYTPLIIKPSAINGINYQME

SEQ ID NO: 2079567 - protein, 19 aa, Staphylococcus
NYTPLIIKPSDIKGMTYTM

SEQ ID NO: 2079568 - protein, 26 aa, Staphylococcus
NYVPDIGQFFLFDTTSRIIGSEPDKT

SEQ ID NO: 2079569 - protein, 22 aa, Staphylococcus
NYVPLPIIVSEAEGIWVTDPEG

SEQ ID NO: 2079570 - protein, 18 aa, Staphylococcus
NYVPLPIVIAEAEGVWVT

SEQ ID NO: 2079571 - protein, 33 aa, Staphylococcus
NYYLKNMLMILANNRHLALIHSIFKEFKHLYDH

SEQ ID NO: 2079572 - protein, 17 aa, Staphylococcus
PAALMYPAGNKLYDWIY

SEQ ID NO: 2079573 - protein, 17 aa, Staphylococcus
PAALRCSQFIYKEQKQQ

SEQ ID NO: 2079574 - protein, 17 aa, Staphylococcus
PAALRCSQFVYKEQKNQ

SEQ ID NO: 2079575 - protein, 24 aa, Staphylococcus
PAANPYLALAAILQAGLDGIKNKL

SEQ ID NO: 2079576 - protein, 24 aa, Staphylococcus
PAANPYMALATILQAGLDGIKNKT

SEQ ID NO: 2079577 - protein, 23 aa, Staphylococcus
PAASFAKLWLDKHPNETIGLIPC

SEQ ID NO: 2079578 - protein, 21 aa, Staphylococcus
PACGAGNFLNLAYAKLREIET

SEQ ID NO: 2079579 - protein, 19 aa, Staphylococcus
PADAPLKGYKKMNPMVYCG

SEQ ID NO: 2079580 - protein, 29 aa, Staphylococcus
PADIISSMSYFFNLLAGIGYTDDIDHLGN

SEQ ID NO: 2079581 - protein, 25 aa, Staphylococcus
PADKKVIMYAPTWRDDEFVKKGQYL

SEQ ID NO: 2079582 - protein, 25 aa, Staphylococcus
PADVDVFLVAPKGPGHLVRRTFVEG

SEQ ID NO: 2079583 - protein, 25 aa, Staphylococcus
PAEAEALSHQLLLKAGLIKQSTSGI

SEQ ID NO: 2079584 - protein, 26 aa, Staphylococcus
PAEAEALSHRLLLKAGLIKQSTSGIY

SEQ ID NO: 2079585 - protein, 27 aa, Staphylococcus
PAEAEALSHRLLLKAGLIKQSTSGIYS

SEQ ID NO: 2079586 - protein, 27 aa, Staphylococcus
PAEAEALSHRLLLKAGLIKQSTSGVYS

SEQ ID NO: 2079587 - protein, 18 aa, Staphylococcus
PAEGLYLEKIYLAPQELI

SEQ ID NO: 2079588 - protein, 17 aa, Staphylococcus
PAELPDPDKRNTIRYVR

SEQ ID NO: 2079589 - protein, 17 aa, Staphylococcus
PAFFTRESDVALTSRAD

SEQ ID NO: 2079590 - protein, 23 aa, Staphylococcus
PAFINILELVALEYAKDIGYELY

SEQ ID NO: 2079591 - protein, 24 aa, Staphylococcus
PAGRQFYKFFGENIFRADICNADV

SEQ ID NO: 2079592 - protein, 27 aa, Staphylococcus
PAIMAAFHFDVPCLFAKKAKPSTLKDG

SEQ ID NO: 2079593 - protein, 18 aa, Staphylococcus
PAINLYKKNKYKIVGTFK

SEQ ID NO: 2079594 - protein, 21 aa, Staphylococcus
PAINYYLNMIYPYEHKDEKES

SEQ ID NO: 2079595 - protein, 22 aa, Staphylococcus
PAIQHMMGATAYYPQVVKATLM

SEQ ID NO: 2079596 - protein, 18 aa, Staphylococcus
PAIQPILIKHQALMQGFI

SEQ ID NO: 2079597 - protein, 31 aa, Staphylococcus
PAIQWHQFINELPYYKVIGQYIFVHAGIDTS

SEQ ID NO: 2079598 - protein, 18 aa, Staphylococcus
PAIVYFHSEYWFNVICMF

SEQ ID NO: 2079599 - protein, 26 aa, Staphylococcus
PAKGGINIYFRSWYAHYIDYKVNGIK

SEQ ID NO: 2079600 - protein, 24 aa, Staphylococcus
PAKLNVFEYIENEFDLRESMVNAG

SEQ ID NO: 2079601 - protein, 20 aa, Staphylococcus
PAKRIFQAIRIAVNDELSAF

SEQ ID NO: 2079602 - protein, 25 aa, Staphylococcus
PALAPYKAAILPLSKKLSEEAIKIF

SEQ ID NO: 2079603 - protein, 25 aa, Staphylococcus
PALDRVPPLHFLVTDQTGQSIVITP

SEQ ID NO: 2079604 - protein, 21 aa, Staphylococcus
PALLTHSVALLEALQNLNADY

SEQ ID NO: 2079605 - protein, 25 aa, Staphylococcus
PANDPALFDATIKNIKKLESTISIV

SEQ ID NO: 2079606 - protein, 29 aa, Staphylococcus
PANEGRGYVLRRLLRRAVRFSQTLDIQEP

SEQ ID NO: 2079607 - protein, 23 aa, Staphylococcus
PANGFVCYMIGRLILELCKNTEE

SEQ ID NO: 2079608 - protein, 23 aa, Staphylococcus
PANGFVCYMIGRLILEYCKNVNE

SEQ ID NO: 2079609 - protein, 24 aa, Staphylococcus
PANLMGIRAFRKLLPEIPHVAVFD

SEQ ID NO: 2079610 - protein, 25 aa, Staphylococcus
PANLMGVRAFRKLLPNIPHVVVFDT

SEQ ID NO: 2079611 - protein, 23 aa, Staphylococcus
PANSAYANAWLRQINTESSGNPS

SEQ ID NO: 2079612 - protein, 23 aa, Staphylococcus
PAPADHPWRTMPRNGMTVHYSGM

SEQ ID NO: 2079613 - protein, 19 aa, Staphylococcus
PAQVIIRWNIEHGVVVIPK

SEQ ID NO: 2079614 - protein, 20 aa, Staphylococcus
PAQVIIRWNVQHGVVVIPKS

SEQ ID NO: 2079615 - protein, 19 aa, Staphylococcus
PAQVVIRWNIDNGVITIPK

SEQ ID NO: 2079616 - protein, 23 aa, Staphylococcus
PAREIVLVITGAEKAELVKKLYE

SEQ ID NO: 2079617 - protein, 27 aa, Staphylococcus
PARFHRHPLPVPKFKYFKLNMNRTQSF

SEQ ID NO: 2079618 - protein, 19 aa, Staphylococcus
PARILGSFFIKHHGYRVRI

SEQ ID NO: 2079619 - protein, 21 aa, Staphylococcus
PASDFYHRYPVDLELSEKFGV

SEQ ID NO: 2079620 - protein, 26 aa, Staphylococcus
PATKYNHHLFDRYTFNHFKKGSVFVN

SEQ ID NO: 2079621 - protein, 24 aa, Staphylococcus
PATKYNHHLFNDDLFKQFKQGAVF

SEQ ID NO: 2079622 - protein, 33 aa, Staphylococcus
PATKYNHHLFNEALFSYFKKGAVFVNCARGSLV

SEQ ID NO: 2079623 - protein, 30 aa, Staphylococcus; identical to SEQ ID NO: 1820610

SEQ ID NO: 2079624 - protein, 23 aa, Staphylococcus
PATQLTIICKVEDKLRIEELILK

SEQ ID NO: 2079625 - protein, 19 aa, Staphylococcus
PAVAFRLFKQLVEDKYGKA

SEQ ID NO: 2079626 - protein, 27 aa, Staphylococcus
PAVNGLTPHIILELSRRIVGHPKLVSI

SEQ ID NO: 2079627 - protein, 23 aa, Staphylococcus
PAVVTFFATPYYPAVNVSYDQKI

SEQ ID NO: 2079628 - protein, 17 aa, Staphylococcus
PAYFTMDAGPNVKVLVQ

SEQ ID NO: 2079629 - protein, 25 aa, Staphylococcus
PCEIAHTCAYLWNPLAKSITGTVQK

SEQ ID NO: 2079630 - protein, 22 aa, Staphylococcus
PCFNCLIPQLPSMTLTCDTVGV

SEQ ID NO: 2079631 - protein, 21 aa, Staphylococcus
PCHTMFQFYVQNGKLSCQLYQ

SEQ ID NO: 2079632 - protein, 20 aa, Staphylococcus
PCLFTSIKDIPYSERSFLLQ

SEQ ID NO: 2079633 - protein, 23 aa, Staphylococcus
PCVNKIIEFGIRKVIYAVKDTTL

SEQ ID NO: 2079634 - protein, 18 aa, Staphylococcus
PCVNKIIEFGLSKVIYAV

SEQ ID NO: 2079635 - protein, 23 aa, Staphylococcus
PCVTYNKVNTYDWFKEHLTNIED

SEQ ID NO: 2079636 - protein, 23 aa, Staphylococcus
PCVTYNKVNTYDWFKEHLTSIDD

SEQ ID NO: 2079637 - protein, 23 aa, Staphylococcus
PCVTYNKVNTYDWFKEHLTSIED

SEQ ID NO: 2079638 - protein, 23 aa, Staphylococcus
PCVTYNKVNTYDWFKEHLTSLED

SEQ ID NO: 2079639 - protein, 23 aa, Staphylococcus
PCVTYNKVNTYDWFKEHLVSIDD

SEQ ID NO: 2079640 - protein, 25 aa, Staphylococcus
PDAYGSQLGLKLYLERKFPEKNIYA

SEQ ID NO: 2079641 - protein, 21 aa, Staphylococcus
PDCKLTPLHMFYTEDTYEELF

SEQ ID NO: 2079642 - protein, 17 aa, Staphylococcus
PDDAYILETLLFNDAIV

SEQ ID NO: 2079643 - protein, 25 aa, Staphylococcus
PDDIADIVLFLSSDSAKFMIAQVYL

SEQ ID NO: 2079644 - protein, 23 aa, Staphylococcus
PDDIEMLQDLVIAATNEAMNKAD

SEQ ID NO: 2079645 - protein, 26 aa, Staphylococcus
PDDKGIRTIFFIMNGQTRQIKIQDEN

SEQ ID NO: 2079646 - protein, 24 aa, Staphylococcus
PDDKRIMQDIFIPKGQNLGAVDGH

SEQ ID NO: 2079647 - protein, 24 aa, Staphylococcus
PDDKRIMQDIFIPKGQSLGAIDGH

SEQ ID NO: 2079648 - protein, 25 aa, Staphylococcus
PDDKRIMQDIFIPKGQSLGVVEGHK

SEQ ID NO: 2079649 - protein, 20 aa, Staphylococcus
PDDLKDKFYEHHRWIAGHLD

SEQ ID NO: 2079650 - protein, 23 aa, Staphylococcus
PDDQINLFKQFKSIADKKKSVSD

SEQ ID NO: 2079651 - protein, 17 aa, Staphylococcus
PDDSYILETLLFSDAIT

SEQ ID NO: 2079652 - protein, 22 aa, Staphylococcus
PDDVVFHFIGSLQSRKVKEVIN

SEQ ID NO: 2079653 - protein, 17 aa, Staphylococcus
PDELGVTLKVGRLGEVL

SEQ ID NO: 2079654 - protein, 25 aa, Staphylococcus
PDENKSIIKFLNKLEKYLPKLITGE

SEQ ID NO: 2079655 - protein, 23 aa, Staphylococcus
PDETTFEYIKGRPYAQNFNQSIG

SEQ ID NO: 2079656 - protein, 29 aa, Staphylococcus
PDEVNKRYDIILLLTKQVFNQQVIPKVRD

SEQ ID NO: 2079657 - protein, 18 aa, Staphylococcus
PDFGIWKSIAIEYGDYMN

SEQ ID NO: 2079658 - protein, 31 aa, Staphylococcus
PDFINKLFDIDGVKSIFYVMDFISVDKEDNA

SEQ ID NO: 2079659 - protein, 26 aa, Staphylococcus
PDFINRLFDIEGVKSVFYVMDFISVD

SEQ ID NO: 2079660 - protein, 30 aa, Staphylococcus
PDGNHVLAIPLYKNQLLFTQHKMRGIEFPG

SEQ ID NO: 2079661 - protein, 17 aa, Staphylococcus
PDHLSGLLFDDIPYLKV

SEQ ID NO: 2079662 - protein, 21 aa, Staphylococcus
PDINSYYTEMSFDGELEVYDP

SEQ ID NO: 2079663 - protein, 27 aa, Staphylococcus
PDKDSEHYGLWAFKRVWGTYLSEKIGE

SEQ ID NO: 2079664 - protein, 18 aa, Staphylococcus
PDKWQYAMNSALPDDIYV

SEQ ID NO: 2079665 - protein, 23 aa, Staphylococcus
PDLAVMGGMMEKEQIRTVIAPEH

SEQ ID NO: 2079666 - protein, 24 aa, Staphylococcus
PDLDFTFIHWLVTGVKDHEPILDK

SEQ ID NO: 2079667 - protein, 20 aa, Staphylococcus
PDLLLLDEPTNHLDFESINW

SEQ ID NO: 2079668 - protein, 19 aa, Staphylococcus
PDLLNVWSVKRLKEAGADA

SEQ ID NO: 2079669 - protein, 25 aa, Staphylococcus
PDLSASAIAQFIRRDIWEKTGLTSS

SEQ ID NO: 2079670 - protein, 19 aa, Staphylococcus
PDLVLLDLVMPNMNGIEVT

SEQ ID NO: 2079671 - protein, 22 aa, Staphylococcus
PDMITQLRQKMGDFPMVAIGGI

SEQ ID NO: 2079672 - protein, 22 aa, Staphylococcus
PDMKVIMWDERLSTMAAERSLL

SEQ ID NO: 2079673 - protein, 24 aa, Staphylococcus
PDMPASRIANYIRRDIYEQTQLTA

SEQ ID NO: 2079674 - protein, 24 aa, Staphylococcus
PDNPYRDYYFFRKSAKEGVPPTNW

SEQ ID NO: 2079675 - protein, 20 aa, Staphylococcus
PDPFPTIVRDFQSVIGKEIK

SEQ ID NO: 2079676 - protein, 20 aa, Staphylococcus
PDPFPTIVRDFQSVIGNEIK

SEQ ID NO: 2079677 - protein, 19 aa, Staphylococcus
PDPFPTMVRDFQSVIGNEI

SEQ ID NO: 2079678 - protein, 19 aa, Staphylococcus
PDPFPTMVRDFQSVIGSEI

SEQ ID NO: 2079679 - protein, 17 aa, Staphylococcus
PDQLDITLKVGRLAEVL

SEQ ID NO: 2079680 - protein, 22 aa, Staphylococcus
PDQLHQVLRKIPARSYSISSSN

SEQ ID NO: 2079681 - protein, 17 aa, Staphylococcus
PDRIAGFTPIPAMSMLS

SEQ ID NO: 2079682 - protein, 18 aa, Staphylococcus
PDSIGLILGFLAERFLKN

SEQ ID NO: 2079683 - protein, 23 aa, Staphylococcus
PDSYLNIDTYMSRPPVFTKGDNR

SEQ ID NO: 2079684 - protein, 30 aa, Staphylococcus
PDTLVSDIVYIPYKTPILKLAEAKGNPIYN

SEQ ID NO: 2079685 - protein, 24 aa, Staphylococcus
PDTPHDWKKYFKGFKKRKSKENDD

SEQ ID NO: 2079686 - protein, 27 aa, Staphylococcus
PDTQTLLNQLFKLLQPGGQILIADFNQ

SEQ ID NO: 2079687 - protein, 18 aa, Staphylococcus
PDVILLDLGLPDIDGFTL

SEQ ID NO: 2079688 - protein, 18 aa, Staphylococcus
PDVKIGMDTIIEPGVRIN

SEQ ID NO: 2079689 - protein, 24 aa, Staphylococcus
PDVKPQIMAFTKSYGRPFEELENG

SEQ ID NO: 2079690 - protein, 17 aa, Staphylococcus
PDVQVRGYYPGYATKMF

SEQ ID NO: 2079691 - protein, 21 aa, Staphylococcus
PEAGVIRDAFSLIILNEPVKF

SEQ ID NO: 2079692 - protein, 29 aa, Staphylococcus
PEAIEFDENTYWPLAMPVFKMDYAHKEYE

SEQ ID NO: 2079693 - protein, 25 aa, Staphylococcus
PEAKEYWLCWVTTERGENGPYYAGV

SEQ ID NO: 2079694 - protein, 24 aa, Staphylococcus
PEAKEYWLCWVTTERGEQGAYYAG

SEQ ID NO: 2079695 - protein, 19 aa, Staphylococcus
PEARIPLSQAVIELCLSPK

SEQ ID NO: 2079696 - protein, 21 aa, Staphylococcus
PEARIPLSQAVIELSLSPKSN

SEQ ID NO: 2079697 - protein, 26 aa, Staphylococcus
PEDCKAQLIILPFTDIAKELGNKLMK

SEQ ID NO: 2079698 - protein, 27 aa, Staphylococcus
PEDEVLLVKQFRKPAEKPLLEIPAGKL

SEQ ID NO: 2079699 - protein, 21 aa, Staphylococcus
PEDFDGLLIPGGFSPDHLRGD

SEQ ID NO: 2079700 - protein, 26 aa, Staphylococcus
PEDFHKPGHLFPLIAKENGVLERTGH

SEQ ID NO: 2079701 - protein, 20 aa, Staphylococcus
PEDFYKVMSLITEEILNSPL

SEQ ID NO: 2079702 - protein, 20 aa, Staphylococcus
PEDLKDKFYEHHQWIESHLD

SEQ ID NO: 2079703 - protein, 31 aa, Staphylococcus
PEDLQSYGLIPEFIGRIPIVANLETLDIAAL

SEQ ID NO: 2079704 - protein, 17 aa, Staphylococcus
PEDLTELVLTLGSQMVV

SEQ ID NO: 2079705 - protein, 25 aa, Staphylococcus
PEDWGGDTIFVPLSALNGDGIDDLL

SEQ ID NO: 2079706 - protein, 26 aa, Staphylococcus
PEDWGGDTIFVPLSALSGEGIDDLLE

SEQ ID NO: 2079707 - protein, 26 aa, Staphylococcus
PEDYDALLIPGGFSPDYLRGDTEGRY

SEQ ID NO: 2079708 - protein, 21 aa, Staphylococcus
PEDYDGLLIPGGFSPDHLRGD

SEQ ID NO: 2079709 - protein, 25 aa, Staphylococcus
PEEGNYAVGLFFTNSPIEGSRHETV

SEQ ID NO: 2079710 - protein, 24 aa, Staphylococcus
PEELRVHLINKYSIGIIALNDTDI

SEQ ID NO: 2079711 - protein, 25 aa, Staphylococcus
PEENIRFYRDVLNLKLIKKTVNYDD

SEQ ID NO: 2079712 - protein, 25 aa, Staphylococcus
PEEVYDIVVYQLGALNGFCRIHDVK

SEQ ID NO: 2079713 - protein, 20 aa, Staphylococcus
PEEYWKIEGEFRYKKTKFTA

SEQ ID NO: 2079714 - protein, 22 aa, Staphylococcus
PEFEKVIPLKIMLIEKNHIVTT

SEQ ID NO: 2079715 - protein, 25 aa, Staphylococcus
PEFILQSHHFNLIKNIPFGLVVLDE

SEQ ID NO: 2079716 - protein, 20 aa, Staphylococcus
PEFILQTQNFKLIRNIDFGL

SEQ ID NO: 2079717 - protein, 31 aa, Staphylococcus
PEFINALFDIEGVKSIFYVMDFISVDKEDEA

SEQ ID NO: 2079718 - protein, 38 aa, Staphylococcus
PEFINHLLDLEGVKSIFYVIDFLAIDKTPKADWEEVLP

SEQ ID NO: 2079719 - protein, 27 aa, Staphylococcus
PEFINRLFDIDGVKSIFYVMDFISVDK

SEQ ID NO: 2079720 - protein, 27 aa, Staphylococcus
PEFINRLFDIEGVTSIFYVMDFISVDK

SEQ ID NO: 2079721 - protein, 19 aa, Staphylococcus
PEGFINFCHKRLMYIDKAP

SEQ ID NO: 2079722 - protein, 21 aa, Staphylococcus
PEGIELLNYIKRIFTILHEAE

SEQ ID NO: 2079723 - protein, 28 aa, Staphylococcus
PEGIYLSGALLMFAGKKSYYLYGASSNE

SEQ ID NO: 2079724 - protein, 24 aa, Staphylococcus
PEGKNIWFGVREFAMGAAVNGMAA

SEQ ID NO: 2079725 - protein, 19 aa, Staphylococcus
PEGTPFQQKVWQLLSEIPY

SEQ ID NO: 2079726 - protein, 28 aa, Staphylococcus
PEGVYLSGALLMFAGKKSYYLYGASSND

SEQ ID NO: 2079727 - protein, 25 aa, Staphylococcus
PEHLKAVITRFIEKYKIATPIKVSI

SEQ ID NO: 2079728 - protein, 19 aa, Staphylococcus
PEHSYYHDIGRVKYATASD

SEQ ID NO: 2079729 - protein, 26 aa, Staphylococcus
PEIAGLMISAIISDSLLFKSPTCTDE

SEQ ID NO: 2079730 - protein, 26 aa, Staphylococcus
PEIEKRFMHHYNFPNFSVGETGPVRA

SEQ ID NO: 2079731 - protein, 24 aa, Staphylococcus
PEILKPRLIPLLQMSNKEFKNTYG

SEQ ID NO: 2079732 - protein, 27 aa, Staphylococcus
PEILNRMDDIVLFRPLSVNDMSMIVEK

SEQ ID NO: 2079733 - protein, 33 aa, Staphylococcus
PEITIIYVTHFIEEIIPIFDKIFILSKGVNFAQ

SEQ ID NO: 2079734 - protein, 20 aa, Staphylococcus
PEIYNLGVPILGICYGMQLT

SEQ ID NO: 2079735 - protein, 20 aa, Staphylococcus
PEIYNLGVPVLGICYGMQLT

SEQ ID NO: 2079736 - protein, 37 aa, Staphylococcus
PEKAQQLMDVFWPGPISFILPLKEGFLCKRVSGGLSS

SEQ ID NO: 2079737 - protein, 28 aa, Staphylococcus
PEKDVRAVLGRFLFVQDDVKKIINDLSG

SEQ ID NO: 2079738 - protein, 17 aa, Staphylococcus
PEKFVTLQHQHVLGTLM

SEQ ID NO: 2079739 - protein, 19 aa, Staphylococcus
PEKHIYFHSLPWGVDYIKP

SEQ ID NO: 2079740 - protein, 27 aa, Staphylococcus
PEKVFKFFHIILKYIYRKKSFFHAIFI

SEQ ID NO: 2079741 - protein, 27 aa, Staphylococcus
PEKVYKFFHIILKYIYRKKAFYHAIFI

SEQ ID NO: 2079742 - protein, 24 aa, Staphylococcus
PEKYRSYFIGDWYISGDSAYKDED

SEQ ID NO: 2079743 - protein, 24 aa, Staphylococcus
PELDFDFIHWLVTGVKDHEPVLDD

SEQ ID NO: 2079744 - protein, 26 aa, Staphylococcus
PELEDMDDIFIPPTKINRALDGDIVI

SEQ ID NO: 2079745 - protein, 22 aa, Staphylococcus
PELKQKLALLKSITQIPVVCGF

SEQ ID NO: 2079746 - protein, 17 aa, Staphylococcus
PELLLKRFNKEGYYFYK

SEQ ID NO: 2079747 - protein, 17 aa, Staphylococcus
PELPRTEYICFYPMDKR

SEQ ID NO: 2079748 - protein, 23 aa, Staphylococcus
PELRKRIKLVAEQNYQHLESLEA

SEQ ID NO: 2079749 - protein, 24 aa, Staphylococcus
PELSEQFPYIRQLLDTYHIKHYEL

SEQ ID NO: 2079750 - protein, 25 aa, Staphylococcus
PELSHSHILKQWSGIRPYTEHELPI

SEQ ID NO: 2079751 - protein, 27 aa, Staphylococcus
PELVDRMYRRFTILTTIKMHQPVGRRS

SEQ ID NO: 2079752 - protein, 30 aa, Staphylococcus
PELVKKFNIKKIIIAIPTLSQQRLREINKL

SEQ ID NO: 2079753 - protein, 31 aa, Staphylococcus
PELVNKFKIKKIIIAIPTLSQKRLREITELC

SEQ ID NO: 2079754 - protein, 27 aa, Staphylococcus
PEMEEQLKLLLIPKDPNDEKDVIVEIR

SEQ ID NO: 2079755 - protein, 20 aa, Staphylococcus
PEMIATLKNINPSLPMVAIG

SEQ ID NO: 2079756 - protein, 19 aa, Staphylococcus
PEMLDKMLGITIGQTIVIL

SEQ ID NO: 2079757 - protein, 30 aa, Staphylococcus
PENDDIYDRPRGKFRFPIDLGQDAETYDEA

SEQ ID NO: 2079758 - protein, 28 aa, Staphylococcus
PENEVLLVKQFRKPVEKPLLEIPAGKLE

SEQ ID NO: 2079759 - protein, 25 aa, Staphylococcus
PENIDIAIPFDTDYGWNVSFGKNVF

SEQ ID NO: 2079760 - protein, 19 aa, Staphylococcus
PENMEVLIGWTGSPASSHH

SEQ ID NO: 2079761 - protein, 19 aa, Staphylococcus
PENMEVLIGWTGSPASSPH

SEQ ID NO: 2079762 - protein, 18 aa, Staphylococcus
PENMIWFDLEQRDQFTFP

SEQ ID NO: 2079763 - protein, 28 aa, Staphylococcus
PENNDIYDRPRGKFRFPIDVGQDENYEE

SEQ ID NO: 2079764 - protein, 27 aa, Staphylococcus
PENNDIYNRPKGNFRFPLHVDNPENSE

SEQ ID NO: 2079765 - protein, 26 aa, Staphylococcus
PENRVEYFVSFYDYYQPEAYVPSTDT

SEQ ID NO: 2079766 - protein, 21 aa, Staphylococcus
PENYDALLIPGGFSPDHLRGD

SEQ ID NO: 2079767 - protein, 17 aa, Staphylococcus
PENYSITLIDRMPYHGL

SEQ ID NO: 2079768 - protein, 31 aa, Staphylococcus
PENYTLTLIDRMPFHGLKPEFYALAAGTKSD

SEQ ID NO: 2079769 - protein, 25 aa, Staphylococcus
PEPNLTVLWSQRLPENFKAYCAEMS

SEQ ID NO: 2079770 - protein, 17 aa, Staphylococcus
PEPPIVSLIKLYQNHND

SEQ ID NO: 2079771 - protein, 26 aa, Staphylococcus
PEQEFDFDFDILDPTKLWPEDQVPVK

SEQ ID NO: 2079772 - protein, 18 aa, Staphylococcus
PEQLFAAGYSACFNSALS

SEQ ID NO: 2079773 - protein, 22 aa, Staphylococcus
PEQLQVLLKQSYLIQLQNLLNM

SEQ ID NO: 2079774 - protein, 26 aa, Staphylococcus
PERAAMLMIPEPWLYNKANNANVRAF

SEQ ID NO: 2079775 - protein, 28 aa, Staphylococcus
PERFENNQFMKLLYGLDIKLVAFDEAHC

SEQ ID NO: 2079776 - protein, 17 aa, Staphylococcus
PERGKIYDRNGKILAED

SEQ ID NO: 2079777 - protein, 21 aa, Staphylococcus
PERHVLNFFSYTGAFSVIAAE

SEQ ID NO: 2079778 - protein, 23 aa, Staphylococcus
PERMASRILGMGDVLSLIEKAQQ

SEQ ID NO: 2079779 - protein, 21 aa, Staphylococcus
PERPLVMRYILSYLNNKVNAL

SEQ ID NO: 2079780 - protein, 21 aa, Staphylococcus
PESFHYFYKVKGQIVGYLKLN

SEQ ID NO: 2079781 - protein, 25 aa, Staphylococcus
PESKHLGGFPITGQFLICTNPDVIQ

SEQ ID NO: 2079782 - protein, 21 aa, Staphylococcus
PESLIFYIYDSTLAGFVEWAR

SEQ ID NO: 2079783 - protein, 24 aa, Staphylococcus
PESMDIIDGIRLRILPEGLLSKKV

SEQ ID NO: 2079784 - protein, 17 aa, Staphylococcus
PESVPREPIHRQPPPFD

SEQ ID NO: 2079785 - protein, 30 aa, Staphylococcus
PETARQLALVWGVFPVVKKGRKTTDALLNN

SEQ ID NO: 2079786 - protein, 17 aa, Staphylococcus
PETERFYPNGNFASHLI

SEQ ID NO: 2079787 - protein, 20 aa, Staphylococcus
PETIIMDKALEILGLNKEDV

SEQ ID NO: 2079788 - protein, 19 aa, Staphylococcus
PETIIMEKSLDILQLDKQD

SEQ ID NO: 2079789 - protein, 21 aa, Staphylococcus
PETKMLYIETPSNPLLRVTDI

SEQ ID NO: 2079790 - protein, 22 aa, Staphylococcus
PETKMLYIETPSNPLLRVTDIK

SEQ ID NO: 2079791 - protein, 24 aa, Staphylococcus
PETKMLYIETPSNPLLRVTDIRRA

SEQ ID NO: 2079792 - protein, 19 aa, Staphylococcus
PETLAIHYYESFAKTHQGH

SEQ ID NO: 2079793 - protein, 17 aa, Staphylococcus
PETQTEKWFHDTALARV

SEQ ID NO: 2079794 - protein, 21 aa, Staphylococcus
PETYDALLIPGGFSPDHLRGD

SEQ ID NO: 2079795 - protein, 22 aa, Staphylococcus
PETYDALLIPGGFSPDHLRGDE

SEQ ID NO: 2079796 - protein, 25 aa, Staphylococcus
PETYDLRYQFLQKYWDTLPQKGDIN

SEQ ID NO: 2079797 - protein, 23 aa, Staphylococcus
PEVLAPMMQAELDKKLRLASFAE

SEQ ID NO: 2079798 - protein, 17 aa, Staphylococcus
PEVLCPLFEHVSDLRAE

SEQ ID NO: 2079799 - protein, 19 aa, Staphylococcus
PEVLLFDEPTSALDPEVVG

SEQ ID NO: 2079800 - protein, 24 aa, Staphylococcus
PEVQFNLLNSTAYYRYLSQRIGAI

SEQ ID NO: 2079801 - protein, 17 aa, Staphylococcus
PEWELGLQIIKPEQEFD

SEQ ID NO: 2079802 - protein, 22 aa, Staphylococcus
PEWMEEPYYLSPGKKSLLKLYD

SEQ ID NO: 2079803 - protein, 18 aa, Staphylococcus
PEYKGAATALFDFAVKRA

SEQ ID NO: 2079804 - protein, 17 aa, Staphylococcus
PFAFDEWRYLPDGSDNP

SEQ ID NO: 2079805 - protein, 25 aa, Staphylococcus
PFAKQKLIFLCGMAGERDLTKTPEM

SEQ ID NO: 2079806 - protein, 18 aa, Staphylococcus
PFAPTRRKDFINSRKGRY

SEQ ID NO: 2079807 - protein, 17 aa, Staphylococcus
PFCVRICTYCDFNKYFI

SEQ ID NO: 2079808 - protein, 18 aa, Staphylococcus
PFCVRICTYCDFNKYFID

SEQ ID NO: 2079809 - protein, 19 aa, Staphylococcus
PFDLDFSGFIFKIQANMDP

SEQ ID NO: 2079810 - protein, 25 aa, Staphylococcus
PFDPPMFARVFRKHLEGGIVKSIRQ

SEQ ID NO: 2079811 - protein, 26 aa, Staphylococcus
PFDQEKPFVTSGLRLGTPAATTRGFE

SEQ ID NO: 2079812 - protein, 22 aa, Staphylococcus
PFEELPLYEIGWRLIPEVWGNG

SEQ ID NO: 2079813 - protein, 25 aa, Staphylococcus
PFEGDRISLIEDQSWMEDMIDSEHP

SEQ ID NO: 2079814 - protein, 19 aa, Staphylococcus
PFELTIAVLLSAQCTDVLV

SEQ ID NO: 2079815 - protein, 18 aa, Staphylococcus
PFEWLTQLVKPYQNEAQQ

SEQ ID NO: 2079816 - protein, 18 aa, Staphylococcus
PFFKEALQIYDSKLDISL

SEQ ID NO: 2079817 - protein, 19 aa, Staphylococcus
PFGMVLSLALCLKESLNQE

SEQ ID NO: 2079818 - protein, 19 aa, Staphylococcus
PFGYGRIIRNEQQQLERIV

SEQ ID NO: 2079819 - protein, 24 aa, Staphylococcus
PFHKNKTFYALNDLSLTAYEGDVI

SEQ ID NO: 2079820 - protein, 20 aa, Staphylococcus
PFIDATFPTYKVGNARLLMG

SEQ ID NO: 2079821 - protein, 17 aa, Staphylococcus
PFIITRAVSDLANGEAN

SEQ ID NO: 2079822 - protein, 19 aa, Staphylococcus
PFITDLDLSVLFSVSIQTI

SEQ ID NO: 2079823 - protein, 17 aa, Staphylococcus
PFIVTRAVSDLANGKAE

SEQ ID NO: 2079824 - protein, 17 aa, Staphylococcus
PFKLSDGNLFKTFNLDI

SEQ ID NO: 2079825 - protein, 25 aa, Staphylococcus
PFLTVKQQFQLLKKYKKDVLNKDEY

SEQ ID NO: 2079826 - protein, 20 aa, Staphylococcus
PFNIKCLSTIYTGDLESALE

SEQ ID NO: 2079827 - protein, 20 aa, Staphylococcus
PFNKKFLGNIIAEVFNRFSI

SEQ ID NO: 2079828 - protein, 18 aa, Staphylococcus
PFNMAYPIPERQNLFGYT

SEQ ID NO: 2079829 - protein, 26 aa, Staphylococcus
PFNPDILYCGTFDRGLWKSVDKGDSW

SEQ ID NO: 2079830 - protein, 17 aa, Staphylococcus
PFNVHEFLIGLETLHLR

SEQ ID NO: 2079831 - protein, 18 aa, Staphylococcus
PFPAATMHHIGYGAGTKN

SEQ ID NO: 2079832 - protein, 17 aa, Staphylococcus
PFQFKRADQFMLDHTDQ

SEQ ID NO: 2079833 - protein, 22 aa, Staphylococcus
PFQQLTIDYLYRHITAQKDQVV

SEQ ID NO: 2079834 - protein, 25 aa, Staphylococcus
PFQRIVSIVTLSLRFRRYELRNSAG

SEQ ID NO: 2079835 - protein, 23 aa, Staphylococcus
PFQTLNLLSYFDEKHIVTASEVL

SEQ ID NO: 2079836 - protein, 25 aa, Staphylococcus
PFRRHIEHAGPFKTIGIAGFFGLPI

SEQ ID NO: 2079837 - protein, 20 aa, Staphylococcus
PFSNSIWLFDVGEGTQHQIL

SEQ ID NO: 2079838 - protein, 17 aa, Staphylococcus
PFSPRELVLRINNLLAR

SEQ ID NO: 2079839 - protein, 26 aa, Staphylococcus
PFSVYGVKYILNNPVYKGYVRFNNHQ

SEQ ID NO: 2079840 - protein, 22 aa, Staphylococcus
PFTPFYRALDWVVTDPMAAIKD

SEQ ID NO: 2079841 - protein, 20 aa, Staphylococcus
PFTYDYMHLINEIYVDDVLI

SEQ ID NO: 2079842 - protein, 26 aa, Staphylococcus
PFVKQKLIFLIGMAGERDLTKTPEMG

SEQ ID NO: 2079843 - protein, 20 aa, Staphylococcus
PFVSGFIGTCSFDLIRHEFP

SEQ ID NO: 2079844 - protein, 17 aa, Staphylococcus
PFYESLGYHPQGEIFLE

SEQ ID NO: 2079845 - protein, 26 aa, Staphylococcus
PFYSKWDSHIFHQYLERFNIPSHLKI

SEQ ID NO: 2079846 - protein, 19 aa, Staphylococcus
PGAFEIPLVAKKLAQKNDY

SEQ ID NO: 2079847 - protein, 22 aa, Staphylococcus
PGDFNIAYILEKFQINPELFDS

SEQ ID NO: 2079848 - protein, 27 aa, Staphylococcus
PGDMKPPLNVYFSGYRPAEGFEGYFMM

SEQ ID NO: 2079849 - protein, 23 aa, Staphylococcus
PGDSVDHFFLIHKATQGVTAQGK

SEQ ID NO: 2079850 - protein, 21 aa, Staphylococcus
PGDTITFPAFVYSGDATVVPE

SEQ ID NO: 2079851 - protein, 25 aa, Staphylococcus
PGDVNLWPNLTGGEVIDFLLSLQKN

SEQ ID NO: 2079852 - protein, 24 aa, Staphylococcus
PGEEILFKWITIEQAIKNLKHFEQ

SEQ ID NO: 2079853 - protein, 36 aa, Staphylococcus
PGEETGITFAGIPLGHEFNSLVLAILQVSGRAPKEQ

SEQ ID NO: 2079854 - protein, 17 aa, Staphylococcus
PGFLRFQAQIMPKKLVF

SEQ ID NO: 2079855 - protein, 21 aa, Staphylococcus
PGFNVIYNGILERDTVAIANF

SEQ ID NO: 2079856 - protein, 21 aa, Staphylococcus
PGFWVPNDYVVVKVALRGSSG

SEQ ID NO: 2079857 - protein, 19 aa, Staphylococcus
PGGLLYFHIHDERLKFEKW

SEQ ID NO: 2079858 - protein, 17 aa, Staphylococcus
PGHFAPIADYELITKAK

SEQ ID NO: 2079859 - protein, 19 aa, Staphylococcus
PGHFAPLGDFDLMVKAKKA

SEQ ID NO: 2079860 - protein, 18 aa, Staphylococcus
PGHPLDNDLLLKIIHQYK

SEQ ID NO: 2079861 - protein, 25 aa, Staphylococcus
PGHTPGTTIFLWDNGEHRYLFTGDF

SEQ ID NO: 2079862 - protein, 17 aa, Staphylococcus
PGIFAAGDVRDKGLRQI

SEQ ID NO: 2079863 - protein, 22 aa, Staphylococcus
PGIPYTVSIIQEAYQRHLKILT

SEQ ID NO: 2079864 - protein, 28 aa, Staphylococcus
PGIRFEDTMFLLNTLAQYHPDYFHISAN

SEQ ID NO: 2079865 - protein, 28 aa, Staphylococcus
PGISFDTIYRNLYLFKDLGIIENTELDG

SEQ ID NO: 2079866 - protein, 18 aa, Staphylococcus
PGIYAAGDVREKGLRQIV

SEQ ID NO: 2079867 - protein, 20 aa, Staphylococcus
PGKLTFYEFDGEVFDLRESK

SEQ ID NO: 2079868 - protein, 17 aa, Staphylococcus
PGKPSDYPILKSVLDRY

SEQ ID NO: 2079869 - protein, 24 aa, Staphylococcus
PGKYNETIYYLKPQDIICFRIENK

SEQ ID NO: 2079870 - protein, 17 aa, Staphylococcus
PGLDFSPDKVLQGRLFS

SEQ ID NO: 2079871 - protein, 29 aa, Staphylococcus
PGLDRLIRTTYDLLGLATYFTAGVQEVRA

SEQ ID NO: 2079872 - protein, 29 aa, Staphylococcus
PGLDVLIRTTYDLLGLSTYFTAGVQEVRA

SEQ ID NO: 2079873 - protein, 24 aa, Staphylococcus
PGLPDLQGFGRRKMDIKPKEIYNL

SEQ ID NO: 2079874 - protein, 17 aa, Staphylococcus
PGMPFYLSNGQFIRNQM

SEQ ID NO: 2079875 - protein, 19 aa, Staphylococcus
PGMQPWNRAIGSHASRYHK

SEQ ID NO: 2079876 - protein, 21 aa, Staphylococcus
PGNGKFLYSPFSKFDNESIIE

SEQ ID NO: 2079877 - protein, 26 aa, Staphylococcus
PGNQTVYIQTPWGSLLELQTVPQGFY

SEQ ID NO: 2079878 - protein, 26 aa, Staphylococcus
PGNTDAMIEYLLPKATVVTPNLFEAG

SEQ ID NO: 2079879 - protein, 24 aa, Staphylococcus
PGPREALDYMYKIAQRDGFSTHDV

SEQ ID NO: 2079880 - protein, 17 aa, Staphylococcus
PGQIHVKTLKQQLLFYS

SEQ ID NO: 2079881 - protein, 27 aa, Staphylococcus
PGQLVVDCVLAYFQIEWTQFNVKYRKI

SEQ ID NO: 2079882 - protein, 23 aa, Staphylococcus
PGQPYTRLKGLKEWSFGLFEGES

SEQ ID NO: 2079883 - protein, 18 aa, Staphylococcus
PGRREIGHGALGERALRH

SEQ ID NO: 2079884 - protein, 18 aa, Staphylococcus
PGSKPFNVVMTPSDKKRV

SEQ ID NO: 2079885 - protein, 22 aa, Staphylococcus
PGSNKWLYRFDWSNLSSKDFKS

SEQ ID NO: 2079886 - protein, 25 aa, Staphylococcus
PGSSIKGKMRSLLARDFGLKLNQDN

SEQ ID NO: 2079887 - protein, 42 aa, Staphylococcus
PGVLFAIRQRFNPTKIEMLNFLLTAGAFGFVIANNASISGAA

SEQ ID NO: 2079888 - protein, 20 aa, Staphylococcus
PGVPEELQGAALYLASDASS

SEQ ID NO: 2079889 - protein, 21 aa, Staphylococcus
PGVWLDFQSYLVKGDLHLCWD

SEQ ID NO: 2079890 - protein, 25 aa, Staphylococcus
PGWMHNILKLYQLAPRTLENCLPNL

SEQ ID NO: 2079891 - protein, 17 aa, Staphylococcus
PGYKIMFNTLRAMYHHH

SEQ ID NO: 2079892 - protein, 17 aa, Staphylococcus
PGYKLMFNTLKAMYDTH

SEQ ID NO: 2079893 - protein, 20 aa, Staphylococcus
PGYKSVLIAVDRFVTAAIEA

SEQ ID NO: 2079894 - protein, 20 aa, Staphylococcus
PGYKSVLIAVDRFVTASIED

SEQ ID NO: 2079895 - protein, 20 aa, Staphylococcus
PGYKSVLIAVDRFVTATIEA

SEQ ID NO: 2079896 - protein, 19 aa, Staphylococcus
PGYMGADYHKLPISKVAEV

SEQ ID NO: 2079897 - protein, 17 aa, Staphylococcus
PHAATLTYMALHSLQHR

SEQ ID NO: 2079898 - protein, 25 aa, Staphylococcus
PHASIEDTFPFIKYQLMVQDTEALA

SEQ ID NO: 2079899 - protein, 23 aa, Staphylococcus
PHAYLSGCNFPQFILNNLQGKTN

SEQ ID NO: 2079900 - protein, 30 aa, Staphylococcus; identical to SEQ ID NO: 1698796

SEQ ID NO: 2079901 - protein, 17 aa, Staphylococcus
PHDGFKVYRHFFFNHQQ

SEQ ID NO: 2079902 - protein, 24 aa, Staphylococcus
PHDSLIERVLYYLNVGQLIDTSIV

SEQ ID NO: 2079903 - protein, 19 aa, Staphylococcus
PHEALLCLDATTGQNALSQ

SEQ ID NO: 2079904 - protein, 21 aa, Staphylococcus
PHEALLCLDATTGQNALSQAR

SEQ ID NO: 2079905 - protein, 20 aa, Staphylococcus
PHELFIVKCPLDNGAEIFAG

SEQ ID NO: 2079906 - protein, 24 aa, Staphylococcus
PHERLFALLIQASGETVLFCPKME

SEQ ID NO: 2079907 - protein, 23 aa, Staphylococcus
PHERLFALLITANGDQTLYCPKM

SEQ ID NO: 2079908 - protein, 22 aa, Staphylococcus
PHERLFALLITSNGECTLYCPK

SEQ ID NO: 2079909 - protein, 23 aa, Staphylococcus
PHERLLALLITAEGEQVLFVPKL

SEQ ID NO: 2079910 - protein, 18 aa, Staphylococcus
PHETWVPSFAMRLVLGEM

SEQ ID NO: 2079911 - protein, 19 aa, Staphylococcus
PHETWVPSFLMRLALGEMS

SEQ ID NO: 2079912 - protein, 19 aa, Staphylococcus
PHEVKSTFIAMQPLRELEV

SEQ ID NO: 2079913 - protein, 19 aa, Staphylococcus
PHEVLLCLDATTGQNALSQ

SEQ ID NO: 2079914 - protein, 21 aa, Staphylococcus
PHEVLLCLDATTGQNALSQAK

SEQ ID NO: 2079915 - protein, 25 aa, Staphylococcus
PHEYVMKSIRLFGERVKPIVDKYFE

SEQ ID NO: 2079916 - protein, 17 aa, Staphylococcus
PHFLDRHEPLTLLAALA

SEQ ID NO: 2079917 - protein, 17 aa, Staphylococcus
PHHSQFQVFMKTKNRKI

SEQ ID NO: 2079918 - protein, 23 aa, Staphylococcus
PHIHRALELIKLQNIKAGVVINP

SEQ ID NO: 2079919 - protein, 20 aa, Staphylococcus
PHIHTIPVGSLHELSYPEKG

SEQ ID NO: 2079920 - protein, 25 aa, Staphylococcus
PHINHSHWFYKATPQGIYLSLGAIK

SEQ ID NO: 2079921 - protein, 17 aa, Staphylococcus
PHKIYGFGGDPITQIVT

SEQ ID NO: 2079922 - protein, 21 aa, Staphylococcus
PHLEALIQRHDDFNFHIGAVT

SEQ ID NO: 2079923 - protein, 24 aa, Staphylococcus
PHLSRHPEMWLLSASQRSAKLAAT

SEQ ID NO: 2079924 - protein, 17 aa, Staphylococcus
PHLWFDTKAEQAIDFYK

SEQ ID NO: 2079925 - protein, 17 aa, Staphylococcus
PHMITKLRDYVGELPIV

SEQ ID NO: 2079926 - protein, 27 aa, Staphylococcus
PHMNTNQLFPYLKYKILSTSSDDLRAI

SEQ ID NO: 2079927 - protein, 20 aa, Staphylococcus
PHMSFVKGIFNVKFLKNRVA

SEQ ID NO: 2079928 - protein, 28 aa, Staphylococcus
PHNELEEYLRLLRKLQLKLEIINNSIGN

SEQ ID NO: 2079929 - protein, 24 aa, Staphylococcus
PHNPFDLTKVWYKDDYPLIEVGEF

SEQ ID NO: 2079930 - protein, 28 aa, Staphylococcus
PHPRMLERSFVLIPLNDIATNVIEPNSN

SEQ ID NO: 2079931 - protein, 27 aa, Staphylococcus
PHPRMVERAFVLIPLNDIASKHIEPRS

SEQ ID NO: 2079932 - protein, 25 aa, Staphylococcus
PHQTKVVLFESLKAWLEAEMVADVW

SEQ ID NO: 2079933 - protein, 23 aa, Staphylococcus
PHRGPIHFNLPFREPLTPNLERQ

SEQ ID NO: 2079934 - protein, 22 aa, Staphylococcus
PHRQPFLLIDRIVEYEEGKRCV

SEQ ID NO: 2079935 - protein, 17 aa, Staphylococcus
PHSDIIAVTPSPETARQ

SEQ ID NO: 2079936 - protein, 25 aa, Staphylococcus
PHTSKIFKRAFSLDGLYNGNLLEIG

SEQ ID NO: 2079937 - protein, 18 aa, Staphylococcus
PHTYYIIANSMINGYTHK

SEQ ID NO: 2079938 - protein, 25 aa, Staphylococcus
PHVNSQWLRAWRDLLIEKFKESEEH

SEQ ID NO: 2079939 - protein, 27 aa, Staphylococcus
PHYANRLFFELQSEGYIPIIAHPERNK

SEQ ID NO: 2079940 - protein, 20 aa, Staphylococcus
PHYLIDILDPDEPFSAFAFK

SEQ ID NO: 2079941 - protein, 27 aa, Staphylococcus
PHYTKNLLYEIQTKGFVPIIAHPERNK

SEQ ID NO: 2079942 - protein, 19 aa, Staphylococcus
PHYYQYKGAYALQWHMIKF

SEQ ID NO: 2079943 - protein, 18 aa, Staphylococcus
PIAIKLNSADFQRGGFTE

SEQ ID NO: 2079944 - protein, 18 aa, Staphylococcus
PIAIVFNATCYNQKVITG

SEQ ID NO: 2079945 - protein, 18 aa, Staphylococcus
PIAKASLDLLNVKSAQEL

SEQ ID NO: 2079946 - protein, 20 aa, Staphylococcus
PIAKIIRQKLKKDGIKKGVP

SEQ ID NO: 2079947 - protein, 22 aa, Staphylococcus
PIAKLAAKIAIGLTLDEMLNPI

SEQ ID NO: 2079948 - protein, 19 aa, Staphylococcus
PIARLGYYDYTVVDEIFEM

SEQ ID NO: 2079949 - protein, 19 aa, Staphylococcus
PIARLGYYDYTVVDQVFEM

SEQ ID NO: 2079950 - protein, 24 aa, Staphylococcus
PIDEFHLLRDIITEKKLSGFNVTI

SEQ ID NO: 2079951 - protein, 29 aa, Staphylococcus
PIDIYVNLSYSFPYIICAIDHLPIGADIE

SEQ ID NO: 2079952 - protein, 17 aa, Staphylococcus
PIDQHIKGFKALGAEID

SEQ ID NO: 2079953 - protein, 17 aa, Staphylococcus
PIDQHIKGFKALGAKID

SEQ ID NO: 2079954 - protein, 17 aa, Staphylococcus
PIDRQIKALKRGPQIVV

SEQ ID NO: 2079955 - protein, 26 aa, Staphylococcus
PIDTLKQLYYLSKNLKYDLFNVLFEM

SEQ ID NO: 2079956 - protein, 17 aa, Staphylococcus
PIDVLGLDWRLSIKEAS

SEQ ID NO: 2079957 - protein, 20 aa, Staphylococcus
PIDVTWDFPYITTQLDELLD

SEQ ID NO: 2079958 - protein, 18 aa, Staphylococcus
PIEAIFGVHVNPFAEEGQ

SEQ ID NO: 2079959 - protein, 18 aa, Staphylococcus
PIEASLLHKPTLFYVYDE

SEQ ID NO: 2079960 - protein, 18 aa, Staphylococcus
PIEAVFGIHVMPFNDEGT

SEQ ID NO: 2079961 - protein, 18 aa, Staphylococcus
PIEAVFGIHVNPFAEEGQ

SEQ ID NO: 2079962 - protein, 25 aa, Staphylococcus
PIEEHMYEIIAGERRFRALQSLQKS

SEQ ID NO: 2079963 - protein, 18 aa, Staphylococcus
PIEELKKQLTEMNQPFLY

SEQ ID NO: 2079964 - protein, 24 aa, Staphylococcus
PIEHLLNEFKVPYLIVGKSLNYEN

SEQ ID NO: 2079965 - protein, 25 aa, Staphylococcus
PIEHSLTLYTCMYALYSGRTFSGQD

SEQ ID NO: 2079966 - protein, 17 aa, Staphylococcus
PIEINGVQFFALPFATI

SEQ ID NO: 2079967 - protein, 29 aa, Staphylococcus
PIETPSSNLLPYPKPLDIVYEDEFILIVN

SEQ ID NO: 2079968 - protein, 24 aa, Staphylococcus
PIEVVYGFAQLKRGAALANNELGK

SEQ ID NO: 2079969 - protein, 34 aa, Staphylococcus
PIGLPHMKHALIQKPMILFTRLKKPLSITSSGQT

SEQ ID NO: 2079970 - protein, 26 aa, Staphylococcus
PIGSTPYTLLDYFGDDWLVMVDESHV

SEQ ID NO: 2079971 - protein, 17 aa, Staphylococcus
PIGTIMPVSRRIDLLNW

SEQ ID NO: 2079972 - protein, 34 aa, Staphylococcus; identical to SEQ ID NO: 1831117

SEQ ID NO: 2079973 - protein, 34 aa, Staphylococcus
PIGVVTQITPWNYPLLQASWKLAPALATGCSLVM

SEQ ID NO: 2079974 - protein, 26 aa, Staphylococcus
PIHDACTILYLMQPDLFTMQHTHIDI

SEQ ID NO: 2079975 - protein, 20 aa, Staphylococcus
PIHDYQFLTFNVIGSPFGSS

SEQ ID NO: 2079976 - protein, 18 aa, Staphylococcus
PIHEPLTAINIYKPPKLI

SEQ ID NO: 2079977 - protein, 20 aa, Staphylococcus
PIHEYIVPGQLIVEKVFSMM

SEQ ID NO: 2079978 - protein, 20 aa, Staphylococcus
PIHFQWKPGFVVGVMLASQG

SEQ ID NO: 2079979 - protein, 18 aa, Staphylococcus
PIIDASVARVLYLGIVGD

SEQ ID NO: 2079980 - protein, 27 aa, Staphylococcus
PIIEETLTMPFFSDKKAILVKNAYVFT

SEQ ID NO: 2079981 - protein, 19 aa, Staphylococcus
PIIKKLNHIHVLVKAQFDV

SEQ ID NO: 2079982 - protein, 22 aa, Staphylococcus
PIIQVGVRVIVPFGPRTIQGYV

SEQ ID NO: 2079983 - protein, 32 aa, Staphylococcus
PIKEEYQYFREDLILFTYLHLANDKELTEALA

SEQ ID NO: 2079984 - protein, 20 aa, Staphylococcus
PIKVRYFYNGRILMMNMMPK

SEQ ID NO: 2079985 - protein, 22 aa, Staphylococcus
PILGICLGFQLIYEYYGGEIIH

SEQ ID NO: 2079986 - protein, 29 aa, Staphylococcus
PILGVCLGFQFIYEYYGGTIIHGLKPVHG

SEQ ID NO: 2079987 - protein, 17 aa, Staphylococcus
PILLKRGMSATIEEFIF

SEQ ID NO: 2079988 - protein, 19 aa, Staphylococcus
PILNGVLDYRRQLTNPFTG

SEQ ID NO: 2079989 - protein, 19 aa, Staphylococcus
PILPLMTYTELDTAIDFIA

SEQ ID NO: 2079990 - protein, 20 aa, Staphylococcus
PILYLDGFNFENKKAKLYPL

SEQ ID NO: 2079991 - protein, 18 aa, Staphylococcus
PILYQIWKKKHKKAYYKL

SEQ ID NO: 2079992 - protein, 24 aa, Staphylococcus
PIMVLMRKVIPALVTGCSIVIKPS

SEQ ID NO: 2079993 - protein, 29 aa, Staphylococcus
PINIWVSTPSFIEMCLLLPTLNEEQYGSL

SEQ ID NO: 2079994 - protein, 17 aa, Staphylococcus
PINLLKEHKTVGIFPTG

SEQ ID NO: 2079995 - protein, 17 aa, Staphylococcus
PINQQVLYYPVTNAEFD

SEQ ID NO: 2079996 - protein, 18 aa, Staphylococcus
PIPEMYYLDVASPGAERP

SEQ ID NO: 2079997 - protein, 20 aa, Staphylococcus
PIPIKALTSHLGFGNYELRL

SEQ ID NO: 2079998 - protein, 17 aa, Staphylococcus
PIPMCGVPYHSADGYIE

SEQ ID NO: 2079999 - protein, 17 aa, Staphylococcus
PIPMCGVPYHSADSYIE

SEQ ID NO: 2080000 - protein, 17 aa, Staphylococcus
PIPMCGVPYHSANSYIE

SEQ ID NO: 2080001 - protein, 17 aa, Staphylococcus
PIPRFPGVSRDIALEVN

SEQ ID NO: 2080002 - protein, 26 aa, Staphylococcus
PIQIGSHFHFFEANLALDFERDKAYG

SEQ ID NO: 2080003 - protein, 28 aa, Staphylococcus
PIQQGYLPLNWINKWKLYSTVKLPKRWE

SEQ ID NO: 2080004 - protein, 18 aa, Staphylococcus
PIQTDSIPYALHGLDILG

SEQ ID NO: 2080005 - protein, 26 aa, Staphylococcus
PIRINGINFYTLPFATVAEVQHYFKD

SEQ ID NO: 2080006 - protein, 32 aa, Staphylococcus
PIRLDGATKEFFAWGLRVGFLTFGLNNNVAKE

SEQ ID NO: 2080007 - protein, 31 aa, Staphylococcus
PIRLDGATKEFFAWGLRVGFLTFGLSNQKAK

SEQ ID NO: 2080008 - protein, 28 aa, Staphylococcus
PIRLDGATKEFFAWGLRVGFMSFGVSNE

SEQ ID NO: 2080009 - protein, 29 aa, Staphylococcus
PISFAHHILTYYWMLERDKSRFQDSLKRI

SEQ ID NO: 2080010 - protein, 30 aa, Staphylococcus
PISFAHHIMTYFWMLERDKSRFQDSMKRID

SEQ ID NO: 2080011 - protein, 18 aa, Staphylococcus
PISNYLYSKIFFDKEKGI

SEQ ID NO: 2080012 - protein, 27 aa, Staphylococcus
PITINNINFYTLPFATISEIKAYFDDD

SEQ ID NO: 2080013 - protein, 18 aa, Staphylococcus
PITVITKPTPIFPRLDTE

SEQ ID NO: 2080014 - protein, 24 aa, Staphylococcus
PIVEDGVYSDLWFNANKQVPMKSL

SEQ ID NO: 2080015 - protein, 20 aa, Staphylococcus
PIYETSPIPQIPRKEIAKLE

SEQ ID NO: 2080016 - protein, 22 aa, Staphylococcus
PIYIQLYSYIKQEIKKKRLLPE

SEQ ID NO: 2080017 - protein, 17 aa, Staphylococcus
PIYNSFGMTETCSQFLT

SEQ ID NO: 2080018 - protein, 17 aa, Staphylococcus
PIYSILPSTFKNYMHEH

SEQ ID NO: 2080019 - protein, 20 aa, Staphylococcus
PKAIAHYFKERWQHIPHFGY

SEQ ID NO: 2080020 - protein, 23 aa, Staphylococcus
PKALDTFYALNNRGLYKFANSEW

SEQ ID NO: 2080021 - protein, 21 aa, Staphylococcus
PKAWVVIAKPNVGISTACVFQ

SEQ ID NO: 2080022 - protein, 17 aa, Staphylococcus
PKAYYRNRFSWVVSYDA

SEQ ID NO: 2080023 - protein, 23 aa, Staphylococcus
PKDAVLHFIGSLQSRKVKDVIND

SEQ ID NO: 2080024 - protein, 19 aa, Staphylococcus
PKDIHLKLTYLLNTYQVDE

SEQ ID NO: 2080025 - protein, 26 aa, Staphylococcus
PKDKTLLKEGLVLAVEPFISSNATFV

SEQ ID NO: 2080026 - protein, 21 aa, Staphylococcus
PKDLFAVVMDAKTGEILAFSQ

SEQ ID NO: 2080027 - protein, 23 aa, Staphylococcus
PKDMHFYTVYPDKRNFVAIIGVN

SEQ ID NO: 2080028 - protein, 27 aa, Staphylococcus
PKDSEHYGLWIFKKTWGTYLSEKIGEF

SEQ ID NO: 2080029 - protein, 22 aa, Staphylococcus
PKDWRMHAFFMDALPILNEEWI

SEQ ID NO: 2080030 - protein, 21 aa, Staphylococcus
PKEDIFKFEKELKRLGINATI

SEQ ID NO: 2080031 - protein, 19 aa, Staphylococcus
PKEFIVAITIIFLINELNI

SEQ ID NO: 2080032 - protein, 20 aa, Staphylococcus
PKEIFGDDFVFLPKDELLTF

SEQ ID NO: 2080033 - protein, 21 aa, Staphylococcus
PKEIFGDDFVFLPKDELLTFD

SEQ ID NO: 2080034 - protein, 19 aa, Staphylococcus
PKEIFGDDFVFLPKEELLT

SEQ ID NO: 2080035 - protein, 20 aa, Staphylococcus
PKEIFGDDFVFLPKEELLTF

SEQ ID NO: 2080036 - protein, 17 aa, Staphylococcus
PKELIARHSLKVEAGVI

SEQ ID NO: 2080037 - protein, 18 aa, Staphylococcus
PKELIARHSLRVEAGVIA

SEQ ID NO: 2080038 - protein, 20 aa, Staphylococcus
PKELYLRLKKHMQEGELEIH

SEQ ID NO: 2080039 - protein, 17 aa, Staphylococcus
PKENLIDFKNKLSEAGL

SEQ ID NO: 2080040 - protein, 34 aa, Staphylococcus
PKEVKKLMNAFWPGPISFILPLKQGYLCEKVTGG

SEQ ID NO: 2080041 - protein, 30 aa, Staphylococcus
PKEVKQLILPIQFNKVFMIDFKAFEPSVVA

SEQ ID NO: 2080042 - protein, 23 aa, Staphylococcus
PKFSLEYIAFFPSDKPEKVKDEI

SEQ ID NO: 2080043 - protein, 27 aa, Staphylococcus
PKGFMNFVHQRLLFADKTPNPVHYWIA

SEQ ID NO: 2080044 - protein, 17 aa, Staphylococcus
PKGIIRRMVETKRLSSM

SEQ ID NO: 2080045 - protein, 19 aa, Staphylococcus
PKGKKIVAILTGNGLKDPD

SEQ ID NO: 2080046 - protein, 18 aa, Staphylococcus
PKHLDTELFFENIGKLDE

SEQ ID NO: 2080047 - protein, 20 aa, Staphylococcus
PKHRDRIAFMRIVSGAFERG

SEQ ID NO: 2080048 - protein, 22 aa, Staphylococcus
PKHVVYVWIDALVNYISALGYL

SEQ ID NO: 2080049 - protein, 23 aa, Staphylococcus
PKHVVYVWIDALVNYISALGYLS

SEQ ID NO: 2080050 - protein, 20 aa, Staphylococcus
PKHWDELIKVPVYSMKQLEY

SEQ ID NO: 2080051 - protein, 18 aa, Staphylococcus
PKIESLDDFYFGASFRVI

SEQ ID NO: 2080052 - protein, 17 aa, Staphylococcus
PKIGAYHFTTIKPNLGV

SEQ ID NO: 2080053 - protein, 19 aa, Staphylococcus
PKIILDFATLTGAAVAALG

SEQ ID NO: 2080054 - protein, 20 aa, Staphylococcus
PKIKFGFIHVPFVPEQVTDK

SEQ ID NO: 2080055 - protein, 21 aa, Staphylococcus
PKIKVYFSLNVGDLNKVVTEF

SEQ ID NO: 2080056 - protein, 20 aa, Staphylococcus
PKKNHLLMEIYANVLNKKIT

SEQ ID NO: 2080057 - protein, 24 aa, Staphylococcus
PKKSRLLVDIYANVLNKKVVVLES

SEQ ID NO: 2080058 - protein, 22 aa, Staphylococcus
PKLIEHLLEIRGLGIINVMTLF

SEQ ID NO: 2080059 - protein, 21 aa, Staphylococcus
PKLIEHLLEIRGLGVINVMTL

SEQ ID NO: 2080060 - protein, 18 aa, Staphylococcus
PKLINLKEALVEYLEHQK

SEQ ID NO: 2080061 - protein, 19 aa, Staphylococcus
PKLINLKEALVHYLEHQKT

SEQ ID NO: 2080062 - protein, 25 aa, Staphylococcus
PKLKDLNLKWYAVPIISNMDLQIGG

SEQ ID NO: 2080063 - protein, 34 aa, Staphylococcus
PKLSSVIQPLYDIGAVGMRLLTKYMNDEPIDEPN

SEQ ID NO: 2080064 - protein, 21 aa, Staphylococcus
PKMMLKVILYAYTQSVFSGRK

SEQ ID NO: 2080065 - protein, 22 aa, Staphylococcus
PKNIYVFESPIDALSYKSLNKE

SEQ ID NO: 2080066 - protein, 24 aa, Staphylococcus
PKNNAPFIASNDFQMAYKGTQYLI

SEQ ID NO: 2080067 - protein, 19 aa, Staphylococcus
PKNSIYFHSLTWGVDYIKP

SEQ ID NO: 2080068 - protein, 18 aa, Staphylococcus
PKNTLCMFCPVQEHCEAF

SEQ ID NO: 2080069 - protein, 33 aa, Staphylococcus
PKNYFRGDTLKPLPAYWIPFAQQLFQNWTDMME

SEQ ID NO: 2080070 - protein, 18 aa, Staphylococcus
PKPGTDLAWMSAVTKYII

SEQ ID NO: 2080071 - protein, 24 aa, Staphylococcus
PKQQIELFKQFKAVADKKKSVSDR

SEQ ID NO: 2080072 - protein, 24 aa, Staphylococcus
PKQQLPYFISFLSFYQISIYQILS

SEQ ID NO: 2080073 - protein, 26 aa, Staphylococcus
PKQQLPYVISFLSFHEYLIYQILPPK

SEQ ID NO: 2080074 - protein, 27 aa, Staphylococcus
PKREEGFYVAWLHLAKYDPMLTKTQRK

SEQ ID NO: 2080075 - protein, 23 aa, Staphylococcus
PKRKKLFIRIDGETYLLRGNMKP

SEQ ID NO: 2080076 - protein, 28 aa, Staphylococcus
PKRPNGWILHIPSVYLGIAQAAADYAKD

SEQ ID NO: 2080077 - protein, 17 aa, Staphylococcus
PKRRNLLLIGDGSLQLT

SEQ ID NO: 2080078 - protein, 23 aa, Staphylococcus
PKRYEPRMFIGAISNLKNELKTP

SEQ ID NO: 2080079 - protein, 27 aa, Staphylococcus
PKSDRLRQFFDFITNFGIMVKGTGEDI

SEQ ID NO: 2080080 - protein, 26 aa, Staphylococcus
PKSDRLTQFFDFITNFGIMVRGTGED

SEQ ID NO: 2080081 - protein, 27 aa, Staphylococcus
PKSERLRQFFDFITNFGIMIKGTGEDI

SEQ ID NO: 2080082 - protein, 28 aa, Staphylococcus
PKSERLRQFFDFITNFGIMIKGTGEDIH

SEQ ID NO: 2080083 - protein, 21 aa, Staphylococcus
PKSLHPFLNKYLNQPEFIVVD

SEQ ID NO: 2080084 - protein, 25 aa, Staphylococcus
PKSMVVYALAYIYGVNADLLRVSKK

SEQ ID NO: 2080085 - protein, 24 aa, Staphylococcus
PKSRHQVMTLLKKLQLEQHKTIIL

SEQ ID NO: 2080086 - protein, 18 aa, Staphylococcus
PKSVTPFDLHLITINPKK

SEQ ID NO: 2080087 - protein, 26 aa, Staphylococcus
PKTEMPPYREFAWVQDKFGVSFQLAL

SEQ ID NO: 2080088 - protein, 17 aa, Staphylococcus
PKTILYNLNPIYNDIVG

SEQ ID NO: 2080089 - protein, 21 aa, Staphylococcus
PKTMMSKLVTGLFLCGEVLDI

SEQ ID NO: 2080090 - protein, 26 aa, Staphylococcus
PKTPMPPFREFAWVQDKFGVSFQLAL

SEQ ID NO: 2080091 - protein, 41 aa, Staphylococcus
PKTRYAGGMGAKPLIFLKWALPDKAFDALWMGVLKLQGNSN

SEQ ID NO: 2080092 - protein, 21 aa, Staphylococcus
PKTYILEIASNWKKLGIKTAK

SEQ ID NO: 2080093 - protein, 18 aa, Staphylococcus
PKVFVRNALSPSQVLEVI

SEQ ID NO: 2080094 - protein, 23 aa, Staphylococcus
PKVNHNVLLDRFNYAKSLNVNAH

SEQ ID NO: 2080095 - protein, 24 aa, Staphylococcus
PKVNRNILLDRFNYAKSINVNAHP

SEQ ID NO: 2080096 - protein, 31 aa, Staphylococcus
PKVVNLIEPLAYYVSLALLKPININSYFLES

SEQ ID NO: 2080097 - protein, 32 aa, Staphylococcus
PKYEVSKFTISPFIHLTIGDTTFDMKIAGDFN

SEQ ID NO: 2080098 - protein, 18 aa, Staphylococcus
PKYRQRLLKDVYYQGKIV

SEQ ID NO: 2080099 - protein, 18 aa, Staphylococcus
PLAARHYQYFASFIDTDE

SEQ ID NO: 2080100 - protein, 24 aa, Staphylococcus
PLAESGIGGLALGLSAEGYRPVME

SEQ ID NO: 2080101 - protein, 27 aa, Staphylococcus
PLAIAAGCDMFLFFNDIEEDFNFMLQG

SEQ ID NO: 2080102 - protein, 25 aa, Staphylococcus
PLDEIVKTMIFKVDGEFIMILIRGH

SEQ ID NO: 2080103 - protein, 25 aa, Staphylococcus
PLDEWQKVIDINLTGAFIGAKAAVN

SEQ ID NO: 2080104 - protein, 19 aa, Staphylococcus
PLDIGYAVTFFASQEAKFI

SEQ ID NO: 2080105 - protein, 25 aa, Staphylococcus
PLDTLKQLYYLSKDLKYDLYHILFE

SEQ ID NO: 2080106 - protein, 19 aa, Staphylococcus
PLDYETITARSLLSKVLVR

SEQ ID NO: 2080107 - protein, 24 aa, Staphylococcus
PLEEQSLINFLTDLSLVADIDDAQ

SEQ ID NO: 2080108 - protein, 23 aa, Staphylococcus
PLEEQSLINFLTDLSLVADIDEA

SEQ ID NO: 2080109 - protein, 29 aa, Staphylococcus
PLEEVLSGAVAWISGLRRAQSPTRAHTNF

SEQ ID NO: 2080110 - protein, 17 aa, Staphylococcus
PLEFGKLRKVAMDKGFK

SEQ ID NO: 2080111 - protein, 17 aa, Staphylococcus
PLEKMKLPMSIEAVKKY

SEQ ID NO: 2080112 - protein, 17 aa, Staphylococcus
PLEKVLDTNFEPLLALM

SEQ ID NO: 2080113 - protein, 24 aa, Staphylococcus
PLEQITKSMIFKVDGEFIIVLVRG

SEQ ID NO: 2080114 - protein, 33 aa, Staphylococcus
PLESEYQFFKERLILFTYLHLANEEKLTQALVD

SEQ ID NO: 2080115 - protein, 33 aa, Staphylococcus
PLEYETITARSLLSKLLIRATKKWSTDKAFSKH

SEQ ID NO: 2080116 - protein, 18 aa, Staphylococcus
PLEYIKNKGITLTNTRGI

SEQ ID NO: 2080117 - protein, 19 aa, Staphylococcus
PLFINETLILFPLKHHRAP

SEQ ID NO: 2080118 - protein, 17 aa, Staphylococcus
PLGAVHGLKYWFNYTSD

SEQ ID NO: 2080119 - protein, 27 aa, Staphylococcus
PLGAVHGLKYWFNYTSKDLVSFTPHGP

SEQ ID NO: 2080120 - protein, 31 aa, Staphylococcus
PLGTVLIIGPFNYPVQLVFEPLIGAIAAGNT

SEQ ID NO: 2080121 - protein, 23 aa, Staphylococcus
PLHNMLNYFAILEQGSIPCFLDD

SEQ ID NO: 2080122 - protein, 22 aa, Staphylococcus
PLHQIQGLGPVLLKVNELLLTQ

SEQ ID NO: 2080123 - protein, 23 aa, Staphylococcus
PLHSSFIMSKLALAAYEGGAVGI

SEQ ID NO: 2080124 - protein, 26 aa, Staphylococcus
PLIHCDTLSEMLGINLYVKFEGANPT

SEQ ID NO: 2080125 - protein, 20 aa, Staphylococcus
PLINTLIRNYGVDVNIIYSS

SEQ ID NO: 2080126 - protein, 18 aa, Staphylococcus
PLIRFDLEYIKNNAKSVI

SEQ ID NO: 2080127 - protein, 20 aa, Staphylococcus
PLIYHENKISEYTLLTEYNP

SEQ ID NO: 2080128 - protein, 17 aa, Staphylococcus
PLKKRQISELSGGQLQR

SEQ ID NO: 2080129 - protein, 28 aa, Staphylococcus
PLKPYLPELMDMHKLIYPVGEGRINYIT

SEQ ID NO: 2080130 - protein, 24 aa, Staphylococcus
PLLKPHLEQLNKARLISVGLGNSN

SEQ ID NO: 2080131 - protein, 17 aa, Staphylococcus
PLLLDDDSHYRLYGVFL

SEQ ID NO: 2080132 - protein, 19 aa, Staphylococcus
PLNEHYFTTPYRFKNKDLL

SEQ ID NO: 2080133 - protein, 18 aa, Staphylococcus
PLNLEHFAKYAKAHLNIP

SEQ ID NO: 2080134 - protein, 25 aa, Staphylococcus
PLNPNSFFHPFSYIATKSPLNSMIK

SEQ ID NO: 2080135 - protein, 18 aa, Staphylococcus
PLNQIKGIGPKRLAVLQE

SEQ ID NO: 2080136 - protein, 19 aa, Staphylococcus
PLNSMIKLFGRHFKKNKIP

SEQ ID NO: 2080137 - protein, 24 aa, Staphylococcus
PLNTLTLHIALFMFEHIDKTRTFI

SEQ ID NO: 2080138 - protein, 21 aa, Staphylococcus
PLNYYEKKLPKQLFIKIHRAT

SEQ ID NO: 2080139 - protein, 19 aa, Staphylococcus
PLPNAVYKYGSFLIKEGKN

SEQ ID NO: 2080140 - protein, 27 aa, Staphylococcus
PLPSKDNLAMLYAEGFHICKGELFGKH

SEQ ID NO: 2080141 - protein, 26 aa, Staphylococcus
PLPSKDNLAVLYSEGFHICNGELFGK

SEQ ID NO: 2080142 - protein, 26 aa, Staphylococcus
PLQFQVALLDYNDYLGRIGIGRVFRG

SEQ ID NO: 2080143 - protein, 23 aa, Staphylococcus
PLQNEIELLLRDLGFSIQREHLY

SEQ ID NO: 2080144 - protein, 18 aa, Staphylococcus
PLQQAGIIDKFKARARFD

SEQ ID NO: 2080145 - protein, 26 aa, Staphylococcus
PLQVLNVMHQFYIPKIITGGATSTPS

SEQ ID NO: 2080146 - protein, 27 aa, Staphylococcus
PLRARTAGPAFFWGTFDVSAIVVYSKF

SEQ ID NO: 2080147 - protein, 18 aa, Staphylococcus
PLRQAVYFDTEKDGRMIF

SEQ ID NO: 2080148 - protein, 26 aa, Staphylococcus
PLRSKDNLAMLYKEGFHICNGELFGK

SEQ ID NO: 2080149 - protein, 17 aa, Staphylococcus
PLSAYRGFFGSKPYSKT

SEQ ID NO: 2080150 - protein, 22 aa, Staphylococcus
PLSEGYIYFKDKPISDYPVYEM

SEQ ID NO: 2080151 - protein, 27 aa, Staphylococcus
PLSGKKLPIWIADYVLSTYGTGAVMAV

SEQ ID NO: 2080152 - protein, 18 aa, Staphylococcus
PLSLLDKSPMIVKNPGIP

SEQ ID NO: 2080153 - protein, 20 aa, Staphylococcus
PLSMYLANKGYKIANIPLVL

SEQ ID NO: 2080154 - protein, 29 aa, Staphylococcus
PLSTMYMHYDYWFTYEYEKTVYTERVRHI

SEQ ID NO: 2080155 - protein, 18 aa, Staphylococcus
PLTAVNFYRAPEILCEKC

SEQ ID NO: 2080156 - protein, 25 aa, Staphylococcus
PLTAYKLMEILEEAGLPKGVVNFVP

SEQ ID NO: 2080157 - protein, 23 aa, Staphylococcus
PLTEGYIYFKDKPVSDFPVYEMR

SEQ ID NO: 2080158 - protein, 27 aa, Staphylococcus
PLTLFQIQSKFRDEQRPRFGLLRGREF

SEQ ID NO: 2080159 - protein, 29 aa, Staphylococcus
PLTLFQIQSKYRDEKRPRFGLLRGREFIM

SEQ ID NO: 2080160 - protein, 19 aa, Staphylococcus
PLTLIGPTGLQQFIETALK

SEQ ID NO: 2080161 - protein, 25 aa, Staphylococcus
PLTNIALLFNTYPECKNYVKEIIIM

SEQ ID NO: 2080162 - protein, 27 aa, Staphylococcus
PLTQFAKTQLFTLKPLASTIESRLQHT

SEQ ID NO: 2080163 - protein, 23 aa, Staphylococcus
PLVLEPPYYLPQWDKVDRDILKN

SEQ ID NO: 2080164 - protein, 24 aa, Staphylococcus
PLVNYQLHPFNFKDILFNRITKWT

SEQ ID NO: 2080165 - protein, 28 aa, Staphylococcus
PLVQAGRVFIALPPLYKLEKGKGKSKKV

SEQ ID NO: 2080166 - protein, 18 aa, Staphylococcus
PLVRFRKFLEGKGLWSEE

SEQ ID NO: 2080167 - protein, 26 aa, Staphylococcus
PLWHLTQSIYQEWYLGSTLFKEVEGH

SEQ ID NO: 2080168 - protein, 25 aa, Staphylococcus
PLYNKYKAFWKLFLKLRESLEIFNY

SEQ ID NO: 2080169 - protein, 29 aa, Staphylococcus
PLYNKYKSYWKLFLKPFETLEAFNYHKVY

SEQ ID NO: 2080170 - protein, 20 aa, Staphylococcus
PLYSDIVLPAATWYEKHDIS

SEQ ID NO: 2080171 - protein, 21 aa, Staphylococcus
PLYSDIVLPAATWYEKHDLSS

SEQ ID NO: 2080172 - protein, 21 aa, Staphylococcus
PMAEAIMRQRLIDRNISGVNV

SEQ ID NO: 2080173 - protein, 20 aa, Staphylococcus
PMAHGSHFHRAPGSVGMASD

SEQ ID NO: 2080174 - protein, 17 aa, Staphylococcus
PMAKNELLPYLMDEDRV

SEQ ID NO: 2080175 - protein, 18 aa, Staphylococcus
PMAQLAMRAILGEKLSDL

SEQ ID NO: 2080176 - protein, 27 aa, Staphylococcus
PMDMVQIDLTRTWELLGEIIGESASDE

SEQ ID NO: 2080177 - protein, 29 aa, Staphylococcus
PMDMVQIDLTRTWELLGEIIGESASDELI

SEQ ID NO: 2080178 - protein, 24 aa, Staphylococcus
PMDMVQIDLTRTWQILGEIIGESA

SEQ ID NO: 2080179 - protein, 17 aa, Staphylococcus
PMDRLLCGDVGYGKTEV

SEQ ID NO: 2080180 - protein, 22 aa, Staphylococcus
PMGCQTGFYVSFIDHDDYEDVL

SEQ ID NO: 2080181 - protein, 21 aa, Staphylococcus
PMGCQTGFYVSFINHDDYEDV

SEQ ID NO: 2080182 - protein, 22 aa, Staphylococcus
PMGCQTGFYVSFINHDDYEDVL

SEQ ID NO: 2080183 - protein, 17 aa, Staphylococcus
PMGGLQERVWNALQFMN

SEQ ID NO: 2080184 - protein, 19 aa, Staphylococcus
PMGIAKYANRYNVPVVFIG

SEQ ID NO: 2080185 - protein, 17 aa, Staphylococcus
PMGKAFKKALKYMNIQA

SEQ ID NO: 2080186 - protein, 17 aa, Staphylococcus
PMHVSEEASYNDLDNDK

SEQ ID NO: 2080187 - protein, 17 aa, Staphylococcus
PMIHEEPLLDKIWDINL

SEQ ID NO: 2080188 - protein, 18 aa, Staphylococcus
PMIRRRLYHFAIHPNDQE

SEQ ID NO: 2080189 - protein, 19 aa, Staphylococcus
PMLSVFLYSEVDKKRYQVL

SEQ ID NO: 2080190 - protein, 22 aa, Staphylococcus
PMMKLKQIYPNTLALTNNTFEH

SEQ ID NO: 2080191 - protein, 23 aa, Staphylococcus
PMNANFGLLPVLEKRIKDKKERY

SEQ ID NO: 2080192 - protein, 17 aa, Staphylococcus
PMNCPHHMMVYNNRPHS

SEQ ID NO: 2080193 - protein, 19 aa, Staphylococcus
PMNLYYQTDRLLDSNLLVI

SEQ ID NO: 2080194 - protein, 23 aa, Staphylococcus
PMNNTLITSWFWSHRPKQIERAG

SEQ ID NO: 2080195 - protein, 25 aa, Staphylococcus
PMRIKEFELLWYLASRENEVISKSE

SEQ ID NO: 2080196 - protein, 20 aa, Staphylococcus
PMSELKPEGIVWVIDPIDGT

SEQ ID NO: 2080197 - protein, 29 aa, Staphylococcus
PMTADMCYLLQLLYFNDYTYETLIERHTQ

SEQ ID NO: 2080198 - protein, 25 aa, Staphylococcus
PMTAYGIYIALKRTVAEKFDGDKLE

SEQ ID NO: 2080199 - protein, 23 aa, Staphylococcus
PNAKPPVARIMDYGKYKFEQQKK

SEQ ID NO: 2080200 - protein, 26 aa, Staphylococcus
PNALAHYENELTLPLYPQLTNEEVEY

SEQ ID NO: 2080201 - protein, 23 aa, Staphylococcus
PNAVDGVFFHERRALSHYEKRFT

SEQ ID NO: 2080202 - protein, 17 aa, Staphylococcus
PNAYAAVETKKLLDRIY

SEQ ID NO: 2080203 - protein, 26 aa, Staphylococcus
PNDILNNSPFWYAVSSYPKGEFNRID

SEQ ID NO: 2080204 - protein, 18 aa, Staphylococcus
PNETGALYYREGFITNLM

SEQ ID NO: 2080205 - protein, 17 aa, Staphylococcus
PNETIEFQLAYGLPDFG

SEQ ID NO: 2080206 - protein, 25 aa, Staphylococcus
PNETVQFLPFGYPRVSYLLNYKDNQ

SEQ ID NO: 2080207 - protein, 30 aa, Staphylococcus
PNGFSYFNGYYHIFYQHYPYAPEWGPMHWG

SEQ ID NO: 2080208 - protein, 25 aa, Staphylococcus
PNGKKVILYAPTWRDDEFIKKGQYL

SEQ ID NO: 2080209 - protein, 26 aa, Staphylococcus
PNGNHVLAIPIFQNQLLFTKHSKRGI

SEQ ID NO: 2080210 - protein, 26 aa, Staphylococcus
PNGTIIQLWHGTPIKKLFLDSMEPTQ

SEQ ID NO: 2080211 - protein, 26 aa, Staphylococcus
PNGTIIQLWHGTPIKKLFLDSREPNQ

SEQ ID NO: 2080212 - protein, 25 aa, Staphylococcus
PNHAPLIVAEQFGTLATLYPNRIDL

SEQ ID NO: 2080213 - protein, 18 aa, Staphylococcus
PNHEYIPYHYGINHAEKV

SEQ ID NO: 2080214 - protein, 19 aa, Staphylococcus
PNIEVLKFDYQMGYGGLGV

SEQ ID NO: 2080215 - protein, 20 aa, Staphylococcus
PNIIYNIDTALIYLSKYQIQ

SEQ ID NO: 2080216 - protein, 24 aa, Staphylococcus
PNINESYWFYKATNDGIYLSLGAI

SEQ ID NO: 2080217 - protein, 20 aa, Staphylococcus
PNIRQYPLMDLTSRIIGKDK

SEQ ID NO: 2080218 - protein, 17 aa, Staphylococcus
PNKLEALGFQFSYPHLK

SEQ ID NO: 2080219 - protein, 24 aa, Staphylococcus
PNKLIPLTFFVDKFQQAKSSISED

SEQ ID NO: 2080220 - protein, 33 aa, Staphylococcus
PNKYSFGILDKKIKILLKVWKFGYQTEYSVNDL

SEQ ID NO: 2080221 - protein, 20 aa, Staphylococcus
PNLFAYTRTLNSKKVLVVGN

SEQ ID NO: 2080222 - protein, 20 aa, Staphylococcus
PNLRLFLHRHDLFESDYWSV

SEQ ID NO: 2080223 - protein, 18 aa, Staphylococcus
PNLTLYDYFKTWCETFKK

SEQ ID NO: 2080224 - protein, 18 aa, Staphylococcus
PNLWEQFNKGFYPLPRKD

SEQ ID NO: 2080225 - protein, 18 aa, Staphylococcus
PNMATMLGFITTDANIDA

SEQ ID NO: 2080226 - protein, 17 aa, Staphylococcus
PNNILGVAYIKAISNIA

SEQ ID NO: 2080227 - protein, 26 aa, Staphylococcus
PNNLELFKRKNQLPTLAFERVTHKEE

SEQ ID NO: 2080228 - protein, 17 aa, Staphylococcus
PNNYETYEFLSITDTLI

SEQ ID NO: 2080229 - protein, 18 aa, Staphylococcus
PNPDPYLTAVQKLNYNPT

SEQ ID NO: 2080230 - protein, 23 aa, Staphylococcus
PNPKVLNPLFDAYDVSPDQVAII

SEQ ID NO: 2080231 - protein, 25 aa, Staphylococcus
PNQLIPLTFFVKKFKQAKSSISEDV

SEQ ID NO: 2080232 - protein, 21 aa, Staphylococcus
PNRCAVLLNEHLTFILFDIEE

SEQ ID NO: 2080233 - protein, 18 aa, Staphylococcus
PNRLHQMSKLYVSAKSQA

SEQ ID NO: 2080234 - protein, 23 aa, Staphylococcus
PNSAEIFNFIYGHLDELINQTKV

SEQ ID NO: 2080235 - protein, 17 aa, Staphylococcus
PNSDTYHNLGSNALYLI

SEQ ID NO: 2080236 - protein, 28 aa, Staphylococcus
PNSGLVDRFYFEALYARLGHILLEISTD

SEQ ID NO: 2080237 - protein, 26 aa, Staphylococcus
PNSQRYIEMLKLLQTSPNADVLLLTA

SEQ ID NO: 2080238 - protein, 18 aa, Staphylococcus
PNSWAPVSIAWSKDNRSA

SEQ ID NO: 2080239 - protein, 17 aa, Staphylococcus
PNSWKNLKELERKKAID

SEQ ID NO: 2080240 - protein, 35 aa, Staphylococcus
PNTEDPFERALYSTFLSYLPKEDFSYPLKMNVDHR

SEQ ID NO: 2080241 - protein, 21 aa, Staphylococcus
PNTKFFYCGKDPYRHSLPQEE

SEQ ID NO: 2080242 - protein, 17 aa, Staphylococcus
PNTKVIINLPNGKRITG

SEQ ID NO: 2080243 - protein, 20 aa, Staphylococcus
PNTWKNFDELERKKAIDIGN

SEQ ID NO: 2080244 - protein, 25 aa, Staphylococcus
PNVKKEHWGFDDPAGKPWSEFQRVR

SEQ ID NO: 2080245 - protein, 24 aa, Staphylococcus
PNVKKEHWGFDDPAGKSWSEFQRV

SEQ ID NO: 2080246 - protein, 26 aa, Staphylococcus
PNVPFSMITTFNLFMALAIRETIQEF

SEQ ID NO: 2080247 - protein, 23 aa, Staphylococcus
PNVRRLTEALFMTRGAISKLTKR

SEQ ID NO: 2080248 - protein, 22 aa, Staphylococcus
PNVVTTYDLLLRSGLELEADFV

SEQ ID NO: 2080249 - protein, 19 aa, Staphylococcus
PNYPSRLTSYLMLSKPVIS

SEQ ID NO: 2080250 - protein, 21 aa, Staphylococcus
PNYQTFKPYELDNNVFQALKD

SEQ ID NO: 2080251 - protein, 24 aa, Staphylococcus
PNYRKHWHVIFKLDNDKLLVYSDI

SEQ ID NO: 2080252 - protein, 27 aa, Staphylococcus
PPAEACGTWRLVYTRIVALENATLQHV

SEQ ID NO: 2080253 - protein, 24 aa, Staphylococcus
PPARRALPRAQHPREPAPRRAGLP

SEQ ID NO: 2080254 - protein, 25 aa, Staphylococcus
PPCHTMFQFYVQDGRLSCQLYQRSA

SEQ ID NO: 2080255 - protein, 20 aa, Staphylococcus
PPDIVLLDLVMPEMNGIEVT

SEQ ID NO: 2080256 - protein, 24 aa, Staphylococcus
PPDNPVNDMLWYDTSNPNVAVLRR

SEQ ID NO: 2080257 - protein, 27 aa, Staphylococcus
PPELSEQFPLIRQLLDAYQIKHYELEN

SEQ ID NO: 2080258 - protein, 26 aa, Staphylococcus
PPELSEQFPYIRQLLDAYHIKYYELE

SEQ ID NO: 2080259 - protein, 25 aa, Staphylococcus
PPELSEQFPYVRQLLDAYQIKRYEL

SEQ ID NO: 2080260 - protein, 18 aa, Staphylococcus
PPETIAHLINYDTTHGKF

SEQ ID NO: 2080261 - protein, 18 aa, Staphylococcus
PPETIAHLINYDTTHGRY

SEQ ID NO: 2080262 - protein, 20 aa, Staphylococcus
PPETIAHLINYDTTHGRYDK

SEQ ID NO: 2080263 - protein, 18 aa, Staphylococcus
PPGILYDSVGWTNSVEKI

SEQ ID NO: 2080264 - protein, 47 aa, Staphylococcus
PPGKKLQHLSLLSGGERALSAIALLFAILKVRSAPFVILDEVEAALD

SEQ ID NO: 2080265 - protein, 47 aa, Staphylococcus
PPGKKLQHLSLLSGGERALSAIALLFALLKVRSAPFVILDEVEAALD

SEQ ID NO: 2080266 - protein, 17 aa, Staphylococcus
PPILLPKLVELMEQGNP

SEQ ID NO: 2080267 - protein, 19 aa, Staphylococcus
PPIVSLIKLYQNHNDFTSY

SEQ ID NO: 2080268 - protein, 18 aa, Staphylococcus
PPIYMFGGAYEIYLPDMQ

SEQ ID NO: 2080269 - protein, 18 aa, Staphylococcus
PPLNVYFSGYRTAEGFEG

SEQ ID NO: 2080270 - protein, 28 aa, Staphylococcus
PPLTHFVTNSTYFLWDVLTTAYVGNPQL

SEQ ID NO: 2080271 - protein, 25 aa, Staphylococcus
PPNVKKEHWGFDDPAGKPWSEFQRV

SEQ ID NO: 2080272 - protein, 25 aa, Staphylococcus
PPNVKKEHWGFEDPAGKEWSEFQRV

SEQ ID NO: 2080273 - protein, 19 aa, Staphylococcus
PPQQFIALAAIGTIADLVS

SEQ ID NO: 2080274 - protein, 20 aa, Staphylococcus
PPRLQNGTSWFYFATDQWKY

SEQ ID NO: 2080275 - protein, 25 aa, Staphylococcus
PPRLQNGTSWFYFTTDQWKYEESGV

SEQ ID NO: 2080276 - protein, 19 aa, Staphylococcus
PPSRGLGSSAAIAVAFTRA

SEQ ID NO: 2080277 - protein, 25 aa, Staphylococcus
PPSVKKEHWGFDDPAGKDWSEFQRV

SEQ ID NO: 2080278 - protein, 20 aa, Staphylococcus
PPSWKNLAQLERKKAIDIGN

SEQ ID NO: 2080279 - protein, 29 aa, Staphylococcus
PPTAYQFFNDPMLSVFLFSEVDKKRFVQL

SEQ ID NO: 2080280 - protein, 19 aa, Staphylococcus
PPYEYQHIKVHLAVGQFKF

SEQ ID NO: 2080281 - protein, 23 aa, Staphylococcus
PQAFEGLRLQKRQLRRPDLTFAT

SEQ ID NO: 2080282 - protein, 24 aa, Staphylococcus
PQAKAIYNLLIEELNFEISTDINY

SEQ ID NO: 2080283 - protein, 25 aa, Staphylococcus
PQCFNTAYKILKMIQRQFDVIINES

SEQ ID NO: 2080284 - protein, 24 aa, Staphylococcus
PQCYSTAFKILKLIQMEFDITINE

SEQ ID NO: 2080285 - protein, 23 aa, Staphylococcus
PQDAALMMQLGADGVFVGSGIFK

SEQ ID NO: 2080286 - protein, 18 aa, Staphylococcus
PQDIIIASRVRQGQRQTL

SEQ ID NO: 2080287 - protein, 30 aa, Staphylococcus
PQDKIKLRKQIRQLAAIYLASGIDPDKSTL

SEQ ID NO: 2080288 - protein, 29 aa, Staphylococcus
PQDKIKLRKQIRQLAAIYLASGINPEKAT

SEQ ID NO: 2080289 - protein, 27 aa, Staphylococcus
PQDRARLVIYPAAMRYAGPREAILHAT

SEQ ID NO: 2080290 - protein, 17 aa, Staphylococcus
PQDTNHLHTMFGGILMA

SEQ ID NO: 2080291 - protein, 20 aa, Staphylococcus
PQEIIDKYNIPIAPLSVTFD

SEQ ID NO: 2080292 - protein, 25 aa, Staphylococcus
PQFNDTYVTNLFFENSTRTKCSFEV

SEQ ID NO: 2080293 - protein, 23 aa, Staphylococcus
PQGELYLRRAIADYIYEARGVKC

SEQ ID NO: 2080294 - protein, 18 aa, Staphylococcus
PQHLDVINKINVPVILVG

SEQ ID NO: 2080295 - protein, 25 aa, Staphylococcus
PQIASLMLSAIISDSLLFKSPTCTE

SEQ ID NO: 2080296 - protein, 28 aa, Staphylococcus
PQIQGFFDIPIDHLMGVPILAQHFENDP

SEQ ID NO: 2080297 - protein, 28 aa, Staphylococcus
PQIQGFFDIPIDHLMGVPILAQHFQNDP

SEQ ID NO: 2080298 - protein, 19 aa, Staphylococcus
PQIYDAIRYGTILENVVVE

SEQ ID NO: 2080299 - protein, 26 aa, Staphylococcus
PQKGNINIYFRSWYSHFLDYKQNNIK

SEQ ID NO: 2080300 - protein, 20 aa, Staphylococcus
PQKIVRWRAAMFIFDEGNEE

SEQ ID NO: 2080301 - protein, 24 aa, Staphylococcus
PQKKHEGLFIINQQLEPGTYQAFV

SEQ ID NO: 2080302 - protein, 28 aa, Staphylococcus
PQKNSTLQLVIYYLMGKASQNPTFENIR

SEQ ID NO: 2080303 - protein, 18 aa, Staphylococcus
PQLKEIYNIVLEANLKGI

SEQ ID NO: 2080304 - protein, 20 aa, Staphylococcus
PQLKRIGFDYYFIDNHKLSS

SEQ ID NO: 2080305 - protein, 23 aa, Staphylococcus
PQLSFAVRYLQTSAGIMITASHN

SEQ ID NO: 2080306 - protein, 32 aa, Staphylococcus
PQLSSVIQPLYDIGAVGMRLLTKYMNEEEIDE

SEQ ID NO: 2080307 - protein, 20 aa, Staphylococcus
PQNFAEVKLKLDNHSKKLQI

SEQ ID NO: 2080308 - protein, 26 aa, Staphylococcus
PQNGKRIFISPLARKMAEDKNFDITR

SEQ ID NO: 2080309 - protein, 34 aa, Staphylococcus
PQPPSEDFAFYAATLPSTFFYSGAAPKDGKIYPH

SEQ ID NO: 2080310 - protein, 26 aa, Staphylococcus
PQQLEIQYHCHVLYMTVIRKSSFQRF

SEQ ID NO: 2080311 - protein, 19 aa, Staphylococcus
PQQLYLSEIILEQLMHSEK

SEQ ID NO: 2080312 - protein, 27 aa, Staphylococcus
PQQVEHMNAWLKPYMRAFHLEEPVINI

SEQ ID NO: 2080313 - protein, 20 aa, Staphylococcus
PQSKIWLDPGIGFAKTRDEE

SEQ ID NO: 2080314 - protein, 20 aa, Staphylococcus
PQSLKNLDKLERKKAIDIAN

SEQ ID NO: 2080315 - protein, 20 aa, Staphylococcus
PQSWKNFDELERKKAIDIGN

SEQ ID NO: 2080316 - protein, 24 aa, Staphylococcus
PQSWKNMDKLERKKAIDIGNAMLK

SEQ ID NO: 2080317 - protein, 18 aa, Staphylococcus
PQVILDFATLTGAAIVAL

SEQ ID NO: 2080318 - protein, 18 aa, Staphylococcus
PQVLLLNTHIIVDRSVYE

SEQ ID NO: 2080319 - protein, 20 aa, Staphylococcus
PQVVLAWLRDRPNVDSIVIA

SEQ ID NO: 2080320 - protein, 20 aa, Staphylococcus
PQVVLFNKRDLCPSTMALPM

SEQ ID NO: 2080321 - protein, 39 aa, Staphylococcus
PQYTKYELKFGPILLRNKSDIFFSKWHRELTALKHIKKQ

SEQ ID NO: 2080322 - protein, 19 aa, Staphylococcus
PRAIDYLDLNWPKDTEFVY

SEQ ID NO: 2080323 - protein, 28 aa, Staphylococcus
PRATLKRLPLYYRFAQRVKSKGYDRVNS

SEQ ID NO: 2080324 - protein, 27 aa, Staphylococcus
PRATLKRLPLYYRFVNSLKIKGIDRVS

SEQ ID NO: 2080325 - protein, 26 aa, Staphylococcus
PRATLKRLPLYYRFVNTLKSKGIDRV

SEQ ID NO: 2080326 - protein, 27 aa, Staphylococcus
PRATLKRLPLYYRFVNTLKSKGIDRVN

SEQ ID NO: 2080327 - protein, 26 aa, Staphylococcus
PRATLKRLPLYYRLVNQLHEKGIDRV

SEQ ID NO: 2080328 - protein, 22 aa, Staphylococcus
PREHSFPTPPVKPVLMAFTKSY

SEQ ID NO: 2080329 - protein, 22 aa, Staphylococcus
PREKPYQINYFDKVQIKKDIAS

SEQ ID NO: 2080330 - protein, 19 aa, Staphylococcus
PRELYLRLKKHIQSGRLII

SEQ ID NO: 2080331 - protein, 23 aa, Staphylococcus
PRFTDRFELFIVGREHGNAFTEL

SEQ ID NO: 2080332 - protein, 19 aa, Staphylococcus
PRGGHFVYNLYDFEIMQRD

SEQ ID NO: 2080333 - protein, 19 aa, Staphylococcus
PRGIIRRMVETKRLSSMIF

SEQ ID NO: 2080334 - protein, 22 aa, Staphylococcus
PRGIPIIPEGYSPKLKRVNRKP

SEQ ID NO: 2080335 - protein, 19 aa, Staphylococcus
PRGTVVIVSIFAHPVEFDP

SEQ ID NO: 2080336 - protein, 18 aa, Staphylococcus
PRGVLRKFEMSRIAFREH

SEQ ID NO: 2080337 - protein, 18 aa, Staphylococcus
PRGVMRKFEMSRIAFREH

SEQ ID NO: 2080338 - protein, 29 aa, Staphylococcus
PRIDPETFGYLVYFFELACAMSGYQLGVN

SEQ ID NO: 2080339 - protein, 24 aa, Staphylococcus
PRITNPYFAYLIDAIDKKIKGTPY

SEQ ID NO: 2080340 - protein, 17 aa, Staphylococcus
PRKAIIEPSIQNFHYAI

SEQ ID NO: 2080341 - protein, 29 aa, Staphylococcus
PRLDEETFGYLVYFFELACAMSGYQLGVN

SEQ ID NO: 2080342 - protein, 20 aa, Staphylococcus
PRLEMLEAYYLNRNTDILTG

SEQ ID NO: 2080343 - protein, 28 aa, Staphylococcus
PRLLKEIYDYPFVLFYQGDPQLLTSPNT

SEQ ID NO: 2080344 - protein, 22 aa, Staphylococcus
PRMQERAFVLIPLNDIASDKQN

SEQ ID NO: 2080345 - protein, 26 aa, Staphylococcus
PRMSERAFVLIPLNDIAPTQIEPRSK

SEQ ID NO: 2080346 - protein, 21 aa, Staphylococcus
PRMSNPTKPIGPFYTKEEAEQ

SEQ ID NO: 2080347 - protein, 20 aa, Staphylococcus
PRPMIRGTAYWAIGQIAGET

SEQ ID NO: 2080348 - protein, 20 aa, Staphylococcus
PRPMIRGTAYWAIGQILGND

SEQ ID NO: 2080349 - protein, 18 aa, Staphylococcus
PRQFDFEAKAHWDLIEEL

SEQ ID NO: 2080350 - protein, 20 aa, Staphylococcus
PRTDYKGRIFCYVLDDEHYV

SEQ ID NO: 2080351 - protein, 22 aa, Staphylococcus
PRTDYKGRIFCYVLDEDHYVIG

SEQ ID NO: 2080352 - protein, 25 aa, Staphylococcus
PRVENGELPIWIATGGTPESSLRAG

SEQ ID NO: 2080353 - protein, 20 aa, Staphylococcus
PRVGYYYSGKPQNKLIADEL

SEQ ID NO: 2080354 - protein, 19 aa, Staphylococcus
PSAIFGTKKPRPLENGVIK

SEQ ID NO: 2080355 - protein, 23 aa, Staphylococcus
PSALRVKFLWDQLDEYPHGIVQD

SEQ ID NO: 2080356 - protein, 25 aa, Staphylococcus
PSANSLYYALNGFDRNMRTDIAGLE

SEQ ID NO: 2080357 - protein, 23 aa, Staphylococcus
PSANSLYYALNGFGRDARADING

SEQ ID NO: 2080358 - protein, 24 aa, Staphylococcus
PSANSLYYGLNGFNRNLRADIEGL

SEQ ID NO: 2080359 - protein, 17 aa, Staphylococcus
PSCRIAYIVLPKEILSK

SEQ ID NO: 2080360 - protein, 21 aa, Staphylococcus
PSDGFVFYASKGSMGLKVTSK

SEQ ID NO: 2080361 - protein, 20 aa, Staphylococcus
PSDYPILKSVLDRYASSVPI

SEQ ID NO: 2080362 - protein, 27 aa, Staphylococcus
PSEDEFHYTLYQTVFNLTSRTLYVKYY

SEQ ID NO: 2080363 - protein, 18 aa, Staphylococcus
PSEDFAFYAVELPSTFIY

SEQ ID NO: 2080364 - protein, 31 aa, Staphylococcus
PSEETTLLTLKLAELFRASTIPAGLIQIVPG

SEQ ID NO: 2080365 - protein, 25 aa, Staphylococcus
PSEGVRLKAYFNEMTYDNTLLSNIE

SEQ ID NO: 2080366 - protein, 30 aa, Staphylococcus
PSEKTARQCAIVWGVYPVVKEGRKNTDALL

SEQ ID NO: 2080367 - protein, 26 aa, Staphylococcus
PSETRQLFYDLNWKTVVGFQTRNPVH

SEQ ID NO: 2080368 - protein, 23 aa, Staphylococcus
PSEYPKFILGFGGIKQRELADYV

SEQ ID NO: 2080369 - protein, 17 aa, Staphylococcus
PSFLDVFHIVKSHMAIE

SEQ ID NO: 2080370 - protein, 26 aa, Staphylococcus
PSFSNPWTYYWVGINGKQILTYLSRS

SEQ ID NO: 2080371 - protein, 29 aa, Staphylococcus
PSGDDMLVGMLFIHSIHPYIAKIHLEKIK

SEQ ID NO: 2080372 - protein, 25 aa, Staphylococcus
PSGNSLYYALNGFDRNMRADVDGME

SEQ ID NO: 2080373 - protein, 32 aa, Staphylococcus
PSGPENMPLSKMNMFGLGRLMMKMIMKQKNVD

SEQ ID NO: 2080374 - protein, 18 aa, Staphylococcus
PSGTLFKKGESLAVVVKG

SEQ ID NO: 2080375 - protein, 17 aa, Staphylococcus
PSHFVSIIKQHGALLAK

SEQ ID NO: 2080376 - protein, 28 aa, Staphylococcus
PSHPIGRAILQYIDIPIAAPSANVSGRP

SEQ ID NO: 2080377 - protein, 17 aa, Staphylococcus
PSHPVGRAILKAVRLPI

SEQ ID NO: 2080378 - protein, 20 aa, Staphylococcus
PSIDYIMFANDFELNGLNRA

SEQ ID NO: 2080379 - protein, 21 aa, Staphylococcus
PSIDYIMFTDGFELKGLNRAK

SEQ ID NO: 2080380 - protein, 21 aa, Staphylococcus
PSIDYIMFTDGFELKGLNRAR

SEQ ID NO: 2080381 - protein, 20 aa, Staphylococcus
PSIDYIMFTDGFELSGLNRA

SEQ ID NO: 2080382 - protein, 26 aa, Staphylococcus
PSIDYVMFVDDFKIDGLNRAQDTNKF

SEQ ID NO: 2080383 - protein, 28 aa, Staphylococcus
PSIGLNAGLFLIHFLNELNLDSQAAKFT

SEQ ID NO: 2080384 - protein, 24 aa, Staphylococcus
PSINPLHIVLWFDKMRETYGLEKV

SEQ ID NO: 2080385 - protein, 27 aa, Staphylococcus
PSISSELEWLPQLFVSGGLADLELGPF

SEQ ID NO: 2080386 - protein, 25 aa, Staphylococcus
PSKEFPLLCKIVDATAPLSIHVHPG

SEQ ID NO: 2080387 - protein, 32 aa, Staphylococcus
PSKFRYELNERFVITRGLDKCLFGYTLEEWQN

SEQ ID NO: 2080388 - protein, 17 aa, Staphylococcus
PSKKYIKESVKSSLKRL

SEQ ID NO: 2080389 - protein, 18 aa, Staphylococcus
PSKLILLGDGPELLDMRK

SEQ ID NO: 2080390 - protein, 17 aa, Staphylococcus
PSKLILLGDGPELMDMK

SEQ ID NO: 2080391 - protein, 19 aa, Staphylococcus
PSLIDRFMIMKQDGKQYVL

SEQ ID NO: 2080392 - protein, 29 aa, Staphylococcus
PSLNKLKMPFIGLQWIFGRKGAAASNHFE

SEQ ID NO: 2080393 - protein, 29 aa, Staphylococcus
PSLRWDNYYGLTHFIVPPVAKEIEAPKKD

SEQ ID NO: 2080394 - protein, 25 aa, Staphylococcus
PSLRWDNYYGLTHFIVPPVAKENKA

SEQ ID NO: 2080395 - protein, 20 aa, Staphylococcus
PSLVIFANKIKLNELILLGK

SEQ ID NO: 2080396 - protein, 22 aa, Staphylococcus
PSMNIEFGDILIMIGHDNDLNR

SEQ ID NO: 2080397 - protein, 25 aa, Staphylococcus
PSPASYALILNYYHLTREEILFVSS

SEQ ID NO: 2080398 - protein, 23 aa, Staphylococcus
PSPLSAYRGFFGSKPYSRANTYL

SEQ ID NO: 2080399 - protein, 19 aa, Staphylococcus
PSPMTLHSPIKHDVLEMSV

SEQ ID NO: 2080400 - protein, 33 aa, Staphylococcus
PSPTGYLHIGNARTALFNYLFAKHYGGDFVVRI

SEQ ID NO: 2080401 - protein, 21 aa, Staphylococcus
PSQFDVIVTENLFGDILSDEA

SEQ ID NO: 2080402 - protein, 19 aa, Staphylococcus
PSQYTLVTCNPPYFKVNQL

SEQ ID NO: 2080403 - protein, 18 aa, Staphylococcus
PSRAMALPVKKSNDSIYI

SEQ ID NO: 2080404 - protein, 23 aa, Staphylococcus
PSRLEILDLLSCGELCACDLLEH

SEQ ID NO: 2080405 - protein, 26 aa, Staphylococcus
PSRNINYIIIYFSLTNELTITINGEK

SEQ ID NO: 2080406 - protein, 23 aa, Staphylococcus
PSSEILSSVLMLEHLGWQEAADK

SEQ ID NO: 2080407 - protein, 23 aa, Staphylococcus
PSSELLSAVLMLEHLGWQEAADL

SEQ ID NO: 2080408 - protein, 27 aa, Staphylococcus
PSSPSFALFKGQNLVHFMPREHIEGRD

SEQ ID NO: 2080409 - protein, 29 aa, Staphylococcus
PSTAFENMYDWLSGFKLLNIPTTKFRKKT

SEQ ID NO: 2080410 - protein, 18 aa, Staphylococcus
PSTDVPLDLYLSVLGMPG

SEQ ID NO: 2080411 - protein, 18 aa, Staphylococcus
PSTFIYAGAAPEDGNIYP

SEQ ID NO: 2080412 - protein, 18 aa, Staphylococcus
PSVILDFATLTGAAVAAL

SEQ ID NO: 2080413 - protein, 18 aa, Staphylococcus
PSVKASHDILAKERGWPM

SEQ ID NO: 2080414 - protein, 26 aa, Staphylococcus
PSVLEVMRYLETQGFILKYVNVTPNG

SEQ ID NO: 2080415 - protein, 24 aa, Staphylococcus
PSVNSLYYALDGFKRNMRTDIQGL

SEQ ID NO: 2080416 - protein, 25 aa, Staphylococcus
PSVPDDLVFYLYGGAIKGFSKWIEN

SEQ ID NO: 2080417 - protein, 18 aa, Staphylococcus
PSVVHQAFHIANTGRKGP

SEQ ID NO: 2080418 - protein, 19 aa, Staphylococcus
PSYAENFAIWSTQANAMHQ

SEQ ID NO: 2080419 - protein, 17 aa, Staphylococcus
PSYFAFVGIRNEEKDWV

SEQ ID NO: 2080420 - protein, 20 aa, Staphylococcus
PSYIMDKHYLRKHGTNAYYG

SEQ ID NO: 2080421 - protein, 18 aa, Staphylococcus
PSYRFAQIYYEDDDIAIV

SEQ ID NO: 2080422 - protein, 17 aa, Staphylococcus
PTALRFLKAAMNADTDG

SEQ ID NO: 2080423 - protein, 33 aa, Staphylococcus
PTAVKLAYQLKGHEHFYLITDAMRAKGMSDGEY

SEQ ID NO: 2080424 - protein, 22 aa, Staphylococcus
PTAYQFFNDPMLSVFLYSEVDK

SEQ ID NO: 2080425 - protein, 20 aa, Staphylococcus
PTCVLVFKKCRQADDDVVFI

SEQ ID NO: 2080426 - protein, 23 aa, Staphylococcus
PTDIRVLDWVRQVEYLGAGELLV

SEQ ID NO: 2080427 - protein, 23 aa, Staphylococcus
PTDNMINALLPLLDDEDILIDGG

SEQ ID NO: 2080428 - protein, 21 aa, Staphylococcus
PTDSLVLFMQQAMRSMRYQPN

SEQ ID NO: 2080429 - protein, 25 aa, Staphylococcus
PTDTLKQLFYLSKNLKYQLHDVIFE

SEQ ID NO: 2080430 - protein, 26 aa, Staphylococcus
PTDVELAHHYLWRFAKEMPKSGHIEI

SEQ ID NO: 2080431 - protein, 30 aa, Staphylococcus
PTEDDILMYNYLKYYEIPTFVVATKEDKIA

SEQ ID NO: 2080432 - protein, 22 aa, Staphylococcus
PTEYIYQIFYHWNQKEYLASEI

SEQ ID NO: 2080433 - protein, 25 aa, Staphylococcus
PTEYIYQIFYVWNQKEYLASEIYDL

SEQ ID NO: 2080434 - protein, 30 aa, Staphylococcus
PTFCEEMAQAGIYKWFIDINAGTCSYIDLN

SEQ ID NO: 2080435 - protein, 26 aa, Staphylococcus
PTFIGRFTAFQNLKYFSIQRGMSSNH

SEQ ID NO: 2080436 - protein, 19 aa, Staphylococcus
PTFMEMLMATYHIIAKARE

SEQ ID NO: 2080437 - protein, 20 aa, Staphylococcus
PTFNIIKSYKGKELKLHHMD

SEQ ID NO: 2080438 - protein, 17 aa, Staphylococcus
PTFVMGVGLGGLIILNL

SEQ ID NO: 2080439 - protein, 17 aa, Staphylococcus
PTFVMGVGLGGLILLNV

SEQ ID NO: 2080440 - protein, 36 aa, Staphylococcus
PTFVSGKLTIDNFRWAGVPFYIRTGKRMKSKSIQVV

SEQ ID NO: 2080441 - protein, 25 aa, Staphylococcus
PTGKPGCFLVINPTGDVLFYKSSVT

SEQ ID NO: 2080442 - protein, 27 aa, Staphylococcus
PTGLNFEYTAMLYDFSFKRLNNITDFS

SEQ ID NO: 2080443 - protein, 26 aa, Staphylococcus
PTGVGKTEIARRMARLVGAPFIKVEA

SEQ ID NO: 2080444 - protein, 28 aa, Staphylococcus
PTGVYAKDIILYLINQYGVDFGTGYALE

SEQ ID NO: 2080445 - protein, 20 aa, Staphylococcus
PTHSNIPHTLTSGPVIALHH

SEQ ID NO: 2080446 - protein, 30 aa, Staphylococcus
PTHVSLVPQTLKWLMDAGLNKPYSIEKILL

SEQ ID NO: 2080447 - protein, 25 aa, Staphylococcus
PTIKAVFNYYLQGYGYKKIAQYLEA

SEQ ID NO: 2080448 - protein, 23 aa, Staphylococcus
PTIKQLMKYLKQRHIPMAIATSS

SEQ ID NO: 2080449 - protein, 18 aa, Staphylococcus
PTISFLTTSLFYSMIDNE

SEQ ID NO: 2080450 - protein, 23 aa, Staphylococcus
PTITSWFVNFYNIILKDQFGRDS

SEQ ID NO: 2080451 - protein, 22 aa, Staphylococcus
PTITVKALLKMRMKKKVKKYLN

SEQ ID NO: 2080452 - protein, 22 aa, Staphylococcus
PTIVTAFSYEMFMKFLSDIKEI

SEQ ID NO: 2080453 - protein, 28 aa, Staphylococcus
PTLRWDNYYGLTHFIVPPVAKEFKVLKT

SEQ ID NO: 2080454 - protein, 42 aa, Staphylococcus
PTNHLDFDSIKWLINYVKQYPHTVLFVTHDRYFLNEVSRRIV

SEQ ID NO: 2080455 - protein, 21 aa, Staphylococcus
PTNIIPGLDFSPDKMLQGRLF

SEQ ID NO: 2080456 - protein, 21 aa, Staphylococcus
PTPAVIHWFNKLNELNIKVTV

SEQ ID NO: 2080457 - protein, 25 aa, Staphylococcus
PTPEVKPVIMAFAKSYDRPYDDFEN

SEQ ID NO: 2080458 - protein, 25 aa, Staphylococcus
PTPEVKPVIMAFAKSYDRPYDDLEN

SEQ ID NO: 2080459 - protein, 24 aa, Staphylococcus
PTPPTKPVIMAFTKSYDRPYEQLE

SEQ ID NO: 2080460 - protein, 18 aa, Staphylococcus
PTQFDVIVTENLFGDILS

SEQ ID NO: 2080461 - protein, 30 aa, Staphylococcus
PTQITKSGFYYLYKPVNGPVTLNGMLIVIY

SEQ ID NO: 2080462 - protein, 27 aa, Staphylococcus
PTRADHVKLLIPLLEQNKDTLAELYVK

SEQ ID NO: 2080463 - protein, 27 aa, Staphylococcus
PTRAEHVKLLIPLFEQNKDELAQLYVK

SEQ ID NO: 2080464 - protein, 26 aa, Staphylococcus
PTRCIDGIIVILPIQGDLTIQHFANS

SEQ ID NO: 2080465 - protein, 17 aa, Staphylococcus
PTRKLIITTIQKMDNAI

SEQ ID NO: 2080466 - protein, 17 aa, Staphylococcus
PTRQMILNFAHYRFTDL

SEQ ID NO: 2080467 - protein, 25 aa, Staphylococcus
PTRVGYKFVDGKKIRIAKKSGEEIK

SEQ ID NO: 2080468 - protein, 24 aa, Staphylococcus
PTRVGYKFVDGKKVRIVKKSGEEI

SEQ ID NO: 2080469 - protein, 29 aa, Staphylococcus
PTSELKPETFYKLLRKLPAREYSIASSYE

SEQ ID NO: 2080470 - protein, 32 aa, Staphylococcus
PTSFHDKYEWLLEFFPFLDPQQFVFCGRKNVV

SEQ ID NO: 2080471 - protein, 33 aa, Staphylococcus; identical to SEQ ID NO: 1831269

SEQ ID NO: 2080472 - protein, 32 aa, Staphylococcus
PTSFHDKYEWLLEYFPFLDPQHFIFCGRKNIV

SEQ ID NO: 2080473 - protein, 25 aa, Staphylococcus
PTSGKELFKRVLPDVLIKLEKAGYE

SEQ ID NO: 2080474 - protein, 18 aa, Staphylococcus
PTVEVIFTILHAGGKFGQ

SEQ ID NO: 2080475 - protein, 25 aa, Staphylococcus
PTVKAVFNYYLQGYGYKKIAQYLEA

SEQ ID NO: 2080476 - protein, 17 aa, Staphylococcus
PTVQVIFTVLHAGGKFG

SEQ ID NO: 2080477 - protein, 17 aa, Staphylococcus
PTYFFPTHSDRQDENIW

SEQ ID NO: 2080478 - protein, 17 aa, Staphylococcus
PVDAMTYAVYKLSGFPK

SEQ ID NO: 2080479 - protein, 26 aa, Staphylococcus
PVDKMDLDIPRLVLDGIEVVGSLVGT

SEQ ID NO: 2080480 - protein, 23 aa, Staphylococcus
PVEPKLFRKLPIQTKVKIRGLEA

SEQ ID NO: 2080481 - protein, 18 aa, Staphylococcus
PVEVDKFNWYQVAKKIET

SEQ ID NO: 2080482 - protein, 17 aa, Staphylococcus
PVFVKPNSGSASLNINK

SEQ ID NO: 2080483 - protein, 21 aa, Staphylococcus
PVGEGFRWLTLVSPTHQDGTE

SEQ ID NO: 2080484 - protein, 17 aa, Staphylococcus
PVGLLPKIIVDEKEYVV

SEQ ID NO: 2080485 - protein, 24 aa, Staphylococcus
PVGPSMIATLKNINPSLPMVAIGG

SEQ ID NO: 2080486 - protein, 34 aa, Staphylococcus
PVGVVTQITPWNYPLLQASWKIAPALATGCSLIM

SEQ ID NO: 2080487 - protein, 34 aa, Staphylococcus; identical to SEQ ID NO: 1698927

SEQ ID NO: 2080488 - protein, 17 aa, Staphylococcus
PVHITLPKTFNSKKEYE

SEQ ID NO: 2080489 - protein, 17 aa, Staphylococcus
PVHKRWSRLDFGDFILG

SEQ ID NO: 2080490 - protein, 18 aa, Staphylococcus
PVIHTLPAKAIIADDHPY

SEQ ID NO: 2080491 - protein, 34 aa, Staphylococcus
PVIIIALGPLTNIALLLATYPETAHYIKEIIFMG

SEQ ID NO: 2080492 - protein, 19 aa, Staphylococcus
PVILGDDVLIAAGSTITDD

SEQ ID NO: 2080493 - protein, 26 aa, Staphylococcus
PVINGIYFALDLTPQEGRDIFFNKDL

SEQ ID NO: 2080494 - protein, 20 aa, Staphylococcus
PVKEEILKRIGKYYYGSDHT

SEQ ID NO: 2080495 - protein, 24 aa, Staphylococcus
PVKIGLATLVDRGHRELPIRADFV

SEQ ID NO: 2080496 - protein, 20 aa, Staphylococcus
PVLEFVDGKILPLDKVRTKK

SEQ ID NO: 2080497 - protein, 18 aa, Staphylococcus
PVLEIVDYVLVMTVNPGF

SEQ ID NO: 2080498 - protein, 17 aa, Staphylococcus
PVLIFIPGTNGTGDIFM

SEQ ID NO: 2080499 - protein, 21 aa, Staphylococcus
PVLSLSLSFDHRQIDGATGQN

SEQ ID NO: 2080500 - protein, 17 aa, Staphylococcus
PVLTNFLDPREQYILEV

SEQ ID NO: 2080501 - protein, 18 aa, Staphylococcus
PVMHNANFAALNDLSSYE

SEQ ID NO: 2080502 - protein, 17 aa, Staphylococcus
PVMPNVDPLFIGAIVDE

SEQ ID NO: 2080503 - protein, 18 aa, Staphylococcus
PVMQKYARLLKRIHGLEK

SEQ ID NO: 2080504 - protein, 18 aa, Staphylococcus
PVNEGIIQFWISAQNEMY

SEQ ID NO: 2080505 - protein, 23 aa, Staphylococcus
PVNFGANLGLMLDLYDDYLQDPT

SEQ ID NO: 2080506 - protein, 18 aa, Staphylococcus
PVNFLHPIQGTKFGSMDD

SEQ ID NO: 2080507 - protein, 18 aa, Staphylococcus
PVNFSGKFYNFVEYGVDK

SEQ ID NO: 2080508 - protein, 18 aa, Staphylococcus
PVNFSGQFYNFVEYGVNE

SEQ ID NO: 2080509 - protein, 17 aa, Staphylococcus
PVNIELMSRFRTPKEVK

SEQ ID NO: 2080510 - protein, 23 aa, Staphylococcus
PVNLYEQELIALRVTMDVAFHIA

SEQ ID NO: 2080511 - protein, 17 aa, Staphylococcus
PVNNGGVVLRWLRDELL

SEQ ID NO: 2080512 - protein, 17 aa, Staphylococcus
PVPSFMHDGLTDAFENV

SEQ ID NO: 2080513 - protein, 34 aa, Staphylococcus
PVQQLASINVPEARLLVISPYDKSSVADIEKAIN

SEQ ID NO: 2080514 - protein, 34 aa, Staphylococcus
PVQQLASISVPEARLLVISPYDKSSVGNIEKAIN

SEQ ID NO: 2080515 - protein, 20 aa, Staphylococcus
PVQRRILYAMYDSGNTYDKN

SEQ ID NO: 2080516 - protein, 20 aa, Staphylococcus
PVRNKMLIFSGRISSEILLK

SEQ ID NO: 2080517 - protein, 24 aa, Staphylococcus
PVRNKVLIFSGRISSEILIKAAKI

SEQ ID NO: 2080518 - protein, 23 aa, Staphylococcus
PVRNKVLIFSGRISSEILLKAAK

SEQ ID NO: 2080519 - protein, 35 aa, Staphylococcus
PVSEQPSLNLLRWPWIGLQWIFSRKGPAASNHFEG

SEQ ID NO: 2080520 - protein, 25 aa, Staphylococcus
PVSQILPIINAVDYVLIMTVNPGFG

SEQ ID NO: 2080521 - protein, 25 aa, Staphylococcus
PVTAHDFVFAWRKAVDPKTASEYAY

SEQ ID NO: 2080522 - protein, 18 aa, Staphylococcus
PVTLLFTGPLTDLAKAVT

SEQ ID NO: 2080523 - protein, 24 aa, Staphylococcus
PVVDMVKVKRYLQGRKTRLVGPNC

SEQ ID NO: 2080524 - protein, 19 aa, Staphylococcus
PVVGFIGGQTAPPGKRMGH

SEQ ID NO: 2080525 - protein, 17 aa, Staphylococcus
PVVIKKDGLAAGKGVII

SEQ ID NO: 2080526 - protein, 20 aa, Staphylococcus
PVVLHRAIFGSLDRFFGILI

SEQ ID NO: 2080527 - protein, 19 aa, Staphylococcus
PVYHILPEAFKSYMNNHPN

SEQ ID NO: 2080528 - protein, 22 aa, Staphylococcus
PVYQLIDRFYNNRLVIQYFSGM

SEQ ID NO: 2080529 - protein, 19 aa, Staphylococcus
PVYYAMQDFKARNSYLDSA

SEQ ID NO: 2080530 - protein, 17 aa, Staphylococcus
PVYYRKQPEAKKVKQYA

SEQ ID NO: 2080531 - protein, 18 aa, Staphylococcus
PWDSAKGKGLWMSAVFRP

SEQ ID NO: 2080532 - protein, 17 aa, Staphylococcus
PYAFDALEPHIDKETME

SEQ ID NO: 2080533 - protein, 17 aa, Staphylococcus
PYAPIHEERYIALATNS

SEQ ID NO: 2080534 - protein, 19 aa, Staphylococcus
PYAQLLASKGYREAFKANH

SEQ ID NO: 2080535 - protein, 19 aa, Staphylococcus
PYCEPGIVHKLDEAYFKKI

SEQ ID NO: 2080536 - protein, 29 aa, Staphylococcus
PYDTYQLTTYFRRCSFRKRTRLSSCKAFV

SEQ ID NO: 2080537 - protein, 23 aa, Staphylococcus
PYEEWFNIVKYYTRTMSSNDSIN

SEQ ID NO: 2080538 - protein, 24 aa, Staphylococcus
PYELFVITCPLDEGVELFVGVPSE

SEQ ID NO: 2080539 - protein, 21 aa, Staphylococcus
PYELFVITCPLDNGLELFIGV

SEQ ID NO: 2080540 - protein, 18 aa, Staphylococcus
PYEMGLVKNQYVARTFIQ

SEQ ID NO: 2080541 - protein, 18 aa, Staphylococcus
PYESELYYLPKPLIKIES

SEQ ID NO: 2080542 - protein, 18 aa, Staphylococcus
PYETPVYDFIKMTKTANY

SEQ ID NO: 2080543 - protein, 20 aa, Staphylococcus
PYEWIIEYKDEFIGQVRLTL

SEQ ID NO: 2080544 - protein, 25 aa, Staphylococcus
PYFDINPSIKVKPLVNYQLHPFNFK

SEQ ID NO: 2080545 - protein, 19 aa, Staphylococcus
PYFEPGLVHQLDEAYFKKI

SEQ ID NO: 2080546 - protein, 18 aa, Staphylococcus
PYFMFLDVDDQLASYAIN

SEQ ID NO: 2080547 - protein, 29 aa, Staphylococcus
PYGTVLIIGPFNYPVQLTFEPLIGAIAAG

SEQ ID NO: 2080548 - protein, 32 aa, Staphylococcus; identical to SEQ ID NO: 1820671

SEQ ID NO: 2080549 - protein, 17 aa, Staphylococcus
PYHGLKPEYYALAAGTK

SEQ ID NO: 2080550 - protein, 22 aa, Staphylococcus
PYIALGTRKVILRRAAQFLLEG

SEQ ID NO: 2080551 - protein, 19 aa, Staphylococcus
PYIEIVKFEYAMGQGGIGV

SEQ ID NO: 2080552 - protein, 21 aa, Staphylococcus
PYIENNNIYFNISHSGKVVYV

SEQ ID NO: 2080553 - protein, 17 aa, Staphylococcus
PYITDRNKFISIMAGIS

SEQ ID NO: 2080554 - protein, 19 aa, Staphylococcus
PYIYLSHKNLSHHALLACI

SEQ ID NO: 2080555 - protein, 19 aa, Staphylococcus
PYKVPDFLEDLYLDGKIKE

SEQ ID NO: 2080556 - protein, 19 aa, Staphylococcus
PYLCIIFCNSRESADELAE

SEQ ID NO: 2080557 - protein, 20 aa, Staphylococcus
PYLKATPQNFKMYKLDHYKD

SEQ ID NO: 2080558 - protein, 27 aa, Staphylococcus
PYLKGKNLAFLFEKPSTRTRSAFSVAA

SEQ ID NO: 2080559 - protein, 19 aa, Staphylococcus
PYLTQEDLRKYLQAQHIQM

SEQ ID NO: 2080560 - protein, 18 aa, Staphylococcus
PYMIQMAALLHDTVDSKL

SEQ ID NO: 2080561 - protein, 23 aa, Staphylococcus
PYNDIHMWDYKALPAVFGGDNVA

SEQ ID NO: 2080562 - protein, 24 aa, Staphylococcus
PYPDNFDFTTLDKAFRDNYGTLGK

SEQ ID NO: 2080563 - protein, 25 aa, Staphylococcus
PYPFAVDFIRYHRLSMYWLQENIEQ

SEQ ID NO: 2080564 - protein, 25 aa, Staphylococcus
PYQFHEYLIHLTGVLETGYFLNITD

SEQ ID NO: 2080565 - protein, 20 aa, Staphylococcus
PYQYYKDYGIRKYGFHGTSH

SEQ ID NO: 2080566 - protein, 19 aa, Staphylococcus
PYRLLRIGTFLLTEDGYKV

SEQ ID NO: 2080567 - protein, 19 aa, Staphylococcus
PYRVKRWTSYDASFGAMEP

SEQ ID NO: 2080568 - protein, 24 aa, Staphylococcus
PYSDLIDFMHPTPALGGYPKEEAL

SEQ ID NO: 2080569 - protein, 18 aa, Staphylococcus
PYSLRHTHASYLISKGIP

SEQ ID NO: 2080570 - protein, 25 aa, Staphylococcus
PYSNFKVGAYLKTKDGRTFYGANVE

SEQ ID NO: 2080571 - protein, 20 aa, Staphylococcus
PYSNSIWLFDAGEGTQHQIL

SEQ ID NO: 2080572 - protein, 20 aa, Staphylococcus
PYSNSIWLFDVGEGTQHQIL

SEQ ID NO: 2080573 - protein, 21 aa, Staphylococcus
PYSNSIWLFDVGEGTQHQILH

SEQ ID NO: 2080574 - protein, 25 aa, Staphylococcus
PYSQFKVGAYLKTKDGRGFYGANVE

SEQ ID NO: 2080575 - protein, 19 aa, Staphylococcus
PYSYSYSYTIDQQGNYHYT

SEQ ID NO: 2080576 - protein, 18 aa, Staphylococcus
PYTIAKHYADDYLRHSNL

SEQ ID NO: 2080577 - protein, 18 aa, Staphylococcus
PYVFAGHFAPQQMKEAIA

SEQ ID NO: 2080578 - protein, 22 aa, Staphylococcus
PYVKDTALFYDLIDTLQEIATQ

SEQ ID NO: 2080579 - protein, 29 aa, Staphylococcus
PYVLDNGYLFVFVLDYYRHSLVNEKVDSD

SEQ ID NO: 2080580 - protein, 18 aa, Staphylococcus
PYYAGVTACYLLVNKSIR

SEQ ID NO: 2080581 - protein, 19 aa, Staphylococcus
PYYAGVTACYLLVNKSIRR

SEQ ID NO: 2080582 - protein, 18 aa, Staphylococcus
PYYAGVTACYLLVNRSIR

SEQ ID NO: 2080583 - protein, 25 aa, Staphylococcus
QAAILGMHSIITRPIAIDADTIENR

SEQ ID NO: 2080584 - protein, 18 aa, Staphylococcus
QAAILKWPMSVIRLKGED

SEQ ID NO: 2080585 - protein, 24 aa, Staphylococcus
QAAKHMYLVYQNPELQFITNSVYD

SEQ ID NO: 2080586 - protein, 23 aa, Staphylococcus
QAAQHMYLVYQNPELQFITNSVY

SEQ ID NO: 2080587 - protein, 19 aa, Staphylococcus
QAAQYAIQLLEDPNLYKQM

SEQ ID NO: 2080588 - protein, 37 aa, Staphylococcus
QAARAWLSDYAKSLLDMVIPLLVKYGIALEAHLQNAI

SEQ ID NO: 2080589 - protein, 32 aa, Staphylococcus
QADAAWITTPLNIFYFTGYLSDPHERLLALLI

SEQ ID NO: 2080590 - protein, 23 aa, Staphylococcus
QADFINCVVFRKQAENVNNYLNK

SEQ ID NO: 2080591 - protein, 20 aa, Staphylococcus
QADIHKLAQFKPGEEILFKW

SEQ ID NO: 2080592 - protein, 17 aa, Staphylococcus
QADVIMVLLPDEIQGQV

SEQ ID NO: 2080593 - protein, 20 aa, Staphylococcus
QAEEWYKHATPQELDELKHK

SEQ ID NO: 2080594 - protein, 23 aa, Staphylococcus
QAEKIAFPIILNESLTAVVAVPL

SEQ ID NO: 2080595 - protein, 18 aa, Staphylococcus
QAFARRLSGFNTRTLYHN

SEQ ID NO: 2080596 - protein, 26 aa, Staphylococcus
QAFEGLRIQKRPLRRPDLTFATIDHN

SEQ ID NO: 2080597 - protein, 17 aa, Staphylococcus
QAFHHPLDIVYEDDYLL

SEQ ID NO: 2080598 - protein, 29 aa, Staphylococcus
QAFLEECKNLKWIAWYATGVNNLPLDYIN

SEQ ID NO: 2080599 - protein, 24 aa, Staphylococcus
QAGDRFVIFKDEKQARRIGEARHE

SEQ ID NO: 2080600 - protein, 24 aa, Staphylococcus
QAGDRFVIFSDEKQARRIGEARHE

SEQ ID NO: 2080601 - protein, 17 aa, Staphylococcus
QAGIPETIFSSQQGLLD

SEQ ID NO: 2080602 - protein, 20 aa, Staphylococcus
QAHFIHPINRCLYVWNQKNK

SEQ ID NO: 2080603 - protein, 17 aa, Staphylococcus
QAHLLFIELSKAINEVL

SEQ ID NO: 2080604 - protein, 28 aa, Staphylococcus
QAHTQLFVYGLFIYNKWKGMGTLSSIDV

SEQ ID NO: 2080605 - protein, 28 aa, Staphylococcus
QAHTQLFVYGLFIYNKWKGMGTLSSVDV

SEQ ID NO: 2080606 - protein, 30 aa, Staphylococcus
QAHTQLFVYGLFIYNQWRGMGTLNSIDVIN

SEQ ID NO: 2080607 - protein, 30 aa, Staphylococcus; identical to SEQ ID NO: 1831309

SEQ ID NO: 2080608 - protein, 21 aa, Staphylococcus
QAIALNLEPFSNSIWLFDVGE

SEQ ID NO: 2080609 - protein, 21 aa, Staphylococcus
QAIALNLEPYSNSIWLFDVGE

SEQ ID NO: 2080610 - protein, 20 aa, Staphylococcus
QAIAMIQFKLEIPIIKRRPS

SEQ ID NO: 2080611 - protein, 18 aa, Staphylococcus
QAIGGQAYWSFGGLFLVN

SEQ ID NO: 2080612 - protein, 21 aa, Staphylococcus
QAILPLRGKILNVEKSRLDRI

SEQ ID NO: 2080613 - protein, 23 aa, Staphylococcus
QAINNPYLSPKRIEKLKLLKEKA

SEQ ID NO: 2080614 - protein, 32 aa, Staphylococcus
QAIQYLKQNHLGRATFLPLNVIQARHLNHDIQ

SEQ ID NO: 2080615 - protein, 23 aa, Staphylococcus
QAIRFSDYLLIMKEGQIIDNGPT

SEQ ID NO: 2080616 - protein, 23 aa, Staphylococcus
QAIYVLLILNQLPRQSVMTSTAL

SEQ ID NO: 2080617 - protein, 17 aa, Staphylococcus
QAKAQNLFAKWRKEETL

SEQ ID NO: 2080618 - protein, 24 aa, Staphylococcus
QAKAQNLFARWRKEETLYSEDEKK

SEQ ID NO: 2080619 - protein, 28 aa, Staphylococcus
QAKGSTYYGIALALLRISKALLNNENSV

SEQ ID NO: 2080620 - protein, 28 aa, Staphylococcus
QAKGSTYYGIALALLRISKALLNNENTI

SEQ ID NO: 2080621 - protein, 29 aa, Staphylococcus
QAKSQSLEHLLFGLGIRHLGVKASRVLAE

SEQ ID NO: 2080622 - protein, 26 aa, Staphylococcus
QALDTFLIGLKNWNFAFAYSVQLVEA

SEQ ID NO: 2080623 - protein, 20 aa, Staphylococcus
QALENLKPFLKTDGMLIFQE

SEQ ID NO: 2080624 - protein, 24 aa, Staphylococcus
QALERHVDFLLINNVKAIIVNGTT

SEQ ID NO: 2080625 - protein, 17 aa, Staphylococcus
QALEYLFPSFKSLKMTI

SEQ ID NO: 2080626 - protein, 25 aa, Staphylococcus
QALFRKQIALAKRVNLPIIIHNREA

SEQ ID NO: 2080627 - protein, 26 aa, Staphylococcus
QALGFGFRTGFLGMLHMEIIQERIER

SEQ ID NO: 2080628 - protein, 25 aa, Staphylococcus
QALINSIEAWSLNHNIRRIEATVVT

SEQ ID NO: 2080629 - protein, 28 aa, Staphylococcus
QALKAYPRKLIITQGAKGALFYSDTQQL

SEQ ID NO: 2080630 - protein, 23 aa, Staphylococcus
QALLQQGLNVYVIQLPSGMDPDE

SEQ ID NO: 2080631 - protein, 25 aa, Staphylococcus
QALQDLAKAYLKYVNPKVIAVTGSN

SEQ ID NO: 2080632 - protein, 21 aa, Staphylococcus
QALRQDYLKMIRGQVLHTFST

SEQ ID NO: 2080633 - protein, 27 aa, Staphylococcus
QALSASSSLPGVWPPTTIDGKQYSDGG

SEQ ID NO: 2080634 - protein, 17 aa, Staphylococcus
QALVNYFTNKNIDHVYV

SEQ ID NO: 2080635 - protein, 25 aa, Staphylococcus
QALWDIKGKYFNAPIHQLLGGKARD

SEQ ID NO: 2080636 - protein, 17 aa, Staphylococcus
QALYLIDGLLDKGLVNE

SEQ ID NO: 2080637 - protein, 21 aa, Staphylococcus
QAMIQTMYPVQPVYPEAMCVC

SEQ ID NO: 2080638 - protein, 17 aa, Staphylococcus
QAMMLVPEIALTPQMVL

SEQ ID NO: 2080639 - protein, 18 aa, Staphylococcus
QAMMLVPEIALTPQMVLR

SEQ ID NO: 2080640 - protein, 21 aa, Staphylococcus
QAMRPLVVMSPKSLLRNKTVA

SEQ ID NO: 2080641 - protein, 19 aa, Staphylococcus
QAMSLKAFKALTLFDDAQL

SEQ ID NO: 2080642 - protein, 26 aa, Staphylococcus
QANGEHVLAIPLYQGKYILTNHKKRG

SEQ ID NO: 2080643 - protein, 26 aa, Staphylococcus
QANIDKTFGLIYSQRVLLSLINKGMV

SEQ ID NO: 2080644 - protein, 33 aa, Staphylococcus
QANIVIWDAPNHEYIPYHFGINHAQKVIKDGKV

SEQ ID NO: 2080645 - protein, 35 aa, Staphylococcus
QANNVDIQFLYYRMKLLNFRKFIIGSTIPHLYYKD

SEQ ID NO: 2080646 - protein, 29 aa, Staphylococcus
QANQNFYMLHKVLFINEKYKKLSDSAKVT

SEQ ID NO: 2080647 - protein, 30 aa, Staphylococcus
QANTQLFVHGLFIYAKLRGLGILNSIDVIN

SEQ ID NO: 2080648 - protein, 29 aa, Staphylococcus
QANTQLFVYGLFIYSKWKGMGTLSSVDVI

SEQ ID NO: 2080649 - protein, 25 aa, Staphylococcus
QAQAILDMRLRRLTGLERDKIEAEY

SEQ ID NO: 2080650 - protein, 20 aa, Staphylococcus
QAQSIIYHIYSPHTRTMQSV

SEQ ID NO: 2080651 - protein, 23 aa, Staphylococcus
QARHILAHFMFYGKDVFKKVNEL

SEQ ID NO: 2080652 - protein, 22 aa, Staphylococcus
QARKYLGWTPIATQEEAILAAL

SEQ ID NO: 2080653 - protein, 25 aa, Staphylococcus
QARRDFMVGNLYFNRGCTGAVVGYQ

SEQ ID NO: 2080654 - protein, 17 aa, Staphylococcus
QASLALALGLSEIVQQE

SEQ ID NO: 2080655 - protein, 28 aa, Staphylococcus
QATADLWQRLIQLWTDQTVLIVEHKVEH

SEQ ID NO: 2080656 - protein, 25 aa, Staphylococcus
QATMALFVVPTMLSTILTYDLSHIS

SEQ ID NO: 2080657 - protein, 30 aa, Staphylococcus
QATNMNPLWHIYRLVKFPKVLRQTIIIEIC

SEQ ID NO: 2080658 - protein, 18 aa, Staphylococcus
QATPINIWVSTPSFIEMC

SEQ ID NO: 2080659 - protein, 23 aa, Staphylococcus
QATYKLNHLGDFVDVTFAALKSE

SEQ ID NO: 2080660 - protein, 25 aa, Staphylococcus
QAVFQFAAQKLKKWGLPANRNTVRL

SEQ ID NO: 2080661 - protein, 19 aa, Staphylococcus
QAVFVPADDYTDPAPAAVF

SEQ ID NO: 2080662 - protein, 26 aa, Staphylococcus
QAVIDAIKNAKFPVLLAGMRSSSQAE

SEQ ID NO: 2080663 - protein, 32 aa, Staphylococcus
QAVINASIKRSLTLDFIALRQHYPNAVPRVAD

SEQ ID NO: 2080664 - protein, 40 aa, Staphylococcus
QAVKEGKLLFGDTVAVFGAGPIGLLTIVAAKAAGASKIFV

SEQ ID NO: 2080665 - protein, 41 aa, Staphylococcus
QAVKEGNLLFGDKVAVFGAGPIGLLTVVAAKAAGASKIYVF

SEQ ID NO: 2080666 - protein, 28 aa, Staphylococcus
QAVNEMRSLIWQLKPVGLEHGLVSAVKR

SEQ ID NO: 2080667 - protein, 27 aa, Staphylococcus
QAVNEMRSLIWQLKPVGLEQGLVNALN

SEQ ID NO: 2080668 - protein, 25 aa, Staphylococcus
QAVNNDLPYHLAVKKLKQLDEDFGV

SEQ ID NO: 2080669 - protein, 19 aa, Staphylococcus
QAVVSFVRGFHGRTNLTMS

SEQ ID NO: 2080670 - protein, 19 aa, Staphylococcus
QAWDIDHLYGIPGDSIDAV

SEQ ID NO: 2080671 - protein, 18 aa, Staphylococcus
QAWDLNMGGLMNALETAR

SEQ ID NO: 2080672 - protein, 20 aa, Staphylococcus
QAWTDADLLKQWFMTSQRTN

SEQ ID NO: 2080673 - protein, 20 aa, Staphylococcus
QAWVGTLLKMKPVLRFEEDG

SEQ ID NO: 2080674 - protein, 27 aa, Staphylococcus
QAWVGTLLKMKPVLRFEKDGKIHPFEK

SEQ ID NO: 2080675 - protein, 26 aa, Staphylococcus
QAYIERRNFLIQKLESLGFELDAKPE

SEQ ID NO: 2080676 - protein, 24 aa, Staphylococcus
QAYLKDSLAYLWDENKRHLNPQEY

SEQ ID NO: 2080677 - protein, 32 aa, Staphylococcus
QAYRAKLLRNFKHPLKFVFIDLIQNENIQTYT

SEQ ID NO: 2080678 - protein, 33 aa, Staphylococcus
QAYRAQLLRQLNYPIKFVFLDFIQSENIQTLTS

SEQ ID NO: 2080679 - protein, 19 aa, Staphylococcus
QCHLHNYQLLLNYTGHELE

SEQ ID NO: 2080680 - protein, 18 aa, Staphylococcus
QCKILAQKGYSGQQIAKT

SEQ ID NO: 2080681 - protein, 29 aa, Staphylococcus
QCLYVKIDPYWIYQIYDKDINPLEDREKN

SEQ ID NO: 2080682 - protein, 23 aa, Staphylococcus
QCNQLGLALAKKFATNHQVAVYT

SEQ ID NO: 2080683 - protein, 24 aa, Staphylococcus
QCRENGIPCYFTMDAGPNVKVIVE

SEQ ID NO: 2080684 - protein, 24 aa, Staphylococcus
QCRKAGYPCYFTMDAGPNVKILVE

SEQ ID NO: 2080685 - protein, 23 aa, Staphylococcus
QCRRRYLLEFFGDNPTQPQQCCD

SEQ ID NO: 2080686 - protein, 21 aa, Staphylococcus
QCVLTDILPTIDNIERALQIE

SEQ ID NO: 2080687 - protein, 24 aa, Staphylococcus
QDAATNLPYIYLSAGVSAELFQET

SEQ ID NO: 2080688 - protein, 33 aa, Staphylococcus
QDADLLIMIGTNFPFVKYLPKKNIKAIQIDTKE

SEQ ID NO: 2080689 - protein, 33 aa, Staphylococcus; identical to SEQ ID NO: 1691452

SEQ ID NO: 2080690 - protein, 33 aa, Staphylococcus
QDADLLIMVGTNYPYVDYLPKKNIKAIQVDTNL

SEQ ID NO: 2080691 - protein, 31 aa, Staphylococcus
QDADLVFDVRFLPNPFYVEALRPLTGVDDEV

SEQ ID NO: 2080692 - protein, 24 aa, Staphylococcus
QDALNLFIELTGINFNLIKQELEK

SEQ ID NO: 2080693 - protein, 25 aa, Staphylococcus
QDASTKLPYIYLSAGVSAELFQETL

SEQ ID NO: 2080694 - protein, 25 aa, Staphylococcus
QDCDGYLTFDFLKNQIAAILNNKNS

SEQ ID NO: 2080695 - protein, 24 aa, Staphylococcus
QDDERLFFIGEAIRRGTSLQEIHD

SEQ ID NO: 2080696 - protein, 24 aa, Staphylococcus
QDDERLFFIGEAIRRGTTLEEIHK

SEQ ID NO: 2080697 - protein, 18 aa, Staphylococcus
QDDFVVGVMLASKGYPGS

SEQ ID NO: 2080698 - protein, 18 aa, Staphylococcus
QDDMLFDFFTPKQSYEEK

SEQ ID NO: 2080699 - protein, 29 aa, Staphylococcus
QDDRDVIKYLKFFTFLDKEEIDFLEEKVK

SEQ ID NO: 2080700 - protein, 23 aa, Staphylococcus
QDEDGYFWFEGRKDDIIISSGYT

SEQ ID NO: 2080701 - protein, 26 aa, Staphylococcus
QDETVCYMWLRFEHDSQFKRFNPETY

SEQ ID NO: 2080702 - protein, 26 aa, Staphylococcus
QDEYLAENIFWVPKEARWQYINDNAK

SEQ ID NO: 2080703 - protein, 24 aa, Staphylococcus
QDFALWPHMSVFENVAYPLRVKKD

SEQ ID NO: 2080704 - protein, 20 aa, Staphylococcus
QDGQWKSWGPYLLSGKDVYG

SEQ ID NO: 2080705 - protein, 20 aa, Staphylococcus
QDHNFTWAAPIMSRPVKNMT

SEQ ID NO: 2080706 - protein, 40 aa, Staphylococcus
QDIAILYRDASYADLFESILPLYQIPFNIDTKRSMTHHPI

SEQ ID NO: 2080707 - protein, 18 aa, Staphylococcus
QDIANWLLSGIKPAGYSA

SEQ ID NO: 2080708 - protein, 33 aa, Staphylococcus
QDIINNIHLIRANAYLVIMVVVFTSGHVEHLHL

SEQ ID NO: 2080709 - protein, 25 aa, Staphylococcus
QDIITKDIIVIARQPAKSMSTLEIQ

SEQ ID NO: 2080710 - protein, 27 aa, Staphylococcus
QDILPLLEQIVQSNRPILIIADEVEGD

SEQ ID NO: 2080711 - protein, 19 aa, Staphylococcus
QDIQFDYVRFPEGFENQAD

SEQ ID NO: 2080712 - protein, 24 aa, Staphylococcus
QDIQRIEHMIRNALIIEDNGDNNV

SEQ ID NO: 2080713 - protein, 23 aa, Staphylococcus
QDIQRIEHMIRNALIIEDSGDNN

SEQ ID NO: 2080714 - protein, 24 aa, Staphylococcus
QDIQRIEHMIRNALIIEDTGDNNT

SEQ ID NO: 2080715 - protein, 18 aa, Staphylococcus
QDIQRVENMLRNALIIED

SEQ ID NO: 2080716 - protein, 21 aa, Staphylococcus
QDIRQYLISKVTRYEIPSIVQ

SEQ ID NO: 2080717 - protein, 22 aa, Staphylococcus
QDITIQAFKDLIIKQIMGIDDI

SEQ ID NO: 2080718 - protein, 19 aa, Staphylococcus
QDIVQILYEAILKIQNPNK

SEQ ID NO: 2080719 - protein, 18 aa, Staphylococcus
QDIYFKMMQDFIGGDDIL

SEQ ID NO: 2080720 - protein, 26 aa, Staphylococcus
QDKDLKLPLELYVELVYSVQNEMVFK

SEQ ID NO: 2080721 - protein, 17 aa, Staphylococcus
QDKIDFQIGTLSKAIGV

SEQ ID NO: 2080722 - protein, 19 aa, Staphylococcus
QDKIDFQIGTLSKAIGVVG

SEQ ID NO: 2080723 - protein, 20 aa, Staphylococcus
QDKIDFQIGTLSKAIGVVGG

SEQ ID NO: 2080724 - protein, 21 aa, Staphylococcus
QDKIDFQIGTLSKAIGVVGGY

SEQ ID NO: 2080725 - protein, 24 aa, Staphylococcus
QDKILEEILPEAFALVREGAKRVF

SEQ ID NO: 2080726 - protein, 25 aa, Staphylococcus
QDKNYKALHYISEGTDLVIGLPEGH

SEQ ID NO: 2080727 - protein, 23 aa, Staphylococcus
QDKSDLIYISQKGKFDAVVDDVV

SEQ ID NO: 2080728 - protein, 17 aa, Staphylococcus
QDKSYDLYYDGDKFYQL

SEQ ID NO: 2080729 - protein, 17 aa, Staphylococcus
QDLDFALAIRTMLIDDK

SEQ ID NO: 2080730 - protein, 18 aa, Staphylococcus
QDLGYERVLLRNETQLKE

SEQ ID NO: 2080731 - protein, 21 aa, Staphylococcus
QDLIIRYFNLTAEKLVKDIVG

SEQ ID NO: 2080732 - protein, 24 aa, Staphylococcus
QDLISGHIQFLYVAPERFENQYFL

SEQ ID NO: 2080733 - protein, 23 aa, Staphylococcus
QDLKDRYQFIGGLSPLAGTTNRQ

SEQ ID NO: 2080734 - protein, 27 aa, Staphylococcus
QDLKVEGALALILKDAIKPNLVQTIEG

SEQ ID NO: 2080735 - protein, 19 aa, Staphylococcus
QDLLHALDVWLLGKRQFAE

SEQ ID NO: 2080736 - protein, 22 aa, Staphylococcus
QDLLNVYPDLTAFGKIIGGGLP

SEQ ID NO: 2080737 - protein, 23 aa, Staphylococcus
QDLLNVYPDLTAFGKIIGGGLPI

SEQ ID NO: 2080738 - protein, 18 aa, Staphylococcus
QDLNKMIFAFPGSSSGVI

SEQ ID NO: 2080739 - protein, 21 aa, Staphylococcus
QDLSNRLIQMRKRRGEIDFDI

SEQ ID NO: 2080740 - protein, 21 aa, Staphylococcus
QDLSNRLVNMRKRRGEIDFDI

SEQ ID NO: 2080741 - protein, 24 aa, Staphylococcus
QDLTQMIIVTLAEKTPYLESKRLV

SEQ ID NO: 2080742 - protein, 21 aa, Staphylococcus
QDMVLGNYYLTLERKDAINTG

SEQ ID NO: 2080743 - protein, 20 aa, Staphylococcus
QDMVLGNYYLTLERKDAVNT

SEQ ID NO: 2080744 - protein, 20 aa, Staphylococcus
QDMVLGNYYLTLERKEAVNT

SEQ ID NO: 2080745 - protein, 19 aa, Staphylococcus
QDMVLGNYYLTLERTDAVN

SEQ ID NO: 2080746 - protein, 24 aa, Staphylococcus
QDNAQVRVLPYASITVRQAGKEHV

SEQ ID NO: 2080747 - protein, 25 aa, Staphylococcus
QDNERMLTLFRGGPVVWLSNEDADE

SEQ ID NO: 2080748 - protein, 24 aa, Staphylococcus
QDNERMLTLFRGGPVVWLSNEDAE

SEQ ID NO: 2080749 - protein, 25 aa, Staphylococcus
QDNERMLTLFRGGPVVWLSNEDAEQ

SEQ ID NO: 2080750 - protein, 20 aa, Staphylococcus
QDNIYVVYDWTGGTILGKQA

SEQ ID NO: 2080751 - protein, 22 aa, Staphylococcus
QDNLLQLLTDLSRIFLRAAQEA

SEQ ID NO: 2080752 - protein, 24 aa, Staphylococcus
QDNNRFISIMAGLPIDYIKQQLEV

SEQ ID NO: 2080753 - protein, 22 aa, Staphylococcus
QDNPIYYAQYAHARICSILKQA

SEQ ID NO: 2080754 - protein, 24 aa, Staphylococcus
QDNQHMLTLFRGGPVVWLSNEDAE

SEQ ID NO: 2080755 - protein, 18 aa, Staphylococcus
QDPDGLELILIDNHDRKI

SEQ ID NO: 2080756 - protein, 25 aa, Staphylococcus
QDPLGDPIVLIAPTQNTFQLEQAFV

SEQ ID NO: 2080757 - protein, 25 aa, Staphylococcus
QDQTLLKYIVPKIQNFLPPEYGHAE

SEQ ID NO: 2080758 - protein, 19 aa, Staphylococcus
QDRLKLRKQTRQLAAIYLA

SEQ ID NO: 2080759 - protein, 23 aa, Staphylococcus
QDSTLIIYESPFRVIDTLKAIIK

SEQ ID NO: 2080760 - protein, 20 aa, Staphylococcus
QDSTLIIYESPFRVVETLKA

SEQ ID NO: 2080761 - protein, 34 aa, Staphylococcus
QDTALVFTNKGRYLFIPVHKLAEIRWKELGQHVS

SEQ ID NO: 2080762 - protein, 21 aa, Staphylococcus
QDTDYILLDEPLNNLDMKHSV

SEQ ID NO: 2080763 - protein, 18 aa, Staphylococcus
QDTPLPNAVYKYGSFLIK

SEQ ID NO: 2080764 - protein, 17 aa, Staphylococcus
QDVFPAMKNVEGHTLMI

SEQ ID NO: 2080765 - protein, 24 aa, Staphylococcus
QDVKLTVTALLAKAVVLALKEYGA

SEQ ID NO: 2080766 - protein, 33 aa, Staphylococcus
QDVKLTVTTLLAKAVVLALKDYGAMNARYENGT

SEQ ID NO: 2080767 - protein, 21 aa, Staphylococcus
QDWASMLLRMYQRYCEQNGFN

SEQ ID NO: 2080768 - protein, 23 aa, Staphylococcus
QDWASMLLRMYQRYGEQQGFKIE

SEQ ID NO: 2080769 - protein, 23 aa, Staphylococcus
QDWASMLLRMYQRYGEQQGFKVE

SEQ ID NO: 2080770 - protein, 18 aa, Staphylococcus
QDWDEELLKYIKYADDNI

SEQ ID NO: 2080771 - protein, 26 aa, Staphylococcus
QDWDSDLFNDYLRRFDLPYNQKINQF

SEQ ID NO: 2080772 - protein, 29 aa, Staphylococcus
QDWKARLRMLKAFPTPTFDDIPLLETALN

SEQ ID NO: 2080773 - protein, 26 aa, Staphylococcus
QDYALFPHLNVYDNIAFGLKLKKHSK

SEQ ID NO: 2080774 - protein, 30 aa, Staphylococcus
QDYALFPHLNVYDNIAFGLKLKKLAKSEIK

SEQ ID NO: 2080775 - protein, 31 aa, Staphylococcus
QDYALFPHLNVYDNIAFGLKLKKLSKKDIDQ

SEQ ID NO: 2080776 - protein, 30 aa, Staphylococcus
QDYALFPHLNVYDNIAYGLKLKKLSKSEID

SEQ ID NO: 2080777 - protein, 32 aa, Staphylococcus
QDYGFIYELYVFEGYRRQGVAKKLIYFVNDFF

SEQ ID NO: 2080778 - protein, 19 aa, Staphylococcus
QDYKLYFPKELIYNIEDDV

SEQ ID NO: 2080779 - protein, 18 aa, Staphylococcus
QDYMDEETWLTAKEAKKL

SEQ ID NO: 2080780 - protein, 18 aa, Staphylococcus
QDYQLFPNMTVMQNITFM

SEQ ID NO: 2080781 - protein, 18 aa, Staphylococcus
QDYVRLQDDLEKRESTGQ

SEQ ID NO: 2080782 - protein, 18 aa, Staphylococcus
QEAKLACLTIDTAMRHLD

SEQ ID NO: 2080783 - protein, 22 aa, Staphylococcus
QEAQTRHYTWPTASAALGRTMT

SEQ ID NO: 2080784 - protein, 22 aa, Staphylococcus
QEAQTRHYTWPTASAAMGRTMT

SEQ ID NO: 2080785 - protein, 22 aa, Staphylococcus
QEATLPGRVRILFQAAEEVGSG

SEQ ID NO: 2080786 - protein, 25 aa, Staphylococcus
QEATRKWLMSFGSFNQFIDSMRLNY

SEQ ID NO: 2080787 - protein, 23 aa, Staphylococcus
QECARLLKKWGLPANRNTIRLHC

SEQ ID NO: 2080788 - protein, 24 aa, Staphylococcus
QECIKFYELIQNLIKEQEFLEVSE

SEQ ID NO: 2080789 - protein, 17 aa, Staphylococcus
QEDAQIIFLDTPGIHKP

SEQ ID NO: 2080790 - protein, 22 aa, Staphylococcus
QEDDHDFPKMIAFSNGQDVAEI

SEQ ID NO: 2080791 - protein, 25 aa, Staphylococcus
QEDSKFGLSIKYGLALEAINKIKAS

SEQ ID NO: 2080792 - protein, 26 aa, Staphylococcus
QEEDIELFQDIADKVKQTNSYDLAFE

SEQ ID NO: 2080793 - protein, 19 aa, Staphylococcus
QEEDYTYFFNGVKHILKAK

SEQ ID NO: 2080794 - protein, 25 aa, Staphylococcus
QEEDYTYFFNGVKHILKAKDKELNG

SEQ ID NO: 2080795 - protein, 18 aa, Staphylococcus
QEEDYTYFFNGVKHVLKA

SEQ ID NO: 2080796 - protein, 27 aa, Staphylococcus
QEEEFVVEGPLWIQVHAFEKGVEVLIS

SEQ ID NO: 2080797 - protein, 24 aa, Staphylococcus
QEFKGFMTGNIIKYATRLGRKDEK

SEQ ID NO: 2080798 - protein, 26 aa, Staphylococcus
QEFKMIYQLIMIFLQNNRDYKWNKKL

SEQ ID NO: 2080799 - protein, 24 aa, Staphylococcus
QEFKTTILPTLTPLGIDAYHPFPK

SEQ ID NO: 2080800 - protein, 26 aa, Staphylococcus
QEGDTVPIYLKRNPNFKFPQNEETPV

SEQ ID NO: 2080801 - protein, 24 aa, Staphylococcus
QEGFAISIGIYRDGKPYAGLVYDV

SEQ ID NO: 2080802 - protein, 17 aa, Staphylococcus
QEGKRAVLLLHGFTGNS

SEQ ID NO: 2080803 - protein, 19 aa, Staphylococcus
QEGLIRAYGISSIRPNVID

SEQ ID NO: 2080804 - protein, 22 aa, Staphylococcus
QEGQTRHYTWPTASAAMGRTMT

SEQ ID NO: 2080805 - protein, 18 aa, Staphylococcus
QEGYIFKMHPHDFVPFFE

SEQ ID NO: 2080806 - protein, 24 aa, Staphylococcus
QEHGLDMIVIDYLQLIQGSGSRAS

SEQ ID NO: 2080807 - protein, 25 aa, Staphylococcus
QEHNMTLLFITHDLSLAMDYATHIS

SEQ ID NO: 2080808 - protein, 20 aa, Staphylococcus
QEIEDLFLGLGFEIVNGYEV

SEQ ID NO: 2080809 - protein, 24 aa, Staphylococcus
QEIGLTNLSLHPYLVEINSNQVIV

SEQ ID NO: 2080810 - protein, 22 aa, Staphylococcus
QEILDLMNEESWMSAQDAVDLG

SEQ ID NO: 2080811 - protein, 17 aa, Staphylococcus
QEILENCAPSYISGISI

SEQ ID NO: 2080812 - protein, 32 aa, Staphylococcus
QEILKQCLTLPQTRVRKLLKKMDYYIKFEDTA

SEQ ID NO: 2080813 - protein, 19 aa, Staphylococcus
QEILSYCEPGYISGLSILG

SEQ ID NO: 2080814 - protein, 23 aa, Staphylococcus
QEINLMQFIKKLDKQMDFLDIDK

SEQ ID NO: 2080815 - protein, 18 aa, Staphylococcus
QEISGWRYMLDKCDELLK

SEQ ID NO: 2080816 - protein, 23 aa, Staphylococcus
QEKALFVEGAYIYYLGSFIDSDS

SEQ ID NO: 2080817 - protein, 17 aa, Staphylococcus
QEKDSFHYFFKDEQKVV

SEQ ID NO: 2080818 - protein, 17 aa, Staphylococcus
QEKIIGLSVGNLNEYEK

SEQ ID NO: 2080819 - protein, 24 aa, Staphylococcus
QEKNYKALHYQSEGTDLVVGLPKG

SEQ ID NO: 2080820 - protein, 17 aa, Staphylococcus
QEKQKALYKQELAWMRT

SEQ ID NO: 2080821 - protein, 17 aa, Staphylococcus
QEKRKERILLTGDLPSP

SEQ ID NO: 2080822 - protein, 27 aa, Staphylococcus
QELASGKIQFLYVAPERFENQYFLSIL

SEQ ID NO: 2080823 - protein, 19 aa, Staphylococcus
QELEKLMLFIGDRPTINKQ

SEQ ID NO: 2080824 - protein, 19 aa, Staphylococcus
QELEKMVLFLGDRPTIVKQ

SEQ ID NO: 2080825 - protein, 29 aa, Staphylococcus
QELGDDYVILLRMHYLISNAIDLTGFENF

SEQ ID NO: 2080826 - protein, 32 aa, Staphylococcus
QEMLADAIGFVRAQWVFPIQTHENRVMEISQS

SEQ ID NO: 2080827 - protein, 23 aa, Staphylococcus
QEMLEAIFFGHDEIKRLVEFQQQ

SEQ ID NO: 2080828 - protein, 25 aa, Staphylococcus
QEMLEAIFFGHEEIKRLVAFQEEVV

SEQ ID NO: 2080829 - protein, 20 aa, Staphylococcus
QEMLKKVIPLYDNAPKEQMN

SEQ ID NO: 2080830 - protein, 33 aa, Staphylococcus
QEMTYRKLGKYPPYYFLINFTISHKEMKKVMEA

SEQ ID NO: 2080831 - protein, 19 aa, Staphylococcus
QENFAISIGIYNDGKPYAG

SEQ ID NO: 2080832 - protein, 26 aa, Staphylococcus
QENIFHDQLTPVWLYTENNAVQNKEH

SEQ ID NO: 2080833 - protein, 23 aa, Staphylococcus
QENILKQRLGWNAPSKTLEEIGV

SEQ ID NO: 2080834 - protein, 32 aa, Staphylococcus
QENLRKIKVKPGDFYFIPAGTIHSIGAGIMAY

SEQ ID NO: 2080835 - protein, 25 aa, Staphylococcus
QENTKLFVVIGQLNQLIKGGRVSKT

SEQ ID NO: 2080836 - protein, 25 aa, Staphylococcus
QEQHPYNHILLATGFKPTLLQQPMV

SEQ ID NO: 2080837 - protein, 24 aa, Staphylococcus
QEQIVLFLNRRGYASFMLCRDCGH

SEQ ID NO: 2080838 - protein, 23 aa, Staphylococcus
QEQQLILNFYRDKTIDDVIEDII

SEQ ID NO: 2080839 - protein, 23 aa, Staphylococcus
QEREVFELYSKGYKPKEIVRLLN

SEQ ID NO: 2080840 - protein, 24 aa, Staphylococcus
QERGITFLFIAHDLSMVKYISDRI

SEQ ID NO: 2080841 - protein, 25 aa, Staphylococcus
QERLKLIHQWVDGRIPVIGVGSVFT

SEQ ID NO: 2080842 - protein, 22 aa, Staphylococcus
QERPTISLLMPMSEAHATLRQS

SEQ ID NO: 2080843 - protein, 19 aa, Staphylococcus
QERPTISLLMPMSEAHSTL

SEQ ID NO: 2080844 - protein, 17 aa, Staphylococcus
QERQKFYAIPQSKHFLP

SEQ ID NO: 2080845 - protein, 20 aa, Staphylococcus
QESAFLLKDLKITLTDLRSG

SEQ ID NO: 2080846 - protein, 28 aa, Staphylococcus
QESLQEHLFPIEYGLKGLPHIRISNPEM

SEQ ID NO: 2080847 - protein, 24 aa, Staphylococcus
QESREIIQFIKSYVQSHSFIKSLV

SEQ ID NO: 2080848 - protein, 24 aa, Staphylococcus
QESVQALLGYYYNSLVNGLEEFHF

SEQ ID NO: 2080849 - protein, 19 aa, Staphylococcus
QESYSVIIQVLRGETTDYI

SEQ ID NO: 2080850 - protein, 19 aa, Staphylococcus
QETALALNFYRNLTINDVI

SEQ ID NO: 2080851 - protein, 25 aa, Staphylococcus
QETFENAFLLRTFSKAYGLAGLRVG

SEQ ID NO: 2080852 - protein, 20 aa, Staphylococcus
QETFYLSSNIAVSVALIANE

SEQ ID NO: 2080853 - protein, 24 aa, Staphylococcus
QETKGELLIIGTGGIFNAEDAIQM

SEQ ID NO: 2080854 - protein, 18 aa, Staphylococcus
QETKKLLDRIYPFRKCDT

SEQ ID NO: 2080855 - protein, 23 aa, Staphylococcus
QETLFNLLNDLAMIFMNSALEAL

SEQ ID NO: 2080856 - protein, 19 aa, Staphylococcus
QETYGVIIQVLRGETSDYV

SEQ ID NO: 2080857 - protein, 26 aa, Staphylococcus
QEVEQLIQFKFTINPFKMAKTNQLNL

SEQ ID NO: 2080858 - protein, 17 aa, Staphylococcus
QEVFPAMKSVEGHTLMI

SEQ ID NO: 2080859 - protein, 23 aa, Staphylococcus
QEVHGLGLDLFAGSGALGIEALS

SEQ ID NO: 2080860 - protein, 21 aa, Staphylococcus
QEVRLHIIQLDTPLFERYQKV

SEQ ID NO: 2080861 - protein, 20 aa, Staphylococcus
QEWVFQSLMLLLEKENFDKI

SEQ ID NO: 2080862 - protein, 17 aa, Staphylococcus
QEYAPILYQIWKKKHKK

SEQ ID NO: 2080863 - protein, 18 aa, Staphylococcus
QEYFMKHMLGTSSGLLAE

SEQ ID NO: 2080864 - protein, 18 aa, Staphylococcus
QEYIQAMLDLYQDIGYPT

SEQ ID NO: 2080865 - protein, 22 aa, Staphylococcus
QEYLDELGFNLVGYGCTTCIGN

SEQ ID NO: 2080866 - protein, 30 aa, Staphylococcus
QEYSKDDIFQIYLNKIYYSDGVYGVKAAAK

SEQ ID NO: 2080867 - protein, 17 aa, Staphylococcus
QEYWYIHDGKMERIVGT

SEQ ID NO: 2080868 - protein, 18 aa, Staphylococcus
QFAIIDKLEIQFSDGLTV

SEQ ID NO: 2080869 - protein, 29 aa, Staphylococcus
QFAKMIHHRYRNIPFYLQVGNPYLDDDVE

SEQ ID NO: 2080870 - protein, 17 aa, Staphylococcus
QFALDIDFKTPPPWYQV

SEQ ID NO: 2080871 - protein, 30 aa, Staphylococcus
QFAVRGVYQRYALSSLPYPEKTKFETKGES

SEQ ID NO: 2080872 - protein, 21 aa, Staphylococcus
QFCRKLWLDAWEATYNQQLKA

SEQ ID NO: 2080873 - protein, 29 aa, Staphylococcus
QFDEPLFVKVGMELFYQTGPELIKSIKDR

SEQ ID NO: 2080874 - protein, 29 aa, Staphylococcus
QFDEPLFVKVGMELYYQTGPALIKKIKER

SEQ ID NO: 2080875 - protein, 20 aa, Staphylococcus
QFDETFMMYLPRLCEHCLNP

SEQ ID NO: 2080876 - protein, 20 aa, Staphylococcus
QFDHYLLNDLVQFKGKSPST

SEQ ID NO: 2080877 - protein, 20 aa, Staphylococcus
QFDISFPNYIVLLYIENDKP

SEQ ID NO: 2080878 - protein, 32 aa, Staphylococcus
QFDSEAAIYEHFGRPWIAPPMRVDGSEFDRDL

SEQ ID NO: 2080879 - protein, 19 aa, Staphylococcus
QFDSNSIIFAFIPGSEFRG

SEQ ID NO: 2080880 - protein, 17 aa, Staphylococcus
QFEAALPEYTLLSKLHP

SEQ ID NO: 2080881 - protein, 22 aa, Staphylococcus
QFEANEFLQLMISTMENRLNEH

SEQ ID NO: 2080882 - protein, 24 aa, Staphylococcus
QFEEINTRYTFLDEQRADLRAAKL

SEQ ID NO: 2080883 - protein, 19 aa, Staphylococcus
QFEGATIFTLTPLSTTMIA

SEQ ID NO: 2080884 - protein, 20 aa, Staphylococcus
QFEGKFVSNLFFENSTRTKC

SEQ ID NO: 2080885 - protein, 24 aa, Staphylococcus
QFEKYQSLITDEVVCRRAKHAISE

SEQ ID NO: 2080886 - protein, 19 aa, Staphylococcus
QFELHPFLVEINNTTLIKH

SEQ ID NO: 2080887 - protein, 20 aa, Staphylococcus
QFENIKIVGLMTMAPYTDDE

SEQ ID NO: 2080888 - protein, 23 aa, Staphylococcus
QFERIMEFIRSDLYMKIAQADEV

SEQ ID NO: 2080889 - protein, 18 aa, Staphylococcus
QFFFAYDIEKYDKGLRGF

SEQ ID NO: 2080890 - protein, 18 aa, Staphylococcus
QFFILSEEKIQQLQQKVK

SEQ ID NO: 2080891 - protein, 27 aa, Staphylococcus
QFFYHYFDRHLLQSNLYIKSLLFNRIH

SEQ ID NO: 2080892 - protein, 24 aa, Staphylococcus
QFGESLPIYKPTLPPMVFGTKDKQ

SEQ ID NO: 2080893 - protein, 23 aa, Staphylococcus
QFGTMATLFPNRVDLGLGRAPGT

SEQ ID NO: 2080894 - protein, 22 aa, Staphylococcus
QFGTMETVFPNRVDLGLGRAPG

SEQ ID NO: 2080895 - protein, 25 aa, Staphylococcus
QFIEHKLLQYIDEGLEWVLIQGQIG

SEQ ID NO: 2080896 - protein, 19 aa, Staphylococcus
QFIERLVEASLTKPVAEMI

SEQ ID NO: 2080897 - protein, 17 aa, Staphylococcus
QFIFPKDILIKKGILKS

SEQ ID NO: 2080898 - protein, 19 aa, Staphylococcus
QFIGKPETIIMDKALEILG

SEQ ID NO: 2080899 - protein, 30 aa, Staphylococcus
QFIGKPETIIMQIALDILKLDKSEVAMVGD

SEQ ID NO: 2080900 - protein, 19 aa, Staphylococcus
QFIIDLIGVNAEQFRQLFI

SEQ ID NO: 2080901 - protein, 22 aa, Staphylococcus
QFIIEPLRKQLEALDYIGLSYL

SEQ ID NO: 2080902 - protein, 25 aa, Staphylococcus
QFINDLLELDGVKSIFYVMDFLAID

SEQ ID NO: 2080903 - protein, 23 aa, Staphylococcus
QFINDLLKLEGVKSIFYVMDFLA

SEQ ID NO: 2080904 - protein, 18 aa, Staphylococcus
QFIQQLIEIGIKPFVFPY

SEQ ID NO: 2080905 - protein, 20 aa, Staphylococcus
QFIVLDIKKHRFKSGEYTVQ

SEQ ID NO: 2080906 - protein, 20 aa, Staphylococcus
QFIYVMDTFDFYHYAARHNR

SEQ ID NO: 2080907 - protein, 22 aa, Staphylococcus
QFKGELIQIPPMYSSVKVNGKK

SEQ ID NO: 2080908 - protein, 22 aa, Staphylococcus
QFKLRVSEYNDLDLVNSLIAHA

SEQ ID NO: 2080909 - protein, 19 aa, Staphylococcus
QFKMYPKEFIPFFEGTITI

SEQ ID NO: 2080910 - protein, 18 aa, Staphylococcus
QFKPGDVIQFKWISVDEA

SEQ ID NO: 2080911 - protein, 17 aa, Staphylococcus
QFKPGEEILFKWITIEQ

SEQ ID NO: 2080912 - protein, 17 aa, Staphylococcus
QFKSLNSMQTKDIIKAI

SEQ ID NO: 2080913 - protein, 22 aa, Staphylococcus
QFKSLRRFFKIYVRGIRGASEL

SEQ ID NO: 2080914 - protein, 21 aa, Staphylococcus
QFLDKTLERKAVWDKWMEQDK

SEQ ID NO: 2080915 - protein, 23 aa, Staphylococcus
QFLHEIQVDRIIFGDPAVVMYVK

SEQ ID NO: 2080916 - protein, 17 aa, Staphylococcus
QFLLANYVFQTLGYRRY

SEQ ID NO: 2080917 - protein, 17 aa, Staphylococcus
QFLNLRHSVKMAVLDNL

SEQ ID NO: 2080918 - protein, 25 aa, Staphylococcus
QFLTKDLLIDWRWGETYFKDKLIDY

SEQ ID NO: 2080919 - protein, 18 aa, Staphylococcus
QFMYTSNILFYTVDYNHV

SEQ ID NO: 2080920 - protein, 18 aa, Staphylococcus
QFNDLWDKSIPLTSSWVE

SEQ ID NO: 2080921 - protein, 30 aa, Staphylococcus
QFNEPLFVKVGMELFYQSGPQFIRDIKARG

SEQ ID NO: 2080922 - protein, 19 aa, Staphylococcus
QFNEPLVEFFYKNDDLNDP

SEQ ID NO: 2080923 - protein, 27 aa, Staphylococcus
QFNLLNSTAYYKYLSRRIGSIVETTLN

SEQ ID NO: 2080924 - protein, 18 aa, Staphylococcus
QFNVELELSFIFTNPTVA

SEQ ID NO: 2080925 - protein, 17 aa, Staphylococcus
QFNYIKERVAHLVNAYN

SEQ ID NO: 2080926 - protein, 23 aa, Staphylococcus
QFQPRLICDFATLTGAAIAALGE

SEQ ID NO: 2080927 - protein, 23 aa, Staphylococcus
QFQQLFTLIEQIFARPLSPYEIE

SEQ ID NO: 2080928 - protein, 19 aa, Staphylococcus
QFQRLWIAKALLVNPDILI

SEQ ID NO: 2080929 - protein, 25 aa, Staphylococcus
QFQRVWIAKALIIQPKLLILDEATT

SEQ ID NO: 2080930 - protein, 17 aa, Staphylococcus
QFQTYYQLLVEWNEKMN

SEQ ID NO: 2080931 - protein, 17 aa, Staphylococcus
QFQTYYRLLVEWNEKMN

SEQ ID NO: 2080932 - protein, 28 aa, Staphylococcus
QFRKTSLGFIFQDYSVLPTLTVKENIML

SEQ ID NO: 2080933 - protein, 17 aa, Staphylococcus
QFRNIYQSGYLIGDLNF

SEQ ID NO: 2080934 - protein, 19 aa, Staphylococcus
QFRYEHYLQLFNEISNRKV

SEQ ID NO: 2080935 - protein, 25 aa, Staphylococcus
QFSEQVYNGLWFSPLTDSLKQFIDS

SEQ ID NO: 2080936 - protein, 17 aa, Staphylococcus
QFSGYPINFVKENKTLT

SEQ ID NO: 2080937 - protein, 18 aa, Staphylococcus
QFSQRIRMPFLRSPFVHH

SEQ ID NO: 2080938 - protein, 18 aa, Staphylococcus
QFSVALSTIWKFISRTNK

SEQ ID NO: 2080939 - protein, 28 aa, Staphylococcus
QFTHDSLDHLWRVASLNQAIALNIDKQK

SEQ ID NO: 2080940 - protein, 29 aa, Staphylococcus
QFTKDRTVYLPKAFHPLLDKQTVVANTIE

SEQ ID NO: 2080941 - protein, 23 aa, Staphylococcus
QFTQYTVHDWWNDVLNGYQYLKD

SEQ ID NO: 2080942 - protein, 18 aa, Staphylococcus
QFTSQDWYWNAYIEGPIE

SEQ ID NO: 2080943 - protein, 25 aa, Staphylococcus
QFTYISLDDFRIIKDQLFGNGERST

SEQ ID NO: 2080944 - protein, 17 aa, Staphylococcus
QFVCVISMSAPNEDTLT

SEQ ID NO: 2080945 - protein, 19 aa, Staphylococcus
QFVCVISMSEPDQPTRTFK

SEQ ID NO: 2080946 - protein, 23 aa, Staphylococcus
QFVDAIEYNLGFRLKVVSGGNSS

SEQ ID NO: 2080947 - protein, 18 aa, Staphylococcus
QFVNRLTKKWLRKPDAKL

SEQ ID NO: 2080948 - protein, 21 aa, Staphylococcus
QFVPNISIGIPILDAVRQQSK

SEQ ID NO: 2080949 - protein, 24 aa, Staphylococcus
QFVPNISIGIPILDSVRAATQLPI

SEQ ID NO: 2080950 - protein, 24 aa, Staphylococcus
QFVPNISIGLPILDAVRSTTQLPI

SEQ ID NO: 2080951 - protein, 20 aa, Staphylococcus
QFVPNISIGLPILEAVNAGT

SEQ ID NO: 2080952 - protein, 20 aa, Staphylococcus
QFWAYLVRTGHLTEPGDFIQ

SEQ ID NO: 2080953 - protein, 24 aa, Staphylococcus
QGADAVKFLLYYDVDDDEAINVQK

SEQ ID NO: 2080954 - protein, 17 aa, Staphylococcus
QGALPVGLLPDIEVDGK

SEQ ID NO: 2080955 - protein, 26 aa, Staphylococcus
QGARGYIFFGQPLDIPIVANSYATHT

SEQ ID NO: 2080956 - protein, 23 aa, Staphylococcus
QGCASIGAFYLWEAIHQDLLQYD

SEQ ID NO: 2080957 - protein, 22 aa, Staphylococcus
QGDANVFVFPSLEAGNIGYKIA

SEQ ID NO: 2080958 - protein, 36 aa, Staphylococcus
QGDKLTFWRLFHERMDILHEALLYRIERVAQAVPEN

SEQ ID NO: 2080959 - protein, 21 aa, Staphylococcus
QGDLYIVFRVKPSEKFERDGD

SEQ ID NO: 2080960 - protein, 24 aa, Staphylococcus
QGDMITLDFGAYYHGYCSDITRTF

SEQ ID NO: 2080961 - protein, 25 aa, Staphylococcus
QGDMITLDFGAYYRGYCSDITRTFA

SEQ ID NO: 2080962 - protein, 21 aa, Staphylococcus
QGDMLFYIHIKQLLLHEQLLK

SEQ ID NO: 2080963 - protein, 27 aa, Staphylococcus
QGDMTTFWKIFYHKMTLMHDALVYRIE

SEQ ID NO: 2080964 - protein, 24 aa, Staphylococcus
QGDMVTLDFGAYYKGYCSDITRTF

SEQ ID NO: 2080965 - protein, 23 aa, Staphylococcus
QGDQALIKGAKIMALMGLEIIKN

SEQ ID NO: 2080966 - protein, 25 aa, Staphylococcus
QGDSIDALQLRFILDWNSQAHRPQF

SEQ ID NO: 2080967 - protein, 17 aa, Staphylococcus
QGDTFFPPYTFEDWEVE

SEQ ID NO: 2080968 - protein, 18 aa, Staphylococcus
QGEAYLEGTRKIIPTHEL

SEQ ID NO: 2080969 - protein, 17 aa, Staphylococcus
QGEGRVIGRKTMFVRTA

SEQ ID NO: 2080970 - protein, 28 aa, Staphylococcus
QGEHGFGYDPIFYVPEKGKTMAQLTTTE

SEQ ID NO: 2080971 - protein, 25 aa, Staphylococcus
QGEMSACLILIQKLNERMVELECSS

SEQ ID NO: 2080972 - protein, 23 aa, Staphylococcus
QGEPIRNAILWNDTRTTQQCQSI

SEQ ID NO: 2080973 - protein, 30 aa, Staphylococcus
QGETQFKVVPLLIFSAMHYIVDVPEILSNI

SEQ ID NO: 2080974 - protein, 26 aa, Staphylococcus
QGFDQDYLIHALKSLKGLFVATTQLP

SEQ ID NO: 2080975 - protein, 26 aa, Staphylococcus
QGFFDMPIDHLMGVPILAQYFKNETD

SEQ ID NO: 2080976 - protein, 18 aa, Staphylococcus
QGFKVEFADYLPGDEAGV

SEQ ID NO: 2080977 - protein, 23 aa, Staphylococcus
QGFNVRVDSLLYPGYKVSPYYDS

SEQ ID NO: 2080978 - protein, 22 aa, Staphylococcus
QGFRLYVNQLLKQTSHQKQNKV

SEQ ID NO: 2080979 - protein, 25 aa, Staphylococcus
QGGDMIDTWMKFTPLGRPGVPEELQ

SEQ ID NO: 2080980 - protein, 24 aa, Staphylococcus
QGGRFGINLRYPQKFEFEEAIQRF

SEQ ID NO: 2080981 - protein, 18 aa, Staphylococcus
QGGRIIYIGAGTSGRLGV

SEQ ID NO: 2080982 - protein, 21 aa, Staphylococcus
QGHFADVFKSLFGGGQAELRL

SEQ ID NO: 2080983 - protein, 21 aa, Staphylococcus
QGHFLDDYIFTNVGTGTSLHF

SEQ ID NO: 2080984 - protein, 24 aa, Staphylococcus
QGHQIFPIMMDLIDQESLLYDKIQ

SEQ ID NO: 2080985 - protein, 19 aa, Staphylococcus
QGIDIIEPVPLFQQTKDDL

SEQ ID NO: 2080986 - protein, 26 aa, Staphylococcus
QGIFKKPVITPIKPYKNFYPAEDYHQ

SEQ ID NO: 2080987 - protein, 21 aa, Staphylococcus
QGIGLYRTEFLYMGRDQLPTE

SEQ ID NO: 2080988 - protein, 17 aa, Staphylococcus
QGIHFAMDYLTEQTQLL

SEQ ID NO: 2080989 - protein, 24 aa, Staphylococcus
QGIHQEIDVFVRPSDIFKEAKANL

SEQ ID NO: 2080990 - protein, 17 aa, Staphylococcus
QGIIDYIQPEKQAFIPV

SEQ ID NO: 2080991 - protein, 20 aa, Staphylococcus
QGIIWVIDPIDGTLNFVHQK

SEQ ID NO: 2080992 - protein, 18 aa, Staphylococcus
QGITLTCKASLISFYEQY

SEQ ID NO: 2080993 - protein, 32 aa, Staphylococcus
QGIYRVEKWEAFPYISFIPAREKTIISLRGFK

SEQ ID NO: 2080994 - protein, 18 aa, Staphylococcus
QGIYVLLILATQENQGAV

SEQ ID NO: 2080995 - protein, 21 aa, Staphylococcus
QGKAVAFDKTRYNFYAGSEVI

SEQ ID NO: 2080996 - protein, 31 aa, Staphylococcus
QGKDYCLIVCLFYDGEPLLAYTYEFYQQKLY

SEQ ID NO: 2080997 - protein, 21 aa, Staphylococcus
QGKFYHFKYPYADGNGYIEIA

SEQ ID NO: 2080998 - protein, 24 aa, Staphylococcus
QGKPLVCVGILKGSVMFMADLIKR

SEQ ID NO: 2080999 - protein, 25 aa, Staphylococcus
QGKQLLAYLAAPKHLYEKTPTADLE

SEQ ID NO: 2081000 - protein, 23 aa, Staphylococcus
QGLDQVWRVASLNQAIALKIDDQ

SEQ ID NO: 2081001 - protein, 28 aa, Staphylococcus
QGLGFRGDIFGGYILYKCGFIQSEHRFF

SEQ ID NO: 2081002 - protein, 23 aa, Staphylococcus
QGLKHHILDMSLLSQLTPNALTK

SEQ ID NO: 2081003 - protein, 22 aa, Staphylococcus
QGLKRFDMIVLTGGLGPTKDDL

SEQ ID NO: 2081004 - protein, 17 aa, Staphylococcus
QGLLEGFKNLGFDTYFA

SEQ ID NO: 2081005 - protein, 17 aa, Staphylococcus
QGLLLIDNKDKLEPIVH

SEQ ID NO: 2081006 - protein, 32 aa, Staphylococcus
QGLPKLVQQMILPSQFKKVYTIDFKSFEPSVA

SEQ ID NO: 2081007 - protein, 26 aa, Staphylococcus
QGLTPEELLFEILGEENVQILENVPA

SEQ ID NO: 2081008 - protein, 19 aa, Staphylococcus
QGMIDLIYVSEGQYYFVDY

SEQ ID NO: 2081009 - protein, 27 aa, Staphylococcus
QGMIKSDFFIINKTDLAPYVGASLEQM

SEQ ID NO: 2081010 - protein, 33 aa, Staphylococcus
QGMILAQHITPYPPGIPLFFTGERITQNMLKLI

SEQ ID NO: 2081011 - protein, 23 aa, Staphylococcus
QGNANVFVFPSLEAGNIGYKIAQ

SEQ ID NO: 2081012 - protein, 25 aa, Staphylococcus
QGNLDPSLLLAPWDVIEQRVREILD

SEQ ID NO: 2081013 - protein, 25 aa, Staphylococcus
QGNLDPSLLLAPWDVIESRLKDILD

SEQ ID NO: 2081014 - protein, 25 aa, Staphylococcus
QGNLDPSLLLAPWDVLEQRVKAILD

SEQ ID NO: 2081015 - protein, 23 aa, Staphylococcus
QGNYHYTWEGNWNKDNRFNNNYS

SEQ ID NO: 2081016 - protein, 26 aa, Staphylococcus
QGPDFPTSGLILGKSGIRRAYETGRG

SEQ ID NO: 2081017 - protein, 29 aa, Staphylococcus
QGQFRKNGLPYIMHPIQVAGILTEMHLDG

SEQ ID NO: 2081018 - protein, 19 aa, Staphylococcus
QGQHYVIITQWLNHQSFKN

SEQ ID NO: 2081019 - protein, 22 aa, Staphylococcus
QGQPILLFYNFKHDRDRILERF

SEQ ID NO: 2081020 - protein, 21 aa, Staphylococcus
QGRQLLEYLGAPKHLYEKVPT

SEQ ID NO: 2081021 - protein, 18 aa, Staphylococcus
QGSDIETYVFTEVALRNK

SEQ ID NO: 2081022 - protein, 19 aa, Staphylococcus
QGSNLVLNVGYSHPVEFKP

SEQ ID NO: 2081023 - protein, 23 aa, Staphylococcus
QGSQFDVYINGEFYGQFLSPQYG

SEQ ID NO: 2081024 - protein, 24 aa, Staphylococcus
QGSVFHIPVITADLKTFIAGFNGP

SEQ ID NO: 2081025 - protein, 17 aa, Staphylococcus
QGTLPVGLLPKIIVDDK

SEQ ID NO: 2081026 - protein, 42 aa, Staphylococcus
QGTSFFGAYSLTLPKNMSFIGQPLWGSIGYTLPATLGSQLAN

SEQ ID NO: 2081027 - protein, 33 aa, Staphylococcus
QGVAYTAKALNLKAVIFMPVTTPLQKVNQVKFF

SEQ ID NO: 2081028 - protein, 33 aa, Staphylococcus
QGVDYFTIHAGLLLHYIPLTVDRLTGIVSRGGS

SEQ ID NO: 2081029 - protein, 33 aa, Staphylococcus
QGVDYFTIHAGLRLHYIPLTVDRLTGIVSRGGS

SEQ ID NO: 2081030 - protein, 26 aa, Staphylococcus
QGVDYFTIHAGVLLQYVPLTVDRLTG

SEQ ID NO: 2081031 - protein, 26 aa, Staphylococcus
QGYAIYQSILNDLPKVLLPGAHVVFE

SEQ ID NO: 2081032 - protein, 28 aa, Staphylococcus
QGYGTTMMMYLPQYVQALFPDFNHLYLV

SEQ ID NO: 2081033 - protein, 19 aa, Staphylococcus
QGYYIVVGERRFRASQLAG

SEQ ID NO: 2081034 - protein, 24 aa, Staphylococcus
QHAEGITWTFISPSAEFDFEGKRT

SEQ ID NO: 2081035 - protein, 24 aa, Staphylococcus
QHAIIKLQLEANGLIRMYLKNLDD

SEQ ID NO: 2081036 - protein, 19 aa, Staphylococcus
QHASPINAYFSPEPSYMPG

SEQ ID NO: 2081037 - protein, 20 aa, Staphylococcus
QHCDFFSFGTNDLTQLTYGF

SEQ ID NO: 2081038 - protein, 23 aa, Staphylococcus
QHDIDYCIVINFSSRFANVTAEE

SEQ ID NO: 2081039 - protein, 30 aa, Staphylococcus
QHDIKLDKRKMDLPQGIHALGYTNVPVKLD

SEQ ID NO: 2081040 - protein, 23 aa, Staphylococcus
QHDVDYCIVINFSSRFASVTAEE

SEQ ID NO: 2081041 - protein, 23 aa, Staphylococcus
QHEAIINGKRYPIRALMMSHMFV

SEQ ID NO: 2081042 - protein, 26 aa, Staphylococcus
QHEALLTEYGVWHPHAWDYAPKSTLS

SEQ ID NO: 2081043 - protein, 22 aa, Staphylococcus
QHEFEMDFPYDLTADQSKSIVE

SEQ ID NO: 2081044 - protein, 28 aa, Staphylococcus
QHEPVKPLKMLLLLHGLSSDATSYMRFT

SEQ ID NO: 2081045 - protein, 27 aa, Staphylococcus
QHETADILYLGFISTKGAIQEGKSRLE

SEQ ID NO: 2081046 - protein, 19 aa, Staphylococcus
QHFEFAAWKLYCVLNGINK

SEQ ID NO: 2081047 - protein, 23 aa, Staphylococcus
QHGMTILFITHDLELVIDYATHI

SEQ ID NO: 2081048 - protein, 19 aa, Staphylococcus
QHHIAFEIIPGITAGIAAP

SEQ ID NO: 2081049 - protein, 25 aa, Staphylococcus
QHHIEGRIFISLAVKFSKARLIDNL

SEQ ID NO: 2081050 - protein, 23 aa, Staphylococcus
QHIDEFIVCGLKSAYILKDTSEA

SEQ ID NO: 2081051 - protein, 26 aa, Staphylococcus
QHIDLIDMVVVNLYPFQNTVARPDVT

SEQ ID NO: 2081052 - protein, 18 aa, Staphylococcus
QHIRKRVLIASSSITYVV

SEQ ID NO: 2081053 - protein, 18 aa, Staphylococcus
QHIYQLVYALQDKFPKHF

SEQ ID NO: 2081054 - protein, 23 aa, Staphylococcus
QHKTIGIFGFGRIGQLVAERLKP

SEQ ID NO: 2081055 - protein, 31 aa, Staphylococcus
QHKVKGINGSKYLLIELPSNSVPHYTKNLLY

SEQ ID NO: 2081056 - protein, 30 aa, Staphylococcus
QHLIIKTHCTLPYYAGLSFRTLMPKAPNED

SEQ ID NO: 2081057 - protein, 19 aa, Staphylococcus
QHMLTLFRGGPTVWIAKED

SEQ ID NO: 2081058 - protein, 30 aa, Staphylococcus
QHMMHVTITYPLPDNQLLTQLFTELEIGSV

SEQ ID NO: 2081059 - protein, 22 aa, Staphylococcus
QHNIHVVPLNLTIDKESFVDQV

SEQ ID NO: 2081060 - protein, 31 aa, Staphylococcus
QHPERLIVAHPFHPVYILPLVEIVPGKATTE

SEQ ID NO: 2081061 - protein, 19 aa, Staphylococcus
QHPFIDRVSLVINGGHVTT

SEQ ID NO: 2081062 - protein, 18 aa, Staphylococcus
QHPFIDRVSLVINGLHVT

SEQ ID NO: 2081063 - protein, 24 aa, Staphylococcus
QHPIIDYILEYRTLSKLQSTYVEG

SEQ ID NO: 2081064 - protein, 18 aa, Staphylococcus
QHPLFKFLTEAQNGFFNE

SEQ ID NO: 2081065 - protein, 20 aa, Staphylococcus
QHPYTWGLLSSMPDLETGTD

SEQ ID NO: 2081066 - protein, 23 aa, Staphylococcus
QHQFIKNPFLIETKQLYSESYQI

SEQ ID NO: 2081067 - protein, 28 aa, Staphylococcus
QHQFKMKENIPLQLGYKALFDTTQTEVK

SEQ ID NO: 2081068 - protein, 23 aa, Staphylococcus
QHQHEYYIHYLKYLQKNYHEFFD

SEQ ID NO: 2081069 - protein, 24 aa, Staphylococcus
QHQIPTVTTLLGLGAIPYEHPLFL

SEQ ID NO: 2081070 - protein, 17 aa, Staphylococcus
QHQLRQEYLGMIRGQVL

SEQ ID NO: 2081071 - protein, 18 aa, Staphylococcus
QHQVSVAQVTLAWLRDRP

SEQ ID NO: 2081072 - protein, 21 aa, Staphylococcus
QHSDIPYVIDPVMLAKSGDSL

SEQ ID NO: 2081073 - protein, 21 aa, Staphylococcus
QHSGLMYYTIGQRHGLGIGGD

SEQ ID NO: 2081074 - protein, 27 aa, Staphylococcus
QHSQRDYLLLSFAIHTGVKLSTLLGLR

SEQ ID NO: 2081075 - protein, 28 aa, Staphylococcus
QHSRQYAKRQLTWFKNKLTVQWFNRETM

SEQ ID NO: 2081076 - protein, 18 aa, Staphylococcus
QHSSFIYDLIQPPSAKQF

SEQ ID NO: 2081077 - protein, 17 aa, Staphylococcus
QHTAYFLDIKSYILHQL

SEQ ID NO: 2081078 - protein, 20 aa, Staphylococcus
QHTVRLLHAIELERINLGRR

SEQ ID NO: 2081079 - protein, 24 aa, Staphylococcus
QHVLESEFFDYEKNYIFLTPEAED

SEQ ID NO: 2081080 - protein, 34 aa, Staphylococcus
QHYDFSRAIPFKRYLYFLIRSVKYDYLRKSRAER

SEQ ID NO: 2081081 - protein, 22 aa, Staphylococcus
QHYPQLNYIWVCARPEQTVIPG

SEQ ID NO: 2081082 - protein, 26 aa, Staphylococcus
QHYPQYNYIWVFSKPNNNIIPGNATK

SEQ ID NO: 2081083 - protein, 18 aa, Staphylococcus
QIAPLLKQGIVSEVTLLS

SEQ ID NO: 2081084 - protein, 28 aa, Staphylococcus
QIARKTFYLHYLDKYDLLEKIFIKRLEE

SEQ ID NO: 2081085 - protein, 25 aa, Staphylococcus
QIDEALAFLKKIKSGKARVIIEPLK

SEQ ID NO: 2081086 - protein, 18 aa, Staphylococcus
QIDELSEYLLYLDKHREA

SEQ ID NO: 2081087 - protein, 19 aa, Staphylococcus
QIDILFSAIKGKPICDMLN

SEQ ID NO: 2081088 - protein, 17 aa, Staphylococcus
QIDKIISEAKAYHFKSI

SEQ ID NO: 2081089 - protein, 29 aa, Staphylococcus
QIDPDVLRFFMISVHYRSPINYNMELVEA

SEQ ID NO: 2081090 - protein, 19 aa, Staphylococcus
QIDRFRVAYGHYIEDFPRQ

SEQ ID NO: 2081091 - protein, 19 aa, Staphylococcus
QIEDPLNSLNLRLALYASD

SEQ ID NO: 2081092 - protein, 31 aa, Staphylococcus
QIESIQIQKLVDAIPIFQKYGSEQLLATTKL

SEQ ID NO: 2081093 - protein, 27 aa, Staphylococcus
QIFANFDNFYHAVGQFTLNMEKQAQYN

SEQ ID NO: 2081094 - protein, 19 aa, Staphylococcus
QIFDLPYGKLEEGSYADLT

SEQ ID NO: 2081095 - protein, 19 aa, Staphylococcus
QIFHDQLSEIWIYTENHEL

SEQ ID NO: 2081096 - protein, 18 aa, Staphylococcus
QIFISLAVKFSKARLIDN

SEQ ID NO: 2081097 - protein, 17 aa, Staphylococcus
QIFKLIEQFVSTMGYVG

SEQ ID NO: 2081098 - protein, 17 aa, Staphylococcus
QIFSDVLGVPLKGNKSD

SEQ ID NO: 2081099 - protein, 20 aa, Staphylococcus
QIFYCFIVLKNNEVYYNLPK

SEQ ID NO: 2081100 - protein, 28 aa, Staphylococcus
QIGAQFLQKFYGGKGILLSGIPGVPKGN

SEQ ID NO: 2081101 - protein, 29 aa, Staphylococcus
QIGDDYVILLRMHYLIANALDLNGYEDFA

SEQ ID NO: 2081102 - protein, 17 aa, Staphylococcus
QIGLLKPDRINSSGYRI

SEQ ID NO: 2081103 - protein, 18 aa, Staphylococcus
QIGLYEDQVFVMFGVMHE

SEQ ID NO: 2081104 - protein, 34 aa, Staphylococcus
QIHAKDLKMYLLNRQHFLLNDTPINLASQFGSDH

SEQ ID NO: 2081105 - protein, 22 aa, Staphylococcus
QIHEEWCIPIIFVTHSNYEAEV

SEQ ID NO: 2081106 - protein, 24 aa, Staphylococcus
QIHEQFDHYLLNDLPQFKDKMPST

SEQ ID NO: 2081107 - protein, 20 aa, Staphylococcus
QIHNLLGIQPFARCIEMKEA

SEQ ID NO: 2081108 - protein, 32 aa, Staphylococcus
QIHTRQPYLIYMLGFMPGFPYLGGLDERLHTP

SEQ ID NO: 2081109 - protein, 27 aa, Staphylococcus
QIICYDLRFPELLRYPAKNGAKIAFYV

SEQ ID NO: 2081110 - protein, 29 aa, Staphylococcus
QIIEDMIAQGLYFNPLVNLQTRVVDIRKR

SEQ ID NO: 2081111 - protein, 24 aa, Staphylococcus
QIIFDLLVEYNGELPFWDKSSPEA

SEQ ID NO: 2081112 - protein, 17 aa, Staphylococcus
QIIFIDTPGIHKPKHKL

SEQ ID NO: 2081113 - protein, 17 aa, Staphylococcus
QIIFVDTPGIHKPKHKL

SEQ ID NO: 2081114 - protein, 23 aa, Staphylococcus
QIIPKVHLKRISKSGFGPFAFDE

SEQ ID NO: 2081115 - protein, 22 aa, Staphylococcus
QIIPKVHLKRITKSGFGPFAFD

SEQ ID NO: 2081116 - protein, 22 aa, Staphylococcus
QIIPKVHLKRITKTGFGPFAFD

SEQ ID NO: 2081117 - protein, 23 aa, Staphylococcus
QIIPKVHLKRITKTGFGPFAFDE

SEQ ID NO: 2081118 - protein, 19 aa, Staphylococcus
QIIPLITSANIACGFHAGD

SEQ ID NO: 2081119 - protein, 21 aa, Staphylococcus
QIIPMLHYFKAKNIEVRFIEF

SEQ ID NO: 2081120 - protein, 18 aa, Staphylococcus
QIIRPDIVLYGEMLNQNT

SEQ ID NO: 2081121 - protein, 18 aa, Staphylococcus
QIISGTHAITLALQSNLK

SEQ ID NO: 2081122 - protein, 18 aa, Staphylococcus
QIISGTHAITLALQSTLK

SEQ ID NO: 2081123 - protein, 19 aa, Staphylococcus
QIISGTHAITLALQSTLKY

SEQ ID NO: 2081124 - protein, 20 aa, Staphylococcus
QIISLMETPFRYGMKSLYIH

SEQ ID NO: 2081125 - protein, 20 aa, Staphylococcus
QIISPRYGTLKNMYALGQLT

SEQ ID NO: 2081126 - protein, 18 aa, Staphylococcus
QIKALKRGPQIVVGTPGR

SEQ ID NO: 2081127 - protein, 25 aa, Staphylococcus
QIKANYILMTYYNIVMTYGIEAFFK

SEQ ID NO: 2081128 - protein, 25 aa, Staphylococcus
QIKGGFTFAILTKDALYGVVDPNAI

SEQ ID NO: 2081129 - protein, 25 aa, Staphylococcus
QIKGGFTFAVLTKDALYGAVDPNAI

SEQ ID NO: 2081130 - protein, 25 aa, Staphylococcus
QIKGGFTFTILTKDALYGAVDPNAI

SEQ ID NO: 2081131 - protein, 33 aa, Staphylococcus
QIKIPLTEKWIIQIAYDKFIIMAHYEHSLLEEK

SEQ ID NO: 2081132 - protein, 19 aa, Staphylococcus
QIKLPHTIQFYISNNEEIG

SEQ ID NO: 2081133 - protein, 23 aa, Staphylococcus
QIKNIGLVYFTDGSVNIIDGPST

SEQ ID NO: 2081134 - protein, 24 aa, Staphylococcus
QIKRLKFDYLYIDNAQLTSPYLMD

SEQ ID NO: 2081135 - protein, 26 aa, Staphylococcus
QIKRVNFQFLFIDNSKLNQPYLIEGN

SEQ ID NO: 2081136 - protein, 18 aa, Staphylococcus
QILKLFIVSDSIGETAQR

SEQ ID NO: 2081137 - protein, 27 aa, Staphylococcus
QILTSADLILYVSYFNHSFTDNDKAFI

SEQ ID NO: 2081138 - protein, 28 aa, Staphylococcus
QILTSSDLILYVSYFNHSFTDNDKAFIE

SEQ ID NO: 2081139 - protein, 27 aa, Staphylococcus
QILTSSDLILYVSYFNHSFTDNDKNFI

SEQ ID NO: 2081140 - protein, 21 aa, Staphylococcus
QINALKWVHTFIKYFGGNSNN

SEQ ID NO: 2081141 - protein, 25 aa, Staphylococcus
QINDQLSFKYPYLKDTEKPSKQSVS

SEQ ID NO: 2081142 - protein, 36 aa, Staphylococcus
QINELLTPLVSVVPLQLISYYAALHRGLDVDKPRNL

SEQ ID NO: 2081143 - protein, 18 aa, Staphylococcus
QIPDILPEYLMQYQTVKS

SEQ ID NO: 2081144 - protein, 18 aa, Staphylococcus
QIPLGRFGEDTDIANTVA

SEQ ID NO: 2081145 - protein, 17 aa, Staphylococcus
QIPVLYFVSENEVNREE

SEQ ID NO: 2081146 - protein, 21 aa, Staphylococcus
QIQGFFDIPIDHLMGVPIIGQ

SEQ ID NO: 2081147 - protein, 22 aa, Staphylococcus
QIQGFFDIPIDHLMGVPIIGQH

SEQ ID NO: 2081148 - protein, 29 aa, Staphylococcus
QIQGFFDIPIDHLMGVPILAKYFKENPDI

SEQ ID NO: 2081149 - protein, 19 aa, Staphylococcus
QIQHAFIYGFDLNDNTTAI

SEQ ID NO: 2081150 - protein, 24 aa, Staphylococcus
QIQKGIWQVTPIKHGWDHVDFVGQ

SEQ ID NO: 2081151 - protein, 19 aa, Staphylococcus
QIQMPRFRAMLLDDEIQFE

SEQ ID NO: 2081152 - protein, 25 aa, Staphylococcus
QIQMTLPSLSFYYENINDLYDIQVH

SEQ ID NO: 2081153 - protein, 27 aa, Staphylococcus
QIQNREKALKVLKARVYDMKLQEEQEK

SEQ ID NO: 2081154 - protein, 21 aa, Staphylococcus
QIQSAIFNQISTMAAIEPKQI

SEQ ID NO: 2081155 - protein, 27 aa, Staphylococcus
QIQSVINHYRWLFKQYHPAKQSYVIMS

SEQ ID NO: 2081156 - protein, 26 aa, Staphylococcus
QIQYLNTQYPIPFNPPYVPRENPCGR

SEQ ID NO: 2081157 - protein, 25 aa, Staphylococcus
QIRHESNVPILFLSARDNPMDQVMS

SEQ ID NO: 2081158 - protein, 18 aa, Staphylococcus
QIRHYTVQALRLLKTTAK

SEQ ID NO: 2081159 - protein, 19 aa, Staphylococcus
QIRNLSFQYPVNKAVLPAG

SEQ ID NO: 2081160 - protein, 27 aa, Staphylococcus
QIRVHMKYIGFPLVGDPKYGPKKTLDI

SEQ ID NO: 2081161 - protein, 26 aa, Staphylococcus
QIRVHMKYIGFPLVGDPKYGPRKTLD

SEQ ID NO: 2081162 - protein, 27 aa, Staphylococcus
QIRVHMKYIGYPLVGDPKYGPKKTLDI

SEQ ID NO: 2081163 - protein, 30 aa, Staphylococcus
QIRVHMKYIGYPLVGDPKYGPKRTLDIGGQ

SEQ ID NO: 2081164 - protein, 17 aa, Staphylococcus
QISIFEWLERHSNYSPS

SEQ ID NO: 2081165 - protein, 20 aa, Staphylococcus
QISKLLFENTKRRPMIIPVI

SEQ ID NO: 2081166 - protein, 23 aa, Staphylococcus
QISNIKYYPISSGKLRRYLSFEN

SEQ ID NO: 2081167 - protein, 25 aa, Staphylococcus
QISQIYLVFQHKTSIYFEGMPSINL

SEQ ID NO: 2081168 - protein, 17 aa, Staphylococcus
QISRFFTGIEIHPGAKI

SEQ ID NO: 2081169 - protein, 17 aa, Staphylococcus
QISRFFTGIEIHPGAQI

SEQ ID NO: 2081170 - protein, 21 aa, Staphylococcus
QISRIPLIVLTSDRPHELRSV

SEQ ID NO: 2081171 - protein, 18 aa, Staphylococcus
QISYIDYMSELITMIEQH

SEQ ID NO: 2081172 - protein, 24 aa, Staphylococcus
QITLPNIFSDILIYCTERNVMLVD

SEQ ID NO: 2081173 - protein, 26 aa, Staphylococcus
QITSELEWLPQLFVAGGLADLELGPF

SEQ ID NO: 2081174 - protein, 21 aa, Staphylococcus
QITSIIFEHLKKHGIKSHFIE

SEQ ID NO: 2081175 - protein, 24 aa, Staphylococcus
QIVDGDQIMFIIGQAMHKNQELKK

SEQ ID NO: 2081176 - protein, 21 aa, Staphylococcus
QIVDYILCKAYGRTATNIEKY

SEQ ID NO: 2081177 - protein, 20 aa, Staphylococcus
QKADYPLNYGKAIRIVEHAT

SEQ ID NO: 2081178 - protein, 21 aa, Staphylococcus
QKAERILLNEAPVAPVYQKGE

SEQ ID NO: 2081179 - protein, 28 aa, Staphylococcus
QKAFEVEPIFLKEKLASSKWIGAEHFCL

SEQ ID NO: 2081180 - protein, 17 aa, Staphylococcus
QKAFVLRQFKHLGLDQP

SEQ ID NO: 2081181 - protein, 18 aa, Staphylococcus
QKAGSKIVPFLPIKEEKD

SEQ ID NO: 2081182 - protein, 18 aa, Staphylococcus
QKAIASRRKQLEKELALI

SEQ ID NO: 2081183 - protein, 21 aa, Staphylococcus
QKAILIPGDLRDEQFNYDMVE

SEQ ID NO: 2081184 - protein, 23 aa, Staphylococcus
QKAKSQGCQFAFYGHTHVAKYEY

SEQ ID NO: 2081185 - protein, 19 aa, Staphylococcus
QKALMLPPGLSFVAYNHRA

SEQ ID NO: 2081186 - protein, 19 aa, Staphylococcus
QKCPDVVQALNLMSLLNPN

SEQ ID NO: 2081187 - protein, 18 aa, Staphylococcus
QKDLIRKCNKLGKPVITA

SEQ ID NO: 2081188 - protein, 24 aa, Staphylococcus
QKDTYFVTHGFGSIAALKYIEQLD

SEQ ID NO: 2081189 - protein, 26 aa, Staphylococcus
QKDWGKLKWRSLLESFDKYYMTDDFL

SEQ ID NO: 2081190 - protein, 27 aa, Staphylococcus
QKEDALDFTLWKKAKPGEISWSSPFGE

SEQ ID NO: 2081191 - protein, 25 aa, Staphylococcus
QKEDALDFTLWKQAKPGEISWESPF

SEQ ID NO: 2081192 - protein, 18 aa, Staphylococcus
QKEKLIRLLHILEDKEVK

SEQ ID NO: 2081193 - protein, 33 aa, Staphylococcus
QKEMNYRKIGKYPPYFFLINFTIAHKEMKKVME

SEQ ID NO: 2081194 - protein, 30 aa, Staphylococcus
QKENAIELFQFVAPIKTIITDILYTINADY

SEQ ID NO: 2081195 - protein, 25 aa, Staphylococcus
QKERIELFMKYNVKGYRTIHFTAIE

SEQ ID NO: 2081196 - protein, 19 aa, Staphylococcus
QKESLSTVIILDGLEDPHN

SEQ ID NO: 2081197 - protein, 28 aa, Staphylococcus
QKEVPEGLIPLLKIQGLGSKKIAKLYKE

SEQ ID NO: 2081198 - protein, 25 aa, Staphylococcus
QKEYRRDASIIKSEYPRLSDSEISE

SEQ ID NO: 2081199 - protein, 24 aa, Staphylococcus
QKEYYVGFVIDRATDRVTLMASEE

SEQ ID NO: 2081200 - protein, 20 aa, Staphylococcus
QKFGLRLPGEFNREDVRKAV

SEQ ID NO: 2081201 - protein, 21 aa, Staphylococcus
QKFLDKHLYYSKRKAKKFLKH

SEQ ID NO: 2081202 - protein, 26 aa, Staphylococcus
QKFRAKQIFEWLYQKRVDSIDDMTNL

SEQ ID NO: 2081203 - protein, 26 aa, Staphylococcus
QKFRAKQIFQWLYEKRVDSIDEMTNL

SEQ ID NO: 2081204 - protein, 24 aa, Staphylococcus
QKGDINIYFRSWYSHYLDYKENKI

SEQ ID NO: 2081205 - protein, 39 aa, Staphylococcus
QKGDRVFIFMPRTPELYFAFLGILKVGAIVGPLFEAFME

SEQ ID NO: 2081206 - protein, 22 aa, Staphylococcus
QKGIWQVTPTKHDWDHVDFVGQ

SEQ ID NO: 2081207 - protein, 23 aa, Staphylococcus
QKGKIRYWGVSNYSGWALAKTHT

SEQ ID NO: 2081208 - protein, 22 aa, Staphylococcus
QKGLGVILPFNLMIARNGVDRR

SEQ ID NO: 2081209 - protein, 23 aa, Staphylococcus
QKGNEHMYLITDAMRAKGMEDGE

SEQ ID NO: 2081210 - protein, 28 aa, Staphylococcus
QKGVQMVHESLLRALKDNGLEEIEAEGQ

SEQ ID NO: 2081211 - protein, 26 aa, Staphylococcus
QKGVQMVHESLLRALKDNGLEVIETE

SEQ ID NO: 2081212 - protein, 22 aa, Staphylococcus
QKGYDIELAYEAGLLSRNEENF

SEQ ID NO: 2081213 - protein, 17 aa, Staphylococcus
QKHNIIFASARPIRDLI

SEQ ID NO: 2081214 - protein, 29 aa, Staphylococcus
QKHNLSEENFLLLLFAKVLSEQMGREKIL

SEQ ID NO: 2081215 - protein, 29 aa, Staphylococcus
QKIEDPAGPLYLYLSTLGSPGQTAYHGLL

SEQ ID NO: 2081216 - protein, 17 aa, Staphylococcus
QKIIKFNEDLRTMTKQG

SEQ ID NO: 2081217 - protein, 21 aa, Staphylococcus
QKIKAFIDYYGDIDEIMGVSY

SEQ ID NO: 2081218 - protein, 28 aa, Staphylococcus
QKIKKMKQPPHIIFATAHDTFAVKAFEL

SEQ ID NO: 2081219 - protein, 21 aa, Staphylococcus
QKILPLLLDDDSHYRLYGVFL

SEQ ID NO: 2081220 - protein, 25 aa, Staphylococcus
QKKALALLFERRVSGIIIISLTLEE

SEQ ID NO: 2081221 - protein, 25 aa, Staphylococcus
QKKLDAVVILSDFNRRYLSEFTGTS

SEQ ID NO: 2081222 - protein, 26 aa, Staphylococcus
QKKSAYLLSLFDWSRPQIKNKLIDIE

SEQ ID NO: 2081223 - protein, 26 aa, Staphylococcus
QKLELTKFKDYWQGKPKLNKVNVTYH

SEQ ID NO: 2081224 - protein, 26 aa, Staphylococcus
QKLLKKDFTLSLEKQFVFIDKISEKA

SEQ ID NO: 2081225 - protein, 18 aa, Staphylococcus
QKLLNNMWEFPMYEAEAE

SEQ ID NO: 2081226 - protein, 24 aa, Staphylococcus
QKLNLIQCLLKQADIYILDEPFSG

SEQ ID NO: 2081227 - protein, 33 aa, Staphylococcus
QKLSLENYVLIYYLERIIHQANIRLDIMSGRRY

SEQ ID NO: 2081228 - protein, 21 aa, Staphylococcus
QKMEHIFDWIDITFPELDKVI

SEQ ID NO: 2081229 - protein, 17 aa, Staphylococcus
QKMSIKPGSKPFNVVMT

SEQ ID NO: 2081230 - protein, 20 aa, Staphylococcus
QKNIDNPHKDLRRARSCNES

SEQ ID NO: 2081231 - protein, 23 aa, Staphylococcus
QKPMPEFFDYIFKEIGEQQRESA

SEQ ID NO: 2081232 - protein, 22 aa, Staphylococcus
QKPMREFFDYIFNEIGNINREE

SEQ ID NO: 2081233 - protein, 17 aa, Staphylococcus
QKQFGNVSLLDTPTFFF

SEQ ID NO: 2081234 - protein, 24 aa, Staphylococcus
QKQRVAIMRALMNDPKLLLADEPT

SEQ ID NO: 2081235 - protein, 24 aa, Staphylococcus
QKQYKINVIYLVSHALVETGEGQS

SEQ ID NO: 2081236 - protein, 17 aa, Staphylococcus
QKRIRELAFLNKGISIT

SEQ ID NO: 2081237 - protein, 19 aa, Staphylococcus
QKRIRELAFLNKGISITLR

SEQ ID NO: 2081238 - protein, 22 aa, Staphylococcus
QKRLTQLYDLLSQYFKESKIED

SEQ ID NO: 2081239 - protein, 21 aa, Staphylococcus
QKSFQIILPIHDAIMIECDDE

SEQ ID NO: 2081240 - protein, 21 aa, Staphylococcus
QKSHIWFHTKDIPGSHVVILN

SEQ ID NO: 2081241 - protein, 18 aa, Staphylococcus
QKSKFTAKFLHYKNKPFK

SEQ ID NO: 2081242 - protein, 17 aa, Staphylococcus
QKSPAFFDKKKLAWVNN

SEQ ID NO: 2081243 - protein, 18 aa, Staphylococcus
QKTLAQMPVNLSTRLFNT

SEQ ID NO: 2081244 - protein, 24 aa, Staphylococcus
QKTYFVSMMGYSPGFPYLTGMNER

SEQ ID NO: 2081245 - protein, 20 aa, Staphylococcus
QKVAREQGVMSKEALELKEK

SEQ ID NO: 2081246 - protein, 19 aa, Staphylococcus
QKVFTLPQDFAIVALTATA

SEQ ID NO: 2081247 - protein, 20 aa, Staphylococcus
QKVIDWLWETQDKTFFDSKE

SEQ ID NO: 2081248 - protein, 18 aa, Staphylococcus
QKVKGGMGILLGGVPGVP

SEQ ID NO: 2081249 - protein, 30 aa, Staphylococcus
QKVSMVFQHFNLLWSRTVLNNIKFPLEIAG

SEQ ID NO: 2081250 - protein, 28 aa, Staphylococcus
QKYDHYRFGIHIALHYLSFKKRTEKEVR

SEQ ID NO: 2081251 - protein, 20 aa, Staphylococcus
QKYDIPIIAQLTASNTNYLV

SEQ ID NO: 2081252 - protein, 21 aa, Staphylococcus
QKYFYLKYLKQSSSTHRMTYW

SEQ ID NO: 2081253 - protein, 27 aa, Staphylococcus
QKYGKRIFRLYRNCFYYKEIDKEIQNI

SEQ ID NO: 2081254 - protein, 22 aa, Staphylococcus
QKYLDFFVEKGHMVEPSAPLVP

SEQ ID NO: 2081255 - protein, 21 aa, Staphylococcus
QKYTIAKFYKLYMERSNEGQS

SEQ ID NO: 2081256 - protein, 20 aa, Staphylococcus
QKYYSIMAYGKSGTGKTTLA

SEQ ID NO: 2081257 - protein, 22 aa, Staphylococcus
QKYYTPLEFGKLRKAAMDKGFK

SEQ ID NO: 2081258 - protein, 30 aa, Staphylococcus
QLAACSGFMYSLITAKQYIASGDYQNILVV

SEQ ID NO: 2081259 - protein, 28 aa, Staphylococcus
QLAEDIAFGFYITTSTLRILIIPDEIKG

SEQ ID NO: 2081260 - protein, 19 aa, Staphylococcus
QLAIDKAREYNKSKIWLGV

SEQ ID NO: 2081261 - protein, 22 aa, Staphylococcus
QLAMRAIIGEKLADLGYQPGVQ

SEQ ID NO: 2081262 - protein, 22 aa, Staphylococcus
QLAMRAILGEKLSDLGYQPGLQ

SEQ ID NO: 2081263 - protein, 19 aa, Staphylococcus
QLAQYLLKKERGVLITPQN

SEQ ID NO: 2081264 - protein, 30 aa, Staphylococcus
QLASINVPEPRLLVVSPYDKTSLSDIERAI

SEQ ID NO: 2081265 - protein, 30 aa, Staphylococcus
QLATKLIFMRDGHILLQEDKHILLTDYGII

SEQ ID NO: 2081266 - protein, 35 aa, Staphylococcus
QLCQFLNIQPSMLKFILKVFLDLEFIKDENGIIKM

SEQ ID NO: 2081267 - protein, 17 aa, Staphylococcus
QLDADLSPKFVVGYVKT

SEQ ID NO: 2081268 - protein, 25 aa, Staphylococcus
QLDDIAKMILLDQLFEQLQLNKAFS

SEQ ID NO: 2081269 - protein, 30 aa, Staphylococcus
QLDINIGFSDIYFYVDFLNKNESQLLELNE

SEQ ID NO: 2081270 - protein, 25 aa, Staphylococcus
QLDKCFYKYYGLNKLINILINEKPD

SEQ ID NO: 2081271 - protein, 19 aa, Staphylococcus
QLDKGVIVTIFPDGSDRYM

SEQ ID NO: 2081272 - protein, 17 aa, Staphylococcus
QLDLIYRYMQVNDNTII

SEQ ID NO: 2081273 - protein, 29 aa, Staphylococcus
QLDQLIAETPYPHYLKKLKKRKPHQLSYE

SEQ ID NO: 2081274 - protein, 18 aa, Staphylococcus
QLDYIDLYYIHFPDENTP

SEQ ID NO: 2081275 - protein, 17 aa, Staphylococcus
QLEAMLIVMDKDAILVV

SEQ ID NO: 2081276 - protein, 19 aa, Staphylococcus
QLEAMLIVMDKNSILVVSG

SEQ ID NO: 2081277 - protein, 21 aa, Staphylococcus
QLEDWHITLPNIVKLQKDFEY

SEQ ID NO: 2081278 - protein, 25 aa, Staphylococcus
QLEIDVAFTSLLTRALETTQYILAQ

SEQ ID NO: 2081279 - protein, 25 aa, Staphylococcus
QLEMVTKILLKRLKNIKLKTMNLEE

SEQ ID NO: 2081280 - protein, 26 aa, Staphylococcus
QLENESLYCLMPFANSIKKKLEQLIK

SEQ ID NO: 2081281 - protein, 24 aa, Staphylococcus
QLEQQIKLVSKLKGLFPKIELHLY

SEQ ID NO: 2081282 - protein, 26 aa, Staphylococcus
QLEREGFHILAIKDMAGLLKPKAAYE

SEQ ID NO: 2081283 - protein, 22 aa, Staphylococcus
QLESYIMMELTKIKGATVKLDS

SEQ ID NO: 2081284 - protein, 23 aa, Staphylococcus
QLFDAFLDLDYFKEIPRVFSDLK

SEQ ID NO: 2081285 - protein, 23 aa, Staphylococcus
QLFDAMVMTPYFPKPDVLVYLEC

SEQ ID NO: 2081286 - protein, 20 aa, Staphylococcus
QLFIGAGIGVTPLVSMFDEV

SEQ ID NO: 2081287 - protein, 19 aa, Staphylococcus
QLFIGAGIGVTPLVSMFNE

SEQ ID NO: 2081288 - protein, 27 aa, Staphylococcus
QLFNDTPLDEVLLSTSSLFLPQTLFLQ

SEQ ID NO: 2081289 - protein, 26 aa, Staphylococcus
QLFYSTQIPVCLWFISNNKGQNGKKE

SEQ ID NO: 2081290 - protein, 26 aa, Staphylococcus
QLGADALMLITPYYNKTNQRGLVQHF

SEQ ID NO: 2081291 - protein, 20 aa, Staphylococcus
QLGFMRSAALEYAKYGITVN

SEQ ID NO: 2081292 - protein, 18 aa, Staphylococcus
QLGHQVIFATARPIRDLL

SEQ ID NO: 2081293 - protein, 17 aa, Staphylococcus
QLGIIDDKIVPDSIMGS

SEQ ID NO: 2081294 - protein, 17 aa, Staphylococcus
QLGITPYHRKTFEPVKS

SEQ ID NO: 2081295 - protein, 24 aa, Staphylococcus
QLGLKSYLQLKFPDKTIYAVGESE

SEQ ID NO: 2081296 - protein, 20 aa, Staphylococcus
QLGNKLIQLALDYQSRDNIS

SEQ ID NO: 2081297 - protein, 31 aa, Staphylococcus
QLGYLADTSYPDLLFGFIHVPYIPEQVTDKP

SEQ ID NO: 2081298 - protein, 19 aa, Staphylococcus
QLGYRLLMHHTIVTLTDLE

SEQ ID NO: 2081299 - protein, 19 aa, Staphylococcus
QLGYTRYWVAEHHNVFSVA

SEQ ID NO: 2081300 - protein, 26 aa, Staphylococcus
QLHDIDLPLEIYVELIYSVQNEMVYK

SEQ ID NO: 2081301 - protein, 21 aa, Staphylococcus
QLHEFLIHLTGVLETGYFLDM

SEQ ID NO: 2081302 - protein, 17 aa, Staphylococcus
QLHILIHPHFNIDMNKD

SEQ ID NO: 2081303 - protein, 25 aa, Staphylococcus
QLHLQNVFCLTVLPKSIKEKLPSDI

SEQ ID NO: 2081304 - protein, 20 aa, Staphylococcus
QLHNGQFVSPVPFNVTFEQS

SEQ ID NO: 2081305 - protein, 20 aa, Staphylococcus
QLIAVERLYPFPEEDIKKAL

SEQ ID NO: 2081306 - protein, 17 aa, Staphylococcus
QLICNLFKPGDEVLVAF

SEQ ID NO: 2081307 - protein, 18 aa, Staphylococcus
QLIEEGLEWVLIQGQMGI

SEQ ID NO: 2081308 - protein, 20 aa, Staphylococcus
QLIEGLIHFVSRQAMNIDGL

SEQ ID NO: 2081309 - protein, 18 aa, Staphylococcus
QLIGMRASSDFVRHGEKK

SEQ ID NO: 2081310 - protein, 19 aa, Staphylococcus
QLIIIHDDYLDRTTSISGE

SEQ ID NO: 2081311 - protein, 43 aa, Staphylococcus
QLIIPIDMTLPYYAGLSFRTLMPKYPKLFPHIKLSTNVHITGE

SEQ ID NO: 2081312 - protein, 30 aa, Staphylococcus
QLIKSYLEDYPTIPYVIDPVMLAKSGDSLM

SEQ ID NO: 2081313 - protein, 23 aa, Staphylococcus
QLINDFSYRYRIPWIYGGVVQST

SEQ ID NO: 2081314 - protein, 18 aa, Staphylococcus
QLIQRLPSIGPFEYVYDA

SEQ ID NO: 2081315 - protein, 25 aa, Staphylococcus
QLISKCGIILPTDRLELFDGHRYDL

SEQ ID NO: 2081316 - protein, 17 aa, Staphylococcus
QLIVLLHGFISDSRTFD

SEQ ID NO: 2081317 - protein, 26 aa, Staphylococcus
QLKDGKAYLSLYRAALARSEADWIVG

SEQ ID NO: 2081318 - protein, 18 aa, Staphylococcus
QLKDIQIMPVIRATSFDK

SEQ ID NO: 2081319 - protein, 31 aa, Staphylococcus
QLKHLEPEQLLLPLFQFYQNKYPNICGHIQD

SEQ ID NO: 2081320 - protein, 19 aa, Staphylococcus
QLKHSISEIPNIKNLLQAF

SEQ ID NO: 2081321 - protein, 24 aa, Staphylococcus
QLKHTKIYCQWLSNLTTALETGEI

SEQ ID NO: 2081322 - protein, 20 aa, Staphylococcus
QLKIVQIEVLYVKPDFRRQG

SEQ ID NO: 2081323 - protein, 23 aa, Staphylococcus
QLKKDEFVLFDLGVIYENYCSDM

SEQ ID NO: 2081324 - protein, 28 aa, Staphylococcus
QLKKKVMVALREPALGPTFGIKGGATGG

SEQ ID NO: 2081325 - protein, 23 aa, Staphylococcus
QLKNKQLAQFRKTSLGFIFQDYS

SEQ ID NO: 2081326 - protein, 17 aa, Staphylococcus
QLKVAMGEALPFKQEDI

SEQ ID NO: 2081327 - protein, 17 aa, Staphylococcus
QLKVAMGEALPFKQKDI

SEQ ID NO: 2081328 - protein, 18 aa, Staphylococcus
QLKVAMGEALPFTQSDIK

SEQ ID NO: 2081329 - protein, 17 aa, Staphylococcus
QLLDEGLEWVLIQGQMG

SEQ ID NO: 2081330 - protein, 20 aa, Staphylococcus
QLLEELPQSIQRYLSNFSVN

SEQ ID NO: 2081331 - protein, 24 aa, Staphylococcus
QLLGIVMPLYVKYGIALEAHLQNS

SEQ ID NO: 2081332 - protein, 18 aa, Staphylococcus
QLLKEVWHYEFYGDLRTV

SEQ ID NO: 2081333 - protein, 24 aa, Staphylococcus
QLLKKFGFIIYFKDKVDMYEMMEQ

SEQ ID NO: 2081334 - protein, 18 aa, Staphylococcus
QLLKKNKVTFIKGEATVT

SEQ ID NO: 2081335 - protein, 26 aa, Staphylococcus
QLLNHSSQLLMYLKEKRKNILDNAYI

SEQ ID NO: 2081336 - protein, 33 aa, Staphylococcus
QLLNRGPRRVSPFFVPMLIPDMATGQVSIDLGA

SEQ ID NO: 2081337 - protein, 20 aa, Staphylococcus
QLLPIPVIGVIEPGARTAIM

SEQ ID NO: 2081338 - protein, 19 aa, Staphylococcus
QLLSEIPHRSSFSYIMMDK

SEQ ID NO: 2081339 - protein, 17 aa, Staphylococcus
QLLTFKDNQFYLSKSDK

SEQ ID NO: 2081340 - protein, 19 aa, Staphylococcus
QLLYIDLHLIHEVTSPQAF

SEQ ID NO: 2081341 - protein, 18 aa, Staphylococcus
QLMDEMDLRLVDFKVEFG

SEQ ID NO: 2081342 - protein, 18 aa, Staphylococcus
QLMDEMELRLVDFKIEFG

SEQ ID NO: 2081343 - protein, 24 aa, Staphylococcus
QLMEEMELRLVDFKVEFGKTHDGE

SEQ ID NO: 2081344 - protein, 20 aa, Staphylococcus
QLMELFRRYYKETETLYLNI

SEQ ID NO: 2081345 - protein, 18 aa, Staphylococcus
QLMKYMKGPDFPTGGIIQ

SEQ ID NO: 2081346 - protein, 17 aa, Staphylococcus
QLMPGIQHLFEEAKIEK

SEQ ID NO: 2081347 - protein, 23 aa, Staphylococcus
QLMSLLKADPFWKEGLVADYTIE

SEQ ID NO: 2081348 - protein, 17 aa, Staphylococcus
QLMYRPDILLLDESTSA

SEQ ID NO: 2081349 - protein, 24 aa, Staphylococcus
QLNDYIALKLFPDSEFETLKKFRI

SEQ ID NO: 2081350 - protein, 24 aa, Staphylococcus
QLNGDLPAFLSPEPGLQSGAMIMQ

SEQ ID NO: 2081351 - protein, 20 aa, Staphylococcus
QLNIGIPTLEDIIKSLKAPN

SEQ ID NO: 2081352 - protein, 17 aa, Staphylococcus
QLNIRLMDQRITIKVSD

SEQ ID NO: 2081353 - protein, 19 aa, Staphylococcus
QLNKNIFTDIYRFENNDLK

SEQ ID NO: 2081354 - protein, 19 aa, Staphylococcus
QLNSFLEPLNLNLEDYRVM

SEQ ID NO: 2081355 - protein, 20 aa, Staphylococcus
QLNTASRFVIILARKNVTAD

SEQ ID NO: 2081356 - protein, 24 aa, Staphylococcus
QLNVPAHPVILGPVSFVQLSRGGD

SEQ ID NO: 2081357 - protein, 19 aa, Staphylococcus
QLPGIQYFPISSGKLRRYI

SEQ ID NO: 2081358 - protein, 17 aa, Staphylococcus
QLPILTDLFKDINDKCD

SEQ ID NO: 2081359 - protein, 24 aa, Staphylococcus
QLPKYDGFYWCRKMRQVSNVPILF

SEQ ID NO: 2081360 - protein, 25 aa, Staphylococcus
QLPKYDGFYWCRKMRQVSNVPILFL

SEQ ID NO: 2081361 - protein, 24 aa, Staphylococcus
QLPKYDGFYWCRQIRQVSNVPILF

SEQ ID NO: 2081362 - protein, 27 aa, Staphylococcus
QLPNYKMVLDSLSYYQFVILKVVVGEQ

SEQ ID NO: 2081363 - protein, 30 aa, Staphylococcus
QLPNYRIVIDSLSYYQFVILRLVVGDERIN

SEQ ID NO: 2081364 - protein, 18 aa, Staphylococcus
QLPSISLADNLRGLGFEV

SEQ ID NO: 2081365 - protein, 25 aa, Staphylococcus
QLQAKPFYEKLGYISIGLPFQEENI

SEQ ID NO: 2081366 - protein, 18 aa, Staphylococcus
QLQALFKLVNDTSHVVYS

SEQ ID NO: 2081367 - protein, 21 aa, Staphylococcus
QLQLQSIFWKNGQLATQIEPG

SEQ ID NO: 2081368 - protein, 31 aa, Staphylococcus
QLQPGDIIITKGPVLFGFFGHSSIAIDHDTV

SEQ ID NO: 2081369 - protein, 24 aa, Staphylococcus
QLQRLNIIRTLLAQPDILICDEIT

SEQ ID NO: 2081370 - protein, 26 aa, Staphylococcus
QLQSYHQDILSIESYYQDIKAKQSKL

SEQ ID NO: 2081371 - protein, 19 aa, Staphylococcus
QLQVRPTHLLIDAMSIDST

SEQ ID NO: 2081372 - protein, 21 aa, Staphylococcus
QLRARLFVDQIISFVKNSPYE

SEQ ID NO: 2081373 - protein, 28 aa, Staphylococcus
QLRGSKIKLIGVLLPSLTNPFFSTIMQS

SEQ ID NO: 2081374 - protein, 20 aa, Staphylococcus
QLRNQLMLVENRISDILSRL

SEQ ID NO: 2081375 - protein, 21 aa, Staphylococcus
QLRQEYLGMIRGQVLHTFSTM

SEQ ID NO: 2081376 - protein, 17 aa, Staphylococcus
QLRRPDLTFATLDHNVP

SEQ ID NO: 2081377 - protein, 25 aa, Staphylococcus
QLSEYRYIAKAWDNRYGCVLAIEIL

SEQ ID NO: 2081378 - protein, 20 aa, Staphylococcus
QLSFKGLPTPNIFTGCGNFH

SEQ ID NO: 2081379 - protein, 20 aa, Staphylococcus
QLSFMGLPTPNIFTGCGNFH

SEQ ID NO: 2081380 - protein, 25 aa, Staphylococcus
QLSIHNILQITWLKRLESSTQTLLK

SEQ ID NO: 2081381 - protein, 25 aa, Staphylococcus
QLSKQIFDLILKFADYGFPRAHAVS

SEQ ID NO: 2081382 - protein, 24 aa, Staphylococcus
QLSKRMPVFFSANMSYGVHALTKI

SEQ ID NO: 2081383 - protein, 18 aa, Staphylococcus
QLSLIAGGPLSKLGYETI

SEQ ID NO: 2081384 - protein, 30 aa, Staphylococcus
QLSMIYVDTGAMYRAITYKYLRTNQTEDFE

SEQ ID NO: 2081385 - protein, 23 aa, Staphylococcus
QLSNPFNVPDFLEDLYLDGKIKD

SEQ ID NO: 2081386 - protein, 17 aa, Staphylococcus
QLSNPYKVPDFLEDLYL

SEQ ID NO: 2081387 - protein, 21 aa, Staphylococcus
QLSQNILFPGKYNETIYYLKP

SEQ ID NO: 2081388 - protein, 19 aa, Staphylococcus
QLSRQIAIQTAPQIRMIQN

SEQ ID NO: 2081389 - protein, 30 aa, Staphylococcus
QLSSVIQPLYDIGAVGMRLLTKYMNEEEIA

SEQ ID NO: 2081390 - protein, 31 aa, Staphylococcus
QLSSVIQPLYDIGAVGMRLLTKYMNEEEIDE

SEQ ID NO: 2081391 - protein, 31 aa, Staphylococcus
QLSSVIQPLYDIGAVGMRLLTKYMNNEDITE

SEQ ID NO: 2081392 - protein, 25 aa, Staphylococcus
QLSTSQILVFGAGALGSHIIDQLAR

SEQ ID NO: 2081393 - protein, 20 aa, Staphylococcus
QLSYMGLPTPNIFTGCDNFH

SEQ ID NO: 2081394 - protein, 17 aa, Staphylococcus
QLTCIFVDHGLLRKGEG

SEQ ID NO: 2081395 - protein, 20 aa, Staphylococcus
QLTIEGIIVVVIYHGHFQGK

SEQ ID NO: 2081396 - protein, 39 aa, Staphylococcus
QLTKKPIGVTAGIVPWNAPILVLLRKVIPAIVTGCSVII

SEQ ID NO: 2081397 - protein, 38 aa, Staphylococcus
QLTKSRFIFLSPEFLLQPHNFKLIKHINLGIIVLDEAH

SEQ ID NO: 2081398 - protein, 19 aa, Staphylococcus
QLTLEKFDIPLKGHSVAVL

SEQ ID NO: 2081399 - protein, 19 aa, Staphylococcus
QLTLSVVNAFFQDIMHEKA

SEQ ID NO: 2081400 - protein, 28 aa, Staphylococcus
QLTNNHMYLATQLLLDYVYHTQKRDLSH

SEQ ID NO: 2081401 - protein, 29 aa, Staphylococcus
QLTQDQPYHLWFDIVQYYAHNHPNILDIG

SEQ ID NO: 2081402 - protein, 26 aa, Staphylococcus
QLTSKTVIISTGARWRKLEVPGEEAL

SEQ ID NO: 2081403 - protein, 18 aa, Staphylococcus
QLTVLKWVQYFIPDFDGD

SEQ ID NO: 2081404 - protein, 24 aa, Staphylococcus
QLVGPLRNAGLIRSIRGAKGGYQL

SEQ ID NO: 2081405 - protein, 21 aa, Staphylococcus
QLVGPLRNAGLIRSVRGAKGG

SEQ ID NO: 2081406 - protein, 24 aa, Staphylococcus
QLVGPLRNAGLIRSVRGAKGGYQL

SEQ ID NO: 2081407 - protein, 26 aa, Staphylococcus
QLVHGQFDHYLLNDLPQFEGKSPSTE

SEQ ID NO: 2081408 - protein, 20 aa, Staphylococcus
QLVIMSYFRENPCPENIPVT

SEQ ID NO: 2081409 - protein, 17 aa, Staphylococcus
QLVLLDINLPTLNGFHW

SEQ ID NO: 2081410 - protein, 17 aa, Staphylococcus
QLVMLKVTIPTKANQYQ

SEQ ID NO: 2081411 - protein, 25 aa, Staphylococcus
QLVNRPDHLLIDAMSLDTTIPQTSI

SEQ ID NO: 2081412 - protein, 26 aa, Staphylococcus
QLVNSDVLVCTVIGFPLGATTTATKI

SEQ ID NO: 2081413 - protein, 24 aa, Staphylococcus
QLVQRIFEKWQIPIIFVTHSNYEA

SEQ ID NO: 2081414 - protein, 27 aa, Staphylococcus
QLVRHYRKLIESLAYKYSKGQSHHEDL

SEQ ID NO: 2081415 - protein, 26 aa, Staphylococcus
QLVSNDFFTIVKWNISGTLNYMKPRE

SEQ ID NO: 2081416 - protein, 17 aa, Staphylococcus
QLWLKSDIDVIITTGGT

SEQ ID NO: 2081417 - protein, 17 aa, Staphylococcus
QLYIHYQPDVVFIECSG

SEQ ID NO: 2081418 - protein, 17 aa, Staphylococcus
QLYQNLKRQNPSPYMYY

SEQ ID NO: 2081419 - protein, 20 aa, Staphylococcus
QLYRRNIFKLMKENFKFIYL

SEQ ID NO: 2081420 - protein, 24 aa, Staphylococcus
QMALIGERLAKVFRIGDTVKVKVS

SEQ ID NO: 2081421 - protein, 24 aa, Staphylococcus
QMANELYHFPVMYLEYSGAYGDIE

SEQ ID NO: 2081422 - protein, 32 aa, Staphylococcus
QMAQLAMRAIIGDKLVDLGYQPGIQPYTEGVF

SEQ ID NO: 2081423 - protein, 30 aa, Staphylococcus
QMAQLAMRSIMGHKLAVLGYHQGIQPYSEG

SEQ ID NO: 2081424 - protein, 17 aa, Staphylococcus
QMDEAFVCYIAMTRATQ

SEQ ID NO: 2081425 - protein, 17 aa, Staphylococcus
QMDEAFVCYIAMTRGSE

SEQ ID NO: 2081426 - protein, 24 aa, Staphylococcus
QMDFNEFDAFYKELKPLADMYNNK

SEQ ID NO: 2081427 - protein, 17 aa, Staphylococcus
QMDKFVHIKPYKRTRTY

SEQ ID NO: 2081428 - protein, 19 aa, Staphylococcus
QMDLLNNLELPLARILADM

SEQ ID NO: 2081429 - protein, 19 aa, Staphylococcus
QMFFYYQSIVEKERRLTAL

SEQ ID NO: 2081430 - protein, 23 aa, Staphylococcus
QMGAMALFGEKYGDIVRVVNMAP

SEQ ID NO: 2081431 - protein, 22 aa, Staphylococcus
QMGILKMKLPIEDLEKMKKKKE

SEQ ID NO: 2081432 - protein, 17 aa, Staphylococcus
QMHVSRLQRNAIKKLQQ

SEQ ID NO: 2081433 - protein, 28 aa, Staphylococcus
QMIEHNAHVLVIFQGPDAYISSTWYETE

SEQ ID NO: 2081434 - protein, 34 aa, Staphylococcus
QMIQAQSAFFNKGNMLKPWFVDSIKNPISKKTFY

SEQ ID NO: 2081435 - protein, 30 aa, Staphylococcus
QMIQAQSAFFNKGNMLKPWFVNKVDNPISK

SEQ ID NO: 2081436 - protein, 33 aa, Staphylococcus
QMIQAQSAFFNKGNMLKPWFVNSIDNPVTKKNF

SEQ ID NO: 2081437 - protein, 34 aa, Staphylococcus
QMIQAQSAFFNKGNMLKPWFVQSIDNPISKKTFY

SEQ ID NO: 2081438 - protein, 34 aa, Staphylococcus
QMIQAQSAFFNNGNMLKPWFVSSIDNPISKKNFY

SEQ ID NO: 2081439 - protein, 26 aa, Staphylococcus
QMIQIDVEPYYILSKKHHLLTIIDNT

SEQ ID NO: 2081440 - protein, 27 aa, Staphylococcus
QMKEMRDNILYYKDLGIDLKGICYPKG

SEQ ID NO: 2081441 - protein, 17 aa, Staphylococcus
QMKSSCLIILTTHHLDE

SEQ ID NO: 2081442 - protein, 18 aa, Staphylococcus
QMLPFVMDTYKNSSREVM

SEQ ID NO: 2081443 - protein, 19 aa, Staphylococcus
QMLRQRGGAIINLSSIVGA

SEQ ID NO: 2081444 - protein, 18 aa, Staphylococcus
QMLRQRGGAIINLSSVVG

SEQ ID NO: 2081445 - protein, 19 aa, Staphylococcus
QMLRQRSGAIINLSSIVAA

SEQ ID NO: 2081446 - protein, 21 aa, Staphylococcus
QMLVPRLEMADAVSLSYIIEA

SEQ ID NO: 2081447 - protein, 30 aa, Staphylococcus
QMMEYVVQYRSVASLLLLDIAVPRDIDPQV

SEQ ID NO: 2081448 - protein, 18 aa, Staphylococcus
QMMKYIHFASRDNARTPM

SEQ ID NO: 2081449 - protein, 23 aa, Staphylococcus
QMMRVILIEQVYRAFKIMRGEAY

SEQ ID NO: 2081450 - protein, 21 aa, Staphylococcus
QMMRVILLEQVYRAFKIMRGE

SEQ ID NO: 2081451 - protein, 20 aa, Staphylococcus
QMMSKYRFSLSGGQLARVQI

SEQ ID NO: 2081452 - protein, 18 aa, Staphylococcus
QMNHEFYAAHAYMAMAAF

SEQ ID NO: 2081453 - protein, 21 aa, Staphylococcus
QMNHEYFAAHAYMAMAAYCDD

SEQ ID NO: 2081454 - protein, 24 aa, Staphylococcus
QMNVHTLFFMFKAEVQDYTTDIQM

SEQ ID NO: 2081455 - protein, 32 aa, Staphylococcus
QMPKLMIESKLKVSLLFCFEPPKSWSKKKKTT

SEQ ID NO: 2081456 - protein, 20 aa, Staphylococcus
QMPNLWSLLSQIDISTYIMA

SEQ ID NO: 2081457 - protein, 18 aa, Staphylococcus
QMQKPSVFFLKDGKAREV

SEQ ID NO: 2081458 - protein, 22 aa, Staphylococcus
QMQKPSVFFLKDGKAREVIKRQ

SEQ ID NO: 2081459 - protein, 23 aa, Staphylococcus
QMQKPSVFFLKDGKAREVIKRQS

SEQ ID NO: 2081460 - protein, 17 aa, Staphylococcus
QMRIAQRWRDIPMLIID

SEQ ID NO: 2081461 - protein, 18 aa, Staphylococcus
QMRLKLTTELLLDAQFLT

SEQ ID NO: 2081462 - protein, 18 aa, Staphylococcus
QMSQIRWLSVLDLKDKTE

SEQ ID NO: 2081463 - protein, 27 aa, Staphylococcus
QMSSEILELYFRIVIAYLKDDDGIIDS

SEQ ID NO: 2081464 - protein, 28 aa, Staphylococcus
QMTWFKNKMDVQWFDRAQTSLPLILDEI

SEQ ID NO: 2081465 - protein, 21 aa, Staphylococcus
QMVYESLLRALEENGLEKIEA

SEQ ID NO: 2081466 - protein, 20 aa, Staphylococcus
QMYIQTWHGTPLKRLANDMK

SEQ ID NO: 2081467 - protein, 17 aa, Staphylococcus
QNAAQILKYFGVDSVNL

SEQ ID NO: 2081468 - protein, 28 aa, Staphylococcus
QNADYFLDLGIKVVVITLGEQGTYYAVE

SEQ ID NO: 2081469 - protein, 28 aa, Staphylococcus
QNAEFEEVIYLLWHYRLPNEEELKELKE

SEQ ID NO: 2081470 - protein, 27 aa, Staphylococcus
QNATQFWQKFIYKLLVDNEALIIKSDD

SEQ ID NO: 2081471 - protein, 28 aa, Staphylococcus
QNAVNEMRALIWQLKPIGLEHGLVNAIE

SEQ ID NO: 2081472 - protein, 23 aa, Staphylococcus
QNDDLHYTLYQTVFNLTSRTMFV

SEQ ID NO: 2081473 - protein, 20 aa, Staphylococcus
QNDDSLKPFILLVVDRKEEG

SEQ ID NO: 2081474 - protein, 29 aa, Staphylococcus
QNDPEGFIDFYHKRLLLADKQPNVVHEWI

SEQ ID NO: 2081475 - protein, 25 aa, Staphylococcus
QNDPQVVDLLIATLGWDPEEQIPVS

SEQ ID NO: 2081476 - protein, 25 aa, Staphylococcus
QNDPSIVELLISTLGWDYEEQVLIN

SEQ ID NO: 2081477 - protein, 24 aa, Staphylococcus
QNDTFLAWQAFRGEVPLSVYHEMT

SEQ ID NO: 2081478 - protein, 25 aa, Staphylococcus
QNDYLDKILPQAFALVREGAKRVFN

SEQ ID NO: 2081479 - protein, 25 aa, Staphylococcus
QNDYLDKILPQAYALVREGAKRVFN

SEQ ID NO: 2081480 - protein, 20 aa, Staphylococcus
QNDYLTNKKARKGYLWFHTK

SEQ ID NO: 2081481 - protein, 24 aa, Staphylococcus
QNEEAFYRTLGRYVNTLNGRYYTA

SEQ ID NO: 2081482 - protein, 28 aa, Staphylococcus
QNEKVIYIKRLRFLDNQLLCIETSYFNK

SEQ ID NO: 2081483 - protein, 20 aa, Staphylococcus
QNEMLLHPVIPMLANSDEID

SEQ ID NO: 2081484 - protein, 17 aa, Staphylococcus
QNEYWNHFDKGIYVDKL

SEQ ID NO: 2081485 - protein, 17 aa, Staphylococcus
QNFEGFSPLITKEITER

SEQ ID NO: 2081486 - protein, 22 aa, Staphylococcus
QNFNLLIKMLKDDKKRIYIVSE

SEQ ID NO: 2081487 - protein, 24 aa, Staphylococcus
QNFVKYDVAPYKYPRAIEFVEELP

SEQ ID NO: 2081488 - protein, 17 aa, Staphylococcus
QNGAFDFVFTQAPYSES

SEQ ID NO: 2081489 - protein, 19 aa, Staphylococcus
QNGDLIIITAGVPTGEKGT

SEQ ID NO: 2081490 - protein, 20 aa, Staphylococcus
QNGEFTEEKLELAKKILISQ

SEQ ID NO: 2081491 - protein, 23 aa, Staphylococcus
QNGFFNEKIKWNFTKFLVDKNGD

SEQ ID NO: 2081492 - protein, 25 aa, Staphylococcus
QNGHKSVVIWFTGLSGSGKSTVSVE

SEQ ID NO: 2081493 - protein, 22 aa, Staphylococcus
QNGIIPVYKMVDTCAAEFESAT

SEQ ID NO: 2081494 - protein, 25 aa, Staphylococcus
QNGMINICFELFDDKIKIIISDQGE

SEQ ID NO: 2081495 - protein, 22 aa, Staphylococcus
QNGPTLIEVKTIIGYGAPNVSG

SEQ ID NO: 2081496 - protein, 20 aa, Staphylococcus
QNHMLQMVALLAMEPPISLN

SEQ ID NO: 2081497 - protein, 19 aa, Staphylococcus
QNHPKLLPVIKKIFHYEND

SEQ ID NO: 2081498 - protein, 20 aa, Staphylococcus
QNILFLLMEDGHHTTYFESF

SEQ ID NO: 2081499 - protein, 24 aa, Staphylococcus
QNINLKGMFFVTQAVLKVMKAQRY

SEQ ID NO: 2081500 - protein, 25 aa, Staphylococcus
QNKHRPVIIYFYGGGFVNGHGSAEL

SEQ ID NO: 2081501 - protein, 17 aa, Staphylococcus
QNKIRVEFKFNELLKPL

SEQ ID NO: 2081502 - protein, 24 aa, Staphylococcus
QNKMQEYDFRWEPSILSQSVSDLK

SEQ ID NO: 2081503 - protein, 21 aa, Staphylococcus
QNKNMLYRLGAFGLNVGSKIS

SEQ ID NO: 2081504 - protein, 17 aa, Staphylococcus
QNLFAKWRKDEKLYSDD

SEQ ID NO: 2081505 - protein, 19 aa, Staphylococcus
QNLFAKWRKEETLYKEDEK

SEQ ID NO: 2081506 - protein, 23 aa, Staphylococcus
QNLKHHILDMSLLSQLTPNALTQ

SEQ ID NO: 2081507 - protein, 18 aa, Staphylococcus
QNNDIYNRPRGKFRFPMH

SEQ ID NO: 2081508 - protein, 24 aa, Staphylococcus
QNNVLNGLLPHNGLFIDTTDSVHD

SEQ ID NO: 2081509 - protein, 28 aa, Staphylococcus
QNNVRQYDFRWQPSILSRSIRDLTVAVI

SEQ ID NO: 2081510 - protein, 18 aa, Staphylococcus
QNPFAHLNKFLSANEDYR

SEQ ID NO: 2081511 - protein, 24 aa, Staphylococcus
QNPSPYMYYINMDEPIIIGSSPES

SEQ ID NO: 2081512 - protein, 25 aa, Staphylococcus
QNPSPYMYYINMEKPIIIGSSPESF

SEQ ID NO: 2081513 - protein, 17 aa, Staphylococcus
QNQIDVPSVLRAHLEFL

SEQ ID NO: 2081514 - protein, 18 aa, Staphylococcus
QNQLPWHLPNDLKHVKQL

SEQ ID NO: 2081515 - protein, 17 aa, Staphylococcus
QNQYFCCVIPSSLMKDA

SEQ ID NO: 2081516 - protein, 22 aa, Staphylococcus
QNRDYNFLLLLDATHLSLTDIN

SEQ ID NO: 2081517 - protein, 26 aa, Staphylococcus
QNREKALKVLKARLYDMKLQEEQQKY

SEQ ID NO: 2081518 - protein, 34 aa, Staphylococcus
QNRENYFAFGAFAQNLMLLLYEAGIGTCWKSPAY

SEQ ID NO: 2081519 - protein, 26 aa, Staphylococcus
QNRIKLKYLFKLSDKKKYILYCPTWR

SEQ ID NO: 2081520 - protein, 29 aa, Staphylococcus
QNRYLTEDIAYGLVLWSSLGRAIDVETPN

SEQ ID NO: 2081521 - protein, 24 aa, Staphylococcus
QNSHYKYIFIFDTEKYWKEHYQTI

SEQ ID NO: 2081522 - protein, 22 aa, Staphylococcus
QNVDFEVYLGLKHISPYIEEAV

SEQ ID NO: 2081523 - protein, 17 aa, Staphylococcus
QNVFLLTEFIQKNQKDK

SEQ ID NO: 2081524 - protein, 22 aa, Staphylococcus
QNVHFEVLLVKMAELIKEGDAP

SEQ ID NO: 2081525 - protein, 24 aa, Staphylococcus
QNVKNILFNLLDSPVKYTQHIGGT

SEQ ID NO: 2081526 - protein, 21 aa, Staphylococcus
QNVLVPGYYLLTLVNEKTEYA

SEQ ID NO: 2081527 - protein, 20 aa, Staphylococcus
QNVMVALREPALGPTFGIKG

SEQ ID NO: 2081528 - protein, 19 aa, Staphylococcus
QNVYKELYYLITELKHRIE

SEQ ID NO: 2081529 - protein, 25 aa, Staphylococcus
QNYTGLFRFIQMFVVSNKMETRYYA

SEQ ID NO: 2081530 - protein, 24 aa, Staphylococcus
QNYTYIKRVISWLEPSYNQRKAED

SEQ ID NO: 2081531 - protein, 21 aa, Staphylococcus
QPADLPFLKFNHETIVSSTDL

SEQ ID NO: 2081532 - protein, 26 aa, Staphylococcus
QPAPADHPWRTMPRNGMTIHYSGMTL

SEQ ID NO: 2081533 - protein, 24 aa, Staphylococcus
QPAPATHPWRTMPRNGMTIHYSGM

SEQ ID NO: 2081534 - protein, 29 aa, Staphylococcus
QPASLFVVPTMLYQFILKGLHTAEIKSIF

SEQ ID NO: 2081535 - protein, 21 aa, Staphylococcus
QPAVNAWLNTLRAGGSKSPVE

SEQ ID NO: 2081536 - protein, 21 aa, Staphylococcus
QPDLLLLDEPTNHLDFESINW

SEQ ID NO: 2081537 - protein, 22 aa, Staphylococcus
QPDLLLLDEPTNHLDFESITWL

SEQ ID NO: 2081538 - protein, 20 aa, Staphylococcus
QPECLMGHPYIINDEWAIVG

SEQ ID NO: 2081539 - protein, 30 aa, Staphylococcus
QPEDFNRPGHLFPLIARTGGVLVRNGHTEA

SEQ ID NO: 2081540 - protein, 30 aa, Staphylococcus
QPELAYFEVLHEMKLIVDLMYEGGMDNVRY

SEQ ID NO: 2081541 - protein, 31 aa, Staphylococcus
QPELAYFEVLHEMKLIVDLMYEGGMETMRYS

SEQ ID NO: 2081542 - protein, 19 aa, Staphylococcus
QPELLLLDEATSALDTANK

SEQ ID NO: 2081543 - protein, 20 aa, Staphylococcus
QPESWGWKQFTDQIALGKLS

SEQ ID NO: 2081544 - protein, 18 aa, Staphylococcus
QPEYLFEEKELLKQTKAQ

SEQ ID NO: 2081545 - protein, 18 aa, Staphylococcus
QPFKIMRVTPFDAQMLPN

SEQ ID NO: 2081546 - protein, 25 aa, Staphylococcus
QPGDTLPIYLKKNPNFKFPFDEETP

SEQ ID NO: 2081547 - protein, 25 aa, Staphylococcus
QPGDTVPIYLKRNPNFKFPKDGDTP

SEQ ID NO: 2081548 - protein, 25 aa, Staphylococcus
QPGDTVPIYLKRNPNFKFPKEGDTP

SEQ ID NO: 2081549 - protein, 25 aa, Staphylococcus
QPGDTVPIYLKRNPNFKFPQESEVP

SEQ ID NO: 2081550 - protein, 25 aa, Staphylococcus
QPGDTVPIYLKRNPNFKFPTEADTP

SEQ ID NO: 2081551 - protein, 23 aa, Staphylococcus
QPGYKIMFNTLRAMYQKHPIKVD

SEQ ID NO: 2081552 - protein, 24 aa, Staphylococcus
QPGYKLMFNTLRAMYEKHPIRVDI

SEQ ID NO: 2081553 - protein, 24 aa, Staphylococcus
QPGYKLMFNTLRAMYHHHPIRVDI

SEQ ID NO: 2081554 - protein, 19 aa, Staphylococcus
QPHHIEGLIFKSAIETLTQ

SEQ ID NO: 2081555 - protein, 23 aa, Staphylococcus
QPHPFAQLLHDSIRLAYNYQISC

SEQ ID NO: 2081556 - protein, 21 aa, Staphylococcus
QPIEFFRYPKMIHDFSLFPIH

SEQ ID NO: 2081557 - protein, 18 aa, Staphylococcus
QPIELKIVLLHHSVARVQ

SEQ ID NO: 2081558 - protein, 17 aa, Staphylococcus
QPILLGTVAVETSEYIS

SEQ ID NO: 2081559 - protein, 17 aa, Staphylococcus
QPILQYLESEKIIELLE

SEQ ID NO: 2081560 - protein, 25 aa, Staphylococcus
QPINLKIILIHHQFSRVQSLAKSYN

SEQ ID NO: 2081561 - protein, 24 aa, Staphylococcus
QPIQDIVNILKDYPRAHLHVDAVQ

SEQ ID NO: 2081562 - protein, 19 aa, Staphylococcus
QPIVVRPIEEHMYEIIAGE

SEQ ID NO: 2081563 - protein, 18 aa, Staphylococcus
QPIVVRPIEENMYEIIAG

SEQ ID NO: 2081564 - protein, 20 aa, Staphylococcus
QPKELVIIGGGYIALEFASM

SEQ ID NO: 2081565 - protein, 24 aa, Staphylococcus
QPKFELMRQFIYPGTTGVTVFGSY

SEQ ID NO: 2081566 - protein, 24 aa, Staphylococcus
QPKMKHTIKKVPKFDWLNGENPND

SEQ ID NO: 2081567 - protein, 17 aa, Staphylococcus
QPLELMPRPYDANISIV

SEQ ID NO: 2081568 - protein, 26 aa, Staphylococcus
QPLFDEALLYYEQFIQEVTLFLEKEN

SEQ ID NO: 2081569 - protein, 24 aa, Staphylococcus
QPLGSLFEQAALLFLDSVVLGLMD

SEQ ID NO: 2081570 - protein, 23 aa, Staphylococcus
QPLVNFYNRMSFHFGTLGNHEFN

SEQ ID NO: 2081571 - protein, 21 aa, Staphylococcus
QPNDLFFATFTKYNDQVDASI

SEQ ID NO: 2081572 - protein, 24 aa, Staphylococcus
QPNSRYMVFYNDGLELYTKTNINS

SEQ ID NO: 2081573 - protein, 23 aa, Staphylococcus
QPNTYYRNGHPLNYNLTFQSIED

SEQ ID NO: 2081574 - protein, 19 aa, Staphylococcus
QPPALYQDLIDRELIRDTE

SEQ ID NO: 2081575 - protein, 27 aa, Staphylococcus
QPRDYMRYLFMDYVEVLYGYEKRLSLS

SEQ ID NO: 2081576 - protein, 17 aa, Staphylococcus
QPRRPCWKPGRRVRWIE

SEQ ID NO: 2081577 - protein, 26 aa, Staphylococcus
QPSANSLYYALNGFPRNLRTDIEGLE

SEQ ID NO: 2081578 - protein, 26 aa, Staphylococcus
QPSANSLYYALNGFPRQLRADINGLE

SEQ ID NO: 2081579 - protein, 20 aa, Staphylococcus
QPSRAMALPVRKSNESPFEF

SEQ ID NO: 2081580 - protein, 28 aa, Staphylococcus
QPTEAQWEAMLLGWKVVGAVKSNAVILS

SEQ ID NO: 2081581 - protein, 19 aa, Staphylococcus
QPTLGMEQPWRYRNKSQIP

SEQ ID NO: 2081582 - protein, 29 aa, Staphylococcus
QPTYFVSMMGYTPGFPYLTGMSKRLFVNH

SEQ ID NO: 2081583 - protein, 17 aa, Staphylococcus
QPVLLGTVAVETSEYIS

SEQ ID NO: 2081584 - protein, 18 aa, Staphylococcus
QPVPIYCRTLYGDITFRN

SEQ ID NO: 2081585 - protein, 21 aa, Staphylococcus
QPVTKYFLWGTSPLNFDGNEP

SEQ ID NO: 2081586 - protein, 21 aa, Staphylococcus
QPYDKWFEIVRHYSQNFNHKP

SEQ ID NO: 2081587 - protein, 20 aa, Staphylococcus
QPYDLWFDIVQQLSVSLPSN

SEQ ID NO: 2081588 - protein, 20 aa, Staphylococcus
QPYTASYELIDHEKGIYAFT

SEQ ID NO: 2081589 - protein, 17 aa, Staphylococcus
QPYVVENGYLFVFVMDY

SEQ ID NO: 2081590 - protein, 22 aa, Staphylococcus
QQAFELDFPYELTPDQAKSIEE

SEQ ID NO: 2081591 - protein, 25 aa, Staphylococcus
QQAKQQSLYKKELAWMRAGVKARST

SEQ ID NO: 2081592 - protein, 19 aa, Staphylococcus
QQAPADFILGYRATPEETR

SEQ ID NO: 2081593 - protein, 21 aa, Staphylococcus
QQAYYILDGLLDKGLISEREA

SEQ ID NO: 2081594 - protein, 18 aa, Staphylococcus
QQCNHLLKILIDKQYDIT

SEQ ID NO: 2081595 - protein, 25 aa, Staphylococcus
QQDDERLFFIGEAIRRGTTLEEIHE

SEQ ID NO: 2081596 - protein, 26 aa, Staphylococcus
QQDDLLKLLNDLAMIFINAGHESLEK

SEQ ID NO: 2081597 - protein, 25 aa, Staphylococcus
QQDGPAIEFTIIGPKIEFSSENSFV

SEQ ID NO: 2081598 - protein, 17 aa, Staphylococcus
QQDILNRADLVVTLCSH

SEQ ID NO: 2081599 - protein, 30 aa, Staphylococcus
QQDQLLKLLNDLAMIFLKAAYEEIIKSFNL

SEQ ID NO: 2081600 - protein, 24 aa, Staphylococcus
QQEDYCIILAYFENGQPKLSYIYD

SEQ ID NO: 2081601 - protein, 23 aa, Staphylococcus
QQEGYCIIIGYFVNGKPKLSYIY

SEQ ID NO: 2081602 - protein, 21 aa, Staphylococcus
QQEIYYEVFPFNGSRIALNED

SEQ ID NO: 2081603 - protein, 24 aa, Staphylococcus
QQEKKEFIFLTLTTPNVMSDELEN

SEQ ID NO: 2081604 - protein, 24 aa, Staphylococcus
QQEKQKALYKQELAWMRAGAKART

SEQ ID NO: 2081605 - protein, 25 aa, Staphylococcus
QQELGRLLLYKMIHRQIDQWEYIGG

SEQ ID NO: 2081606 - protein, 22 aa, Staphylococcus
QQERLNIDPLISKTISLDEINE

SEQ ID NO: 2081607 - protein, 28 aa, Staphylococcus
QQFCFTKRELLDYLERLRMWCDKFEVDI

SEQ ID NO: 2081608 - protein, 25 aa, Staphylococcus
QQFKAHHRIVILTPLHNFNITSRLK

SEQ ID NO: 2081609 - protein, 25 aa, Staphylococcus
QQFLADEFYFKAWKGFYHEIHNEPE

SEQ ID NO: 2081610 - protein, 29 aa, Staphylococcus
QQFTKDCQFLLLRSPLKRQYEDLIKESYV

SEQ ID NO: 2081611 - protein, 30 aa, Staphylococcus
QQGIRKGPNIKLPSFDLLEEPEPHEVDEEW

SEQ ID NO: 2081612 - protein, 25 aa, Staphylococcus
QQGLLDIGLDLPFVMKIAQQLEVSN

SEQ ID NO: 2081613 - protein, 21 aa, Staphylococcus
QQGPTLIEIKTIIGYGSPNKK

SEQ ID NO: 2081614 - protein, 26 aa, Staphylococcus
QQGTTVIIIDHRLDYALDLADNIYYI

SEQ ID NO: 2081615 - protein, 25 aa, Staphylococcus
QQHTEGLWRLKVMLGQDGTLTHQIV

SEQ ID NO: 2081616 - protein, 18 aa, Staphylococcus
QQIALFPHMTIKENIAQV

SEQ ID NO: 2081617 - protein, 19 aa, Staphylococcus
QQIALFPHMTIKENIAQVP

SEQ ID NO: 2081618 - protein, 18 aa, Staphylococcus
QQIIRPTGLLDPKIEVRP

SEQ ID NO: 2081619 - protein, 26 aa, Staphylococcus
QQIKASMVGTFFLQDSKELTEPVVQV

SEQ ID NO: 2081620 - protein, 20 aa, Staphylococcus
QQIRAMVQTYPGIKINSPED

SEQ ID NO: 2081621 - protein, 34 aa, Staphylococcus
QQITEIYELIYKNKPFIRILRTMPQLNEVVGTNY

SEQ ID NO: 2081622 - protein, 19 aa, Staphylococcus
QQIYTDTFDFSKKAPLYMT

SEQ ID NO: 2081623 - protein, 23 aa, Staphylococcus
QQKGYDIELAYEAGLLSRNEENF

SEQ ID NO: 2081624 - protein, 23 aa, Staphylococcus
QQKKFVLGSVSHKVAKRATIPVL

SEQ ID NO: 2081625 - protein, 17 aa, Staphylococcus
QQKQSVNFQNYGKQHAY

SEQ ID NO: 2081626 - protein, 24 aa, Staphylococcus
QQKRKHLEHVASYYKFQTPSLLYD

SEQ ID NO: 2081627 - protein, 24 aa, Staphylococcus
QQKRKIEYLAGRFATKEAFSKALG

SEQ ID NO: 2081628 - protein, 20 aa, Staphylococcus
QQKRWLTQTEVRKLYRCTHS

SEQ ID NO: 2081629 - protein, 19 aa, Staphylococcus
QQLHIPIDKLNIWGGAIAT

SEQ ID NO: 2081630 - protein, 28 aa, Staphylococcus
QQLIEIGIKPFVFPYTAFASFCEQKEID

SEQ ID NO: 2081631 - protein, 24 aa, Staphylococcus
QQLPSYINSTFPYINEIILTVNTD

SEQ ID NO: 2081632 - protein, 28 aa, Staphylococcus
QQLQQLVEIFKGFKFKVNGTLPIDKAFV

SEQ ID NO: 2081633 - protein, 25 aa, Staphylococcus
QQLRKRYNIPTKQAPKLLLKGDGDL

SEQ ID NO: 2081634 - protein, 24 aa, Staphylococcus
QQLSQLHIIVHPRFNLQPDVVDQP

SEQ ID NO: 2081635 - protein, 18 aa, Staphylococcus
QQMNLSHVILTTKINPEL

SEQ ID NO: 2081636 - protein, 20 aa, Staphylococcus
QQNDIFRLIERPCPEWSIVE

SEQ ID NO: 2081637 - protein, 26 aa, Staphylococcus
QQNQKQRALYKQELSWMRAGAKARST

SEQ ID NO: 2081638 - protein, 24 aa, Staphylococcus
QQQAYYIIDGLLDKGLISDREARM

SEQ ID NO: 2081639 - protein, 21 aa, Staphylococcus
QQQFEKILKRMHKRHVRIHPT

SEQ ID NO: 2081640 - protein, 23 aa, Staphylococcus
QQQGLDLQTYYQISGQNEDQLRE

SEQ ID NO: 2081641 - protein, 23 aa, Staphylococcus
QQQGLNLETYFQISGQDESQLRE

SEQ ID NO: 2081642 - protein, 31 aa, Staphylococcus
QQQYREKFYQLPKVFFTNEKYMQLSNDAKIA

SEQ ID NO: 2081643 - protein, 26 aa, Staphylococcus
QQRDAQLLANLYYLKEITPVDMFPHT

SEQ ID NO: 2081644 - protein, 20 aa, Staphylococcus
QQRRDAMLLNWNTYKAIQSQ

SEQ ID NO: 2081645 - protein, 21 aa, Staphylococcus
QQRVCIARTLAIEPDVILMDE

SEQ ID NO: 2081646 - protein, 23 aa, Staphylococcus
QQRVMIARALISNPELLILDEPA

SEQ ID NO: 2081647 - protein, 23 aa, Staphylococcus
QQSELFYQWLQDGAAIYVCGDEK

SEQ ID NO: 2081648 - protein, 25 aa, Staphylococcus
QQSFTHIELPQHALLSCYPNASLLD

SEQ ID NO: 2081649 - protein, 22 aa, Staphylococcus
QQSPFQMSGGQMRKIAITSILA

SEQ ID NO: 2081650 - protein, 26 aa, Staphylococcus
QQSQIITYSYFLAPALHFLKHFSTTN

SEQ ID NO: 2081651 - protein, 18 aa, Staphylococcus
QQSQRERKLMKMFEENRI

SEQ ID NO: 2081652 - protein, 24 aa, Staphylococcus
QQTHFIYQLIQPPSPSQFFNDPML

SEQ ID NO: 2081653 - protein, 25 aa, Staphylococcus
QQTKGHYVALYLTYESAPFFNNQLE

SEQ ID NO: 2081654 - protein, 20 aa, Staphylococcus
QQTKGKFLIIGTGGIFSSED

SEQ ID NO: 2081655 - protein, 17 aa, Staphylococcus
QQTSYMIEQLLSGLDIA

SEQ ID NO: 2081656 - protein, 23 aa, Staphylococcus
QQTSYPVVLKPIYGSGSMDVYII

SEQ ID NO: 2081657 - protein, 25 aa, Staphylococcus
QQTTQNLIIPIYGKAESLNVAIAGS

SEQ ID NO: 2081658 - protein, 21 aa, Staphylococcus
QQVIKLTWWDKENLSDDVICD

SEQ ID NO: 2081659 - protein, 26 aa, Staphylococcus
QQVKNVTMELGGLAPLIVHNDADIEA

SEQ ID NO: 2081660 - protein, 25 aa, Staphylococcus
QQYITPFNIYFAITNLYGYASLERV

SEQ ID NO: 2081661 - protein, 17 aa, Staphylococcus
QQYLELVPERSTFENKA

SEQ ID NO: 2081662 - protein, 18 aa, Staphylococcus
QQYLEVPIAYPNEVFVTS

SEQ ID NO: 2081663 - protein, 34 aa, Staphylococcus
QQYLKIKSQYQDCLLFFRLGDFYEMFFEDAKEAS

SEQ ID NO: 2081664 - protein, 34 aa, Staphylococcus
QQYLKIKSQYQDCLLFFRLGDFYEMFFEDAKVAS

SEQ ID NO: 2081665 - protein, 34 aa, Staphylococcus
QQYLNIKAQYNDCLLFFRLGDFYEMFFDDAKEAS

SEQ ID NO: 2081666 - protein, 22 aa, Staphylococcus
QQYLPDILKNRIYYEPKTTSKS

SEQ ID NO: 2081667 - protein, 29 aa, Staphylococcus
QQYTGVDFPKLFKAFKDMGIIVNTVNIEQ

SEQ ID NO: 2081668 - protein, 25 aa, Staphylococcus
QRAELYEMLTDREMEILLLIANGYS

SEQ ID NO: 2081669 - protein, 31 aa, Staphylococcus
QRAELYEMLTEREMEILLLIAKGYSNQEIAS

SEQ ID NO: 2081670 - protein, 27 aa, Staphylococcus
QRDINTINLFFYESDFWRFQQTKVIYN

SEQ ID NO: 2081671 - protein, 26 aa, Staphylococcus
QRDVEYPLFFVLNRSLGINLEKVLKN

SEQ ID NO: 2081672 - protein, 17 aa, Staphylococcus
QREIIYGERNNIIDSES

SEQ ID NO: 2081673 - protein, 28 aa, Staphylococcus
QRELEHPNSYFYFLYDNDKVVGYLKLNV

SEQ ID NO: 2081674 - protein, 25 aa, Staphylococcus
QREPLIGTMSLIPQIVDHVSIPVVA

SEQ ID NO: 2081675 - protein, 32 aa, Staphylococcus
QREQKLYLMIAERFIENLLPPYEYDAVKVVCK

SEQ ID NO: 2081676 - protein, 18 aa, Staphylococcus
QRESESMWFKKDGKFIYV

SEQ ID NO: 2081677 - protein, 25 aa, Staphylococcus
QRESKIYMMIAQRYLENLMPPHEYE

SEQ ID NO: 2081678 - protein, 32 aa, Staphylococcus
QRESLAHAFHLWLLRINYLDQPKFYPSTSYAA

SEQ ID NO: 2081679 - protein, 25 aa, Staphylococcus
QREVTGKWSWLAPPISPTLTNNYHH

SEQ ID NO: 2081680 - protein, 36 aa, Staphylococcus
QREWERVPQPTRAEHVKLLIPLLEQNRDEIAQLYVK

SEQ ID NO: 2081681 - protein, 24 aa, Staphylococcus
QRFNVLRTVMLQPDILICDEITAS

SEQ ID NO: 2081682 - protein, 18 aa, Staphylococcus
QRFYRPAIQALHNLGATD

SEQ ID NO: 2081683 - protein, 24 aa, Staphylococcus
QRGITFGLFRLSVGLEQPDELIAD

SEQ ID NO: 2081684 - protein, 26 aa, Staphylococcus
QRGQQYLKYLKKQFPNRLYVTNINKE

SEQ ID NO: 2081685 - protein, 24 aa, Staphylococcus
QRGYGPLLEGFLKVDFGDVDQLKD

SEQ ID NO: 2081686 - protein, 18 aa, Staphylococcus
QRIAIARQLMYQPEILLL

SEQ ID NO: 2081687 - protein, 20 aa, Staphylococcus
QRIALIMSIVREAKFLIADE

SEQ ID NO: 2081688 - protein, 19 aa, Staphylococcus
QRIALVMSIVREAKLLIVD

SEQ ID NO: 2081689 - protein, 23 aa, Staphylococcus
QRIGIRMADLLDKETFEKLLKSN

SEQ ID NO: 2081690 - protein, 22 aa, Staphylococcus
QRIGIRMGDLVEKETFERLLKQ

SEQ ID NO: 2081691 - protein, 24 aa, Staphylococcus
QRIKLIRHLNSPLSDLIYIIDEPS

SEQ ID NO: 2081692 - protein, 22 aa, Staphylococcus
QRIRMPFLRSPFVHHCHPNPFH

SEQ ID NO: 2081693 - protein, 18 aa, Staphylococcus
QRKIDVEPVFGFMKAILG

SEQ ID NO: 2081694 - protein, 22 aa, Staphylococcus
QRKMMLESIRYVDLVIPEEGWG

SEQ ID NO: 2081695 - protein, 22 aa, Staphylococcus
QRKMMLESIRYVDLVIPEENWG

SEQ ID NO: 2081696 - protein, 28 aa, Staphylococcus
QRKPSLNGWILHIPSVYLGIAQAARDYA

SEQ ID NO: 2081697 - protein, 17 aa, Staphylococcus
QRKRPATAKPVLLGITK

SEQ ID NO: 2081698 - protein, 28 aa, Staphylococcus
QRLEENPSWILQPYPIAIPHMKDAMFKQ

SEQ ID NO: 2081699 - protein, 21 aa, Staphylococcus
QRLFGELITANIYRIKQGDKT

SEQ ID NO: 2081700 - protein, 20 aa, Staphylococcus
QRLGNVDWTGNLFITAINAK

SEQ ID NO: 2081701 - protein, 18 aa, Staphylococcus
QRLHFYLVDIFRKKSRQL

SEQ ID NO: 2081702 - protein, 22 aa, Staphylococcus
QRLKLIRHLNSSLSDLVYIIDE

SEQ ID NO: 2081703 - protein, 23 aa, Staphylococcus
QRLMNDINKFDLVLVYKLDRLTR

SEQ ID NO: 2081704 - protein, 17 aa, Staphylococcus
QRLNFYLIDLFRKENLK

SEQ ID NO: 2081705 - protein, 24 aa, Staphylococcus
QRLNTDYIDLYYTHLWDGQTPVEE

SEQ ID NO: 2081706 - protein, 21 aa, Staphylococcus
QRLRTLFPYIKEASENHKKRV

SEQ ID NO: 2081707 - protein, 17 aa, Staphylococcus
QRQFIGVDFLGISYAAV

SEQ ID NO: 2081708 - protein, 18 aa, Staphylococcus
QRQLLDEATLFKVQKQFG

SEQ ID NO: 2081709 - protein, 17 aa, Staphylococcus
QRQLRRPDLTFATLDHN

SEQ ID NO: 2081710 - protein, 23 aa, Staphylococcus
QRRAIRMTMQTLKPLFQSDNDIV

SEQ ID NO: 2081711 - protein, 23 aa, Staphylococcus
QRRHEPMVLIDIAVPRDIDPAIE

SEQ ID NO: 2081712 - protein, 26 aa, Staphylococcus
QRRPNGWILHIPSTYLGIAQAARDYA

SEQ ID NO: 2081713 - protein, 19 aa, Staphylococcus
QRRRFVSIVFGQTNQYLQN

SEQ ID NO: 2081714 - protein, 25 aa, Staphylococcus
QRSADIFLGVPFNIASYALLTHLVA

SEQ ID NO: 2081715 - protein, 26 aa, Staphylococcus
QRSADIFLGVPFNIASYSLLTHLIAK

SEQ ID NO: 2081716 - protein, 26 aa, Staphylococcus
QRSADIFLGVPFNIASYSLLTHLVAK

SEQ ID NO: 2081717 - protein, 25 aa, Staphylococcus
QRSFSHIELPDKAFLSCYPNASLLD

SEQ ID NO: 2081718 - protein, 30 aa, Staphylococcus
QRSMPWRETTNPYYIWLSEVMLQQTQVKTV

SEQ ID NO: 2081719 - protein, 25 aa, Staphylococcus
QRTSAARAFITLPKIIFADEPTGAL

SEQ ID NO: 2081720 - protein, 25 aa, Staphylococcus
QRTSAARAFITYPKIIFADEPTGAL

SEQ ID NO: 2081721 - protein, 20 aa, Staphylococcus
QRVAIARAIINEPKFIIADE

SEQ ID NO: 2081722 - protein, 20 aa, Staphylococcus
QRVAIARALVTDPKILLCDE

SEQ ID NO: 2081723 - protein, 20 aa, Staphylococcus
QRVAIARALVTNPKILLCDE

SEQ ID NO: 2081724 - protein, 22 aa, Staphylococcus
QRVAIARALVTNPKILLCDEAT

SEQ ID NO: 2081725 - protein, 23 aa, Staphylococcus
QRVALVMAIVREAQFLIADEPTS

SEQ ID NO: 2081726 - protein, 24 aa, Staphylococcus
QRVGIARALALKPKLIILDEPVSA

SEQ ID NO: 2081727 - protein, 23 aa, Staphylococcus
QRVGIARALINQPKLLLADEPTG

SEQ ID NO: 2081728 - protein, 21 aa, Staphylococcus
QRVGPIKLHIVPFTNLQKQIN

SEQ ID NO: 2081729 - protein, 20 aa, Staphylococcus
QRVLLALINKGMVREEAYDK

SEQ ID NO: 2081730 - protein, 17 aa, Staphylococcus
QRVLVARALMSESTLYL

SEQ ID NO: 2081731 - protein, 20 aa, Staphylococcus
QRYEDWISEFNACPVVRVNI

SEQ ID NO: 2081732 - protein, 18 aa, Staphylococcus
QRYVSNNYTIVVLVETET

SEQ ID NO: 2081733 - protein, 22 aa, Staphylococcus
QSAFEMDFPYELTPDQAKSIDE

SEQ ID NO: 2081734 - protein, 20 aa, Staphylococcus
QSAFLSDYYYYLIEIGQIKQ

SEQ ID NO: 2081735 - protein, 17 aa, Staphylococcus
QSAVILFKSLGFIIEGE

SEQ ID NO: 2081736 - protein, 25 aa, Staphylococcus
QSAYHILDLVFWFGKLEILKAHGVN

SEQ ID NO: 2081737 - protein, 21 aa, Staphylococcus
QSCPIQIKALLNQAGYNDTIN

SEQ ID NO: 2081738 - protein, 28 aa, Staphylococcus
QSDDDVIKFLKYFTFLNKEEIERLEASR

SEQ ID NO: 2081739 - protein, 29 aa, Staphylococcus
QSDEDVIKFLKYFTFLSKEDINRLEQSRD

SEQ ID NO: 2081740 - protein, 27 aa, Staphylococcus
QSDEDVIKFLKYFTFLSKEEIDQLEQS

SEQ ID NO: 2081741 - protein, 25 aa, Staphylococcus
QSDEKTIQYFYHKSQLKLTTDAGVF

SEQ ID NO: 2081742 - protein, 32 aa, Staphylococcus
QSDTLIFIYPLYWLNMPMLLKGFIDMTFWPNE

SEQ ID NO: 2081743 - protein, 25 aa, Staphylococcus
QSECKRAIILPNNKNILMASEQAAE

SEQ ID NO: 2081744 - protein, 27 aa, Staphylococcus
QSEEMAQLYNFLGLSVGLNLNSKSTEE

SEQ ID NO: 2081745 - protein, 20 aa, Staphylococcus
QSEFLSDYYFYLLEIGHKDK

SEQ ID NO: 2081746 - protein, 21 aa, Staphylococcus
QSEFLSDYYFYLLEIGQKDTA

SEQ ID NO: 2081747 - protein, 26 aa, Staphylococcus
QSEKKEIFLYLMYVYQQIVKADIEYL

SEQ ID NO: 2081748 - protein, 22 aa, Staphylococcus
QSEVPAHVQAGWMLTTIASIGE

SEQ ID NO: 2081749 - protein, 21 aa, Staphylococcus
QSEVPAHVQAGWMLTTIASVG

SEQ ID NO: 2081750 - protein, 18 aa, Staphylococcus
QSEYPWIVKVIIRDQQVF

SEQ ID NO: 2081751 - protein, 17 aa, Staphylococcus
QSFFKIKGETRNCIAIL

SEQ ID NO: 2081752 - protein, 29 aa, Staphylococcus
QSFLESCPNLKWIAWYATGVNSLPLNYVL

SEQ ID NO: 2081753 - protein, 24 aa, Staphylococcus
QSGAEILVIDLYADALLTSLKLNN

SEQ ID NO: 2081754 - protein, 24 aa, Staphylococcus
QSGRKHIILINNYQNNIWSKTIHT

SEQ ID NO: 2081755 - protein, 20 aa, Staphylococcus
QSHLLGLSLLGINEILTITG

SEQ ID NO: 2081756 - protein, 19 aa, Staphylococcus
QSHTCVENLIYAFKTNNIK

SEQ ID NO: 2081757 - protein, 21 aa, Staphylococcus
QSIALNLEPYSNSVWLFDVGE

SEQ ID NO: 2081758 - protein, 21 aa, Staphylococcus
QSIFGGIIALNRTVTSDLAET

SEQ ID NO: 2081759 - protein, 31 aa, Staphylococcus
QSIKVCPLIHWTWDNVWDYIKSNELPYNILH

SEQ ID NO: 2081760 - protein, 18 aa, Staphylococcus
QSILQDRAFKNDKIDFIW

SEQ ID NO: 2081761 - protein, 27 aa, Staphylococcus
QSIMRAKRIILLAFGERKQEAIDRLVN

SEQ ID NO: 2081762 - protein, 18 aa, Staphylococcus
QSIRILTGAKISKVTTSK

SEQ ID NO: 2081763 - protein, 23 aa, Staphylococcus
QSIVSRWIKKLVNLGYVVRHQSH

SEQ ID NO: 2081764 - protein, 21 aa, Staphylococcus
QSIVTLLKYNLETAGYIVDVA

SEQ ID NO: 2081765 - protein, 21 aa, Staphylococcus
QSIVTLLKYNLETAGYIVEVA

SEQ ID NO: 2081766 - protein, 24 aa, Staphylococcus
QSKAQKLFEQWRKEETLYKEDEKD

SEQ ID NO: 2081767 - protein, 18 aa, Staphylococcus
QSKCLILFTSYKMMHMVQ

SEQ ID NO: 2081768 - protein, 22 aa, Staphylococcus
QSKIVFDSKLMSWIEQRHLKVE

SEQ ID NO: 2081769 - protein, 17 aa, Staphylococcus
QSKLKRIFKRTKASVNE

SEQ ID NO: 2081770 - protein, 25 aa, Staphylococcus
QSKLRKKYLEAFRKGFKQQIESTKV

SEQ ID NO: 2081771 - protein, 25 aa, Staphylococcus
QSKLRKQYLDSFRKGFKQQLENTKV

SEQ ID NO: 2081772 - protein, 24 aa, Staphylococcus
QSKQDLIIVIYDNDIKNIKNVLAT

SEQ ID NO: 2081773 - protein, 25 aa, Staphylococcus
QSLGKRLVFIAWETNFDNYTPAGQQ

SEQ ID NO: 2081774 - protein, 21 aa, Staphylococcus
QSLGVLSLLIKLQSLTPILHY

SEQ ID NO: 2081775 - protein, 18 aa, Staphylococcus
QSLIDYLGMETSELEDER

SEQ ID NO: 2081776 - protein, 29 aa, Staphylococcus
QSLKGALFTSLLLEKMKMKTVPKYNVKRT

SEQ ID NO: 2081777 - protein, 26 aa, Staphylococcus
QSLKGALFTSLLLEKMNMNTVPKYDA

SEQ ID NO: 2081778 - protein, 28 aa, Staphylococcus
QSLKGALFTSLLLTKLNMRTVPAYDTPR

SEQ ID NO: 2081779 - protein, 27 aa, Staphylococcus
QSLKKRGHDIFLDLKLHDIPNTVSKAM

SEQ ID NO: 2081780 - protein, 27 aa, Staphylococcus
QSLLDIMTIYEEFKDFAGLNILICGDI

SEQ ID NO: 2081781 - protein, 23 aa, Staphylococcus
QSLLDIMTIYEEYKDFKDLNVLI

SEQ ID NO: 2081782 - protein, 17 aa, Staphylococcus
QSLPKKLSKKRLLQPKA

SEQ ID NO: 2081783 - protein, 26 aa, Staphylococcus
QSLQLLDTPGILWPKFEDEIVGKKLS

SEQ ID NO: 2081784 - protein, 27 aa, Staphylococcus
QSLTATTYLMIIEKLKLFLKEDNYLND

SEQ ID NO: 2081785 - protein, 31 aa, Staphylococcus
QSMEALILPYGFYRCHRSYIINLQKVKEIIS

SEQ ID NO: 2081786 - protein, 24 aa, Staphylococcus
QSMNPLWRIYQFVRFSKVLKNTVI

SEQ ID NO: 2081787 - protein, 26 aa, Staphylococcus
QSMQDKIMYCFYKIKQKAKQHKQGVT

SEQ ID NO: 2081788 - protein, 17 aa, Staphylococcus
QSMTFSMLPDTINFFTW

SEQ ID NO: 2081789 - protein, 24 aa, Staphylococcus
QSNKAILEIIPSYRAIMLTIDITQ

SEQ ID NO: 2081790 - protein, 23 aa, Staphylococcus
QSNKRLNLVKKLIKHYPSHEQKA

SEQ ID NO: 2081791 - protein, 24 aa, Staphylococcus
QSNPTITTLWKIANGLHISLSQLT

SEQ ID NO: 2081792 - protein, 19 aa, Staphylococcus
QSNSIFLGGKVKLIDALNE

SEQ ID NO: 2081793 - protein, 22 aa, Staphylococcus
QSNWDKLMCDFAKAIKSAIENI

SEQ ID NO: 2081794 - protein, 27 aa, Staphylococcus
QSNYTNKLIIYYAPKIIGGSGKYQFFH

SEQ ID NO: 2081795 - protein, 20 aa, Staphylococcus
QSPIYKLAIEYKLAFPLHPE

SEQ ID NO: 2081796 - protein, 20 aa, Staphylococcus
QSPMKRYYLAVKGQIIMTQD

SEQ ID NO: 2081797 - protein, 22 aa, Staphylococcus
QSPNNILSIGYLKGIQQFAPQI

SEQ ID NO: 2081798 - protein, 36 aa, Staphylococcus
QSPNNMLGISYLKAIKRFAPIIKAMTIKREGSHHHH

SEQ ID NO: 2081799 - protein, 20 aa, Staphylococcus
QSPQFMIQDLASNNLQILDY

SEQ ID NO: 2081800 - protein, 21 aa, Staphylococcus
QSPYKMLLSHGFVMDGEGKKM

SEQ ID NO: 2081801 - protein, 25 aa, Staphylococcus
QSQCKRAIILPNNKNILMASEQAAE

SEQ ID NO: 2081802 - protein, 26 aa, Staphylococcus
QSQCKRAIILPNNKNILMASEQAANI

SEQ ID NO: 2081803 - protein, 26 aa, Staphylococcus
QSQCKRAIILPNNKNILMASEQAASI

SEQ ID NO: 2081804 - protein, 24 aa, Staphylococcus
QSQKFFEYYTPLLKNGGLVITDNV

SEQ ID NO: 2081805 - protein, 24 aa, Staphylococcus
QSQRIGIIRALALNPDVLLLDEPT

SEQ ID NO: 2081806 - protein, 27 aa, Staphylococcus
QSQYKRSFQHNLLFTHIPLQEYREVEN

SEQ ID NO: 2081807 - protein, 19 aa, Staphylococcus
QSRHYYLDELGLDHVSDLP

SEQ ID NO: 2081808 - protein, 35 aa, Staphylococcus
QSSEDPITLIPIGPLTNIALLLSTYPEVKDYIKEI

SEQ ID NO: 2081809 - protein, 20 aa, Staphylococcus
QSSGHIFNIASISGFEVTKS

SEQ ID NO: 2081810 - protein, 17 aa, Staphylococcus
QSSGHIINIASISGFEV

SEQ ID NO: 2081811 - protein, 24 aa, Staphylococcus
QSSSKLFEALLNLAKHHLDQTLTN

SEQ ID NO: 2081812 - protein, 17 aa, Staphylococcus
QSSYKLTPQREATVSVL

SEQ ID NO: 2081813 - protein, 31 aa, Staphylococcus
QSTFKFSNPKYLPRFIFGHYMKDYLQQFINQ

SEQ ID NO: 2081814 - protein, 28 aa, Staphylococcus
QSTIVVVPDYQLSLAIGKRGQNARLAAK

SEQ ID NO: 2081815 - protein, 22 aa, Staphylococcus
QSTQLLLDYIQHTQKRDLSHLE

SEQ ID NO: 2081816 - protein, 28 aa, Staphylococcus
QSTVVIVPDYQLSLAIGKRGQNARLAAK

SEQ ID NO: 2081817 - protein, 24 aa, Staphylococcus
QSVIKKVFTLPQNFTIVALTATAT

SEQ ID NO: 2081818 - protein, 26 aa, Staphylococcus
QSVSVLTSILKYLKQYATVILTSHDE

SEQ ID NO: 2081819 - protein, 17 aa, Staphylococcus
QSVVLPETWIKTGDYAY

SEQ ID NO: 2081820 - protein, 21 aa, Staphylococcus
QSVVPLKPLEDTFGLKRVAYT

SEQ ID NO: 2081821 - protein, 26 aa, Staphylococcus
QSVVPLKVLQDAFGLSRVAYTTYQAV

SEQ ID NO: 2081822 - protein, 29 aa, Staphylococcus
QSVVPLKVLQDQFGLKRVAYTTYQAVSGS

SEQ ID NO: 2081823 - protein, 29 aa, Staphylococcus
QSVVPLRVLQEKFGLKRVAYTTYQAVSGS

SEQ ID NO: 2081824 - protein, 25 aa, Staphylococcus
QSYIEGQLLALPGWAGMMYYRAEEN

SEQ ID NO: 2081825 - protein, 17 aa, Staphylococcus
QSYIGLIDRMHPTPALG

SEQ ID NO: 2081826 - protein, 17 aa, Staphylococcus
QSYLIDIQDKGYKVVLA

SEQ ID NO: 2081827 - protein, 22 aa, Staphylococcus
QSYSILFDRYKHDVGYSEAKET

SEQ ID NO: 2081828 - protein, 23 aa, Staphylococcus
QTAFNFFSLFNFNEPVSKVVTHF

SEQ ID NO: 2081829 - protein, 22 aa, Staphylococcus
QTANQLIKIITFAPEVEGATDT

SEQ ID NO: 2081830 - protein, 26 aa, Staphylococcus
QTCQKKRGIMIKKTVSLWIQDLYMLL

SEQ ID NO: 2081831 - protein, 23 aa, Staphylococcus
QTCYQFNLPFIVTRAVSDLANGK

SEQ ID NO: 2081832 - protein, 17 aa, Staphylococcus
QTDGQFLIIGTGGIFNA

SEQ ID NO: 2081833 - protein, 31 aa, Staphylococcus
QTDIDKALERYPNKLIITLGDKGAMYHNGTE

SEQ ID NO: 2081834 - protein, 18 aa, Staphylococcus
QTDLKLPYICLNGAEVRD

SEQ ID NO: 2081835 - protein, 25 aa, Staphylococcus
QTDYIDLYYIHFPDDNTPKDKAVAA

SEQ ID NO: 2081836 - protein, 23 aa, Staphylococcus
QTEDNPLRYALSKLFDKQEETKE

SEQ ID NO: 2081837 - protein, 29 aa, Staphylococcus
QTEGERLIGFIWARYDKTLKTALIEMLYV

SEQ ID NO: 2081838 - protein, 27 aa, Staphylococcus
QTEGIPAGLLTYPPLMAADIVLYNTNI

SEQ ID NO: 2081839 - protein, 29 aa, Staphylococcus
QTEGVPAGLLTYPPLMAADIVIYNTNIVP

SEQ ID NO: 2081840 - protein, 25 aa, Staphylococcus
QTEKILERLPKFINHGKKILSNYKK

SEQ ID NO: 2081841 - protein, 17 aa, Staphylococcus
QTEMFFLCNRYKQAQDI

SEQ ID NO: 2081842 - protein, 25 aa, Staphylococcus
QTESTLLIGFLKDTASRPGAMGKSI

SEQ ID NO: 2081843 - protein, 24 aa, Staphylococcus
QTESTLLIGFLKDTEQRPGSMGKA

SEQ ID NO: 2081844 - protein, 24 aa, Staphylococcus
QTESTLLIGFLKDTESRPGSMGKA

SEQ ID NO: 2081845 - protein, 25 aa, Staphylococcus
QTESTLLIGFLKDTKSRPGSMGKEI

SEQ ID NO: 2081846 - protein, 18 aa, Staphylococcus
QTFIDMCASKIKLLNDLK

SEQ ID NO: 2081847 - protein, 20 aa, Staphylococcus
QTFLDYLENNTLPDIVLLDL

SEQ ID NO: 2081848 - protein, 18 aa, Staphylococcus
QTFLKDTKLFKLQNEQAI

SEQ ID NO: 2081849 - protein, 20 aa, Staphylococcus
QTFMMYLPRLCEHCLNPSCV

SEQ ID NO: 2081850 - protein, 17 aa, Staphylococcus
QTGHIINLIDELALHYP

SEQ ID NO: 2081851 - protein, 22 aa, Staphylococcus
QTGHLIHWYIMTSDINHEATVT

SEQ ID NO: 2081852 - protein, 23 aa, Staphylococcus
QTGIGFALSIERLLLALDEENIE

SEQ ID NO: 2081853 - protein, 18 aa, Staphylococcus
QTHLKWGAQKEVIKLIPG

SEQ ID NO: 2081854 - protein, 23 aa, Staphylococcus
QTHLSRVIVSTKINPDLIGGFRV

SEQ ID NO: 2081855 - protein, 21 aa, Staphylococcus
QTIDDLKAHGFWIVGTEADNA

SEQ ID NO: 2081856 - protein, 20 aa, Staphylococcus
QTIEHWFNYTYQVTLTGNLK

SEQ ID NO: 2081857 - protein, 27 aa, Staphylococcus
QTIFDLYQHLDPEEIFPYAPPQGIEEL

SEQ ID NO: 2081858 - protein, 23 aa, Staphylococcus
QTIFPEAYVPFLQKYNSHIIDGT

SEQ ID NO: 2081859 - protein, 29 aa, Staphylococcus
QTIIQLDIRAQYGISIIAIKRGRDILVSP

SEQ ID NO: 2081860 - protein, 19 aa, Staphylococcus
QTIKFKGFMTLYVESKDEE

SEQ ID NO: 2081861 - protein, 20 aa, Staphylococcus
QTIKFKGFMTLYVETKDDKD

SEQ ID NO: 2081862 - protein, 19 aa, Staphylococcus
QTIKFKGFMTLYVETKDDS

SEQ ID NO: 2081863 - protein, 22 aa, Staphylococcus
QTILGYIPLHWHNDLQLMVVTC

SEQ ID NO: 2081864 - protein, 24 aa, Staphylococcus
QTINAPMVGTFYKSPSPEEDAYVQ

SEQ ID NO: 2081865 - protein, 25 aa, Staphylococcus
QTINAPMVGTFYKSPSPEESAYVQV

SEQ ID NO: 2081866 - protein, 20 aa, Staphylococcus
QTIQGILTQALEAGITMFQF

SEQ ID NO: 2081867 - protein, 20 aa, Staphylococcus
QTIQPILKEKFENLGLIVKE

SEQ ID NO: 2081868 - protein, 20 aa, Staphylococcus
QTIRLDRTYLKIPELRKRIK

SEQ ID NO: 2081869 - protein, 24 aa, Staphylococcus
QTIVSNKPVWFKQGKVTTLKPLDL

SEQ ID NO: 2081870 - protein, 17 aa, Staphylococcus
QTKDMFMNGPSTELLRR

SEQ ID NO: 2081871 - protein, 17 aa, Staphylococcus
QTKFEDIFNNKGSKFDK

SEQ ID NO: 2081872 - protein, 27 aa, Staphylococcus
QTKHRHYIILTLWKDRQSFYDWQSSDA

SEQ ID NO: 2081873 - protein, 17 aa, Staphylococcus
QTKIHLFEALKSWLEEE

SEQ ID NO: 2081874 - protein, 25 aa, Staphylococcus
QTKINLFESLRAWLDEEIVADTWID

SEQ ID NO: 2081875 - protein, 22 aa, Staphylococcus
QTKLDFKFRLPDDMLQAHIQAV

SEQ ID NO: 2081876 - protein, 23 aa, Staphylococcus
QTKTIAFIIPRHDAYYASIIDAI

SEQ ID NO: 2081877 - protein, 19 aa, Staphylococcus
QTLALEDMDLYTAKQFLYA

SEQ ID NO: 2081878 - protein, 20 aa, Staphylococcus
QTLEERLPVWIAQSKKMIKE

SEQ ID NO: 2081879 - protein, 18 aa, Staphylococcus
QTLGYRRYEWKCDALNEP

SEQ ID NO: 2081880 - protein, 25 aa, Staphylococcus
QTLINAIEAWSLNHNIRRIEATVVP

SEQ ID NO: 2081881 - protein, 25 aa, Staphylococcus
QTLINLPFDYIFFTGSDKVGQIVYE

SEQ ID NO: 2081882 - protein, 23 aa, Staphylococcus
QTLNELLVLNAFHVPLHAGKIEE

SEQ ID NO: 2081883 - protein, 29 aa, Staphylococcus
QTLQRDRHAYYIATLALIATSLEKFAVEV

SEQ ID NO: 2081884 - protein, 29 aa, Staphylococcus
QTLQRDRHAYYIATLALIATSMEKFAVEI

SEQ ID NO: 2081885 - protein, 29 aa, Staphylococcus
QTLQRDRHAYYIATLALIATSMEKFAVEV

SEQ ID NO: 2081886 - protein, 27 aa, Staphylococcus
QTLQRDRHAYYIATLALVATSLEKFAV

SEQ ID NO: 2081887 - protein, 26 aa, Staphylococcus
QTLQRDRHAYYVATLALISTSMEKFA

SEQ ID NO: 2081888 - protein, 28 aa, Staphylococcus
QTLRRLARHLKWPILKERHGLFKTEMGL

SEQ ID NO: 2081889 - protein, 21 aa, Staphylococcus
QTMKLPYKFYVGGKLGSGRQW

SEQ ID NO: 2081890 - protein, 24 aa, Staphylococcus
QTMKVFPYKLYLMEKDDVLKFKET

SEQ ID NO: 2081891 - protein, 24 aa, Staphylococcus
QTMNRPRILTLEEALQFINDDELV

SEQ ID NO: 2081892 - protein, 32 aa, Staphylococcus
QTMPEKSFLYSLPYQYYKDYGIRKYGFHGTSH

SEQ ID NO: 2081893 - protein, 32 aa, Staphylococcus
QTMPEQAYLYSLPFHYYKDYGIRKYGFHGTSH

SEQ ID NO: 2081894 - protein, 26 aa, Staphylococcus
QTMPEQAYLYSLPYQYYEDYGIRKYG

SEQ ID NO: 2081895 - protein, 34 aa, Staphylococcus
QTMRHRLYRLSYQLHIEPLLNKYPFEISGGEQQR

SEQ ID NO: 2081896 - protein, 25 aa, Staphylococcus
QTNADTFIMLTDVSNVYINYGKENE

SEQ ID NO: 2081897 - protein, 23 aa, Staphylococcus
QTNAITVMLDYFRRHGINNQNSI

SEQ ID NO: 2081898 - protein, 17 aa, Staphylococcus
QTNLPPSRGLGSSAAIA

SEQ ID NO: 2081899 - protein, 23 aa, Staphylococcus
QTNSLAMMLDYLNNELLNDTDTL

SEQ ID NO: 2081900 - protein, 24 aa, Staphylococcus
QTNWLMNDLIISDTFPYESELYYL

SEQ ID NO: 2081901 - protein, 27 aa, Staphylococcus
QTPLDTITYEQYRQVFDVNVGSIFWGI

SEQ ID NO: 2081902 - protein, 31 aa, Staphylococcus
QTPLFEHGLDLLNELIWNPLIHNKQFDDKFV

SEQ ID NO: 2081903 - protein, 17 aa, Staphylococcus
QTPLVLLESFSDEHVQI

SEQ ID NO: 2081904 - protein, 22 aa, Staphylococcus
QTPNNILGLSYLKAIHNFAPNI

SEQ ID NO: 2081905 - protein, 18 aa, Staphylococcus
QTPPCDTLHFLNKVLKIK

SEQ ID NO: 2081906 - protein, 17 aa, Staphylococcus
QTQFIVITHRKGTMEYS

SEQ ID NO: 2081907 - protein, 26 aa, Staphylococcus
QTRAEWLLLDTFNWSRTDYLIHMNDE

SEQ ID NO: 2081908 - protein, 26 aa, Staphylococcus
QTRDFIYIKDLLQAIWIVIQDDATNG

SEQ ID NO: 2081909 - protein, 22 aa, Staphylococcus
QTRFKIALTLIDKPEGLSIMQL

SEQ ID NO: 2081910 - protein, 25 aa, Staphylococcus
QTRFVYQLIQPPTAYQFFNDPMLSV

SEQ ID NO: 2081911 - protein, 18 aa, Staphylococcus
QTRHYTWPTASAALGRTM

SEQ ID NO: 2081912 - protein, 29 aa, Staphylococcus
QTRMREIQFALYKRKIPLVLVFEGMDAAG

SEQ ID NO: 2081913 - protein, 18 aa, Staphylococcus
QTSIFNSIKTMTAIEPKE

SEQ ID NO: 2081914 - protein, 28 aa, Staphylococcus
QTSITDLMNYLFEIIDPYSINKQGVDEG

SEQ ID NO: 2081915 - protein, 25 aa, Staphylococcus
QTTAIITGNFLLALGLQHLSEIKDK

SEQ ID NO: 2081916 - protein, 27 aa, Staphylococcus
QTTDEILDLLLKIKKSQSLTIVLITHE

SEQ ID NO: 2081917 - protein, 17 aa, Staphylococcus
QTTLLPLADVVTPNIPE

SEQ ID NO: 2081918 - protein, 26 aa, Staphylococcus
QTVEKPFEFRLANFDLDKDTNALVLR

SEQ ID NO: 2081919 - protein, 18 aa, Staphylococcus
QTVGLLLEIQNKLDIEVS

SEQ ID NO: 2081920 - protein, 19 aa, Staphylococcus
QTVGLLLEIQNRLGIEVSI

SEQ ID NO: 2081921 - protein, 20 aa, Staphylococcus
QTVGLLLEIQNRLGIEVSIM

SEQ ID NO: 2081922 - protein, 19 aa, Staphylococcus
QTVLYENLPESFKIMRYHS

SEQ ID NO: 2081923 - protein, 22 aa, Staphylococcus
QTVLYQIVVDMTKLLAPILVHT

SEQ ID NO: 2081924 - protein, 35 aa, Staphylococcus
QTYDVQTPFRTMGLYNMFLFKQKPADLYRQFIDTV

SEQ ID NO: 2081925 - protein, 23 aa, Staphylococcus
QTYNFKNAIIATGSRPIEIPNFK

SEQ ID NO: 2081926 - protein, 26 aa, Staphylococcus
QTYNYKKWIKIITKPAVNQASFTTVD

SEQ ID NO: 2081927 - protein, 17 aa, Staphylococcus
QVAFLVPTTILAQQHYE

SEQ ID NO: 2081928 - protein, 18 aa, Staphylococcus
QVAINHPIFIQGLSYIHS

SEQ ID NO: 2081929 - protein, 27 aa, Staphylococcus
QVAPRKLIIVTHIVTHPAFMVPTPHRL

SEQ ID NO: 2081930 - protein, 18 aa, Staphylococcus
QVASISPELFFQKGPFDG

SEQ ID NO: 2081931 - protein, 23 aa, Staphylococcus
QVASMSDHHLLISKASDDSRTTT

SEQ ID NO: 2081932 - protein, 22 aa, Staphylococcus
QVASMSDHHLLISKASNDDRTT

SEQ ID NO: 2081933 - protein, 23 aa, Staphylococcus
QVASMSDYHLLISKASHDDRTTT

SEQ ID NO: 2081934 - protein, 23 aa, Staphylococcus
QVASMSNHHLLISKASSDDRTTT

SEQ ID NO: 2081935 - protein, 22 aa, Staphylococcus
QVDKFIHYTPAYMYHEPLVKLS

SEQ ID NO: 2081936 - protein, 18 aa, Staphylococcus
QVDKFIHYTPAYMYHESA

SEQ ID NO: 2081937 - protein, 24 aa, Staphylococcus
QVDQFIHYTPAYMYHEPLVKLAKK

SEQ ID NO: 2081938 - protein, 24 aa, Staphylococcus
QVDYIDLYYIHFPDENTPKDKAVA

SEQ ID NO: 2081939 - protein, 24 aa, Staphylococcus
QVDYKYDVIWFSHYHTNGVSVLQI

SEQ ID NO: 2081940 - protein, 22 aa, Staphylococcus
QVDYLEELISKYPIITIEDGMD

SEQ ID NO: 2081941 - protein, 22 aa, Staphylococcus
QVDYLEQLINKYPIITIEDGMD

SEQ ID NO: 2081942 - protein, 23 aa, Staphylococcus
QVEDFEAIFRLSQDRPTIVRLLD

SEQ ID NO: 2081943 - protein, 26 aa, Staphylococcus
QVEFVNNVYIMLNKPKGYISATHDES

SEQ ID NO: 2081944 - protein, 26 aa, Staphylococcus
QVEHMNAWLKPYRKALNLEEPVVNIS

SEQ ID NO: 2081945 - protein, 25 aa, Staphylococcus
QVEKDIYASMLWEGFQPFEIEKIEQ

SEQ ID NO: 2081946 - protein, 27 aa, Staphylococcus
QVELAQLDYLLPRLQGHGRSLSRLGGG

SEQ ID NO: 2081947 - protein, 25 aa, Staphylococcus
QVELAQLDYLMPRLQGHGKSLSRLG

SEQ ID NO: 2081948 - protein, 26 aa, Staphylococcus
QVELAQLDYLMPRLQGHGRSLSRLGG

SEQ ID NO: 2081949 - protein, 25 aa, Staphylococcus
QVENEYFDFVLTNPPIRAGKNVVHR

SEQ ID NO: 2081950 - protein, 23 aa, Staphylococcus
QVFKTLLFINNNHDPYVFVIPVE

SEQ ID NO: 2081951 - protein, 20 aa, Staphylococcus
QVFLNDQILNQLKSLGLNSN

SEQ ID NO: 2081952 - protein, 31 aa, Staphylococcus
QVFLNSNFKKELFPFWKIRDFHEGFNFFINN

SEQ ID NO: 2081953 - protein, 23 aa, Staphylococcus
QVGRKTFYLHYIDKYDLLDQVVS

SEQ ID NO: 2081954 - protein, 19 aa, Staphylococcus
QVGSHFHFFEANKGLKFDR

SEQ ID NO: 2081955 - protein, 22 aa, Staphylococcus
QVGSHYHFFEANTGLKFDREKA

SEQ ID NO: 2081956 - protein, 17 aa, Staphylococcus
QVHLETDVLFKYVERMV

SEQ ID NO: 2081957 - protein, 17 aa, Staphylococcus
QVIALLIHNGYFIEEVR

SEQ ID NO: 2081958 - protein, 27 aa, Staphylococcus
QVIEKDFESFINQFEWHDASFPIVQNV

SEQ ID NO: 2081959 - protein, 25 aa, Staphylococcus
QVIEYPLLEIIVRYNDNGYETRYLA

SEQ ID NO: 2081960 - protein, 26 aa, Staphylococcus
QVIEYPLLEIIVRYNNNGYETRYLAL

SEQ ID NO: 2081961 - protein, 18 aa, Staphylococcus
QVIGSMIVIYRESVDNKE

SEQ ID NO: 2081962 - protein, 17 aa, Staphylococcus
QVIGSMIVLYRESQENK

SEQ ID NO: 2081963 - protein, 25 aa, Staphylococcus
QVIGTYNLIFNIFSLVRNNVGSAVV

SEQ ID NO: 2081964 - protein, 24 aa, Staphylococcus
QVITWLEQAITQVPYRTYYENVLV

SEQ ID NO: 2081965 - protein, 17 aa, Staphylococcus
QVKEALRQESPKAFTTS

SEQ ID NO: 2081966 - protein, 37 aa, Staphylococcus
QVKIQKFPFYNPFSNTLITSWFWSHRPHHIEQAGLKT

SEQ ID NO: 2081967 - protein, 30 aa, Staphylococcus
QVKNLGPLDDIMKMIPGMNKMKGIDKLNMN

SEQ ID NO: 2081968 - protein, 26 aa, Staphylococcus
QVKNLGPLDDIMKMIPGMNKMKGMDK

SEQ ID NO: 2081969 - protein, 28 aa, Staphylococcus
QVKNLGPLDDIMKMIPGMNKMKGMNKLN

SEQ ID NO: 2081970 - protein, 22 aa, Staphylococcus
QVKSAILFASLFSKTASTITEI

SEQ ID NO: 2081971 - protein, 28 aa, Staphylococcus
QVKSYAYQLLLDLGFDHHIMEQSPFEMS

SEQ ID NO: 2081972 - protein, 27 aa, Staphylococcus
QVKTQLKTYFDIKPFHFELTQDAPMKQ

SEQ ID NO: 2081973 - protein, 20 aa, Staphylococcus
QVLADFLTAKEVLKKPYHEI

SEQ ID NO: 2081974 - protein, 19 aa, Staphylococcus
QVLAFLEKESQWKESYQYL

SEQ ID NO: 2081975 - protein, 17 aa, Staphylococcus
QVLAPMYKGNAGIKRLN

SEQ ID NO: 2081976 - protein, 18 aa, Staphylococcus
QVLAPMYKGNAGIKRLNQ

SEQ ID NO: 2081977 - protein, 26 aa, Staphylococcus
QVLKVNAPLVEGSFTASVKLSTGGSV

SEQ ID NO: 2081978 - protein, 17 aa, Staphylococcus
QVLLIDRIQDPGNLGTL

SEQ ID NO: 2081979 - protein, 17 aa, Staphylococcus
QVLPKLAEKVGLNEAII

SEQ ID NO: 2081980 - protein, 22 aa, Staphylococcus
QVLPMEDINLHFNGDFHAITTA

SEQ ID NO: 2081981 - protein, 23 aa, Staphylococcus
QVLPMEDINLHFNGDFHAITTAN

SEQ ID NO: 2081982 - protein, 17 aa, Staphylococcus
QVLQIISKLALSVLTIH

SEQ ID NO: 2081983 - protein, 37 aa, Staphylococcus
QVLSMYPHMLSGGMLQRLMIALALSLQPKLIIADEPT

SEQ ID NO: 2081984 - protein, 17 aa, Staphylococcus
QVLWMSTFHSMCVRILR

SEQ ID NO: 2081985 - protein, 22 aa, Staphylococcus
QVNDIRVGKLLYFTVDEATDEA

SEQ ID NO: 2081986 - protein, 19 aa, Staphylococcus
QVNTMWLTSSLFNQIASER

SEQ ID NO: 2081987 - protein, 22 aa, Staphylococcus
QVPIWIADYVLSTYGTGAVMAV

SEQ ID NO: 2081988 - protein, 31 aa, Staphylococcus
QVPLFNGRHELLNSVFLWHSGTKYKVNVHDA

SEQ ID NO: 2081989 - protein, 18 aa, Staphylococcus
QVPYRTYYENVLVYEIDG

SEQ ID NO: 2081990 - protein, 22 aa, Staphylococcus
QVQAHFTTVFQSLFGGGHAKLE

SEQ ID NO: 2081991 - protein, 24 aa, Staphylococcus
QVQTHFTNVFKSLFGGGHAKLELT

SEQ ID NO: 2081992 - protein, 19 aa, Staphylococcus
QVRHREKYYFPGGKIDEGE

SEQ ID NO: 2081993 - protein, 17 aa, Staphylococcus
QVRPRLGNSLKTKLRVA

SEQ ID NO: 2081994 - protein, 25 aa, Staphylococcus
QVRQYLTYFQSSSPSYLLMAGLERA

SEQ ID NO: 2081995 - protein, 18 aa, Staphylococcus
QVRRYFPSLLSYKRSEHD

SEQ ID NO: 2081996 - protein, 23 aa, Staphylococcus
QVSDYCLFYPRFANQPNNVMTEL

SEQ ID NO: 2081997 - protein, 17 aa, Staphylococcus
QVSFLRQVKLHDTVHAF

SEQ ID NO: 2081998 - protein, 25 aa, Staphylococcus
QVSKQFWAYLVKHGNLTQPEEFIHS

SEQ ID NO: 2081999 - protein, 18 aa, Staphylococcus
QVSYYYLTRGFDSHLGKN

SEQ ID NO: 2082000 - protein, 29 aa, Staphylococcus
QVTAITGSGPAFLYHVFEQYVKAGTSLGL

SEQ ID NO: 2082001 - protein, 20 aa, Staphylococcus
QVTFKYGETKYSLGRALAHN

SEQ ID NO: 2082002 - protein, 17 aa, Staphylococcus
QVTFRDDALRLANEDLF

SEQ ID NO: 2082003 - protein, 20 aa, Staphylococcus
QVTNLFHRKAQFSNTIINKT

SEQ ID NO: 2082004 - protein, 20 aa, Staphylococcus
QVVGFFILHQYYQHEGYDTP

SEQ ID NO: 2082005 - protein, 17 aa, Staphylococcus
QVVIRCIFAYFNVIGEE

SEQ ID NO: 2082006 - protein, 17 aa, Staphylococcus
QVVKFEDFFTPGVKHKV

SEQ ID NO: 2082007 - protein, 20 aa, Staphylococcus
QVVNLFQRKAGFKDTIIHDT

SEQ ID NO: 2082008 - protein, 26 aa, Staphylococcus
QVVNNDLPYHLAIKKLKQLDDDFGLI

SEQ ID NO: 2082009 - protein, 18 aa, Staphylococcus
QVVQFLEKRFEVTVPPLK

SEQ ID NO: 2082010 - protein, 18 aa, Staphylococcus
QVVTVGATVLNGYGPRIV

SEQ ID NO: 2082011 - protein, 19 aa, Staphylococcus
QVVVHIDGAKYNGIIPISQ

SEQ ID NO: 2082012 - protein, 20 aa, Staphylococcus
QVVVHINGGKFNGIIPISQL

SEQ ID NO: 2082013 - protein, 19 aa, Staphylococcus
QVVVHINGGKYNGIIPISQ

SEQ ID NO: 2082014 - protein, 17 aa, Staphylococcus
QVVVIKPFRMGGIDHVI

SEQ ID NO: 2082015 - protein, 27 aa, Staphylococcus
QVYEDVEFKLYLGLKHISPYIEEAVEK

SEQ ID NO: 2082016 - protein, 19 aa, Staphylococcus
QVYLGYYDDSVFKYETFKM

SEQ ID NO: 2082017 - protein, 18 aa, Staphylococcus
QVYQFESNAWYFGEGGNK

SEQ ID NO: 2082018 - protein, 19 aa, Staphylococcus
QVYVLIDHDKYEKVYFAHV

SEQ ID NO: 2082019 - protein, 19 aa, Staphylococcus
QWAGLYDPKIFDVVSDYNA

SEQ ID NO: 2082020 - protein, 23 aa, Staphylococcus
QWAGSCWYYLRYIDPHNSNMLAD

SEQ ID NO: 2082021 - protein, 18 aa, Staphylococcus
QWCLAHHEESFLYEHFSD

SEQ ID NO: 2082022 - protein, 17 aa, Staphylococcus
QWEHMSLDYDPIRGKWN

SEQ ID NO: 2082023 - protein, 17 aa, Staphylococcus
QWGNHDVLWIGAYAGSK

SEQ ID NO: 2082024 - protein, 17 aa, Staphylococcus
QWPIYAVQYHPESILSE

SEQ ID NO: 2082025 - protein, 23 aa, Staphylococcus
QWQAPPLKANRGTLAKYAKLVSS

SEQ ID NO: 2082026 - protein, 19 aa, Staphylococcus
QWQDKFFNHRFSHSVFNDQ

SEQ ID NO: 2082027 - protein, 29 aa, Staphylococcus
QWRQQGQHHVFNPLTIFKLQHACRENDYQ

SEQ ID NO: 2082028 - protein, 18 aa, Staphylococcus
QYAKLKSIFGERAMYFVA

SEQ ID NO: 2082029 - protein, 26 aa, Staphylococcus
QYAKLKSIFGKRDMFFISENGAVIYK

SEQ ID NO: 2082030 - protein, 24 aa, Staphylococcus
QYAQLRSFFPDKVDNITFVAENGA

SEQ ID NO: 2082031 - protein, 18 aa, Staphylococcus
QYASYWKAYDFNSGYFMA

SEQ ID NO: 2082032 - protein, 27 aa, Staphylococcus
QYDAHSIFVKKLIVSKAKLYGRVTLSN

SEQ ID NO: 2082033 - protein, 17 aa, Staphylococcus
QYDDIMFFESSSKSHRL

SEQ ID NO: 2082034 - protein, 24 aa, Staphylococcus
QYDKIKIVGLMTMAPYTEDTAYIR

SEQ ID NO: 2082035 - protein, 25 aa, Staphylococcus
QYDLPLTIFVLNNKQLAFIKYEQQA

SEQ ID NO: 2082036 - protein, 20 aa, Staphylococcus
QYDMNRDISPLKKADDAITV

SEQ ID NO: 2082037 - protein, 23 aa, Staphylococcus
QYDMNREISPLRKADDAITLDTT

SEQ ID NO: 2082038 - protein, 23 aa, Staphylococcus
QYDNYIFSNALSGDSKYIASKIS

SEQ ID NO: 2082039 - protein, 19 aa, Staphylococcus
QYDPLKNQITHIDFLAINM

SEQ ID NO: 2082040 - protein, 25 aa, Staphylococcus
QYDVVFLAIGTLSYHDPYKLKGTKG

SEQ ID NO: 2082041 - protein, 19 aa, Staphylococcus
QYENIEIIGLMTMAPLTDD

SEQ ID NO: 2082042 - protein, 21 aa, Staphylococcus
QYFYNFIDHFGDKVLVPLAYI

SEQ ID NO: 2082043 - protein, 26 aa, Staphylococcus
QYFYNFIDHYGDKVLLPLAYIDLDEY

SEQ ID NO: 2082044 - protein, 22 aa, Staphylococcus
QYGLSNIVVHAPYIINIGNTTK

SEQ ID NO: 2082045 - protein, 20 aa, Staphylococcus
QYGLVLCHLEMFEQAIKQLK

SEQ ID NO: 2082046 - protein, 28 aa, Staphylococcus
QYHTSQLPLEIYVELIYGIQQEMVFKPT

SEQ ID NO: 2082047 - protein, 27 aa, Staphylococcus
QYIDDYFELLLLFFKQINEIESIDLIH

SEQ ID NO: 2082048 - protein, 23 aa, Staphylococcus
QYIGQFKAGYFSPLANLARLTEE

SEQ ID NO: 2082049 - protein, 22 aa, Staphylococcus
QYINEVYGNYFDKHQPARSCVE

SEQ ID NO: 2082050 - protein, 19 aa, Staphylococcus
QYISREKTPKWLEEHTYEK

SEQ ID NO: 2082051 - protein, 24 aa, Staphylococcus
QYKFLKDHYLCKVLAAIINLPEGK

SEQ ID NO: 2082052 - protein, 21 aa, Staphylococcus
QYKKRDSSYWRDIAFGVGEGE

SEQ ID NO: 2082053 - protein, 29 aa, Staphylococcus
QYKMSKEEILILLTLWKEGSMTLKEMDDF

SEQ ID NO: 2082054 - protein, 25 aa, Staphylococcus
QYKNKPVIIYFYGGGFVNGHGSQEL

SEQ ID NO: 2082055 - protein, 26 aa, Staphylococcus
QYKNQDPIILVHGFNGFTDDINPNVL

SEQ ID NO: 2082056 - protein, 28 aa, Staphylococcus
QYKQNPYMIVFSFNGYRIVAFNGGRLLI

SEQ ID NO: 2082057 - protein, 19 aa, Staphylococcus
QYLFEKYPEIDGKKFQIAL

SEQ ID NO: 2082058 - protein, 23 aa, Staphylococcus
QYLIDILENFVLERGIYGKRWID

SEQ ID NO: 2082059 - protein, 29 aa, Staphylococcus
QYLMLEQGLREFIICGLKSAYILKDTSQP

SEQ ID NO: 2082060 - protein, 25 aa, Staphylococcus
QYLNRKRVYIVELIEKLTLEIENKY

SEQ ID NO: 2082061 - protein, 20 aa, Staphylococcus
QYMGAYRLQWDMICFAKSHH

SEQ ID NO: 2082062 - protein, 25 aa, Staphylococcus
QYNDEELFFVISVDTPMVTGKAISA

SEQ ID NO: 2082063 - protein, 25 aa, Staphylococcus
QYNINKFNFVAHSMGNMSFAYYMNN

SEQ ID NO: 2082064 - protein, 27 aa, Staphylococcus
QYNIPGHFAPLADFELILKAKQKADDI

SEQ ID NO: 2082065 - protein, 24 aa, Staphylococcus
QYNLCPHMEFMATPPYDGAFCEYV

SEQ ID NO: 2082066 - protein, 21 aa, Staphylococcus
QYNLTYIIDDKFNYSTNLNAD

SEQ ID NO: 2082067 - protein, 25 aa, Staphylococcus
QYNNNLKKFFFASSAAIYGDLPDLP

SEQ ID NO: 2082068 - protein, 26 aa, Staphylococcus
QYNNQYYRFTPYFTKDFDNLSFYITS

SEQ ID NO: 2082069 - protein, 25 aa, Staphylococcus
QYPHTVLFVTHDRYFLNEIATRIVE

SEQ ID NO: 2082070 - protein, 19 aa, Staphylococcus
QYPHYGIQYHPESFATEHG

SEQ ID NO: 2082071 - protein, 25 aa, Staphylococcus
QYPHYIQQLIERKPYQLDPKVEQTL

SEQ ID NO: 2082072 - protein, 18 aa, Staphylococcus
QYPTMNEKDIRAVLGRFL

SEQ ID NO: 2082073 - protein, 18 aa, Staphylococcus
QYPTMPEKDVRAVLGRFL

SEQ ID NO: 2082074 - protein, 21 aa, Staphylococcus
QYQHILKQKNNYLKQLQIGNN

SEQ ID NO: 2082075 - protein, 28 aa, Staphylococcus
QYQLQGNRLFYLAMAPQFFGIISDFLKT

SEQ ID NO: 2082076 - protein, 35 aa, Staphylococcus
QYQPRYNILLKDDKSYPFIKITKEKYPRLIVTRTV

SEQ ID NO: 2082077 - protein, 20 aa, Staphylococcus
QYRRLGQFHLVINPSYFGDE

SEQ ID NO: 2082078 - protein, 26 aa, Staphylococcus
QYSSIEELFKDFLGKPVRVTVKNETS

SEQ ID NO: 2082079 - protein, 17 aa, Staphylococcus
QYTDMPFVLMLDEDENG

SEQ ID NO: 2082080 - protein, 33 aa, Staphylococcus
QYTFSGPIDRQLFYQFILKLPQNVFRLKGFVRF

SEQ ID NO: 2082081 - protein, 23 aa, Staphylococcus
QYTSTLVRPLIAYIQDYGIALEA

SEQ ID NO: 2082082 - protein, 21 aa, Staphylococcus
QYVDDLAERILAIGGNPIGTL

SEQ ID NO: 2082083 - protein, 19 aa, Staphylococcus
QYVDDLAERILAIGGNPVA

SEQ ID NO: 2082084 - protein, 19 aa, Staphylococcus
QYVDDLAERILAIGGNPVG

SEQ ID NO: 2082085 - protein, 19 aa, Staphylococcus
QYVDDLAERILAVGGHPVG

SEQ ID NO: 2082086 - protein, 18 aa, Staphylococcus
QYVDDLAERILAVGGNPV

SEQ ID NO: 2082087 - protein, 17 aa, Staphylococcus
QYYFVDYKTDAFNKRRG

SEQ ID NO: 2082088 - protein, 19 aa, Staphylococcus
QYYRETGIYAERTAPWIRR

SEQ ID NO: 2082089 - protein, 20 aa, Staphylococcus
RAAFLYLEGIQHKFNQTKTY

SEQ ID NO: 2082090 - protein, 22 aa, Staphylococcus
RAARIIDQLEQLGYITGANGSK

SEQ ID NO: 2082091 - protein, 17 aa, Staphylococcus
RAARIIDQLEQLGYVSG

SEQ ID NO: 2082092 - protein, 30 aa, Staphylococcus
RAASFGIASWLVDLIHFNTTYFSKSGDVVK

SEQ ID NO: 2082093 - protein, 17 aa, Staphylococcus
RAAYLVHHLLPNSDDHP

SEQ ID NO: 2082094 - protein, 30 aa, Staphylococcus
RADEFYQPKPGTDLVWLGAATKYIIDHDLH

SEQ ID NO: 2082095 - protein, 32 aa, Staphylococcus
RADEFYQPKPGTDLVWLGAVTKYIIDNDLHDK

SEQ ID NO: 2082096 - protein, 20 aa, Staphylococcus
RADFDALPIKEETGLPFASK

SEQ ID NO: 2082097 - protein, 19 aa, Staphylococcus
RADFDALPIQEATGLPFAS

SEQ ID NO: 2082098 - protein, 24 aa, Staphylococcus
RADIGHNWWVVNQSLVTLNQRDDL

SEQ ID NO: 2082099 - protein, 25 aa, Staphylococcus
RADIILPAVSVFKTLYKKIDAKQFT

SEQ ID NO: 2082100 - protein, 23 aa, Staphylococcus
RADLVVTLCSHADQHCPTIPPSV

SEQ ID NO: 2082101 - protein, 30 aa, Staphylococcus
RADRDLLQAQLYLLLHNKLPFSQEDIVFNG

SEQ ID NO: 2082102 - protein, 28 aa, Staphylococcus
RADRDLLQAQLYLMQHDKLPFSQDDIVF

SEQ ID NO: 2082103 - protein, 25 aa, Staphylococcus
RAEIMIGRASFIESFPLFGYNLNDY

SEQ ID NO: 2082104 - protein, 23 aa, Staphylococcus
RAEVLMFKGIPYQLKITTNKDEQ

SEQ ID NO: 2082105 - protein, 21 aa, Staphylococcus
RAEYLHAWADNLLQKKEKLAS

SEQ ID NO: 2082106 - protein, 22 aa, Staphylococcus
RAEYRLLLRHDNADLRLTDLGY

SEQ ID NO: 2082107 - protein, 17 aa, Staphylococcus
RAFFEKYFDLVCIGSAG

SEQ ID NO: 2082108 - protein, 25 aa, Staphylococcus
RAFKNDKIDFIWSHTLKTINDKDGK

SEQ ID NO: 2082109 - protein, 28 aa, Staphylococcus
RAFSLKSGYMTSLLRKYILGDEKVESII

SEQ ID NO: 2082110 - protein, 23 aa, Staphylococcus
RAFVPLSEMFGYATSLRSNTQGR

SEQ ID NO: 2082111 - protein, 24 aa, Staphylococcus
RAGAALILAGLVAEGTTEVSELKH

SEQ ID NO: 2082112 - protein, 25 aa, Staphylococcus
RAGASIILLIVNILTNDTLQSLYHY

SEQ ID NO: 2082113 - protein, 25 aa, Staphylococcus
RAGHHCAQPLMKWLGVSSTARTSFY

SEQ ID NO: 2082114 - protein, 30 aa, Staphylococcus
RAGIKDPNRPIGSFLFLGPTGVGKTELAKA

SEQ ID NO: 2082115 - protein, 20 aa, Staphylococcus
RAGTLLRYYTGLLEHSKVQP

SEQ ID NO: 2082116 - protein, 29 aa, Staphylococcus
RAHLERYKVPMRWIKVPHMIWTSSGKIAR

SEQ ID NO: 2082117 - protein, 19 aa, Staphylococcus
RAHLLKLIDSLTSTLENKY

SEQ ID NO: 2082118 - protein, 20 aa, Staphylococcus
RAIAGYFLSFDAPNAQNTAL

SEQ ID NO: 2082119 - protein, 17 aa, Staphylococcus
RAIIAPSYFEPTEGDFE

SEQ ID NO: 2082120 - protein, 20 aa, Staphylococcus
RAIIAPSYYEPRVEDFELCC

SEQ ID NO: 2082121 - protein, 20 aa, Staphylococcus
RAIISRCDLVLMDEPLSALD

SEQ ID NO: 2082122 - protein, 33 aa, Staphylococcus
RAIKERLFKKGLMKRYKLLLNKVNIESFENHDY

SEQ ID NO: 2082123 - protein, 18 aa, Staphylococcus
RAIMKQNLEVMRAAVEKG

SEQ ID NO: 2082124 - protein, 17 aa, Staphylococcus
RAIRIQAKIASLVTAFA

SEQ ID NO: 2082125 - protein, 19 aa, Staphylococcus
RAIRYRTRIVTLEGDIVNP

SEQ ID NO: 2082126 - protein, 17 aa, Staphylococcus
RAKAFDMDILYTGPHQK

SEQ ID NO: 2082127 - protein, 23 aa, Staphylococcus
RAKAGLFLAMQYPSEITGVTNAD

SEQ ID NO: 2082128 - protein, 18 aa, Staphylococcus
RAKEQLILIGRLKSTKKL

SEQ ID NO: 2082129 - protein, 20 aa, Staphylococcus
RAKHEATINGKRYPIKALMM

SEQ ID NO: 2082130 - protein, 18 aa, Staphylococcus
RAKLNKINEIKPLSQLLD

SEQ ID NO: 2082131 - protein, 25 aa, Staphylococcus
RAKWDRPFRLAVIQLGTYDGTIYNA

SEQ ID NO: 2082132 - protein, 28 aa, Staphylococcus
RAKWGERSGLTLFLPHAFEGQGPEHSSA

SEQ ID NO: 2082133 - protein, 29 aa, Staphylococcus
RAKWGERSGLTLFLPHAFEGQGPEHSSAR

SEQ ID NO: 2082134 - protein, 28 aa, Staphylococcus
RAKWGERSGLTLFLPHSFEGQGPEHSSA

SEQ ID NO: 2082135 - protein, 18 aa, Staphylococcus
RAKYYFPGGKIDALIREI

SEQ ID NO: 2082136 - protein, 28 aa, Staphylococcus
RALAGTVMSKLIFTLPGSTGAVKLAMTK

SEQ ID NO: 2082137 - protein, 19 aa, Staphylococcus
RALHLLLTTRYSISAIATE

SEQ ID NO: 2082138 - protein, 23 aa, Staphylococcus
RALKFYKYFYTHRGPVMDYSNIK

SEQ ID NO: 2082139 - protein, 22 aa, Staphylococcus
RALSHIIPDLKDFPYTVRIVSE

SEQ ID NO: 2082140 - protein, 24 aa, Staphylococcus
RALSHYEKRFTPKSKLREFNVEEM

SEQ ID NO: 2082141 - protein, 18 aa, Staphylococcus
RALVISGYTNVSVNNFTA

SEQ ID NO: 2082142 - protein, 28 aa, Staphylococcus
RAMELIEQYDFLYAIIGWHPVDAIDFTE

SEQ ID NO: 2082143 - protein, 18 aa, Staphylococcus
RAMHRPHETWVPAFVLRT

SEQ ID NO: 2082144 - protein, 28 aa, Staphylococcus
RAMKLIDQYDFLYAIIGWHPVDAIDYTE

SEQ ID NO: 2082145 - protein, 24 aa, Staphylococcus
RANALLLNHYGVPFDNIYITDYAT

SEQ ID NO: 2082146 - protein, 30 aa, Staphylococcus
RANFDLRPAGIIKMLDLKHPIYKQTAAYGH

SEQ ID NO: 2082147 - protein, 29 aa, Staphylococcus
RANFDLRPAGIIKMLDLKQPIYKQTAAYG

SEQ ID NO: 2082148 - protein, 19 aa, Staphylococcus
RANIKLGDFVVLSGAGTLG

SEQ ID NO: 2082149 - protein, 21 aa, Staphylococcus
RANLYGLFNKAVEFENSSFRG

SEQ ID NO: 2082150 - protein, 22 aa, Staphylococcus
RANLYGLFNKTIEFENSSFRGL

SEQ ID NO: 2082151 - protein, 20 aa, Staphylococcus
RAPEIGLATVYRTLELLAEL

SEQ ID NO: 2082152 - protein, 17 aa, Staphylococcus
RAPFTPTEYGDPSMLEA

SEQ ID NO: 2082153 - protein, 34 aa, Staphylococcus
RAPRLFRNLNMEWVYRLLIDWKRIGRIKSIPKFM

SEQ ID NO: 2082154 - protein, 17 aa, Staphylococcus
RAQALVRKKSVLSSSIS

SEQ ID NO: 2082155 - protein, 20 aa, Staphylococcus
RAQIFELYALDENDIRIALE

SEQ ID NO: 2082156 - protein, 32 aa, Staphylococcus
RAQQTEIWFMSITKHNIKWINNADLKQGFQSA

SEQ ID NO: 2082157 - protein, 21 aa, Staphylococcus
RAQRILWIKQVLQDNNIPIYQ

SEQ ID NO: 2082158 - protein, 26 aa, Staphylococcus
RAQSFGMHILAFDPYLSEDKAKELNV

SEQ ID NO: 2082159 - protein, 20 aa, Staphylococcus
RAQVILPYHLLQDEYEERLR

SEQ ID NO: 2082160 - protein, 31 aa, Staphylococcus; identical to SEQ ID NO: 1682136

SEQ ID NO: 2082161 - protein, 26 aa, Staphylococcus
RARHDIEMLLGSKVYLELWVKVQKDW

SEQ ID NO: 2082162 - protein, 27 aa, Staphylococcus
RARHDIEMLLGSKVYLELWVKVQKDWR

SEQ ID NO: 2082163 - protein, 31 aa, Staphylococcus
RARHDIEMLLGSKVYLELWVKVQKDWRNKVN

SEQ ID NO: 2082164 - protein, 26 aa, Staphylococcus
RARHDIEMLLGSKVYLELWVKVQRDW

SEQ ID NO: 2082165 - protein, 28 aa, Staphylococcus
RARLKDIVDLFLDSGLGKDAFSIISQGR

SEQ ID NO: 2082166 - protein, 26 aa, Staphylococcus
RARLRDITELFLDSGLGKEAFSIISQ

SEQ ID NO: 2082167 - protein, 27 aa, Staphylococcus
RARRRESIFMTYILKYHPRFKNDDVPV

SEQ ID NO: 2082168 - protein, 23 aa, Staphylococcus
RARVLEGLEFMGVYWDPKKNSQL

SEQ ID NO: 2082169 - protein, 25 aa, Staphylococcus
RASDTLEIIFPNENYRRLKGIKEWN

SEQ ID NO: 2082170 - protein, 27 aa, Staphylococcus
RASHQYKLLIILSPSGAYYGGDTLKTT

SEQ ID NO: 2082171 - protein, 17 aa, Staphylococcus
RASIMLHLPGLSIMKRM

SEQ ID NO: 2082172 - protein, 27 aa, Staphylococcus
RASKKYKLLIILSPSGAYYGGDTLKST

SEQ ID NO: 2082173 - protein, 21 aa, Staphylococcus
RASKRFTIVPSWEDYSKESED

SEQ ID NO: 2082174 - protein, 19 aa, Staphylococcus
RASNFIDYCQDIHIISPQV

SEQ ID NO: 2082175 - protein, 27 aa, Staphylococcus
RASQQYKLLIILSPSGAYYGGDTLKTT

SEQ ID NO: 2082176 - protein, 21 aa, Staphylococcus
RASYDYLGIPLSDDDLLTYAN

SEQ ID NO: 2082177 - protein, 28 aa, Staphylococcus
RASYMKRSYLFTAYIVEFQVLNGMRIGE

SEQ ID NO: 2082178 - protein, 25 aa, Staphylococcus
RATGHLMSMLVTLKGLPLAYNKDLQ

SEQ ID NO: 2082179 - protein, 26 aa, Staphylococcus
RATLKRLPLYYRFVSNLKSKGIDRVN

SEQ ID NO: 2082180 - protein, 26 aa, Staphylococcus
RATLKRLPLYYRFVSTLKSKGIDRVN

SEQ ID NO: 2082181 - protein, 23 aa, Staphylococcus
RAVLGRFLFVQEDVKKIINDLSG

SEQ ID NO: 2082182 - protein, 20 aa, Staphylococcus
RAVTVKKWQLWYDMDIIADN

SEQ ID NO: 2082183 - protein, 19 aa, Staphylococcus
RAWLKVLNTLLAEGYTFDM

SEQ ID NO: 2082184 - protein, 18 aa, Staphylococcus
RAWSHVFLALIEAPPPQG

SEQ ID NO: 2082185 - protein, 20 aa, Staphylococcus
RAYLKYLKHQFPERHFITNI

SEQ ID NO: 2082186 - protein, 17 aa, Staphylococcus
RAYTYIRTMGNIGLKEV

SEQ ID NO: 2082187 - protein, 18 aa, Staphylococcus
RAYYKKEFPQLKVTASHI

SEQ ID NO: 2082188 - protein, 20 aa, Staphylococcus
RAYYQAYAKAKYWVSNARLP

SEQ ID NO: 2082189 - protein, 17 aa, Staphylococcus
RCEGYSNEFALQSCINC

SEQ ID NO: 2082190 - protein, 24 aa, Staphylococcus
RCIGRLFWETLIVQDARDVESNEA

SEQ ID NO: 2082191 - protein, 33 aa, Staphylococcus
RCIKKAEVILYDRLVNPLILQYAPADAEFIDVG

SEQ ID NO: 2082192 - protein, 18 aa, Staphylococcus
RCNLGVVTLNLPRIALES

SEQ ID NO: 2082193 - protein, 24 aa, Staphylococcus
RCPKNYLAHVLSKYGFNVKKEKKL

SEQ ID NO: 2082194 - protein, 21 aa, Staphylococcus
RCPTCKMTLKDIAHVGKFGCA

SEQ ID NO: 2082195 - protein, 25 aa, Staphylococcus
RCQDGIILLFPIEGSLEIQHFAKKV

SEQ ID NO: 2082196 - protein, 17 aa, Staphylococcus
RCQHVYFKPIDKGQFIN

SEQ ID NO: 2082197 - protein, 17 aa, Staphylococcus
RCQHVYFKPIDKTKFIN

SEQ ID NO: 2082198 - protein, 30 aa, Staphylococcus
RCTHYHTFLDVIAIKFKCCNKYYPCYQCHE

SEQ ID NO: 2082199 - protein, 17 aa, Staphylococcus
RCYLVKASKLRWEFEFE

SEQ ID NO: 2082200 - protein, 17 aa, Staphylococcus
RDAFKLLKQDQLIHLER

SEQ ID NO: 2082201 - protein, 18 aa, Staphylococcus
RDAFSLIILNEPVKFSDG

SEQ ID NO: 2082202 - protein, 19 aa, Staphylococcus
RDALSQLNSIAPKLGLTVE

SEQ ID NO: 2082203 - protein, 26 aa, Staphylococcus
RDARIKLQLILKYLEKYSLKCFAHLF

SEQ ID NO: 2082204 - protein, 23 aa, Staphylococcus
RDCADVIYEFQYAHGLPSYGEVD

SEQ ID NO: 2082205 - protein, 17 aa, Staphylococcus
RDDAQIIFIDTPGIHKP

SEQ ID NO: 2082206 - protein, 24 aa, Staphylococcus
RDDDFYYNRLRYYKDRVLVPLAYM

SEQ ID NO: 2082207 - protein, 22 aa, Staphylococcus
RDDIQVLSKCGIVLPSKTQTFT

SEQ ID NO: 2082208 - protein, 25 aa, Staphylococcus
RDDQFYYNRFKYYKDRVLVPLAYLK

SEQ ID NO: 2082209 - protein, 27 aa, Staphylococcus
RDDQIETIFYRLFTGRFTRSHLGIAYT

SEQ ID NO: 2082210 - protein, 29 aa, Staphylococcus
RDEEGQDVLLFIDNIFRFTQAGSEVSALL

SEQ ID NO: 2082211 - protein, 32 aa, Staphylococcus
RDEKVIDLFIFIFPYYLKKAMRKGLYKEYTRN

SEQ ID NO: 2082212 - protein, 25 aa, Staphylococcus
RDESYAYLLASVLPQFDIPFHIDIK

SEQ ID NO: 2082213 - protein, 36 aa, Staphylococcus
RDEVIGPLLHYRMVQELPTFFSSNLSFEELEYHLSV

SEQ ID NO: 2082214 - protein, 20 aa, Staphylococcus
RDFFAVLISETNGIFKHYFV

SEQ ID NO: 2082215 - protein, 19 aa, Staphylococcus
RDFIYIDDLVEACWLVLHN

SEQ ID NO: 2082216 - protein, 20 aa, Staphylococcus
RDGFLLAQDISSYSLTIVAH

SEQ ID NO: 2082217 - protein, 22 aa, Staphylococcus
RDGQLFLLDVFEGNIFKVNPDT

SEQ ID NO: 2082218 - protein, 18 aa, Staphylococcus
RDGYIYEQKFNKGGLPAT

SEQ ID NO: 2082219 - protein, 22 aa, Staphylococcus
RDHALTGLEFACGIPGSIGGAV

SEQ ID NO: 2082220 - protein, 20 aa, Staphylococcus
RDHIVFPGMVYISHPTEYGT

SEQ ID NO: 2082221 - protein, 23 aa, Staphylococcus
RDHQRYIKVFPGLVTYVGHTHEE

SEQ ID NO: 2082222 - protein, 21 aa, Staphylococcus
RDIESELTGLPMKRVNDIKAY

SEQ ID NO: 2082223 - protein, 24 aa, Staphylococcus
RDIIERFHHWLEEPSLHDTIHQAI

SEQ ID NO: 2082224 - protein, 27 aa, Staphylococcus
RDIINNYPFPNTFQVLKLTGAGIKDAL

SEQ ID NO: 2082225 - protein, 24 aa, Staphylococcus
RDIKGKIIVPGFFGYSKKGNIVTF

SEQ ID NO: 2082226 - protein, 28 aa, Staphylococcus
RDILDLPEYTFPLFGMAIGEPADDEQGT

SEQ ID NO: 2082227 - protein, 27 aa, Staphylococcus
RDINQYKPWVDLFIIDTPSIQLGGTGQ

SEQ ID NO: 2082228 - protein, 22 aa, Staphylococcus
RDIQALFYEQLSYCSTLFVNKI

SEQ ID NO: 2082229 - protein, 27 aa, Staphylococcus
RDIQTSILNFIVTRNHKPLLLGESNVV

SEQ ID NO: 2082230 - protein, 17 aa, Staphylococcus
RDKAFFVLSDNGKLKMP

SEQ ID NO: 2082231 - protein, 17 aa, Staphylococcus
RDKFLAEVQDAIACFIT

SEQ ID NO: 2082232 - protein, 17 aa, Staphylococcus
RDKFYDLTVNTEPVWIR

SEQ ID NO: 2082233 - protein, 26 aa, Staphylococcus
RDKGFYTAWLHLAQHDPMLQKEQRQK

SEQ ID NO: 2082234 - protein, 21 aa, Staphylococcus
RDKLFNEGIYYYIHVDAAYGG

SEQ ID NO: 2082235 - protein, 17 aa, Staphylococcus
RDKTELLVYLSSKDISI

SEQ ID NO: 2082236 - protein, 17 aa, Staphylococcus
RDKTELLVYLSSKNISI

SEQ ID NO: 2082237 - protein, 26 aa, Staphylococcus
RDKTGLLLDPYFAGTKVKWILDNVDG

SEQ ID NO: 2082238 - protein, 26 aa, Staphylococcus
RDKTGLLLDPYFAGTKVKWILDNVEG

SEQ ID NO: 2082239 - protein, 23 aa, Staphylococcus
RDKVIQYLSYFQTSSPSYLVMAS

SEQ ID NO: 2082240 - protein, 25 aa, Staphylococcus
RDLEMTFFYELIFGEETDFYQNLLN

SEQ ID NO: 2082241 - protein, 31 aa, Staphylococcus
RDLINKRYWECPIGCYHWEDLAAYFGTNKTS

SEQ ID NO: 2082242 - protein, 17 aa, Staphylococcus
RDLIPVVKNFNSRLLIG

SEQ ID NO: 2082243 - protein, 28 aa, Staphylococcus
RDLVNTVLEYHPLFIKPNKDELEEMFDV

SEQ ID NO: 2082244 - protein, 26 aa, Staphylococcus
RDMIRHRLGSMPLEWSDKLNIVATEL

SEQ ID NO: 2082245 - protein, 18 aa, Staphylococcus
RDMLGKYHKLFTDKKELS

SEQ ID NO: 2082246 - protein, 33 aa, Staphylococcus
RDNFDLRPAGIIKMLDLKRPIYKQTAAYGHFGR

SEQ ID NO: 2082247 - protein, 20 aa, Staphylococcus
RDNINYLRDIDLGLIVLDEA

SEQ ID NO: 2082248 - protein, 22 aa, Staphylococcus
RDQAILLLHSFTGTVRDVKHLA

SEQ ID NO: 2082249 - protein, 26 aa, Staphylococcus
RDQDAATHLPYIYLSAGVSAELFQDT

SEQ ID NO: 2082250 - protein, 26 aa, Staphylococcus
RDRFGVHLRLEYYQELELKEIIVRTA

SEQ ID NO: 2082251 - protein, 25 aa, Staphylococcus
RDRTGLLLDPYFAGTKVKWILDHVE

SEQ ID NO: 2082252 - protein, 23 aa, Staphylococcus
RDSLYVEIYPFDISFEDPFTKIQ

SEQ ID NO: 2082253 - protein, 17 aa, Staphylococcus
RDSYQFIKDLKTALHIP

SEQ ID NO: 2082254 - protein, 21 aa, Staphylococcus
RDTCCIAPKIKYHEDKFVFSP

SEQ ID NO: 2082255 - protein, 24 aa, Staphylococcus
RDTSRFYQYWLDNVEPDLKEIKEA

SEQ ID NO: 2082256 - protein, 19 aa, Staphylococcus
RDTSRFYQYWLNHVDEDIA

SEQ ID NO: 2082257 - protein, 26 aa, Staphylococcus
RDVATKAWYNTYLNIYAASTINELLA

SEQ ID NO: 2082258 - protein, 26 aa, Staphylococcus
RDVATKAWYNTYLNIYAASTVNELLA

SEQ ID NO: 2082259 - protein, 18 aa, Staphylococcus
RDVFGYNVSKGWMCVQVF

SEQ ID NO: 2082260 - protein, 20 aa, Staphylococcus
RDVFMSGLKTFYADSLDLEK

SEQ ID NO: 2082261 - protein, 23 aa, Staphylococcus
RDVKIHEWLSEDLKAKYKLESLE

SEQ ID NO: 2082262 - protein, 29 aa, Staphylococcus
RDVQGQDVLLFIDNIFRFTQAGSEVSALL

SEQ ID NO: 2082263 - protein, 22 aa, Staphylococcus
RDYLIDAINYMFPSVNVKDEDI

SEQ ID NO: 2082264 - protein, 20 aa, Staphylococcus
RDYLIDAVNYMFPGLDIEDK

SEQ ID NO: 2082265 - protein, 28 aa, Staphylococcus
RDYNIAAQILKYFAIEKVNLLSNNPKKF

SEQ ID NO: 2082266 - protein, 20 aa, Staphylococcus
RDYYHAAEILKHFGIEKINL

SEQ ID NO: 2082267 - protein, 25 aa, Staphylococcus
READFINIVVFRKQADNVNNYLKKG

SEQ ID NO: 2082268 - protein, 25 aa, Staphylococcus
READFINVVVFRRQAENVNNYLSKG

SEQ ID NO: 2082269 - protein, 26 aa, Staphylococcus
REAERLVIHGFLDPVVRELPIEDVKR

SEQ ID NO: 2082270 - protein, 25 aa, Staphylococcus
REALYDMINYWIDFGVDGFRFDVIN

SEQ ID NO: 2082271 - protein, 23 aa, Staphylococcus
REDAQIIFLDTPGIHKPKHKLGD

SEQ ID NO: 2082272 - protein, 22 aa, Staphylococcus
REDAQLLYGFISEEEKDMFHSL

SEQ ID NO: 2082273 - protein, 25 aa, Staphylococcus
REDDQLDFVLAYRAVASLLQRLKTF

SEQ ID NO: 2082274 - protein, 22 aa, Staphylococcus
REDETFIFAYEESYGYLAGEFV

SEQ ID NO: 2082275 - protein, 35 aa, Staphylococcus
REDIKGTVIGFFTPELFHGIGSAGFHIHFANDDRN

SEQ ID NO: 2082276 - protein, 24 aa, Staphylococcus
REDRPDLIFISQKGKFDAVVEDVV

SEQ ID NO: 2082277 - protein, 17 aa, Staphylococcus
REDVRAIMKQNLEVMRA

SEQ ID NO: 2082278 - protein, 21 aa, Staphylococcus
REDVYYQVYTNRGIYTEDPTR

SEQ ID NO: 2082279 - protein, 24 aa, Staphylococcus
REEAILLLHSFTGTIRDVKPLAQA

SEQ ID NO: 2082280 - protein, 17 aa, Staphylococcus
REEDYTYFFNGVKHVLK

SEQ ID NO: 2082281 - protein, 25 aa, Staphylococcus
REEGRECQFIAVKLPYGVQSDADEV

SEQ ID NO: 2082282 - protein, 22 aa, Staphylococcus
REEHGFKGNTWLFFGDQHFTTD

SEQ ID NO: 2082283 - protein, 18 aa, Staphylococcus
REEIVSLNYQILDLLSKR

SEQ ID NO: 2082284 - protein, 18 aa, Staphylococcus
REEVSLPVIGIVKRDYEG

SEQ ID NO: 2082285 - protein, 29 aa, Staphylococcus
REFANIYALLIPIMPDLESVRFLVDQIQF

SEQ ID NO: 2082286 - protein, 18 aa, Staphylococcus
REFAWVQDRFGVNFQLAL

SEQ ID NO: 2082287 - protein, 20 aa, Staphylococcus
REFCTKIAWIEGGKLKEFGE

SEQ ID NO: 2082288 - protein, 24 aa, Staphylococcus
REFRDNILPTLTPLGIDAYHPFPK

SEQ ID NO: 2082289 - protein, 17 aa, Staphylococcus
REFTLILYVNDIVGMLA

SEQ ID NO: 2082290 - protein, 26 aa, Staphylococcus
REGAKRVFNMTPYPVQIMGGIAIHNG

SEQ ID NO: 2082291 - protein, 25 aa, Staphylococcus
REGDDIFYNLNVSFPQAALGDEIKV

SEQ ID NO: 2082292 - protein, 22 aa, Staphylococcus
REGFLLAQDISSYSLTIVAREA

SEQ ID NO: 2082293 - protein, 21 aa, Staphylococcus
REGFLLAQDISSYSLTLVAHE

SEQ ID NO: 2082294 - protein, 23 aa, Staphylococcus
REGIHYKNLLGTYLHGPVLPKNH

SEQ ID NO: 2082295 - protein, 20 aa, Staphylococcus
REGNALYDNLYPTRIIVGEK

SEQ ID NO: 2082296 - protein, 28 aa, Staphylococcus
REGSKRVFNMIPFKVQVMGGIAIHKGDI

SEQ ID NO: 2082297 - protein, 27 aa, Staphylococcus
REGSKRVFNMIPYKVQVMGGIAIHGGD

SEQ ID NO: 2082298 - protein, 28 aa, Staphylococcus
REGSKRVFNMIPYKVQVMGGIAIHHGDI

SEQ ID NO: 2082299 - protein, 20 aa, Staphylococcus
REGWLFGDKYDSTETFLFIW

SEQ ID NO: 2082300 - protein, 31 aa, Staphylococcus
REHLSFGVINILLQFVMLKEDMKLPKSYIFE

SEQ ID NO: 2082301 - protein, 17 aa, Staphylococcus
REHNLFLCEVFGGKIFK

SEQ ID NO: 2082302 - protein, 17 aa, Staphylococcus
REIEIEIDYKWLQNIFA

SEQ ID NO: 2082303 - protein, 17 aa, Staphylococcus
REIIKLGERTREIGYSL

SEQ ID NO: 2082304 - protein, 19 aa, Staphylococcus
REIILVVTGAEKSEVIKRL

SEQ ID NO: 2082305 - protein, 23 aa, Staphylococcus
REILDELGILKDGVFTHAIDPDM

SEQ ID NO: 2082306 - protein, 18 aa, Staphylococcus
REILGREPNFTEVGIFSV

SEQ ID NO: 2082307 - protein, 23 aa, Staphylococcus
REILSQFVNFPIYVDNDANAAAL

SEQ ID NO: 2082308 - protein, 25 aa, Staphylococcus
REINTIICHHPLIFKGLTSITDDGY

SEQ ID NO: 2082309 - protein, 24 aa, Staphylococcus
REINYLISMFLPENSPASQVVSAV

SEQ ID NO: 2082310 - protein, 18 aa, Staphylococcus
REIRLNAELLQYEFGERL

SEQ ID NO: 2082311 - protein, 24 aa, Staphylococcus
REISPRLRLVIPLKRNVNADEYEA

SEQ ID NO: 2082312 - protein, 21 aa, Staphylococcus
REIYQLMNELTERGMSIIMIS

SEQ ID NO: 2082313 - protein, 34 aa, Staphylococcus
REKERLIPYYIYQDYWFLYYHDNVFFAAQYERDG

SEQ ID NO: 2082314 - protein, 23 aa, Staphylococcus
REKHLELIMKWCAQELKNNFQLE

SEQ ID NO: 2082315 - protein, 17 aa, Staphylococcus
REKILNGLVRSCEKRPV

SEQ ID NO: 2082316 - protein, 18 aa, Staphylococcus
REKLEVFEKWIEKGYLIS

SEQ ID NO: 2082317 - protein, 22 aa, Staphylococcus
REKLHDLFHLFMKASKESMQDN

SEQ ID NO: 2082318 - protein, 31 aa, Staphylococcus
REKMSFGVINILLQFVMLKEDMKLPKSYIFE

SEQ ID NO: 2082319 - protein, 25 aa, Staphylococcus
REKQKLRYLYGMTERQFRNTFEIAG

SEQ ID NO: 2082320 - protein, 26 aa, Staphylococcus
REKTGLVLDPYFSGSKIKWILDNVEG

SEQ ID NO: 2082321 - protein, 22 aa, Staphylococcus
RELESHFFGRVGLFRNQVGDEL

SEQ ID NO: 2082322 - protein, 26 aa, Staphylococcus
RELKIYTIIVQRFLETLMKPYEYENV

SEQ ID NO: 2082323 - protein, 26 aa, Staphylococcus
RELNEWYILTIERLIDLITYCSSKYT

SEQ ID NO: 2082324 - protein, 18 aa, Staphylococcus
RELRDNNYMKIISLAPEV

SEQ ID NO: 2082325 - protein, 20 aa, Staphylococcus
RELRQQVGLVFQFPESQLFE

SEQ ID NO: 2082326 - protein, 27 aa, Staphylococcus
RELTKDPKYLIGRIIARPYIGEPGSFK

SEQ ID NO: 2082327 - protein, 26 aa, Staphylococcus
RELTKDPKYLIGRIIARPYVGEPGNF

SEQ ID NO: 2082328 - protein, 18 aa, Staphylococcus
REMEILLLIANGYSNQEI

SEQ ID NO: 2082329 - protein, 18 aa, Staphylococcus
REMFLEDLGIEEPGLDRL

SEQ ID NO: 2082330 - protein, 18 aa, Staphylococcus
REMFLEDLGIEEPGLDVL

SEQ ID NO: 2082331 - protein, 28 aa, Staphylococcus
REMPWRETSNPYYIWLSEVMLQQTQVKT

SEQ ID NO: 2082332 - protein, 29 aa, Staphylococcus
REMPWRETTNPYYIWLSEVMLQQTQVKTV

SEQ ID NO: 2082333 - protein, 33 aa, Staphylococcus
REMTYRKLGKYPPYYFLINFTISHKEMKKVMEA

SEQ ID NO: 2082334 - protein, 22 aa, Staphylococcus
REMYDLRLMLESFAFSRLKDHD

SEQ ID NO: 2082335 - protein, 18 aa, Staphylococcus
RENEYSVFIIYQSDMFQY

SEQ ID NO: 2082336 - protein, 24 aa, Staphylococcus
RENIEIKQAPFFELYGPGDTQSES

SEQ ID NO: 2082337 - protein, 17 aa, Staphylococcus
RENKYMIMFEYKGHRIV

SEQ ID NO: 2082338 - protein, 17 aa, Staphylococcus
RENYEALLIYYKESNHN

SEQ ID NO: 2082339 - protein, 25 aa, Staphylococcus
REPNINKVIFLVDRKDLDSQTLAEF

SEQ ID NO: 2082340 - protein, 34 aa, Staphylococcus
REQDWENEWKHYFHPFRASEKFTIVPSWETYQQE

SEQ ID NO: 2082341 - protein, 18 aa, Staphylococcus
REQFLKELEDVDACFITL

SEQ ID NO: 2082342 - protein, 17 aa, Staphylococcus
REQFLREKILNGLVRSC

SEQ ID NO: 2082343 - protein, 21 aa, Staphylococcus
REQLLKDVWHYEFYGDLRTVD

SEQ ID NO: 2082344 - protein, 21 aa, Staphylococcus
REQLLKEVWHYEFYGDLRTVD

SEQ ID NO: 2082345 - protein, 33 aa, Staphylococcus
REQLNIPEVPFIVGLLPDFLGKAAFGQSAVEYA

SEQ ID NO: 2082346 - protein, 22 aa, Staphylococcus
REQQNLTIVLITHEMHVIRRIC

SEQ ID NO: 2082347 - protein, 22 aa, Staphylococcus
REQWSYDPFKLTEDNGYLYGRG

SEQ ID NO: 2082348 - protein, 22 aa, Staphylococcus
RERIMNVMKTHKPYFVYHAAAH

SEQ ID NO: 2082349 - protein, 20 aa, Staphylococcus
RERKFLKRKKFKEALQQKRE

SEQ ID NO: 2082350 - protein, 17 aa, Staphylococcus
RERLIILTTHHLDEVEA

SEQ ID NO: 2082351 - protein, 23 aa, Staphylococcus
RESRIYYSYRMDELIVSYLLQSY

SEQ ID NO: 2082352 - protein, 18 aa, Staphylococcus
RESYLKDRRYRHLDHRMM

SEQ ID NO: 2082353 - protein, 26 aa, Staphylococcus
RESYLTGHFLSLPGWAGMMYYRAEQH

SEQ ID NO: 2082354 - protein, 26 aa, Staphylococcus
RETEKIYMHLKPWDRVQLARLQERPT

SEQ ID NO: 2082355 - protein, 21 aa, Staphylococcus
REVFKFAVRIMGDASTRVVDK

SEQ ID NO: 2082356 - protein, 21 aa, Staphylococcus
REVFKFAVRIMGDASTRVVEK

SEQ ID NO: 2082357 - protein, 20 aa, Staphylococcus
REVHHVACLLGYGANAVIPY

SEQ ID NO: 2082358 - protein, 21 aa, Staphylococcus
REVHHVACLLGYGANAVIPYL

SEQ ID NO: 2082359 - protein, 20 aa, Staphylococcus
REVHHVACLLGYGANAVVPY

SEQ ID NO: 2082360 - protein, 21 aa, Staphylococcus
REVHHVACLLGYGANAVVPYL

SEQ ID NO: 2082361 - protein, 17 aa, Staphylococcus
REVIEDYTKLRGCQPYY

SEQ ID NO: 2082362 - protein, 17 aa, Staphylococcus
REVLGRKLHIGHSNGKQ

SEQ ID NO: 2082363 - protein, 29 aa, Staphylococcus
REVSAWRPEVMQALRLAGLPANSAYANAW

SEQ ID NO: 2082364 - protein, 27 aa, Staphylococcus
REVTGKWSWLAPSLSPTLVPNYHHGYK

SEQ ID NO: 2082365 - protein, 26 aa, Staphylococcus
REVYQHYALSALPFPEKTKFETKGES

SEQ ID NO: 2082366 - protein, 26 aa, Staphylococcus
REVYQHYALSELPFPKKTQFETKGES

SEQ ID NO: 2082367 - protein, 24 aa, Staphylococcus
REYDLLIYFIRHKNQVLTKQQLYE

SEQ ID NO: 2082368 - protein, 28 aa, Staphylococcus
REYHVYLKSHYFIYKKLLNTSYEEHLIP

SEQ ID NO: 2082369 - protein, 17 aa, Staphylococcus
REYIVLKLRSKPNRLHQ

SEQ ID NO: 2082370 - protein, 26 aa, Staphylococcus
REYNKSKIWLGVWENNPSAIDFYKKQ

SEQ ID NO: 2082371 - protein, 29 aa, Staphylococcus
RFAGVTNGYIYNVKSYDALLHCIDVTYAN

SEQ ID NO: 2082372 - protein, 19 aa, Staphylococcus
RFANAMFEPLWNNKYISNI

SEQ ID NO: 2082373 - protein, 41 aa, Staphylococcus
RFAYDCYRRLLQMFGEVVYGIPMLAFDTYFDDFKNKHNYKN

SEQ ID NO: 2082374 - protein, 17 aa, Staphylococcus
RFDAYYIAYQLAPLAKI

SEQ ID NO: 2082375 - protein, 18 aa, Staphylococcus
RFDELHVCILKNSSKAGT

SEQ ID NO: 2082376 - protein, 24 aa, Staphylococcus
RFDINFGRKFEAFLVPTVIGEIKR

SEQ ID NO: 2082377 - protein, 24 aa, Staphylococcus
RFDISFDRKFEAFLVPTVIGEIKR

SEQ ID NO: 2082378 - protein, 23 aa, Staphylococcus
RFDLSFDRKFEAFLVPTVIGEIK

SEQ ID NO: 2082379 - protein, 21 aa, Staphylococcus
RFEELFHTVKVKPGDFFYVPA

SEQ ID NO: 2082380 - protein, 22 aa, Staphylococcus
RFEILPYHQLGVHKYEALGQSY

SEQ ID NO: 2082381 - protein, 25 aa, Staphylococcus
RFENQYFLSILRKLEIHLIAFDEAH

SEQ ID NO: 2082382 - protein, 17 aa, Staphylococcus
RFEPRMFVGAISNLKNE

SEQ ID NO: 2082383 - protein, 17 aa, Staphylococcus
RFFLDKTVNQIYDVALG

SEQ ID NO: 2082384 - protein, 22 aa, Staphylococcus
RFFNMMKKREPIEDYTLVSLLQ

SEQ ID NO: 2082385 - protein, 25 aa, Staphylococcus
RFGQTKTIWIWTGFQYEYLSQDKGL

SEQ ID NO: 2082386 - protein, 30 aa, Staphylococcus
RFGSIYIKFDQTLFRFIFHIEKGSLRIEKQ

SEQ ID NO: 2082387 - protein, 18 aa, Staphylococcus
RFGVHLRLEYYNEADLKE

SEQ ID NO: 2082388 - protein, 18 aa, Staphylococcus
RFGVHLRLEYYSESDLKE

SEQ ID NO: 2082389 - protein, 26 aa, Staphylococcus
RFGYSKTIWIWTGFLFEYLKHQTDER

SEQ ID NO: 2082390 - protein, 19 aa, Staphylococcus
RFHMEKVKIPSFKGEIVFK

SEQ ID NO: 2082391 - protein, 30 aa, Staphylococcus
RFHRQPLPVPIFQYLKFKPKQVQFKLLNFL

SEQ ID NO: 2082392 - protein, 18 aa, Staphylococcus
RFIDVLAQKAKDYKYTLM

SEQ ID NO: 2082393 - protein, 27 aa, Staphylococcus
RFIERGIIEIAPLAYMRGRTLDDAFVI

SEQ ID NO: 2082394 - protein, 27 aa, Staphylococcus
RFIERGIIEVAPLAYMRGRTLDDAFVI

SEQ ID NO: 2082395 - protein, 27 aa, Staphylococcus
RFIERGTIEIAPLAYMRGRTLDDAFVI

SEQ ID NO: 2082396 - protein, 26 aa, Staphylococcus
RFKDWIADRRLIPTPVTLPSKATLSF

SEQ ID NO: 2082397 - protein, 20 aa, Staphylococcus
RFKEVYQIFSDVLGVPLKGK

SEQ ID NO: 2082398 - protein, 28 aa, Staphylococcus
RFKGIIASGMHTLSISFKLWVEEGKYGE

SEQ ID NO: 2082399 - protein, 23 aa, Staphylococcus
RFKHHFDLIIVDEVDAFPLVMDH

SEQ ID NO: 2082400 - protein, 22 aa, Staphylococcus
RFKNHFDLIFVDEVDAFPLAME

SEQ ID NO: 2082401 - protein, 35 aa, Staphylococcus
RFKPFFENMEILEASFDLLFVKWVPRDKNKEANQL

SEQ ID NO: 2082402 - protein, 17 aa, Staphylococcus
RFKVLDEVYLLPFSKFE

SEQ ID NO: 2082403 - protein, 22 aa, Staphylococcus
RFKVSVLPRRASFSGKQSLKRM

SEQ ID NO: 2082404 - protein, 17 aa, Staphylococcus
RFKYFKLNTTRVQTQFI

SEQ ID NO: 2082405 - protein, 17 aa, Staphylococcus
RFLELFDVGLEQLEFVM

SEQ ID NO: 2082406 - protein, 27 aa, Staphylococcus
RFLKPDQGLTYKIYFGFESRTAYEDFK

SEQ ID NO: 2082407 - protein, 29 aa, Staphylococcus
RFLNVGENIWGLRDWYSVADIEEKIAPTI

SEQ ID NO: 2082408 - protein, 18 aa, Staphylococcus
RFLQVRIPVRMDDGTVQT

SEQ ID NO: 2082409 - protein, 17 aa, Staphylococcus
RFNDTLDVLFIAVKTHQ

SEQ ID NO: 2082410 - protein, 17 aa, Staphylococcus
RFNEQFCRKLWLDAWEA

SEQ ID NO: 2082411 - protein, 22 aa, Staphylococcus
RFNIEPLVHITCRDRNLIGLQS

SEQ ID NO: 2082412 - protein, 17 aa, Staphylococcus
RFPSFRPDSWRGKRYLY

SEQ ID NO: 2082413 - protein, 17 aa, Staphylococcus
RFRDYLLELVDTFDIRS

SEQ ID NO: 2082414 - protein, 20 aa, Staphylococcus
RFSNLSVLDIGVASGVFSVP

SEQ ID NO: 2082415 - protein, 22 aa, Staphylococcus
RFTDRFELFIVGREHANAFTEL

SEQ ID NO: 2082416 - protein, 21 aa, Staphylococcus
RFTEYMNLDPFYEKLSQLLKK

SEQ ID NO: 2082417 - protein, 19 aa, Staphylococcus
RFTIVPSWETYTKDSNEEL

SEQ ID NO: 2082418 - protein, 23 aa, Staphylococcus
RFTLNVLYNRYQIPLFIVENGFG

SEQ ID NO: 2082419 - protein, 17 aa, Staphylococcus
RFVIILARKNVTADSEY

SEQ ID NO: 2082420 - protein, 20 aa, Staphylococcus
RFVQRQIETPLARKMIRENL

SEQ ID NO: 2082421 - protein, 17 aa, Staphylococcus
RFVVILARKNVTAQSDY

SEQ ID NO: 2082422 - protein, 17 aa, Staphylococcus
RFVVLNYLDQPVGASYL

SEQ ID NO: 2082423 - protein, 19 aa, Staphylococcus
RFYDVGVSGIHRLFAHIES

SEQ ID NO: 2082424 - protein, 19 aa, Staphylococcus
RFYDWIYSTNNEPHMGGRQ

SEQ ID NO: 2082425 - protein, 19 aa, Staphylococcus
RFYFHAIYSKEPGHIIFEF

SEQ ID NO: 2082426 - protein, 17 aa, Staphylococcus
RFYYHQLNEITQLEDLP

SEQ ID NO: 2082427 - protein, 25 aa, Staphylococcus
RGAKNIRFMCLIAALEGVEKLQEAH

SEQ ID NO: 2082428 - protein, 27 aa, Staphylococcus
RGAQEMWRSVYYLGNIISKLSKLDTNK

SEQ ID NO: 2082429 - protein, 24 aa, Staphylococcus
RGAQILAKYPKLQIKWIRGNIDTR

SEQ ID NO: 2082430 - protein, 18 aa, Staphylococcus
RGCTGAVVGYQPFGGFKM

SEQ ID NO: 2082431 - protein, 17 aa, Staphylococcus
RGDDTYLILNEEDILAV

SEQ ID NO: 2082432 - protein, 29 aa, Staphylococcus
RGDHYPKAIKPWILPNFESLVNHEKITME

SEQ ID NO: 2082433 - protein, 28 aa, Staphylococcus
RGDLRQILIDSLPNETIGWNKKVDRVEE

SEQ ID NO: 2082434 - protein, 27 aa, Staphylococcus
RGDLRQILIHSLPEETIEWNKKVDHIE

SEQ ID NO: 2082435 - protein, 29 aa, Staphylococcus
RGDRMYEFLDKLIAVSLPRVRDFHGVSKK

SEQ ID NO: 2082436 - protein, 29 aa, Staphylococcus
RGDRYSAAIKPWILPNFESLVNHEKIDME

SEQ ID NO: 2082437 - protein, 30 aa, Staphylococcus
RGDRYSAAIKPWILPNFESLVNHEKIKMEF

SEQ ID NO: 2082438 - protein, 30 aa, Staphylococcus
RGDRYSAAIKPWILPNFESLVNHEKITMEF

SEQ ID NO: 2082439 - protein, 33 aa, Staphylococcus
RGEGGRIWTYKDGKPWYFLEEKYPDYGNLVPRD

SEQ ID NO: 2082440 - protein, 36 aa, Staphylococcus
RGEIDPVIRFYTWNPATLSIGYFQRLKREIDIDKVK

SEQ ID NO: 2082441 - protein, 28 aa, Staphylococcus
RGEIDPVIRFYTWNPATLSIGYFQRLQK

SEQ ID NO: 2082442 - protein, 22 aa, Staphylococcus
RGERFILSNVNIYNSSPKVGIA

SEQ ID NO: 2082443 - protein, 29 aa, Staphylococcus
RGERMYEFLDKLIAVSLPRVRDFHGVSKK

SEQ ID NO: 2082444 - protein, 30 aa, Staphylococcus; identical to SEQ ID NO: 1681246

SEQ ID NO: 2082445 - protein, 18 aa, Staphylococcus
RGFAIRQEVLEELGFDFS

SEQ ID NO: 2082446 - protein, 17 aa, Staphylococcus
RGFPDFIETTVDGFIQK

SEQ ID NO: 2082447 - protein, 25 aa, Staphylococcus
RGGGRDRFFKKGNLQFVILKMLKEE

SEQ ID NO: 2082448 - protein, 21 aa, Staphylococcus
RGHHIMIATGRPYRASQIYYH

SEQ ID NO: 2082449 - protein, 18 aa, Staphylococcus
RGHKLYGNKLVVFDIRRH

SEQ ID NO: 2082450 - protein, 19 aa, Staphylococcus
RGIETADHKIIMLIEQGQF

SEQ ID NO: 2082451 - protein, 21 aa, Staphylococcus
RGIGYLFQDYQLFPNMTVMQN

SEQ ID NO: 2082452 - protein, 23 aa, Staphylococcus
RGIRVNSVAPGPFWSPLQISGGQ

SEQ ID NO: 2082453 - protein, 17 aa, Staphylococcus
RGISIFELLNEKASQRY

SEQ ID NO: 2082454 - protein, 23 aa, Staphylococcus
RGIVISLLSLNHIAVSDDAIIAG

SEQ ID NO: 2082455 - protein, 17 aa, Staphylococcus
RGIVLSLLSMDYIKVED

SEQ ID NO: 2082456 - protein, 18 aa, Staphylococcus
RGIYILPRKMWADDDIIR

SEQ ID NO: 2082457 - protein, 24 aa, Staphylococcus
RGKDLVCIGILKGSAMFMSDLIKR

SEQ ID NO: 2082458 - protein, 18 aa, Staphylococcus
RGKIYDRNGKILAEDVQR

SEQ ID NO: 2082459 - protein, 18 aa, Staphylococcus
RGLAPWPVAYTTMDDKNM

SEQ ID NO: 2082460 - protein, 17 aa, Staphylococcus
RGLGSSASALVAGIYLA

SEQ ID NO: 2082461 - protein, 22 aa, Staphylococcus
RGLIAHFTTIADAVKLPVVLYN

SEQ ID NO: 2082462 - protein, 17 aa, Staphylococcus
RGLIRLHQFDKVELVRF

SEQ ID NO: 2082463 - protein, 17 aa, Staphylococcus
RGLIYQQTDEAGIEELL

SEQ ID NO: 2082464 - protein, 17 aa, Staphylococcus
RGLIYQQTDESGIENIL

SEQ ID NO: 2082465 - protein, 21 aa, Staphylococcus
RGLKERYEVYHGVRIQDKALV

SEQ ID NO: 2082466 - protein, 17 aa, Staphylococcus
RGLLVPVVKHADRKSIF

SEQ ID NO: 2082467 - protein, 27 aa, Staphylococcus
RGLTFMKQWLNIVLEIPLVNTRNIKFD

SEQ ID NO: 2082468 - protein, 17 aa, Staphylococcus
RGMISRIIMSIMTASPK

SEQ ID NO: 2082469 - protein, 18 aa, Staphylococcus
RGMLKAVMDEKTGLILGA

SEQ ID NO: 2082470 - protein, 19 aa, Staphylococcus
RGMLLSDIVNWLEFELSCV

SEQ ID NO: 2082471 - protein, 17 aa, Staphylococcus
RGMNRLFDLGLTLHDLA

SEQ ID NO: 2082472 - protein, 24 aa, Staphylococcus
RGMNRLFSLNLSLDELCALGSQIG

SEQ ID NO: 2082473 - protein, 30 aa, Staphylococcus
RGNEYPKAIKPWILPNFESLVRHEKIDMAF

SEQ ID NO: 2082474 - protein, 19 aa, Staphylococcus
RGNIKWRAFATLPEQYEIL

SEQ ID NO: 2082475 - protein, 25 aa, Staphylococcus
RGPATNPLFKSFFNAGVEAGYHKTE

SEQ ID NO: 2082476 - protein, 25 aa, Staphylococcus
RGPATNPLFKSFFNAGVEAGYHKTP

SEQ ID NO: 2082477 - protein, 19 aa, Staphylococcus
RGPLLMQDAYFLEQMSHFD

SEQ ID NO: 2082478 - protein, 23 aa, Staphylococcus
RGPMAHGSHFHRAPGSVGMASDA

SEQ ID NO: 2082479 - protein, 23 aa, Staphylococcus
RGQEIDAGLWGARAAFIGGFDST

SEQ ID NO: 2082480 - protein, 18 aa, Staphylococcus
RGQKFIQLALDKAKELNK

SEQ ID NO: 2082481 - protein, 29 aa, Staphylococcus
RGQKNNVANFRIAVQRPFKNKQTDEYETD

SEQ ID NO: 2082482 - protein, 17 aa, Staphylococcus
RGQLMAEAFPDGVGSMA

SEQ ID NO: 2082483 - protein, 17 aa, Staphylococcus
RGQLMAQAFPNGVGSMA

SEQ ID NO: 2082484 - protein, 21 aa, Staphylococcus
RGQLNLWYITTIERLIELITY

SEQ ID NO: 2082485 - protein, 27 aa, Staphylococcus
RGQRQMELIKILFKKAQKLDSVNKLNN

SEQ ID NO: 2082486 - protein, 23 aa, Staphylococcus
RGQSPYKFLLSHGFVMDGEGKKM

SEQ ID NO: 2082487 - protein, 25 aa, Staphylococcus
RGQYAPMRLFKHSKTTLIKLLRNPF

SEQ ID NO: 2082488 - protein, 24 aa, Staphylococcus
RGRIIGDYRRVALYGIDFLMEEKL

SEQ ID NO: 2082489 - protein, 21 aa, Staphylococcus
RGRKTLLFGPMKPVGLEDPKT

SEQ ID NO: 2082490 - protein, 23 aa, Staphylococcus
RGRKTLLFGPMKPVGLEDPKTGE

SEQ ID NO: 2082491 - protein, 17 aa, Staphylococcus
RGRMQPVQPPTDDLRGL

SEQ ID NO: 2082492 - protein, 21 aa, Staphylococcus
RGSVIPLFKKQIAAGGPVTVT

SEQ ID NO: 2082493 - protein, 18 aa, Staphylococcus
RGTAILITGGFQPTKEVI

SEQ ID NO: 2082494 - protein, 17 aa, Staphylococcus
RGTAYWAIGQIAGETER

SEQ ID NO: 2082495 - protein, 19 aa, Staphylococcus
RGTAYWAIGQILGNDARTF

SEQ ID NO: 2082496 - protein, 22 aa, Staphylococcus
RGTEITSYFYNRMFQQHPELKN

SEQ ID NO: 2082497 - protein, 21 aa, Staphylococcus
RGTLLELKQNLEQLLMDEGYI

SEQ ID NO: 2082498 - protein, 17 aa, Staphylococcus
RGTPRVANRLLKRVRDF

SEQ ID NO: 2082499 - protein, 27 aa, Staphylococcus
RGYAKKAFKMAIDYAFLVLNMNKVYLY

SEQ ID NO: 2082500 - protein, 17 aa, Staphylococcus
RGYAWAIDPIDGTTNLV

SEQ ID NO: 2082501 - protein, 22 aa, Staphylococcus
RGYIAFGQPINVPLIANSYATH

SEQ ID NO: 2082502 - protein, 17 aa, Staphylococcus
RGYQKGRFSFNVKGGRC

SEQ ID NO: 2082503 - protein, 30 aa, Staphylococcus
RGYRKVVASPLPISILEHKLISTLVEQKNI

SEQ ID NO: 2082504 - protein, 24 aa, Staphylococcus
RGYRKVVPSPLPVSILEHQLISTL

SEQ ID NO: 2082505 - protein, 18 aa, Staphylococcus
RGYRRVVPSPQPIEIIEQ

SEQ ID NO: 2082506 - protein, 19 aa, Staphylococcus
RGYTSYTKGHILYENEFAF

SEQ ID NO: 2082507 - protein, 20 aa, Staphylococcus
RGYVNFHEKLKSLGANIERV

SEQ ID NO: 2082508 - protein, 26 aa, Staphylococcus
RHCKDTLLKNGWRYGQYYGYHGNSHI

SEQ ID NO: 2082509 - protein, 23 aa, Staphylococcus
RHDVIMFTICMDVVDSAFAPGVS

SEQ ID NO: 2082510 - protein, 17 aa, Staphylococcus
RHDYALKPFGKTVMNTL

SEQ ID NO: 2082511 - protein, 23 aa, Staphylococcus
RHDYQFLTFNVIGSPFGSSSKLN

SEQ ID NO: 2082512 - protein, 22 aa, Staphylococcus
RHELPPNLWKQFDEGFYPLPRK

SEQ ID NO: 2082513 - protein, 26 aa, Staphylococcus
RHEQKLIRTFVKRPDLLAKYPLTTED

SEQ ID NO: 2082514 - protein, 38 aa, Staphylococcus
RHEQSILHLSFDFLILDWTSIWILLKSFESAYFNENDV

SEQ ID NO: 2082515 - protein, 19 aa, Staphylococcus
RHFTYDYLHLLNEIYVNDE

SEQ ID NO: 2082516 - protein, 25 aa, Staphylococcus
RHGGRDRFFKKGNLQFVILKMLEEE

SEQ ID NO: 2082517 - protein, 25 aa, Staphylococcus
RHGKMPLTMFITKKGKKVKVNHLEQ

SEQ ID NO: 2082518 - protein, 27 aa, Staphylococcus
RHIAHPTGRIIGRRPGYKPNIEKLMKL

SEQ ID NO: 2082519 - protein, 21 aa, Staphylococcus
RHIIKFSIRKHHIPDTALLEC

SEQ ID NO: 2082520 - protein, 27 aa, Staphylococcus
RHIMNNHTILLYPLDIYDLYNKQQWID

SEQ ID NO: 2082521 - protein, 19 aa, Staphylococcus
RHIPGNGKFLYSPFSVFDN

SEQ ID NO: 2082522 - protein, 26 aa, Staphylococcus
RHKLEDISLIYHYFEERLNGEFITAE

SEQ ID NO: 2082523 - protein, 29 aa, Staphylococcus
RHKQKLIRTYLKRPDLLMAYPLSEQDKEI

SEQ ID NO: 2082524 - protein, 24 aa, Staphylococcus
RHKTLPAFSVQYHPEARPGPSDSN

SEQ ID NO: 2082525 - protein, 26 aa, Staphylococcus
RHLDDKASVAMILELLEKLKQEETQL

SEQ ID NO: 2082526 - protein, 28 aa, Staphylococcus
RHLDDKASVGMILELLKKLRNEGTKLPH

SEQ ID NO: 2082527 - protein, 30 aa, Staphylococcus
RHLEKSLLKFYLIKNVFFKSLPNIEKENNN

SEQ ID NO: 2082528 - protein, 17 aa, Staphylococcus
RHLGHIHEIYIAFETLY

SEQ ID NO: 2082529 - protein, 18 aa, Staphylococcus
RHLLKGNVVFIFQYGEEI

SEQ ID NO: 2082530 - protein, 19 aa, Staphylococcus
RHLLKGNVVFIFQYGEEIM

SEQ ID NO: 2082531 - protein, 17 aa, Staphylococcus
RHLSRKDKLQRLKENGW

SEQ ID NO: 2082532 - protein, 25 aa, Staphylococcus
RHMLKQFGPALKKPWTKLIAPELTT

SEQ ID NO: 2082533 - protein, 24 aa, Staphylococcus
RHNKTYWLNEEYYGFGAGASGYVN

SEQ ID NO: 2082534 - protein, 18 aa, Staphylococcus
RHPLGCEIIKNYDFEDIH

SEQ ID NO: 2082535 - protein, 23 aa, Staphylococcus
RHPNLNMIIGHWGEFVPFFLERM

SEQ ID NO: 2082536 - protein, 23 aa, Staphylococcus
RHQQAIQWVWQTVGLEGGDIHIG

SEQ ID NO: 2082537 - protein, 18 aa, Staphylococcus
RHQSWFNDQFKEETLAFL

SEQ ID NO: 2082538 - protein, 19 aa, Staphylococcus
RHQSWFNDQFKEETLSFLT

SEQ ID NO: 2082539 - protein, 18 aa, Staphylococcus
RHSSSTYALIEGLAYLGE

SEQ ID NO: 2082540 - protein, 18 aa, Staphylococcus
RHTHCSLLFEAGLSVQEV

SEQ ID NO: 2082541 - protein, 19 aa, Staphylococcus
RHTMDAVLFPDKFKRYETQ

SEQ ID NO: 2082542 - protein, 28 aa, Staphylococcus
RIAEISYWENGYISALNCYIQKLDTLES

SEQ ID NO: 2082543 - protein, 18 aa, Staphylococcus
RIAFMRIVSGAFERGMDV

SEQ ID NO: 2082544 - protein, 25 aa, Staphylococcus
RIAKYYDFIEVQPPALYQDLIDREL

SEQ ID NO: 2082545 - protein, 17 aa, Staphylococcus
RIAMLKYGIEDIRYFYT

SEQ ID NO: 2082546 - protein, 23 aa, Staphylococcus
RIAQRWRDIPMLIIDNHIEDESL

SEQ ID NO: 2082547 - protein, 25 aa, Staphylococcus
RIAQTINRFGFTIRGIYGEGSHVYG

SEQ ID NO: 2082548 - protein, 25 aa, Staphylococcus
RIAQTINRFGFTIRGIYGEGSQVYG

SEQ ID NO: 2082549 - protein, 30 aa, Staphylococcus
RIARELIELIIAFMFHHQIPMRVETSKLLS

SEQ ID NO: 2082550 - protein, 22 aa, Staphylococcus
RIAVIKSYRRTGVGKKLMLAIE

SEQ ID NO: 2082551 - protein, 30 aa, Staphylococcus; identical to SEQ ID NO: 1681249

SEQ ID NO: 2082552 - protein, 30 aa, Staphylococcus
RIAYFKVHHPLYYYASYFTVRASDFDLITM

SEQ ID NO: 2082553 - protein, 26 aa, Staphylococcus
RICDNIKYYFGLTCEKPYDFGENKDN

SEQ ID NO: 2082554 - protein, 26 aa, Staphylococcus
RIDFDKALDYWLNRFKIMENKDKKIE

SEQ ID NO: 2082555 - protein, 25 aa, Staphylococcus
RIDFIQVFKDDKFLCAFKTEKELFE

SEQ ID NO: 2082556 - protein, 29 aa, Staphylococcus
RIDIENLLGSKVYLDLWVKVQKDWRNKVN

SEQ ID NO: 2082557 - protein, 20 aa, Staphylococcus
RIDKGIIVTIFPDGSDRYMS

SEQ ID NO: 2082558 - protein, 21 aa, Staphylococcus
RIDKLLPEFNSDWSRSQIQDW

SEQ ID NO: 2082559 - protein, 20 aa, Staphylococcus
RIDMPYLRSPIVHHIHPDPF

SEQ ID NO: 2082560 - protein, 23 aa, Staphylococcus
RIDPPLPFNTRKTILRRAAQFLN

SEQ ID NO: 2082561 - protein, 22 aa, Staphylococcus
RIDYALFDIKLFYANETNLKLQ

SEQ ID NO: 2082562 - protein, 18 aa, Staphylococcus
RIEAWIAQIARKVDMMLN

SEQ ID NO: 2082563 - protein, 17 aa, Staphylococcus
RIEESDMYLYPDLDTWV

SEQ ID NO: 2082564 - protein, 29 aa, Staphylococcus
RIEGYESARWILIDLVNVVVHVFHKDERS

SEQ ID NO: 2082565 - protein, 24 aa, Staphylococcus
RIEKYRAHFPRLKDALLSCGEDFN

SEQ ID NO: 2082566 - protein, 34 aa, Staphylococcus
RIEVYIYDYDYKRVHFFLMLYTDEDELAATNEVI

SEQ ID NO: 2082567 - protein, 19 aa, Staphylococcus
RIEWKRVLDMNDRALRNVI

SEQ ID NO: 2082568 - protein, 17 aa, Staphylococcus
RIFEGMLASLTVNTDRL

SEQ ID NO: 2082569 - protein, 20 aa, Staphylococcus
RIGFDYLFIDNAHLEQPYLL

SEQ ID NO: 2082570 - protein, 17 aa, Staphylococcus
RIGIRMADLLEKETFER

SEQ ID NO: 2082571 - protein, 17 aa, Staphylococcus
RIGIRVADLLDKETFEK

SEQ ID NO: 2082572 - protein, 25 aa, Staphylococcus
RIGLLKIDFLGLRNLSIIHQIINQV

SEQ ID NO: 2082573 - protein, 25 aa, Staphylococcus
RIGLLKIDFLGLRNLSIIHQIITQV

SEQ ID NO: 2082574 - protein, 22 aa, Staphylococcus
RIGLLKIDFLGLRNLSIIHQIV

SEQ ID NO: 2082575 - protein, 25 aa, Staphylococcus
RIGLLKIDFLGLRNLSIIHQIVNQV

SEQ ID NO: 2082576 - protein, 17 aa, Staphylococcus
RIGQFYYGSDDTLLEQS

SEQ ID NO: 2082577 - protein, 19 aa, Staphylococcus
RIGRLFDITGLKDLMHVNE

SEQ ID NO: 2082578 - protein, 24 aa, Staphylococcus
RIGSIPTLMDFIEQNSIDPAVLLS

SEQ ID NO: 2082579 - protein, 17 aa, Staphylococcus
RIGVGRPTNGMSVPDYV

SEQ ID NO: 2082580 - protein, 23 aa, Staphylococcus
RIGYLTQQMTLDSSLTVIEEMSK

SEQ ID NO: 2082581 - protein, 17 aa, Staphylococcus
RIHTPSQMGIRKPEFTS

SEQ ID NO: 2082582 - protein, 19 aa, Staphylococcus
RIIDVGCGYGPIGLMIAKV

SEQ ID NO: 2082583 - protein, 19 aa, Staphylococcus
RIIFSRTFQASIEKVFDAY

SEQ ID NO: 2082584 - protein, 19 aa, Staphylococcus
RIIGDYRRVALYGVDFLME

SEQ ID NO: 2082585 - protein, 19 aa, Staphylococcus
RIIIWRYNDMNIDEGHNAT

SEQ ID NO: 2082586 - protein, 18 aa, Staphylococcus
RIILRRGPLFASLKEMYI

SEQ ID NO: 2082587 - protein, 22 aa, Staphylococcus
RIINEPTAAALAYGLDKTEQDQ

SEQ ID NO: 2082588 - protein, 19 aa, Staphylococcus
RIINRAAEQLGMKHIGLTT

SEQ ID NO: 2082589 - protein, 20 aa, Staphylococcus
RIISELLGEPPLLQTPNNIL

SEQ ID NO: 2082590 - protein, 18 aa, Staphylococcus
RIIVPIFDARREAVYTGL

SEQ ID NO: 2082591 - protein, 23 aa, Staphylococcus
RIKDANFFELYLPGDIESDDYVA

SEQ ID NO: 2082592 - protein, 30 aa, Staphylococcus
RIKDGTMILKPIFRDYLLKLANEKEINYQY

SEQ ID NO: 2082593 - protein, 31 aa, Staphylococcus
RIKDGTMILKPRFRDYLLKLATENDIKHQYY

SEQ ID NO: 2082594 - protein, 25 aa, Staphylococcus
RIKEWDFPFVIKPGDDLPTAGGYGV

SEQ ID NO: 2082595 - protein, 17 aa, Staphylococcus
RIKIRYLPCPCKVKYDE

SEQ ID NO: 2082596 - protein, 17 aa, Staphylococcus
RIKIWIENKIGRELEMI

SEQ ID NO: 2082597 - protein, 19 aa, Staphylococcus
RIKLIRHLNSALSDLVYII

SEQ ID NO: 2082598 - protein, 22 aa, Staphylococcus
RIKLIRHLNSPLSDLVYIIDEP

SEQ ID NO: 2082599 - protein, 19 aa, Staphylococcus
RIKLLKDYQVNRAMFDKTG

SEQ ID NO: 2082600 - protein, 25 aa, Staphylococcus
RIKLYYKRFFGLEPSALETNHSVYL

SEQ ID NO: 2082601 - protein, 17 aa, Staphylococcus
RIKRIFRRTKASINEVF

SEQ ID NO: 2082602 - protein, 21 aa, Staphylococcus
RIKRYIAKYTINPAITHGISD

SEQ ID NO: 2082603 - protein, 24 aa, Staphylococcus
RIKSWSYPFVIKPGDDLPTAGGYG

SEQ ID NO: 2082604 - protein, 17 aa, Staphylococcus
RIKTAIPNIALTTDIIV

SEQ ID NO: 2082605 - protein, 25 aa, Staphylococcus
RIKTRKLLESLILVGAFDSLGHNRA

SEQ ID NO: 2082606 - protein, 19 aa, Staphylococcus
RIKTRKLLESLILVGAFDT

SEQ ID NO: 2082607 - protein, 20 aa, Staphylococcus
RIKTRKLLESLILVGAFDTF

SEQ ID NO: 2082608 - protein, 27 aa, Staphylococcus
RIKVKPGEFYFIPAGMLHSIGSGVLVY

SEQ ID NO: 2082609 - protein, 17 aa, Staphylococcus
RIKYYPLAIDHGYGATL

SEQ ID NO: 2082610 - protein, 21 aa, Staphylococcus
RIKYYPLAIDYGYGATLVDVD

SEQ ID NO: 2082611 - protein, 21 aa, Staphylococcus
RILDFALALIGKPQCIFLDEP

SEQ ID NO: 2082612 - protein, 18 aa, Staphylococcus
RILDFALTVTGRPKLLIL

SEQ ID NO: 2082613 - protein, 23 aa, Staphylococcus
RILDFGLCLIGKPKLLILDEPTA

SEQ ID NO: 2082614 - protein, 25 aa, Staphylococcus
RILDNTTLVYLTYPNNPTGSTATKE

SEQ ID NO: 2082615 - protein, 17 aa, Staphylococcus
RILGFDAVGIVESIGKN

SEQ ID NO: 2082616 - protein, 30 aa, Staphylococcus; identical to SEQ ID NO: 1831872

SEQ ID NO: 2082617 - protein, 17 aa, Staphylococcus
RILLIFGPEGGFSEKEI

SEQ ID NO: 2082618 - protein, 17 aa, Staphylococcus
RILNMDGIYINSPKDRL

SEQ ID NO: 2082619 - protein, 20 aa, Staphylococcus
RILPLLLDDDSHYRLYGIFL

SEQ ID NO: 2082620 - protein, 20 aa, Staphylococcus
RILRAETAPLYALSAISFEK

SEQ ID NO: 2082621 - protein, 25 aa, Staphylococcus
RILRRFPEKLSKYIEKWFKKHDVTV

SEQ ID NO: 2082622 - protein, 25 aa, Staphylococcus
RILTERGVLIIPDVLASAGGVTVSY

SEQ ID NO: 2082623 - protein, 17 aa, Staphylococcus
RILTLEEALEYINDDEL

SEQ ID NO: 2082624 - protein, 19 aa, Staphylococcus
RIMLALKSIFVKSRGQTAI

SEQ ID NO: 2082625 - protein, 20 aa, Staphylococcus
RIMRLHFEGILEERLDELGE

SEQ ID NO: 2082626 - protein, 22 aa, Staphylococcus
RIMRLHYEGILQERLDELGEMP

SEQ ID NO: 2082627 - protein, 19 aa, Staphylococcus
RIMSQRVGPIKLHIVPFTN

SEQ ID NO: 2082628 - protein, 22 aa, Staphylococcus
RINEMLDKQLYLTRLESKNRDM

SEQ ID NO: 2082629 - protein, 25 aa, Staphylococcus
RINFVTLIENIFSYKPRKVPIDLKE

SEQ ID NO: 2082630 - protein, 22 aa, Staphylococcus
RINNEYRFQILVKYKSEPQLHQ

SEQ ID NO: 2082631 - protein, 23 aa, Staphylococcus
RINPHIRGQLFKLLEFSNMEESD

SEQ ID NO: 2082632 - protein, 18 aa, Staphylococcus
RIPFIKKMQDKGLFASIS

SEQ ID NO: 2082633 - protein, 17 aa, Staphylococcus
RIPFIKKMQNKGLFASI

SEQ ID NO: 2082634 - protein, 26 aa, Staphylococcus
RIQGTLIKKQAMMRGFLVAEFADDFK

SEQ ID NO: 2082635 - protein, 18 aa, Staphylococcus
RIQLQRPVLTPSQLEYIE

SEQ ID NO: 2082636 - protein, 17 aa, Staphylococcus
RIRAMLRRQPQKNLIDI

SEQ ID NO: 2082637 - protein, 18 aa, Staphylococcus
RIRLYVPLSERISANEYR

SEQ ID NO: 2082638 - protein, 18 aa, Staphylococcus
RIRRLLKLYLERESFDIE

SEQ ID NO: 2082639 - protein, 17 aa, Staphylococcus
RISLSIKDTLPTPFENI

SEQ ID NO: 2082640 - protein, 21 aa, Staphylococcus
RISLSIKDTLPTPFENIKGKF

SEQ ID NO: 2082641 - protein, 21 aa, Staphylococcus
RISLSIKDTLPTPFERIKGQF

SEQ ID NO: 2082642 - protein, 20 aa, Staphylococcus
RISMPYLRSPIVHHIHPNPF

SEQ ID NO: 2082643 - protein, 17 aa, Staphylococcus
RISPFDSSGRRHTSFAS

SEQ ID NO: 2082644 - protein, 19 aa, Staphylococcus
RISYAYELDALKEAMRRLE

SEQ ID NO: 2082645 - protein, 25 aa, Staphylococcus
RITAIFPKLVFSIKRGVNLNESDPN

SEQ ID NO: 2082646 - protein, 27 aa, Staphylococcus
RITGGEPLLRRNLYQLIAELNQIDGIE

SEQ ID NO: 2082647 - protein, 28 aa, Staphylococcus
RITHRMDMLFTHFGVSGPGALRCSQFVY

SEQ ID NO: 2082648 - protein, 18 aa, Staphylococcus
RITLVFFHHIETMLAAYH

SEQ ID NO: 2082649 - protein, 20 aa, Staphylococcus
RITPQRQAILRFLISSDTHP

SEQ ID NO: 2082650 - protein, 22 aa, Staphylococcus
RITRHLIKKYQESFFTFPAASS

SEQ ID NO: 2082651 - protein, 17 aa, Staphylococcus
RITRKEVLLNNIKTPIL

SEQ ID NO: 2082652 - protein, 33 aa, Staphylococcus
RITSKFLQTDFINQLIIYYAPKIIGGSGKNQFY

SEQ ID NO: 2082653 - protein, 27 aa, Staphylococcus
RIVGNKKIILAANKLDLLPKQINKRRV

SEQ ID NO: 2082654 - protein, 27 aa, Staphylococcus
RIVGNKKIILAANKLDLLPKQINQRRV

SEQ ID NO: 2082655 - protein, 26 aa, Staphylococcus
RIVGNKKIILAANKLDLLPRQINQRR

SEQ ID NO: 2082656 - protein, 26 aa, Staphylococcus
RIVGNKKIILVANKLDLLPKQINHRR

SEQ ID NO: 2082657 - protein, 26 aa, Staphylococcus
RIVGNKKIILVANKMDLLPKQINHRR

SEQ ID NO: 2082658 - protein, 27 aa, Staphylococcus
RIVGNKQIILVGNKLDLLPKQINKRRV

SEQ ID NO: 2082659 - protein, 26 aa, Staphylococcus
RIVHNYDFPMWFIRPKYKTKTQSRST

SEQ ID NO: 2082660 - protein, 33 aa, Staphylococcus
RIVKNVTIAPSPIWMQARLMKAGIRPINNVVDI

SEQ ID NO: 2082661 - protein, 33 aa, Staphylococcus
RIVKNVTIAPSPIWMQMRLIKAGIRPINNVVDI

SEQ ID NO: 2082662 - protein, 25 aa, Staphylococcus
RIVNYTKLFWSTIEDYFFGVIPSKV

SEQ ID NO: 2082663 - protein, 18 aa, Staphylococcus
RIVTWTKRNYDIPVVAQL

SEQ ID NO: 2082664 - protein, 17 aa, Staphylococcus
RIYGIFLLNQVNGKELM

SEQ ID NO: 2082665 - protein, 17 aa, Staphylococcus
RIYGYDNIPSTLPVFDD

SEQ ID NO: 2082666 - protein, 19 aa, Staphylococcus
RIYKANVKALLPIKPQTID

SEQ ID NO: 2082667 - protein, 28 aa, Staphylococcus
RIYQMKDLNWIYLVKHLRQAGVTIELLV

SEQ ID NO: 2082668 - protein, 27 aa, Staphylococcus
RKALSQADLILFVLNNNEALTEDDQTL

SEQ ID NO: 2082669 - protein, 29 aa, Staphylococcus
RKALSQADLILFVLNYNEPLTKEDRTLFE

SEQ ID NO: 2082670 - protein, 25 aa, Staphylococcus
RKDDLRYQFLQKYWNTLPKKGDINV

SEQ ID NO: 2082671 - protein, 18 aa, Staphylococcus
RKDGILNYLRPDGKVQVT

SEQ ID NO: 2082672 - protein, 25 aa, Staphylococcus
RKDGNYHILLFNKINDRYLSDSKQK

SEQ ID NO: 2082673 - protein, 23 aa, Staphylococcus
RKDIQIILYDRGERILRNFPEKL

SEQ ID NO: 2082674 - protein, 24 aa, Staphylococcus
RKDPHFNSYINGEYLTFWGEFASD

SEQ ID NO: 2082675 - protein, 18 aa, Staphylococcus
RKDYAVSDPVTVLAAAAA

SEQ ID NO: 2082676 - protein, 23 aa, Staphylococcus
RKEAILLLHSFTGTVRDVKPLAK

SEQ ID NO: 2082677 - protein, 25 aa, Staphylococcus
RKELLGIEDLKMYDLYTPLVKDVKF

SEQ ID NO: 2082678 - protein, 24 aa, Staphylococcus
RKETVCNILFRNAIIKAHDIKFNE

SEQ ID NO: 2082679 - protein, 26 aa, Staphylococcus
RKGHIQFLYVAPERFDNQYFLSLLSR

SEQ ID NO: 2082680 - protein, 21 aa, Staphylococcus
RKGLAPLAHFLIEGQSMNVHE

SEQ ID NO: 2082681 - protein, 25 aa, Staphylococcus
RKGLTPEMNLLYSSEFHQPQSLKFI

SEQ ID NO: 2082682 - protein, 19 aa, Staphylococcus
RKGPTIGYLAEYDALPGLG

SEQ ID NO: 2082683 - protein, 28 aa, Staphylococcus
RKHDFKQIFLMFNPVSKLNWVYKYFFEH

SEQ ID NO: 2082684 - protein, 19 aa, Staphylococcus
RKHFNNIQTLNIMLFGEHN

SEQ ID NO: 2082685 - protein, 20 aa, Staphylococcus
RKHLIDKYSIGIIALNDTDI

SEQ ID NO: 2082686 - protein, 18 aa, Staphylococcus
RKHVGFTSELDLIHETTD

SEQ ID NO: 2082687 - protein, 23 aa, Staphylococcus
RKHWHVIFHLNNGKKLVFSDIRR

SEQ ID NO: 2082688 - protein, 34 aa, Staphylococcus
RKIADLILKEIISRLYFLNNVGLDYLTLNRSSGT

SEQ ID NO: 2082689 - protein, 19 aa, Staphylococcus
RKIEADVPVYYYGFSNKDD

SEQ ID NO: 2082690 - protein, 17 aa, Staphylococcus
RKIKMIEKMQFIDEHEE

SEQ ID NO: 2082691 - protein, 23 aa, Staphylococcus
RKIKPLEEVLGGAIAWISGLRRD

SEQ ID NO: 2082692 - protein, 19 aa, Staphylococcus
RKIMLKSLYYHQSSPSLLH

SEQ ID NO: 2082693 - protein, 23 aa, Staphylococcus
RKINILIGLLSQPKILILDEPTV

SEQ ID NO: 2082694 - protein, 25 aa, Staphylococcus
RKIRQVSNVPILFLSSRDNPMDQVM

SEQ ID NO: 2082695 - protein, 30 aa, Staphylococcus
RKISVQDVMFLLLYAIKDLGGRLNMDPITD

SEQ ID NO: 2082696 - protein, 20 aa, Staphylococcus
RKIYREKLNYILERLKPHED

SEQ ID NO: 2082697 - protein, 19 aa, Staphylococcus
RKKALKRLLIYFEQVDILD

SEQ ID NO: 2082698 - protein, 25 aa, Staphylococcus
RKKDIGFIFQDYNILHTLTVKENIM

SEQ ID NO: 2082699 - protein, 17 aa, Staphylococcus
RKKLHQYSDFEYIDTKW

SEQ ID NO: 2082700 - protein, 17 aa, Staphylococcus
RKKTGIMVHPHLLRHTH

SEQ ID NO: 2082701 - protein, 23 aa, Staphylococcus
RKLKSLKDHFYRYSLKLRQKVKT

SEQ ID NO: 2082702 - protein, 20 aa, Staphylococcus
RKLLKVLIEQELLIITQGED

SEQ ID NO: 2082703 - protein, 26 aa, Staphylococcus
RKLNKEQLLFPLNHLFRKIELNEMCT

SEQ ID NO: 2082704 - protein, 21 aa, Staphylococcus
RKLTEMGIYPAVDPLASTSRA

SEQ ID NO: 2082705 - protein, 28 aa, Staphylococcus
RKMISTPTIFNIVGPLINPFKLTYQVLG

SEQ ID NO: 2082706 - protein, 17 aa, Staphylococcus
RKMVESLQFLVDGRIHK

SEQ ID NO: 2082707 - protein, 18 aa, Staphylococcus
RKNAHLKFIPMTEDGQLA

SEQ ID NO: 2082708 - protein, 22 aa, Staphylococcus
RKNDNVFLYEIGRVFFANGEGE

SEQ ID NO: 2082709 - protein, 24 aa, Staphylococcus
RKNHPKTLFVWRSNLISSSAKGQE

SEQ ID NO: 2082710 - protein, 24 aa, Staphylococcus
RKNKERFNLYLDGVFEMGIDMDTL

SEQ ID NO: 2082711 - protein, 25 aa, Staphylococcus
RKPLPNMIFHQVEVNQYAVFQYPPY

SEQ ID NO: 2082712 - protein, 23 aa, Staphylococcus
RKPNIIHKIEKLVWMGGTFLTRG

SEQ ID NO: 2082713 - protein, 28 aa, Staphylococcus
RKPQPNGWILHIPSCYLGIAQAARDYAV

SEQ ID NO: 2082714 - protein, 27 aa, Staphylococcus
RKPQPNGWILHIPSTYLGIAQAARNYA

SEQ ID NO: 2082715 - protein, 27 aa, Staphylococcus
RKPSEFYNPLTLYRGLKLKTFNNANQL

SEQ ID NO: 2082716 - protein, 25 aa, Staphylococcus
RKPTQHYLFNVPNILGLSNLITQNE

SEQ ID NO: 2082717 - protein, 26 aa, Staphylococcus
RKQAENVNNYLFKGSLAGVDGRIQSR

SEQ ID NO: 2082718 - protein, 31 aa, Staphylococcus
RKQHFIAEKNFFHFFRNFFTQKWEREVDTNL

SEQ ID NO: 2082719 - protein, 28 aa, Staphylococcus
RKQIKSPTIFNLVGPLINPFKLTYQVMG

SEQ ID NO: 2082720 - protein, 27 aa, Staphylococcus
RKQKLEPAYAFMIRVRLPGGKATPEQW

SEQ ID NO: 2082721 - protein, 17 aa, Staphylococcus
RKQREIIYGERNNIIDS

SEQ ID NO: 2082722 - protein, 24 aa, Staphylococcus
RKQTACNIIFRTAIVKAHHLKFNE

SEQ ID NO: 2082723 - protein, 19 aa, Staphylococcus
RKQTACNIIFRTAIVRAHD

SEQ ID NO: 2082724 - protein, 17 aa, Staphylococcus
RKRAIIAPSYFEPTEGD

SEQ ID NO: 2082725 - protein, 23 aa, Staphylococcus
RKRCLNMGIADLKKIYFTEDLVK

SEQ ID NO: 2082726 - protein, 17 aa, Staphylococcus
RKREFYEKPSVKRKKKS

SEQ ID NO: 2082727 - protein, 24 aa, Staphylococcus
RKRGQFINMDYLDDIRVNIIYDIP

SEQ ID NO: 2082728 - protein, 17 aa, Staphylococcus
RKRGVVGKFVEFFGPGV

SEQ ID NO: 2082729 - protein, 21 aa, Staphylococcus
RKRIAFYIDNRLDSALIIYGA

SEQ ID NO: 2082730 - protein, 18 aa, Staphylococcus
RKRKWRAVLQGFDSMAKI

SEQ ID NO: 2082731 - protein, 17 aa, Staphylococcus
RKRLYSENFMVIYNDDN

SEQ ID NO: 2082732 - protein, 29 aa, Staphylococcus
RKRNYKYLYPLFRILPKNKKKVIYYSYWG

SEQ ID NO: 2082733 - protein, 20 aa, Staphylococcus
RKRVLIASSSITYVVDCLVK

SEQ ID NO: 2082734 - protein, 29 aa, Staphylococcus
RKRVLRAIEYYLKTKKLLSSRKKVQQFTE

SEQ ID NO: 2082735 - protein, 26 aa, Staphylococcus
RKRVLRAIEYYLKTKKLLSYRKKVQQ

SEQ ID NO: 2082736 - protein, 27 aa, Staphylococcus
RKRVLRAIEYYLNTKKLISSRKKVQQF

SEQ ID NO: 2082737 - protein, 19 aa, Staphylococcus
RKRVLRAVEYYLKTKKLLS

SEQ ID NO: 2082738 - protein, 24 aa, Staphylococcus
RKRVLYHCWAYVPQWKMTELQQAI

SEQ ID NO: 2082739 - protein, 20 aa, Staphylococcus
RKTFYLHYIDKYDLLDRIVD

SEQ ID NO: 2082740 - protein, 22 aa, Staphylococcus
RKTQVLYLNGIIDSFNVYNDES

SEQ ID NO: 2082741 - protein, 18 aa, Staphylococcus
RKVILRRAAQFLLEGDVI

SEQ ID NO: 2082742 - protein, 18 aa, Staphylococcus
RKVNVLIGLLSNPQILIL

SEQ ID NO: 2082743 - protein, 20 aa, Staphylococcus
RKVRRLYNDKVLAGFAGSVA

SEQ ID NO: 2082744 - protein, 18 aa, Staphylococcus
RKVTIPFAELKYLSNYYT

SEQ ID NO: 2082745 - protein, 17 aa, Staphylococcus
RKWIPLMMQGHSAGDIM

SEQ ID NO: 2082746 - protein, 18 aa, Staphylococcus
RKYDIPIIAQLTASNTNY

SEQ ID NO: 2082747 - protein, 26 aa, Staphylococcus
RKYDKKLWPGLWDFSAAGAVMQGETS

SEQ ID NO: 2082748 - protein, 25 aa, Staphylococcus
RKYDTYFVTHGFGTIAALKYIEGTH

SEQ ID NO: 2082749 - protein, 20 aa, Staphylococcus
RKYEIPIIAQLTASNTNYLV

SEQ ID NO: 2082750 - protein, 21 aa, Staphylococcus
RKYFLERTFRKPSEFYNPLTL

SEQ ID NO: 2082751 - protein, 17 aa, Staphylococcus
RKYLLKTAANREHLARC

SEQ ID NO: 2082752 - protein, 23 aa, Staphylococcus
RKYMAVLYQKTHFPKLVKVKELF

SEQ ID NO: 2082753 - protein, 17 aa, Staphylococcus
RKYPQLMDEMRTEFIAF

SEQ ID NO: 2082754 - protein, 19 aa, Staphylococcus
RKYQDYTVINEKGIYRLIM

SEQ ID NO: 2082755 - protein, 18 aa, Staphylococcus
RLAGLPANSAYANAWLRQ

SEQ ID NO: 2082756 - protein, 17 aa, Staphylococcus
RLAILDHMLQTIDTSRS

SEQ ID NO: 2082757 - protein, 18 aa, Staphylococcus
RLAIMDHMLQTIDQPRKE

SEQ ID NO: 2082758 - protein, 17 aa, Staphylococcus
RLAIMDHMLQTIDQPRN

SEQ ID NO: 2082759 - protein, 17 aa, Staphylococcus
RLAIMDHMLQTIDQPRS

SEQ ID NO: 2082760 - protein, 24 aa, Staphylococcus
RLAKSRFIFLSPEFILQPQNFKLI

SEQ ID NO: 2082761 - protein, 17 aa, Staphylococcus
RLALKRGTKVERAGREQ

SEQ ID NO: 2082762 - protein, 17 aa, Staphylococcus
RLALKRGTKVERTGREG

SEQ ID NO: 2082763 - protein, 17 aa, Staphylococcus
RLALQQDESWMRGMVRE

SEQ ID NO: 2082764 - protein, 19 aa, Staphylococcus
RLATQIGSRLSGVLYVLDE

SEQ ID NO: 2082765 - protein, 21 aa, Staphylococcus
RLCHELQSLGYIPIIAHPERN

SEQ ID NO: 2082766 - protein, 21 aa, Staphylococcus
RLDATYRDFFAVLISETNGIF

SEQ ID NO: 2082767 - protein, 27 aa, Staphylococcus
RLDEETFGYVVYFFELACAMSGYQLGV

SEQ ID NO: 2082768 - protein, 22 aa, Staphylococcus
RLDHFMGVLQILQKPEYLERHI

SEQ ID NO: 2082769 - protein, 28 aa, Staphylococcus
RLDIDTFPQDGFLSLKIFVDTKDAMGAN

SEQ ID NO: 2082770 - protein, 17 aa, Staphylococcus
RLDKRIYDLQLSRQIAL

SEQ ID NO: 2082771 - protein, 19 aa, Staphylococcus
RLDRYFPDWHATYSRVAEL

SEQ ID NO: 2082772 - protein, 21 aa, Staphylococcus
RLEILDLLSCGELCACDLLAY

SEQ ID NO: 2082773 - protein, 25 aa, Staphylococcus
RLEKEQIFVYISYGNHDPLTEKITN

SEQ ID NO: 2082774 - protein, 28 aa, Staphylococcus
RLERLRQAIPNVLFQMLLRASNAVGYKN

SEQ ID NO: 2082775 - protein, 28 aa, Staphylococcus
RLERVCALTMLYVLGKYLDKKQSYMLDD

SEQ ID NO: 2082776 - protein, 28 aa, Staphylococcus
RLEVKNPLQLIYAILAKYQANHLTNDLK

SEQ ID NO: 2082777 - protein, 19 aa, Staphylococcus
RLEVVESFRNSGNKPEWMI

SEQ ID NO: 2082778 - protein, 17 aa, Staphylococcus
RLEYYSESDLKEIIIRT

SEQ ID NO: 2082779 - protein, 20 aa, Staphylococcus
RLFEGFSMGNPKIQTGNLLE

SEQ ID NO: 2082780 - protein, 20 aa, Staphylococcus
RLFKDYYKEWLKLNGKYELS

SEQ ID NO: 2082781 - protein, 25 aa, Staphylococcus
RLFSLNDLERLLEIKKLIEKGFNIK

SEQ ID NO: 2082782 - protein, 17 aa, Staphylococcus
RLGFIESEGRYFIDGKE

SEQ ID NO: 2082783 - protein, 18 aa, Staphylococcus
RLGFKRYAYRHDKYGYKR

SEQ ID NO: 2082784 - protein, 17 aa, Staphylococcus
RLGIRLEKTFEYIDTPH

SEQ ID NO: 2082785 - protein, 33 aa, Staphylococcus
RLGKSRPYIANMLRLLHLPSAIMKMVKEGELSG

SEQ ID NO: 2082786 - protein, 30 aa, Staphylococcus
RLGKSRPYIANMLRLLHLPTSLKDSVQRGE

SEQ ID NO: 2082787 - protein, 27 aa, Staphylococcus
RLGKSRPYIANMLRLLNLPKDISNQVK

SEQ ID NO: 2082788 - protein, 30 aa, Staphylococcus
RLGKSRPYIANMLRLLNLPSDIAKLVRENR

SEQ ID NO: 2082789 - protein, 31 aa, Staphylococcus
RLGKSRPYIANMLRLLNLPTDITQYIKDGKL

SEQ ID NO: 2082790 - protein, 23 aa, Staphylococcus
RLGKTVAILLDTKGPEIRTHNMK

SEQ ID NO: 2082791 - protein, 25 aa, Staphylococcus
RLGLLKIDFLGLRNLSIIHQIITQV

SEQ ID NO: 2082792 - protein, 25 aa, Staphylococcus
RLGLLKIDFLGLRNLSIIHQIVTQV

SEQ ID NO: 2082793 - protein, 18 aa, Staphylococcus
RLGNSLKTKLRVALGTID

SEQ ID NO: 2082794 - protein, 18 aa, Staphylococcus
RLHTNPMRILDCKVDRDK

SEQ ID NO: 2082795 - protein, 21 aa, Staphylococcus
RLIDQYLTNGKSRSIPIFVFM

SEQ ID NO: 2082796 - protein, 17 aa, Staphylococcus
RLIHAYPNFLSFSEYDL

SEQ ID NO: 2082797 - protein, 18 aa, Staphylococcus
RLILDKAHNKKPTKRLWI

SEQ ID NO: 2082798 - protein, 17 aa, Staphylococcus
RLIPLSEGYIYFKDKPV

SEQ ID NO: 2082799 - protein, 43 aa, Staphylococcus
RLISLHNIGHRIIFASARPIRDLLPVLPSQFHRFTLIGGNGSI

SEQ ID NO: 2082800 - protein, 18 aa, Staphylococcus
RLISLSEGYIYFNDKPIS

SEQ ID NO: 2082801 - protein, 17 aa, Staphylococcus
RLIVPKKSKLSLQDTVE

SEQ ID NO: 2082802 - protein, 18 aa, Staphylococcus
RLKADLIREFLDSVIPHL

SEQ ID NO: 2082803 - protein, 17 aa, Staphylococcus
RLKDGILAIDLLRRPEM

SEQ ID NO: 2082804 - protein, 21 aa, Staphylococcus
RLKDHAAIVQWLEKYQTLGIG

SEQ ID NO: 2082805 - protein, 28 aa, Staphylococcus
RLKDHFEIPYPQYCKHEFVLSGSKQKEH

SEQ ID NO: 2082806 - protein, 18 aa, Staphylococcus
RLKDLIKVYLKENDFEVL

SEQ ID NO: 2082807 - protein, 21 aa, Staphylococcus
RLKDVIVPFHKNKTFYALNDL

SEQ ID NO: 2082808 - protein, 21 aa, Staphylococcus
RLKEVKNFYLKYFGLEESSYV

SEQ ID NO: 2082809 - protein, 17 aa, Staphylococcus
RLKGLKEWHFGVFEGES

SEQ ID NO: 2082810 - protein, 19 aa, Staphylococcus
RLKGVFAWGYRINSTNPEE

SEQ ID NO: 2082811 - protein, 20 aa, Staphylococcus
RLKIALENWAIEMGAKSIEG

SEQ ID NO: 2082812 - protein, 20 aa, Staphylococcus
RLKNLYFKYLILIEQSLKNN

SEQ ID NO: 2082813 - protein, 23 aa, Staphylococcus
RLKQWIDRPLIYKQAINERLDAV

SEQ ID NO: 2082814 - protein, 24 aa, Staphylococcus
RLKRKKPHLFTVPQKHPRGKWCSH

SEQ ID NO: 2082815 - protein, 18 aa, Staphylococcus
RLKSIIKKEFSISFEEFA

SEQ ID NO: 2082816 - protein, 36 aa, Staphylococcus
RLKWKDLFHDFEMHFYRYVFPYYDTLYTLEKLSEHD

SEQ ID NO: 2082817 - protein, 18 aa, Staphylococcus
RLKYRYLDLRRQELAQTF

SEQ ID NO: 2082818 - protein, 18 aa, Staphylococcus
RLKYRYLDLRRTELAQTF

SEQ ID NO: 2082819 - protein, 21 aa, Staphylococcus
RLLDFGVHPPTIYFPLNVEEG

SEQ ID NO: 2082820 - protein, 20 aa, Staphylococcus
RLLDIQYPIIQAGMAGSTTA

SEQ ID NO: 2082821 - protein, 20 aa, Staphylococcus
RLLDNIFTNCLGKYPDYLNN

SEQ ID NO: 2082822 - protein, 32 aa, Staphylococcus
RLLEREEVEWIILAGYMRLIGPDLLDAYEGKI

SEQ ID NO: 2082823 - protein, 24 aa, Staphylococcus
RLLKDNYDWLIFSSKNAVKFFLPY

SEQ ID NO: 2082824 - protein, 17 aa, Staphylococcus
RLLKGVVSGIGGYGNCI

SEQ ID NO: 2082825 - protein, 18 aa, Staphylococcus
RLLVPIFDARREAVYTGV

SEQ ID NO: 2082826 - protein, 18 aa, Staphylococcus
RLMQFSDPYTLVIGPYYR

SEQ ID NO: 2082827 - protein, 17 aa, Staphylococcus
RLNFDYYFIDIENLETK

SEQ ID NO: 2082828 - protein, 19 aa, Staphylococcus
RLNIHLENWHKEKLYDRVG

SEQ ID NO: 2082829 - protein, 17 aa, Staphylococcus
RLNIYRSNKHIYAQVID

SEQ ID NO: 2082830 - protein, 19 aa, Staphylococcus
RLNKRLPKLLDIADHHCMI

SEQ ID NO: 2082831 - protein, 24 aa, Staphylococcus
RLNRYTIQRLALGIAYYLQDNMAQ

SEQ ID NO: 2082832 - protein, 20 aa, Staphylococcus
RLNVFYATQVAIEPPTFIVF

SEQ ID NO: 2082833 - protein, 20 aa, Staphylococcus
RLNVFYATQVAIEPPTFVIF

SEQ ID NO: 2082834 - protein, 20 aa, Staphylococcus
RLNVFYTTQVAIEPPTFVVF

SEQ ID NO: 2082835 - protein, 17 aa, Staphylococcus
RLNVTAVYTIEQVKAIT

SEQ ID NO: 2082836 - protein, 18 aa, Staphylococcus
RLNYFVYRHPNTLEYEVI

SEQ ID NO: 2082837 - protein, 24 aa, Staphylococcus
RLNYHTRRLCHSCSQLGFQFSENA

SEQ ID NO: 2082838 - protein, 21 aa, Staphylococcus
RLNYIINQIRRYTKEDYDIAI

SEQ ID NO: 2082839 - protein, 26 aa, Staphylococcus
RLNYTYIRMAMYMDPLKPYLPELVKM

SEQ ID NO: 2082840 - protein, 17 aa, Staphylococcus
RLPDCLVEWSAKRLKEQ

SEQ ID NO: 2082841 - protein, 17 aa, Staphylococcus
RLPEICELLVKFGKDPQ

SEQ ID NO: 2082842 - protein, 22 aa, Staphylococcus
RLPLQWRSFFTNGKVIDLYEDL

SEQ ID NO: 2082843 - protein, 23 aa, Staphylococcus
RLPNGFAGICAISYFMSASLQQI

SEQ ID NO: 2082844 - protein, 21 aa, Staphylococcus
RLQHTLKLPVNIVGSKSLANY

SEQ ID NO: 2082845 - protein, 22 aa, Staphylococcus
RLQQEYKLKFKPCETKELKISG

SEQ ID NO: 2082846 - protein, 27 aa, Staphylococcus
RLQSFGMTVLAYDPFLTKEKAKELNIV

SEQ ID NO: 2082847 - protein, 23 aa, Staphylococcus
RLQVDYIDLYYIHFPDEETPKDK

SEQ ID NO: 2082848 - protein, 26 aa, Staphylococcus
RLQVDYIDLYYIHFPDEYTPKDEAVA

SEQ ID NO: 2082849 - protein, 20 aa, Staphylococcus
RLQWVNDLAFKPFNKRIPDA

SEQ ID NO: 2082850 - protein, 23 aa, Staphylococcus
RLQYQIIDMLSKILDKHPLPKSD

SEQ ID NO: 2082851 - protein, 18 aa, Staphylococcus
RLREGKITERHARAVLVL

SEQ ID NO: 2082852 - protein, 21 aa, Staphylococcus
RLRFKRFWITEHHNVPAFACS

SEQ ID NO: 2082853 - protein, 21 aa, Staphylococcus
RLRILELLYKGEASVGHITHT

SEQ ID NO: 2082854 - protein, 17 aa, Staphylococcus
RLRNDPMHTFMCDECKS

SEQ ID NO: 2082855 - protein, 20 aa, Staphylococcus
RLRRPDLTFATLDHNVPTID

SEQ ID NO: 2082856 - protein, 19 aa, Staphylococcus
RLSDLEKLIRLPGKFKYFE

SEQ ID NO: 2082857 - protein, 22 aa, Staphylococcus
RLSDLEKLIRLPGKFKYFEHNV

SEQ ID NO: 2082858 - protein, 27 aa, Staphylococcus
RLSIWNIMSYLFEVIDPYSLNQQGQDI

SEQ ID NO: 2082859 - protein, 31 aa, Staphylococcus
RLSKSRPYIANMLRLLKLPSDVAKMVRDGEL

SEQ ID NO: 2082860 - protein, 28 aa, Staphylococcus
RLSKSRPYIANMLRLLNLPQTVSNMVRD

SEQ ID NO: 2082861 - protein, 21 aa, Staphylococcus
RLSPEYFHYLSRAKYWINNQN

SEQ ID NO: 2082862 - protein, 17 aa, Staphylococcus
RLSSCKAFVNQITLLKQ

SEQ ID NO: 2082863 - protein, 27 aa, Staphylococcus
RLSSKENLAILYQEGFHICKGDLFGKH

SEQ ID NO: 2082864 - protein, 19 aa, Staphylococcus
RLSSTYGVVFLQAEQSRIY

SEQ ID NO: 2082865 - protein, 27 aa, Staphylococcus
RLTDDIYLPIHQLYRQLTTEANGNYTA

SEQ ID NO: 2082866 - protein, 17 aa, Staphylococcus
RLTEVPGFHAKGYIFEH

SEQ ID NO: 2082867 - protein, 29 aa, Staphylococcus
RLTGIQFLELFTDDLYFKISKHAIDMAKK

SEQ ID NO: 2082868 - protein, 26 aa, Staphylococcus
RLTGIQFLELFTDDLYFKISRHAIEM

SEQ ID NO: 2082869 - protein, 20 aa, Staphylococcus
RLTIPNIYFKSNLQEIYDII

SEQ ID NO: 2082870 - protein, 39 aa, Staphylococcus
RLTKNIYLNNPLVNNIKKLYPFIFSVLFEVIETLNKESN

SEQ ID NO: 2082871 - protein, 23 aa, Staphylococcus
RLTPAKFSRFKPLLPGGTVTVGN

SEQ ID NO: 2082872 - protein, 18 aa, Staphylococcus
RLTTYLEHELAKTTSLHG

SEQ ID NO: 2082873 - protein, 37 aa, Staphylococcus
RLTWRDLFNDFEMHFYRYVFPYYDTLYTLEKLTESGY

SEQ ID NO: 2082874 - protein, 21 aa, Staphylococcus
RLVEVLFEILVESDVLAASDS

SEQ ID NO: 2082875 - protein, 27 aa, Staphylococcus
RLVGIQFLELFTDNLYFEISRHAINMA

SEQ ID NO: 2082876 - protein, 17 aa, Staphylococcus
RLVLKKYCKTCNAHTIH

SEQ ID NO: 2082877 - protein, 31 aa, Staphylococcus
RLVPYYIHQNYWFLYYHDVNYFAVKFDKQNI

SEQ ID NO: 2082878 - protein, 24 aa, Staphylococcus
RLVSDIHYPISDLYYYLTQTNNGG

SEQ ID NO: 2082879 - protein, 17 aa, Staphylococcus
RLYIKISTTDRPPYTYR

SEQ ID NO: 2082880 - protein, 18 aa, Staphylococcus
RLYMIAQTLKDLGRRRAI

SEQ ID NO: 2082881 - protein, 17 aa, Staphylococcus
RLYYQSKILEQKGYSGQ

SEQ ID NO: 2082882 - protein, 25 aa, Staphylococcus
RMAQDFSYRYPLVDGQGNFGSMDGD

SEQ ID NO: 2082883 - protein, 25 aa, Staphylococcus
RMAQTFSYRYPLVDGQGNFGSMDGD

SEQ ID NO: 2082884 - protein, 17 aa, Staphylococcus
RMDPYQTSAKEKSVLSY

SEQ ID NO: 2082885 - protein, 19 aa, Staphylococcus
RMELLKRNITNKQLADMLG

SEQ ID NO: 2082886 - protein, 23 aa, Staphylococcus
RMGTYDVIVGINLLREGIDIPEV

SEQ ID NO: 2082887 - protein, 21 aa, Staphylococcus
RMHFRGDAVYKKIAVLSGGEK

SEQ ID NO: 2082888 - protein, 18 aa, Staphylococcus
RMHIVEGLMKALSILDEV

SEQ ID NO: 2082889 - protein, 18 aa, Staphylococcus
RMIDFQIVGMPLPKKDKS

SEQ ID NO: 2082890 - protein, 18 aa, Staphylococcus
RMIDFQIVGMPLPKNDKS

SEQ ID NO: 2082891 - protein, 20 aa, Staphylococcus
RMIDFQIVGMPLPKNDRSQR

SEQ ID NO: 2082892 - protein, 21 aa, Staphylococcus
RMIERRLLQHFRKKGYIKWEE

SEQ ID NO: 2082893 - protein, 21 aa, Staphylococcus
RMIKFDKPISIPYVLNRALQS

SEQ ID NO: 2082894 - protein, 22 aa, Staphylococcus
RMIQLRRYLHQYPELSFEEKQT

SEQ ID NO: 2082895 - protein, 21 aa, Staphylococcus
RMKKVMQAYKPYVVYHAAAHK

SEQ ID NO: 2082896 - protein, 29 aa, Staphylococcus
RMLEIQFALYERKIPLILVFEGMDAAGKG

SEQ ID NO: 2082897 - protein, 17 aa, Staphylococcus
RMLGFKHKGFKEGLSKD

SEQ ID NO: 2082898 - protein, 17 aa, Staphylococcus
RMLISTLEKLGYKHQGY

SEQ ID NO: 2082899 - protein, 25 aa, Staphylococcus
RMLLGEPIQYIVGFQSFYGYQLQVN

SEQ ID NO: 2082900 - protein, 23 aa, Staphylococcus
RMNEAGLPVVFVINQIDKHQEEE

SEQ ID NO: 2082901 - protein, 18 aa, Staphylococcus
RMNLLNNLKRKYGKDIPS

SEQ ID NO: 2082902 - protein, 17 aa, Staphylococcus
RMPSLSGLSKVSPLLHR

SEQ ID NO: 2082903 - protein, 20 aa, Staphylococcus
RMREAGYAPVKRFEKPIYKE

SEQ ID NO: 2082904 - protein, 25 aa, Staphylococcus
RMRQEEVSMLLAIDNKRLLKGSITA

SEQ ID NO: 2082905 - protein, 18 aa, Staphylococcus
RMRSIPKFMFKVFKVQRK

SEQ ID NO: 2082906 - protein, 17 aa, Staphylococcus
RMSIAYSLPKWIVDHWV

SEQ ID NO: 2082907 - protein, 19 aa, Staphylococcus
RMSKITLELLRDLNKDTID

SEQ ID NO: 2082908 - protein, 24 aa, Staphylococcus
RMTYDDLLITKGLIHLPGTKTENA

SEQ ID NO: 2082909 - protein, 21 aa, Staphylococcus
RMVHELPTFFSSNLNLEELEH

SEQ ID NO: 2082910 - protein, 23 aa, Staphylococcus
RMVQLRRYLHQYPELSFEEKRTH

SEQ ID NO: 2082911 - protein, 31 aa, Staphylococcus
RMVVSQFLTKDLFIDWTWGEDYFRRKLIDFD

SEQ ID NO: 2082912 - protein, 17 aa, Staphylococcus
RNAGKVPAVVYGYGTKN

SEQ ID NO: 2082913 - protein, 18 aa, Staphylococcus
RNAGLIRSVRGAKGGYQL

SEQ ID NO: 2082914 - protein, 35 aa, Staphylococcus
RNAISRIIEMDYLSRLFINKRFLKSEDKQLFYDAF

SEQ ID NO: 2082915 - protein, 19 aa, Staphylococcus
RNAISVVLEEMKPTHYGVG

SEQ ID NO: 2082916 - protein, 24 aa, Staphylococcus
RNAVFEMMNWWFDKGIDGFRVDAI

SEQ ID NO: 2082917 - protein, 17 aa, Staphylococcus
RNDAQIIFLDTPGIHKP

SEQ ID NO: 2082918 - protein, 32 aa, Staphylococcus
RNDDNFRDLLKRFYNFSIANPSPFEWLDSLVE

SEQ ID NO: 2082919 - protein, 33 aa, Staphylococcus
RNDDQFRNIIKRLYFFSIANPNPFEWLDQLSQP

SEQ ID NO: 2082920 - protein, 34 aa, Staphylococcus
RNDDRFREILKRFYYFSIANPSPFKWLDSLVDPY

SEQ ID NO: 2082921 - protein, 17 aa, Staphylococcus
RNDFTPSILTAMKIARI

SEQ ID NO: 2082922 - protein, 25 aa, Staphylococcus
RNDIYDFYSLGFGDPYPISGSHGLG

SEQ ID NO: 2082923 - protein, 22 aa, Staphylococcus
RNDLKLVMDILKLALQNNDASN

SEQ ID NO: 2082924 - protein, 25 aa, Staphylococcus
RNDLYALTLIILLFTRNKPTRDNLI

SEQ ID NO: 2082925 - protein, 26 aa, Staphylococcus
RNEGRDCQFIAVKLPYGVQKDAEEVE

SEQ ID NO: 2082926 - protein, 25 aa, Staphylococcus
RNEILQLMMLQPKFAILDEIDSGLD

SEQ ID NO: 2082927 - protein, 25 aa, Staphylococcus
RNEIYDFYSLGFGDPYPISGSHGLG

SEQ ID NO: 2082928 - protein, 19 aa, Staphylococcus
RNELRYRWEYLGEAIGSGV

SEQ ID NO: 2082929 - protein, 23 aa, Staphylococcus
RNEQARIRLYIPLNERISADDYR

SEQ ID NO: 2082930 - protein, 25 aa, Staphylococcus
RNFEGRIHPLVKANYLASPQLVVAY

SEQ ID NO: 2082931 - protein, 24 aa, Staphylococcus
RNFKPEEYWKIEGNFRYKKSTFSA

SEQ ID NO: 2082932 - protein, 30 aa, Staphylococcus
RNGNWSLKQLIDYLTIKPATIFNLNYGKLH

SEQ ID NO: 2082933 - protein, 24 aa, Staphylococcus
RNGRSFEKFILFTSYKVDLDEECL

SEQ ID NO: 2082934 - protein, 20 aa, Staphylococcus
RNGTEYIAVSGGFVEIRQHK

SEQ ID NO: 2082935 - protein, 24 aa, Staphylococcus
RNHNKLQFDVPYVEKDILDITRED

SEQ ID NO: 2082936 - protein, 21 aa, Staphylococcus
RNHRKLGKQLKLFMFSEEAPG

SEQ ID NO: 2082937 - protein, 24 aa, Staphylococcus
RNIGYPVVVRPSYVLGGRAMEIVD

SEQ ID NO: 2082938 - protein, 25 aa, Staphylococcus
RNIKGKIIIPGFFGVSKHGYIVTFP

SEQ ID NO: 2082939 - protein, 24 aa, Staphylococcus
RNIQYYTEIVFKHATKRKLIQTAD

SEQ ID NO: 2082940 - protein, 26 aa, Staphylococcus
RNKTGLLLDPYFAGTKVKWILDNVDG

SEQ ID NO: 2082941 - protein, 18 aa, Staphylococcus
RNLENHVHPLMFLSEQDG

SEQ ID NO: 2082942 - protein, 18 aa, Staphylococcus
RNLFSYIAPIKTIITDII

SEQ ID NO: 2082943 - protein, 22 aa, Staphylococcus
RNLLAMCYLYLNEYETAKEMFE

SEQ ID NO: 2082944 - protein, 21 aa, Staphylococcus
RNLTKLLFYSGLRIGEALALQ

SEQ ID NO: 2082945 - protein, 29 aa, Staphylococcus
RNLVGIITNRDLRFIEDFSIKISDVMTKE

SEQ ID NO: 2082946 - protein, 19 aa, Staphylococcus
RNMIRERLGSVPLEWNEQL

SEQ ID NO: 2082947 - protein, 26 aa, Staphylococcus
RNMVNLCISIDHRILDGLQAGRFMNF

SEQ ID NO: 2082948 - protein, 17 aa, Staphylococcus
RNNDLIITPLFEDSYVL

SEQ ID NO: 2082949 - protein, 20 aa, Staphylococcus
RNNEIPSPELYLLGGSENSA

SEQ ID NO: 2082950 - protein, 30 aa, Staphylococcus
RNNFDLRPAGIIKMLDLKHPIYKQTAAYGH

SEQ ID NO: 2082951 - protein, 20 aa, Staphylococcus
RNNFSFLPISSCRDLNLPYI

SEQ ID NO: 2082952 - protein, 20 aa, Staphylococcus
RNNHFLYAITKEGDNCGVAS

SEQ ID NO: 2082953 - protein, 29 aa, Staphylococcus
RNNIDKTFGLIYSQRVLLALINKGMVREE

SEQ ID NO: 2082954 - protein, 20 aa, Staphylococcus
RNNYLALIEPLKRASNQEAG

SEQ ID NO: 2082955 - protein, 24 aa, Staphylococcus
RNPDDLFFEIYEMSLETIMQFDHL

SEQ ID NO: 2082956 - protein, 23 aa, Staphylococcus
RNPEDLFFEIYEHSLETIMQFDH

SEQ ID NO: 2082957 - protein, 24 aa, Staphylococcus
RNPEDLFFEIYEHSLETIMQFDHL

SEQ ID NO: 2082958 - protein, 23 aa, Staphylococcus
RNPEPLFFEIYEMSLETIIQFDH

SEQ ID NO: 2082959 - protein, 24 aa, Staphylococcus
RNPEPLFFEIYEMSLETIMQFDHL

SEQ ID NO: 2082960 - protein, 24 aa, Staphylococcus
RNPEQLFFEIYEMSLETIMQFDHL

SEQ ID NO: 2082961 - protein, 17 aa, Staphylococcus
RNPIAFTGLFRSINYRV

SEQ ID NO: 2082962 - protein, 25 aa, Staphylococcus
RNPSPYMYYINMTTQIIIGSSPESF

SEQ ID NO: 2082963 - protein, 25 aa, Staphylococcus
RNQHRSVVIWFTGLSGSGKSTISVA

SEQ ID NO: 2082964 - protein, 24 aa, Staphylococcus
RNQKLNFNYLYHCFEFSNNLVKAR

SEQ ID NO: 2082965 - protein, 18 aa, Staphylococcus
RNRIIITSRLFASTTKKE

SEQ ID NO: 2082966 - protein, 19 aa, Staphylococcus
RNRIIITSRLFVSTTKKEI

SEQ ID NO: 2082967 - protein, 20 aa, Staphylococcus
RNRIILCTRLFSSNPKKEIK

SEQ ID NO: 2082968 - protein, 22 aa, Staphylococcus
RNRVFYNTLLDENASCHIALGA

SEQ ID NO: 2082969 - protein, 28 aa, Staphylococcus
RNTEKLYDRLIYRYGSSNSAFSLEQHRD

SEQ ID NO: 2082970 - protein, 27 aa, Staphylococcus
RNTFDWLQPLLKRKYPDKQFEFTYIDI

SEQ ID NO: 2082971 - protein, 17 aa, Staphylococcus
RNWPAYLYSIEHSIYVD

SEQ ID NO: 2082972 - protein, 21 aa, Staphylococcus
RNYMELFYLRDYSLSEIAETF

SEQ ID NO: 2082973 - protein, 25 aa, Staphylococcus
RPAAAHALHYDKLPDRLVTVFAGQD

SEQ ID NO: 2082974 - protein, 26 aa, Staphylococcus
RPAASHALHYDKLPNRLVTVFAGQDK

SEQ ID NO: 2082975 - protein, 25 aa, Staphylococcus
RPAASHALHYDKLPQRLVTVFAGQD

SEQ ID NO: 2082976 - protein, 24 aa, Staphylococcus
RPAATHALHYDKLPDRLVTVFAGQ

SEQ ID NO: 2082977 - protein, 21 aa, Staphylococcus
RPAEAPLKGYKKMNPMVYCGL

SEQ ID NO: 2082978 - protein, 22 aa, Staphylococcus
RPAEAPLQGYKKMNPMVFCGLF

SEQ ID NO: 2082979 - protein, 20 aa, Staphylococcus
RPDITRFRDLPDWIKENKEQ

SEQ ID NO: 2082980 - protein, 24 aa, Staphylococcus
RPDKDIPYIFKYNDAPAITIDDLN

SEQ ID NO: 2082981 - protein, 25 aa, Staphylococcus
RPDLPASKIANFIRRDILEQTELTA

SEQ ID NO: 2082982 - protein, 18 aa, Staphylococcus
RPDLPASQIANYIRRDIY

SEQ ID NO: 2082983 - protein, 25 aa, Staphylococcus
RPDLPASRIAQYIRRDIYEATMLTS

SEQ ID NO: 2082984 - protein, 30 aa, Staphylococcus
RPDVPYAMIPKFNLFIALGIRDAIQQFSRH

SEQ ID NO: 2082985 - protein, 24 aa, Staphylococcus
RPEAVKMAPLIQALKHDDALEPIV

SEQ ID NO: 2082986 - protein, 30 aa, Staphylococcus; identical to SEQ ID NO: 1820808

SEQ ID NO: 2082987 - protein, 30 aa, Staphylococcus
RPEDLQSYGLIPEFIGRVPIVANLETLDVE

SEQ ID NO: 2082988 - protein, 19 aa, Staphylococcus
RPEFLNRIDEFITFKPLDQ

SEQ ID NO: 2082989 - protein, 24 aa, Staphylococcus
RPEQGLLALRKSLGLFANIRPTKV

SEQ ID NO: 2082990 - protein, 24 aa, Staphylococcus
RPEQGLLGIRKALGLFANIRPTTV

SEQ ID NO: 2082991 - protein, 23 aa, Staphylococcus
RPEQGLLTLRKSLGLYANIRPTK

SEQ ID NO: 2082992 - protein, 22 aa, Staphylococcus
RPETHLVPIVLQVALGQREALT

SEQ ID NO: 2082993 - protein, 20 aa, Staphylococcus
RPFIMVIHIHNMSELRAMLI

SEQ ID NO: 2082994 - protein, 19 aa, Staphylococcus
RPFLEKTLERKAVWDKWME

SEQ ID NO: 2082995 - protein, 31 aa, Staphylococcus
RPGFEGGQLPLFRRLPKRGFTNINRKEFAVV

SEQ ID NO: 2082996 - protein, 19 aa, Staphylococcus
RPHETWVPAFVLRTVLGEM

SEQ ID NO: 2082997 - protein, 21 aa, Staphylococcus
RPHHTWVPSLAIRLALGQMST

SEQ ID NO: 2082998 - protein, 45 aa, Staphylococcus
RPIAELMFNDFLGFGLDPILNQGAKMRYMFGGKAKIPLVVRTVHG

SEQ ID NO: 2082999 - protein, 23 aa, Staphylococcus
RPIDQHIKGFKALGAKIDESSST

SEQ ID NO: 2083000 - protein, 17 aa, Staphylococcus
RPIIINFSNYELEKLFK

SEQ ID NO: 2083001 - protein, 25 aa, Staphylococcus
RPIQVGSHFHFFEANKALAFDREKA

SEQ ID NO: 2083002 - protein, 27 aa, Staphylococcus
RPIQVGSHYHFFEANPALQFDHEKAYG

SEQ ID NO: 2083003 - protein, 19 aa, Staphylococcus
RPIYHAIVWQSRQTQSICH

SEQ ID NO: 2083004 - protein, 18 aa, Staphylococcus
RPKFMQDEIPVHMKIIYD

SEQ ID NO: 2083005 - protein, 20 aa, Staphylococcus
RPKLINLKEALVEYLEHQKT

SEQ ID NO: 2083006 - protein, 18 aa, Staphylococcus
RPKMDGRQMFIMLSPINE

SEQ ID NO: 2083007 - protein, 19 aa, Staphylococcus
RPKQRLNKHQPFNFIKSEE

SEQ ID NO: 2083008 - protein, 23 aa, Staphylococcus
RPLGHDELLFVLERQWRKLGKTL

SEQ ID NO: 2083009 - protein, 21 aa, Staphylococcus
RPLKTQLGMYRFFVQTDIGKN

SEQ ID NO: 2083010 - protein, 17 aa, Staphylococcus
RPLLTLDKEEIVKMARK

SEQ ID NO: 2083011 - protein, 30 aa, Staphylococcus
RPLYNKYKSYWKLFLKPFETLEAFNYHKVH

SEQ ID NO: 2083012 - protein, 27 aa, Staphylococcus
RPMGSTPYTLLDYFGDDWLVMIDESHV

SEQ ID NO: 2083013 - protein, 19 aa, Staphylococcus
RPMVFRRELLDHYAELGLT

SEQ ID NO: 2083014 - protein, 20 aa, Staphylococcus
RPNITRFRDLPDWIKENKEV

SEQ ID NO: 2083015 - protein, 28 aa, Staphylococcus
RPNRNINNYIDLPFGECHFSVAAKPNVT

SEQ ID NO: 2083016 - protein, 31 aa, Staphylococcus
RPNVPFDMMPKFNLFIALGIRDAIQAFANDE

SEQ ID NO: 2083017 - protein, 17 aa, Staphylococcus
RPQAFEKSFRKNPKSNE

SEQ ID NO: 2083018 - protein, 21 aa, Staphylococcus
RPQDLIFLSDMKSEFEKSVTA

SEQ ID NO: 2083019 - protein, 21 aa, Staphylococcus
RPQFFFAYDIDKYDKGLRGFY

SEQ ID NO: 2083020 - protein, 20 aa, Staphylococcus
RPQQLYLSEIILDQLMHSDK

SEQ ID NO: 2083021 - protein, 21 aa, Staphylococcus
RPQQLYLSEIILDQLMHSDKA

SEQ ID NO: 2083022 - protein, 23 aa, Staphylococcus
RPQQLYLSEIILEQLMHSEKAMI

SEQ ID NO: 2083023 - protein, 23 aa, Staphylococcus
RPRDLIGKRLTYPGAPGSGGIAI

SEQ ID NO: 2083024 - protein, 20 aa, Staphylococcus
RPRGVLRKFEMSRIAFREHA

SEQ ID NO: 2083025 - protein, 23 aa, Staphylococcus
RPRGVYRKFGMSRIALRDYAHKG

SEQ ID NO: 2083026 - protein, 17 aa, Staphylococcus
RPRILTLEEALEYINDD

SEQ ID NO: 2083027 - protein, 19 aa, Staphylococcus
RPRILTLEEALEYINDDEL

SEQ ID NO: 2083028 - protein, 28 aa, Staphylococcus
RPSDNGFYYTLYQTVFNLTTKTLYIKYY

SEQ ID NO: 2083029 - protein, 27 aa, Staphylococcus
RPSKDWVPTTTLFYFVDGNIVGAVDIR

SEQ ID NO: 2083030 - protein, 21 aa, Staphylococcus
RPTELPFLPFDHHTVLSSDDV

SEQ ID NO: 2083031 - protein, 32 aa, Staphylococcus
RPTHVSLVPQTLKWLMDAGLSQPFSIEKILLG

SEQ ID NO: 2083032 - protein, 17 aa, Staphylococcus
RPTISLLMPMSEAHSTL

SEQ ID NO: 2083033 - protein, 18 aa, Staphylococcus
RPTMPNTNPLFINAIVDE

SEQ ID NO: 2083034 - protein, 21 aa, Staphylococcus
RPTVSSLLKNLERKKLIYRYI

SEQ ID NO: 2083035 - protein, 18 aa, Staphylococcus
RPVIIRRELLDHYNQLGI

SEQ ID NO: 2083036 - protein, 18 aa, Staphylococcus
RPYIISFVNAYHGSTYGS

SEQ ID NO: 2083037 - protein, 30 aa, Staphylococcus
RPYLIQIHEKYNVQYIAFVQRKIFNHKRNR

SEQ ID NO: 2083038 - protein, 24 aa, Staphylococcus
RQAENVNNYLFKGSLAGVDGRIQS

SEQ ID NO: 2083039 - protein, 26 aa, Staphylococcus
RQAIEDILIYIARIVGVSPSLILGEN

SEQ ID NO: 2083040 - protein, 35 aa, Staphylococcus
RQAIQFLKQKGLGRATFLPLNVIKSRQLSNNIRHI

SEQ ID NO: 2083041 - protein, 27 aa, Staphylococcus
RQAIQYLKQNGLGRATFLPLNVIQPRH

SEQ ID NO: 2083042 - protein, 24 aa, Staphylococcus
RQDFIRHLLEFKTCKPIDISKVEP

SEQ ID NO: 2083043 - protein, 23 aa, Staphylococcus
RQDNLIIEIIDLGKGFNLHEVNV

SEQ ID NO: 2083044 - protein, 28 aa, Staphylococcus
RQDTLGKLIPLFKILGKIIKNMKPVHVT

SEQ ID NO: 2083045 - protein, 30 aa, Staphylococcus
RQELLGLDDLKMYDLYTPLVKDIKFEMPYE

SEQ ID NO: 2083046 - protein, 23 aa, Staphylococcus
RQELSDMPPIYYPGNIQGRHFGE

SEQ ID NO: 2083047 - protein, 20 aa, Staphylococcus
RQELWDYPLLSEEVADSLIE

SEQ ID NO: 2083048 - protein, 20 aa, Staphylococcus
RQERLLSGMWEFPMFETSHA

SEQ ID NO: 2083049 - protein, 18 aa, Staphylococcus
RQEVLEELGFDFSNSYNP

SEQ ID NO: 2083050 - protein, 18 aa, Staphylococcus
RQEYLGMIRGQVLHTFST

SEQ ID NO: 2083051 - protein, 18 aa, Staphylococcus
RQEYLKMIRGQVIHTFST

SEQ ID NO: 2083052 - protein, 26 aa, Staphylococcus
RQFDDFMASFYYLKGQNFIVTHINSI

SEQ ID NO: 2083053 - protein, 21 aa, Staphylococcus
RQFILTAYRKAVELEYRFFSF

SEQ ID NO: 2083054 - protein, 18 aa, Staphylococcus
RQGICDLSSVIGCRDDIM

SEQ ID NO: 2083055 - protein, 20 aa, Staphylococcus
RQGNLLLCEVFGGTIFHVNL

SEQ ID NO: 2083056 - protein, 26 aa, Staphylococcus
RQGRQLLVFLHAPKHLYEKVPTADLE

SEQ ID NO: 2083057 - protein, 17 aa, Staphylococcus
RQHGFKVFGPNQDAAQI

SEQ ID NO: 2083058 - protein, 34 aa, Staphylococcus
RQIFEQRFGVEALYQDAVDILLPEAYGEAIEETG

SEQ ID NO: 2083059 - protein, 25 aa, Staphylococcus
RQIGYLFQDYQLFPNMTVLQNITFM

SEQ ID NO: 2083060 - protein, 26 aa, Staphylococcus
RQIKGGFTFAILTKDALYGAVDPNAI

SEQ ID NO: 2083061 - protein, 19 aa, Staphylococcus
RQIYEFIDEAKRMVRPANF

SEQ ID NO: 2083062 - protein, 18 aa, Staphylococcus
RQKAFFDYYLKEEDNDWK

SEQ ID NO: 2083063 - protein, 18 aa, Staphylococcus
RQLDPKLAAKRKLSVFLY

SEQ ID NO: 2083064 - protein, 19 aa, Staphylococcus
RQLDPKLAAKRKLSVFLYS

SEQ ID NO: 2083065 - protein, 20 aa, Staphylococcus
RQLEAMLIVMDKDGILVVSG

SEQ ID NO: 2083066 - protein, 23 aa, Staphylococcus
RQLEAMLIVVDKSGILVVSGTGE

SEQ ID NO: 2083067 - protein, 18 aa, Staphylococcus
RQLGRFLQKKGYTSYAPQ

SEQ ID NO: 2083068 - protein, 17 aa, Staphylococcus
RQLGRYLQKKGYTSYAP

SEQ ID NO: 2083069 - protein, 25 aa, Staphylococcus
RQLINDFAYKHHIPWIYGGVVQSTY

SEQ ID NO: 2083070 - protein, 19 aa, Staphylococcus
RQLMYQPEILLLDESTSAL

SEQ ID NO: 2083071 - protein, 19 aa, Staphylococcus
RQLMYQPELLLLDEATSAL

SEQ ID NO: 2083072 - protein, 25 aa, Staphylococcus
RQLNDKSLPLIVTTIQKMSKAIQNN

SEQ ID NO: 2083073 - protein, 21 aa, Staphylococcus
RQLRRPDLTFATLDHNVPTID

SEQ ID NO: 2083074 - protein, 25 aa, Staphylococcus
RQLSIFTVPVDLIFFQGKEVHRQAR

SEQ ID NO: 2083075 - protein, 17 aa, Staphylococcus
RQLVKVAAWYDNEMSYT

SEQ ID NO: 2083076 - protein, 18 aa, Staphylococcus
RQLVKVAAWYDNEMSYTS

SEQ ID NO: 2083077 - protein, 18 aa, Staphylococcus
RQMILNFAHYRFTDLKES

SEQ ID NO: 2083078 - protein, 17 aa, Staphylococcus
RQMLATIPGLEKADMMR

SEQ ID NO: 2083079 - protein, 26 aa, Staphylococcus
RQNPSPYMYYLNIDNPIIVGSSPESF

SEQ ID NO: 2083080 - protein, 24 aa, Staphylococcus
RQNPSPYMYYLNMDERIVVGSSPE

SEQ ID NO: 2083081 - protein, 26 aa, Staphylococcus
RQPLGDPIVLIAPTQSTFQLEQAFLS

SEQ ID NO: 2083082 - protein, 29 aa, Staphylococcus
RQQYGNLSLLDTPTFFFGMRNGETVEIEI

SEQ ID NO: 2083083 - protein, 25 aa, Staphylococcus
RQRAYIAMTIAQDTDYILLDEPLNN

SEQ ID NO: 2083084 - protein, 26 aa, Staphylococcus
RQRAYIAMTIAQDTDYILLDEPLNNL

SEQ ID NO: 2083085 - protein, 26 aa, Staphylococcus
RQRAYIAMTIAQNTDYILLDEPLNNL

SEQ ID NO: 2083086 - protein, 32 aa, Staphylococcus
RQRAYIAMTIAQNTEYILLDEPLNNLDMKHSV

SEQ ID NO: 2083087 - protein, 26 aa, Staphylococcus
RQRAYVAMTIAQDTDYILLDEPLNNL

SEQ ID NO: 2083088 - protein, 26 aa, Staphylococcus
RQRICLARQLMYIPDVLLLDEATSAL

SEQ ID NO: 2083089 - protein, 18 aa, Staphylococcus
RQRIVIAIALACEPKLLI

SEQ ID NO: 2083090 - protein, 17 aa, Staphylococcus
RQRLWNEVDKVEKHNAK

SEQ ID NO: 2083091 - protein, 21 aa, Staphylococcus
RQRQYMYTIGQAKRASTRQNR

SEQ ID NO: 2083092 - protein, 23 aa, Staphylococcus
RQRRAIWAIYSVCRIIDDSIDIH

SEQ ID NO: 2083093 - protein, 17 aa, Staphylococcus
RQRYWGEPIPVIHWEDG

SEQ ID NO: 2083094 - protein, 17 aa, Staphylococcus
RQSIWRELRHLSEEGQT

SEQ ID NO: 2083095 - protein, 18 aa, Staphylococcus
RQSPLIDQLHAIPGNDAM

SEQ ID NO: 2083096 - protein, 24 aa, Staphylococcus
RQTDFYHNILGLQVLKTAPTQTTL

SEQ ID NO: 2083097 - protein, 29 aa, Staphylococcus
RQTRNGHQSVLIWFTGLSGSGKSTVSVAL

SEQ ID NO: 2083098 - protein, 27 aa, Staphylococcus
RQVFDVNVGSIFWGIQAAVEAFESLGH

SEQ ID NO: 2083099 - protein, 24 aa, Staphylococcus
RQVRRFFPSILSYRRSELDMQAMK

SEQ ID NO: 2083100 - protein, 24 aa, Staphylococcus
RQVTGKWSWLAPPLSPTLTDNYHH

SEQ ID NO: 2083101 - protein, 19 aa, Staphylococcus
RRAKLYYLRNLRGKAARIQ

SEQ ID NO: 2083102 - protein, 18 aa, Staphylococcus
RRALLLYGGAKNGKSVFI

SEQ ID NO: 2083103 - protein, 22 aa, Staphylococcus
RRANLYGLYNKAIEFENSSFRG

SEQ ID NO: 2083104 - protein, 23 aa, Staphylococcus
RRCINQVILLFSLSNHLDITLNG

SEQ ID NO: 2083105 - protein, 27 aa, Staphylococcus
RRDGDDLFYELNISFPQASLGDEVKVP

SEQ ID NO: 2083106 - protein, 19 aa, Staphylococcus
RREAIVLLGMIEDRQILPY

SEQ ID NO: 2083107 - protein, 17 aa, Staphylococcus
RREQLGFVFQEFNILES

SEQ ID NO: 2083108 - protein, 21 aa, Staphylococcus
RREVMDMLLLVKEKAYYSYRM

SEQ ID NO: 2083109 - protein, 18 aa, Staphylococcus
RRFLDRVWRLLINEDGSL

SEQ ID NO: 2083110 - protein, 21 aa, Staphylococcus
RRFRFTALVVVGDKNGRVGFG

SEQ ID NO: 2083111 - protein, 25 aa, Staphylococcus
RRGAPNTYLIVDVPFGAVGVNDQYD

SEQ ID NO: 2083112 - protein, 21 aa, Staphylococcus
RRGELVSCFLLEVDDSLNSIN

SEQ ID NO: 2083113 - protein, 30 aa, Staphylococcus; identical to SEQ ID NO: 1819385

SEQ ID NO: 2083114 - protein, 17 aa, Staphylococcus
RRHIRHCYKADPDYGKG

SEQ ID NO: 2083115 - protein, 17 aa, Staphylococcus
RRIAFNINIPKESINKA

SEQ ID NO: 2083116 - protein, 23 aa, Staphylococcus
RRIAFNINIPKESINKAAKFLIS

SEQ ID NO: 2083117 - protein, 17 aa, Staphylococcus
RRIAFNINIPKESVNKA

SEQ ID NO: 2083118 - protein, 24 aa, Staphylococcus
RRIEWKRVLDMNDRELRKVVVGLG

SEQ ID NO: 2083119 - protein, 19 aa, Staphylococcus
RRITQDHRLVYKVTSESIL

SEQ ID NO: 2083120 - protein, 28 aa, Staphylococcus
RRKCEQMYDHFLYLKHKLNYSEAATIKM

SEQ ID NO: 2083121 - protein, 23 aa, Staphylococcus
RRKFVGIVFGDANYYLKNMLMIL

SEQ ID NO: 2083122 - protein, 29 aa, Staphylococcus
RRKGLGTYLMTWLFAKYRNMTMYVGTSDT

SEQ ID NO: 2083123 - protein, 27 aa, Staphylococcus
RRKQKLEPLYAFMIRVRIPGGKVSTDQ

SEQ ID NO: 2083124 - protein, 20 aa, Staphylococcus
RRKSFRFFSDALRKYQNTTA

SEQ ID NO: 2083125 - protein, 23 aa, Staphylococcus
RRLKQWIDRPLIQKKQIESRLDT

SEQ ID NO: 2083126 - protein, 22 aa, Staphylococcus
RRLKQWIDRPLIYKQQIEERLN

SEQ ID NO: 2083127 - protein, 23 aa, Staphylococcus
RRNDIWAENLKFPMAVIDEVLKA

SEQ ID NO: 2083128 - protein, 25 aa, Staphylococcus
RRNIDMVYNHPLFDKSVPIHGLVID

SEQ ID NO: 2083129 - protein, 24 aa, Staphylococcus
RRNSQKFGILYYKKNRLHTMNQSN

SEQ ID NO: 2083130 - protein, 19 aa, Staphylococcus
RRNVKLLNKLQFIDKYEEY

SEQ ID NO: 2083131 - protein, 24 aa, Staphylococcus
RRNYVDFGIAFDSLWNLAVLPEEI

SEQ ID NO: 2083132 - protein, 17 aa, Staphylococcus
RRPDLTFATLDHNVPTI

SEQ ID NO: 2083133 - protein, 21 aa, Staphylococcus
RRPVHIHLPIDVAMTEIEVDS

SEQ ID NO: 2083134 - protein, 20 aa, Staphylococcus
RRPVHIHLPIDVAMTEIEVT

SEQ ID NO: 2083135 - protein, 29 aa, Staphylococcus
RRQRKRDFRKLWITRINAAARKHDISYSR

SEQ ID NO: 2083136 - protein, 26 aa, Staphylococcus
RRQRKRDFRKLWITRINAAARNHGMS

SEQ ID NO: 2083137 - protein, 23 aa, Staphylococcus
RRQSRGLKLNYPEAVAIISYEML

SEQ ID NO: 2083138 - protein, 25 aa, Staphylococcus
RRQVEVTLDLKLLFNTNAVLNFPPE

SEQ ID NO: 2083139 - protein, 21 aa, Staphylococcus
RRRAIRHLEKNRVVIFAAGIG

SEQ ID NO: 2083140 - protein, 17 aa, Staphylococcus
RRREQALTLVKKKSILS

SEQ ID NO: 2083141 - protein, 25 aa, Staphylococcus
RRRKARGLKLNYPEALALISDELLE

SEQ ID NO: 2083142 - protein, 28 aa, Staphylococcus
RRRQQRGLKLNYPEAVAIISFELLEGAR

SEQ ID NO: 2083143 - protein, 17 aa, Staphylococcus
RRSFKFDGRKIRLVSNI

SEQ ID NO: 2083144 - protein, 17 aa, Staphylococcus
RRSHQQRFLIIFSDGEP

SEQ ID NO: 2083145 - protein, 29 aa, Staphylococcus
RRTYAFTELFMFELRMQWLNRLEKSSDEA

SEQ ID NO: 2083146 - protein, 29 aa, Staphylococcus
RRTYAFTELFMFELRMQWLNRLEKTSDEA

SEQ ID NO: 2083147 - protein, 17 aa, Staphylococcus
RRVAKEEGILAGISSGA

SEQ ID NO: 2083148 - protein, 20 aa, Staphylococcus
RRVALYGVDFLMEQKLHDFH

SEQ ID NO: 2083149 - protein, 19 aa, Staphylococcus
RRVERLVNPQLNNGLPAFL

SEQ ID NO: 2083150 - protein, 24 aa, Staphylococcus
RRVITPLSPISIFAARNPWEELEY

SEQ ID NO: 2083151 - protein, 24 aa, Staphylococcus
RRVITPLSPISIFAARNPWEEMEH

SEQ ID NO: 2083152 - protein, 25 aa, Staphylococcus
RRVLYDIINHWIDFGIDGFRFDVIN

SEQ ID NO: 2083153 - protein, 24 aa, Staphylococcus
RSAKLAGRIGLPFVIAQMGQEPQQ

SEQ ID NO: 2083154 - protein, 25 aa, Staphylococcus
RSDAQRIMVEVKPLLNYVKSAEEHQ

SEQ ID NO: 2083155 - protein, 29 aa, Staphylococcus
RSDERLRQIIKSVYYFAVANPQPEQWLKS

SEQ ID NO: 2083156 - protein, 20 aa, Staphylococcus
RSDIPLARGLGSSASALVGA

SEQ ID NO: 2083157 - protein, 21 aa, Staphylococcus
RSDIPLARGLGSSASALVGAL

SEQ ID NO: 2083158 - protein, 25 aa, Staphylococcus
RSDIPLARGLGSSASALVGALYIAN

SEQ ID NO: 2083159 - protein, 21 aa, Staphylococcus
RSEIPLARGLGSSASALVAGI

SEQ ID NO: 2083160 - protein, 21 aa, Staphylococcus
RSEIPLARGLGSSASALVGAL

SEQ ID NO: 2083161 - protein, 24 aa, Staphylococcus
RSEIPLARGLGSSASALVGALYIA

SEQ ID NO: 2083162 - protein, 20 aa, Staphylococcus
RSEIQKMREERQMLGQMINQ

SEQ ID NO: 2083163 - protein, 20 aa, Staphylococcus
RSEIQKMREERQMLGQMISQ

SEQ ID NO: 2083164 - protein, 21 aa, Staphylococcus
RSEIYDIKYGIYSHWHPDHTM

SEQ ID NO: 2083165 - protein, 17 aa, Staphylococcus
RSELFKQFRHMLEPLIA

SEQ ID NO: 2083166 - protein, 27 aa, Staphylococcus
RSENGVITNPFFLIPDESVYEAEALMG

SEQ ID NO: 2083167 - protein, 23 aa, Staphylococcus
RSFISYSRHDYFRRILSSFIGDL

SEQ ID NO: 2083168 - protein, 22 aa, Staphylococcus
RSFISYSRHDYFRRILSTFIGD

SEQ ID NO: 2083169 - protein, 17 aa, Staphylococcus
RSFQFEDLEWPYNTEFF

SEQ ID NO: 2083170 - protein, 25 aa, Staphylococcus
RSGDFEPLRFFNDNAYAVLGLITSK

SEQ ID NO: 2083171 - protein, 19 aa, Staphylococcus
RSGICDLSSVIGCRDDIMV

SEQ ID NO: 2083172 - protein, 24 aa, Staphylococcus
RSGLKAIVVIPEGKIALGKLSQAV

SEQ ID NO: 2083173 - protein, 18 aa, Staphylococcus
RSHFGVVPLESMIRLFEK

SEQ ID NO: 2083174 - protein, 28 aa, Staphylococcus
RSHLLMTTDLFLNVFGMKSIEELPSTEE

SEQ ID NO: 2083175 - protein, 21 aa, Staphylococcus
RSHTGLIRLYFDAVYQERKYG

SEQ ID NO: 2083176 - protein, 20 aa, Staphylococcus
RSIDEDLFFIISLSGESHQL

SEQ ID NO: 2083177 - protein, 24 aa, Staphylococcus
RSIGLDLSIFGRAYEYIIRNQDDE

SEQ ID NO: 2083178 - protein, 25 aa, Staphylococcus
RSIGYPVVVRPSYVLGGRAMEIVNS

SEQ ID NO: 2083179 - protein, 28 aa, Staphylococcus
RSKEDLVYGRTLILFSEKDTIKRALSFF

SEQ ID NO: 2083180 - protein, 31 aa, Staphylococcus
RSKHPDGIYLSGALLMFCGKKAYYLYGASSN

SEQ ID NO: 2083181 - protein, 20 aa, Staphylococcus
RSKLRKALPKEYTYIVEELL

SEQ ID NO: 2083182 - protein, 24 aa, Staphylococcus
RSKYIVFYLEKDGDKRILISHLGM

SEQ ID NO: 2083183 - protein, 20 aa, Staphylococcus
RSLALFLMAEVDISILSMVP

SEQ ID NO: 2083184 - protein, 22 aa, Staphylococcus
RSLCCSTFLGDFQPVSIKMAKD

SEQ ID NO: 2083185 - protein, 20 aa, Staphylococcus
RSLEFNYILSEGMTAVILPH

SEQ ID NO: 2083186 - protein, 20 aa, Staphylococcus
RSLHEIYLSAFKRVVEEAQP

SEQ ID NO: 2083187 - protein, 20 aa, Staphylococcus
RSLTAYNVALNNCMALYPVY

SEQ ID NO: 2083188 - protein, 25 aa, Staphylococcus
RSMGIGLKPCYLPQTGKPSFDIEDN

SEQ ID NO: 2083189 - protein, 24 aa, Staphylococcus
RSMGIGLSPCYLPQTGKPSFDLKD

SEQ ID NO: 2083190 - protein, 24 aa, Staphylococcus
RSMTKWEYLPSKARLRGTIEIPMT

SEQ ID NO: 2083191 - protein, 25 aa, Staphylococcus
RSMVNLCISLDHRILDGLQAGRFMN

SEQ ID NO: 2083192 - protein, 23 aa, Staphylococcus
RSNAFAFITGKPLSLGGSQGRNR

SEQ ID NO: 2083193 - protein, 34 aa, Staphylococcus
RSNKHYISIFINGRYIKNFALNKAITEGYHTLLT

SEQ ID NO: 2083194 - protein, 38 aa, Staphylococcus
RSNKHYISIFINGRYIKNFILNKAILEGYHTLLTIGRY

SEQ ID NO: 2083195 - protein, 36 aa, Staphylococcus
RSNKHYISIFINGRYIKNFILNKAIVEGYHTLMMIG

SEQ ID NO: 2083196 - protein, 51 aa, Staphylococcus
RSNKHYISIFINGRYIKNFLLNKAILEGYHTLLMIGRYPICYINIEMDPIL

SEQ ID NO: 2083197 - protein, 36 aa, Staphylococcus
RSNKHYISIFINGRYIKNFVLNKAIIEGYHTLLTIG

SEQ ID NO: 2083198 - protein, 28 aa, Staphylococcus
RSNKHYISIFINGRYIKNFVLNKAIVEG

SEQ ID NO: 2083199 - protein, 22 aa, Staphylococcus
RSNKPVLLKRGLSATIEEFIFA

SEQ ID NO: 2083200 - protein, 25 aa, Staphylococcus
RSNLLTYLGVFDRVRNFFSKETGLN

SEQ ID NO: 2083201 - protein, 24 aa, Staphylococcus
RSNLLTYLGVFDRVRNFFSKKTGL

SEQ ID NO: 2083202 - protein, 24 aa, Staphylococcus
RSNLVMMGVLPLQFKDGDSADSLG

SEQ ID NO: 2083203 - protein, 24 aa, Staphylococcus
RSNLVMMGVLPLQFKDGESADSLG

SEQ ID NO: 2083204 - protein, 24 aa, Staphylococcus
RSNLVMMGVLPLQFKDGESAESLG

SEQ ID NO: 2083205 - protein, 25 aa, Staphylococcus
RSNLVMMGVLPLQFKQGESADSLGL

SEQ ID NO: 2083206 - protein, 27 aa, Staphylococcus
RSNRHYISIFINGRYIKNFVLNKAIVE

SEQ ID NO: 2083207 - protein, 23 aa, Staphylococcus
RSNVKLALMPLQGYTVKANRDRM

SEQ ID NO: 2083208 - protein, 23 aa, Staphylococcus
RSQLNDMPPIFYPGNIQGRHFNE

SEQ ID NO: 2083209 - protein, 24 aa, Staphylococcus
RSQVIEYLSYFQTSSPSYLVMSSL

SEQ ID NO: 2083210 - protein, 24 aa, Staphylococcus
RSREELQQFWYDLADDLVQTEALT

SEQ ID NO: 2083211 - protein, 18 aa, Staphylococcus
RSRMMSILLLDNEKIYYS

SEQ ID NO: 2083212 - protein, 17 aa, Staphylococcus
RSRVKLETDGKLLTGKD

SEQ ID NO: 2083213 - protein, 18 aa, Staphylococcus
RSRYHHCPVILGSATPSL

SEQ ID NO: 2083214 - protein, 24 aa, Staphylococcus
RSSKKLLIEIKKPSQYPGIEKMIV

SEQ ID NO: 2083215 - protein, 24 aa, Staphylococcus
RSSRVGYAYFLHPTNKVLSETAEE

SEQ ID NO: 2083216 - protein, 24 aa, Staphylococcus
RSSSAALGFLFNETAWESKLSSIQ

SEQ ID NO: 2083217 - protein, 28 aa, Staphylococcus
RSTAELTFALVLAVARRIPEGDQLSRTK

SEQ ID NO: 2083218 - protein, 26 aa, Staphylococcus
RSTDINYFYKYRKDLYFIARNIIKNS

SEQ ID NO: 2083219 - protein, 17 aa, Staphylococcus
RSTFYLHYQSKDDFIVS

SEQ ID NO: 2083220 - protein, 22 aa, Staphylococcus
RSTHPQFIPGTNQLLICTNDIE

SEQ ID NO: 2083221 - protein, 24 aa, Staphylococcus
RSTIFPDFIGHTFAVYDGRKHVPV

SEQ ID NO: 2083222 - protein, 23 aa, Staphylococcus
RSTKLVHGGLRYLKQAQIKVVAE

SEQ ID NO: 2083223 - protein, 19 aa, Staphylococcus
RSTLPFKHVYQAVVYISGQ

SEQ ID NO: 2083224 - protein, 26 aa, Staphylococcus
RSTTVPHVGSWRYKFFKEREGKYQVE

SEQ ID NO: 2083225 - protein, 21 aa, Staphylococcus
RSWNGLIINYLSRCTDYTAHF

SEQ ID NO: 2083226 - protein, 26 aa, Staphylococcus
RSYDLDIQLLRRIHFKLNDNLRDLFY

SEQ ID NO: 2083227 - protein, 17 aa, Staphylococcus
RSYFSEVTGLKKSLFSY

SEQ ID NO: 2083228 - protein, 33 aa, Staphylococcus
RSYGFQCFDLANQWWLYLFNHTLKGVGAADIPT

SEQ ID NO: 2083229 - protein, 20 aa, Staphylococcus
RSYHVIIEYPIETLSGQKMI

SEQ ID NO: 2083230 - protein, 18 aa, Staphylococcus
RSYNIRHIGHHRAKTDKR

SEQ ID NO: 2083231 - protein, 27 aa, Staphylococcus
RTAAKQTKWFPFVGQAVSASISYYFMK

SEQ ID NO: 2083232 - protein, 26 aa, Staphylococcus
RTAGHLMSMLVTLKGLPLAYNKDLQE

SEQ ID NO: 2083233 - protein, 29 aa, Staphylococcus
RTAKFEGLIHRFRRSFLLNDNFEKKRFAK

SEQ ID NO: 2083234 - protein, 24 aa, Staphylococcus
RTAKTLLQRFPSAYIYNTYGPTEA

SEQ ID NO: 2083235 - protein, 21 aa, Staphylococcus
RTALFNYLFAKHYDGDFVIRI

SEQ ID NO: 2083236 - protein, 17 aa, Staphylococcus
RTALKALDLDLLVQSQD

SEQ ID NO: 2083237 - protein, 18 aa, Staphylococcus
RTDFDQRFDCNCGHAGCI

SEQ ID NO: 2083238 - protein, 29 aa, Staphylococcus
RTDGVPAGLLTYPPLMAADIVIYNTNIVP

SEQ ID NO: 2083239 - protein, 17 aa, Staphylococcus
RTDIIFLDEPTTYLDIC

SEQ ID NO: 2083240 - protein, 20 aa, Staphylococcus
RTDIIFLDEPTTYLDICHQL

SEQ ID NO: 2083241 - protein, 18 aa, Staphylococcus
RTDIYDFYALGFGEPFPI

SEQ ID NO: 2083242 - protein, 17 aa, Staphylococcus
RTDLPSFRTGDTLRVHV

SEQ ID NO: 2083243 - protein, 18 aa, Staphylococcus
RTDLPTFRPGDTVRVHVR

SEQ ID NO: 2083244 - protein, 32 aa, Staphylococcus
RTDNKLLDFFIIDILNKLYLPSLNKRINHKIV

SEQ ID NO: 2083245 - protein, 30 aa, Staphylococcus
RTDRDLLTAQLYLLMHDKLPFAQQDITFNG

SEQ ID NO: 2083246 - protein, 19 aa, Staphylococcus
RTDYKGRIFCYVLDEDHYV

SEQ ID NO: 2083247 - protein, 19 aa, Staphylococcus
RTDYKGRIFCYVLTEDHYV

SEQ ID NO: 2083248 - protein, 17 aa, Staphylococcus
RTEALLFAASRREHLVE

SEQ ID NO: 2083249 - protein, 27 aa, Staphylococcus
RTEDYIKSFFITKYLASPLGKKQIDLL

SEQ ID NO: 2083250 - protein, 19 aa, Staphylococcus
RTEHEELDWFIADLLNHSQ

SEQ ID NO: 2083251 - protein, 26 aa, Staphylococcus
RTFEKDFYIRLLKQTGFNRIETFVDF

SEQ ID NO: 2083252 - protein, 20 aa, Staphylococcus
RTFVEGTAVPALFGVQQDAT

SEQ ID NO: 2083253 - protein, 20 aa, Staphylococcus
RTFVEGTAVPALFGVQQDDS

SEQ ID NO: 2083254 - protein, 26 aa, Staphylococcus
RTGGFKTIISERLMIGQIVFDNVKDT

SEQ ID NO: 2083255 - protein, 26 aa, Staphylococcus
RTGLSKLIITNVINKSLIGGIRAKVG

SEQ ID NO: 2083256 - protein, 24 aa, Staphylococcus
RTGRIWINTYNQIPAGAPFGGYKK

SEQ ID NO: 2083257 - protein, 17 aa, Staphylococcus
RTHYPERPVYYVIEESS

SEQ ID NO: 2083258 - protein, 23 aa, Staphylococcus
RTIANFLAKHNYVSIVKGLVHHF

SEQ ID NO: 2083259 - protein, 21 aa, Staphylococcus
RTIDLCLDVLVLPNGEYELVD

SEQ ID NO: 2083260 - protein, 20 aa, Staphylococcus
RTIHAIPLKIKEPLNFEVRG

SEQ ID NO: 2083261 - protein, 20 aa, Staphylococcus
RTIHAIPLKINEPLSFEVRG

SEQ ID NO: 2083262 - protein, 21 aa, Staphylococcus
RTIHAIPLKLKEPLNFEVRGE

SEQ ID NO: 2083263 - protein, 27 aa, Staphylococcus
RTIQALRRWEQWFKSLNVKDIHLDITP

SEQ ID NO: 2083264 - protein, 18 aa, Staphylococcus
RTIQEIEDLFLGLGFEIV

SEQ ID NO: 2083265 - protein, 25 aa, Staphylococcus
RTISETYHVPLLMKFEVQGTNKDVI

SEQ ID NO: 2083266 - protein, 18 aa, Staphylococcus
RTKALLDQFGFNFKKSLG

SEQ ID NO: 2083267 - protein, 18 aa, Staphylococcus
RTKKLLMDAFREIAKEKK

SEQ ID NO: 2083268 - protein, 24 aa, Staphylococcus
RTKSGDWLPWQSINDFKDTGWINL

SEQ ID NO: 2083269 - protein, 31 aa, Staphylococcus
RTKTTYTDLIFLYLEKSFLTEDFYDVPSIRS

SEQ ID NO: 2083270 - protein, 24 aa, Staphylococcus
RTKYLQDVPGFKALRFLRPQTKHR

SEQ ID NO: 2083271 - protein, 22 aa, Staphylococcus
RTLDLFLDVLVLPSTGEYELVD

SEQ ID NO: 2083272 - protein, 25 aa, Staphylococcus
RTLDLFLDVLVLPTGKYELVDEDDL

SEQ ID NO: 2083273 - protein, 18 aa, Staphylococcus
RTLEYRNEKVHYGVGAGI

SEQ ID NO: 2083274 - protein, 28 aa, Staphylococcus
RTMELIDEYDFIYGIIGWHPVDAIDFTE

SEQ ID NO: 2083275 - protein, 28 aa, Staphylococcus
RTMELIDKYDFVYGIIGWHPVDAIDCTE

SEQ ID NO: 2083276 - protein, 26 aa, Staphylococcus
RTMERLHSFFDKMNELFIANYKTNHI

SEQ ID NO: 2083277 - protein, 25 aa, Staphylococcus
RTPAQMIAYQLGWLNLIQSWENDNK

SEQ ID NO: 2083278 - protein, 23 aa, Staphylococcus
RTQAILPLRGKILNVEKARLDRI

SEQ ID NO: 2083279 - protein, 23 aa, Staphylococcus
RTQAILPLRGKILNVEKSRLDRI

SEQ ID NO: 2083280 - protein, 27 aa, Staphylococcus
RTQETYRYIFPYDIPSTVTSLLRERSL

SEQ ID NO: 2083281 - protein, 24 aa, Staphylococcus
RTQSFLKYMLLNQIEHKRFTLVFF

SEQ ID NO: 2083282 - protein, 29 aa, Staphylococcus
RTREIGYSIIPLKLYLKHGQCKVLLGIAR

SEQ ID NO: 2083283 - protein, 29 aa, Staphylococcus
RTREIGYSLIPLKLYLKHGQCKVLLGVAR

SEQ ID NO: 2083284 - protein, 17 aa, Staphylococcus
RTRPTVSSLLKNLERKK

SEQ ID NO: 2083285 - protein, 23 aa, Staphylococcus
RTSAARAFITYPKIIFADEPTGA

SEQ ID NO: 2083286 - protein, 24 aa, Staphylococcus
RTSPYDFQGLGLEGLKILKNVKDK

SEQ ID NO: 2083287 - protein, 24 aa, Staphylococcus
RTSPYDFQGLGLEGLKILKNVKEK

SEQ ID NO: 2083288 - protein, 21 aa, Staphylococcus
RTTAYFNIGGLWIALNEEQNI

SEQ ID NO: 2083289 - protein, 17 aa, Staphylococcus
RTTDFKDDKDRVLIKND

SEQ ID NO: 2083290 - protein, 34 aa, Staphylococcus
RTTFYKHFYDKYDLLIYLIKLLTKDYLATDIKER

SEQ ID NO: 2083291 - protein, 31 aa, Staphylococcus
RTTFYKHFYDKYDLLIYLITEITKNYFSMDI

SEQ ID NO: 2083292 - protein, 26 aa, Staphylococcus
RTTFYKHFYDKYDLLSYLLQNVTKGY

SEQ ID NO: 2083293 - protein, 33 aa, Staphylococcus
RTTFYKHFYDKYELLKYLLKLTHDDYFATDIKE

SEQ ID NO: 2083294 - protein, 26 aa, Staphylococcus
RTTGHLMSMLMTLKGLPLAYNKDMQE

SEQ ID NO: 2083295 - protein, 25 aa, Staphylococcus
RTTGHLMSMLVTLKGLPLAYNKDLQ

SEQ ID NO: 2083296 - protein, 21 aa, Staphylococcus
RTVIHFHLPTSPSSYIQEIGR

SEQ ID NO: 2083297 - protein, 19 aa, Staphylococcus
RTVLHFHPALAPYKAAVLP

SEQ ID NO: 2083298 - protein, 29 aa, Staphylococcus
RTVQTYSCIFPYDIPTTLTPLLRERSLGV

SEQ ID NO: 2083299 - protein, 30 aa, Staphylococcus
RTVQYQRFIRHIQFLIRRLNKKEYVHAQDE

SEQ ID NO: 2083300 - protein, 24 aa, Staphylococcus
RTVVIDWVGPMDRFRLIHLNEHGY

SEQ ID NO: 2083301 - protein, 18 aa, Staphylococcus
RTWDWNYGKNPKYNFERE

SEQ ID NO: 2083302 - protein, 23 aa, Staphylococcus
RTYELQGKRYIVKSIGAKIKEMH

SEQ ID NO: 2083303 - protein, 46 aa, Staphylococcus
RTYILGTVDMYTFGRYFPLLKGTSIDYLMPEFLRDIFKEKLIQMHH

SEQ ID NO: 2083304 - protein, 18 aa, Staphylococcus
RTYLFRYQSSIFEHAHHL

SEQ ID NO: 2083305 - protein, 19 aa, Staphylococcus
RVAIARALVTNPKILLCDE

SEQ ID NO: 2083306 - protein, 19 aa, Staphylococcus
RVAILKPYRNKGFGKTLMN

SEQ ID NO: 2083307 - protein, 30 aa, Staphylococcus
RVANEKIRFARFRPFPFWKRVHDSFISSGD

SEQ ID NO: 2083308 - protein, 30 aa, Staphylococcus
RVANEKVRFARFRPFPFWKRVHDSFIESDD

SEQ ID NO: 2083309 - protein, 37 aa, Staphylococcus
RVANKLKLGTVWINDFHPYFAQAPWGGFKQSGIGREL

SEQ ID NO: 2083310 - protein, 20 aa, Staphylococcus
RVANYIAYLCSILSVTSNPK

SEQ ID NO: 2083311 - protein, 25 aa, Staphylococcus
RVARSNFISLISLGANVMFSSPDEW

SEQ ID NO: 2083312 - protein, 28 aa, Staphylococcus
RVARTWIGFLLRETDGNFFNNIYAETLQ

SEQ ID NO: 2083313 - protein, 24 aa, Staphylococcus
RVASLILGAKFPIVLTSRSDTKQN

SEQ ID NO: 2083314 - protein, 24 aa, Staphylococcus
RVASLIVHKLYNYPSEQLTTYGVT

SEQ ID NO: 2083315 - protein, 25 aa, Staphylococcus
RVASLLAHTLFDFPSHQLTTYGVTG

SEQ ID NO: 2083316 - protein, 24 aa, Staphylococcus
RVATEIQFLLAQYVFENLGYRRYE

SEQ ID NO: 2083317 - protein, 29 aa, Staphylococcus
RVAVGAVCKILLKQLGINVLSRVVEIGGI

SEQ ID NO: 2083318 - protein, 26 aa, Staphylococcus
RVAVGAVCKLLLAQLGINMYSRVVEI

SEQ ID NO: 2083319 - protein, 18 aa, Staphylococcus
RVDEILNAKPADRRQIIE

SEQ ID NO: 2083320 - protein, 24 aa, Staphylococcus
RVDFGLSQWGLKQQPGESYISYLL

SEQ ID NO: 2083321 - protein, 28 aa, Staphylococcus
RVDGVPAGLLTYPPLMAADIVIYNTNIV

SEQ ID NO: 2083322 - protein, 22 aa, Staphylococcus
RVDIILPAVSVFKTLYKKVDAT

SEQ ID NO: 2083323 - protein, 20 aa, Staphylococcus
RVDIPWKEKYLDQHPTFLKI

SEQ ID NO: 2083324 - protein, 24 aa, Staphylococcus
RVDKPDLIYISQKGKFDAVVQDVI

SEQ ID NO: 2083325 - protein, 25 aa, Staphylococcus
RVDPEQLYYLMSRGISRTEAERLVI

SEQ ID NO: 2083326 - protein, 18 aa, Staphylococcus
RVDRIIFGDPAVVMYVKK

SEQ ID NO: 2083327 - protein, 38 aa, Staphylococcus
RVEAPLIQAQLIETILLNIINFHTLIATKASRIRQIAM

SEQ ID NO: 2083328 - protein, 37 aa, Staphylococcus
RVEAPLIQAQLIETVLLNIINFHTLISTKASRIRQVA

SEQ ID NO: 2083329 - protein, 25 aa, Staphylococcus
RVEKEFNFKILDHRLTFHGVCSNCQ

SEQ ID NO: 2083330 - protein, 24 aa, Staphylococcus
RVENEFNFKILDHRLTFHGICSEC

SEQ ID NO: 2083331 - protein, 25 aa, Staphylococcus
RVENEFNFKILDHRLTFHGVCSDCQ

SEQ ID NO: 2083332 - protein, 24 aa, Staphylococcus
RVEPPCIYYYKCGGCQLQHLAYDA

SEQ ID NO: 2083333 - protein, 25 aa, Staphylococcus
RVESEYQFKILDHRLTFHGICSECQ

SEQ ID NO: 2083334 - protein, 25 aa, Staphylococcus
RVETEFNFKILDHRLTFHGICAECQ

SEQ ID NO: 2083335 - protein, 25 aa, Staphylococcus
RVETEYNFKILDHRLTFHGVCAECQ

SEQ ID NO: 2083336 - protein, 21 aa, Staphylococcus
RVFDEVVKVLRLGIENGGTSI

SEQ ID NO: 2083337 - protein, 20 aa, Staphylococcus
RVFNMSPYKVQVMGGIAIHK

SEQ ID NO: 2083338 - protein, 18 aa, Staphylococcus
RVFSPNDDYFYQSIKHYM

SEQ ID NO: 2083339 - protein, 20 aa, Staphylococcus
RVGFFYPEVAMYFKNPSRIL

SEQ ID NO: 2083340 - protein, 21 aa, Staphylococcus
RVGIVRALALKPKVLLLDEPT

SEQ ID NO: 2083341 - protein, 20 aa, Staphylococcus
RVGPIKLHIVPFTDLQKQIN

SEQ ID NO: 2083342 - protein, 20 aa, Staphylococcus
RVGPIKLHIVPFTELQKQIN

SEQ ID NO: 2083343 - protein, 18 aa, Staphylococcus
RVGRYILAKLLNDNLDSF

SEQ ID NO: 2083344 - protein, 21 aa, Staphylococcus
RVHMVICCYYGLGISQLLETK

SEQ ID NO: 2083345 - protein, 19 aa, Staphylococcus
RVIGVNNQLPWHLPSDLKH

SEQ ID NO: 2083346 - protein, 20 aa, Staphylococcus
RVIGYKNALPWHIPNDLKHV

SEQ ID NO: 2083347 - protein, 20 aa, Staphylococcus
RVIGYQNQLPWHLPNDLKHV

SEQ ID NO: 2083348 - protein, 18 aa, Staphylococcus
RVILTLERRSKIEEKIMD

SEQ ID NO: 2083349 - protein, 17 aa, Staphylococcus
RVILVKLADRLHNMRTL

SEQ ID NO: 2083350 - protein, 26 aa, Staphylococcus
RVINRNNRLKRLLDLGAPGIIVQNEK

SEQ ID NO: 2083351 - protein, 27 aa, Staphylococcus
RVINTLIKFLPYITNTIRYPHLTNGPI

SEQ ID NO: 2083352 - protein, 19 aa, Staphylococcus
RVIVSPYEHPSIAAALEPF

SEQ ID NO: 2083353 - protein, 19 aa, Staphylococcus
RVKAILRRSAIVNEAVPVE

SEQ ID NO: 2083354 - protein, 25 aa, Staphylococcus
RVKEEWIVPLPKDLTLEEAMIYGTA

SEQ ID NO: 2083355 - protein, 30 aa, Staphylococcus
RVKELLKLPEYTFPLFGMAVGVPADDENGA

SEQ ID NO: 2083356 - protein, 19 aa, Staphylococcus
RVKEWLKRAAKKYGLEAED

SEQ ID NO: 2083357 - protein, 18 aa, Staphylococcus
RVKEWLKRSAKKYGLEAE

SEQ ID NO: 2083358 - protein, 17 aa, Staphylococcus
RVKFEKVFADHFMALYD

SEQ ID NO: 2083359 - protein, 18 aa, Staphylococcus
RVKFEKVFADHFMSLYDK

SEQ ID NO: 2083360 - protein, 17 aa, Staphylococcus
RVKFEKVFADHFMTLYD

SEQ ID NO: 2083361 - protein, 19 aa, Staphylococcus
RVKFEKVFADHYLKLYDET

SEQ ID NO: 2083362 - protein, 17 aa, Staphylococcus
RVKLAHELGLIDNNKLN

SEQ ID NO: 2083363 - protein, 23 aa, Staphylococcus
RVKQYILKLIKNGELDSTGKLPS

SEQ ID NO: 2083364 - protein, 24 aa, Staphylococcus
RVKSLHPFYYPLGEVVSISRMIED

SEQ ID NO: 2083365 - protein, 17 aa, Staphylococcus
RVKTLSTPYYLEGKNYR

SEQ ID NO: 2083366 - protein, 26 aa, Staphylococcus
RVKVQPGEFYFIPAGTIHSIGSGITV

SEQ ID NO: 2083367 - protein, 18 aa, Staphylococcus
RVLDTLHDVGLYDKENLV

SEQ ID NO: 2083368 - protein, 17 aa, Staphylococcus
RVLGGLTYRESHFALEF

SEQ ID NO: 2083369 - protein, 17 aa, Staphylococcus
RVLGYKLSLNPLTQKND

SEQ ID NO: 2083370 - protein, 17 aa, Staphylococcus
RVLMKELQSLGLDVKIM

SEQ ID NO: 2083371 - protein, 25 aa, Staphylococcus
RVLNEGLPLPDLIIVDGGKGHMSGV

SEQ ID NO: 2083372 - protein, 19 aa, Staphylococcus
RVLVFNKRGYPIGQILMPG

SEQ ID NO: 2083373 - protein, 29 aa, Staphylococcus
RVMEPGCKFDYMLTLYGPQGVGKSAILKK

SEQ ID NO: 2083374 - protein, 26 aa, Staphylococcus
RVNCVAPGPFWSPLQITGGQPQSAIP

SEQ ID NO: 2083375 - protein, 21 aa, Staphylococcus
RVNEFGFIETPYRKVDIDTNA

SEQ ID NO: 2083376 - protein, 21 aa, Staphylococcus
RVNEFGFIETPYRKVDIDTNS

SEQ ID NO: 2083377 - protein, 21 aa, Staphylococcus
RVNEFGFIETPYRKVDLDTNA

SEQ ID NO: 2083378 - protein, 20 aa, Staphylococcus
RVNEFGFIETPYRKVDLETN

SEQ ID NO: 2083379 - protein, 26 aa, Staphylococcus
RVPVQAGEFYFIPAGTLHSISAGVLA

SEQ ID NO: 2083380 - protein, 21 aa, Staphylococcus
RVQDYNFTWKAPIMSKPVKNM

SEQ ID NO: 2083381 - protein, 25 aa, Staphylococcus
RVQFYNRPYRQKVFPRIDESLNVPL

SEQ ID NO: 2083382 - protein, 26 aa, Staphylococcus
RVQSTLIKHQALMRGFLVAEFADDFE

SEQ ID NO: 2083383 - protein, 21 aa, Staphylococcus
RVRDRTDLLVYLSSKHISIGD

SEQ ID NO: 2083384 - protein, 19 aa, Staphylococcus
RVRLRHLLSNLAKDKIVII

SEQ ID NO: 2083385 - protein, 22 aa, Staphylococcus
RVRQYRIGAYTYERPKFLRQER

SEQ ID NO: 2083386 - protein, 20 aa, Staphylococcus
RVRQYRIGVATYERPRFLSE

SEQ ID NO: 2083387 - protein, 19 aa, Staphylococcus
RVRQYRIGVATYERPRFMR

SEQ ID NO: 2083388 - protein, 23 aa, Staphylococcus
RVRYMTTLAGYIHWYLTDEKVIG

SEQ ID NO: 2083389 - protein, 26 aa, Staphylococcus
RVSGTSGLALFDYKFGQTGVHETEAD

SEQ ID NO: 2083390 - protein, 30 aa, Staphylococcus
RVSKTKGLIGNIMKIKPIGTLSDGKLELVH

SEQ ID NO: 2083391 - protein, 27 aa, Staphylococcus
RVSLVQYVTWAYLRSLLDIEHDSWKHA

SEQ ID NO: 2083392 - protein, 18 aa, Staphylococcus
RVSNIIDHLLKPADTSKG

SEQ ID NO: 2083393 - protein, 32 aa, Staphylococcus
RVSPDIFTKRISYYNYILLNSDGLSDYVRNHE

SEQ ID NO: 2083394 - protein, 25 aa, Staphylococcus
RVSRFPFYIKGEIYDPFVKPALSKQ

SEQ ID NO: 2083395 - protein, 34 aa, Staphylococcus
RVSSVFLETFLFYSGFYYPLYLAGQGRMTTSGEI

SEQ ID NO: 2083396 - protein, 23 aa, Staphylococcus
RVTDHRIGLTLQKLSQILEGNLD

SEQ ID NO: 2083397 - protein, 19 aa, Staphylococcus
RVTKILRYLCQTVGYDNDE

SEQ ID NO: 2083398 - protein, 18 aa, Staphylococcus
RVTKKDILAFINAADSHP

SEQ ID NO: 2083399 - protein, 27 aa, Staphylococcus
RVTNAWNVMHLIFPVVSTTFASFASMY

SEQ ID NO: 2083400 - protein, 18 aa, Staphylococcus
RVTQIFKALSDINRIRIM

SEQ ID NO: 2083401 - protein, 17 aa, Staphylococcus
RVTSWNQAKALGIDQTK

SEQ ID NO: 2083402 - protein, 18 aa, Staphylococcus
RVTTGKYYSPSEFKAALE

SEQ ID NO: 2083403 - protein, 24 aa, Staphylococcus
RVVCNYFDDIYVIEKLLLKQEDVK

SEQ ID NO: 2083404 - protein, 22 aa, Staphylococcus
RVVCNYLEDIYVIEKMLLQQED

SEQ ID NO: 2083405 - protein, 18 aa, Staphylococcus
RVVITRPANDPALFDATI

SEQ ID NO: 2083406 - protein, 17 aa, Staphylococcus
RVVLAPMAGVCNSAFRL

SEQ ID NO: 2083407 - protein, 19 aa, Staphylococcus
RVVPSPQPIEIIEQTSIET

SEQ ID NO: 2083408 - protein, 17 aa, Staphylococcus
RVVPVLSMVDYVLVMTV

SEQ ID NO: 2083409 - protein, 25 aa, Staphylococcus
RVVVFWHHYLRPEIKFDGIDPLVEQ

SEQ ID NO: 2083410 - protein, 18 aa, Staphylococcus
RVWLEKESYDFSFSGLKS

SEQ ID NO: 2083411 - protein, 29 aa, Staphylococcus
RVYLAIGGGFKLDSWLNSTSTDLNIGVGG

SEQ ID NO: 2083412 - protein, 18 aa, Staphylococcus
RWFVGDYMTSLDMQGFSL

SEQ ID NO: 2083413 - protein, 21 aa, Staphylococcus
RWIYKTMNEIRFFEEKVHKIF

SEQ ID NO: 2083414 - protein, 28 aa, Staphylococcus
RWNKSHHQLIFFGRYHCLARKPKCDICP

SEQ ID NO: 2083415 - protein, 27 aa, Staphylococcus
RWNKTHHQLIFFGRYHCLARSPKCDVC

SEQ ID NO: 2083416 - protein, 23 aa, Staphylococcus
RWNPKMKRYIFTERNGIYIIDLQ

SEQ ID NO: 2083417 - protein, 28 aa, Staphylococcus
RWNRSHHQLIFFGRYHCLARKPKCDICP

SEQ ID NO: 2083418 - protein, 19 aa, Staphylococcus
RWPGTITTIVHRIGPLQIS

SEQ ID NO: 2083419 - protein, 28 aa, Staphylococcus
RWSKSHHQLIFFGRYHCIARKPKCDICP

SEQ ID NO: 2083420 - protein, 28 aa, Staphylococcus
RWSRSHHQLIFFGRYHCLARKPKCDICP

SEQ ID NO: 2083421 - protein, 18 aa, Staphylococcus
RYAEQQGFKVEFADYLPG

SEQ ID NO: 2083422 - protein, 23 aa, Staphylococcus
RYAPEFEKVIPLKVMLIKKEDAI

SEQ ID NO: 2083423 - protein, 25 aa, Staphylococcus
RYCPNCGRLLKYDYIHYNQIGHYHC

SEQ ID NO: 2083424 - protein, 18 aa, Staphylococcus
RYDCSVVPVFWIAGEDHD

SEQ ID NO: 2083425 - protein, 20 aa, Staphylococcus
RYDDLILAQLIHSPSYSAYV

SEQ ID NO: 2083426 - protein, 39 aa, Staphylococcus
RYDIDKTFQFLYNDFFYLGFIFNYYFTNTILKFENDFIN

SEQ ID NO: 2083427 - protein, 19 aa, Staphylococcus
RYDIHHLLEQLKSQCLIIM

SEQ ID NO: 2083428 - protein, 25 aa, Staphylococcus
RYDSFFGTPLDSLLRERDIKEIEIV

SEQ ID NO: 2083429 - protein, 17 aa, Staphylococcus
RYEEDHIFCLTLGTGIG

SEQ ID NO: 2083430 - protein, 20 aa, Staphylococcus
RYFDDVTLYIAAAQRKKQDI

SEQ ID NO: 2083431 - protein, 18 aa, Staphylococcus
RYFEANQLCFSLFSNRNR

SEQ ID NO: 2083432 - protein, 17 aa, Staphylococcus
RYFFPNHSELLNAVMST

SEQ ID NO: 2083433 - protein, 27 aa, Staphylococcus
RYFNGNEIGLLLMKLRFQDLTEDSTPQ

SEQ ID NO: 2083434 - protein, 20 aa, Staphylococcus
RYGNRKFWCKGYYVDTVGRN

SEQ ID NO: 2083435 - protein, 21 aa, Staphylococcus
RYGTFAKYFTKNDVPTFAICH

SEQ ID NO: 2083436 - protein, 22 aa, Staphylococcus
RYGTFAKYFTKNDVPTFAICHG

SEQ ID NO: 2083437 - protein, 23 aa, Staphylococcus
RYHDRSFIHCNVEQIPTVVEKVV

SEQ ID NO: 2083438 - protein, 18 aa, Staphylococcus
RYHKLYASGLMQEDELFD

SEQ ID NO: 2083439 - protein, 25 aa, Staphylococcus
RYHRQPLPVPRFKYFKLKQHKIQYA

SEQ ID NO: 2083440 - protein, 21 aa, Staphylococcus
RYHTKKKDVLAVDHVDLNIPT

SEQ ID NO: 2083441 - protein, 28 aa, Staphylococcus
RYIEAYNVDIVILKPFRLGGIDRMLEAI

SEQ ID NO: 2083442 - protein, 27 aa, Staphylococcus
RYIEMTSDFLALYGTYTRTWQGKTSTN

SEQ ID NO: 2083443 - protein, 19 aa, Staphylococcus
RYIIFNINEDNLLKPELYM

SEQ ID NO: 2083444 - protein, 17 aa, Staphylococcus
RYILAKLLNDNLDSFTA

SEQ ID NO: 2083445 - protein, 17 aa, Staphylococcus
RYKALELASLIVDKPYR

SEQ ID NO: 2083446 - protein, 25 aa, Staphylococcus
RYKQQEIPIYLDDLVIIFTDGVTEV

SEQ ID NO: 2083447 - protein, 26 aa, Staphylococcus
RYLERISELCDVKISIFSVGPDRNQT

SEQ ID NO: 2083448 - protein, 28 aa, Staphylococcus
RYLNLKPSNEFIISSWLGTMGCALPGAM

SEQ ID NO: 2083449 - protein, 17 aa, Staphylococcus
RYLRLAIFKCCSSHLLQ

SEQ ID NO: 2083450 - protein, 20 aa, Staphylococcus
RYLTITNCYSHHPTIGKGNN

SEQ ID NO: 2083451 - protein, 34 aa, Staphylococcus
RYNEIDYLWNELATFKDDYLLKIKNIESSQTEKI

SEQ ID NO: 2083452 - protein, 22 aa, Staphylococcus
RYNIEPLVHITCRDRNLIGLQS

SEQ ID NO: 2083453 - protein, 25 aa, Staphylococcus
RYNTALWQGTSLRPFHFKATHIGPQ

SEQ ID NO: 2083454 - protein, 26 aa, Staphylococcus
RYPNIDFILPHAGGVLPYLEWRIDET

SEQ ID NO: 2083455 - protein, 20 aa, Staphylococcus
RYPNIKIILAHAGGTLPYLT

SEQ ID NO: 2083456 - protein, 18 aa, Staphylococcus
RYPNLNMIIGHWGEFIPF

SEQ ID NO: 2083457 - protein, 35 aa, Staphylococcus
RYQDIAILYRDEAYAYLFDSVLPQYDIPFNIDTKR

SEQ ID NO: 2083458 - protein, 27 aa, Staphylococcus
RYRAQLLRKCNETIKFVFLDFIKNENI

SEQ ID NO: 2083459 - protein, 29 aa, Staphylococcus
RYRKHNYRGLFRFIQLFVVSNKKETRYYA

SEQ ID NO: 2083460 - protein, 32 aa, Staphylococcus
RYRKQNYTGLFRYIQLFIISNGIDTRYISNND

SEQ ID NO: 2083461 - protein, 18 aa, Staphylococcus
RYRLGVNHWQIPVNQPKA

SEQ ID NO: 2083462 - protein, 18 aa, Staphylococcus
RYSVLTAVGLLPIAAAGI

SEQ ID NO: 2083463 - protein, 26 aa, Staphylococcus
RYTEFILEDLNQKLYHYWALGHIHER

SEQ ID NO: 2083464 - protein, 25 aa, Staphylococcus
RYTEFILENLKEKLYHYWALGHIHE

SEQ ID NO: 2083465 - protein, 30 aa, Staphylococcus
RYTEFLLEDLNTKLYHYWALGHIHERSQLN

SEQ ID NO: 2083466 - protein, 19 aa, Staphylococcus
RYTLNALYNRYQIPLFIVE

SEQ ID NO: 2083467 - protein, 25 aa, Staphylococcus
RYTPLEFSYYYLKEMFKEIMGFDEF

SEQ ID NO: 2083468 - protein, 27 aa, Staphylococcus
RYTYKLRSVYYLRISTLPLSIGSESCV

SEQ ID NO: 2083469 - protein, 23 aa, Staphylococcus
RYVAIELIKLLQDKPDAILGLAT

SEQ ID NO: 2083470 - protein, 27 aa, Staphylococcus
RYVRNEQKLYVFNGSDWLEFEEANYDP

SEQ ID NO: 2083471 - protein, 26 aa, Staphylococcus
RYVSNGLVHFLLPEELREVAPLTEDF

SEQ ID NO: 2083472 - protein, 18 aa, Staphylococcus
RYVVKHHPNLPITATSRH

SEQ ID NO: 2083473 - protein, 17 aa, Staphylococcus
RYYAMDRDKRWEREEKA

SEQ ID NO: 2083474 - protein, 18 aa, Staphylococcus
RYYDKYPTTQIEASGLDV

SEQ ID NO: 2083475 - protein, 20 aa, Staphylococcus
RYYEKIGLLKIPRDTNQYRY

SEQ ID NO: 2083476 - protein, 18 aa, Staphylococcus
RYYNKYPTTQIEASGLDV

SEQ ID NO: 2083477 - protein, 25 aa, Staphylococcus
SAADLAPLLYIAPYSGVTMGEEFMF

SEQ ID NO: 2083478 - protein, 25 aa, Staphylococcus
SAAEPAPLLYIAPYAGVTMGEEFMF

SEQ ID NO: 2083479 - protein, 25 aa, Staphylococcus
SAAEPAPLLYIAPYSGVAMGEEFMF

SEQ ID NO: 2083480 - protein, 25 aa, Staphylococcus
SAAEPAPLLYIAPYSGVTMGEEFMF

SEQ ID NO: 2083481 - protein, 24 aa, Staphylococcus
SAAFFIVAALISPGSDITIHNVGI

SEQ ID NO: 2083482 - protein, 23 aa, Staphylococcus
SAAFFIVAALITPGSDVTIHNVG

SEQ ID NO: 2083483 - protein, 23 aa, Staphylococcus
SAAKDVAMHIAAINPKYVSSDQV

SEQ ID NO: 2083484 - protein, 23 aa, Staphylococcus
SAAKSMYLVYQNPELQFITNSVY

SEQ ID NO: 2083485 - protein, 23 aa, Staphylococcus
SAATINIVVPYYGYARQDRKARS

SEQ ID NO: 2083486 - protein, 24 aa, Staphylococcus
SAAYFIVAGLITPGSDITIHNVGI

SEQ ID NO: 2083487 - protein, 32 aa, Staphylococcus
SACFTGFELFVKPAIYHMMGADAFYPQVVKAT

SEQ ID NO: 2083488 - protein, 22 aa, Staphylococcus
SADIEGFLFLDADDQYLSGSID

SEQ ID NO: 2083489 - protein, 23 aa, Staphylococcus
SADKILGAILFEQTMDREVEGKY

SEQ ID NO: 2083490 - protein, 30 aa, Staphylococcus
SADKYVIATPMWNLSFPPAVKRYFDAVSVA

SEQ ID NO: 2083491 - protein, 19 aa, Staphylococcus
SADLVITLCDHADKNCSVV

SEQ ID NO: 2083492 - protein, 17 aa, Staphylococcus
SADPSFLEDERFSNYGK

SEQ ID NO: 2083493 - protein, 25 aa, Staphylococcus
SADQALLQRLDLMKFQAEELSEANL

SEQ ID NO: 2083494 - protein, 25 aa, Staphylococcus
SADQALLQRLDLMKFQFEELQEASL

SEQ ID NO: 2083495 - protein, 26 aa, Staphylococcus
SADQALLQRLDLMKFQLEELTEASLK

SEQ ID NO: 2083496 - protein, 28 aa, Staphylococcus
SADRPFDLIYSILAKYQSTSLLPEYRFE

SEQ ID NO: 2083497 - protein, 36 aa, Staphylococcus
SAEKAFDIVFEDSPFKYVLLVPTDKFQFQGIGEGAS

SEQ ID NO: 2083498 - protein, 23 aa, Staphylococcus
SAEMLDCDFFFFNPKDVDINHKN

SEQ ID NO: 2083499 - protein, 27 aa, Staphylococcus
SAEPSEYSALFIPGGFSPDHLRGDVDG

SEQ ID NO: 2083500 - protein, 31 aa, Staphylococcus
SAERIMLPDVTIALDYALNRFTNIIDRLTVF

SEQ ID NO: 2083501 - protein, 24 aa, Staphylococcus
SAERIMLPDVTIALDYGLNRFTNI

SEQ ID NO: 2083502 - protein, 20 aa, Staphylococcus
SAFEHDFPYELTPDQGKSIE

SEQ ID NO: 2083503 - protein, 18 aa, Staphylococcus
SAFEKSGLKYNISYASKA

SEQ ID NO: 2083504 - protein, 26 aa, Staphylococcus
SAGGQWFTPVINYPEVAILGIGRIAQ

SEQ ID NO: 2083505 - protein, 27 aa, Staphylococcus
SAGKSTLINLLLEESILPSSPVPTTSN

SEQ ID NO: 2083506 - protein, 28 aa, Staphylococcus
SAGKSTLINLLLEQDILPSSPVPTTSNT

SEQ ID NO: 2083507 - protein, 28 aa, Staphylococcus
SAGKSTLINLLLEQNILPSSPVPTTSNT

SEQ ID NO: 2083508 - protein, 17 aa, Staphylococcus
SAGVDIIVQPPGKKLQH

SEQ ID NO: 2083509 - protein, 42 aa, Staphylococcus
SAGYTLEQLAVQDFFFQPDYDRPWNYLNVLAQQALNDTFGSD

SEQ ID NO: 2083510 - protein, 18 aa, Staphylococcus
SAGYWFDKKFSEEKVLTF

SEQ ID NO: 2083511 - protein, 17 aa, Staphylococcus
SAHFKVFSDNIGKYVSE

SEQ ID NO: 2083512 - protein, 29 aa, Staphylococcus
SAIDGLIYHLLIAIHRLKGKFSFDVPSEQ

SEQ ID NO: 2083513 - protein, 17 aa, Staphylococcus
SAIIKILKQTNAHVTLY

SEQ ID NO: 2083514 - protein, 21 aa, Staphylococcus
SAIILVPVKSKFQMKREWLKI

SEQ ID NO: 2083515 - protein, 18 aa, Staphylococcus
SAIKAQYPNVIIFVDNCY

SEQ ID NO: 2083516 - protein, 25 aa, Staphylococcus
SAIKHFYEKLLKLKSLMHTETAKQL

SEQ ID NO: 2083517 - protein, 29 aa, Staphylococcus
SAIPELEEQLKFLLIPKDPNDEKDVIVEI

SEQ ID NO: 2083518 - protein, 30 aa, Staphylococcus
SAIQTVIKYRVPVCCFTFGIPSKEIIEQLK

SEQ ID NO: 2083519 - protein, 24 aa, Staphylococcus
SAISLNMRRKIGPLLPGIHHIPFP

SEQ ID NO: 2083520 - protein, 24 aa, Staphylococcus
SAKAMQYLFPKFKQIPLTIISGLA

SEQ ID NO: 2083521 - protein, 25 aa, Staphylococcus
SAKEKQRLRTLFPLIKEASENHKKR

SEQ ID NO: 2083522 - protein, 25 aa, Staphylococcus
SAKEQLRLKTLFPYIKEASENHKKR

SEQ ID NO: 2083523 - protein, 25 aa, Staphylococcus
SAKERQRLRTLFPYINEASENHKKR

SEQ ID NO: 2083524 - protein, 24 aa, Staphylococcus
SAKIFFSSLGFENLAFEKNASKIG

SEQ ID NO: 2083525 - protein, 23 aa, Staphylococcus
SAKSYLLEKLKYNLKEFKLDKNQ

SEQ ID NO: 2083526 - protein, 29 aa, Staphylococcus
SAKVIVIDTYYLMLGGLKKKPNQTIIQTW

SEQ ID NO: 2083527 - protein, 28 aa, Staphylococcus
SALDFQIKHLMVSKVKGAFEKFDVNVEG

SEQ ID NO: 2083528 - protein, 26 aa, Staphylococcus
SALEVLRRYCFDKAFIGMNGLDLNHG

SEQ ID NO: 2083529 - protein, 25 aa, Staphylococcus
SALKDLMLLHHFKYDTNVPKLFELA

SEQ ID NO: 2083530 - protein, 18 aa, Staphylococcus
SALLAAHLKSDQLIILTA

SEQ ID NO: 2083531 - protein, 22 aa, Staphylococcus
SALNFKFLKRMNEAGLPVVFVI

SEQ ID NO: 2083532 - protein, 26 aa, Staphylococcus
SALPLLDYCTFGRINDLRIGESLFRG

SEQ ID NO: 2083533 - protein, 20 aa, Staphylococcus
SALSFEYLKSHDALGSIIVG

SEQ ID NO: 2083534 - protein, 20 aa, Staphylococcus
SAMEDFFLDIIIGKGDEARS

SEQ ID NO: 2083535 - protein, 17 aa, Staphylococcus
SAMIIVFGDLKNYEKAE

SEQ ID NO: 2083536 - protein, 30 aa, Staphylococcus
SAMPVVHIYGLLSPYYKQPITTLPYAIVTK

SEQ ID NO: 2083537 - protein, 20 aa, Staphylococcus
SANIEFALTKEPYFSTPYII

SEQ ID NO: 2083538 - protein, 26 aa, Staphylococcus
SAPKIFQKVTDLIKEQVKHMTGLQVV

SEQ ID NO: 2083539 - protein, 30 aa, Staphylococcus
SAPKIFRKVTELVKEQVKYITGLQVVEVNM

SEQ ID NO: 2083540 - protein, 20 aa, Staphylococcus
SAPLLIETFVRTASYFNGIG

SEQ ID NO: 2083541 - protein, 17 aa, Staphylococcus
SAQALVNYFTNKNIDHV

SEQ ID NO: 2083542 - protein, 23 aa, Staphylococcus
SAQEHLLKFYGSFGFERTSETYL

SEQ ID NO: 2083543 - protein, 26 aa, Staphylococcus
SAQTYNFKHAIIATGSRPIEIPNFEF

SEQ ID NO: 2083544 - protein, 24 aa, Staphylococcus
SARLHPWLLSIYEKRGYEIYAEHE

SEQ ID NO: 2083545 - protein, 17 aa, Staphylococcus
SARLRYLISNELNVAPA

SEQ ID NO: 2083546 - protein, 21 aa, Staphylococcus
SARSIIAIAVGYPNKLKGAPK

SEQ ID NO: 2083547 - protein, 20 aa, Staphylococcus
SASMKAFFDHWSETLLDSNY

SEQ ID NO: 2083548 - protein, 17 aa, Staphylococcus
SASWDAHKLLFQTYSCA

SEQ ID NO: 2083549 - protein, 22 aa, Staphylococcus
SATEYRFYLHGLSSHVADKEQG

SEQ ID NO: 2083550 - protein, 22 aa, Staphylococcus
SATFFENIGFTIKKNEAVLDKM

SEQ ID NO: 2083551 - protein, 25 aa, Staphylococcus
SATKGAIVAFTRSLATTLMSKGIRV

SEQ ID NO: 2083552 - protein, 24 aa, Staphylococcus
SATKGAIVSFTRSLATTLMEKNIR

SEQ ID NO: 2083553 - protein, 24 aa, Staphylococcus
SATKGAIVSFTRSLATTLMEKSIR

SEQ ID NO: 2083554 - protein, 17 aa, Staphylococcus
SATPYYYGTYEYENESV

SEQ ID NO: 2083555 - protein, 18 aa, Staphylococcus
SATSHAVVYFLQQGTPFI

SEQ ID NO: 2083556 - protein, 24 aa, Staphylococcus
SATSHAVVYFLQQGTPFIYQGQEI

SEQ ID NO: 2083557 - protein, 25 aa, Staphylococcus
SAVDRELPYHLAIKKLKQLDEDFGV

SEQ ID NO: 2083558 - protein, 24 aa, Staphylococcus
SAVDRELPYHLAIKNLKQLDEDFG

SEQ ID NO: 2083559 - protein, 25 aa, Staphylococcus
SAVHYFFEEANLPNFYAYYAIGRQT

SEQ ID NO: 2083560 - protein, 20 aa, Staphylococcus
SAVIMLLDKGDHLILNSDVY

SEQ ID NO: 2083561 - protein, 18 aa, Staphylococcus
SAVRYYFENGDTPEFHHY

SEQ ID NO: 2083562 - protein, 22 aa, Staphylococcus
SAYAFIKRLIKQFGKPQKIVTD

SEQ ID NO: 2083563 - protein, 27 aa, Staphylococcus
SAYDDVEFKLYLGLKHISPYIEEAVES

SEQ ID NO: 2083564 - protein, 24 aa, Staphylococcus
SAYFNYYRYKKFGILPKLDYELKE

SEQ ID NO: 2083565 - protein, 26 aa, Staphylococcus
SAYRELSLLLRRPPGREAYPGDVFYL

SEQ ID NO: 2083566 - protein, 21 aa, Staphylococcus
SAYVFIKRLIKQFGKPQKVIT

SEQ ID NO: 2083567 - protein, 30 aa, Staphylococcus
SCDLLMSIIKFRYFAYYKYHKLTILKGLLN

SEQ ID NO: 2083568 - protein, 19 aa, Staphylococcus
SCLNKGIPVILVSRSFNGI

SEQ ID NO: 2083569 - protein, 21 aa, Staphylococcus
SCQALPDEPLHSSFIMSKLAL

SEQ ID NO: 2083570 - protein, 20 aa, Staphylococcus
SCQALPEEPLHSSFIMSKMA

SEQ ID NO: 2083571 - protein, 18 aa, Staphylococcus
SCSPFRIPGAILATAQSQ

SEQ ID NO: 2083572 - protein, 18 aa, Staphylococcus
SCSPFRVPGAILAAAQSQ

SEQ ID NO: 2083573 - protein, 19 aa, Staphylococcus
SCVIRLIPQYFTSKREYKD

SEQ ID NO: 2083574 - protein, 27 aa, Staphylococcus
SCVTNNLQLVMSIAALKLKLSPNEIWN

SEQ ID NO: 2083575 - protein, 17 aa, Staphylococcus
SCWYYLRYIDPDNEQML

SEQ ID NO: 2083576 - protein, 29 aa, Staphylococcus
SDADIIISAPFYPAYLTRKRIEQAPKLKL

SEQ ID NO: 2083577 - protein, 22 aa, Staphylococcus
SDADRLYFLKQHTLVSELNFNE

SEQ ID NO: 2083578 - protein, 22 aa, Staphylococcus
SDAFIKSKRLKGLSLKDVELSV

SEQ ID NO: 2083579 - protein, 23 aa, Staphylococcus
SDAGLLYISYITNPTTGGVSASF

SEQ ID NO: 2083580 - protein, 29 aa, Staphylococcus
SDAKKSTPLKIYINGDFSNISFPDSFKVF

SEQ ID NO: 2083581 - protein, 18 aa, Staphylococcus
SDALLDVLFEVLAAIEVL

SEQ ID NO: 2083582 - protein, 18 aa, Staphylococcus
SDALLLAESIMGHLDFLI

SEQ ID NO: 2083583 - protein, 18 aa, Staphylococcus
SDDAFLLETLLFADMITD

SEQ ID NO: 2083584 - protein, 27 aa, Staphylococcus
SDDDVIKFLKYFTFLDKDEINRLEESK

SEQ ID NO: 2083585 - protein, 20 aa, Staphylococcus
SDDILKLEALPKSLAIIGGG

SEQ ID NO: 2083586 - protein, 26 aa, Staphylococcus
SDDNLYDYWISFSRGIKSRGKAEIGD

SEQ ID NO: 2083587 - protein, 17 aa, Staphylococcus
SDDNQHRYLLKKTWDKD

SEQ ID NO: 2083588 - protein, 19 aa, Staphylococcus
SDDSKFKRWVIGSIISRTY

SEQ ID NO: 2083589 - protein, 22 aa, Staphylococcus
SDDVEAFMFLDADDQFLPGRLD

SEQ ID NO: 2083590 - protein, 27 aa, Staphylococcus
SDDVMCRRIYKLPIGFKWDNHPHITLI

SEQ ID NO: 2083591 - protein, 29 aa, Staphylococcus
SDDWSEIYALYLLEAYQRHMIGYALTQRA

SEQ ID NO: 2083592 - protein, 28 aa, Staphylococcus
SDEDVIKFLKYFTFLDKEEIDRLEQSKE

SEQ ID NO: 2083593 - protein, 23 aa, Staphylococcus
SDEFLNFIRNYYYDIKKVASFNE

SEQ ID NO: 2083594 - protein, 20 aa, Staphylococcus
SDELFFGLPAEQTVWMSHSD

SEQ ID NO: 2083595 - protein, 23 aa, Staphylococcus
SDEMVAQMLYKSKKPVLLAVNKV

SEQ ID NO: 2083596 - protein, 23 aa, Staphylococcus
SDEPKITYVNWSKKGWENQVPDI

SEQ ID NO: 2083597 - protein, 26 aa, Staphylococcus
SDEQLKQVVIAYEPIWAIGTGKSSTA

SEQ ID NO: 2083598 - protein, 18 aa, Staphylococcus
SDETDLMHILMQQKQKLV

SEQ ID NO: 2083599 - protein, 23 aa, Staphylococcus
SDETLLKFYQYNPVKPSSFDQRM

SEQ ID NO: 2083600 - protein, 24 aa, Staphylococcus
SDETWGQVPLLYYISEDNIDIASL

SEQ ID NO: 2083601 - protein, 17 aa, Staphylococcus
SDEYSIIVLGQSGVDFL

SEQ ID NO: 2083602 - protein, 20 aa, Staphylococcus
SDFDIHLIPETRKSTILNQK

SEQ ID NO: 2083603 - protein, 20 aa, Staphylococcus
SDFNKPGHLFPLIAQDNGVL

SEQ ID NO: 2083604 - protein, 31 aa, Staphylococcus; identical to SEQ ID NO: 1682713

SEQ ID NO: 2083605 - protein, 18 aa, Staphylococcus
SDHDPLLVQLDLLHLNKK

SEQ ID NO: 2083606 - protein, 29 aa, Staphylococcus
SDHIIDAFGMRPYIKKKVKKYSMGMKQKL

SEQ ID NO: 2083607 - protein, 23 aa, Staphylococcus
SDIDYLGYYILPNGHTTTITKAE

SEQ ID NO: 2083608 - protein, 23 aa, Staphylococcus
SDIGIKYLTLYAFSTENWSRPES

SEQ ID NO: 2083609 - protein, 20 aa, Staphylococcus
SDIGNIIALKQRAKKRNIKL

SEQ ID NO: 2083610 - protein, 18 aa, Staphylococcus
SDIPLARGLGSSASELVG

SEQ ID NO: 2083611 - protein, 22 aa, Staphylococcus
SDIQQLMSKIPFETSQLSQGMK

SEQ ID NO: 2083612 - protein, 23 aa, Staphylococcus
SDIVQVIGSMIVLYKESQDNKQI

SEQ ID NO: 2083613 - protein, 22 aa, Staphylococcus
SDIYASVRLLWSRIGTPFVGYS

SEQ ID NO: 2083614 - protein, 23 aa, Staphylococcus
SDKAIKFFVRYGGEKQLKQGFSP

SEQ ID NO: 2083615 - protein, 23 aa, Staphylococcus
SDKCDFYIKIPMVGHVNSLNASV

SEQ ID NO: 2083616 - protein, 26 aa, Staphylococcus
SDKEQRLFEEGAYIYYLGSFIDSDSS

SEQ ID NO: 2083617 - protein, 22 aa, Staphylococcus
SDKERFFGMHFFNPPRIMKLVE

SEQ ID NO: 2083618 - protein, 23 aa, Staphylococcus
SDKIGVIKNLLNIADKILIGGGM

SEQ ID NO: 2083619 - protein, 18 aa, Staphylococcus
SDKIIDAFGMRPYIKKKV

SEQ ID NO: 2083620 - protein, 17 aa, Staphylococcus
SDKKMIISGIWTHFGYA

SEQ ID NO: 2083621 - protein, 23 aa, Staphylococcus
SDKKVIMYAPTWRDDEFVSKGKY

SEQ ID NO: 2083622 - protein, 31 aa, Staphylococcus
SDKVDVPTFKTNPILVTGISFSPNTKEIKTG

SEQ ID NO: 2083623 - protein, 32 aa, Staphylococcus
SDLARRFINRDLFKYIPFDGSIITITELQELF

SEQ ID NO: 2083624 - protein, 22 aa, Staphylococcus
SDLDHVYVAKRNPKTLPDESGE

SEQ ID NO: 2083625 - protein, 28 aa, Staphylococcus
SDLDPIIQNMYLYLPNFFMNHTSEDNKY

SEQ ID NO: 2083626 - protein, 29 aa, Staphylococcus
SDLEKTMLKLLDRIIQKHQKAQITYFGGM

SEQ ID NO: 2083627 - protein, 20 aa, Staphylococcus
SDLFHIRTLGFRGEALASIS

SEQ ID NO: 2083628 - protein, 18 aa, Staphylococcus
SDLISIIEKVTHSQPLME

SEQ ID NO: 2083629 - protein, 30 aa, Staphylococcus
SDLKKRVPEGLIPLLKIQGLGSKKIAKLYQ

SEQ ID NO: 2083630 - protein, 27 aa, Staphylococcus
SDLLEPAFLVYWFQLAPEVHSQYKQYM

SEQ ID NO: 2083631 - protein, 17 aa, Staphylococcus
SDLLRQHGFKVFGPNQD

SEQ ID NO: 2083632 - protein, 26 aa, Staphylococcus
SDLMNGHLTLPVLLEARKNPQFKAII

SEQ ID NO: 2083633 - protein, 21 aa, Staphylococcus
SDLQIFLYDRGERILRRFPEK

SEQ ID NO: 2083634 - protein, 23 aa, Staphylococcus
SDLQTHLELYKAWPEIGGIVHTH

SEQ ID NO: 2083635 - protein, 24 aa, Staphylococcus
SDLSYAANFLYMLKGELPSDTEVE

SEQ ID NO: 2083636 - protein, 24 aa, Staphylococcus
SDLSYAGNFLYMLKGELPTDIEEE

SEQ ID NO: 2083637 - protein, 21 aa, Staphylococcus
SDMKSGLMALAIAMIELKEND

SEQ ID NO: 2083638 - protein, 20 aa, Staphylococcus
SDMSMFEFKQDVKFFDKNII

SEQ ID NO: 2083639 - protein, 31 aa, Staphylococcus
SDNAYFVSMMGYAPGFPYLTGMNEALYVNHT

SEQ ID NO: 2083640 - protein, 27 aa, Staphylococcus
SDNDQRLFEEGAYIYYLGSFIDSDSSS

SEQ ID NO: 2083641 - protein, 27 aa, Staphylococcus
SDNDQTLLILPLWHEHDTFPFELLKER

SEQ ID NO: 2083642 - protein, 22 aa, Staphylococcus
SDNHDILLNHPLIDEDVANSLI

SEQ ID NO: 2083643 - protein, 25 aa, Staphylococcus
SDNKTLGRFQLTDIPPAPRGIPQIE

SEQ ID NO: 2083644 - protein, 22 aa, Staphylococcus
SDNQISIFQWLKRHSNYSPSHT

SEQ ID NO: 2083645 - protein, 28 aa, Staphylococcus
SDNQVRQLLVHLILIIKRTNSEELDWES

SEQ ID NO: 2083646 - protein, 32 aa, Staphylococcus
SDNTLLKMPNNILAITYLKAIQQFAPHMKGLA

SEQ ID NO: 2083647 - protein, 21 aa, Staphylococcus
SDNVVFLRKWEDFGIRYGDID

SEQ ID NO: 2083648 - protein, 22 aa, Staphylococcus
SDPLKLLIQYQGYSGFEIQTWF

SEQ ID NO: 2083649 - protein, 21 aa, Staphylococcus
SDPNTLVFGPYYRGNNGSEGR

SEQ ID NO: 2083650 - protein, 21 aa, Staphylococcus
SDQEWIPVHKSWRLNERHYGK

SEQ ID NO: 2083651 - protein, 26 aa, Staphylococcus
SDQLLDIRVVITRPANDPALFDATVK

SEQ ID NO: 2083652 - protein, 24 aa, Staphylococcus
SDQRQTMLFSATMPKAIQDLVQQF

SEQ ID NO: 2083653 - protein, 18 aa, Staphylococcus
SDQVLPQLRKGEAIGLNH

SEQ ID NO: 2083654 - protein, 25 aa, Staphylococcus
SDRDYLLFKLAIHTGMRLTDLLHLK

SEQ ID NO: 2083655 - protein, 17 aa, Staphylococcus
SDRLIAISNFISNNNIE

SEQ ID NO: 2083656 - protein, 26 aa, Staphylococcus
SDRLRSRFEWGLIVDITPPDYETRMA

SEQ ID NO: 2083657 - protein, 17 aa, Staphylococcus
SDRNLVGIITNRDLRFI

SEQ ID NO: 2083658 - protein, 21 aa, Staphylococcus
SDSLPLVVFTGQVATPGIGKD

SEQ ID NO: 2083659 - protein, 22 aa, Staphylococcus
SDSLPLVVFTGQVATPGIGKDA

SEQ ID NO: 2083660 - protein, 27 aa, Staphylococcus
SDSMFSFGNLIAQKLHIPTISSITSFA

SEQ ID NO: 2083661 - protein, 24 aa, Staphylococcus
SDSQKRLIIIGGAGSLYVDKAHTE

SEQ ID NO: 2083662 - protein, 17 aa, Staphylococcus
SDTIYRSILNLIMLCGC

SEQ ID NO: 2083663 - protein, 33 aa, Staphylococcus
SDTQFRNIIKQLYFFSIANPDPFQWLNQLSAPY

SEQ ID NO: 2083664 - protein, 27 aa, Staphylococcus
SDTVIFASPVYWYSVSASLKAFIDHWS

SEQ ID NO: 2083665 - protein, 18 aa, Staphylococcus
SDVLFKYVENILNQNQSS

SEQ ID NO: 2083666 - protein, 38 aa, Staphylococcus
SDWENEWKNYFHPFKASKNFTIVPSWETYQKESDSELC

SEQ ID NO: 2083667 - protein, 27 aa, Staphylococcus
SDWFNAAYIIMWGSNVPLTRTPDAHFM

SEQ ID NO: 2083668 - protein, 27 aa, Staphylococcus
SDWYNAAYIIMWGSNVPLTRTPDAHFM

SEQ ID NO: 2083669 - protein, 18 aa, Staphylococcus
SDYGLYWVKKNVKPDIIV

SEQ ID NO: 2083670 - protein, 25 aa, Staphylococcus
SDYREDVVFILWGKPAQQKIKLIDT

SEQ ID NO: 2083671 - protein, 29 aa, Staphylococcus
SDYSSAIKPWILPNFESLVRHEKIDMHFN

SEQ ID NO: 2083672 - protein, 18 aa, Staphylococcus
SDYVFYSGSLLQYSFSET

SEQ ID NO: 2083673 - protein, 28 aa, Staphylococcus
SEADFQKHIYAIHTLTSLYADTRPKSDN

SEQ ID NO: 2083674 - protein, 24 aa, Staphylococcus
SEAEALSHQLLLKAGLIKQSTSGI

SEQ ID NO: 2083675 - protein, 24 aa, Staphylococcus
SEAERIALALLEKVGLISVKDQRP

SEQ ID NO: 2083676 - protein, 39 aa, Staphylococcus
SEAGLFHIAYLLPTDTDLANFLYFVANKGMHIGAGDHLV

SEQ ID NO: 2083677 - protein, 24 aa, Staphylococcus
SEAGLFHLAIKLPSKTDLADLLVQ

SEQ ID NO: 2083678 - protein, 25 aa, Staphylococcus
SEAGLFYVGILLPSITDLADLLVQM

SEQ ID NO: 2083679 - protein, 28 aa, Staphylococcus
SEAHATLRQSLLPHLIEATAYNVARKNK

SEQ ID NO: 2083680 - protein, 30 aa, Staphylococcus
SEAHAVLRQSLLPHLIDAAAYNVARKNDNV

SEQ ID NO: 2083681 - protein, 29 aa, Staphylococcus
SEAHSTLRQSLLPHLIEAAAYNVARKNKD

SEQ ID NO: 2083682 - protein, 29 aa, Staphylococcus
SEAHSTLRQSLLPHLIEAAAYNVARKNQD

SEQ ID NO: 2083683 - protein, 28 aa, Staphylococcus
SEAHSTLRQSLLPHLIEATAYNVARKNK

SEQ ID NO: 2083684 - protein, 29 aa, Staphylococcus
SEAHSTLRQSLLPHLIEAVAYNVARKNSD

SEQ ID NO: 2083685 - protein, 25 aa, Staphylococcus
SEAPGVGMRFIQINDIKLAIINLQG

SEQ ID NO: 2083686 - protein, 29 aa, Staphylococcus
SEAQLQQLVIAYEPIWAIGTGKSSTAKDA

SEQ ID NO: 2083687 - protein, 18 aa, Staphylococcus
SEAYFVSMMGYSPGFPYL

SEQ ID NO: 2083688 - protein, 19 aa, Staphylococcus
SEAYRYLAIGQIENIARIT

SEQ ID NO: 2083689 - protein, 19 aa, Staphylococcus
SECILLFSERDKGLHEYFI

SEQ ID NO: 2083690 - protein, 25 aa, Staphylococcus
SECQRAIILPNNKNIRMSSDQAAQL

SEQ ID NO: 2083691 - protein, 23 aa, Staphylococcus
SEDFAFYATELPSTFIYSGAAPE

SEQ ID NO: 2083692 - protein, 19 aa, Staphylococcus
SEDLSLFFSYRVEKGKTGR

SEQ ID NO: 2083693 - protein, 26 aa, Staphylococcus
SEDNKYQIYPYFKFDIEKKFESYMVL

SEQ ID NO: 2083694 - protein, 27 aa, Staphylococcus
SEDNRKIIYLTPGHPLKFDSNTWIYKK

SEQ ID NO: 2083695 - protein, 25 aa, Staphylococcus
SEDRQTMLFSATMPKAIQTLVQQFM

SEQ ID NO: 2083696 - protein, 18 aa, Staphylococcus
SEDYPEFGVRLKAYFNEI

SEQ ID NO: 2083697 - protein, 25 aa, Staphylococcus
SEEAVLQMNLLGHDFFVFADRETEG

SEQ ID NO: 2083698 - protein, 24 aa, Staphylococcus
SEEDRTKLYKGWKKAVEATQVFKL

SEQ ID NO: 2083699 - protein, 24 aa, Staphylococcus
SEEEIFLLNAWEDTNIYSKKDKLA

SEQ ID NO: 2083700 - protein, 27 aa, Staphylococcus
SEEEKEMFLSLIKVTGIGPKSALAILA

SEQ ID NO: 2083701 - protein, 25 aa, Staphylococcus
SEEEKGMFLSLNKVTGIGPKSALAI

SEQ ID NO: 2083702 - protein, 27 aa, Staphylococcus
SEEKPQIMPVWSLKNRALKVRDEDFEE

SEQ ID NO: 2083703 - protein, 19 aa, Staphylococcus
SEELINLVKLAIDQKIPYS

SEQ ID NO: 2083704 - protein, 23 aa, Staphylococcus
SEELIRRLRRGLYAKQKVVVFKP

SEQ ID NO: 2083705 - protein, 26 aa, Staphylococcus
SEEMAQLYNFLGLSVGLNLNSKTTAE

SEQ ID NO: 2083706 - protein, 24 aa, Staphylococcus
SEEMRLIYVALTRAKEQLFLIGRV

SEQ ID NO: 2083707 - protein, 24 aa, Staphylococcus
SEEMRLIYVALTRAKEQLILIGRL

SEQ ID NO: 2083708 - protein, 25 aa, Staphylococcus
SEEREDVVFILWGKPAQQKIKLIDT

SEQ ID NO: 2083709 - protein, 26 aa, Staphylococcus
SEEVALVMMVLRLNTLLKGHSGATLE

SEQ ID NO: 2083710 - protein, 26 aa, Staphylococcus
SEEVALVMMVLRLNTLLKGHSGTTVA

SEQ ID NO: 2083711 - protein, 21 aa, Staphylococcus
SEFDKIFIATPQKWISHTKDT

SEQ ID NO: 2083712 - protein, 21 aa, Staphylococcus
SEFIVEMKLTYVWINADKPEE

SEQ ID NO: 2083713 - protein, 22 aa, Staphylococcus
SEFKPYYLTKALQKLKDLQLLS

SEQ ID NO: 2083714 - protein, 38 aa, Staphylococcus
SEFPIVIMPTVKQYFRMLQRPILYTGLTRAKQSLVLLG

SEQ ID NO: 2083715 - protein, 37 aa, Staphylococcus
SEFPIVIMPVVKQYFRMLQKPILYTGLTRAKQSLVLL

SEQ ID NO: 2083716 - protein, 26 aa, Staphylococcus
SEFVVEMKLTYLWINADKPEEQLEVS

SEQ ID NO: 2083717 - protein, 19 aa, Staphylococcus
SEFWLQMQADIFNASIRKL

SEQ ID NO: 2083718 - protein, 29 aa, Staphylococcus
SEGAALAMSILDYTRALGALVMATTHYPE

SEQ ID NO: 2083719 - protein, 25 aa, Staphylococcus
SEGAALAMSILDYVRNLGSLVMATT

SEQ ID NO: 2083720 - protein, 33 aa, Staphylococcus
SEGEKRLIGFLHFYYSLFMIADREMKENIEYII

SEQ ID NO: 2083721 - protein, 25 aa, Staphylococcus
SEGFYRRMVIIPMLRKFGKDGQKKD

SEQ ID NO: 2083722 - protein, 27 aa, Staphylococcus
SEGLLEGFKLLGFDAYFAIPRSKEERE

SEQ ID NO: 2083723 - protein, 27 aa, Staphylococcus
SEGLLEGFKLLGFEAYFAIPRSKEERE

SEQ ID NO: 2083724 - protein, 19 aa, Staphylococcus
SEGLYLEKVYLSDKALIKD

SEQ ID NO: 2083725 - protein, 25 aa, Staphylococcus
SEGRECHFIAVKLPYGIQKDADEVE

SEQ ID NO: 2083726 - protein, 23 aa, Staphylococcus
SEGRPVLMGIRQFIDSYLNHQID

SEQ ID NO: 2083727 - protein, 19 aa, Staphylococcus
SEGYIYFNDKPISDYPVYE

SEQ ID NO: 2083728 - protein, 23 aa, Staphylococcus
SEHFERFLYENPNVARIIVEKGI

SEQ ID NO: 2083729 - protein, 20 aa, Staphylococcus
SEHKPIRHAILWNDTRNSEQ

SEQ ID NO: 2083730 - protein, 24 aa, Staphylococcus
SEHLSLDLQILLWNMVKERDNQPH

SEQ ID NO: 2083731 - protein, 27 aa, Staphylococcus
SEHNKVYWKNEYYYGFGAGASGYVDGV

SEQ ID NO: 2083732 - protein, 23 aa, Staphylococcus
SEHPKVRMMSFTGSGPTGAKIME

SEQ ID NO: 2083733 - protein, 23 aa, Staphylococcus
SEHPKVRMMSFTGSGPTGSSIMK

SEQ ID NO: 2083734 - protein, 17 aa, Staphylococcus
SEHPNIISTYDLLYRVG

SEQ ID NO: 2083735 - protein, 24 aa, Staphylococcus
SEIEKHYLTIFLSNAIIGIIQEWI

SEQ ID NO: 2083736 - protein, 25 aa, Staphylococcus
SEIERLHYLVDNHFYFNVFKKYSEE

SEQ ID NO: 2083737 - protein, 26 aa, Staphylococcus
SEIERLHYLVDNNFYFNVFDKYSEED

SEQ ID NO: 2083738 - protein, 26 aa, Staphylococcus
SEIERLHYLVDNNFYFNVFEKYSDSD

SEQ ID NO: 2083739 - protein, 25 aa, Staphylococcus
SEIEYFTPILNVGETGILGIGALSQ

SEQ ID NO: 2083740 - protein, 21 aa, Staphylococcus
SEIILLSEIFSTLEAVDGFVS

SEQ ID NO: 2083741 - protein, 25 aa, Staphylococcus
SEIKKLKFNTPLYSLGYSKINGDNT

SEQ ID NO: 2083742 - protein, 18 aa, Staphylococcus
SEILCPFHYFGVSDYIQD

SEQ ID NO: 2083743 - protein, 18 aa, Staphylococcus
SEILTYFRNNPCPENIPV

SEQ ID NO: 2083744 - protein, 20 aa, Staphylococcus
SEIQKMRDERHMLGQMINQV

SEQ ID NO: 2083745 - protein, 21 aa, Staphylococcus
SEITLGLKPGGLFIYDGDEPL

SEQ ID NO: 2083746 - protein, 23 aa, Staphylococcus
SEITSIFSKLLKRINFTKNVIKQ

SEQ ID NO: 2083747 - protein, 26 aa, Staphylococcus
SEIYRNLGLGQLLLKYGMTYAAHTCD

SEQ ID NO: 2083748 - protein, 28 aa, Staphylococcus
SEKDPKLLPFQGYILQNFELDNVGYCQV

SEQ ID NO: 2083749 - protein, 26 aa, Staphylococcus
SEKDPKLMPFQGYVLQNFELSDSHEY

SEQ ID NO: 2083750 - protein, 25 aa, Staphylococcus
SEKEIYEHFGVNWIEPALREDGSEF

SEQ ID NO: 2083751 - protein, 34 aa, Staphylococcus
SEKELFEFIRYIQNTPMLILNHKIGKKIYDEIQS

SEQ ID NO: 2083752 - protein, 33 aa, Staphylococcus
SEKFENILNDLFKYYDFILIDTPPVNTVTDAQV

SEQ ID NO: 2083753 - protein, 34 aa, Staphylococcus
SEKGYAMPILLAVSHVHQLLIKEGLRMRTSIVAL

SEQ ID NO: 2083754 - protein, 21 aa, Staphylococcus
SEKIAILPVGYADGFPRMMQG

SEQ ID NO: 2083755 - protein, 17 aa, Staphylococcus
SEKNKLLVPIFDARREA

SEQ ID NO: 2083756 - protein, 25 aa, Staphylococcus
SEKNNQYILKVDLPGFEKKDINLSY

SEQ ID NO: 2083757 - protein, 24 aa, Staphylococcus
SEKRKLEFLSGRFATKEAFSKALG

SEQ ID NO: 2083758 - protein, 25 aa, Staphylococcus
SEKTEVTVFFLNGFQMKGTIEDFDS

SEQ ID NO: 2083759 - protein, 17 aa, Staphylococcus
SEKWMGMEPEKLYVTIH

SEQ ID NO: 2083760 - protein, 26 aa, Staphylococcus
SEKWPSFLEKSLVEGIFTISDQHAFD

SEQ ID NO: 2083761 - protein, 23 aa, Staphylococcus
SELDNIPFYFPDPHSPWQRGTNE

SEQ ID NO: 2083762 - protein, 26 aa, Staphylococcus
SELGSRMRLRIIPELNFEYDESIDYG

SEQ ID NO: 2083763 - protein, 25 aa, Staphylococcus
SELGSRMRLRIVPELQFEYDHSIEY

SEQ ID NO: 2083764 - protein, 18 aa, Staphylococcus
SELIKWKEYIRDQYRPED

SEQ ID NO: 2083765 - protein, 27 aa, Staphylococcus
SELINLNILTSMRLTLAPKLLGQGVNL

SEQ ID NO: 2083766 - protein, 19 aa, Staphylococcus
SELKIAIVVSRFNDFITNR

SEQ ID NO: 2083767 - protein, 23 aa, Staphylococcus
SELKKIRSLGKVPAVVYGYSTKN

SEQ ID NO: 2083768 - protein, 18 aa, Staphylococcus
SELKQRIPLILEVNTNQY

SEQ ID NO: 2083769 - protein, 18 aa, Staphylococcus
SELKQRIPLILEVSTNQY

SEQ ID NO: 2083770 - protein, 25 aa, Staphylococcus
SELLIKLGYQLLMYQQPLTSEAIGK

SEQ ID NO: 2083771 - protein, 24 aa, Staphylococcus
SELLPNQFVLIATGSRPQTLPFLK

SEQ ID NO: 2083772 - protein, 17 aa, Staphylococcus
SELNESGLAFVLPSSMK

SEQ ID NO: 2083773 - protein, 33 aa, Staphylococcus
SELNEWYITTINRLIKLITYASSKYTRTKLRKS

SEQ ID NO: 2083774 - protein, 18 aa, Staphylococcus
SELNLPIGIIPGGTFNDF

SEQ ID NO: 2083775 - protein, 19 aa, Staphylococcus
SELRLNEIGFIFQSSHLVP

SEQ ID NO: 2083776 - protein, 25 aa, Staphylococcus
SELSYAANFLYMLRGELPTDIEVEA

SEQ ID NO: 2083777 - protein, 21 aa, Staphylococcus
SELYAMLDSQPYFYVSDDRLP

SEQ ID NO: 2083778 - protein, 18 aa, Staphylococcus
SELYLDLDPVLTTGQNSL

SEQ ID NO: 2083779 - protein, 27 aa, Staphylococcus
SEMKLINILTALFPCGSITGAPKLSTM

SEQ ID NO: 2083780 - protein, 26 aa, Staphylococcus
SEMLEAIFFGHEEIKRLVAFQQEIID

SEQ ID NO: 2083781 - protein, 21 aa, Staphylococcus
SEMLEAIFFGHSEIQRLVNFQ

SEQ ID NO: 2083782 - protein, 17 aa, Staphylococcus
SENFKMKIVFLPESTKT

SEQ ID NO: 2083783 - protein, 24 aa, Staphylococcus
SENGFIPQQYLPDKLKNRQYYHPK

SEQ ID NO: 2083784 - protein, 26 aa, Staphylococcus
SENGVISNPFFLTPDEKVYEAEALMG

SEQ ID NO: 2083785 - protein, 20 aa, Staphylococcus
SENGVISNPFFLTPDESVYE

SEQ ID NO: 2083786 - protein, 18 aa, Staphylococcus
SENGVISNPFFLTPEESV

SEQ ID NO: 2083787 - protein, 18 aa, Staphylococcus
SENGVISNPFYLTPDESV

SEQ ID NO: 2083788 - protein, 18 aa, Staphylococcus
SENGVITNPFYLTPDESV

SEQ ID NO: 2083789 - protein, 23 aa, Staphylococcus
SENLDYFFSYRVEKGQTGRMLAF

SEQ ID NO: 2083790 - protein, 22 aa, Staphylococcus
SENLLDTILVRMKSQNLFSAVK

SEQ ID NO: 2083791 - protein, 25 aa, Staphylococcus
SENLNALVAIPLWHEQHVAGVLLLG

SEQ ID NO: 2083792 - protein, 24 aa, Staphylococcus
SENMSLPLLWEFPGGKIEKGESEE

SEQ ID NO: 2083793 - protein, 23 aa, Staphylococcus
SENPKVRMMSFTGSGPTGAKIMK

SEQ ID NO: 2083794 - protein, 18 aa, Staphylococcus
SEPEILVDLLSLNDVDSL

SEQ ID NO: 2083795 - protein, 26 aa, Staphylococcus
SEPELLKALQYLDDYYHEAYLKNKLA

SEQ ID NO: 2083796 - protein, 26 aa, Staphylococcus
SEPHERLFALLIKKNGEQILYCPKME

SEQ ID NO: 2083797 - protein, 18 aa, Staphylococcus
SEPKHLILKTHAYVGYSV

SEQ ID NO: 2083798 - protein, 24 aa, Staphylococcus
SEPNRIRIMHLLEQGPSSVGHITH

SEQ ID NO: 2083799 - protein, 23 aa, Staphylococcus
SEPTASIRIQYTPDLQPAELSGE

SEQ ID NO: 2083800 - protein, 26 aa, Staphylococcus
SEQENIKKVIFLVDRKDLDSQTEEEF

SEQ ID NO: 2083801 - protein, 17 aa, Staphylococcus
SEQLTSLMQQYPKLHIH

SEQ ID NO: 2083802 - protein, 24 aa, Staphylococcus
SEQMSLPLLWEFPGGKIEQGESDV

SEQ ID NO: 2083803 - protein, 24 aa, Staphylococcus
SEQRILISHLGMAGGFFVVDHLEQ

SEQ ID NO: 2083804 - protein, 18 aa, Staphylococcus
SEQRLKIKRQFSEAMAVE

SEQ ID NO: 2083805 - protein, 23 aa, Staphylococcus
SEQRVIPPCIYYEKCGGCQLQHM

SEQ ID NO: 2083806 - protein, 30 aa, Staphylococcus
SEQSLTQFDFLFNFERLNINKGFFCCSGIS

SEQ ID NO: 2083807 - protein, 22 aa, Staphylococcus
SERKPFKAKVKTGYLARYTALV

SEQ ID NO: 2083808 - protein, 25 aa, Staphylococcus
SERKTHFPINLLIKLNNEIEEYLTT

SEQ ID NO: 2083809 - protein, 25 aa, Staphylococcus
SERLQESAFLLKNLKITLKDLRDGK

SEQ ID NO: 2083810 - protein, 25 aa, Staphylococcus
SERLQESAFLLKNLKITLKDLRNGK

SEQ ID NO: 2083811 - protein, 24 aa, Staphylococcus
SERRKLEFLAGRFTTKEAFSKALG

SEQ ID NO: 2083812 - protein, 29 aa, Staphylococcus
SERVSYLYQPYNPAILRLVKQVIEASHAE

SEQ ID NO: 2083813 - protein, 27 aa, Staphylococcus
SERVSYLYQPYNPSILRLVKQVIEASH

SEQ ID NO: 2083814 - protein, 24 aa, Staphylococcus
SERYAFTLLYQNLKGKIIYASHAQ

SEQ ID NO: 2083815 - protein, 24 aa, Staphylococcus
SESDTFIYCLEGCVTLTLGKERYQ

SEQ ID NO: 2083816 - protein, 24 aa, Staphylococcus
SESDTFIYCLKGCVTLTLGNSRYQ

SEQ ID NO: 2083817 - protein, 20 aa, Staphylococcus
SESLKYLLNVNHQRLSDFKS

SEQ ID NO: 2083818 - protein, 27 aa, Staphylococcus
SETADVLLVYIFKCIEFIPDSYTRRLY

SEQ ID NO: 2083819 - protein, 25 aa, Staphylococcus
SETAKVRVLPYASITKRQAGKELVD

SEQ ID NO: 2083820 - protein, 27 aa, Staphylococcus
SETFEQFLLQELSILVAPGIPFGQNGK

SEQ ID NO: 2083821 - protein, 22 aa, Staphylococcus
SETFEQYLLKEKSILVAPGIPF

SEQ ID NO: 2083822 - protein, 29 aa, Staphylococcus
SETFETNVYPIFWTVQKAVDYLQAGATIT

SEQ ID NO: 2083823 - protein, 20 aa, Staphylococcus
SETINLFHNILGLNYEEQSS

SEQ ID NO: 2083824 - protein, 24 aa, Staphylococcus
SETNVLTFAVRRMNLYDKNLPNPL

SEQ ID NO: 2083825 - protein, 24 aa, Staphylococcus
SETNVLTFAVRRMNLYDRDLPNPL

SEQ ID NO: 2083826 - protein, 24 aa, Staphylococcus
SETRHIIQFIKNYVQSHSFIKSLT

SEQ ID NO: 2083827 - protein, 25 aa, Staphylococcus
SETRKHFTGLIIAGKMHSAGVDEPV

SEQ ID NO: 2083828 - protein, 25 aa, Staphylococcus
SETSAYFNLGGIWLALNEEKNIPRS

SEQ ID NO: 2083829 - protein, 17 aa, Staphylococcus
SETSLYEKGEIKEVLAK

SEQ ID NO: 2083830 - protein, 23 aa, Staphylococcus
SETYDLVFLDINLMDESGIDLAQ

SEQ ID NO: 2083831 - protein, 23 aa, Staphylococcus
SEVEALVHYLKTKEIFIISDEIY

SEQ ID NO: 2083832 - protein, 24 aa, Staphylococcus
SEVFKLWVDYLFEQNFVHRLGIST

SEQ ID NO: 2083833 - protein, 22 aa, Staphylococcus
SEVGISWLLKHAQQRIPELSHS

SEQ ID NO: 2083834 - protein, 31 aa, Staphylococcus
SEVLVLIEFDAAIELLLLSDVLVLIESDVLS

SEQ ID NO: 2083835 - protein, 21 aa, Staphylococcus
SEVPAHVQAGWMLTTIASIGE

SEQ ID NO: 2083836 - protein, 20 aa, Staphylococcus
SEVPAHVQAGWMLTTISSVG

SEQ ID NO: 2083837 - protein, 18 aa, Staphylococcus
SEVTGLKKSLFSYNSAGA

SEQ ID NO: 2083838 - protein, 17 aa, Staphylococcus
SEWNSRKSALDGNVNWV

SEQ ID NO: 2083839 - protein, 42 aa, Staphylococcus
SEYLINDTTFYPFFNKRKGQKYFIVWHGTPLKYMGKDMPVVV

SEQ ID NO: 2083840 - protein, 17 aa, Staphylococcus
SEYLVMASELLMIKSRL

SEQ ID NO: 2083841 - protein, 17 aa, Staphylococcus
SEYPFKELPLYEIGWRL

SEQ ID NO: 2083842 - protein, 24 aa, Staphylococcus
SEYQFYDFNLQLPKIFNEATLLFD

SEQ ID NO: 2083843 - protein, 17 aa, Staphylococcus
SEYQGPFQFKRADQFML

SEQ ID NO: 2083844 - protein, 30 aa, Staphylococcus
SEYQYFKEGLILFTYLHLANEEKLTQALID

SEQ ID NO: 2083845 - protein, 23 aa, Staphylococcus
SEYVPEWYIQYNGKWYVYENGGL

SEQ ID NO: 2083846 - protein, 21 aa, Staphylococcus
SEYYICLKYLVMLIDQTHHSK

SEQ ID NO: 2083847 - protein, 20 aa, Staphylococcus
SFAFDLLPERQRRAIWAIYS

SEQ ID NO: 2083848 - protein, 28 aa, Staphylococcus
SFAHHVMTYFWMLERDKNRFEDALKRID

SEQ ID NO: 2083849 - protein, 28 aa, Staphylococcus
SFAHHVMTYFWMLERDYSRFVDSMKRID

SEQ ID NO: 2083850 - protein, 25 aa, Staphylococcus
SFAKHALNEFTNSYVALGTQMSNLE

SEQ ID NO: 2083851 - protein, 31 aa, Staphylococcus
SFASMYRGLPKDFIDYLFIDEAGQALPQAAV

SEQ ID NO: 2083852 - protein, 18 aa, Staphylococcus
SFATYMLNYGNDASLPRL

SEQ ID NO: 2083853 - protein, 20 aa, Staphylococcus
SFDATFTLLIDASASMFDKM

SEQ ID NO: 2083854 - protein, 31 aa, Staphylococcus
SFDGSTYLDIFLAPTQLYVKPILTLKEKVKI

SEQ ID NO: 2083855 - protein, 17 aa, Staphylococcus
SFDIYKGETLGLVGESG

SEQ ID NO: 2083856 - protein, 26 aa, Staphylococcus
SFDLARHEFPILKKTPLKLNNEHDAR

SEQ ID NO: 2083857 - protein, 24 aa, Staphylococcus
SFDLSVMAIYPCLVSGGTLNLVDK

SEQ ID NO: 2083858 - protein, 17 aa, Staphylococcus
SFDMERILRLMRPSKDE

SEQ ID NO: 2083859 - protein, 23 aa, Staphylococcus
SFDMGFIDTGYERLGFGPSTNGV

SEQ ID NO: 2083860 - protein, 24 aa, Staphylococcus
SFDTIYRNLHLFKDLAIIESTELD

SEQ ID NO: 2083861 - protein, 21 aa, Staphylococcus
SFDTIYRNLHLFKDLNIVEST

SEQ ID NO: 2083862 - protein, 19 aa, Staphylococcus
SFDWTLLKGLDQSIPFLIA

SEQ ID NO: 2083863 - protein, 26 aa, Staphylococcus
SFEDFIYYICNNKKIFKHLLVSSRQA

SEQ ID NO: 2083864 - protein, 20 aa, Staphylococcus
SFEDFIYYIGNNKKIFKHLL

SEQ ID NO: 2083865 - protein, 26 aa, Staphylococcus
SFEELWEDYLEPLLSDYVRGLFGEEE

SEQ ID NO: 2083866 - protein, 19 aa, Staphylococcus
SFEEPDASKLPWGDLGVDV

SEQ ID NO: 2083867 - protein, 25 aa, Staphylococcus
SFEEVDFYTLPFATLSEMQHYFPDE

SEQ ID NO: 2083868 - protein, 25 aa, Staphylococcus
SFEHSQLLHFGIQYHPESFATADGV

SEQ ID NO: 2083869 - protein, 18 aa, Staphylococcus
SFENILDVYFKTFDPTDD

SEQ ID NO: 2083870 - protein, 17 aa, Staphylococcus
SFENKPVYLHVETTNGA

SEQ ID NO: 2083871 - protein, 24 aa, Staphylococcus
SFEYPMSFIMTKLLNTHDYRPQIK

SEQ ID NO: 2083872 - protein, 18 aa, Staphylococcus
SFGDYLRSGAMASVAPII

SEQ ID NO: 2083873 - protein, 19 aa, Staphylococcus
SFGTAGIRSTFGLGPARLN

SEQ ID NO: 2083874 - protein, 20 aa, Staphylococcus
SFHNFKKFTMPIVQALQSLG

SEQ ID NO: 2083875 - protein, 18 aa, Staphylococcus
SFHYFYKVNDQIAGYLKL

SEQ ID NO: 2083876 - protein, 20 aa, Staphylococcus
SFIELYRPYIKATKPILDRF

SEQ ID NO: 2083877 - protein, 23 aa, Staphylococcus
SFIERYVYELYDKHTTHITVVTS

SEQ ID NO: 2083878 - protein, 17 aa, Staphylococcus
SFIFAVCEYLKYGQFNK

SEQ ID NO: 2083879 - protein, 18 aa, Staphylococcus
SFIGIYRPYIKRTQPILD

SEQ ID NO: 2083880 - protein, 19 aa, Staphylococcus
SFIGVYRPYTKLTQPILDK

SEQ ID NO: 2083881 - protein, 17 aa, Staphylococcus
SFIILKNNEVYFNLPKI

SEQ ID NO: 2083882 - protein, 25 aa, Staphylococcus
SFINFACPFCKNYFKAADHALTPHI

SEQ ID NO: 2083883 - protein, 21 aa, Staphylococcus
SFIPGFEEQLVGVKTGEEKDV

SEQ ID NO: 2083884 - protein, 31 aa, Staphylococcus
SFIPSYTSMPSFWFDPLINLTAISQVTQHIG

SEQ ID NO: 2083885 - protein, 21 aa, Staphylococcus
SFIRKQWAKLGLGLDYSRERF

SEQ ID NO: 2083886 - protein, 24 aa, Staphylococcus
SFISIYRPYIKLTQPILDRYDIHT

SEQ ID NO: 2083887 - protein, 24 aa, Staphylococcus
SFKDDAFYVLATRNGMIKKSNVSL

SEQ ID NO: 2083888 - protein, 38 aa, Staphylococcus
SFKENEGYNLTFFAFFVKAVAEALKSNPLLNSSWDGEE

SEQ ID NO: 2083889 - protein, 31 aa, Staphylococcus
SFKESLRWGAEIFHNLAKILKKRGLETAVGD

SEQ ID NO: 2083890 - protein, 21 aa, Staphylococcus
SFKFHGVVAMQLFLSDDLELP

SEQ ID NO: 2083891 - protein, 19 aa, Staphylococcus
SFKGNWAIAYMTGALSKVE

SEQ ID NO: 2083892 - protein, 17 aa, Staphylococcus
SFKILSEFKLNTPSLPI

SEQ ID NO: 2083893 - protein, 20 aa, Staphylococcus
SFKINEGEFFILIGPSGCGK

SEQ ID NO: 2083894 - protein, 23 aa, Staphylococcus
SFKKDAHFYYRQLEEIHSLQHLP

SEQ ID NO: 2083895 - protein, 36 aa, Staphylococcus
SFKLFESTFFDHQLLRRLVAFMYDQPSTIIDYFAND

SEQ ID NO: 2083896 - protein, 37 aa, Staphylococcus
SFKLFESTFFDHQLLRRLVAFMYEQPSTIIDYFRDDA

SEQ ID NO: 2083897 - protein, 35 aa, Staphylococcus
SFKLFETTFFDHQLLRRLVAFMYEQPSTLIDYFAK

SEQ ID NO: 2083898 - protein, 30 aa, Staphylococcus
SFKLPVEVDKFNWFHIAKKIEAFDDIITER

SEQ ID NO: 2083899 - protein, 43 aa, Staphylococcus
SFKNNEGYNLTFFAFFVKAVAKALKAYPMLNSSWNGSEIIIHK

SEQ ID NO: 2083900 - protein, 18 aa, Staphylococcus
SFKSFSKPKWSKLINKLS

SEQ ID NO: 2083901 - protein, 27 aa, Staphylococcus
SFKTLVELVEYWSFEKELHKGNSFVQL

SEQ ID NO: 2083902 - protein, 17 aa, Staphylococcus
SFKYVDRILLNWKKNNV

SEQ ID NO: 2083903 - protein, 17 aa, Staphylococcus
SFLFAYEESYGYLADDF

SEQ ID NO: 2083904 - protein, 18 aa, Staphylococcus
SFLGADLLKETLPFIIDG

SEQ ID NO: 2083905 - protein, 17 aa, Staphylococcus
SFLGADLLKKTLPEIIN

SEQ ID NO: 2083906 - protein, 18 aa, Staphylococcus
SFLHILEVLGTSPELFFK

SEQ ID NO: 2083907 - protein, 18 aa, Staphylococcus
SFLTAGLCGLVRHWLDTS

SEQ ID NO: 2083908 - protein, 24 aa, Staphylococcus
SFLVFFGYNFNSSFLKYGELALLN

SEQ ID NO: 2083909 - protein, 18 aa, Staphylococcus
SFMGLPTPNIFTGCGNFH

SEQ ID NO: 2083910 - protein, 24 aa, Staphylococcus
SFNDIEFLPPVTPPNNVIAFGRNY

SEQ ID NO: 2083911 - protein, 26 aa, Staphylococcus
SFNDISPIIQYKLDKGVTALWMGDLT

SEQ ID NO: 2083912 - protein, 17 aa, Staphylococcus
SFNFKPMYSHIKNDIQS

SEQ ID NO: 2083913 - protein, 25 aa, Staphylococcus
SFNIQKGEFFVLIGPSGCGKTTTLK

SEQ ID NO: 2083914 - protein, 17 aa, Staphylococcus
SFNIYKGETLGLVGESG

SEQ ID NO: 2083915 - protein, 26 aa, Staphylococcus
SFNTFSDWLPYLDLLDSYPATRCTVV

SEQ ID NO: 2083916 - protein, 22 aa, Staphylococcus
SFNTLIELQAIPNGYYYPKDSE

SEQ ID NO: 2083917 - protein, 21 aa, Staphylococcus
SFNVDLFLRNAHRIPDYASNR

SEQ ID NO: 2083918 - protein, 26 aa, Staphylococcus
SFPDTKILILTMYDDEEYLFHVLRNG

SEQ ID NO: 2083919 - protein, 28 aa, Staphylococcus
SFQSYLYTRLNFYLIDLFRKQHNTYEIC

SEQ ID NO: 2083920 - protein, 22 aa, Staphylococcus
SFQTEMFFLCNRYKQAKDIAKM

SEQ ID NO: 2083921 - protein, 25 aa, Staphylococcus
SFQTEMFFLCNRYKQFQDLALIENG

SEQ ID NO: 2083922 - protein, 25 aa, Staphylococcus
SFSGHKFNGLKGQGLLLIDNKDKLE

SEQ ID NO: 2083923 - protein, 32 aa, Staphylococcus
SFSGHKFNGLKGQGLLLVRNIHNLEPVIHGGG

SEQ ID NO: 2083924 - protein, 22 aa, Staphylococcus
SFSMYPSLWENMGLSYPDLIAK

SEQ ID NO: 2083925 - protein, 17 aa, Staphylococcus
SFSNRVVMLKDGLIFTE

SEQ ID NO: 2083926 - protein, 26 aa, Staphylococcus
SFSTCFGAPFLPLNPKRYAELLGQLI

SEQ ID NO: 2083927 - protein, 19 aa, Staphylococcus
SFSTDALLLGYFTEVRKKD

SEQ ID NO: 2083928 - protein, 33 aa, Staphylococcus
SFSWYEYSPLRVKYPYIRGQLLELWQEALEENH

SEQ ID NO: 2083929 - protein, 25 aa, Staphylococcus
SFTGKAYFDLVFKGTGYKYNLHAKV

SEQ ID NO: 2083930 - protein, 22 aa, Staphylococcus
SFTRYGAFYIPMDETLARVVTD

SEQ ID NO: 2083931 - protein, 18 aa, Staphylococcus
SFTVLFKKSEIELLETVY

SEQ ID NO: 2083932 - protein, 19 aa, Staphylococcus
SFVESLGFNKEEWARAGKV

SEQ ID NO: 2083933 - protein, 26 aa, Staphylococcus
SFVRRPSDVLDIRKLLEAKQNKNISI

SEQ ID NO: 2083934 - protein, 21 aa, Staphylococcus
SFVYRRRLPFHAERFNAWLEQ

SEQ ID NO: 2083935 - protein, 17 aa, Staphylococcus
SFYGYRFTVSDRCLIPR

SEQ ID NO: 2083936 - protein, 18 aa, Staphylococcus
SGAEFFFDGIHDGTLYVP

SEQ ID NO: 2083937 - protein, 18 aa, Staphylococcus
SGAFMKTLEDAEALAHAM

SEQ ID NO: 2083938 - protein, 18 aa, Staphylococcus
SGAFMKTLEEAEALAHAM

SEQ ID NO: 2083939 - protein, 28 aa, Staphylococcus
SGAHLTNPFILLNWSDTVSDLFTLIHEF

SEQ ID NO: 2083940 - protein, 22 aa, Staphylococcus
SGAKIVEFGGWAMPVQFTSIKE

SEQ ID NO: 2083941 - protein, 23 aa, Staphylococcus
SGAKIVEFGGWAMPVQFTSIKEE

SEQ ID NO: 2083942 - protein, 19 aa, Staphylococcus
SGAMALFGEKYGDVVRVVD

SEQ ID NO: 2083943 - protein, 30 aa, Staphylococcus
SGAPKLRAIRRIYETYPYKRGLYSGGVGYI

SEQ ID NO: 2083944 - protein, 18 aa, Staphylococcus
SGAVAWVSGLRRAQSPTR

SEQ ID NO: 2083945 - protein, 27 aa, Staphylococcus
SGAVPGLWPHIRLLNQDWIDGGMTSPA

SEQ ID NO: 2083946 - protein, 21 aa, Staphylococcus
SGAYILSKRQLETEKSYEFLQ

SEQ ID NO: 2083947 - protein, 20 aa, Staphylococcus
SGCYQTIGWFKRVDHASKMK

SEQ ID NO: 2083948 - protein, 26 aa, Staphylococcus
SGDLAPLSHLALALIGEGLVYFKNEE

SEQ ID NO: 2083949 - protein, 27 aa, Staphylococcus
SGEHPTIVRLLDPPLHEFLPHSEEDIA

SEQ ID NO: 2083950 - protein, 29 aa, Staphylococcus
SGEKIPKALALDYIYGYTIINDITDRKAQ

SEQ ID NO: 2083951 - protein, 27 aa, Staphylococcus
SGEKIPKALALDYVYGYTIINDITDRN

SEQ ID NO: 2083952 - protein, 29 aa, Staphylococcus
SGEKIPKGLALDYVYGYTIINDITDRKAQ

SEQ ID NO: 2083953 - protein, 24 aa, Staphylococcus
SGENHPFVEHYKFLKAHTPEGIEA

SEQ ID NO: 2083954 - protein, 17 aa, Staphylococcus
SGFAFGMGPDRIAMLKY

SEQ ID NO: 2083955 - protein, 25 aa, Staphylococcus
SGFAMPMLLAMSHVHQCLIREGLRM

SEQ ID NO: 2083956 - protein, 34 aa, Staphylococcus
SGFDYIVTGSGFLYNMVRVLIAFLIEVGKGKREP

SEQ ID NO: 2083957 - protein, 21 aa, Staphylococcus
SGFNGIFLVATNPVDVLTYVT

SEQ ID NO: 2083958 - protein, 17 aa, Staphylococcus
SGFYPLGSCTMKYNPKI

SEQ ID NO: 2083959 - protein, 27 aa, Staphylococcus
SGGEPLLQMPFLEQLFKQLKAEDIHTC

SEQ ID NO: 2083960 - protein, 30 aa, Staphylococcus
SGGEQKRLYLLRLLVHQPNVLLLDEPTNDL

SEQ ID NO: 2083961 - protein, 26 aa, Staphylococcus
SGGKRPLICFFSNDLNIHRTKTEKAN

SEQ ID NO: 2083962 - protein, 25 aa, Staphylococcus
SGGKRPLVCFFSNELNIHRTKTEKA

SEQ ID NO: 2083963 - protein, 26 aa, Staphylococcus
SGGKRPLVCYFSNDLNIHRTKTENAN

SEQ ID NO: 2083964 - protein, 25 aa, Staphylococcus
SGGQFQRVWIAKALILEPEILILDE

SEQ ID NO: 2083965 - protein, 23 aa, Staphylococcus
SGGQRGIQIVLQLKDLVSMTNAQ

SEQ ID NO: 2083966 - protein, 23 aa, Staphylococcus
SGHIINIASISGFEVTKKSTLYS

SEQ ID NO: 2083967 - protein, 23 aa, Staphylococcus
SGHQVIFASARPIRDMLPVISKD

SEQ ID NO: 2083968 - protein, 26 aa, Staphylococcus
SGIAQTINRFGFTIRGIYGEGSQVYG

SEQ ID NO: 2083969 - protein, 23 aa, Staphylococcus
SGIHPDWLYCAKANLVLQPAYTG

SEQ ID NO: 2083970 - protein, 22 aa, Staphylococcus
SGILYHLYEVHKDADVLLHLGD

SEQ ID NO: 2083971 - protein, 17 aa, Staphylococcus
SGITMFQFREKGNGALI

SEQ ID NO: 2083972 - protein, 25 aa, Staphylococcus
SGIYSYLPLATRVLNHISRIIREEM

SEQ ID NO: 2083973 - protein, 23 aa, Staphylococcus
SGIYSYLPLATRVLNNISKIIRE

SEQ ID NO: 2083974 - protein, 23 aa, Staphylococcus
SGKKLAFVPILRAGLGMTQGILS

SEQ ID NO: 2083975 - protein, 17 aa, Staphylococcus
SGKQIYIPLNNDALENG

SEQ ID NO: 2083976 - protein, 19 aa, Staphylococcus
SGKSLAYLIAALMYNIETK

SEQ ID NO: 2083977 - protein, 22 aa, Staphylococcus
SGKSTLFHLLNNLISPTDGELF

SEQ ID NO: 2083978 - protein, 25 aa, Staphylococcus
SGKSTLLRCMNLLETPTSGEVIFKE

SEQ ID NO: 2083979 - protein, 24 aa, Staphylococcus
SGKSTLLRLISNLISPTKGELYLN

SEQ ID NO: 2083980 - protein, 30 aa, Staphylococcus; identical to SEQ ID NO: 1681585

SEQ ID NO: 2083981 - protein, 57 aa, Staphylococcus
SGKSVCINSILMSLLYKNHPEELRLLLIDPKMVELAPYNDLPHLVAPVITDVKAATQ

SEQ ID NO: 2083982 - protein, 23 aa, Staphylococcus
SGKTILEYAFSIAYDIYKKTALK

SEQ ID NO: 2083983 - protein, 20 aa, Staphylococcus
SGKTMIFDAIVYALYGEAST

SEQ ID NO: 2083984 - protein, 25 aa, Staphylococcus
SGKTTLLHILYKKIVPEEGIVKQFS

SEQ ID NO: 2083985 - protein, 23 aa, Staphylococcus
SGKTVLMSTLLYELGKYNLDLNQ

SEQ ID NO: 2083986 - protein, 22 aa, Staphylococcus
SGLKAIILGKQLIQLGEADVVA

SEQ ID NO: 2083987 - protein, 23 aa, Staphylococcus
SGLKAIILGKQLIQLGEAKVVAV

SEQ ID NO: 2083988 - protein, 24 aa, Staphylococcus
SGLKSIILGKQLIQLGEAKVVAVG

SEQ ID NO: 2083989 - protein, 28 aa, Staphylococcus
SGLPSYIYTFIGFLPRKEKDKISVLQER

SEQ ID NO: 2083990 - protein, 17 aa, Staphylococcus
SGLSYHVLTMLRIAKSI

SEQ ID NO: 2083991 - protein, 27 aa, Staphylococcus
SGLTEVKPLIHRAKIGSILNVRELNQI

SEQ ID NO: 2083992 - protein, 18 aa, Staphylococcus
SGLTYNISYASKAFTCLQ

SEQ ID NO: 2083993 - protein, 26 aa, Staphylococcus
SGMSLTRETSRFYQYWLDHVDQDLAE

SEQ ID NO: 2083994 - protein, 18 aa, Staphylococcus
SGMVIKDAKLRGVDSSGM

SEQ ID NO: 2083995 - protein, 33 aa, Staphylococcus
SGNDPSWMILDVLPIIPPEIRPMVQLDGGRFAT

SEQ ID NO: 2083996 - protein, 39 aa, Staphylococcus
SGNGFIKDLLGINAEQFRQLFILPQGEFKKFLVSNSSDK

SEQ ID NO: 2083997 - protein, 24 aa, Staphylococcus
SGNGLLIYKQAIDAGVDIIDTAIA

SEQ ID NO: 2083998 - protein, 21 aa, Staphylococcus
SGNIHGMPLRILAGDGDDKLV

SEQ ID NO: 2083999 - protein, 33 aa, Staphylococcus
SGNNPAWMILDVLPIIPPEIRPMVQLDGGRFAT

SEQ ID NO: 2084000 - protein, 24 aa, Staphylococcus
SGNQTVYIKAPWGSLIELQTVPNG

SEQ ID NO: 2084001 - protein, 27 aa, Staphylococcus
SGNRIVPLFVFYKKIFWGKKKLFKYYV

SEQ ID NO: 2084002 - protein, 25 aa, Staphylococcus
SGNRPYYYNLKYNDNNILIPFRSNS

SEQ ID NO: 2084003 - protein, 17 aa, Staphylococcus
SGPAALRCSQFIYKEQK

SEQ ID NO: 2084004 - protein, 17 aa, Staphylococcus
SGPAALRCSQFVYKEQK

SEQ ID NO: 2084005 - protein, 18 aa, Staphylococcus
SGPLHLEITLTRSKFEEL

SEQ ID NO: 2084006 - protein, 24 aa, Staphylococcus
SGQPLVFLHGWPANNTMFEYQADF

SEQ ID NO: 2084007 - protein, 22 aa, Staphylococcus
SGQPYAAVFPLLHGPNGEDGTI

SEQ ID NO: 2084008 - protein, 19 aa, Staphylococcus
SGQRYQLQRREALSQGFSG

SEQ ID NO: 2084009 - protein, 24 aa, Staphylococcus
SGRPKHIYSIYRKMVKQKKQFDQI

SEQ ID NO: 2084010 - protein, 20 aa, Staphylococcus
SGRPTEGMLPTAKKLKFDTY

SEQ ID NO: 2084011 - protein, 19 aa, Staphylococcus
SGRRYQLKRRESISQGYSG

SEQ ID NO: 2084012 - protein, 20 aa, Staphylococcus
SGRTKWIFKFEIASADRVHC

SEQ ID NO: 2084013 - protein, 26 aa, Staphylococcus
SGRTPYVIGGLKYAKAVGAKTAALAC

SEQ ID NO: 2084014 - protein, 17 aa, Staphylococcus
SGSAAVYTARKGLRTGI

SEQ ID NO: 2084015 - protein, 21 aa, Staphylococcus
SGSIFGVIGFSGAGKSTLIRM

SEQ ID NO: 2084016 - protein, 26 aa, Staphylococcus
SGSQANMVVYLVALDYGDTVLGMNLS

SEQ ID NO: 2084017 - protein, 19 aa, Staphylococcus
SGSVFMKPAAPGTGVIAGG

SEQ ID NO: 2084018 - protein, 19 aa, Staphylococcus
SGSVIPRPIAFVTSEDEKG

SEQ ID NO: 2084019 - protein, 22 aa, Staphylococcus
SGSYIYIYEMNSDGSRGKLISQ

SEQ ID NO: 2084020 - protein, 17 aa, Staphylococcus
SGTAAIYTARKGLRTGI

SEQ ID NO: 2084021 - protein, 18 aa, Staphylococcus
SGTGWLLEIVISDTHYDI

SEQ ID NO: 2084022 - protein, 17 aa, Staphylococcus
SGTGWLLEIVISSNHYD

SEQ ID NO: 2084023 - protein, 24 aa, Staphylococcus
SGTVNLPIDIAIVKALKHAVQERE

SEQ ID NO: 2084024 - protein, 24 aa, Staphylococcus
SGTVNLPMAVSMVKSIKLTMGRLD

SEQ ID NO: 2084025 - protein, 25 aa, Staphylococcus
SGTVNLPMDVSLVKALKLANEHLLS

SEQ ID NO: 2084026 - protein, 28 aa, Staphylococcus
SGTVNLPMNVSLVKAITLAIDNLNERHQ

SEQ ID NO: 2084027 - protein, 22 aa, Staphylococcus
SGVALITRLLNMTHWKRGVATM

SEQ ID NO: 2084028 - protein, 29 aa, Staphylococcus
SGVHGENFMRLLARRLDAVVYALGLARTR

SEQ ID NO: 2084029 - protein, 22 aa, Staphylococcus
SGVILSQLFRGFSKSLETYETI

SEQ ID NO: 2084030 - protein, 21 aa, Staphylococcus
SGVLSIMNQKFLNKAPFTFFG

SEQ ID NO: 2084031 - protein, 25 aa, Staphylococcus
SGVNLVDFWATWCGPCKMIAPVLEE

SEQ ID NO: 2084032 - protein, 21 aa, Staphylococcus
SGVNPADISILLVYLEQGKLE

SEQ ID NO: 2084033 - protein, 26 aa, Staphylococcus
SGVSQTQISLPFISAGENGPLHLEIN

SEQ ID NO: 2084034 - protein, 26 aa, Staphylococcus
SGVSQTQISLPFISAGENGPLHLELT

SEQ ID NO: 2084035 - protein, 26 aa, Staphylococcus
SGVSQTQISLPFISAGESGPLHLEIN

SEQ ID NO: 2084036 - protein, 20 aa, Staphylococcus
SGVYSYLPLATRVLNKITAI

SEQ ID NO: 2084037 - protein, 25 aa, Staphylococcus
SGYAKSVTLIYRKADIKGYEVMKEK

SEQ ID NO: 2084038 - protein, 25 aa, Staphylococcus
SGYDLINFFNKKRGPWIKTVLRMIE

SEQ ID NO: 2084039 - protein, 37 aa, Staphylococcus
SGYENIPIMSYGIKYASSFFGPFRDAADSAPSFGDRK

SEQ ID NO: 2084040 - protein, 31 aa, Staphylococcus
SGYLARIVGHKKAREIWYLCRQYDAQQALDM

SEQ ID NO: 2084041 - protein, 31 aa, Staphylococcus
SGYLARIVGHKKAREIWYLCRQYNAQEALEM

SEQ ID NO: 2084042 - protein, 23 aa, Staphylococcus
SGYRSFHVIIEYPIETLNGEKSI

SEQ ID NO: 2084043 - protein, 18 aa, Staphylococcus
SGYRSYHVIIKYPIETLN

SEQ ID NO: 2084044 - protein, 27 aa, Staphylococcus
SGYSFNLFELELFKILLNNIEDFPVPT

SEQ ID NO: 2084045 - protein, 24 aa, Staphylococcus
SHADILRKVLFGPTITVKALLSMR

SEQ ID NO: 2084046 - protein, 28 aa, Staphylococcus
SHDAIDPQFYIFHNNYKKFTILTDTGYV

SEQ ID NO: 2084047 - protein, 26 aa, Staphylococcus
SHDAIDPQFYIFHNNYKKFTMITDTG

SEQ ID NO: 2084048 - protein, 25 aa, Staphylococcus
SHDAIDPQFYIFNNNYKKFTMLTDT

SEQ ID NO: 2084049 - protein, 23 aa, Staphylococcus
SHDLVLNDVWVPKDFFVESKRKP

SEQ ID NO: 2084050 - protein, 23 aa, Staphylococcus
SHDRYFLDKIVTQIYDVALGDVQ

SEQ ID NO: 2084051 - protein, 25 aa, Staphylococcus
SHDRYFLDKIVTQIYDVALGNVKRY

SEQ ID NO: 2084052 - protein, 22 aa, Staphylococcus
SHDRYFLDKIVTQVYDVALGEV

SEQ ID NO: 2084053 - protein, 17 aa, Staphylococcus
SHDVVFKLRKILKTKKI

SEQ ID NO: 2084054 - protein, 17 aa, Staphylococcus
SHEFMFARPLNQTDDMI

SEQ ID NO: 2084055 - protein, 24 aa, Staphylococcus
SHEPLDYIVIDQFAVRGVYQNYAL

SEQ ID NO: 2084056 - protein, 21 aa, Staphylococcus
SHEYLKKHDIHVIPLSITIDG

SEQ ID NO: 2084057 - protein, 24 aa, Staphylococcus
SHEYTLIFDLLNKNIDDRNSLISQ

SEQ ID NO: 2084058 - protein, 18 aa, Staphylococcus
SHFDARINQCNFTIATDV

SEQ ID NO: 2084059 - protein, 26 aa, Staphylococcus
SHFEETIADLYFSKGQNFIIKHINSI

SEQ ID NO: 2084060 - protein, 18 aa, Staphylococcus
SHFLVAFDAGKTTFRHSK

SEQ ID NO: 2084061 - protein, 26 aa, Staphylococcus
SHFVTDKHLIFFNIAASMGSIRFMNV

SEQ ID NO: 2084062 - protein, 18 aa, Staphylococcus
SHGDVLSLFTHTCLPLAE

SEQ ID NO: 2084063 - protein, 24 aa, Staphylococcus
SHHMKVLVTYQFVTTRKVGNKRFY

SEQ ID NO: 2084064 - protein, 21 aa, Staphylococcus
SHHRLYGIFLLNQLKGREVLL

SEQ ID NO: 2084065 - protein, 18 aa, Staphylococcus
SHIITKMDKLLQGLALAN

SEQ ID NO: 2084066 - protein, 19 aa, Staphylococcus
SHISLLSQLGVSLRAIMDR

SEQ ID NO: 2084067 - protein, 20 aa, Staphylococcus
SHISLLSQLGVSLRAIMERV

SEQ ID NO: 2084068 - protein, 18 aa, Staphylococcus
SHKAMIENLFLLDKKDES

SEQ ID NO: 2084069 - protein, 21 aa, Staphylococcus
SHKAYIKKWALDTCINHIART

SEQ ID NO: 2084070 - protein, 30 aa, Staphylococcus
SHKDRAEFLIRVAAIIRRRKEEISAVMVYE

SEQ ID NO: 2084071 - protein, 54 aa, Staphylococcus
SHKLTLENYVLIYYLEKIIFQANQRLLTMSGNRYQLIRREAISQGFSGLEIDVF

SEQ ID NO: 2084072 - protein, 21 aa, Staphylococcus
SHKNDILNDKLLLVANRDRSS

SEQ ID NO: 2084073 - protein, 17 aa, Staphylococcus
SHKNIGWELFTDEVIKA

SEQ ID NO: 2084074 - protein, 32 aa, Staphylococcus
SHKQQLEMMYPETLPIYTLYEYAEQDGEVSDP

SEQ ID NO: 2084075 - protein, 29 aa, Staphylococcus
SHKVPHFTQRLIYEIQTRGYIPVIVHPER

SEQ ID NO: 2084076 - protein, 22 aa, Staphylococcus
SHLGIKYLTLYAFSTENWSRPE

SEQ ID NO: 2084077 - protein, 18 aa, Staphylococcus
SHLWFHTKDIPGSHVVIL

SEQ ID NO: 2084078 - protein, 25 aa, Staphylococcus
SHNDWVNMLGVVPVIRALREKAMNI

SEQ ID NO: 2084079 - protein, 31 aa, Staphylococcus
SHNKLFIFMSEGLLKGYLYLQVFENTKKAEI

SEQ ID NO: 2084080 - protein, 19 aa, Staphylococcus
SHNNYIKRLPVSTYRAQNR

SEQ ID NO: 2084081 - protein, 27 aa, Staphylococcus
SHPIAWQAQLLLYLAHKINFNSFKSSV

SEQ ID NO: 2084082 - protein, 23 aa, Staphylococcus
SHPMLRPREVHRTGYLVITSDKG

SEQ ID NO: 2084083 - protein, 23 aa, Staphylococcus
SHPMLRPRQVQRSGYLVITSDKG

SEQ ID NO: 2084084 - protein, 23 aa, Staphylococcus
SHREDILPTFHKLGLDEYIDVIV

SEQ ID NO: 2084085 - protein, 18 aa, Staphylococcus
SHRNIGWEVFTDEIIKAV

SEQ ID NO: 2084086 - protein, 26 aa, Staphylococcus
SHSAPLLYLSVIKLKEHFSGYGLNLF

SEQ ID NO: 2084087 - protein, 26 aa, Staphylococcus
SHSELTYLTFVYKVSAMDFIFKDDPA

SEQ ID NO: 2084088 - protein, 30 aa, Staphylococcus
SHSELTYLTFVYKVSAMDFIFKDDPNQLKT

SEQ ID NO: 2084089 - protein, 26 aa, Staphylococcus
SHSELTYLTFVYKVSAMDFIFKDDPS

SEQ ID NO: 2084090 - protein, 22 aa, Staphylococcus
SHSFPFGVVTLKHKFFDGKDHN

SEQ ID NO: 2084091 - protein, 22 aa, Staphylococcus
SHSLMSFFFIKISRTELQTFLY

SEQ ID NO: 2084092 - protein, 25 aa, Staphylococcus
SHSLSLFVCVFALYTGRTFIGQQQF

SEQ ID NO: 2084093 - protein, 25 aa, Staphylococcus
SHTARALLNYLPKGLDMSFTEYQFE

SEQ ID NO: 2084094 - protein, 28 aa, Staphylococcus
SHTLPNYMIPVHFMKIDKIPITINGKLD

SEQ ID NO: 2084095 - protein, 22 aa, Staphylococcus
SHTPVWFMRQAGRSQPEYRRLK

SEQ ID NO: 2084096 - protein, 28 aa, Staphylococcus
SHTSNFDMTFPLYINAMTGGSDWTKTIN

SEQ ID NO: 2084097 - protein, 30 aa, Staphylococcus
SHYDLGVITALWLKQTPLLQNREREWKKRM

SEQ ID NO: 2084098 - protein, 25 aa, Staphylococcus
SHYITAEQIIFFNIAAAMGSIRFMN

SEQ ID NO: 2084099 - protein, 27 aa, Staphylococcus
SHYNGMMETLYLLQSSTNAQHLAQAIE

SEQ ID NO: 2084100 - protein, 24 aa, Staphylococcus
SIAKRLKLSPIIKKILESKQIIEE

SEQ ID NO: 2084101 - protein, 23 aa, Staphylococcus
SIALLAQDYYYKDQSHLTFEERL

SEQ ID NO: 2084102 - protein, 22 aa, Staphylococcus
SIARFISTIRSFHQFALREKYA

SEQ ID NO: 2084103 - protein, 23 aa, Staphylococcus
SIARFISTIRSFHQFALREKYAA

SEQ ID NO: 2084104 - protein, 31 aa, Staphylococcus
SICDIYPLLNRSLLYSAIILHDLGKVKELSG

SEQ ID NO: 2084105 - protein, 34 aa, Staphylococcus
SICKKWYINSFKYFRNMYKAFYYSQPDQLDKCFY

SEQ ID NO: 2084106 - protein, 31 aa, Staphylococcus
SICKKWYINSFKYFRNMYKNFYYSRPEEIDK

SEQ ID NO: 2084107 - protein, 34 aa, Staphylococcus
SIDEGKLADIILWEPAFFGVKPDVIVKGGLINAA

SEQ ID NO: 2084108 - protein, 26 aa, Staphylococcus
SIDGLYQFLFEFIFDIDERYIRLYVQ

SEQ ID NO: 2084109 - protein, 17 aa, Staphylococcus
SIDLLRMAENLNAKVII

SEQ ID NO: 2084110 - protein, 29 aa, Staphylococcus
SIDNPHLWQPLNAYLYHMKVELLNDGEVV

SEQ ID NO: 2084111 - protein, 27 aa, Staphylococcus
SIDQINWVGFYLIENEALILGPFQGHP

SEQ ID NO: 2084112 - protein, 20 aa, Staphylococcus
SIDYIMFTNGFEIKGLNRAT

SEQ ID NO: 2084113 - protein, 25 aa, Staphylococcus
SIEDLKNKFKTFDKVIFSVGSGGST

SEQ ID NO: 2084114 - protein, 18 aa, Staphylococcus
SIEDYTLVSLLTKGGEDA

SEQ ID NO: 2084115 - protein, 35 aa, Staphylococcus
SIEEGKLADLVIWDPAFFGVKPEMILKAGMINTAV

SEQ ID NO: 2084116 - protein, 19 aa, Staphylococcus
SIEHNCIAACRIYGDFFGQ

SEQ ID NO: 2084117 - protein, 28 aa, Staphylococcus
SIEHRRWGAPFPVIEIVKRGISKARGID

SEQ ID NO: 2084118 - protein, 24 aa, Staphylococcus
SIEKGDYPAWELGLQIIREDQEFD

SEQ ID NO: 2084119 - protein, 33 aa, Staphylococcus
SIEKGKLADLVLWNPAFFGVKPELVVKGGLINS

SEQ ID NO: 2084120 - protein, 24 aa, Staphylococcus
SIERTQIPIILDAKQRVIAIGQLY

SEQ ID NO: 2084121 - protein, 22 aa, Staphylococcus
SIERYLELFPPIQNVKHDYLLV

SEQ ID NO: 2084122 - protein, 33 aa, Staphylococcus
SIESGKLADLVLWDPAFFGVKPELVVKGGLINV

SEQ ID NO: 2084123 - protein, 20 aa, Staphylococcus
SIETFKNYYLSLRKEIDEYH

SEQ ID NO: 2084124 - protein, 18 aa, Staphylococcus
SIETRFFEALGDNSYEMP

SEQ ID NO: 2084125 - protein, 30 aa, Staphylococcus
SIEVPIELLPYLFFQFAKDGKRMYDDNAVD

SEQ ID NO: 2084126 - protein, 18 aa, Staphylococcus
SIFDYLQTRLKINIGFSD

SEQ ID NO: 2084127 - protein, 23 aa, Staphylococcus
SIFEALIYYVDANKKLFKHLAIS

SEQ ID NO: 2084128 - protein, 20 aa, Staphylococcus
SIFFDYLVTNKPIVFYTPDL

SEQ ID NO: 2084129 - protein, 19 aa, Staphylococcus
SIFGGIIALNRTVTAELAE

SEQ ID NO: 2084130 - protein, 18 aa, Staphylococcus
SIFGGIVAVNRPVTKELA

SEQ ID NO: 2084131 - protein, 24 aa, Staphylococcus
SIFPTPVVGMVGLIDDVNYLANFK

SEQ ID NO: 2084132 - protein, 21 aa, Staphylococcus
SIFVGDYLITGGQPNTMDYRM

SEQ ID NO: 2084133 - protein, 23 aa, Staphylococcus
SIGANRLLFAPYLAGERTPHGDA

SEQ ID NO: 2084134 - protein, 17 aa, Staphylococcus
SIGDYFKKEAIHFAWEF

SEQ ID NO: 2084135 - protein, 25 aa, Staphylococcus
SIGEHLNFYKLMFNLGKESNLHEKL

SEQ ID NO: 2084136 - protein, 25 aa, Staphylococcus
SIGELEPRMFSFNSPFGACPDCDGL

SEQ ID NO: 2084137 - protein, 26 aa, Staphylococcus
SIGKRPMDRILKPLKLMNANINGIEN

SEQ ID NO: 2084138 - protein, 17 aa, Staphylococcus
SIGLILGFLVQKFMAKS

SEQ ID NO: 2084139 - protein, 18 aa, Staphylococcus
SIGLILGFLVQKFTENNK

SEQ ID NO: 2084140 - protein, 17 aa, Staphylococcus
SIGLILGFLVQRFTQDN

SEQ ID NO: 2084141 - protein, 23 aa, Staphylococcus
SIGMALNKFLYLDVTVNDEDQWS

SEQ ID NO: 2084142 - protein, 26 aa, Staphylococcus
SIGNPLYHWSQLELKMYFNIDDLLTS

SEQ ID NO: 2084143 - protein, 24 aa, Staphylococcus
SIGVNLLVIRHSQNAYYDDLEGLN

SEQ ID NO: 2084144 - protein, 24 aa, Staphylococcus
SIGVNLLVIRHSQNAYYEELENIN

SEQ ID NO: 2084145 - protein, 25 aa, Staphylococcus
SIGYQDDFLNYLKNLSFTGSIRSMQ

SEQ ID NO: 2084146 - protein, 17 aa, Staphylococcus
SIHKVLEGNKIIHPEVQ

SEQ ID NO: 2084147 - protein, 35 aa, Staphylococcus
SIHLVEYIDDLYPFYLDPMPNLYFTRDPQASIGHG

SEQ ID NO: 2084148 - protein, 26 aa, Staphylococcus
SIHPSTMHLPLRLAESTITVVPSRNE

SEQ ID NO: 2084149 - protein, 24 aa, Staphylococcus
SIHYIATVVSIYRKVIDAYASDPE

SEQ ID NO: 2084150 - protein, 22 aa, Staphylococcus
SIHYIATVVSVYRKVIDAYAMD

SEQ ID NO: 2084151 - protein, 28 aa, Staphylococcus
SIIEKFPIQLVVLKPYRLGGIDKVLEAI

SEQ ID NO: 2084152 - protein, 18 aa, Staphylococcus
SIIESAKFKNAESKLTVA

SEQ ID NO: 2084153 - protein, 23 aa, Staphylococcus
SIIETLQPYLYDKTARRPMILPV

SEQ ID NO: 2084154 - protein, 21 aa, Staphylococcus
SIIETLQPYLYEKTARKPMIL

SEQ ID NO: 2084155 - protein, 19 aa, Staphylococcus
SIIETPKFKNTESKLTVAM

SEQ ID NO: 2084156 - protein, 28 aa, Staphylococcus
SIIGINPNWLTKPIMGPIFAPIVNDARS

SEQ ID NO: 2084157 - protein, 24 aa, Staphylococcus
SIIGNGFAVIYLISQRLVKKSLED

SEQ ID NO: 2084158 - protein, 17 aa, Staphylococcus
SIIGTSSLRRGAQILSK

SEQ ID NO: 2084159 - protein, 24 aa, Staphylococcus
SIIKAFGNFDLVFVQSAYSPELMD

SEQ ID NO: 2084160 - protein, 26 aa, Staphylococcus
SIIKAKRIILLAFGEKKKQAINDLLN

SEQ ID NO: 2084161 - protein, 28 aa, Staphylococcus
SIIQGMIDLIFLKDDQYYFVDYKTDAFN

SEQ ID NO: 2084162 - protein, 19 aa, Staphylococcus
SIKAFKTLAIYIRNQYKNP

SEQ ID NO: 2084163 - protein, 25 aa, Staphylococcus
SIKANKKLLPNSKVLLLTDGDITMP

SEQ ID NO: 2084164 - protein, 27 aa, Staphylococcus
SIKDEVLWKDAYFYINGGDKIGLVGAN

SEQ ID NO: 2084165 - protein, 25 aa, Staphylococcus
SIKDRGHDIFLDLKLHDIPNTVGKA

SEQ ID NO: 2084166 - protein, 26 aa, Staphylococcus
SIKDRGHSIFLDLKLHDIPNTVSKAM

SEQ ID NO: 2084167 - protein, 18 aa, Staphylococcus
SIKDTLPTPFESIKGQFH

SEQ ID NO: 2084168 - protein, 19 aa, Staphylococcus
SIKKLNLELGGNASVLVTQ

SEQ ID NO: 2084169 - protein, 26 aa, Staphylococcus
SIKNVVKPLLKYAYDRGIYTQMNSNL

SEQ ID NO: 2084170 - protein, 27 aa, Staphylococcus
SIKSELEGFAWFWHTTFNHTNESPRIR

SEQ ID NO: 2084171 - protein, 18 aa, Staphylococcus
SILESPKFKNAESKLTVA

SEQ ID NO: 2084172 - protein, 20 aa, Staphylococcus
SILHIYFENPINKIEKLYIK

SEQ ID NO: 2084173 - protein, 22 aa, Staphylococcus
SILKAIRLIHTLDEAKILDALN

SEQ ID NO: 2084174 - protein, 26 aa, Staphylococcus
SILKAKRIILLAFGEKKKEAIHQLMN

SEQ ID NO: 2084175 - protein, 25 aa, Staphylococcus
SILKEKQFFVIEHLARSMVKEAKTI

SEQ ID NO: 2084176 - protein, 25 aa, Staphylococcus
SILKEKQFFVIENLARLMIKEAKTI

SEQ ID NO: 2084177 - protein, 18 aa, Staphylococcus
SILKFLEDPPENTIAILL

SEQ ID NO: 2084178 - protein, 17 aa, Staphylococcus
SILKFLEEPPENTIAIL

SEQ ID NO: 2084179 - protein, 19 aa, Staphylococcus
SILKFLEEPPKNTIAILIS

SEQ ID NO: 2084180 - protein, 18 aa, Staphylococcus
SILKFLEEPPQNTIAILL

SEQ ID NO: 2084181 - protein, 26 aa, Staphylococcus
SILKQYLLQIPVCPYSQALKMAHLTV

SEQ ID NO: 2084182 - protein, 19 aa, Staphylococcus
SILMLLSYEENMTLSPSDL

SEQ ID NO: 2084183 - protein, 17 aa, Staphylococcus
SILPGITRKTVIELAQN

SEQ ID NO: 2084184 - protein, 18 aa, Staphylococcus
SIMAFIPGTTLRGPLYKG

SEQ ID NO: 2084185 - protein, 26 aa, Staphylococcus
SIMAFYVQTVASYIFKHILLEVYKAQ

SEQ ID NO: 2084186 - protein, 27 aa, Staphylococcus
SIMDSGFDGYFLIAANPVDILTRYVKE

SEQ ID NO: 2084187 - protein, 17 aa, Staphylococcus
SIMEASGIRFETDTEIG

SEQ ID NO: 2084188 - protein, 19 aa, Staphylococcus
SIMGIGPVEAVRQALKRSN

SEQ ID NO: 2084189 - protein, 27 aa, Staphylococcus
SIMRAKRIILLAFGERKRDAIHQLLNG

SEQ ID NO: 2084190 - protein, 26 aa, Staphylococcus
SINANLEWLPNLFVSGGLADLELGPF

SEQ ID NO: 2084191 - protein, 20 aa, Staphylococcus
SINFFSLFTFKENTEEIVTH

SEQ ID NO: 2084192 - protein, 24 aa, Staphylococcus
SINGDAFLILSYLDEGRTGSQREL

SEQ ID NO: 2084193 - protein, 20 aa, Staphylococcus
SINGMIYQRGNPLDYEGWAE

SEQ ID NO: 2084194 - protein, 20 aa, Staphylococcus
SINHDLLTIKLPETILNDLS

SEQ ID NO: 2084195 - protein, 25 aa, Staphylococcus
SINKAAKFLIALYNVFIEKDCSIVE

SEQ ID NO: 2084196 - protein, 25 aa, Staphylococcus
SINKAAKFLISLYNVFVEKDCSIVE

SEQ ID NO: 2084197 - protein, 20 aa, Staphylococcus
SINSIKRALLQLALNHLNAD

SEQ ID NO: 2084198 - protein, 26 aa, Staphylococcus
SIPFDTDYGWNIKFGKNVFINTNCYL

SEQ ID NO: 2084199 - protein, 20 aa, Staphylococcus
SIPKYPKKIAILTASTGAAI

SEQ ID NO: 2084200 - protein, 17 aa, Staphylococcus
SIPQGFVTGFIGANGAG

SEQ ID NO: 2084201 - protein, 23 aa, Staphylococcus
SIPSKLLLLGDGPELCDMRQKAR

SEQ ID NO: 2084202 - protein, 17 aa, Staphylococcus
SIQPILQYLESEKIIEL

SEQ ID NO: 2084203 - protein, 25 aa, Staphylococcus
SIQQQDRFIFIGRLSLQKQVDHLIK

SEQ ID NO: 2084204 - protein, 30 aa, Staphylococcus
SIQSQLNHTKLYYKWLKNLSSAIESGDIFE

SEQ ID NO: 2084205 - protein, 26 aa, Staphylococcus
SIQTQILDLLLTLRSTRQLSYIFITH

SEQ ID NO: 2084206 - protein, 17 aa, Staphylococcus
SIRLIQDDLRHLNYELH

SEQ ID NO: 2084207 - protein, 27 aa, Staphylococcus
SIRLKSKKGTLLWLMDETKTPMGARRL

SEQ ID NO: 2084208 - protein, 18 aa, Staphylococcus
SIRNALRTALKSLDLELL

SEQ ID NO: 2084209 - protein, 23 aa, Staphylococcus
SIRNDFRFVPLTQQTYIQQRVKH

SEQ ID NO: 2084210 - protein, 26 aa, Staphylococcus
SIRNVVKPLLKYAYNRGIYTQMNSNL

SEQ ID NO: 2084211 - protein, 17 aa, Staphylococcus
SIRVLLESVLRQEDDFV

SEQ ID NO: 2084212 - protein, 18 aa, Staphylococcus
SIRVLLESVLRQEDGFVI

SEQ ID NO: 2084213 - protein, 23 aa, Staphylococcus
SISARLFHSFGCKVVGYDPIRRP

SEQ ID NO: 2084214 - protein, 25 aa, Staphylococcus
SISDKIVEFIAFDMGALGDGQTSDE

SEQ ID NO: 2084215 - protein, 19 aa, Staphylococcus
SISDKLYFEPLTEEDVMSI

SEQ ID NO: 2084216 - protein, 25 aa, Staphylococcus
SISERIFELILKFADYGFPRAHAVS

SEQ ID NO: 2084217 - protein, 20 aa, Staphylococcus
SISFILLNWNTLTGDTHLTN

SEQ ID NO: 2084218 - protein, 25 aa, Staphylococcus
SISICNKNMLYRLSALGIKKGSEVC

SEQ ID NO: 2084219 - protein, 24 aa, Staphylococcus
SISLDLMYHLPKQTIDDFKDSLEK

SEQ ID NO: 2084220 - protein, 24 aa, Staphylococcus
SISLDLMYHLPKQTLEDFEDSLNL

SEQ ID NO: 2084221 - protein, 24 aa, Staphylococcus
SISLDLMYHLPQQSLEDFKQSLEL

SEQ ID NO: 2084222 - protein, 24 aa, Staphylococcus
SISLDLMYHLPQQTLDDFKDSIER

SEQ ID NO: 2084223 - protein, 24 aa, Staphylococcus
SISLDLMYHLPTQTLDDFSDSLNR

SEQ ID NO: 2084224 - protein, 17 aa, Staphylococcus
SISMTTRQMREGEVNGV

SEQ ID NO: 2084225 - protein, 24 aa, Staphylococcus
SISNNHFPLILGGDHSIAIGSISG

SEQ ID NO: 2084226 - protein, 21 aa, Staphylococcus
SISPELFFQKGKFKGKSNIIV

SEQ ID NO: 2084227 - protein, 20 aa, Staphylococcus
SISQFTLFADVKKGNRPGFS

SEQ ID NO: 2084228 - protein, 19 aa, Staphylococcus
SISVPLQYLIAAALEVTDV

SEQ ID NO: 2084229 - protein, 25 aa, Staphylococcus
SISYGLGFQLEHIVKWISEGHSTEE

SEQ ID NO: 2084230 - protein, 31 aa, Staphylococcus
SITDGEFRRSWWHLDFFWGLNGVEAIKDAGG

SEQ ID NO: 2084231 - protein, 17 aa, Staphylococcus
SITDILMQIGFAKVSTN

SEQ ID NO: 2084232 - protein, 24 aa, Staphylococcus
SITGYLLRRYVDPNLVYGLVSAWA

SEQ ID NO: 2084233 - protein, 20 aa, Staphylococcus
SITLIDRMPYHGLKPEFYEL

SEQ ID NO: 2084234 - protein, 24 aa, Staphylococcus
SITNYLRRINRKTALLIQLATEVG

SEQ ID NO: 2084235 - protein, 25 aa, Staphylococcus
SITPKIYQELLPQAKFKTIRAPMFE

SEQ ID NO: 2084236 - protein, 20 aa, Staphylococcus
SIVIGVPLRYMHSNVSIMHK

SEQ ID NO: 2084237 - protein, 19 aa, Staphylococcus
SIVIHYDIRHLSAEFADII

SEQ ID NO: 2084238 - protein, 19 aa, Staphylococcus
SIVIHYDIRHLSSEFAHII

SEQ ID NO: 2084239 - protein, 17 aa, Staphylococcus
SIVLLTCYMLTLEKWSN

SEQ ID NO: 2084240 - protein, 18 aa, Staphylococcus
SIVNKWLNRLIAKGYINE

SEQ ID NO: 2084241 - protein, 22 aa, Staphylococcus
SIVPLKLYLKHGHCKVLLGVAR

SEQ ID NO: 2084242 - protein, 28 aa, Staphylococcus
SIVQALHFFSLVFKNPYLRQEEEIRYII

SEQ ID NO: 2084243 - protein, 24 aa, Staphylococcus
SIVSRWIKKLCQMGYITSKQSNKD

SEQ ID NO: 2084244 - protein, 17 aa, Staphylococcus
SIVSRWIKKLVLKGYIT

SEQ ID NO: 2084245 - protein, 19 aa, Staphylococcus
SIVTLLKYNLETAGYIVEV

SEQ ID NO: 2084246 - protein, 20 aa, Staphylococcus
SIYNYPTHQTFFSSSDKLSI

SEQ ID NO: 2084247 - protein, 19 aa, Staphylococcus
SKADRVFLCDIFGSIREHD

SEQ ID NO: 2084248 - protein, 19 aa, Staphylococcus
SKAFKGYMEASQKNQFPWV

SEQ ID NO: 2084249 - protein, 26 aa, Staphylococcus
SKAKRLLNINKLIPIYINRDTILFPL

SEQ ID NO: 2084250 - protein, 23 aa, Staphylococcus
SKAYYAHGWVMQIHFGAIRNNNT

SEQ ID NO: 2084251 - protein, 25 aa, Staphylococcus
SKDDSFILGIQWHPEMLWKESSMDE

SEQ ID NO: 2084252 - protein, 17 aa, Staphylococcus
SKDFPLLAKIVDAESPL

SEQ ID NO: 2084253 - protein, 20 aa, Staphylococcus
SKDFPLMAKIVDAEAPLSIH

SEQ ID NO: 2084254 - protein, 18 aa, Staphylococcus
SKDIIVIARQPAKNMSTL

SEQ ID NO: 2084255 - protein, 23 aa, Staphylococcus
SKDIKLLDGLYQQNKDYFDDVNL

SEQ ID NO: 2084256 - protein, 20 aa, Staphylococcus
SKDIMAVPAVFLNGEEFGNG

SEQ ID NO: 2084257 - protein, 27 aa, Staphylococcus
SKDNARLMDFILDKLIELSAEIMPDNY

SEQ ID NO: 2084258 - protein, 23 aa, Staphylococcus
SKDPDFLQAYFYLQQLYENEHNH

SEQ ID NO: 2084259 - protein, 23 aa, Staphylococcus
SKDPDFLQGYFYLQSLYENEKNY

SEQ ID NO: 2084260 - protein, 26 aa, Staphylococcus
SKDSEHYGLWAFKRVWGTYLSEKIGE

SEQ ID NO: 2084261 - protein, 25 aa, Staphylococcus
SKDVLIDLGLIVGKDARHKREKLGR

SEQ ID NO: 2084262 - protein, 17 aa, Staphylococcus
SKDVSTHKPRFAGSKPF

SEQ ID NO: 2084263 - protein, 28 aa, Staphylococcus
SKEEQLYQLIVEKIRYAFKDRILIPQND

SEQ ID NO: 2084264 - protein, 26 aa, Staphylococcus
SKEGVKLLWASCRELFNVIQADEIGA

SEQ ID NO: 2084265 - protein, 23 aa, Staphylococcus
SKEGVKLLWASCRELLNVIQADE

SEQ ID NO: 2084266 - protein, 22 aa, Staphylococcus
SKEGVKLLWASCREVINVIQAD

SEQ ID NO: 2084267 - protein, 25 aa, Staphylococcus
SKEHSNQLLVMLHGFISDASTFDKH

SEQ ID NO: 2084268 - protein, 25 aa, Staphylococcus
SKELSTILKFSFGIAPRKVEYGDIK

SEQ ID NO: 2084269 - protein, 19 aa, Staphylococcus
SKEMLACRKAGIITGLPDA

SEQ ID NO: 2084270 - protein, 18 aa, Staphylococcus
SKEMLACRKAGVITGLPD

SEQ ID NO: 2084271 - protein, 23 aa, Staphylococcus
SKERLNYGSKWFEKSHMYIRTDL

SEQ ID NO: 2084272 - protein, 26 aa, Staphylococcus
SKESNIKLIYWLKGTGKVFINLKEYE

SEQ ID NO: 2084273 - protein, 33 aa, Staphylococcus
SKEVKQLILPTQFNKVFVIDFKAFEPSVLAYLA

SEQ ID NO: 2084274 - protein, 17 aa, Staphylococcus
SKFEYFWKRYKADVKKS

SEQ ID NO: 2084275 - protein, 28 aa, Staphylococcus
SKFGHQIRFDLTKGFPLLTTKKVSFKLI

SEQ ID NO: 2084276 - protein, 27 aa, Staphylococcus
SKFGHQLRFDLSEGFPLLTTKKVSFKL

SEQ ID NO: 2084277 - protein, 26 aa, Staphylococcus
SKFGHQLRFDLTKGFPLLTTKKVSFK

SEQ ID NO: 2084278 - protein, 21 aa, Staphylococcus
SKFGLSIRYGLANEAIDKIKQ

SEQ ID NO: 2084279 - protein, 18 aa, Staphylococcus
SKFLRAPSIRQFSNRMKH

SEQ ID NO: 2084280 - protein, 19 aa, Staphylococcus
SKFLRAPSIRQFSNRMQHI

SEQ ID NO: 2084281 - protein, 19 aa, Staphylococcus
SKFLRAPSIRQFSSRIKNI

SEQ ID NO: 2084282 - protein, 31 aa, Staphylococcus
SKFRYDLNERFIITRGLDKCLFGYTLEEWQV

SEQ ID NO: 2084283 - protein, 33 aa, Staphylococcus
SKGDQQLMLRLLRPKFFLPIHGEYRMLKAHGQS

SEQ ID NO: 2084284 - protein, 39 aa, Staphylococcus
SKGFKPYMEASQKNQFPWVVAAFPTKDWARRVYPDMDEE

SEQ ID NO: 2084285 - protein, 25 aa, Staphylococcus
SKGGLLYHFKNKFALIQGLVDHADE

SEQ ID NO: 2084286 - protein, 21 aa, Staphylococcus
SKGGRLIYIGAGTSGRLGVLD

SEQ ID NO: 2084287 - protein, 26 aa, Staphylococcus
SKGIYKFRYIIIEAIKKVFKFESVFE

SEQ ID NO: 2084288 - protein, 25 aa, Staphylococcus
SKGKMALRVYPPWETGLNNTAAKTQ

SEQ ID NO: 2084289 - protein, 21 aa, Staphylococcus
SKGLELFYRPIFNPDTMSERI

SEQ ID NO: 2084290 - protein, 24 aa, Staphylococcus
SKGLHSIMYGHEPINLIGLEQLVD

SEQ ID NO: 2084291 - protein, 23 aa, Staphylococcus
SKGNLYYHFKTKENLFLEILNIE

SEQ ID NO: 2084292 - protein, 24 aa, Staphylococcus
SKGNYLTMMAMTDSQIIIMPEQGT

SEQ ID NO: 2084293 - protein, 23 aa, Staphylococcus
SKHFEISFYLTTHSIPEAYGVII

SEQ ID NO: 2084294 - protein, 23 aa, Staphylococcus
SKHFEISFYLTTHSIPEAYGVVV

SEQ ID NO: 2084295 - protein, 25 aa, Staphylococcus
SKHRENVVFILWGKPAQQKEKLIDT

SEQ ID NO: 2084296 - protein, 24 aa, Staphylococcus
SKHYENLGLIWYDAHGDLNIPEES

SEQ ID NO: 2084297 - protein, 26 aa, Staphylococcus
SKIAYIMSYLKVHYANYFYANILSNA

SEQ ID NO: 2084298 - protein, 22 aa, Staphylococcus
SKIDIPRVRFTTSHPWDFTDRM

SEQ ID NO: 2084299 - protein, 25 aa, Staphylococcus
SKIDRWFTNAYKLLPTDFPKIVIHE

SEQ ID NO: 2084300 - protein, 23 aa, Staphylococcus
SKIKEFKLLSTAGAYWRGDSDNK

SEQ ID NO: 2084301 - protein, 20 aa, Staphylococcus
SKILAQIVTLGKDKLRNVYD

SEQ ID NO: 2084302 - protein, 20 aa, Staphylococcus
SKILEVPSGLLVPHLSEIYV

SEQ ID NO: 2084303 - protein, 20 aa, Staphylococcus
SKILYFFNNQKNCVGVYFVC

SEQ ID NO: 2084304 - protein, 25 aa, Staphylococcus
SKKDVKRLIFVAAPGIYDELPAKFN

SEQ ID NO: 2084305 - protein, 24 aa, Staphylococcus
SKKFEPRMFIGAISNLKNELKTPE

SEQ ID NO: 2084306 - protein, 23 aa, Staphylococcus
SKKFEPRMFISAISNLKNELKTP

SEQ ID NO: 2084307 - protein, 28 aa, Staphylococcus
SKKIPSTIVYLPEFIRTLKNGFKDGSYE

SEQ ID NO: 2084308 - protein, 24 aa, Staphylococcus
SKKKAPNFYMLPGGKYEGTENDIE

SEQ ID NO: 2084309 - protein, 22 aa, Staphylococcus
SKKLNQWLKTTTAFQILVQNND

SEQ ID NO: 2084310 - protein, 33 aa, Staphylococcus
SKKLTLENYVLIYYLERIIHQANIRLERMSGER

SEQ ID NO: 2084311 - protein, 32 aa, Staphylococcus
SKKNRTWDFQIKLPRFLSKEDYLIFTHAIVEE

SEQ ID NO: 2084312 - protein, 22 aa, Staphylococcus
SKKNVIHIPVLYNLEMGPDLEE

SEQ ID NO: 2084313 - protein, 28 aa, Staphylococcus
SKKQELNDAFYYFNVPAEVKNVTVGPSV

SEQ ID NO: 2084314 - protein, 25 aa, Staphylococcus
SKKRFDEMLGWFKYEIRQYTESDIS

SEQ ID NO: 2084315 - protein, 25 aa, Staphylococcus
SKKRFEEMLGWFKYEIRQYTESDIS

SEQ ID NO: 2084316 - protein, 28 aa, Staphylococcus
SKKYDDLIIVPLFLFDGRLVNKVKRLIS

SEQ ID NO: 2084317 - protein, 26 aa, Staphylococcus
SKLHQSPLIEKLYAIPGNDAMTHLAE

SEQ ID NO: 2084318 - protein, 17 aa, Staphylococcus
SKLKRYIEPLGLKLDRY

SEQ ID NO: 2084319 - protein, 23 aa, Staphylococcus
SKLKTFVGPFAYYIKGMEMLPQM

SEQ ID NO: 2084320 - protein, 23 aa, Staphylococcus
SKLLSDAGLITLTAFISPYREDR

SEQ ID NO: 2084321 - protein, 26 aa, Staphylococcus
SKLNIDLKIPIILISGNHDGKERLNY

SEQ ID NO: 2084322 - protein, 30 aa, Staphylococcus
SKLNLNAVIFMPVTTPLQKINQVKFFGGDN

SEQ ID NO: 2084323 - protein, 20 aa, Staphylococcus
SKLRKQYLDSFREGFKQQIE

SEQ ID NO: 2084324 - protein, 39 aa, Staphylococcus; identical to SEQ ID NO: 1820894

SEQ ID NO: 2084325 - protein, 39 aa, Staphylococcus
SKMKEEPQWMLDFRLKALKLFYKMPMPQWGGDLSELNFD

SEQ ID NO: 2084326 - protein, 26 aa, Staphylococcus
SKNDFGLPRVWLRTARYLNDNDADTI

SEQ ID NO: 2084327 - protein, 24 aa, Staphylococcus
SKNKPDAKLFILLVGERPEEVTDI

SEQ ID NO: 2084328 - protein, 26 aa, Staphylococcus
SKNMKELLQLIPPDKLKPFINNILGP

SEQ ID NO: 2084329 - protein, 30 aa, Staphylococcus
SKNRTWEFHITLPYFLSHEDYLLFNHAIVE

SEQ ID NO: 2084330 - protein, 26 aa, Staphylococcus
SKNVDFKFDYLIPKNLEAFIQVGVRV

SEQ ID NO: 2084331 - protein, 22 aa, Staphylococcus
SKPDVVVASFRQAHTKTLEEMK

SEQ ID NO: 2084332 - protein, 20 aa, Staphylococcus
SKPGIKMLGASMAGLHDDVP

SEQ ID NO: 2084333 - protein, 26 aa, Staphylococcus
SKQFDELPLKYIFTPGHAPGHVVFYH

SEQ ID NO: 2084334 - protein, 17 aa, Staphylococcus
SKQFWAYLVRTGHLTEP

SEQ ID NO: 2084335 - protein, 22 aa, Staphylococcus
SKQIIDYIYPMIENEIHEDMKM

SEQ ID NO: 2084336 - protein, 21 aa, Staphylococcus
SKQLCFLFYVSSKEIIKKYSS

SEQ ID NO: 2084337 - protein, 21 aa, Staphylococcus
SKQLCFLFYVSSKEIIKKYTN

SEQ ID NO: 2084338 - protein, 21 aa, Staphylococcus
SKQLCFLLYVTSKEVIKKYTH

SEQ ID NO: 2084339 - protein, 24 aa, Staphylococcus
SKQQYWYEHSLDLFLKHFGEDIKI

SEQ ID NO: 2084340 - protein, 28 aa, Staphylococcus
SKQYDELIIVPLFLFDGRLVNKVKRLID

SEQ ID NO: 2084341 - protein, 20 aa, Staphylococcus
SKRDQYLPMGLLLANHLIEK

SEQ ID NO: 2084342 - protein, 24 aa, Staphylococcus
SKRFEAYFHLHQMKIDGKLADQIF

SEQ ID NO: 2084343 - protein, 24 aa, Staphylococcus
SKRFEPRMFIGAISNLKNELKTPE

SEQ ID NO: 2084344 - protein, 25 aa, Staphylococcus
SKRFLRKLDYLIHPTFQMIEHNFNN

SEQ ID NO: 2084345 - protein, 24 aa, Staphylococcus
SKRNYICFFEKSKIKPEHYYKLLN

SEQ ID NO: 2084346 - protein, 24 aa, Staphylococcus
SKSHYFVSMMGYSPGFPYLTGMNE

SEQ ID NO: 2084347 - protein, 23 aa, Staphylococcus
SKSITFEPFSRLDYEMFGDINPP

SEQ ID NO: 2084348 - protein, 31 aa, Staphylococcus
SKSIYPSCRIAYIVLPPKLLEQYHHYHYKEA

SEQ ID NO: 2084349 - protein, 26 aa, Staphylococcus
SKSLFPSCRIAYLVLPKKLLAQYEHL

SEQ ID NO: 2084350 - protein, 30 aa, Staphylococcus
SKSLYPSCRIAYIVLPQKLLQSYLSMPYKE

SEQ ID NO: 2084351 - protein, 18 aa, Staphylococcus
SKSMPILIHGDAAYPGQG

SEQ ID NO: 2084352 - protein, 26 aa, Staphylococcus
SKSVDFKFDYLIPDHLKDFIKVGVRV

SEQ ID NO: 2084353 - protein, 40 aa, Staphylococcus
SKSVDFTFDYIIPIRLQSMIQIGMRVIVPFGPRTIQGYVM

SEQ ID NO: 2084354 - protein, 27 aa, Staphylococcus
SKSVDFTFDYVIPKRLAAFVQVGVRVV

SEQ ID NO: 2084355 - protein, 18 aa, Staphylococcus
SKTKIFIDDTPGIRINDL

SEQ ID NO: 2084356 - protein, 20 aa, Staphylococcus
SKTLSKWKKWFDVTILEEGD

SEQ ID NO: 2084357 - protein, 25 aa, Staphylococcus
SKTRRHLIEFWMIEAEMAFTTHAES

SEQ ID NO: 2084358 - protein, 23 aa, Staphylococcus
SKTRRHLIEFWMIEGEMAFYEHA

SEQ ID NO: 2084359 - protein, 24 aa, Staphylococcus
SKTRRHLIEFWMIEPEMAFTEHAE

SEQ ID NO: 2084360 - protein, 25 aa, Staphylococcus
SKTRRHLIEFWMIEPEMAFTNHAES

SEQ ID NO: 2084361 - protein, 24 aa, Staphylococcus
SKTRRHLIEFWMIEPEMAFTNHEE

SEQ ID NO: 2084362 - protein, 25 aa, Staphylococcus
SKTRRHLIEFWMIEPEMAFTNHVES

SEQ ID NO: 2084363 - protein, 24 aa, Staphylococcus
SKTSGIFFMIKDDEQYIFGDCAIN

SEQ ID NO: 2084364 - protein, 24 aa, Staphylococcus
SKTSGIFFMIKDDQQYVFGDCAIN

SEQ ID NO: 2084365 - protein, 23 aa, Staphylococcus
SKTSGIFFMMKGEEQYIFGDCAI

SEQ ID NO: 2084366 - protein, 24 aa, Staphylococcus
SKTSGVFFMIKGDEQYVFGDCAIN

SEQ ID NO: 2084367 - protein, 22 aa, Staphylococcus
SKTYDLEVWLPSYNDYKEISSC

SEQ ID NO: 2084368 - protein, 23 aa, Staphylococcus
SKTYHAYYIINNATRSCSSISEP

SEQ ID NO: 2084369 - protein, 26 aa, Staphylococcus
SKVALYGIVYKLGFDNALVPNVYKSF

SEQ ID NO: 2084370 - protein, 21 aa, Staphylococcus
SKVHYPISMLYTYLTHNNNGG

SEQ ID NO: 2084371 - protein, 21 aa, Staphylococcus
SKVNFKIYPLKDIDERLISKH

SEQ ID NO: 2084372 - protein, 33 aa, Staphylococcus
SKVQPCCFKLYNDPFDIVYVMMNGKLFGHVYIQ

SEQ ID NO: 2084373 - protein, 25 aa, Staphylococcus
SKYDLSYIALDGDIGCMVNGAGLAM

SEQ ID NO: 2084374 - protein, 17 aa, Staphylococcus
SKYPKLLCDLYSGVLTE

SEQ ID NO: 2084375 - protein, 25 aa, Staphylococcus
SKYRDDVVFILWGKPAQQKIKLIDT

SEQ ID NO: 2084376 - protein, 25 aa, Staphylococcus
SKYTNIKWIIPHCGALLPVIAQRVA

SEQ ID NO: 2084377 - protein, 22 aa, Staphylococcus
SKYTRSKLRKALPEQFVYIIEE

SEQ ID NO: 2084378 - protein, 25 aa, Staphylococcus
SKYTRTKLRKSLPKNYVFIIEELLY

SEQ ID NO: 2084379 - protein, 20 aa, Staphylococcus
SLAAAIALGYQPGDFESITV

SEQ ID NO: 2084380 - protein, 17 aa, Staphylococcus
SLAAVLERSGFTDIKIA

SEQ ID NO: 2084381 - protein, 29 aa, Staphylococcus
SLADSGKYYLIEPPFRGFPDFIETTVDGF

SEQ ID NO: 2084382 - protein, 30 aa, Staphylococcus
SLAFDACFFEIWLPLLNNGSIAFIPDPVFD

SEQ ID NO: 2084383 - protein, 20 aa, Staphylococcus
SLAIGWELGYLLTLSNQGID

SEQ ID NO: 2084384 - protein, 28 aa, Staphylococcus
SLAMLDYALRRRFAFFDMNPAFETIQFK

SEQ ID NO: 2084385 - protein, 30 aa, Staphylococcus
SLCEQFDDFSCRIGMPFLRSPHVHHVHPDP

SEQ ID NO: 2084386 - protein, 34 aa, Staphylococcus
SLDAILLHERPIKIGLATLVDRGHRELPIRADFV

SEQ ID NO: 2084387 - protein, 32 aa, Staphylococcus
SLDCNLKFKTFLLEEGIIDEAWLEKIETEHKE

SEQ ID NO: 2084388 - protein, 20 aa, Staphylococcus
SLDDFYFGASFRVIQNKTLE

SEQ ID NO: 2084389 - protein, 20 aa, Staphylococcus
SLDIFLNFKTINSDLLHCIE

SEQ ID NO: 2084390 - protein, 20 aa, Staphylococcus
SLDLSKRMKWYTVIQAIGLV

SEQ ID NO: 2084391 - protein, 24 aa, Staphylococcus
SLDNTFHIWVTSDNLLKGAALNTV

SEQ ID NO: 2084392 - protein, 23 aa, Staphylococcus
SLDQLDYYLFKGIETKLHIVVED

SEQ ID NO: 2084393 - protein, 27 aa, Staphylococcus
SLDSDQLVMLKLTIPTQPNLYKELAQH

SEQ ID NO: 2084394 - protein, 21 aa, Staphylococcus
SLDVFLTFKYENSDLLNCIEE

SEQ ID NO: 2084395 - protein, 25 aa, Staphylococcus
SLEDYTLMALLQKKGADAGLSIADM

SEQ ID NO: 2084396 - protein, 18 aa, Staphylococcus
SLEFYRSHIGGHAQGLHD

SEQ ID NO: 2084397 - protein, 19 aa, Staphylococcus
SLEGPRLYEPIHGSAPDIA

SEQ ID NO: 2084398 - protein, 19 aa, Staphylococcus
SLEGQDIGFIGELHPQVAA

SEQ ID NO: 2084399 - protein, 29 aa, Staphylococcus
SLELEKKVWILKEYLLINGQIYTESQKIE

SEQ ID NO: 2084400 - protein, 22 aa, Staphylococcus
SLELIRDLDFDALVPWVSIEGE

SEQ ID NO: 2084401 - protein, 25 aa, Staphylococcus
SLETPIEIEVLPKAIQLLTFPEFGK

SEQ ID NO: 2084402 - protein, 23 aa, Staphylococcus
SLETPITIEVLPKALQILTFPEN

SEQ ID NO: 2084403 - protein, 30 aa, Staphylococcus
SLFAQMFTIDILYYRYIALNYQSSLDFITQ

SEQ ID NO: 2084404 - protein, 30 aa, Staphylococcus
SLFAQMFTIDVLYYRYIALNYQSSLDFITQ

SEQ ID NO: 2084405 - protein, 17 aa, Staphylococcus
SLFEHLKDLFLEETFEE

SEQ ID NO: 2084406 - protein, 18 aa, Staphylococcus
SLFFSYRVEKGKTGRMLA

SEQ ID NO: 2084407 - protein, 17 aa, Staphylococcus
SLFHNLLSQSSRTYKQL

SEQ ID NO: 2084408 - protein, 27 aa, Staphylococcus
SLFYNTPARLKYIKSLYTELGKITDIV

SEQ ID NO: 2084409 - protein, 24 aa, Staphylococcus
SLGAKRVLPLAVSGPFHSSMMNVI

SEQ ID NO: 2084410 - protein, 24 aa, Staphylococcus
SLGAKRVMPLAVSGPFHSSMMQVI

SEQ ID NO: 2084411 - protein, 23 aa, Staphylococcus
SLGFDHIHLDTEIYLRMYSEQDE

SEQ ID NO: 2084412 - protein, 34 aa, Staphylococcus
SLGFDQHTKWLSVLPIYHISGLSVILRSVIEGFT

SEQ ID NO: 2084413 - protein, 21 aa, Staphylococcus
SLGILSLLIKLQSLTPILHHD

SEQ ID NO: 2084414 - protein, 18 aa, Staphylococcus
SLGIRMLKKLMYSIKYYS

SEQ ID NO: 2084415 - protein, 32 aa, Staphylococcus
SLGKSQSFIANKLRLLKLAPKVINRLREGKIT

SEQ ID NO: 2084416 - protein, 32 aa, Staphylococcus
SLGKSQSFIANKLRLLKLAPKVITRLREGKIT

SEQ ID NO: 2084417 - protein, 32 aa, Staphylococcus; identical to SEQ ID NO: 1819414

SEQ ID NO: 2084418 - protein, 28 aa, Staphylococcus
SLGMNAGLYLIDFLSTLNLNQTAKEFAE

SEQ ID NO: 2084419 - protein, 20 aa, Staphylococcus
SLGVKYLYQRKGIGQALINA

SEQ ID NO: 2084420 - protein, 29 aa, Staphylococcus
SLGVNAGLYLLKFLSSLNLDKSAKDFVEF

SEQ ID NO: 2084421 - protein, 33 aa, Staphylococcus
SLGYSLQSKWLSVLPIYHISGLSVILRSVMEGF

SEQ ID NO: 2084422 - protein, 19 aa, Staphylococcus
SLHKGFIDRSLVHQGHHVP

SEQ ID NO: 2084423 - protein, 18 aa, Staphylococcus
SLHKKNGALFPIESIIKD

SEQ ID NO: 2084424 - protein, 25 aa, Staphylococcus
SLHSIILNQWSLSDLELIGIGGFSP

SEQ ID NO: 2084425 - protein, 21 aa, Staphylococcus
SLIATSGSFSDRMSRLLIGED

SEQ ID NO: 2084426 - protein, 25 aa, Staphylococcus
SLIESILQLIKYKGQMYYNGTVISK

SEQ ID NO: 2084427 - protein, 25 aa, Staphylococcus
SLIITHYQRLLNYITPDHVHVMYGG

SEQ ID NO: 2084428 - protein, 20 aa, Staphylococcus
SLIKLDYELYSTGGTKGALE

SEQ ID NO: 2084429 - protein, 24 aa, Staphylococcus
SLIKTDLEIPPFIQALTSIEDQML

SEQ ID NO: 2084430 - protein, 20 aa, Staphylococcus
SLINALLGDNYLVSSPNPTT

SEQ ID NO: 2084431 - protein, 21 aa, Staphylococcus
SLINDLYQMQITISNQYVLTF

SEQ ID NO: 2084432 - protein, 32 aa, Staphylococcus
SLINQMGMTANSPFWYTIPDYPDGSQYNRTKE

SEQ ID NO: 2084433 - protein, 21 aa, Staphylococcus
SLIQRHFQIGYNRAARIIDQL

SEQ ID NO: 2084434 - protein, 20 aa, Staphylococcus
SLIQTMYPVQPSYPGAMCVC

SEQ ID NO: 2084435 - protein, 18 aa, Staphylococcus
SLIRFPENSLRPLGRTAS

SEQ ID NO: 2084436 - protein, 22 aa, Staphylococcus
SLISRFYSFNKGDKQYIILIED

SEQ ID NO: 2084437 - protein, 22 aa, Staphylococcus
SLKAIRDYKPLLKGLAGLEVFP

SEQ ID NO: 2084438 - protein, 24 aa, Staphylococcus
SLKDTLVRVIPYWNDQISQQLLDG

SEQ ID NO: 2084439 - protein, 25 aa, Staphylococcus
SLKEAIRIRKLAPNATIFLMNAVYE

SEQ ID NO: 2084440 - protein, 29 aa, Staphylococcus
SLKGALFTSLLLEKLNMKTTPKYNVKRTD

SEQ ID NO: 2084441 - protein, 28 aa, Staphylococcus
SLKGALFTSLLLEKLNMTTTPKYNVKRT

SEQ ID NO: 2084442 - protein, 25 aa, Staphylococcus
SLKGALFTSLLLEKMDMRTSPRYDE

SEQ ID NO: 2084443 - protein, 24 aa, Staphylococcus
SLKGALFTSLLLEKMHMHTTPKYD

SEQ ID NO: 2084444 - protein, 26 aa, Staphylococcus
SLKGLDSLLSIVQMPGGIPVATTAIG

SEQ ID NO: 2084445 - protein, 30 aa, Staphylococcus
SLKHLEPEALLKPLFRHLTETYSEAMAHID

SEQ ID NO: 2084446 - protein, 26 aa, Staphylococcus
SLKKDWGSFFMPKFNFVINVTNENRI

SEQ ID NO: 2084447 - protein, 31 aa, Staphylococcus
SLKKDWGSFFMPKIHFIIYGTQKYSIDKITT

SEQ ID NO: 2084448 - protein, 32 aa, Staphylococcus
SLKKLNLDYLDLYLMHWPGTDEALMIDTWQGM

SEQ ID NO: 2084449 - protein, 31 aa, Staphylococcus
SLKLLGLDYLDLYLIHWPGTDQSLMIETWEG

SEQ ID NO: 2084450 - protein, 24 aa, Staphylococcus
SLKNLNYSQLYLVLQHQQSIYFDG

SEQ ID NO: 2084451 - protein, 19 aa, Staphylococcus
SLKRLIMPSIEREIRSDLT

SEQ ID NO: 2084452 - protein, 24 aa, Staphylococcus
SLLAHELFDFPSHQLVTYGVTGTN

SEQ ID NO: 2084453 - protein, 17 aa, Staphylococcus
SLLEKDKVDFAKELLDR

SEQ ID NO: 2084454 - protein, 29 aa, Staphylococcus
SLLFEEMKHYFILNFPQRPGALREFVNEV

SEQ ID NO: 2084455 - protein, 19 aa, Staphylococcus
SLLLAPWDVIQPRLDKILD

SEQ ID NO: 2084456 - protein, 18 aa, Staphylococcus
SLLQILKKQISSNRYTLV

SEQ ID NO: 2084457 - protein, 19 aa, Staphylococcus
SLLRSIRLGLANRFNWTQS

SEQ ID NO: 2084458 - protein, 17 aa, Staphylococcus
SLLTVLPLDKERLADME

SEQ ID NO: 2084459 - protein, 22 aa, Staphylococcus
SLLVYITYFYNREEKTMAQTSK

SEQ ID NO: 2084460 - protein, 18 aa, Staphylococcus
SLMLKHGFEFETEVPKLF

SEQ ID NO: 2084461 - protein, 20 aa, Staphylococcus
SLMRMRMEGKVKKYVNTEVA

SEQ ID NO: 2084462 - protein, 18 aa, Staphylococcus
SLMVAGAMLGVNIRICTP

SEQ ID NO: 2084463 - protein, 27 aa, Staphylococcus
SLNDDQLVMLKLTIPTKANLYKELADH

SEQ ID NO: 2084464 - protein, 20 aa, Staphylococcus
SLNDLLVLGIIWSNQNDISL

SEQ ID NO: 2084465 - protein, 22 aa, Staphylococcus
SLNDQILELLSRRGELAQKIGE

SEQ ID NO: 2084466 - protein, 18 aa, Staphylococcus
SLNIGLTMRGIAPSVTFS

SEQ ID NO: 2084467 - protein, 19 aa, Staphylococcus
SLNIIYIKTVPIEASIRVQ

SEQ ID NO: 2084468 - protein, 24 aa, Staphylococcus
SLNKLNFEFGIVQTLLTIKVAKQI

SEQ ID NO: 2084469 - protein, 18 aa, Staphylococcus
SLNMLFFPVKVNKQHIVV

SEQ ID NO: 2084470 - protein, 30 aa, Staphylococcus
SLNMRKYYGPLLNGFYHIPFPDKYRGMFEQ

SEQ ID NO: 2084471 - protein, 24 aa, Staphylococcus
SLNPNIVYKMYTAEATHPTLIGKQ

SEQ ID NO: 2084472 - protein, 24 aa, Staphylococcus
SLNPPHLKAMIPWEGLNDMYREVA

SEQ ID NO: 2084473 - protein, 20 aa, Staphylococcus
SLNVLTIFRVFIIDSQALNR

SEQ ID NO: 2084474 - protein, 28 aa, Staphylococcus
SLPAYYYAIVAPYKRHPMIKLMNAMQYD

SEQ ID NO: 2084475 - protein, 24 aa, Staphylococcus
SLPDQWYLGIIKPIVNKHQIFDQI

SEQ ID NO: 2084476 - protein, 17 aa, Staphylococcus
SLPKWLVDHWTTHFGIE

SEQ ID NO: 2084477 - protein, 25 aa, Staphylococcus
SLPNDRKYHPLEKLGRYLIDSFVNI

SEQ ID NO: 2084478 - protein, 27 aa, Staphylococcus
SLPQANVIRILFKEGFIALRPSGTEPK

SEQ ID NO: 2084479 - protein, 17 aa, Staphylococcus
SLPVYKPTLPPMVFGTK

SEQ ID NO: 2084480 - protein, 25 aa, Staphylococcus
SLPYNYYEDFGIRKYGFHGTSHKYV

SEQ ID NO: 2084481 - protein, 24 aa, Staphylococcus
SLQDKLFPIEYGLKGLQEIEINDE

SEQ ID NO: 2084482 - protein, 26 aa, Staphylococcus
SLQLLDTPGILWPKFEDQLVGKKLSV

SEQ ID NO: 2084483 - protein, 32 aa, Staphylococcus
SLQPSLDIKRMPFIGLQWIFARKGAAASNHFE

SEQ ID NO: 2084484 - protein, 32 aa, Staphylococcus; identical to SEQ ID NO: 1819416

SEQ ID NO: 2084485 - protein, 20 aa, Staphylococcus
SLQQGAWNRKAFRGVELYQK

SEQ ID NO: 2084486 - protein, 22 aa, Staphylococcus
SLQVFNLIGHRRSFAGSAIGGI

SEQ ID NO: 2084487 - protein, 24 aa, Staphylococcus
SLRAGAFGLPITYAIIGGNPRRFT

SEQ ID NO: 2084488 - protein, 22 aa, Staphylococcus
SLRAKYLFKDNLDYFIYNGEVV

SEQ ID NO: 2084489 - protein, 26 aa, Staphylococcus
SLRGGIIDIYPLIGAPVRIELFDTEV

SEQ ID NO: 2084490 - protein, 30 aa, Staphylococcus
SLRLNDIGFIFQSSHLVPYLTVREQLMIVA

SEQ ID NO: 2084491 - protein, 28 aa, Staphylococcus
SLRQVSRIPLSLTFDHQILDGAGAAEFL

SEQ ID NO: 2084492 - protein, 18 aa, Staphylococcus
SLRRVINIPKRGIGPSSV

SEQ ID NO: 2084493 - protein, 26 aa, Staphylococcus
SLRSRSFYLELMLEVIVDKLLERLKL

SEQ ID NO: 2084494 - protein, 18 aa, Staphylococcus
SLSCIHLISTIDNLEFYQ

SEQ ID NO: 2084495 - protein, 26 aa, Staphylococcus
SLSDELEWLPQLFVVGGLADLELGPF

SEQ ID NO: 2084496 - protein, 23 aa, Staphylococcus
SLSDHRIGMMLAIGSLLSSEPLE

SEQ ID NO: 2084497 - protein, 49 aa, Staphylococcus
SLSEEKVRFKLYKAGKHWIKAGLKDIELLRIMGMPFGRKTIEKEQKLEI

SEQ ID NO: 2084498 - protein, 33 aa, Staphylococcus
SLSGHKFNGLKGQGLLIIKNIQNIEPVVHGGGQ

SEQ ID NO: 2084499 - protein, 17 aa, Staphylococcus
SLSIKDTLPSPFESIKG

SEQ ID NO: 2084500 - protein, 21 aa, Staphylococcus
SLSIKDTLPSPFESIKGQIHA

SEQ ID NO: 2084501 - protein, 19 aa, Staphylococcus
SLSIKDTLPTPFENIKGKF

SEQ ID NO: 2084502 - protein, 17 aa, Staphylococcus
SLSILINEMWNKKTILG

SEQ ID NO: 2084503 - protein, 23 aa, Staphylococcus
SLSNTELLAILINTGRKGSSSIE

SEQ ID NO: 2084504 - protein, 17 aa, Staphylococcus
SLSPFQMSGGQMRKLAL

SEQ ID NO: 2084505 - protein, 22 aa, Staphylococcus
SLSPNDLFTWSSGIKSPIYCDN

SEQ ID NO: 2084506 - protein, 24 aa, Staphylococcus
SLSQSNIPIIFLTAKDNLDTRLKC

SEQ ID NO: 2084507 - protein, 21 aa, Staphylococcus
SLSVNIRILFAEPSDLEDIYD

SEQ ID NO: 2084508 - protein, 25 aa, Staphylococcus
SLTAQLFMINVLYYRYLSLDFSNSL

SEQ ID NO: 2084509 - protein, 21 aa, Staphylococcus
SLTEFVNIYGAKGLAWVKVVE

SEQ ID NO: 2084510 - protein, 19 aa, Staphylococcus
SLTFVFKDFAVVGDTLFKQ

SEQ ID NO: 2084511 - protein, 26 aa, Staphylococcus
SLTLVDVLVDVLWLFAVLVDVLVDVL

SEQ ID NO: 2084512 - protein, 21 aa, Staphylococcus
SLTMPFFSDKKVVLVQNAYLF

SEQ ID NO: 2084513 - protein, 29 aa, Staphylococcus
SLTMVFFSGKLIQMLNNPTLVIVTDRNDL

SEQ ID NO: 2084514 - protein, 24 aa, Staphylococcus
SLTPILHYDIYKFFLNALSSVRIE

SEQ ID NO: 2084515 - protein, 18 aa, Staphylococcus
SLTTVDYVIVRNSIFNGD

SEQ ID NO: 2084516 - protein, 30 aa, Staphylococcus
SLTVITNCLPVFKILMNKQSLHFRVYLLGG

SEQ ID NO: 2084517 - protein, 18 aa, Staphylococcus
SLVEFAEWMVSLNGAGQG

SEQ ID NO: 2084518 - protein, 19 aa, Staphylococcus
SLVIFANKIDLNELILLGK

SEQ ID NO: 2084519 - protein, 19 aa, Staphylococcus
SLVIFANKIQLNELILLGK

SEQ ID NO: 2084520 - protein, 23 aa, Staphylococcus
SLVLFIMICTGCRISGALNLKRE

SEQ ID NO: 2084521 - protein, 20 aa, Staphylococcus
SLVPFEWITKYQSNIAIVFK

SEQ ID NO: 2084522 - protein, 22 aa, Staphylococcus
SLVQRHFQIGYNRAARIIDQLE

SEQ ID NO: 2084523 - protein, 23 aa, Staphylococcus
SLVQRHFQIGYNRAARIIDQLEQ

SEQ ID NO: 2084524 - protein, 18 aa, Staphylococcus
SLVQYLMLEQGLREFIIC

SEQ ID NO: 2084525 - protein, 34 aa, Staphylococcus
SLVSYLLNITTIDPLRYNLLFERFLNPERVTMPD

SEQ ID NO: 2084526 - protein, 28 aa, Staphylococcus
SLYPSCRMAYIVLPNKLLKLFREMQYVE

SEQ ID NO: 2084527 - protein, 26 aa, Staphylococcus
SLYYKHDGILPKALLRAIFQDIFNTE

SEQ ID NO: 2084528 - protein, 22 aa, Staphylococcus
SMAEWDVMNIIWDKKSVSANEI

SEQ ID NO: 2084529 - protein, 17 aa, Staphylococcus
SMAKEALLPYFINGENT

SEQ ID NO: 2084530 - protein, 25 aa, Staphylococcus
SMALRYEMIISRLKYANDIILINEH

SEQ ID NO: 2084531 - protein, 19 aa, Staphylococcus
SMCGPKFCSMKLSHDIRDS

SEQ ID NO: 2084532 - protein, 25 aa, Staphylococcus
SMCLLYALTHLYRDTYRKLTCLHVN

SEQ ID NO: 2084533 - protein, 18 aa, Staphylococcus
SMDINHISSYGLILEPKT

SEQ ID NO: 2084534 - protein, 18 aa, Staphylococcus
SMDPYLRNGMRKNDPYIT

SEQ ID NO: 2084535 - protein, 26 aa, Staphylococcus
SMDVHTLFFMFRVTVTSFATQIQVPN

SEQ ID NO: 2084536 - protein, 26 aa, Staphylococcus
SMEEEQLYLIWNKSSVTRSLYTETWC

SEQ ID NO: 2084537 - protein, 28 aa, Staphylococcus
SMEIPHDIFTPIFAVSRTAGWTAHILEQ

SEQ ID NO: 2084538 - protein, 17 aa, Staphylococcus
SMEKALNRIQRLEKPLL

SEQ ID NO: 2084539 - protein, 21 aa, Staphylococcus
SMEMIVAILGILKSGAGYLPI

SEQ ID NO: 2084540 - protein, 23 aa, Staphylococcus
SMGAMALFGEKYGDIVRVVNMAP

SEQ ID NO: 2084541 - protein, 27 aa, Staphylococcus
SMGKKLAMHIIPYPPGIPVYLKGERIT

SEQ ID NO: 2084542 - protein, 17 aa, Staphylococcus
SMGLSSIMKAKRIILLA

SEQ ID NO: 2084543 - protein, 25 aa, Staphylococcus
SMHHQYLNGIYYYYMMDRAARVATF

SEQ ID NO: 2084544 - protein, 20 aa, Staphylococcus
SMHLAYLYPQAIILLQPQSY

SEQ ID NO: 2084545 - protein, 20 aa, Staphylococcus
SMICIGFVDVYMKLATEIPE

SEQ ID NO: 2084546 - protein, 24 aa, Staphylococcus
SMIKTDLEIPPFIQALTSIEEDML

SEQ ID NO: 2084547 - protein, 26 aa, Staphylococcus
SMIRPYEGHLWIMDPIDGTANLVKQQ

SEQ ID NO: 2084548 - protein, 24 aa, Staphylococcus
SMIRTDLEIPPFIQALTSIEEDML

SEQ ID NO: 2084549 - protein, 24 aa, Staphylococcus
SMIRTDLEIPPFIQALTSIEETML

SEQ ID NO: 2084550 - protein, 26 aa, Staphylococcus
SMIYVDTGAMYRAITYKYLQEDKNDD

SEQ ID NO: 2084551 - protein, 24 aa, Staphylococcus
SMKEIDYKIFPKADWVVVDDLEGV

SEQ ID NO: 2084552 - protein, 26 aa, Staphylococcus
SMKFSRMPVSLNYFAWMQHMSTLDEM

SEQ ID NO: 2084553 - protein, 27 aa, Staphylococcus
SMKRIDVEKFLLYDDFSKVKVWIKEQL

SEQ ID NO: 2084554 - protein, 22 aa, Staphylococcus
SMLDFSKVFYVGTGLIGELTKE

SEQ ID NO: 2084555 - protein, 25 aa, Staphylococcus
SMLHEPELLILDEPFSGLDPVNVEL

SEQ ID NO: 2084556 - protein, 25 aa, Staphylococcus
SMLHQPELLILDEPFSGLDPVNVEL

SEQ ID NO: 2084557 - protein, 19 aa, Staphylococcus
SMLIKKNQATLYAGCGIIE

SEQ ID NO: 2084558 - protein, 17 aa, Staphylococcus
SMLIKQNQTTLFAGCGI

SEQ ID NO: 2084559 - protein, 22 aa, Staphylococcus
SMLPKIQAAIEFAKTGKEAIIC

SEQ ID NO: 2084560 - protein, 23 aa, Staphylococcus
SMMGYSPGFPYLTGMHKKLHVNH

SEQ ID NO: 2084561 - protein, 19 aa, Staphylococcus
SMMIFTNFFRDQMDRFGEI

SEQ ID NO: 2084562 - protein, 33 aa, Staphylococcus
SMMYSLQAGGKRIRPVLLLLTLNMLNEDYHKGF

SEQ ID NO: 2084563 - protein, 29 aa, Staphylococcus
SMNIKHDLFTPIFAVSRTSGWIAHILEQY

SEQ ID NO: 2084564 - protein, 26 aa, Staphylococcus
SMNKLKPFLSIISHPKSFYSLVTMDE

SEQ ID NO: 2084565 - protein, 26 aa, Staphylococcus
SMNLVHKIYELWNIPIIFVTHSNEEA

SEQ ID NO: 2084566 - protein, 26 aa, Staphylococcus
SMPEQSYLYSLPYQYYKDYGIRKYGF

SEQ ID NO: 2084567 - protein, 18 aa, Staphylococcus
SMPGMMDTILNLGLNDDN

SEQ ID NO: 2084568 - protein, 20 aa, Staphylococcus
SMPGMMDTILNLGLNDENVK

SEQ ID NO: 2084569 - protein, 19 aa, Staphylococcus
SMPQLGFNAISPLVKFVYK

SEQ ID NO: 2084570 - protein, 17 aa, Staphylococcus
SMPVKLNNIIKFSSKPV

SEQ ID NO: 2084571 - protein, 25 aa, Staphylococcus
SMQTVLYQILVDMTKLLAPILVHTA

SEQ ID NO: 2084572 - protein, 23 aa, Staphylococcus
SMRKFIGILGDFHQLYPNITYNL

SEQ ID NO: 2084573 - protein, 22 aa, Staphylococcus
SMRKYLNVSIAISKIALRYVPA

SEQ ID NO: 2084574 - protein, 19 aa, Staphylococcus
SMRPLVVMSPKSLLRNKTV

SEQ ID NO: 2084575 - protein, 24 aa, Staphylococcus
SMSKTRFLELFDIGLEQLEFIMIP

SEQ ID NO: 2084576 - protein, 24 aa, Staphylococcus
SMSQSPMLLKNGRFGFKMGNQTLE

SEQ ID NO: 2084577 - protein, 26 aa, Staphylococcus
SMTDSPYAIFLYLTRHKAYQHLHHIW

SEQ ID NO: 2084578 - protein, 17 aa, Staphylococcus
SMTILKDIKETLSISET

SEQ ID NO: 2084579 - protein, 25 aa, Staphylococcus
SMTQGMIGFWIETEVNRVLAEIKSP

SEQ ID NO: 2084580 - protein, 30 aa, Staphylococcus
SMVDTNIKGLLYSLNAILPKFEAQGSGHVV

SEQ ID NO: 2084581 - protein, 22 aa, Staphylococcus
SMVLIDLIYQIKPDAQIVFLDT

SEQ ID NO: 2084582 - protein, 27 aa, Staphylococcus
SMYDGITSFAEACILAFNHTKKNKIVV

SEQ ID NO: 2084583 - protein, 25 aa, Staphylococcus
SMYDGITSFAEACILAFNQTRKNKI

SEQ ID NO: 2084584 - protein, 18 aa, Staphylococcus
SMYPSLWENMGVSYSDLI

SEQ ID NO: 2084585 - protein, 18 aa, Staphylococcus
SMYWNSNNYIWVTPTDIN

SEQ ID NO: 2084586 - protein, 27 aa, Staphylococcus
SNAEFEKHIYAIHTLTSLVSDNSSSKK

SEQ ID NO: 2084587 - protein, 25 aa, Staphylococcus
SNAIGTFYPFIKDEVQLYGVEAAGE

SEQ ID NO: 2084588 - protein, 26 aa, Staphylococcus
SNAIGTFYPFIKDKVKLYGVEAAGQG

SEQ ID NO: 2084589 - protein, 25 aa, Staphylococcus
SNAIGTFYPFIKDNVKLYGVEAAGR

SEQ ID NO: 2084590 - protein, 25 aa, Staphylococcus
SNAIGTFYPFVKDDVKLYGVEAAGD

SEQ ID NO: 2084591 - protein, 24 aa, Staphylococcus
SNAKIVEFGGWAMPVQFSSIKEEH

SEQ ID NO: 2084592 - protein, 23 aa, Staphylococcus
SNAKLNFLKLKEILMEWQIGIYQ

SEQ ID NO: 2084593 - protein, 22 aa, Staphylococcus
SNALFQAYISKEPIEFVSKTYN

SEQ ID NO: 2084594 - protein, 24 aa, Staphylococcus
SNALKLKAFFNSDVPVHRGSAKPL

SEQ ID NO: 2084595 - protein, 17 aa, Staphylococcus
SNAWYFGEGGNKLTIDQ

SEQ ID NO: 2084596 - protein, 17 aa, Staphylococcus
SNCLMYNNYLRYQWTIK

SEQ ID NO: 2084597 - protein, 23 aa, Staphylococcus
SNDARFKRWVIGSIISRTYYHNM

SEQ ID NO: 2084598 - protein, 23 aa, Staphylococcus
SNDDYFYQSILHYIKYDQANAQL

SEQ ID NO: 2084599 - protein, 20 aa, Staphylococcus
SNDELGERLAFISNSTGGVL

SEQ ID NO: 2084600 - protein, 25 aa, Staphylococcus
SNDEPVQHLGFKALYQIATIPEDKR

SEQ ID NO: 2084601 - protein, 23 aa, Staphylococcus
SNDFFTIVKWEISGTLNYMKPRE

SEQ ID NO: 2084602 - protein, 17 aa, Staphylococcus
SNDFFTMVKWEISGTLN

SEQ ID NO: 2084603 - protein, 18 aa, Staphylococcus
SNDLVLAKKLEALGVHAV

SEQ ID NO: 2084604 - protein, 24 aa, Staphylococcus
SNDPKFKRWVIGSILSRTYYHNMI

SEQ ID NO: 2084605 - protein, 23 aa, Staphylococcus
SNDPMIILGQLMTSIQSIVSRNI

SEQ ID NO: 2084606 - protein, 25 aa, Staphylococcus
SNDPVLFFEHKKAYRFLKEEVPDSY

SEQ ID NO: 2084607 - protein, 25 aa, Staphylococcus
SNDPVLFFEHKKAYRFLKEEVPEGY

SEQ ID NO: 2084608 - protein, 24 aa, Staphylococcus
SNDPVLYFEHKKAYRFLKEEVPED

SEQ ID NO: 2084609 - protein, 31 aa, Staphylococcus
SNDVSALKIMKWLHDLHFHIPYDVQVIGYDD

SEQ ID NO: 2084610 - protein, 29 aa, Staphylococcus
SNDYPVDAAIFNLGYLPKGDKHIVTEADT

SEQ ID NO: 2084611 - protein, 23 aa, Staphylococcus
SNEFEMEPLILTLKPGASYKNFK

SEQ ID NO: 2084612 - protein, 26 aa, Staphylococcus
SNEIAQFWIQQMLNNGLLEDVVYQKE

SEQ ID NO: 2084613 - protein, 27 aa, Staphylococcus
SNEKEMFTYFFDFYFNDQDIVFNDARL

SEQ ID NO: 2084614 - protein, 23 aa, Staphylococcus
SNEKYRTWDWNYGKNPKYNFERD

SEQ ID NO: 2084615 - protein, 18 aa, Staphylococcus
SNELSPIQKWFFETQKED

SEQ ID NO: 2084616 - protein, 26 aa, Staphylococcus
SNEQLKQVVIAYEPIWAIGTGKSSTS

SEQ ID NO: 2084617 - protein, 30 aa, Staphylococcus
SNEQQFEKHIYAIHTLTSLYTTTTSGHRAS

SEQ ID NO: 2084618 - protein, 26 aa, Staphylococcus
SNEVTYDKLFLSPGGKPVTPPIDGID

SEQ ID NO: 2084619 - protein, 31 aa, Staphylococcus; identical to SEQ ID NO: 1832464

SEQ ID NO: 2084620 - protein, 20 aa, Staphylococcus
SNFSHLSPFLDFIKEDVTVE

SEQ ID NO: 2084621 - protein, 25 aa, Staphylococcus
SNFTTGWIFFINEEGDHELVSSVDL

SEQ ID NO: 2084622 - protein, 20 aa, Staphylococcus
SNGDLIIITAGVPTGEKGTT

SEQ ID NO: 2084623 - protein, 31 aa, Staphylococcus
SNGIKCVMIAKLPFMNKYNTKHWLMDSEFES

SEQ ID NO: 2084624 - protein, 31 aa, Staphylococcus
SNGIKCVMIAKLPFMNKYNTKYWLMDSEFKS

SEQ ID NO: 2084625 - protein, 30 aa, Staphylococcus
SNGIKCVMIAKLPFMNQNNTKYWLMESEFT

SEQ ID NO: 2084626 - protein, 23 aa, Staphylococcus
SNGKMYYDHILLATGFENTVMSQ

SEQ ID NO: 2084627 - protein, 28 aa, Staphylococcus
SNGKQLLKKLNAFGYTEADVRQALGLEK

SEQ ID NO: 2084628 - protein, 25 aa, Staphylococcus
SNGKQLLKKLNAFGYTEEDVRRALN

SEQ ID NO: 2084629 - protein, 26 aa, Staphylococcus
SNGKQLLKKLNAFGYTEEDVRRALSM

SEQ ID NO: 2084630 - protein, 25 aa, Staphylococcus
SNGKQLLKKLNAFGYTEQDVREALL

SEQ ID NO: 2084631 - protein, 24 aa, Staphylococcus
SNGKQLLKKLNAFGYTESDVREAL

SEQ ID NO: 2084632 - protein, 32 aa, Staphylococcus; identical to SEQ ID NO: 1688736

SEQ ID NO: 2084633 - protein, 26 aa, Staphylococcus
SNGMQTLGVALPWAISAALVRPNTQV

SEQ ID NO: 2084634 - protein, 27 aa, Staphylococcus
SNGMQTLGVALPWAISAALVRPNTQVV

SEQ ID NO: 2084635 - protein, 24 aa, Staphylococcus
SNGRWARNFVQELLVRHKNKVIQT

SEQ ID NO: 2084636 - protein, 19 aa, Staphylococcus
SNGVKRFKFKDNKSELELD

SEQ ID NO: 2084637 - protein, 31 aa, Staphylococcus
SNHLLNIIERYKSLPILGVCLGAQAITCYYG

SEQ ID NO: 2084638 - protein, 24 aa, Staphylococcus
SNHPMLRPRHIQRSGYLVITSDKG

SEQ ID NO: 2084639 - protein, 18 aa, Staphylococcus
SNIGGASGPLYGFSFVKM

SEQ ID NO: 2084640 - protein, 23 aa, Staphylococcus
SNIGIKYLTLYAFSTENWSRPES

SEQ ID NO: 2084641 - protein, 28 aa, Staphylococcus
SNIKDHIVFLGFDYGFRGNSRYLFNHFA

SEQ ID NO: 2084642 - protein, 18 aa, Staphylococcus
SNIKVYVVIGQLTQLIKG

SEQ ID NO: 2084643 - protein, 17 aa, Staphylococcus
SNIWQSLHKKNGALFPI

SEQ ID NO: 2084644 - protein, 23 aa, Staphylococcus
SNKDVPKLYFTSHMDTVVPGLDI

SEQ ID NO: 2084645 - protein, 34 aa, Staphylococcus
SNKKLANFRKKQLGFIFQDYSVLPTLTVKENIML

SEQ ID NO: 2084646 - protein, 22 aa, Staphylococcus
SNKQLFLGSGIGVTPLVSMFNE

SEQ ID NO: 2084647 - protein, 17 aa, Staphylococcus
SNKRYFIFIGKINSYSG

SEQ ID NO: 2084648 - protein, 23 aa, Staphylococcus
SNKTFYLLDILQKLPIDKMNHFN

SEQ ID NO: 2084649 - protein, 25 aa, Staphylococcus
SNKTILDYLWDQYPTMNEKDIRAVL

SEQ ID NO: 2084650 - protein, 23 aa, Staphylococcus
SNKTLYLLNILQQLPIEKMNQLS

SEQ ID NO: 2084651 - protein, 33 aa, Staphylococcus
SNKVFKKYKLTYPQFLVLTILWEDSPVNVKKVV

SEQ ID NO: 2084652 - protein, 24 aa, Staphylococcus
SNKVRPLFEAHQVATILIVGGSGD

SEQ ID NO: 2084653 - protein, 24 aa, Staphylococcus
SNKVRPLVSFYLDDGYQNDYDVVF

SEQ ID NO: 2084654 - protein, 20 aa, Staphylococcus
SNLDYTIIRPGWLTDKNENV

SEQ ID NO: 2084655 - protein, 23 aa, Staphylococcus
SNLGTLYKLMNKKQGLILLSGPT

SEQ ID NO: 2084656 - protein, 20 aa, Staphylococcus
SNLKYYYRDYYGSDVYTIEL

SEQ ID NO: 2084657 - protein, 17 aa, Staphylococcus
SNLLLATGNYRKPGSGA

SEQ ID NO: 2084658 - protein, 20 aa, Staphylococcus
SNLLSGVTVDYYGAPTPVQQ

SEQ ID NO: 2084659 - protein, 25 aa, Staphylococcus
SNLMAAMIAVWSKGIDFKDIVEVVK

SEQ ID NO: 2084660 - protein, 21 aa, Staphylococcus
SNLTIKQLFIIEPERTEQALI

SEQ ID NO: 2084661 - protein, 26 aa, Staphylococcus
SNLVMPSIPVFYFYSEDENFFKCYFD

SEQ ID NO: 2084662 - protein, 34 aa, Staphylococcus
SNMAINLLLREDTTFAKALLFAPLYPADIENVRD

SEQ ID NO: 2084663 - protein, 24 aa, Staphylococcus
SNMALTECDLLINLGSHFDDRLAS

SEQ ID NO: 2084664 - protein, 28 aa, Staphylococcus
SNMALTECDLLINLGSRFDDRLASKPDA

SEQ ID NO: 2084665 - protein, 22 aa, Staphylococcus
SNMDKIIKFEFKKDSKGFSFAI

SEQ ID NO: 2084666 - protein, 27 aa, Staphylococcus
SNMGLSPMMRLFKTNILSNQFKNSSYL

SEQ ID NO: 2084667 - protein, 24 aa, Staphylococcus
SNNDWHCPITIRSPFGGGIHGALY

SEQ ID NO: 2084668 - protein, 25 aa, Staphylococcus
SNNDWNVPLTIRAPFGGGIHGGLYH

SEQ ID NO: 2084669 - protein, 26 aa, Staphylococcus
SNNELNRLLKIYSTTGKILVNKGGFS

SEQ ID NO: 2084670 - protein, 17 aa, Staphylococcus
SNNKMLQRIYGTAFFDK

SEQ ID NO: 2084671 - protein, 24 aa, Staphylococcus
SNNKMLQRIYGTAFFDKKDLKAHL

SEQ ID NO: 2084672 - protein, 23 aa, Staphylococcus
SNNLSQSYIPKHQFRFLESDAEM

SEQ ID NO: 2084673 - protein, 28 aa, Staphylococcus
SNNMKIHKFFVIVLKYIQRKKAFFHAVF

SEQ ID NO: 2084674 - protein, 26 aa, Staphylococcus
SNNRTLKAEVFLREQFKRLEREQIFV

SEQ ID NO: 2084675 - protein, 26 aa, Staphylococcus
SNNYDLIILDLMLPNINGLEICRRVR

SEQ ID NO: 2084676 - protein, 26 aa, Staphylococcus
SNNYQEYILPRFIAECIKFGGYGGLV

SEQ ID NO: 2084677 - protein, 32 aa, Staphylococcus
SNPEQYIHKIKYAGAMFLGPYAPEALGDYNAG

SEQ ID NO: 2084678 - protein, 31 aa, Staphylococcus
SNPPHKVIPISFFKKLIFIGVIRFRYANMQK

SEQ ID NO: 2084679 - protein, 21 aa, Staphylococcus
SNPPMIMISTGRLNGKRKDTS

SEQ ID NO: 2084680 - protein, 17 aa, Staphylococcus
SNPYKVPDFLEDLYLDG

SEQ ID NO: 2084681 - protein, 19 aa, Staphylococcus
SNQALRLVLERAKTYSVPN

SEQ ID NO: 2084682 - protein, 24 aa, Staphylococcus
SNQIQRNFYHIQGQTRNCIAILHE

SEQ ID NO: 2084683 - protein, 21 aa, Staphylococcus
SNQLCFLLYVTSKEVIKKYTY

SEQ ID NO: 2084684 - protein, 23 aa, Staphylococcus
SNQLGGYPLFMQADPRAYDKGLR

SEQ ID NO: 2084685 - protein, 22 aa, Staphylococcus
SNQRIMLAFYDTSQNYKMEYQS

SEQ ID NO: 2084686 - protein, 22 aa, Staphylococcus
SNQTYYIICAAGARSARVVQYL

SEQ ID NO: 2084687 - protein, 22 aa, Staphylococcus
SNQYVLTFCDDLMKALKQHIAK

SEQ ID NO: 2084688 - protein, 22 aa, Staphylococcus
SNREIILFAPTWRGNNVNKPED

SEQ ID NO: 2084689 - protein, 22 aa, Staphylococcus
SNRQPIHLLQRNGKIREISSQS

SEQ ID NO: 2084690 - protein, 29 aa, Staphylococcus
SNSGIIDRYFFKSLYYRHNKIMYEFATEA

SEQ ID NO: 2084691 - protein, 20 aa, Staphylococcus
SNSKFIYCDFTQSIFDDVHF

SEQ ID NO: 2084692 - protein, 35 aa, Staphylococcus
SNSLTPNNYFLLLWSLTLKYLFGKNDILFGVTTSG

SEQ ID NO: 2084693 - protein, 25 aa, Staphylococcus
SNTCKTFNIPLYIDGARLGYGLVSD

SEQ ID NO: 2084694 - protein, 25 aa, Staphylococcus
SNTNTSMFLITPKYDKPGLLASILN

SEQ ID NO: 2084695 - protein, 28 aa, Staphylococcus
SNTPIQSYVFIYILIITGGRFGEVQRLC

SEQ ID NO: 2084696 - protein, 18 aa, Staphylococcus
SNVAWFWHTSYSHRNEQA

SEQ ID NO: 2084697 - protein, 25 aa, Staphylococcus
SNVQRMHWGFEDPAGKDWSKFQEVR

SEQ ID NO: 2084698 - protein, 20 aa, Staphylococcus
SNVRFVIHYNMPGDLESYYQ

SEQ ID NO: 2084699 - protein, 24 aa, Staphylococcus
SNWHINAMMRLLKTNVLTDQFKNS

SEQ ID NO: 2084700 - protein, 24 aa, Staphylococcus
SNWNINAMLRLFKTNVLTSQFKNS

SEQ ID NO: 2084701 - protein, 19 aa, Staphylococcus
SNWSQFMDNFTIAIVQAIQ

SEQ ID NO: 2084702 - protein, 23 aa, Staphylococcus
SNYDTFLVANIINRAMFNQIIRK

SEQ ID NO: 2084703 - protein, 24 aa, Staphylococcus
SNYEVCILKMQLLIWITETDTGDI

SEQ ID NO: 2084704 - protein, 20 aa, Staphylococcus
SNYHIGAAYFLKLNDMSFEE

SEQ ID NO: 2084705 - protein, 24 aa, Staphylococcus
SNYQALTALGANVKFAAPGEWVDE

SEQ ID NO: 2084706 - protein, 20 aa, Staphylococcus
SNYQIDYQLPLKFLEHVQSG

SEQ ID NO: 2084707 - protein, 18 aa, Staphylococcus
SPAFNEAKLKDPVPAKIY

SEQ ID NO: 2084708 - protein, 23 aa, Staphylococcus
SPAQFECNCSHEKFLNAIKGLGE

SEQ ID NO: 2084709 - protein, 21 aa, Staphylococcus
SPAQVIIRWNIQHGVVVIPKS

SEQ ID NO: 2084710 - protein, 25 aa, Staphylococcus
SPASYALILKYYPVKRDEVLFVSSN

SEQ ID NO: 2084711 - protein, 30 aa, Staphylococcus
SPDCLMIFQHHNLFPWKNIYDNIRIGLNKR

SEQ ID NO: 2084712 - protein, 26 aa, Staphylococcus
SPDGKYIFEAIYGAGLARIYEANPET

SEQ ID NO: 2084713 - protein, 26 aa, Staphylococcus
SPDSTTFYAHFPKKGMYKIWAEFKFN

SEQ ID NO: 2084714 - protein, 26 aa, Staphylococcus
SPEEIYNIVVYQLGALNGFCQIHDVK

SEQ ID NO: 2084715 - protein, 21 aa, Staphylococcus
SPEERLYRRYANQIRNWDKEE

SEQ ID NO: 2084716 - protein, 18 aa, Staphylococcus
SPEFEKVIPLKIMLIHKD

SEQ ID NO: 2084717 - protein, 17 aa, Staphylococcus
SPEIGLATVYRTLELLA

SEQ ID NO: 2084718 - protein, 17 aa, Staphylococcus
SPELFFQKGPFDGQDNV

SEQ ID NO: 2084719 - protein, 21 aa, Staphylococcus
SPELLMMHLLGETKRIKLGSG

SEQ ID NO: 2084720 - protein, 19 aa, Staphylococcus
SPFMGTYEKVADLIIEWFE

SEQ ID NO: 2084721 - protein, 21 aa, Staphylococcus
SPFPLSQIKGLGPKRLAVLNE

SEQ ID NO: 2084722 - protein, 25 aa, Staphylococcus
SPGPIETPLLMEWLVSDEEAKAVRL

SEQ ID NO: 2084723 - protein, 26 aa, Staphylococcus
SPHMASELEFYLFNDSFKDINTQGYD

SEQ ID NO: 2084724 - protein, 19 aa, Staphylococcus
SPHVWFKDALDGYDFLVEH

SEQ ID NO: 2084725 - protein, 17 aa, Staphylococcus
SPIRLVVVIQAPQAFIS

SEQ ID NO: 2084726 - protein, 29 aa, Staphylococcus
SPIRRYPDLIVHRLIRKYIIEQSMDRKEK

SEQ ID NO: 2084727 - protein, 28 aa, Staphylococcus
SPIRRYPDLTVHRLIRKYLIDNSMNNKE

SEQ ID NO: 2084728 - protein, 28 aa, Staphylococcus
SPIRRYPDLTVHRLIRKYLIEHSMDKKE

SEQ ID NO: 2084729 - protein, 28 aa, Staphylococcus
SPIRRYPDLTVHRLIRKYLIEHSMDSKT

SEQ ID NO: 2084730 - protein, 29 aa, Staphylococcus
SPIRRYPDLTVHRLIRKYLIENSMDKKEL

SEQ ID NO: 2084731 - protein, 28 aa, Staphylococcus
SPIRRYPDLTVHRLIRKYLVDHSMNHKE

SEQ ID NO: 2084732 - protein, 18 aa, Staphylococcus
SPKFVVGYVKTKEKHPNA

SEQ ID NO: 2084733 - protein, 25 aa, Staphylococcus
SPKGIHKWAALKMLGIDKGDYIAFG

SEQ ID NO: 2084734 - protein, 20 aa, Staphylococcus
SPLSAFRGFFGSKPYSRTNE

SEQ ID NO: 2084735 - protein, 19 aa, Staphylococcus
SPLSAYRGFFGSKPYSRTN

SEQ ID NO: 2084736 - protein, 19 aa, Staphylococcus
SPLVLPKHHTCLITPVNHN

SEQ ID NO: 2084737 - protein, 23 aa, Staphylococcus
SPMGCQTGFYVSFINHDDYDDVL

SEQ ID NO: 2084738 - protein, 23 aa, Staphylococcus
SPMGCQTGFYVSFINHDDYEDVL

SEQ ID NO: 2084739 - protein, 24 aa, Staphylococcus
SPMGCQTGFYVSFINHDDYNDVLN

SEQ ID NO: 2084740 - protein, 24 aa, Staphylococcus
SPMGCQTGFYVSLINHDDYEDVLN

SEQ ID NO: 2084741 - protein, 22 aa, Staphylococcus
SPMTAYGIYIAMKRTAKEKFDD

SEQ ID NO: 2084742 - protein, 20 aa, Staphylococcus
SPNDLYTWSSGIKSPIYCDN

SEQ ID NO: 2084743 - protein, 20 aa, Staphylococcus
SPNDPFTWSSGIKSPIYCDN

SEQ ID NO: 2084744 - protein, 27 aa, Staphylococcus
SPNFSYVFPYMMQFIDQLPVVAHNAAF

SEQ ID NO: 2084745 - protein, 27 aa, Staphylococcus
SPNTLVSDIIYIPYKTSFLQQAEEKGN

SEQ ID NO: 2084746 - protein, 19 aa, Staphylococcus
SPRILGFDAVGTVQKTGTE

SEQ ID NO: 2084747 - protein, 24 aa, Staphylococcus
SPSKDNLAMLYREGFHICKGELFG

SEQ ID NO: 2084748 - protein, 26 aa, Staphylococcus
SPSMNIIPLTYHMDAWYFDAQKVADQ

SEQ ID NO: 2084749 - protein, 17 aa, Staphylococcus
SPSYALFKGTELKHFIP

SEQ ID NO: 2084750 - protein, 18 aa, Staphylococcus
SPSYALFKGTELKHFMPR

SEQ ID NO: 2084751 - protein, 19 aa, Staphylococcus
SPSYLLMAGLERAQGFYQN

SEQ ID NO: 2084752 - protein, 17 aa, Staphylococcus
SPSYLLMSSLELAHDFY

SEQ ID NO: 2084753 - protein, 18 aa, Staphylococcus
SPTALRFLKAAMNADTDG

SEQ ID NO: 2084754 - protein, 20 aa, Staphylococcus
SPTNQQFFILSEEKIQQLQQ

SEQ ID NO: 2084755 - protein, 23 aa, Staphylococcus
SPTNQQFFVLSDDKIKDLQSKVK

SEQ ID NO: 2084756 - protein, 25 aa, Staphylococcus
SPTVSIVNLYRRWSRGGAGLLMTGN

SEQ ID NO: 2084757 - protein, 24 aa, Staphylococcus
SPVRDAFKLLKQDQLICLERMGAD

SEQ ID NO: 2084758 - protein, 17 aa, Staphylococcus
SPVVFKLASEHQIDLTQ

SEQ ID NO: 2084759 - protein, 24 aa, Staphylococcus
SPWHSLIELQSIPNGYYYPEDSES

SEQ ID NO: 2084760 - protein, 19 aa, Staphylococcus
SPYDFQGLGVEGLKILKNT

SEQ ID NO: 2084761 - protein, 20 aa, Staphylococcus
SPYEHPSIAAALEPFRKQFE

SEQ ID NO: 2084762 - protein, 20 aa, Staphylococcus
SPYELFVISCPLDNGLEIFV

SEQ ID NO: 2084763 - protein, 22 aa, Staphylococcus
SPYELYQFWINTTDADVIKFLK

SEQ ID NO: 2084764 - protein, 23 aa, Staphylococcus
SPYPLQSIKGLGPKRIALLHELN

SEQ ID NO: 2084765 - protein, 23 aa, Staphylococcus
SPYPLQSIKGLGPKRIALLQELN

SEQ ID NO: 2084766 - protein, 28 aa, Staphylococcus
SPYYRDLAFVTYMGMKPLDTMLASFGKR

SEQ ID NO: 2084767 - protein, 39 aa, Staphylococcus
SQAFKGYMEGSQKNRFPWVVAAFPSKDWARRVYPDLDEE

SEQ ID NO: 2084768 - protein, 18 aa, Staphylococcus
SQAYLMQVALKYGQELKR

SEQ ID NO: 2084769 - protein, 25 aa, Staphylococcus
SQCKRAIILPNNKNIRMSSDQAATL

SEQ ID NO: 2084770 - protein, 28 aa, Staphylococcus
SQCLIDHPPEYFIVLATIGTIADLVSLT

SEQ ID NO: 2084771 - protein, 22 aa, Staphylococcus
SQDEMLAVINFFNKIEDYYERK

SEQ ID NO: 2084772 - protein, 22 aa, Staphylococcus
SQDGYILRFNFAGEETTEPIVS

SEQ ID NO: 2084773 - protein, 18 aa, Staphylococcus
SQDSYKKGFGPLLNNIHY

SEQ ID NO: 2084774 - protein, 18 aa, Staphylococcus
SQDVFPELKKLEGHTLMI

SEQ ID NO: 2084775 - protein, 23 aa, Staphylococcus
SQDVPTIIEIKTVIGFGAPNKEG

SEQ ID NO: 2084776 - protein, 31 aa, Staphylococcus
SQDWNDVTALTLYWTAILILQGNVKQHGLTN

SEQ ID NO: 2084777 - protein, 29 aa, Staphylococcus
SQEEVSQILKDRLTRERKKSDERIKDAVQ

SEQ ID NO: 2084778 - protein, 31 aa, Staphylococcus
SQEGYAMPMLLALSHVHQLLIREGLRMETSL

SEQ ID NO: 2084779 - protein, 23 aa, Staphylococcus
SQELDKLMLFLGDRPTINKDDVN

SEQ ID NO: 2084780 - protein, 24 aa, Staphylococcus
SQELEKIILFLGERPTINKKDVEE

SEQ ID NO: 2084781 - protein, 21 aa, Staphylococcus
SQELLDKYQIPVAPLSVIFDD

SEQ ID NO: 2084782 - protein, 25 aa, Staphylococcus
SQEMAELYEFLGLSVGLNLNSKTTT

SEQ ID NO: 2084783 - protein, 26 aa, Staphylococcus
SQETFPELKKLIGHTLMITDGTSLLG

SEQ ID NO: 2084784 - protein, 23 aa, Staphylococcus
SQETVIGFLVRLFQSQKRRTAET

SEQ ID NO: 2084785 - protein, 25 aa, Staphylococcus
SQFGEKLILPALFPSKFQTIKIPKD

SEQ ID NO: 2084786 - protein, 21 aa, Staphylococcus
SQFISEYLPETSLTLDIKAIS

SEQ ID NO: 2084787 - protein, 39 aa, Staphylococcus
SQGDIPNFDKLKARLILMITRFSLYLRKATPEAKNQLMK

SEQ ID NO: 2084788 - protein, 34 aa, Staphylococcus
SQGDQQLMLRLIQPKFFLPIHGEYRMLTAHGQTG

SEQ ID NO: 2084789 - protein, 33 aa, Staphylococcus; identical to SEQ ID NO: 1819422

SEQ ID NO: 2084790 - protein, 33 aa, Staphylococcus
SQGDQQLMLRLIRPKFFMPIHGEYRMLKAHSQT

SEQ ID NO: 2084791 - protein, 24 aa, Staphylococcus
SQGLLEGYKELGLDAYFAIPKSKE

SEQ ID NO: 2084792 - protein, 23 aa, Staphylococcus
SQGNKNIILCERGIRTYEKATRN

SEQ ID NO: 2084793 - protein, 23 aa, Staphylococcus
SQGNSNIILCERGIRTYEKATRN

SEQ ID NO: 2084794 - protein, 17 aa, Staphylococcus
SQGRVDEILNAKPADRR

SEQ ID NO: 2084795 - protein, 25 aa, Staphylococcus
SQGSIFHIPIVIKGLTTYINEFDGP

SEQ ID NO: 2084796 - protein, 23 aa, Staphylococcus
SQGSVFHLPIISQDIKEFVQDFD

SEQ ID NO: 2084797 - protein, 26 aa, Staphylococcus
SQHEFEKHMYAIHTITSLYTTSSTQS

SEQ ID NO: 2084798 - protein, 26 aa, Staphylococcus
SQHLEILNRLFTPLIGPQAIGLYHFM

SEQ ID NO: 2084799 - protein, 24 aa, Staphylococcus
SQINSKYLIATTAAKRARELDEKP

SEQ ID NO: 2084800 - protein, 18 aa, Staphylococcus
SQIRSYVFHPYAMVKDHR

SEQ ID NO: 2084801 - protein, 23 aa, Staphylococcus
SQISRLPLIVLTSDRPHELRSVG

SEQ ID NO: 2084802 - protein, 23 aa, Staphylococcus
SQITRFFTGIEIHPGAQIGRRLF

SEQ ID NO: 2084803 - protein, 23 aa, Staphylococcus
SQKALMLPPGLAFAAYSDRAKDR

SEQ ID NO: 2084804 - protein, 24 aa, Staphylococcus
SQKKFVLGSVSHKVAKRATIPVLI

SEQ ID NO: 2084805 - protein, 17 aa, Staphylococcus
SQKLKLYVYQERQNKNI

SEQ ID NO: 2084806 - protein, 34 aa, Staphylococcus
SQKLTLENYVLIYYLEKIIAQANLRLATMSGQRY

SEQ ID NO: 2084807 - protein, 34 aa, Staphylococcus
SQKLTLETYVLIYYLERIIAQANLRLATMSGQRY

SEQ ID NO: 2084808 - protein, 28 aa, Staphylococcus
SQKNAFPWVVAAFPSKAWAKRVYPNLPE

SEQ ID NO: 2084809 - protein, 27 aa, Staphylococcus
SQKNQFPWVVAAFPSKAWAHRVYPDLS

SEQ ID NO: 2084810 - protein, 35 aa, Staphylococcus
SQKTAYALPILLATSYIHQLLIKENLRMNTSIVAY

SEQ ID NO: 2084811 - protein, 18 aa, Staphylococcus
SQLFPLPLVMGCEGVSAA

SEQ ID NO: 2084812 - protein, 17 aa, Staphylococcus
SQLLKLMEGDVVLTASY

SEQ ID NO: 2084813 - protein, 34 aa, Staphylococcus
SQLLNRGPRRVSPFFVPMLIPDMATGQVSIDLGA

SEQ ID NO: 2084814 - protein, 25 aa, Staphylococcus
SQLPDIKYYPISSGKLRRYLSFENA

SEQ ID NO: 2084815 - protein, 31 aa, Staphylococcus
SQLPMIATIEKLMAYLKQRHIPMAIATSSHR

SEQ ID NO: 2084816 - protein, 18 aa, Staphylococcus
SQLPQLFGFQAEGASPIV

SEQ ID NO: 2084817 - protein, 18 aa, Staphylococcus
SQLPRLFGFQAEGASPIV

SEQ ID NO: 2084818 - protein, 26 aa, Staphylococcus
SQLRNFLYRNGLFEASYWSVFDAIQG

SEQ ID NO: 2084819 - protein, 22 aa, Staphylococcus
SQLVGLGPRILRAETAPLYTLG

SEQ ID NO: 2084820 - protein, 25 aa, Staphylococcus
SQLYNVHIGFWIYNLSRDVVEPTIN

SEQ ID NO: 2084821 - protein, 24 aa, Staphylococcus
SQNIKYILYVKQQLQDYPMCVEFR

SEQ ID NO: 2084822 - protein, 18 aa, Staphylococcus
SQNLAYIGFINDDTNEVG

SEQ ID NO: 2084823 - protein, 20 aa, Staphylococcus
SQNLIIPIYGKAESLNVAIA

SEQ ID NO: 2084824 - protein, 21 aa, Staphylococcus
SQPFSIEKILLGGAKLSSTLI

SEQ ID NO: 2084825 - protein, 36 aa, Staphylococcus
SQPTIPVFKQGYQLYFKFVMPIFGKLFAKSKEEYEW

SEQ ID NO: 2084826 - protein, 34 aa, Staphylococcus
SQPTLPLFKQVYSLYFKFVMPIFGKMFAKSKEEY

SEQ ID NO: 2084827 - protein, 24 aa, Staphylococcus
SQQEIPIYIDDLVIIFTDGVTEAR

SEQ ID NO: 2084828 - protein, 27 aa, Staphylococcus
SQQEIREIIQFIKNYVQSHTFIESLVL

SEQ ID NO: 2084829 - protein, 25 aa, Staphylococcus
SQQFKRLRRFFKIYVKGIKGASQLR

SEQ ID NO: 2084830 - protein, 27 aa, Staphylococcus
SQQLLDTDVLVCTVIGFPLGATTTDVK

SEQ ID NO: 2084831 - protein, 22 aa, Staphylococcus
SQQLLSLYHSLPKLKYQTFERL

SEQ ID NO: 2084832 - protein, 19 aa, Staphylococcus
SQQLLSLYHSLPNLKYPSF

SEQ ID NO: 2084833 - protein, 23 aa, Staphylococcus
SQQLLSLYHSLPNLKYPTFERFI

SEQ ID NO: 2084834 - protein, 18 aa, Staphylococcus
SQQLPISEAVFAKLKSFG

SEQ ID NO: 2084835 - protein, 23 aa, Staphylococcus
SQQNQIFYLERISDNIRHYHTPQ

SEQ ID NO: 2084836 - protein, 32 aa, Staphylococcus
SQQPMILFGHMSPFMIVGMIGAIKAGCGYVPI

SEQ ID NO: 2084837 - protein, 25 aa, Staphylococcus
SQQTEVTVFFLNGFQMKGVIEDFDK

SEQ ID NO: 2084838 - protein, 18 aa, Staphylococcus
SQRLIHMRRRRGEIDFDI

SEQ ID NO: 2084839 - protein, 19 aa, Staphylococcus
SQRNYICFFEKSKVKPEHY

SEQ ID NO: 2084840 - protein, 20 aa, Staphylococcus
SQRPFIMKSLYNNKKLKKYE

SEQ ID NO: 2084841 - protein, 23 aa, Staphylococcus
SQSFIQYLTKQLNVAFLTYRKCI

SEQ ID NO: 2084842 - protein, 20 aa, Staphylococcus
SQSLLQHVAGLSPQIAQNII

SEQ ID NO: 2084843 - protein, 22 aa, Staphylococcus
SQSLYNMFATIPGVKVVVPSNP

SEQ ID NO: 2084844 - protein, 18 aa, Staphylococcus
SQSQLSFFSCEDLEKIDY

SEQ ID NO: 2084845 - protein, 19 aa, Staphylococcus
SQTNYYIDTIDFKLKDHRS

SEQ ID NO: 2084846 - protein, 23 aa, Staphylococcus
SQTSNLFRIKWSQDVNYTLLKSI

SEQ ID NO: 2084847 - protein, 26 aa, Staphylococcus
SQVEKNLPGITLKIKQLPFKQRIALE

SEQ ID NO: 2084848 - protein, 18 aa, Staphylococcus
SQVGLFFEPEAIHIMVPG

SEQ ID NO: 2084849 - protein, 25 aa, Staphylococcus
SQVKGLYLHGPFGTGKSFILGAIAN

SEQ ID NO: 2084850 - protein, 22 aa, Staphylococcus
SQVSRFFTGIEIHPGAKIGKRL

SEQ ID NO: 2084851 - protein, 25 aa, Staphylococcus
SQWHILCHNQWIKSTHLVIAFGCNH

SEQ ID NO: 2084852 - protein, 25 aa, Staphylococcus
SQYENIRVVGLMTMAPFTEDEAQIR

SEQ ID NO: 2084853 - protein, 17 aa, Staphylococcus
SQYFDNLFFVGGSVNPG

SEQ ID NO: 2084854 - protein, 17 aa, Staphylococcus
SQYPFEELPLYEIGWRL

SEQ ID NO: 2084855 - protein, 25 aa, Staphylococcus
SQYPFNNLPFYEIGWRLIPEVWGNG

SEQ ID NO: 2084856 - protein, 22 aa, Staphylococcus
SQYQRILKQKNNYLKQLQMKQK

SEQ ID NO: 2084857 - protein, 23 aa, Staphylococcus
SQYQRILKQKNNYLKQLQYGQKT

SEQ ID NO: 2084858 - protein, 23 aa, Staphylococcus
SRAEYRLLLRHDNADLRLTDIGY

SEQ ID NO: 2084859 - protein, 24 aa, Staphylococcus
SRAEYRLLLRHDNADLRLTDIGYE

SEQ ID NO: 2084860 - protein, 23 aa, Staphylococcus
SRAEYRLLLRHDNADLRLTDLGH

SEQ ID NO: 2084861 - protein, 20 aa, Staphylococcus
SRAFLPFRPYVVEDGHLVTG

SEQ ID NO: 2084862 - protein, 34 aa, Staphylococcus
SRAHQLIIKISSAWSFLVPEILQIDEDKLQSFIE

SEQ ID NO: 2084863 - protein, 33 aa, Staphylococcus
SRAHQLIIKISSAWSFLVPEILQIDEEKLESFI

SEQ ID NO: 2084864 - protein, 20 aa, Staphylococcus
SRAIAGAVGDKLIFSIPGST

SEQ ID NO: 2084865 - protein, 17 aa, Staphylococcus
SRAIGGTAKDKLIFALP

SEQ ID NO: 2084866 - protein, 22 aa, Staphylococcus
SRAQIFELYPLDENDVRVSLDR

SEQ ID NO: 2084867 - protein, 23 aa, Staphylococcus
SRDFLSLEQMPNSITFIGVGIIS

SEQ ID NO: 2084868 - protein, 21 aa, Staphylococcus
SRDGFLLAQDISSYSLTIVAH

SEQ ID NO: 2084869 - protein, 24 aa, Staphylococcus
SRDGFLLAQDISSYSLTLVAREAK

SEQ ID NO: 2084870 - protein, 23 aa, Staphylococcus
SRFAEEIIFWSSAEANFITLSDA

SEQ ID NO: 2084871 - protein, 19 aa, Staphylococcus
SRFFTGIEIHPGAKIGKRL

SEQ ID NO: 2084872 - protein, 26 aa, Staphylococcus
SRFIYLSPEFLLQPQNFKLISHLDFG

SEQ ID NO: 2084873 - protein, 27 aa, Staphylococcus
SRFSTNTFPSWKRAHPNRLLMHNGEIN

SEQ ID NO: 2084874 - protein, 17 aa, Staphylococcus
SRFVDALDLFSLLANVG

SEQ ID NO: 2084875 - protein, 20 aa, Staphylococcus
SRGIVKWQAFKTLPEQYEQL

SEQ ID NO: 2084876 - protein, 31 aa, Staphylococcus
SRGLNSNWDMLFIALSIHLIDLLKNVSPEEK

SEQ ID NO: 2084877 - protein, 19 aa, Staphylococcus
SRGTPRVANRLLKRVRDFQ

SEQ ID NO: 2084878 - protein, 25 aa, Staphylococcus
SRHVEKEMLFVPFKGENVDGHRFVE

SEQ ID NO: 2084879 - protein, 22 aa, Staphylococcus
SRILFVAATAPFTPFYRALDWV

SEQ ID NO: 2084880 - protein, 18 aa, Staphylococcus
SRITALQDDLKMALAAKD

SEQ ID NO: 2084881 - protein, 19 aa, Staphylococcus
SRIYYYKHNFVTHLHQLSF

SEQ ID NO: 2084882 - protein, 28 aa, Staphylococcus
SRKALGEADLILFVLNYNERLTDEDRKL

SEQ ID NO: 2084883 - protein, 24 aa, Staphylococcus
SRKLGLSLGIINKAKTMIGTDEQE

SEQ ID NO: 2084884 - protein, 24 aa, Staphylococcus
SRKYAKRQLTWFKNKMNVHWLDRE

SEQ ID NO: 2084885 - protein, 18 aa, Staphylococcus
SRLHTNPMRILDCKIDRD

SEQ ID NO: 2084886 - protein, 19 aa, Staphylococcus
SRLHTNPMRILDCKIDRDK

SEQ ID NO: 2084887 - protein, 19 aa, Staphylococcus
SRLKDGILAIDLLRRPEMT

SEQ ID NO: 2084888 - protein, 28 aa, Staphylococcus
SRLKDGILALELLRRPEMTYDLILEILD

SEQ ID NO: 2084889 - protein, 20 aa, Staphylococcus
SRLKSIVGPFAYYIKGFEML

SEQ ID NO: 2084890 - protein, 21 aa, Staphylococcus
SRLKSIVGPFAYYIKGFEMLP

SEQ ID NO: 2084891 - protein, 21 aa, Staphylococcus
SRLMQMLKTFDEFSFDKDKLG

SEQ ID NO: 2084892 - protein, 25 aa, Staphylococcus
SRLNKLTEMVKPKKTIPTTFEFTDI

SEQ ID NO: 2084893 - protein, 22 aa, Staphylococcus
SRLTTFLEHELARTTSLHGVLV

SEQ ID NO: 2084894 - protein, 18 aa, Staphylococcus
SRLVGQIMNTLLYGIQTV

SEQ ID NO: 2084895 - protein, 32 aa, Staphylococcus
SRMDEYVVLRFGWLYGPGTWYGKDGMIYNQFV

SEQ ID NO: 2084896 - protein, 17 aa, Staphylococcus
SRMLKYIRKIDTSALNS

SEQ ID NO: 2084897 - protein, 25 aa, Staphylococcus
SRNINQIILLFSLTNELRMTINSST

SEQ ID NO: 2084898 - protein, 35 aa, Staphylococcus
SRNYAKRQMTWFKNKLDVLWLDREKMSLSLMLDEV

SEQ ID NO: 2084899 - protein, 20 aa, Staphylococcus
SRPQKIGLAALVDRGHRELP

SEQ ID NO: 2084900 - protein, 23 aa, Staphylococcus
SRQNLWKDHTLPFYYKPDKTEFD

SEQ ID NO: 2084901 - protein, 19 aa, Staphylococcus
SRQVIRRAIRRNPDAVVCV

SEQ ID NO: 2084902 - protein, 28 aa, Staphylococcus
SRRFINRDLLKYMPFDGSIITISELTDL

SEQ ID NO: 2084903 - protein, 19 aa, Staphylococcus
SRRIKKLIDSGFVALQKSN

SEQ ID NO: 2084904 - protein, 25 aa, Staphylococcus
SRRKIKRELYDTRGFLSCTRILSTD

SEQ ID NO: 2084905 - protein, 24 aa, Staphylococcus
SRSERPEWNTVGLIGQIYTNVEKD

SEQ ID NO: 2084906 - protein, 21 aa, Staphylococcus
SRSIGFNWFKGKSNKNDSTQN

SEQ ID NO: 2084907 - protein, 17 aa, Staphylococcus
SRSNLLTYLNIFDDVRS

SEQ ID NO: 2084908 - protein, 27 aa, Staphylococcus
SRSQRDYLLFKFAIHTGIKLSELLNMS

SEQ ID NO: 2084909 - protein, 22 aa, Staphylococcus
SRTLMFNIHDLKWDKELLDILE

SEQ ID NO: 2084910 - protein, 25 aa, Staphylococcus
SRTLMYNIYDLQWDDELLDLLNVPK

SEQ ID NO: 2084911 - protein, 24 aa, Staphylococcus
SRTSGIFFMIKDDKQYIFGDCAIN

SEQ ID NO: 2084912 - protein, 24 aa, Staphylococcus
SRTSGIFFMIKEDKQYIFGDCAIN

SEQ ID NO: 2084913 - protein, 25 aa, Staphylococcus
SRTTDFDMTYPIYINAMTGGSEWTK

SEQ ID NO: 2084914 - protein, 20 aa, Staphylococcus
SRTVLHFHPALAPYKAAVLP

SEQ ID NO: 2084915 - protein, 20 aa, Staphylococcus
SRTYLRLMRNVYLNNPLTSE

SEQ ID NO: 2084916 - protein, 22 aa, Staphylococcus
SRVQIFELYPLDEKDVYQALTR

SEQ ID NO: 2084917 - protein, 26 aa, Staphylococcus
SRVYLAIGGGFKLDRWLDSTSTDFNV

SEQ ID NO: 2084918 - protein, 18 aa, Staphylococcus
SRWLGYYGFNVSSEWMIP

SEQ ID NO: 2084919 - protein, 17 aa, Staphylococcus
SRWLNYLVDHFYVIKTM

SEQ ID NO: 2084920 - protein, 18 aa, Staphylococcus
SRYAFVKYMDQLARKMHC

SEQ ID NO: 2084921 - protein, 20 aa, Staphylococcus
SRYEYSVFKDIFYDKTHNIY

SEQ ID NO: 2084922 - protein, 17 aa, Staphylococcus
SRYLFQRLHFYLVDIFR

SEQ ID NO: 2084923 - protein, 22 aa, Staphylococcus
SRYNDILVKPEIRMPKVGGRVM

SEQ ID NO: 2084924 - protein, 22 aa, Staphylococcus
SRYNDVLIKPEIRMPKVGGRVM

SEQ ID NO: 2084925 - protein, 22 aa, Staphylococcus
SRYRQNVVFILWGKPAQQKMKL

SEQ ID NO: 2084926 - protein, 25 aa, Staphylococcus
SSAAFFIVAALITPGSDITIHNVGM

SEQ ID NO: 2084927 - protein, 22 aa, Staphylococcus
SSAEAILEFYNGHKEELSQKAN

SEQ ID NO: 2084928 - protein, 24 aa, Staphylococcus
SSAGAMDLYSYLIGKTLIGNNGPS

SEQ ID NO: 2084929 - protein, 22 aa, Staphylococcus
SSALSYFANELSMMSQYATLVV

SEQ ID NO: 2084930 - protein, 20 aa, Staphylococcus
SSCHLYITWIKGASEEKRNE

SEQ ID NO: 2084931 - protein, 17 aa, Staphylococcus
SSCNISPVTYWVAAMSK

SEQ ID NO: 2084932 - protein, 17 aa, Staphylococcus
SSCNISPVTYWVASMSK

SEQ ID NO: 2084933 - protein, 25 aa, Staphylococcus
SSDDILNMDILPDSIAIIGGGVIGL

SEQ ID NO: 2084934 - protein, 18 aa, Staphylococcus
SSDEYSIIVLGQSGVDFL

SEQ ID NO: 2084935 - protein, 26 aa, Staphylococcus
SSDHNFLFEAVYGAGIARIYQLNKDT

SEQ ID NO: 2084936 - protein, 29 aa, Staphylococcus
SSDHNFLFEAVYTAGIARIYQLNPETGEV

SEQ ID NO: 2084937 - protein, 29 aa, Staphylococcus
SSDLAFYNNIRVVWFKNARYLNQEDVETI

SEQ ID NO: 2084938 - protein, 20 aa, Staphylococcus
SSDPFKILSKRELEILPLIA

SEQ ID NO: 2084939 - protein, 18 aa, Staphylococcus
SSDPQFLEDPRFSNYGKL

SEQ ID NO: 2084940 - protein, 25 aa, Staphylococcus
SSDQPTYVYLLLDGIVLRETINEDG

SEQ ID NO: 2084941 - protein, 36 aa, Staphylococcus
SSDRFIGILLEHFGGNLPLWLAPVQMEVILVNADLH

SEQ ID NO: 2084942 - protein, 22 aa, Staphylococcus
SSDRMGIRLKGTPIPPIESADI

SEQ ID NO: 2084943 - protein, 18 aa, Staphylococcus
SSEDKWLYIHGRKEWESY

SEQ ID NO: 2084944 - protein, 19 aa, Staphylococcus
SSEKWLGILLRVTPLPIRN

SEQ ID NO: 2084945 - protein, 28 aa, Staphylococcus
SSEPLSHLRLIVRSLLGIAVPTQIATHD

SEQ ID NO: 2084946 - protein, 26 aa, Staphylococcus
SSEPLSHLRVIIRSLLGIAVPTQIAT

SEQ ID NO: 2084947 - protein, 25 aa, Staphylococcus
SSEPLSHLRVIVRSLLGIAVPTQIA

SEQ ID NO: 2084948 - protein, 26 aa, Staphylococcus
SSEPLSHLRVIVRSLLGIAVPTQIAT

SEQ ID NO: 2084949 - protein, 21 aa, Staphylococcus
SSERIVNHIKYYFNLTKEKPT

SEQ ID NO: 2084950 - protein, 27 aa, Staphylococcus
SSEWYNAAYLIMWGSNVPLTRTPDAHF

SEQ ID NO: 2084951 - protein, 20 aa, Staphylococcus
SSFDIHRLAVSTYLAHHFMS

SEQ ID NO: 2084952 - protein, 22 aa, Staphylococcus
SSFKAILRCDPDVILIGEIRDA

SEQ ID NO: 2084953 - protein, 24 aa, Staphylococcus
SSFRGLYQFIRFIDELIERNKDFG

SEQ ID NO: 2084954 - protein, 28 aa, Staphylococcus
SSFSLTDLYLFIFNNSIKTLTIVTNKGQ

SEQ ID NO: 2084955 - protein, 26 aa, Staphylococcus
SSFSTGWIFFINAEGIQEMVADYHLP

SEQ ID NO: 2084956 - protein, 19 aa, Staphylococcus
SSFTLDDFLEQLDQVKNLG

SEQ ID NO: 2084957 - protein, 24 aa, Staphylococcus
SSFVYRRKLPFNAERFKDWFDHLP

SEQ ID NO: 2084958 - protein, 18 aa, Staphylococcus
SSGAAIHAAIQKAKELGK

SEQ ID NO: 2084959 - protein, 29 aa, Staphylococcus
SSGAHLTNPFILLNWSDTISDLYTLIHEF

SEQ ID NO: 2084960 - protein, 29 aa, Staphylococcus
SSGAHLTNPFILLNWSDTISDLYTLVHEF

SEQ ID NO: 2084961 - protein, 29 aa, Staphylococcus
SSGAHLTNPFILLNWSDTVSDLYTLIHEF

SEQ ID NO: 2084962 - protein, 29 aa, Staphylococcus
SSGAHLTNPFILLNWSNTVSDLYTLVHEF

SEQ ID NO: 2084963 - protein, 20 aa, Staphylococcus
SSGSVFMKPAAPGTGVIAGG

SEQ ID NO: 2084964 - protein, 23 aa, Staphylococcus
SSGTIPGTLFKLEATHGLTEDQM

SEQ ID NO: 2084965 - protein, 19 aa, Staphylococcus
SSHFLSIGGKFRTLTPIEA

SEQ ID NO: 2084966 - protein, 19 aa, Staphylococcus
SSHILRHSHISLLSQQGVS

SEQ ID NO: 2084967 - protein, 20 aa, Staphylococcus
SSHLFKQSYKALFIRKEMNL

SEQ ID NO: 2084968 - protein, 17 aa, Staphylococcus
SSHLSFPSLVFDLTYFA

SEQ ID NO: 2084969 - protein, 25 aa, Staphylococcus
SSIIETLQPYLFEKTARKPMILPVI

SEQ ID NO: 2084970 - protein, 26 aa, Staphylococcus
SSIIETLQPYLFEKTARRPMILPVIM

SEQ ID NO: 2084971 - protein, 23 aa, Staphylococcus
SSIIETLQPYLYEKTARKPMILP

SEQ ID NO: 2084972 - protein, 26 aa, Staphylococcus
SSIKRGDYLAILSTGAYHYSMASNYN

SEQ ID NO: 2084973 - protein, 32 aa, Staphylococcus
SSIKSSIIPGSKPFNVVMTPSDKKRLMDAKKF

SEQ ID NO: 2084974 - protein, 28 aa, Staphylococcus
SSIMKAKRIILLAFGKNKQQAIKALLEG

SEQ ID NO: 2084975 - protein, 22 aa, Staphylococcus
SSIQPILQYLESERITELLQTI

SEQ ID NO: 2084976 - protein, 23 aa, Staphylococcus
SSIRAAEFGLPITYAIIGGNPKR

SEQ ID NO: 2084977 - protein, 17 aa, Staphylococcus
SSIRKPSAIIVANHALL

SEQ ID NO: 2084978 - protein, 17 aa, Staphylococcus
SSIYFLLKDADVSHFHR

SEQ ID NO: 2084979 - protein, 25 aa, Staphylococcus
SSIYKGVSWCKTKNKWRAYITIQKK

SEQ ID NO: 2084980 - protein, 22 aa, Staphylococcus
SSKAFIHFKNINELFQFVFNDY

SEQ ID NO: 2084981 - protein, 23 aa, Staphylococcus
SSKGLEFPFVIYSGLSRKFRRDD

SEQ ID NO: 2084982 - protein, 24 aa, Staphylococcus
SSKGLEFPFVIYSGLTREFNKKDL

SEQ ID NO: 2084983 - protein, 27 aa, Staphylococcus
SSKNAVQLFYPFFNSVNIKYVAAIGDK

SEQ ID NO: 2084984 - protein, 18 aa, Staphylococcus
SSKNYSPLKLALAKGRGA

SEQ ID NO: 2084985 - protein, 23 aa, Staphylococcus
SSKTYDLEVWLPSYNDYKEISSC

SEQ ID NO: 2084986 - protein, 30 aa, Staphylococcus
SSKYLVDQQYWLNKLPHLGQYPQLPITIDN

SEQ ID NO: 2084987 - protein, 20 aa, Staphylococcus
SSKYTRSKLRKALPKEYTYI

SEQ ID NO: 2084988 - protein, 26 aa, Staphylococcus
SSKYTRSKLRKALPSEYTYIIEELLY

SEQ ID NO: 2084989 - protein, 17 aa, Staphylococcus
SSLAFDTIYAEGQRRYV

SEQ ID NO: 2084990 - protein, 23 aa, Staphylococcus
SSLALFIMICTGCRISGVLNMKY

SEQ ID NO: 2084991 - protein, 21 aa, Staphylococcus
SSLAPFLFGDLEATTVTIGCN

SEQ ID NO: 2084992 - protein, 21 aa, Staphylococcus
SSLINALLGDTYLVSSPNPTT

SEQ ID NO: 2084993 - protein, 18 aa, Staphylococcus
SSLNRPNDEKKGFFARLF

SEQ ID NO: 2084994 - protein, 27 aa, Staphylococcus
SSLPEYMIPRKFVWMDQLPLTSNGKID

SEQ ID NO: 2084995 - protein, 25 aa, Staphylococcus
SSLQEMYQGFFLAPHVVSQSLKGAL

SEQ ID NO: 2084996 - protein, 22 aa, Staphylococcus
SSLRKELFVNNKSSRKSREDRD

SEQ ID NO: 2084997 - protein, 25 aa, Staphylococcus
SSLSFDLSIFDIFASIIVGGTLHLV

SEQ ID NO: 2084998 - protein, 28 aa, Staphylococcus
SSLTEIGLDLPFPMKINQMLGNPPEFLN

SEQ ID NO: 2084999 - protein, 21 aa, Staphylococcus
SSMLPLLKQYDLGCINELRIG

SEQ ID NO: 2085000 - protein, 25 aa, Staphylococcus
SSNERWLRRVINSLVYDYGYPIGCS

SEQ ID NO: 2085001 - protein, 33 aa, Staphylococcus
SSNLKLNILIGPLVKLWRIGFEDAQLPTNTEIQ

SEQ ID NO: 2085002 - protein, 23 aa, Staphylococcus
SSNYIFVIFVKNPILKEKMITDL

SEQ ID NO: 2085003 - protein, 20 aa, Staphylococcus
SSPETLVIGPYYRGNNGSEG

SEQ ID NO: 2085004 - protein, 21 aa, Staphylococcus
SSPHTYYIIANSMIDGFKHED

SEQ ID NO: 2085005 - protein, 20 aa, Staphylococcus
SSPHTYYIIANSMINGYTHK

SEQ ID NO: 2085006 - protein, 23 aa, Staphylococcus
SSPSVLGLYPHSVFEISKRVILS

SEQ ID NO: 2085007 - protein, 31 aa, Staphylococcus
SSPSYALFKGQNLVHFIPREHIEGRDINDIA

SEQ ID NO: 2085008 - protein, 23 aa, Staphylococcus
SSPTKIDFYQWLKNNTLTINQLN

SEQ ID NO: 2085009 - protein, 24 aa, Staphylococcus
SSQDLLERLVYMNKYRQTTIIMVT

SEQ ID NO: 2085010 - protein, 26 aa, Staphylococcus
SSQRFKAIKKKLPLVKRFVGLTGTPS

SEQ ID NO: 2085011 - protein, 34 aa, Staphylococcus
SSQYPPLLKTIYDYPFILFYRGNIHLLSSTYTLG

SEQ ID NO: 2085012 - protein, 29 aa, Staphylococcus
SSRDRNMYRLIKFIDKSPIFPLFGNGNNL

SEQ ID NO: 2085013 - protein, 24 aa, Staphylococcus
SSRMRTHSVPWHSAGRYWGHMNSE

SEQ ID NO: 2085014 - protein, 37 aa, Staphylococcus
SSSASIELLTGWLIKQLFNLHLERLQLIKLGQVVENK

SEQ ID NO: 2085015 - protein, 25 aa, Staphylococcus
SSSKTYLWHLLEQSLEKMEFDQSQY

SEQ ID NO: 2085016 - protein, 18 aa, Staphylococcus
SSSLLSDASEFIDTVPLG

SEQ ID NO: 2085017 - protein, 17 aa, Staphylococcus
SSSSNYFHLLRAQAKSL

SEQ ID NO: 2085018 - protein, 23 aa, Staphylococcus
SSTAISNFLLATGNYRKPGSGAY

SEQ ID NO: 2085019 - protein, 26 aa, Staphylococcus
SSTDFWQKVIYKLIYDNEVLIVVTDT

SEQ ID NO: 2085020 - protein, 22 aa, Staphylococcus
SSTLLYINDQPKRMLTVGLGNL

SEQ ID NO: 2085021 - protein, 18 aa, Staphylococcus
SSTLTTLILKELGVKKVT

SEQ ID NO: 2085022 - protein, 28 aa, Staphylococcus
SSTLVSDIIYIPYKTKFLKEAEFKGNTV

SEQ ID NO: 2085023 - protein, 19 aa, Staphylococcus
SSTYLHDLIQYLDGKDYSV

SEQ ID NO: 2085024 - protein, 31 aa, Staphylococcus
SSVAFDFSFLYKPVIYYQFDKERFLGKDGSH

SEQ ID NO: 2085025 - protein, 23 aa, Staphylococcus
SSVGPLYASGYLKGAVAVKNETS

SEQ ID NO: 2085026 - protein, 26 aa, Staphylococcus
SSVHRGDILAILSTGAYHYSMSSNYN

SEQ ID NO: 2085027 - protein, 19 aa, Staphylococcus
SSVKIIVGEKFHNGINVIG

SEQ ID NO: 2085028 - protein, 26 aa, Staphylococcus
SSVKNVTMELGGLAPLIVHKDADIDF

SEQ ID NO: 2085029 - protein, 17 aa, Staphylococcus
SSVNKWLYVHGRKEWES

SEQ ID NO: 2085030 - protein, 24 aa, Staphylococcus
SSVQYQRFIRHVQFLIRRLKQNEA

SEQ ID NO: 2085031 - protein, 27 aa, Staphylococcus
SSVRAFYEYYSYLMEPWDGPTMIAFCN

SEQ ID NO: 2085032 - protein, 34 aa, Staphylococcus
SSWTMPKREEGFYTAWLHLAQHDPALTKEARQLI

SEQ ID NO: 2085033 - protein, 33 aa, Staphylococcus
SSWTMPKREHGFYAAWLHLAQHDPMLSKTQRKM

SEQ ID NO: 2085034 - protein, 21 aa, Staphylococcus
SSWTMPQRDKGFYTAWLHLAQ

SEQ ID NO: 2085035 - protein, 26 aa, Staphylococcus
SSYKKDIFPVFKSLGLDEYINIIVGR

SEQ ID NO: 2085036 - protein, 24 aa, Staphylococcus
SSYQIVLIDLRGHGFSDKPLHIDF

SEQ ID NO: 2085037 - protein, 25 aa, Staphylococcus
SSYREDIYPTFKKLGLDNYIDVIIG

SEQ ID NO: 2085038 - protein, 27 aa, Staphylococcus
SSYRIHKGFHMLKFEGINNINDIEHLK

SEQ ID NO: 2085039 - protein, 24 aa, Staphylococcus
SSYRQDIMPTVHQLGLDAYVDVIV

SEQ ID NO: 2085040 - protein, 22 aa, Staphylococcus
STAHGFEMLFDKLQIALETFEA

SEQ ID NO: 2085041 - protein, 25 aa, Staphylococcus
STAWLVPVNSINYAMYASVGYLSIN

SEQ ID NO: 2085042 - protein, 18 aa, Staphylococcus
STCDLVVELPAYAALSAG

SEQ ID NO: 2085043 - protein, 25 aa, Staphylococcus
STCFGAPFLPLNPTVYADLLGELID

SEQ ID NO: 2085044 - protein, 25 aa, Staphylococcus
STDKQWDLLRLLENELQAFGLSTDI

SEQ ID NO: 2085045 - protein, 17 aa, Staphylococcus
STDLYGRVLPYIQYLVV

SEQ ID NO: 2085046 - protein, 24 aa, Staphylococcus
STDSVDFLLPIKNGDILSYEAMVS

SEQ ID NO: 2085047 - protein, 26 aa, Staphylococcus
STEDYPIAVIFNASWYNETTVIGRLS

SEQ ID NO: 2085048 - protein, 25 aa, Staphylococcus
STEKQWDLLHLLQKELQDFGLETEL

SEQ ID NO: 2085049 - protein, 25 aa, Staphylococcus
STEKQWDLLNLLNDELTDLGLETDI

SEQ ID NO: 2085050 - protein, 25 aa, Staphylococcus
STEKQWDLLRLLQQELEGFGLETNL

SEQ ID NO: 2085051 - protein, 23 aa, Staphylococcus
STEVDLFFTLCNKLKEQDTRKVT

SEQ ID NO: 2085052 - protein, 24 aa, Staphylococcus
STFDKLYLFSKTLNSRILFITHSM

SEQ ID NO: 2085053 - protein, 17 aa, Staphylococcus
STFLDIYAERDLNNGTI

SEQ ID NO: 2085054 - protein, 17 aa, Staphylococcus
STFLDIYAERDLQDGVL

SEQ ID NO: 2085055 - protein, 17 aa, Staphylococcus
STFLKDVFFIEVSHFIE

SEQ ID NO: 2085056 - protein, 24 aa, Staphylococcus
STFRGLYQFIRFIDELIERKKDFG

SEQ ID NO: 2085057 - protein, 22 aa, Staphylococcus
STGHREWTHMWSGQSPRLATSQ

SEQ ID NO: 2085058 - protein, 29 aa, Staphylococcus
STGINPLWHMYRFIRFPKVLKQTVIIEFC

SEQ ID NO: 2085059 - protein, 19 aa, Staphylococcus
STGMCLMSNIGGASGPLYG

SEQ ID NO: 2085060 - protein, 24 aa, Staphylococcus
STGQLLFHLFAAFAEFERNLILER

SEQ ID NO: 2085061 - protein, 17 aa, Staphylococcus
STGYFIEPTIFSGLKSS

SEQ ID NO: 2085062 - protein, 18 aa, Staphylococcus
STHFLQNMLLDNGKYIYG

SEQ ID NO: 2085063 - protein, 31 aa, Staphylococcus
STHHSDYLKVFGHLFQYLKKNRISHVSLLFD

SEQ ID NO: 2085064 - protein, 21 aa, Staphylococcus
STHPVLFKKAKKITTFDENLK

SEQ ID NO: 2085065 - protein, 23 aa, Staphylococcus
STIELLVPKIAELIHQHHYEITG

SEQ ID NO: 2085066 - protein, 17 aa, Staphylococcus
STIFIPSGTFYISKNLE

SEQ ID NO: 2085067 - protein, 24 aa, Staphylococcus
STIFPNFIGITFAVYDGRKHVPVY

SEQ ID NO: 2085068 - protein, 23 aa, Staphylococcus
STIGEKLSIRRFAIRTKSDNDAF

SEQ ID NO: 2085069 - protein, 23 aa, Staphylococcus
STIGEKLSIRRFAIRTKTDNDAF

SEQ ID NO: 2085070 - protein, 23 aa, Staphylococcus
STIIASLLKKPELLEKLRVKSEM

SEQ ID NO: 2085071 - protein, 19 aa, Staphylococcus
STIKNFNYKIPSSVFYTNF

SEQ ID NO: 2085072 - protein, 24 aa, Staphylococcus
STILNLMQFAIDYAKSRNIEKLMT

SEQ ID NO: 2085073 - protein, 22 aa, Staphylococcus
STIPIINLYEWLSDYNVYNVPK

SEQ ID NO: 2085074 - protein, 24 aa, Staphylococcus
STITNWFINFYHLIMAQQFGRESH

SEQ ID NO: 2085075 - protein, 25 aa, Staphylococcus
STIVSLIKDFQHMKIFPVGRVGKDT

SEQ ID NO: 2085076 - protein, 22 aa, Staphylococcus
STIYDGFLEYARNFKKYEGKDQ

SEQ ID NO: 2085077 - protein, 20 aa, Staphylococcus
STIYFQPYNSSQLLQRVTYN

SEQ ID NO: 2085078 - protein, 23 aa, Staphylococcus
STKAKYIIEPLMQQLKSLSYIGL

SEQ ID NO: 2085079 - protein, 24 aa, Staphylococcus
STKKDLIMMVYDYDINDILTVIEL

SEQ ID NO: 2085080 - protein, 24 aa, Staphylococcus
STKKLPNFVLGLGAKFNKEAKEGK

SEQ ID NO: 2085081 - protein, 22 aa, Staphylococcus
STKLVHGGLRYLKQAQIKVVAE

SEQ ID NO: 2085082 - protein, 26 aa, Staphylococcus
STLEQLQVKFLWDQLTDYPHGKVKDA

SEQ ID NO: 2085083 - protein, 17 aa, Staphylococcus
STLIYMTATPPRHLLHQ

SEQ ID NO: 2085084 - protein, 19 aa, Staphylococcus
STLLNILGGLLTPTDGKIL

SEQ ID NO: 2085085 - protein, 21 aa, Staphylococcus
STLLRCMNLLEQPTDGHVIFE

SEQ ID NO: 2085086 - protein, 24 aa, Staphylococcus
STLNELLVLNAIHIPLHAGKIEEM

SEQ ID NO: 2085087 - protein, 27 aa, Staphylococcus
STLSQFQGWITQIPPMYSSVKVKGKKL

SEQ ID NO: 2085088 - protein, 21 aa, Staphylococcus
STMDPIYLEQVTVLGKVVGLF

SEQ ID NO: 2085089 - protein, 22 aa, Staphylococcus
STMIRQGLKPVLFVINNDGYTV

SEQ ID NO: 2085090 - protein, 18 aa, Staphylococcus
STMQFDQLYHLMLGDKKN

SEQ ID NO: 2085091 - protein, 17 aa, Staphylococcus
STNAILHLLAIAHTIEV

SEQ ID NO: 2085092 - protein, 26 aa, Staphylococcus
STNFGDMVYISPADWLREQAKLVQEA

SEQ ID NO: 2085093 - protein, 18 aa, Staphylococcus
STNFLQNMLLDNGKYIYG

SEQ ID NO: 2085094 - protein, 24 aa, Staphylococcus
STNKPDAKLFILLVGERPEEVTDI

SEQ ID NO: 2085095 - protein, 23 aa, Staphylococcus
STNKPLRNAILWNDTRSTHQCTT

SEQ ID NO: 2085096 - protein, 25 aa, Staphylococcus
STNKRGYKMLPHFQIGLYEDQVFVM

SEQ ID NO: 2085097 - protein, 25 aa, Staphylococcus
STNTKLLQHQLLQKDIPSINRALDF

SEQ ID NO: 2085098 - protein, 25 aa, Staphylococcus
STNTKLLQHQLLYKDIPELNQALEF

SEQ ID NO: 2085099 - protein, 19 aa, Staphylococcus
STPKSLPFIEFDHERILSS

SEQ ID NO: 2085100 - protein, 23 aa, Staphylococcus
STPLKVYVNGTFDGVNFPESFKV

SEQ ID NO: 2085101 - protein, 18 aa, Staphylococcus
STPSFIEMCLLLPNLNEK

SEQ ID NO: 2085102 - protein, 23 aa, Staphylococcus
STQAILPLRGKILNVEKARLDRI

SEQ ID NO: 2085103 - protein, 19 aa, Staphylococcus
STQLAQYLLNKGRGYIIAP

SEQ ID NO: 2085104 - protein, 17 aa, Staphylococcus
STQLLKDYAIPRQVIGV

SEQ ID NO: 2085105 - protein, 26 aa, Staphylococcus
STQLVDRFLVIAHSYGLNPRIVVTKK

SEQ ID NO: 2085106 - protein, 26 aa, Staphylococcus
STQNDLFKIKYMVSLFIPNNDEMAQL

SEQ ID NO: 2085107 - protein, 23 aa, Staphylococcus
STQQIHRLLRFSPSFMKYSKVDK

SEQ ID NO: 2085108 - protein, 19 aa, Staphylococcus
STQWFVKMKPLAEQALNNQ

SEQ ID NO: 2085109 - protein, 24 aa, Staphylococcus
STRAAFSSIYFLLTSNDISHFHRI

SEQ ID NO: 2085110 - protein, 22 aa, Staphylococcus
STRANTKLLPNSKVLAVTDGDI

SEQ ID NO: 2085111 - protein, 18 aa, Staphylococcus
STRFYASAGGLYPIDISL

SEQ ID NO: 2085112 - protein, 20 aa, Staphylococcus
STRIVLLLNDQHIKFWENAK

SEQ ID NO: 2085113 - protein, 29 aa, Staphylococcus
STRKSNVFLFGVKILFIAITPYQDLSKSH

SEQ ID NO: 2085114 - protein, 24 aa, Staphylococcus
STSGFRTHLLLYNHQSKKINKNVR

SEQ ID NO: 2085115 - protein, 25 aa, Staphylococcus
STSGIYSYLPLASRVLNNISKIIRE

SEQ ID NO: 2085116 - protein, 17 aa, Staphylococcus
STSKVLLEKVEALLPEA

SEQ ID NO: 2085117 - protein, 26 aa, Staphylococcus
STSNDAEFFFTYEDLPLLNPDVILEE

SEQ ID NO: 2085118 - protein, 25 aa, Staphylococcus
STTADFLYAVLSYPAYADGDASDVD

SEQ ID NO: 2085119 - protein, 25 aa, Staphylococcus
STTEKIVFVDRLGKIIAMNGAARDI

SEQ ID NO: 2085120 - protein, 22 aa, Staphylococcus
STTIKHMLGLLTPIEGTLSISD

SEQ ID NO: 2085121 - protein, 25 aa, Staphylococcus
STTKQWDLLNLLESELKALGLETDM

SEQ ID NO: 2085122 - protein, 17 aa, Staphylococcus
STTLLIEKFNPDIVINT

SEQ ID NO: 2085123 - protein, 26 aa, Staphylococcus
STTLRRLMDLYGFKEKLQQSDLPIFG

SEQ ID NO: 2085124 - protein, 26 aa, Staphylococcus
STTLRRLMDLYGFKEKLQQSDLPMFG

SEQ ID NO: 2085125 - protein, 27 aa, Staphylococcus
STTLRRLMDLYGFKEKLQQSDLPMFGT

SEQ ID NO: 2085126 - protein, 21 aa, Staphylococcus
STTMINLNDKFVKLITVGLGN

SEQ ID NO: 2085127 - protein, 20 aa, Staphylococcus
STTSLPQRLLDKYNISVVSL

SEQ ID NO: 2085128 - protein, 17 aa, Staphylococcus
STVAYLRSALVENGYDV

SEQ ID NO: 2085129 - protein, 18 aa, Staphylococcus
STVAYLRTALVENGYDVG

SEQ ID NO: 2085130 - protein, 18 aa, Staphylococcus
STVKYTLEQALNVKVNSI

SEQ ID NO: 2085131 - protein, 18 aa, Staphylococcus
STVSYLRSALVDNGYEVG

SEQ ID NO: 2085132 - protein, 27 aa, Staphylococcus
STVVVVPDYQLSLAIGKRGQNARLAAK

SEQ ID NO: 2085133 - protein, 24 aa, Staphylococcus
STVWSTRYLNLTVNNKFIVSSWLG

SEQ ID NO: 2085134 - protein, 19 aa, Staphylococcus
STWAGVRPLILEEGKDPSE

SEQ ID NO: 2085135 - protein, 24 aa, Staphylococcus
STYEQNLLFATLDPKTRQIQLNEG

SEQ ID NO: 2085136 - protein, 25 aa, Staphylococcus
STYIQNPTFFQGLSKKPGTIEPLKD

SEQ ID NO: 2085137 - protein, 23 aa, Staphylococcus
SVAEHAVMDLLILLRNYEEGHRQ

SEQ ID NO: 2085138 - protein, 22 aa, Staphylococcus
SVAERLFYEYGFKGVGLKQIIQ

SEQ ID NO: 2085139 - protein, 21 aa, Staphylococcus
SVAFMHIPMLMERIKATYNRN

SEQ ID NO: 2085140 - protein, 48 aa, Staphylococcus
SVAINSMLLSLLYKNHPEELKLLLIDPKMVELAPYNGLPHLVSPVITD

SEQ ID NO: 2085141 - protein, 25 aa, Staphylococcus
SVAKDSIYHYLETQLGLDISYSSKS

SEQ ID NO: 2085142 - protein, 23 aa, Staphylococcus
SVALLAQDYYYKDQSHLTFDERL

SEQ ID NO: 2085143 - protein, 23 aa, Staphylococcus
SVANFGMFIELPNTIEGMVHISN

SEQ ID NO: 2085144 - protein, 23 aa, Staphylococcus
SVAQRLLIQTFFSTFSNQRHDDY

SEQ ID NO: 2085145 - protein, 19 aa, Staphylococcus
SVASVFVNPLQFAPGEDYD

SEQ ID NO: 2085146 - protein, 18 aa, Staphylococcus
SVAWVQEEPKNQGAWLFV

SEQ ID NO: 2085147 - protein, 26 aa, Staphylococcus
SVCAHKRWLFISSTLIKQTVRNSLLK

SEQ ID NO: 2085148 - protein, 27 aa, Staphylococcus
SVCAHKRWLFISSTLIKQTVRSSLIKG

SEQ ID NO: 2085149 - protein, 18 aa, Staphylococcus
SVCIGFTEVFIKMGDQIP

SEQ ID NO: 2085150 - protein, 24 aa, Staphylococcus
SVDEWQKMIDINLTGAFVGSREAV

SEQ ID NO: 2085151 - protein, 17 aa, Staphylococcus
SVDFFPKNFSQEGFIDE

SEQ ID NO: 2085152 - protein, 22 aa, Staphylococcus
SVDFLLPIRTGDVISYEAMVSY

SEQ ID NO: 2085153 - protein, 40 aa, Staphylococcus
SVDIKTLVYPGFATDLQQPITPLLFMADGVSFVTETIYPA

SEQ ID NO: 2085154 - protein, 20 aa, Staphylococcus
SVDNTFLTPLSQKPLELGAD

SEQ ID NO: 2085155 - protein, 24 aa, Staphylococcus
SVDRDKFIDLAIENDIMGIPSFLV

SEQ ID NO: 2085156 - protein, 21 aa, Staphylococcus
SVDYFIGYLKLVMTSKDMCLN

SEQ ID NO: 2085157 - protein, 29 aa, Staphylococcus
SVEDDQYWIYPPFQLTEHQDWLYGRGVSD

SEQ ID NO: 2085158 - protein, 18 aa, Staphylococcus
SVEFRRDLLDKIVQEYKN

SEQ ID NO: 2085159 - protein, 25 aa, Staphylococcus
SVEKDIYTEMLWDGFQPFKVETIEQ

SEQ ID NO: 2085160 - protein, 25 aa, Staphylococcus
SVFDIRDYYAARQLLFESVKSLDNQ

SEQ ID NO: 2085161 - protein, 24 aa, Staphylococcus
SVFDQLLQHPTIASKRYLYEQYDQ

SEQ ID NO: 2085162 - protein, 17 aa, Staphylococcus
SVFFLKDGKAREVIKRQ

SEQ ID NO: 2085163 - protein, 24 aa, Staphylococcus
SVFHIHFHFLPRYENDIDGFGYHW

SEQ ID NO: 2085164 - protein, 17 aa, Staphylococcus
SVFIIYQSDMFQYFEKI

SEQ ID NO: 2085165 - protein, 17 aa, Staphylococcus
SVFINNHDPRLFEGFSM

SEQ ID NO: 2085166 - protein, 30 aa, Staphylococcus
SVFTPMKVRERVWRRLATDLRPDQLHDIKT

SEQ ID NO: 2085167 - protein, 21 aa, Staphylococcus
SVGALYPWGLSEAKDYAQVID

SEQ ID NO: 2085168 - protein, 24 aa, Staphylococcus
SVGDFDYLPEIYKAIDAKVLFNKV

SEQ ID NO: 2085169 - protein, 24 aa, Staphylococcus
SVGDFDYLPEIYKALDAEVLFNKV

SEQ ID NO: 2085170 - protein, 25 aa, Staphylococcus
SVGDKLPVYLKKNPNFKFPYDTETP

SEQ ID NO: 2085171 - protein, 25 aa, Staphylococcus
SVGDYDFLPKIYKAIQAEVLFNKIA

SEQ ID NO: 2085172 - protein, 23 aa, Staphylococcus
SVGKIIFNEIIPDSFAYINEPSQ

SEQ ID NO: 2085173 - protein, 32 aa, Staphylococcus
SVGKSQSFIANKLRLLKLAPKVKQKLSEGKIT

SEQ ID NO: 2085174 - protein, 33 aa, Staphylococcus
SVGKSQSFIANKLRLLKLAPKVLERLRESKITE

SEQ ID NO: 2085175 - protein, 22 aa, Staphylococcus
SVGLRPVWIIEDIKYRNGKLTL

SEQ ID NO: 2085176 - protein, 25 aa, Staphylococcus
SVGNPLYHWSQLELKMYFDIEDLLT

SEQ ID NO: 2085177 - protein, 25 aa, Staphylococcus
SVGYDMMSQIRWLSVLDLKDKNEDQ

SEQ ID NO: 2085178 - protein, 19 aa, Staphylococcus
SVHLANFLEIPFDVYPQDA

SEQ ID NO: 2085179 - protein, 25 aa, Staphylococcus
SVHRGDYLAILSTGAYHYSMASNYN

SEQ ID NO: 2085180 - protein, 18 aa, Staphylococcus
SVIFIHKDAPYYNQVRQY

SEQ ID NO: 2085181 - protein, 29 aa, Staphylococcus
SVIGGKWKIPIIFHLLESDILRLSEFEKK

SEQ ID NO: 2085182 - protein, 48 aa, Staphylococcus
SVIGTMGYLLPKYIDIQFLYYRMKLLEFKKYIIGSTIPHLYYKDYSKE

SEQ ID NO: 2085183 - protein, 19 aa, Staphylococcus
SVIISFYPKFAVHPDHEAT

SEQ ID NO: 2085184 - protein, 24 aa, Staphylococcus
SVIKMIKHIKKYIPKTFVIAGNVG

SEQ ID NO: 2085185 - protein, 19 aa, Staphylococcus
SVILNDIKTNKIKLVIVAT

SEQ ID NO: 2085186 - protein, 22 aa, Staphylococcus
SVINPLCTILDKTIAEFAEYDQ

SEQ ID NO: 2085187 - protein, 23 aa, Staphylococcus
SVIQRICHRIIVLKDGAIVDDFN

SEQ ID NO: 2085188 - protein, 17 aa, Staphylococcus
SVIRLTEGTGIFVVLVR

SEQ ID NO: 2085189 - protein, 21 aa, Staphylococcus
SVIVAIFGHPVEFNPLLQMNR

SEQ ID NO: 2085190 - protein, 28 aa, Staphylococcus
SVKEKFRIIYYDGEAVLALLRLYQKDEN

SEQ ID NO: 2085191 - protein, 25 aa, Staphylococcus
SVKKPIPKFPKRIAVLTASTGAAIR

SEQ ID NO: 2085192 - protein, 25 aa, Staphylococcus
SVKRGDYLAILSTGAYHYSMASNYN

SEQ ID NO: 2085193 - protein, 27 aa, Staphylococcus
SVKVCPLIHWTWDDVWDYIKAHDLHYN

SEQ ID NO: 2085194 - protein, 19 aa, Staphylococcus
SVLELSWYEKQFDLMAHGK

SEQ ID NO: 2085195 - protein, 20 aa, Staphylococcus
SVLIDLGLIIGKDARRRREI

SEQ ID NO: 2085196 - protein, 22 aa, Staphylococcus
SVLKALNVNLLPKTQIKELIGD

SEQ ID NO: 2085197 - protein, 18 aa, Staphylococcus
SVLKRFKAMLLQKNETVE

SEQ ID NO: 2085198 - protein, 23 aa, Staphylococcus
SVLRLKGFVKFRDLPEVTYEFQY

SEQ ID NO: 2085199 - protein, 24 aa, Staphylococcus
SVLSELCLPLVKKGGHFIALKSSK

SEQ ID NO: 2085200 - protein, 19 aa, Staphylococcus
SVLTYVLDNTMRMLHPFMP

SEQ ID NO: 2085201 - protein, 27 aa, Staphylococcus
SVMDSGFDGFFLIAANPVDILTRYVKE

SEQ ID NO: 2085202 - protein, 26 aa, Staphylococcus
SVMDSGFDGYFLIAANPVDILTRFIK

SEQ ID NO: 2085203 - protein, 17 aa, Staphylococcus
SVMFDYGVLKRPQFFFA

SEQ ID NO: 2085204 - protein, 21 aa, Staphylococcus
SVMPGFDFYFIPTVMNSNDTT

SEQ ID NO: 2085205 - protein, 18 aa, Staphylococcus
SVMPGFDFYFVPTVLNSN

SEQ ID NO: 2085206 - protein, 24 aa, Staphylococcus
SVNELSYKLLEEKYNYAKAVKELV

SEQ ID NO: 2085207 - protein, 17 aa, Staphylococcus
SVNFQNYGKQHAFEQSE

SEQ ID NO: 2085208 - protein, 17 aa, Staphylococcus
SVNFQNYGKQHAYQQSE

SEQ ID NO: 2085209 - protein, 20 aa, Staphylococcus
SVNFTHEFMFARPVNRTNDM

SEQ ID NO: 2085210 - protein, 25 aa, Staphylococcus
SVNGACLTVIDFTSNYFSVQLIKGT

SEQ ID NO: 2085211 - protein, 26 aa, Staphylococcus
SVNIKTLVYPGFATDLQQPITPLLFL

SEQ ID NO: 2085212 - protein, 17 aa, Staphylococcus
SVNMQPWRFLVVESDEG

SEQ ID NO: 2085213 - protein, 25 aa, Staphylococcus
SVNNQAWLAAFMLKQNGITPTLADT

SEQ ID NO: 2085214 - protein, 17 aa, Staphylococcus
SVNPYRLEGQKTGAFEV

SEQ ID NO: 2085215 - protein, 21 aa, Staphylococcus
SVNQMLFSLKLTAHAAHDITE

SEQ ID NO: 2085216 - protein, 29 aa, Staphylococcus
SVPQLSIRYDLQIGVLPLPRSTNPVHMKE

SEQ ID NO: 2085217 - protein, 17 aa, Staphylococcus
SVQKLMDYCKQRHIPMA

SEQ ID NO: 2085218 - protein, 24 aa, Staphylococcus
SVQKLSLRFMDCHLAHFIASDAHS

SEQ ID NO: 2085219 - protein, 20 aa, Staphylococcus
SVQNLYRNYAYKNKLKQIEQ

SEQ ID NO: 2085220 - protein, 17 aa, Staphylococcus
SVRFLVDQIQFIVNGEV

SEQ ID NO: 2085221 - protein, 28 aa, Staphylococcus
SVRSISGYPFVWWFATQPEFDGQGYGSQ

SEQ ID NO: 2085222 - protein, 18 aa, Staphylococcus
SVRTLIIKAERIIDDMHI

SEQ ID NO: 2085223 - protein, 39 aa, Staphylococcus
SVSHEMIQLIKKPIGVTAGIVPWNAPIMVLMRKVIPALV

SEQ ID NO: 2085224 - protein, 27 aa, Staphylococcus
SVSITQLLERFLFPSATHGKKIYKLSG

SEQ ID NO: 2085225 - protein, 23 aa, Staphylococcus
SVSLDFTLPLSFLDGVTAGKENI

SEQ ID NO: 2085226 - protein, 27 aa, Staphylococcus
SVSVTQLLERFLFPSATHGKKIYKLSG

SEQ ID NO: 2085227 - protein, 27 aa, Staphylococcus
SVSVTQLLERFLFPSSTHGKKVYKLSG

SEQ ID NO: 2085228 - protein, 23 aa, Staphylococcus
SVTEKLAYLFKLVGKQIPTHIYK

SEQ ID NO: 2085229 - protein, 22 aa, Staphylococcus
SVTLKLIAQLIRPTKGKIQTNG

SEQ ID NO: 2085230 - protein, 32 aa, Staphylococcus
SVTSLFYTFKLMKHNVLPSLLLPELSGPFLSL

SEQ ID NO: 2085231 - protein, 33 aa, Staphylococcus
SVTSMFYTFKLMKHNVLPSLLLPELSGPFLSIN

SEQ ID NO: 2085232 - protein, 24 aa, Staphylococcus
SVTVTNVFIVSRKGKILGSNLNEL

SEQ ID NO: 2085233 - protein, 37 aa, Staphylococcus
SVVDNTFMTPYFQNPLTLGIDIVLHSATKYIGGHSDV

SEQ ID NO: 2085234 - protein, 18 aa, Staphylococcus
SVVFFNFRPDRAGQLSEI

SEQ ID NO: 2085235 - protein, 20 aa, Staphylococcus
SVVLEEMKPTHYGVGGVRKS

SEQ ID NO: 2085236 - protein, 36 aa, Staphylococcus
SVVLRPNVSFAMIPKFNLFIALGIRDAIQAFSRDKV

SEQ ID NO: 2085237 - protein, 23 aa, Staphylococcus
SVVLRSLIEGFTLRLESKFNTEQ

SEQ ID NO: 2085238 - protein, 27 aa, Staphylococcus
SVVPLKPLQEAFGLKRVAYTTYQAVSG

SEQ ID NO: 2085239 - protein, 26 aa, Staphylococcus
SVVSKLNQLFNLDKLTLSGGGGVNWS

SEQ ID NO: 2085240 - protein, 25 aa, Staphylococcus
SVVSPKFSGLFSLNDDFDSILSKIS

SEQ ID NO: 2085241 - protein, 27 aa, Staphylococcus
SVVVIVAHIIWIRCCLYYSGVITEEEL

SEQ ID NO: 2085242 - protein, 19 aa, Staphylococcus
SVVYVPAPFAADSILEAAD

SEQ ID NO: 2085243 - protein, 24 aa, Staphylococcus
SVYDAMVRLSQGWKLCHVLIEMQG

SEQ ID NO: 2085244 - protein, 30 aa, Staphylococcus; identical to SEQ ID NO: 2040719

SEQ ID NO: 2085245 - protein, 22 aa, Staphylococcus
SWDVQARYTYLTANGGFVTVLP

SEQ ID NO: 2085246 - protein, 20 aa, Staphylococcus
SWDYAHCLPYFKRLEKTFGA

SEQ ID NO: 2085247 - protein, 17 aa, Staphylococcus
SWKERARVKNLRKSENY

SEQ ID NO: 2085248 - protein, 21 aa, Staphylococcus
SWLEFKDKYLNLFINNQFDNT

SEQ ID NO: 2085249 - protein, 25 aa, Staphylococcus
SWLTYEEFFILRGFIESAIKKEDIV

SEQ ID NO: 2085250 - protein, 18 aa, Staphylococcus
SWNGLIINYLSRCADYTA

SEQ ID NO: 2085251 - protein, 32 aa, Staphylococcus
SWTMPKREEGFYISWLHLAQHDPMLTKTQRKM

SEQ ID NO: 2085252 - protein, 19 aa, Staphylococcus
SWVYYFRYENSADKRIQAF

SEQ ID NO: 2085253 - protein, 27 aa, Staphylococcus
SWYQQSIQFNLYYQTPYIWTAMIDYLS

SEQ ID NO: 2085254 - protein, 32 aa, Staphylococcus
SYAAFEPALDYVISKIPRFPFDKFEKGERVLG

SEQ ID NO: 2085255 - protein, 19 aa, Staphylococcus
SYAFDLLPESERRAVWAVY

SEQ ID NO: 2085256 - protein, 20 aa, Staphylococcus
SYAGWVPDYPDPTAFLQTMT

SEQ ID NO: 2085257 - protein, 20 aa, Staphylococcus
SYAHYLLIEQAVEALRGSGY

SEQ ID NO: 2085258 - protein, 17 aa, Staphylococcus
SYALQHLLPKRVAQAHK

SEQ ID NO: 2085259 - protein, 26 aa, Staphylococcus
SYCSQPHHKLIPHKIYGFGGDPITQI

SEQ ID NO: 2085260 - protein, 17 aa, Staphylococcus
SYDGLNIVVAEKDLWYF

SEQ ID NO: 2085261 - protein, 20 aa, Staphylococcus
SYDKYVFRDLPPSIQAIKTT

SEQ ID NO: 2085262 - protein, 22 aa, Staphylococcus
SYDNDFLLGCMRQSLIDEGKLS

SEQ ID NO: 2085263 - protein, 24 aa, Staphylococcus
SYDQRKIIKIYDFLLKNLEEERNQ

SEQ ID NO: 2085264 - protein, 23 aa, Staphylococcus
SYDTFLVANIINRAMFNQKIRKE

SEQ ID NO: 2085265 - protein, 18 aa, Staphylococcus
SYEDMLTSFQYMLKFIKE

SEQ ID NO: 2085266 - protein, 20 aa, Staphylococcus
SYEEPDASKLPWGDLDIDVV

SEQ ID NO: 2085267 - protein, 19 aa, Staphylococcus
SYEKLIADIGKKGYVRLRV

SEQ ID NO: 2085268 - protein, 19 aa, Staphylococcus
SYELAFEELEKENDFLQIV

SEQ ID NO: 2085269 - protein, 26 aa, Staphylococcus
SYELQDMLHLFPQLKIAKEPYGLHAN

SEQ ID NO: 2085270 - protein, 20 aa, Staphylococcus
SYELRLPLVPLEDNDRQTLE

SEQ ID NO: 2085271 - protein, 18 aa, Staphylococcus
SYEMFMKFLSDIKEINGI

SEQ ID NO: 2085272 - protein, 24 aa, Staphylococcus
SYEPWKFQAFRPQKIILDESIISE

SEQ ID NO: 2085273 - protein, 36 aa, Staphylococcus
SYETILKHYYPKNRARLVIYPAAMRYAGPKEAVLHA

SEQ ID NO: 2085274 - protein, 31 aa, Staphylococcus
SYETTEYILDQLPCWLTYTNGETHKVIDDNL

SEQ ID NO: 2085275 - protein, 26 aa, Staphylococcus
SYFDRFRDRIMFPLNNAQGRIVGYSG

SEQ ID NO: 2085276 - protein, 25 aa, Staphylococcus
SYFFNGVKHILKAKNKQLTGIRGAV

SEQ ID NO: 2085277 - protein, 19 aa, Staphylococcus
SYFFNISKYADRLLAFYDE

SEQ ID NO: 2085278 - protein, 26 aa, Staphylococcus
SYGKKVIVFSFFEDTIKYLENNLHLL

SEQ ID NO: 2085279 - protein, 18 aa, Staphylococcus
SYGPFKMACDKNHISTVY

SEQ ID NO: 2085280 - protein, 20 aa, Staphylococcus
SYHSLWHQYTNAIIYYYMVD

SEQ ID NO: 2085281 - protein, 31 aa, Staphylococcus
SYHSYMNEMLFKQYPYFNPSLLHIPNGDADN

SEQ ID NO: 2085282 - protein, 17 aa, Staphylococcus
SYHVIIEYPIETLNGQK

SEQ ID NO: 2085283 - protein, 20 aa, Staphylococcus
SYHVIIKYPIETLNGQKHIL

SEQ ID NO: 2085284 - protein, 20 aa, Staphylococcus
SYHVLTMLKIAKSLCDIYPL

SEQ ID NO: 2085285 - protein, 19 aa, Staphylococcus
SYHVLTMLKVAKSICDIYP

SEQ ID NO: 2085286 - protein, 20 aa, Staphylococcus
SYHVLTMLQIAKSLCDIYPL

SEQ ID NO: 2085287 - protein, 26 aa, Staphylococcus
SYHVTNDHLIFFNIAASMGSIRFMNV

SEQ ID NO: 2085288 - protein, 29 aa, Staphylococcus
SYHYYMDDILFNQYPYFNRQRIHIPNGDV

SEQ ID NO: 2085289 - protein, 25 aa, Staphylococcus
SYIERYVYDLYDKHTRHITVVTSDM

SEQ ID NO: 2085290 - protein, 24 aa, Staphylococcus
SYIERYVYDLYNKHTTHITVVTSD

SEQ ID NO: 2085291 - protein, 17 aa, Staphylococcus
SYIFKNILWEVYQHQCD

SEQ ID NO: 2085292 - protein, 19 aa, Staphylococcus
SYIMMELTRIKGATVKLNS

SEQ ID NO: 2085293 - protein, 21 aa, Staphylococcus
SYINSIRTWHNIRSKMIPLSI

SEQ ID NO: 2085294 - protein, 19 aa, Staphylococcus
SYIQDIWGYIAPNTKNEKS

SEQ ID NO: 2085295 - protein, 20 aa, Staphylococcus
SYIQFHLNQQPRPKVKKIKN

SEQ ID NO: 2085296 - protein, 29 aa, Staphylococcus
SYITPKSIYWKPKQSLILNFDKSTLDLTG

SEQ ID NO: 2085297 - protein, 20 aa, Staphylococcus
SYIYDYPHDKLYKAIAGEGA

SEQ ID NO: 2085298 - protein, 19 aa, Staphylococcus
SYIYDYPHNKLYKAISGEG

SEQ ID NO: 2085299 - protein, 20 aa, Staphylococcus
SYIYQKGTPFEYEALHHIDT

SEQ ID NO: 2085300 - protein, 26 aa, Staphylococcus
SYKEWKLNDLPIIPNKMKTIVISKTR

SEQ ID NO: 2085301 - protein, 21 aa, Staphylococcus
SYKKAADIPGLKWIELDVAIT

SEQ ID NO: 2085302 - protein, 33 aa, Staphylococcus
SYKQLPLTLFQIQSKYRDEKRPRFGLLRGREFI

SEQ ID NO: 2085303 - protein, 20 aa, Staphylococcus
SYKRLPLTLFQIQSKYRDEK

SEQ ID NO: 2085304 - protein, 25 aa, Staphylococcus
SYKVNDIVYIYATSPFQNIRYKTQV

SEQ ID NO: 2085305 - protein, 17 aa, Staphylococcus
SYLFVLESQDSIFFSQT

SEQ ID NO: 2085306 - protein, 26 aa, Staphylococcus
SYLKENSINVIPLNVTIDGKSYIDQI

SEQ ID NO: 2085307 - protein, 19 aa, Staphylococcus
SYLLEILNHKKKPSIMLVM

SEQ ID NO: 2085308 - protein, 24 aa, Staphylococcus
SYLNEFIVLAKYQNYFKASQELYI

SEQ ID NO: 2085309 - protein, 19 aa, Staphylococcus
SYLNGKKGALSYIQDIWGY

SEQ ID NO: 2085310 - protein, 30 aa, Staphylococcus
SYLNGTQGTLKYIQDIWGYIAPNTKKEQTP

SEQ ID NO: 2085311 - protein, 20 aa, Staphylococcus
SYLSMILNDIGVNAKAMTGH

SEQ ID NO: 2085312 - protein, 21 aa, Staphylococcus
SYNGWHSVIDIVLNGTWHCTQ

SEQ ID NO: 2085313 - protein, 18 aa, Staphylococcus
SYNIKYGPGELIIPDYNG

SEQ ID NO: 2085314 - protein, 20 aa, Staphylococcus
SYNLKSLMLEYLRFSNYDSE

SEQ ID NO: 2085315 - protein, 18 aa, Staphylococcus
SYNVKPPFFIQWDESEAY

SEQ ID NO: 2085316 - protein, 23 aa, Staphylococcus
SYPDLKMVILIATPKTINNEALL

SEQ ID NO: 2085317 - protein, 18 aa, Staphylococcus
SYPFIKITKEKHPRLLVT

SEQ ID NO: 2085318 - protein, 20 aa, Staphylococcus
SYPFSLLTIEQIVTTLSFAI

SEQ ID NO: 2085319 - protein, 23 aa, Staphylococcus
SYPVAEILCKLLPAFVNEPLPEK

SEQ ID NO: 2085320 - protein, 19 aa, Staphylococcus
SYRAGKNIFPYAASKHGVV

SEQ ID NO: 2085321 - protein, 25 aa, Staphylococcus
SYREDILPTFKNLGLDAYIDIIVGR

SEQ ID NO: 2085322 - protein, 19 aa, Staphylococcus
SYRFQQFYNQAVTIYTSLI

SEQ ID NO: 2085323 - protein, 25 aa, Staphylococcus
SYRIHKGFHMLKFEGINNINDIEQY

SEQ ID NO: 2085324 - protein, 21 aa, Staphylococcus
SYRISEFSEIDYMISDYAKPQ

SEQ ID NO: 2085325 - protein, 20 aa, Staphylococcus
SYRLIIPNIIFKSNLNEIYD

SEQ ID NO: 2085326 - protein, 17 aa, Staphylococcus
SYRLTIPHISYLSNSKL

SEQ ID NO: 2085327 - protein, 25 aa, Staphylococcus
SYRMDDLIVSYLIQAYLIKYSKVTL

SEQ ID NO: 2085328 - protein, 25 aa, Staphylococcus
SYRMHKGFHMLTFEGIHNINDIEHF

SEQ ID NO: 2085329 - protein, 26 aa, Staphylococcus
SYRVHKGFHMLKFEGINNINDVEQYK

SEQ ID NO: 2085330 - protein, 30 aa, Staphylococcus
SYSRKQFYFEILDYFFGNRKIRFRCIVVNT

SEQ ID NO: 2085331 - protein, 25 aa, Staphylococcus
SYTGQIITFTYPLIGNYGINRDDFE

SEQ ID NO: 2085332 - protein, 24 aa, Staphylococcus
SYVDNVYMMLNKPKDYISATEDNA

SEQ ID NO: 2085333 - protein, 26 aa, Staphylococcus
SYVGQFLEILGFDIPLDQKDANKYKP

SEQ ID NO: 2085334 - protein, 21 aa, Staphylococcus
SYVGQFLQKVGFNGSVPKDME

SEQ ID NO: 2085335 - protein, 24 aa, Staphylococcus
SYVLERTMRMLHPYMPFVTEEIWQ

SEQ ID NO: 2085336 - protein, 25 aa, Staphylococcus
SYVMRYLLDGRVPNLPLAINYPEYE

SEQ ID NO: 2085337 - protein, 17 aa, Staphylococcus
SYYANYLKKLHYPVQIV

SEQ ID NO: 2085338 - protein, 26 aa, Staphylococcus
SYYDRFRDRIMFPLNNAQGRIVGYSG

SEQ ID NO: 2085339 - protein, 24 aa, Staphylococcus
SYYDRFRDRIMFPLNNAQGRTVGY

SEQ ID NO: 2085340 - protein, 25 aa, Staphylococcus
SYYDRFRDRIMFPLNNAQGRTVGYS

SEQ ID NO: 2085341 - protein, 22 aa, Staphylococcus
SYYIIRAPLLPVSIYNTYLKND

SEQ ID NO: 2085342 - protein, 31 aa, Staphylococcus
SYYQRGKVDMTYGRAFILVCEDSLLSKAKDE

SEQ ID NO: 2085343 - protein, 24 aa, Staphylococcus
SYYTYMHELLFNHNEWNEDHIYIP

SEQ ID NO: 2085344 - protein, 31 aa, Staphylococcus
TAAELGAPLWKKWLMAFAARKINKAAEEHHA

SEQ ID NO: 2085345 - protein, 30 aa, Staphylococcus
TAAIDRQLFYQFIMRLPDSVLRLKGFVKFR

SEQ ID NO: 2085346 - protein, 17 aa, Staphylococcus
TAAIYTARKGLRTGIVA

SEQ ID NO: 2085347 - protein, 24 aa, Staphylococcus
TAAKQTKWFPLVGQAISASISYYF

SEQ ID NO: 2085348 - protein, 18 aa, Staphylococcus
TAALLIYEALRQQNFPGL

SEQ ID NO: 2085349 - protein, 18 aa, Staphylococcus
TAALLIYEALRQQSFPGL

SEQ ID NO: 2085350 - protein, 29 aa, Staphylococcus
TAAPGWQKWVWSPFLSSLGSGATAFVYNG

SEQ ID NO: 2085351 - protein, 24 aa, Staphylococcus
TACYLLVNKSIRRGYKSMPEHVNM

SEQ ID NO: 2085352 - protein, 23 aa, Staphylococcus
TACYLLVNRSIRRGYKSMPEHVN

SEQ ID NO: 2085353 - protein, 21 aa, Staphylococcus
TADDELGERLAFISNSTGGVL

SEQ ID NO: 2085354 - protein, 23 aa, Staphylococcus
TADLPIFDKAKRWLDAYFSGNNP

SEQ ID NO: 2085355 - protein, 24 aa, Staphylococcus
TADQLELLRILYNYDRLSQYDLTM

SEQ ID NO: 2085356 - protein, 30 aa, Staphylococcus
TADSLHIGHLLPFLTLRRFQEHGHRPLVLI

SEQ ID NO: 2085357 - protein, 30 aa, Staphylococcus; identical to SEQ ID NO: 2040858

SEQ ID NO: 2085358 - protein, 30 aa, Staphylococcus
TADSMHIGHLLPLLTLRRFQNHGHKPIVLI

SEQ ID NO: 2085359 - protein, 21 aa, Staphylococcus
TADVLIVYIFGGVEFIPDSYT

SEQ ID NO: 2085360 - protein, 20 aa, Staphylococcus
TADVLLVYIFERVEFIPDHY

SEQ ID NO: 2085361 - protein, 21 aa, Staphylococcus
TAEFNIWVDAEAAKRVFECGV

SEQ ID NO: 2085362 - protein, 22 aa, Staphylococcus
TAEIGLFKIISESGTGAGVRRI

SEQ ID NO: 2085363 - protein, 28 aa, Staphylococcus
TAELHDLAFLLLVYPLSEVEGALDSAYY

SEQ ID NO: 2085364 - protein, 23 aa, Staphylococcus
TAEQLELLRILYNYDRLSQYDLT

SEQ ID NO: 2085365 - protein, 24 aa, Staphylococcus
TAEQQIWLTGYLTAQQGAVAQTTE

SEQ ID NO: 2085366 - protein, 24 aa, Staphylococcus
TAESFKAFIYYIEQHKTVFKHLLV

SEQ ID NO: 2085367 - protein, 23 aa, Staphylococcus
TAEWNAFWDPEAVKIVFDSEIKI

SEQ ID NO: 2085368 - protein, 23 aa, Staphylococcus
TAEWNAFWDPSAVKTVFDADLTI

SEQ ID NO: 2085369 - protein, 20 aa, Staphylococcus
TAEYLAVQGIIVYGASRRIE

SEQ ID NO: 2085370 - protein, 30 aa, Staphylococcus
TAFKLFNDPKYNIYSKLFKSWSGTIHTSMY

SEQ ID NO: 2085371 - protein, 17 aa, Staphylococcus
TAGAVRIGLVARALFGE

SEQ ID NO: 2085372 - protein, 17 aa, Staphylococcus
TAGDIIRLLEGPITFVE

SEQ ID NO: 2085373 - protein, 18 aa, Staphylococcus
TAGDIIRLLEGPITFVES

SEQ ID NO: 2085374 - protein, 20 aa, Staphylococcus
TAHLGFGNYELRLPLIPLDD

SEQ ID NO: 2085375 - protein, 24 aa, Staphylococcus
TAIFPKLVFSIKDGINLKKDDPNY

SEQ ID NO: 2085376 - protein, 23 aa, Staphylococcus
TAILTGNFLLARGLEHISNIEAN

SEQ ID NO: 2085377 - protein, 22 aa, Staphylococcus
TAILTGNYLLALALNNISSIQD

SEQ ID NO: 2085378 - protein, 18 aa, Staphylococcus
TAINPFGYGRIIRNEQQQ

SEQ ID NO: 2085379 - protein, 19 aa, Staphylococcus
TAIQFGPRKFKLPVVPANM

SEQ ID NO: 2085380 - protein, 22 aa, Staphylococcus
TAISNLLLVTGNYRKPGSGAYP

SEQ ID NO: 2085381 - protein, 33 aa, Staphylococcus
TAIVEGIYTPELLKFPFIPVSDASGIVVEIGSK

SEQ ID NO: 2085382 - protein, 28 aa, Staphylococcus
TAKFEGLIHRFRRSFLLNDNFEKKRFKA

SEQ ID NO: 2085383 - protein, 28 aa, Staphylococcus
TAKFEGLIHRFRRSFLLNDNFEKNKFRS

SEQ ID NO: 2085384 - protein, 18 aa, Staphylococcus
TAKFLHYKNKPYKLNKKE

SEQ ID NO: 2085385 - protein, 28 aa, Staphylococcus
TAKQLKLKAVIFMPVTTPLQKINQVKFF

SEQ ID NO: 2085386 - protein, 24 aa, Staphylococcus
TAKQWDLLNLLQRELDALGLATEL

SEQ ID NO: 2085387 - protein, 24 aa, Staphylococcus
TAKSEQTMIRRGPNIKLPDLDILN

SEQ ID NO: 2085388 - protein, 17 aa, Staphylococcus
TAKWFDFYSTEMAPLIE

SEQ ID NO: 2085389 - protein, 20 aa, Staphylococcus
TALDMQGFSLTLVPNSEATL

SEQ ID NO: 2085390 - protein, 18 aa, Staphylococcus
TALFHYKLKRYSTKMGKR

SEQ ID NO: 2085391 - protein, 24 aa, Staphylococcus
TALKFAAHKLKKWGLPANRNTVRL

SEQ ID NO: 2085392 - protein, 21 aa, Staphylococcus
TALQLPPFYEARRHEIEAALT

SEQ ID NO: 2085393 - protein, 25 aa, Staphylococcus
TANLRTIRAIPLRINKPLTFEVRGE

SEQ ID NO: 2085394 - protein, 25 aa, Staphylococcus
TAPFTPFYRALDWVVTDPLAAIKDE

SEQ ID NO: 2085395 - protein, 25 aa, Staphylococcus
TAPFTPFYRALDWVVTNPLEAIKDE

SEQ ID NO: 2085396 - protein, 23 aa, Staphylococcus
TAPKRFIREFRNVNVDEYEVGQE

SEQ ID NO: 2085397 - protein, 23 aa, Staphylococcus
TAQFIIEPLRKQLESLDYIGLSY

SEQ ID NO: 2085398 - protein, 18 aa, Staphylococcus
TAQFPLMVKMIDAQEPLS

SEQ ID NO: 2085399 - protein, 24 aa, Staphylococcus
TAQKLRDITLAHVLQINAVPKARI

SEQ ID NO: 2085400 - protein, 23 aa, Staphylococcus
TAQMKAMFLEKYNEAFPNGEIEE

SEQ ID NO: 2085401 - protein, 27 aa, Staphylococcus
TARIAPHPFINVLLHALLQTSGAQIAS

SEQ ID NO: 2085402 - protein, 22 aa, Staphylococcus
TARKIIKVLFEKDLLLVTQGTD

SEQ ID NO: 2085403 - protein, 24 aa, Staphylococcus
TARRIYSLIKKVFNIEVEILVRKK

SEQ ID NO: 2085404 - protein, 23 aa, Staphylococcus
TARRIYSLIKKVFNVEVELLVRK

SEQ ID NO: 2085405 - protein, 22 aa, Staphylococcus
TARRIYSLIKRIFNVEVEILVR

SEQ ID NO: 2085406 - protein, 22 aa, Staphylococcus
TARRIYSLIKRVFDVEVEILVR

SEQ ID NO: 2085407 - protein, 19 aa, Staphylococcus
TASEFYYRAMRMGIKGLVS

SEQ ID NO: 2085408 - protein, 26 aa, Staphylococcus
TASETFVIISFKHRIILIGGTEYAGE

SEQ ID NO: 2085409 - protein, 17 aa, Staphylococcus
TASKFPYAANGRALSLD

SEQ ID NO: 2085410 - protein, 23 aa, Staphylococcus
TASKSLLQYVSGLTAPIAQNIID

SEQ ID NO: 2085411 - protein, 17 aa, Staphylococcus
TASLYVNQFSKNPKENL

SEQ ID NO: 2085412 - protein, 26 aa, Staphylococcus
TASQFDIPNTWKLIAQMPFGDVRESA

SEQ ID NO: 2085413 - protein, 22 aa, Staphylococcus
TASRSLLQYVSGLSSQIAQNLI

SEQ ID NO: 2085414 - protein, 18 aa, Staphylococcus
TASSFFEGTPGYQQQMFG

SEQ ID NO: 2085415 - protein, 24 aa, Staphylococcus
TASTPFTMIYSILAKYQSSSITND

SEQ ID NO: 2085416 - protein, 25 aa, Staphylococcus
TATMPLYLNALTGKSAFLITTNDYL

SEQ ID NO: 2085417 - protein, 19 aa, Staphylococcus
TAVCNPIVNSYKRLVPGYE

SEQ ID NO: 2085418 - protein, 29 aa, Staphylococcus
TAVDHQLLRRLVAFMYETPATLIDYFQQD

SEQ ID NO: 2085419 - protein, 28 aa, Staphylococcus
TAVEVDNLIWYLGELIKNELKIAIGPIE

SEQ ID NO: 2085420 - protein, 20 aa, Staphylococcus
TAVKGLLDKLLTDDSEILTM

SEQ ID NO: 2085421 - protein, 22 aa, Staphylococcus
TAVQLPKYMTWLDLSNRDDYTF

SEQ ID NO: 2085422 - protein, 24 aa, Staphylococcus
TAVSTSVLYLIEDIPQHAQDLKEV

SEQ ID NO: 2085423 - protein, 25 aa, Staphylococcus
TAYENGISRQLNLQRVVRPVKNIRQ

SEQ ID NO: 2085424 - protein, 22 aa, Staphylococcus
TAYETSALYGAPLTLPETQPDT

SEQ ID NO: 2085425 - protein, 26 aa, Staphylococcus
TAYINDMTIMFYDRRFYAEGDQVNLE

SEQ ID NO: 2085426 - protein, 17 aa, Staphylococcus
TAYVLRKSMLERYVFDG

SEQ ID NO: 2085427 - protein, 18 aa, Staphylococcus
TAYYRYLSQRIGAIIETT

SEQ ID NO: 2085428 - protein, 23 aa, Staphylococcus
TCFGAPFLPLNPNKYADLLGELI

SEQ ID NO: 2085429 - protein, 26 aa, Staphylococcus
TCFGAPFLPLNPTVYADLLGALIDEH

SEQ ID NO: 2085430 - protein, 17 aa, Staphylococcus
TCFQFNVPFIVTRAVSD

SEQ ID NO: 2085431 - protein, 23 aa, Staphylococcus
TCGKTPHYPFLKNRQRQYTTLCG

SEQ ID NO: 2085432 - protein, 18 aa, Staphylococcus
TCLNVGCIPSKTLLEHGK

SEQ ID NO: 2085433 - protein, 20 aa, Staphylococcus
TCPHGRPIIINFSNYELEKL

SEQ ID NO: 2085434 - protein, 19 aa, Staphylococcus
TCPHGRPIIINFSNYELER

SEQ ID NO: 2085435 - protein, 25 aa, Staphylococcus
TCWKTPPYIFEPKVRKIFGIAGDEA

SEQ ID NO: 2085436 - protein, 22 aa, Staphylococcus
TCWKTPPYIFEPKVRKVFGVHG

SEQ ID NO: 2085437 - protein, 23 aa, Staphylococcus
TCYLAACKPAFKDALHSAVQTEC

SEQ ID NO: 2085438 - protein, 18 aa, Staphylococcus
TDADLRILRRLVRDTKER

SEQ ID NO: 2085439 - protein, 26 aa, Staphylococcus
TDAGIFDFDILVVSLGFESETFGIKG

SEQ ID NO: 2085440 - protein, 21 aa, Staphylococcus
TDAIIVYTLVKPEIKKYMVAK

SEQ ID NO: 2085441 - protein, 22 aa, Staphylococcus
TDAIKWVLGEQSAKSLRGAKME

SEQ ID NO: 2085442 - protein, 20 aa, Staphylococcus
TDAIKWVLGEQSAKSLRGSK

SEQ ID NO: 2085443 - protein, 22 aa, Staphylococcus
TDAIKWVLGEQSAKSLRGSKME

SEQ ID NO: 2085444 - protein, 27 aa, Staphylococcus
TDAQAEAIVMLQLYRLTNTDIVELKNE

SEQ ID NO: 2085445 - protein, 25 aa, Staphylococcus
TDDDVIKFLKYFTFLEQEEIEALEK

SEQ ID NO: 2085446 - protein, 17 aa, Staphylococcus
TDDEPGWWREIIDGGYM

SEQ ID NO: 2085447 - protein, 25 aa, Staphylococcus
TDDFEDLLYMLNNEYYYAIHFDDNV

SEQ ID NO: 2085448 - protein, 23 aa, Staphylococcus
TDDGIHWLLEKSSERIPALAHSK

SEQ ID NO: 2085449 - protein, 26 aa, Staphylococcus
TDDIRKNFQFLDYAQIAFVSAKERQR

SEQ ID NO: 2085450 - protein, 28 aa, Staphylococcus
TDDLSTDLVWYLWTGKYSSLFGKRAMTT

SEQ ID NO: 2085451 - protein, 20 aa, Staphylococcus
TDDMMLLNTLVAPLSLNIDT

SEQ ID NO: 2085452 - protein, 19 aa, Staphylococcus
TDDTILVSIMFVNNEVGTV

SEQ ID NO: 2085453 - protein, 22 aa, Staphylococcus
TDDTILVSIMFVNNEVGTVQPI

SEQ ID NO: 2085454 - protein, 25 aa, Staphylococcus
TDEAPKQLPVLLLLHGLSSDETSYL

SEQ ID NO: 2085455 - protein, 27 aa, Staphylococcus
TDEDLREIYKWMDLGRKLDERLWLLNR

SEQ ID NO: 2085456 - protein, 25 aa, Staphylococcus
TDEFEDLLYSLNNVYYYAVHYDETV

SEQ ID NO: 2085457 - protein, 25 aa, Staphylococcus
TDEGAIILKFFLSLDKDIQLERFKA

SEQ ID NO: 2085458 - protein, 27 aa, Staphylococcus
TDEGIWRRFVIIPFDKQIPLKEVDRDL

SEQ ID NO: 2085459 - protein, 17 aa, Staphylococcus
TDEILELLLKIKEERNL

SEQ ID NO: 2085460 - protein, 25 aa, Staphylococcus
TDEPLLYLNGFNFDNGKAKLYPLTF

SEQ ID NO: 2085461 - protein, 24 aa, Staphylococcus
TDEQLHRLYHYACQLDLEVLVEVH

SEQ ID NO: 2085462 - protein, 23 aa, Staphylococcus
TDEQLLELNPERLILMVDKKDEP

SEQ ID NO: 2085463 - protein, 28 aa, Staphylococcus
TDFKEEDIELFRDIADKVKQTNSYDLAF

SEQ ID NO: 2085464 - protein, 25 aa, Staphylococcus
TDFKQWMTCEESLRFFGGLSGLNKT

SEQ ID NO: 2085465 - protein, 25 aa, Staphylococcus
TDFLKAMPIIIHGDAAYPGQGINFE

SEQ ID NO: 2085466 - protein, 17 aa, Staphylococcus
TDFLYQTEWQAWLKDET

SEQ ID NO: 2085467 - protein, 33 aa, Staphylococcus
TDGAHIQVLLLTFFFKYMKPLVEAGRVFIALPP

SEQ ID NO: 2085468 - protein, 34 aa, Staphylococcus
TDGAHIQVLLLTFFFKYMKPLVQAGRVFIALPPL

SEQ ID NO: 2085469 - protein, 47 aa, Staphylococcus
TDGAHIQVLLLTFFFKYMKPLVQAGRVFIALPPLYKLEKGKGKAKQV

SEQ ID NO: 2085470 - protein, 47 aa, Staphylococcus; identical to SEQ ID NO: 1832704

SEQ ID NO: 2085471 - protein, 47 aa, Staphylococcus
TDGAHIQVLLLTFFFKYMKPLVQAGRVFIALPPLYKLEKGKGKSKQV

SEQ ID NO: 2085472 - protein, 47 aa, Staphylococcus
TDGAHIQVLLLTFFFKYMKPLVQAGRVFIALPPLYKLEKGKGKTKKV

SEQ ID NO: 2085473 - protein, 47 aa, Staphylococcus
TDGAHIQVLLLTFFFKYMRPLVQAGRVFIALPPLYKLEKGKGKSKKV

SEQ ID NO: 2085474 - protein, 25 aa, Staphylococcus
TDGDRDLFSLFRKPSESLTHIEEIA

SEQ ID NO: 2085475 - protein, 28 aa, Staphylococcus
TDGGWLADFGIPTILYGPGSLTEAHSVD

SEQ ID NO: 2085476 - protein, 26 aa, Staphylococcus
TDGQIFLQSDLFFSGVRPAINAGQSV

SEQ ID NO: 2085477 - protein, 19 aa, Staphylococcus
TDHKQMLLITNNLYQADKL

SEQ ID NO: 2085478 - protein, 25 aa, Staphylococcus
TDHMKKIMTMLDVKTIKDLKQTQMV

SEQ ID NO: 2085479 - protein, 19 aa, Staphylococcus
TDHRIGMMLAIASLLSNEA

SEQ ID NO: 2085480 - protein, 20 aa, Staphylococcus
TDHRIGMMLAIASLLSSEPL

SEQ ID NO: 2085481 - protein, 27 aa, Staphylococcus
TDHTREYIPVLLYSPKLKDKAHELSGD

SEQ ID NO: 2085482 - protein, 21 aa, Staphylococcus
TDIAKYCDIFYIGGTKVGALC

SEQ ID NO: 2085483 - protein, 25 aa, Staphylococcus
TDIEYKFPFGWGELWGIASRTDFDL

SEQ ID NO: 2085484 - protein, 25 aa, Staphylococcus
TDIEYKFPFGWGELWGIASRTDYDL

SEQ ID NO: 2085485 - protein, 19 aa, Staphylococcus
TDIIVINLSSGISGSYQSA

SEQ ID NO: 2085486 - protein, 20 aa, Staphylococcus
TDINYLIAGGLTLNKIKYIE

SEQ ID NO: 2085487 - protein, 19 aa, Staphylococcus
TDIYNRLNFDFGTLGNHEF

SEQ ID NO: 2085488 - protein, 25 aa, Staphylococcus
TDKGIYDFDILVVALGFVSETFGID

SEQ ID NO: 2085489 - protein, 18 aa, Staphylococcus
TDKIIDAFGMRPYIKKKV

SEQ ID NO: 2085490 - protein, 24 aa, Staphylococcus
TDKKANYYYGTLEKFLYKLKEHHI

SEQ ID NO: 2085491 - protein, 18 aa, Staphylococcus
TDKLVLSDVLVFIESDVL

SEQ ID NO: 2085492 - protein, 22 aa, Staphylococcus
TDKMGFIYHGNYATWFEVARTD

SEQ ID NO: 2085493 - protein, 22 aa, Staphylococcus
TDKTKVILLNYPTNPTGVILER

SEQ ID NO: 2085494 - protein, 22 aa, Staphylococcus
TDKVILLFTGPLTDLAEALKRK

SEQ ID NO: 2085495 - protein, 20 aa, Staphylococcus
TDLAVFQFEAGVVKLVELQP

SEQ ID NO: 2085496 - protein, 26 aa, Staphylococcus
TDLDAFYISYQLAPLARMLGPQQLID

SEQ ID NO: 2085497 - protein, 28 aa, Staphylococcus
TDLELALEYLMFGQLLAAKKSVAFGLNP

SEQ ID NO: 2085498 - protein, 20 aa, Staphylococcus
TDLVLIINQINMWNRLSISM

SEQ ID NO: 2085499 - protein, 24 aa, Staphylococcus
TDMHPFIHPFNPAIDPLWESRSDW

SEQ ID NO: 2085500 - protein, 23 aa, Staphylococcus
TDMHPYVHPFNPAIDPLWESRSD

SEQ ID NO: 2085501 - protein, 25 aa, Staphylococcus
TDMMNRMHRDMGFSQPEWGASIHLD

SEQ ID NO: 2085502 - protein, 26 aa, Staphylococcus
TDMYYNTMIELVKPLGKIATIVAFKE

SEQ ID NO: 2085503 - protein, 25 aa, Staphylococcus
TDNGNYILDCALPKGIDPYEMHEFL

SEQ ID NO: 2085504 - protein, 21 aa, Staphylococcus
TDPDPLPMDLIYRRLDEIPDL

SEQ ID NO: 2085505 - protein, 20 aa, Staphylococcus
TDPIPLHWDAEALVTNYFQC

SEQ ID NO: 2085506 - protein, 28 aa, Staphylococcus
TDPSFRVPMPHRIFNYFNAFIGTSDFQP

SEQ ID NO: 2085507 - protein, 21 aa, Staphylococcus
TDQALLEIYERLRPGEPPTVE

SEQ ID NO: 2085508 - protein, 24 aa, Staphylococcus
TDQDLISYAIYPKVYEQYINTKEQ

SEQ ID NO: 2085509 - protein, 23 aa, Staphylococcus
TDQEDYFLLVQRKRKSTFFDAEI

SEQ ID NO: 2085510 - protein, 23 aa, Staphylococcus
TDQIWDFPYITEQINRVLSQFEK

SEQ ID NO: 2085511 - protein, 18 aa, Staphylococcus
TDQLVEWIESTYPDVEIE

SEQ ID NO: 2085512 - protein, 24 aa, Staphylococcus
TDQNLFEKWFHPQGATTEVYESDV

SEQ ID NO: 2085513 - protein, 20 aa, Staphylococcus
TDQNVAQLVEDLRSEIQKMR

SEQ ID NO: 2085514 - protein, 21 aa, Staphylococcus
TDQNVSKLVEDLRSEIQKMRD

SEQ ID NO: 2085515 - protein, 24 aa, Staphylococcus
TDRFKPFMNILMINLSRNPNETVK

SEQ ID NO: 2085516 - protein, 17 aa, Staphylococcus
TDRGLLVPVVKHADRKS

SEQ ID NO: 2085517 - protein, 17 aa, Staphylococcus
TDRGLLVPVVKNADRKS

SEQ ID NO: 2085518 - protein, 28 aa, Staphylococcus
TDRKEGIHYKNLLGSYLHGPVLPKNHEM

SEQ ID NO: 2085519 - protein, 18 aa, Staphylococcus
TDRQGGYTRVLKAGPRRG

SEQ ID NO: 2085520 - protein, 17 aa, Staphylococcus
TDRRPFNDVLLHGLVRA

SEQ ID NO: 2085521 - protein, 19 aa, Staphylococcus
TDRVLLFAPFYTEAVQHDT

SEQ ID NO: 2085522 - protein, 22 aa, Staphylococcus
TDRYFQIEEMPTLGFAPDAEFP

SEQ ID NO: 2085523 - protein, 33 aa, Staphylococcus
TDSDKMVADLERPYILITDKKISSFQDILPLLE

SEQ ID NO: 2085524 - protein, 26 aa, Staphylococcus
TDSGIFNYDILVVALGFETETFGING

SEQ ID NO: 2085525 - protein, 30 aa, Staphylococcus
TDSHIIPRKIYALPDEHRWAPQSGVTLIGD

SEQ ID NO: 2085526 - protein, 32 aa, Staphylococcus
TDSTGHILNLYFPFIDVETMLTLLDLSNVYVS

SEQ ID NO: 2085527 - protein, 20 aa, Staphylococcus
TDSVDFLRPIKTGDILSYEA

SEQ ID NO: 2085528 - protein, 25 aa, Staphylococcus
TDSYEDLLYMLDSNYYYAVHFDEKV

SEQ ID NO: 2085529 - protein, 17 aa, Staphylococcus
TDTIHAPWLIVPADHKK

SEQ ID NO: 2085530 - protein, 24 aa, Staphylococcus
TDTRTMIPFLNSIQEIYGHLPEYI

SEQ ID NO: 2085531 - protein, 17 aa, Staphylococcus
TDTRTMIPFLNSIQETY

SEQ ID NO: 2085532 - protein, 26 aa, Staphylococcus
TDTYNDWLVIGYTPMTLFTPEKEDFT

SEQ ID NO: 2085533 - protein, 23 aa, Staphylococcus
TDVELQHHYLWRFAKEMPRTGHI

SEQ ID NO: 2085534 - protein, 20 aa, Staphylococcus
TDVIVVFLSSGISGSYQSGK

SEQ ID NO: 2085535 - protein, 26 aa, Staphylococcus
TDVKERFYFHAVYMKEPGNLIFEFAT

SEQ ID NO: 2085536 - protein, 24 aa, Staphylococcus
TDVKWCRMMIRQILSNSLKYSDNT

SEQ ID NO: 2085537 - protein, 17 aa, Staphylococcus
TDVLFKYVESIVGKNKS

SEQ ID NO: 2085538 - protein, 21 aa, Staphylococcus
TDVTFFDFPGIPKGTHGTDEI

SEQ ID NO: 2085539 - protein, 22 aa, Staphylococcus
TDWDGVKLDVYILGKALGGGVL

SEQ ID NO: 2085540 - protein, 25 aa, Staphylococcus
TDYEKLYLTYLIQGLKLTKLDFIHR

SEQ ID NO: 2085541 - protein, 25 aa, Staphylococcus
TDYHQSMPIIIHGDAAYPGQGINFE

SEQ ID NO: 2085542 - protein, 17 aa, Staphylococcus
TDYILLDEPLNNLDMKH

SEQ ID NO: 2085543 - protein, 18 aa, Staphylococcus
TDYKGRIFCYVLTENHYV

SEQ ID NO: 2085544 - protein, 25 aa, Staphylococcus
TDYLDLFLIHWPCEADDLFIESYKA

SEQ ID NO: 2085545 - protein, 24 aa, Staphylococcus
TDYNAIMETLYLQQNPANAAHLKR

SEQ ID NO: 2085546 - protein, 23 aa, Staphylococcus
TDYQTILTDLIYNGKTVTSAEAG

SEQ ID NO: 2085547 - protein, 27 aa, Staphylococcus
TDYSSFISYHIFFETLLRKYNERKDNG

SEQ ID NO: 2085548 - protein, 26 aa, Staphylococcus
TDYSSFISYHIFFETLLRKYNERKEK

SEQ ID NO: 2085549 - protein, 24 aa, Staphylococcus
TEADIKLMMREVRLALLEADVNFK

SEQ ID NO: 2085550 - protein, 19 aa, Staphylococcus
TEADWDYIQNINLKGMFFV

SEQ ID NO: 2085551 - protein, 23 aa, Staphylococcus
TEADWIIDIGPYAGSKGGKLLFE

SEQ ID NO: 2085552 - protein, 27 aa, Staphylococcus
TEAEFEKHMYAIHTLTSLYTSSDNQTS

SEQ ID NO: 2085553 - protein, 26 aa, Staphylococcus
TEAERLVIHGFLDPVVRELPIEDVKR

SEQ ID NO: 2085554 - protein, 20 aa, Staphylococcus
TEAGLFYIGILLPHNSDLAN

SEQ ID NO: 2085555 - protein, 26 aa, Staphylococcus
TEAKRKGLEPFATWLLQPKLNENVES

SEQ ID NO: 2085556 - protein, 27 aa, Staphylococcus
TEAQAEAIVMLQLYRLTNTDIVALEEE

SEQ ID NO: 2085557 - protein, 28 aa, Staphylococcus
TEAQAEAIVMLQLYRLTNTDIVALEEEH

SEQ ID NO: 2085558 - protein, 27 aa, Staphylococcus
TEARALKFFKYFYSQRGPILDYTNLSL

SEQ ID NO: 2085559 - protein, 25 aa, Staphylococcus
TEARALKVFKYFYTHRGPVMDYSNI

SEQ ID NO: 2085560 - protein, 17 aa, Staphylococcus
TEARKFGKAIIADGGIK

SEQ ID NO: 2085561 - protein, 24 aa, Staphylococcus
TEATAYIFIKMLQQMKELGVSNHK

SEQ ID NO: 2085562 - protein, 24 aa, Staphylococcus
TEATAYMFIKMLKQLEALGVHNHQ

SEQ ID NO: 2085563 - protein, 23 aa, Staphylococcus
TEDDKYFLLVQPNSSYDFYSAEA

SEQ ID NO: 2085564 - protein, 33 aa, Staphylococcus
TEDDVLMYDFLKYYDLPVLIIATKEDKIAKGKV

SEQ ID NO: 2085565 - protein, 30 aa, Staphylococcus
TEDNRFYDHGALDYKRLFGAVAKNVTGGFG

SEQ ID NO: 2085566 - protein, 30 aa, Staphylococcus
TEDNRFYKHGALDYKRLFGAVGKNITGGFG

SEQ ID NO: 2085567 - protein, 24 aa, Staphylococcus
TEDTIYDGFLDYARNFKKYEGKDQ

SEQ ID NO: 2085568 - protein, 23 aa, Staphylococcus
TEDVRFLFLPQDLPKHEKLEKNQ

SEQ ID NO: 2085569 - protein, 26 aa, Staphylococcus
TEDVRIEFQFLDYAQIAFVSAKEQLR

SEQ ID NO: 2085570 - protein, 27 aa, Staphylococcus
TEEDLKNMYKWMDLGRKLDERLWLLNR

SEQ ID NO: 2085571 - protein, 28 aa, Staphylococcus
TEEDLKSMYKWMDLGRKLDERMWLLNRA

SEQ ID NO: 2085572 - protein, 24 aa, Staphylococcus
TEEEIEFFINGYTKGDIPDYQASS

SEQ ID NO: 2085573 - protein, 28 aa, Staphylococcus
TEEIKDKMLSWVLPHYKGLSREGMKDIV

SEQ ID NO: 2085574 - protein, 28 aa, Staphylococcus
TEEIKTQMLEWILPYYKSLSREGMKDIV

SEQ ID NO: 2085575 - protein, 17 aa, Staphylococcus
TEEKLELAKKILISQRN

SEQ ID NO: 2085576 - protein, 18 aa, Staphylococcus
TEERFVIVVQSLEEKHQR

SEQ ID NO: 2085577 - protein, 23 aa, Staphylococcus
TEETIDIMLFSHGQMYIDGLTIV

SEQ ID NO: 2085578 - protein, 19 aa, Staphylococcus
TEETILVSIMFVNNEIGTV

SEQ ID NO: 2085579 - protein, 25 aa, Staphylococcus
TEEYFDRVILLNRNIRYFGDSITAM

SEQ ID NO: 2085580 - protein, 22 aa, Staphylococcus
TEFDIHRMLPHPINVVRVKLTG

SEQ ID NO: 2085581 - protein, 30 aa, Staphylococcus
TEFEIITTMMFLYFGEIHPVDFVVIEAGLG

SEQ ID NO: 2085582 - protein, 21 aa, Staphylococcus
TEFENKLYQAYRYNEKLKSRI

SEQ ID NO: 2085583 - protein, 32 aa, Staphylococcus
TEFENLYDWLSGFKLLSIPMTKFKKKPVYKEM

SEQ ID NO: 2085584 - protein, 25 aa, Staphylococcus
TEFKKSMPILIHGDAAYPGQGINFE

SEQ ID NO: 2085585 - protein, 22 aa, Staphylococcus
TEFLMDHRHLWLRSKKQHAVMK

SEQ ID NO: 2085586 - protein, 25 aa, Staphylococcus
TEFPDQTVQVFKIGDGGLGGEIHLY

SEQ ID NO: 2085587 - protein, 25 aa, Staphylococcus
TEFPEQVIQVFQIGEGGLGGELHLY

SEQ ID NO: 2085588 - protein, 18 aa, Staphylococcus
TEFPQFFERAPFAPEGQD

SEQ ID NO: 2085589 - protein, 28 aa, Staphylococcus
TEFQVIEYPLLELIVRYNDNGYETRYLA

SEQ ID NO: 2085590 - protein, 33 aa, Staphylococcus
TEGELTFPSFIKQLLLQIPYFEKNQSQILLETT

SEQ ID NO: 2085591 - protein, 17 aa, Staphylococcus
TEGKPWFPVNPNYKDIN

SEQ ID NO: 2085592 - protein, 17 aa, Staphylococcus
TEGLLKEQFYTKGKYKD

SEQ ID NO: 2085593 - protein, 20 aa, Staphylococcus
TEGLTLHPLEKMKLPMSIEA

SEQ ID NO: 2085594 - protein, 21 aa, Staphylococcus
TEGPGLIGALLIGINAAKALA

SEQ ID NO: 2085595 - protein, 24 aa, Staphylococcus
TEGTGIFVVLVRSYSHFSMQDYPS

SEQ ID NO: 2085596 - protein, 24 aa, Staphylococcus
TEGTIYDGFLEYARNFKKYEGKDQ

SEQ ID NO: 2085597 - protein, 24 aa, Staphylococcus
TEGTIYEGFLEYARNFKKYEGKDQ

SEQ ID NO: 2085598 - protein, 27 aa, Staphylococcus
TEGVYMVPAFVGLGTPYWDSDARGAFF

SEQ ID NO: 2085599 - protein, 27 aa, Staphylococcus
TEGYHTLLTIGRYPICYINIEMDPILV

SEQ ID NO: 2085600 - protein, 25 aa, Staphylococcus
TEHLEILNRLFTPLIGPQSIGLYHF

SEQ ID NO: 2085601 - protein, 19 aa, Staphylococcus
TEHLFLMSIHNDDNPMIAI

SEQ ID NO: 2085602 - protein, 35 aa, Staphylococcus
TEHMFFAPERLIEMRRFILFDTQDKRIAALNTIKQ

SEQ ID NO: 2085603 - protein, 27 aa, Staphylococcus
TEHMFFGAERLVQMRRFILASSKEERV

SEQ ID NO: 2085604 - protein, 25 aa, Staphylococcus
TEHRELFGEFPSKDFPLLAKIVDAE

SEQ ID NO: 2085605 - protein, 17 aa, Staphylococcus
TEHSVAMLLAMARNIPN

SEQ ID NO: 2085606 - protein, 30 aa, Staphylococcus
TEIERLRYLVDNDFYFDLFAKYSEADLQEI

SEQ ID NO: 2085607 - protein, 17 aa, Staphylococcus
TEIKGPVYVLLTMERIV

SEQ ID NO: 2085608 - protein, 23 aa, Staphylococcus
TEIKRLNLTLKKTIRVESEMKKQ

SEQ ID NO: 2085609 - protein, 17 aa, Staphylococcus
TEILREPGFFRRLKVMP

SEQ ID NO: 2085610 - protein, 24 aa, Staphylococcus
TEINEKVIMLITKQQPIATDLRLM

SEQ ID NO: 2085611 - protein, 25 aa, Staphylococcus
TEISSGIFAFDNRVLFSKLEEVKND

SEQ ID NO: 2085612 - protein, 26 aa, Staphylococcus
TEIYAMMHGALKRLIEGSSFSTGWIF

SEQ ID NO: 2085613 - protein, 20 aa, Staphylococcus
TEKALALYIPHSEKPNEIKP

SEQ ID NO: 2085614 - protein, 19 aa, Staphylococcus
TEKDLFVILSGSGSTEHLR

SEQ ID NO: 2085615 - protein, 25 aa, Staphylococcus
TEKEHNLFLLLCNGVSFEKAGSIFG

SEQ ID NO: 2085616 - protein, 28 aa, Staphylococcus
TEKFKTTMITFKFMAPLEYETITARSVL

SEQ ID NO: 2085617 - protein, 23 aa, Staphylococcus
TEKHLYDIINKHLSFHGVKPVSL

SEQ ID NO: 2085618 - protein, 23 aa, Staphylococcus
TEKIYKQLLREGVDFMTMGNHTY

SEQ ID NO: 2085619 - protein, 21 aa, Staphylococcus
TEKLKRYYKDFGFTEIENHTS

SEQ ID NO: 2085620 - protein, 17 aa, Staphylococcus
TEKLVFIADYIEPGRKT

SEQ ID NO: 2085621 - protein, 19 aa, Staphylococcus
TEKLVFIADYIEPGRQTPG

SEQ ID NO: 2085622 - protein, 26 aa, Staphylococcus
TEKPDLIIMDIKMPKLNGLKASKIIS

SEQ ID NO: 2085623 - protein, 25 aa, Staphylococcus
TEKPLKLFHPVHTYKMKFIKSFEAK

SEQ ID NO: 2085624 - protein, 25 aa, Staphylococcus
TEKQKNYLELFYLNDYSLSEIAETF

SEQ ID NO: 2085625 - protein, 19 aa, Staphylococcus
TEKTILVSIMFVNNEVGTV

SEQ ID NO: 2085626 - protein, 30 aa, Staphylococcus
TELEIDFSKKLRAAIPSLEKIRFVNSGTEA

SEQ ID NO: 2085627 - protein, 18 aa, Staphylococcus
TELFKLKSNLWQLAKDTY

SEQ ID NO: 2085628 - protein, 18 aa, Staphylococcus
TELIAFDINDWWHDAQNG

SEQ ID NO: 2085629 - protein, 21 aa, Staphylococcus
TELIAIPGTPPDLLHPPKGDA

SEQ ID NO: 2085630 - protein, 22 aa, Staphylococcus
TELLQMMKLLKDDQIIYPRIAT

SEQ ID NO: 2085631 - protein, 19 aa, Staphylococcus
TELNIRLLDQRISIEVSDA

SEQ ID NO: 2085632 - protein, 19 aa, Staphylococcus
TELPFLLKCVQTAVDVGAS

SEQ ID NO: 2085633 - protein, 23 aa, Staphylococcus
TELQILNMLFRNEGKYVSRTALI

SEQ ID NO: 2085634 - protein, 30 aa, Staphylococcus
TELQPENMYQLLRKLPPREYSISSSYKATP

SEQ ID NO: 2085635 - protein, 27 aa, Staphylococcus
TELTTPEPIYPLWHRAMNAYDKASDSE

SEQ ID NO: 2085636 - protein, 19 aa, Staphylococcus
TELVLTLGSQMVVLAERAN

SEQ ID NO: 2085637 - protein, 19 aa, Staphylococcus
TELVLTLGSQMVVLAQKAQ

SEQ ID NO: 2085638 - protein, 53 aa, Staphylococcus
TELVYGTLKRKYTLDYLLKPFVQTKLKGWVRQLLWMSIYQYVYLDKIPEHAII

SEQ ID NO: 2085639 - protein, 21 aa, Staphylococcus
TELYFNYLTSVLRLQRWIPPL

SEQ ID NO: 2085640 - protein, 19 aa, Staphylococcus
TEMYIGIANLKYVDKKKII

SEQ ID NO: 2085641 - protein, 17 aa, Staphylococcus
TENLRTIHAIPLKIKEP

SEQ ID NO: 2085642 - protein, 20 aa, Staphylococcus
TENMLGMFANTLLYRGHPTN

SEQ ID NO: 2085643 - protein, 25 aa, Staphylococcus
TENNELLDPFYLTKIWNQFAEFKQF

SEQ ID NO: 2085644 - protein, 17 aa, Staphylococcus
TENPFEIDPLSFNKLLI

SEQ ID NO: 2085645 - protein, 28 aa, Staphylococcus
TENVIFIGLLCDEGLWKAVIFEIGLGKT

SEQ ID NO: 2085646 - protein, 25 aa, Staphylococcus
TENYDPFVFLTYLSAFTSKIALGTS

SEQ ID NO: 2085647 - protein, 27 aa, Staphylococcus
TEPDSETIFKFINQRLLKLIDNSKAST

SEQ ID NO: 2085648 - protein, 24 aa, Staphylococcus
TEPGYKSVLIALNRFVTATIEPST

SEQ ID NO: 2085649 - protein, 23 aa, Staphylococcus
TEPGYKSVLIAVNRFVTASIEAS

SEQ ID NO: 2085650 - protein, 25 aa, Staphylococcus
TEPGYKSVLIAVNRFVTATIKASNE

SEQ ID NO: 2085651 - protein, 20 aa, Staphylococcus
TEPKIKLYVSLSVDHFEQTA

SEQ ID NO: 2085652 - protein, 20 aa, Staphylococcus
TEPKIKLYVSLTIDHFDDVA

SEQ ID NO: 2085653 - protein, 18 aa, Staphylococcus
TEPSYWFFNQENLPNPAV

SEQ ID NO: 2085654 - protein, 28 aa, Staphylococcus
TEQAAIPYDFILLATGFEPTLLKQPMIQ

SEQ ID NO: 2085655 - protein, 26 aa, Staphylococcus
TEQDIISYVLYPKVYEQFIATQKQFG

SEQ ID NO: 2085656 - protein, 25 aa, Staphylococcus
TEQDVISYVLYPKVFDQFMQTKQQY

SEQ ID NO: 2085657 - protein, 24 aa, Staphylococcus
TEQDVISYVLYPKVYNQYIQTKEQ

SEQ ID NO: 2085658 - protein, 25 aa, Staphylococcus
TEQENQLYQAYRYTDKLKSRIDSLA

SEQ ID NO: 2085659 - protein, 26 aa, Staphylococcus
TEQIIIRLHDLGFGPKLAMAIYQAYL

SEQ ID NO: 2085660 - protein, 18 aa, Staphylococcus
TEQILTRFNIQFSTIDTT

SEQ ID NO: 2085661 - protein, 22 aa, Staphylococcus
TEQKFLDLFDKHELDSAVIGEV

SEQ ID NO: 2085662 - protein, 18 aa, Staphylococcus
TEQLYNPNFLSDLGYRHR

SEQ ID NO: 2085663 - protein, 21 aa, Staphylococcus
TERDILLVPDVLASAGGVTVS

SEQ ID NO: 2085664 - protein, 19 aa, Staphylococcus
TEREKLLHLGDILHKRVVG

SEQ ID NO: 2085665 - protein, 17 aa, Staphylococcus
TERFIERGIIEIAPLAY

SEQ ID NO: 2085666 - protein, 28 aa, Staphylococcus
TERFYQLPKYLFEDIYFKKMSAEAKIMY

SEQ ID NO: 2085667 - protein, 19 aa, Staphylococcus
TERGLLVPVVKHADRKSMF

SEQ ID NO: 2085668 - protein, 21 aa, Staphylococcus
TERHWPADLVLLSIGFEGTEP

SEQ ID NO: 2085669 - protein, 23 aa, Staphylococcus
TERHWPADLVLLSIGFEGTETTV

SEQ ID NO: 2085670 - protein, 25 aa, Staphylococcus
TERHWPADLVLLSIGFIGTETTVPH

SEQ ID NO: 2085671 - protein, 25 aa, Staphylococcus
TERHWPADLVLLSIGFVGTENIVPH

SEQ ID NO: 2085672 - protein, 32 aa, Staphylococcus
TERKGDYGFGYDPIFYLPEKNKTMAELTTEEK

SEQ ID NO: 2085673 - protein, 22 aa, Staphylococcus
TERRVQRLYKALDSLGDSKPDW

SEQ ID NO: 2085674 - protein, 17 aa, Staphylococcus
TERSFEMIISMVAAIKV

SEQ ID NO: 2085675 - protein, 24 aa, Staphylococcus
TESKLYYHFDSLKKKGLIEVTQTI

SEQ ID NO: 2085676 - protein, 31 aa, Staphylococcus
TESLNYLKQYKYIFWLDCDIDVIFKRVTNDK

SEQ ID NO: 2085677 - protein, 26 aa, Staphylococcus
TESQDWASMLLRMYQRYAEQQGFKVE

SEQ ID NO: 2085678 - protein, 18 aa, Staphylococcus
TESQDWASMLLRMYQRYG

SEQ ID NO: 2085679 - protein, 25 aa, Staphylococcus
TESQDWVSMLLRMYQRYCEQSGFKV

SEQ ID NO: 2085680 - protein, 27 aa, Staphylococcus
TESRALKFFKYFYSQKGPILDFNHLEL

SEQ ID NO: 2085681 - protein, 24 aa, Staphylococcus
TESTLLIGLLKDVPGRPGSMGKAI

SEQ ID NO: 2085682 - protein, 22 aa, Staphylococcus
TESVPQIVGMTKALEIATKNRD

SEQ ID NO: 2085683 - protein, 24 aa, Staphylococcus
TESYPLIQQLIDEGLPFDTNTANN

SEQ ID NO: 2085684 - protein, 25 aa, Staphylococcus
TETEVINVFPIRFVVDKDNEVSDPK

SEQ ID NO: 2085685 - protein, 24 aa, Staphylococcus
TETGLWLEEAGEPYDILRNEGIDV

SEQ ID NO: 2085686 - protein, 25 aa, Staphylococcus
TETLFEQWFHPQGGKTKVYRFNPEA

SEQ ID NO: 2085687 - protein, 33 aa, Staphylococcus
TETTGHILNLYFPFIDVETMLTLLDLANIYVSS

SEQ ID NO: 2085688 - protein, 27 aa, Staphylococcus
TETYHPAMLILLFQVFYEFQEKQRKNA

SEQ ID NO: 2085689 - protein, 20 aa, Staphylococcus
TEVLHFERLSYRVFQEVGGL

SEQ ID NO: 2085690 - protein, 22 aa, Staphylococcus
TEVPLPVIGIVKRDYEGSDVFI

SEQ ID NO: 2085691 - protein, 19 aa, Staphylococcus
TEVPYAYFSRHLDFDIPEE

SEQ ID NO: 2085692 - protein, 21 aa, Staphylococcus
TEVVDTFPIRFVVDGDNEVSD

SEQ ID NO: 2085693 - protein, 21 aa, Staphylococcus
TEVYKYLVELLEKNQLDVSHV

SEQ ID NO: 2085694 - protein, 17 aa, Staphylococcus
TEWVDLWQKALQVNYRP

SEQ ID NO: 2085695 - protein, 25 aa, Staphylococcus
TEYARIMPHITIKPHFELKETELDS

SEQ ID NO: 2085696 - protein, 25 aa, Staphylococcus
TEYEDKLYQAYRYTDKMRARIESLE

SEQ ID NO: 2085697 - protein, 31 aa, Staphylococcus
TEYMRHPYPFYMDPLPNLYFTRDPQAFIGNG

SEQ ID NO: 2085698 - protein, 21 aa, Staphylococcus
TEYRLMAKLPNLTDYNLEHLH

SEQ ID NO: 2085699 - protein, 18 aa, Staphylococcus
TEYYSVRFGLDIICLRFS

SEQ ID NO: 2085700 - protein, 27 aa, Staphylococcus
TFADIKTYIFYQLFETFVIDQSMASST

SEQ ID NO: 2085701 - protein, 20 aa, Staphylococcus
TFANLDSRAIWYIFEESEIS

SEQ ID NO: 2085702 - protein, 25 aa, Staphylococcus
TFDDLVDFVMWLKSPQRYKKVIYKD

SEQ ID NO: 2085703 - protein, 18 aa, Staphylococcus
TFDMERILRLMRPSKDEV

SEQ ID NO: 2085704 - protein, 44 aa, Staphylococcus
TFDVAYNFLKENPWKRLERLRKEIPNVLFQMLLRASNAVGYKNY

SEQ ID NO: 2085705 - protein, 23 aa, Staphylococcus
TFDVITIFCDSLNYLNSYNAVMD

SEQ ID NO: 2085706 - protein, 25 aa, Staphylococcus
TFEELPFYEIGWRLIPEVWGNGFAT

SEQ ID NO: 2085707 - protein, 26 aa, Staphylococcus
TFEERMEEEMFLGLRMNQGVSISRFK

SEQ ID NO: 2085708 - protein, 19 aa, Staphylococcus
TFEIWMSLLNGCSLLVVPD

SEQ ID NO: 2085709 - protein, 19 aa, Staphylococcus
TFELDFPYELTPDQSKSIE

SEQ ID NO: 2085710 - protein, 19 aa, Staphylococcus
TFEMTQEVFRILRPYYTSE

SEQ ID NO: 2085711 - protein, 18 aa, Staphylococcus
TFESAVTALQRWLPEVRR

SEQ ID NO: 2085712 - protein, 17 aa, Staphylococcus
TFETPLVEFFYKNDDLN

SEQ ID NO: 2085713 - protein, 19 aa, Staphylococcus
TFFPPYTFEDWTVASSEEG

SEQ ID NO: 2085714 - protein, 19 aa, Staphylococcus
TFFPPYTFEEWEVASSEEG

SEQ ID NO: 2085715 - protein, 25 aa, Staphylococcus
TFGEPAIAIPFTSGKVKVLIESLEK

SEQ ID NO: 2085716 - protein, 23 aa, Staphylococcus
TFGEPAIAIPFTTGKVKAKIESL

SEQ ID NO: 2085717 - protein, 21 aa, Staphylococcus
TFGGNPLACAVSIAALDVIID

SEQ ID NO: 2085718 - protein, 20 aa, Staphylococcus
TFGGNPLACAVSIAALDVIL

SEQ ID NO: 2085719 - protein, 19 aa, Staphylococcus
TFGIFFNQRTNPLYQKVKS

SEQ ID NO: 2085720 - protein, 21 aa, Staphylococcus
TFGKFGIFSFNGNKIITTSGG

SEQ ID NO: 2085721 - protein, 25 aa, Staphylococcus
TFGQPAIAIPFNASKIKILIESMEE

SEQ ID NO: 2085722 - protein, 25 aa, Staphylococcus
TFGQPAIAIPFNSGKIKVLIESLEK

SEQ ID NO: 2085723 - protein, 25 aa, Staphylococcus
TFGQPAIAIPFTSGKVKVLIESLEK

SEQ ID NO: 2085724 - protein, 22 aa, Staphylococcus
TFGVTKFYQKKGIGLALINAVE

SEQ ID NO: 2085725 - protein, 20 aa, Staphylococcus
TFGYTEVPVRKLPSAAIIAT

SEQ ID NO: 2085726 - protein, 18 aa, Staphylococcus
TFHLKPNAYMEYIADPII

SEQ ID NO: 2085727 - protein, 18 aa, Staphylococcus
TFHLVCPKELRPKDELLK

SEQ ID NO: 2085728 - protein, 21 aa, Staphylococcus
TFHSMCVRILRRDADRIGIER

SEQ ID NO: 2085729 - protein, 17 aa, Staphylococcus
TFIAMQPLRELEVIEAT

SEQ ID NO: 2085730 - protein, 28 aa, Staphylococcus
TFIGKPQPIIMDMAMDILKLPKDEVAMV

SEQ ID NO: 2085731 - protein, 17 aa, Staphylococcus
TFIGLDVKIGMDTIIEP

SEQ ID NO: 2085732 - protein, 18 aa, Staphylococcus
TFILEKLTPYKEQLKIEG

SEQ ID NO: 2085733 - protein, 17 aa, Staphylococcus
TFITHMYGSPGFSNEKL

SEQ ID NO: 2085734 - protein, 25 aa, Staphylococcus
TFITHVDYYFLDKYAKHVDLIIDAT

SEQ ID NO: 2085735 - protein, 19 aa, Staphylococcus
TFKACFKILMSKQKVNLVN

SEQ ID NO: 2085736 - protein, 17 aa, Staphylococcus
TFKFTPYLEKQATYHID

SEQ ID NO: 2085737 - protein, 25 aa, Staphylococcus
TFKKMHVRMMPKQEPPYTRLIDSAR

SEQ ID NO: 2085738 - protein, 26 aa, Staphylococcus
TFKKMHVRMMPKQEPPYTRLIDSARR

SEQ ID NO: 2085739 - protein, 17 aa, Staphylococcus
TFKKVHDQIPSKLLLLG

SEQ ID NO: 2085740 - protein, 21 aa, Staphylococcus
TFKQEYWKHLARGPETLCIYM

SEQ ID NO: 2085741 - protein, 43 aa, Staphylococcus
TFKQNEGYNLTFFAFFVKAVADALKAHPLLNSTWQGDEIIIHK

SEQ ID NO: 2085742 - protein, 18 aa, Staphylococcus
TFKVAEFEMLPQTDIELS

SEQ ID NO: 2085743 - protein, 28 aa, Staphylococcus
TFLDKPPSAWVVLAKPDLGISSPDVFKA

SEQ ID NO: 2085744 - protein, 17 aa, Staphylococcus
TFLDLVKINSETGNEEK

SEQ ID NO: 2085745 - protein, 20 aa, Staphylococcus
TFLHEINVDRIIFGDPAVVM

SEQ ID NO: 2085746 - protein, 20 aa, Staphylococcus
TFLVANIINRAMYNQKIRKE

SEQ ID NO: 2085747 - protein, 18 aa, Staphylococcus
TFMTPLGQSPLALGADIV

SEQ ID NO: 2085748 - protein, 19 aa, Staphylococcus
TFMTPLGQSPLALGADIVV

SEQ ID NO: 2085749 - protein, 23 aa, Staphylococcus
TFNEKFHLLNRFNKNDFTDEEAY

SEQ ID NO: 2085750 - protein, 18 aa, Staphylococcus
TFNMKIAGDFNAFNAIAA

SEQ ID NO: 2085751 - protein, 24 aa, Staphylococcus
TFNQQLETGGFLLGKDLNVEFDLE

SEQ ID NO: 2085752 - protein, 26 aa, Staphylococcus
TFNYRLGAWGFLDWSFFKSNYDCNNG

SEQ ID NO: 2085753 - protein, 19 aa, Staphylococcus
TFPLEIAGYSKTKANERAK

SEQ ID NO: 2085754 - protein, 22 aa, Staphylococcus
TFPTFLEMLMATYRLVQKAKDT

SEQ ID NO: 2085755 - protein, 19 aa, Staphylococcus
TFQLIKLFQERVKQGQTIV

SEQ ID NO: 2085756 - protein, 22 aa, Staphylococcus
TFQNLFKQFHQFAGMTGTAKQG

SEQ ID NO: 2085757 - protein, 19 aa, Staphylococcus
TFRKSLMIKVFEHTNDYDN

SEQ ID NO: 2085758 - protein, 26 aa, Staphylococcus
TFRRFRARVLRWPLPVLMVSRSISDS

SEQ ID NO: 2085759 - protein, 17 aa, Staphylococcus
TFSDEVIEKIAGIAARE

SEQ ID NO: 2085760 - protein, 17 aa, Staphylococcus
TFSFKMPQFSELEDIIT

SEQ ID NO: 2085761 - protein, 30 aa, Staphylococcus
TFSGGMKRRLSLAITLLSDPSLIILDEPTV

SEQ ID NO: 2085762 - protein, 19 aa, Staphylococcus
TFSKGLLMGARGNSGVILS

SEQ ID NO: 2085763 - protein, 20 aa, Staphylococcus
TFSRTQAFLDEFADALSKAD

SEQ ID NO: 2085764 - protein, 18 aa, Staphylococcus
TFTSMSPALTHFLVSGYD

SEQ ID NO: 2085765 - protein, 22 aa, Staphylococcus
TFTSPFIETFNERISLNGLPIT

SEQ ID NO: 2085766 - protein, 20 aa, Staphylococcus
TFTSPFIETFNERISLNGNP

SEQ ID NO: 2085767 - protein, 20 aa, Staphylococcus
TFTSPYIETFNERISLNGEP

SEQ ID NO: 2085768 - protein, 17 aa, Staphylococcus
TFTVDELAFIVIHFASS

SEQ ID NO: 2085769 - protein, 40 aa, Staphylococcus
TFVCNHILYQLGYLNATRFPNLLFGFIHVPYIPEQVESTS

SEQ ID NO: 2085770 - protein, 27 aa, Staphylococcus
TFVCNHILYQLGYLQATAFPKIKFGFI

SEQ ID NO: 2085771 - protein, 27 aa, Staphylococcus
TFVCNHILYQLGYLQATRYPDIKFGFI

SEQ ID NO: 2085772 - protein, 18 aa, Staphylococcus
TFVIAHRLNINIQNIVFD

SEQ ID NO: 2085773 - protein, 35 aa, Staphylococcus; identical to SEQ ID NO: 1820966

SEQ ID NO: 2085774 - protein, 34 aa, Staphylococcus
TFVSGRLTIDNFRWAGVPFYIRTGKRMKSKCIQV

SEQ ID NO: 2085775 - protein, 17 aa, Staphylococcus
TFYITDFDFPKALTKEE

SEQ ID NO: 2085776 - protein, 17 aa, Staphylococcus
TFYKYIQQYLNDDIDFV

SEQ ID NO: 2085777 - protein, 26 aa, Staphylococcus
TFYLDKFNYTDGLIAPIHSFSLQRPQ

SEQ ID NO: 2085778 - protein, 25 aa, Staphylococcus
TGAEPLYFLDYIATNKVVPSIIEQI

SEQ ID NO: 2085779 - protein, 34 aa, Staphylococcus
TGAFCASPYFTHSYVFISWTGKMAETFVLAHELG

SEQ ID NO: 2085780 - protein, 17 aa, Staphylococcus
TGALMSAGLFIVGRIKG

SEQ ID NO: 2085781 - protein, 22 aa, Staphylococcus
TGALMSAGLFIVGRIKGVSRPA

SEQ ID NO: 2085782 - protein, 30 aa, Staphylococcus
TGAQAWIGTMLKMKPVLKFEDGKIVPDEKV

SEQ ID NO: 2085783 - protein, 32 aa, Staphylococcus
TGAYCASPYYTHSYVFISWTGKMTETFVLAHE

SEQ ID NO: 2085784 - protein, 34 aa, Staphylococcus
TGDDANFVIWDAPNYEYILYHYGINHAENVYKDG

SEQ ID NO: 2085785 - protein, 21 aa, Staphylococcus
TGDDPRKVPMKIFPAVHYSMG

SEQ ID NO: 2085786 - protein, 19 aa, Staphylococcus
TGDIFMPLAQQLKDTFTIV

SEQ ID NO: 2085787 - protein, 24 aa, Staphylococcus
TGDLSHRKLFPSIFHLFQQDNLDE

SEQ ID NO: 2085788 - protein, 25 aa, Staphylococcus
TGDNFSLAVLPLNKALSESTLDQIK

SEQ ID NO: 2085789 - protein, 28 aa, Staphylococcus
TGDVKDVVLLDVTPLSLGIEIMGGRMNT

SEQ ID NO: 2085790 - protein, 24 aa, Staphylococcus
TGDVVFPSILRRGRLTLSISTNGA

SEQ ID NO: 2085791 - protein, 25 aa, Staphylococcus
TGEEYSFFIYPNRSGELFATQNMPD

SEQ ID NO: 2085792 - protein, 22 aa, Staphylococcus
TGEFRKRYGFIYVNRYDNFEGT

SEQ ID NO: 2085793 - protein, 26 aa, Staphylococcus
TGEGKIDFQTLYGKTPMGIAKYANRY

SEQ ID NO: 2085794 - protein, 22 aa, Staphylococcus
TGEGLIITGSLYFISEIKAKIK

SEQ ID NO: 2085795 - protein, 21 aa, Staphylococcus
TGFDPILQIRFHSILNLKDKT

SEQ ID NO: 2085796 - protein, 21 aa, Staphylococcus
TGFDPILQIRFHSVLNLKDKT

SEQ ID NO: 2085797 - protein, 33 aa, Staphylococcus
TGFDYVVTGSGFLYNMVRVLVAFLIEVGKGKRQ

SEQ ID NO: 2085798 - protein, 21 aa, Staphylococcus
TGFLKHLKDLIPKAKSVVISG

SEQ ID NO: 2085799 - protein, 25 aa, Staphylococcus
TGGEPLLRRDLYKLIEKLNRIEGIE

SEQ ID NO: 2085800 - protein, 24 aa, Staphylococcus
TGGEPLLRRNLYQLIEQLNQIDGI

SEQ ID NO: 2085801 - protein, 24 aa, Staphylococcus
TGGKPFNVVMTPSDKKRMMDKNKG

SEQ ID NO: 2085802 - protein, 24 aa, Staphylococcus
TGGKWKVLMIAAEERYVLLENGKM

SEQ ID NO: 2085803 - protein, 28 aa, Staphylococcus
TGHESVIQPILKTKLKQLGLNVIEDQAS

SEQ ID NO: 2085804 - protein, 23 aa, Staphylococcus
TGHISYYFEPLTALAAISRETHS

SEQ ID NO: 2085805 - protein, 33 aa, Staphylococcus
TGIAPYRAYLQERAYLNLKGEQWLIFGNQNYHH

SEQ ID NO: 2085806 - protein, 24 aa, Staphylococcus
TGIDSMCLLYKLLNDLSYSYQSIT

SEQ ID NO: 2085807 - protein, 21 aa, Staphylococcus
TGIERLFGMMLPSGPENMPLS

SEQ ID NO: 2085808 - protein, 17 aa, Staphylococcus
TGIFLDQKEVRKKLRDH

SEQ ID NO: 2085809 - protein, 21 aa, Staphylococcus
TGIFVTILRSFSHYSNKVLPN

SEQ ID NO: 2085810 - protein, 17 aa, Staphylococcus
TGIGVLYGKRTLLNKME

SEQ ID NO: 2085811 - protein, 19 aa, Staphylococcus
TGIIVADPLIIETCKKVAP

SEQ ID NO: 2085812 - protein, 25 aa, Staphylococcus
TGIKVVDLLAPYIKGGKVGLFGGAG

SEQ ID NO: 2085813 - protein, 19 aa, Staphylococcus
TGINIVLKALEAPVRQIAE

SEQ ID NO: 2085814 - protein, 21 aa, Staphylococcus
TGIRIPTITFSGHRRFPMGSN

SEQ ID NO: 2085815 - protein, 27 aa, Staphylococcus
TGKAIRQLLRYCFTYHTHYIDASGDIQ

SEQ ID NO: 2085816 - protein, 21 aa, Staphylococcus
TGKKLAFVPILRAGLGMTQGI

SEQ ID NO: 2085817 - protein, 17 aa, Staphylococcus
TGKSHSFLLPLVNEIDT

SEQ ID NO: 2085818 - protein, 17 aa, Staphylococcus
TGKTFLAVVYAAKELRQ

SEQ ID NO: 2085819 - protein, 23 aa, Staphylococcus
TGKTHTLNFLPGKTLYINVDKSE

SEQ ID NO: 2085820 - protein, 32 aa, Staphylococcus
TGKTTVARLLAQIFKHLGLLSKGHLIETERSK

SEQ ID NO: 2085821 - protein, 18 aa, Staphylococcus
TGKWGEIPVRFISPKGNT

SEQ ID NO: 2085822 - protein, 25 aa, Staphylococcus
TGKYIMYRQFFPESDIIKFEDYFVD

SEQ ID NO: 2085823 - protein, 28 aa, Staphylococcus
TGLEALNLPYLLEQDIPFLINTDNRTVT

SEQ ID NO: 2085824 - protein, 35 aa, Staphylococcus
TGLGEKIEFLNKPPATWVVLAKPDLGISSPDVFKA

SEQ ID NO: 2085825 - protein, 34 aa, Staphylococcus
TGLGKACLYMYDKKLLDCFFLDIEFEQVTPYTVK

SEQ ID NO: 2085826 - protein, 22 aa, Staphylococcus
TGLIKANIPTRIAFMVSSSVDS

SEQ ID NO: 2085827 - protein, 26 aa, Staphylococcus
TGLISNMASLVFLLGDLNVDDLTTML

SEQ ID NO: 2085828 - protein, 26 aa, Staphylococcus
TGLKAIICIHDTTLGPALGGCRVRND

SEQ ID NO: 2085829 - protein, 24 aa, Staphylococcus
TGLLSNMASLVFLLGDLNVKDLSE

SEQ ID NO: 2085830 - protein, 20 aa, Staphylococcus
TGLRNVFNKIAWLNKSEMQE

SEQ ID NO: 2085831 - protein, 17 aa, Staphylococcus
TGLTISVDNAIWKVIDF

SEQ ID NO: 2085832 - protein, 17 aa, Staphylococcus
TGLWLGELVHFYDLMHQ

SEQ ID NO: 2085833 - protein, 24 aa, Staphylococcus
TGMINLCFEIFDDKIKIVISDQGE

SEQ ID NO: 2085834 - protein, 18 aa, Staphylococcus
TGMRAGELLALKWSDIDF

SEQ ID NO: 2085835 - protein, 25 aa, Staphylococcus
TGNGRIKVYVAFRMPSEKLDDYKVL

SEQ ID NO: 2085836 - protein, 18 aa, Staphylococcus
TGNLLVLKTLPGNAQSIG

SEQ ID NO: 2085837 - protein, 22 aa, Staphylococcus
TGNMPNLWPQVSSLRVRTLILT

SEQ ID NO: 2085838 - protein, 18 aa, Staphylococcus
TGPLPDHIHFANSAVDRI

SEQ ID NO: 2085839 - protein, 21 aa, Staphylococcus
TGPVTILNWSFERVDIPRTTV

SEQ ID NO: 2085840 - protein, 20 aa, Staphylococcus
TGPVTILNWSFERVDLPREE

SEQ ID NO: 2085841 - protein, 21 aa, Staphylococcus
TGPVTILNWSFERVDVPRKIV

SEQ ID NO: 2085842 - protein, 22 aa, Staphylococcus
TGQIITFTYPLIGNYGINRDDF

SEQ ID NO: 2085843 - protein, 26 aa, Staphylococcus
TGQKADILLWVLRPEMQELNSIELAL

SEQ ID NO: 2085844 - protein, 25 aa, Staphylococcus
TGQKADILLWYLRPEMKELNEIENE

SEQ ID NO: 2085845 - protein, 20 aa, Staphylococcus
TGQLPLAEAGLLDEFKALAR

SEQ ID NO: 2085846 - protein, 17 aa, Staphylococcus
TGQLQLQSIFWKNGQLA

SEQ ID NO: 2085847 - protein, 24 aa, Staphylococcus
TGQSLELYTPYLETIYSILAASEN

SEQ ID NO: 2085848 - protein, 22 aa, Staphylococcus
TGRIWVNTYNQIPAGAPFGGYK

SEQ ID NO: 2085849 - protein, 18 aa, Staphylococcus
TGRMRYLGVLLYDADRVE

SEQ ID NO: 2085850 - protein, 24 aa, Staphylococcus
TGRTGWYFRVLKEGPIQQNDIFRL

SEQ ID NO: 2085851 - protein, 23 aa, Staphylococcus
TGRYFTHDALRNFLERVPSHIPV

SEQ ID NO: 2085852 - protein, 17 aa, Staphylococcus
TGSKAFVLPIEGANLPS

SEQ ID NO: 2085853 - protein, 20 aa, Staphylococcus
TGSKPFVPPIDGLDNVDYET

SEQ ID NO: 2085854 - protein, 18 aa, Staphylococcus
TGSRPIEIPNFKFGDRVI

SEQ ID NO: 2085855 - protein, 25 aa, Staphylococcus
TGSRPQTLPFLKINHRNILSSDDIL

SEQ ID NO: 2085856 - protein, 22 aa, Staphylococcus
TGSSAFVLPIPGADLPSVIGWR

SEQ ID NO: 2085857 - protein, 25 aa, Staphylococcus
TGSTIELLLPKIAALLNDGTQITGV

SEQ ID NO: 2085858 - protein, 25 aa, Staphylococcus
TGSVPQSLPFLKFDHNVILSSDDIL

SEQ ID NO: 2085859 - protein, 27 aa, Staphylococcus
TGTDARMLYWFTDKEYPVIRKPQGANI

SEQ ID NO: 2085860 - protein, 28 aa, Staphylococcus
TGTGKSHAFLLPLIDLINTDIKEPQSIV

SEQ ID NO: 2085861 - protein, 27 aa, Staphylococcus
TGTGKSHAFLLPLLNSIDTDYKEPQAI

SEQ ID NO: 2085862 - protein, 27 aa, Staphylococcus
TGTIEVYKLFFIETYQTVYQMTSMVTG

SEQ ID NO: 2085863 - protein, 22 aa, Staphylococcus
TGTIFNHLFKQAITFAKRAHSE

SEQ ID NO: 2085864 - protein, 28 aa, Staphylococcus
TGTPIHPMSPLAKIFWMKHEQPEIFQHT

SEQ ID NO: 2085865 - protein, 27 aa, Staphylococcus
TGTPIHPMSPLSKIFWMKHEKPEVYNN

SEQ ID NO: 2085866 - protein, 28 aa, Staphylococcus
TGTPIHPMSPLSKIFWMKHEQPDIFNRT

SEQ ID NO: 2085867 - protein, 27 aa, Staphylococcus
TGTPIHPMSPLSKIFWMKHEQPDIYQN

SEQ ID NO: 2085868 - protein, 24 aa, Staphylococcus
TGTPIHPMSPLSKIFWMKHEQQEI

SEQ ID NO: 2085869 - protein, 24 aa, Staphylococcus
TGTPIHPMSPLSKIFWMKHEQSDI

SEQ ID NO: 2085870 - protein, 27 aa, Staphylococcus
TGTPLHPMSPLSKIFWMKHEQPDIYNQ

SEQ ID NO: 2085871 - protein, 24 aa, Staphylococcus
TGVEKIKMLFRYSDNTDMTLDDIR

SEQ ID NO: 2085872 - protein, 24 aa, Staphylococcus
TGVQPVFIGKPEPIIMNKALEILD

SEQ ID NO: 2085873 - protein, 23 aa, Staphylococcus
TGVQYLATWVSTGGGITPLLDEN

SEQ ID NO: 2085874 - protein, 17 aa, Staphylococcus
TGVSIMNLIKHLAEVHK

SEQ ID NO: 2085875 - protein, 24 aa, Staphylococcus
TGWGKIPMSLGFTYSSNTLMMHLQ

SEQ ID NO: 2085876 - protein, 28 aa, Staphylococcus
TGYQKPMIEFFDYVFEKIGKDKRKSTII

SEQ ID NO: 2085877 - protein, 25 aa, Staphylococcus
TGYQKPMPEFFDYVFNKIGEDKRGY

SEQ ID NO: 2085878 - protein, 24 aa, Staphylococcus
TGYQVLLKVHPFVYKKIAQSDNLK

SEQ ID NO: 2085879 - protein, 22 aa, Staphylococcus
TGYTLNVPLFVNEGDILVINTG

SEQ ID NO: 2085880 - protein, 22 aa, Staphylococcus
TGYTLNVPLFVNEGDILVINTS

SEQ ID NO: 2085881 - protein, 23 aa, Staphylococcus
TGYTLNVPLFVNEGDTLIINTGD

SEQ ID NO: 2085882 - protein, 22 aa, Staphylococcus
THAGLMYYTIGQRHGLGIGGDG

SEQ ID NO: 2085883 - protein, 23 aa, Staphylococcus
THAQMKMFLTRLGFGSKMVVTGD

SEQ ID NO: 2085884 - protein, 24 aa, Staphylococcus
THAQMKMFLTRLGFSSKMVVTGDQ

SEQ ID NO: 2085885 - protein, 23 aa, Staphylococcus
THCEDLLTEFGVWHPKAWEHAPT

SEQ ID NO: 2085886 - protein, 17 aa, Staphylococcus
THDISIYNYQKFLNPTD

SEQ ID NO: 2085887 - protein, 28 aa, Staphylococcus
THDKLALVLVQFPPWFDCSMENVTYLRY

SEQ ID NO: 2085888 - protein, 19 aa, Staphylococcus
THEALINGKRYPIRALMMS

SEQ ID NO: 2085889 - protein, 18 aa, Staphylococcus
THEDFPLLTKILDANDKL

SEQ ID NO: 2085890 - protein, 25 aa, Staphylococcus
THEDGIPVYLGMPMGLILEVEGKTI

SEQ ID NO: 2085891 - protein, 19 aa, Staphylococcus
THELGIPVMIIFEGIPASG

SEQ ID NO: 2085892 - protein, 23 aa, Staphylococcus
THESLKRYLLEETFELFEAIDNE

SEQ ID NO: 2085893 - protein, 23 aa, Staphylococcus
THETLKRYLLEETFELFEAIDNE

SEQ ID NO: 2085894 - protein, 27 aa, Staphylococcus
THETTSTALGFIGGFPGKFIKDALEKA

SEQ ID NO: 2085895 - protein, 23 aa, Staphylococcus
THGAPVNFSGQFYNFVEYGVDQE

SEQ ID NO: 2085896 - protein, 25 aa, Staphylococcus
THGILQPIVLRKTINGYYIVVGERR

SEQ ID NO: 2085897 - protein, 17 aa, Staphylococcus
THHKQISKVKRLGPKTF

SEQ ID NO: 2085898 - protein, 17 aa, Staphylococcus
THHTHVLPIGYPRVQYL

SEQ ID NO: 2085899 - protein, 20 aa, Staphylococcus
THIAAPHRYKLKLIGETSHS

SEQ ID NO: 2085900 - protein, 21 aa, Staphylococcus
THIFNLQQMKLPLILKNGYYS

SEQ ID NO: 2085901 - protein, 22 aa, Staphylococcus
THIQRILMNILLNIQQTDVNHN

SEQ ID NO: 2085902 - protein, 20 aa, Staphylococcus
THLFNDEHYFIYPKDKRAEV

SEQ ID NO: 2085903 - protein, 19 aa, Staphylococcus
THLHQLSFQLYQKLKRQNP

SEQ ID NO: 2085904 - protein, 26 aa, Staphylococcus
THLIDLLENFAIERGIYGKKWLDDEI

SEQ ID NO: 2085905 - protein, 17 aa, Staphylococcus
THLKWGAQKDVIRLIPG

SEQ ID NO: 2085906 - protein, 29 aa, Staphylococcus
THLVQLNIPIFYFYIEDTSFFECYFDRHL

SEQ ID NO: 2085907 - protein, 30 aa, Staphylococcus
THMMHVTISYPLPDNKLLTKLFSQLEDGSV

SEQ ID NO: 2085908 - protein, 28 aa, Staphylococcus
THMNCTLDALYQIPYLINALAETYTDGK

SEQ ID NO: 2085909 - protein, 23 aa, Staphylococcus
THNTKALEAVWDYAYDKVSYLGT

SEQ ID NO: 2085910 - protein, 30 aa, Staphylococcus
THNTSIANIVLAFYLTRPSLDVVIPGAKRA

SEQ ID NO: 2085911 - protein, 24 aa, Staphylococcus
THPDSIFVQNLLITQPKSYGRVTM

SEQ ID NO: 2085912 - protein, 27 aa, Staphylococcus
THPGMTRYFMTIPEASRLVLQAGALAT

SEQ ID NO: 2085913 - protein, 27 aa, Staphylococcus
THPHSLINLINYILLEKSGADIASTAL

SEQ ID NO: 2085914 - protein, 26 aa, Staphylococcus
THPKFAVPMPHRLFDYFNAFIGTSDF

SEQ ID NO: 2085915 - protein, 23 aa, Staphylococcus
THPRYHIPKTYVAKLKGYLMREE

SEQ ID NO: 2085916 - protein, 26 aa, Staphylococcus
THPVNNYILNGITRKVIKWISEDEDI

SEQ ID NO: 2085917 - protein, 19 aa, Staphylococcus
THQAIDNAALLKSSTKYSA

SEQ ID NO: 2085918 - protein, 19 aa, Staphylococcus
THQLAMISYFRNGTIHSIA

SEQ ID NO: 2085919 - protein, 18 aa, Staphylococcus
THQTFFSSSDKLSIGDIP

SEQ ID NO: 2085920 - protein, 23 aa, Staphylococcus
THQTLKRYLLEETFELFEAIDNE

SEQ ID NO: 2085921 - protein, 24 aa, Staphylococcus
THQTLKRYLLEETFELFEAIDNED

SEQ ID NO: 2085922 - protein, 23 aa, Staphylococcus
THQVPLYHKKGKLITLTKAGQIL

SEQ ID NO: 2085923 - protein, 19 aa, Staphylococcus
THQYLAEHQIHVVPLNLTI

SEQ ID NO: 2085924 - protein, 22 aa, Staphylococcus
THRMEVYFKHQLLVLDHSEYLG

SEQ ID NO: 2085925 - protein, 18 aa, Staphylococcus
THRYHYVYDFDTQSILND

SEQ ID NO: 2085926 - protein, 26 aa, Staphylococcus
THSETFIIVSFKHKVILIGGTEYAGE

SEQ ID NO: 2085927 - protein, 18 aa, Staphylococcus
THSFRYTHYALLIEAGVH

SEQ ID NO: 2085928 - protein, 28 aa, Staphylococcus
THSKFVVPTPHRIFDFFNAFIGTSDFDQ

SEQ ID NO: 2085929 - protein, 23 aa, Staphylococcus
THSQHKWLARFDWCKPKSIHFKS

SEQ ID NO: 2085930 - protein, 25 aa, Staphylococcus
THTSNFKLDYPLYINAMTGGSEWTK

SEQ ID NO: 2085931 - protein, 19 aa, Staphylococcus
THVLFLNMHGKPLSRQGIW

SEQ ID NO: 2085932 - protein, 39 aa, Staphylococcus
THVSLVPQTLKWLMDAGLHRPFYIEKILLGGAKLSRNLI

SEQ ID NO: 2085933 - protein, 31 aa, Staphylococcus
THVSLVPQTLKWLMDGGLTQPFSIEKILLGG

SEQ ID NO: 2085934 - protein, 24 aa, Staphylococcus
THVYRLKGFMRFADKPYTYLVQCT

SEQ ID NO: 2085935 - protein, 19 aa, Staphylococcus
THYAQIKPHITIKAQFHIN

SEQ ID NO: 2085936 - protein, 17 aa, Staphylococcus
THYILKDAMPKAIITYH

SEQ ID NO: 2085937 - protein, 29 aa, Staphylococcus
THYQTPLDIIAIKFKCCNKYYPCYKCHNE

SEQ ID NO: 2085938 - protein, 20 aa, Staphylococcus
TIADAVKLPVVLYNVPSRTN

SEQ ID NO: 2085939 - protein, 25 aa, Staphylococcus
TIANEVKLPVVLYNVPSRTNMTIDP

SEQ ID NO: 2085940 - protein, 25 aa, Staphylococcus
TIANEVKLPVVLYNVPSRTNMTIEA

SEQ ID NO: 2085941 - protein, 23 aa, Staphylococcus
TICGKKMLFIHYEIDNSKLNTTI

SEQ ID NO: 2085942 - protein, 19 aa, Staphylococcus
TICSDVLDFAFNPGGPVDG

SEQ ID NO: 2085943 - protein, 17 aa, Staphylococcus
TIDLIGGFKYNAIEGEY

SEQ ID NO: 2085944 - protein, 29 aa, Staphylococcus
TIDMYEPYMSLIKQLFPNAKIIIDRFHIV

SEQ ID NO: 2085945 - protein, 24 aa, Staphylococcus
TIDNLVWYFSEILKNEAHLVTSTV

SEQ ID NO: 2085946 - protein, 24 aa, Staphylococcus
TIDPIKYNLLFERFLNPERVTMPD

SEQ ID NO: 2085947 - protein, 24 aa, Staphylococcus
TIDVDMYIIVSYGVKISEVASNLQ

SEQ ID NO: 2085948 - protein, 21 aa, Staphylococcus
TIDWKSLYEKALNHDFAEVFT

SEQ ID NO: 2085949 - protein, 25 aa, Staphylococcus
TIEEIKLLFLEKYIDYLDESPSLMI

SEQ ID NO: 2085950 - protein, 18 aa, Staphylococcus
TIEESYLMQKLARQVIGT

SEQ ID NO: 2085951 - protein, 26 aa, Staphylococcus
TIEEYLIAIKGPLTTPIGGGIRSLNV

SEQ ID NO: 2085952 - protein, 23 aa, Staphylococcus
TIEGITYSLYESYRYMMQANSNS

SEQ ID NO: 2085953 - protein, 18 aa, Staphylococcus
TIEGMGPLIYYLKSIDEK

SEQ ID NO: 2085954 - protein, 23 aa, Staphylococcus
TIEGMPFSYYMSYVSGAGISLVK

SEQ ID NO: 2085955 - protein, 20 aa, Staphylococcus
TIEIQQWFKRANELGITITI

SEQ ID NO: 2085956 - protein, 21 aa, Staphylococcus
TIEKLYTDILINLDVNKIDTY

SEQ ID NO: 2085957 - protein, 22 aa, Staphylococcus
TIEKYHYAFTRLQIQTFNESGH

SEQ ID NO: 2085958 - protein, 22 aa, Staphylococcus
TIELSFGLKFLNIIDKEMGMEA

SEQ ID NO: 2085959 - protein, 25 aa, Staphylococcus
TIEQMCGHTYLFRMPKHAFDYSNHF

SEQ ID NO: 2085960 - protein, 26 aa, Staphylococcus
TIEQMIQMILYSASKYTRSKLRKALP

SEQ ID NO: 2085961 - protein, 17 aa, Staphylococcus
TIEVNKYRGEVIDSYTN

SEQ ID NO: 2085962 - protein, 18 aa, Staphylococcus
TIEYQSFYNLIQTVYEDQ

SEQ ID NO: 2085963 - protein, 17 aa, Staphylococcus
TIFLHCLPAFHDTNTTY

SEQ ID NO: 2085964 - protein, 17 aa, Staphylococcus
TIFLYGYGSSYVCALEF

SEQ ID NO: 2085965 - protein, 24 aa, Staphylococcus
TIFPSAYVPYLQTFDSRIVDGTGT

SEQ ID NO: 2085966 - protein, 20 aa, Staphylococcus
TIFRVFIIDSQALNRSIRLI

SEQ ID NO: 2085967 - protein, 18 aa, Staphylococcus
TIFSKLKPDIPTCKVIFT

SEQ ID NO: 2085968 - protein, 18 aa, Staphylococcus
TIGKLAYRYKMEGKKVML

SEQ ID NO: 2085969 - protein, 19 aa, Staphylococcus
TIGLLLPNGKAIFNVAIRT

SEQ ID NO: 2085970 - protein, 21 aa, Staphylococcus
TIGMDYPWRYRNKSQLPVGKD

SEQ ID NO: 2085971 - protein, 19 aa, Staphylococcus
TIGMPLAEIKEIISLIYEE

SEQ ID NO: 2085972 - protein, 18 aa, Staphylococcus
TIHAIPLKIKEPLNVEVR

SEQ ID NO: 2085973 - protein, 30 aa, Staphylococcus
TIHKLGLDYLDLYLMHWPGTNEAVMIDTWQ

SEQ ID NO: 2085974 - protein, 17 aa, Staphylococcus
TIHRFTRKLGFDGYSDF

SEQ ID NO: 2085975 - protein, 20 aa, Staphylococcus
TIHVANFTFQIIDSGIENAV

SEQ ID NO: 2085976 - protein, 22 aa, Staphylococcus
TIHVNKPFFIESYKTVYQMTSM

SEQ ID NO: 2085977 - protein, 26 aa, Staphylococcus
TIHVQRHRIQLPKLGWIKLKEKSYIP

SEQ ID NO: 2085978 - protein, 22 aa, Staphylococcus
TIIAHVGLRRHIKKVAKDKGIE

SEQ ID NO: 2085979 - protein, 19 aa, Staphylococcus
TIIAYRRHLHEHPEVSFKE

SEQ ID NO: 2085980 - protein, 20 aa, Staphylococcus
TIICHHPLIFKGIKQITQDD

SEQ ID NO: 2085981 - protein, 27 aa, Staphylococcus
TIIDKQLIYDEWIAQGIKPLKFRIYHG

SEQ ID NO: 2085982 - protein, 18 aa, Staphylococcus
TIIIDLDGAVKAIEASKK

SEQ ID NO: 2085983 - protein, 21 aa, Staphylococcus
TIIIYESPYRVIQTLKAIQSI

SEQ ID NO: 2085984 - protein, 28 aa, Staphylococcus
TIIKQIDLPMFKLYSEGYKITRVERRSK

SEQ ID NO: 2085985 - protein, 17 aa, Staphylococcus
TIINFYRKPCVICETCF

SEQ ID NO: 2085986 - protein, 27 aa, Staphylococcus
TIKDLKQTQMVFSPKLQSWIEQRGLDI

SEQ ID NO: 2085987 - protein, 25 aa, Staphylococcus
TIKEAAMLAGYFSKAGLSGQIPVDY

SEQ ID NO: 2085988 - protein, 25 aa, Staphylococcus
TIKEMYYFSVANPNPLNWLQHLSTP

SEQ ID NO: 2085989 - protein, 26 aa, Staphylococcus
TIKENIVLVPKLLKWSQEKKDKKARE

SEQ ID NO: 2085990 - protein, 17 aa, Staphylococcus
TIKERLYALLATDYKSQ

SEQ ID NO: 2085991 - protein, 17 aa, Staphylococcus
TIKFAMISSIDIARIAA

SEQ ID NO: 2085992 - protein, 19 aa, Staphylococcus
TIKFKELDLDMPCSSIALD

SEQ ID NO: 2085993 - protein, 18 aa, Staphylococcus
TIKFLFELQDGYTIETVL

SEQ ID NO: 2085994 - protein, 17 aa, Staphylococcus
TIKGHIFTHSFPKDTPS

SEQ ID NO: 2085995 - protein, 26 aa, Staphylococcus
TIKGIGLYKAVILKAAFELGERMYAR

SEQ ID NO: 2085996 - protein, 27 aa, Staphylococcus
TIKLFKRYVGMTPFQYLLHYRLEKGAK

SEQ ID NO: 2085997 - protein, 17 aa, Staphylococcus
TIKLLTEEKLNVPLIGF

SEQ ID NO: 2085998 - protein, 22 aa, Staphylococcus
TIKMMLILSIARPPLFKNDFYF

SEQ ID NO: 2085999 - protein, 27 aa, Staphylococcus
TIKPAQTFDLPFGRLEEGYLADLTVIN

SEQ ID NO: 2086000 - protein, 17 aa, Staphylococcus
TIKQHIAMLYDAKKSTL

SEQ ID NO: 2086001 - protein, 24 aa, Staphylococcus
TIKQLYNQVAIYKEQSNRDKEQIN

SEQ ID NO: 2086002 - protein, 26 aa, Staphylococcus
TIKRHYIIRDGLRLALNALDLELLVE

SEQ ID NO: 2086003 - protein, 47 aa, Staphylococcus
TIKRKYTLDYILKPFVKTKIKGWVRQLLWMSIYQYVYLDKVPDHAII

SEQ ID NO: 2086004 - protein, 21 aa, Staphylococcus
TIKRYYICSLFNRSGSSACHS

SEQ ID NO: 2086005 - protein, 19 aa, Staphylococcus
TIKSERLMIGQIVFDDVKD

SEQ ID NO: 2086006 - protein, 23 aa, Staphylococcus
TIKSIRKQLLYLNDRFKQIEQSL

SEQ ID NO: 2086007 - protein, 23 aa, Staphylococcus
TIKSLYNDILIDLNLDKINNYFA

SEQ ID NO: 2086008 - protein, 30 aa, Staphylococcus
TIKTTKIIKKVRITNLLLNPKKCLQKSRTR

SEQ ID NO: 2086009 - protein, 18 aa, Staphylococcus
TIKWNQPMFTDHGTFIIG

SEQ ID NO: 2086010 - protein, 17 aa, Staphylococcus
TIKYIDLRLITRLTFTE

SEQ ID NO: 2086011 - protein, 26 aa, Staphylococcus
TILEEGKGWLVFYSHTNIFKQNTMVR

SEQ ID NO: 2086012 - protein, 24 aa, Staphylococcus
TILEQNWLGGAYWTPPEVATRRTH

SEQ ID NO: 2086013 - protein, 19 aa, Staphylococcus
TILFADMILPYDIDCYELG

SEQ ID NO: 2086014 - protein, 19 aa, Staphylococcus
TILGASFFTTPGGKGANQA

SEQ ID NO: 2086015 - protein, 21 aa, Staphylococcus
TILNKRVNGYLYFFQFGEMSI

SEQ ID NO: 2086016 - protein, 26 aa, Staphylococcus
TILNTFAIFNINLSWIESRPLKTQLG

SEQ ID NO: 2086017 - protein, 18 aa, Staphylococcus
TILTVGYISKRKNQLKIC

SEQ ID NO: 2086018 - protein, 18 aa, Staphylococcus
TILVLDDSALINTTQSLH

SEQ ID NO: 2086019 - protein, 20 aa, Staphylococcus
TIMFTICMDVIDSAFAPGVS

SEQ ID NO: 2086020 - protein, 23 aa, Staphylococcus
TINDLGIELIIDESLRNVRKQKL

SEQ ID NO: 2086021 - protein, 29 aa, Staphylococcus
TINDQHFLNLYYRLLPEFTGHNYAFEAIS

SEQ ID NO: 2086022 - protein, 26 aa, Staphylococcus
TINGTDFVWILPITSREVRFPTDIEV

SEQ ID NO: 2086023 - protein, 20 aa, Staphylococcus
TINKIWIQEGIRKQQINDIL

SEQ ID NO: 2086024 - protein, 23 aa, Staphylococcus
TINRAGSMIGYFLNEGPVTNFEE

SEQ ID NO: 2086025 - protein, 22 aa, Staphylococcus
TINRMYWRARRRESIFMTYILK

SEQ ID NO: 2086026 - protein, 20 aa, Staphylococcus
TINTIKYWVLDPNRISVDEL

SEQ ID NO: 2086027 - protein, 26 aa, Staphylococcus
TINYEVLCNLGRRLPRIYKFDNKEYI

SEQ ID NO: 2086028 - protein, 27 aa, Staphylococcus
TINYEVLCNLGRRLPRIYYLNKKFEVT

SEQ ID NO: 2086029 - protein, 17 aa, Staphylococcus
TINYEVLCNLSKRLPRI

SEQ ID NO: 2086030 - protein, 23 aa, Staphylococcus
TINYEVLCNLSRRLPRIYHIEDN

SEQ ID NO: 2086031 - protein, 17 aa, Staphylococcus
TIPFAPTRRKDFINSRK

SEQ ID NO: 2086032 - protein, 18 aa, Staphylococcus
TIPFQIHSYLTGANSGDV

SEQ ID NO: 2086033 - protein, 19 aa, Staphylococcus
TIPQIILKWHVQNGVVPIP

SEQ ID NO: 2086034 - protein, 19 aa, Staphylococcus
TIPSLFMTIVPSVLSSFKK

SEQ ID NO: 2086035 - protein, 18 aa, Staphylococcus
TIQDYILEYCNFGCPYFI

SEQ ID NO: 2086036 - protein, 23 aa, Staphylococcus
TIQGEGRVIGRKTMFVRTAGCDY

SEQ ID NO: 2086037 - protein, 18 aa, Staphylococcus
TIQIRQLHPFPKDTIQHA

SEQ ID NO: 2086038 - protein, 24 aa, Staphylococcus
TIQLDRHKNNLSKDIKLLDGLYQQ

SEQ ID NO: 2086039 - protein, 24 aa, Staphylococcus
TIQRGGTFLYSARCPEFKDKEVRA

SEQ ID NO: 2086040 - protein, 24 aa, Staphylococcus
TIQRGGTFLYSARCPEFKEVEVRK

SEQ ID NO: 2086041 - protein, 23 aa, Staphylococcus
TIQRGGTFLYSARCPQFKDESVR

SEQ ID NO: 2086042 - protein, 23 aa, Staphylococcus
TIQRGGTFLYSARCPQFKEAEHR

SEQ ID NO: 2086043 - protein, 24 aa, Staphylococcus
TIQRGGTFLYSARCPQFKEASVRQ

SEQ ID NO: 2086044 - protein, 25 aa, Staphylococcus
TIRGNINWMRARQKRLIQTLFDESD

SEQ ID NO: 2086045 - protein, 31 aa, Staphylococcus
TIRHEFPDNMVSGLVGFLGHGGVKSGVVAKG

SEQ ID NO: 2086046 - protein, 17 aa, Staphylococcus
TIRHWQSFNPTEKTHQI

SEQ ID NO: 2086047 - protein, 18 aa, Staphylococcus
TIRIAPRKVRLVLDLIRG

SEQ ID NO: 2086048 - protein, 20 aa, Staphylococcus
TIRLVIFNFNKESGINELLN

SEQ ID NO: 2086049 - protein, 25 aa, Staphylococcus
TIRMNYLFDFYQALLTKKQRNYLEL

SEQ ID NO: 2086050 - protein, 22 aa, Staphylococcus
TIRMNYLFDFYQSLLTQKQKSY

SEQ ID NO: 2086051 - protein, 21 aa, Staphylococcus
TISADLPFAQKRWCASNGLDN

SEQ ID NO: 2086052 - protein, 20 aa, Staphylococcus
TISADLPFAQKRWCASNGLE

SEQ ID NO: 2086053 - protein, 24 aa, Staphylococcus
TISDIYASVRLLWSRIGEPFVGHS

SEQ ID NO: 2086054 - protein, 25 aa, Staphylococcus
TISDIYASVRLLWSRIGEPFVGYSD

SEQ ID NO: 2086055 - protein, 25 aa, Staphylococcus
TISEEYHVPLLMKFEVQGSNKDVIE

SEQ ID NO: 2086056 - protein, 18 aa, Staphylococcus
TISFPHAQIKLYAPILGQ

SEQ ID NO: 2086057 - protein, 24 aa, Staphylococcus
TISFYTNLLQFKKAHHWSLEEYHI

SEQ ID NO: 2086058 - protein, 22 aa, Staphylococcus
TISIKPIPRIKTKPKYMLREEF

SEQ ID NO: 2086059 - protein, 24 aa, Staphylococcus
TISKDYMVPLLMKFEVQGTKKDVE

SEQ ID NO: 2086060 - protein, 20 aa, Staphylococcus
TISSQRLMIGQIVFDDIEDT

SEQ ID NO: 2086061 - protein, 26 aa, Staphylococcus
TISTGLIVPAKFFELAKNGEDFYMFA

SEQ ID NO: 2086062 - protein, 21 aa, Staphylococcus
TISTVKFWVNDPHRLSVEDLT

SEQ ID NO: 2086063 - protein, 27 aa, Staphylococcus
TISVDNAIWKVIDFQHVKPGKGSAFVR

SEQ ID NO: 2086064 - protein, 22 aa, Staphylococcus
TISVDNGIWKVIDFQHVKPGKG

SEQ ID NO: 2086065 - protein, 22 aa, Staphylococcus
TISYEVLCNLGRRLPRIYQVDD

SEQ ID NO: 2086066 - protein, 21 aa, Staphylococcus
TITDKTILVSIMFVNNEVGTV

SEQ ID NO: 2086067 - protein, 25 aa, Staphylococcus
TITFQNLFMQFERFSGMTATGKLAE

SEQ ID NO: 2086068 - protein, 24 aa, Staphylococcus
TITNYLRRINRKTALLIQLATELG

SEQ ID NO: 2086069 - protein, 24 aa, Staphylococcus
TITNYLRRINRKTALLIQLSTEVG

SEQ ID NO: 2086070 - protein, 23 aa, Staphylococcus
TIVERDYTLIYDKYVSVGPKLET

SEQ ID NO: 2086071 - protein, 21 aa, Staphylococcus
TIVHPGILLNDSGINKFAADA

SEQ ID NO: 2086072 - protein, 19 aa, Staphylococcus
TIVIGKTSKQFKTVKSLLL

SEQ ID NO: 2086073 - protein, 30 aa, Staphylococcus
TIVLFSGELDKALAAFIIANGARAAGREVS

SEQ ID NO: 2086074 - protein, 20 aa, Staphylococcus
TIVNHRFPLVLGGDHSIAVG

SEQ ID NO: 2086075 - protein, 19 aa, Staphylococcus
TIVNLLKGFTFKVNGTLPI

SEQ ID NO: 2086076 - protein, 26 aa, Staphylococcus
TIVPFKSFSLLQWFDQSHIVTASEVL

SEQ ID NO: 2086077 - protein, 27 aa, Staphylococcus
TIVSNQPTWFQKGVFTSLESLRIPGYM

SEQ ID NO: 2086078 - protein, 20 aa, Staphylococcus
TIVYKGWLRSDQIKGLYLDL

SEQ ID NO: 2086079 - protein, 21 aa, Staphylococcus
TIVYKGWLRSDQIKSLFIDLN

SEQ ID NO: 2086080 - protein, 24 aa, Staphylococcus
TIWNSVPNLMYLYLNSNKVIENKL

SEQ ID NO: 2086081 - protein, 27 aa, Staphylococcus
TIYEISKRTVLFLIGKDITVYGATIAC

SEQ ID NO: 2086082 - protein, 26 aa, Staphylococcus
TIYEISKRTVLFLIGNDISVYKATID

SEQ ID NO: 2086083 - protein, 18 aa, Staphylococcus
TIYKPLLGEDCRRTMEIF

SEQ ID NO: 2086084 - protein, 26 aa, Staphylococcus
TKAMPKEMLPILDKPTIQYIVEEAAR

SEQ ID NO: 2086085 - protein, 35 aa, Staphylococcus
TKAVIPYMKEQQYGKLVYISSGLSKRAAPNFLAHG

SEQ ID NO: 2086086 - protein, 23 aa, Staphylococcus
TKDDFIIKTLPKDSYQLSEDNDC

SEQ ID NO: 2086087 - protein, 21 aa, Staphylococcus
TKDDLLPLERMGEKKADNLLN

SEQ ID NO: 2086088 - protein, 26 aa, Staphylococcus
TKDDLYLCYKTFYHPSNMVMFVVGDV

SEQ ID NO: 2086089 - protein, 22 aa, Staphylococcus
TKDFKALIKFNIRKPNPLLSQY

SEQ ID NO: 2086090 - protein, 19 aa, Staphylococcus
TKDIDLLDGLYDQNKRYFD

SEQ ID NO: 2086091 - protein, 20 aa, Staphylococcus
TKDIILDWQGQSHFFASKQD

SEQ ID NO: 2086092 - protein, 19 aa, Staphylococcus
TKDKFLRPIRKHVGMVFQF

SEQ ID NO: 2086093 - protein, 17 aa, Staphylococcus
TKDKVIYISTFSKSLFP

SEQ ID NO: 2086094 - protein, 22 aa, Staphylococcus
TKDMYRLLAIAKYEDRFVIPTS

SEQ ID NO: 2086095 - protein, 23 aa, Staphylococcus
TKDTYQCRFLTVATGYYGQHNDL

SEQ ID NO: 2086096 - protein, 22 aa, Staphylococcus
TKEEAVIKRLKSIKLPKITTKE

SEQ ID NO: 2086097 - protein, 18 aa, Staphylococcus
TKEIKAYGFDLELGKVQQ

SEQ ID NO: 2086098 - protein, 18 aa, Staphylococcus
TKENFKNLRYTSSNFRNS

SEQ ID NO: 2086099 - protein, 26 aa, Staphylococcus
TKEPRALFRFTSQLEDWHITLPNIVK

SEQ ID NO: 2086100 - protein, 21 aa, Staphylococcus
TKEQALYHFLSGFTSKLAGTE

SEQ ID NO: 2086101 - protein, 26 aa, Staphylococcus
TKETYQYIFPYDIPTTVTSLLRERSL

SEQ ID NO: 2086102 - protein, 25 aa, Staphylococcus
TKEYQQTVVPIFWIAGEDHDFDEVN

SEQ ID NO: 2086103 - protein, 26 aa, Staphylococcus
TKFTLRNAMPFTTFVAFLISQQREID

SEQ ID NO: 2086104 - protein, 24 aa, Staphylococcus
TKGAFPTWLAPKQVEIIPVNLDLH

SEQ ID NO: 2086105 - protein, 24 aa, Staphylococcus
TKGESTISLIKKLSAENVRLNVTA

SEQ ID NO: 2086106 - protein, 23 aa, Staphylococcus
TKGHILFENDFEFLKEVLEKVNA

SEQ ID NO: 2086107 - protein, 20 aa, Staphylococcus
TKGHILYENNYQFLKDVLAH

SEQ ID NO: 2086108 - protein, 24 aa, Staphylococcus
TKGKVIYISTFSKSLFPSCRIAYI

SEQ ID NO: 2086109 - protein, 23 aa, Staphylococcus
TKGNALKRLLNTWQLDASELMAF

SEQ ID NO: 2086110 - protein, 26 aa, Staphylococcus
TKGSLKYIHDIWGYIAPNTKSEKQPK

SEQ ID NO: 2086111 - protein, 25 aa, Staphylococcus
TKHKKEIPRFPKKIAVLTASTGAAI

SEQ ID NO: 2086112 - protein, 26 aa, Staphylococcus
TKHQIPTVTTLLGLGAIPYEHPLFLG

SEQ ID NO: 2086113 - protein, 27 aa, Staphylococcus
TKHTVRLLHAIELERLNLGRKLGFELS

SEQ ID NO: 2086114 - protein, 31 aa, Staphylococcus
TKIDNNGFIKFQPIGGWWSQVMLSQKVTITT

SEQ ID NO: 2086115 - protein, 18 aa, Staphylococcus
TKKAYRLMEDQHDFNFTG

SEQ ID NO: 2086116 - protein, 34 aa, Staphylococcus
TKKFKTTMVTFKFMAPLDYKTITARSILSKVLVR

SEQ ID NO: 2086117 - protein, 22 aa, Staphylococcus
TKKPMISALDKIPFTGRMWLSI

SEQ ID NO: 2086118 - protein, 20 aa, Staphylococcus
TKKQLFDATSIYLEAIYSLC

SEQ ID NO: 2086119 - protein, 24 aa, Staphylococcus
TKKQRNYLELFYLQDFSLSEIADT

SEQ ID NO: 2086120 - protein, 19 aa, Staphylococcus
TKLFDTNIGKIKKGEILFL

SEQ ID NO: 2086121 - protein, 21 aa, Staphylococcus
TKLRGCQPYYIEHGAFSGAIG

SEQ ID NO: 2086122 - protein, 21 aa, Staphylococcus
TKLVHGGLRYLKQLQVGVVAE

SEQ ID NO: 2086123 - protein, 20 aa, Staphylococcus
TKMALGKIFYNPDMPLIKDY

SEQ ID NO: 2086124 - protein, 24 aa, Staphylococcus
TKMKSHDFRWEPSILSQSISDLKV

SEQ ID NO: 2086125 - protein, 24 aa, Staphylococcus
TKNDVPTFAICHGPLVLIDTDDLN

SEQ ID NO: 2086126 - protein, 30 aa, Staphylococcus
TKNHVPEHIAKFLLGIFIASREDEFTTIDN

SEQ ID NO: 2086127 - protein, 22 aa, Staphylococcus
TKNKEGIGYFGYAFYEQNKDKL

SEQ ID NO: 2086128 - protein, 26 aa, Staphylococcus
TKNKGFYSNARWRKTRLKVLARDHYE

SEQ ID NO: 2086129 - protein, 17 aa, Staphylococcus
TKNPTFHLTALGQLSAL

SEQ ID NO: 2086130 - protein, 18 aa, Staphylococcus
TKPFLIFVGNSNGATEVA

SEQ ID NO: 2086131 - protein, 19 aa, Staphylococcus
TKPKAPTPTLRSIKKAAKL

SEQ ID NO: 2086132 - protein, 30 aa, Staphylococcus
TKPTFYEARTIYLPNAFHPLLDKETVVANT

SEQ ID NO: 2086133 - protein, 19 aa, Staphylococcus
TKPTFYKERTVYLPNAYHP

SEQ ID NO: 2086134 - protein, 22 aa, Staphylococcus
TKQADVIMVLLPDEIQGSVYKK

SEQ ID NO: 2086135 - protein, 19 aa, Staphylococcus
TKQADVVMILLPDEIQGNV

SEQ ID NO: 2086136 - protein, 22 aa, Staphylococcus
TKQHEFIPIYLPMTSEAELIVK

SEQ ID NO: 2086137 - protein, 24 aa, Staphylococcus
TKQLESYIMLELTKIKGATVKLNS

SEQ ID NO: 2086138 - protein, 25 aa, Staphylococcus
TKQVDTPLFMFPSKSYIKPEPYGTI

SEQ ID NO: 2086139 - protein, 26 aa, Staphylococcus
TKQYCMYYDHLLLATGFKESIMQQPV

SEQ ID NO: 2086140 - protein, 21 aa, Staphylococcus
TKRFHDRSFISCNVDQIPKVV

SEQ ID NO: 2086141 - protein, 17 aa, Staphylococcus
TKRLLEEGYEVAGLTTS

SEQ ID NO: 2086142 - protein, 26 aa, Staphylococcus
TKSETFVIISFKHKVILIGGTEYAGE

SEQ ID NO: 2086143 - protein, 24 aa, Staphylococcus
TKSKYVELLLKIKNYEIPILKFNE

SEQ ID NO: 2086144 - protein, 24 aa, Staphylococcus
TKSQLKLFVYDYGKKDILEVLSYL

SEQ ID NO: 2086145 - protein, 24 aa, Staphylococcus
TKTEKLIFIADYIEPGRKTPGVEE

SEQ ID NO: 2086146 - protein, 24 aa, Staphylococcus
TKTERRLFFYMYENRDLILTKNQI

SEQ ID NO: 2086147 - protein, 26 aa, Staphylococcus
TKTETFVIVSFKHKVILIGGTEYAGE

SEQ ID NO: 2086148 - protein, 26 aa, Staphylococcus
TKTFHLYDYIEYKPEYWIKAGVNANN

SEQ ID NO: 2086149 - protein, 17 aa, Staphylococcus
TKTGALLTFAIMSAVDI

SEQ ID NO: 2086150 - protein, 29 aa, Staphylococcus
TKTPDEITLLFSKFWKVLSRNIYIEKEVQ

SEQ ID NO: 2086151 - protein, 25 aa, Staphylococcus
TKTSEFNMKYPVYINAMTGGSEWTK

SEQ ID NO: 2086152 - protein, 49 aa, Staphylococcus
TKTTSGFYYYDINAIPFPAGISFVKVFSTTVSILGNYYITGGTSKNAIG

SEQ ID NO: 2086153 - protein, 24 aa, Staphylococcus
TKTYDLIILDIMLPHINGLEICRR

SEQ ID NO: 2086154 - protein, 23 aa, Staphylococcus
TKVHLKIIYDEDTHRILGGQIMS

SEQ ID NO: 2086155 - protein, 29 aa, Staphylococcus
TKVNSPISFELWIAILLTVEQTNTSLSDL

SEQ ID NO: 2086156 - protein, 25 aa, Staphylococcus
TKVYLSFMDTLKWCKNKFQVTNQVS

SEQ ID NO: 2086157 - protein, 24 aa, Staphylococcus
TKVYLSLMNIKKWCQNTFQVTNQV

SEQ ID NO: 2086158 - protein, 17 aa, Staphylococcus
TKWFPVVGQAISASISY

SEQ ID NO: 2086159 - protein, 23 aa, Staphylococcus
TKYDSVLIVLTYQGHLVFVKNKK

SEQ ID NO: 2086160 - protein, 25 aa, Staphylococcus
TKYETFFVTHGFGTLAALKFIEKSQ

SEQ ID NO: 2086161 - protein, 23 aa, Staphylococcus
TKYLKKHRTLFASLDPYILENIR

SEQ ID NO: 2086162 - protein, 24 aa, Staphylococcus
TKYNPHLFNRDLFSKFKKGAVFVN

SEQ ID NO: 2086163 - protein, 24 aa, Staphylococcus
TKYNVKIFEFTRPSIRLTSDGEKI

SEQ ID NO: 2086164 - protein, 19 aa, Staphylococcus
TLAAFFMTPLHGIPKYNMS

SEQ ID NO: 2086165 - protein, 21 aa, Staphylococcus
TLAEWFAENDYFYIMHRFDEE

SEQ ID NO: 2086166 - protein, 21 aa, Staphylococcus
TLAGEHPPLVRQENITRCIYT

SEQ ID NO: 2086167 - protein, 19 aa, Staphylococcus
TLALQRFITRLIAVGFPKD

SEQ ID NO: 2086168 - protein, 18 aa, Staphylococcus
TLAMNFWSTIEHTLRYKY

SEQ ID NO: 2086169 - protein, 18 aa, Staphylococcus
TLANILIAAGYHVTREYY

SEQ ID NO: 2086170 - protein, 19 aa, Staphylococcus
TLAQLRQHCSLYIVTNGVA

SEQ ID NO: 2086171 - protein, 18 aa, Staphylococcus
TLATLYPNRIDLGLGRAP

SEQ ID NO: 2086172 - protein, 24 aa, Staphylococcus
TLATPTWIWSVVVDGKLFVRAYNG

SEQ ID NO: 2086173 - protein, 25 aa, Staphylococcus
TLAYALNVRLFGVSSLEALAATTHQ

SEQ ID NO: 2086174 - protein, 32 aa, Staphylococcus
TLDADGVFIYIGMKPLTAPFLDLGITNETGYI

SEQ ID NO: 2086175 - protein, 27 aa, Staphylococcus
TLDADGVFIYIGMKPLTAPFNNLGITN

SEQ ID NO: 2086176 - protein, 27 aa, Staphylococcus
TLDADGVFIYIGMKPLTAPFVNLGITN

SEQ ID NO: 2086177 - protein, 24 aa, Staphylococcus
TLDEDMAIRFKYIASLVSSGHDSI

SEQ ID NO: 2086178 - protein, 22 aa, Staphylococcus
TLDEVVPSLPPYDALEKKVIKS

SEQ ID NO: 2086179 - protein, 17 aa, Staphylococcus
TLDILKLNQLKLGIITN

SEQ ID NO: 2086180 - protein, 25 aa, Staphylococcus
TLDIYHMLVPLNQELHRLRIKTQDL

SEQ ID NO: 2086181 - protein, 20 aa, Staphylococcus
TLDLFLDVLVLPSTGEYELV

SEQ ID NO: 2086182 - protein, 18 aa, Staphylococcus
TLDNCDIFFIGGGSDREQ

SEQ ID NO: 2086183 - protein, 24 aa, Staphylococcus
TLDRIYRSLGILQNSRIISMEEAS

SEQ ID NO: 2086184 - protein, 33 aa, Staphylococcus
TLDVEMPIVLPRIKITYLYTRIEKLLQQYQLDI

SEQ ID NO: 2086185 - protein, 30 aa, Staphylococcus
TLDVSMPIVLPRLRISYLYPRTEKLLSQYQ

SEQ ID NO: 2086186 - protein, 19 aa, Staphylococcus
TLDYFIDAMLQIADEVESN

SEQ ID NO: 2086187 - protein, 25 aa, Staphylococcus
TLDYGALLKAFGNLFQFLKEERVTE

SEQ ID NO: 2086188 - protein, 17 aa, Staphylococcus
TLEAILHYCEPDYIAGL

SEQ ID NO: 2086189 - protein, 17 aa, Staphylococcus
TLEDIIKSLIAPNRDPR

SEQ ID NO: 2086190 - protein, 27 aa, Staphylococcus
TLEEPPSHAIFILATTEPHKIPPTIIS

SEQ ID NO: 2086191 - protein, 30 aa, Staphylococcus
TLEESNFIYLKNMNIPYIYLSVNPKNNAPF

SEQ ID NO: 2086192 - protein, 25 aa, Staphylococcus
TLEEWQKVIDINLTGAFIGSREAIK

SEQ ID NO: 2086193 - protein, 27 aa, Staphylococcus
TLEFKCQIIGLPFWKTKYSTQEIQKIG

SEQ ID NO: 2086194 - protein, 27 aa, Staphylococcus
TLEKDQFDLILLDLMLPEVSGEEVLSY

SEQ ID NO: 2086195 - protein, 19 aa, Staphylococcus
TLENCDIFFIGGGSDREQS

SEQ ID NO: 2086196 - protein, 26 aa, Staphylococcus
TLEREGFHILAIKDMAGLLKPKAANE

SEQ ID NO: 2086197 - protein, 23 aa, Staphylococcus
TLESYIAILKDKPSRLLDALLSC

SEQ ID NO: 2086198 - protein, 19 aa, Staphylococcus
TLETIYPNRVDLGLGRAPG

SEQ ID NO: 2086199 - protein, 19 aa, Staphylococcus
TLEWDDELLEILDIPKQML

SEQ ID NO: 2086200 - protein, 17 aa, Staphylococcus
TLFIDKVLRNIIQHVYD

SEQ ID NO: 2086201 - protein, 18 aa, Staphylococcus
TLFNPTNHVYFNLNRDNN

SEQ ID NO: 2086202 - protein, 24 aa, Staphylococcus
TLGAKRVLPLAVSGPFHSSMMSVI

SEQ ID NO: 2086203 - protein, 20 aa, Staphylococcus
TLGEQVIMKQTARKVRRLYE

SEQ ID NO: 2086204 - protein, 21 aa, Staphylococcus
TLGEQVIMKQTARKVRRLYEG

SEQ ID NO: 2086205 - protein, 28 aa, Staphylococcus
TLGGDQLMKAFKILKPHGTVVSINGIPD

SEQ ID NO: 2086206 - protein, 25 aa, Staphylococcus
TLGINEPFMYKLVDIVADIMEPYYP

SEQ ID NO: 2086207 - protein, 20 aa, Staphylococcus
TLGLNRFMIHTPVGSMPHEK

SEQ ID NO: 2086208 - protein, 20 aa, Staphylococcus
TLGLNRFMIHTPVGSMPHEY

SEQ ID NO: 2086209 - protein, 21 aa, Staphylococcus
TLGLSRFMIHTPVGSMPHENT

SEQ ID NO: 2086210 - protein, 18 aa, Staphylococcus
TLGPLTNIALLFNTYPEC

SEQ ID NO: 2086211 - protein, 23 aa, Staphylococcus
TLGQHMPVFFSANMSYGIHALTK

SEQ ID NO: 2086212 - protein, 17 aa, Staphylococcus
TLGWHKYVGTQGKVIGI

SEQ ID NO: 2086213 - protein, 20 aa, Staphylococcus
TLGYDLMSVGKAYLVEPNWL

SEQ ID NO: 2086214 - protein, 17 aa, Staphylococcus
TLGYFIEQVINEGALDA

SEQ ID NO: 2086215 - protein, 21 aa, Staphylococcus
TLHEVLVQYKIPGISGVDTRS

SEQ ID NO: 2086216 - protein, 23 aa, Staphylococcus
TLHEVVLPIYPKAPEFHLEDTYN

SEQ ID NO: 2086217 - protein, 17 aa, Staphylococcus
TLHGLGTIPYENPLFLG

SEQ ID NO: 2086218 - protein, 23 aa, Staphylococcus
TLHSIFLEVVIAPKFDKEALDIL

SEQ ID NO: 2086219 - protein, 24 aa, Staphylococcus
TLIAPLKEEILERIGKYYYGSDDI

SEQ ID NO: 2086220 - protein, 19 aa, Staphylococcus
TLIATSGSFSDRMSRLLTG

SEQ ID NO: 2086221 - protein, 27 aa, Staphylococcus
TLIDDDFPLMLKWLTDERVLEFYGGRD

SEQ ID NO: 2086222 - protein, 17 aa, Staphylococcus
TLIDFDMSWMKVDIQMV

SEQ ID NO: 2086223 - protein, 18 aa, Staphylococcus
TLIDILIGHKHANSGTVE

SEQ ID NO: 2086224 - protein, 19 aa, Staphylococcus
TLIEFDKSWEKIGIRLVDK

SEQ ID NO: 2086225 - protein, 25 aa, Staphylococcus
TLIEQPDLLLLDEPTNHLDFDSIKW

SEQ ID NO: 2086226 - protein, 19 aa, Staphylococcus
TLIFKMYNDPSIELRYFET

SEQ ID NO: 2086227 - protein, 20 aa, Staphylococcus
TLIGFVELDHIYSSALKEIC

SEQ ID NO: 2086228 - protein, 19 aa, Staphylococcus
TLINLPFDYIFFTGSENVG

SEQ ID NO: 2086229 - protein, 20 aa, Staphylococcus
TLIRLIMNLIRPDSGNIEML

SEQ ID NO: 2086230 - protein, 26 aa, Staphylococcus
TLITNPVFKQIYTLYHHADESVFVNF

SEQ ID NO: 2086231 - protein, 39 aa, Staphylococcus
TLKASRLNYAIIKPSFFMDNFLRIVKEQGGRLVIPEFIN

SEQ ID NO: 2086232 - protein, 19 aa, Staphylococcus
TLKEGWLYRKMIIKTENER

SEQ ID NO: 2086233 - protein, 25 aa, Staphylococcus
TLKEQLPLEYFLTDKPQTTGYKFDT

SEQ ID NO: 2086234 - protein, 17 aa, Staphylococcus
TLKLTYLNQLIKDYESN

SEQ ID NO: 2086235 - protein, 18 aa, Staphylococcus
TLKMINRLIPLSEGYIYF

SEQ ID NO: 2086236 - protein, 18 aa, Staphylococcus
TLKMINRLIPLTEGYIYF

SEQ ID NO: 2086237 - protein, 20 aa, Staphylococcus
TLKREGITIILVTHDIGVVA

SEQ ID NO: 2086238 - protein, 24 aa, Staphylococcus
TLKRINIEPSYRQALLAKIVSDDY

SEQ ID NO: 2086239 - protein, 25 aa, Staphylococcus
TLKSQSLFLSDYYFYLIEIGQKDKA

SEQ ID NO: 2086240 - protein, 27 aa, Staphylococcus
TLKTYAYCLKRYFMYLELIDKNHNDAT

SEQ ID NO: 2086241 - protein, 24 aa, Staphylococcus
TLKTYIDRSFLIDYIRYVNRFVRI

SEQ ID NO: 2086242 - protein, 23 aa, Staphylococcus
TLLDIRVVITRPANDPALFDATI

SEQ ID NO: 2086243 - protein, 18 aa, Staphylococcus
TLLDLAAALFIYNNHEMY

SEQ ID NO: 2086244 - protein, 20 aa, Staphylococcus
TLLEFGSPKAIIPKKIAKEV

SEQ ID NO: 2086245 - protein, 28 aa, Staphylococcus
TLLEKKPVAYFTLFTSSMQVPLQHIIKF

SEQ ID NO: 2086246 - protein, 20 aa, Staphylococcus
TLLELIRHENILVTPHIAFF

SEQ ID NO: 2086247 - protein, 19 aa, Staphylococcus
TLLFYKARFKYYKNVEFVI

SEQ ID NO: 2086248 - protein, 30 aa, Staphylococcus
TLLGKQKSDIGMFFPFTVTGNVIGKAAEKE

SEQ ID NO: 2086249 - protein, 23 aa, Staphylococcus
TLLHDFNFQVVLLDLNLHAEDGY

SEQ ID NO: 2086250 - protein, 29 aa, Staphylococcus
TLLKEIYDFPPILFYRGDISLLNSNTTLA

SEQ ID NO: 2086251 - protein, 18 aa, Staphylococcus
TLLKLLSRNLKPSKGVIY

SEQ ID NO: 2086252 - protein, 26 aa, Staphylococcus
TLLKPAIMMNLLGRDLDLLEDQFAEH

SEQ ID NO: 2086253 - protein, 18 aa, Staphylococcus
TLLLQIDSTKKGNAKIMW

SEQ ID NO: 2086254 - protein, 18 aa, Staphylococcus
TLLNILGGLLSPSSGDVL

SEQ ID NO: 2086255 - protein, 20 aa, Staphylococcus
TLLNNRIYGGYSLLLDVDYD

SEQ ID NO: 2086256 - protein, 19 aa, Staphylococcus
TLLNVLSSIDYITSGTVEI

SEQ ID NO: 2086257 - protein, 17 aa, Staphylococcus
TLLQAFHQYSHMLSQVA

SEQ ID NO: 2086258 - protein, 19 aa, Staphylococcus
TLLRDTGACLSPLNAFLLL

SEQ ID NO: 2086259 - protein, 25 aa, Staphylococcus
TLLYEETYHLYLPKEEPLALAMNPH

SEQ ID NO: 2086260 - protein, 23 aa, Staphylococcus
TLMAHAVSFLKEKGFTVATIKHH

SEQ ID NO: 2086261 - protein, 22 aa, Staphylococcus
TLMFEATQLLLDYIHHTQKRDL

SEQ ID NO: 2086262 - protein, 23 aa, Staphylococcus
TLMHTVMQHLPFNETGLTREELD

SEQ ID NO: 2086263 - protein, 17 aa, Staphylococcus
TLMNMISILRKQAKIEL

SEQ ID NO: 2086264 - protein, 27 aa, Staphylococcus
TLMPSIRMSYMILPTKLVRQFELQNQN

SEQ ID NO: 2086265 - protein, 20 aa, Staphylococcus
TLMSHTIQFLKSHLLTVATV

SEQ ID NO: 2086266 - protein, 27 aa, Staphylococcus
TLNDFTEIFLRPCHIAKMISRYMIINE

SEQ ID NO: 2086267 - protein, 17 aa, Staphylococcus
TLNHGRIDFRHCSEKIE

SEQ ID NO: 2086268 - protein, 24 aa, Staphylococcus
TLNIVPPLHFIITDASGHTVAVEP

SEQ ID NO: 2086269 - protein, 26 aa, Staphylococcus
TLNNNKSILVIFQGPHGYVSSTWYEN

SEQ ID NO: 2086270 - protein, 17 aa, Staphylococcus
TLNRMFIRDFEGLRIDE

SEQ ID NO: 2086271 - protein, 25 aa, Staphylococcus
TLNSRILFITHSMLNYVLCSNLYRF

SEQ ID NO: 2086272 - protein, 19 aa, Staphylococcus
TLNTLKMNYLGIPATKDEA

SEQ ID NO: 2086273 - protein, 17 aa, Staphylococcus
TLNYKPGWAYYQGKHLG

SEQ ID NO: 2086274 - protein, 20 aa, Staphylococcus
TLPHNVVFIFQPAEETGGGA

SEQ ID NO: 2086275 - protein, 18 aa, Staphylococcus
TLPILGICLGAQALTCYY

SEQ ID NO: 2086276 - protein, 17 aa, Staphylococcus
TLPILGTHNMKNATIAI

SEQ ID NO: 2086277 - protein, 24 aa, Staphylococcus
TLPILNGVLDYRRSLTNPYTGEVI

SEQ ID NO: 2086278 - protein, 28 aa, Staphylococcus
TLPNKEFQLLFLLASNEKQIFSRTHLIE

SEQ ID NO: 2086279 - protein, 33 aa, Staphylococcus
TLPVFKQVYRLYFKFVMPIFGKLFAKSKEEYEW

SEQ ID NO: 2086280 - protein, 20 aa, Staphylococcus
TLPVGLLPKIIVDDKEYVVP

SEQ ID NO: 2086281 - protein, 24 aa, Staphylococcus
TLQDRRKAFQFAYLSLLQEETIQA

SEQ ID NO: 2086282 - protein, 24 aa, Staphylococcus
TLQDRRKAFQFAYLSLMQEENIQA

SEQ ID NO: 2086283 - protein, 24 aa, Staphylococcus
TLQDRRKAFQFAYLSLMQEETIQA

SEQ ID NO: 2086284 - protein, 17 aa, Staphylococcus
TLQEWVRRYKAYGVDGL

SEQ ID NO: 2086285 - protein, 22 aa, Staphylococcus
TLQNLICEVINYAKSRHIEKLM

SEQ ID NO: 2086286 - protein, 18 aa, Staphylococcus
TLQPFYEELLGFKKVEET

SEQ ID NO: 2086287 - protein, 24 aa, Staphylococcus
TLQPSAFHWRFMDKLSLSTLSEVV

SEQ ID NO: 2086288 - protein, 24 aa, Staphylococcus
TLQPSPFHWRFIDKLTLSTIHEVV

SEQ ID NO: 2086289 - protein, 17 aa, Staphylococcus
TLREIFQQLHLPKKDLH

SEQ ID NO: 2086290 - protein, 32 aa, Staphylococcus
TLRGERMYDFLDKLIAVSLPRVRDFQGVSKTA

SEQ ID NO: 2086291 - protein, 22 aa, Staphylococcus
TLRGPRGGLILCKEEYKKDIDK

SEQ ID NO: 2086292 - protein, 18 aa, Staphylococcus
TLRLFTNYQIYLHGYSMG

SEQ ID NO: 2086293 - protein, 19 aa, Staphylococcus
TLRLYEMFMGPLDAAIAWS

SEQ ID NO: 2086294 - protein, 21 aa, Staphylococcus
TLRLYEMFMGPLDAAIAWSDK

SEQ ID NO: 2086295 - protein, 22 aa, Staphylococcus
TLRMNYLFDFYHSLLTEKQKNY

SEQ ID NO: 2086296 - protein, 22 aa, Staphylococcus
TLRMNYLFDFYQALLTKKQRNY

SEQ ID NO: 2086297 - protein, 24 aa, Staphylococcus
TLRMNYLFDFYQALLTKKQRNYLE

SEQ ID NO: 2086298 - protein, 22 aa, Staphylococcus
TLRMNYLFDFYQSLLTDKQRNY

SEQ ID NO: 2086299 - protein, 22 aa, Staphylococcus
TLRMNYLFDFYQTLLTEKQRNY

SEQ ID NO: 2086300 - protein, 20 aa, Staphylococcus
TLRPFVVAIKILQLAKELGV

SEQ ID NO: 2086301 - protein, 17 aa, Staphylococcus
TLRQEYLKMIRGQVIHT

SEQ ID NO: 2086302 - protein, 27 aa, Staphylococcus
TLRVASLLAHTLFDFPSHQLTTYGVTG

SEQ ID NO: 2086303 - protein, 18 aa, Staphylococcus
TLRYYEKVGVIPPVERDK

SEQ ID NO: 2086304 - protein, 26 aa, Staphylococcus
TLSEKHKIIMFILAQIEYFSSEDYIT

SEQ ID NO: 2086305 - protein, 22 aa, Staphylococcus
TLSHNNYIKRLPVSTYRAQHRG

SEQ ID NO: 2086306 - protein, 25 aa, Staphylococcus
TLSIGYIGLYEAATVFYGPHWERLS

SEQ ID NO: 2086307 - protein, 17 aa, Staphylococcus
TLSIIKAYESAVNAYAA

SEQ ID NO: 2086308 - protein, 32 aa, Staphylococcus
TLSKIGEHGFGYDPIFYLDDKNKTMAQLSAEE

SEQ ID NO: 2086309 - protein, 17 aa, Staphylococcus
TLSKILEVPSGLLVPHL

SEQ ID NO: 2086310 - protein, 18 aa, Staphylococcus
TLSLINKCLASTAGNGCY

SEQ ID NO: 2086311 - protein, 27 aa, Staphylococcus
TLSTAQIDFLLPERFELTYIGSDGENH

SEQ ID NO: 2086312 - protein, 28 aa, Staphylococcus
TLSTAQLDFLLPERFDLAYIGKDGEEHR

SEQ ID NO: 2086313 - protein, 27 aa, Staphylococcus
TLSTAQLDFLLPERFDLSYIGSDGENH

SEQ ID NO: 2086314 - protein, 27 aa, Staphylococcus
TLSTAQLDFLLPERFELTYIGQDGEQH

SEQ ID NO: 2086315 - protein, 27 aa, Staphylococcus
TLSTAQLDFLLPERFELTYIGSDGEQH

SEQ ID NO: 2086316 - protein, 27 aa, Staphylococcus
TLSTAQLDFLLPQKFELTYIGNDGEQH

SEQ ID NO: 2086317 - protein, 20 aa, Staphylococcus
TLTDHHIPFVFIDRINNEHN

SEQ ID NO: 2086318 - protein, 25 aa, Staphylococcus
TLTINEIIFIIKHLSYRNGENNQIS

SEQ ID NO: 2086319 - protein, 25 aa, Staphylococcus
TLTKKTFPGYVLVELVMTDESWYIV

SEQ ID NO: 2086320 - protein, 18 aa, Staphylococcus
TLTSLYSDVSKRPSKKSK

SEQ ID NO: 2086321 - protein, 20 aa, Staphylococcus
TLTVKENIMLPLSIQNLPKQ

SEQ ID NO: 2086322 - protein, 19 aa, Staphylococcus
TLTVKENIMLPLSVKKIDK

SEQ ID NO: 2086323 - protein, 22 aa, Staphylococcus
TLTVKENIMLPLSVQKLSAAEM

SEQ ID NO: 2086324 - protein, 19 aa, Staphylococcus
TLTVKENIMLPLSVQKMKK

SEQ ID NO: 2086325 - protein, 38 aa, Staphylococcus
TLTVRKDFDLIYYRTYTNALMPYNFLNARFKQDGSRPG

SEQ ID NO: 2086326 - protein, 25 aa, Staphylococcus
TLVDRMPFHGLKPEFYALAAGTKSD

SEQ ID NO: 2086327 - protein, 33 aa, Staphylococcus; identical to SEQ ID NO: 1820992

SEQ ID NO: 2086328 - protein, 18 aa, Staphylococcus
TLVFFDNINLMKTAYHRY

SEQ ID NO: 2086329 - protein, 28 aa, Staphylococcus
TLVGIITNRDLRFIEDFSIKISDVMTKE

SEQ ID NO: 2086330 - protein, 21 aa, Staphylococcus
TLVGLGPRILRAETAPLYALS

SEQ ID NO: 2086331 - protein, 21 aa, Staphylococcus
TLVHKGNIMKFTEGAFKQWGY

SEQ ID NO: 2086332 - protein, 18 aa, Staphylococcus
TLVLAPLVAAVGVPVAKM

SEQ ID NO: 2086333 - protein, 28 aa, Staphylococcus
TLVMAIYQMYHDLPKFKVAYGATISGIS

SEQ ID NO: 2086334 - protein, 18 aa, Staphylococcus
TLVQAFQKAIEAAGFTYK

SEQ ID NO: 2086335 - protein, 24 aa, Staphylococcus
TLVSDIVYVPFKTPILEIAEAKGN

SEQ ID NO: 2086336 - protein, 21 aa, Staphylococcus
TLVSLLEDLNIKTTLKGKELD

SEQ ID NO: 2086337 - protein, 21 aa, Staphylococcus
TLYDISAGRLTLTVKTLSILH

SEQ ID NO: 2086338 - protein, 23 aa, Staphylococcus
TLYEVVLPIYPKAPEFHIDDTFK

SEQ ID NO: 2086339 - protein, 21 aa, Staphylococcus
TLYFKINKRVDIMLGHGLFNE

SEQ ID NO: 2086340 - protein, 20 aa, Staphylococcus
TLYLLKDMIYFEADGLLKGS

SEQ ID NO: 2086341 - protein, 27 aa, Staphylococcus
TLYMDGFNFENGRAKLFPLTFDNFFKE

SEQ ID NO: 2086342 - protein, 20 aa, Staphylococcus
TLYVDRNLKYHGLIQAYSRT

SEQ ID NO: 2086343 - protein, 18 aa, Staphylococcus
TMAALLNATKNTSQYRAQ

SEQ ID NO: 2086344 - protein, 18 aa, Staphylococcus
TMAPYTEDTAYIRQLFKQ

SEQ ID NO: 2086345 - protein, 20 aa, Staphylococcus
TMAVVLPHGVLFRGNAEGTI

SEQ ID NO: 2086346 - protein, 21 aa, Staphylococcus
TMAVVLPHGVLFRSQAEGVIR

SEQ ID NO: 2086347 - protein, 19 aa, Staphylococcus
TMCMGHAKDILLYNVTIKD

SEQ ID NO: 2086348 - protein, 24 aa, Staphylococcus
TMDAQFECNCSHEKFLNAIKGLGE

SEQ ID NO: 2086349 - protein, 22 aa, Staphylococcus
TMDTFGHIDILFNNAGINEHVN

SEQ ID NO: 2086350 - protein, 23 aa, Staphylococcus
TMDYFELTHLLQRNIFELSGGEK

SEQ ID NO: 2086351 - protein, 20 aa, Staphylococcus
TMDYLEGIGLLKSFVRHQSD

SEQ ID NO: 2086352 - protein, 30 aa, Staphylococcus
TMEDIFNCVFDILINLELTRVNGGFVVTGG

SEQ ID NO: 2086353 - protein, 24 aa, Staphylococcus
TMEELLTIYEWPEKLLNKELKKLS

SEQ ID NO: 2086354 - protein, 25 aa, Staphylococcus
TMELIDKYEFIYGIIGWHPVDAIDC

SEQ ID NO: 2086355 - protein, 24 aa, Staphylococcus
TMELIQHYLKQHSDIPYVIDPVML

SEQ ID NO: 2086356 - protein, 32 aa, Staphylococcus
TMELIQSYLKKYSDIPYVIDPVMLAKSGDSLM

SEQ ID NO: 2086357 - protein, 33 aa, Staphylococcus
TMELIQTYLKNHSDILYVIDPVMLAKSGDSLMD

SEQ ID NO: 2086358 - protein, 19 aa, Staphylococcus
TMFGAVPKPLWSRKLEPND

SEQ ID NO: 2086359 - protein, 18 aa, Staphylococcus
TMFKLKLINDLKDLDLDL

SEQ ID NO: 2086360 - protein, 18 aa, Staphylococcus
TMHEKEMHFVLVSNDMEK

SEQ ID NO: 2086361 - protein, 17 aa, Staphylococcus
TMIELYEAYADYHDIMD

SEQ ID NO: 2086362 - protein, 23 aa, Staphylococcus
TMIHHIYRKLGKGSAYLGTNGFQ

SEQ ID NO: 2086363 - protein, 26 aa, Staphylococcus
TMIHHRYPSIPFYLQVGNPYLEDEVE

SEQ ID NO: 2086364 - protein, 18 aa, Staphylococcus
TMILTTDKGPGIFRQKLR

SEQ ID NO: 2086365 - protein, 26 aa, Staphylococcus
TMIRQDIKPVIFLINNDGYTVERLIH

SEQ ID NO: 2086366 - protein, 22 aa, Staphylococcus
TMIRQNLKPVIFVINNDGYTVE

SEQ ID NO: 2086367 - protein, 20 aa, Staphylococcus
TMKFALTQGRLFSKASPLSS

SEQ ID NO: 2086368 - protein, 23 aa, Staphylococcus
TMKNLSIPLQYLVAAALEVTDVT

SEQ ID NO: 2086369 - protein, 19 aa, Staphylococcus
TMKRPRTLTLEEALQFIND

SEQ ID NO: 2086370 - protein, 25 aa, Staphylococcus
TMKVASFLLTFPFNHNAELNKLSEK

SEQ ID NO: 2086371 - protein, 19 aa, Staphylococcus
TMLAIYSFNTSFMINTINF

SEQ ID NO: 2086372 - protein, 17 aa, Staphylococcus
TMLGLDHILIKDPIQQG

SEQ ID NO: 2086373 - protein, 18 aa, Staphylococcus
TMMQQWPSGLIVLSGQSG

SEQ ID NO: 2086374 - protein, 17 aa, Staphylococcus
TMMTYYTNILGFKVISQ

SEQ ID NO: 2086375 - protein, 18 aa, Staphylococcus
TMMVFTNFFRDQMDRFGE

SEQ ID NO: 2086376 - protein, 24 aa, Staphylococcus
TMNEMLMANYLFNSSNDPKFKRWV

SEQ ID NO: 2086377 - protein, 21 aa, Staphylococcus
TMNLYDIIDEFKALGHYEDDE

SEQ ID NO: 2086378 - protein, 30 aa, Staphylococcus
TMNNHAILLYPLNVFDLYTCDDWITGYDVY

SEQ ID NO: 2086379 - protein, 23 aa, Staphylococcus
TMNRPRVLTLEEALQFINDDELV

SEQ ID NO: 2086380 - protein, 25 aa, Staphylococcus
TMPDKLCLYYHIGQCLGPCVYDVDQ

SEQ ID NO: 2086381 - protein, 26 aa, Staphylococcus
TMPEQAYLYSLPYHYYEDYGIRKYGF

SEQ ID NO: 2086382 - protein, 33 aa, Staphylococcus
TMPEQAYLYSLPYRYYEDYGIRKYGFHGTSHKY

SEQ ID NO: 2086383 - protein, 32 aa, Staphylococcus
TMPVFKQVYKLYFKFVMPVFGKLFAKSKEEYE

SEQ ID NO: 2086384 - protein, 33 aa, Staphylococcus
TMPVFKQVYKLYFRFVMPIFGKLFAKSKEEYEW

SEQ ID NO: 2086385 - protein, 24 aa, Staphylococcus
TMQAQFECNCSHEKFLNAIKGLGE

SEQ ID NO: 2086386 - protein, 20 aa, Staphylococcus
TMQHFLAGVIKYTKDFALMF

SEQ ID NO: 2086387 - protein, 24 aa, Staphylococcus
TMQSISIPLQYLIAAALEVTDVNL

SEQ ID NO: 2086388 - protein, 21 aa, Staphylococcus
TMQYHGILKRNLKKSMQSIHD

SEQ ID NO: 2086389 - protein, 17 aa, Staphylococcus
TMRAYIQQVPSSPSYAL

SEQ ID NO: 2086390 - protein, 24 aa, Staphylococcus
TMRDIINNYPFPNTFKVLEMTGKG

SEQ ID NO: 2086391 - protein, 17 aa, Staphylococcus
TMRDIINNYPFPNTFQV

SEQ ID NO: 2086392 - protein, 28 aa, Staphylococcus
TMRDIINNYPFPNTFQVLELNGKGIKAA

SEQ ID NO: 2086393 - protein, 23 aa, Staphylococcus
TMRHIHVNLLPREGFRIKDANFF

SEQ ID NO: 2086394 - protein, 24 aa, Staphylococcus
TMRMLHPFMPFVTEQIWQNLPHEG

SEQ ID NO: 2086395 - protein, 20 aa, Staphylococcus
TMTATLLMGAMLKGDQKLTV

SEQ ID NO: 2086396 - protein, 24 aa, Staphylococcus
TMTNYLRRINRKTALLIQLATEVG

SEQ ID NO: 2086397 - protein, 21 aa, Staphylococcus
TMTPYSIIIKGAKYRFEPNEG

SEQ ID NO: 2086398 - protein, 18 aa, Staphylococcus
TMTRGYRREEVDAFLDDI

SEQ ID NO: 2086399 - protein, 26 aa, Staphylococcus
TMVDVYRFLVQLLRKNKLDVSEIETF

SEQ ID NO: 2086400 - protein, 17 aa, Staphylococcus
TMYMMTSTNYSFISSSV

SEQ ID NO: 2086401 - protein, 18 aa, Staphylococcus
TMYMMTSTNYSFISSSVV

SEQ ID NO: 2086402 - protein, 25 aa, Staphylococcus
TNAQPKFYPGWNDFAFNQQVKSVTF

SEQ ID NO: 2086403 - protein, 17 aa, Staphylococcus
TNDKEALSLNYLPSIKL

SEQ ID NO: 2086404 - protein, 23 aa, Staphylococcus
TNDLLTRNAAMLKQNAIETATEN

SEQ ID NO: 2086405 - protein, 24 aa, Staphylococcus
TNDPFKILSKRELEILPLIAKGYG

SEQ ID NO: 2086406 - protein, 25 aa, Staphylococcus
TNDPFRILSKRELEILPLIAKGYGN

SEQ ID NO: 2086407 - protein, 22 aa, Staphylococcus
TNDPLQVFRESKASLLTSKFEG

SEQ ID NO: 2086408 - protein, 24 aa, Staphylococcus
TNDQLELLRILYNYDRLSQYDLTM

SEQ ID NO: 2086409 - protein, 28 aa, Staphylococcus
TNDQNLEMLFIDPKYFRKGYGTQILQTL

SEQ ID NO: 2086410 - protein, 27 aa, Staphylococcus
TNDQNLEMLFIKPEFFNNGYGTEIIRY

SEQ ID NO: 2086411 - protein, 24 aa, Staphylococcus
TNDQPGWWRGIIDGGYMPINDYQF

SEQ ID NO: 2086412 - protein, 31 aa, Staphylococcus
TNDTYILWNNYYEYVFAQAPYIDFYITATDL

SEQ ID NO: 2086413 - protein, 22 aa, Staphylococcus
TNDTYYIICAAGVRSEKVARYL

SEQ ID NO: 2086414 - protein, 27 aa, Staphylococcus
TNEALLMDVPLLAFPQNADQPLVAQQI

SEQ ID NO: 2086415 - protein, 26 aa, Staphylococcus
TNEEMMQVIHFFNKIENYYESSVKGE

SEQ ID NO: 2086416 - protein, 17 aa, Staphylococcus
TNEQPGWWREIIDGGYM

SEQ ID NO: 2086417 - protein, 22 aa, Staphylococcus
TNERYKLIILRKGRGLAGTVMK

SEQ ID NO: 2086418 - protein, 28 aa, Staphylococcus
TNETDTYMPLPIFLSHQLAKRLSDVRKD

SEQ ID NO: 2086419 - protein, 29 aa, Staphylococcus
TNETDTYMPLPIFLSHQLAKRLSDVRKDD

SEQ ID NO: 2086420 - protein, 29 aa, Staphylococcus
TNETDTYMPLPIFLSHQLAKRLSDVRKDE

SEQ ID NO: 2086421 - protein, 28 aa, Staphylococcus
TNETETYMPLPIFLSHQLAKRLSDVRKD

SEQ ID NO: 2086422 - protein, 38 aa, Staphylococcus
TNEYGTKWYAYYDGDYQRFVMIAYLDNKVHALYTNQNI

SEQ ID NO: 2086423 - protein, 23 aa, Staphylococcus
TNFDQSIDWWQTLYSDEDAYFDK

SEQ ID NO: 2086424 - protein, 38 aa, Staphylococcus
TNFFKEASRFFLKYPYIKLASAPILIRKGHTLSAQNLN

SEQ ID NO: 2086425 - protein, 25 aa, Staphylococcus
TNGEFLFEAVYGAGLARIYQLNPTT

SEQ ID NO: 2086426 - protein, 27 aa, Staphylococcus
TNGKSRSIPIFVFLNDNFEQENVWGPR

SEQ ID NO: 2086427 - protein, 26 aa, Staphylococcus
TNGKSRSIPIFVFLNDNYEQETVWGP

SEQ ID NO: 2086428 - protein, 24 aa, Staphylococcus
TNGLRLFVIPKNGFQKTFVTYTTQ

SEQ ID NO: 2086429 - protein, 25 aa, Staphylococcus
TNGLTHVEPLLKKGFKTIIVGGDVK

SEQ ID NO: 2086430 - protein, 25 aa, Staphylococcus
TNGMINLCFELFDDKIKIVISDQGE

SEQ ID NO: 2086431 - protein, 32 aa, Staphylococcus
TNGMPLIINGVMKPIPTLYKPLNSVDINTKED

SEQ ID NO: 2086432 - protein, 27 aa, Staphylococcus
TNGTARSIPIFIFMNDQFEQVSVWGPR

SEQ ID NO: 2086433 - protein, 27 aa, Staphylococcus
TNGTSRSIPIFIFLNDNYEQETVWGPR

SEQ ID NO: 2086434 - protein, 26 aa, Staphylococcus
TNGVSYLAVTQWWVASLNPPHLKAMI

SEQ ID NO: 2086435 - protein, 27 aa, Staphylococcus
TNGVSYLAVTQWWVASLNPPHLKAMIP

SEQ ID NO: 2086436 - protein, 30 aa, Staphylococcus
TNGVSYLAVTQWWVASLNPSHLKAMIPWEG

SEQ ID NO: 2086437 - protein, 30 aa, Staphylococcus
TNGVSYLAVTQWWVASLNPTHLKAMIPWEG

SEQ ID NO: 2086438 - protein, 25 aa, Staphylococcus
TNHEINLVGIFRYANTYDTGIQILS

SEQ ID NO: 2086439 - protein, 26 aa, Staphylococcus
TNHGIYDYDILVVALGFESETFGING

SEQ ID NO: 2086440 - protein, 28 aa, Staphylococcus
TNHLDFESINWLINYVKQYPHTVLFVTH

SEQ ID NO: 2086441 - protein, 41 aa, Staphylococcus
TNHLDFESINWLINYVKQYPYTVLFVTHDRYFLNEVSSRII

SEQ ID NO: 2086442 - protein, 29 aa, Staphylococcus
TNHLDFESITWLINYVKQYPHTVLFVTHD

SEQ ID NO: 2086443 - protein, 32 aa, Staphylococcus
TNIDKTFGLIFSQRVLLALINKGMVREEAYDK

SEQ ID NO: 2086444 - protein, 21 aa, Staphylococcus
TNIELLPYRTSTVGDIGFSKK

SEQ ID NO: 2086445 - protein, 18 aa, Staphylococcus
TNIFISKNTFHQTGDYAL

SEQ ID NO: 2086446 - protein, 27 aa, Staphylococcus
TNIIGEILPAKYIRPFGLAWHIENKMI

SEQ ID NO: 2086447 - protein, 23 aa, Staphylococcus
TNIPFLVNVMRNEKFRSGDYTTK

SEQ ID NO: 2086448 - protein, 25 aa, Staphylococcus
TNKAQYTLVKLLAAKFKNLCVVGDS

SEQ ID NO: 2086449 - protein, 24 aa, Staphylococcus
TNKAQYTLVKLLANKFKNLCVVGD

SEQ ID NO: 2086450 - protein, 25 aa, Staphylococcus
TNKDFKGFDVEQPNDLFFATFTKYN

SEQ ID NO: 2086451 - protein, 25 aa, Staphylococcus
TNKGDMTFKLFPDIAPKTVENFVTH

SEQ ID NO: 2086452 - protein, 25 aa, Staphylococcus
TNKGDMTFKLFPEIAPKTVENFVTH

SEQ ID NO: 2086453 - protein, 26 aa, Staphylococcus
TNKGDMTFKLFPNIAPKTVENFVTHA

SEQ ID NO: 2086454 - protein, 26 aa, Staphylococcus
TNKGDMTFKLFPNIAPKTVENFVTHS

SEQ ID NO: 2086455 - protein, 26 aa, Staphylococcus
TNKGDMTFKLLPDLAPKTVENFVKHA

SEQ ID NO: 2086456 - protein, 17 aa, Staphylococcus
TNKLPLSFNGNIIDGFT

SEQ ID NO: 2086457 - protein, 20 aa, Staphylococcus
TNKWYFSVRYKDVYGNNKRK

SEQ ID NO: 2086458 - protein, 21 aa, Staphylococcus
TNLEDAKFKTITKLYEYALNE

SEQ ID NO: 2086459 - protein, 19 aa, Staphylococcus
TNLGGLLLLILKNDPRQRQ

SEQ ID NO: 2086460 - protein, 22 aa, Staphylococcus
TNLHLDNLLPIRLDGATKEFFA

SEQ ID NO: 2086461 - protein, 18 aa, Staphylococcus
TNLKRSFSFIAQLAKQFN

SEQ ID NO: 2086462 - protein, 27 aa, Staphylococcus
TNLMTHPRYHIKKKYVAKLKGYLMREE

SEQ ID NO: 2086463 - protein, 27 aa, Staphylococcus
TNLMTHPRYHIKKKYVAKLKGYLMREQ

SEQ ID NO: 2086464 - protein, 17 aa, Staphylococcus
TNLSKWFEFYSTEMREL

SEQ ID NO: 2086465 - protein, 24 aa, Staphylococcus
TNLVPFLTVKQQFKLLAKQKKDVL

SEQ ID NO: 2086466 - protein, 24 aa, Staphylococcus
TNMLYGLFNDYGDIFGRMIKSNLM

SEQ ID NO: 2086467 - protein, 17 aa, Staphylococcus
TNMYLHIIERLEYALEK

SEQ ID NO: 2086468 - protein, 19 aa, Staphylococcus
TNNDLIIVNKRFGQRANLT

SEQ ID NO: 2086469 - protein, 26 aa, Staphylococcus
TNNQLVGAGLPLWLPNGATIRREIER

SEQ ID NO: 2086470 - protein, 17 aa, Staphylococcus
TNPLPYHAIRKHPTVDK

SEQ ID NO: 2086471 - protein, 26 aa, Staphylococcus
TNPSLFERWFHPQGAKTKVYRFNTEE

SEQ ID NO: 2086472 - protein, 17 aa, Staphylococcus
TNQIISPRYGTLKNMYA

SEQ ID NO: 2086473 - protein, 25 aa, Staphylococcus
TNQMKLLYKIFGIDISKYQPDNYHG

SEQ ID NO: 2086474 - protein, 17 aa, Staphylococcus
TNQSFLLDGAYPYIETK

SEQ ID NO: 2086475 - protein, 17 aa, Staphylococcus
TNRFKIIRVGADIRIKC

SEQ ID NO: 2086476 - protein, 25 aa, Staphylococcus
TNRFSIVMNDLLKLPFIGDSFSQTE

SEQ ID NO: 2086477 - protein, 24 aa, Staphylococcus
TNRSLYLLDILQKLPINKMNSLSI

SEQ ID NO: 2086478 - protein, 17 aa, Staphylococcus
TNSAANMIFAISYQAYS

SEQ ID NO: 2086479 - protein, 21 aa, Staphylococcus
TNSAFLIYLITKNKDNHDEVM

SEQ ID NO: 2086480 - protein, 26 aa, Staphylococcus
TNSEFEIMKLLMQYPEKAFSKQKIYE

SEQ ID NO: 2086481 - protein, 17 aa, Staphylococcus
TNSIFYTQSYDFGDIEA

SEQ ID NO: 2086482 - protein, 29 aa, Staphylococcus
TNSIQYQRFIRHIQFLIRRLQKGEIIQVN

SEQ ID NO: 2086483 - protein, 18 aa, Staphylococcus
TNSNRLYPIVFTSSLGTG

SEQ ID NO: 2086484 - protein, 27 aa, Staphylococcus
TNSQLVGAGLPLWLPNGATIRREIERY

SEQ ID NO: 2086485 - protein, 23 aa, Staphylococcus
TNTKLLQNQLLLKDIPSINQALN

SEQ ID NO: 2086486 - protein, 27 aa, Staphylococcus
TNTYQQLLDYGAIYNLKDLYEKYKDNP

SEQ ID NO: 2086487 - protein, 24 aa, Staphylococcus
TNVDKLFLLILELPERLTRQEFSL

SEQ ID NO: 2086488 - protein, 22 aa, Staphylococcus
TNVIDLAYPGVLPVVNKRAVDW

SEQ ID NO: 2086489 - protein, 20 aa, Staphylococcus
TNVIDLAYPGVLPVVNRRAV

SEQ ID NO: 2086490 - protein, 18 aa, Staphylococcus
TNVIPKDKYLVLGDNREV

SEQ ID NO: 2086491 - protein, 30 aa, Staphylococcus
TNVKGNIALPLDFPGLFKGYYKDEERTKAA

SEQ ID NO: 2086492 - protein, 26 aa, Staphylococcus
TNWNISPMMRLIKTNILTNHFKDSAY

SEQ ID NO: 2086493 - protein, 21 aa, Staphylococcus
TNYLLDTWVLEEPHLKFKSDK

SEQ ID NO: 2086494 - protein, 22 aa, Staphylococcus
TPAFTLNKVCGSGLKAIQLAYQ

SEQ ID NO: 2086495 - protein, 25 aa, Staphylococcus
TPAGIKLSVLPIEKAATNIKNGKYD

SEQ ID NO: 2086496 - protein, 18 aa, Staphylococcus
TPAKAIIGGAKFVRQDYI

SEQ ID NO: 2086497 - protein, 24 aa, Staphylococcus
TPAQIILNWHLCHGRIVIPKSQTP

SEQ ID NO: 2086498 - protein, 26 aa, Staphylococcus
TPAQIVLRWHLAHDRIIIPKSKTPSR

SEQ ID NO: 2086499 - protein, 25 aa, Staphylococcus
TPAQIVLRWHLAHNRIIIPKSKTPS

SEQ ID NO: 2086500 - protein, 25 aa, Staphylococcus
TPAQIVLRWHLAHNRIIIPKSQTPS

SEQ ID NO: 2086501 - protein, 25 aa, Staphylococcus
TPAQIVLRWHLAHNRLIIPKSKTPE

SEQ ID NO: 2086502 - protein, 24 aa, Staphylococcus
TPAQIVLRWHLAHNRMIIPKSKTP

SEQ ID NO: 2086503 - protein, 21 aa, Staphylococcus
TPDLSYAVRFLEAHAGVMITA

SEQ ID NO: 2086504 - protein, 22 aa, Staphylococcus
TPELAFKLGRYGGYVLAHNEGE

SEQ ID NO: 2086505 - protein, 28 aa, Staphylococcus
TPENLRYQFLQKYWNTLPAKGGINIYFR

SEQ ID NO: 2086506 - protein, 20 aa, Staphylococcus
TPEQKVWLSGYLIANQQTIQ

SEQ ID NO: 2086507 - protein, 21 aa, Staphylococcus
TPEQKVWLSGYLVANQQLTSG

SEQ ID NO: 2086508 - protein, 21 aa, Staphylococcus
TPEQKVWLSGYLVANQQLTSN

SEQ ID NO: 2086509 - protein, 31 aa, Staphylococcus; identical to SEQ ID NO: 2042240

SEQ ID NO: 2086510 - protein, 23 aa, Staphylococcus
TPERMLLPMHKGGSMGKFTTSIG

SEQ ID NO: 2086511 - protein, 25 aa, Staphylococcus
TPESDVIELPYGAVPIDFAYAVHSE

SEQ ID NO: 2086512 - protein, 29 aa, Staphylococcus
TPESEALHFIFYKMSQFPADYLKLAVMPE

SEQ ID NO: 2086513 - protein, 19 aa, Staphylococcus
TPFIGYKVYGNPVLTMVAG

SEQ ID NO: 2086514 - protein, 19 aa, Staphylococcus
TPFIGYKVYGTPVLTMVEG

SEQ ID NO: 2086515 - protein, 23 aa, Staphylococcus
TPFIMDETLWKNSGHWDHYQDNM

SEQ ID NO: 2086516 - protein, 18 aa, Staphylococcus
TPFYEKLGYITSGRPFYE

SEQ ID NO: 2086517 - protein, 17 aa, Staphylococcus
TPGMLLAAVRTNVPAIF

SEQ ID NO: 2086518 - protein, 18 aa, Staphylococcus
TPGPWHIHRMLEAAEELP

SEQ ID NO: 2086519 - protein, 21 aa, Staphylococcus
TPIGRFKGKLSHYSAVELGTK

SEQ ID NO: 2086520 - protein, 18 aa, Staphylococcus
TPIILLNDHYTIGSYPQI

SEQ ID NO: 2086521 - protein, 18 aa, Staphylococcus
TPIILLNDHYTLGSYPQI

SEQ ID NO: 2086522 - protein, 24 aa, Staphylococcus
TPIQNPPRILGFDAVGEVVAAGPD

SEQ ID NO: 2086523 - protein, 22 aa, Staphylococcus
TPKDDIFKFEKELKRLGINATI

SEQ ID NO: 2086524 - protein, 24 aa, Staphylococcus
TPKDLIGKRLQYPGAPGLGGIAIA

SEQ ID NO: 2086525 - protein, 22 aa, Staphylococcus
TPKEDIFKFEKELKRLGINATI

SEQ ID NO: 2086526 - protein, 26 aa, Staphylococcus
TPKEIYNLVVYQLGALDGFCKVHQTR

SEQ ID NO: 2086527 - protein, 33 aa, Staphylococcus
TPKNAGKLFAVKYLLDLFDVPATEVLGFGDSGN

SEQ ID NO: 2086528 - protein, 17 aa, Staphylococcus
TPKNPLCLFCPIQSHCE

SEQ ID NO: 2086529 - protein, 23 aa, Staphylococcus
TPLDVVAMRFKCCDKYYACIHCH

SEQ ID NO: 2086530 - protein, 18 aa, Staphylococcus
TPLFKYKVIFCFDGLDFF

SEQ ID NO: 2086531 - protein, 35 aa, Staphylococcus
TPLKVYVNGQFNDVTFPNTFKVFGSDDSKVIFCEA

SEQ ID NO: 2086532 - protein, 20 aa, Staphylococcus
TPLSMYLANKGYKIANIPLV

SEQ ID NO: 2086533 - protein, 17 aa, Staphylococcus
TPLSQLQIFVDTSSIEI

SEQ ID NO: 2086534 - protein, 26 aa, Staphylococcus
TPLTAYKLMEILEEAGLPKGVVNFVP

SEQ ID NO: 2086535 - protein, 17 aa, Staphylococcus
TPLTKIPGYSGAKAAIS

SEQ ID NO: 2086536 - protein, 17 aa, Staphylococcus
TPMTLQFTQNLQLNWKE

SEQ ID NO: 2086537 - protein, 26 aa, Staphylococcus
TPNFDFFNYAGIHRPVKIYTTPQTYI

SEQ ID NO: 2086538 - protein, 18 aa, Staphylococcus
TPNKKGYFFAMWKKDENN

SEQ ID NO: 2086539 - protein, 28 aa, Staphylococcus
TPPELSEQFPYIRQLLDAYHIKRYELEN

SEQ ID NO: 2086540 - protein, 24 aa, Staphylococcus
TPQALLTMTRLLNARSELVRFQAA

SEQ ID NO: 2086541 - protein, 21 aa, Staphylococcus
TPQQLINIRPVIASIKEFFGS

SEQ ID NO: 2086542 - protein, 25 aa, Staphylococcus
TPQSDVIELPYGAVPIDFAYAVHSE

SEQ ID NO: 2086543 - protein, 20 aa, Staphylococcus
TPRFYLDLNKYIDSSTKHST

SEQ ID NO: 2086544 - protein, 29 aa, Staphylococcus
TPRKEYNSLWYLLKSFKDSLHIQDSVWLV

SEQ ID NO: 2086545 - protein, 20 aa, Staphylococcus
TPRQILNMMTGLQSASTLFK

SEQ ID NO: 2086546 - protein, 18 aa, Staphylococcus
TPRTFEFEDKAHWDLVEE

SEQ ID NO: 2086547 - protein, 29 aa, Staphylococcus
TPSDFIEALYKRIQYFHDKGGRLADHGLE

SEQ ID NO: 2086548 - protein, 22 aa, Staphylococcus
TPSTFGQRKLGVNLGPDAIRYA

SEQ ID NO: 2086549 - protein, 36 aa, Staphylococcus
TPTFVSGKLMIDNFRWAGVPFYIRTGKRMKSKTIQV

SEQ ID NO: 2086550 - protein, 26 aa, Staphylococcus
TPTGLWLSELVHFYDAFKDTNVDIDL

SEQ ID NO: 2086551 - protein, 17 aa, Staphylococcus
TPTSLLIGIYAEAIRKV

SEQ ID NO: 2086552 - protein, 18 aa, Staphylococcus
TPTTLKSLTFHAACDEWF

SEQ ID NO: 2086553 - protein, 25 aa, Staphylococcus
TPVCDYLFCKAFGKMATNIEKYTKQ

SEQ ID NO: 2086554 - protein, 25 aa, Staphylococcus
TPVESILLVLSIVDYVLVMTVNPGF

SEQ ID NO: 2086555 - protein, 31 aa, Staphylococcus
TPVFKQCYKLYFKFVMPIFGKIFAKSKDEYE

SEQ ID NO: 2086556 - protein, 25 aa, Staphylococcus
TPVGKFRGKLRDYSAVQLGTIALEA

SEQ ID NO: 2086557 - protein, 17 aa, Staphylococcus
TPVIGTSTCHLMLDPKQ

SEQ ID NO: 2086558 - protein, 23 aa, Staphylococcus
TPVQFECQCSHEKFLNAIKGLGE

SEQ ID NO: 2086559 - protein, 18 aa, Staphylococcus
TPVYDFIELSKEGSYGLG

SEQ ID NO: 2086560 - protein, 19 aa, Staphylococcus
TPYEVFTYGIHRPAQFKAE

SEQ ID NO: 2086561 - protein, 25 aa, Staphylococcus
TPYMTPLKFNLLISNIQSLSVECHF

SEQ ID NO: 2086562 - protein, 22 aa, Staphylococcus
TQAIALNLDPYSNSIWLFDAGE

SEQ ID NO: 2086563 - protein, 23 aa, Staphylococcus
TQAIALNLEPYSNSIWLFDVGEG

SEQ ID NO: 2086564 - protein, 22 aa, Staphylococcus
TQAILPLRGKILNVEKARLDRI

SEQ ID NO: 2086565 - protein, 17 aa, Staphylococcus
TQAKAFIDCKNTYFLHD

SEQ ID NO: 2086566 - protein, 34 aa, Staphylococcus
TQDTALVFTNKGRYLFIPIHKIADVRWKELGQHV

SEQ ID NO: 2086567 - protein, 18 aa, Staphylococcus
TQEFDIPASWKLVAQMPF

SEQ ID NO: 2086568 - protein, 20 aa, Staphylococcus
TQEHLVALFLNTKNIVIKEE

SEQ ID NO: 2086569 - protein, 17 aa, Staphylococcus
TQEVYQEWYLGQSLYEE

SEQ ID NO: 2086570 - protein, 20 aa, Staphylococcus
TQEWLIKFKSEQLECLKLKE

SEQ ID NO: 2086571 - protein, 26 aa, Staphylococcus
TQFDEFERMILLRSIDTHWTDHIDTM

SEQ ID NO: 2086572 - protein, 23 aa, Staphylococcus
TQFDIMHYINYFKNLDYPLEKVL

SEQ ID NO: 2086573 - protein, 18 aa, Staphylococcus
TQFFVKLFESALEEREYY

SEQ ID NO: 2086574 - protein, 28 aa, Staphylococcus
TQFGLKGNRLFYLAMAPQFFGVISDYLK

SEQ ID NO: 2086575 - protein, 24 aa, Staphylococcus
TQFQPQLIMDFATLTGAAIVALGE

SEQ ID NO: 2086576 - protein, 17 aa, Staphylococcus
TQFVSKYQIPVVTTLLG

SEQ ID NO: 2086577 - protein, 27 aa, Staphylococcus
TQFVSNTFFTVEKWDISEHLTLEKPHP

SEQ ID NO: 2086578 - protein, 24 aa, Staphylococcus
TQGAIYEGFLEYARNFKKYEGKDQ

SEQ ID NO: 2086579 - protein, 17 aa, Staphylococcus
TQGFRAFKKAKAGDKVI

SEQ ID NO: 2086580 - protein, 21 aa, Staphylococcus
TQGPGLIGALLVGINAAKALA

SEQ ID NO: 2086581 - protein, 19 aa, Staphylococcus
TQGVLLPESFYRGAHQHIF

SEQ ID NO: 2086582 - protein, 21 aa, Staphylococcus
TQHQIPVVTTLLGLGAISYEN

SEQ ID NO: 2086583 - protein, 25 aa, Staphylococcus
TQHRELFGDFPSKDFPLLCKIVDAN

SEQ ID NO: 2086584 - protein, 32 aa, Staphylococcus; identical to SEQ ID NO: 1833046

SEQ ID NO: 2086585 - protein, 27 aa, Staphylococcus
TQIICYDLRFPELLRYPARKDAQIAFY

SEQ ID NO: 2086586 - protein, 29 aa, Staphylococcus
TQIICYDLRFPELLRYPARNGAQIAFFVA

SEQ ID NO: 2086587 - protein, 29 aa, Staphylococcus
TQIICYDLRFPELLRYPSREGAQIAFYVA

SEQ ID NO: 2086588 - protein, 24 aa, Staphylococcus
TQIKIGATVLNGYGPRIVRINDYP

SEQ ID NO: 2086589 - protein, 22 aa, Staphylococcus
TQIPVIIVDPFLSLAAREKLNH

SEQ ID NO: 2086590 - protein, 23 aa, Staphylococcus
TQKASLQFIKKDLVNFLENHSLK

SEQ ID NO: 2086591 - protein, 24 aa, Staphylococcus
TQKQKSYLELFYLRDYSLSEIADT

SEQ ID NO: 2086592 - protein, 18 aa, Staphylococcus
TQKYNIIKPFILGEQSLS

SEQ ID NO: 2086593 - protein, 25 aa, Staphylococcus
TQLDELLDIYKSYDITLLGYSMGGR

SEQ ID NO: 2086594 - protein, 18 aa, Staphylococcus
TQLDQTILGYIPLHWHND

SEQ ID NO: 2086595 - protein, 21 aa, Staphylococcus
TQLEFIFKNHLKANSLITIQT

SEQ ID NO: 2086596 - protein, 21 aa, Staphylococcus
TQLIHNNPIKSFPFTVEDLPF

SEQ ID NO: 2086597 - protein, 17 aa, Staphylococcus
TQLKEDILAFKYNSHEK

SEQ ID NO: 2086598 - protein, 22 aa, Staphylococcus
TQLMTYLLEMYSEKKWSLNCDY

SEQ ID NO: 2086599 - protein, 17 aa, Staphylococcus
TQLNIRLMDQRISIEVS

SEQ ID NO: 2086600 - protein, 20 aa, Staphylococcus
TQLQALKRELKEELKLELSD

SEQ ID NO: 2086601 - protein, 19 aa, Staphylococcus
TQLVLPYMRAQHSGKIVNV

SEQ ID NO: 2086602 - protein, 22 aa, Staphylococcus
TQLYVNIFRPNKEGQFPVVISA

SEQ ID NO: 2086603 - protein, 27 aa, Staphylococcus
TQMNVHTLFIMFKATIKNEVIDIQMKD

SEQ ID NO: 2086604 - protein, 26 aa, Staphylococcus
TQMPEFERMILLRSIDTHWTDHIDTM

SEQ ID NO: 2086605 - protein, 18 aa, Staphylococcus
TQMQQIMTMLNAPDIEAL

SEQ ID NO: 2086606 - protein, 25 aa, Staphylococcus
TQNLKPVVIYFYGGGFTQGHGTADL

SEQ ID NO: 2086607 - protein, 25 aa, Staphylococcus
TQNYADVVVFYDINKKFLSGLSRSA

SEQ ID NO: 2086608 - protein, 24 aa, Staphylococcus
TQPALLTHSIALLNALNNVEADYT

SEQ ID NO: 2086609 - protein, 24 aa, Staphylococcus
TQPALLTHSIALYSALDNINADYT

SEQ ID NO: 2086610 - protein, 21 aa, Staphylococcus
TQPVLLTHSSALLNALNDLNA

SEQ ID NO: 2086611 - protein, 19 aa, Staphylococcus
TQPYKLEKILLGGAKLSVA

SEQ ID NO: 2086612 - protein, 26 aa, Staphylococcus
TQQLCTNLFSIFNINNIVLGGGVTQS

SEQ ID NO: 2086613 - protein, 25 aa, Staphylococcus
TQQTYEAIFPYNIPTTFTDLLKERS

SEQ ID NO: 2086614 - protein, 26 aa, Staphylococcus
TQQTYEGIFPYNIPTTFTKSLRERSL

SEQ ID NO: 2086615 - protein, 26 aa, Staphylococcus
TQQVDTPLFMFPTKSYIMKEPYGTVL

SEQ ID NO: 2086616 - protein, 33 aa, Staphylococcus
TQSAHLPMIENIRKLMNLLEKKSVPMSIATSSS

SEQ ID NO: 2086617 - protein, 29 aa, Staphylococcus
TQSERMEEEMFLGLRMNKGVDKVKFLSKF

SEQ ID NO: 2086618 - protein, 28 aa, Staphylococcus
TQSLHYAMPMLLAVSHIHQLLIKEDLRM

SEQ ID NO: 2086619 - protein, 33 aa, Staphylococcus
TQSLKWAVEEMERRYKLFAKYHVRNITAFNKKA

SEQ ID NO: 2086620 - protein, 23 aa, Staphylococcus
TQSLKWAVEEMERRYKLFAQYHV

SEQ ID NO: 2086621 - protein, 19 aa, Staphylococcus
TQSLLKQKYHLQLLDDYAG

SEQ ID NO: 2086622 - protein, 23 aa, Staphylococcus
TQSRFESYGWNYILVKDGNDLEE

SEQ ID NO: 2086623 - protein, 24 aa, Staphylococcus
TQSRYDLLKDRAIIMHPAPVNRGV

SEQ ID NO: 2086624 - protein, 24 aa, Staphylococcus
TQTLQSFNSMKAFLATPAIDAIKG

SEQ ID NO: 2086625 - protein, 23 aa, Staphylococcus
TQTLVQPLIAYIQDYGIALEAHM

SEQ ID NO: 2086626 - protein, 19 aa, Staphylococcus
TQTNFYIDTPNFELAEQLM

SEQ ID NO: 2086627 - protein, 37 aa, Staphylococcus
TQTVLVHLYDYIPKLVWPVYYLFQSPFQGLMLRGFEI

SEQ ID NO: 2086628 - protein, 20 aa, Staphylococcus
TQVGCRIGCTFCASTLGGLK

SEQ ID NO: 2086629 - protein, 20 aa, Staphylococcus
TQYIQELFKKLRLKRDDIQQ

SEQ ID NO: 2086630 - protein, 23 aa, Staphylococcus
TQYSMYPSLWENMGLSYADLITK

SEQ ID NO: 2086631 - protein, 22 aa, Staphylococcus
TQYVGHLNVVLFAPEDLNIVKG

SEQ ID NO: 2086632 - protein, 27 aa, Staphylococcus
TRAERVKSLIPLLKQHKDDIAHLYVKE

SEQ ID NO: 2086633 - protein, 20 aa, Staphylococcus
TRALMNFPVFNKDVVIKQTD

SEQ ID NO: 2086634 - protein, 25 aa, Staphylococcus
TRARNKLIILYSGQITPLLDNSSFE

SEQ ID NO: 2086635 - protein, 18 aa, Staphylococcus
TRASFNILISKYAKTHIT

SEQ ID NO: 2086636 - protein, 26 aa, Staphylococcus
TRCQDGIILLFPIEGQLILQHFTKTV

SEQ ID NO: 2086637 - protein, 25 aa, Staphylococcus
TRDNIDQLLYLIADKLEEVKDVDFS

SEQ ID NO: 2086638 - protein, 28 aa, Staphylococcus
TREIGYSIIPLKLYLKHGQCKVLLGIAR

SEQ ID NO: 2086639 - protein, 27 aa, Staphylococcus
TREIGYSIIPLKLYLKHGVCKVLIGVA

SEQ ID NO: 2086640 - protein, 24 aa, Staphylococcus
TREQAPYKFLLSHGFVMDGEGKKM

SEQ ID NO: 2086641 - protein, 27 aa, Staphylococcus
TREVGYSIIPLKLYLKHGHCKVLLGVA

SEQ ID NO: 2086642 - protein, 17 aa, Staphylococcus
TRFKEDVSVKLFIGGTD

SEQ ID NO: 2086643 - protein, 18 aa, Staphylococcus
TRGIVGESFFNKAKPNLQ

SEQ ID NO: 2086644 - protein, 20 aa, Staphylococcus
TRGIVNADFFSKAKPTLQII

SEQ ID NO: 2086645 - protein, 21 aa, Staphylococcus
TRGTDRHGIDLKRANALLLEN

SEQ ID NO: 2086646 - protein, 20 aa, Staphylococcus
TRIIRIEGNFWDIGEGPSGP

SEQ ID NO: 2086647 - protein, 25 aa, Staphylococcus
TRIKSIESILFASKIDYKCVTTMRL

SEQ ID NO: 2086648 - protein, 19 aa, Staphylococcus
TRILAEHVGPIKLHIVPFT

SEQ ID NO: 2086649 - protein, 34 aa, Staphylococcus
TRILFVAATAPFTPFYRALDWIVTDPLEAIKDEI

SEQ ID NO: 2086650 - protein, 29 aa, Staphylococcus
TRIMDLVAPIGLGQRGLIVAPPKAGKTSL

SEQ ID NO: 2086651 - protein, 30 aa, Staphylococcus
TRIMDLVTPIGLGQRGLIVAPPKAGKTSLL

SEQ ID NO: 2086652 - protein, 24 aa, Staphylococcus
TRIQRMLMNVLLNFKQQDKPTTLN

SEQ ID NO: 2086653 - protein, 23 aa, Staphylococcus
TRITRHFYFPPVMADITMWSDQH

SEQ ID NO: 2086654 - protein, 19 aa, Staphylococcus
TRIVAYYLHKPVGILDVIV

SEQ ID NO: 2086655 - protein, 17 aa, Staphylococcus
TRIVLLLNDNHDKFWDI

SEQ ID NO: 2086656 - protein, 24 aa, Staphylococcus
TRIYRANVKALLPLKPQTIDMPIG

SEQ ID NO: 2086657 - protein, 25 aa, Staphylococcus
TRKEAVLLLHSFTGTIRDVKPLAQK

SEQ ID NO: 2086658 - protein, 19 aa, Staphylococcus
TRKEVLLNNIKTPILAFDY

SEQ ID NO: 2086659 - protein, 17 aa, Staphylococcus
TRKKVNEVIKRLNYRPN

SEQ ID NO: 2086660 - protein, 24 aa, Staphylococcus
TRKMILVTHIVTHPAFVVPTPHRI

SEQ ID NO: 2086661 - protein, 25 aa, Staphylococcus
TRKMMGEYLIYYDDVLIGGLYDNQL

SEQ ID NO: 2086662 - protein, 18 aa, Staphylococcus
TRLKGGDPFIFGRGGEEA

SEQ ID NO: 2086663 - protein, 17 aa, Staphylococcus
TRLNRIIERRLLNYFKR

SEQ ID NO: 2086664 - protein, 25 aa, Staphylococcus
TRLSLAQMLLNEPDLLLLDEPTNHL

SEQ ID NO: 2086665 - protein, 28 aa, Staphylococcus
TRNGDMKVLVKHKFPLVLGSDFAGVIEK

SEQ ID NO: 2086666 - protein, 24 aa, Staphylococcus
TRNIEYYREIVFKLAAKRNLIRVA

SEQ ID NO: 2086667 - protein, 34 aa, Staphylococcus
TRNKVKIPFIDWTINLFYEHGWILVEDRIRELQQ

SEQ ID NO: 2086668 - protein, 18 aa, Staphylococcus
TRQGIWKMIKQYGLKANI

SEQ ID NO: 2086669 - protein, 26 aa, Staphylococcus
TRQLINDFAFKEKVPWIYGGVVQSTY

SEQ ID NO: 2086670 - protein, 23 aa, Staphylococcus
TRQLINDIAYQKCIPWIYGGVVQ

SEQ ID NO: 2086671 - protein, 22 aa, Staphylococcus
TRQLLDVSGIWKFKLVGYKEHV

SEQ ID NO: 2086672 - protein, 23 aa, Staphylococcus
TRQTFQFHGILKRNLKASMRHIN

SEQ ID NO: 2086673 - protein, 29 aa, Staphylococcus
TRRTHGYDFPMWFIRPFYAKETTKNKIKS

SEQ ID NO: 2086674 - protein, 31 aa, Staphylococcus
TRRTHGYDFPMWFIRPFYAKSTKLNAVKSKS

SEQ ID NO: 2086675 - protein, 19 aa, Staphylococcus
TRSVIGRPETQRKTVEALG

SEQ ID NO: 2086676 - protein, 21 aa, Staphylococcus
TRTEFEIIKLLSLNSNFYFSK

SEQ ID NO: 2086677 - protein, 19 aa, Staphylococcus
TRTLRYYDEIKLLKAHRSA

SEQ ID NO: 2086678 - protein, 25 aa, Staphylococcus
TRTLRYYHEIGLLIPSIIAENGYRY

SEQ ID NO: 2086679 - protein, 31 aa, Staphylococcus
TRTLRYYHEIGLLVPSYIDDNGYRYYHSQDI

SEQ ID NO: 2086680 - protein, 21 aa, Staphylococcus
TRTMIPFLNSIQETYGHLPEY

SEQ ID NO: 2086681 - protein, 23 aa, Staphylococcus
TRTRLYFKVLKEYKAFFPNYQEQ

SEQ ID NO: 2086682 - protein, 21 aa, Staphylococcus
TRVGYKIVDGKKVRVAKKSGE

SEQ ID NO: 2086683 - protein, 28 aa, Staphylococcus
TRVRNINFIPITALDNYIMKINKPIANK

SEQ ID NO: 2086684 - protein, 24 aa, Staphylococcus
TRYIKLIFEFLKKERNANAVILDP

SEQ ID NO: 2086685 - protein, 27 aa, Staphylococcus
TRYKSMLGYYAPYVPGWDTHGLPIEQA

SEQ ID NO: 2086686 - protein, 24 aa, Staphylococcus
TRYKTLFLETIPDITKRSAPQVPY

SEQ ID NO: 2086687 - protein, 25 aa, Staphylococcus
TRYQKMIDLLFRSEGLKVLGYREVP

SEQ ID NO: 2086688 - protein, 22 aa, Staphylococcus
TRYVKELTGLPAERVIGSGTVL

SEQ ID NO: 2086689 - protein, 23 aa, Staphylococcus
TSARLHPWLLKIYEKRGYEVYAE

SEQ ID NO: 2086690 - protein, 29 aa, Staphylococcus
TSCGSEYTYLDGALFVCPMCAHEWTQDSV

SEQ ID NO: 2086691 - protein, 18 aa, Staphylococcus
TSCLRFFNIYGPKQNPTS

SEQ ID NO: 2086692 - protein, 24 aa, Staphylococcus
TSDDIDLFIPHQANIRIMESARER

SEQ ID NO: 2086693 - protein, 24 aa, Staphylococcus
TSDDIDLFVPHQANIRIMESARLR

SEQ ID NO: 2086694 - protein, 20 aa, Staphylococcus
TSDDYVILSADYSQIELRVL

SEQ ID NO: 2086695 - protein, 23 aa, Staphylococcus
TSDINLWINLFEEVLQTMGVNYD

SEQ ID NO: 2086696 - protein, 18 aa, Staphylococcus
TSDIYWNTLDSRNGYILQ

SEQ ID NO: 2086697 - protein, 25 aa, Staphylococcus
TSDNNGLVVLPLNKAISESTLNKIR

SEQ ID NO: 2086698 - protein, 25 aa, Staphylococcus
TSDSEVLAHLLIRGKSPNIKTNQKA

SEQ ID NO: 2086699 - protein, 21 aa, Staphylococcus
TSDVKKVIYYLEKLNLNLNDI

SEQ ID NO: 2086700 - protein, 25 aa, Staphylococcus
TSEEKVLMQSFLKLAIEELDLSRTK

SEQ ID NO: 2086701 - protein, 21 aa, Staphylococcus
TSEIGLFKIISESGTGAGVRR

SEQ ID NO: 2086702 - protein, 27 aa, Staphylococcus
TSEIKQLYPFIFNTLYDVIHQLSKDTD

SEQ ID NO: 2086703 - protein, 25 aa, Staphylococcus
TSEIKTLYPYAFNVLFDIVQTLSQR

SEQ ID NO: 2086704 - protein, 27 aa, Staphylococcus
TSELHDLAFLLLVYPMSEYEGALDSAY

SEQ ID NO: 2086705 - protein, 25 aa, Staphylococcus
TSENLDLFFSYRIEKGQTGRMLAFI

SEQ ID NO: 2086706 - protein, 25 aa, Staphylococcus
TSENLDLFFSYRVEKSKTGRMLAFI

SEQ ID NO: 2086707 - protein, 26 aa, Staphylococcus
TSEPLSHLRLIVRSLLGIAVPTQIAT

SEQ ID NO: 2086708 - protein, 24 aa, Staphylococcus
TSEQLEMLRILYNYKKLSQYDLTM

SEQ ID NO: 2086709 - protein, 30 aa, Staphylococcus
TSFHDKYEWLLQHFPFLDPQHFVFCGRKNI

SEQ ID NO: 2086710 - protein, 21 aa, Staphylococcus
TSFMPYFIKREEQVYLNTWHG

SEQ ID NO: 2086711 - protein, 24 aa, Staphylococcus
TSFNKFNFYNTLKSKGFNSQLTVL

SEQ ID NO: 2086712 - protein, 23 aa, Staphylococcus
TSFPTLDVFNWLQQQGNISTDEM

SEQ ID NO: 2086713 - protein, 22 aa, Staphylococcus
TSFSMYPSLWENMGLSYADLIA

SEQ ID NO: 2086714 - protein, 24 aa, Staphylococcus
TSFTVAIPNYTSLAPMLEQLNRSF

SEQ ID NO: 2086715 - protein, 38 aa, Staphylococcus
TSFYDKYEWLLEHFPFLDPQHFVFCGRKNIINADYLID

SEQ ID NO: 2086716 - protein, 23 aa, Staphylococcus
TSGESTIPLIKKLSADNVQVNVT

SEQ ID NO: 2086717 - protein, 29 aa, Staphylococcus
TSGEYLFEAVYSAGLLRLYKLDTQTGHII

SEQ ID NO: 2086718 - protein, 19 aa, Staphylococcus
TSGFSLYTNLAPGARLIEL

SEQ ID NO: 2086719 - protein, 18 aa, Staphylococcus
TSGGRVILALGKGATIED

SEQ ID NO: 2086720 - protein, 22 aa, Staphylococcus
TSGIYSYLPLATRVLNNISNIV

SEQ ID NO: 2086721 - protein, 24 aa, Staphylococcus
TSGKELFKRMLPDVLIKLEKAGYE

SEQ ID NO: 2086722 - protein, 25 aa, Staphylococcus
TSGKELFKRTLPDVLIKLEKAGFET

SEQ ID NO: 2086723 - protein, 25 aa, Staphylococcus
TSGTGIFVIIVRSFSHYTTQTYPEH

SEQ ID NO: 2086724 - protein, 24 aa, Staphylococcus
TSHDDEIDMLIPKYLKLAEEYCNQ

SEQ ID NO: 2086725 - protein, 23 aa, Staphylococcus
TSHDVVFKLRKILHTKKVGHTGT

SEQ ID NO: 2086726 - protein, 20 aa, Staphylococcus
TSHDVVFKLRKILKTKKIGH

SEQ ID NO: 2086727 - protein, 20 aa, Staphylococcus
TSHDVVFKLRKILKTKKVGH

SEQ ID NO: 2086728 - protein, 30 aa, Staphylococcus
TSHLGFGNYELRLPLLPLEDADAKVLINVF

SEQ ID NO: 2086729 - protein, 30 aa, Staphylococcus
TSHLGFGNYELRLPLLPLEKEKANVLVNAY

SEQ ID NO: 2086730 - protein, 25 aa, Staphylococcus
TSHNLGMQALYEIATLPEPERTKEH

SEQ ID NO: 2086731 - protein, 20 aa, Staphylococcus
TSHPANCLMARIGKRITLDQ

SEQ ID NO: 2086732 - protein, 20 aa, Staphylococcus
TSHPANCLMARIGNRITLDQ

SEQ ID NO: 2086733 - protein, 28 aa, Staphylococcus
TSHSELTYLTFVYKVAAMDFIFKDDPAE

SEQ ID NO: 2086734 - protein, 31 aa, Staphylococcus
TSHSELTYLTFVYKVAAMDFIFKDDPDELKS

SEQ ID NO: 2086735 - protein, 30 aa, Staphylococcus; identical to SEQ ID NO: 1819451

SEQ ID NO: 2086736 - protein, 23 aa, Staphylococcus
TSHTPVWFMRQAGRSQPEYRKLK

SEQ ID NO: 2086737 - protein, 24 aa, Staphylococcus
TSHTPVWFMRQAGRSQPEYRKLKE

SEQ ID NO: 2086738 - protein, 26 aa, Staphylococcus
TSIATMIHLIYRGLGKGSAYLGTNGF

SEQ ID NO: 2086739 - protein, 32 aa, Staphylococcus
TSICKKWYINSFKYFRNMYKRFYYSRPNELDK

SEQ ID NO: 2086740 - protein, 36 aa, Staphylococcus
TSICKKWYINSFRYFRNMYKNFYYSRPDQLDKCFYK

SEQ ID NO: 2086741 - protein, 24 aa, Staphylococcus
TSILRRWVDQYLKYGSKGLDKKLK

SEQ ID NO: 2086742 - protein, 24 aa, Staphylococcus
TSIPNAFVFVEQWKDRAALNAHVE

SEQ ID NO: 2086743 - protein, 27 aa, Staphylococcus
TSISLDPKIFVPLIKNLKENNDLVVVN

SEQ ID NO: 2086744 - protein, 20 aa, Staphylococcus
TSIYFEGMPSINLFKQCYKA

SEQ ID NO: 2086745 - protein, 23 aa, Staphylococcus
TSKELLNLFRLHLSLFEKYSSDE

SEQ ID NO: 2086746 - protein, 24 aa, Staphylococcus
TSKIKEFKLLSTAGAYWRGDSNNK

SEQ ID NO: 2086747 - protein, 17 aa, Staphylococcus
TSKTPLSMYLANKGYKI

SEQ ID NO: 2086748 - protein, 24 aa, Staphylococcus
TSKTPLSMYLANKGYKIANIPLVL

SEQ ID NO: 2086749 - protein, 17 aa, Staphylococcus
TSKVFWRSFDRNGLNYR

SEQ ID NO: 2086750 - protein, 25 aa, Staphylococcus
TSKVKPYKLGFGPFAPEVYQAPYPN

SEQ ID NO: 2086751 - protein, 19 aa, Staphylococcus
TSKVMFPNPSRQPLNYIAN

SEQ ID NO: 2086752 - protein, 28 aa, Staphylococcus
TSLDDEGLYQYWIAFCKGIQDRGKAKIG

SEQ ID NO: 2086753 - protein, 27 aa, Staphylococcus
TSLENSNIVFWYGWNKQAFDVVSELVN

SEQ ID NO: 2086754 - protein, 31 aa, Staphylococcus
TSLFAQLFTVDILYYRYIALNYQSALDSITQ

SEQ ID NO: 2086755 - protein, 24 aa, Staphylococcus
TSLIQRHFQIGYNRAARIIDQLEQ

SEQ ID NO: 2086756 - protein, 17 aa, Staphylococcus
TSLITYTNPLTHKEQVV

SEQ ID NO: 2086757 - protein, 25 aa, Staphylococcus
TSLLESILQLIKYKGVMTFQGQELR

SEQ ID NO: 2086758 - protein, 19 aa, Staphylococcus
TSLLFNIIPERFQGQEVND

SEQ ID NO: 2086759 - protein, 28 aa, Staphylococcus
TSLPNQYKLLGLLLYAIPKSIRNLGYQL

SEQ ID NO: 2086760 - protein, 37 aa, Staphylococcus
TSLVMVHLYDYIPKLFWPIYYFIQAPIQGLLMRGFEI

SEQ ID NO: 2086761 - protein, 23 aa, Staphylococcus
TSMFYTFKLMKNNVLPSLLLPEL

SEQ ID NO: 2086762 - protein, 25 aa, Staphylococcus
TSNYELLLIAIQLLGRRASLMEEII

SEQ ID NO: 2086763 - protein, 18 aa, Staphylococcus
TSNYFSVQLIKGTEDKTY

SEQ ID NO: 2086764 - protein, 21 aa, Staphylococcus
TSNYIKMWEALAYIAEQAYHD

SEQ ID NO: 2086765 - protein, 17 aa, Staphylococcus
TSPERFIKDKTLKGLSL

SEQ ID NO: 2086766 - protein, 29 aa, Staphylococcus
TSPIRRYPDLVVHRLIRKYLIDETMDRKE

SEQ ID NO: 2086767 - protein, 20 aa, Staphylococcus
TSPMDIIASLLPTGTVSGAP

SEQ ID NO: 2086768 - protein, 33 aa, Staphylococcus
TSPTGKIMKMTWPKSSKILYAPISGFHAFDRID

SEQ ID NO: 2086769 - protein, 22 aa, Staphylococcus
TSPYDFQGLGIEGLKILKNVKD

SEQ ID NO: 2086770 - protein, 23 aa, Staphylococcus
TSPYDFQGLGIEGLKILKNVKDK

SEQ ID NO: 2086771 - protein, 23 aa, Staphylococcus
TSPYEFYQFWINTTDDDVIKFLK

SEQ ID NO: 2086772 - protein, 18 aa, Staphylococcus
TSPYEFYQFWLNQDDRDV

SEQ ID NO: 2086773 - protein, 19 aa, Staphylococcus
TSPYYMGIYDASLAEEDIR

SEQ ID NO: 2086774 - protein, 28 aa, Staphylococcus
TSQEIKSLIDLFLIWSKEVLLKSDICVS

SEQ ID NO: 2086775 - protein, 25 aa, Staphylococcus
TSQLKDFTLDQPLYINAMTGGSEWT

SEQ ID NO: 2086776 - protein, 25 aa, Staphylococcus
TSQPLFFNEVPIPRFWTIEGNNNTA

SEQ ID NO: 2086777 - protein, 24 aa, Staphylococcus
TSRAEYRLLLRHDNADLRLTDLGH

SEQ ID NO: 2086778 - protein, 20 aa, Staphylococcus
TSRLTLLSSCTVPCICETVE

SEQ ID NO: 2086779 - protein, 21 aa, Staphylococcus
TSSDFYQTLLARVCEVYKINM

SEQ ID NO: 2086780 - protein, 25 aa, Staphylococcus
TSSFNLPLSLLSKYPYELSGGQLQR

SEQ ID NO: 2086781 - protein, 32 aa, Staphylococcus
TSSIEIPLELLPYLFFQFAKDGKRLYDDNSVD

SEQ ID NO: 2086782 - protein, 21 aa, Staphylococcus
TSSMQVPLQHIIKFSCKPVQQ

SEQ ID NO: 2086783 - protein, 19 aa, Staphylococcus
TSSPLAEFKKSKASLLTSS

SEQ ID NO: 2086784 - protein, 19 aa, Staphylococcus
TSTCHLMLDPKQEPIPSIT

SEQ ID NO: 2086785 - protein, 21 aa, Staphylococcus
TSTPVLRPLLTLDKEEIVKMA

SEQ ID NO: 2086786 - protein, 24 aa, Staphylococcus
TSTQDFVVCLKKKDLQHISYEVMD

SEQ ID NO: 2086787 - protein, 18 aa, Staphylococcus
TSTRRMMLRVADIVLEKV

SEQ ID NO: 2086788 - protein, 24 aa, Staphylococcus
TSTRRMMLRVTDIILERIGANAIV

SEQ ID NO: 2086789 - protein, 26 aa, Staphylococcus
TSTVVNWFMNFYHILLKDHFGRDNHA

SEQ ID NO: 2086790 - protein, 18 aa, Staphylococcus
TSTYIGWNDIASNRKFII

SEQ ID NO: 2086791 - protein, 17 aa, Staphylococcus
TSVATKLLEHHMKSCIM

SEQ ID NO: 2086792 - protein, 22 aa, Staphylococcus
TSVKDIERAIIAANLGVNPTSD

SEQ ID NO: 2086793 - protein, 34 aa, Staphylococcus
TSYDALTQFDLETLYYMIDIINDTLVSIRFSVNQ

SEQ ID NO: 2086794 - protein, 21 aa, Staphylococcus
TSYDPHVWLDPILDQQFAKKI

SEQ ID NO: 2086795 - protein, 20 aa, Staphylococcus
TSYDSFSQVRWMGVLNLEGK

SEQ ID NO: 2086796 - protein, 17 aa, Staphylococcus
TSYEGHNRLLDYKMLVT

SEQ ID NO: 2086797 - protein, 23 aa, Staphylococcus
TSYHAQLLLQVHDELIFEVPANE

SEQ ID NO: 2086798 - protein, 21 aa, Staphylococcus
TSYKAKLLLQVHDELIFEVPK

SEQ ID NO: 2086799 - protein, 26 aa, Staphylococcus
TSYRIHKGFHMLKFEGFDNINDVESY

SEQ ID NO: 2086800 - protein, 20 aa, Staphylococcus
TSYRVKYIETVGINELIQFQ

SEQ ID NO: 2086801 - protein, 28 aa, Staphylococcus
TSYSELTYLTFVYKVAAMDFIFKDDPSE

SEQ ID NO: 2086802 - protein, 18 aa, Staphylococcus
TTADFLYAVLSYPEYADG

SEQ ID NO: 2086803 - protein, 26 aa, Staphylococcus
TTAIPFEPKYIPLLEKHVLNIEGDQI

SEQ ID NO: 2086804 - protein, 24 aa, Staphylococcus
TTAKLMIKAFQKFETLPLDTLKQL

SEQ ID NO: 2086805 - protein, 23 aa, Staphylococcus
TTAQFECNCSHEKFLNAIKGLGE

SEQ ID NO: 2086806 - protein, 23 aa, Staphylococcus
TTAYGSLLIFDEVMTGFRVGYNC

SEQ ID NO: 2086807 - protein, 18 aa, Staphylococcus
TTCICKCEPNKPNEPGKP

SEQ ID NO: 2086808 - protein, 23 aa, Staphylococcus
TTCKLGIFDTKLERLHKWSIETD

SEQ ID NO: 2086809 - protein, 25 aa, Staphylococcus
TTDADFKVQVFRLGEGGLGGELHIF

SEQ ID NO: 2086810 - protein, 28 aa, Staphylococcus
TTDADVIKFLKYFTFLDKEEIERLEQSK

SEQ ID NO: 2086811 - protein, 26 aa, Staphylococcus
TTDFHHGMPIIIHGDAAYPGQGINFE

SEQ ID NO: 2086812 - protein, 28 aa, Staphylococcus
TTDIDNAIWYKLLVNLAINSVTALTRST

SEQ ID NO: 2086813 - protein, 22 aa, Staphylococcus
TTDLFLNVFGIEKIEDLPTTEE

SEQ ID NO: 2086814 - protein, 28 aa, Staphylococcus
TTDNGLTRIIFMVPARGLIGYTTEFMSQ

SEQ ID NO: 2086815 - protein, 26 aa, Staphylococcus
TTDNGLTRLIFMVPARGMIGYTTEFM

SEQ ID NO: 2086816 - protein, 32 aa, Staphylococcus
TTDPNYYKWTQWIFIQLYNKGLAYVDEVAVNW

SEQ ID NO: 2086817 - protein, 24 aa, Staphylococcus
TTDPYKVSALLPVAGPKGYGLMMM

SEQ ID NO: 2086818 - protein, 27 aa, Staphylococcus
TTDSFFKHSTLPEQLTIVGGGVIATEL

SEQ ID NO: 2086819 - protein, 25 aa, Staphylococcus
TTDTFFDIETLPKQLAIIGGGVIAT

SEQ ID NO: 2086820 - protein, 25 aa, Staphylococcus
TTDTFFDMEALPKSLVVIGGGVIAT

SEQ ID NO: 2086821 - protein, 25 aa, Staphylococcus
TTEDIRWLRCDIKSLNLLGNVLAKE

SEQ ID NO: 2086822 - protein, 21 aa, Staphylococcus
TTEHPLLADLGIKNAGLRLKF

SEQ ID NO: 2086823 - protein, 30 aa, Staphylococcus
TTELQPDNLYQLLRKLPPREYSISSSYKAT

SEQ ID NO: 2086824 - protein, 30 aa, Staphylococcus
TTELQPENLYQLLRKLPPREYSISSSYEAL

SEQ ID NO: 2086825 - protein, 29 aa, Staphylococcus
TTEQNDRMVWVFPLTFNNSEYYIPGNISD

SEQ ID NO: 2086826 - protein, 20 aa, Staphylococcus
TTEYYWHWDLDQAQLDVFEY

SEQ ID NO: 2086827 - protein, 18 aa, Staphylococcus
TTFENKPVYLHVETTNGA

SEQ ID NO: 2086828 - protein, 23 aa, Staphylococcus
TTFGIKMALWYTEMKRNLKRFKE

SEQ ID NO: 2086829 - protein, 19 aa, Staphylococcus
TTFIDGIEHRYGYGLAINS

SEQ ID NO: 2086830 - protein, 26 aa, Staphylococcus
TTFPTFLEMLMATYKLIQKAKATGFE

SEQ ID NO: 2086831 - protein, 25 aa, Staphylococcus
TTFPTFLEMLMATYRLIQKAKQEGH

SEQ ID NO: 2086832 - protein, 26 aa, Staphylococcus
TTFTTTYAIPPKLPARIPIGSPINGT

SEQ ID NO: 2086833 - protein, 25 aa, Staphylococcus
TTGAEPLYFLDYIAANKVVPEVIEQ

SEQ ID NO: 2086834 - protein, 24 aa, Staphylococcus
TTGAEPLYFLDYIATHKVVPEIIE

SEQ ID NO: 2086835 - protein, 24 aa, Staphylococcus
TTGFCLWCQLAFSTYLENADQAHL

SEQ ID NO: 2086836 - protein, 25 aa, Staphylococcus
TTGKVIYISTFSKSLFPSCRIAFMV

SEQ ID NO: 2086837 - protein, 22 aa, Staphylococcus
TTGLPKAYYRNEHSWLISYKEN

SEQ ID NO: 2086838 - protein, 26 aa, Staphylococcus
TTGRPRRVGWFDSVVLRHSRRASGIT

SEQ ID NO: 2086839 - protein, 24 aa, Staphylococcus
TTGTIFNHLFKQAITFAKRAHHET

SEQ ID NO: 2086840 - protein, 24 aa, Staphylococcus
TTGTIFNHLFKQAITFAKRAHSET

SEQ ID NO: 2086841 - protein, 21 aa, Staphylococcus
TTHGQMLTFHFDKNLKSQLQN

SEQ ID NO: 2086842 - protein, 17 aa, Staphylococcus
TTHYTDYELIGKLAQEL

SEQ ID NO: 2086843 - protein, 25 aa, Staphylococcus
TTIDPIKFDLLFERFLNPERVTMPD

SEQ ID NO: 2086844 - protein, 19 aa, Staphylococcus
TTIEFYRKELQERSKLLEN

SEQ ID NO: 2086845 - protein, 20 aa, Staphylococcus
TTIGKLAYRYKMEGKKVMLA

SEQ ID NO: 2086846 - protein, 18 aa, Staphylococcus
TTIGRYLSDLQNLSYVDL

SEQ ID NO: 2086847 - protein, 19 aa, Staphylococcus
TTILNIIAGLRQPDEAYIN

SEQ ID NO: 2086848 - protein, 18 aa, Staphylococcus
TTINLFERVPDALEYYQN

SEQ ID NO: 2086849 - protein, 19 aa, Staphylococcus
TTIQFLQSLLNIPADETIV

SEQ ID NO: 2086850 - protein, 25 aa, Staphylococcus
TTIWFDFFETHQTFFKCLFSIKNAD

SEQ ID NO: 2086851 - protein, 20 aa, Staphylococcus
TTKEFIAFYLNELNIDYKQV

SEQ ID NO: 2086852 - protein, 19 aa, Staphylococcus
TTKRFNVQGLPKLVQQMIL

SEQ ID NO: 2086853 - protein, 28 aa, Staphylococcus
TTKYDSFSQVRWMGVLYLKNETPQSLKK

SEQ ID NO: 2086854 - protein, 22 aa, Staphylococcus
TTKYIKEFLDKLGVEYDCPLET

SEQ ID NO: 2086855 - protein, 18 aa, Staphylococcus
TTLDFVDNDRIGALGICA

SEQ ID NO: 2086856 - protein, 25 aa, Staphylococcus
TTLEKLIHSLKNRPPRLYDALLSCG

SEQ ID NO: 2086857 - protein, 17 aa, Staphylococcus
TTLEMIPYIDAKDIIVV

SEQ ID NO: 2086858 - protein, 19 aa, Staphylococcus
TTLEMIPYIKASDIIVVTN

SEQ ID NO: 2086859 - protein, 20 aa, Staphylococcus
TTLKMINRLIPLSEGYIYFK

SEQ ID NO: 2086860 - protein, 21 aa, Staphylococcus
TTLKSLTFHVACDEWLEHYKN

SEQ ID NO: 2086861 - protein, 24 aa, Staphylococcus
TTLMTHAISFLKERNFKVASIKHH

SEQ ID NO: 2086862 - protein, 25 aa, Staphylococcus
TTLRRLMDLYGFKEKLQQSDLPMFG

SEQ ID NO: 2086863 - protein, 19 aa, Staphylococcus
TTLVVCGDTPLITSKTLES

SEQ ID NO: 2086864 - protein, 18 aa, Staphylococcus
TTNAAFIIYLVAVDTPER

SEQ ID NO: 2086865 - protein, 24 aa, Staphylococcus
TTNAAFLIYLIAQDGPNHDELITL

SEQ ID NO: 2086866 - protein, 25 aa, Staphylococcus
TTNGRLGFDYLFDNLADHINAKYLP

SEQ ID NO: 2086867 - protein, 25 aa, Staphylococcus
TTNGRLGFDYLIDNLADDIQAKFLP

SEQ ID NO: 2086868 - protein, 25 aa, Staphylococcus
TTNGRLGFDYLIDNLADSLEGKFMP

SEQ ID NO: 2086869 - protein, 24 aa, Staphylococcus
TTNKPDAKLFILLVGERPEEVTDI

SEQ ID NO: 2086870 - protein, 17 aa, Staphylococcus
TTNLGLTAYDRLAGVKK

SEQ ID NO: 2086871 - protein, 21 aa, Staphylococcus
TTNQAWLARFDWCIPLHHDYG

SEQ ID NO: 2086872 - protein, 24 aa, Staphylococcus
TTNRFSIMMHELLKISSIGEYFGK

SEQ ID NO: 2086873 - protein, 24 aa, Staphylococcus
TTNSAFLIYLLAQDGPEHDNILDE

SEQ ID NO: 2086874 - protein, 24 aa, Staphylococcus
TTNSALFLVPTMLHAITKINHDHL

SEQ ID NO: 2086875 - protein, 25 aa, Staphylococcus
TTNYDPFVFLSYLSAKTSKIALGTS

SEQ ID NO: 2086876 - protein, 26 aa, Staphylococcus
TTNYDPFVFLTYLSAFTSKIALGTGS

SEQ ID NO: 2086877 - protein, 26 aa, Staphylococcus
TTNYDPFVFLTYLSAQTSKIALGTSS

SEQ ID NO: 2086878 - protein, 17 aa, Staphylococcus
TTNYILKESDQLWIPVH

SEQ ID NO: 2086879 - protein, 24 aa, Staphylococcus
TTPDVFDLIAQTTPLRKVTTPQDV

SEQ ID NO: 2086880 - protein, 38 aa, Staphylococcus
TTPTFVAGKLTIDNFRWAGVPFYIRTGKRMKSKTIQVV

SEQ ID NO: 2086881 - protein, 30 aa, Staphylococcus
TTQLPVLCKDFIIDPLQIDVAQKAGASIIL

SEQ ID NO: 2086882 - protein, 17 aa, Staphylococcus
TTRLLAGLLSGLGIECV

SEQ ID NO: 2086883 - protein, 17 aa, Staphylococcus
TTRMLMHALRNPVTRGH

SEQ ID NO: 2086884 - protein, 23 aa, Staphylococcus
TTRNAFFIGRTIDYNVSLEGALK

SEQ ID NO: 2086885 - protein, 25 aa, Staphylococcus
TTRQAFQFHGILKRNLKQSMKDINQ

SEQ ID NO: 2086886 - protein, 25 aa, Staphylococcus
TTRQAFQFHGILKRNLKQSMKEIND

SEQ ID NO: 2086887 - protein, 25 aa, Staphylococcus
TTRQAFQFHGILKRNLKQTMKDINQ

SEQ ID NO: 2086888 - protein, 25 aa, Staphylococcus
TTRQTFQFHGILKRNLKSSMKKINE

SEQ ID NO: 2086889 - protein, 25 aa, Staphylococcus
TTRQTFQFHGILKRNLKTSMKKINE

SEQ ID NO: 2086890 - protein, 22 aa, Staphylococcus
TTRWGSWYDATKGVVIPGSNPV

SEQ ID NO: 2086891 - protein, 23 aa, Staphylococcus
TTSDIYWNTLESRYGYILQGNKV

SEQ ID NO: 2086892 - protein, 25 aa, Staphylococcus
TTSKGMYIVFLFSSDEKEVYLTLNQ

SEQ ID NO: 2086893 - protein, 24 aa, Staphylococcus
TTSKPYFLEFMAQGVSKGNAVTDL

SEQ ID NO: 2086894 - protein, 18 aa, Staphylococcus
TTSKYIVKALKSAGAKEV

SEQ ID NO: 2086895 - protein, 32 aa, Staphylococcus
TTSLFAQMFTIDVLFYRYIALNYESSLDFITQ

SEQ ID NO: 2086896 - protein, 18 aa, Staphylococcus
TTSYFIQMFKDKYKVTPK

SEQ ID NO: 2086897 - protein, 25 aa, Staphylococcus
TTTADFLYAVLNYPAYADGDARNVD

SEQ ID NO: 2086898 - protein, 25 aa, Staphylococcus
TTTADFLYAVLSYPLYADGDASEVD

SEQ ID NO: 2086899 - protein, 26 aa, Staphylococcus
TTTADFLYAVLSYPLYADGDASEVDI

SEQ ID NO: 2086900 - protein, 24 aa, Staphylococcus
TTTAKLMIKAFKKFESLPLDTQKQ

SEQ ID NO: 2086901 - protein, 25 aa, Staphylococcus
TTTGESTLPLIKKLSADNVRLNVTA

SEQ ID NO: 2086902 - protein, 28 aa, Staphylococcus
TTTGRPRRVGWFDSVVLRHARRVSGITD

SEQ ID NO: 2086903 - protein, 27 aa, Staphylococcus
TTTGRPRRVGWFDSVVLRHSRRVSGIT

SEQ ID NO: 2086904 - protein, 23 aa, Staphylococcus
TTTVFRVFVLDSHALRRSIELIK

SEQ ID NO: 2086905 - protein, 26 aa, Staphylococcus
TTVIVPDYQLSLAIGKRGQNARLAAK

SEQ ID NO: 2086906 - protein, 25 aa, Staphylococcus
TTVNDLGVELIIDEALRKARKDKLT

SEQ ID NO: 2086907 - protein, 27 aa, Staphylococcus
TTVYKLGVLISKKKYWHRLPNFEDISQ

SEQ ID NO: 2086908 - protein, 20 aa, Staphylococcus
TTWQHMFEWIKKQILKKNKV

SEQ ID NO: 2086909 - protein, 35 aa, Staphylococcus
TTYGFDYIVTGSGFLYNMVRVLMAFLIEVGKGNRS

SEQ ID NO: 2086910 - protein, 20 aa, Staphylococcus
TTYGLIFNDLSWMINQNKVK

SEQ ID NO: 2086911 - protein, 23 aa, Staphylococcus
TTYNLARMNMLLHDVRFENFDIQ

SEQ ID NO: 2086912 - protein, 19 aa, Staphylococcus
TTYSPLNHWKAYEGKKNVA

SEQ ID NO: 2086913 - protein, 20 aa, Staphylococcus
TVAIANFWECATAYLGKNAP

SEQ ID NO: 2086914 - protein, 23 aa, Staphylococcus
TVALVEQLVYYINNRIVPVIPQQ

SEQ ID NO: 2086915 - protein, 34 aa, Staphylococcus; identical to SEQ ID NO: 1681313

SEQ ID NO: 2086916 - protein, 20 aa, Staphylococcus
TVAPGPWHIHRMLEAAEGLP

SEQ ID NO: 2086917 - protein, 30 aa, Staphylococcus
TVASTMICAALADIPFFVTGGIGGVHKGAE

SEQ ID NO: 2086918 - protein, 30 aa, Staphylococcus
TVAYTKLHNFHWYVKGPNFFSLHVKFEELY

SEQ ID NO: 2086919 - protein, 18 aa, Staphylococcus
TVCILEAMKLFNEIQAEI

SEQ ID NO: 2086920 - protein, 19 aa, Staphylococcus
TVCILEAMKLFNEIQAETS

SEQ ID NO: 2086921 - protein, 17 aa, Staphylococcus
TVDFKKIPYYIPEFNEQ

SEQ ID NO: 2086922 - protein, 25 aa, Staphylococcus
TVDGVSLTIFQLKQSDFDIHLIPET

SEQ ID NO: 2086923 - protein, 24 aa, Staphylococcus
TVDGVSLTIFRLGEGQFDIHLIPE

SEQ ID NO: 2086924 - protein, 26 aa, Staphylococcus
TVDKIRTTVLPKLKKWNIGVSSIGSP

SEQ ID NO: 2086925 - protein, 23 aa, Staphylococcus
TVDKLIRIEFGNLNLKGLNAGEG

SEQ ID NO: 2086926 - protein, 25 aa, Staphylococcus
TVDQQPIHYLFQDAITLKAEIIEIK

SEQ ID NO: 2086927 - protein, 39 aa, Staphylococcus
TVDVGSHYIWMARKFRSYNPRHLLFSNGMQTLGVALPWA

SEQ ID NO: 2086928 - protein, 21 aa, Staphylococcus
TVEAFLKSKGGKLADFVRYEV

SEQ ID NO: 2086929 - protein, 18 aa, Staphylococcus
TVEALLETNLPDGKSVDQ

SEQ ID NO: 2086930 - protein, 25 aa, Staphylococcus
TVEDIRWLRCDIKSLNLLGNVLAKE

SEQ ID NO: 2086931 - protein, 21 aa, Staphylococcus
TVEFNQLLIATGRKPNTQVVN

SEQ ID NO: 2086932 - protein, 26 aa, Staphylococcus
TVEQLVAFGRFPYSKGRLTKFDKHKI

SEQ ID NO: 2086933 - protein, 19 aa, Staphylococcus
TVEQLVNFGRFPYCKGHLK

SEQ ID NO: 2086934 - protein, 19 aa, Staphylococcus
TVEQLVQFGRFPYCKGRLN

SEQ ID NO: 2086935 - protein, 17 aa, Staphylococcus
TVERARDLYKAEEPIES

SEQ ID NO: 2086936 - protein, 18 aa, Staphylococcus
TVFGYTSLYEKMRFKDTT

SEQ ID NO: 2086937 - protein, 20 aa, Staphylococcus
TVFIHKFAGFLADKGLSLTE

SEQ ID NO: 2086938 - protein, 20 aa, Staphylococcus
TVFPILGGGERLGTLVLGRV

SEQ ID NO: 2086939 - protein, 17 aa, Staphylococcus
TVFSFLEAAGIYDSHLE

SEQ ID NO: 2086940 - protein, 17 aa, Staphylococcus
TVFYDKHEKNGVTALLQ

SEQ ID NO: 2086941 - protein, 17 aa, Staphylococcus
TVGFIVNGSINREKYGI

SEQ ID NO: 2086942 - protein, 23 aa, Staphylococcus
TVGKGGLLITLAKMSAHYNLGLE

SEQ ID NO: 2086943 - protein, 22 aa, Staphylococcus
TVGVLLIPILATPPSDEAYEYG

SEQ ID NO: 2086944 - protein, 25 aa, Staphylococcus
TVGYDMMSQIRWLSVLDLKGKSEDQ

SEQ ID NO: 2086945 - protein, 24 aa, Staphylococcus
TVGYSTMSQIRWLSVLDLKDKSED

SEQ ID NO: 2086946 - protein, 26 aa, Staphylococcus
TVIFASPVYWYSISGSLKAFIDHWSE

SEQ ID NO: 2086947 - protein, 24 aa, Staphylococcus
TVIFASPVYWYSVSASLKAFIDHW

SEQ ID NO: 2086948 - protein, 17 aa, Staphylococcus
TVIGPRGLQQFIETTLR

SEQ ID NO: 2086949 - protein, 26 aa, Staphylococcus
TVIIASPVYWYSLSASMKAFFDHWSE

SEQ ID NO: 2086950 - protein, 27 aa, Staphylococcus
TVILGCTHYPLLFEPLHDYFGGSKTVI

SEQ ID NO: 2086951 - protein, 27 aa, Staphylococcus
TVILGCTHYPLLYKPINDYFGGNKKVI

SEQ ID NO: 2086952 - protein, 28 aa, Staphylococcus
TVILGCTHYPLLYKPIYDYFDGEKTVIS

SEQ ID NO: 2086953 - protein, 27 aa, Staphylococcus
TVILGCTHYPLLYQPLNDYFGGDKTVI

SEQ ID NO: 2086954 - protein, 26 aa, Staphylococcus
TVINELAWHNLFAHNMFIRPESKDEA

SEQ ID NO: 2086955 - protein, 26 aa, Staphylococcus
TVINELAWHNLFAQNMFIRPDSKEEA

SEQ ID NO: 2086956 - protein, 17 aa, Staphylococcus
TVITMYPHLDGVLSLDL

SEQ ID NO: 2086957 - protein, 22 aa, Staphylococcus
TVKENLVFLNKLNNPTAQFIIE

SEQ ID NO: 2086958 - protein, 23 aa, Staphylococcus
TVKGAYKTYAYVVSYKPTNGNEK

SEQ ID NO: 2086959 - protein, 23 aa, Staphylococcus
TVKKFDQTLALEDCILYTAKTFA

SEQ ID NO: 2086960 - protein, 23 aa, Staphylococcus
TVKPESMILTPQNAPEWTKDRQR

SEQ ID NO: 2086961 - protein, 25 aa, Staphylococcus
TVKRGDYLAILSTGAYHYSMASNYN

SEQ ID NO: 2086962 - protein, 22 aa, Staphylococcus
TVKSFRKQLLYLNERYKAIENS

SEQ ID NO: 2086963 - protein, 18 aa, Staphylococcus
TVLIFVNATQRKKIDKLL

SEQ ID NO: 2086964 - protein, 19 aa, Staphylococcus
TVLNLIRKYKHMHPQDIVQ

SEQ ID NO: 2086965 - protein, 20 aa, Staphylococcus
TVLPKYEQFLKDFKKKSKKD

SEQ ID NO: 2086966 - protein, 29 aa, Staphylococcus
TVLSATAQIPFGYGRIVRDEQRRLQRIVE

SEQ ID NO: 2086967 - protein, 19 aa, Staphylococcus
TVLSELCLPLVKKGGQFIA

SEQ ID NO: 2086968 - protein, 17 aa, Staphylococcus
TVMPIERAIKRTIIDKL

SEQ ID NO: 2086969 - protein, 17 aa, Staphylococcus
TVMPIERAIQRTIIDKL

SEQ ID NO: 2086970 - protein, 26 aa, Staphylococcus
TVMSEELAHWFAKNDYFYIMHRFDEA

SEQ ID NO: 2086971 - protein, 20 aa, Staphylococcus
TVMTDYRLHKNWVTPHSSRY

SEQ ID NO: 2086972 - protein, 24 aa, Staphylococcus
TVNLIEYYMGIPIEKSFSLMSSVD

SEQ ID NO: 2086973 - protein, 23 aa, Staphylococcus
TVNQLMKHIKGPDFPTGGIIQGI

SEQ ID NO: 2086974 - protein, 18 aa, Staphylococcus
TVQLPDRSLPLLTPMSEV

SEQ ID NO: 2086975 - protein, 20 aa, Staphylococcus
TVQLPDRTLPLLTPMSEVAG

SEQ ID NO: 2086976 - protein, 24 aa, Staphylococcus
TVQSISALIKYYQAFNKVNQEYDC

SEQ ID NO: 2086977 - protein, 24 aa, Staphylococcus
TVRDYHIHMTLPSLKYYYEHKEDL

SEQ ID NO: 2086978 - protein, 23 aa, Staphylococcus
TVRYILFHLRIAPDEAHAVEMMN

SEQ ID NO: 2086979 - protein, 24 aa, Staphylococcus
TVSDIYASVRLLWSRIGEPFVGYS

SEQ ID NO: 2086980 - protein, 24 aa, Staphylococcus
TVSFSQLFAPLIEPELVFILTEDL

SEQ ID NO: 2086981 - protein, 29 aa, Staphylococcus
TVSHDRYFLNKLFNTTYLLKNKTLEKFEG

SEQ ID NO: 2086982 - protein, 27 aa, Staphylococcus
TVSITQLLERFLFPSSTHGKKIYKLSG

SEQ ID NO: 2086983 - protein, 24 aa, Staphylococcus
TVSLIERNDFMPSILTAVKIARIF

SEQ ID NO: 2086984 - protein, 19 aa, Staphylococcus
TVSLIERNEFMPSVLTAAK

SEQ ID NO: 2086985 - protein, 20 aa, Staphylococcus
TVSSQRLMIGQIVFDGVTDT

SEQ ID NO: 2086986 - protein, 25 aa, Staphylococcus
TVSSWINAVKYPRRDKIELLADYFG

SEQ ID NO: 2086987 - protein, 21 aa, Staphylococcus
TVSVDLPFAQKRWCASNGLDN

SEQ ID NO: 2086988 - protein, 27 aa, Staphylococcus
TVSVTQLLERFLFPSSTHGKKVYKLSG

SEQ ID NO: 2086989 - protein, 20 aa, Staphylococcus
TVSYDKLFLSPGGQPVTPPV

SEQ ID NO: 2086990 - protein, 17 aa, Staphylococcus
TVSYFEWVQNNQGYYWS

SEQ ID NO: 2086991 - protein, 29 aa, Staphylococcus
TVTHSKAGVKLLWASCRELYNVIQADEVG

SEQ ID NO: 2086992 - protein, 32 aa, Staphylococcus
TVTLKTLGLIIIMAQSGLLIPTLDGSQLSVFE

SEQ ID NO: 2086993 - protein, 27 aa, Staphylococcus
TVTLKTLGLIIVMAQSGILIPTLDGSQ

SEQ ID NO: 2086994 - protein, 33 aa, Staphylococcus
TVTLKTLGLIIVMAQSGLLIPALDGSKLSVFDN

SEQ ID NO: 2086995 - protein, 31 aa, Staphylococcus; identical to SEQ ID NO: 1821027

SEQ ID NO: 2086996 - protein, 33 aa, Staphylococcus
TVTLKTLGLIIVMAQSGLLIPTLDGSQLSVFEN

SEQ ID NO: 2086997 - protein, 17 aa, Staphylococcus
TVTNVFIVSRRGKILGS

SEQ ID NO: 2086998 - protein, 19 aa, Staphylococcus
TVTPGPWHIHRMLEAAEAL

SEQ ID NO: 2086999 - protein, 18 aa, Staphylococcus
TVTPVQMIQAQSAFFNNG

SEQ ID NO: 2087000 - protein, 18 aa, Staphylococcus
TVTPVQMLRAQSAFFNDG

SEQ ID NO: 2087001 - protein, 18 aa, Staphylococcus
TVTVKFSAGYIKQAILTE

SEQ ID NO: 2087002 - protein, 24 aa, Staphylococcus
TVVAAICMYALKTAGFQSALMVPT

SEQ ID NO: 2087003 - protein, 25 aa, Staphylococcus
TVVAALCMFALKTAGYQSALMVPTE

SEQ ID NO: 2087004 - protein, 25 aa, Staphylococcus
TVVMALYQMYYKLKAFKVEYGATVS

SEQ ID NO: 2087005 - protein, 26 aa, Staphylococcus
TVVNELAWHNLFAQNMFIRPSTNEEA

SEQ ID NO: 2087006 - protein, 27 aa, Staphylococcus
TVVNEMAWHNLFAHNMFIRPSSKDEAE

SEQ ID NO: 2087007 - protein, 26 aa, Staphylococcus
TVVNKLFNIVSPNKAYFGKKDAQQLA

SEQ ID NO: 2087008 - protein, 17 aa, Staphylococcus
TVVPRTILFDNEKNKFN

SEQ ID NO: 2087009 - protein, 25 aa, Staphylococcus
TVVTNFYDYLFRTKKFNVDIAKSVL

SEQ ID NO: 2087010 - protein, 19 aa, Staphylococcus
TVVTVLPSNGERYLSTPLF

SEQ ID NO: 2087011 - protein, 19 aa, Staphylococcus
TVVTVLPSNGERYLSTPLY

SEQ ID NO: 2087012 - protein, 26 aa, Staphylococcus
TVVVVPDYQLSLAIGKRGQNARLAAK

SEQ ID NO: 2087013 - protein, 26 aa, Staphylococcus
TVVYRVVQEAIFNALKYAGVYEVEVT

SEQ ID NO: 2087014 - protein, 22 aa, Staphylococcus
TVVYRVVQEALFNALKYAQVDI

SEQ ID NO: 2087015 - protein, 29 aa, Staphylococcus
TVVYRVVQEAVFNALKYAGVSSVDVFVQE

SEQ ID NO: 2087016 - protein, 19 aa, Staphylococcus
TVWGTRYLDLNVNNKFIIS

SEQ ID NO: 2087017 - protein, 20 aa, Staphylococcus
TVWSTRYLNLGVNNKFIISS

SEQ ID NO: 2087018 - protein, 20 aa, Staphylococcus
TVWSTRYLNLSVNNKFIISS

SEQ ID NO: 2087019 - protein, 19 aa, Staphylococcus
TVYGIDFKGPCLKCLLKHI

SEQ ID NO: 2087020 - protein, 17 aa, Staphylococcus
TVYHSMNIPHDLFTPIF

SEQ ID NO: 2087021 - protein, 19 aa, Staphylococcus
TVYRAVQIAGKLPVILDPK

SEQ ID NO: 2087022 - protein, 20 aa, Staphylococcus
TWAKHRGLVAAEQILEDITQ

SEQ ID NO: 2087023 - protein, 25 aa, Staphylococcus
TWIEDQSFMLRIPVETLNLKSKKIA

SEQ ID NO: 2087024 - protein, 34 aa, Staphylococcus
TWKDLFHDFEMHFYRYVFPYYDTLYTLEKLSSHD

SEQ ID NO: 2087025 - protein, 32 aa, Staphylococcus; identical to SEQ ID NO: 1720038

SEQ ID NO: 2087026 - protein, 17 aa, Staphylococcus
TWTDIFKALLHAVFKEH

SEQ ID NO: 2087027 - protein, 18 aa, Staphylococcus
TWVLGYHQSIEELCAHAD

SEQ ID NO: 2087028 - protein, 18 aa, Staphylococcus
TWVNLPSEEILTRYSFQL

SEQ ID NO: 2087029 - protein, 25 aa, Staphylococcus
TYAQNLMLLLYEAGIGTCWKSPEYI

SEQ ID NO: 2087030 - protein, 19 aa, Staphylococcus
TYCGIGTIGLYMAPKAKHV

SEQ ID NO: 2087031 - protein, 19 aa, Staphylococcus
TYCGIGTIGLYMAPQAKHV

SEQ ID NO: 2087032 - protein, 27 aa, Staphylococcus
TYDADGVFIYIGMKPLTAPFTDLGITN

SEQ ID NO: 2087033 - protein, 28 aa, Staphylococcus
TYDADGVFIYIGMKPLTTPFTNLGITNE

SEQ ID NO: 2087034 - protein, 18 aa, Staphylococcus
TYDFILKHHFSELHVFPY

SEQ ID NO: 2087035 - protein, 19 aa, Staphylococcus
TYDFLLLVSKILFNFIIKG

SEQ ID NO: 2087036 - protein, 19 aa, Staphylococcus
TYDFTRTHYPIFGKKVGEA

SEQ ID NO: 2087037 - protein, 22 aa, Staphylococcus
TYDGRYLLFQPNDGGLAQIGPT

SEQ ID NO: 2087038 - protein, 17 aa, Staphylococcus
TYDIPRFNKSPYDGFAI

SEQ ID NO: 2087039 - protein, 24 aa, Staphylococcus
TYDKAYFNRLYQKIVQQNIKFIVA

SEQ ID NO: 2087040 - protein, 19 aa, Staphylococcus
TYDLEYIKGYLPVHNHPQA

SEQ ID NO: 2087041 - protein, 26 aa, Staphylococcus
TYDLPIKDEWLIYWGGDNELFNYHYN

SEQ ID NO: 2087042 - protein, 25 aa, Staphylococcus
TYDSYFHYIYTQTYNYKKWIKIITK

SEQ ID NO: 2087043 - protein, 28 aa, Staphylococcus
TYDVNLISFNLLYNTIKPYLIKHAHIVG

SEQ ID NO: 2087044 - protein, 26 aa, Staphylococcus
TYDVNVLGFITLFKTVKPYLTMNASI

SEQ ID NO: 2087045 - protein, 41 aa, Staphylococcus
TYDVVKYIETILNLSHIQLIGLSFNFMCFKSGTPIEDDVFM

SEQ ID NO: 2087046 - protein, 25 aa, Staphylococcus
TYDWKILDTIHDVDYLIAGGINYEN

SEQ ID NO: 2087047 - protein, 30 aa, Staphylococcus
TYEACEILLERGYIVCPYIAEDVVLAKRLE

SEQ ID NO: 2087048 - protein, 19 aa, Staphylococcus
TYEFQYAFGLPDYQIIDDE

SEQ ID NO: 2087049 - protein, 23 aa, Staphylococcus
TYEGVYKDWQPGQKVHLVGHSMG

SEQ ID NO: 2087050 - protein, 30 aa, Staphylococcus
TYENNPDFLGDYYFFLIETGQIEQAKALLP

SEQ ID NO: 2087051 - protein, 20 aa, Staphylococcus
TYERDAWLENMYIAIQAAQF

SEQ ID NO: 2087052 - protein, 25 aa, Staphylococcus
TYERLEGFKSLQWPVAPDGTDEPIL

SEQ ID NO: 2087053 - protein, 18 aa, Staphylococcus
TYEYERGLFPGDYRGKEI

SEQ ID NO: 2087054 - protein, 19 aa, Staphylococcus
TYFLLVQRNRDQSFYAAEI

SEQ ID NO: 2087055 - protein, 21 aa, Staphylococcus
TYFNHVHVYNVTWGEAVNVNE

SEQ ID NO: 2087056 - protein, 25 aa, Staphylococcus
TYGDIEPMYMEHPQLFIYRRNYDNQ

SEQ ID NO: 2087057 - protein, 23 aa, Staphylococcus
TYGDWLVIGYTPVKLFNPELEDF

SEQ ID NO: 2087058 - protein, 18 aa, Staphylococcus
TYGHLDIIERSADRFDEI

SEQ ID NO: 2087059 - protein, 25 aa, Staphylococcus
TYGKLGVKVWIYRGEVLPTKNTSEG

SEQ ID NO: 2087060 - protein, 35 aa, Staphylococcus
TYGNSETFYPMPFLSPQTMWYYKSAFNTDQMRLID

SEQ ID NO: 2087061 - protein, 26 aa, Staphylococcus
TYGQLHRKVYFSSKTFFKILEEYYDT

SEQ ID NO: 2087062 - protein, 24 aa, Staphylococcus
TYGVPRIVFINKMDKLGANFEYSV

SEQ ID NO: 2087063 - protein, 23 aa, Staphylococcus
TYGYTEVPVFLKPSIAVIATGSE

SEQ ID NO: 2087064 - protein, 25 aa, Staphylococcus
TYHENLLEWIKIANEYKIPTFVLGV

SEQ ID NO: 2087065 - protein, 24 aa, Staphylococcus
TYHFPRVWLEKDSYDFSFSGLKSA

SEQ ID NO: 2087066 - protein, 20 aa, Staphylococcus
TYHVPFRVFGTRVELGQSLG

SEQ ID NO: 2087067 - protein, 20 aa, Staphylococcus
TYIDILKLLIEYAQFELLDI

SEQ ID NO: 2087068 - protein, 25 aa, Staphylococcus
TYISKSLIHSMYRQQPYYPNSMCVC

SEQ ID NO: 2087069 - protein, 24 aa, Staphylococcus
TYIYQGIGLTYKNNVWYFVTVNVK

SEQ ID NO: 2087070 - protein, 20 aa, Staphylococcus
TYKIMTMFEPYFREYKMIFV

SEQ ID NO: 2087071 - protein, 35 aa, Staphylococcus
TYKPIVEKELIARIGFVIEPQFLFSNLINKIEAQT

SEQ ID NO: 2087072 - protein, 17 aa, Staphylococcus
TYKYLKLNKTEDFEDLI

SEQ ID NO: 2087073 - protein, 21 aa, Staphylococcus
TYLDKDILLPAIGQGALGIEC

SEQ ID NO: 2087074 - protein, 25 aa, Staphylococcus
TYLDQIHQRLYLEQSLITERIKKYF

SEQ ID NO: 2087075 - protein, 24 aa, Staphylococcus
TYLEFINFFINKSDYKYFISSMDE

SEQ ID NO: 2087076 - protein, 19 aa, Staphylococcus
TYLKLFINNQFDNTIQDRV

SEQ ID NO: 2087077 - protein, 26 aa, Staphylococcus
TYLNEFYPDLIDYFKQYILIGRDKIS

SEQ ID NO: 2087078 - protein, 24 aa, Staphylococcus
TYLPFGHSMLYLSSIMDIYNGEIV

SEQ ID NO: 2087079 - protein, 19 aa, Staphylococcus
TYLQLSKAYISLISISGVI

SEQ ID NO: 2087080 - protein, 18 aa, Staphylococcus
TYLSKILTRLVKVGVISA

SEQ ID NO: 2087081 - protein, 19 aa, Staphylococcus
TYLTVNKIYELAPKAIIIS

SEQ ID NO: 2087082 - protein, 19 aa, Staphylococcus
TYLYIELMLEGGLKTNQYE

SEQ ID NO: 2087083 - protein, 20 aa, Staphylococcus
TYMDMMFMDDAIDAIIKLME

SEQ ID NO: 2087084 - protein, 18 aa, Staphylococcus
TYNDLVEKAWIIKERPQN

SEQ ID NO: 2087085 - protein, 24 aa, Staphylococcus
TYNDWLVIGYTPIKLFSPERDHFN

SEQ ID NO: 2087086 - protein, 19 aa, Staphylococcus
TYNHYQLKMLLAQKFEAIN

SEQ ID NO: 2087087 - protein, 49 aa, Staphylococcus
TYNPLTDMIKYKYPRLFDNVSKALRIVWPDLIFPESEVAFIVLHFGGSI

SEQ ID NO: 2087088 - protein, 23 aa, Staphylococcus
TYNPLTEMIKYKYPRLFDIVHKA

SEQ ID NO: 2087089 - protein, 18 aa, Staphylococcus
TYPVMKHIQPIRKMMDGP

SEQ ID NO: 2087090 - protein, 17 aa, Staphylococcus
TYQEWYLGKDLFNKVEE

SEQ ID NO: 2087091 - protein, 23 aa, Staphylococcus
TYQPHRLMYWPSTSNDAEFFFTY

SEQ ID NO: 2087092 - protein, 21 aa, Staphylococcus
TYQSYLYYLSLLIDQNIGDIV

SEQ ID NO: 2087093 - protein, 23 aa, Staphylococcus
TYQYKQQYYLRISTLPLSLGTES

SEQ ID NO: 2087094 - protein, 25 aa, Staphylococcus
TYSWDKLYFQHVSPNYLKHILSKEE

SEQ ID NO: 2087095 - protein, 26 aa, Staphylococcus
TYTHIQRLLMNILLNFKKHDEPASIN

SEQ ID NO: 2087096 - protein, 20 aa, Staphylococcus
TYTIVIPPPNVTGKLHLGHA

SEQ ID NO: 2087097 - protein, 34 aa, Staphylococcus
TYTLDIIKRHRLLELFLIKILQYNWEEVHQEAEV

SEQ ID NO: 2087098 - protein, 20 aa, Staphylococcus
TYVEAPFIPGKTPCFNCLIP

SEQ ID NO: 2087099 - protein, 21 aa, Staphylococcus
TYVGEFLTKLGFATALNDKVA

SEQ ID NO: 2087100 - protein, 18 aa, Staphylococcus
TYVIPQINELLTPLVSVV

SEQ ID NO: 2087101 - protein, 18 aa, Staphylococcus
TYYEWFHQIANDKAQFEI

SEQ ID NO: 2087102 - protein, 18 aa, Staphylococcus
TYYGIAMGLVHITKAILN

SEQ ID NO: 2087103 - protein, 17 aa, Staphylococcus
TYYLMMGGYHKKKGQAV

SEQ ID NO: 2087104 - protein, 19 aa, Staphylococcus
TYYPSYLKMYSKEKAKIDI

SEQ ID NO: 2087105 - protein, 24 aa, Staphylococcus
TYYSYRMDNLIVSYLIQAHLMKNS

SEQ ID NO: 2087106 - protein, 23 aa, Staphylococcus
VAAADIWLKDHPLSFEWGGASMI

SEQ ID NO: 2087107 - protein, 23 aa, Staphylococcus
VAAASSCYIISLAATLERAKFTN

SEQ ID NO: 2087108 - protein, 25 aa, Staphylococcus
VAADLKLVLMERYPDDFEVKIVTGA

SEQ ID NO: 2087109 - protein, 37 aa, Staphylococcus
VAAEQGIKLTFLPYVVKALVSALKKYPALNTSFNEEA

SEQ ID NO: 2087110 - protein, 18 aa, Staphylococcus
VAAGLHPNPVEHADFVTT

SEQ ID NO: 2087111 - protein, 18 aa, Staphylococcus
VAALEDLTPLIGTKVLVR

SEQ ID NO: 2087112 - protein, 21 aa, Staphylococcus
VAAPNLFKYDVEDIAYACLDN

SEQ ID NO: 2087113 - protein, 29 aa, Staphylococcus
VAATAPFTPFYRALDWIVTDPLEAIKDEI

SEQ ID NO: 2087114 - protein, 34 aa, Staphylococcus
VAAVRKHFDLRPAGIIKMLDLKHPIYKQTAAYGH

SEQ ID NO: 2087115 - protein, 21 aa, Staphylococcus
VAAVVNYARDNQLKIIASCPF

SEQ ID NO: 2087116 - protein, 17 aa, Staphylococcus
VACFEIPSYHKMLMISD

SEQ ID NO: 2087117 - protein, 24 aa, Staphylococcus
VADADIWLRENPLQFEWGGESMIE

SEQ ID NO: 2087118 - protein, 19 aa, Staphylococcus
VADCKLVLESLLNESNHYT

SEQ ID NO: 2087119 - protein, 26 aa, Staphylococcus
VADDNYRWLQILPEKKRYSITVMFDD

SEQ ID NO: 2087120 - protein, 23 aa, Staphylococcus
VADILGRQLVIDDVALNFIQDYF

SEQ ID NO: 2087121 - protein, 19 aa, Staphylococcus
VADKYANWEWNYGHSPRYE

SEQ ID NO: 2087122 - protein, 19 aa, Staphylococcus
VADLIIEWFEDGAADGFIF

SEQ ID NO: 2087123 - protein, 24 aa, Staphylococcus
VADNFRMDLLRPLFEDAGIEYEVI

SEQ ID NO: 2087124 - protein, 32 aa, Staphylococcus
VADQIHTGRYYIQRFLARKFGLEVDEIKEMSE

SEQ ID NO: 2087125 - protein, 33 aa, Staphylococcus
VADQIHTGRYYIQRFLARSFGLDVEDIKNMTEV

SEQ ID NO: 2087126 - protein, 26 aa, Staphylococcus
VADTDVIDVFPIRFIVDGDNEVSDPK

SEQ ID NO: 2087127 - protein, 25 aa, Staphylococcus
VAEADIWLRENPLKFEWGGESMIED

SEQ ID NO: 2087128 - protein, 24 aa, Staphylococcus
VAEASIDWYTYNIISLREQKVGNA

SEQ ID NO: 2087129 - protein, 26 aa, Staphylococcus
VAEGIAQIQIIYDPDLILIGGGISSQ

SEQ ID NO: 2087130 - protein, 26 aa, Staphylococcus
VAEGIAQIQIIYDPGLILIGGGISSQ

SEQ ID NO: 2087131 - protein, 28 aa, Staphylococcus
VAEHAVMDLLIILRNYMEGHRQAVEGEW

SEQ ID NO: 2087132 - protein, 28 aa, Staphylococcus
VAEHAVMDLLIVLRNFMEGHRQSVEGEW

SEQ ID NO: 2087133 - protein, 19 aa, Staphylococcus
VAEHIVMTTLILVRNYEEG

SEQ ID NO: 2087134 - protein, 27 aa, Staphylococcus
VAELNDILKYHHLSFDSLEALLKSDLN

SEQ ID NO: 2087135 - protein, 26 aa, Staphylococcus
VAEVIEKLRPFLLRDGGDCSLVDVED

SEQ ID NO: 2087136 - protein, 20 aa, Staphylococcus
VAFDLTFLKKAFKKSNITYQ

SEQ ID NO: 2087137 - protein, 17 aa, Staphylococcus
VAFDLYGGTFRLFDYYE

SEQ ID NO: 2087138 - protein, 18 aa, Staphylococcus
VAFLASEKAKYITGQTIH

SEQ ID NO: 2087139 - protein, 24 aa, Staphylococcus
VAFNDSGYRIGYGGGYFDKFISTY

SEQ ID NO: 2087140 - protein, 24 aa, Staphylococcus
VAFRDDGYRIGYGGGYYDRFLSDS

SEQ ID NO: 2087141 - protein, 19 aa, Staphylococcus
VAGAINIPTPKYGRPRLFQ

SEQ ID NO: 2087142 - protein, 25 aa, Staphylococcus
VAGAKYRGEFEERLKAVLKEIKDSD

SEQ ID NO: 2087143 - protein, 25 aa, Staphylococcus
VAGAKYRGEFEERLKAVLKEVKESE

SEQ ID NO: 2087144 - protein, 19 aa, Staphylococcus
VAGFDFTFGKFGKGNMAVL

SEQ ID NO: 2087145 - protein, 17 aa, Staphylococcus
VAGFLKKNIRRIDYNDD

SEQ ID NO: 2087146 - protein, 24 aa, Staphylococcus
VAGLVTPWNFPTNQTSLKLAAAFA

SEQ ID NO: 2087147 - protein, 19 aa, Staphylococcus
VAGNVLRFQPPLVITYEQL

SEQ ID NO: 2087148 - protein, 24 aa, Staphylococcus
VAGNVLRFQPPLVITYEQLDTALN

SEQ ID NO: 2087149 - protein, 28 aa, Staphylococcus
VAGPKGYGLMMMVDILSGSLLGLPFGGH

SEQ ID NO: 2087150 - protein, 27 aa, Staphylococcus
VAGPKGYGLMMMVDILSGSLLGLPFGQ

SEQ ID NO: 2087151 - protein, 33 aa, Staphylococcus
VAGSKQLIDWLKAQSRPFLFSTSLAPGDTKAIT

SEQ ID NO: 2087152 - protein, 33 aa, Staphylococcus
VAGTKALIDWLKAQSRPFLFSTSLAPGDTKAIT

SEQ ID NO: 2087153 - protein, 36 aa, Staphylococcus
VAGTQELIDWLKVQSRPFLFSTSLTPESSAAIIAAV

SEQ ID NO: 2087154 - protein, 33 aa, Staphylococcus
VAGTQSLIDWLKAQSRPFLFSTSLAPGDTKAIT

SEQ ID NO: 2087155 - protein, 21 aa, Staphylococcus
VAHNISFDLNFIKNAFNNCDI

SEQ ID NO: 2087156 - protein, 24 aa, Staphylococcus
VAHNVAFDLNFIKKAFKNCNIKYR

SEQ ID NO: 2087157 - protein, 24 aa, Staphylococcus
VAHNVAFDLNFIKKSFKQCHINYR

SEQ ID NO: 2087158 - protein, 26 aa, Staphylococcus
VAHSKNGVKLLWASCREVFNVIQANE

SEQ ID NO: 2087159 - protein, 29 aa, Staphylococcus
VAIDFSNPELLLPLLEEDFNLPVVIATTG

SEQ ID NO: 2087160 - protein, 34 aa, Staphylococcus
VAIDFSNPNLLLPLLDEGFELPLVIATTGEKEKL

SEQ ID NO: 2087161 - protein, 29 aa, Staphylococcus
VAIDFSNPNLLLPLLDESFELPLVVATTG

SEQ ID NO: 2087162 - protein, 27 aa, Staphylococcus
VAIQELIEFIVDFYKLKIDPKDIEITF

SEQ ID NO: 2087163 - protein, 17 aa, Staphylococcus
VAIRSMLIKQNQTTLFA

SEQ ID NO: 2087164 - protein, 19 aa, Staphylococcus
VAIVVSRFNDFITGRLLEG

SEQ ID NO: 2087165 - protein, 25 aa, Staphylococcus
VAKDFKNIIIIAPLADGYGNLSSVN

SEQ ID NO: 2087166 - protein, 26 aa, Staphylococcus
VAKGQLDAYLTPRLQPWDYAGGLMIL

SEQ ID NO: 2087167 - protein, 18 aa, Staphylococcus
VAKKIGYPVIIKATAGGG

SEQ ID NO: 2087168 - protein, 18 aa, Staphylococcus
VAKNVIYPHPPVNKIEPA

SEQ ID NO: 2087169 - protein, 28 aa, Staphylococcus
VAKRAQSFGMQILAFDPYLTEDKAKSLD

SEQ ID NO: 2087170 - protein, 26 aa, Staphylococcus
VAKRLDKTVALLLDTKGPEIRTHNMK

SEQ ID NO: 2087171 - protein, 21 aa, Staphylococcus
VAKTMPYVYQIFVDITNHQDI

SEQ ID NO: 2087172 - protein, 27 aa, Staphylococcus
VALDRKEPILFQWQDDFVVGVMLASKG

SEQ ID NO: 2087173 - protein, 27 aa, Staphylococcus
VALEPNMLPQLLRKLPPREYSIASSNK

SEQ ID NO: 2087174 - protein, 17 aa, Staphylococcus
VALFLNTKNIVIKEETI

SEQ ID NO: 2087175 - protein, 27 aa, Staphylococcus
VALGENQLAALYWSYGHFAKEIEMGQP

SEQ ID NO: 2087176 - protein, 24 aa, Staphylococcus
VALIEAVRITLHNALTLVGVSAPE

SEQ ID NO: 2087177 - protein, 18 aa, Staphylococcus
VALQKPNNKIDQRLKYIV

SEQ ID NO: 2087178 - protein, 32 aa, Staphylococcus
VALRQQLDLFTCLRPVRWFKGVPSPVKRPQDV

SEQ ID NO: 2087179 - protein, 21 aa, Staphylococcus
VALYYAVYGKCSLSKLIIESS

SEQ ID NO: 2087180 - protein, 18 aa, Staphylococcus
VANCAHMMIWEGIELLPV

SEQ ID NO: 2087181 - protein, 25 aa, Staphylococcus
VANDITYDFNYIKGYLPLHNHQQAY

SEQ ID NO: 2087182 - protein, 22 aa, Staphylococcus
VANFQVFQKLHPNKTVMPVVKA

SEQ ID NO: 2087183 - protein, 23 aa, Staphylococcus
VANIGMPGILKPVGASGSKGIFK

SEQ ID NO: 2087184 - protein, 24 aa, Staphylococcus
VANTDFILVRELTGGIYFGEPKQL

SEQ ID NO: 2087185 - protein, 17 aa, Staphylococcus
VANVIKKYKLDAQFIIV

SEQ ID NO: 2087186 - protein, 35 aa, Staphylococcus
VANWTVLYTKIHNFHWFVKGPHFFSLHVKFEELYN

SEQ ID NO: 2087187 - protein, 19 aa, Staphylococcus
VANYIGYLCSIISVTSNPK

SEQ ID NO: 2087188 - protein, 29 aa, Staphylococcus
VANYYDFIEVQPPALYQDLLDRELIRDTA

SEQ ID NO: 2087189 - protein, 25 aa, Staphylococcus
VAPAIRIGWIIAPEKIIERLADIRM

SEQ ID NO: 2087190 - protein, 27 aa, Staphylococcus
VAPEEVAYTCAYLYHPMAQSVTGTVQK

SEQ ID NO: 2087191 - protein, 18 aa, Staphylococcus
VAPGPIYTPLIPSTFDEE

SEQ ID NO: 2087192 - protein, 17 aa, Staphylococcus
VAPIISFDTIAEAIKIA

SEQ ID NO: 2087193 - protein, 18 aa, Staphylococcus
VAQALYLLQNGTGTALSA

SEQ ID NO: 2087194 - protein, 19 aa, Staphylococcus
VAQEFWYVHDGQIERIIGN

SEQ ID NO: 2087195 - protein, 27 aa, Staphylococcus
VAQFPARIKCATLAWKALEKGTVEKEG

SEQ ID NO: 2087196 - protein, 24 aa, Staphylococcus
VAQLLVRQYDYCVYFCNSGAEANE

SEQ ID NO: 2087197 - protein, 17 aa, Staphylococcus
VAQMLYKSKKPVVLAVN

SEQ ID NO: 2087198 - protein, 20 aa, Staphylococcus
VAQSLGALRLKLARELDLID

SEQ ID NO: 2087199 - protein, 21 aa, Staphylococcus
VARDFSYMPPNLLTPKVFADE

SEQ ID NO: 2087200 - protein, 25 aa, Staphylococcus
VARDYALTGLEFACGIPGSIGGAVF

SEQ ID NO: 2087201 - protein, 25 aa, Staphylococcus
VARMILHIVDQLKGIPFTEKMEKQL

SEQ ID NO: 2087202 - protein, 17 aa, Staphylococcus
VARVLYLGIVGDTGRFL

SEQ ID NO: 2087203 - protein, 18 aa, Staphylococcus
VARVLYLGIVGDTGRFLF

SEQ ID NO: 2087204 - protein, 30 aa, Staphylococcus
VASEFVYNTPLLSEKPLFIYISQSGETADS

SEQ ID NO: 2087205 - protein, 20 aa, Staphylococcus
VASEIMAILCLSRSIKDLRE

SEQ ID NO: 2087206 - protein, 29 aa, Staphylococcus
VASIKIWIDSFYVYLEKMLNLSFSPTENI

SEQ ID NO: 2087207 - protein, 18 aa, Staphylococcus
VASQLYDLFDDTKYELSE

SEQ ID NO: 2087208 - protein, 24 aa, Staphylococcus
VATEKKSFIVFKYKTKQDEIQHND

SEQ ID NO: 2087209 - protein, 18 aa, Staphylococcus
VATKAGVIGLTKSAAREL

SEQ ID NO: 2087210 - protein, 20 aa, Staphylococcus
VATKAGVIGLTKSAARELAS

SEQ ID NO: 2087211 - protein, 24 aa, Staphylococcus
VATKAGVIGLTKTAARELASRGIT

SEQ ID NO: 2087212 - protein, 26 aa, Staphylococcus
VATSGWTDIFIYPGFEYKAIDGLITN

SEQ ID NO: 2087213 - protein, 29 aa, Staphylococcus
VATVTEIYDYIRLLYARIGKPFCPNHGIE

SEQ ID NO: 2087214 - protein, 29 aa, Staphylococcus
VATVTEIYDYIRLLYARIGKPYCPNHNIE

SEQ ID NO: 2087215 - protein, 28 aa, Staphylococcus
VATVTEIYDYIRLLYARVGKAFCPYHGI

SEQ ID NO: 2087216 - protein, 27 aa, Staphylococcus
VATVTEIYDYIRLLYARVGKAYCPNHG

SEQ ID NO: 2087217 - protein, 28 aa, Staphylococcus
VATVTEIYDYIRLLYARVGKPYCPHHGI

SEQ ID NO: 2087218 - protein, 28 aa, Staphylococcus
VATVTEIYDYIRLLYARVGKPYCPNHHI

SEQ ID NO: 2087219 - protein, 19 aa, Staphylococcus
VAVIWLIEQLQYRKGYLYL

SEQ ID NO: 2087220 - protein, 19 aa, Staphylococcus
VAVLLPGTTFYLDKEGYAD

SEQ ID NO: 2087221 - protein, 29 aa, Staphylococcus
VAVSGWTDIFIYPGFTYKAIDGLITNFHL

SEQ ID NO: 2087222 - protein, 17 aa, Staphylococcus
VAVWFKRERRDGSYQQV

SEQ ID NO: 2087223 - protein, 17 aa, Staphylococcus
VAYGHYIEDFPRQCIFI

SEQ ID NO: 2087224 - protein, 17 aa, Staphylococcus
VAYKLAQALLENVPNYF

SEQ ID NO: 2087225 - protein, 33 aa, Staphylococcus
VAYTADVYDFWRPTGYKYPLVAGALSKDAYIES

SEQ ID NO: 2087226 - protein, 17 aa, Staphylococcus
VCDILGREPNFTEIGIF

SEQ ID NO: 2087227 - protein, 19 aa, Staphylococcus
VCEILGREPNFTETGIFSV

SEQ ID NO: 2087228 - protein, 20 aa, Staphylococcus
VCEYIFQNYQLTWSSFKVKY

SEQ ID NO: 2087229 - protein, 21 aa, Staphylococcus
VCFNCDHHIALPAYKRIEAIT

SEQ ID NO: 2087230 - protein, 17 aa, Staphylococcus
VCGPTVYNYIHIGNARP

SEQ ID NO: 2087231 - protein, 24 aa, Staphylococcus
VCHLYQLMRHGGGVCYKLIETDPM

SEQ ID NO: 2087232 - protein, 25 aa, Staphylococcus
VCHQHQYQLLLNYTGLDIRAEIEAL

SEQ ID NO: 2087233 - protein, 17 aa, Staphylococcus
VCILEAMKLFNEIQAEV

SEQ ID NO: 2087234 - protein, 22 aa, Staphylococcus
VCKREILNGNIIILAGKHPHSR

SEQ ID NO: 2087235 - protein, 17 aa, Staphylococcus
VCLGFQFLIEHYGGNIV

SEQ ID NO: 2087236 - protein, 35 aa, Staphylococcus
VCLYSKKNYELWKHDLPALPPYAMFGENLTATDLD

SEQ ID NO: 2087237 - protein, 39 aa, Staphylococcus
VCNHVLYQLGYLADKFYPNLLFGFIHVPFIPEQVIDKPN

SEQ ID NO: 2087238 - protein, 24 aa, Staphylococcus
VCSFNILIRCGKGTYIRTLATDIG

SEQ ID NO: 2087239 - protein, 23 aa, Staphylococcus
VCSRVLKFGLRFLKKTKRFSPNS

SEQ ID NO: 2087240 - protein, 19 aa, Staphylococcus
VCYMIGRLILQYCKTVDDA

SEQ ID NO: 2087241 - protein, 22 aa, Staphylococcus
VDACLTPILAPFTSIKHMLGIV

SEQ ID NO: 2087242 - protein, 25 aa, Staphylococcus
VDAFPLSMDPLLQHTLECASSITSS

SEQ ID NO: 2087243 - protein, 17 aa, Staphylococcus
VDAGTIAITAFISPYRE

SEQ ID NO: 2087244 - protein, 23 aa, Staphylococcus
VDAIYKYPTHQTFFSSSDKLSIG

SEQ ID NO: 2087245 - protein, 32 aa, Staphylococcus
VDAVVEHARQNNLKIIASCPFAKDVLEKNDSY

SEQ ID NO: 2087246 - protein, 26 aa, Staphylococcus
VDCGFIKFVLNINVNIAFQIQTDEEV

SEQ ID NO: 2087247 - protein, 26 aa, Staphylococcus
VDDDQYWQYPPFKLTEVDGWLYGRGV

SEQ ID NO: 2087248 - protein, 22 aa, Staphylococcus
VDDEIGNFVYPTIFADLKYDDR

SEQ ID NO: 2087249 - protein, 19 aa, Staphylococcus
VDDIFIPPTKINRALDGDT

SEQ ID NO: 2087250 - protein, 17 aa, Staphylococcus
VDDLEREARRYENQLKQ

SEQ ID NO: 2087251 - protein, 24 aa, Staphylococcus
VDDNQFDFVLTNPPIRAGKAVVHR

SEQ ID NO: 2087252 - protein, 27 aa, Staphylococcus
VDEAVEKGLTIPKLLIQCGTEDFLYED

SEQ ID NO: 2087253 - protein, 25 aa, Staphylococcus
VDEDGYFWFEGRADDIIISSGYTIG

SEQ ID NO: 2087254 - protein, 26 aa, Staphylococcus
VDEGLRTLLDFRYQTHFKAKKGENGQ

SEQ ID NO: 2087255 - protein, 25 aa, Staphylococcus
VDEGLRTLLDFRYQTHFKAKRGDGG

SEQ ID NO: 2087256 - protein, 26 aa, Staphylococcus
VDENREEFFYYFNPGDFKPPLNVYFS

SEQ ID NO: 2087257 - protein, 23 aa, Staphylococcus
VDENRIYFGITEYGRILLGADNF

SEQ ID NO: 2087258 - protein, 18 aa, Staphylococcus
VDEQLRLLGRKSAGLDTT

SEQ ID NO: 2087259 - protein, 20 aa, Staphylococcus
VDEWIGLLDQLEEKVKTVQH

SEQ ID NO: 2087260 - protein, 21 aa, Staphylococcus
VDFCREHNFLILTYQDGHIIH

SEQ ID NO: 2087261 - protein, 24 aa, Staphylococcus
VDFCRENNLFVLTYQDGHIIYEGT

SEQ ID NO: 2087262 - protein, 26 aa, Staphylococcus
VDFGSDLLIQSFLKANPPGPSKTIAD

SEQ ID NO: 2087263 - protein, 18 aa, Staphylococcus
VDFGWIYSTTPATATGVY

SEQ ID NO: 2087264 - protein, 22 aa, Staphylococcus
VDFIVIAGDLFDKENRSLRAEV

SEQ ID NO: 2087265 - protein, 18 aa, Staphylococcus
VDFKPAEYQLIINHTDRP

SEQ ID NO: 2087266 - protein, 17 aa, Staphylococcus
VDFLVVQDAFLTQTARF

SEQ ID NO: 2087267 - protein, 24 aa, Staphylococcus
VDFTSCTVVFLDENFKPLHMNEDL

SEQ ID NO: 2087268 - protein, 51 aa, Staphylococcus
VDGAHIRTLLLTFFYRFMRPLIEAGYVYIAQPPLFKLTQGKQKYYVFNDKE

SEQ ID NO: 2087269 - protein, 51 aa, Staphylococcus
VDGAHIRTLLLTFFYRFMRPLIEAGYVYIAQPPLFKLTQGKQKYYVFNERE

SEQ ID NO: 2087270 - protein, 35 aa, Staphylococcus
VDGAHIRTLLLTFFYRFMRPLIEAGYVYIAQPPLY

SEQ ID NO: 2087271 - protein, 49 aa, Staphylococcus
VDGAHIRTLLLTFFYRFMRPLIEAGYVYIAQPPLYKLAQGKQKYYVFND

SEQ ID NO: 2087272 - protein, 51 aa, Staphylococcus
VDGAHIRTLLLTFFYRFMRPLLEAGYVYIAQPPLFKLTQGKQKYYVFNERE

SEQ ID NO: 2087273 - protein, 18 aa, Staphylococcus
VDGEFIMILIRGHHELND

SEQ ID NO: 2087274 - protein, 22 aa, Staphylococcus
VDGGFTIGGINFDVGGSVGAQA

SEQ ID NO: 2087275 - protein, 27 aa, Staphylococcus
VDGVKSIFYVMDFLAVDKKPKYDWEVL

SEQ ID NO: 2087276 - protein, 22 aa, Staphylococcus
VDGVRILNYGSGHAWGIIGLEI

SEQ ID NO: 2087277 - protein, 17 aa, Staphylococcus
VDHPQTHFPLNEQGKLD

SEQ ID NO: 2087278 - protein, 32 aa, Staphylococcus
VDHSRSHHLITTDLFLNVFGIESLESLPTTEE

SEQ ID NO: 2087279 - protein, 33 aa, Staphylococcus
VDIAGPGFINFYLDNHYLTAIIPEAISKGAHYG

SEQ ID NO: 2087280 - protein, 29 aa, Staphylococcus
VDIAGPGFINFYLDNQYLTAVIPEAINKG

SEQ ID NO: 2087281 - protein, 28 aa, Staphylococcus
VDIAGPGFINFYLDNQYLTAVISEAIQK

SEQ ID NO: 2087282 - protein, 22 aa, Staphylococcus
VDIASILRYIEAYNVDIVILKP

SEQ ID NO: 2087283 - protein, 23 aa, Staphylococcus
VDIKEVFLKLPIIGTEVYDESNE

SEQ ID NO: 2087284 - protein, 22 aa, Staphylococcus
VDIKEVFLKLPIVATEVYDETN

SEQ ID NO: 2087285 - protein, 24 aa, Staphylococcus
VDIKTLVYPGFATDLQQPITPLLF

SEQ ID NO: 2087286 - protein, 21 aa, Staphylococcus
VDIMLDLLKRCYKDEFEGWEE

SEQ ID NO: 2087287 - protein, 21 aa, Staphylococcus
VDIVEIGTPIVINEGLPAVQH

SEQ ID NO: 2087288 - protein, 18 aa, Staphylococcus
VDIYPLIGKPVRIEFFDT

SEQ ID NO: 2087289 - protein, 34 aa, Staphylococcus
VDKDLKYKLLREAPAILNWMAEGAYMWMQEGLAM

SEQ ID NO: 2087290 - protein, 25 aa, Staphylococcus
VDKGEDFPFIMFGPGETSQAHVIDE

SEQ ID NO: 2087291 - protein, 27 aa, Staphylococcus
VDKGWHDLKIIPYAPFEVSPAAQGLHY

SEQ ID NO: 2087292 - protein, 25 aa, Staphylococcus
VDKHNTLFHLFRKYERRIANKQYDN

SEQ ID NO: 2087293 - protein, 23 aa, Staphylococcus
VDKILGQLNMRLVDQRISIEVTD

SEQ ID NO: 2087294 - protein, 22 aa, Staphylococcus
VDKILNKLINLGFLDIKSNFDV

SEQ ID NO: 2087295 - protein, 17 aa, Staphylococcus
VDKILTQLNIRLMDQRI

SEQ ID NO: 2087296 - protein, 23 aa, Staphylococcus
VDKIMIPINLLEDLDIHQSKIII

SEQ ID NO: 2087297 - protein, 25 aa, Staphylococcus
VDKIYGTHLWSGYPSGTIYSRPGAI

SEQ ID NO: 2087298 - protein, 26 aa, Staphylococcus
VDKIYGTHLWSGYRTGTIYSRPGAIM

SEQ ID NO: 2087299 - protein, 26 aa, Staphylococcus
VDKKPNRLVIDLPIDYYGQAETIGIT

SEQ ID NO: 2087300 - protein, 22 aa, Staphylococcus
VDKLPFIEFQADPIYINQIKEW

SEQ ID NO: 2087301 - protein, 23 aa, Staphylococcus
VDKSDLIYISQKGKFDAVVEDVV

SEQ ID NO: 2087302 - protein, 27 aa, Staphylococcus
VDKTKALIDILNPYLCIIFCNSRESAD

SEQ ID NO: 2087303 - protein, 23 aa, Staphylococcus
VDKTLAYLFYNLLNSPNQYQDVI

SEQ ID NO: 2087304 - protein, 32 aa, Staphylococcus
VDKTLQLIDILNPYLCIIFCNSRENANELAQS

SEQ ID NO: 2087305 - protein, 31 aa, Staphylococcus
VDKTLQLIDILNPYLCIVFCNSRDNADELAN

SEQ ID NO: 2087306 - protein, 20 aa, Staphylococcus
VDLALKKEVDFIIIAGDLFD

SEQ ID NO: 2087307 - protein, 27 aa, Staphylococcus
VDLGQLRKIAHKIAWLKGKASKGSLVY

SEQ ID NO: 2087308 - protein, 24 aa, Staphylococcus
VDNAYHEPLLILSDLFRNEEDYEA

SEQ ID NO: 2087309 - protein, 20 aa, Staphylococcus
VDNIVQFQAPFKGITAMQTA

SEQ ID NO: 2087310 - protein, 32 aa, Staphylococcus
VDNKSQFAFLNLMKHMFKNEAYRFLATGQLEQ

SEQ ID NO: 2087311 - protein, 24 aa, Staphylococcus
VDNNYKWLQILPEKKRYSITAMFD

SEQ ID NO: 2087312 - protein, 27 aa, Staphylococcus
VDNYDGHLLIQWYSKGIYAFRDTILNA

SEQ ID NO: 2087313 - protein, 28 aa, Staphylococcus
VDPDVLRFFMISVHYRSPINYNMELVES

SEQ ID NO: 2087314 - protein, 26 aa, Staphylococcus
VDPEQLRLHLINNYSIGIIALNDTDI

SEQ ID NO: 2087315 - protein, 19 aa, Staphylococcus
VDPEQLYYLMSRGISQHEA

SEQ ID NO: 2087316 - protein, 17 aa, Staphylococcus
VDPEQLYYLMSRGISQK

SEQ ID NO: 2087317 - protein, 24 aa, Staphylococcus
VDPEQLYYLMSRGISRQEAERLVI

SEQ ID NO: 2087318 - protein, 25 aa, Staphylococcus
VDPEQLYYLMSRGISRREAERLVIH

SEQ ID NO: 2087319 - protein, 21 aa, Staphylococcus
VDPESFPFNLYRKLVNEIFQS

SEQ ID NO: 2087320 - protein, 21 aa, Staphylococcus
VDPPCVYYWKCGGCQLQHMSY

SEQ ID NO: 2087321 - protein, 22 aa, Staphylococcus
VDPQLMYILDYEDTNHIFIQTS

SEQ ID NO: 2087322 - protein, 27 aa, Staphylococcus
VDQLEQPIRLEPMSTFPIIRDLQVDRS

SEQ ID NO: 2087323 - protein, 19 aa, Staphylococcus
VDQLKGFKYPGELLKIHSG

SEQ ID NO: 2087324 - protein, 26 aa, Staphylococcus
VDQLMKIGLELPFSMKMNQLLFESSS

SEQ ID NO: 2087325 - protein, 24 aa, Staphylococcus
VDQQMIWNHMFDWIQKQVLKNNQS

SEQ ID NO: 2087326 - protein, 19 aa, Staphylococcus
VDRELPYHLAVKQLAQLDE

SEQ ID NO: 2087327 - protein, 24 aa, Staphylococcus
VDRLDKRIYDLQLSRQIAIQTAPQ

SEQ ID NO: 2087328 - protein, 22 aa, Staphylococcus
VDRYINEFLKKGSSNYPIEILK

SEQ ID NO: 2087329 - protein, 24 aa, Staphylococcus
VDSAFYIWINEQFVGYSQIAHSIS

SEQ ID NO: 2087330 - protein, 26 aa, Staphylococcus
VDTAYKAIMKPVEGTILTVARDAADA

SEQ ID NO: 2087331 - protein, 26 aa, Staphylococcus
VDTAYKAVMKPVEGTILTVAKDAAKA

SEQ ID NO: 2087332 - protein, 26 aa, Staphylococcus
VDTAYKAVMKPVEGTILTVAKDAASA

SEQ ID NO: 2087333 - protein, 24 aa, Staphylococcus
VDTDADLRILRRLTRDTQERGRSM

SEQ ID NO: 2087334 - protein, 23 aa, Staphylococcus
VDTGDYVIIINASKIQFTGNKEQ

SEQ ID NO: 2087335 - protein, 17 aa, Staphylococcus
VDTLLYTQAQSFSYTPQ

SEQ ID NO: 2087336 - protein, 20 aa, Staphylococcus
VDTLQLQFVSNGLQSAVVVI

SEQ ID NO: 2087337 - protein, 24 aa, Staphylococcus
VDTLSPTYKLLMGVPGRSNAFDIS

SEQ ID NO: 2087338 - protein, 33 aa, Staphylococcus
VDTTGHIINLYFPFIDVETMLTLLDLSQIYVSS

SEQ ID NO: 2087339 - protein, 29 aa, Staphylococcus
VDTVHKYLPLLHRYTKLRQELLGLDDLKM

SEQ ID NO: 2087340 - protein, 17 aa, Staphylococcus
VDVDELFDMFIFKNDRL

SEQ ID NO: 2087341 - protein, 26 aa, Staphylococcus
VDVDPLNDVLLLIESLTLVDVDPLND

SEQ ID NO: 2087342 - protein, 18 aa, Staphylococcus
VDVESIYPPGADLHSYEP

SEQ ID NO: 2087343 - protein, 21 aa, Staphylococcus
VDVFRIFDSLNWVDQMKVANE

SEQ ID NO: 2087344 - protein, 24 aa, Staphylococcus
VDVIIAEKDLWYFDGEDLTIDVDN

SEQ ID NO: 2087345 - protein, 17 aa, Staphylococcus
VDVLAEFTTLSDALALV

SEQ ID NO: 2087346 - protein, 25 aa, Staphylococcus
VDVPVIIKEVGFGMSKELYKDLIDV

SEQ ID NO: 2087347 - protein, 19 aa, Staphylococcus
VDVYIRYLRNKLKPFGKDK

SEQ ID NO: 2087348 - protein, 22 aa, Staphylococcus
VDVYIRYLRNKLKPFNKEKVIE

SEQ ID NO: 2087349 - protein, 23 aa, Staphylococcus
VDVYIRYLRNKLKPFNKERTIET

SEQ ID NO: 2087350 - protein, 20 aa, Staphylococcus
VDVYIRYLRNKLKPYGKDKT

SEQ ID NO: 2087351 - protein, 32 aa, Staphylococcus
VDWETSIPEKSFSKIYLFSPDIEKITNFRNNL

SEQ ID NO: 2087352 - protein, 25 aa, Staphylococcus
VDWSKYKEILISGLRHYLVRSTRQG

SEQ ID NO: 2087353 - protein, 27 aa, Staphylococcus
VDYCREKGFLVLTYDEGYIIYDGDHEY

SEQ ID NO: 2087354 - protein, 25 aa, Staphylococcus
VDYIKKPFDPMELYYRVSLHLNDKG

SEQ ID NO: 2087355 - protein, 19 aa, Staphylococcus
VDYIPYANRFVRILGFPFY

SEQ ID NO: 2087356 - protein, 18 aa, Staphylococcus
VDYLDKGFTGHIIRRGTA

SEQ ID NO: 2087357 - protein, 23 aa, Staphylococcus
VDYLDKGFTGHIIRRGTTAADAS

SEQ ID NO: 2087358 - protein, 17 aa, Staphylococcus
VDYLTTLDFVDNDRIGA

SEQ ID NO: 2087359 - protein, 18 aa, Staphylococcus
VDYVFGIPGAKIDYLFNA

SEQ ID NO: 2087360 - protein, 24 aa, Staphylococcus
VEAAPKMLPMFSDDLVNHAVNYLE

SEQ ID NO: 2087361 - protein, 25 aa, Staphylococcus
VEAEEIYIPRIKQMLTRFYAENIEH

SEQ ID NO: 2087362 - protein, 25 aa, Staphylococcus
VEAGETVYFTLKATPFYAVSGGQVA

SEQ ID NO: 2087363 - protein, 20 aa, Staphylococcus
VEAGYPQDLLEKWIKDGVIQ

SEQ ID NO: 2087364 - protein, 25 aa, Staphylococcus
VEAHISFLKELLLDESFYIKVHIYD

SEQ ID NO: 2087365 - protein, 25 aa, Staphylococcus
VEAKLKVRVKYPVWINNRITTEEER

SEQ ID NO: 2087366 - protein, 18 aa, Staphylococcus
VEALQFLVSGRIHKVNQP

SEQ ID NO: 2087367 - protein, 18 aa, Staphylococcus
VEALYRKGYAITVIGNEA

SEQ ID NO: 2087368 - protein, 25 aa, Staphylococcus
VEAYKQNMFALLGKPGFEDKKKELE

SEQ ID NO: 2087369 - protein, 29 aa, Staphylococcus
VEDAPSFEYVYPYMLKFINELPVVAHNAA

SEQ ID NO: 2087370 - protein, 30 aa, Staphylococcus
VEDAPTFQTVYPYMLQFIGDLPVVAHNAAF

SEQ ID NO: 2087371 - protein, 25 aa, Staphylococcus
VEDDIAYELWFINRQVKNTEGKYKA

SEQ ID NO: 2087372 - protein, 24 aa, Staphylococcus
VEDLIRLIAADLVELDWAEGFDIE

SEQ ID NO: 2087373 - protein, 18 aa, Staphylococcus
VEDLRSEIQKMRDERHML

SEQ ID NO: 2087374 - protein, 23 aa, Staphylococcus
VEDMDVVISSPFLPAYITKERIE

SEQ ID NO: 2087375 - protein, 24 aa, Staphylococcus
VEEELTYLATLKGLSSRDIQQRID

SEQ ID NO: 2087376 - protein, 25 aa, Staphylococcus
VEEHDLIEILKEKLIRHAYLDVFEN

SEQ ID NO: 2087377 - protein, 31 aa, Staphylococcus
VEELLSALQLWLLRINYLDQPQFYPSIETAK

SEQ ID NO: 2087378 - protein, 30 aa, Staphylococcus
VEELYFPDYDNYILLWKLEVLPEYQHHGYG

SEQ ID NO: 2087379 - protein, 30 aa, Staphylococcus
VEETLIQPTFIYGHPIDISPLAKKNPEDPR

SEQ ID NO: 2087380 - protein, 26 aa, Staphylococcus
VEEYVDIVEIGTPIVINEGLPAVEHL

SEQ ID NO: 2087381 - protein, 28 aa, Staphylococcus
VEEYVDIVEIGTPIVINEGLPAVQHLDE

SEQ ID NO: 2087382 - protein, 24 aa, Staphylococcus
VEFDATVLPFILRGNNLLGVDSVE

SEQ ID NO: 2087383 - protein, 29 aa, Staphylococcus
VEFDVNILSPTYKLLMGVPGRSNAFEISS

SEQ ID NO: 2087384 - protein, 18 aa, Staphylococcus
VEFELVSVLKRFKAMLLQ

SEQ ID NO: 2087385 - protein, 20 aa, Staphylococcus
VEFHPYLIQQSLRDYLASES

SEQ ID NO: 2087386 - protein, 20 aa, Staphylococcus
VEGEKLLDRYKQFKKIVPGK

SEQ ID NO: 2087387 - protein, 30 aa, Staphylococcus
VEGFRPVMEIQFLGFVFEVFDSVAGQIART

SEQ ID NO: 2087388 - protein, 17 aa, Staphylococcus
VEGGFYYDFDMDEKVSS

SEQ ID NO: 2087389 - protein, 23 aa, Staphylococcus
VEGKFYHFKYPYADGEGYIEIAT

SEQ ID NO: 2087390 - protein, 18 aa, Staphylococcus
VEGLIHFVSRQAMNIDGL

SEQ ID NO: 2087391 - protein, 27 aa, Staphylococcus
VEGYHTLLTIGRYPICYINIEMDPILV

SEQ ID NO: 2087392 - protein, 27 aa, Staphylococcus
VEGYHTLLTIGRYPICYINIQMDPILV

SEQ ID NO: 2087393 - protein, 27 aa, Staphylococcus
VEGYHTLMMIGRYPICYINIKMDPILV

SEQ ID NO: 2087394 - protein, 20 aa, Staphylococcus
VEHAIIPDRIEAGTLLIAGA

SEQ ID NO: 2087395 - protein, 23 aa, Staphylococcus
VEHFNFIPDMITFGKSLAGGLPM

SEQ ID NO: 2087396 - protein, 33 aa, Staphylococcus
VEHKRYLHELDLKELVLPLIVLDYSKEVAENPD

SEQ ID NO: 2087397 - protein, 25 aa, Staphylococcus
VEHMFNDHPLPVNYHLMPKCVYTYP

SEQ ID NO: 2087398 - protein, 33 aa, Staphylococcus
VEHMKSCFLQKGLVFLLIRFKVLDEVYLLPFSK

SEQ ID NO: 2087399 - protein, 25 aa, Staphylococcus
VEHPNDILEWVLIEAPELDNEASDQ

SEQ ID NO: 2087400 - protein, 29 aa, Staphylococcus
VEHSRSHHLYTTELFLNVFGLETIEDLPT

SEQ ID NO: 2087401 - protein, 35 aa, Staphylococcus
VEHTRYLHELNLKELALPLVVLDFSQSVKANSDFI

SEQ ID NO: 2087402 - protein, 21 aa, Staphylococcus
VEHVFATQSLWQTKPKNLLID

SEQ ID NO: 2087403 - protein, 24 aa, Staphylococcus
VEHYYQQPKFLQYWTEKINETLAN

SEQ ID NO: 2087404 - protein, 26 aa, Staphylococcus
VEIAEQIITFIPHSLLTMKNDKYNEQ

SEQ ID NO: 2087405 - protein, 26 aa, Staphylococcus
VEIHGANHYLIHQFFSPYYNRREDEW

SEQ ID NO: 2087406 - protein, 18 aa, Staphylococcus
VEILAKEAGVPVWNGLTD

SEQ ID NO: 2087407 - protein, 18 aa, Staphylococcus
VEILVRKKMKLKKNNIYI

SEQ ID NO: 2087408 - protein, 24 aa, Staphylococcus
VEIPDHLLHYINLNTPRPIVYTED

SEQ ID NO: 2087409 - protein, 24 aa, Staphylococcus
VEKAVITVPAYFNDAERQATKDAG

SEQ ID NO: 2087410 - protein, 23 aa, Staphylococcus
VEKEGLYMIPTAEVPLTNYYREE

SEQ ID NO: 2087411 - protein, 29 aa, Staphylococcus
VEKHQMTDFMFFASAIMVLLHKYTRQDDI

SEQ ID NO: 2087412 - protein, 25 aa, Staphylococcus
VEKMDLEIPRLVLDGIEVVGSLVGT

SEQ ID NO: 2087413 - protein, 25 aa, Staphylococcus
VEKMVEGRLRKYLQEICAVDQNFVK

SEQ ID NO: 2087414 - protein, 30 aa, Staphylococcus
VEKPTLKFELFYFDIFRYATSFITLQVERD

SEQ ID NO: 2087415 - protein, 30 aa, Staphylococcus
VEKPTLKFELFYFDIFRYATSFVTLQVNRE

SEQ ID NO: 2087416 - protein, 27 aa, Staphylococcus
VEKTLKLIDILNPYLCIIFCNSRDSAD

SEQ ID NO: 2087417 - protein, 17 aa, Staphylococcus
VEKWFHETAPQRVKRRK

SEQ ID NO: 2087418 - protein, 20 aa, Staphylococcus
VEKYSRLRSVYRYEIFNEQG

SEQ ID NO: 2087419 - protein, 26 aa, Staphylococcus
VELAKNYEIPLYLGRTLSNVKGTWIM

SEQ ID NO: 2087420 - protein, 26 aa, Staphylococcus
VELANNYNIPLYLGRTLSNVKGTWIM

SEQ ID NO: 2087421 - protein, 24 aa, Staphylococcus
VELECPSIISQVKFYHVPEGISIE

SEQ ID NO: 2087422 - protein, 24 aa, Staphylococcus
VELGGYIYPFTRRNQFTPHILTMT

SEQ ID NO: 2087423 - protein, 19 aa, Staphylococcus
VELKNKFVLAPLTHISSND

SEQ ID NO: 2087424 - protein, 17 aa, Staphylococcus
VELSDRIKLNIPVVSAG

SEQ ID NO: 2087425 - protein, 20 aa, Staphylococcus
VELSLPLQLFFEKDTCLSTS

SEQ ID NO: 2087426 - protein, 18 aa, Staphylococcus
VELVPYTEKLISDVKHIA

SEQ ID NO: 2087427 - protein, 29 aa, Staphylococcus
VENIKEFHGIFNEPIACSKINSGLFSQML

SEQ ID NO: 2087428 - protein, 25 aa, Staphylococcus
VENNCIIYPYITKNGFLHLSMSDYV

SEQ ID NO: 2087429 - protein, 30 aa, Staphylococcus
VENRYLTEDIAYGLVLWSSIGRVIDVPTPN

SEQ ID NO: 2087430 - protein, 27 aa, Staphylococcus
VENSESQLPIYFLKQALRSLGYMGILK

SEQ ID NO: 2087431 - protein, 28 aa, Staphylococcus
VENTPDSWYYSKRLLYSKLEALRAQLNF

SEQ ID NO: 2087432 - protein, 27 aa, Staphylococcus
VEPDHAQVLIYKKLFNAYKELHDLLGY

SEQ ID NO: 2087433 - protein, 28 aa, Staphylococcus
VEPMYGEKYLPRKFKIGIAVPPSNDIDV

SEQ ID NO: 2087434 - protein, 21 aa, Staphylococcus
VEPPCIYYYKCGGCQLQHMSY

SEQ ID NO: 2087435 - protein, 29 aa, Staphylococcus
VEPTEAQWDAMLLGWKVVASVKSNAVILS

SEQ ID NO: 2087436 - protein, 18 aa, Staphylococcus
VEPYLSTQWFVKMKPLAQ

SEQ ID NO: 2087437 - protein, 28 aa, Staphylococcus
VEQEIYSHMLWEGFQPFKIVKIEELSSD

SEQ ID NO: 2087438 - protein, 17 aa, Staphylococcus
VEQGFHHDALYSDYLIA

SEQ ID NO: 2087439 - protein, 29 aa, Staphylococcus
VEQHQITDFMFFASAIMVLLHKYTRQDDL

SEQ ID NO: 2087440 - protein, 18 aa, Staphylococcus
VEQLMAKSVKRKYVALVH

SEQ ID NO: 2087441 - protein, 24 aa, Staphylococcus
VEQNLFKIYTDYKPKQLILTGTPN

SEQ ID NO: 2087442 - protein, 19 aa, Staphylococcus
VEQQFEIAKKIIAKGLVPI

SEQ ID NO: 2087443 - protein, 39 aa, Staphylococcus
VEQWDTMIDVNLKGTLYVLQAALPHLLNQSSGHIINIAS

SEQ ID NO: 2087444 - protein, 25 aa, Staphylococcus
VERARRIQFFLSQNFHVAEQFTGQK

SEQ ID NO: 2087445 - protein, 26 aa, Staphylococcus
VERFSFRNYLYVFVSNYFVASELSNH

SEQ ID NO: 2087446 - protein, 17 aa, Staphylococcus
VERNILRLLDMVETPYF

SEQ ID NO: 2087447 - protein, 30 aa, Staphylococcus
VERPTLKFELFYFDIFRYGTSFITLQVSRE

SEQ ID NO: 2087448 - protein, 24 aa, Staphylococcus
VERPVRHVLIKNIYRTSNLTFQNN

SEQ ID NO: 2087449 - protein, 31 aa, Staphylococcus
VERVREILELPKHTFPLFGMALGIPEDDENG

SEQ ID NO: 2087450 - protein, 18 aa, Staphylococcus
VERYINEFLKKGSSNYPI

SEQ ID NO: 2087451 - protein, 22 aa, Staphylococcus
VERYINEFLKKGSSNYPIEILK

SEQ ID NO: 2087452 - protein, 22 aa, Staphylococcus
VERYYQQPKFIKYWTNKVNETL

SEQ ID NO: 2087453 - protein, 19 aa, Staphylococcus
VESECDFGLAFDGDGDRLI

SEQ ID NO: 2087454 - protein, 26 aa, Staphylococcus
VESKSLKLYLFSFRNHGDFHEDCMNI

SEQ ID NO: 2087455 - protein, 21 aa, Staphylococcus
VESLPLGGIIYTDISKDGKLE

SEQ ID NO: 2087456 - protein, 18 aa, Staphylococcus
VESLQFLVDGRIHKINQP

SEQ ID NO: 2087457 - protein, 19 aa, Staphylococcus
VESPYFIFIDSDDYLASYA

SEQ ID NO: 2087458 - protein, 24 aa, Staphylococcus
VESVWNFINKIWNAARFSLMNIGE

SEQ ID NO: 2087459 - protein, 26 aa, Staphylococcus
VETAYKAVMKPVEGTILTVAKDAAQA

SEQ ID NO: 2087460 - protein, 25 aa, Staphylococcus
VETAYRAVMKPVEGTILTVAKDAAA

SEQ ID NO: 2087461 - protein, 18 aa, Staphylococcus
VETFSLPTLILNIDHEQN

SEQ ID NO: 2087462 - protein, 25 aa, Staphylococcus
VETIAFPCLALIASTFDKDLLRKYG

SEQ ID NO: 2087463 - protein, 22 aa, Staphylococcus
VETIGFMEYLPSSTLKAIAKAK

SEQ ID NO: 2087464 - protein, 21 aa, Staphylococcus
VETLQLQFVSNGLQSAVVVIK

SEQ ID NO: 2087465 - protein, 20 aa, Staphylococcus
VETLRNGWITTGPKAKQFEE

SEQ ID NO: 2087466 - protein, 25 aa, Staphylococcus
VETLSPTYKLLMGVPGRSNAFDISK

SEQ ID NO: 2087467 - protein, 19 aa, Staphylococcus
VETPIEWLKKYESHFVIIF

SEQ ID NO: 2087468 - protein, 31 aa, Staphylococcus
VETVHLKLPIDWLKNKIIVDSLGLYSNNQRH

SEQ ID NO: 2087469 - protein, 25 aa, Staphylococcus
VEVDYMQRFLVTKTFLKSDNKEFFF

SEQ ID NO: 2087470 - protein, 19 aa, Staphylococcus
VEVEYLLVDACSMHLITRP

SEQ ID NO: 2087471 - protein, 18 aa, Staphylococcus
VEVHLLTRVLSYINQENI

SEQ ID NO: 2087472 - protein, 24 aa, Staphylococcus
VEVRGEAYMPRRSFMRLNDEREKN

SEQ ID NO: 2087473 - protein, 19 aa, Staphylococcus
VEWQLNYLLLRRKYDRHQS

SEQ ID NO: 2087474 - protein, 24 aa, Staphylococcus
VEYALELLHLTEIRGRYLKTLSGG

SEQ ID NO: 2087475 - protein, 26 aa, Staphylococcus
VEYDVALFSYNKLLEIFFSVIDPLDD

SEQ ID NO: 2087476 - protein, 26 aa, Staphylococcus
VEYKQYIRIRHILNPSLRILTKCQAQ

SEQ ID NO: 2087477 - protein, 31 aa, Staphylococcus
VEYLDDRYPFYLDPMPNLYFTRDPQASIGRG

SEQ ID NO: 2087478 - protein, 19 aa, Staphylococcus
VEYVTMTQSKCLVLFTSYK

SEQ ID NO: 2087479 - protein, 19 aa, Staphylococcus
VFAMIGYHPDYKFLQSIGI

SEQ ID NO: 2087480 - protein, 17 aa, Staphylococcus
VFCHNYYPRPDTGLSAT

SEQ ID NO: 2087481 - protein, 18 aa, Staphylococcus
VFDAVNTLSFYYPGNIPN

SEQ ID NO: 2087482 - protein, 18 aa, Staphylococcus
VFDEHQWGFNGIFDKTNG

SEQ ID NO: 2087483 - protein, 23 aa, Staphylococcus
VFDIRDYYAARELLKQAVSHLTN

SEQ ID NO: 2087484 - protein, 19 aa, Staphylococcus
VFDIRDYYSARHLLKECIT

SEQ ID NO: 2087485 - protein, 26 aa, Staphylococcus
VFDLHETTFDIHLIPETRKSTILSDK

SEQ ID NO: 2087486 - protein, 18 aa, Staphylococcus
VFDLYFRSMPFESGYAVF

SEQ ID NO: 2087487 - protein, 18 aa, Staphylococcus
VFDNESIIHFFESRGVLL

SEQ ID NO: 2087488 - protein, 18 aa, Staphylococcus
VFDQLLQHPTIASKHYLY

SEQ ID NO: 2087489 - protein, 17 aa, Staphylococcus
VFEDFYQYMKEAGFVLY

SEQ ID NO: 2087490 - protein, 22 aa, Staphylococcus
VFEGIEIYNYLKSLSNHITIEV

SEQ ID NO: 2087491 - protein, 26 aa, Staphylococcus
VFEMGIDIDTLVRFNLKKGQILEPSD

SEQ ID NO: 2087492 - protein, 31 aa, Staphylococcus
VFEMIEAILKDQHRLLPSIALLEGEYGFSDI

SEQ ID NO: 2087493 - protein, 19 aa, Staphylococcus
VFGEWKAVLAGDALLTKAF

SEQ ID NO: 2087494 - protein, 19 aa, Staphylococcus
VFGIPGAKIDYLFNALEDD

SEQ ID NO: 2087495 - protein, 27 aa, Staphylococcus
VFGIVRTIHMFVPLLEQSEQPVIVNVS

SEQ ID NO: 2087496 - protein, 18 aa, Staphylococcus
VFGKIQPPYTATVRSVVY

SEQ ID NO: 2087497 - protein, 18 aa, Staphylococcus
VFGTKKRRPIENGVIPPL

SEQ ID NO: 2087498 - protein, 17 aa, Staphylococcus
VFHIPVISESLQSYINT

SEQ ID NO: 2087499 - protein, 28 aa, Staphylococcus
VFHKIKPDVFYFLPSYMAPLKEHNDYLD

SEQ ID NO: 2087500 - protein, 24 aa, Staphylococcus
VFHVIHRPFYLRKLNKIKPSKKYV

SEQ ID NO: 2087501 - protein, 21 aa, Staphylococcus
VFIFDVHTIYKMSTLFHNQCY

SEQ ID NO: 2087502 - protein, 33 aa, Staphylococcus
VFINSRTTIFPILGGGERLGTLILGRVKDDFNE

SEQ ID NO: 2087503 - protein, 23 aa, Staphylococcus
VFKINMDKPFKKLTDRQKDIILY

SEQ ID NO: 2087504 - protein, 18 aa, Staphylococcus
VFLDTDLHFQETYDLIED

SEQ ID NO: 2087505 - protein, 17 aa, Staphylococcus
VFLGFDYHYRGNSKYLF

SEQ ID NO: 2087506 - protein, 18 aa, Staphylococcus
VFMNAHEIDFFITATDIQ

SEQ ID NO: 2087507 - protein, 25 aa, Staphylococcus
VFMTNGCYIVPKYPNRFLIGATSEF

SEQ ID NO: 2087508 - protein, 26 aa, Staphylococcus
VFNDYFDIDLSYLPRPAILINDVSDM

SEQ ID NO: 2087509 - protein, 18 aa, Staphylococcus
VFNHFKPSSLFMLHQIIK

SEQ ID NO: 2087510 - protein, 17 aa, Staphylococcus
VFNHLSHLGMFIFDIHT

SEQ ID NO: 2087511 - protein, 18 aa, Staphylococcus
VFNKGNMIKPWYVNSIDN

SEQ ID NO: 2087512 - protein, 17 aa, Staphylococcus
VFNKWLTSDLAKSLNCH

SEQ ID NO: 2087513 - protein, 24 aa, Staphylococcus
VFNLNGFFEPLQALIDHMIKEGFI

SEQ ID NO: 2087514 - protein, 18 aa, Staphylococcus
VFNNERHLAALSFLTFVA

SEQ ID NO: 2087515 - protein, 21 aa, Staphylococcus
VFPNFIGHTFAVYDGRKHVPV

SEQ ID NO: 2087516 - protein, 29 aa, Staphylococcus
VFPNTLHWQFGHILTIFDSALSIGSQNTV

SEQ ID NO: 2087517 - protein, 25 aa, Staphylococcus
VFPNTLHWQFGHVLTIFDSALSMGG

SEQ ID NO: 2087518 - protein, 20 aa, Staphylococcus
VFPNTLHWQYGHVLTVFEEA

SEQ ID NO: 2087519 - protein, 28 aa, Staphylococcus
VFQDFALWPHMTVFQNVAYPLKVNKDTK

SEQ ID NO: 2087520 - protein, 18 aa, Staphylococcus
VFQEINQIIVKPLDEIYA

SEQ ID NO: 2087521 - protein, 25 aa, Staphylococcus
VFQHKGLKVFGLTASPNYIANIRKN

SEQ ID NO: 2087522 - protein, 36 aa, Staphylococcus
VFQSFNLFPHKTVLENIYMAPKLLKKGDLDTLKKEA

SEQ ID NO: 2087523 - protein, 22 aa, Staphylococcus
VFQSYNLFPHKTALENVMEGLI

SEQ ID NO: 2087524 - protein, 18 aa, Staphylococcus
VFRILRPYYTSEIIQNIN

SEQ ID NO: 2087525 - protein, 23 aa, Staphylococcus
VFRRNRPFAFTNLKTDEGLDEVV

SEQ ID NO: 2087526 - protein, 19 aa, Staphylococcus
VFSNVAMPLILEGKDKKYI

SEQ ID NO: 2087527 - protein, 27 aa, Staphylococcus
VFSSFPFKSFYRIYEYYKKFGLFSETI

SEQ ID NO: 2087528 - protein, 36 aa, Staphylococcus; identical to SEQ ID NO: 1689499

SEQ ID NO: 2087529 - protein, 27 aa, Staphylococcus
VFTEVEPIRKIILFAKETGCRVHIVHV

SEQ ID NO: 2087530 - protein, 19 aa, Staphylococcus
VFTPLIHWKTILTANKNKA

SEQ ID NO: 2087531 - protein, 17 aa, Staphylococcus
VFVKIPIVTTSGESTIP

SEQ ID NO: 2087532 - protein, 33 aa, Staphylococcus
VFVNSRTTIFPILGGGERLGTLVLGRVQDDFNE

SEQ ID NO: 2087533 - protein, 19 aa, Staphylococcus
VFVYVPKNVVVEHPVQYVV

SEQ ID NO: 2087534 - protein, 17 aa, Staphylococcus
VFYFFNASQQKVLDKMK

SEQ ID NO: 2087535 - protein, 20 aa, Staphylococcus
VFYINRDSEQRILISHLGMA

SEQ ID NO: 2087536 - protein, 20 aa, Staphylococcus
VGAPTQMKIYTTIKGKTAHA

SEQ ID NO: 2087537 - protein, 24 aa, Staphylococcus
VGARSSIFAPFKNLGLIIIDEEHE

SEQ ID NO: 2087538 - protein, 30 aa, Staphylococcus
VGAVVAWNFPMLLATWKVAPALAAGDTVVL

SEQ ID NO: 2087539 - protein, 29 aa, Staphylococcus
VGCDPEIMGIAPFYAVSKLLEKTGKTMND

SEQ ID NO: 2087540 - protein, 28 aa, Staphylococcus
VGCDPQYMGYAPFYAVEKLLDKTDSKID

SEQ ID NO: 2087541 - protein, 27 aa, Staphylococcus
VGCDPQYMGYAPFYAVEKLLEKTHQNI

SEQ ID NO: 2087542 - protein, 28 aa, Staphylococcus
VGCDPQYMGYAPFYAVEKLLEKTQRHID

SEQ ID NO: 2087543 - protein, 29 aa, Staphylococcus
VGDFDYLPEIYRALDANVLFNKVAMRPGS

SEQ ID NO: 2087544 - protein, 20 aa, Staphylococcus
VGDHIVCTFIPSCGHCIPCR

SEQ ID NO: 2087545 - protein, 23 aa, Staphylococcus
VGDLNEVLAIKNTFGDAANNLKV

SEQ ID NO: 2087546 - protein, 24 aa, Staphylococcus
VGDPAIFIKFKYTDFTTFLEYTNS

SEQ ID NO: 2087547 - protein, 24 aa, Staphylococcus
VGDQVIFYQVQMDTGLLGFGEITS

SEQ ID NO: 2087548 - protein, 24 aa, Staphylococcus
VGDRVSIAWMYAACGRCEYCTSGR

SEQ ID NO: 2087549 - protein, 17 aa, Staphylococcus
VGDSIVVGNTYGRIRAM

SEQ ID NO: 2087550 - protein, 20 aa, Staphylococcus
VGEALIQRTGLSKLIITNVI

SEQ ID NO: 2087551 - protein, 25 aa, Staphylococcus
VGEEQFAIWKMADLGDIVGIEGVMF

SEQ ID NO: 2087552 - protein, 25 aa, Staphylococcus
VGEEQFDIWKIADLGDIVGIDGVMF

SEQ ID NO: 2087553 - protein, 25 aa, Staphylococcus
VGEEQFDIWKIADLGDIVGIEGVMF

SEQ ID NO: 2087554 - protein, 17 aa, Staphylococcus
VGEFSEEKLALAKKIII

SEQ ID NO: 2087555 - protein, 25 aa, Staphylococcus
VGENRPVFYPNYWGGDKFHIKEQFE

SEQ ID NO: 2087556 - protein, 19 aa, Staphylococcus
VGERRFRAATIAGLTEIPA

SEQ ID NO: 2087557 - protein, 25 aa, Staphylococcus
VGFDDSYWNEIYTPKLTVISQPVKE

SEQ ID NO: 2087558 - protein, 30 aa, Staphylococcus
VGFDITYDLDYQFGYPVLYNHPTQTNHVVD

SEQ ID NO: 2087559 - protein, 23 aa, Staphylococcus
VGFGDLPLQALPITNIDPTHPVT

SEQ ID NO: 2087560 - protein, 17 aa, Staphylococcus
VGFIDVYDDCEFIVAIR

SEQ ID NO: 2087561 - protein, 18 aa, Staphylococcus
VGFIDVYNDCEFIVAIRS

SEQ ID NO: 2087562 - protein, 17 aa, Staphylococcus
VGFRYYTEKIAQKHNIV

SEQ ID NO: 2087563 - protein, 19 aa, Staphylococcus
VGFRYYTQRLANKYNILGT

SEQ ID NO: 2087564 - protein, 23 aa, Staphylococcus
VGFTMAPMDYGSGVKFAIFDDTC

SEQ ID NO: 2087565 - protein, 18 aa, Staphylococcus
VGGKFIIPTKDTVNIHYA

SEQ ID NO: 2087566 - protein, 18 aa, Staphylococcus
VGGMYEFGLSRYFTAMLA

SEQ ID NO: 2087567 - protein, 24 aa, Staphylococcus
VGGRLPGGIKIKRAKLRGERSEGM

SEQ ID NO: 2087568 - protein, 25 aa, Staphylococcus
VGGRLPGGIKIKRAKLRGERSEGMI

SEQ ID NO: 2087569 - protein, 25 aa, Staphylococcus
VGGRLPGGIRIKRAKLRGERSEGMI

SEQ ID NO: 2087570 - protein, 21 aa, Staphylococcus
VGKALHVAGFLKKNIRRIDYN

SEQ ID NO: 2087571 - protein, 22 aa, Staphylococcus
VGKIIFNEIIPDSFAYINEPTQ

SEQ ID NO: 2087572 - protein, 26 aa, Staphylococcus
VGKRLAQHLVPYPPGIPSFFKGEQVT

SEQ ID NO: 2087573 - protein, 23 aa, Staphylococcus
VGKTEIARRMAKIVGAPFIKVEA

SEQ ID NO: 2087574 - protein, 24 aa, Staphylococcus
VGKTYVTLLIYQALSEAGYNVGIY

SEQ ID NO: 2087575 - protein, 21 aa, Staphylococcus
VGLAKLFYKELPNVNLHSLGG

SEQ ID NO: 2087576 - protein, 17 aa, Staphylococcus
VGLFFSNEKIQGTKHET

SEQ ID NO: 2087577 - protein, 18 aa, Staphylococcus
VGLGNIKELTYADYLIIW

SEQ ID NO: 2087578 - protein, 17 aa, Staphylococcus
VGMFVTTLPFRIDFRDC

SEQ ID NO: 2087579 - protein, 20 aa, Staphylococcus
VGMILSLAMCLRESLNQATA

SEQ ID NO: 2087580 - protein, 24 aa, Staphylococcus
VGMINLCFEIFDDKIKIIISDQGD

SEQ ID NO: 2087581 - protein, 24 aa, Staphylococcus
VGNDIPVFFVQDAIKFPDVIHAVK

SEQ ID NO: 2087582 - protein, 26 aa, Staphylococcus
VGNKKPIKRLWISSVTKKAIKDGFNH

SEQ ID NO: 2087583 - protein, 28 aa, Staphylococcus
VGNKKPIQRLWISSVTKKAIQNGFKHLK

SEQ ID NO: 2087584 - protein, 28 aa, Staphylococcus
VGNKKPIQRLWISSVTKKAIQQGFKNLQ

SEQ ID NO: 2087585 - protein, 19 aa, Staphylococcus
VGPIKLHIVPFTDLQKQVN

SEQ ID NO: 2087586 - protein, 19 aa, Staphylococcus
VGPIKLHIVPFTELQKQIN

SEQ ID NO: 2087587 - protein, 18 aa, Staphylococcus
VGPKGIIRRMVETKRLSS

SEQ ID NO: 2087588 - protein, 17 aa, Staphylococcus
VGPLFEAFMEKAVTDRL

SEQ ID NO: 2087589 - protein, 23 aa, Staphylococcus
VGPLYASGYLKGALVTKGLTELS

SEQ ID NO: 2087590 - protein, 17 aa, Staphylococcus
VGPVIDGGFYYDFDMDE

SEQ ID NO: 2087591 - protein, 28 aa, Staphylococcus
VGQHQMWAAQFYPFKDHGQWVTSGGLGT

SEQ ID NO: 2087592 - protein, 26 aa, Staphylococcus
VGQHQMWAAQFYPFKDHNQFVTSGGL

SEQ ID NO: 2087593 - protein, 28 aa, Staphylococcus
VGQIMDSGFDGIFLIAANPVDVLTYVTK

SEQ ID NO: 2087594 - protein, 19 aa, Staphylococcus
VGQLLEDVGFKAGISKENE

SEQ ID NO: 2087595 - protein, 24 aa, Staphylococcus
VGQNPARQIAIKAGLPNTTPAMTI

SEQ ID NO: 2087596 - protein, 20 aa, Staphylococcus
VGQRGFVPASLISTDFIEDF

SEQ ID NO: 2087597 - protein, 22 aa, Staphylococcus
VGQRGFVPASLISTDFIEDFSS

SEQ ID NO: 2087598 - protein, 18 aa, Staphylococcus
VGQTFYKQFKGKGITKIL

SEQ ID NO: 2087599 - protein, 26 aa, Staphylococcus
VGRAILKAVRLPIAAPSANLSGRPSP

SEQ ID NO: 2087600 - protein, 17 aa, Staphylococcus
VGRCYLVKASKLRWEFE

SEQ ID NO: 2087601 - protein, 18 aa, Staphylococcus
VGRELRKMMPFIKAKSIQ

SEQ ID NO: 2087602 - protein, 23 aa, Staphylococcus
VGRHLLNVFSYTGAFSVVSATKA

SEQ ID NO: 2087603 - protein, 17 aa, Staphylococcus
VGRIPFIKKMQNKGLFA

SEQ ID NO: 2087604 - protein, 18 aa, Staphylococcus
VGRNPISIIIPCHRVVGK

SEQ ID NO: 2087605 - protein, 22 aa, Staphylococcus
VGRTILPTYGLFRSIAIKNLEA

SEQ ID NO: 2087606 - protein, 19 aa, Staphylococcus
VGRVFRGTMRVGDNVSLIK

SEQ ID NO: 2087607 - protein, 24 aa, Staphylococcus
VGSQFLQKFNGGMGILLGGVPGVP

SEQ ID NO: 2087608 - protein, 26 aa, Staphylococcus
VGSTSMLYMTMPAVAGMGIAIKSSVD

SEQ ID NO: 2087609 - protein, 26 aa, Staphylococcus
VGTDKEYFVFYLLCQGKSLNEVGKVF

SEQ ID NO: 2087610 - protein, 20 aa, Staphylococcus
VGTKALLSRALAGTVMSKLI

SEQ ID NO: 2087611 - protein, 25 aa, Staphylococcus
VGTSEYIMNLIYKETPYVCGTSKSF

SEQ ID NO: 2087612 - protein, 27 aa, Staphylococcus
VGTSPEILIMYLLDHTKQMRIGSGGVM

SEQ ID NO: 2087613 - protein, 22 aa, Staphylococcus
VGTYDFTRTHYPIFGKKVGEEV

SEQ ID NO: 2087614 - protein, 22 aa, Staphylococcus
VGTYDFTRTHYPIFGKKVGEKV

SEQ ID NO: 2087615 - protein, 25 aa, Staphylococcus
VGTYDYVRTHYPIYGTRIGELVANG

SEQ ID NO: 2087616 - protein, 30 aa, Staphylococcus
VGVHGLPVQFDIDKLWIKNINVSTGLVSGN

SEQ ID NO: 2087617 - protein, 32 aa, Staphylococcus
VGVHGLPVQFDIEKLWIKNINITTGLVSANTT

SEQ ID NO: 2087618 - protein, 34 aa, Staphylococcus; identical to SEQ ID NO: 1680063

SEQ ID NO: 2087619 - protein, 30 aa, Staphylococcus
VGVKYTAPNFFLLERIRKAFPNKLILSGFD

SEQ ID NO: 2087620 - protein, 24 aa, Staphylococcus
VGVMADLHFAPTFNAAKNLLDEGK

SEQ ID NO: 2087621 - protein, 32 aa, Staphylococcus
VGVQIELTSSLRKSLFKNNKFNRKSRMDESNW

SEQ ID NO: 2087622 - protein, 23 aa, Staphylococcus
VGYDTMSQIRWLSVLDLKDKTED

SEQ ID NO: 2087623 - protein, 17 aa, Staphylococcus
VGYNIFNASNHLSLDGN

SEQ ID NO: 2087624 - protein, 23 aa, Staphylococcus
VGYSTMSQIRWLSVLDLKNKTED

SEQ ID NO: 2087625 - protein, 19 aa, Staphylococcus
VGYVETKEKHPNADKLSIL

SEQ ID NO: 2087626 - protein, 20 aa, Staphylococcus
VHALCHYTLLLYNTNEMEKY

SEQ ID NO: 2087627 - protein, 26 aa, Staphylococcus
VHALTKILEAAIPLLQDYDIELTEAH

SEQ ID NO: 2087628 - protein, 22 aa, Staphylococcus
VHAPYIINIANTTKPEVFQLGV

SEQ ID NO: 2087629 - protein, 24 aa, Staphylococcus
VHAVWSHLIAHELYKKKKYVLARL

SEQ ID NO: 2087630 - protein, 24 aa, Staphylococcus
VHDTIPWPNYVNYAASKGGLKLMM

SEQ ID NO: 2087631 - protein, 21 aa, Staphylococcus
VHDYIFIFDEPTTGLHEDDLP

SEQ ID NO: 2087632 - protein, 22 aa, Staphylococcus
VHDYPELIAWLENDKTEKIVYD

SEQ ID NO: 2087633 - protein, 28 aa, Staphylococcus
VHERKAVFDLYFRKMPFDSGYAVFNGLR

SEQ ID NO: 2087634 - protein, 29 aa, Staphylococcus
VHEVFKVYGVLFIDAQYEPLRKLERPILK

SEQ ID NO: 2087635 - protein, 20 aa, Staphylococcus
VHFADVLYKNGYDIDYISPE

SEQ ID NO: 2087636 - protein, 29 aa, Staphylococcus
VHFDRSFVDMPVGALWRRGHKPMKAQGLE

SEQ ID NO: 2087637 - protein, 19 aa, Staphylococcus
VHFECEYVQTIRIPTGDPV

SEQ ID NO: 2087638 - protein, 29 aa, Staphylococcus
VHFGSSEWYLIMIIKYDQPTFAELTHKIN

SEQ ID NO: 2087639 - protein, 17 aa, Staphylococcus
VHFNLKKGDVLTAANME

SEQ ID NO: 2087640 - protein, 18 aa, Staphylococcus
VHGLHTPKLNFDESQLIH

SEQ ID NO: 2087641 - protein, 18 aa, Staphylococcus
VHHSLGEGTFDDYRKMFE

SEQ ID NO: 2087642 - protein, 19 aa, Staphylococcus
VHHSLGEGTFDNYRKMFKE

SEQ ID NO: 2087643 - protein, 20 aa, Staphylococcus
VHIDLFNTYIPLIDKDVLTG

SEQ ID NO: 2087644 - protein, 28 aa, Staphylococcus
VHIINQVIKKVYLNQFTLTFVGHFSAGK

SEQ ID NO: 2087645 - protein, 21 aa, Staphylococcus
VHIKNIILQWLKLDVEVERIS

SEQ ID NO: 2087646 - protein, 21 aa, Staphylococcus
VHIRARYGVILATGGFGANTK

SEQ ID NO: 2087647 - protein, 26 aa, Staphylococcus
VHKDGRLFICYLGDFKTTGGIFSTTE

SEQ ID NO: 2087648 - protein, 26 aa, Staphylococcus
VHKKITLLIGDLAFYHDMNGLLMSKL

SEQ ID NO: 2087649 - protein, 18 aa, Staphylococcus
VHLFLHQDNMRQLLTEEN

SEQ ID NO: 2087650 - protein, 19 aa, Staphylococcus
VHLLARVFSLINHKNIPIT

SEQ ID NO: 2087651 - protein, 25 aa, Staphylococcus
VHLMNLKELFLVQLQERSIPFEVNG

SEQ ID NO: 2087652 - protein, 23 aa, Staphylococcus
VHNILRDLYNKGIGSLYVEAGPN

SEQ ID NO: 2087653 - protein, 19 aa, Staphylococcus
VHPDPFHLKKFAKTNQYTG

SEQ ID NO: 2087654 - protein, 19 aa, Staphylococcus
VHQGLGHNSFWFGGSKEQQ

SEQ ID NO: 2087655 - protein, 18 aa, Staphylococcus
VHQILLQHLSERALVLGP

SEQ ID NO: 2087656 - protein, 24 aa, Staphylococcus
VHQILLQHLTDKALVLGPSPAALA

SEQ ID NO: 2087657 - protein, 17 aa, Staphylococcus
VHQVGRLAWAKSRGLIA

SEQ ID NO: 2087658 - protein, 22 aa, Staphylococcus
VHRGLGYAVIPRVYYQSFNAKD

SEQ ID NO: 2087659 - protein, 18 aa, Staphylococcus
VHRLDDAYFKKIDAIEFA

SEQ ID NO: 2087660 - protein, 17 aa, Staphylococcus
VHSGIDGLLIGETLMKC

SEQ ID NO: 2087661 - protein, 26 aa, Staphylococcus
VHSHYKHLFALLELAKQKGLDKVYVH

SEQ ID NO: 2087662 - protein, 26 aa, Staphylococcus
VHSHYKHLFALLELAKQRGIDKVYVH

SEQ ID NO: 2087663 - protein, 26 aa, Staphylococcus
VHSHYQHLFALLELAKQKGLDKVYVH

SEQ ID NO: 2087664 - protein, 26 aa, Staphylococcus
VHSKGGIYCWLKTPPGYESESFEQFL

SEQ ID NO: 2087665 - protein, 21 aa, Staphylococcus
VHSKGGIYSWLQTPPGYDSES

SEQ ID NO: 2087666 - protein, 22 aa, Staphylococcus
VHSKGGIYSWLRTPPDYDSETF

SEQ ID NO: 2087667 - protein, 25 aa, Staphylococcus
VHYFIEHLNLTPFLNRKLKDCSKGT

SEQ ID NO: 2087668 - protein, 17 aa, Staphylococcus
VHYHRPKMPDTDPLFIG

SEQ ID NO: 2087669 - protein, 24 aa, Staphylococcus
VIAAILTCTWSYNYIGLKLAEKEG

SEQ ID NO: 2087670 - protein, 26 aa, Staphylococcus
VIADKGNFNYFSFKGLRSKGNNELHV

SEQ ID NO: 2087671 - protein, 20 aa, Staphylococcus
VIAGFDFTFGKFGKGNMMIL

SEQ ID NO: 2087672 - protein, 30 aa, Staphylococcus
VIAIIDDAYFGLFYEDVYTQSIFSALTQIE

SEQ ID NO: 2087673 - protein, 18 aa, Staphylococcus
VIAVQFMAENVILNNITV

SEQ ID NO: 2087674 - protein, 32 aa, Staphylococcus
VIAVSHGGILFMFALKWLPIEEVKKINFGNCC

SEQ ID NO: 2087675 - protein, 17 aa, Staphylococcus
VIAWLNANTFESISLTG

SEQ ID NO: 2087676 - protein, 30 aa, Staphylococcus
VIDAPSFEYVFPYMMQFIDKLPVVAHNAAF

SEQ ID NO: 2087677 - protein, 24 aa, Staphylococcus
VIDFQAWLNGTPLSFNQFDGRLDT

SEQ ID NO: 2087678 - protein, 24 aa, Staphylococcus
VIDIDMYIIVSYGVKISEVANNVQ

SEQ ID NO: 2087679 - protein, 39 aa, Staphylococcus
VIDKFPVGVVGAITPWNFPAAMITRKMAPALAAGCTIIC

SEQ ID NO: 2087680 - protein, 23 aa, Staphylococcus
VIDKIIEISLTYKLSDYLTHVVN

SEQ ID NO: 2087681 - protein, 25 aa, Staphylococcus
VIDQPQEFKFLYDLDQSLEEKIETI

SEQ ID NO: 2087682 - protein, 25 aa, Staphylococcus
VIDQPQEFKFLYDLNQPLEEKIETI

SEQ ID NO: 2087683 - protein, 25 aa, Staphylococcus
VIDQTYGEILGAFIVGPHATDLIGE

SEQ ID NO: 2087684 - protein, 19 aa, Staphylococcus
VIDQYGELVPLTEIDKSLL

SEQ ID NO: 2087685 - protein, 27 aa, Staphylococcus
VIDRFKTTFHAVQGYFTEVFKSLFGGG

SEQ ID NO: 2087686 - protein, 23 aa, Staphylococcus
VIDRKRPKLIHQLKINGKDLEIK

SEQ ID NO: 2087687 - protein, 19 aa, Staphylococcus
VIDSWFYIENCNAVIENLT

SEQ ID NO: 2087688 - protein, 22 aa, Staphylococcus
VIDYYDRFIQRFPTIADLSEAH

SEQ ID NO: 2087689 - protein, 24 aa, Staphylococcus
VIDYYHRFVNRFPTIAALSEAHED

SEQ ID NO: 2087690 - protein, 30 aa, Staphylococcus
VIEAFKNGGRLFYIGAGTSGRLGVLDAAEC

SEQ ID NO: 2087691 - protein, 26 aa, Staphylococcus
VIEAIKNAKFPVLLAGMRSSSSDETN

SEQ ID NO: 2087692 - protein, 30 aa, Staphylococcus
VIEARPYRLLRIGSFLLSKYGYKIFVHETE

SEQ ID NO: 2087693 - protein, 18 aa, Staphylococcus
VIEENFTFYNVDLDDGLM

SEQ ID NO: 2087694 - protein, 18 aa, Staphylococcus
VIEENFTFYNVDLNDGLM

SEQ ID NO: 2087695 - protein, 31 aa, Staphylococcus
VIEGKVIRLANFGAFVEIAPGVQGLVHISEI

SEQ ID NO: 2087696 - protein, 26 aa, Staphylococcus
VIEGNTGLFVAMPSKRTPDGEFRDIA

SEQ ID NO: 2087697 - protein, 23 aa, Staphylococcus
VIEKDFEDYINQFEWHDAKIPVV

SEQ ID NO: 2087698 - protein, 27 aa, Staphylococcus
VIEKENKFILFIYDWRVLESESRNANY

SEQ ID NO: 2087699 - protein, 18 aa, Staphylococcus
VIENLIINKLGITILPAT

SEQ ID NO: 2087700 - protein, 19 aa, Staphylococcus
VIENLPKVRDGHIKAWVNI

SEQ ID NO: 2087701 - protein, 29 aa, Staphylococcus
VIESKWSFEPLMRLFKTQVLTKKFKDNRY

SEQ ID NO: 2087702 - protein, 18 aa, Staphylococcus
VIEVPKRVFKKLGIEPNT

SEQ ID NO: 2087703 - protein, 24 aa, Staphylococcus
VIEYPLLEIIVRYNDNGYETRHLA

SEQ ID NO: 2087704 - protein, 23 aa, Staphylococcus
VIFASPVYWYSVSASLKAFIDHW

SEQ ID NO: 2087705 - protein, 18 aa, Staphylococcus
VIFDLLVEYDGELPFWDK

SEQ ID NO: 2087706 - protein, 23 aa, Staphylococcus
VIFDLLVEYDGELPFWDKSSPEA

SEQ ID NO: 2087707 - protein, 19 aa, Staphylococcus
VIFTILHAGGKFGQGGYKT

SEQ ID NO: 2087708 - protein, 19 aa, Staphylococcus
VIFTTTILERGFTMAKLDV

SEQ ID NO: 2087709 - protein, 18 aa, Staphylococcus
VIFTVLHAGGKFGQGGYK

SEQ ID NO: 2087710 - protein, 22 aa, Staphylococcus
VIGEQKFGLRLAGEFDREAMKE

SEQ ID NO: 2087711 - protein, 19 aa, Staphylococcus
VIGHVLLGEILLVSNNHQT

SEQ ID NO: 2087712 - protein, 20 aa, Staphylococcus
VIGKKMILPIVGRELPILAD

SEQ ID NO: 2087713 - protein, 17 aa, Staphylococcus
VIGLTKSAARELASRNI

SEQ ID NO: 2087714 - protein, 18 aa, Staphylococcus
VIGMTYGSLFDATQTRVM

SEQ ID NO: 2087715 - protein, 32 aa, Staphylococcus
VIGPLLHYRMVHELPTFFTSNLSYDELEHHLS

SEQ ID NO: 2087716 - protein, 22 aa, Staphylococcus
VIGPLLHYRMVHELPTLFSSNL

SEQ ID NO: 2087717 - protein, 28 aa, Staphylococcus
VIGYDDIPLAKLFYPSLTTIEQPAYEIG

SEQ ID NO: 2087718 - protein, 17 aa, Staphylococcus
VIGYQNQLPWHLPNDLK

SEQ ID NO: 2087719 - protein, 18 aa, Staphylococcus
VIHDAISHRLVVPNGTMG

SEQ ID NO: 2087720 - protein, 21 aa, Staphylococcus
VIHHQALNTPIYIFVKKEDAD

SEQ ID NO: 2087721 - protein, 20 aa, Staphylococcus
VIHLMSRVRRYPLPLALEVS

SEQ ID NO: 2087722 - protein, 26 aa, Staphylococcus
VIHLMSRVRRYPLPLVLEISNLESVM

SEQ ID NO: 2087723 - protein, 25 aa, Staphylococcus
VIHLMSRVRRYPLPLVLEVSNLDSV

SEQ ID NO: 2087724 - protein, 17 aa, Staphylococcus
VIIDAFNFRHATKRFNP

SEQ ID NO: 2087725 - protein, 19 aa, Staphylococcus
VIINLLKEKEFLTLQELIK

SEQ ID NO: 2087726 - protein, 17 aa, Staphylococcus
VIINLPNGKRITGRVNS

SEQ ID NO: 2087727 - protein, 21 aa, Staphylococcus
VIIPDLPYELTQKLKHKISKF

SEQ ID NO: 2087728 - protein, 18 aa, Staphylococcus
VIKAHMIEQLYSPVQFID

SEQ ID NO: 2087729 - protein, 17 aa, Staphylococcus
VIKFKKGYNADVIEYVG

SEQ ID NO: 2087730 - protein, 19 aa, Staphylococcus
VIKKTAMVFGQMNEPPGAR

SEQ ID NO: 2087731 - protein, 39 aa, Staphylococcus
VIKLHTEPTYLIYMLGFMPGFPYLGGLDERLYTPRRDEP

SEQ ID NO: 2087732 - protein, 18 aa, Staphylococcus
VIKLIPGLENVDIVRYGV

SEQ ID NO: 2087733 - protein, 25 aa, Staphylococcus
VIKRHYVIRDGLRAALKALDLPLLV

SEQ ID NO: 2087734 - protein, 18 aa, Staphylococcus
VIKVKKNFAIGKLLEVNK

SEQ ID NO: 2087735 - protein, 25 aa, Staphylococcus
VILGCTHYPLLYQPINDYFGGEKTV

SEQ ID NO: 2087736 - protein, 25 aa, Staphylococcus
VILGCTHYPLLYQPINDYFGGKKTV

SEQ ID NO: 2087737 - protein, 25 aa, Staphylococcus
VILIHACWIAQIEIAMLNTRLTEQE

SEQ ID NO: 2087738 - protein, 20 aa, Staphylococcus
VILLNKKYYLYCFGGDISLI

SEQ ID NO: 2087739 - protein, 17 aa, Staphylococcus
VILNNLYKQTPLQTSFG

SEQ ID NO: 2087740 - protein, 18 aa, Staphylococcus
VILNNLYKQTPLQTSFGV

SEQ ID NO: 2087741 - protein, 18 aa, Staphylococcus
VILPHMFTYGYLTSVTTK

SEQ ID NO: 2087742 - protein, 20 aa, Staphylococcus
VIMFTICMDVVDSAFAPGVS

SEQ ID NO: 2087743 - protein, 19 aa, Staphylococcus
VIMLALALVPNEINYMAKK

SEQ ID NO: 2087744 - protein, 19 aa, Staphylococcus
VIMNDTLQSIYLLADGMRT

SEQ ID NO: 2087745 - protein, 22 aa, Staphylococcus
VINKLGFYISLGGPVTFKNAKQ

SEQ ID NO: 2087746 - protein, 22 aa, Staphylococcus
VINKLNFYVSLGGPVTFKNAKQ

SEQ ID NO: 2087747 - protein, 18 aa, Staphylococcus
VINMIKHIKSYLPNSFVI

SEQ ID NO: 2087748 - protein, 19 aa, Staphylococcus
VINPFGSFVAKGVMYPHPP

SEQ ID NO: 2087749 - protein, 18 aa, Staphylococcus
VINPFGTFIAKSVIYPHP

SEQ ID NO: 2087750 - protein, 19 aa, Staphylococcus
VINPFGTFIAKSVIYPHPP

SEQ ID NO: 2087751 - protein, 20 aa, Staphylococcus
VINPFGTFVAKGVMYPHPPV

SEQ ID NO: 2087752 - protein, 23 aa, Staphylococcus
VINPSVLSHYWGGDKLDIRQDLE

SEQ ID NO: 2087753 - protein, 26 aa, Staphylococcus
VIPHQFAEWIESKYLLPTPFEVEAKA

SEQ ID NO: 2087754 - protein, 19 aa, Staphylococcus
VIPRFYYQSFNTRNLDYIK

SEQ ID NO: 2087755 - protein, 19 aa, Staphylococcus
VIPVERYGVKVISMAFFVE

SEQ ID NO: 2087756 - protein, 17 aa, Staphylococcus
VIQFKWISVDEANAMLK

SEQ ID NO: 2087757 - protein, 18 aa, Staphylococcus
VIQLIPGLENVEIVRYGV

SEQ ID NO: 2087758 - protein, 30 aa, Staphylococcus
VIQPPEDVDVFLVAPKGPGHLVRRTFTEGS

SEQ ID NO: 2087759 - protein, 24 aa, Staphylococcus
VIQRHYIIRDALRHALKALDLDVL

SEQ ID NO: 2087760 - protein, 30 aa, Staphylococcus
VIQTGWQFDPLMRLFKTNILTKKFKDSQYL

SEQ ID NO: 2087761 - protein, 17 aa, Staphylococcus
VIQTYFERANVKFLSSL

SEQ ID NO: 2087762 - protein, 17 aa, Staphylococcus
VIRCIFAYFNVIGEEEA

SEQ ID NO: 2087763 - protein, 26 aa, Staphylococcus
VIREREHFAIFPASHFVTREEKMKVA

SEQ ID NO: 2087764 - protein, 23 aa, Staphylococcus
VIRKTIETLMRKGYKYDKIKSKL

SEQ ID NO: 2087765 - protein, 19 aa, Staphylococcus
VIRLIMDLLQYDSGSISIL

SEQ ID NO: 2087766 - protein, 22 aa, Staphylococcus
VIRYANYLKQLSEKTQFIVITH

SEQ ID NO: 2087767 - protein, 22 aa, Staphylococcus
VIRYAQFLNDLSEKTQFIVITH

SEQ ID NO: 2087768 - protein, 23 aa, Staphylococcus
VIRYAQYLKELSDQTQFIVITHR

SEQ ID NO: 2087769 - protein, 21 aa, Staphylococcus
VIRYAQYLNELSDQTQFIVIT

SEQ ID NO: 2087770 - protein, 37 aa, Staphylococcus
VIRYRFEAHIIERLLKLKWWQYGFADFKGVTADDSIE

SEQ ID NO: 2087771 - protein, 18 aa, Staphylococcus
VISALTYANQLEAKTVAL

SEQ ID NO: 2087772 - protein, 17 aa, Staphylococcus
VISHSSFDYIKDLKAID

SEQ ID NO: 2087773 - protein, 25 aa, Staphylococcus
VISLERLMRINPELIYQAWTDADVM

SEQ ID NO: 2087774 - protein, 17 aa, Staphylococcus
VISLTDHIIFAYKRLKQ

SEQ ID NO: 2087775 - protein, 24 aa, Staphylococcus
VISRQRVWGVPLPVFYTENGDIIM

SEQ ID NO: 2087776 - protein, 23 aa, Staphylococcus
VISYKFMEVLEEAGLPKGVVNWI

SEQ ID NO: 2087777 - protein, 19 aa, Staphylococcus
VITAFRFHYGAAQDLLGVI

SEQ ID NO: 2087778 - protein, 26 aa, Staphylococcus
VITGHYRNGILLSPVIGRDIANWLLT

SEQ ID NO: 2087779 - protein, 21 aa, Staphylococcus
VITQDYGLASLLIDKVHIVMH

SEQ ID NO: 2087780 - protein, 24 aa, Staphylococcus
VITQDYGLASLLIGKARMVMHHNG

SEQ ID NO: 2087781 - protein, 20 aa, Staphylococcus
VITQDYGLASLLLNKVKTVL

SEQ ID NO: 2087782 - protein, 29 aa, Staphylococcus
VITQDYGLASLLLNKVRFVMHHKGFLFND

SEQ ID NO: 2087783 - protein, 19 aa, Staphylococcus
VITQVLQKGYKLKDRVLRP

SEQ ID NO: 2087784 - protein, 17 aa, Staphylococcus
VIVIHQPAEEMPPGGAK

SEQ ID NO: 2087785 - protein, 18 aa, Staphylococcus
VIVRELTSGIYFGEPRHI

SEQ ID NO: 2087786 - protein, 22 aa, Staphylococcus
VIVSIFSHPIQFDPMQLTNTGV

SEQ ID NO: 2087787 - protein, 19 aa, Staphylococcus
VIVYKFKHPIPWKQHDVKL

SEQ ID NO: 2087788 - protein, 17 aa, Staphylococcus
VIWDKKTGRPIYHAIVW

SEQ ID NO: 2087789 - protein, 17 aa, Staphylococcus
VIWTDAQWRSIYAKGQD

SEQ ID NO: 2087790 - protein, 17 aa, Staphylococcus
VIYLGTFSKTLMPSIRM

SEQ ID NO: 2087791 - protein, 18 aa, Staphylococcus
VIYQGITEFPFSELISFK

SEQ ID NO: 2087792 - protein, 24 aa, Staphylococcus
VKAEYLYNFEPFSKILKMKEIQTP

SEQ ID NO: 2087793 - protein, 17 aa, Staphylococcus
VKAFQKCGFNIDKIIFE

SEQ ID NO: 2087794 - protein, 20 aa, Staphylococcus
VKAHGFLPRIYKEPLLSEAV

SEQ ID NO: 2087795 - protein, 17 aa, Staphylococcus
VKAIAASSAFQGAYPTI

SEQ ID NO: 2087796 - protein, 18 aa, Staphylococcus
VKAILRRSQFVNEAANDA

SEQ ID NO: 2087797 - protein, 20 aa, Staphylococcus
VKAIYNCQTPIISAVGHETD

SEQ ID NO: 2087798 - protein, 24 aa, Staphylococcus
VKALEAWDIDHLYGIPGDSIDAVV

SEQ ID NO: 2087799 - protein, 26 aa, Staphylococcus
VKALSMWMTMKCGITNLPFGGGKGGI

SEQ ID NO: 2087800 - protein, 23 aa, Staphylococcus
VKALSMWMTMKCGIVDLPYGGGK

SEQ ID NO: 2087801 - protein, 28 aa, Staphylococcus
VKARAYKLLIDFGFSRDILQQSPFQMSG

SEQ ID NO: 2087802 - protein, 24 aa, Staphylococcus
VKCTKLQFIDYLDALPSNIYRMKG

SEQ ID NO: 2087803 - protein, 28 aa, Staphylococcus
VKDAPDFKEVFPYMLQFINQLPVVAHNA

SEQ ID NO: 2087804 - protein, 29 aa, Staphylococcus
VKDDVRVKKVIDLLLDDAKLVEPSEDAEE

SEQ ID NO: 2087805 - protein, 23 aa, Staphylococcus
VKDIWPVSGDYLLVTLRIDRDNH

SEQ ID NO: 2087806 - protein, 24 aa, Staphylococcus
VKDKCDFYIKIPMVGHVNSLNASV

SEQ ID NO: 2087807 - protein, 38 aa, Staphylococcus
VKDKHIILMTHIVTHPKFIVPMPHRIFDFFNAYIGTKD

SEQ ID NO: 2087808 - protein, 25 aa, Staphylococcus
VKDKQIILMTHIVTHPKFAVPMPHR

SEQ ID NO: 2087809 - protein, 25 aa, Staphylococcus
VKDNKIEIVLSWKLNRISRSMRDVF

SEQ ID NO: 2087810 - protein, 26 aa, Staphylococcus
VKDRKYFKALYFKEKGDIVFEIATEG

SEQ ID NO: 2087811 - protein, 17 aa, Staphylococcus
VKDSIADIFLQQILTRP

SEQ ID NO: 2087812 - protein, 18 aa, Staphylococcus
VKDSIADIFLQQILTRPS

SEQ ID NO: 2087813 - protein, 30 aa, Staphylococcus
VKEAIGVAGLITPWNFPTNQTSLKLAAAFA

SEQ ID NO: 2087814 - protein, 23 aa, Staphylococcus
VKEDLITLLKRFEKKDGARWENM

SEQ ID NO: 2087815 - protein, 24 aa, Staphylococcus
VKEEILIEALKEKLIRHAYLDVFE

SEQ ID NO: 2087816 - protein, 21 aa, Staphylococcus
VKEFYVLYEIYKAKGKKYKIN

SEQ ID NO: 2087817 - protein, 23 aa, Staphylococcus
VKEKCDFYINIPMVGHVNSLNAS

SEQ ID NO: 2087818 - protein, 27 aa, Staphylococcus
VKEKPKARWLFLTLSTRNAIDGETLEQ

SEQ ID NO: 2087819 - protein, 25 aa, Staphylococcus
VKELFYLHHALYPQAMSLKAFKALT

SEQ ID NO: 2087820 - protein, 24 aa, Staphylococcus
VKELLFRIQAVLRRYQINSQDIIK

SEQ ID NO: 2087821 - protein, 22 aa, Staphylococcus
VKELLNCFDYLIKHKKHSSRKR

SEQ ID NO: 2087822 - protein, 22 aa, Staphylococcus
VKELYKLFCQLYKDAISIDEFK

SEQ ID NO: 2087823 - protein, 18 aa, Staphylococcus
VKEPLRFLEVRIPVRMDD

SEQ ID NO: 2087824 - protein, 18 aa, Staphylococcus
VKERFYFHAIYSKEPGHI

SEQ ID NO: 2087825 - protein, 29 aa, Staphylococcus
VKETFMTNIFGMMFLSQAAVPHLSKGDAI

SEQ ID NO: 2087826 - protein, 24 aa, Staphylococcus
VKETIAQLMRYLKQHHIPMAIATS

SEQ ID NO: 2087827 - protein, 23 aa, Staphylococcus
VKEVLIGFKFIAKAIRELREDET

SEQ ID NO: 2087828 - protein, 20 aa, Staphylococcus
VKEVLIGFKHIAKAIRELDD

SEQ ID NO: 2087829 - protein, 17 aa, Staphylococcus
VKEWLKKTAKKYGLDPE

SEQ ID NO: 2087830 - protein, 21 aa, Staphylococcus
VKFECNCSHEKFLNAIKGLGE

SEQ ID NO: 2087831 - protein, 20 aa, Staphylococcus
VKFEMPYEEAKSWMLKALEP

SEQ ID NO: 2087832 - protein, 24 aa, Staphylococcus
VKFKSYLLDTGIIDQTWLDKIENE

SEQ ID NO: 2087833 - protein, 22 aa, Staphylococcus
VKGALSVLAPEGSLLLCTNSSA

SEQ ID NO: 2087834 - protein, 23 aa, Staphylococcus
VKGDKEYLIPYIADVVKEVDVEH

SEQ ID NO: 2087835 - protein, 25 aa, Staphylococcus
VKGGLQFTYISLDDFRILKAKLFGN

SEQ ID NO: 2087836 - protein, 24 aa, Staphylococcus
VKGGLQFTYISLDDFRILKSELFG

SEQ ID NO: 2087837 - protein, 25 aa, Staphylococcus
VKGGLQFTYISLDDFRILRSQLFGD

SEQ ID NO: 2087838 - protein, 22 aa, Staphylococcus
VKGIQFKGLRDIGNPVDFALYY

SEQ ID NO: 2087839 - protein, 25 aa, Staphylococcus
VKGIWDARRILKKEKPDLLFSKGGF

SEQ ID NO: 2087840 - protein, 19 aa, Staphylococcus
VKGLDKAIETLKEAKPYLF

SEQ ID NO: 2087841 - protein, 25 aa, Staphylococcus
VKGLLYAINAVMPHFQQQSSGHIFN

SEQ ID NO: 2087842 - protein, 18 aa, Staphylococcus
VKGPIIWVDDTLIALQQL

SEQ ID NO: 2087843 - protein, 21 aa, Staphylococcus
VKGVLWGIQAAHAQFKQLGHG

SEQ ID NO: 2087844 - protein, 25 aa, Staphylococcus
VKHKFSELHVFPYSARIGTPAARMD

SEQ ID NO: 2087845 - protein, 24 aa, Staphylococcus
VKHKFSELHVFPYSQRIGTPAARM

SEQ ID NO: 2087846 - protein, 26 aa, Staphylococcus
VKHNACDYILTNPPIRAGKEVVHRIF

SEQ ID NO: 2087847 - protein, 23 aa, Staphylococcus
VKHYQKLIESLAFKYSKGQSHHE

SEQ ID NO: 2087848 - protein, 23 aa, Staphylococcus
VKIDSSLAAMQFMLVAKAHGYDT

SEQ ID NO: 2087849 - protein, 28 aa, Staphylococcus
VKIDSSLMAMQLMLVAKQYGYDTNPIGG

SEQ ID NO: 2087850 - protein, 19 aa, Staphylococcus
VKIELLIEFCKLGQLPSNE

SEQ ID NO: 2087851 - protein, 28 aa, Staphylococcus
VKIIDRTQLILEIFALRARSKEGKLQVE

SEQ ID NO: 2087852 - protein, 17 aa, Staphylococcus
VKILDEDYFLTSIVSNI

SEQ ID NO: 2087853 - protein, 21 aa, Staphylococcus
VKIPISLLTTPKRKKLFIRID

SEQ ID NO: 2087854 - protein, 18 aa, Staphylococcus
VKIQKADYPLNYGKAIRI

SEQ ID NO: 2087855 - protein, 33 aa, Staphylococcus
VKIQKFPYYNPFSNTLITSWFWSHRPKAVEAAG

SEQ ID NO: 2087856 - protein, 28 aa, Staphylococcus
VKITDHYILTRLKTMGDLALLMLKDLDT

SEQ ID NO: 2087857 - protein, 22 aa, Staphylococcus
VKKGWHTIPLHAIAPVQYSTTS

SEQ ID NO: 2087858 - protein, 17 aa, Staphylococcus
VKKLIDMGFRVSVTGGL

SEQ ID NO: 2087859 - protein, 24 aa, Staphylococcus
VKKNNLLKFFKDKLKDWKSIDIVD

SEQ ID NO: 2087860 - protein, 17 aa, Staphylococcus
VKKVFVDLYNKGIIYRG

SEQ ID NO: 2087861 - protein, 25 aa, Staphylococcus
VKKYNCLYLRVDPYLPYQYLNHDGE

SEQ ID NO: 2087862 - protein, 19 aa, Staphylococcus
VKLKRGPATNPLFKSFFNA

SEQ ID NO: 2087863 - protein, 17 aa, Staphylococcus
VKLLRKIGDKILEQKDR

SEQ ID NO: 2087864 - protein, 18 aa, Staphylococcus
VKLLTPFELKIIGVSKTG

SEQ ID NO: 2087865 - protein, 25 aa, Staphylococcus
VKLMQLKELFLVSLQERAIPFELNG

SEQ ID NO: 2087866 - protein, 26 aa, Staphylococcus
VKLPKYDGFYWTRKIREVSNTPILFL

SEQ ID NO: 2087867 - protein, 18 aa, Staphylococcus
VKLPVVLYNVPSRTNMTI

SEQ ID NO: 2087868 - protein, 18 aa, Staphylococcus
VKLTPILGWAERGGASAS

SEQ ID NO: 2087869 - protein, 27 aa, Staphylococcus
VKLYDALRESFNIPALKAWQSTKENAG

SEQ ID NO: 2087870 - protein, 19 aa, Staphylococcus
VKMALWYTEMKRNLKRFKD

SEQ ID NO: 2087871 - protein, 18 aa, Staphylococcus
VKNAHKRELAYTRYSWPK

SEQ ID NO: 2087872 - protein, 29 aa, Staphylococcus
VKNDNVQGEYYLPDVLSLILDDGGKAEVY

SEQ ID NO: 2087873 - protein, 27 aa, Staphylococcus
VKNESKLLANYLIPRIDILKVGHHGSK

SEQ ID NO: 2087874 - protein, 30 aa, Staphylococcus
VKNGDWTLQQLVDYLTIKPAQTFDLPFGRL

SEQ ID NO: 2087875 - protein, 24 aa, Staphylococcus
VKNHVVFLGFDYGYRGNSKYLFNY

SEQ ID NO: 2087876 - protein, 28 aa, Staphylococcus
VKNLGPLDDIMKMIPGMNKMKGLDQLNM

SEQ ID NO: 2087877 - protein, 18 aa, Staphylococcus
VKNNEYDVFYKDHIYTTA

SEQ ID NO: 2087878 - protein, 31 aa, Staphylococcus
VKNRYLTEDIAFGLVLWSSLGREIDVATPNI

SEQ ID NO: 2087879 - protein, 18 aa, Staphylococcus
VKPENIVLIGMRDLDVGE

SEQ ID NO: 2087880 - protein, 20 aa, Staphylococcus
VKPPVIYGDVKWTAPLTVKE

SEQ ID NO: 2087881 - protein, 19 aa, Staphylococcus
VKPPVIYGDVKWTKPITVE

SEQ ID NO: 2087882 - protein, 17 aa, Staphylococcus
VKQAFKPNFDRYYEKYP

SEQ ID NO: 2087883 - protein, 18 aa, Staphylococcus
VKQFINRLPFELTDAQKT

SEQ ID NO: 2087884 - protein, 18 aa, Staphylococcus
VKQLCHYAFETLSLNKLT

SEQ ID NO: 2087885 - protein, 24 aa, Staphylococcus
VKQLYSPVQFIKSTEWLIDQGVDH

SEQ ID NO: 2087886 - protein, 24 aa, Staphylococcus
VKQLYSPVQFIKSTEWLIEQGVDH

SEQ ID NO: 2087887 - protein, 25 aa, Staphylococcus
VKQQEDYCIILGYFVDGEPKLSYIY

SEQ ID NO: 2087888 - protein, 21 aa, Staphylococcus
VKQRFESYGWNHILVKDGNNL

SEQ ID NO: 2087889 - protein, 26 aa, Staphylococcus
VKQTNSYDLAFEELEKEKDFLQVLVK

SEQ ID NO: 2087890 - protein, 24 aa, Staphylococcus
VKQTNSYDLAFEELEQEKDFLQVL

SEQ ID NO: 2087891 - protein, 24 aa, Staphylococcus
VKQTPFEYLLRYRLEQSKSILDKD

SEQ ID NO: 2087892 - protein, 17 aa, Staphylococcus
VKQYRAIRLKSLQTDPK

SEQ ID NO: 2087893 - protein, 22 aa, Staphylococcus
VKRFESKLFMFSKEGWQKLDDS

SEQ ID NO: 2087894 - protein, 30 aa, Staphylococcus
VKRMEGFNDARWILIDLANVVVHVFHKDER

SEQ ID NO: 2087895 - protein, 22 aa, Staphylococcus
VKRYINEFLKKGSSNYPIEILK

SEQ ID NO: 2087896 - protein, 17 aa, Staphylococcus
VKSEKIIFVGTAVTKTE

SEQ ID NO: 2087897 - protein, 18 aa, Staphylococcus
VKSIFYVMDFISVDKEDD

SEQ ID NO: 2087898 - protein, 20 aa, Staphylococcus
VKSIFYVMDFLAIDKQPKAD

SEQ ID NO: 2087899 - protein, 21 aa, Staphylococcus
VKSIFYVMDFLAIDKQPKANW

SEQ ID NO: 2087900 - protein, 22 aa, Staphylococcus
VKSLDNWRIISHSNLSIVNFRY

SEQ ID NO: 2087901 - protein, 25 aa, Staphylococcus
VKSNYILKYVFANGISRDIIYPLLV

SEQ ID NO: 2087902 - protein, 24 aa, Staphylococcus
VKTDILRDMIIVSLHGVLTQAEYK

SEQ ID NO: 2087903 - protein, 19 aa, Staphylococcus
VKTLSILHFVNKSGGKLKI

SEQ ID NO: 2087904 - protein, 18 aa, Staphylococcus
VKTMIFKVDGEFMMFLVR

SEQ ID NO: 2087905 - protein, 26 aa, Staphylococcus
VKTNIPFLINVMRNKKFRSGDYTTKF

SEQ ID NO: 2087906 - protein, 24 aa, Staphylococcus
VKTPYKKWFERMSDYGFEENIDYA

SEQ ID NO: 2087907 - protein, 40 aa, Staphylococcus
VKTSDRTWVFQITFPHFLTIENYLLFTGAIIEEFKTIADV

SEQ ID NO: 2087908 - protein, 25 aa, Staphylococcus
VKTTDLLIRLYEKVIDRLDYTSKKK

SEQ ID NO: 2087909 - protein, 25 aa, Staphylococcus
VKTTDLLIRLYEKVINHLDYQDKKR

SEQ ID NO: 2087910 - protein, 23 aa, Staphylococcus
VKTTDLLVRLYEKVMNNLNYQDK

SEQ ID NO: 2087911 - protein, 30 aa, Staphylococcus
VKTVHEYLPLLHRYTKLRKELLGLDDMKMY

SEQ ID NO: 2087912 - protein, 27 aa, Staphylococcus
VKTVHINLPLEWLKGKIIVDSLGLHSN

SEQ ID NO: 2087913 - protein, 26 aa, Staphylococcus
VKTVHLKLPIEWLQDKIIVDSLGLHS

SEQ ID NO: 2087914 - protein, 22 aa, Staphylococcus
VKTVIDYYHRFTERFPTVEELS

SEQ ID NO: 2087915 - protein, 17 aa, Staphylococcus
VKVKKYEHANPTSLIFA

SEQ ID NO: 2087916 - protein, 35 aa, Staphylococcus
VKWCQLLLTNRSMALIAIVDLLKQAKNRKLQLVTL

SEQ ID NO: 2087917 - protein, 23 aa, Staphylococcus
VKYFFASLTKYLRKLKCIYVLVD

SEQ ID NO: 2087918 - protein, 22 aa, Staphylococcus
VKYPILDSQMAQLPILTDLFKD

SEQ ID NO: 2087919 - protein, 25 aa, Staphylococcus
VKYSYDDAFLLKDADYVFLGTKPHD

SEQ ID NO: 2087920 - protein, 18 aa, Staphylococcus
VLAHLLGVDLPNPSIIDE

SEQ ID NO: 2087921 - protein, 18 aa, Staphylococcus
VLAHLLGVELPNPSMIDE

SEQ ID NO: 2087922 - protein, 25 aa, Staphylococcus
VLARKRLVMFDKNINIPYILQKASQ

SEQ ID NO: 2087923 - protein, 22 aa, Staphylococcus
VLATSKLWRKTINEISHEFPDV

SEQ ID NO: 2087924 - protein, 17 aa, Staphylococcus
VLAVDGVKSIFYVMDFL

SEQ ID NO: 2087925 - protein, 22 aa, Staphylococcus
VLCLNRYYGWYTQSADLASAKK

SEQ ID NO: 2087926 - protein, 21 aa, Staphylococcus
VLCLNRYYGWYTQSGDLESAK

SEQ ID NO: 2087927 - protein, 17 aa, Staphylococcus
VLCPLFEHVSDLRAEEI

SEQ ID NO: 2087928 - protein, 18 aa, Staphylococcus
VLDALSYYQFVILQTVVG

SEQ ID NO: 2087929 - protein, 20 aa, Staphylococcus
VLDDAKLLDALNGAIKGRQV

SEQ ID NO: 2087930 - protein, 19 aa, Staphylococcus
VLDEAKLLDALSGGIKGRQ

SEQ ID NO: 2087931 - protein, 26 aa, Staphylococcus
VLDEVYLLPFSKFEPFWERYKKEIKK

SEQ ID NO: 2087932 - protein, 17 aa, Staphylococcus
VLDFIPKAHIVKISDEE

SEQ ID NO: 2087933 - protein, 19 aa, Staphylococcus
VLDKMRGIETADHKIIMLI

SEQ ID NO: 2087934 - protein, 27 aa, Staphylococcus
VLDLIPEFSHLGIFPVGRLDKDTEGLL

SEQ ID NO: 2087935 - protein, 29 aa, Staphylococcus
VLDNPIESLKWLIRKLDTQGKQLHKGEIV

SEQ ID NO: 2087936 - protein, 24 aa, Staphylococcus
VLDQFDNAVILFMGAGDIQKLQRA

SEQ ID NO: 2087937 - protein, 19 aa, Staphylococcus
VLDRDLVIDQNALDYIEQY

SEQ ID NO: 2087938 - protein, 25 aa, Staphylococcus
VLDSARFRYLISQELNVVPSSVHAS

SEQ ID NO: 2087939 - protein, 30 aa, Staphylococcus
VLDSDVVIFASPVYWYSVSASMKAFIDHWS

SEQ ID NO: 2087940 - protein, 20 aa, Staphylococcus
VLDTIKLLTQEKLNVPLIGF

SEQ ID NO: 2087941 - protein, 26 aa, Staphylococcus
VLDVTMPIVLPRMKITYITKRIEKLL

SEQ ID NO: 2087942 - protein, 17 aa, Staphylococcus
VLEDIRAFTKSRKYPQF

SEQ ID NO: 2087943 - protein, 22 aa, Staphylococcus
VLEFGPAIKGARGYIFFGHPLD

SEQ ID NO: 2087944 - protein, 20 aa, Staphylococcus
VLEGLEFMGVYWDPKKNENL

SEQ ID NO: 2087945 - protein, 24 aa, Staphylococcus
VLEKFDNAVILFMGAGDIQKIQRA

SEQ ID NO: 2087946 - protein, 24 aa, Staphylococcus
VLEKFENAVILFMGAGDIQKMQKA

SEQ ID NO: 2087947 - protein, 18 aa, Staphylococcus
VLELKRLKISNLTLDENL

SEQ ID NO: 2087948 - protein, 17 aa, Staphylococcus
VLEMKAPRFGSKLQGFI

SEQ ID NO: 2087949 - protein, 20 aa, Staphylococcus
VLEPTYCFSIITSATQYPDK

SEQ ID NO: 2087950 - protein, 18 aa, Staphylococcus
VLEQEFISRIGYVIEPQY

SEQ ID NO: 2087951 - protein, 21 aa, Staphylococcus
VLETLLLLRNYEEGHRQAMEG

SEQ ID NO: 2087952 - protein, 34 aa, Staphylococcus
VLEYGESAPKIFRKVTDLVKEQVKYITGLDVVEV

SEQ ID NO: 2087953 - protein, 17 aa, Staphylococcus
VLFIDEAYTLVSEGDKG

SEQ ID NO: 2087954 - protein, 17 aa, Staphylococcus
VLFIEPMTMMNLSGEAV

SEQ ID NO: 2087955 - protein, 17 aa, Staphylococcus
VLFLHEGVSISMLMAKK

SEQ ID NO: 2087956 - protein, 17 aa, Staphylococcus
VLFLNMHGKPLSRQGIW

SEQ ID NO: 2087957 - protein, 17 aa, Staphylococcus
VLGEFRLQDRYVKAVGK

SEQ ID NO: 2087958 - protein, 17 aa, Staphylococcus
VLGESFFTTPGGKGANQ

SEQ ID NO: 2087959 - protein, 18 aa, Staphylococcus
VLGFLYLENREDRLQALL

SEQ ID NO: 2087960 - protein, 20 aa, Staphylococcus
VLGIELLDHIIIGDAKYLSM

SEQ ID NO: 2087961 - protein, 19 aa, Staphylococcus
VLGIIIGQIKWMMNQSRTI

SEQ ID NO: 2087962 - protein, 17 aa, Staphylococcus
VLGIQYPIIQAGMAGST

SEQ ID NO: 2087963 - protein, 18 aa, Staphylococcus
VLGSVSHKVAKRATIPVL

SEQ ID NO: 2087964 - protein, 18 aa, Staphylococcus
VLGVEKIEFIPTGNGDVI

SEQ ID NO: 2087965 - protein, 17 aa, Staphylococcus
VLGVRFFDENEEALPEG

SEQ ID NO: 2087966 - protein, 17 aa, Staphylococcus
VLHFERLSYRVFQEVGG

SEQ ID NO: 2087967 - protein, 26 aa, Staphylococcus
VLHLMSRVRRYPIPLVLEISNIDSVM

SEQ ID NO: 2087968 - protein, 26 aa, Staphylococcus
VLHNERHLAALSFLTFVALDDNGKPI

SEQ ID NO: 2087969 - protein, 17 aa, Staphylococcus
VLIAKLQAIYRRVYEFG

SEQ ID NO: 2087970 - protein, 27 aa, Staphylococcus
VLIHSPKPWRELLVGSPKPYFDENLAV

SEQ ID NO: 2087971 - protein, 41 aa, Staphylococcus
VLISSFNVYLVKLAEALLPEYPRALIFKSAAFQGDWRTLLD

SEQ ID NO: 2087972 - protein, 30 aa, Staphylococcus
VLKALKDWKYPRRILWLRKVQSTIKDSLFE

SEQ ID NO: 2087973 - protein, 25 aa, Staphylococcus
VLKQDLAERVNLINALVLLNEQGVS

SEQ ID NO: 2087974 - protein, 17 aa, Staphylococcus
VLKSHIIIFKNKKDIKW

SEQ ID NO: 2087975 - protein, 19 aa, Staphylococcus
VLKVYEKGSVYLAGPIHLV

SEQ ID NO: 2087976 - protein, 18 aa, Staphylococcus
VLLALINKGMVREEAYDK

SEQ ID NO: 2087977 - protein, 17 aa, Staphylococcus
VLLGPGMNIKRSPLAGR

SEQ ID NO: 2087978 - protein, 28 aa, Staphylococcus
VLLSTKFKAPRWLVNPIKNYSLRKHKEI

SEQ ID NO: 2087979 - protein, 19 aa, Staphylococcus
VLMYLPDVPKALRILKDFL

SEQ ID NO: 2087980 - protein, 25 aa, Staphylococcus
VLNCIHKGIYLLDVPLSEYQAQHSS

SEQ ID NO: 2087981 - protein, 21 aa, Staphylococcus
VLNDILPTIDNIERALQIDGE

SEQ ID NO: 2087982 - protein, 28 aa, Staphylococcus
VLNDKPESLFNYFKQLFAQVTNPPIDAY

SEQ ID NO: 2087983 - protein, 28 aa, Staphylococcus
VLNDRPESLFNYFKQLFAQVTNPPIDAY

SEQ ID NO: 2087984 - protein, 41 aa, Staphylococcus
VLNKRLPIVDLPIIPIWVSRYWVQLISKVPKEMVYPLMNSL

SEQ ID NO: 2087985 - protein, 17 aa, Staphylococcus
VLNLIQRMSGIATQTRQ

SEQ ID NO: 2087986 - protein, 18 aa, Staphylococcus
VLPAFRPDDVFKVGEPAF

SEQ ID NO: 2087987 - protein, 18 aa, Staphylococcus
VLPDAVIRFRQGLGRLIR

SEQ ID NO: 2087988 - protein, 18 aa, Staphylococcus
VLPIGYADGFLRAMQGFA

SEQ ID NO: 2087989 - protein, 20 aa, Staphylococcus
VLPITFIEGNIAKTGTYITQ

SEQ ID NO: 2087990 - protein, 17 aa, Staphylococcus
VLPIYPKAPDYHIEDSE

SEQ ID NO: 2087991 - protein, 30 aa, Staphylococcus
VLPKANLIRFIFEEGFIALRPSGTEPKIKV

SEQ ID NO: 2087992 - protein, 19 aa, Staphylococcus
VLPMEDINLHFNGDFHAIT

SEQ ID NO: 2087993 - protein, 18 aa, Staphylococcus
VLPQLRKGEAIGLNHSRY

SEQ ID NO: 2087994 - protein, 19 aa, Staphylococcus
VLPTIAFLDGEYGYRDICL

SEQ ID NO: 2087995 - protein, 17 aa, Staphylococcus
VLPYLKKGDTIIVESTI

SEQ ID NO: 2087996 - protein, 17 aa, Staphylococcus
VLQEALNFVRMGDRFIV

SEQ ID NO: 2087997 - protein, 18 aa, Staphylococcus
VLQERLRSFPNVDIHTNA

SEQ ID NO: 2087998 - protein, 17 aa, Staphylococcus
VLQILYSYYTYQQLRNI

SEQ ID NO: 2087999 - protein, 17 aa, Staphylococcus
VLQMKAPNKLFGNHLQQ

SEQ ID NO: 2088000 - protein, 21 aa, Staphylococcus
VLQPIILRKTVRGYHIVVGER

SEQ ID NO: 2088001 - protein, 17 aa, Staphylococcus
VLRELGLNDESIRIGFE

SEQ ID NO: 2088002 - protein, 24 aa, Staphylococcus
VLRERDHFAIFPASHFVTREEKMK

SEQ ID NO: 2088003 - protein, 20 aa, Staphylococcus
VLREREHFAIFPASHFVTRD

SEQ ID NO: 2088004 - protein, 19 aa, Staphylococcus
VLRFQPPLVITYEQLDEAL

SEQ ID NO: 2088005 - protein, 21 aa, Staphylococcus
VLRGCEPYYIEHGAFSGALGS

SEQ ID NO: 2088006 - protein, 21 aa, Staphylococcus
VLRKQREIIYNERNSIIDSED

SEQ ID NO: 2088007 - protein, 17 aa, Staphylococcus
VLRQHFNIRRLNDSIVQ

SEQ ID NO: 2088008 - protein, 27 aa, Staphylococcus
VLRQREHFSIFPASHYVTRDEKLKLAI

SEQ ID NO: 2088009 - protein, 17 aa, Staphylococcus
VLRVKALLRRTLTATSE

SEQ ID NO: 2088010 - protein, 24 aa, Staphylococcus
VLSDPLNDVLILVESLSLVDVDPL

SEQ ID NO: 2088011 - protein, 25 aa, Staphylococcus
VLSDPLNDVLILVESLTLVDVDALT

SEQ ID NO: 2088012 - protein, 21 aa, Staphylococcus
VLSDPLNDVLVLVESLTLVDV

SEQ ID NO: 2088013 - protein, 17 aa, Staphylococcus
VLSDVLLLIDPDSLDEA

SEQ ID NO: 2088014 - protein, 23 aa, Staphylococcus
VLSELCLPLVKTGGHFIAMKSSK

SEQ ID NO: 2088015 - protein, 28 aa, Staphylococcus
VLSERLQESAFLLKNLKIKLIDLRRGKE

SEQ ID NO: 2088016 - protein, 28 aa, Staphylococcus
VLSERLQESAFLLKNLKITLNDLRSGKE

SEQ ID NO: 2088017 - protein, 18 aa, Staphylococcus
VLSFLKTVDNPLQDIYLV

SEQ ID NO: 2088018 - protein, 20 aa, Staphylococcus
VLSGYFKSIGLYKTFNHQQL

SEQ ID NO: 2088019 - protein, 20 aa, Staphylococcus
VLSLLSMDYIKVEDNVIIAG

SEQ ID NO: 2088020 - protein, 24 aa, Staphylococcus
VLSPSFDVLLSDFKHVLTQLLNVV

SEQ ID NO: 2088021 - protein, 19 aa, Staphylococcus
VLTALFPCGSITGAPKLNT

SEQ ID NO: 2088022 - protein, 19 aa, Staphylococcus
VLTFQVRREINGESYPLEI

SEQ ID NO: 2088023 - protein, 19 aa, Staphylococcus
VLTGVNWLIQENELICTAT

SEQ ID NO: 2088024 - protein, 18 aa, Staphylococcus
VLTIYNAFTLPSSDDRIN

SEQ ID NO: 2088025 - protein, 23 aa, Staphylococcus
VLTMLVHMQYEQGLWYVKGGIHH

SEQ ID NO: 2088026 - protein, 25 aa, Staphylococcus
VLTTEYYWHWDLKNSGLDVYEYKKL

SEQ ID NO: 2088027 - protein, 26 aa, Staphylococcus
VLTTEYYWHWDLKQAKLDVFEYKKVM

SEQ ID NO: 2088028 - protein, 26 aa, Staphylococcus
VLTTEYYWHWDLKSAKLDVFEYKKMM

SEQ ID NO: 2088029 - protein, 19 aa, Staphylococcus
VLTYQVLLKSIFGYVNKCE

SEQ ID NO: 2088030 - protein, 22 aa, Staphylococcus
VLVDGPFINHLYRPNLPYKGSM

SEQ ID NO: 2088031 - protein, 23 aa, Staphylococcus
VLVDGPFIQALFQPNLAYKGSLN

SEQ ID NO: 2088032 - protein, 18 aa, Staphylococcus
VLVKMRNRMNQRAELYEM

SEQ ID NO: 2088033 - protein, 17 aa, Staphylococcus
VLVLTANYGNFKKLGVK

SEQ ID NO: 2088034 - protein, 18 aa, Staphylococcus
VLVNIKNKQPYRTVFRTT

SEQ ID NO: 2088035 - protein, 19 aa, Staphylococcus
VLVPLAYIYFDEYLEELNN

SEQ ID NO: 2088036 - protein, 19 aa, Staphylococcus
VLVSPHIAFFTGEAVKNLT

SEQ ID NO: 2088037 - protein, 27 aa, Staphylococcus
VLYGHMSPYMIVGMLGAIKAGCGYVPI

SEQ ID NO: 2088038 - protein, 20 aa, Staphylococcus
VLYLGIVGDTGRFLFNNTTP

SEQ ID NO: 2088039 - protein, 17 aa, Staphylococcus
VLYLGIVGDTGRFLFSN

SEQ ID NO: 2088040 - protein, 17 aa, Staphylococcus
VLYSEAIYLALPPDYAL

SEQ ID NO: 2088041 - protein, 18 aa, Staphylococcus
VLYVSFDELLENSDFVIC

SEQ ID NO: 2088042 - protein, 19 aa, Staphylococcus
VMADENYLLAKAFDNRFGC

SEQ ID NO: 2088043 - protein, 24 aa, Staphylococcus
VMAHLTMEFFTNGLVPITSLSFAY

SEQ ID NO: 2088044 - protein, 18 aa, Staphylococcus
VMALGQLITSLQTIISRN

SEQ ID NO: 2088045 - protein, 26 aa, Staphylococcus
VMASRGSVIPLFIDKIKAGEPLTVTD

SEQ ID NO: 2088046 - protein, 26 aa, Staphylococcus
VMASRGSVIPLFIEKIKTGEPLTITD

SEQ ID NO: 2088047 - protein, 27 aa, Staphylococcus
VMATITFQNLFKLFNGFSGMTGTGKLG

SEQ ID NO: 2088048 - protein, 25 aa, Staphylococcus
VMCSGAIVMSRIPRVVYGASDPKGG

SEQ ID NO: 2088049 - protein, 19 aa, Staphylococcus
VMDRLDELVATEYPVLLAT

SEQ ID NO: 2088050 - protein, 22 aa, Staphylococcus
VMDTFGRIDILFNNAGINEHVK

SEQ ID NO: 2088051 - protein, 25 aa, Staphylococcus
VMEEKLAINLGFAKGLKFIESCTVG

SEQ ID NO: 2088052 - protein, 18 aa, Staphylococcus
VMEEWLFNTVAFIGGPSE

SEQ ID NO: 2088053 - protein, 21 aa, Staphylococcus
VMELLYNRRFVVDKAVILAAT

SEQ ID NO: 2088054 - protein, 18 aa, Staphylococcus
VMFYDYIDANEPLKPHDD

SEQ ID NO: 2088055 - protein, 24 aa, Staphylococcus
VMGRDCGDLALWAGLAVGAETIIV

SEQ ID NO: 2088056 - protein, 23 aa, Staphylococcus
VMGRDCGDLALWAGLSVGAETII

SEQ ID NO: 2088057 - protein, 23 aa, Staphylococcus
VMGRDCGDLALWAGLSVGAETIM

SEQ ID NO: 2088058 - protein, 17 aa, Staphylococcus
VMHACGHDIHMASILAI

SEQ ID NO: 2088059 - protein, 19 aa, Staphylococcus
VMHYFKEAHPYFDQNVVII

SEQ ID NO: 2088060 - protein, 17 aa, Staphylococcus
VMIGILYQFIVANELLN

SEQ ID NO: 2088061 - protein, 20 aa, Staphylococcus
VMIGILYQFIVANQMLHTEY

SEQ ID NO: 2088062 - protein, 19 aa, Staphylococcus
VMISVLRAPRTFTREDIIE

SEQ ID NO: 2088063 - protein, 25 aa, Staphylococcus
VMKINDMYALNFVGLGLIVQNAENV

SEQ ID NO: 2088064 - protein, 21 aa, Staphylococcus
VMKTIEALMRKGYNYDKIKVT

SEQ ID NO: 2088065 - protein, 22 aa, Staphylococcus
VMKTIESLMRKGYKYDKIKSKL

SEQ ID NO: 2088066 - protein, 20 aa, Staphylococcus
VMLHLPGLSITKRMNRIAQT

SEQ ID NO: 2088067 - protein, 21 aa, Staphylococcus
VMLLQHMILSHHGKLEYGSPK

SEQ ID NO: 2088068 - protein, 22 aa, Staphylococcus
VMLLRHMILAHHGKMEFGSPKL

SEQ ID NO: 2088069 - protein, 25 aa, Staphylococcus
VMLNMQLLNVLYEYQLRIPEDIQTA

SEQ ID NO: 2088070 - protein, 17 aa, Staphylococcus
VMMALREPALGPVFGIK

SEQ ID NO: 2088071 - protein, 18 aa, Staphylococcus
VMNESLAEWFAENDYFYI

SEQ ID NO: 2088072 - protein, 23 aa, Staphylococcus
VMNKGYWTGNLWREIESAKSGKL

SEQ ID NO: 2088073 - protein, 22 aa, Staphylococcus
VMQEEIFGPILPIITYDDFDEA

SEQ ID NO: 2088074 - protein, 24 aa, Staphylococcus
VMQKYAKLLQRIHGLDKMRFEDLK

SEQ ID NO: 2088075 - protein, 17 aa, Staphylococcus
VMSIVREAKLLIVDEPT

SEQ ID NO: 2088076 - protein, 26 aa, Staphylococcus
VMTSLKVLDFTLFKATIGDIYGSPLI

SEQ ID NO: 2088077 - protein, 19 aa, Staphylococcus
VMVEDLNFNYLQNDDTPLI

SEQ ID NO: 2088078 - protein, 25 aa, Staphylococcus
VMVSDYQFDPLKNQITHIDFLAINM

SEQ ID NO: 2088079 - protein, 18 aa, Staphylococcus
VMWDFAKDKGLIDLAEKI

SEQ ID NO: 2088080 - protein, 18 aa, Staphylococcus
VMYFGKIVELGPSEEIYH

SEQ ID NO: 2088081 - protein, 27 aa, Staphylococcus
VNAAISTTLLIEKFNPKFIINTGSAGA

SEQ ID NO: 2088082 - protein, 18 aa, Staphylococcus
VNAALHYLARLIEAGDLP

SEQ ID NO: 2088083 - protein, 20 aa, Staphylococcus
VNADRLLDFKARLSEELKDA

SEQ ID NO: 2088084 - protein, 28 aa, Staphylococcus
VNAEQFRQLFILPQGEFKKFLLSNSKEK

SEQ ID NO: 2088085 - protein, 28 aa, Staphylococcus
VNAEQFRQLFILPQGEFKKFLQSNSKEK

SEQ ID NO: 2088086 - protein, 28 aa, Staphylococcus
VNAEQFRQLFILPQGEFKKFLVSNSTDK

SEQ ID NO: 2088087 - protein, 35 aa, Staphylococcus
VNAEQFRQLFILPQGEFKRFLLSKSVEKQDILRTL

SEQ ID NO: 2088088 - protein, 29 aa, Staphylococcus
VNAEQFRQLFILPQGEFKRFLVSSSSDKQ

SEQ ID NO: 2088089 - protein, 20 aa, Staphylococcus
VNAMLRSTLQRGVTYHISEE

SEQ ID NO: 2088090 - protein, 25 aa, Staphylococcus
VNAQNKLILKFNPNANIYGFIVGTT

SEQ ID NO: 2088091 - protein, 21 aa, Staphylococcus
VNCVAPGPFWSPLQITGGQPQ

SEQ ID NO: 2088092 - protein, 32 aa, Staphylococcus
VNDASFFKLKGPLWFVARDLYQELYLGSELFK

SEQ ID NO: 2088093 - protein, 17 aa, Staphylococcus
VNDGDAVIFFNFRPDRA

SEQ ID NO: 2088094 - protein, 24 aa, Staphylococcus
VNDGDAVIFYNFRPDRAAQLSEVF

SEQ ID NO: 2088095 - protein, 24 aa, Staphylococcus
VNDGDAVIFYNFRPDRAGQLSEIF

SEQ ID NO: 2088096 - protein, 24 aa, Staphylococcus
VNDGDAVVFYNFRPDRAAQLSEIF

SEQ ID NO: 2088097 - protein, 20 aa, Staphylococcus
VNDIIKAQPVAPNSNQEDAA

SEQ ID NO: 2088098 - protein, 17 aa, Staphylococcus
VNDLGVELVIDEALREA

SEQ ID NO: 2088099 - protein, 29 aa, Staphylococcus
VNDRDVRDYLPFESLILDLNQPFDVTETK

SEQ ID NO: 2088100 - protein, 29 aa, Staphylococcus
VNDRDVREYLPFESLILDLNQPFDVTETK

SEQ ID NO: 2088101 - protein, 26 aa, Staphylococcus
VNDTEFYYYAILREGLYRIADTSTIP

SEQ ID NO: 2088102 - protein, 25 aa, Staphylococcus
VNEDKIIGHILLSKILIDTEDKKVE

SEQ ID NO: 2088103 - protein, 21 aa, Staphylococcus
VNEFILTPTLDELFAYYAKKY

SEQ ID NO: 2088104 - protein, 24 aa, Staphylococcus
VNEGDAFTFDKVLFVGGDAVKVGA

SEQ ID NO: 2088105 - protein, 20 aa, Staphylococcus
VNEIKIIKPVLLKAKTSFNN

SEQ ID NO: 2088106 - protein, 23 aa, Staphylococcus
VNEKIRVHTPSQMGIRKPEFTSA

SEQ ID NO: 2088107 - protein, 18 aa, Staphylococcus
VNEKVRIHTPSQMGIRKP

SEQ ID NO: 2088108 - protein, 18 aa, Staphylococcus
VNELLVTTSIFKNVFNLT

SEQ ID NO: 2088109 - protein, 29 aa, Staphylococcus
VNERDVREYLPFESLILDLNQPFDVTETK

SEQ ID NO: 2088110 - protein, 22 aa, Staphylococcus
VNESDEWFFKGFDLYIEYDAQK

SEQ ID NO: 2088111 - protein, 17 aa, Staphylococcus
VNEVIKRLNYRPNAVAR

SEQ ID NO: 2088112 - protein, 18 aa, Staphylococcus
VNEVIKRLNYRPNAVARG

SEQ ID NO: 2088113 - protein, 17 aa, Staphylococcus
VNEVKIEFMIKASQYAL

SEQ ID NO: 2088114 - protein, 27 aa, Staphylococcus
VNEWEFEKLVRIFHRYGEEKFSKQIAR

SEQ ID NO: 2088115 - protein, 18 aa, Staphylococcus
VNFADLKKLIHNQFDHHL

SEQ ID NO: 2088116 - protein, 19 aa, Staphylococcus
VNFNHGLPILVMDGSKNKS

SEQ ID NO: 2088117 - protein, 17 aa, Staphylococcus
VNFRNGTEYIAVSGGFV

SEQ ID NO: 2088118 - protein, 40 aa, Staphylococcus
VNGNRGYILYFVDKYKIKMPFLDQLLINYLNQEIGQESIN

SEQ ID NO: 2088119 - protein, 29 aa, Staphylococcus
VNGRDVRSYLPFESLILDINQAFDVTETK

SEQ ID NO: 2088120 - protein, 26 aa, Staphylococcus
VNGSVSDRLLLKRYLWNEDYKAKGRK

SEQ ID NO: 2088121 - protein, 24 aa, Staphylococcus
VNHAEAMIIAIKELLAKGIDRIDY

SEQ ID NO: 2088122 - protein, 32 aa, Staphylococcus
VNHLQSLLNFLKIPNRIIPIIKIAISHYYFGY

SEQ ID NO: 2088123 - protein, 25 aa, Staphylococcus
VNIADKILIGGGMAYTFIKAQGHEI

SEQ ID NO: 2088124 - protein, 25 aa, Staphylococcus
VNIADKILIGGGMAYTFMKAQGKEI

SEQ ID NO: 2088125 - protein, 19 aa, Staphylococcus
VNIALYQLLADWNPMHFED

SEQ ID NO: 2088126 - protein, 23 aa, Staphylococcus
VNIDHLEAILPVVKEIAYKHCAL

SEQ ID NO: 2088127 - protein, 30 aa, Staphylococcus; identical to SEQ ID NO: 1689505

SEQ ID NO: 2088128 - protein, 17 aa, Staphylococcus
VNIIDYKSSGYSGTLDL

SEQ ID NO: 2088129 - protein, 19 aa, Staphylococcus
VNIIMTRMPNLSFVLEGEK

SEQ ID NO: 2088130 - protein, 17 aa, Staphylococcus
VNIVACENAIMATNTLK

SEQ ID NO: 2088131 - protein, 23 aa, Staphylococcus
VNIVWSPPWNKDMMSRYAKIALG

SEQ ID NO: 2088132 - protein, 24 aa, Staphylococcus
VNKAAKFLLSLYNVFVEKDCSIVE

SEQ ID NO: 2088133 - protein, 23 aa, Staphylococcus
VNKKLIYQEWLENEVKPLEFNIY

SEQ ID NO: 2088134 - protein, 23 aa, Staphylococcus
VNKKVHAVFKHGMTPIICVGETN

SEQ ID NO: 2088135 - protein, 17 aa, Staphylococcus
VNKLDNYIKYANKVRFI

SEQ ID NO: 2088136 - protein, 18 aa, Staphylococcus
VNKPEAKLFILLVGERPE

SEQ ID NO: 2088137 - protein, 18 aa, Staphylococcus
VNKYLLPHRSIIFSSDEA

SEQ ID NO: 2088138 - protein, 25 aa, Staphylococcus
VNLDIRAQYGINIIAIKRGKEIIVS

SEQ ID NO: 2088139 - protein, 25 aa, Staphylococcus
VNLHLMELLIMIDACRRASAANINI

SEQ ID NO: 2088140 - protein, 24 aa, Staphylococcus
VNLKGVLYGIGAVVPKMRAQKSGH

SEQ ID NO: 2088141 - protein, 23 aa, Staphylococcus
VNLLGNGSAYYAPAAALYEMVIA

SEQ ID NO: 2088142 - protein, 18 aa, Staphylococcus
VNLLKQPTHLQLDYIPSL

SEQ ID NO: 2088143 - protein, 20 aa, Staphylococcus
VNLLLKLQREKNITFLFIAH

SEQ ID NO: 2088144 - protein, 27 aa, Staphylococcus
VNLMDKMNLRLVDFKIEFGRTNEGEIL

SEQ ID NO: 2088145 - protein, 25 aa, Staphylococcus
VNLNGKRYRLCDVYKYFDVADSTVR

SEQ ID NO: 2088146 - protein, 33 aa, Staphylococcus
VNLPTKEFQLLFLLCGQPKHIFTRDTLIERIWG

SEQ ID NO: 2088147 - protein, 27 aa, Staphylococcus
VNLQSLQPFALLAANSIFVGDYLITGG

SEQ ID NO: 2088148 - protein, 25 aa, Staphylococcus
VNLRSILEKPAFKNAESKLTVAMGL

SEQ ID NO: 2088149 - protein, 23 aa, Staphylococcus
VNLVKFYHPKLTIKSSILELIKE

SEQ ID NO: 2088150 - protein, 20 aa, Staphylococcus
VNMALYDAYLLAKSIERNED

SEQ ID NO: 2088151 - protein, 21 aa, Staphylococcus
VNMIALVNGRPKLINLKEALI

SEQ ID NO: 2088152 - protein, 23 aa, Staphylococcus
VNMIALVNGRPKLINLKEALVHY

SEQ ID NO: 2088153 - protein, 23 aa, Staphylococcus
VNMIALVNGRPKLINLKQALVEY

SEQ ID NO: 2088154 - protein, 17 aa, Staphylococcus
VNMRQKISWFKEQVSDV

SEQ ID NO: 2088155 - protein, 17 aa, Staphylococcus
VNMTRLRKKLQSIGIVD

SEQ ID NO: 2088156 - protein, 24 aa, Staphylococcus
VNNKDWLGQISLIDFLRDYGKHVG

SEQ ID NO: 2088157 - protein, 26 aa, Staphylococcus
VNNKFIISSWLGTMGCGLPGAIAAKI

SEQ ID NO: 2088158 - protein, 25 aa, Staphylococcus
VNNKFIISSWLGTMGCGLPGAIASK

SEQ ID NO: 2088159 - protein, 29 aa, Staphylococcus
VNNKFIVSSWLGTMGCALPGAIAAKRAYP

SEQ ID NO: 2088160 - protein, 20 aa, Staphylococcus
VNNLKQYYPIKGGFFRRTVG

SEQ ID NO: 2088161 - protein, 25 aa, Staphylococcus
VNNRDWLGKISLIDFLRDYGKHVGV

SEQ ID NO: 2088162 - protein, 18 aa, Staphylococcus
VNPFRIEGQKTGAFELVE

SEQ ID NO: 2088163 - protein, 17 aa, Staphylococcus
VNPPKSWTYTVSEDAKL

SEQ ID NO: 2088164 - protein, 23 aa, Staphylococcus
VNQAIKNWDYLISPSPYASACFK

SEQ ID NO: 2088165 - protein, 24 aa, Staphylococcus
VNQAIKNWDYLISPSPYASKCFKS

SEQ ID NO: 2088166 - protein, 31 aa, Staphylococcus
VNQAPHQIDLLQWLCGLPKKVYANVKYGYQR

SEQ ID NO: 2088167 - protein, 24 aa, Staphylococcus
VNQLKYIPYGYPLTNQTIYILNNE

SEQ ID NO: 2088168 - protein, 19 aa, Staphylococcus
VNQMLFSLKLTAHAAYGIS

SEQ ID NO: 2088169 - protein, 25 aa, Staphylococcus
VNQNVHFEVLLVKIAEMMKTSPENV

SEQ ID NO: 2088170 - protein, 26 aa, Staphylococcus
VNQNVHFEVLLVKLAEMIKAQPQTVQ

SEQ ID NO: 2088171 - protein, 25 aa, Staphylococcus
VNQNVHFEVLLVKLAEMVKTNPTKV

SEQ ID NO: 2088172 - protein, 25 aa, Staphylococcus
VNQSVHFEVLLVKLAEMIKAKPETV

SEQ ID NO: 2088173 - protein, 24 aa, Staphylococcus
VNQYAVFQYPPYDISLSTKIASVI

SEQ ID NO: 2088174 - protein, 24 aa, Staphylococcus
VNQYAVFQYPPYDITLSTKISDVI

SEQ ID NO: 2088175 - protein, 20 aa, Staphylococcus
VNRAGSMIGYFLNAGPVTNF

SEQ ID NO: 2088176 - protein, 23 aa, Staphylococcus
VNRAGSMIGYFLNEGPVTNFDEA

SEQ ID NO: 2088177 - protein, 23 aa, Staphylococcus
VNRAGSMIGYFLNEGPVTNFEQA

SEQ ID NO: 2088178 - protein, 24 aa, Staphylococcus
VNRAGSMIGYFLNKGPVTNFEEAN

SEQ ID NO: 2088179 - protein, 19 aa, Staphylococcus
VNREGIIAHIPQFSQWTSH

SEQ ID NO: 2088180 - protein, 26 aa, Staphylococcus
VNRHQLPVVSTLLGLGAIPYEHPLFL

SEQ ID NO: 2088181 - protein, 26 aa, Staphylococcus
VNRLINDMIYFVRDTIMIKTSNESIE

SEQ ID NO: 2088182 - protein, 24 aa, Staphylococcus
VNRLINDMIYFVRDTIMNKTINEQ

SEQ ID NO: 2088183 - protein, 25 aa, Staphylococcus
VNRLINDMIYFVRDTIMNKTSNQEV

SEQ ID NO: 2088184 - protein, 24 aa, Staphylococcus
VNRLINDMIYFVRDTIMNKTVNNH

SEQ ID NO: 2088185 - protein, 23 aa, Staphylococcus
VNRLINDMIYFVRDTIMSKTADE

SEQ ID NO: 2088186 - protein, 21 aa, Staphylococcus
VNRTIDFITEAQLAYIQNEIQ

SEQ ID NO: 2088187 - protein, 24 aa, Staphylococcus
VNRVYAKEILLKTVWYAEVENAGG

SEQ ID NO: 2088188 - protein, 23 aa, Staphylococcus
VNSDFVIGAVLIPGAKAPKLVTE

SEQ ID NO: 2088189 - protein, 24 aa, Staphylococcus
VNSDWIVPLPEHLTLEETMIYGTA

SEQ ID NO: 2088190 - protein, 25 aa, Staphylococcus
VNSVVEYARNNNLKIIASCPFAKDV

SEQ ID NO: 2088191 - protein, 22 aa, Staphylococcus
VNSYVRDTIVFKGTFKMFYISE

SEQ ID NO: 2088192 - protein, 26 aa, Staphylococcus
VNTFPTPPIFDWLQQQGQISTDEMYN

SEQ ID NO: 2088193 - protein, 27 aa, Staphylococcus
VNTKGESMIPLIKKLSADNVRLNVTAV

SEQ ID NO: 2088194 - protein, 26 aa, Staphylococcus
VNTKGRMIMLYLTSDWFTEQGFSFFE

SEQ ID NO: 2088195 - protein, 17 aa, Staphylococcus
VNTLPHFQIRETQGNNG

SEQ ID NO: 2088196 - protein, 17 aa, Staphylococcus
VNTWWETEKDFEAWTKS

SEQ ID NO: 2088197 - protein, 24 aa, Staphylococcus
VNVHLMELLIMIDACKRASAATIN

SEQ ID NO: 2088198 - protein, 17 aa, Staphylococcus
VNVITGLIKANIPTRIA

SEQ ID NO: 2088199 - protein, 25 aa, Staphylococcus
VNVPNATFMIIYDADRFGLSTLHQL

SEQ ID NO: 2088200 - protein, 25 aa, Staphylococcus
VNVRNIFKQFVDCPVYVDNDANVAA

SEQ ID NO: 2088201 - protein, 25 aa, Staphylococcus
VNVRSGEFYFVPAGTIHSIGAGIVA

SEQ ID NO: 2088202 - protein, 27 aa, Staphylococcus
VNYDGINKFRTVIGRDAFIGCNTNLIA

SEQ ID NO: 2088203 - protein, 22 aa, Staphylococcus
VNYKSIYLKISLKDSYDPDIQL

SEQ ID NO: 2088204 - protein, 26 aa, Staphylococcus
VNYLSLEEFFAKAIHFWSNDAELLML

SEQ ID NO: 2088205 - protein, 18 aa, Staphylococcus
VNYLTKELNFDAGVDYKK

SEQ ID NO: 2088206 - protein, 23 aa, Staphylococcus
VNYSQIFLIILGAEPSFVFKNTI

SEQ ID NO: 2088207 - protein, 25 aa, Staphylococcus
VPCDNAILPIFDQIFTRIGAADDLV

SEQ ID NO: 2088208 - protein, 20 aa, Staphylococcus
VPCESAILPVFDQIFTRIGA

SEQ ID NO: 2088209 - protein, 23 aa, Staphylococcus
VPCGSAVLPIFDQIFTRIGAADD

SEQ ID NO: 2088210 - protein, 25 aa, Staphylococcus
VPCNKAELPIFDQIFTRIGAADDLV

SEQ ID NO: 2088211 - protein, 19 aa, Staphylococcus
VPCTPLGIMELLKNADIDL

SEQ ID NO: 2088212 - protein, 27 aa, Staphylococcus
VPDDIAGPVMFLASDWSRFMTGQVLYV

SEQ ID NO: 2088213 - protein, 25 aa, Staphylococcus
VPDHIYRVVVLVNPTLDLIKQVFNE

SEQ ID NO: 2088214 - protein, 25 aa, Staphylococcus
VPDRDIPRFINLYHQGRLPVNELLT

SEQ ID NO: 2088215 - protein, 26 aa, Staphylococcus
VPDRDIPRFVSLYKQGRLNIDPLISE

SEQ ID NO: 2088216 - protein, 25 aa, Staphylococcus
VPDRDIPRFVSLYQQERLNIDPLIS

SEQ ID NO: 2088217 - protein, 23 aa, Staphylococcus
VPDSLSHFLPKEAIYIKLCDNVT

SEQ ID NO: 2088218 - protein, 24 aa, Staphylococcus
VPDSRYMIFYDQEFDLYTKTSRDS

SEQ ID NO: 2088219 - protein, 26 aa, Staphylococcus
VPDTEVIDVFPIRFIVDGDNEVSDPK

SEQ ID NO: 2088220 - protein, 25 aa, Staphylococcus
VPDYQPIDVLFEDQYFIAVSKGKKQ

SEQ ID NO: 2088221 - protein, 18 aa, Staphylococcus
VPEIALTPQMVLRFKKRF

SEQ ID NO: 2088222 - protein, 18 aa, Staphylococcus
VPEIALTPQMVLRVKRRF

SEQ ID NO: 2088223 - protein, 22 aa, Staphylococcus
VPETEIINAFPIKFVVDGENEV

SEQ ID NO: 2088224 - protein, 25 aa, Staphylococcus
VPETEVINVFPIRFVVDKENEVSDP

SEQ ID NO: 2088225 - protein, 19 aa, Staphylococcus
VPEWANWDHFNELDKKGLI

SEQ ID NO: 2088226 - protein, 21 aa, Staphylococcus
VPFACARFRPYNNAAKVERVA

SEQ ID NO: 2088227 - protein, 17 aa, Staphylococcus
VPFLLEILTYDDQIGDE

SEQ ID NO: 2088228 - protein, 17 aa, Staphylococcus
VPFRTLTGRQSYYIDHE

SEQ ID NO: 2088229 - protein, 20 aa, Staphylococcus
VPGAFEIPLVAKKLARKGDY

SEQ ID NO: 2088230 - protein, 27 aa, Staphylococcus
VPGIDFSNDPLLQGRLFSYTDTQISRL

SEQ ID NO: 2088231 - protein, 18 aa, Staphylococcus
VPGIGPSKAKEILNYKEQ

SEQ ID NO: 2088232 - protein, 23 aa, Staphylococcus
VPGIWPHIRLNNCDWIDGGMVSP

SEQ ID NO: 2088233 - protein, 19 aa, Staphylococcus
VPGLDFSPDKVLQGRLFSY

SEQ ID NO: 2088234 - protein, 38 aa, Staphylococcus
VPGVLFGLKPRLEPSRKDMLNFLLTSGAFGFVVANNAS

SEQ ID NO: 2088235 - protein, 25 aa, Staphylococcus
VPHQLPIDWISIPYGTALKGQMYKV

SEQ ID NO: 2088236 - protein, 25 aa, Staphylococcus
VPHVYAIGDLVAGYQLAHTASAHGA

SEQ ID NO: 2088237 - protein, 28 aa, Staphylococcus
VPHYTKRLFFDLQSNGYIPIIAHPERNK

SEQ ID NO: 2088238 - protein, 19 aa, Staphylococcus
VPIHYNTFPLIEQNPQEFK

SEQ ID NO: 2088239 - protein, 19 aa, Staphylococcus
VPIKAIIDSLTTFSGIDHR

SEQ ID NO: 2088240 - protein, 26 aa, Staphylococcus
VPITSKEPFIIRKTLKGLSLKDVSLS

SEQ ID NO: 2088241 - protein, 20 aa, Staphylococcus
VPIVDKLTLDMIKQLIRMNH

SEQ ID NO: 2088242 - protein, 31 aa, Staphylococcus
VPIVDRLTLDLIKQLIRIHKPQSILEIGTAI

SEQ ID NO: 2088243 - protein, 17 aa, Staphylococcus
VPIVKAYMDMKSDVLKF

SEQ ID NO: 2088244 - protein, 22 aa, Staphylococcus
VPKVDIILTIPPYELRTEDSRN

SEQ ID NO: 2088245 - protein, 18 aa, Staphylococcus
VPLAARHFEYFASVIDTD

SEQ ID NO: 2088246 - protein, 18 aa, Staphylococcus
VPLIGFTGAPFTLASYMI

SEQ ID NO: 2088247 - protein, 18 aa, Staphylococcus
VPMQAFDTYFEDYKQRHN

SEQ ID NO: 2088248 - protein, 24 aa, Staphylococcus
VPNAKIVFISPQNDDYIASIKKNT

SEQ ID NO: 2088249 - protein, 19 aa, Staphylococcus
VPNGFYYPKDSEAKVFIPK

SEQ ID NO: 2088250 - protein, 19 aa, Staphylococcus
VPNLTYPILIQTGDKNILI

SEQ ID NO: 2088251 - protein, 17 aa, Staphylococcus
VPNTAWLQDAIELNGRG

SEQ ID NO: 2088252 - protein, 31 aa, Staphylococcus
VPNTFVPARNLLFLSFAGALAYQIKARHIIT

SEQ ID NO: 2088253 - protein, 23 aa, Staphylococcus
VPQDAWYIRFSTLTSAINSTMLV

SEQ ID NO: 2088254 - protein, 20 aa, Staphylococcus
VPQSSYHKLALKKKIEEKKQ

SEQ ID NO: 2088255 - protein, 26 aa, Staphylococcus
VPQYKNHFVANLFFENSTRTKCSFEV

SEQ ID NO: 2088256 - protein, 24 aa, Staphylococcus
VPRGLPVIPEAYTPKLKRVNRKPI

SEQ ID NO: 2088257 - protein, 23 aa, Staphylococcus
VPRPVAMRLAIQRIFNWMKEIEE

SEQ ID NO: 2088258 - protein, 38 aa, Staphylococcus
VPRQIFEQRFGVEALYQDAVDILLPEAYGEAIDETGIN

SEQ ID NO: 2088259 - protein, 25 aa, Staphylococcus
VPRTDWDWMIYPKGLYDQIMRVVKD

SEQ ID NO: 2088260 - protein, 25 aa, Staphylococcus
VPRTDWDWMIYPKGLYDQIMRVVKE

SEQ ID NO: 2088261 - protein, 25 aa, Staphylococcus
VPRTDWDWMIYPQGLYDQIMRVIKD

SEQ ID NO: 2088262 - protein, 23 aa, Staphylococcus
VPSAIFGTKKRRPIENGIIPDVE

SEQ ID NO: 2088263 - protein, 18 aa, Staphylococcus
VPSAIFGTKQRRPLENGV

SEQ ID NO: 2088264 - protein, 26 aa, Staphylococcus
VPSANADRLYFLKQHTLISELVFDEI

SEQ ID NO: 2088265 - protein, 30 aa, Staphylococcus
VPTDDQWDAMLLGWKVIPSVKSNAVILSNS

SEQ ID NO: 2088266 - protein, 28 aa, Staphylococcus
VPTELIFYVYGTSLYGFMEWIRDNDIQL

SEQ ID NO: 2088267 - protein, 17 aa, Staphylococcus
VPVIVKEVGFGMSKETF

SEQ ID NO: 2088268 - protein, 18 aa, Staphylococcus
VPVIVKEVGFGMSKETYK

SEQ ID NO: 2088269 - protein, 17 aa, Staphylococcus
VPVIVKEVGFGMSRELI

SEQ ID NO: 2088270 - protein, 18 aa, Staphylococcus
VPVKAIIDSLTTFSGIEH

SEQ ID NO: 2088271 - protein, 18 aa, Staphylococcus
VPVLSMVDYVLVMTVNPG

SEQ ID NO: 2088272 - protein, 17 aa, Staphylococcus
VPVYNKELFLDDTMNSI

SEQ ID NO: 2088273 - protein, 18 aa, Staphylococcus
VPYDLPINNNDYFKYEGK

SEQ ID NO: 2088274 - protein, 28 aa, Staphylococcus
VPYLLKQINVPIYGGPLALGLIRNKLEE

SEQ ID NO: 2088275 - protein, 31 aa, Staphylococcus
VPYLLKQINVPIYGGPLALGLIRNKLEEHNL

SEQ ID NO: 2088276 - protein, 17 aa, Staphylococcus
VPYQLHFEDYSPEEVAD

SEQ ID NO: 2088277 - protein, 18 aa, Staphylococcus
VQALFPDFNHLYLVVDTE

SEQ ID NO: 2088278 - protein, 21 aa, Staphylococcus
VQAPYQIVYFDFFATKDGDKD

SEQ ID NO: 2088279 - protein, 28 aa, Staphylococcus
VQCFDLANQYWLYLFNHGLKGVGAADIP

SEQ ID NO: 2088280 - protein, 24 aa, Staphylococcus
VQDGDAVIFFNFRPDRAAQLSEIF

SEQ ID NO: 2088281 - protein, 22 aa, Staphylococcus
VQDGTLVILGALTTYRMETSYQ

SEQ ID NO: 2088282 - protein, 25 aa, Staphylococcus
VQDHFTTVFKQLFGGGQAELRLTED

SEQ ID NO: 2088283 - protein, 22 aa, Staphylococcus
VQDLLIPMTFHFSKDEQIIINQ

SEQ ID NO: 2088284 - protein, 19 aa, Staphylococcus
VQDLWDHRKKFKEIAAEQG

SEQ ID NO: 2088285 - protein, 17 aa, Staphylococcus
VQDPERLPVDELILYIY

SEQ ID NO: 2088286 - protein, 23 aa, Staphylococcus
VQDYRYYIKPAMNKLISGIKEKY

SEQ ID NO: 2088287 - protein, 37 aa, Staphylococcus
VQEEPKNQGAWLFVYPYLRALVADRYDLSYHGRIQRA

SEQ ID NO: 2088288 - protein, 37 aa, Staphylococcus
VQEEPKNQGAWLFVYPYLRALVGDKYDLSYHGRIQRA

SEQ ID NO: 2088289 - protein, 38 aa, Staphylococcus
VQEEPQNQGAWLYAYPHLKSITPEQINLSYHGRIKRAA

SEQ ID NO: 2088290 - protein, 23 aa, Staphylococcus
VQEPRYILLDEPTTYLDIHYQYQ

SEQ ID NO: 2088291 - protein, 24 aa, Staphylococcus
VQETLIRIYLALHTFDFSTDVPFE

SEQ ID NO: 2088292 - protein, 23 aa, Staphylococcus
VQEVRAWTFKQGMTAPQCAGIIH

SEQ ID NO: 2088293 - protein, 23 aa, Staphylococcus
VQEVRAWTFVQGMTAPQCAGIIH

SEQ ID NO: 2088294 - protein, 20 aa, Staphylococcus
VQEYAPILYQIWKKKHKKAN

SEQ ID NO: 2088295 - protein, 24 aa, Staphylococcus
VQFQYGLALCHLEMFNQAINQLKI

SEQ ID NO: 2088296 - protein, 24 aa, Staphylococcus
VQFQYGLTLCHLEMFQEAIKQLNY

SEQ ID NO: 2088297 - protein, 26 aa, Staphylococcus
VQFSDIEFLPPVTPPNNVIAFGRNYK

SEQ ID NO: 2088298 - protein, 19 aa, Staphylococcus
VQGFAEGKLFLEYLENNEQ

SEQ ID NO: 2088299 - protein, 22 aa, Staphylococcus
VQGLINGLVPYIYTAGNNTVVV

SEQ ID NO: 2088300 - protein, 27 aa, Staphylococcus
VQHTKYHAKLLLQVHDELIFEVPKDEV

SEQ ID NO: 2088301 - protein, 18 aa, Staphylococcus
VQIHAFIAQVDRAFLSSN

SEQ ID NO: 2088302 - protein, 23 aa, Staphylococcus
VQKFNDWLISLENYSTNFINMDD

SEQ ID NO: 2088303 - protein, 23 aa, Staphylococcus
VQLAQAILLDEHPIEPVSASVNG

SEQ ID NO: 2088304 - protein, 19 aa, Staphylococcus
VQLKALYLTVIDRIDIRKD

SEQ ID NO: 2088305 - protein, 27 aa, Staphylococcus
VQLPKYDGFYWCRKIRQVSNVPILFLS

SEQ ID NO: 2088306 - protein, 32 aa, Staphylococcus
VQLPLEIPSANLLPYLKPLDILFEDDYIIIVS

SEQ ID NO: 2088307 - protein, 19 aa, Staphylococcus
VQMGIIKMKLPIADLEKKK

SEQ ID NO: 2088308 - protein, 34 aa, Staphylococcus
VQMLRAQSAFFNDGNMLKPWYVNSISNPVSKDTF

SEQ ID NO: 2088309 - protein, 21 aa, Staphylococcus
VQNFLNAYVDFAPMPHARQTK

SEQ ID NO: 2088310 - protein, 20 aa, Staphylococcus
VQNGDLIIITAGVPTGEKGT

SEQ ID NO: 2088311 - protein, 23 aa, Staphylococcus
VQNGDLLIITAGVPTGEKGTTNM

SEQ ID NO: 2088312 - protein, 27 aa, Staphylococcus
VQNGEWQSWGPYLFAGKDLSNANVGIY

SEQ ID NO: 2088313 - protein, 18 aa, Staphylococcus
VQNLYRIKTYKHKLKEIE

SEQ ID NO: 2088314 - protein, 23 aa, Staphylococcus
VQNSLVLCHIYLREYQQAKRICE

SEQ ID NO: 2088315 - protein, 18 aa, Staphylococcus
VQPFKLNQPIIGHVLARV

SEQ ID NO: 2088316 - protein, 17 aa, Staphylococcus
VQQAGAVMLVLEAVPSD

SEQ ID NO: 2088317 - protein, 27 aa, Staphylococcus
VQQALDWTLDYDKFVITLCHGPAALLS

SEQ ID NO: 2088318 - protein, 33 aa, Staphylococcus
VQQLASINVPEARLLVISPYDKSSVADIEKAIY

SEQ ID NO: 2088319 - protein, 33 aa, Staphylococcus; identical to SEQ ID NO: 1681339

SEQ ID NO: 2088320 - protein, 32 aa, Staphylococcus
VQQLASINVPEARLLVISPYDKTSVDDIEKAI

SEQ ID NO: 2088321 - protein, 32 aa, Staphylococcus
VQQLASINVPEARLLVISPYDKTSVKDIERAI

SEQ ID NO: 2088322 - protein, 24 aa, Staphylococcus
VQRDFNGLSFLNLVDFDALYGHRR

SEQ ID NO: 2088323 - protein, 19 aa, Staphylococcus
VQRLLTTFENKPVYLHVET

SEQ ID NO: 2088324 - protein, 22 aa, Staphylococcus
VQRQMLETIPGLEKADMMRAGY

SEQ ID NO: 2088325 - protein, 17 aa, Staphylococcus
VQRVDVPVIIKEVGFGM

SEQ ID NO: 2088326 - protein, 18 aa, Staphylococcus
VQSFLDYNNEFKVSGLVG

SEQ ID NO: 2088327 - protein, 37 aa, Staphylococcus
VQSFPVGVVGAITPWNFPAAMITRKMAPALAAGCTIV

SEQ ID NO: 2088328 - protein, 33 aa, Staphylococcus
VQSLVIIIRSVFKYVFKYYDLQDISVLDKIDIP

SEQ ID NO: 2088329 - protein, 20 aa, Staphylococcus
VQTASSYIFKNILWEVYQHQ

SEQ ID NO: 2088330 - protein, 25 aa, Staphylococcus
VQTASSYIFKNILWEVYQHQCNQED

SEQ ID NO: 2088331 - protein, 33 aa, Staphylococcus
VQTECSQIYIVPYLWFTGILDQQIIDTVTEYQN

SEQ ID NO: 2088332 - protein, 17 aa, Staphylococcus
VQTGISGILIGGALMNC

SEQ ID NO: 2088333 - protein, 19 aa, Staphylococcus
VQTLFPNFNHLYLVVDAEN

SEQ ID NO: 2088334 - protein, 18 aa, Staphylococcus
VQTLLSKDPDFLQAYFYL

SEQ ID NO: 2088335 - protein, 29 aa, Staphylococcus
VQTVGKGGLLITLARISAHYGLGLEASID

SEQ ID NO: 2088336 - protein, 27 aa, Staphylococcus
VQTVGKGGLLITLARISAHYSLGLKAK

SEQ ID NO: 2088337 - protein, 29 aa, Staphylococcus
VQTVGKGGLLLTLAKISAYYNLGLHAQLD

SEQ ID NO: 2088338 - protein, 21 aa, Staphylococcus
VQVRHREKYYFPGGKIDEGET

SEQ ID NO: 2088339 - protein, 18 aa, Staphylococcus
VQVRHREKYYFPGGKIEA

SEQ ID NO: 2088340 - protein, 23 aa, Staphylococcus
VQWLIDEGYTLLTLPKAYGGEGG

SEQ ID NO: 2088341 - protein, 25 aa, Staphylococcus
VQYDYLVEDLLKQLGIPFNHEDRKV

SEQ ID NO: 2088342 - protein, 17 aa, Staphylococcus
VQYKHGDIWLLYAKHQD

SEQ ID NO: 2088343 - protein, 24 aa, Staphylococcus
VRAEQVIMFFNYNEIIDTVNEDQN

SEQ ID NO: 2088344 - protein, 17 aa, Staphylococcus
VRAFTASAGPGLSLMME

SEQ ID NO: 2088345 - protein, 28 aa, Staphylococcus
VRAGHHCAQPLMKWLNQSSTARASFYIY

SEQ ID NO: 2088346 - protein, 18 aa, Staphylococcus
VRARLYPELPRTEYICFY

SEQ ID NO: 2088347 - protein, 31 aa, Staphylococcus
VRATHRKSGYGQLLMQFLETSAKQQGYSKLA

SEQ ID NO: 2088348 - protein, 27 aa, Staphylococcus
VRDEIIGPLLHYRMVHELPTFFSSNFD

SEQ ID NO: 2088349 - protein, 22 aa, Staphylococcus
VRDKTDLLVYLSSKDIYIGNTV

SEQ ID NO: 2088350 - protein, 22 aa, Staphylococcus
VRDKVLIFSGRISSEILIKAAK

SEQ ID NO: 2088351 - protein, 22 aa, Staphylococcus
VRDRTKLLIYLSSKSISIGDEI

SEQ ID NO: 2088352 - protein, 25 aa, Staphylococcus
VREDAQLLYGFINQEEKDMFLSLIK

SEQ ID NO: 2088353 - protein, 23 aa, Staphylococcus
VREDAQLLYGFMSEEEKGMFLSL

SEQ ID NO: 2088354 - protein, 27 aa, Staphylococcus
VREFIEAFKIPTIVTLPAKGILADDHP

SEQ ID NO: 2088355 - protein, 35 aa, Staphylococcus
VRELGIELGIPEHLVWRQPFPGPGLGIRVLGEITE

SEQ ID NO: 2088356 - protein, 28 aa, Staphylococcus
VRENEIHMTLPSLAYYYEHKEDLEGVHV

SEQ ID NO: 2088357 - protein, 24 aa, Staphylococcus
VRESVFNMMNWWFEKGIDGFRVDA

SEQ ID NO: 2088358 - protein, 32 aa, Staphylococcus
VRHDNATLCYIYKFRARFAVLAKIIADREGLS

SEQ ID NO: 2088359 - protein, 22 aa, Staphylococcus
VRIAQYLVDHGASFFAVATLDE

SEQ ID NO: 2088360 - protein, 18 aa, Staphylococcus
VRIILRVPPLAASLKEMY

SEQ ID NO: 2088361 - protein, 20 aa, Staphylococcus
VRILFVAATAPFTPFYRALD

SEQ ID NO: 2088362 - protein, 21 aa, Staphylococcus
VRIQWRVADIKIPTSEIKNIS

SEQ ID NO: 2088363 - protein, 19 aa, Staphylococcus
VRITHLPTGIIATSSEKSQ

SEQ ID NO: 2088364 - protein, 26 aa, Staphylococcus
VRITNFPFYYRGEVYDPFYGNTLSDQ

SEQ ID NO: 2088365 - protein, 22 aa, Staphylococcus
VRIVNFPFYYRGEVYDPFNGNT

SEQ ID NO: 2088366 - protein, 19 aa, Staphylococcus
VRKIVQHLEERGYQLSKTE

SEQ ID NO: 2088367 - protein, 17 aa, Staphylococcus
VRKKYDMPIIMLTAKDS

SEQ ID NO: 2088368 - protein, 17 aa, Staphylococcus
VRKKYEMPIIMLTAKDS

SEQ ID NO: 2088369 - protein, 18 aa, Staphylococcus
VRKKYEMPIIMLTAKDSE

SEQ ID NO: 2088370 - protein, 23 aa, Staphylococcus
VRKLCLYLDVSADIYFLNVSSEN

SEQ ID NO: 2088371 - protein, 18 aa, Staphylococcus
VRKLLKRMDKYIKFDTIE

SEQ ID NO: 2088372 - protein, 19 aa, Staphylococcus
VRKNIPSKLILLGDGPELL

SEQ ID NO: 2088373 - protein, 21 aa, Staphylococcus
VRLDEILLSQLLLSPDYSLHL

SEQ ID NO: 2088374 - protein, 28 aa, Staphylococcus
VRLDGATKEFFAWGLRVGFITFGIKDEM

SEQ ID NO: 2088375 - protein, 27 aa, Staphylococcus
VRLDGATKEFFAWGLRVGFMTFGIHND

SEQ ID NO: 2088376 - protein, 19 aa, Staphylococcus
VRMTQLYDLLEAYFGHETQ

SEQ ID NO: 2088377 - protein, 21 aa, Staphylococcus
VRMWNLQSEYPWIVKVIIRDQ

SEQ ID NO: 2088378 - protein, 18 aa, Staphylococcus
VRNAHKRELAYTRYTWPK

SEQ ID NO: 2088379 - protein, 17 aa, Staphylococcus
VRNIAESVYYYFTGEHF

SEQ ID NO: 2088380 - protein, 22 aa, Staphylococcus
VRNKVLIFSGRISSEILIKAAK

SEQ ID NO: 2088381 - protein, 40 aa, Staphylococcus
VRNTPESWYYSKRLMYSKLTDFKDVLGFNYVLDGMIMDDL

SEQ ID NO: 2088382 - protein, 19 aa, Staphylococcus
VRPAFVILSSQFGKEEGVS

SEQ ID NO: 2088383 - protein, 25 aa, Staphylococcus
VRPEQGLLKLRKSLNLYANIRPTIV

SEQ ID NO: 2088384 - protein, 26 aa, Staphylococcus
VRPERRSTLGLRWLVNYARLRGEKTM

SEQ ID NO: 2088385 - protein, 32 aa, Staphylococcus
VRPGFEGGQLPLFRRLPKRGFTNINRKEYAIV

SEQ ID NO: 2088386 - protein, 29 aa, Staphylococcus
VRPTESQWEAMLLGWKVVSSVKSNAVILS

SEQ ID NO: 2088387 - protein, 17 aa, Staphylococcus
VRQKFFMKGPCTLEMNG

SEQ ID NO: 2088388 - protein, 24 aa, Staphylococcus
VRQRVMELLLLMNEKTYYSYRMDN

SEQ ID NO: 2088389 - protein, 18 aa, Staphylococcus
VRRRISIMEASGIRFETD

SEQ ID NO: 2088390 - protein, 17 aa, Staphylococcus
VRRWSSLSQPAAYYIRK

SEQ ID NO: 2088391 - protein, 19 aa, Staphylococcus
VRSIIAIAVGYPNKLKGAP

SEQ ID NO: 2088392 - protein, 21 aa, Staphylococcus
VRSIVEKLITLGKKGDLASRR

SEQ ID NO: 2088393 - protein, 24 aa, Staphylococcus
VRTRKLLLGGLYELLEEKEFSKLT

SEQ ID NO: 2088394 - protein, 24 aa, Staphylococcus
VRTYQQLISIFINLSRSLEARYTE

SEQ ID NO: 2088395 - protein, 24 aa, Staphylococcus
VRVFDFPFYYRGEVYDPFNSNTLS

SEQ ID NO: 2088396 - protein, 22 aa, Staphylococcus
VRVVSMPNWFAFEQQSDDYKES

SEQ ID NO: 2088397 - protein, 19 aa, Staphylococcus
VRWRAAMFIFDEGNEQQLV

SEQ ID NO: 2088398 - protein, 21 aa, Staphylococcus
VRYGFKRIFTNLLSVKQEERE

SEQ ID NO: 2088399 - protein, 26 aa, Staphylococcus
VRYKSMQGYYSPYVPGWDTHGLPIEQ

SEQ ID NO: 2088400 - protein, 27 aa, Staphylococcus
VRYKTMQGFYSPYVPGWDTHGLPIEQA

SEQ ID NO: 2088401 - protein, 33 aa, Staphylococcus
VRYNKQKLLQFFRIQFKYIYRYQRFFHAVFISH

SEQ ID NO: 2088402 - protein, 30 aa, Staphylococcus
VSAEPLSHLRLIVRTLLGIAVPTQIATHDS

SEQ ID NO: 2088403 - protein, 18 aa, Staphylococcus
VSAILTYGKEFDSNLLTI

SEQ ID NO: 2088404 - protein, 26 aa, Staphylococcus
VSAKESLRLRTLFPYITEASENHKKR

SEQ ID NO: 2088405 - protein, 30 aa, Staphylococcus
VSAPAVLGIYPHTVFELAKRIVPSEKVKSV

SEQ ID NO: 2088406 - protein, 45 aa, Staphylococcus
VSAPEAYPVMKYIQPVRKMIGKPTFFNLIGPIINPFALTYQVMGV

SEQ ID NO: 2088407 - protein, 24 aa, Staphylococcus
VSDEPLYLWLGDITTLDIDGIVNA

SEQ ID NO: 2088408 - protein, 24 aa, Staphylococcus
VSDGQYLTQLLFSNQQQPTERENK

SEQ ID NO: 2088409 - protein, 18 aa, Staphylococcus
VSDIHGYIFPTDFSKRDQ

SEQ ID NO: 2088410 - protein, 24 aa, Staphylococcus
VSDIHGYIFPTDFSKRNQNLPMGL

SEQ ID NO: 2088411 - protein, 23 aa, Staphylococcus
VSDIYSSVRLLWSRIGEPFVGYS

SEQ ID NO: 2088412 - protein, 24 aa, Staphylococcus
VSDKCDFYIKIPMVGHVNSLNASV

SEQ ID NO: 2088413 - protein, 26 aa, Staphylococcus
VSDLKNMIKFYTQILGLTIKHETNHA

SEQ ID NO: 2088414 - protein, 20 aa, Staphylococcus
VSDMKGGMSSLFYVLERLHQ

SEQ ID NO: 2088415 - protein, 21 aa, Staphylococcus
VSDMKGGMSSLFYVLERLKHE

SEQ ID NO: 2088416 - protein, 29 aa, Staphylococcus
VSDMKGGVASLFYVLERLNLEGIHPEGDI

SEQ ID NO: 2088417 - protein, 25 aa, Staphylococcus
VSDQQFDYILTNPPIRAGKDVVHRI

SEQ ID NO: 2088418 - protein, 25 aa, Staphylococcus
VSDRNPENLPWKDLNIDIVIEATGK

SEQ ID NO: 2088419 - protein, 24 aa, Staphylococcus
VSDRNPENLPWKELDIDVVIEATG

SEQ ID NO: 2088420 - protein, 17 aa, Staphylococcus
VSDVHGYIFPTDFSKTN

SEQ ID NO: 2088421 - protein, 25 aa, Staphylococcus
VSEEDEFIYRFKGYELENIALNMSG

SEQ ID NO: 2088422 - protein, 24 aa, Staphylococcus
VSEFVKYDIQDWWKDVEAAYHFLQ

SEQ ID NO: 2088423 - protein, 26 aa, Staphylococcus
VSEHLTHVVFILWGKPAQQKIKLIDT

SEQ ID NO: 2088424 - protein, 19 aa, Staphylococcus
VSELKQRIPLILEVTTEQY

SEQ ID NO: 2088425 - protein, 24 aa, Staphylococcus
VSEQLLQQLYTQLNDFSYICYCHN

SEQ ID NO: 2088426 - protein, 26 aa, Staphylococcus
VSEYRDHVVFILWGKPAQQKERLIDT

SEQ ID NO: 2088427 - protein, 25 aa, Staphylococcus
VSFDTTVYPFILRGVSLVGIDSVFT

SEQ ID NO: 2088428 - protein, 24 aa, Staphylococcus
VSFELDTLYRMIDIINDTLVSIRF

SEQ ID NO: 2088429 - protein, 26 aa, Staphylococcus
VSFHSLWHQYTNAIFFYYMVDKQSRM

SEQ ID NO: 2088430 - protein, 27 aa, Staphylococcus
VSFKLLATELVWFIKGDTNIKYLLQYN

SEQ ID NO: 2088431 - protein, 29 aa, Staphylococcus
VSFKLVATELLWFIKGDTNIKYLLQYNNN

SEQ ID NO: 2088432 - protein, 29 aa, Staphylococcus
VSFKLVATELLWFIKGDTNIRYLLQHNNN

SEQ ID NO: 2088433 - protein, 26 aa, Staphylococcus
VSGGEPLLQMPFLEALFKELQANGVH

SEQ ID NO: 2088434 - protein, 28 aa, Staphylococcus
VSGGEPLLQMPFLEALFKSLKAYGIHTC

SEQ ID NO: 2088435 - protein, 25 aa, Staphylococcus
VSGGQRGMQIILEPNDLIAVTQAQT

SEQ ID NO: 2088436 - protein, 21 aa, Staphylococcus
VSGILEMKGGFVDNISSSFGS

SEQ ID NO: 2088437 - protein, 20 aa, Staphylococcus
VSGPAALRCSQFVYKEQKNQ

SEQ ID NO: 2088438 - protein, 20 aa, Staphylococcus
VSGPGALRCSQFVYKEQKSQ

SEQ ID NO: 2088439 - protein, 25 aa, Staphylococcus
VSHDRYFLNKVAQEFWYVHDGQIER

SEQ ID NO: 2088440 - protein, 32 aa, Staphylococcus
VSHDRYFLNKVAQEYWFIHDGMMERIVGSFED

SEQ ID NO: 2088441 - protein, 18 aa, Staphylococcus
VSHSPRILGFDAVGIVES

SEQ ID NO: 2088442 - protein, 25 aa, Staphylococcus
VSIEHRLIYKIKDDSIFVVSCRFHY

SEQ ID NO: 2088443 - protein, 17 aa, Staphylococcus
VSIMNLIKHLAEVHKVT

SEQ ID NO: 2088444 - protein, 17 aa, Staphylococcus
VSKDLDYIISTRHPLHV

SEQ ID NO: 2088445 - protein, 19 aa, Staphylococcus
VSKEYYIYEDLKALFFEEM

SEQ ID NO: 2088446 - protein, 24 aa, Staphylococcus
VSKGGLLYHFESKQALIQGLVDYA

SEQ ID NO: 2088447 - protein, 25 aa, Staphylococcus
VSKGWMCIQVFFIRQGNLIQRDATM

SEQ ID NO: 2088448 - protein, 24 aa, Staphylococcus
VSKHIVPQLLSKRIKIIDLSGDFR

SEQ ID NO: 2088449 - protein, 22 aa, Staphylococcus
VSKIKAAIPNIALTTDIIVGYP

SEQ ID NO: 2088450 - protein, 22 aa, Staphylococcus
VSKILLKQLDINFYSRVVEIGG

SEQ ID NO: 2088451 - protein, 25 aa, Staphylococcus
VSKKSGTIGLIWPSVDRVAVTHLIT

SEQ ID NO: 2088452 - protein, 22 aa, Staphylococcus
VSKLPFIEFQADPIYINQIKEW

SEQ ID NO: 2088453 - protein, 24 aa, Staphylococcus
VSKLPYSIRVLLESVLRQEDDFVI

SEQ ID NO: 2088454 - protein, 40 aa, Staphylococcus
VSKMRASILVMGPLLARLGHAIVALPGGCAIGARPIEQHI

SEQ ID NO: 2088455 - protein, 35 aa, Staphylococcus; identical to SEQ ID NO: 1680081

SEQ ID NO: 2088456 - protein, 40 aa, Staphylococcus
VSKMRASVLVMGPLLARLGHAIVALPGGCAIGARPIEQHI

SEQ ID NO: 2088457 - protein, 20 aa, Staphylococcus
VSKQFWSYLVKQGQLDHPEA

SEQ ID NO: 2088458 - protein, 23 aa, Staphylococcus
VSKQFWTYLVRTGQLDNPGKFIQ

SEQ ID NO: 2088459 - protein, 30 aa, Staphylococcus
VSKQTIFNNIKRLDIETIKKDNTSFIKNDI

SEQ ID NO: 2088460 - protein, 25 aa, Staphylococcus
VSKTSGIFFMIKDDKQYIFGDCAIN

SEQ ID NO: 2088461 - protein, 26 aa, Staphylococcus
VSLEESLDLYQRGMKLSSACDKTLKD

SEQ ID NO: 2088462 - protein, 28 aa, Staphylococcus
VSLEESLDLYQRGMKLSTACDSTLKDAE

SEQ ID NO: 2088463 - protein, 27 aa, Staphylococcus
VSLEESLDLYQRGMKLSTACDTTLKDA

SEQ ID NO: 2088464 - protein, 18 aa, Staphylococcus
VSLLFNVDCQVKFEEGYP

SEQ ID NO: 2088465 - protein, 23 aa, Staphylococcus
VSLNYQILDLLSKRGELAQKIGE

SEQ ID NO: 2088466 - protein, 22 aa, Staphylococcus
VSLRNRFVLAPLTHTSSNDDGT

SEQ ID NO: 2088467 - protein, 19 aa, Staphylococcus
VSLTPYFTMKGRNLSFRIN

SEQ ID NO: 2088468 - protein, 22 aa, Staphylococcus
VSMDVFYQKGWTNAAISKVTSF

SEQ ID NO: 2088469 - protein, 21 aa, Staphylococcus
VSMIAAVQITLRNALALVGVS

SEQ ID NO: 2088470 - protein, 24 aa, Staphylococcus
VSMRRGVFILVDPYVLENIRSADG

SEQ ID NO: 2088471 - protein, 25 aa, Staphylococcus
VSNIMAAMIAVWSKGIALNDIVDAV

SEQ ID NO: 2088472 - protein, 21 aa, Staphylococcus
VSNIVYVRWFEDLRTVFINQY

SEQ ID NO: 2088473 - protein, 32 aa, Staphylococcus
VSNKIFECIHAGLPVILSPVKEHYYLNDKYNF

SEQ ID NO: 2088474 - protein, 17 aa, Staphylococcus
VSNLFFENSTRTKCSFE

SEQ ID NO: 2088475 - protein, 17 aa, Staphylococcus
VSNPWLEPDEHQSNFLT

SEQ ID NO: 2088476 - protein, 31 aa, Staphylococcus
VSPDLFVKRTNFYDFLLLNTDGLTDYVRDYE

SEQ ID NO: 2088477 - protein, 32 aa, Staphylococcus
VSPHDYLNHVRYVGALFLGYYSPEVIGDYVAG

SEQ ID NO: 2088478 - protein, 20 aa, Staphylococcus
VSPKLPILKKGHRYLFKFNF

SEQ ID NO: 2088479 - protein, 22 aa, Staphylococcus
VSPYRNAKEMIFIPNISDIEDI

SEQ ID NO: 2088480 - protein, 28 aa, Staphylococcus
VSQFPARIKCATLAWKALEKGTVEKEGK

SEQ ID NO: 2088481 - protein, 28 aa, Staphylococcus
VSQFPARIKCATLAWKALEKGTVEREGK

SEQ ID NO: 2088482 - protein, 18 aa, Staphylococcus
VSQFYQISDLVLLLSEKE

SEQ ID NO: 2088483 - protein, 18 aa, Staphylococcus
VSQPQQPVTNIADTQPKT

SEQ ID NO: 2088484 - protein, 27 aa, Staphylococcus
VSRAKRVITPLSPISIFAARNPWESLE

SEQ ID NO: 2088485 - protein, 24 aa, Staphylococcus
VSREKLLQAQLGLIVTYAYAQIEQ

SEQ ID NO: 2088486 - protein, 44 aa, Staphylococcus
VSREKLPLGVINILLQFVMLKNEMMLPKKYIFEVASNWKKLGIS

SEQ ID NO: 2088487 - protein, 17 aa, Staphylococcus
VSRLIKRRTLAKEISDQ

SEQ ID NO: 2088488 - protein, 17 aa, Staphylococcus
VSRLIKRRTLAKEVSDQ

SEQ ID NO: 2088489 - protein, 26 aa, Staphylococcus
VSRRNPTLIPGWNTFRSTKLMQKVVF

SEQ ID NO: 2088490 - protein, 23 aa, Staphylococcus
VSSFKAILRCDPDIILIGEIRDA

SEQ ID NO: 2088491 - protein, 23 aa, Staphylococcus
VSSIQPILQYIESNKITQLLDEM

SEQ ID NO: 2088492 - protein, 26 aa, Staphylococcus
VSSKKMCLLLAQQIYNYGFLTGIYHG

SEQ ID NO: 2088493 - protein, 18 aa, Staphylococcus
VSSLMKYLKQRHIPMAIA

SEQ ID NO: 2088494 - protein, 26 aa, Staphylococcus
VSSTNGWLFKLVWSDSQLSTIYFQPY

SEQ ID NO: 2088495 - protein, 25 aa, Staphylococcus
VSSVLIQQFLKYNNKLLIKSKEKEY

SEQ ID NO: 2088496 - protein, 24 aa, Staphylococcus
VSTFKAILRCDPDVILIGEIRDAS

SEQ ID NO: 2088497 - protein, 26 aa, Staphylococcus
VSTIPKRIRVLKKCKLYTDVTFKNEP

SEQ ID NO: 2088498 - protein, 24 aa, Staphylococcus
VSTKTIPDFAIKLGARFNSEAQEG

SEQ ID NO: 2088499 - protein, 20 aa, Staphylococcus
VSTPSFIEMCLLLPNLNEKQ

SEQ ID NO: 2088500 - protein, 25 aa, Staphylococcus
VSTPSFIEMCLLLPTLDEKQYPSLK

SEQ ID NO: 2088501 - protein, 24 aa, Staphylococcus
VSTPSFIEMCLLLPTLNENDYPSL

SEQ ID NO: 2088502 - protein, 25 aa, Staphylococcus
VSTPSFMEMCLLLPNLNESSYPSLN

SEQ ID NO: 2088503 - protein, 26 aa, Staphylococcus
VSVALEQALFELGKHAYRLDGDNVRH

SEQ ID NO: 2088504 - protein, 18 aa, Staphylococcus
VSVATFTLAVNRTFTNAQ

SEQ ID NO: 2088505 - protein, 26 aa, Staphylococcus
VSVKRAFIGSFLFGGRYSSSKFKINQ

SEQ ID NO: 2088506 - protein, 31 aa, Staphylococcus
VSVPQRAISYPIHIVTGSINGLFDGGSSKKD

SEQ ID NO: 2088507 - protein, 27 aa, Staphylococcus
VSVTDLMGYLFEIIDPYSLHQQGQDIG

SEQ ID NO: 2088508 - protein, 17 aa, Staphylococcus
VSWKYHDNNIVLGNVVE

SEQ ID NO: 2088509 - protein, 19 aa, Staphylococcus
VSYDVFFVLGGDGTVNELV

SEQ ID NO: 2088510 - protein, 24 aa, Staphylococcus
VTAARLGWLPSYPQFDTNSLRFGE

SEQ ID NO: 2088511 - protein, 18 aa, Staphylococcus
VTADKYLFGLSGNPSACF

SEQ ID NO: 2088512 - protein, 18 aa, Staphylococcus
VTAEPWLEISKQGLQLEG

SEQ ID NO: 2088513 - protein, 29 aa, Staphylococcus
VTAITGSGPAFLYHVFEKYVDAGVRLGLD

SEQ ID NO: 2088514 - protein, 27 aa, Staphylococcus
VTAITGSGPAFLYHVFEQYVKAGTDLG

SEQ ID NO: 2088515 - protein, 29 aa, Staphylococcus
VTAITGSGPAFLYHVFEQYVKAGTELGLE

SEQ ID NO: 2088516 - protein, 27 aa, Staphylococcus
VTAITGSGPAFLYHVFEQYVKAGTNLG

SEQ ID NO: 2088517 - protein, 29 aa, Staphylococcus
VTAITGSGPAFLYHVFEQYVKAGTQLGLE

SEQ ID NO: 2088518 - protein, 21 aa, Staphylococcus
VTAITGSGPAFLYHVFEQYVT

SEQ ID NO: 2088519 - protein, 24 aa, Staphylococcus
VTANDFVFAWRKVVDPKTGSEFAY

SEQ ID NO: 2088520 - protein, 22 aa, Staphylococcus
VTAWMPLMRNRGLLDDPVITDI

SEQ ID NO: 2088521 - protein, 29 aa, Staphylococcus
VTDDLATDLVWYLWTGKYSSLFGKRAMTT

SEQ ID NO: 2088522 - protein, 25 aa, Staphylococcus
VTDLMGYLFEIIDPYSVNKQGQDVG

SEQ ID NO: 2088523 - protein, 24 aa, Staphylococcus
VTDQDILHFCSVDLVESLMKQAHS

SEQ ID NO: 2088524 - protein, 27 aa, Staphylococcus
VTDQDLISYVLYPKVYEQYIATKEQYG

SEQ ID NO: 2088525 - protein, 30 aa, Staphylococcus
VTDYFKQIKTRIYPVGRLDYDTSGLLLLTN

SEQ ID NO: 2088526 - protein, 25 aa, Staphylococcus
VTEEEFDQFYKAYNKEMTGFKDEHQ

SEQ ID NO: 2088527 - protein, 19 aa, Staphylococcus
VTEFGPFPAATMHHIGYGA

SEQ ID NO: 2088528 - protein, 24 aa, Staphylococcus
VTEKEKILVLGSGPIRIGQGVEFD

SEQ ID NO: 2088529 - protein, 24 aa, Staphylococcus
VTEKYLSPRPWFTEMGHLVPSHRY

SEQ ID NO: 2088530 - protein, 22 aa, Staphylococcus
VTELIRILHSKYPYTFIHMIGF

SEQ ID NO: 2088531 - protein, 24 aa, Staphylococcus
VTELKQRIPLILEVTSKQFQSATQ

SEQ ID NO: 2088532 - protein, 30 aa, Staphylococcus
VTEMRADRDLLVAQLYLLQHDELPFKQEDI

SEQ ID NO: 2088533 - protein, 26 aa, Staphylococcus
VTEQDIISYVLYPKVFDQFIQTRQQY

SEQ ID NO: 2088534 - protein, 26 aa, Staphylococcus
VTEQDIISYVLYPKVYKQFITTKEQF

SEQ ID NO: 2088535 - protein, 24 aa, Staphylococcus
VTERDGIFYIANNKGIFSSDNGGK

SEQ ID NO: 2088536 - protein, 17 aa, Staphylococcus
VTEVVCDSVQFLEPKNQ

SEQ ID NO: 2088537 - protein, 24 aa, Staphylococcus
VTEYDIHRMLPHPINLVRVKVTGT

SEQ ID NO: 2088538 - protein, 25 aa, Staphylococcus
VTEYDIHRMLPHPINLVRVRLTGDE

SEQ ID NO: 2088539 - protein, 24 aa, Staphylococcus
VTEYLDPELLVPAIGQGALGIECR

SEQ ID NO: 2088540 - protein, 21 aa, Staphylococcus
VTFDDCDIFFIGGGSDREQAL

SEQ ID NO: 2088541 - protein, 20 aa, Staphylococcus
VTFDDCDIFFIGGGSDREQS

SEQ ID NO: 2088542 - protein, 24 aa, Staphylococcus
VTFDDLVDFVLWLKSPNKYEKVIF

SEQ ID NO: 2088543 - protein, 20 aa, Staphylococcus
VTFDNCDIFFIGGGSDREQA

SEQ ID NO: 2088544 - protein, 24 aa, Staphylococcus
VTFHKQLTFLPSPLNRFVRIMPFT

SEQ ID NO: 2088545 - protein, 18 aa, Staphylococcus
VTFHRVINDFMIQGGDPT

SEQ ID NO: 2088546 - protein, 25 aa, Staphylococcus
VTFPHVMPLLIQNYVSRHPNIKIKQ

SEQ ID NO: 2088547 - protein, 24 aa, Staphylococcus
VTGAAYIEPYGQLFEYGFNISDDA

SEQ ID NO: 2088548 - protein, 24 aa, Staphylococcus
VTGAAYIEPYGQLFEYGFNISDDT

SEQ ID NO: 2088549 - protein, 25 aa, Staphylococcus
VTGCYLLVNKSIRRGYKSMPEHVNM

SEQ ID NO: 2088550 - protein, 23 aa, Staphylococcus
VTGHSRFPVVNKDWKLVGIVTSK

SEQ ID NO: 2088551 - protein, 17 aa, Staphylococcus
VTGLRQVYPDLEDAYIL

SEQ ID NO: 2088552 - protein, 20 aa, Staphylococcus
VTGSLRIFEGMLASLTVNTD

SEQ ID NO: 2088553 - protein, 20 aa, Staphylococcus
VTGTFPWQKVVNVKAKHAIK

SEQ ID NO: 2088554 - protein, 22 aa, Staphylococcus
VTGTYTMPCARTLEPVEVPLDV

SEQ ID NO: 2088555 - protein, 20 aa, Staphylococcus
VTHFLAILEMAKAGLINIEQ

SEQ ID NO: 2088556 - protein, 29 aa, Staphylococcus
VTHGKISALLFKPLYYFKDKHTTLTYQFP

SEQ ID NO: 2088557 - protein, 25 aa, Staphylococcus
VTHSKKGVKLLWASCREVINVIQAD

SEQ ID NO: 2088558 - protein, 22 aa, Staphylococcus
VTHTPVWFMRQAGRSQPEYRAL

SEQ ID NO: 2088559 - protein, 27 aa, Staphylococcus
VTHVIEEIIPLFSKIFLLKEGSCFDKG

SEQ ID NO: 2088560 - protein, 25 aa, Staphylococcus
VTIAPFGASIPYYFTGHEGPDSCCI

SEQ ID NO: 2088561 - protein, 21 aa, Staphylococcus
VTIHPVTFWVAAMSEPKQRAI

SEQ ID NO: 2088562 - protein, 17 aa, Staphylococcus
VTKFNRLIERRLLNHFR

SEQ ID NO: 2088563 - protein, 25 aa, Staphylococcus
VTKHHDLIRMLLMKQDAFLTENNKI

SEQ ID NO: 2088564 - protein, 32 aa, Staphylococcus
VTKIDNEGFIKFQPIGGWWSQVMLSQKVTITT

SEQ ID NO: 2088565 - protein, 20 aa, Staphylococcus
VTKLGGMLLLIMKADPRQRQ

SEQ ID NO: 2088566 - protein, 20 aa, Staphylococcus
VTLDNCDIFFIGGGSDREQS

SEQ ID NO: 2088567 - protein, 36 aa, Staphylococcus
VTLELVDQLKYFINERIIPVIPQQGSLGASGDLAPL

SEQ ID NO: 2088568 - protein, 17 aa, Staphylococcus
VTLFLGHKPEYTEANIY

SEQ ID NO: 2088569 - protein, 24 aa, Staphylococcus
VTLGYPLVRNAIRDGLIKLINEKF

SEQ ID NO: 2088570 - protein, 31 aa, Staphylococcus
VTLIEEKSYIYLIFVVHHIIFDGISLEKFIS

SEQ ID NO: 2088571 - protein, 27 aa, Staphylococcus
VTLKTLGLIIIMAQSGLLIPTLDGSQL

SEQ ID NO: 2088572 - protein, 26 aa, Staphylococcus
VTLKTLGLIIVMAQSGMLIPTLDGSQ

SEQ ID NO: 2088573 - protein, 25 aa, Staphylococcus
VTLNGMLIVIYANANYMKFIYTPYT

SEQ ID NO: 2088574 - protein, 17 aa, Staphylococcus
VTLPLKEIVRLATEDDL

SEQ ID NO: 2088575 - protein, 22 aa, Staphylococcus
VTLTPNVLSIMLEYLRFAEYDQ

SEQ ID NO: 2088576 - protein, 18 aa, Staphylococcus
VTMAGLINALRIVDKDLS

SEQ ID NO: 2088577 - protein, 29 aa, Staphylococcus
VTMEELLTIYEWPEKLLVKELKKLALQQK

SEQ ID NO: 2088578 - protein, 24 aa, Staphylococcus
VTMTTSFQLRDAFKLLTEQSVPTK

SEQ ID NO: 2088579 - protein, 25 aa, Staphylococcus
VTMTTSLQIRDALKLLIEHTPDTKL

SEQ ID NO: 2088580 - protein, 24 aa, Staphylococcus
VTNDDFTHWKKIMGADPISEEDQD

SEQ ID NO: 2088581 - protein, 25 aa, Staphylococcus
VTNDDFTHWRKIMGAAPISDEEREN

SEQ ID NO: 2088582 - protein, 25 aa, Staphylococcus
VTNDDFTHWRNIMGVAPISEEEQEQ

SEQ ID NO: 2088583 - protein, 26 aa, Staphylococcus
VTNEMNYHILQLIKIGIKHKTIMELM

SEQ ID NO: 2088584 - protein, 28 aa, Staphylococcus
VTNNLQLVMTIANLKLKLSPNEVWNAVT

SEQ ID NO: 2088585 - protein, 17 aa, Staphylococcus
VTNYFQCNYWGEKGAAR

SEQ ID NO: 2088586 - protein, 23 aa, Staphylococcus
VTPDIFVKKTNFYDYLMLNSDGL

SEQ ID NO: 2088587 - protein, 32 aa, Staphylococcus
VTPDIYFKRINYYNYLLLCSDGLTDYIRNDVI

SEQ ID NO: 2088588 - protein, 19 aa, Staphylococcus
VTPFYYPLSFEEIKQYYFD

SEQ ID NO: 2088589 - protein, 21 aa, Staphylococcus
VTPGPWHIHRMLEVAEALPIN

SEQ ID NO: 2088590 - protein, 23 aa, Staphylococcus
VTQDYGLASLLLNKAKIVMHHKG

SEQ ID NO: 2088591 - protein, 24 aa, Staphylococcus
VTQGCIQFYDLLQNLIKEQEFLEI

SEQ ID NO: 2088592 - protein, 17 aa, Staphylococcus
VTQQYLPDKLKNRIYYE

SEQ ID NO: 2088593 - protein, 17 aa, Staphylococcus
VTRNNHFLYAITKEGDN

SEQ ID NO: 2088594 - protein, 23 aa, Staphylococcus
VTRPIMEEWLFNTVSFIGGPSEI

SEQ ID NO: 2088595 - protein, 25 aa, Staphylococcus
VTRQLDYLGLNRFIKDALGLHIKEL

SEQ ID NO: 2088596 - protein, 25 aa, Staphylococcus
VTSLKVGDRVSIAWLFESCGHCEYC

SEQ ID NO: 2088597 - protein, 32 aa, Staphylococcus
VTSMFYTFKLMKHNVLPSLLLPELSGPFLSLN

SEQ ID NO: 2088598 - protein, 23 aa, Staphylococcus
VTSPLKIVQLNSPIKLYINVNVH

SEQ ID NO: 2088599 - protein, 25 aa, Staphylococcus
VTSTPVLRPLLTLDKEDIIKKARDI

SEQ ID NO: 2088600 - protein, 30 aa, Staphylococcus
VTTAILTGNFLLALGLEHLSEIRDNRIHHI

SEQ ID NO: 2088601 - protein, 27 aa, Staphylococcus
VTTDGTSTIPLIKALSAKQVRLNVTAV

SEQ ID NO: 2088602 - protein, 36 aa, Staphylococcus
VTTDLVDQLIYFINHRIIPIIPQQGSLGASGDLAPL

SEQ ID NO: 2088603 - protein, 29 aa, Staphylococcus
VTTDNGLTRLIFMVPARGLIGYTTEFMSM

SEQ ID NO: 2088604 - protein, 23 aa, Staphylococcus
VTTPRFYLNLNKYFDSLQQDSTP

SEQ ID NO: 2088605 - protein, 17 aa, Staphylococcus
VTTQVGCRIGCTFCAST

SEQ ID NO: 2088606 - protein, 25 aa, Staphylococcus
VTTSKPYFLEFMAHGVSKGNALRAL

SEQ ID NO: 2088607 - protein, 29 aa, Staphylococcus
VTTVLNPAPAIDLPKSLLALTDIIIPNET

SEQ ID NO: 2088608 - protein, 27 aa, Staphylococcus
VTVHKYSASFILKEYNYWKGDNNSKWV

SEQ ID NO: 2088609 - protein, 26 aa, Staphylococcus
VTVIEWSQFISDLLPYQHLTININVI

SEQ ID NO: 2088610 - protein, 24 aa, Staphylococcus
VTVISIFVNPLQFGPNEDFDAYPR

SEQ ID NO: 2088611 - protein, 18 aa, Staphylococcus
VTVRKMMMAGDKLTIMLP

SEQ ID NO: 2088612 - protein, 17 aa, Staphylococcus
VTVSDLFEYVEKEVELM

SEQ ID NO: 2088613 - protein, 27 aa, Staphylococcus
VTVVNKLFNIISPDYAYFGKKDAQQLA

SEQ ID NO: 2088614 - protein, 29 aa, Staphylococcus
VTVVNKLFNIVQPDRAYFGKKDAQQLAIV

SEQ ID NO: 2088615 - protein, 27 aa, Staphylococcus
VTVVNKLFNIVRPHKAYFGKKDAQQLA

SEQ ID NO: 2088616 - protein, 26 aa, Staphylococcus
VTVVNKLFNIVSPDYAYFGKKDAQQL

SEQ ID NO: 2088617 - protein, 30 aa, Staphylococcus
VTYSEQFPYISFIPVIYPTVISLKGFKYNL

SEQ ID NO: 2088618 - protein, 22 aa, Staphylococcus
VVAAICMYALKTAGYQSALMVP

SEQ ID NO: 2088619 - protein, 24 aa, Staphylococcus
VVDDAYYGLFYEDVYRQSIFTALN

SEQ ID NO: 2088620 - protein, 28 aa, Staphylococcus
VVDEDAKFIIWTTTPWTLPSNVAITVHP

SEQ ID NO: 2088621 - protein, 27 aa, Staphylococcus
VVDEDAQFIIWTTTPWTIPSNVAITVH

SEQ ID NO: 2088622 - protein, 17 aa, Staphylococcus
VVDFHNFANKAYLILTD

SEQ ID NO: 2088623 - protein, 18 aa, Staphylococcus
VVDHHETLLFYKARFKYY

SEQ ID NO: 2088624 - protein, 19 aa, Staphylococcus
VVDILGREPNFTEVGIFSV

SEQ ID NO: 2088625 - protein, 27 aa, Staphylococcus
VVDKDAQFIIWTTTPWTIPSNVAITVH

SEQ ID NO: 2088626 - protein, 24 aa, Staphylococcus
VVDNDLPYHLAIKNLKQLDEDFGV

SEQ ID NO: 2088627 - protein, 27 aa, Staphylococcus
VVDQDAQFIIWTTTPWTIPSNVAITVH

SEQ ID NO: 2088628 - protein, 28 aa, Staphylococcus
VVDSDAKFIIWTTTPWTIPSNVAITVHP

SEQ ID NO: 2088629 - protein, 23 aa, Staphylococcus
VVDVDMYIIVSFGTKISEVASNV

SEQ ID NO: 2088630 - protein, 24 aa, Staphylococcus
VVDVYIRYLRNKLKPFNKEKSIET

SEQ ID NO: 2088631 - protein, 24 aa, Staphylococcus
VVDVYIRYLRNKLKPFNKEKVIET

SEQ ID NO: 2088632 - protein, 24 aa, Staphylococcus
VVDYGYPIGYSYKKDARGYFMVKS

SEQ ID NO: 2088633 - protein, 23 aa, Staphylococcus
VVDYIKKPFDPMELYYRVSLHLK

SEQ ID NO: 2088634 - protein, 23 aa, Staphylococcus
VVEDLQSLKLNKKLLVTYRTSNQ

SEQ ID NO: 2088635 - protein, 24 aa, Staphylococcus
VVEFSVKHLMISNIKGRFTEFDAN

SEQ ID NO: 2088636 - protein, 21 aa, Staphylococcus
VVEGFTLTKLLWVKENEPELW

SEQ ID NO: 2088637 - protein, 19 aa, Staphylococcus
VVEILGREPNFTEVGIFSV

SEQ ID NO: 2088638 - protein, 19 aa, Staphylococcus
VVESGIDGLLIGESLMKCE

SEQ ID NO: 2088639 - protein, 23 aa, Staphylococcus
VVFDFINECRTSHAFWASLDTFD

SEQ ID NO: 2088640 - protein, 23 aa, Staphylococcus
VVFDLLVEYDGELPFWDKSSPEA

SEQ ID NO: 2088641 - protein, 17 aa, Staphylococcus
VVFIFQPAEETGGGANR

SEQ ID NO: 2088642 - protein, 17 aa, Staphylococcus
VVFSWLRRKCKESPEEM

SEQ ID NO: 2088643 - protein, 19 aa, Staphylococcus
VVFTIELFYTSAVQQTMAY

SEQ ID NO: 2088644 - protein, 21 aa, Staphylococcus
VVFYDSRLLSEAFSKELSTIL

SEQ ID NO: 2088645 - protein, 32 aa, Staphylococcus
VVGAVVAWNFPFLLSSWKLAPALAAGNTVVIQ

SEQ ID NO: 2088646 - protein, 32 aa, Staphylococcus
VVGAVVAWNFPILLASWKLAPALAAGNTIVIQ

SEQ ID NO: 2088647 - protein, 32 aa, Staphylococcus; identical to SEQ ID NO: 1821138

SEQ ID NO: 2088648 - protein, 17 aa, Staphylococcus
VVGDFGYELLRLKGFYK

SEQ ID NO: 2088649 - protein, 18 aa, Staphylococcus
VVGFIGGQTAPPGKRMGH

SEQ ID NO: 2088650 - protein, 18 aa, Staphylococcus
VVGFSVGGALALKYGVKH

SEQ ID NO: 2088651 - protein, 24 aa, Staphylococcus
VVGIAFIIELKYLNGMEKIKDYDV

SEQ ID NO: 2088652 - protein, 17 aa, Staphylococcus
VVGMTFGSLFDATQTRV

SEQ ID NO: 2088653 - protein, 17 aa, Staphylococcus
VVGMTYGSLFDATQTRV

SEQ ID NO: 2088654 - protein, 25 aa, Staphylococcus
VVGPEQPLIDGLPDKLRQTGVKVFG

SEQ ID NO: 2088655 - protein, 23 aa, Staphylococcus
VVGQGQMFALSPGKGIVAHREYG

SEQ ID NO: 2088656 - protein, 21 aa, Staphylococcus
VVHAPYIINIANTTKPEVFEL

SEQ ID NO: 2088657 - protein, 21 aa, Staphylococcus
VVHDHGISYVFSLVGRDDDNK

SEQ ID NO: 2088658 - protein, 24 aa, Staphylococcus
VVHKHYWNIGIAADTDKGLLVPVV

SEQ ID NO: 2088659 - protein, 21 aa, Staphylococcus
VVHMREKIHWFVEQADVNKLS

SEQ ID NO: 2088660 - protein, 25 aa, Staphylococcus
VVIDQGITEFPFSELISFKEVQEEL

SEQ ID NO: 2088661 - protein, 22 aa, Staphylococcus
VVIGDLPIGYYPVDDRSKEMAL

SEQ ID NO: 2088662 - protein, 17 aa, Staphylococcus
VVIIHQPAEEMPPGGAQ

SEQ ID NO: 2088663 - protein, 31 aa, Staphylococcus
VVILPSKCAYDFLLFCFRNPKTCPLLDVSEK

SEQ ID NO: 2088664 - protein, 25 aa, Staphylococcus
VVIMGGNTFRWLLDNNVKENPYEGK

SEQ ID NO: 2088665 - protein, 24 aa, Staphylococcus
VVINKLNFYISLGGPVTFKNAKQP

SEQ ID NO: 2088666 - protein, 18 aa, Staphylococcus
VVIVPNIPSRLRAGDFEE

SEQ ID NO: 2088667 - protein, 31 aa, Staphylococcus
VVKEAIGVSGLITPWNFPTNQTSLKLAAAFA

SEQ ID NO: 2088668 - protein, 21 aa, Staphylococcus
VVKEKLGLRNYERLLHIVRTR

SEQ ID NO: 2088669 - protein, 17 aa, Staphylococcus
VVKFKKGFNADVVEYVG

SEQ ID NO: 2088670 - protein, 25 aa, Staphylococcus
VVKGEKEYLIPYIADVVKEIDIENK

SEQ ID NO: 2088671 - protein, 25 aa, Staphylococcus
VVKHDFTGISFLNLVDFDALYGHRR

SEQ ID NO: 2088672 - protein, 24 aa, Staphylococcus
VVKNSIDIFPKTRLNLSLSTNDVI

SEQ ID NO: 2088673 - protein, 31 aa, Staphylococcus
VVKNSIKAMKILALYIRKNYRNPIVCITGSM

SEQ ID NO: 2088674 - protein, 19 aa, Staphylococcus
VVKPLLKYAHQRGIYVQMN

SEQ ID NO: 2088675 - protein, 17 aa, Staphylococcus
VVKQYMNLLLLADPEKQ

SEQ ID NO: 2088676 - protein, 33 aa, Staphylococcus
VVKWNQPMYTYNETFIIAFSKAKQHFSIMPEAA

SEQ ID NO: 2088677 - protein, 24 aa, Staphylococcus
VVLTISVDLPFAQKRWCAANGLDN

SEQ ID NO: 2088678 - protein, 24 aa, Staphylococcus
VVLTISVDLPFAQKRWCASNGLDN

SEQ ID NO: 2088679 - protein, 24 aa, Staphylococcus
VVLTISVDLPFAQKRWCASNGLEN

SEQ ID NO: 2088680 - protein, 25 aa, Staphylococcus
VVNDQWRYIIQDGIVFRDFVHQYDM

SEQ ID NO: 2088681 - protein, 30 aa, Staphylococcus
VVNEGNFAMWWLGNCGIWIKTPEGANIVMD

SEQ ID NO: 2088682 - protein, 18 aa, Staphylococcus
VVNHWIQFGVDGFRFDVI

SEQ ID NO: 2088683 - protein, 33 aa, Staphylococcus
VVNIMLRLQREKGITFLFIAHDLSMVKYISDRI

SEQ ID NO: 2088684 - protein, 24 aa, Staphylococcus
VVNKHYWNIGIAADTERGLLVPVV

SEQ ID NO: 2088685 - protein, 27 aa, Staphylococcus
VVNLDGIFVQIGLVPNTAWLQDAIELN

SEQ ID NO: 2088686 - protein, 28 aa, Staphylococcus
VVNLDGIFVQIGLVPNTSWISDAVELNG

SEQ ID NO: 2088687 - protein, 19 aa, Staphylococcus
VVNSNFKGVNWSTRLWQDM

SEQ ID NO: 2088688 - protein, 23 aa, Staphylococcus
VVNVEYRSYYKNVWVYEVDGKVA

SEQ ID NO: 2088689 - protein, 18 aa, Staphylococcus
VVPDLLYPEYITIGKNCV

SEQ ID NO: 2088690 - protein, 17 aa, Staphylococcus
VVPFRTAHEIVGKIVLN

SEQ ID NO: 2088691 - protein, 18 aa, Staphylococcus
VVPGLINAHTHIVADHTG

SEQ ID NO: 2088692 - protein, 17 aa, Staphylococcus
VVPIVKLATIDKNGPTG

SEQ ID NO: 2088693 - protein, 20 aa, Staphylococcus
VVPPVEGFLQGLRDITTAYG

SEQ ID NO: 2088694 - protein, 19 aa, Staphylococcus
VVPTPHRIFDFFNAYIGTK

SEQ ID NO: 2088695 - protein, 18 aa, Staphylococcus
VVPVIRALREKAMAIQAE

SEQ ID NO: 2088696 - protein, 19 aa, Staphylococcus
VVQALNLMSLLNPNISHTM

SEQ ID NO: 2088697 - protein, 19 aa, Staphylococcus
VVQPAAGLISYFEGQHLII

SEQ ID NO: 2088698 - protein, 27 aa, Staphylococcus
VVQPHPMALSYIYYEIYTQMIEMIRDL

SEQ ID NO: 2088699 - protein, 26 aa, Staphylococcus
VVRLANFGAFVEIAPAVQGLVHISEI

SEQ ID NO: 2088700 - protein, 20 aa, Staphylococcus
VVRLLAYYQNQPAGILDMIV

SEQ ID NO: 2088701 - protein, 26 aa, Staphylococcus
VVRLTDFGAFVEIAAGVQGLVHISEI

SEQ ID NO: 2088702 - protein, 21 aa, Staphylococcus
VVSGFTLDGRYFVSGLNKVDQ

SEQ ID NO: 2088703 - protein, 17 aa, Staphylococcus
VVSISYPLEKLAIDIID

SEQ ID NO: 2088704 - protein, 18 aa, Staphylococcus
VVSISYPLEKLVINIIDE

SEQ ID NO: 2088705 - protein, 32 aa, Staphylococcus
VVTKPTLKFELFYFDIFKYATSFITLQVPREE

SEQ ID NO: 2088706 - protein, 26 aa, Staphylococcus
VVTNDDFTHWRKIMGVAPISDEEREY

SEQ ID NO: 2088707 - protein, 28 aa, Staphylococcus
VVTVLNKLFNIVSPNKAYFGKKDAQQLA

SEQ ID NO: 2088708 - protein, 28 aa, Staphylococcus
VVVKPRQKAFYPLWQPMAEDLLADDWEV

SEQ ID NO: 2088709 - protein, 18 aa, Staphylococcus
VVVMPDFTLSPEAKYPTA

SEQ ID NO: 2088710 - protein, 23 aa, Staphylococcus
VVVRTFIPELLTIAIPSYPPYLH

SEQ ID NO: 2088711 - protein, 18 aa, Staphylococcus
VVVVDFLVDDIGFVDVEV

SEQ ID NO: 2088712 - protein, 19 aa, Staphylococcus
VVVVFPLHMNPEVRKLSYA

SEQ ID NO: 2088713 - protein, 33 aa, Staphylococcus
VVWATAAPGWQKWVWSPFLSIMGSGATAFVYNG

SEQ ID NO: 2088714 - protein, 21 aa, Staphylococcus
VVYDHLSGRLPMIASGGINSV

SEQ ID NO: 2088715 - protein, 31 aa, Staphylococcus
VWATAAPGWQKWVWSPFLSIMGSGATAFVYN

SEQ ID NO: 2088716 - protein, 20 aa, Staphylococcus
VWGQPDFNSLSLFKLLALES

SEQ ID NO: 2088717 - protein, 17 aa, Staphylococcus
VWLEKDSYDFSFSGLKS

SEQ ID NO: 2088718 - protein, 17 aa, Staphylococcus
VWLGVWEHNPQALAFYK

SEQ ID NO: 2088719 - protein, 17 aa, Staphylococcus
VWYITTIEQLIDLITYC

SEQ ID NO: 2088720 - protein, 26 aa, Staphylococcus
VYAKFDQMIEWLAGVYINSLNVIHYM

SEQ ID NO: 2088721 - protein, 25 aa, Staphylococcus
VYALHEMYQGFFLAPHVVSQSLKGA

SEQ ID NO: 2088722 - protein, 27 aa, Staphylococcus
VYAQLEHSIIYYKWLTQISDAIQSGEI

SEQ ID NO: 2088723 - protein, 22 aa, Staphylococcus
VYDEYNQIFNKEPSDIIKDSMT

SEQ ID NO: 2088724 - protein, 26 aa, Staphylococcus
VYDFDKTLVFVGLANTLLISEAEKIG

SEQ ID NO: 2088725 - protein, 27 aa, Staphylococcus
VYDFDPTLIYVGLSNTLLISEAQALGL

SEQ ID NO: 2088726 - protein, 26 aa, Staphylococcus
VYDKFDKMMDWLAGVYINSLNIIHYM

SEQ ID NO: 2088727 - protein, 18 aa, Staphylococcus
VYDYILKQFNSNISINVI

SEQ ID NO: 2088728 - protein, 27 aa, Staphylococcus
VYEATKHLDVPLFIGIMPVTSYNNALF

SEQ ID NO: 2088729 - protein, 32 aa, Staphylococcus
VYEATKHLNIPIFIGIMPIASYNNALFLHNEV

SEQ ID NO: 2088730 - protein, 32 aa, Staphylococcus
VYEATKHLNTPFFIGIMPIASYNNALFLHNEV

SEQ ID NO: 2088731 - protein, 22 aa, Staphylococcus
VYEDDYLLIVCKPSLQNCAPSR

SEQ ID NO: 2088732 - protein, 20 aa, Staphylococcus
VYEDFGFKDYTFRLSYRDPE

SEQ ID NO: 2088733 - protein, 24 aa, Staphylococcus
VYEGLLPKNITYNVTFKGSNPPKD

SEQ ID NO: 2088734 - protein, 24 aa, Staphylococcus
VYEPFLIQKGFLERTPRGRKATPF

SEQ ID NO: 2088735 - protein, 20 aa, Staphylococcus
VYEVKLGTIAKLLYEFKEIA

SEQ ID NO: 2088736 - protein, 18 aa, Staphylococcus
VYFICGTQDIPEGKSLEQ

SEQ ID NO: 2088737 - protein, 19 aa, Staphylococcus
VYFICGTQDIPEGRTIQEV

SEQ ID NO: 2088738 - protein, 18 aa, Staphylococcus
VYGIDFTGPCLKCLLQQV

SEQ ID NO: 2088739 - protein, 25 aa, Staphylococcus
VYGLIIPDLPHELVQQLKARHPERK

SEQ ID NO: 2088740 - protein, 28 aa, Staphylococcus
VYHQLKPDKFYFLPSYMAPLKTHDDYLD

SEQ ID NO: 2088741 - protein, 17 aa, Staphylococcus
VYHYVHQIFPLSTRRED

SEQ ID NO: 2088742 - protein, 19 aa, Staphylococcus
VYIEAIHFHSPPFTSEKAK

SEQ ID NO: 2088743 - protein, 17 aa, Staphylococcus
VYIEPLTHDFIARIIRK

SEQ ID NO: 2088744 - protein, 18 aa, Staphylococcus
VYIGLLTDQAFKAKMFKM

SEQ ID NO: 2088745 - protein, 17 aa, Staphylococcus
VYKDWQPGQKVHLVAHS

SEQ ID NO: 2088746 - protein, 17 aa, Staphylococcus
VYKGWLRSDQIKGLYLD

SEQ ID NO: 2088747 - protein, 23 aa, Staphylococcus
VYKIKMDKPFKKLTDRQKDIILY

SEQ ID NO: 2088748 - protein, 17 aa, Staphylococcus
VYKKLKDADLLTVQRGV

SEQ ID NO: 2088749 - protein, 17 aa, Staphylococcus
VYKTLVLENTNHAHFVF

SEQ ID NO: 2088750 - protein, 20 aa, Staphylococcus
VYKVVDYARENNLKIIASCP

SEQ ID NO: 2088751 - protein, 26 aa, Staphylococcus
VYLAEQKLRRLFFRRKHYSVVTSDIP

SEQ ID NO: 2088752 - protein, 20 aa, Staphylococcus
VYLAGPIQLLKRPQHNKFAD

SEQ ID NO: 2088753 - protein, 20 aa, Staphylococcus
VYLEHMKLYRSFREEVPEEE

SEQ ID NO: 2088754 - protein, 25 aa, Staphylococcus
VYLVDRVIPMIPHRLSNGICSLNPD

SEQ ID NO: 2088755 - protein, 25 aa, Staphylococcus
VYLVDRVIPMIPHRLSNGICSLNPN

SEQ ID NO: 2088756 - protein, 25 aa, Staphylococcus
VYLVDRVIPMIPHRLSNGICSLNPQ

SEQ ID NO: 2088757 - protein, 24 aa, Staphylococcus
VYNHIRGLSPWPVAYTKLDDTNMK

SEQ ID NO: 2088758 - protein, 32 aa, Staphylococcus
VYNTNVFGIVRMMHTFIPLLEKSEQPVVVNVS

SEQ ID NO: 2088759 - protein, 17 aa, Staphylococcus
VYNYIHIGNARPAINYD

SEQ ID NO: 2088760 - protein, 38 aa, Staphylococcus
VYQNNLHFLYTGLGLSREKLLFPYQLLAFINNHHQANK

SEQ ID NO: 2088761 - protein, 17 aa, Staphylococcus
VYRDDTLLELTPKEFEL

SEQ ID NO: 2088762 - protein, 17 aa, Staphylococcus
VYRFKRGFNVQIEELIG

SEQ ID NO: 2088763 - protein, 17 aa, Staphylococcus
VYRISSTRLASYLLKKN

SEQ ID NO: 2088764 - protein, 20 aa, Staphylococcus
VYVIVTFYLKNGKAFDHCMI

SEQ ID NO: 2088765 - protein, 19 aa, Staphylococcus
VYVKGYEDLKFYEAFVLNS

SEQ ID NO: 2088766 - protein, 30 aa, Staphylococcus
VYVRIDRTRKLPLTVLLRALGFSNDQEIID

SEQ ID NO: 2088767 - protein, 30 aa, Staphylococcus
VYVRIDRTRKLPLTVLLRALGFSSDQEIID

SEQ ID NO: 2088768 - protein, 30 aa, Staphylococcus; identical to SEQ ID NO: 1679723

SEQ ID NO: 2088769 - protein, 30 aa, Staphylococcus; identical to SEQ ID NO: 1819489

SEQ ID NO: 2088770 - protein, 30 aa, Staphylococcus
VYVRIDRTRKLPLTVLLRALGFSTDQEIVE

SEQ ID NO: 2088771 - protein, 26 aa, Staphylococcus
VYVVPAFVGLGTPYWDANARGAIFGL

SEQ ID NO: 2088772 - protein, 17 aa, Staphylococcus
VYYAQYAHARICSILKQ

SEQ ID NO: 2088773 - protein, 23 aa, Staphylococcus
VYYLKQFIRHKLINYLDEGLEWV

SEQ ID NO: 2088774 - protein, 17 aa, Staphylococcus
WAGVRPLILEEGKDPSE

SEQ ID NO: 2088775 - protein, 19 aa, Staphylococcus
WAIFKTDMLLKSLSTKAYE

SEQ ID NO: 2088776 - protein, 18 aa, Staphylococcus
WAIFYKALAHKLLEYQNC

SEQ ID NO: 2088777 - protein, 18 aa, Staphylococcus
WAKLIINSALSGMSAATN

SEQ ID NO: 2088778 - protein, 18 aa, Staphylococcus
WAKRTPFGKYGGKLKHLE

SEQ ID NO: 2088779 - protein, 27 aa, Staphylococcus
WANEWKNYFHPFKASNRFTIVPSWETY

SEQ ID NO: 2088780 - protein, 19 aa, Staphylococcus
WAPLFFRGREVSGKTIGII

SEQ ID NO: 2088781 - protein, 19 aa, Staphylococcus
WAPLFFRGREVSGKTLGII

SEQ ID NO: 2088782 - protein, 17 aa, Staphylococcus
WASCRELLNVIQADEIG

SEQ ID NO: 2088783 - protein, 19 aa, Staphylococcus
WASMLLRMYQRYCEQNGFK

SEQ ID NO: 2088784 - protein, 17 aa, Staphylococcus
WASYMEHPFIKGLEDGS

SEQ ID NO: 2088785 - protein, 17 aa, Staphylococcus
WAYLVRTGQLEHPGNFI

SEQ ID NO: 2088786 - protein, 17 aa, Staphylococcus
WAYLVRTGQLENPENFI

SEQ ID NO: 2088787 - protein, 19 aa, Staphylococcus
WCHGFSDVPAETYIQSVTP

SEQ ID NO: 2088788 - protein, 25 aa, Staphylococcus
WCQDNKKLGIWGFPSTFISNNHHHY

SEQ ID NO: 2088789 - protein, 25 aa, Staphylococcus
WDGEPRLERLFIKYLGVEDTEVNRT

SEQ ID NO: 2088790 - protein, 18 aa, Staphylococcus
WDIAAQFLFAKELGLVMT

SEQ ID NO: 2088791 - protein, 17 aa, Staphylococcus
WDIKLTDIFYVTKFDHP

SEQ ID NO: 2088792 - protein, 17 aa, Staphylococcus
WDINLIIQNGQSLSFEY

SEQ ID NO: 2088793 - protein, 29 aa, Staphylococcus
WDKAEKIFVFNMYLLLKSGPPSRGEEVNG

SEQ ID NO: 2088794 - protein, 27 aa, Staphylococcus
WDNRYGCLIAIEILELLKDIELDVDLY

SEQ ID NO: 2088795 - protein, 19 aa, Staphylococcus
WDSEDDFKGWLKSDAFKEA

SEQ ID NO: 2088796 - protein, 31 aa, Staphylococcus
WECPDFFNLNQTDVLLFCPQGISPEGERFNN

SEQ ID NO: 2088797 - protein, 24 aa, Staphylococcus
WEDELSMIFVVINNKSKKVKSRAG

SEQ ID NO: 2088798 - protein, 24 aa, Staphylococcus
WEDELSMIFVVINNQSKKVSSRSG

SEQ ID NO: 2088799 - protein, 17 aa, Staphylococcus
WEFLTSEKWMGMEPEKL

SEQ ID NO: 2088800 - protein, 19 aa, Staphylococcus
WEGTHFSFGFSKLYRTNCP

SEQ ID NO: 2088801 - protein, 18 aa, Staphylococcus
WEHAYYLKYQNKRPDYIS

SEQ ID NO: 2088802 - protein, 25 aa, Staphylococcus
WEKDLSMIFVVINNQSKKVSSRSGM

SEQ ID NO: 2088803 - protein, 25 aa, Staphylococcus
WENELAMVFVVINNKSKKVSSRSGM

SEQ ID NO: 2088804 - protein, 27 aa, Staphylococcus
WENEWKNYFHPFRASEKFTIVPSWEQY

SEQ ID NO: 2088805 - protein, 27 aa, Staphylococcus
WENEWKNYFHPFRASKRFTIVPSWETY

SEQ ID NO: 2088806 - protein, 30 aa, Staphylococcus
WEQDADVLDTWFSSALWPFSTLGWPDTESE

SEQ ID NO: 2088807 - protein, 19 aa, Staphylococcus
WEQFFEEKGYYPVAVDAKH

SEQ ID NO: 2088808 - protein, 21 aa, Staphylococcus
WEQVYTIAYIGDEGGQVIFFY

SEQ ID NO: 2088809 - protein, 30 aa, Staphylococcus
WERLEKLRKAIPNVLFQMLLRASNAVGYKN

SEQ ID NO: 2088810 - protein, 19 aa, Staphylococcus
WESTLFAVPATLRKYIPEN

SEQ ID NO: 2088811 - protein, 25 aa, Staphylococcus
WESYFKEKGFYPVAIDAKHGKGLKQ

SEQ ID NO: 2088812 - protein, 19 aa, Staphylococcus
WETEEDFNNWVKSDAFKEA

SEQ ID NO: 2088813 - protein, 27 aa, Staphylococcus
WETSKDGKFLLRYPTVYIINDKKEKND

SEQ ID NO: 2088814 - protein, 18 aa, Staphylococcus
WEVLLKPAKRIKVGNKLT

SEQ ID NO: 2088815 - protein, 18 aa, Staphylococcus
WEVLLKPAKRIKVGNTLS

SEQ ID NO: 2088816 - protein, 18 aa, Staphylococcus
WEVLLKPAKRIKVGQKLS

SEQ ID NO: 2088817 - protein, 17 aa, Staphylococcus
WFALMNHLVQVSIDYVV

SEQ ID NO: 2088818 - protein, 19 aa, Staphylococcus
WFDEVYTNGWAFKGGSALK

SEQ ID NO: 2088819 - protein, 20 aa, Staphylococcus
WFDFDVVVATPDMMGEVGKL

SEQ ID NO: 2088820 - protein, 18 aa, Staphylococcus
WFEFFENNRSFFMKLFNI

SEQ ID NO: 2088821 - protein, 17 aa, Staphylococcus
WFIHEIMGYNTELKVVS

SEQ ID NO: 2088822 - protein, 20 aa, Staphylococcus
WFIIGMYELSKYLTNELIIY

SEQ ID NO: 2088823 - protein, 18 aa, Staphylococcus
WFIQGRIDFQIKLNGYRM

SEQ ID NO: 2088824 - protein, 27 aa, Staphylococcus
WFKQGKVTTLKPLDLNGYMVVIDTGVR

SEQ ID NO: 2088825 - protein, 17 aa, Staphylococcus
WFKVMNKLGYQHQGFTT

SEQ ID NO: 2088826 - protein, 17 aa, Staphylococcus
WFLSEFTTDLSLSIAYE

SEQ ID NO: 2088827 - protein, 18 aa, Staphylococcus
WFNIVQTFSKRESNDILD

SEQ ID NO: 2088828 - protein, 17 aa, Staphylococcus
WFNTLETFKNWKKKPGK

SEQ ID NO: 2088829 - protein, 19 aa, Staphylococcus
WFTIAVYELGKWLGRELYY

SEQ ID NO: 2088830 - protein, 29 aa, Staphylococcus
WFTSSLFNVFIDLDPYLFSKISNVFVGGE

SEQ ID NO: 2088831 - protein, 23 aa, Staphylococcus
WGAEIFHNLKSILKNRGLETAVG

SEQ ID NO: 2088832 - protein, 18 aa, Staphylococcus
WGFNPKYDLESMTKLMLD

SEQ ID NO: 2088833 - protein, 17 aa, Staphylococcus
WGFNPKYHLAKMTETMI

SEQ ID NO: 2088834 - protein, 20 aa, Staphylococcus
WGIAVLARYLIDVKEGVTLA

SEQ ID NO: 2088835 - protein, 17 aa, Staphylococcus
WGIIDIVSFTTGEMRLI

SEQ ID NO: 2088836 - protein, 21 aa, Staphylococcus
WGPRTLDIDILLYGNKIIEDQ

SEQ ID NO: 2088837 - protein, 20 aa, Staphylococcus
WGPRTLDIDILLYSDDIIET

SEQ ID NO: 2088838 - protein, 27 aa, Staphylococcus
WGRTFRVDYWFMGSYINELRKKYTFPV

SEQ ID NO: 2088839 - protein, 17 aa, Staphylococcus
WGSLLELQTVPQGFYYP

SEQ ID NO: 2088840 - protein, 19 aa, Staphylococcus
WGSVPYLYYVANKDIAEEQ

SEQ ID NO: 2088841 - protein, 17 aa, Staphylococcus
WGTGIFHHIAWAVPNNE

SEQ ID NO: 2088842 - protein, 20 aa, Staphylococcus
WGYDFRPHYALIGQITHHFK

SEQ ID NO: 2088843 - protein, 19 aa, Staphylococcus
WGYDFRPHYALISKITNYY

SEQ ID NO: 2088844 - protein, 18 aa, Staphylococcus
WHDLKITPYAPIELDPAA

SEQ ID NO: 2088845 - protein, 18 aa, Staphylococcus
WHNGIAKFITSFNLSDEE

SEQ ID NO: 2088846 - protein, 17 aa, Staphylococcus
WHNPEVRTAIFDMMNWW

SEQ ID NO: 2088847 - protein, 18 aa, Staphylococcus
WHQYTNAIIYYYMVDKHA

SEQ ID NO: 2088848 - protein, 23 aa, Staphylococcus
WHSALQFVFVLRGKLTIRISDKN

SEQ ID NO: 2088849 - protein, 17 aa, Staphylococcus
WHVSRTTIYRYLNKLED

SEQ ID NO: 2088850 - protein, 27 aa, Staphylococcus
WIEVLENPPWNLTYKNNFKFISQQNIG

SEQ ID NO: 2088851 - protein, 19 aa, Staphylococcus
WIFDKLSTLGFKHEGFHNG

SEQ ID NO: 2088852 - protein, 24 aa, Staphylococcus
WIGAEHFCLKFAQILVKENEELNF

SEQ ID NO: 2088853 - protein, 17 aa, Staphylococcus
WIKWYSIDTTIDDILYT

SEQ ID NO: 2088854 - protein, 20 aa, Staphylococcus
WILDESRQELWDYPLLSEEV

SEQ ID NO: 2088855 - protein, 17 aa, Staphylococcus
WILSTFPEWGTWLNEEI

SEQ ID NO: 2088856 - protein, 18 aa, Staphylococcus
WINSGVATLKKYFDGRET

SEQ ID NO: 2088857 - protein, 18 aa, Staphylococcus
WIPVDERLNRMLKGEKTN

SEQ ID NO: 2088858 - protein, 20 aa, Staphylococcus
WIQQNYLICDSMRAADLFES

SEQ ID NO: 2088859 - protein, 17 aa, Staphylococcus
WIRGNIDTRLKKLETED

SEQ ID NO: 2088860 - protein, 22 aa, Staphylococcus
WKDVLQLIAAQLLYTIKKDGPD

SEQ ID NO: 2088861 - protein, 33 aa, Staphylococcus
WKETKTFFEKLMDLLIFMIPGYKKEGKSQLVIA

SEQ ID NO: 2088862 - protein, 25 aa, Staphylococcus
WKGIPAGISLKLISIFTGKRKRLKW

SEQ ID NO: 2088863 - protein, 18 aa, Staphylococcus
WKLAKMNLAIRGIDNDLG

SEQ ID NO: 2088864 - protein, 17 aa, Staphylococcus
WKNEGYYGFGAGASGYV

SEQ ID NO: 2088865 - protein, 26 aa, Staphylococcus
WKQYNVNLVFFLAISKKDLEVAKSFI

SEQ ID NO: 2088866 - protein, 21 aa, Staphylococcus
WKRVLDMNDRALRHVNVGLGG

SEQ ID NO: 2088867 - protein, 20 aa, Staphylococcus
WKRWIYIHLLNMTIGQHTAI

SEQ ID NO: 2088868 - protein, 17 aa, Staphylococcus
WLAIVFDIGHGCTRELP

SEQ ID NO: 2088869 - protein, 19 aa, Staphylococcus
WLEEGVLSKLDLAFSRETE

SEQ ID NO: 2088870 - protein, 19 aa, Staphylococcus
WLEHQMYGVLLLGQRNHHP

SEQ ID NO: 2088871 - protein, 19 aa, Staphylococcus
WLGANNLICTLPATSAKED

SEQ ID NO: 2088872 - protein, 17 aa, Staphylococcus
WLGPDVQDLTRELYKEH

SEQ ID NO: 2088873 - protein, 20 aa, Staphylococcus
WLGTLAQPIETLEPGLYECS

SEQ ID NO: 2088874 - protein, 19 aa, Staphylococcus
WLGYIGLNYLPKDSKYPFE

SEQ ID NO: 2088875 - protein, 17 aa, Staphylococcus
WLKKYHLYPKKNTILMS

SEQ ID NO: 2088876 - protein, 18 aa, Staphylococcus
WLNCGYNRWNHNEPMVGQ

SEQ ID NO: 2088877 - protein, 19 aa, Staphylococcus
WLNCGYTRWNHNEPLIGQT

SEQ ID NO: 2088878 - protein, 20 aa, Staphylococcus
WLNCGYTRWNHNEPLVGQIT

SEQ ID NO: 2088879 - protein, 20 aa, Staphylococcus
WLNCGYTRWNHNEPLVGQTT

SEQ ID NO: 2088880 - protein, 18 aa, Staphylococcus
WLNLPLEEDIRELGTPLP

SEQ ID NO: 2088881 - protein, 21 aa, Staphylococcus
WLNYLVDHFYVIKTMDNAYIF

SEQ ID NO: 2088882 - protein, 18 aa, Staphylococcus
WLTILKKKESYEEAFYNF

SEQ ID NO: 2088883 - protein, 20 aa, Staphylococcus
WMERMIAYGFEENIDYIIQS

SEQ ID NO: 2088884 - protein, 19 aa, Staphylococcus
WMGILLTLVPKPIRNFGYD

SEQ ID NO: 2088885 - protein, 28 aa, Staphylococcus
WMKSNYYAPLLKIFNKNVYFLLNIRHGV

SEQ ID NO: 2088886 - protein, 19 aa, Staphylococcus
WMSIVLRPDVPFDTITKFN

SEQ ID NO: 2088887 - protein, 36 aa, Staphylococcus
WMSLVLRPNVPFSMIPKFNLFVALGIRDAIQSFTND

SEQ ID NO: 2088888 - protein, 17 aa, Staphylococcus
WMSRESEARLKRISSEL

SEQ ID NO: 2088889 - protein, 30 aa, Staphylococcus
WNDPDGSFYIWFKFSISINVKTLFNESIKE

SEQ ID NO: 2088890 - protein, 18 aa, Staphylococcus
WNHFEKGIYVDKLSGKPL

SEQ ID NO: 2088891 - protein, 21 aa, Staphylococcus
WNIAQMRIFWQYTAIVRKYAQ

SEQ ID NO: 2088892 - protein, 19 aa, Staphylococcus
WNKTLYQQWRDTLLKVGIG

SEQ ID NO: 2088893 - protein, 21 aa, Staphylococcus
WNLARAIYQEWYLGTTLYEKV

SEQ ID NO: 2088894 - protein, 22 aa, Staphylococcus
WNNYYEYQFRNAKFVDFFITAT

SEQ ID NO: 2088895 - protein, 17 aa, Staphylococcus
WNPLQIMNDFGMDVFNP

SEQ ID NO: 2088896 - protein, 20 aa, Staphylococcus
WNQPMFTDHGTFIIGFSVAK

SEQ ID NO: 2088897 - protein, 24 aa, Staphylococcus
WNSDRFFEVIQRFELPTNVQIKTF

SEQ ID NO: 2088898 - protein, 17 aa, Staphylococcus
WNSLYWNNHDNPRCVSR

SEQ ID NO: 2088899 - protein, 41 aa, Staphylococcus
WNSNELQYHRGLLFLKAMELQKLILIANNGPVYYAMQDFKA

SEQ ID NO: 2088900 - protein, 19 aa, Staphylococcus
WNSNLKKFIFASSAAVYGD

SEQ ID NO: 2088901 - protein, 18 aa, Staphylococcus
WNTLKKWKTNKEAFMTAI

SEQ ID NO: 2088902 - protein, 19 aa, Staphylococcus
WNTLPAKGGINIYFRSWYA

SEQ ID NO: 2088903 - protein, 17 aa, Staphylococcus
WPGTIVSIVHRIGPLKI

SEQ ID NO: 2088904 - protein, 19 aa, Staphylococcus
WPKSVTPFDLHLITINPKK

SEQ ID NO: 2088905 - protein, 25 aa, Staphylococcus
WPQIKKRYEIWLKPQNFDEKGNQVN

SEQ ID NO: 2088906 - protein, 19 aa, Staphylococcus
WQACYKYLRKLIFEETELE

SEQ ID NO: 2088907 - protein, 28 aa, Staphylococcus
WQCVDLANMYWYKLFGHGLKGEGAADIP

SEQ ID NO: 2088908 - protein, 17 aa, Staphylococcus
WQDKFFNHRFSHSVFND

SEQ ID NO: 2088909 - protein, 26 aa, Staphylococcus
WQGQYTHFDILPLIYKMPNSKIKYHE

SEQ ID NO: 2088910 - protein, 19 aa, Staphylococcus
WQKQFPFWSERTIKRTFSS

SEQ ID NO: 2088911 - protein, 18 aa, Staphylococcus
WQRRQGVTLIGDAAHLMA

SEQ ID NO: 2088912 - protein, 28 aa, Staphylococcus
WQVVPRAWSHIFLALINKPIQEGPLPEQ

SEQ ID NO: 2088913 - protein, 18 aa, Staphylococcus
WQYAMNSALPDDIYVKEV

SEQ ID NO: 2088914 - protein, 17 aa, Staphylococcus
WQYAMNSALPDDIYVNE

SEQ ID NO: 2088915 - protein, 19 aa, Staphylococcus
WRAGCIIRARFLQKIKDAY

SEQ ID NO: 2088916 - protein, 18 aa, Staphylococcus
WRGKRYLYTGLFDNDKKL

SEQ ID NO: 2088917 - protein, 19 aa, Staphylococcus
WRGKRYLYTGLFDNDKKLK

SEQ ID NO: 2088918 - protein, 17 aa, Staphylococcus
WRKDAYLNYVTRQWIDF

SEQ ID NO: 2088919 - protein, 22 aa, Staphylococcus
WRKFIEAFPKYKGVQFEAWSFG

SEQ ID NO: 2088920 - protein, 19 aa, Staphylococcus
WRKLENEIIELLPKAYQTG

SEQ ID NO: 2088921 - protein, 18 aa, Staphylococcus
WRQQGQYHAFNPTTIRLL

SEQ ID NO: 2088922 - protein, 28 aa, Staphylococcus
WRYHDVPNKLWNIQPLREFWGINKRTEV

SEQ ID NO: 2088923 - protein, 17 aa, Staphylococcus
WRYIENQLDKLMKLYNY

SEQ ID NO: 2088924 - protein, 28 aa, Staphylococcus
WRYQDVPDKLWPIQPLRDFWGINKRTEA

SEQ ID NO: 2088925 - protein, 26 aa, Staphylococcus
WSHDVTPLPFDLFNKQLETAISIGPD

SEQ ID NO: 2088926 - protein, 20 aa, Staphylococcus
WSKIAFGKIFYNPDMPVIKD

SEQ ID NO: 2088927 - protein, 28 aa, Staphylococcus
WSKVHPRAYVDFYKSDCWYHAKAYKCSS

SEQ ID NO: 2088928 - protein, 18 aa, Staphylococcus
WSLERLLKTDRIILRMAT

SEQ ID NO: 2088929 - protein, 25 aa, Staphylococcus
WSNAKLDFLKLKEILMDWQIGIFEG

SEQ ID NO: 2088930 - protein, 17 aa, Staphylococcus
WSRRSTIFPDFIGHTFA

SEQ ID NO: 2088931 - protein, 17 aa, Staphylococcus
WSTGHLPYLLELGAIEL

SEQ ID NO: 2088932 - protein, 18 aa, Staphylococcus
WSYGHFAKEIEMGQPLNL

SEQ ID NO: 2088933 - protein, 17 aa, Staphylococcus
WSYLGELLVSIPFEPDD

SEQ ID NO: 2088934 - protein, 18 aa, Staphylococcus
WSYLVKQGQLDHPEAFIK

SEQ ID NO: 2088935 - protein, 20 aa, Staphylococcus
WTAHFGIPTILYGPGSLTEA

SEQ ID NO: 2088936 - protein, 17 aa, Staphylococcus
WTEQYDIWFSIYSTPSE

SEQ ID NO: 2088937 - protein, 20 aa, Staphylococcus
WTGKLLQQYLPCETVIGVKG

SEQ ID NO: 2088938 - protein, 18 aa, Staphylococcus
WTGLFRSKKHQVALPVSA

SEQ ID NO: 2088939 - protein, 19 aa, Staphylococcus
WTGNLFITAINAKSGQLAT

SEQ ID NO: 2088940 - protein, 27 aa, Staphylococcus
WTHDEMLKVIAFFNQIERYYESSVLSD

SEQ ID NO: 2088941 - protein, 18 aa, Staphylococcus
WTKAFNIPRHLDGSKLNE

SEQ ID NO: 2088942 - protein, 25 aa, Staphylococcus
WTKSHHQLIFFGRYHCLARAPKCDI

SEQ ID NO: 2088943 - protein, 30 aa, Staphylococcus
WTQDEDVLDTWFSSALWPFSTLGWPDVDAE

SEQ ID NO: 2088944 - protein, 30 aa, Staphylococcus
WTQDEDVLDTWFSSALWPFSTLGWPNEEAK

SEQ ID NO: 2088945 - protein, 17 aa, Staphylococcus
WTQHGIRIIPGPSSMWF

SEQ ID NO: 2088946 - protein, 19 aa, Staphylococcus
WTSINALELGIPLTIITES

SEQ ID NO: 2088947 - protein, 22 aa, Staphylococcus
WTTFKVDMLLKSLSTKSFELQK

SEQ ID NO: 2088948 - protein, 17 aa, Staphylococcus
WTTFNEIGPIGDGQYLV

SEQ ID NO: 2088949 - protein, 31 aa, Staphylococcus
WTVAYTKLHNFHWYVKGPNFFSLHEKFEELY

SEQ ID NO: 2088950 - protein, 30 aa, Staphylococcus
WTVAYTKLHNFHWYVKGPNFFSLHTKFEEL

SEQ ID NO: 2088951 - protein, 31 aa, Staphylococcus; identical to SEQ ID NO: 1690617

SEQ ID NO: 2088952 - protein, 18 aa, Staphylococcus
WTYLFENPILHKEEFNKY

SEQ ID NO: 2088953 - protein, 17 aa, Staphylococcus
WVAEHHNVFSVASSAPE

SEQ ID NO: 2088954 - protein, 22 aa, Staphylococcus
WVEKWQHYSPLDLPTTWDDKRL

SEQ ID NO: 2088955 - protein, 30 aa, Staphylococcus
WVISRQRVWGVPLPVFYAENGDIIMTSETV

SEQ ID NO: 2088956 - protein, 22 aa, Staphylococcus
WVNQAQLLTSKKMLYIANVGED

SEQ ID NO: 2088957 - protein, 23 aa, Staphylococcus
WVNQAQLLTSKKMLYIANVGEDE

SEQ ID NO: 2088958 - protein, 30 aa, Staphylococcus
WVQDEDVLDTWFSSALWPFSTLGWPDVEAD

SEQ ID NO: 2088959 - protein, 31 aa, Staphylococcus
WVQDEDVLDTWFSSALWPFSTLGWPNIDADD

SEQ ID NO: 2088960 - protein, 30 aa, Staphylococcus
WVQDEDVLDTWFSSGLWPFSTLGWPDVESE

SEQ ID NO: 2088961 - protein, 40 aa, Staphylococcus
WVQEEPKNQGAWLFVYPYLKSIVGHQYNLSYQGRIQRAAP

SEQ ID NO: 2088962 - protein, 38 aa, Staphylococcus
WVQEEPKNQGAWLFVYPYLKSLVGNQFNLSYHGRIQRA

SEQ ID NO: 2088963 - protein, 26 aa, Staphylococcus
WVQEYAPIFYQLWKRKHKKTYYKWRI

SEQ ID NO: 2088964 - protein, 38 aa, Staphylococcus
WVRDEIIGPLLHYRMVQELPTFFSSNLSFEELEHHLSI

SEQ ID NO: 2088965 - protein, 38 aa, Staphylococcus
WVRDEVIGPLLHYRMVQELPTFFSSNLNFEELEHHLSI

SEQ ID NO: 2088966 - protein, 19 aa, Staphylococcus
WVRSFKLRGAYNAISVLTS

SEQ ID NO: 2088967 - protein, 19 aa, Staphylococcus
WVSKKQLIPSYTKDNLRHF

SEQ ID NO: 2088968 - protein, 25 aa, Staphylococcus
WYDELEWPIDRKGGYVIHRLAGSPE

SEQ ID NO: 2088969 - protein, 30 aa, Staphylococcus
WYDTSNPNVAVLRRYWNGEWLNETVDDVEK

SEQ ID NO: 2088970 - protein, 31 aa, Staphylococcus
WYEYSPLRVRYPYMRGKLWELWTTALEEHEG

SEQ ID NO: 2088971 - protein, 19 aa, Staphylococcus
WYLEYRITLNRPGLLGDVS

SEQ ID NO: 2088972 - protein, 25 aa, Staphylococcus
WYNANYIIMWGSNVPLTRTPDAHFM

SEQ ID NO: 2088973 - protein, 17 aa, Staphylococcus
WYNGIVSYILKNSQLAS

SEQ ID NO: 2088974 - protein, 17 aa, Staphylococcus
WYTEIYNLDIQPAISVE

SEQ ID NO: 2088975 - protein, 20 aa, Staphylococcus
WYYRATKSNIYLSLGAIKGV

SEQ ID NO: 2088976 - protein, 28 aa, Staphylococcus
YAAENDITFVPYFPLASGILAGKYEENQ

SEQ ID NO: 2088977 - protein, 28 aa, Staphylococcus
YAAENQITFVPYFPLASGILAGKYDEDT

SEQ ID NO: 2088978 - protein, 31 aa, Staphylococcus
YAAFEPTLDYVISKIPRFPFDKFEKGERVLG

SEQ ID NO: 2088979 - protein, 24 aa, Staphylococcus
YAAQYVLAELPFFLNANPIINTQE

SEQ ID NO: 2088980 - protein, 22 aa, Staphylococcus
YADGEKRYIIAPKGLQVGQVVE

SEQ ID NO: 2088981 - protein, 21 aa, Staphylococcus
YAERQGGYTRILKVGPRRGDG

SEQ ID NO: 2088982 - protein, 25 aa, Staphylococcus
YAERTAPWLERLGFDNVKAVLLDPE

SEQ ID NO: 2088983 - protein, 20 aa, Staphylococcus
YAEVQLKLDNKARKLQVDSD

SEQ ID NO: 2088984 - protein, 18 aa, Staphylococcus
YAFDYLPDRERRAVWAIY

SEQ ID NO: 2088985 - protein, 18 aa, Staphylococcus
YAFIKRLIKQFGKPQMII

SEQ ID NO: 2088986 - protein, 24 aa, Staphylococcus
YAFRSMKRKLPKLDRLSIKETKER

SEQ ID NO: 2088987 - protein, 19 aa, Staphylococcus
YAGDVWYPQPAPADHPWRT

SEQ ID NO: 2088988 - protein, 19 aa, Staphylococcus
YAGGHGVMWDFAKDKGLID

SEQ ID NO: 2088989 - protein, 23 aa, Staphylococcus
YAGGKDIAFPSVSLICHELNISK

SEQ ID NO: 2088990 - protein, 20 aa, Staphylococcus
YAGLWYGQMINCETTQIIGY

SEQ ID NO: 2088991 - protein, 18 aa, Staphylococcus
YAHARICSILRQAKEQGV

SEQ ID NO: 2088992 - protein, 18 aa, Staphylococcus
YAHDIIYTTNGRLGFDYL

SEQ ID NO: 2088993 - protein, 18 aa, Staphylococcus
YAHKLLPLSPKREDNFIA

SEQ ID NO: 2088994 - protein, 18 aa, Staphylococcus
YAHVMHTHLLINFVTQLE

SEQ ID NO: 2088995 - protein, 18 aa, Staphylococcus
YAHVMHTHLLINFVTRDA

SEQ ID NO: 2088996 - protein, 22 aa, Staphylococcus
YAICKKLGKKKIFFGDTVRLRP

SEQ ID NO: 2088997 - protein, 31 aa, Staphylococcus
YAIDFSGYSMFWANLILATKVKRKLIYLHSD

SEQ ID NO: 2088998 - protein, 19 aa, Staphylococcus
YAIGDLTSGYQLAHAASAH

SEQ ID NO: 2088999 - protein, 25 aa, Staphylococcus
YAIHYAFEHYSIDKVYFKIRSKNAT

SEQ ID NO: 2089000 - protein, 23 aa, Staphylococcus
YAITFYLDKFNYTDGLIAPVHSF

SEQ ID NO: 2089001 - protein, 17 aa, Staphylococcus
YAIVHPMHPEYEYPFHF

SEQ ID NO: 2089002 - protein, 18 aa, Staphylococcus
YAIYVEYGTGIYATGPGG

SEQ ID NO: 2089003 - protein, 19 aa, Staphylococcus
YAKAKYWVSNARLPLYLNK

SEQ ID NO: 2089004 - protein, 27 aa, Staphylococcus
YAKEERLLYITLKLLEANTPTSSQVLA

SEQ ID NO: 2089005 - protein, 17 aa, Staphylococcus
YAKEHGFEVLATLGDYA

SEQ ID NO: 2089006 - protein, 19 aa, Staphylococcus
YALCHYTLVLYITNNKEKF

SEQ ID NO: 2089007 - protein, 21 aa, Staphylococcus
YALHALLFMIKNNGDVQRIPV

SEQ ID NO: 2089008 - protein, 20 aa, Staphylococcus
YALLKILKKQILTERYTLVF

SEQ ID NO: 2089009 - protein, 23 aa, Staphylococcus
YALQGLLDQYPGLQVAMEPFGAY

SEQ ID NO: 2089010 - protein, 19 aa, Staphylococcus
YALTVFKRDKVTGNIEIVD

SEQ ID NO: 2089011 - protein, 25 aa, Staphylococcus
YANDLLTTPVNLAGLPGISIPCGQT

SEQ ID NO: 2089012 - protein, 24 aa, Staphylococcus
YANDLLTTPVNLAGLPGISVPCGQ

SEQ ID NO: 2089013 - protein, 25 aa, Staphylococcus
YANDLLTTPVNLAGLPGISVPCGQF

SEQ ID NO: 2089014 - protein, 24 aa, Staphylococcus
YANGKYFSFYTAQDITPRFAKVQQ

SEQ ID NO: 2089015 - protein, 28 aa, Staphylococcus
YANHLEEPLTFPLITLIVSGGHTELVYM

SEQ ID NO: 2089016 - protein, 29 aa, Staphylococcus
YANHLEKPLQFPLIALIVSGGHTELVYMK

SEQ ID NO: 2089017 - protein, 17 aa, Staphylococcus
YANKFMRQLHPYEGEQF

SEQ ID NO: 2089018 - protein, 17 aa, Staphylococcus
YANKFNRKLHPYEGKQY

SEQ ID NO: 2089019 - protein, 27 aa, Staphylococcus
YANQELVHFFFNELTKYLKKYNCLYVR

SEQ ID NO: 2089020 - protein, 26 aa, Staphylococcus
YAPEFEKIIPLHIMLVSSSHIITTSM

SEQ ID NO: 2089021 - protein, 23 aa, Staphylococcus
YAPPSKIRLIIDRDIVGIPDKYL

SEQ ID NO: 2089022 - protein, 19 aa, Staphylococcus
YAQFGIRINNISPGAIVTK

SEQ ID NO: 2089023 - protein, 20 aa, Staphylococcus
YAQYGIRINNISPGAIVTEH

SEQ ID NO: 2089024 - protein, 25 aa, Staphylococcus
YARDNQLKIIASCPFAKHVLETNDD

SEQ ID NO: 2089025 - protein, 20 aa, Staphylococcus
YARENNLKIIASCPFAKDVL

SEQ ID NO: 2089026 - protein, 17 aa, Staphylococcus
YARIMPHITIKSHFEIN

SEQ ID NO: 2089027 - protein, 19 aa, Staphylococcus
YARNIIDHFPEFKQFYAGK

SEQ ID NO: 2089028 - protein, 25 aa, Staphylococcus
YARNTPFMRLYETDGIRNESIIHTG

SEQ ID NO: 2089029 - protein, 22 aa, Staphylococcus
YARVNEFGFIETPYRKVDLETN

SEQ ID NO: 2089030 - protein, 22 aa, Staphylococcus
YASFIRQQWAKLGLGLDYDRER

SEQ ID NO: 2089031 - protein, 27 aa, Staphylococcus
YATAVELALIPLLQNKLIQLDSIIIDA

SEQ ID NO: 2089032 - protein, 24 aa, Staphylococcus
YATDPLAFVRWHYDKKKRIIYAVD

SEQ ID NO: 2089033 - protein, 25 aa, Staphylococcus
YATDPRLYKDAKRLDYVSYEEMMEM

SEQ ID NO: 2089034 - protein, 18 aa, Staphylococcus
YATFTKYNDDVDAEIVFE

SEQ ID NO: 2089035 - protein, 17 aa, Staphylococcus
YATFTKYNDNVNAEIVF

SEQ ID NO: 2089036 - protein, 21 aa, Staphylococcus
YATISFLNWFLDEQVEEEAMF

SEQ ID NO: 2089037 - protein, 21 aa, Staphylococcus
YATISFLNWFLDEQVEEESMF

SEQ ID NO: 2089038 - protein, 17 aa, Staphylococcus
YATPFYEKLGYITSGRP

SEQ ID NO: 2089039 - protein, 24 aa, Staphylococcus
YAVDNLKANYKKNALEKAKDYADT

SEQ ID NO: 2089040 - protein, 18 aa, Staphylococcus
YAVIITTGAEYKKIGVPG

SEQ ID NO: 2089041 - protein, 17 aa, Staphylococcus
YAVLSYPEYADGDASQV

SEQ ID NO: 2089042 - protein, 26 aa, Staphylococcus
YAVNFEEEYWDKVFTYFLDEYKKGRT

SEQ ID NO: 2089043 - protein, 24 aa, Staphylococcus
YAVNFEEEYWNKVFTYFLDEYKKG

SEQ ID NO: 2089044 - protein, 28 aa, Staphylococcus
YAVNFEQEYWDKVFTYFLDEYKKGRTPN

SEQ ID NO: 2089045 - protein, 33 aa, Staphylococcus
YAVVPPLTHFITNSTYFLWDVLTTAFVGKPDLV

SEQ ID NO: 2089046 - protein, 19 aa, Staphylococcus
YAYFSRHLDFDIPEEGQYA

SEQ ID NO: 2089047 - protein, 25 aa, Staphylococcus
YCAEHDIITILNPAPYRDLTAEVID

SEQ ID NO: 2089048 - protein, 21 aa, Staphylococcus
YCANMSEMLGIELYVKYEGAN

SEQ ID NO: 2089049 - protein, 18 aa, Staphylococcus
YCATKFAVRALTEALRQE

SEQ ID NO: 2089050 - protein, 25 aa, Staphylococcus
YCDEHDMISILNPAPFREVEADVID

SEQ ID NO: 2089051 - protein, 17 aa, Staphylococcus
YCDRFIILDKGKVVAFG

SEQ ID NO: 2089052 - protein, 18 aa, Staphylococcus
YCDRFIILDKGKVVAFGD

SEQ ID NO: 2089053 - protein, 25 aa, Staphylococcus
YCEEQQFYPLISFTAPRIENLLEMV

SEQ ID NO: 2089054 - protein, 18 aa, Staphylococcus
YCFSIITSATQYPDKLKE

SEQ ID NO: 2089055 - protein, 27 aa, Staphylococcus
YCINSAAIQFIPYDKLEELGYGDLIPH

SEQ ID NO: 2089056 - protein, 27 aa, Staphylococcus
YCINSAAIQFIPYDKLEELGYGDLIQH

SEQ ID NO: 2089057 - protein, 27 aa, Staphylococcus
YCINSAAIQFIPYDKLQELGYGDLIPH

SEQ ID NO: 2089058 - protein, 27 aa, Staphylococcus
YCINSAAIQFIPYEKLEELGYGDLIQH

SEQ ID NO: 2089059 - protein, 18 aa, Staphylococcus
YCIPDPFDKRVAPSVARE

SEQ ID NO: 2089060 - protein, 18 aa, Staphylococcus
YCIPGPFDKRVAPSVARE

SEQ ID NO: 2089061 - protein, 17 aa, Staphylococcus
YCNHKVLMFGGGGYNIW

SEQ ID NO: 2089062 - protein, 19 aa, Staphylococcus
YCPNCGKLLVYDYIHYNQI

SEQ ID NO: 2089063 - protein, 24 aa, Staphylococcus
YCPNCGRLLHYDYIQYNQIGHYHC

SEQ ID NO: 2089064 - protein, 24 aa, Staphylococcus
YCPNCGRLLQYDYIHYNQIGHYHC

SEQ ID NO: 2089065 - protein, 18 aa, Staphylococcus
YCPNCGRLLTYDYTHYNQ

SEQ ID NO: 2089066 - protein, 18 aa, Staphylococcus
YCSLLNGYTLVIANNEER

SEQ ID NO: 2089067 - protein, 17 aa, Staphylococcus
YCYLLNKDFNYQVPTLM

SEQ ID NO: 2089068 - protein, 25 aa, Staphylococcus
YCYNYCIWLIQHGLPKNYEFATLKG

SEQ ID NO: 2089069 - protein, 17 aa, Staphylococcus
YDAAMKYKEDGTGLVVL

SEQ ID NO: 2089070 - protein, 20 aa, Staphylococcus
YDAFATPFILLNGEPMHQID

SEQ ID NO: 2089071 - protein, 23 aa, Staphylococcus
YDAIIEIETIFPYITLSHFSKEQ

SEQ ID NO: 2089072 - protein, 19 aa, Staphylococcus
YDAISAVTPFYYPFSFEEI

SEQ ID NO: 2089073 - protein, 19 aa, Staphylococcus
YDALSAVTPFYYPLSFEEI

SEQ ID NO: 2089074 - protein, 26 aa, Staphylococcus
YDASQQILLPLYKKGKFASIQMFNAL

SEQ ID NO: 2089075 - protein, 18 aa, Staphylococcus
YDCRFGITHLPTHGFSLR

SEQ ID NO: 2089076 - protein, 36 aa, Staphylococcus
YDCYRRLLQMFGEVVYNIPMVAFDTYFEDYKQRHGF

SEQ ID NO: 2089077 - protein, 22 aa, Staphylococcus
YDDDVIKYHRYLNDISNKAVGG

SEQ ID NO: 2089078 - protein, 25 aa, Staphylococcus
YDDEEYLFHVLKSGAKGYILKNAPD

SEQ ID NO: 2089079 - protein, 24 aa, Staphylococcus
YDDEEYLFHVLRNGAKGYILKNSP

SEQ ID NO: 2089080 - protein, 20 aa, Staphylococcus
YDDFTLFKKINQAHWEAFQN

SEQ ID NO: 2089081 - protein, 24 aa, Staphylococcus
YDDIARMILHMIDHFEGRLFTERV

SEQ ID NO: 2089082 - protein, 24 aa, Staphylococcus
YDDKRIHFFLKLIKENGTLAATNE

SEQ ID NO: 2089083 - protein, 30 aa, Staphylococcus
YDDKVFQGEALLFLLGLTNSMAGFEKLVPD

SEQ ID NO: 2089084 - protein, 30 aa, Staphylococcus
YDDKYYYYIDPLWSHLFKFVIFPAIVPNRF

SEQ ID NO: 2089085 - protein, 25 aa, Staphylococcus
YDDLLRSLPYTDVRYKKKLSTRLAE

SEQ ID NO: 2089086 - protein, 24 aa, Staphylococcus
YDDNKTIYFNPGAVGLNNGANAVY

SEQ ID NO: 2089087 - protein, 28 aa, Staphylococcus
YDDVARMILHMVDHLNGILFTDKANRIL

SEQ ID NO: 2089088 - protein, 26 aa, Staphylococcus
YDDVEFKLYIGLKHIHPFIEDAVQSM

SEQ ID NO: 2089089 - protein, 17 aa, Staphylococcus
YDDVMRFGRYHPDYKTI

SEQ ID NO: 2089090 - protein, 18 aa, Staphylococcus
YDEIIRHIPGNGKFLYSP

SEQ ID NO: 2089091 - protein, 27 aa, Staphylococcus
YDEINFDLVRIINLSLRAKYLFDYNLD

SEQ ID NO: 2089092 - protein, 25 aa, Staphylococcus
YDEKRVHFFLELFKNDETLAATSEI

SEQ ID NO: 2089093 - protein, 17 aa, Staphylococcus
YDELNTTTLIPIFDEAV

SEQ ID NO: 2089094 - protein, 23 aa, Staphylococcus
YDENYDIHFFSRSSNFVKIRGYR

SEQ ID NO: 2089095 - protein, 20 aa, Staphylococcus
YDEWIYNFNACPVVRVNINE

SEQ ID NO: 2089096 - protein, 22 aa, Staphylococcus
YDEYDKGYILKWLVTNSNEYDM

SEQ ID NO: 2089097 - protein, 22 aa, Staphylococcus
YDEYDRGYILNWLVTDSNEFEM

SEQ ID NO: 2089098 - protein, 22 aa, Staphylococcus
YDEYDRGYILNWLVTKSNEFEM

SEQ ID NO: 2089099 - protein, 24 aa, Staphylococcus
YDFDSAIMLVGLSNSLLISEAKAI

SEQ ID NO: 2089100 - protein, 20 aa, Staphylococcus
YDFIEVQPPKLYQDLIDREL

SEQ ID NO: 2089101 - protein, 19 aa, Staphylococcus
YDFIKLQKQSEFGLGIIGE

SEQ ID NO: 2089102 - protein, 17 aa, Staphylococcus
YDFLKQKRKAIIDNAYI

SEQ ID NO: 2089103 - protein, 17 aa, Staphylococcus
YDFPRVWLEKESYDFSF

SEQ ID NO: 2089104 - protein, 28 aa, Staphylococcus
YDFQEKQLIELLTRLGIKLNLPSLDFDT

SEQ ID NO: 2089105 - protein, 18 aa, Staphylococcus
YDFYTNILNLKLIKQTVN

SEQ ID NO: 2089106 - protein, 17 aa, Staphylococcus
YDGEAALALLRLYQRDK

SEQ ID NO: 2089107 - protein, 20 aa, Staphylococcus
YDGHHYNECPNFVKGHIPEL

SEQ ID NO: 2089108 - protein, 20 aa, Staphylococcus
YDGHRFEECPNFVKGHVPEL

SEQ ID NO: 2089109 - protein, 36 aa, Staphylococcus
YDGKRWIYNSYPNWAKQFPFWSERTIKRAFGSLEKQ

SEQ ID NO: 2089110 - protein, 20 aa, Staphylococcus
YDGRYLLYQPNDGGLAQIGP

SEQ ID NO: 2089111 - protein, 18 aa, Staphylococcus
YDGTLFTVKEHFERFLRS

SEQ ID NO: 2089112 - protein, 28 aa, Staphylococcus
YDGTQLMRYMHPYLTTIIQPISQIADKA

SEQ ID NO: 2089113 - protein, 21 aa, Staphylococcus
YDGVNKFKTVVGKDAFIGCNT

SEQ ID NO: 2089114 - protein, 18 aa, Staphylococcus
YDHILDTSLLFNIIPERF

SEQ ID NO: 2089115 - protein, 27 aa, Staphylococcus
YDHILDTSLLFNIIPERFQGREVNDDL

SEQ ID NO: 2089116 - protein, 21 aa, Staphylococcus
YDHLPLYQQAFSHSSFINDFN

SEQ ID NO: 2089117 - protein, 20 aa, Staphylococcus
YDHPFAFDNDLLISNLKDLR

SEQ ID NO: 2089118 - protein, 27 aa, Staphylococcus
YDIDDLPLGIYRFIQKQDKIYARTLEH

SEQ ID NO: 2089119 - protein, 24 aa, Staphylococcus
YDIEASTYLAQTEQFLYAITKENE

SEQ ID NO: 2089120 - protein, 18 aa, Staphylococcus
YDIELAYESGLLSRNEEN

SEQ ID NO: 2089121 - protein, 24 aa, Staphylococcus
YDIHKMLPHPINLVRVRLTGSELK

SEQ ID NO: 2089122 - protein, 24 aa, Staphylococcus
YDINEKVIMLITKQQPIATDLRMM

SEQ ID NO: 2089123 - protein, 24 aa, Staphylococcus
YDINEQVIMLITKQQPIATDLRMM

SEQ ID NO: 2089124 - protein, 21 aa, Staphylococcus
YDIYSRLLKDRIIMLGSAIDD

SEQ ID NO: 2089125 - protein, 19 aa, Staphylococcus
YDIYYTCGPKPMLKAIKEH

SEQ ID NO: 2089126 - protein, 30 aa, Staphylococcus
YDKDLYTDIMPPSNLYLPVKFDGGEWVGTP

SEQ ID NO: 2089127 - protein, 19 aa, Staphylococcus
YDKEGGLSILFGNLAPKGA

SEQ ID NO: 2089128 - protein, 26 aa, Staphylococcus
YDKFANWIANKFLLTTPFDVDSKATL

SEQ ID NO: 2089129 - protein, 23 aa, Staphylococcus
YDKGIYLYQPISHSLLKIVAQKD

SEQ ID NO: 2089130 - protein, 22 aa, Staphylococcus
YDKNIIPTIPYKWDNSKAKYIN

SEQ ID NO: 2089131 - protein, 26 aa, Staphylococcus
YDKRYQTWNLNDLPIIPKHMKTIVIG

SEQ ID NO: 2089132 - protein, 28 aa, Staphylococcus
YDKTYKEWKLEDLPILPKQMHTVVIGKT

SEQ ID NO: 2089133 - protein, 21 aa, Staphylococcus
YDKVMLMDCLLQYTDIPAPYS

SEQ ID NO: 2089134 - protein, 34 aa, Staphylococcus
YDLALYKDNTFIGQPLWGSIGYTLPATLGTEIAA

SEQ ID NO: 2089135 - protein, 22 aa, Staphylococcus
YDLDILHMHYAVPHAICGILAK

SEQ ID NO: 2089136 - protein, 22 aa, Staphylococcus
YDLDILHMHYAVPHAICGILGR

SEQ ID NO: 2089137 - protein, 23 aa, Staphylococcus
YDLERYVPVMIVAIGKKAKEAHT

SEQ ID NO: 2089138 - protein, 19 aa, Staphylococcus
YDLGHFRGAVRPDITRFRD

SEQ ID NO: 2089139 - protein, 18 aa, Staphylococcus
YDLILKQNKVRGAEPEVT

SEQ ID NO: 2089140 - protein, 19 aa, Staphylococcus
YDLMLIQTDRHYGKTLVLN

SEQ ID NO: 2089141 - protein, 26 aa, Staphylococcus
YDLNERFIITRGLDKCLFGYTLDEWQ

SEQ ID NO: 2089142 - protein, 21 aa, Staphylococcus
YDLPGHVFIFGGQSLFEEMID

SEQ ID NO: 2089143 - protein, 18 aa, Staphylococcus
YDLPGHVFIFGGQTLFEE

SEQ ID NO: 2089144 - protein, 29 aa, Staphylococcus
YDLTEKRMILERILPILSDREKEIIQCTF

SEQ ID NO: 2089145 - protein, 30 aa, Staphylococcus; identical to SEQ ID NO: 1833791

SEQ ID NO: 2089146 - protein, 29 aa, Staphylococcus
YDLTEKRMILERILPILSEREREIIQCTF

SEQ ID NO: 2089147 - protein, 29 aa, Staphylococcus
YDLTEKRMILERILPILTDREREIIQCTF

SEQ ID NO: 2089148 - protein, 28 aa, Staphylococcus
YDLTKEEVLILLTLWDKGSMTLKEMDSY

SEQ ID NO: 2089149 - protein, 18 aa, Staphylococcus
YDLYYDGNTFYQLTTDMF

SEQ ID NO: 2089150 - protein, 18 aa, Staphylococcus
YDMNRDISPLKKADDAVT

SEQ ID NO: 2089151 - protein, 17 aa, Staphylococcus
YDMNREISPLKKATDAI

SEQ ID NO: 2089152 - protein, 25 aa, Staphylococcus
YDNKELVHFFFNELSKYVKKHHCLY

SEQ ID NO: 2089153 - protein, 27 aa, Staphylococcus
YDNKELVHFFFNELSKYVKKYNCLYLR

SEQ ID NO: 2089154 - protein, 24 aa, Staphylococcus
YDNLRNRIIITSRLFASTTKKEIK

SEQ ID NO: 2089155 - protein, 17 aa, Staphylococcus
YDNLYPTRIIVGEKSDK

SEQ ID NO: 2089156 - protein, 29 aa, Staphylococcus
YDNNPELENLLLDPYFKNIVTDYQDALRD

SEQ ID NO: 2089157 - protein, 25 aa, Staphylococcus
YDNRELVHFFFNELTKYLKQHNCLY

SEQ ID NO: 2089158 - protein, 23 aa, Staphylococcus
YDNSLEFLALFEKLSLEMNDVMN

SEQ ID NO: 2089159 - protein, 17 aa, Staphylococcus
YDNVDVVIMGGNTFRWL

SEQ ID NO: 2089160 - protein, 23 aa, Staphylococcus
YDPKHPYTWGLLSSMPDLTTSNE

SEQ ID NO: 2089161 - protein, 17 aa, Staphylococcus
YDPRKYLGPAREAIKAT

SEQ ID NO: 2089162 - protein, 17 aa, Staphylococcus
YDPRKYLGPAREAIKET

SEQ ID NO: 2089163 - protein, 24 aa, Staphylococcus
YDPVNQIVGYLLSGDPAYIPRHNE

SEQ ID NO: 2089164 - protein, 22 aa, Staphylococcus
YDQFNKFLYERDIAGYYLVVQE

SEQ ID NO: 2089165 - protein, 21 aa, Staphylococcus
YDQFNKFLYERDMDGYYLIVQ

SEQ ID NO: 2089166 - protein, 22 aa, Staphylococcus
YDQFNKFLYERDMDGYYLVVQE

SEQ ID NO: 2089167 - protein, 23 aa, Staphylococcus
YDQIQYVNIKYPIPFDPPNVPEE

SEQ ID NO: 2089168 - protein, 18 aa, Staphylococcus
YDQKRPMHSALNKTMFSG

SEQ ID NO: 2089169 - protein, 23 aa, Staphylococcus
YDSDRYVPVLAIAIGKKAQEAHG

SEQ ID NO: 2089170 - protein, 24 aa, Staphylococcus
YDSNNWWDSAVVPFYIKRKTTEFD

SEQ ID NO: 2089171 - protein, 19 aa, Staphylococcus
YDTEKRAWLKVLNTLLAEG

SEQ ID NO: 2089172 - protein, 18 aa, Staphylococcus
YDTLYTLEKLTESGYLTG

SEQ ID NO: 2089173 - protein, 25 aa, Staphylococcus
YDTTTAYDFLLNNFVEMQNTNKQKE

SEQ ID NO: 2089174 - protein, 25 aa, Staphylococcus
YDVDPSLILVGLSNTLLISEAEAVG

SEQ ID NO: 2089175 - protein, 19 aa, Staphylococcus
YDVHDKHALSHYDNWLLQW

SEQ ID NO: 2089176 - protein, 20 aa, Staphylococcus
YDVIIGIRPGCSFDKAKDDG

SEQ ID NO: 2089177 - protein, 17 aa, Staphylococcus
YDVLQLLKKYGFIIYFK

SEQ ID NO: 2089178 - protein, 17 aa, Staphylococcus
YDVLQLLKKYGYIIYFK

SEQ ID NO: 2089179 - protein, 25 aa, Staphylococcus
YDVQYEFLFMHPSGQQLREITELIE

SEQ ID NO: 2089180 - protein, 18 aa, Staphylococcus
YDVVVGINLLREGIDIPE

SEQ ID NO: 2089181 - protein, 20 aa, Staphylococcus
YDYDILVVALGFVSETFGIE

SEQ ID NO: 2089182 - protein, 24 aa, Staphylococcus
YDYIEVQPPALYQDLIDRELIRDN

SEQ ID NO: 2089183 - protein, 17 aa, Staphylococcus
YDYIKHIVQTKGYPPSV

SEQ ID NO: 2089184 - protein, 19 aa, Staphylococcus
YEAFMSWTERRFGYTFPQE

SEQ ID NO: 2089185 - protein, 17 aa, Staphylococcus
YEALLKVGCITRPFPTG

SEQ ID NO: 2089186 - protein, 17 aa, Staphylococcus
YEAMTERDEAEYVVKEI

SEQ ID NO: 2089187 - protein, 24 aa, Staphylococcus
YEANDLLQMMINTMENRLNEHNEN

SEQ ID NO: 2089188 - protein, 31 aa, Staphylococcus
YEANSFASCLLFPLNIRYKYRNVLNVGDAAD

SEQ ID NO: 2089189 - protein, 18 aa, Staphylococcus
YEAQAYRALDYLENFKKT

SEQ ID NO: 2089190 - protein, 27 aa, Staphylococcus
YEASQKLLFPLYKKGKFISLQLFHALS

SEQ ID NO: 2089191 - protein, 26 aa, Staphylococcus
YEASQKLLLPLYRKSKFPSPQMYNAL

SEQ ID NO: 2089192 - protein, 25 aa, Staphylococcus
YEASSPIEPTGLKVPYICLNGAEVR

SEQ ID NO: 2089193 - protein, 31 aa, Staphylococcus
YEATKHLDTPLFIGIMPIASYNNALFLHNEV

SEQ ID NO: 2089194 - protein, 31 aa, Staphylococcus
YEATKHLNVPLFIGIMPIASYNNALFLHNEV

SEQ ID NO: 2089195 - protein, 17 aa, Staphylococcus
YEAVREFGLSRSAFYKY

SEQ ID NO: 2089196 - protein, 19 aa, Staphylococcus
YEDCCTIFTPKNPITEPDI

SEQ ID NO: 2089197 - protein, 18 aa, Staphylococcus
YEDDFVYAFLDISQVTKG

SEQ ID NO: 2089198 - protein, 22 aa, Staphylococcus
YEDIVIVSPLHLNPKVRELAYE

SEQ ID NO: 2089199 - protein, 18 aa, Staphylococcus
YEDLAFFEPFILQSQERL

SEQ ID NO: 2089200 - protein, 20 aa, Staphylococcus
YEDLFNEKLQMLLKINKHEI

SEQ ID NO: 2089201 - protein, 20 aa, Staphylococcus
YEDTYLIIVSKPVHLNCAPS

SEQ ID NO: 2089202 - protein, 23 aa, Staphylococcus
YEELNHLLYCSSAGHEPGYIYRA

SEQ ID NO: 2089203 - protein, 26 aa, Staphylococcus
YEEMKPLYEWLGLTTSLGFVENPQGP

SEQ ID NO: 2089204 - protein, 26 aa, Staphylococcus
YEEMRPLYEWLGLTTSLGFIGDPDYE

SEQ ID NO: 2089205 - protein, 25 aa, Staphylococcus
YEENEHHFVIIETLTFNYMQMDEVP

SEQ ID NO: 2089206 - protein, 31 aa, Staphylococcus; identical to SEQ ID NO: 1819499

SEQ ID NO: 2089207 - protein, 26 aa, Staphylococcus
YEFKLNNQIFKIHREAPFIKEGNTTK

SEQ ID NO: 2089208 - protein, 19 aa, Staphylococcus
YEFQFSMGLPTYGITDREV

SEQ ID NO: 2089209 - protein, 24 aa, Staphylococcus
YEFYLTGHLLSLPGWAGMMYYRAE

SEQ ID NO: 2089210 - protein, 36 aa, Staphylococcus
YEGFENLLKPFAVTYFTLFTATMPVQLNEIIKFSCK

SEQ ID NO: 2089211 - protein, 21 aa, Staphylococcus
YEGFGLTIMESISMGCPVISY

SEQ ID NO: 2089212 - protein, 18 aa, Staphylococcus
YEGLIAKNPTFKVSYRAS

SEQ ID NO: 2089213 - protein, 28 aa, Staphylococcus
YEGSNIIFYFMPYLYEYGKLLTQNEKNY

SEQ ID NO: 2089214 - protein, 20 aa, Staphylococcus
YEGWWLFEDWPEKIVKQSEF

SEQ ID NO: 2089215 - protein, 18 aa, Staphylococcus
YEGWWLFSDWTEKIVEQH

SEQ ID NO: 2089216 - protein, 28 aa, Staphylococcus
YEHALNNLHYFYPKARPIIELAAVAYRE

SEQ ID NO: 2089217 - protein, 24 aa, Staphylococcus
YEIEASTYLAQTDDYLYAITKEGE

SEQ ID NO: 2089218 - protein, 18 aa, Staphylococcus
YEIGWRLIPEVWGNGLAT

SEQ ID NO: 2089219 - protein, 26 aa, Staphylococcus
YEIHMTLPSLTYYYEHKEDLRNIHVH

SEQ ID NO: 2089220 - protein, 28 aa, Staphylococcus
YEINLINFNILLKQLAPYFTKHPYIVGI

SEQ ID NO: 2089221 - protein, 17 aa, Staphylococcus
YEKFLNDFKKRSKGEQK

SEQ ID NO: 2089222 - protein, 18 aa, Staphylococcus
YEKKGVAVLILPNNLLNN

SEQ ID NO: 2089223 - protein, 17 aa, Staphylococcus
YEKQLDIFLNPFDEDVI

SEQ ID NO: 2089224 - protein, 17 aa, Staphylococcus
YEKQLDLFLDPFDEEVI

SEQ ID NO: 2089225 - protein, 18 aa, Staphylococcus
YEKQLELFLDPFDEEVIA

SEQ ID NO: 2089226 - protein, 27 aa, Staphylococcus
YELIKEPLRFLEVRIPIRMDDGTVKTF

SEQ ID NO: 2089227 - protein, 18 aa, Staphylococcus
YELIQPPTPKQFFNDPML

SEQ ID NO: 2089228 - protein, 19 aa, Staphylococcus
YELPILGVHNMRNAAIAIA

SEQ ID NO: 2089229 - protein, 23 aa, Staphylococcus
YEMNYFFKHYLEYKGFKAEAMSA

SEQ ID NO: 2089230 - protein, 23 aa, Staphylococcus
YEMRWDIGYVLQQIALFPHMSVK

SEQ ID NO: 2089231 - protein, 26 aa, Staphylococcus
YEMYIDFLYESRQLIKRLSIEPSRKQ

SEQ ID NO: 2089232 - protein, 19 aa, Staphylococcus
YENDYVYAFLDISQVTKGH

SEQ ID NO: 2089233 - protein, 22 aa, Staphylococcus
YENDYVYAFLDISQVTKGHTLL

SEQ ID NO: 2089234 - protein, 18 aa, Staphylococcus
YENEADYFTFDWTNKTIE

SEQ ID NO: 2089235 - protein, 23 aa, Staphylococcus
YENIYINMPDFGLGKALGNEPVS

SEQ ID NO: 2089236 - protein, 27 aa, Staphylococcus
YENKELVHFFFNELSKYLKQQYCLYVR

SEQ ID NO: 2089237 - protein, 20 aa, Staphylococcus
YENLGVIWYDAHGDLNIPEE

SEQ ID NO: 2089238 - protein, 19 aa, Staphylococcus
YENLKVLPHIPYIQDQPFT

SEQ ID NO: 2089239 - protein, 24 aa, Staphylococcus
YENLPESFKIMRYHSLISDPETFP

SEQ ID NO: 2089240 - protein, 17 aa, Staphylococcus
YENNVLPPFFNTLADYV

SEQ ID NO: 2089241 - protein, 20 aa, Staphylococcus
YEPGSTFKSFGLAAAIQEGK

SEQ ID NO: 2089242 - protein, 20 aa, Staphylococcus
YEPGSTFKTFGLAAAIQEGK

SEQ ID NO: 2089243 - protein, 18 aa, Staphylococcus
YEPQSLFAWMTLGENKAP

SEQ ID NO: 2089244 - protein, 21 aa, Staphylococcus
YEPSMQYFNEWWKQLYGESEG

SEQ ID NO: 2089245 - protein, 22 aa, Staphylococcus
YEPYMSLIKQLFPNAKIIIDRF

SEQ ID NO: 2089246 - protein, 24 aa, Staphylococcus
YEQAETWLRFNLKEINRELFEYAQ

SEQ ID NO: 2089247 - protein, 18 aa, Staphylococcus
YEQFLGNLEVRPIDKVIL

SEQ ID NO: 2089248 - protein, 17 aa, Staphylococcus
YEQIKQQIKENILKGYV

SEQ ID NO: 2089249 - protein, 23 aa, Staphylococcus
YEQLDKWFKIDELKKLITFVIVN

SEQ ID NO: 2089250 - protein, 24 aa, Staphylococcus
YEQNRLFHSWITSKGFDAYMISAT

SEQ ID NO: 2089251 - protein, 25 aa, Staphylococcus
YEQRKMMLESIRYVDLVIPENDWGQ

SEQ ID NO: 2089252 - protein, 27 aa, Staphylococcus
YEQRMPKIVIVIDELADLMMMAPQEVE

SEQ ID NO: 2089253 - protein, 38 aa, Staphylococcus
YERKIIEWLTSEKVEWIVLAGYMKLIGENILRAYDKRI

SEQ ID NO: 2089254 - protein, 24 aa, Staphylococcus
YERLEGFNSLQWPVAPDGIDQPTL

SEQ ID NO: 2089255 - protein, 27 aa, Staphylococcus
YESATSHAIVYFLQQGTPFIYQGQEIG

SEQ ID NO: 2089256 - protein, 21 aa, Staphylococcus
YESYPPFLEIAPEPFDKEAMI

SEQ ID NO: 2089257 - protein, 18 aa, Staphylococcus
YETLGVPATQIYELSYND

SEQ ID NO: 2089258 - protein, 22 aa, Staphylococcus
YETMEAFDLPKYLMAHRDELDL

SEQ ID NO: 2089259 - protein, 20 aa, Staphylococcus
YETMIDLIRPRGHIATIVAF

SEQ ID NO: 2089260 - protein, 28 aa, Staphylococcus
YETTDTFFDLKQLPKQLAVIGGGVIATE

SEQ ID NO: 2089261 - protein, 27 aa, Staphylococcus
YETTEYILEQLPCWLTYTNDKTHQVID

SEQ ID NO: 2089262 - protein, 20 aa, Staphylococcus
YETVQLPDRSLPLLSPMSEV

SEQ ID NO: 2089263 - protein, 21 aa, Staphylococcus
YETVQLPDRSLPLLTPMSEVA

SEQ ID NO: 2089264 - protein, 18 aa, Staphylococcus
YETYVNSGAKIVEFGGWA

SEQ ID NO: 2089265 - protein, 27 aa, Staphylococcus
YEVNILKMQLLIWILETNTGDMQELNL

SEQ ID NO: 2089266 - protein, 31 aa, Staphylococcus
YEVVNEWPYEALVKIFYRYGEEKFSKQIARR

SEQ ID NO: 2089267 - protein, 23 aa, Staphylococcus
YEVYIAALKLGVSLIPASEMLRT

SEQ ID NO: 2089268 - protein, 18 aa, Staphylococcus
YEWIQNGQLEDALKALFQ

SEQ ID NO: 2089269 - protein, 33 aa, Staphylococcus
YEYENVVINFGIKDLIFTLKENIPKQLGFKALK

SEQ ID NO: 2089270 - protein, 22 aa, Staphylococcus
YEYKRMIHAFPLLPIRESHKVV

SEQ ID NO: 2089271 - protein, 18 aa, Staphylococcus
YEYLNGRVPLIASGGINT

SEQ ID NO: 2089272 - protein, 17 aa, Staphylococcus
YEYMTLNPRVYKHFEEY

SEQ ID NO: 2089273 - protein, 17 aa, Staphylococcus
YFAIIDHKREKALGYLS

SEQ ID NO: 2089274 - protein, 26 aa, Staphylococcus
YFAKAGRIPYYPLIIDHAHGAVLTDV

SEQ ID NO: 2089275 - protein, 20 aa, Staphylococcus
YFAKVFASIGSISTINPCFG

SEQ ID NO: 2089276 - protein, 19 aa, Staphylococcus
YFCHNYYPRPDTGLALNLF

SEQ ID NO: 2089277 - protein, 24 aa, Staphylococcus
YFDDVTLYIAAAQRKKQQIQSETI

SEQ ID NO: 2089278 - protein, 18 aa, Staphylococcus
YFDDYQLIYRVKPGQYEE

SEQ ID NO: 2089279 - protein, 20 aa, Staphylococcus
YFDGLPHLDKFKACYKALLA

SEQ ID NO: 2089280 - protein, 18 aa, Staphylococcus
YFDIPKDLLIPINEVGNY

SEQ ID NO: 2089281 - protein, 25 aa, Staphylococcus
YFDKKAIDHIYISDLLRTRQTYNAI

SEQ ID NO: 2089282 - protein, 42 aa, Staphylococcus
YFDVPNIYDAPYFDLVRNINLALRATYLFDLNLDYIIMDGEI

SEQ ID NO: 2089283 - protein, 17 aa, Staphylococcus
YFEALYARIGHILIEVS

SEQ ID NO: 2089284 - protein, 20 aa, Staphylococcus
YFEELGKLNYFQNPLLFEGR

SEQ ID NO: 2089285 - protein, 22 aa, Staphylococcus
YFEGAQKYLSFLKSTVDVNLEG

SEQ ID NO: 2089286 - protein, 20 aa, Staphylococcus
YFEGAQKYLSYLKSTIDVNL

SEQ ID NO: 2089287 - protein, 20 aa, Staphylococcus
YFEGAQKYLSYLKSTVDVNL

SEQ ID NO: 2089288 - protein, 24 aa, Staphylococcus
YFEKDGHILSLKLALQTDEFPEWK

SEQ ID NO: 2089289 - protein, 26 aa, Staphylococcus
YFENNKYIVTWALGHLVTNATPEQYD

SEQ ID NO: 2089290 - protein, 23 aa, Staphylococcus
YFESEEMPALGFAPDAEFPAIHG

SEQ ID NO: 2089291 - protein, 17 aa, Staphylococcus
YFEYKGYDVNYVSNFTD

SEQ ID NO: 2089292 - protein, 20 aa, Staphylococcus
YFFSDIEAIIFDHYRSYFSH

SEQ ID NO: 2089293 - protein, 18 aa, Staphylococcus
YFGAHYYPEKAMPLELHA

SEQ ID NO: 2089294 - protein, 18 aa, Staphylococcus
YFHFKLKNMSHVTDPIIH

SEQ ID NO: 2089295 - protein, 18 aa, Staphylococcus
YFIEPTIFSGLKSSDRIM

SEQ ID NO: 2089296 - protein, 18 aa, Staphylococcus
YFIHPTIISGLTSSDQVM

SEQ ID NO: 2089297 - protein, 19 aa, Staphylococcus
YFKGAIVIISHDRYFLDKI

SEQ ID NO: 2089298 - protein, 21 aa, Staphylococcus
YFKKEAIEFAWEFLTSDKWMA

SEQ ID NO: 2089299 - protein, 35 aa, Staphylococcus
YFKKEAIEFAWEFLTSDKWMGMEPEKLYVTIHPED

SEQ ID NO: 2089300 - protein, 19 aa, Staphylococcus
YFKMMQDFLQLDDILIAEQ

SEQ ID NO: 2089301 - protein, 35 aa, Staphylococcus
YFKNEAIEFAWEFLTSDKWMGMEPEKLYVTIHPED

SEQ ID NO: 2089302 - protein, 19 aa, Staphylococcus
YFKQEAIEFAWEFLTSEKW

SEQ ID NO: 2089303 - protein, 20 aa, Staphylococcus
YFKREAIEFAWEFLTSDRWM

SEQ ID NO: 2089304 - protein, 17 aa, Staphylococcus
YFLEFMAKNVSKGHAIS

SEQ ID NO: 2089305 - protein, 19 aa, Staphylococcus
YFLNKVAQEYWYIHDGYME

SEQ ID NO: 2089306 - protein, 21 aa, Staphylococcus
YFMAQSHLLALRSTCERLSVG

SEQ ID NO: 2089307 - protein, 26 aa, Staphylococcus
YFNQGMQFQNMRFKLRGNSLPEDTVI

SEQ ID NO: 2089308 - protein, 17 aa, Staphylococcus
YFPHFDKTINFYNVLRH

SEQ ID NO: 2089309 - protein, 17 aa, Staphylococcus
YFPSHLFRKYAKDVFED

SEQ ID NO: 2089310 - protein, 17 aa, Staphylococcus
YFQGAIVIISHDRYFLD

SEQ ID NO: 2089311 - protein, 17 aa, Staphylococcus
YFQIYETLHKGIKSGLY

SEQ ID NO: 2089312 - protein, 22 aa, Staphylococcus
YFQTEEMPALGFAPDAEFPAIH

SEQ ID NO: 2089313 - protein, 19 aa, Staphylococcus
YFSEAFPKHFKNYYAIGQQ

SEQ ID NO: 2089314 - protein, 17 aa, Staphylococcus
YFSEFFISMARGGGKNG

SEQ ID NO: 2089315 - protein, 23 aa, Staphylococcus
YFSKDNFNFIPKSNLYEVIKAVN

SEQ ID NO: 2089316 - protein, 17 aa, Staphylococcus
YFSNFTQAIGKVKFVDK

SEQ ID NO: 2089317 - protein, 17 aa, Staphylococcus
YFTIYDQVKPLKNDKNK

SEQ ID NO: 2089318 - protein, 17 aa, Staphylococcus
YFTLIIVEKANLAELGH

SEQ ID NO: 2089319 - protein, 18 aa, Staphylococcus
YFTLIIVEKANLAELGHI

SEQ ID NO: 2089320 - protein, 19 aa, Staphylococcus
YFTLIIVQKANLAELGHIM

SEQ ID NO: 2089321 - protein, 19 aa, Staphylococcus
YFTQNDVPTFAICHGPLLL

SEQ ID NO: 2089322 - protein, 17 aa, Staphylococcus
YFTSLSHKTIVYKGWLR

SEQ ID NO: 2089323 - protein, 18 aa, Staphylococcus
YFTSLSHKTIVYKGWLRS

SEQ ID NO: 2089324 - protein, 19 aa, Staphylococcus
YFVIVFENEIIGYLGLWMV

SEQ ID NO: 2089325 - protein, 26 aa, Staphylococcus
YFVSMMGYSPGFPYLSGLNESLYVNH

SEQ ID NO: 2089326 - protein, 20 aa, Staphylococcus
YFVVIFQEEIIGYLGLWIVI

SEQ ID NO: 2089327 - protein, 18 aa, Staphylococcus
YFYQNIKQYQIAYDSKNQ

SEQ ID NO: 2089328 - protein, 18 aa, Staphylococcus
YFYSVIFVPTSEDHAYQL

SEQ ID NO: 2089329 - protein, 17 aa, Staphylococcus
YFYTNDVRFLEQFKAVE

SEQ ID NO: 2089330 - protein, 20 aa, Staphylococcus
YGAFDMERILRLMRPSKDEV

SEQ ID NO: 2089331 - protein, 20 aa, Staphylococcus
YGAFVELFAGKDALLHISQI

SEQ ID NO: 2089332 - protein, 17 aa, Staphylococcus
YGALLIFDEVMTGFRVG

SEQ ID NO: 2089333 - protein, 25 aa, Staphylococcus
YGASWFEHSKLFIRTKLKHMNQPIV

SEQ ID NO: 2089334 - protein, 22 aa, Staphylococcus
YGCDKFCTYCIVPFTRGKERSR

SEQ ID NO: 2089335 - protein, 17 aa, Staphylococcus
YGDFQRFYRPAIQALHN

SEQ ID NO: 2089336 - protein, 17 aa, Staphylococcus
YGDLFVNIKVVTPTKLN

SEQ ID NO: 2089337 - protein, 28 aa, Staphylococcus
YGDLSLLDTPTFLFGMRNGETVEIEIDT

SEQ ID NO: 2089338 - protein, 26 aa, Staphylococcus
YGDTGIMNTIWLLGLALNNENLIEKA

SEQ ID NO: 2089339 - protein, 17 aa, Staphylococcus
YGDVKWTAPLTVKETVY

SEQ ID NO: 2089340 - protein, 20 aa, Staphylococcus
YGDYFPHRLGHGLGLEEHEY

SEQ ID NO: 2089341 - protein, 19 aa, Staphylococcus
YGEMPLTMYITKKGKQVKI

SEQ ID NO: 2089342 - protein, 19 aa, Staphylococcus
YGEVLGAFIVGPHATDLIS

SEQ ID NO: 2089343 - protein, 27 aa, Staphylococcus
YGEWKALLAGDALLTKAFHLISTDSLL

SEQ ID NO: 2089344 - protein, 18 aa, Staphylococcus
YGFAMLLEKILKEEQPNH

SEQ ID NO: 2089345 - protein, 20 aa, Staphylococcus
YGFAYLLDDGESYSYLIFVQ

SEQ ID NO: 2089346 - protein, 21 aa, Staphylococcus
YGFCIQNHIPVRNKVLIFSGR

SEQ ID NO: 2089347 - protein, 20 aa, Staphylococcus
YGFNIIIAGSFSDIFYMNCT

SEQ ID NO: 2089348 - protein, 32 aa, Staphylococcus
YGGGYYDKFLTQFKTRTVSLLYDFQLTTFDKE

SEQ ID NO: 2089349 - protein, 26 aa, Staphylococcus
YGGSYNLLNITFKKLGIKVHFVDPSD

SEQ ID NO: 2089350 - protein, 22 aa, Staphylococcus
YGGTLFDLYYDAQGQSYIGTSE

SEQ ID NO: 2089351 - protein, 27 aa, Staphylococcus
YGHFGRTDILLPWEKLDKVNVLKDTIN

SEQ ID NO: 2089352 - protein, 27 aa, Staphylococcus
YGHFGRTDVLLPWEKLDKVNILKDAVQ

SEQ ID NO: 2089353 - protein, 27 aa, Staphylococcus
YGHFGRTDVLLPWEKLDKVNLLKDSVK

SEQ ID NO: 2089354 - protein, 24 aa, Staphylococcus
YGHGDLFVNIKVVTPTKLTDRQKE

SEQ ID NO: 2089355 - protein, 17 aa, Staphylococcus
YGHIMHTHLLINFVTQQ

SEQ ID NO: 2089356 - protein, 18 aa, Staphylococcus
YGHVMHTHLLINLVTREE

SEQ ID NO: 2089357 - protein, 17 aa, Staphylococcus
YGIDFKGPCLKCLLQYI

SEQ ID NO: 2089358 - protein, 19 aa, Staphylococcus
YGIFSPWLSGVTNCIAGGR

SEQ ID NO: 2089359 - protein, 18 aa, Staphylococcus
YGIHFAMDYLTEQTQIAN

SEQ ID NO: 2089360 - protein, 17 aa, Staphylococcus
YGIINHTFEEFRPRVKA

SEQ ID NO: 2089361 - protein, 19 aa, Staphylococcus
YGINLRPLLTLAEEHYNGE

SEQ ID NO: 2089362 - protein, 19 aa, Staphylococcus
YGINLRPLLTLAEKHYDGD

SEQ ID NO: 2089363 - protein, 20 aa, Staphylococcus
YGIPMNAFDQYFDKYKEEHG

SEQ ID NO: 2089364 - protein, 25 aa, Staphylococcus
YGISYGQLYQWVQNIKYMAAMAFKM

SEQ ID NO: 2089365 - protein, 24 aa, Staphylococcus
YGKAEHPFVPHFTIAQGLSSQEFE

SEQ ID NO: 2089366 - protein, 24 aa, Staphylococcus
YGKAEHPFVPHFTIAQGLTSQEFE

SEQ ID NO: 2089367 - protein, 25 aa, Staphylococcus
YGKAEHQFVPHFTIAQGLSSQEFED

SEQ ID NO: 2089368 - protein, 25 aa, Staphylococcus
YGKESEEIINLVKLAIDQKLSYKVL

SEQ ID NO: 2089369 - protein, 24 aa, Staphylococcus
YGKESEEMINLIKLAMDQHIPYQV

SEQ ID NO: 2089370 - protein, 18 aa, Staphylococcus
YGKIASRLAFVESEILAL

SEQ ID NO: 2089371 - protein, 18 aa, Staphylococcus
YGKLGVKVWIYRGEVLPT

SEQ ID NO: 2089372 - protein, 23 aa, Staphylococcus
YGKLGVKVWIYRGEVLPTKNNSE

SEQ ID NO: 2089373 - protein, 23 aa, Staphylococcus
YGKLGVKVWIYRGEVLPTKNTSE

SEQ ID NO: 2089374 - protein, 23 aa, Staphylococcus
YGKQMQMMTYMDIVLQNSERLGL

SEQ ID NO: 2089375 - protein, 25 aa, Staphylococcus
YGKSIAQVVLRWLVERDIVVLAKSV

SEQ ID NO: 2089376 - protein, 23 aa, Staphylococcus
YGKTECWYIISAKEGAEIIYGVH

SEQ ID NO: 2089377 - protein, 24 aa, Staphylococcus
YGKTECWYILDAEPGSEIIYGVEA

SEQ ID NO: 2089378 - protein, 24 aa, Staphylococcus
YGKTECWYILDAKENAEIIYGVNV

SEQ ID NO: 2089379 - protein, 25 aa, Staphylococcus
YGLALIDFYYPETTHLWLKGPDGLQ

SEQ ID NO: 2089380 - protein, 24 aa, Staphylococcus
YGLDDLPLGIYRFIQQQDCVYART

SEQ ID NO: 2089381 - protein, 17 aa, Staphylococcus
YGLEFAVEQFLDIGINT

SEQ ID NO: 2089382 - protein, 20 aa, Staphylococcus
YGLEFAVRTFLEAGIHTFST

SEQ ID NO: 2089383 - protein, 18 aa, Staphylococcus
YGLEFSVKEFLKAGIQTF

SEQ ID NO: 2089384 - protein, 18 aa, Staphylococcus
YGLLLRPENVCTSHKGQH

SEQ ID NO: 2089385 - protein, 19 aa, Staphylococcus
YGLPYLIDTLQNLNHPVLC

SEQ ID NO: 2089386 - protein, 23 aa, Staphylococcus
YGLQMQMMTYMDIVLQNHERLGL

SEQ ID NO: 2089387 - protein, 23 aa, Staphylococcus
YGLQMQMMTYMDIVLQNKDRLEL

SEQ ID NO: 2089388 - protein, 25 aa, Staphylococcus
YGLQMQMMTYMDIVLQNKSRLGLTD

SEQ ID NO: 2089389 - protein, 25 aa, Staphylococcus
YGLQMQMMTYMDIVLQNQDRLGLTD

SEQ ID NO: 2089390 - protein, 22 aa, Staphylococcus
YGLQMQMMTYMDVVLQNKERLN

SEQ ID NO: 2089391 - protein, 30 aa, Staphylococcus
YGLSNIVVHAPYIINIANTQKPHVFELGVD

SEQ ID NO: 2089392 - protein, 20 aa, Staphylococcus
YGLSNIVVHAPYIINIANTT

SEQ ID NO: 2089393 - protein, 18 aa, Staphylococcus
YGLTFKPCATKELKISGG

SEQ ID NO: 2089394 - protein, 18 aa, Staphylococcus
YGLTIPLVVKSDGKKFGK

SEQ ID NO: 2089395 - protein, 17 aa, Staphylococcus
YGLTLMISLAKKEGQGC

SEQ ID NO: 2089396 - protein, 17 aa, Staphylococcus
YGLTLMISLAKREGQGC

SEQ ID NO: 2089397 - protein, 24 aa, Staphylococcus
YGLVAPLYEQGIVLADYLTQKETN

SEQ ID NO: 2089398 - protein, 27 aa, Staphylococcus
YGLYRDNFLQVAFFYYSPGGNGKTTLL

SEQ ID NO: 2089399 - protein, 20 aa, Staphylococcus
YGMPQVISYAKPSKLEEGSK

SEQ ID NO: 2089400 - protein, 18 aa, Staphylococcus
YGMSFNQALETGGVMLGK

SEQ ID NO: 2089401 - protein, 29 aa, Staphylococcus
YGMTKEEILILLTLWQKGSMTLKEMDSFV

SEQ ID NO: 2089402 - protein, 31 aa, Staphylococcus
YGNFAKYFTTNNVPAFAICHGPQVLIDTDDL

SEQ ID NO: 2089403 - protein, 25 aa, Staphylococcus
YGNHLWTGYPTGMIYSRPGAMMASP

SEQ ID NO: 2089404 - protein, 17 aa, Staphylococcus
YGNIYKLRDIKGKIIVP

SEQ ID NO: 2089405 - protein, 23 aa, Staphylococcus
YGNMRIMARILPNALPEGYRLTL

SEQ ID NO: 2089406 - protein, 25 aa, Staphylococcus
YGNMRIMSRILPDVLPQEYTLTLID

SEQ ID NO: 2089407 - protein, 20 aa, Staphylococcus
YGPEYFVFGGLYKVEKIMPE

SEQ ID NO: 2089408 - protein, 26 aa, Staphylococcus
YGPHRGPIHFNLPFREPLTPDLEMTE

SEQ ID NO: 2089409 - protein, 19 aa, Staphylococcus
YGQFRHWPAYLYSIEHSIY

SEQ ID NO: 2089410 - protein, 23 aa, Staphylococcus
YGQGRVLVFNKKGYPIGQILIPG

SEQ ID NO: 2089411 - protein, 23 aa, Staphylococcus
YGQGRVLVFNKKGYPIGQILMPG

SEQ ID NO: 2089412 - protein, 18 aa, Staphylococcus
YGRFPHQKGFGRLSAEDK

SEQ ID NO: 2089413 - protein, 19 aa, Staphylococcus
YGRFPHQKGFGRLSAEDKK

SEQ ID NO: 2089414 - protein, 20 aa, Staphylococcus
YGRFPHQKGFGRLTAEDKKE

SEQ ID NO: 2089415 - protein, 20 aa, Staphylococcus
YGRVSRFGLVAFASSLDQIG

SEQ ID NO: 2089416 - protein, 21 aa, Staphylococcus
YGSGSVLMKPAAPGTGVIAGG

SEQ ID NO: 2089417 - protein, 24 aa, Staphylococcus
YGSKLTLALVKESIKKRNIKKKVT

SEQ ID NO: 2089418 - protein, 20 aa, Staphylococcus
YGSLLIFDEVMTGFRVGYNC

SEQ ID NO: 2089419 - protein, 29 aa, Staphylococcus
YGSSWFEHNQLFIRTKLKDIHKPIEINGV

SEQ ID NO: 2089420 - protein, 24 aa, Staphylococcus
YGSTIKSLLVGIYALGAEEIIIMA

SEQ ID NO: 2089421 - protein, 21 aa, Staphylococcus
YGTDYIGPWVTSTDWNKNQKL

SEQ ID NO: 2089422 - protein, 22 aa, Staphylococcus
YGTFAKAFMKDNKPVFAICHGP

SEQ ID NO: 2089423 - protein, 20 aa, Staphylococcus
YGTIIRRLIKHDIQLIALHT

SEQ ID NO: 2089424 - protein, 50 aa, Staphylococcus
YGTIKRKITLEYYLKPFVQTRIKGWMRHLLWMSIYQYQYLDKVPDHAIIN

SEQ ID NO: 2089425 - protein, 20 aa, Staphylococcus
YGTPLYHKKGKHFKLTEAGE

SEQ ID NO: 2089426 - protein, 31 aa, Staphylococcus
YGTTLGNSLRRILLSSLPGAAVKYIEIEGVL

SEQ ID NO: 2089427 - protein, 30 aa, Staphylococcus
YGTTLGNSLRRILLSSLPGSAVKYIEIEGV

SEQ ID NO: 2089428 - protein, 30 aa, Staphylococcus
YGVKIYDVFTILYLLQPQAFNVKEADVQIE

SEQ ID NO: 2089429 - protein, 20 aa, Staphylococcus
YGVNYAALRYFNVAGAKEEG

SEQ ID NO: 2089430 - protein, 25 aa, Staphylococcus
YGVSYHQIYHWVKSYKKNGIDGLKD

SEQ ID NO: 2089431 - protein, 17 aa, Staphylococcus
YGVYVIFDQKKPVYVGQ

SEQ ID NO: 2089432 - protein, 20 aa, Staphylococcus
YGYAKYLRDALPNATFVGFT

SEQ ID NO: 2089433 - protein, 26 aa, Staphylococcus
YGYFNLAPEEFIVWVLGFVKSIEELK

SEQ ID NO: 2089434 - protein, 17 aa, Staphylococcus
YGYGDLFVNIKVVTPTK

SEQ ID NO: 2089435 - protein, 27 aa, Staphylococcus
YGYGTKMMMYLPRYVQTLFPNFNHLYL

SEQ ID NO: 2089436 - protein, 17 aa, Staphylococcus
YGYIVIDQNQSKWYDEL

SEQ ID NO: 2089437 - protein, 25 aa, Staphylococcus
YGYSRFHIPQFLRPNLKYQALAAKL

SEQ ID NO: 2089438 - protein, 19 aa, Staphylococcus
YHAPAFIKGSVARKGFNLG

SEQ ID NO: 2089439 - protein, 25 aa, Staphylococcus
YHASQKLLLPLYKKGKFASIQMFNA

SEQ ID NO: 2089440 - protein, 23 aa, Staphylococcus
YHCIPIINQHFINYIKQTTINEA

SEQ ID NO: 2089441 - protein, 25 aa, Staphylococcus
YHDKHGVTLPRLFGFQAEGASPIVQ

SEQ ID NO: 2089442 - protein, 17 aa, Staphylococcus
YHDMNGLLMAKINNINL

SEQ ID NO: 2089443 - protein, 19 aa, Staphylococcus
YHEEENAMVTDLDDLKELG

SEQ ID NO: 2089444 - protein, 24 aa, Staphylococcus
YHENILEWIKIANEYKIPTFVLGV

SEQ ID NO: 2089445 - protein, 33 aa, Staphylococcus
YHEPSLEALNYYIKRYMLAVPFENINVQNGMPV

SEQ ID NO: 2089446 - protein, 32 aa, Staphylococcus
YHFSGPIDRQLFYQFILRLPDNVLRLKGYVKF

SEQ ID NO: 2089447 - protein, 17 aa, Staphylococcus
YHGYKVSPYYDSLVAKV

SEQ ID NO: 2089448 - protein, 18 aa, Staphylococcus
YHHHLALNQWISGTKRVD

SEQ ID NO: 2089449 - protein, 27 aa, Staphylococcus
YHHSYTELFKTLPFDFLSDIVYQWERF

SEQ ID NO: 2089450 - protein, 28 aa, Staphylococcus
YHHYMQKVLFEQYPYFTANNIHVPIGDA

SEQ ID NO: 2089451 - protein, 20 aa, Staphylococcus
YHIRKPLVIYEATTLLLDDK

SEQ ID NO: 2089452 - protein, 17 aa, Staphylococcus
YHIYKNKIFARNTLNAS

SEQ ID NO: 2089453 - protein, 28 aa, Staphylococcus
YHKALKNHLINLCKINDIPYKVDIYPYY

SEQ ID NO: 2089454 - protein, 24 aa, Staphylococcus
YHKTKIWLGVWEHNPQALRFYEKR

SEQ ID NO: 2089455 - protein, 21 aa, Staphylococcus
YHKVIFLDTTTDFKFLSGSTK

SEQ ID NO: 2089456 - protein, 27 aa, Staphylococcus
YHLADKLLDQPLYIVAGDKPGAFGSYR

SEQ ID NO: 2089457 - protein, 19 aa, Staphylococcus
YHLQKYKKLLNALYFSFDK

SEQ ID NO: 2089458 - protein, 19 aa, Staphylococcus
YHLQRRKSLSHGYSGLEID

SEQ ID NO: 2089459 - protein, 17 aa, Staphylococcus
YHLSKTEYRGREATDFK

SEQ ID NO: 2089460 - protein, 17 aa, Staphylococcus
YHLYVPKDDAIALTFNP

SEQ ID NO: 2089461 - protein, 19 aa, Staphylococcus
YHMTEGDIVLLMLNDLYQI

SEQ ID NO: 2089462 - protein, 27 aa, Staphylococcus
YHNLGSNALYLITTLPETERTKEHTTS

SEQ ID NO: 2089463 - protein, 20 aa, Staphylococcus
YHNVIFLDTTTDFKFLSGST

SEQ ID NO: 2089464 - protein, 18 aa, Staphylococcus
YHPDYKFLQSIGIDIHTN

SEQ ID NO: 2089465 - protein, 25 aa, Staphylococcus
YHPKMMLKVILYAYTQSVFSGRKIG

SEQ ID NO: 2089466 - protein, 25 aa, Staphylococcus
YHPTWKMVLGLFPKEDKVKAMDALE

SEQ ID NO: 2089467 - protein, 17 aa, Staphylococcus
YHQAYKKGVPQFDLKEI

SEQ ID NO: 2089468 - protein, 17 aa, Staphylococcus
YHQAYKKGVPQFDLKEV

SEQ ID NO: 2089469 - protein, 24 aa, Staphylococcus
YHRHFKLRLSYFDKSYEQLIFKQH

SEQ ID NO: 2089470 - protein, 26 aa, Staphylococcus
YHRQPLPVPHYKYLKFKPDKLQISLL

SEQ ID NO: 2089471 - protein, 32 aa, Staphylococcus
YHSAYHILDMIFWFGHLYILKANGLDVTTHER

SEQ ID NO: 2089472 - protein, 18 aa, Staphylococcus
YHSLAKKYLPKGQGAILT

SEQ ID NO: 2089473 - protein, 32 aa, Staphylococcus
YHSMNIPHDLFTPIFAISRTSGWLAHIFEQYR

SEQ ID NO: 2089474 - protein, 31 aa, Staphylococcus
YHSQDISKLQTILFLRQLNLSLENIQNYFQQ

SEQ ID NO: 2089475 - protein, 38 aa, Staphylococcus
YHSVDIKTLVYPGFATDLQQPITPLLVMANGPSFVTDT

SEQ ID NO: 2089476 - protein, 24 aa, Staphylococcus
YHTPTRLYNRQVKWAYSFTYESIK

SEQ ID NO: 2089477 - protein, 25 aa, Staphylococcus
YHVTNDQLIFFNIAASMASIRFMNV

SEQ ID NO: 2089478 - protein, 17 aa, Staphylococcus
YHWCSRELHFSLSQEAF

SEQ ID NO: 2089479 - protein, 17 aa, Staphylococcus
YHYAHKLLPLSPKREDN

SEQ ID NO: 2089480 - protein, 17 aa, Staphylococcus
YHYWALGHIHERQQLSD

SEQ ID NO: 2089481 - protein, 26 aa, Staphylococcus
YIAEHGGMILYLPQEGRGIGLINKLK

SEQ ID NO: 2089482 - protein, 17 aa, Staphylococcus
YIDAEKLYNYGLKKTLL

SEQ ID NO: 2089483 - protein, 18 aa, Staphylococcus
YIDDLAERILAAGGNPVA

SEQ ID NO: 2089484 - protein, 19 aa, Staphylococcus
YIDDLQPRFSPTRPFIMVI

SEQ ID NO: 2089485 - protein, 25 aa, Staphylococcus
YIDENGDFKLFRVPAEQSIPIWTDS

SEQ ID NO: 2089486 - protein, 20 aa, Staphylococcus
YIDEQTFVPCTPLGIMEILK

SEQ ID NO: 2089487 - protein, 23 aa, Staphylococcus
YIDFLHEIKVDRIIFGDPAVVMY

SEQ ID NO: 2089488 - protein, 18 aa, Staphylococcus
YIDPGAQSMVYILNALIG

SEQ ID NO: 2089489 - protein, 17 aa, Staphylococcus
YIDPLWSQFGEKLILPA

SEQ ID NO: 2089490 - protein, 19 aa, Staphylococcus
YIDTIDFKLKDHRSALRIR

SEQ ID NO: 2089491 - protein, 34 aa, Staphylococcus
YIDYASDDLLLRRIYKLPIGFKWDNQANLTLIGD

SEQ ID NO: 2089492 - protein, 20 aa, Staphylococcus
YIEAPYKPHEFMKMAKERGL

SEQ ID NO: 2089493 - protein, 24 aa, Staphylococcus
YIECHLLSKIQFIYKILHEIHKSS

SEQ ID NO: 2089494 - protein, 29 aa, Staphylococcus
YIEKIKGKYYIRLLLKVIIKSATKKSERS

SEQ ID NO: 2089495 - protein, 35 aa, Staphylococcus
YIENKKALFIVYSNPLALGVLTPPGQFGADIVVGD

SEQ ID NO: 2089496 - protein, 19 aa, Staphylococcus
YIENSNLNYTIVHPGPLQN

SEQ ID NO: 2089497 - protein, 26 aa, Staphylococcus
YIEQHHLPDIVLLDLVMPEMNGIEIT

SEQ ID NO: 2089498 - protein, 19 aa, Staphylococcus
YIERLVYDLYDKHTTHIAV

SEQ ID NO: 2089499 - protein, 18 aa, Staphylococcus
YIERRNYLVSKLKELGFE

SEQ ID NO: 2089500 - protein, 19 aa, Staphylococcus
YIFEAPFKNPIKTPKVEMD

SEQ ID NO: 2089501 - protein, 19 aa, Staphylococcus
YIFKHILLEVYKAQCTQKS

SEQ ID NO: 2089502 - protein, 18 aa, Staphylococcus
YIFLNNIDNVLVKVLDPL

SEQ ID NO: 2089503 - protein, 21 aa, Staphylococcus
YIGDFVKPIKPLFYHVKELID

SEQ ID NO: 2089504 - protein, 20 aa, Staphylococcus
YIGHPLVGDPKYGPKKTMDI

SEQ ID NO: 2089505 - protein, 18 aa, Staphylococcus
YIGLIDRMHPTPALGGYP

SEQ ID NO: 2089506 - protein, 18 aa, Staphylococcus
YIGQFYYDTALSTGESTF

SEQ ID NO: 2089507 - protein, 18 aa, Staphylococcus
YIGWNDIASNRKFIIYYD

SEQ ID NO: 2089508 - protein, 19 aa, Staphylococcus
YIHFLKMSIGERTAFAYKV

SEQ ID NO: 2089509 - protein, 17 aa, Staphylococcus
YIHGGYNTLQPSPFHWR

SEQ ID NO: 2089510 - protein, 17 aa, Staphylococcus
YIHMIGFSRGGLQGLLT

SEQ ID NO: 2089511 - protein, 28 aa, Staphylococcus
YIHVKQMMRCCRFFIDKLRQSQHGRVIV

SEQ ID NO: 2089512 - protein, 17 aa, Staphylococcus
YIHYQPDVVFIECSGVA

SEQ ID NO: 2089513 - protein, 18 aa, Staphylococcus
YIIDYCLCKDNSGAMFVF

SEQ ID NO: 2089514 - protein, 26 aa, Staphylococcus
YIIEDINWLSQKMIDFALKLRESNEL

SEQ ID NO: 2089515 - protein, 28 aa, Staphylococcus
YIIKYVHTKWHCPIIFYTCIRENDLTYK

SEQ ID NO: 2089516 - protein, 21 aa, Staphylococcus
YIKALAHAWLVAHDNFKYDPD

SEQ ID NO: 2089517 - protein, 20 aa, Staphylococcus
YIKAPMIPGHEFIARIVEKG

SEQ ID NO: 2089518 - protein, 26 aa, Staphylococcus
YIKEDVAMALGFFDGLHKGHAQVFHA

SEQ ID NO: 2089519 - protein, 28 aa, Staphylococcus
YIKESVKVSLKRLGLNHIDLYQLHGGTI

SEQ ID NO: 2089520 - protein, 35 aa, Staphylococcus
YIKFSEKWFFPLQDFQKFISCFVFLYEKDTKTPYF

SEQ ID NO: 2089521 - protein, 18 aa, Staphylococcus
YIKIKGKWSYLYRAIDAE

SEQ ID NO: 2089522 - protein, 29 aa, Staphylococcus
YIKKSDWGWAIDPVGLRYTLNALYNRYQI

SEQ ID NO: 2089523 - protein, 19 aa, Staphylococcus
YIKKYIPIFDHVPAKLLHH

SEQ ID NO: 2089524 - protein, 18 aa, Staphylococcus
YIKPSMERLIKGIKAQHD

SEQ ID NO: 2089525 - protein, 17 aa, Staphylococcus
YIKQIPGMKGIVSAIYD

SEQ ID NO: 2089526 - protein, 25 aa, Staphylococcus
YIKRSYMMTAYITEFQVLNGLRIGE

SEQ ID NO: 2089527 - protein, 19 aa, Staphylococcus
YILANPPFNASDWGQERLL

SEQ ID NO: 2089528 - protein, 25 aa, Staphylococcus
YILEKLFEMIPSIKILFSLMVLEDR

SEQ ID NO: 2089529 - protein, 27 aa, Staphylococcus
YILKESDQLWIPVHKSWRLNERHYGKL

SEQ ID NO: 2089530 - protein, 19 aa, Staphylococcus
YILSFIKQDSNYALSYCDI

SEQ ID NO: 2089531 - protein, 17 aa, Staphylococcus
YILTPGMAMPHARPEAG

SEQ ID NO: 2089532 - protein, 17 aa, Staphylococcus
YIMHRFDEEARIPFIKK

SEQ ID NO: 2089533 - protein, 26 aa, Staphylococcus
YINDHGGLIIYLPQEGRGIGLMNKLK

SEQ ID NO: 2089534 - protein, 26 aa, Staphylococcus
YINESDEWFFKGLDLLVEYNPETDEI

SEQ ID NO: 2089535 - protein, 20 aa, Staphylococcus
YINEVYGQFFNAHRPARSCV

SEQ ID NO: 2089536 - protein, 27 aa, Staphylococcus
YINNSETPIWTLIKKYKKAHQFESYDE

SEQ ID NO: 2089537 - protein, 17 aa, Staphylococcus
YINYEPIPKFPGVSRDI

SEQ ID NO: 2089538 - protein, 24 aa, Staphylococcus
YINYQAIPRFPGVSRDIALVVNRA

SEQ ID NO: 2089539 - protein, 17 aa, Staphylococcus
YINYQPIPKFPGVTRDI

SEQ ID NO: 2089540 - protein, 17 aa, Staphylococcus
YIPIRRIEKPIFQELAD

SEQ ID NO: 2089541 - protein, 32 aa, Staphylococcus
YIQANVVILPLDYAYDFLKFCFKNPKTCPLLD

SEQ ID NO: 2089542 - protein, 31 aa, Staphylococcus
YIQANVVILPSKYAYDFLKFCFRNPKTCPLL

SEQ ID NO: 2089543 - protein, 23 aa, Staphylococcus
YIQFLHDIKVDRIIFGDPAVVMY

SEQ ID NO: 2089544 - protein, 18 aa, Staphylococcus
YIQHLTFNSAVQTLEDIL

SEQ ID NO: 2089545 - protein, 25 aa, Staphylococcus
YIQNVNYLRYFADLKVIGNPIIPFK

SEQ ID NO: 2089546 - protein, 18 aa, Staphylococcus
YIQQIFIDLKHSADAEKR

SEQ ID NO: 2089547 - protein, 19 aa, Staphylococcus
YIQQVPSSPSFALFKGQNL

SEQ ID NO: 2089548 - protein, 17 aa, Staphylococcus
YIQSLIYDYAFEDETIS

SEQ ID NO: 2089549 - protein, 18 aa, Staphylococcus
YIQYIYDLKIYKDNRQCI

SEQ ID NO: 2089550 - protein, 17 aa, Staphylococcus
YIRKLGFNYADMEAVGI

SEQ ID NO: 2089551 - protein, 18 aa, Staphylococcus
YIRLWKTGKILLNKERIM

SEQ ID NO: 2089552 - protein, 17 aa, Staphylococcus
YIRRLERLETLSEGYDG

SEQ ID NO: 2089553 - protein, 18 aa, Staphylococcus
YISLIYRNDRHLTSIIQD

SEQ ID NO: 2089554 - protein, 22 aa, Staphylococcus
YISQFKAGYFSPLANLARLTEE

SEQ ID NO: 2089555 - protein, 26 aa, Staphylococcus
YITEAVAMAFGFFDGMHKGHAKVFET

SEQ ID NO: 2089556 - protein, 18 aa, Staphylococcus
YITEFQVLNGLRIGELLA

SEQ ID NO: 2089557 - protein, 18 aa, Staphylococcus
YITPFQLNEPMNGHIVGK

SEQ ID NO: 2089558 - protein, 17 aa, Staphylococcus
YITSIELPFTDKFKDKL

SEQ ID NO: 2089559 - protein, 19 aa, Staphylococcus
YIVCLLSQGKQHLIYKHAI

SEQ ID NO: 2089560 - protein, 17 aa, Staphylococcus
YIVCPYISNDVVLAKRL

SEQ ID NO: 2089561 - protein, 17 aa, Staphylococcus
YIVMDNQIYGLTKGQTS

SEQ ID NO: 2089562 - protein, 17 aa, Staphylococcus
YIVNSYPVWFPKAEAEE

SEQ ID NO: 2089563 - protein, 18 aa, Staphylococcus
YIVNSYPVWFPKVEAEEI

SEQ ID NO: 2089564 - protein, 21 aa, Staphylococcus
YIVSHYPIDTVVLKPFRLGGI

SEQ ID NO: 2089565 - protein, 20 aa, Staphylococcus
YIYCGTIGLLLPDDKMIFNI

SEQ ID NO: 2089566 - protein, 21 aa, Staphylococcus
YKACVLLDMHIGHLKSIMGLL

SEQ ID NO: 2089567 - protein, 25 aa, Staphylococcus
YKAENLNFYVFKFNNELIATGAIGP

SEQ ID NO: 2089568 - protein, 19 aa, Staphylococcus
YKAIDAKVLFNKVAMRPGS

SEQ ID NO: 2089569 - protein, 25 aa, Staphylococcus
YKAITLNPWAISDLELIAIGGFSPL

SEQ ID NO: 2089570 - protein, 21 aa, Staphylococcus
YKANHLTFITHMYGSPGFSNE

SEQ ID NO: 2089571 - protein, 27 aa, Staphylococcus
YKARYDVTILINGLPLVQIELKRRGID

SEQ ID NO: 2089572 - protein, 25 aa, Staphylococcus
YKARYDVTILINGLPLVQVELKRRG

SEQ ID NO: 2089573 - protein, 25 aa, Staphylococcus
YKASQQLLLPLYKKGKFVSVQMFNA

SEQ ID NO: 2089574 - protein, 29 aa, Staphylococcus
YKAVIDSLSYYQFYILKLVVGKKRIEEAV

SEQ ID NO: 2089575 - protein, 18 aa, Staphylococcus
YKAYLLNTLCRKSIEKAD

SEQ ID NO: 2089576 - protein, 20 aa, Staphylococcus
YKCQSCGYKYLRIRKVDVRK

SEQ ID NO: 2089577 - protein, 17 aa, Staphylococcus
YKDAKFYQRNQFHLAKT

SEQ ID NO: 2089578 - protein, 26 aa, Staphylococcus
YKDARNYLSFLYSKGLKRTTVSRKIS

SEQ ID NO: 2089579 - protein, 25 aa, Staphylococcus
YKDARNYLSYLYNKNLKRTTVSRKI

SEQ ID NO: 2089580 - protein, 26 aa, Staphylococcus
YKDARNYLSYLYSKNLKRTSVSRKIS

SEQ ID NO: 2089581 - protein, 25 aa, Staphylococcus
YKDARNYLSYLYSNNLKRTTVSRKI

SEQ ID NO: 2089582 - protein, 26 aa, Staphylococcus
YKDARNYLSYLYSQNLKRTTVSRKIS

SEQ ID NO: 2089583 - protein, 23 aa, Staphylococcus
YKDDIVTLPYLNEYKWQIFLQMV

SEQ ID NO: 2089584 - protein, 18 aa, Staphylococcus
YKDFFDFTRRIPKRIKTR

SEQ ID NO: 2089585 - protein, 25 aa, Staphylococcus
YKDIEADFIITSPPYWNMLGKSRGN

SEQ ID NO: 2089586 - protein, 19 aa, Staphylococcus
YKDKGFIVLGFPCNQFGGQ

SEQ ID NO: 2089587 - protein, 26 aa, Staphylococcus
YKEFIAGGILRIIYAWLKEGQERSVD

SEQ ID NO: 2089588 - protein, 17 aa, Staphylococcus
YKEKLIIPGFFGVSKHN

SEQ ID NO: 2089589 - protein, 21 aa, Staphylococcus
YKETLGFIPNLSEEMKQMFVD

SEQ ID NO: 2089590 - protein, 20 aa, Staphylococcus
YKFDFGTVKFVQAFHSSSYT

SEQ ID NO: 2089591 - protein, 22 aa, Staphylococcus
YKFDQWLDLTFYQLDLYNIKRD

SEQ ID NO: 2089592 - protein, 19 aa, Staphylococcus
YKFDRWLDLAFYQYDLHDK

SEQ ID NO: 2089593 - protein, 23 aa, Staphylococcus
YKGKLFTVEEHFDRFLRSADEIG

SEQ ID NO: 2089594 - protein, 29 aa, Staphylococcus
YKGKYYISHEWYPFYSKQGLSYGYQYESS

SEQ ID NO: 2089595 - protein, 27 aa, Staphylococcus
YKHGFNHFPHFIALFNKKYGITPGQIR

SEQ ID NO: 2089596 - protein, 25 aa, Staphylococcus
YKHGFNHFPRFIALFSKKYGMTPGQ

SEQ ID NO: 2089597 - protein, 19 aa, Staphylococcus
YKHPNAQQSFINWLKTLDS

SEQ ID NO: 2089598 - protein, 25 aa, Staphylococcus
YKHSKPFLKQFPTTGERILMGPGEG

SEQ ID NO: 2089599 - protein, 24 aa, Staphylococcus
YKHSKPFLKQFPTTSEHVLMGPGE

SEQ ID NO: 2089600 - protein, 18 aa, Staphylococcus
YKIKKKYVVKLKGYLMRE

SEQ ID NO: 2089601 - protein, 20 aa, Staphylococcus
YKILASYYMFEYIHPFYDGN

SEQ ID NO: 2089602 - protein, 20 aa, Staphylococcus
YKIMTMFEPYMREYKLIFIN

SEQ ID NO: 2089603 - protein, 20 aa, Staphylococcus
YKIPTFVLGVGLGGLILINL

SEQ ID NO: 2089604 - protein, 24 aa, Staphylococcus
YKIPTYVLGIGLGGLIVLNLLEKT

SEQ ID NO: 2089605 - protein, 26 aa, Staphylococcus
YKKAIDKTMFPGIQGGPLEHVIAAKA

SEQ ID NO: 2089606 - protein, 25 aa, Staphylococcus
YKKDIDKTIFPGIQGGPLEHVIAAK

SEQ ID NO: 2089607 - protein, 18 aa, Staphylococcus
YKKGFGPLLNNIHYADFG

SEQ ID NO: 2089608 - protein, 25 aa, Staphylococcus
YKKKKYVLARLISQITRFFTGIEIH

SEQ ID NO: 2089609 - protein, 32 aa, Staphylococcus
YKKYKGIYGYRRIYIYIRLYLQKEVNHKRVYR

SEQ ID NO: 2089610 - protein, 24 aa, Staphylococcus
YKLDNLLLTQLLNSPYYAVYMQDI

SEQ ID NO: 2089611 - protein, 20 aa, Staphylococcus
YKLFGLEQRTAIKEGLFRKG

SEQ ID NO: 2089612 - protein, 19 aa, Staphylococcus
YKLIKVNKNFAIGKLLQIF

SEQ ID NO: 2089613 - protein, 20 aa, Staphylococcus
YKLTLNDLALLKLAYEYTAD

SEQ ID NO: 2089614 - protein, 24 aa, Staphylococcus
YKMPKKMRRLALRSALSFKVKENG

SEQ ID NO: 2089615 - protein, 25 aa, Staphylococcus
YKMPKKMRRLALRSALSFKVKENGF

SEQ ID NO: 2089616 - protein, 25 aa, Staphylococcus
YKMPKKMRRLALRSALSFKVKENNF

SEQ ID NO: 2089617 - protein, 25 aa, Staphylococcus
YKMPKKMRRLALRSALSFKVQEKGL

SEQ ID NO: 2089618 - protein, 25 aa, Staphylococcus
YKMPKKMRRLALRSALSFKVQENGF

SEQ ID NO: 2089619 - protein, 25 aa, Staphylococcus
YKMPKKMRRLALRSALSFKVQENNF

SEQ ID NO: 2089620 - protein, 37 aa, Staphylococcus
YKNGAKVMSLLEPAYQRSKRDLPYGRALIIYSDSSIV

SEQ ID NO: 2089621 - protein, 22 aa, Staphylococcus
YKNNIVFHRIWKAKATGKYDMR

SEQ ID NO: 2089622 - protein, 25 aa, Staphylococcus
YKNNKIFANLLYRIINKDILEGKFY

SEQ ID NO: 2089623 - protein, 18 aa, Staphylococcus
YKQHVAIVALYLANGHKA

SEQ ID NO: 2089624 - protein, 24 aa, Staphylococcus
YKQKGLKVFGLTASPQYIANIRKN

SEQ ID NO: 2089625 - protein, 24 aa, Staphylococcus
YKQQEIPIYLNDLIIIFTDGVTEI

SEQ ID NO: 2089626 - protein, 19 aa, Staphylococcus
YKQTAAYGHFGRTDILLPW

SEQ ID NO: 2089627 - protein, 33 aa, Staphylococcus
YKRLPLTLFQIQSKFRDEKRPRFGLLRGREFIM

SEQ ID NO: 2089628 - protein, 19 aa, Staphylococcus
YKRLPLTLFQIQSKFRDEQ

SEQ ID NO: 2089629 - protein, 20 aa, Staphylococcus
YKRTHLFLRMLHEDGTIAAT

SEQ ID NO: 2089630 - protein, 23 aa, Staphylococcus
YKSKDNGKIIKNHKWMTGNELKA

SEQ ID NO: 2089631 - protein, 30 aa, Staphylococcus
YKSRYDVTILINGLPLVQIELKRSGIAITQ

SEQ ID NO: 2089632 - protein, 20 aa, Staphylococcus
YKTFLKNEIARWIKIQEDIG

SEQ ID NO: 2089633 - protein, 23 aa, Staphylococcus
YKTINRHYALLMKENLLKTNEEL

SEQ ID NO: 2089634 - protein, 46 aa, Staphylococcus
YKTVFKKQEGYNLTFFAFFVKAVAEALKSNPLLNSSWDGNEIIIHK

SEQ ID NO: 2089635 - protein, 19 aa, Staphylococcus
YKVPLRVFGTREELGIALG

SEQ ID NO: 2089636 - protein, 17 aa, Staphylococcus
YKVVLASGRPTEGMLPV

SEQ ID NO: 2089637 - protein, 27 aa, Staphylococcus
YKYFTENYFIFGGYEPMIYITFSGHFK

SEQ ID NO: 2089638 - protein, 25 aa, Staphylococcus
YKYKMDNFMHYLNGVGVPEGTAIES

SEQ ID NO: 2089639 - protein, 20 aa, Staphylococcus
YKYTTIDDPELFATEHLAFC

SEQ ID NO: 2089640 - protein, 17 aa, Staphylococcus
YKYVTIDDPETFAAEHL

SEQ ID NO: 2089641 - protein, 20 aa, Staphylococcus
YLAATALHYIYGIDKANLIV

SEQ ID NO: 2089642 - protein, 17 aa, Staphylococcus
YLAMIRGQVLHTFSTMK

SEQ ID NO: 2089643 - protein, 19 aa, Staphylococcus
YLASKLYYSYIDLDTYIEM

SEQ ID NO: 2089644 - protein, 25 aa, Staphylococcus
YLASYALSFYMKKLNQFDALIAPIH

SEQ ID NO: 2089645 - protein, 17 aa, Staphylococcus
YLAYAGRFYGQPTILDA

SEQ ID NO: 2089646 - protein, 17 aa, Staphylococcus
YLDAHIIKLYETPVRIP

SEQ ID NO: 2089647 - protein, 27 aa, Staphylococcus
YLDDIRVNIIYDIPLSEVVFDFFDQIK

SEQ ID NO: 2089648 - protein, 19 aa, Staphylococcus
YLDHKNIALLFEKNSTRTR

SEQ ID NO: 2089649 - protein, 19 aa, Staphylococcus
YLDILDNYPAARSTLVMAI

SEQ ID NO: 2089650 - protein, 17 aa, Staphylococcus
YLDKALKLIDSLNEPHA

SEQ ID NO: 2089651 - protein, 19 aa, Staphylococcus
YLDKDVLLPAIGQGALGIE

SEQ ID NO: 2089652 - protein, 24 aa, Staphylococcus
YLDQIHQRMFLEQSLITERIKKYF

SEQ ID NO: 2089653 - protein, 17 aa, Staphylococcus
YLDQVHQRLYLEQTLLV

SEQ ID NO: 2089654 - protein, 18 aa, Staphylococcus
YLDVLSSLSLYPLTTIDV

SEQ ID NO: 2089655 - protein, 21 aa, Staphylococcus
YLEDKGIHTLLTYGNDAKFIS

SEQ ID NO: 2089656 - protein, 22 aa, Staphylococcus
YLEDLKQRLNLDEFALYSGNDD

SEQ ID NO: 2089657 - protein, 17 aa, Staphylococcus
YLEGFNFENKKAKFYPL

SEQ ID NO: 2089658 - protein, 25 aa, Staphylococcus
YLEGKNIALLFEKTSTRTRAAFTVA

SEQ ID NO: 2089659 - protein, 19 aa, Staphylococcus
YLEHMKLYRSFRDEVPEEE

SEQ ID NO: 2089660 - protein, 19 aa, Staphylococcus
YLEHMKLYRSFREEVPEEE

SEQ ID NO: 2089661 - protein, 19 aa, Staphylococcus
YLEIFLDSNFLKEDVVIVD

SEQ ID NO: 2089662 - protein, 23 aa, Staphylococcus
YLEIPFDVYPQDAIMPLPLEESD

SEQ ID NO: 2089663 - protein, 18 aa, Staphylococcus
YLEIYNELNLLIDSLKNK

SEQ ID NO: 2089664 - protein, 19 aa, Staphylococcus
YLEKFNLPFDEKIKHFSTG

SEQ ID NO: 2089665 - protein, 19 aa, Staphylococcus
YLENHLLSLPGWAGMMLWQ

SEQ ID NO: 2089666 - protein, 21 aa, Staphylococcus
YLENNLHLLIKDKIDNFKQKS

SEQ ID NO: 2089667 - protein, 25 aa, Staphylococcus
YLENNTLPDIVLLDLVMPEMNGIEI

SEQ ID NO: 2089668 - protein, 25 aa, Staphylococcus
YLERISELCNVRISIFSVGPDRDQT

SEQ ID NO: 2089669 - protein, 18 aa, Staphylococcus
YLESFPSKYLILYMDNQA

SEQ ID NO: 2089670 - protein, 17 aa, Staphylococcus
YLFDDFIAMINEFKEKE

SEQ ID NO: 2089671 - protein, 20 aa, Staphylococcus
YLFGEDFSFYSQIAPSYFVF

SEQ ID NO: 2089672 - protein, 17 aa, Staphylococcus
YLGEMLVSIPFEPDDPI

SEQ ID NO: 2089673 - protein, 27 aa, Staphylococcus
YLGFELDVHWIWRAGLNPIEVIPNYAN

SEQ ID NO: 2089674 - protein, 17 aa, Staphylococcus
YLGIVGDTGRFLFGNTT

SEQ ID NO: 2089675 - protein, 19 aa, Staphylococcus
YLGIVGDTGRFLFSNTSPH

SEQ ID NO: 2089676 - protein, 18 aa, Staphylococcus
YLGIVGDTGRFLFSNTTP

SEQ ID NO: 2089677 - protein, 18 aa, Staphylococcus
YLGRIGIGRVFRGTIKVG

SEQ ID NO: 2089678 - protein, 34 aa, Staphylococcus
YLHHHQCLYVKLDPYWIYQIYDKDVNPLENHDKN

SEQ ID NO: 2089679 - protein, 17 aa, Staphylococcus
YLHIFRLQEDDKNILSI

SEQ ID NO: 2089680 - protein, 34 aa, Staphylococcus
YLHQHQCLYVKLDPYWIYQIYDKDINPVEGHEKN

SEQ ID NO: 2089681 - protein, 30 aa, Staphylococcus
YLHQHQCLYVKLDPYWIYQVHDKDINPLTE

SEQ ID NO: 2089682 - protein, 17 aa, Staphylococcus
YLHQVTAITGSGPAFLY

SEQ ID NO: 2089683 - protein, 19 aa, Staphylococcus
YLHSRLLERAAKLNDALGG

SEQ ID NO: 2089684 - protein, 17 aa, Staphylococcus
YLHSRLLERAAKLNDTL

SEQ ID NO: 2089685 - protein, 18 aa, Staphylococcus
YLIDAINYMFPDVNVADE

SEQ ID NO: 2089686 - protein, 21 aa, Staphylococcus
YLILSYNIYVLNETTLKDLKE

SEQ ID NO: 2089687 - protein, 35 aa, Staphylococcus
YLIPSRNPIEILYEDDYLIIVSKPNYLNSTPSREH

SEQ ID NO: 2089688 - protein, 19 aa, Staphylococcus
YLISQRLVKKSLEDGYLVG

SEQ ID NO: 2089689 - protein, 26 aa, Staphylococcus
YLKAEKGVHRLVRISPFDASGRRHTS

SEQ ID NO: 2089690 - protein, 17 aa, Staphylococcus
YLKAQRIPMESWSPLQN

SEQ ID NO: 2089691 - protein, 18 aa, Staphylococcus
YLKCFYTVLEHYTPQERH

SEQ ID NO: 2089692 - protein, 27 aa, Staphylococcus
YLKDLGIDVIWLSPMYKSPNDDNGYDI

SEQ ID NO: 2089693 - protein, 46 aa, Staphylococcus
YLKDPKAWDVSMYSYLTIPRGDTGYFFNTAYLPNGALNKGHYNNKE

SEQ ID NO: 2089694 - protein, 24 aa, Staphylococcus
YLKDRNFNIEFITKLEGAHLDYEK

SEQ ID NO: 2089695 - protein, 32 aa, Staphylococcus
YLKELQQLVPEGLIPLMKIQGLGSKKIAKLYK

SEQ ID NO: 2089696 - protein, 17 aa, Staphylococcus
YLKIKSEYDDCLLFFRL

SEQ ID NO: 2089697 - protein, 25 aa, Staphylococcus
YLKKHYPNIKILVLTSYVDDEHVIS

SEQ ID NO: 2089698 - protein, 18 aa, Staphylococcus
YLKNLSLEDIKAFPFILY

SEQ ID NO: 2089699 - protein, 17 aa, Staphylococcus
YLKQFDISFPNYIVLLY

SEQ ID NO: 2089700 - protein, 17 aa, Staphylococcus
YLKQHHIPMAIATSSYR

SEQ ID NO: 2089701 - protein, 27 aa, Staphylococcus
YLKQHNCLYVLLDPYILENLRNADGEI

SEQ ID NO: 2089702 - protein, 19 aa, Staphylococcus
YLKQRLITGNLNFATGRVY

SEQ ID NO: 2089703 - protein, 26 aa, Staphylococcus
YLKTFWNNLRPVMESLILLSMSKRMN

SEQ ID NO: 2089704 - protein, 17 aa, Staphylococcus
YLKTQQNVIWLDCDIDI

SEQ ID NO: 2089705 - protein, 17 aa, Staphylococcus
YLKYQNKRPDYISAFWN

SEQ ID NO: 2089706 - protein, 18 aa, Staphylococcus
YLLIGGEVLNAKWVNLLN

SEQ ID NO: 2089707 - protein, 17 aa, Staphylococcus
YLLLRRKYDRHQSCDLL

SEQ ID NO: 2089708 - protein, 17 aa, Staphylococcus
YLLLTYLDEGVSGSQEA

SEQ ID NO: 2089709 - protein, 17 aa, Staphylococcus
YLMRELPFGSDGVFTPE

SEQ ID NO: 2089710 - protein, 31 aa, Staphylococcus
YLNDIDEFYRLPYALFDNPFYNKLSPDAIIT

SEQ ID NO: 2089711 - protein, 18 aa, Staphylococcus
YLNDIIQTTIITNSLKIA

SEQ ID NO: 2089712 - protein, 28 aa, Staphylococcus
YLNEGYNVIMDIPLLFENDLQDTVDEVW

SEQ ID NO: 2089713 - protein, 23 aa, Staphylococcus
YLNGNVVLIFQYGEEIVPGGAQQ

SEQ ID NO: 2089714 - protein, 30 aa, Staphylococcus
YLNLIDLNFFNYVPFFRSLDMKQTKVNSPI

SEQ ID NO: 2089715 - protein, 25 aa, Staphylococcus
YLNLKGIISLYYKFDYLVSVSEETC

SEQ ID NO: 2089716 - protein, 17 aa, Staphylococcus
YLNYVTRQWIDFISTLQ

SEQ ID NO: 2089717 - protein, 30 aa, Staphylococcus
YLPARFHRHPLPVPRFKYFKLKCNRQQQTL

SEQ ID NO: 2089718 - protein, 18 aa, Staphylococcus
YLPDKLKNKIYYEPKSTS

SEQ ID NO: 2089719 - protein, 18 aa, Staphylococcus
YLPQFFYEAEMDALFETV

SEQ ID NO: 2089720 - protein, 18 aa, Staphylococcus
YLPQWDKVDRDILKNTRL

SEQ ID NO: 2089721 - protein, 17 aa, Staphylococcus
YLPVRKWNRETDSVGKL

SEQ ID NO: 2089722 - protein, 25 aa, Staphylococcus
YLQCLNYPLEIIPKLNFEDTYQFML

SEQ ID NO: 2089723 - protein, 25 aa, Staphylococcus
YLQKGIVFLMIRFKTLDEVYILPYS

SEQ ID NO: 2089724 - protein, 19 aa, Staphylococcus
YLQQFETINFLPAGNKRVF

SEQ ID NO: 2089725 - protein, 19 aa, Staphylococcus
YLQSPYFIPDQSYINALKM

SEQ ID NO: 2089726 - protein, 33 aa, Staphylococcus
YLQTRLKINIGFSDIYFYIDFLNDNEANYLDLN

SEQ ID NO: 2089727 - protein, 25 aa, Staphylococcus
YLQVLAYMYRFDAKTGYYFFPNQTG

SEQ ID NO: 2089728 - protein, 22 aa, Staphylococcus
YLQYDFPDIDIALLRGTYADMD

SEQ ID NO: 2089729 - protein, 26 aa, Staphylococcus
YLRKLEADVPIYYYGFKETDDIYAKN

SEQ ID NO: 2089730 - protein, 18 aa, Staphylococcus
YLRNIMTFLGVPSYETII

SEQ ID NO: 2089731 - protein, 17 aa, Staphylococcus
YLRTALVENGYDVGTFT

SEQ ID NO: 2089732 - protein, 24 aa, Staphylococcus
YLSDYHLYINQTFYSSFKSFYQNN

SEQ ID NO: 2089733 - protein, 29 aa, Staphylococcus
YLSEGYHVIMDIPLLFENNLQDTVDEVWL

SEQ ID NO: 2089734 - protein, 28 aa, Staphylococcus
YLSEGYNVIMDIPLLFENNLQDTVDETW

SEQ ID NO: 2089735 - protein, 23 aa, Staphylococcus
YLSFLDTRHWCQNKFQITNQVSV

SEQ ID NO: 2089736 - protein, 25 aa, Staphylococcus
YLSITMLKELLYKQGEHFKFVGADT

SEQ ID NO: 2089737 - protein, 18 aa, Staphylococcus
YLSMVLNDIGVKAKAMTG

SEQ ID NO: 2089738 - protein, 18 aa, Staphylococcus
YLSTFSKSIYPSCRIAYI

SEQ ID NO: 2089739 - protein, 23 aa, Staphylococcus
YLSTQWFVKMKPLAQQALDNQKT

SEQ ID NO: 2089740 - protein, 19 aa, Staphylococcus
YLTADILKFGIQADGHFVV

SEQ ID NO: 2089741 - protein, 17 aa, Staphylococcus
YLTEELGFDAGIDYKKD

SEQ ID NO: 2089742 - protein, 17 aa, Staphylococcus
YLTLTVHIVLSIDRMLN

SEQ ID NO: 2089743 - protein, 24 aa, Staphylococcus
YLTNDDIFNLIQTASRFKSGKETV

SEQ ID NO: 2089744 - protein, 20 aa, Staphylococcus
YLTRLRTGALSGIASKYMSK

SEQ ID NO: 2089745 - protein, 39 aa, Staphylococcus
YLTVITNCLPVFKILFEKRSLHFNVYLLGGEMRELTESF

SEQ ID NO: 2089746 - protein, 17 aa, Staphylococcus
YLVALNMGDTVLGMNLS

SEQ ID NO: 2089747 - protein, 27 aa, Staphylococcus
YLVEGAELFGFIYYADNKKIYIHDNNS

SEQ ID NO: 2089748 - protein, 19 aa, Staphylococcus
YLYFLDTEHWCQNKFQVTN

SEQ ID NO: 2089749 - protein, 26 aa, Staphylococcus
YLYNELSLTTEYYYPLQNAIIEFCTE

SEQ ID NO: 2089750 - protein, 26 aa, Staphylococcus
YLYQNNLKHDALIKTAALLLKYDDTN

SEQ ID NO: 2089751 - protein, 18 aa, Staphylococcus
YLYSIEHSIYVDSAYRGH

SEQ ID NO: 2089752 - protein, 17 aa, Staphylococcus
YLYSQAFKSPIVTPKVS

SEQ ID NO: 2089753 - protein, 19 aa, Staphylococcus
YMAIIRSLNMLFFPVKVNK

SEQ ID NO: 2089754 - protein, 17 aa, Staphylococcus
YMDIYDFTPVQFPADDQ

SEQ ID NO: 2089755 - protein, 22 aa, Staphylococcus
YMEAEPFMWPTYLEVQKNLVED

SEQ ID NO: 2089756 - protein, 17 aa, Staphylococcus
YMEELAKEKGMTIVHPY

SEQ ID NO: 2089757 - protein, 26 aa, Staphylococcus
YMEPETFMFPVYQEYTKKVRADLERL

SEQ ID NO: 2089758 - protein, 19 aa, Staphylococcus
YMESRGIFLYINHNTRTTK

SEQ ID NO: 2089759 - protein, 18 aa, Staphylococcus
YMGAYRLQWDMIKFAKEH

SEQ ID NO: 2089760 - protein, 18 aa, Staphylococcus
YMGPYAMHWHMINYCFDN

SEQ ID NO: 2089761 - protein, 25 aa, Staphylococcus
YMGPYMMHWFMINYCFDNGYDRYNF

SEQ ID NO: 2089762 - protein, 25 aa, Staphylococcus
YMGPYMMHWFMMNYCFDHGYDRYNF

SEQ ID NO: 2089763 - protein, 25 aa, Staphylococcus
YMGPYMMHWYMINYCFEHGYERYNF

SEQ ID NO: 2089764 - protein, 25 aa, Staphylococcus
YMGPYMMHWYMMNYCFDHGYGRYNF

SEQ ID NO: 2089765 - protein, 32 aa, Staphylococcus
YMGTFSKLLLPSLRISYMVLPISLINIYQEDF

SEQ ID NO: 2089766 - protein, 24 aa, Staphylococcus
YMHERLFDNYSGWNKAFIHIPNGA

SEQ ID NO: 2089767 - protein, 17 aa, Staphylococcus
YMIFKNMEDLELQSVKH

SEQ ID NO: 2089768 - protein, 21 aa, Staphylococcus
YMIPKKIIFKDKFPLTANGKL

SEQ ID NO: 2089769 - protein, 17 aa, Staphylococcus
YMKIGLASPEKIRSWSF

SEQ ID NO: 2089770 - protein, 18 aa, Staphylococcus
YMKIGLASPEKIRSWSYG

SEQ ID NO: 2089771 - protein, 17 aa, Staphylococcus
YMKKSVVSPKFSGLFSL

SEQ ID NO: 2089772 - protein, 18 aa, Staphylococcus
YMLSYAFTVLNKKGYQHI

SEQ ID NO: 2089773 - protein, 18 aa, Staphylococcus
YMLTLADTLIDMKDQFKG

SEQ ID NO: 2089774 - protein, 18 aa, Staphylococcus
YMMVAERFLESLMAPHEY

SEQ ID NO: 2089775 - protein, 22 aa, Staphylococcus
YMNLDPFYTKLLSLLKQQELKS

SEQ ID NO: 2089776 - protein, 26 aa, Staphylococcus
YMPIYDYQFLTFNVIGSPFGSSSPLN

SEQ ID NO: 2089777 - protein, 26 aa, Staphylococcus
YMPIYDYQFLTFNVIGSPFGSSSPLT

SEQ ID NO: 2089778 - protein, 17 aa, Staphylococcus
YMPPNLLTPKVFADEIT

SEQ ID NO: 2089779 - protein, 17 aa, Staphylococcus
YMQAAKDLGFDVKIHAD

SEQ ID NO: 2089780 - protein, 28 aa, Staphylococcus
YMQKYYPNYNYVWSLKKPDKSVIPGNAK

SEQ ID NO: 2089781 - protein, 35 aa, Staphylococcus
YMQYYRETGIYAERTAPWLERMGFENVKEYVLDPE

SEQ ID NO: 2089782 - protein, 20 aa, Staphylococcus
YMRHMFIEYVRTYYGYDKRI

SEQ ID NO: 2089783 - protein, 23 aa, Staphylococcus
YMSDIFCLPSYREGMPRSIIEAM

SEQ ID NO: 2089784 - protein, 25 aa, Staphylococcus
YMSKQIFDLILKFADYGFPRAHAVS

SEQ ID NO: 2089785 - protein, 18 aa, Staphylococcus
YMTTLSGFVHWYLTGERV

SEQ ID NO: 2089786 - protein, 18 aa, Staphylococcus
YMVEAHMINLIGVNKVMN

SEQ ID NO: 2089787 - protein, 24 aa, Staphylococcus
YNDDYWLFFLIKLTTNAIKPNGIN

SEQ ID NO: 2089788 - protein, 19 aa, Staphylococcus
YNDFGRIDVLINNAGLMPQ

SEQ ID NO: 2089789 - protein, 19 aa, Staphylococcus
YNDILVKPEIRMPKVGGRV

SEQ ID NO: 2089790 - protein, 20 aa, Staphylococcus
YNDILVKPEIRMPKVGGRVM

SEQ ID NO: 2089791 - protein, 17 aa, Staphylococcus
YNDQYSEGILSFVNNVR

SEQ ID NO: 2089792 - protein, 24 aa, Staphylococcus
YNEEPPIISLIQRYKHHYDKSNLD

SEQ ID NO: 2089793 - protein, 17 aa, Staphylococcus
YNEILGAFIVGPHATDL

SEQ ID NO: 2089794 - protein, 18 aa, Staphylococcus
YNELSILHYFLQGYEETM

SEQ ID NO: 2089795 - protein, 21 aa, Staphylococcus
YNERQGGYTRILKVGPRRGDG

SEQ ID NO: 2089796 - protein, 28 aa, Staphylococcus
YNETVINRLQWMKDVLGPVLGKAIREME

SEQ ID NO: 2089797 - protein, 20 aa, Staphylococcus
YNFMPVFDWTRSQLDYRLDD

SEQ ID NO: 2089798 - protein, 22 aa, Staphylococcus
YNFPELPFYEIGWRLIPEVWDN

SEQ ID NO: 2089799 - protein, 21 aa, Staphylococcus
YNFRDLFNKIAYLNKFEMEEA

SEQ ID NO: 2089800 - protein, 21 aa, Staphylococcus
YNGKRVYLPVRKWNRETDSVG

SEQ ID NO: 2089801 - protein, 23 aa, Staphylococcus
YNGSIIFVSHDRKFIEKVATRIM

SEQ ID NO: 2089802 - protein, 24 aa, Staphylococcus
YNGTYYVSHQWFPLGAVHGLKYWF

SEQ ID NO: 2089803 - protein, 21 aa, Staphylococcus
YNHFAHLNKFLNKNEDYRDQN

SEQ ID NO: 2089804 - protein, 23 aa, Staphylococcus
YNHFKILFLEEYLETEKLDELLE

SEQ ID NO: 2089805 - protein, 20 aa, Staphylococcus
YNIAYSLYTDLKDPEVPIRL

SEQ ID NO: 2089806 - protein, 25 aa, Staphylococcus
YNIDDLPLGVYRFLENKTKIYARTL

SEQ ID NO: 2089807 - protein, 21 aa, Staphylococcus
YNIEPLVHITCRDRNLIGLQS

SEQ ID NO: 2089808 - protein, 21 aa, Staphylococcus
YNILHTLTVKENIMLPLSVQK

SEQ ID NO: 2089809 - protein, 23 aa, Staphylococcus
YNINGFFEPLQSLIDHMIAEGFI

SEQ ID NO: 2089810 - protein, 21 aa, Staphylococcus
YNIWKVVPRAWSHVFLALIEA

SEQ ID NO: 2089811 - protein, 25 aa, Staphylococcus
YNIWRVVPRAWSHVFLSLMDQPIQH

SEQ ID NO: 2089812 - protein, 18 aa, Staphylococcus
YNIYSKLFKSWSGTIHTS

SEQ ID NO: 2089813 - protein, 27 aa, Staphylococcus
YNKKPMLVAADIYRPAAIDQLQTVGKQ

SEQ ID NO: 2089814 - protein, 18 aa, Staphylococcus
YNLVLDDIKYWFKEDPKG

SEQ ID NO: 2089815 - protein, 19 aa, Staphylococcus
YNMDINTAVLTFQVRREIN

SEQ ID NO: 2089816 - protein, 38 aa, Staphylococcus
YNMKKDKFYKILFGNNNFILWKYNNVIYNVFSDNFLKR

SEQ ID NO: 2089817 - protein, 23 aa, Staphylococcus
YNNDQWWRNLNQPFYIKNAMIEF

SEQ ID NO: 2089818 - protein, 27 aa, Staphylococcus
YNNEIGLPLTILQLDKDTEISILEMGM

SEQ ID NO: 2089819 - protein, 26 aa, Staphylococcus
YNNIEVFGVYQGYQGLLDDNIHKLEL

SEQ ID NO: 2089820 - protein, 24 aa, Staphylococcus
YNNIEVYGIYHGYQGLLDDDIHKL

SEQ ID NO: 2089821 - protein, 23 aa, Staphylococcus
YNNIEVYGVYHGYQGLVEDDIHK

SEQ ID NO: 2089822 - protein, 24 aa, Staphylococcus
YNNIEVYGVYQGYQGLLNDDIEKL

SEQ ID NO: 2089823 - protein, 17 aa, Staphylococcus
YNNNENIDFLREGGLGL

SEQ ID NO: 2089824 - protein, 25 aa, Staphylococcus
YNPSLKLCINIAKTLGVTLNDLFWE

SEQ ID NO: 2089825 - protein, 24 aa, Staphylococcus
YNPVNQIVGYLLSGDPAYIPRNNE

SEQ ID NO: 2089826 - protein, 24 aa, Staphylococcus
YNQDQPFIQLIKPGDTFEFKCLKE

SEQ ID NO: 2089827 - protein, 21 aa, Staphylococcus
YNQFVMISYIKDRVNGMYTNQ

SEQ ID NO: 2089828 - protein, 26 aa, Staphylococcus
YNQKSLRLISLLIKIKSLTPTLHKEI

SEQ ID NO: 2089829 - protein, 23 aa, Staphylococcus
YNQLHKWFKINELKSYITFVIVN

SEQ ID NO: 2089830 - protein, 26 aa, Staphylococcus
YNQQEIPIYLEDLIIIFTDGVTEARN

SEQ ID NO: 2089831 - protein, 22 aa, Staphylococcus
YNQTWNNMYDWIKKNILKKNKA

SEQ ID NO: 2089832 - protein, 23 aa, Staphylococcus
YNQYIRIRHILNPSLRVLTKCQA

SEQ ID NO: 2089833 - protein, 19 aa, Staphylococcus
YNRMGGFYGVKRSKSSNPK

SEQ ID NO: 2089834 - protein, 25 aa, Staphylococcus
YNRPRGKFRFPMHVSEEASYNDLDN

SEQ ID NO: 2089835 - protein, 18 aa, Staphylococcus
YNRRYLSGFTGTSGALII

SEQ ID NO: 2089836 - protein, 19 aa, Staphylococcus
YNSELLPKVTRELIPTLFK

SEQ ID NO: 2089837 - protein, 24 aa, Staphylococcus
YNTDIRICQIWDWENGYRNVSNKN

SEQ ID NO: 2089838 - protein, 19 aa, Staphylococcus
YNVYAYDFKPQNYTKTLFI

SEQ ID NO: 2089839 - protein, 24 aa, Staphylococcus
YNYDEFYQLLLIKLWQLSKNYNKN

SEQ ID NO: 2089840 - protein, 20 aa, Staphylococcus
YNYDLLNFVLTKISSGQSAQ

SEQ ID NO: 2089841 - protein, 20 aa, Staphylococcus
YNYGFILSAMEKELGTCVID

SEQ ID NO: 2089842 - protein, 33 aa, Staphylococcus
YNYGYFPHFDKKIGFYNILRHSSSTYALIEGLN

SEQ ID NO: 2089843 - protein, 29 aa, Staphylococcus
YNYYSKHQCTWWAYKRRVQLGKPVSNRWG

SEQ ID NO: 2089844 - protein, 29 aa, Staphylococcus
YPDKLIVTQGALGAVFYDGLEQIEIQGIE

SEQ ID NO: 2089845 - protein, 25 aa, Staphylococcus
YPDLDFEFIHWLVTGVKDHEQVLDQ

SEQ ID NO: 2089846 - protein, 27 aa, Staphylococcus
YPEFGVRLKAYFNEIKFTKSLATQIKK

SEQ ID NO: 2089847 - protein, 25 aa, Staphylococcus
YPELKLGIITPFLGHTHRWNEQNQA

SEQ ID NO: 2089848 - protein, 19 aa, Staphylococcus
YPELPRTEYICFYPMDKRR

SEQ ID NO: 2089849 - protein, 28 aa, Staphylococcus
YPENRTRLVIYPAAMRYAGPREAILHAT

SEQ ID NO: 2089850 - protein, 23 aa, Staphylococcus
YPESKVEKWFYESAPKRVQRRKD

SEQ ID NO: 2089851 - protein, 23 aa, Staphylococcus
YPFKELPLYEIGWRLIPEVWGNG

SEQ ID NO: 2089852 - protein, 18 aa, Staphylococcus
YPFVLYDRNFYHHNFKQF

SEQ ID NO: 2089853 - protein, 25 aa, Staphylococcus
YPGRFKSFALLPMPHVKESLKEIEY

SEQ ID NO: 2089854 - protein, 17 aa, Staphylococcus
YPGVLPVVNKRAVDWAM

SEQ ID NO: 2089855 - protein, 17 aa, Staphylococcus
YPGYQVSPYYDSLVAKV

SEQ ID NO: 2089856 - protein, 17 aa, Staphylococcus
YPHGKLYKAVRGFGAYV

SEQ ID NO: 2089857 - protein, 22 aa, Staphylococcus
YPHHHPKFKIDEKSMLVAAEAV

SEQ ID NO: 2089858 - protein, 25 aa, Staphylococcus
YPHKILNIHPSLLPKYKGIDAIGQA

SEQ ID NO: 2089859 - protein, 22 aa, Staphylococcus
YPHLEIKWIRGNIDTRLKKLET

SEQ ID NO: 2089860 - protein, 17 aa, Staphylococcus
YPHLSINCYHKLALYYI

SEQ ID NO: 2089861 - protein, 20 aa, Staphylococcus
YPIEAVFGIHVNPFAEEGKV

SEQ ID NO: 2089862 - protein, 20 aa, Staphylococcus
YPIIEETIRLNKQIFVPSTE

SEQ ID NO: 2089863 - protein, 17 aa, Staphylococcus
YPILIQTGDKNILIDAG

SEQ ID NO: 2089864 - protein, 29 aa, Staphylococcus
YPILSHTIILPQLLNQTFLSYQKLLHGMN

SEQ ID NO: 2089865 - protein, 20 aa, Staphylococcus
YPILVLPKLATEIGLNEAIV

SEQ ID NO: 2089866 - protein, 26 aa, Staphylococcus
YPKLAHLNLKWYAVPIISNMDLKIGG

SEQ ID NO: 2089867 - protein, 19 aa, Staphylococcus
YPLIDVKAKLYDGSYHDVD

SEQ ID NO: 2089868 - protein, 18 aa, Staphylococcus
YPLLRRLVKSGELATYYQ

SEQ ID NO: 2089869 - protein, 17 aa, Staphylococcus
YPNRSWKIYRNTSSFVP

SEQ ID NO: 2089870 - protein, 20 aa, Staphylococcus
YPPETIAHLINYDTTHGRFD

SEQ ID NO: 2089871 - protein, 23 aa, Staphylococcus
YPQKSNGYSWYFPSRSAVSAAMN

SEQ ID NO: 2089872 - protein, 32 aa, Staphylococcus
YPQLLREIYDPPLILFYRGKLTLMQSPRTLAI

SEQ ID NO: 2089873 - protein, 26 aa, Staphylococcus
YPQPAPADHPWRKMPRNAMTIHYSGM

SEQ ID NO: 2089874 - protein, 17 aa, Staphylococcus
YPQPAPADHPWRTMPRN

SEQ ID NO: 2089875 - protein, 18 aa, Staphylococcus
YPQVGKVIGFIPKDKAEE

SEQ ID NO: 2089876 - protein, 17 aa, Staphylococcus
YPRCLLKHFANDNKKFH

SEQ ID NO: 2089877 - protein, 25 aa, Staphylococcus
YPRLKELGIKWYAVPIISNMDLKIG

SEQ ID NO: 2089878 - protein, 21 aa, Staphylococcus
YPRRDKIELLADYFGVMPSDI

SEQ ID NO: 2089879 - protein, 17 aa, Staphylococcus
YPSFLEIAPEPFDEEAL

SEQ ID NO: 2089880 - protein, 17 aa, Staphylococcus
YPSIFSQIAMFSPHSDH

SEQ ID NO: 2089881 - protein, 19 aa, Staphylococcus
YPSIIRRGGGYRGIDIDAF

SEQ ID NO: 2089882 - protein, 18 aa, Staphylococcus
YPSVFVFIGSNSEYDLHH

SEQ ID NO: 2089883 - protein, 19 aa, Staphylococcus
YPTQFISTMQFDQLYHLML

SEQ ID NO: 2089884 - protein, 17 aa, Staphylococcus
YPTYVTALNKAKKISNK

SEQ ID NO: 2089885 - protein, 35 aa, Staphylococcus
YPVPHLGWNNLISKHPLLLHDVYFVHAYQAEMSQH

SEQ ID NO: 2089886 - protein, 21 aa, Staphylococcus
YPVVVRPSYVLGGRAMEIVNS

SEQ ID NO: 2089887 - protein, 17 aa, Staphylococcus
YPYYASGGFIHYCEYPK

SEQ ID NO: 2089888 - protein, 24 aa, Staphylococcus
YQAKSTFYLRISTLPLSLGIESCV

SEQ ID NO: 2089889 - protein, 26 aa, Staphylococcus
YQASQNLLYPLYKKGKFLSIQMYNAL

SEQ ID NO: 2089890 - protein, 19 aa, Staphylococcus
YQATYQFLESLQLSIDDFG

SEQ ID NO: 2089891 - protein, 21 aa, Staphylococcus
YQDAVDILLPEAYGEAIEETG

SEQ ID NO: 2089892 - protein, 22 aa, Staphylococcus
YQDIAILYRDESYAYLLASVLP

SEQ ID NO: 2089893 - protein, 34 aa, Staphylococcus
YQDIAILYRDETYAYLFESILPQYDIPYNIDTKK

SEQ ID NO: 2089894 - protein, 19 aa, Staphylococcus
YQDLYLQNINYRKLLSLKQ

SEQ ID NO: 2089895 - protein, 24 aa, Staphylococcus
YQDVGTGIPVILIHGLDGNLAGFY

SEQ ID NO: 2089896 - protein, 25 aa, Staphylococcus
YQDVPEKLWNIKPLNKFWGINKRTE

SEQ ID NO: 2089897 - protein, 23 aa, Staphylococcus
YQDYIHIPTFVIPNIINETRLQE

SEQ ID NO: 2089898 - protein, 24 aa, Staphylococcus
YQEHGYKHFIYTPVGFVCNHLEVL

SEQ ID NO: 2089899 - protein, 23 aa, Staphylococcus
YQEHHFKNFIYTPVGFVCEHLEV

SEQ ID NO: 2089900 - protein, 25 aa, Staphylococcus
YQEQPGYKLMFNTLRAMYSEHPVRV

SEQ ID NO: 2089901 - protein, 25 aa, Staphylococcus
YQEQPGYKLMFNTLRAMYSNHPIRV

SEQ ID NO: 2089902 - protein, 25 aa, Staphylococcus
YQETRTLLFNLLDSPVKYTQHIGGT

SEQ ID NO: 2089903 - protein, 23 aa, Staphylococcus
YQEWVEKGYFRPSGDKSKETYTI

SEQ ID NO: 2089904 - protein, 20 aa, Staphylococcus
YQFDAPLVEFFYKNDELNDP

SEQ ID NO: 2089905 - protein, 20 aa, Staphylococcus
YQFFNDPMLSIYLYNQVDKQ

SEQ ID NO: 2089906 - protein, 17 aa, Staphylococcus
YQFISYHKDLPGMVGLT

SEQ ID NO: 2089907 - protein, 19 aa, Staphylococcus
YQFIVANTLLDTQFDISYY

SEQ ID NO: 2089908 - protein, 22 aa, Staphylococcus
YQGDALIITGSLYFISEVKAKV

SEQ ID NO: 2089909 - protein, 22 aa, Staphylococcus
YQGDEWFTLNDISFKIPKGKWT

SEQ ID NO: 2089910 - protein, 17 aa, Staphylococcus
YQGPFQFKRADQFMLDH

SEQ ID NO: 2089911 - protein, 23 aa, Staphylococcus
YQHYRYHFSDLIYVSSKDALRFS

SEQ ID NO: 2089912 - protein, 18 aa, Staphylococcus
YQIDIIYITNDGAWKKKE

SEQ ID NO: 2089913 - protein, 21 aa, Staphylococcus
YQIGLGPRILRAETAPLYVLS

SEQ ID NO: 2089914 - protein, 19 aa, Staphylococcus
YQIPILGTHNMRNAAIAIS

SEQ ID NO: 2089915 - protein, 26 aa, Staphylococcus
YQIPQSKHFLPSQTNFIFVKTNNSKA

SEQ ID NO: 2089916 - protein, 27 aa, Staphylococcus
YQIQMTLPSLAYYYKYKNDLSGIKVHL

SEQ ID NO: 2089917 - protein, 26 aa, Staphylococcus
YQKDVFELVRLFGKRGRGLYNKARGI

SEQ ID NO: 2089918 - protein, 18 aa, Staphylococcus
YQKKGIGLALINAVEAWA

SEQ ID NO: 2089919 - protein, 17 aa, Staphylococcus
YQLALERDIFFHHPYES

SEQ ID NO: 2089920 - protein, 23 aa, Staphylococcus
YQLHLKYQLPLYHIDQIQWLNNK

SEQ ID NO: 2089921 - protein, 21 aa, Staphylococcus
YQLLLIKLWEISKIYTPSSSV

SEQ ID NO: 2089922 - protein, 19 aa, Staphylococcus
YQLLTLPERVNQQALPSID

SEQ ID NO: 2089923 - protein, 18 aa, Staphylococcus
YQLQDIVHLYPATPSLNQ

SEQ ID NO: 2089924 - protein, 19 aa, Staphylococcus
YQLSKTEYRGREATDFQEE

SEQ ID NO: 2089925 - protein, 17 aa, Staphylococcus
YQLSSMIQYIDSDDLRE

SEQ ID NO: 2089926 - protein, 20 aa, Staphylococcus
YQLYQNLKRQNPSPYMYYLN

SEQ ID NO: 2089927 - protein, 20 aa, Staphylococcus
YQMYVKLLFDKWQHDKIPPR

SEQ ID NO: 2089928 - protein, 22 aa, Staphylococcus
YQNKLNVFASGGLRTPLDAIKS

SEQ ID NO: 2089929 - protein, 25 aa, Staphylococcus
YQNKRPDYIDAFWNVVNWNKVDELY

SEQ ID NO: 2089930 - protein, 26 aa, Staphylococcus
YQNKRPDYISAFWNVINWEKVDELYN

SEQ ID NO: 2089931 - protein, 26 aa, Staphylococcus
YQNKRPDYISAFWNVVNWEKVDELYK

SEQ ID NO: 2089932 - protein, 19 aa, Staphylococcus
YQNLKTLFSIYKRFDKLIS

SEQ ID NO: 2089933 - protein, 20 aa, Staphylococcus
YQNQLPWHLPNDLKHVKQLT

SEQ ID NO: 2089934 - protein, 35 aa, Staphylococcus
YQNVPIMSYGIKYASSFFGPFRDAADSAPSFGDRK

SEQ ID NO: 2089935 - protein, 22 aa, Staphylococcus
YQNYALSQMPYPDKTHFETKGE

SEQ ID NO: 2089936 - protein, 22 aa, Staphylococcus
YQPYAEGFVKMLAPIAPHIGEE

SEQ ID NO: 2089937 - protein, 42 aa, Staphylococcus
YQQKTNIIGLLFPTVANPFFGELIFELEKRLYDKGYIVIIGN

SEQ ID NO: 2089938 - protein, 18 aa, Staphylococcus
YQQPKFIQYWTEKINETL

SEQ ID NO: 2089939 - protein, 37 aa, Staphylococcus
YQQQGVVFLLIRFKSLDEVYLLPYANFKKFWERHIQE

SEQ ID NO: 2089940 - protein, 25 aa, Staphylococcus
YQQYQLYLFGYSMGGRVALYYALHG

SEQ ID NO: 2089941 - protein, 17 aa, Staphylococcus
YQRALKYNMNPIDANYM

SEQ ID NO: 2089942 - protein, 22 aa, Staphylococcus
YQRLKFYLIDLFRKEQLKIDCL

SEQ ID NO: 2089943 - protein, 17 aa, Staphylococcus
YQRVMFWSEYEIRQYTH

SEQ ID NO: 2089944 - protein, 25 aa, Staphylococcus
YQSARWVLIDLADVVVHIFHKDERN

SEQ ID NO: 2089945 - protein, 17 aa, Staphylococcus
YQSFYNLIQTVYEDQDF

SEQ ID NO: 2089946 - protein, 23 aa, Staphylococcus
YQSLKNVLYEPLNNEFEYEYKKR

SEQ ID NO: 2089947 - protein, 25 aa, Staphylococcus
YQSQRVLTDILPTIDNIERALQIEG

SEQ ID NO: 2089948 - protein, 22 aa, Staphylococcus
YQTSLNIAKYAPNATIIVLTNP

SEQ ID NO: 2089949 - protein, 25 aa, Staphylococcus
YQVGDKIQFSLGYKALAHSMYMVNL

SEQ ID NO: 2089950 - protein, 22 aa, Staphylococcus
YQVLVKVHPFVYKTALKYKELK

SEQ ID NO: 2089951 - protein, 24 aa, Staphylococcus
YQVPPRWLFLKIITDEGLEGWGEP

SEQ ID NO: 2089952 - protein, 26 aa, Staphylococcus
YQVRKNIFLLDDWLDDILLNHEKLMN

SEQ ID NO: 2089953 - protein, 18 aa, Staphylococcus
YQYLLTRKYHFMGYRQMK

SEQ ID NO: 2089954 - protein, 18 aa, Staphylococcus
YQYMLVRKYHFMGYSQMK

SEQ ID NO: 2089955 - protein, 31 aa, Staphylococcus
YQYTEIMPPSNLYPPRKFDGEKWYGATANDT

SEQ ID NO: 2089956 - protein, 27 aa, Staphylococcus
YRAKSKRLMVMKQSFKKVVIKNCENMK

SEQ ID NO: 2089957 - protein, 19 aa, Staphylococcus
YRDCYVMGLLKRNWVNQQD

SEQ ID NO: 2089958 - protein, 24 aa, Staphylococcus
YRDEATWFALMDHLVAISIDYVNA

SEQ ID NO: 2089959 - protein, 20 aa, Staphylococcus
YRDFGRINELRIGETLFRGV

SEQ ID NO: 2089960 - protein, 19 aa, Staphylococcus
YRDRTMLELLYATGMRVSE

SEQ ID NO: 2089961 - protein, 20 aa, Staphylococcus
YRDRTMLELLYATGMRVSEV

SEQ ID NO: 2089962 - protein, 18 aa, Staphylococcus
YRDVGQGIPIVLIHGLDG

SEQ ID NO: 2089963 - protein, 19 aa, Staphylococcus
YRDYYYFKPSQDGPPTNWE

SEQ ID NO: 2089964 - protein, 26 aa, Staphylococcus
YREMAKEGVFLPPSQFEGTFLSMAHT

SEQ ID NO: 2089965 - protein, 26 aa, Staphylococcus
YREMAKEGVFLPPSQFEGTFLSTAHS

SEQ ID NO: 2089966 - protein, 26 aa, Staphylococcus
YREMAKEGVFLPPSQFEGTFLSTAHT

SEQ ID NO: 2089967 - protein, 25 aa, Staphylococcus
YREMAKEGVFLPPSQFEGTFLSTSH

SEQ ID NO: 2089968 - protein, 24 aa, Staphylococcus
YRFMGIAFDLLSYALQYTFSNYDV

SEQ ID NO: 2089969 - protein, 17 aa, Staphylococcus
YRGERIINWDPEARTAL

SEQ ID NO: 2089970 - protein, 20 aa, Staphylococcus
YRGFLVNTLCRKAIEKANVN

SEQ ID NO: 2089971 - protein, 20 aa, Staphylococcus
YRHEGIAFNLLSYAINYAFK

SEQ ID NO: 2089972 - protein, 28 aa, Staphylococcus
YRILYKHMGPQGWWPADSKIEIILGAIL

SEQ ID NO: 2089973 - protein, 23 aa, Staphylococcus
YRKALRLMKQAEKFGRPIFTFID

SEQ ID NO: 2089974 - protein, 23 aa, Staphylococcus
YRKALRLMKQAEKFKRPIFTFID

SEQ ID NO: 2089975 - protein, 18 aa, Staphylococcus
YRKALRLMKQAEKFNRPI

SEQ ID NO: 2089976 - protein, 23 aa, Staphylococcus
YRKALRLMKQAEKFNRPIFSFID

SEQ ID NO: 2089977 - protein, 19 aa, Staphylococcus
YRKGYLYLNTFQAYFINPI

SEQ ID NO: 2089978 - protein, 31 aa, Staphylococcus
YRKQNYTGLFRYIQMFIISNGIETRYISNND

SEQ ID NO: 2089979 - protein, 23 aa, Staphylococcus
YRKSKLLLLDIAVPRDIEPCHNL

SEQ ID NO: 2089980 - protein, 18 aa, Staphylococcus
YRKSLMIKVFEHTTQYDE

SEQ ID NO: 2089981 - protein, 24 aa, Staphylococcus
YRKVLEFFHPEFKKEYVILAEEGA

SEQ ID NO: 2089982 - protein, 23 aa, Staphylococcus
YRKVLEFYHPEFDKEYVILAEEG

SEQ ID NO: 2089983 - protein, 17 aa, Staphylococcus
YRLGVNHWQIPVNQPKG

SEQ ID NO: 2089984 - protein, 18 aa, Staphylococcus
YRLKGIAFDLLSYAIHYA

SEQ ID NO: 2089985 - protein, 19 aa, Staphylococcus
YRLLTSRAEYRLLLRHDNA

SEQ ID NO: 2089986 - protein, 24 aa, Staphylococcus
YRLNNNDILVLRLGGEYTVKRVRR

SEQ ID NO: 2089987 - protein, 21 aa, Staphylococcus
YRMDELIVSYLLQSYIEKHDI

SEQ ID NO: 2089988 - protein, 24 aa, Staphylococcus
YRMHKGLHMLTFEGINNINDIEYL

SEQ ID NO: 2089989 - protein, 23 aa, Staphylococcus
YRMQKNWITPFSQRYYLATEELK

SEQ ID NO: 2089990 - protein, 20 aa, Staphylococcus
YRNFGMAHPEGYRKALRLMK

SEQ ID NO: 2089991 - protein, 20 aa, Staphylococcus
YRNNILKDPALARRFNEVLV

SEQ ID NO: 2089992 - protein, 18 aa, Staphylococcus
YRPEMPNTNPLFIGAIVD

SEQ ID NO: 2089993 - protein, 19 aa, Staphylococcus
YRPEMPNTNPLFIGAIVDE

SEQ ID NO: 2089994 - protein, 18 aa, Staphylococcus
YRQLLQDYFNLNVTIDRL

SEQ ID NO: 2089995 - protein, 32 aa, Staphylococcus
YRRFDDKYDLLKLLIRKLIFRVREKHFSTLNP

SEQ ID NO: 2089996 - protein, 17 aa, Staphylococcus
YRRGLNDAIQFLSYRKR

SEQ ID NO: 2089997 - protein, 18 aa, Staphylococcus
YRRVVPSPMPINIVELDS

SEQ ID NO: 2089998 - protein, 19 aa, Staphylococcus
YRSTWFAEGAYDSVASPLF

SEQ ID NO: 2089999 - protein, 20 aa, Staphylococcus
YRSYHVIIEYPIETLNGQKS

SEQ ID NO: 2090000 - protein, 17 aa, Staphylococcus
YRSYRFLKPDQGLTYKI

SEQ ID NO: 2090001 - protein, 20 aa, Staphylococcus
YRTGFHLYNSLDYGVIGWND

SEQ ID NO: 2090002 - protein, 25 aa, Staphylococcus
YRTHKGFHMLKFEGIDNINDIEYLK

SEQ ID NO: 2090003 - protein, 29 aa, Staphylococcus
YRTNDLNWIYLVKNLRLAGVKIELLIEFC

SEQ ID NO: 2090004 - protein, 17 aa, Staphylococcus
YRVLKQHSQRDYLLLSF

SEQ ID NO: 2090005 - protein, 21 aa, Staphylococcus
YRYEWFDYIMKQLGASVLLTA

SEQ ID NO: 2090006 - protein, 21 aa, Staphylococcus
YRYGNRKFWCKGFYVDTVGRN

SEQ ID NO: 2090007 - protein, 37 aa, Staphylococcus
YSADYLFIATGDFAFPYQPFQYGRHYSKIHDFNTLGQ

SEQ ID NO: 2090008 - protein, 17 aa, Staphylococcus
YSAEIKTILSKLGIYDT

SEQ ID NO: 2090009 - protein, 17 aa, Staphylococcus
YSASGVALITRLLNMTH

SEQ ID NO: 2090010 - protein, 26 aa, Staphylococcus
YSATKSAVLMIFNGLEKELAKTGIKT

SEQ ID NO: 2090011 - protein, 19 aa, Staphylococcus
YSDAYNYGFILSAMEKELG

SEQ ID NO: 2090012 - protein, 24 aa, Staphylococcus
YSDEATWFALMDHLVEMSITYTSA

SEQ ID NO: 2090013 - protein, 26 aa, Staphylococcus
YSDNYTFQTLIFQPEPLTTKEVLDSK

SEQ ID NO: 2090014 - protein, 20 aa, Staphylococcus
YSDYYILKVLNIYSVLQNNQ

SEQ ID NO: 2090015 - protein, 17 aa, Staphylococcus
YSEARHFGFVLPDDKRI

SEQ ID NO: 2090016 - protein, 23 aa, Staphylococcus
YSEFKPYYLTKALQKLKDLQLLS

SEQ ID NO: 2090017 - protein, 45 aa, Staphylococcus
YSEHVFSKIKSLPMVMVMLYASLGSVLLREFELQPFIVEISGSTS

SEQ ID NO: 2090018 - protein, 25 aa, Staphylococcus
YSEKHHFIALAHAGWRGTYGQIVVE

SEQ ID NO: 2090019 - protein, 24 aa, Staphylococcus
YSEKNHFIGLAHAGWRGTVGQIVN

SEQ ID NO: 2090020 - protein, 28 aa, Staphylococcus
YSEWDYERFDFFLEKFNLPVNKKIKSFS

SEQ ID NO: 2090021 - protein, 34 aa, Staphylococcus
YSFAYILDDGQSYSYLIFVQETWSMLYENKGKKL

SEQ ID NO: 2090022 - protein, 18 aa, Staphylococcus
YSGFAFGMGPDRIAMLKY

SEQ ID NO: 2090023 - protein, 24 aa, Staphylococcus
YSGFAFGMGPDRIAMLKYGIEDIR

SEQ ID NO: 2090024 - protein, 27 aa, Staphylococcus
YSGIVKTYLDLLPRGAFTGKTVLPLAL

SEQ ID NO: 2090025 - protein, 22 aa, Staphylococcus
YSGKGLLITGSLYFISEVKDNV

SEQ ID NO: 2090026 - protein, 17 aa, Staphylococcus
YSGTEMDILPDGSLDYD

SEQ ID NO: 2090027 - protein, 26 aa, Staphylococcus
YSGTKAALIGLTRSWAKELGKFNINV

SEQ ID NO: 2090028 - protein, 25 aa, Staphylococcus
YSGTLVNGLMYQIKDLSGINGEIRP

SEQ ID NO: 2090029 - protein, 20 aa, Staphylococcus
YSHATAVNGLVFTSGQLPLN

SEQ ID NO: 2090030 - protein, 32 aa, Staphylococcus
YSIDHLNICRRMLLLMLAWDKGYKFDFQVNFG

SEQ ID NO: 2090031 - protein, 19 aa, Staphylococcus
YSIIRSFIKRELAIHGFEM

SEQ ID NO: 2090032 - protein, 25 aa, Staphylococcus
YSKEPGHIIFEFATVGPGFMVDEDI

SEQ ID NO: 2090033 - protein, 20 aa, Staphylococcus
YSKGIYAFRDTILNAIQDVF

SEQ ID NO: 2090034 - protein, 24 aa, Staphylococcus
YSKIAYIMAYLKVHYPNYFYANIL

SEQ ID NO: 2090035 - protein, 30 aa, Staphylococcus
YSKIAYIMAYLKVHYPNYFYANILSNVVGN

SEQ ID NO: 2090036 - protein, 24 aa, Staphylococcus
YSKIAYIMSYLKVHYPHYFYANIL

SEQ ID NO: 2090037 - protein, 32 aa, Staphylococcus
YSKIAYIMSYLKVYYPNYFYANILSNVIGSEK

SEQ ID NO: 2090038 - protein, 18 aa, Staphylococcus
YSKSFSYAFDLLPESERR

SEQ ID NO: 2090039 - protein, 17 aa, Staphylococcus
YSKYFEQVYQPPSLKEA

SEQ ID NO: 2090040 - protein, 32 aa, Staphylococcus
YSLNAGGKRIRPLLVFLTLDVLNQDYKKGKKT

SEQ ID NO: 2090041 - protein, 25 aa, Staphylococcus
YSLQEMYQGFFLAPHVVSQSLKGAL

SEQ ID NO: 2090042 - protein, 23 aa, Staphylococcus
YSLVHFLDYLADHGLYFKLPKDS

SEQ ID NO: 2090043 - protein, 27 aa, Staphylococcus
YSMIEEFKVTIWYTAPTALRMLMSAGD

SEQ ID NO: 2090044 - protein, 39 aa, Staphylococcus
YSMMNGALHYLLQGSQFTTGWIFFIDDSGHHELVADADL

SEQ ID NO: 2090045 - protein, 23 aa, Staphylococcus
YSNFKVGAYLKAKDGRTFYGTNV

SEQ ID NO: 2090046 - protein, 18 aa, Staphylococcus
YSNNIWLFDVGEGTQHQI

SEQ ID NO: 2090047 - protein, 35 aa, Staphylococcus
YSNNVFKKYKLTYPQFLVLTILWADSPVNVKKVVT

SEQ ID NO: 2090048 - protein, 20 aa, Staphylococcus
YSPEYLLSRDYLQDDPEGFI

SEQ ID NO: 2090049 - protein, 18 aa, Staphylococcus
YSPIIMKKNRPATQLTII

SEQ ID NO: 2090050 - protein, 37 aa, Staphylococcus
YSPNGPPPGYAFNWPHPGIDLPYIYEPVYSTISGTAH

SEQ ID NO: 2090051 - protein, 25 aa, Staphylococcus
YSPSPGSVYPILQMLEDRDFVSISK

SEQ ID NO: 2090052 - protein, 19 aa, Staphylococcus
YSPYLIQAMKAHYVSKIYF

SEQ ID NO: 2090053 - protein, 25 aa, Staphylococcus
YSQQEIPIYLDDLIIIFTDGVTEAR

SEQ ID NO: 2090054 - protein, 21 aa, Staphylococcus
YSRQLITPLINLIQEYGIALE

SEQ ID NO: 2090055 - protein, 23 aa, Staphylococcus
YSSLPIEASLLNKPTLFYNYDEK

SEQ ID NO: 2090056 - protein, 31 aa, Staphylococcus
YSSLVYEFAVFKRPMLFYAFDLEDYITSRDF

SEQ ID NO: 2090057 - protein, 23 aa, Staphylococcus
YSSNIAMVLTKIAKRNPREIAQA

SEQ ID NO: 2090058 - protein, 26 aa, Staphylococcus
YSSVMFDFGILKRPQFFFAYDIEKYD

SEQ ID NO: 2090059 - protein, 26 aa, Staphylococcus
YSSVMFDYGILKRPQFFFAYDIDKYD

SEQ ID NO: 2090060 - protein, 26 aa, Staphylococcus
YSSVMFDYGILKRPQFFFAYDIEKYD

SEQ ID NO: 2090061 - protein, 18 aa, Staphylococcus
YSTGLHPASWRLPHSYVE

SEQ ID NO: 2090062 - protein, 23 aa, Staphylococcus
YSTNIAMVLTKIAKRNPHEIAQA

SEQ ID NO: 2090063 - protein, 22 aa, Staphylococcus
YSTNIAMVLTKVAKRNPREIAQ

SEQ ID NO: 2090064 - protein, 17 aa, Staphylococcus
YSTRIMDLVAPIGLGQR

SEQ ID NO: 2090065 - protein, 17 aa, Staphylococcus
YSTRIMDLVTPIGLGQR

SEQ ID NO: 2090066 - protein, 31 aa, Staphylococcus
YSTRIMDLVTPIGLGQRGLIVAPPKAGKTSL

SEQ ID NO: 2090067 - protein, 17 aa, Staphylococcus
YSVELLLVKVATPSEDE

SEQ ID NO: 2090068 - protein, 19 aa, Staphylococcus
YSVLYMNVPQLITTYKDTY

SEQ ID NO: 2090069 - protein, 27 aa, Staphylococcus
YSVRFGLDIICLRFSHLFGANEKNNYM

SEQ ID NO: 2090070 - protein, 25 aa, Staphylococcus
YSYELYNFFDVDTIIRIGSCGALQE

SEQ ID NO: 2090071 - protein, 24 aa, Staphylococcus
YSYELYNFFDVDTIIRVGSCGALQ

SEQ ID NO: 2090072 - protein, 29 aa, Staphylococcus
YSYPELVEQKWMSGQVFISLAVKFSKARL

SEQ ID NO: 2090073 - protein, 18 aa, Staphylococcus
YSYRDYQKLVDKMQFHDK

SEQ ID NO: 2090074 - protein, 18 aa, Staphylococcus
YSYRDYQKLVNKLQFHDK

SEQ ID NO: 2090075 - protein, 31 aa, Staphylococcus
YSYRMDDLIVSYLIQAYLLKCSKVTPEFIDK

SEQ ID NO: 2090076 - protein, 24 aa, Staphylococcus
YTAERIFILISFDEKDPTIDIFFQ

SEQ ID NO: 2090077 - protein, 18 aa, Staphylococcus
YTAGLAIEKLEKANFMTL

SEQ ID NO: 2090078 - protein, 29 aa, Staphylococcus
YTAKKLNLKAVIFMPVTTPLQKINQVQFF

SEQ ID NO: 2090079 - protein, 18 aa, Staphylococcus
YTCEGIFGEALKLSPQLR

SEQ ID NO: 2090080 - protein, 20 aa, Staphylococcus
YTDFDFAVYIIDHLVDDEKG

SEQ ID NO: 2090081 - protein, 22 aa, Staphylococcus
YTDMPFVIMLDQDKQGYKAGRF

SEQ ID NO: 2090082 - protein, 25 aa, Staphylococcus
YTDRAFPTLPFLKKGVTYHFKFHVT

SEQ ID NO: 2090083 - protein, 25 aa, Staphylococcus
YTDRQGGYTRILKEGPRRGDGAGSV

SEQ ID NO: 2090084 - protein, 25 aa, Staphylococcus
YTEDVYDFWRPSGEIYPLVAGKLSK

SEQ ID NO: 2090085 - protein, 24 aa, Staphylococcus
YTEDVYDFWRPTGHAYPLVDGALS

SEQ ID NO: 2090086 - protein, 17 aa, Staphylococcus
YTEGRHFGFVIPDDKRI

SEQ ID NO: 2090087 - protein, 25 aa, Staphylococcus
YTEKMQPAVWLDFLNDIFAGDQEVI

SEQ ID NO: 2090088 - protein, 26 aa, Staphylococcus
YTEPTKLKNPPANWPRTAKFEGLIHR

SEQ ID NO: 2090089 - protein, 33 aa, Staphylococcus
YTFGGPIDRQLFYQFILRLPDNVLRLKGYVQFR

SEQ ID NO: 2090090 - protein, 21 aa, Staphylococcus
YTFIGQFYSLNQHILPKEVHI

SEQ ID NO: 2090091 - protein, 31 aa, Staphylococcus
YTFSSPIDRQLFYQFIMRLPDEVFRLKGFVK

SEQ ID NO: 2090092 - protein, 18 aa, Staphylococcus
YTFTAAIDRQLFYQFIMR

SEQ ID NO: 2090093 - protein, 33 aa, Staphylococcus
YTFTSPIDRQLFYQFIMQLPKNVMRLKGYVQFR

SEQ ID NO: 2090094 - protein, 17 aa, Staphylococcus
YTGFQLFVKTGVLNMMG

SEQ ID NO: 2090095 - protein, 26 aa, Staphylococcus
YTGKAYFDAVFKDTIYNYTLVATVYA

SEQ ID NO: 2090096 - protein, 26 aa, Staphylococcus
YTGLITNLAPMVFMLGNLEVKELSQF

SEQ ID NO: 2090097 - protein, 19 aa, Staphylococcus
YTGLRRNSMACVAFPTCGL

SEQ ID NO: 2090098 - protein, 25 aa, Staphylococcus
YTGTLVNGLMYQIKDLSGINGEIRP

SEQ ID NO: 2090099 - protein, 28 aa, Staphylococcus
YTGVLNNLAPLVFMIGKLNVPNLQDMLE

SEQ ID NO: 2090100 - protein, 19 aa, Staphylococcus
YTHCVLVWKKSRIQTPILK

SEQ ID NO: 2090101 - protein, 25 aa, Staphylococcus
YTHDSPRIRTIPVGSLHQISYPQEP

SEQ ID NO: 2090102 - protein, 19 aa, Staphylococcus
YTHFTSPIRRYPDLVVHRL

SEQ ID NO: 2090103 - protein, 25 aa, Staphylococcus
YTHLQRILMQILLNVKKEDSIQSIS

SEQ ID NO: 2090104 - protein, 25 aa, Staphylococcus
YTHNAYTFYFMSPAEFTIEIYHDVN

SEQ ID NO: 2090105 - protein, 26 aa, Staphylococcus
YTHPVNNFILNGITRKVIKWISEDKN

SEQ ID NO: 2090106 - protein, 23 aa, Staphylococcus
YTHPVNNYILNGITRMVIKSVAE

SEQ ID NO: 2090107 - protein, 26 aa, Staphylococcus
YTHPVNNYILNGITRRVIKWIADDYN

SEQ ID NO: 2090108 - protein, 17 aa, Staphylococcus
YTHTAFELMIDSPDYDG

SEQ ID NO: 2090109 - protein, 28 aa, Staphylococcus
YTIAKHYADHYLRASGLNYTIVHPGVLT

SEQ ID NO: 2090110 - protein, 27 aa, Staphylococcus
YTIQSLFEQWFHPPGAKIKVYHFEAVT

SEQ ID NO: 2090111 - protein, 21 aa, Staphylococcus
YTKALFKSLQQRRISRYFNTN

SEQ ID NO: 2090112 - protein, 25 aa, Staphylococcus
YTKEELDLFLYQEPIKLKKPPEEWR

SEQ ID NO: 2090113 - protein, 25 aa, Staphylococcus
YTKEELDLFLYQEPIKLKNPPEEWR

SEQ ID NO: 2090114 - protein, 17 aa, Staphylococcus
YTKIRRPVELVYQETYS

SEQ ID NO: 2090115 - protein, 20 aa, Staphylococcus
YTKIYDKFVTLGPLLEKANV

SEQ ID NO: 2090116 - protein, 27 aa, Staphylococcus
YTKKELFEQWFHPKGASIEVYHFNAVE

SEQ ID NO: 2090117 - protein, 32 aa, Staphylococcus
YTKKVLTSLQKQGHYLMIATGRPYRASQIYYH

SEQ ID NO: 2090118 - protein, 26 aa, Staphylococcus
YTKKYALGVLISKKQYWYKQPDYENI

SEQ ID NO: 2090119 - protein, 23 aa, Staphylococcus
YTKTRRPVKLVYQEAFETKSEAM

SEQ ID NO: 2090120 - protein, 31 aa, Staphylococcus
YTLTKNEILTGFYLAIAPAGEYHYKLVDFTL

SEQ ID NO: 2090121 - protein, 18 aa, Staphylococcus
YTMSCARTLVPVEVPIDI

SEQ ID NO: 2090122 - protein, 20 aa, Staphylococcus
YTNLSLVDFYFSELTKYLKQ

SEQ ID NO: 2090123 - protein, 20 aa, Staphylococcus
YTNQLMIILVTNGKAFKQAQ

SEQ ID NO: 2090124 - protein, 29 aa, Staphylococcus
YTNVFDVNFLIFKFKKYKQIYIIGPYMEQ

SEQ ID NO: 2090125 - protein, 23 aa, Staphylococcus
YTNVGPFAQLRPGAQLGADVKVG

SEQ ID NO: 2090126 - protein, 34 aa, Staphylococcus
YTNWNSAVFFEWIKVFDLPMKQKVKYFSRGMTMK

SEQ ID NO: 2090127 - protein, 17 aa, Staphylococcus
YTPLLKPQKISQYEPGL

SEQ ID NO: 2090128 - protein, 23 aa, Staphylococcus
YTQALLKSILKRDIHRYYETEVT

SEQ ID NO: 2090129 - protein, 20 aa, Staphylococcus
YTRESYLDLVNRIKKSIPNV

SEQ ID NO: 2090130 - protein, 19 aa, Staphylococcus
YTRESYLDLVNRIKTAIPD

SEQ ID NO: 2090131 - protein, 20 aa, Staphylococcus
YTRESYLDLVNRIKTAIPNI

SEQ ID NO: 2090132 - protein, 19 aa, Staphylococcus
YTRILKVGPRRGDGAESVI

SEQ ID NO: 2090133 - protein, 24 aa, Staphylococcus
YTRVLNDGLPLPDLIIVDGGKGQM

SEQ ID NO: 2090134 - protein, 17 aa, Staphylococcus
YTRVLNEGLPLPDLIIV

SEQ ID NO: 2090135 - protein, 27 aa, Staphylococcus
YTRVLNEGLPLPDLIIVDGGKGHMNGV

SEQ ID NO: 2090136 - protein, 28 aa, Staphylococcus
YTRVLNEGLPLPDLIIVDGGKGHMSGVI

SEQ ID NO: 2090137 - protein, 28 aa, Staphylococcus
YTRVLNEGLPLPDLIIVDGGKGHMSGVL

SEQ ID NO: 2090138 - protein, 28 aa, Staphylococcus
YTSEHGITFIPYFPLVSGLLAGKYNENS

SEQ ID NO: 2090139 - protein, 28 aa, Staphylococcus
YTSFKAGIQIRFYAVQALKLLKAQFDVD

SEQ ID NO: 2090140 - protein, 21 aa, Staphylococcus
YTSPERFIKTAYLKNYLIGSE

SEQ ID NO: 2090141 - protein, 25 aa, Staphylococcus
YTSYDYPIAIVFRASLFDEKILTGN

SEQ ID NO: 2090142 - protein, 19 aa, Staphylococcus
YTTVFYDKHEKNGVTALYQ

SEQ ID NO: 2090143 - protein, 28 aa, Staphylococcus
YTVGTRREYYIFFLLCEGKSINEIAKIF

SEQ ID NO: 2090144 - protein, 43 aa, Staphylococcus
YTVKDLFEIYKHYKYDLFKFSNSFVLGLKYKSGFIRGKEETII

SEQ ID NO: 2090145 - protein, 18 aa, Staphylococcus
YTVLALAPLSVLPEYRNK

SEQ ID NO: 2090146 - protein, 25 aa, Staphylococcus
YTVLRGCHPFYIENGAFSGAIGVLH

SEQ ID NO: 2090147 - protein, 25 aa, Staphylococcus
YTYDNPLIRTVPVGSLNQLIHPEKK

SEQ ID NO: 2090148 - protein, 26 aa, Staphylococcus
YTYHAKSIFYLRISTLPLSLGIESCV

SEQ ID NO: 2090149 - protein, 26 aa, Staphylococcus
YTYKLQNMYYLRISTLPLSLGNESCV

SEQ ID NO: 2090150 - protein, 35 aa, Staphylococcus
YTYKRLVNFNIPENMWLKFVVEFLLKEINSIDKEI

SEQ ID NO: 2090151 - protein, 26 aa, Staphylococcus
YVAIMKMHALLDGLALHKLLNPEQMI

SEQ ID NO: 2090152 - protein, 19 aa, Staphylococcus
YVDALRKKYNGGLSSGEIQ

SEQ ID NO: 2090153 - protein, 24 aa, Staphylococcus
YVDFSKMIQGFWRANEWQYTDQEL

SEQ ID NO: 2090154 - protein, 23 aa, Staphylococcus
YVDKKKIIYILEDKAKDIQDKLQ

SEQ ID NO: 2090155 - protein, 24 aa, Staphylococcus
YVDLDEVVVLYYLKKWIQEDDAIL

SEQ ID NO: 2090156 - protein, 24 aa, Staphylococcus
YVDTDADLRILRRLKRDTHERGRS

SEQ ID NO: 2090157 - protein, 25 aa, Staphylococcus
YVDTDADLRILRRLLRDTEERGRTM

SEQ ID NO: 2090158 - protein, 20 aa, Staphylococcus
YVEELDTVGFFLVPREFDGV

SEQ ID NO: 2090159 - protein, 22 aa, Staphylococcus
YVEELGQVGFFLVPRDFEGVDI

SEQ ID NO: 2090160 - protein, 26 aa, Staphylococcus
YVELDEVTVLFYLKKWIHEEDEILSD

SEQ ID NO: 2090161 - protein, 25 aa, Staphylococcus
YVENTLFINTLPKHKINNDDRGLFK

SEQ ID NO: 2090162 - protein, 22 aa, Staphylococcus
YVEQFFQQWLNDTALKIPRENA

SEQ ID NO: 2090163 - protein, 17 aa, Staphylococcus
YVETVYLMLNKPKGYIS

SEQ ID NO: 2090164 - protein, 17 aa, Staphylococcus
YVFDHYKDELYIISTNL

SEQ ID NO: 2090165 - protein, 19 aa, Staphylococcus
YVFNTMSDWEYGYLIAELN

SEQ ID NO: 2090166 - protein, 23 aa, Staphylococcus
YVGHHLWIKLGYHQTIFPTALVP

SEQ ID NO: 2090167 - protein, 19 aa, Staphylococcus
YVGRIGIGRVFRGKMHVGD

SEQ ID NO: 2090168 - protein, 20 aa, Staphylococcus
YVGRIGIGRVFRGKMRVGDN

SEQ ID NO: 2090169 - protein, 24 aa, Staphylococcus
YVHKNVRCLLYKGVLTYIPMGCEC

SEQ ID NO: 2090170 - protein, 18 aa, Staphylococcus
YVIIINAEKIELTGKKEQ

SEQ ID NO: 2090171 - protein, 28 aa, Staphylococcus
YVISGHYRNGILLSPIIGRDIANWILTG

SEQ ID NO: 2090172 - protein, 19 aa, Staphylococcus
YVIYTLKLIEDGATPNEII

SEQ ID NO: 2090173 - protein, 28 aa, Staphylococcus
YVKDDYIVFKGFRIIHKDDLVLPGEHNL

SEQ ID NO: 2090174 - protein, 20 aa, Staphylococcus
YVKDLYKTDWGIALLHNQEQ

SEQ ID NO: 2090175 - protein, 26 aa, Staphylococcus
YVKIYNSLYNVPTSCLRFFNIYGPKQ

SEQ ID NO: 2090176 - protein, 23 aa, Staphylococcus
YVKSNVKVHLKPSAQWISEIVQT

SEQ ID NO: 2090177 - protein, 18 aa, Staphylococcus
YVLAKLKDAKKPVLLVGA

SEQ ID NO: 2090178 - protein, 17 aa, Staphylococcus
YVLPDAVTRFRQGLGRL

SEQ ID NO: 2090179 - protein, 21 aa, Staphylococcus
YVLSPQIFNYLENQGIGAGGE

SEQ ID NO: 2090180 - protein, 18 aa, Staphylococcus
YVMGLKQVYPDLENAYVL

SEQ ID NO: 2090181 - protein, 36 aa, Staphylococcus
YVMKWQETAIFYDKLLDLLKFMIPGYKKEGKTQLVI

SEQ ID NO: 2090182 - protein, 18 aa, Staphylococcus
YVMLGAGLVAKKAIEKGL

SEQ ID NO: 2090183 - protein, 23 aa, Staphylococcus
YVMNLLMHVDQVSYVRFASVYKE

SEQ ID NO: 2090184 - protein, 19 aa, Staphylococcus
YVNEYGLPAYDAHVLTLTK

SEQ ID NO: 2090185 - protein, 21 aa, Staphylococcus
YVNIQPSNEGYLLPINRDVFS

SEQ ID NO: 2090186 - protein, 37 aa, Staphylococcus
YVNQFDVNFLLFKYRKYNRVVILGPFLHQRPNEKRCH

SEQ ID NO: 2090187 - protein, 31 aa, Staphylococcus
YVNRFVRIFDFPFYFRGEVYHPFETETLSEQ

SEQ ID NO: 2090188 - protein, 23 aa, Staphylococcus
YVNSYGMHAIHGRALPIAQGVKM

SEQ ID NO: 2090189 - protein, 18 aa, Staphylococcus
YVPERKWSQWFKIYGEQE

SEQ ID NO: 2090190 - protein, 24 aa, Staphylococcus
YVPNDCYLDQNNFIYLITGPNMSG

SEQ ID NO: 2090191 - protein, 23 aa, Staphylococcus
YVPVLIVAIGKKEKEPHTSYRMP

SEQ ID NO: 2090192 - protein, 21 aa, Staphylococcus
YVQDGQWKSWGPYLLSGKDVH

SEQ ID NO: 2090193 - protein, 17 aa, Staphylococcus
YVQFLYESRQYIKALSI

SEQ ID NO: 2090194 - protein, 19 aa, Staphylococcus
YVRHIAHPTRRIIGRRDGY

SEQ ID NO: 2090195 - protein, 18 aa, Staphylococcus
YVRHIDGSPYRFLKKTYE

SEQ ID NO: 2090196 - protein, 18 aa, Staphylococcus
YVRTYERNPDGSRGKLIS

SEQ ID NO: 2090197 - protein, 18 aa, Staphylococcus
YVSDRFLPDKAIDLIDEA

SEQ ID NO: 2090198 - protein, 19 aa, Staphylococcus
YVSDTLTALQQLAKAYLNY

SEQ ID NO: 2090199 - protein, 26 aa, Staphylococcus
YVSFSKVIQGFWRAQDWQWTPQQLNR

SEQ ID NO: 2090200 - protein, 20 aa, Staphylococcus
YVSLIADYPADQLYAQFGFT

SEQ ID NO: 2090201 - protein, 26 aa, Staphylococcus
YVSNFEIREIRIIKSVLLKGKKSFNN

SEQ ID NO: 2090202 - protein, 27 aa, Staphylococcus
YVSRSHPGLLKRLFEQEVPEIFDGTVI

SEQ ID NO: 2090203 - protein, 27 aa, Staphylococcus
YVSRSHPGLLKRLFEQEVPEIYDGTVV

SEQ ID NO: 2090204 - protein, 23 aa, Staphylococcus
YVSSLDNWRIISHANLSIVNFRY

SEQ ID NO: 2090205 - protein, 17 aa, Staphylococcus
YVTALNKAKKISNKKLS

SEQ ID NO: 2090206 - protein, 19 aa, Staphylococcus
YVTEFPLTIMVNGEEFATV

SEQ ID NO: 2090207 - protein, 31 aa, Staphylococcus
YVVDFSGYSMFWSKILLATQSKRKLIYLHSD

SEQ ID NO: 2090208 - protein, 28 aa, Staphylococcus
YVVDNGYLFVFVLDYYRHNLINEDVEQH

SEQ ID NO: 2090209 - protein, 28 aa, Staphylococcus
YVVDNGYLFVFVLDYYRHNLINENVDFD

SEQ ID NO: 2090210 - protein, 28 aa, Staphylococcus
YVVDNGYLFVFVLDYYRHQMINERTDND

SEQ ID NO: 2090211 - protein, 28 aa, Staphylococcus
YVVENGYLFVFVLDYYRHNLINENVESN

SEQ ID NO: 2090212 - protein, 28 aa, Staphylococcus
YVVENGYLFVFVMDYYRHSIINEESKHD

SEQ ID NO: 2090213 - protein, 18 aa, Staphylococcus
YVYFARPDSEFHKHSIYN

SEQ ID NO: 2090214 - protein, 17 aa, Staphylococcus
YVYIKGYGDLKFFEPFV

SEQ ID NO: 2090215 - protein, 23 aa, Staphylococcus
YVYINGYGDLKFFETFILDSDEK

SEQ ID NO: 2090216 - protein, 17 aa, Staphylococcus
YVYLDKIPEHAIINEAV

SEQ ID NO: 2090217 - protein, 18 aa, Staphylococcus
YWITFNEINMILHAPFNG

SEQ ID NO: 2090218 - protein, 25 aa, Staphylococcus
YWPEGTEFIYTPYIVKAYTGTHTSS

SEQ ID NO: 2090219 - protein, 27 aa, Staphylococcus
YWQEHEVKLVFFLAITPQDIHMNKQLM

SEQ ID NO: 2090220 - protein, 17 aa, Staphylococcus
YWQYHDHWLGYCTNELV

SEQ ID NO: 2090221 - protein, 25 aa, Staphylococcus
YWRVKVDNWSMPWNYQIKPKRKVKD

SEQ ID NO: 2090222 - protein, 17 aa, Staphylococcus
YYAGVTACYLLVNKSIR

SEQ ID NO: 2090223 - protein, 27 aa, Staphylococcus
YYDAYAKAKYWVTNARLPLYLNKKENQ

SEQ ID NO: 2090224 - protein, 19 aa, Staphylococcus
YYDVGVSGIHRLFEHIHEI

SEQ ID NO: 2090225 - protein, 17 aa, Staphylococcus
YYEQLAHCSHLFVNKID

SEQ ID NO: 2090226 - protein, 17 aa, Staphylococcus
YYFYITNEFLKPNNKIK

SEQ ID NO: 2090227 - protein, 17 aa, Staphylococcus
YYHEAYLKNKLALKIDI

SEQ ID NO: 2090228 - protein, 18 aa, Staphylococcus
YYHQPKFIEYWTNKINET

SEQ ID NO: 2090229 - protein, 17 aa, Staphylococcus
YYHQVMLLSGTLHLDSH

SEQ ID NO: 2090230 - protein, 20 aa, Staphylococcus
YYIAYQLAPLAKIIAPESYI

SEQ ID NO: 2090231 - protein, 25 aa, Staphylococcus
YYINNRIVPVIPQQGSLGASGDLAP

SEQ ID NO: 2090232 - protein, 22 aa, Staphylococcus
YYISKALIIYDSTTLLLEDDTT

SEQ ID NO: 2090233 - protein, 22 aa, Staphylococcus
YYKPTIRIFKNIKKQLIKKKEL

SEQ ID NO: 2090234 - protein, 31 aa, Staphylococcus
YYLKNMLMILANNRHLVLINSIFKEFKSLYN

SEQ ID NO: 2090235 - protein, 17 aa, Staphylococcus
YYLMSRGISQQEAERLV

SEQ ID NO: 2090236 - protein, 20 aa, Staphylococcus
YYMNEVLFDQYPNFNKENIH

SEQ ID NO: 2090237 - protein, 19 aa, Staphylococcus
YYNIEKLYRDAPLESYRQA

SEQ ID NO: 2090238 - protein, 18 aa, Staphylococcus
YYNKFINVLESKPTAKRV

SEQ ID NO: 2090239 - protein, 19 aa, Staphylococcus
YYNNYSIMFESLRVFGYEN

SEQ ID NO: 2090240 - protein, 23 aa, Staphylococcus
YYNRREDEWGDHLKFPLAVIDEV

SEQ ID NO: 2090241 - protein, 25 aa, Staphylococcus
YYPLLHDNMMRLPVLTDLFQEINDK

SEQ ID NO: 2090242 - protein, 20 aa, Staphylococcus
YYQNLINAMLLDVKKPTSSL

SEQ ID NO: 2090243 - protein, 20 aa, Staphylococcus
YYQVKLLYRDKKGIKPTPEG

SEQ ID NO: 2090244 - protein, 23 aa, Staphylococcus
YYSYRMDNLIVSYLIQAHLLKNS

SEQ ID NO: 2090245 - protein, 25 aa, Staphylococcus
YYSYTELYQTLPFDFLSDIVYQWER

SEQ ID NO: 2090246 - protein, 22 aa, Staphylococcus
YYTPLEFGKLRKVAMDKGFKHC

SEQ ID NO: 2090247 - protein, 18 aa, Staphylococcus
YYTPLEFGKMRKVAMDKG

SEQ ID NO: 2090248 - protein, 20 aa, Staphylococcus
YYTPLEFGKMRKVAMEKGFK

SEQ ID NO: 2090249 - protein, 18 aa, Staphylococcus
YYYFHKQQHYFLCHDILE

SEQ ID NO: 2090250 - protein, 17 aa, Staphylococcus
YYYFHTRQHYFLCHDIL

SEQ ID NO: 2090251 - protein, 17 aa, Staphylococcus
YYYTAPFHSPITTPKIE

SEQ ID NO: 2090252 - protein, 24 aa, Staphylococcus
LDATLYMRIAIELHLKRLIVGGLE

SEQ ID NO: 2090253 - protein, 23 aa, Staphylococcus
YEDRSFTFITKTPPAPVLLKKAA

SEQ ID NO: 2090254 - protein, 24 aa, Staphylococcus
DGTKLGFMSFFTKAAVAALKKYPE

SEQ ID NO: 2090255 - protein, 20 aa, Staphylococcus
GQLPLFRRLPKRGFTNINRK

SEQ ID NO: 2090256 - protein, 18 aa, Staphylococcus
HNRLSLLMAVLEKKENYL

SEQ ID NO: 2090257 - protein, 18 aa, Staphylococcus
IELGIPEHLVWRQPFPGP

SEQ ID NO: 2090258 - protein, 25 aa, Staphylococcus
IQTKSYDWFLKEGLLEMFRDISPIE

SEQ ID NO: 2090259 - protein, 17 aa, Staphylococcus
PGFGDRRKAMLEDLAIL

SEQ ID NO: 2090260 - protein, 28 aa, Staphylococcus
SVFLETFLFYSGFYYPLYLAGQGKMTTS

SEQ ID NO: 2090261 - protein, 25 aa, Staphylococcus
TTLGNSLRRILLSSLPGAAVKYIEI

SEQ ID NO: 2090262 - protein, 29 aa, Staphylococcus
VVTQITPWNYPLLQASWKIAPALATGCSL

SEQ ID NO: 2090263 - protein, 22 aa, Staphylococcus
AILGLVHTLWKPMPGRFKDYIA

SEQ ID NO: 2090264 - protein, 19 aa, Staphylococcus
DVLDTWFSSALWPFSTLGW

SEQ ID NO: 2090265 - protein, 26 aa, Staphylococcus
EYYKWTQWIFIQLYNKGLAYVDEVAV

SEQ ID NO: 2090266 - protein, 18 aa, Staphylococcus
FMHHYNFPNFSVGETGPV

SEQ ID NO: 2090267 - protein, 28 aa, Staphylococcus
GAHIRTLLLTFFYRFMRPLIEAGYVYIA

SEQ ID NO: 2090268 - protein, 20 aa, Staphylococcus
NLMFHFLPIAVRYDGQKAPV

SEQ ID NO: 2090269 - protein, 24 aa, Staphylococcus
NNFCTFCIIPWARGLMRSRDPEKV

SEQ ID NO: 2090270 - protein, 20 aa, Staphylococcus
PTLDYVISKIPRFPFDKFEK

SEQ ID NO: 2090271 - protein, 21 aa, Staphylococcus
RYVGRGMLFLDLIQEGNMGLI

SEQ ID NO: 2090272 - protein, 23 aa, Staphylococcus
TREHILLSRNVGVPALVVFLNKV

SEQ ID NO: 2090273 - protein, 24 aa, Staphylococcus
AELERPYILVTDKKISSFQDILPL

SEQ ID NO: 2090274 - protein, 17 aa, Staphylococcus
AFGMRPYIKKKVKKYSM

SEQ ID NO: 2090275 - protein, 26 aa, Staphylococcus
DDLSTDLVWYLWTGKYSSLFGKRAMT

SEQ ID NO: 2090276 - protein, 18 aa, Staphylococcus
DFILPGYRDVPQIIWHGL

SEQ ID NO: 2090277 - protein, 17 aa, Staphylococcus
DFRKLWITRINAAARQH

SEQ ID NO: 2090278 - protein, 18 aa, Staphylococcus
DRRKAMLEDLAILTGAQV

SEQ ID NO: 2090279 - protein, 23 aa, Staphylococcus
DVGSHYIWMARKFRSYNPRHLLF

SEQ ID NO: 2090280 - protein, 18 aa, Staphylococcus
DVLLFIDNIFRFTQAGSE

SEQ ID NO: 2090281 - protein, 23 aa, Staphylococcus
EAERLVIHGFLDPVVRELPIEDV

SEQ ID NO: 2090282 - protein, 21 aa, Staphylococcus
FPARIKCATLAWKALEKGTVE

SEQ ID NO: 2090283 - protein, 20 aa, Staphylococcus
GAKMRYMFGGKAKIPLVVRT

SEQ ID NO: 2090284 - protein, 17 aa, Staphylococcus
HYLKVRPGAFFLTGCGN

SEQ ID NO: 2090285 - protein, 24 aa, Staphylococcus
KLTFLPYVVKALVSALKKYPALNT

SEQ ID NO: 2090286 - protein, 18 aa, Staphylococcus
LKALKLFYKMPMPQWGGD

SEQ ID NO: 2090287 - protein, 17 aa, Staphylococcus
NFRVTKIFGYFGLKREE

SEQ ID NO: 2090288 - protein, 21 aa, Staphylococcus
PQLFKQLLMISGFDKYYQIVK

SEQ ID NO: 2090289 - protein, 19 aa, Staphylococcus
PRRVGWFDSVVLRHSRRVS

SEQ ID NO: 2090290 - protein, 24 aa, Staphylococcus
RFHSIIWPILLMALDLPLPKKVFA

SEQ ID NO: 2090291 - protein, 24 aa, Staphylococcus
RRVSPFFVPMLIPDMATGQVSIDL

SEQ ID NO: 2090292 - protein, 32 aa, Staphylococcus; identical to SEQ ID NO: 1835302

SEQ ID NO: 2090293 - protein, 19 aa, Staphylococcus
SLYIRPFVFATEGILGVRA

SEQ ID NO: 2090294 - protein, 20 aa, Staphylococcus
VDMLRMCRYPWKTKQRILSD

SEQ ID NO: 2090295 - protein, 17 aa, Staphylococcus
WMILDVLPIIPPEIRPM

SEQ ID NO: 2090296 - protein, 25 aa, Staphylococcus
YGATFFVFSDYLKPALRLSAIMGLN

SEQ ID NO: 2090297 - protein, 20 aa, Staphylococcus
CNVYLKREDLQWVRSFKLRG

SEQ ID NO: 2090298 - protein, 19 aa, Staphylococcus
EFLDKLIAVSLPRVRDFQG

SEQ ID NO: 2090299 - protein, 20 aa, Staphylococcus
EHRLPFILFSASGGARMQEG

SEQ ID NO: 2090300 - protein, 30 aa, Staphylococcus; identical to SEQ ID NO: 1834210

SEQ ID NO: 2090301 - protein, 24 aa, Staphylococcus
EQKRLYLLRLLVHQPNVLLLDEPT

SEQ ID NO: 2090302 - protein, 20 aa, Staphylococcus
ETYMPLPIFLSHQLAKRLSD

SEQ ID NO: 2090303 - protein, 18 aa, Staphylococcus
FGAFVEIAPGVQGLVHIS

SEQ ID NO: 2090304 - protein, 28 aa, Staphylococcus
GAHIQVLLLTFFFKYMKPLVQAGRVFIA

SEQ ID NO: 2090305 - protein, 24 aa, Staphylococcus
GNTDAMIKYLLPKATVVTPNLFEA

SEQ ID NO: 2090306 - protein, 17 aa, Staphylococcus
GYVVYFFELACAMSGYQ

SEQ ID NO: 2090307 - protein, 19 aa, Staphylococcus
HFDLRPAGIIKMLDLKHPI

SEQ ID NO: 2090308 - protein, 24 aa, Staphylococcus
HPEELRLLLIDPKMVELAPYNDLP

SEQ ID NO: 2090309 - protein, 17 aa, Staphylococcus
IAPFGATIPYYFTGHEG

SEQ ID NO: 2090310 - protein, 18 aa, Staphylococcus
IENRPMMYIALSYDHRII

SEQ ID NO: 2090311 - protein, 18 aa, Staphylococcus
KVHHPLYYYAAYFTIRAS

SEQ ID NO: 2090312 - protein, 19 aa, Staphylococcus
LEPKTQFYNMYRKGKLKLP

SEQ ID NO: 2090313 - protein, 20 aa, Staphylococcus
LIQPTFIYGHPIEISPLAKK

SEQ ID NO: 2090314 - protein, 18 aa, Staphylococcus
LLNRSLLYSAIILHDLGK

SEQ ID NO: 2090315 - protein, 17 aa, Staphylococcus
MMYIALSYDHRIIDGKE

SEQ ID NO: 2090316 - protein, 26 aa, Staphylococcus
MPIVKQYFRMLQRPILYTGLTRAKQS

SEQ ID NO: 2090317 - protein, 28 aa, Staphylococcus
NAIYEFLTLRIPMLLIPLGLDQSRGDQI

SEQ ID NO: 2090318 - protein, 24 aa, Staphylococcus
NRKGYYLYGYRHFSSRIKGGHTNN

SEQ ID NO: 2090319 - protein, 20 aa, Staphylococcus
PLALGLLTPPGSFGADIVVG

SEQ ID NO: 2090320 - protein, 22 aa, Staphylococcus
QCKRAIILPNNKNILMASEQAA

SEQ ID NO: 2090321 - protein, 19 aa, Staphylococcus
QDVLLFIDNIFRFTQAGSE

SEQ ID NO: 2090322 - protein, 22 aa, Staphylococcus
QYQDCLLFFRLGDFYEMFFEDA

SEQ ID NO: 2090323 - protein, 17 aa, Staphylococcus
RLRPSYFPFTEPSVEVD

SEQ ID NO: 2090324 - protein, 20 aa, Staphylococcus
RLVIHGFLDPVVRELPIEDV

SEQ ID NO: 2090325 - protein, 23 aa, Staphylococcus
TTAGKLALLMRKKYNKKPMLVAA

SEQ ID NO: 2090326 - protein, 23 aa, Staphylococcus
TTAGKLALLMRKKYNKKPMLVAG

SEQ ID NO: 2090327 - protein, 23 aa, Staphylococcus
TTLEPMVLPARFPNLLVNGSTGI

SEQ ID NO: 2090328 - protein, 21 aa, Staphylococcus
VKRRIFLGTFALSSGYYDAYY

SEQ ID NO: 2090329 - protein, 23 aa, Staphylococcus
VNYKLRDWLFSRQRYWGEPIPII

SEQ ID NO: 2090330 - protein, 23 aa, Staphylococcus
VNYKLRDWLFSRQRYWGEPIPVI

SEQ ID NO: 2090331 - protein, 25 aa, Staphylococcus
VQAGRVFIALPPLYKLEKGKGKSKK

SEQ ID NO: 2090332 - protein, 18 aa, Staphylococcus
YEEMKHYFILNFPQRPGA

SEQ ID NO: 2090333 - protein, 19 aa, Staphylococcus
YVGKLTFFRVYSGTLSSGS

SEQ ID NO: 2090334 - protein, 17 aa, Staphylococcus
AERLVIHGFLDPVVREL

SEQ ID NO: 2090335 - protein, 21 aa, Staphylococcus
AFTELFMFELRMQWLNRLEKA

SEQ ID NO: 2090336 - protein, 20 aa, Staphylococcus
AKYVGLIPRFRRIFLGDKEF

SEQ ID NO: 2090337 - protein, 22 aa, Staphylococcus
AVLHLLYARFWHKVLYDLGVVP

SEQ ID NO: 2090338 - protein, 27 aa, Staphylococcus
AVVAWNFPILLASWKLGPALAAGNTVV

SEQ ID NO: 2090339 - protein, 23 aa, Staphylococcus
AYFKVHYPLYYYASYFTVRASDF

SEQ ID NO: 2090340 - protein, 17 aa, Staphylococcus
CFPVFQILFEKRSLNFK

SEQ ID NO: 2090341 - protein, 26 aa, Staphylococcus
CGKTTLLRLFNGLIPYFFNGKLTGEI

SEQ ID NO: 2090342 - protein, 21 aa, Staphylococcus
CKVYLKREDLQWVRSFKLRGA

SEQ ID NO: 2090343 - protein, 17 aa, Staphylococcus
DAHTAYMLILAETLIEM

SEQ ID NO: 2090344 - protein, 19 aa, Staphylococcus
DAQFIIWTTTPWTLPSNVA

SEQ ID NO: 2090345 - protein, 26 aa, Staphylococcus
DDLATDLVWYLWTGKYSSLFGKRAMT

SEQ ID NO: 2090346 - protein, 22 aa, Staphylococcus
DDQWDAMLLGWKVIPSVKSNAV

SEQ ID NO: 2090347 - protein, 29 aa, Staphylococcus
DGAHIQVLLLTFFFKYMKPLVQAGRVFIA

SEQ ID NO: 2090348 - protein, 23 aa, Staphylococcus
DGNEYIDYVLSWGPLILGHKNKQ

SEQ ID NO: 2090349 - protein, 19 aa, Staphylococcus
DHTKVVAPFIRLAGTMEGL

SEQ ID NO: 2090350 - protein, 26 aa, Staphylococcus
DLTEDQMIDFLFTSALFGRVVANNAS

SEQ ID NO: 2090351 - protein, 18 aa, Staphylococcus
DRRKAMLEDLAILTGATV

SEQ ID NO: 2090352 - protein, 20 aa, Staphylococcus
DTYMPLPIFLSHQLAKRLSD

SEQ ID NO: 2090353 - protein, 24 aa, Staphylococcus
DVGSHYIWMARKFRSYNPRHLLFS

SEQ ID NO: 2090354 - protein, 25 aa, Staphylococcus
EFRTMPMVWYCPPLSPIMSYFEGKN

SEQ ID NO: 2090355 - protein, 20 aa, Staphylococcus
EIIDHFIMKLRIVKFARTPD

SEQ ID NO: 2090356 - protein, 20 aa, Staphylococcus
EIRLRPSYFPFTEPSVEVDV

SEQ ID NO: 2090357 - protein, 29 aa, Staphylococcus
ELAAPVSHIWYFKGIPSRMGLLLDMSPRA

SEQ ID NO: 2090358 - protein, 20 aa, Staphylococcus
ELGFIFQDYSVLPTLTVKEN

SEQ ID NO: 2090359 - protein, 20 aa, Staphylococcus
ELTRPARALKLWITLQVIGE

SEQ ID NO: 2090360 - protein, 26 aa, Staphylococcus
ENFKEAVQWLYLAYLAAIKEQNGAAM

SEQ ID NO: 2090361 - protein, 20 aa, Staphylococcus
EPMVLPARFPNLLINGSTGI

SEQ ID NO: 2090362 - protein, 24 aa, Staphylococcus
EPNDPIIHFALAELLYFDGQYLRA

SEQ ID NO: 2090363 - protein, 24 aa, Staphylococcus
EQEDKLYILFYKPAQVITSVSDDR

SEQ ID NO: 2090364 - protein, 19 aa, Staphylococcus
EYFNGLYIITPFQKVDYSL

SEQ ID NO: 2090365 - protein, 18 aa, Staphylococcus
FELIRLFGKRGRGLYNKA

SEQ ID NO: 2090366 - protein, 18 aa, Staphylococcus
FFLLERIRKAFPNKLILS

SEQ ID NO: 2090367 - protein, 17 aa, Staphylococcus
FGILIEHFKGAFPLWMA

SEQ ID NO: 2090368 - protein, 24 aa, Staphylococcus
FINRDLFKYIPFDGSIITISELQE

SEQ ID NO: 2090369 - protein, 18 aa, Staphylococcus
FLDKLIAVSLPRVRDFHG

SEQ ID NO: 2090370 - protein, 22 aa, Staphylococcus
FPARIKCATLAWKALEKGTVQK

SEQ ID NO: 2090371 - protein, 19 aa, Staphylococcus
FSNYRPQFYFRTTDVTGVV

SEQ ID NO: 2090372 - protein, 18 aa, Staphylococcus
FTNYRPQFYFRTTDVTGV

SEQ ID NO: 2090373 - protein, 25 aa, Staphylococcus
GEQKRLYLLRLLVHKPNVLLLDEPT

SEQ ID NO: 2090374 - protein, 23 aa, Staphylococcus
GHILNLYFPFIDVETMLTLLDLA

SEQ ID NO: 2090375 - protein, 21 aa, Staphylococcus
GITFAGIPLGHEFNSLVLAIL

SEQ ID NO: 2090376 - protein, 18 aa, Staphylococcus
GLYIITPFQKVDYSLELA

SEQ ID NO: 2090377 - protein, 26 aa, Staphylococcus
GNAETFYPMPFLSPETMWYYKSAFNT

SEQ ID NO: 2090378 - protein, 23 aa, Staphylococcus
GTNYPYVDYLPKKNIKAIQIDTN

SEQ ID NO: 2090379 - protein, 18 aa, Staphylococcus
GYVVYFFELACAMSGYQL

SEQ ID NO: 2090380 - protein, 18 aa, Staphylococcus
HGDHIFGLPGLLTSRSFQ

SEQ ID NO: 2090381 - protein, 24 aa, Staphylococcus
HPDLDTWVIFPWTAGQGKVARLIC

SEQ ID NO: 2090382 - protein, 20 aa, Staphylococcus
HSFFYFIYDEDKLAGYLKLN

SEQ ID NO: 2090383 - protein, 26 aa, Staphylococcus
IEGKKALFIVYANPLALGLLTPPGSF

SEQ ID NO: 2090384 - protein, 24 aa, Staphylococcus
IIAEHRLYYLYDIVDRLVVMEQGA

SEQ ID NO: 2090385 - protein, 23 aa, Staphylococcus
INELAWHNLFAHNMFIRPESKDE

SEQ ID NO: 2090386 - protein, 24 aa, Staphylococcus
INNEPLLMDIAKTPHALIAGATGS

SEQ ID NO: 2090387 - protein, 25 aa, Staphylococcus
INNEPLLMDIAKTPHALIAGATGSG

SEQ ID NO: 2090388 - protein, 18 aa, Staphylococcus
ISAGFFFINPFEVVYYAG

SEQ ID NO: 2090389 - protein, 20 aa, Staphylococcus
ITTPLNIFYFTGYRSEPHER

SEQ ID NO: 2090390 - protein, 21 aa, Staphylococcus
KAKTFTLLSKALRPLPDKFHG

SEQ ID NO: 2090391 - protein, 18 aa, Staphylococcus
KDIIDLFLDSGLGKEAFS

SEQ ID NO: 2090392 - protein, 24 aa, Staphylococcus
KGSTYYGIALALLRISKALLNNEN

SEQ ID NO: 2090393 - protein, 19 aa, Staphylococcus
KLGKYPPYYFLINFTISHK

SEQ ID NO: 2090394 - protein, 23 aa, Staphylococcus
KVDERLWLLNRAGKIPFVVSGQG

SEQ ID NO: 2090395 - protein, 25 aa, Staphylococcus
LCPDLDTWVIFPWTAGQGKVARLIC

SEQ ID NO: 2090396 - protein, 19 aa, Staphylococcus
LFTCLRPVRWFKGVPSPVK

SEQ ID NO: 2090397 - protein, 20 aa, Staphylococcus
LFTCLRPVRWFQGVPSPVKR

SEQ ID NO: 2090398 - protein, 17 aa, Staphylococcus
LGTFALSSGYYDAFYKK

SEQ ID NO: 2090399 - protein, 20 aa, Staphylococcus
LHIGHLLPFLTLRRFQEHGH

SEQ ID NO: 2090400 - protein, 18 aa, Staphylococcus
LLNRSLLYSAIILHDIGK

SEQ ID NO: 2090401 - protein, 17 aa, Staphylococcus
LNGPLDLTFIFGLVDHL

SEQ ID NO: 2090402 - protein, 19 aa, Staphylococcus
LTEDIAYGLVLWSSLGREI

SEQ ID NO: 2090403 - protein, 20 aa, Staphylococcus
LTRDQHRLYKLIWERFVASQ

SEQ ID NO: 2090404 - protein, 21 aa, Staphylococcus
LTYPQFLVLTILWDESPVNVK

SEQ ID NO: 2090405 - protein, 19 aa, Staphylococcus
LVNFYYPKLTFKSSILQLI

SEQ ID NO: 2090406 - protein, 17 aa, Staphylococcus
LYDIGAVGMRLLTKYMN

SEQ ID NO: 2090407 - protein, 18 aa, Staphylococcus
LYDIGAVGMRLLTKYMNE

SEQ ID NO: 2090408 - protein, 18 aa, Staphylococcus
MIAKLPFMNQNNTKYWLM

SEQ ID NO: 2090409 - protein, 17 aa, Staphylococcus
MITLDFGAYYRGYCSDI

SEQ ID NO: 2090410 - protein, 24 aa, Staphylococcus
MRASILVMGPLLARLGHAIVALPG

SEQ ID NO: 2090411 - protein, 25 aa, Staphylococcus
MRASILVMGPLLARLGHAIVALPGG

SEQ ID NO: 2090412 - protein, 25 aa, Staphylococcus
MSRQHHRFLFFINKLPGITIKELLQ

SEQ ID NO: 2090413 - protein, 24 aa, Staphylococcus
NAETFYPMPFLSPETMWYYKSAFN

SEQ ID NO: 2090414 - protein, 25 aa, Staphylococcus
NAETFYPMPFLSPETMWYYKSAFNT

SEQ ID NO: 2090415 - protein, 20 aa, Staphylococcus
NFFLLERIRKAFPDKLILSG

SEQ ID NO: 2090416 - protein, 20 aa, Staphylococcus
NKIEMVLSWKLNRISRSMRD

SEQ ID NO: 2090417 - protein, 23 aa, Staphylococcus
NNEPLLMDIAKTPHALIAGATGS

SEQ ID NO: 2090418 - protein, 18 aa, Staphylococcus
NNPHSFFYFIYDEDKLAG

SEQ ID NO: 2090419 - protein, 17 aa, Staphylococcus
NNVLAFPGIFRGALDVE

SEQ ID NO: 2090420 - protein, 24 aa, Staphylococcus
NRKGYFLYGYRHFSSRIKGGHTNN

SEQ ID NO: 2090421 - protein, 18 aa, Staphylococcus
NSILMSLLYKNHPEELRL

SEQ ID NO: 2090422 - protein, 23 aa, Staphylococcus
PEELRLLLIDPKMVELAPYNDLP

SEQ ID NO: 2090423 - protein, 25 aa, Staphylococcus
PELEEQLKFLLIPKDPNDEKDVIVE

SEQ ID NO: 2090424 - protein, 21 aa, Staphylococcus
PELENLLLDPYFKNIVTDYQD

SEQ ID NO: 2090425 - protein, 18 aa, Staphylococcus
PFDLTKVWYKGDYPLIEV

SEQ ID NO: 2090426 - protein, 17 aa, Staphylococcus
PFILLNWSDTISDLYTL

SEQ ID NO: 2090427 - protein, 23 aa, Staphylococcus
PLSQIYLAVTMWTAGLRGPGQLL

SEQ ID NO: 2090428 - protein, 21 aa, Staphylococcus
PQDSYLLVRGIKTLGLRMEQI

SEQ ID NO: 2090429 - protein, 21 aa, Staphylococcus
PQWMLDFRLKALKLFYKMPMP

SEQ ID NO: 2090430 - protein, 17 aa, Staphylococcus
QMNLLGHDFFIFTDRET

SEQ ID NO: 2090431 - protein, 18 aa, Staphylococcus
QMQKPPVFFLKDGKAREV

SEQ ID NO: 2090432 - protein, 20 aa, Staphylococcus
QRVWIAMALAQKTDIIFLDE

SEQ ID NO: 2090433 - protein, 19 aa, Staphylococcus
RGYVLRRLLRRAVRFSQSL

SEQ ID NO: 2090434 - protein, 18 aa, Staphylococcus
RKAIPNVLFQMLLRASNA

SEQ ID NO: 2090435 - protein, 19 aa, Staphylococcus
RLYVYAHYKGLKSLYYTRN

SEQ ID NO: 2090436 - protein, 21 aa, Staphylococcus
RQRVWIAMALAQRTDIIFLDE

SEQ ID NO: 2090437 - protein, 25 aa, Staphylococcus
RRVSPFFVPMLIPDMATGQVSIDLG

SEQ ID NO: 2090438 - protein, 20 aa, Staphylococcus
RSDYFWDLFIQMPAALMFPS

SEQ ID NO: 2090439 - protein, 23 aa, Staphylococcus
RSDYPWDLFIQMPAALMFPSGNP

SEQ ID NO: 2090440 - protein, 18 aa, Staphylococcus
RVGYKFVDGKKVRIAKKS

SEQ ID NO: 2090441 - protein, 24 aa, Staphylococcus
RVKPFYGNFGIYLRAYTYIRTMGA

SEQ ID NO: 2090442 - protein, 20 aa, Staphylococcus
RVVISLTYVYGIGTSTAKKI

SEQ ID NO: 2090443 - protein, 20 aa, Staphylococcus
RYVGRGMLFLDLIQEGNMGL

SEQ ID NO: 2090444 - protein, 20 aa, Staphylococcus
SDLILYVSYFNHSFTDNDKA

SEQ ID NO: 2090445 - protein, 24 aa, Staphylococcus
SDRLRQFFDFITNFGIMIKGTGED

SEQ ID NO: 2090446 - protein, 23 aa, Staphylococcus
SEESYFLFYVNRPSIIVGKNQNT

SEQ ID NO: 2090447 - protein, 24 aa, Staphylococcus
SERLRQFFDFITNFGIMIKGTGED

SEQ ID NO: 2090448 - protein, 20 aa, Staphylococcus
SFIANKLRLLKLAPKVIVRL

SEQ ID NO: 2090449 - protein, 31 aa, Staphylococcus; identical to SEQ ID NO: 1834292

SEQ ID NO: 2090450 - protein, 26 aa, Staphylococcus
SKIFRSRFRMLVEAQLDLLKNDDWDY

SEQ ID NO: 2090451 - protein, 18 aa, Staphylococcus
SKPPILLTPLFPTYFFPT

SEQ ID NO: 2090452 - protein, 23 aa, Staphylococcus
SLSFRAFYALPLLSNKAGIHTNA

SEQ ID NO: 2090453 - protein, 25 aa, Staphylococcus
SMVDTWLFHQFLSAVPLDAQIILVG

SEQ ID NO: 2090454 - protein, 28 aa, Staphylococcus
SSILTSIPLWKNQMAIALTLMRQRNAVS

SEQ ID NO: 2090455 - protein, 23 aa, Staphylococcus
SVTQLLERFLFPSSTHGKKIYKL

SEQ ID NO: 2090456 - protein, 22 aa, Staphylococcus
SYENWLKVINLNLNGVFLVAQA

SEQ ID NO: 2090457 - protein, 22 aa, Staphylococcus
TEDVYDFWRPTGHKYPLVAGAL

SEQ ID NO: 2090458 - protein, 18 aa, Staphylococcus
TFAGIPLGHEFNSLVLAI

SEQ ID NO: 2090459 - protein, 22 aa, Staphylococcus
TGRYYIQRFLARSFGFEVDDIK

SEQ ID NO: 2090460 - protein, 17 aa, Staphylococcus
TLDFGAYYRGYCSDITR

SEQ ID NO: 2090461 - protein, 21 aa, Staphylococcus
TLHAIFLEVVIAPRFTDEALD

SEQ ID NO: 2090462 - protein, 18 aa, Staphylococcus
VFNMIPYKVQVMGGIAIH

SEQ ID NO: 2090463 - protein, 17 aa, Staphylococcus
VGLIPRFSRIFLGDKEF

SEQ ID NO: 2090464 - protein, 24 aa, Staphylococcus
VGNNTPVFFFRDPKLFVSLNRAVK

SEQ ID NO: 2090465 - protein, 22 aa, Staphylococcus
VKPFYGNFGIYLRAYTYIRTMG

SEQ ID NO: 2090466 - protein, 21 aa, Staphylococcus
VKRRIFLGTFALSSGYYDAFY

SEQ ID NO: 2090467 - protein, 18 aa, Staphylococcus
VRDYLPFESLILDLNQPF

SEQ ID NO: 2090468 - protein, 18 aa, Staphylococcus
VRFARFRPFPFWKRVHDS

SEQ ID NO: 2090469 - protein, 17 aa, Staphylococcus
WLNCGYTRWNHNEPLVG

SEQ ID NO: 2090470 - protein, 19 aa, Staphylococcus
WMLDFRLKALKLFYKMPMP

SEQ ID NO: 2090471 - protein, 20 aa, Staphylococcus
YAERYFLMKFFNIPTDEDDA

SEQ ID NO: 2090472 - protein, 17 aa, Staphylococcus
YILFYKPTQVITSVSDD

SEQ ID NO: 2090473 - protein, 17 aa, Staphylococcus
YKSYWKLFLKPFETLEA

SEQ ID NO: 2090474 - protein, 24 aa, Staphylococcus
YTKLHNFHWYVKGPNFFSLHEKFE

SEQ ID NO: 2090475 - protein, 24 aa, Staphylococcus
YTKLHNFHWYVKGPNFFSLHVKFE

SEQ ID NO: 2090476 - protein, 23 aa, Staphylococcus
YVFVSPMWNLSFPPVLKAYIDAI

SEQ ID NO: 2090477 - protein, 20 aa, Staphylococcus
YVGKLTFFRVYSGTLTSGSY

SEQ ID NO: 2090478 - protein, 24 aa, Staphylococcus
AAAFKTGIIFLPINWRLNPKEIAG

SEQ ID NO: 2090479 - protein, 18 aa, Staphylococcus
AAAFVTHFSGQTPHIHFD

SEQ ID NO: 2090480 - protein, 23 aa, Staphylococcus
ACLSPLNAFLLLQGLETLSLRME

SEQ ID NO: 2090481 - protein, 24 aa, Staphylococcus
ADDYQVLLILPLWHEQDKYPFDEL

SEQ ID NO: 2090482 - protein, 23 aa, Staphylococcus
ADFQKHIYAIHTLTSLYADTRPK

SEQ ID NO: 2090483 - protein, 22 aa, Staphylococcus
ADIILYDRLVNPLILQYASEKA

SEQ ID NO: 2090484 - protein, 18 aa, Staphylococcus
ADIIPMCHQLPLTGIDVT

SEQ ID NO: 2090485 - protein, 23 aa, Staphylococcus
ADLERPYILVTDKKISSFQDILP

SEQ ID NO: 2090486 - protein, 19 aa, Staphylococcus
ADRDLLVAQLYLLQHDELP

SEQ ID NO: 2090487 - protein, 22 aa, Staphylococcus
ADYRLRIFTPNNELPFAGHPTV

SEQ ID NO: 2090488 - protein, 23 aa, Staphylococcus
AEESYFLFYINRPSIIVGKNQNT

SEQ ID NO: 2090489 - protein, 23 aa, Staphylococcus
AEFEKHMYAIHTLTSLYTSSDNQ

SEQ ID NO: 2090490 - protein, 23 aa, Staphylococcus
AEGKIKFFHIIATGNLAVKHPLF

SEQ ID NO: 2090491 - protein, 25 aa, Staphylococcus
AEGQRGFFIIPLNGLKKLQTPVDIW

SEQ ID NO: 2090492 - protein, 18 aa, Staphylococcus
AEHVKLLIPLLEQNKDEL

SEQ ID NO: 2090493 - protein, 19 aa, Staphylococcus
AEHVKLLIPLLEQNRDEIA

SEQ ID NO: 2090494 - protein, 27 aa, Staphylococcus
AEKDLVDTVLPYRPLFIKPNKDELEVM

SEQ ID NO: 2090495 - protein, 30 aa, Staphylococcus
AEKDLVNTILPFQPLFIKPNKYELEEMFDI

SEQ ID NO: 2090496 - protein, 17 aa, Staphylococcus
AEKWLLDLGIKNDSIRL

SEQ ID NO: 2090497 - protein, 25 aa, Staphylococcus
AENDITFVPYFPLASGILAGKYEEN

SEQ ID NO: 2090498 - protein, 25 aa, Staphylococcus
AENNITFIPYFPLASGILAGKYEEN

SEQ ID NO: 2090499 - protein, 25 aa, Staphylococcus
AENNITFIPYFPLASGILAGKYTED

SEQ ID NO: 2090500 - protein, 25 aa, Staphylococcus
AENNITFVPYFPLASGILAGKYDED

SEQ ID NO: 2090501 - protein, 25 aa, Staphylococcus
AENQITFVPYFPLASGILAGKYDED

SEQ ID NO: 2090502 - protein, 25 aa, Staphylococcus
AEQFRQLFILPQGEFKKFLLSNSKE

SEQ ID NO: 2090503 - protein, 24 aa, Staphylococcus
AEQFRQLFILPQGEFKKFLQSNSK

SEQ ID NO: 2090504 - protein, 24 aa, Staphylococcus
AEQFRQLFILPQGEFKKFLVSNSS

SEQ ID NO: 2090505 - protein, 24 aa, Staphylococcus
AEQFRQLFILPQGEFKKFLVSNST

SEQ ID NO: 2090506 - protein, 25 aa, Staphylococcus
AEQFRQLFILPQGEFKRFLLSKSVE

SEQ ID NO: 2090507 - protein, 25 aa, Staphylococcus
AEQFRQLFILPQGEFKRFLVSSSSD

SEQ ID NO: 2090508 - protein, 18 aa, Staphylococcus
AERYFLMKFFNIPTDEDD

SEQ ID NO: 2090509 - protein, 17 aa, Staphylococcus
AETPYPHYLKKLKKRKP

SEQ ID NO: 2090510 - protein, 20 aa, Staphylococcus
AEYFPLNLFRKYAKEAFEDN

SEQ ID NO: 2090511 - protein, 20 aa, Staphylococcus
AFRMKGNQHFYLITDAMRAK

SEQ ID NO: 2090512 - protein, 18 aa, Staphylococcus
AFSYQLLIFAFKETAHNS

SEQ ID NO: 2090513 - protein, 21 aa, Staphylococcus
AFTELFMFELRMQWLNRLEKS

SEQ ID NO: 2090514 - protein, 21 aa, Staphylococcus
AFTELFMFELRMQWLNRLEKT

SEQ ID NO: 2090515 - protein, 23 aa, Staphylococcus
AFYNNIRVVWFKNARYLNQEDVE

SEQ ID NO: 2090516 - protein, 23 aa, Staphylococcus
AGETIYFILRETPFYAVSGGQVA

SEQ ID NO: 2090517 - protein, 25 aa, Staphylococcus
AGGLFALLGPFWGYGASIATSLANV

SEQ ID NO: 2090518 - protein, 25 aa, Staphylococcus
AGPGFINFYLDNHYLTAIIPEAISK

SEQ ID NO: 2090519 - protein, 17 aa, Staphylococcus
AGPGFINFYLDNQYLTQ

SEQ ID NO: 2090520 - protein, 18 aa, Staphylococcus
AGYSLNWLKRTFFDNDTF

SEQ ID NO: 2090521 - protein, 20 aa, Staphylococcus
AHELHPDLILMDLLMEDMDG

SEQ ID NO: 2090522 - protein, 22 aa, Staphylococcus
AHHIMTYFWMLERDKGRFTDSL

SEQ ID NO: 2090523 - protein, 23 aa, Staphylococcus
AHHIMTYFWMLERDKSRFQDSMK

SEQ ID NO: 2090524 - protein, 24 aa, Staphylococcus
AHNYKLLIILSPSGSYYGGDSLKP

SEQ ID NO: 2090525 - protein, 21 aa, Staphylococcus
AHSTLRQSLLPHLIEAAAYNV

SEQ ID NO: 2090526 - protein, 22 aa, Staphylococcus
AHSTLRQSLLPHLIEAAAYNVA

SEQ ID NO: 2090527 - protein, 18 aa, Staphylococcus
AIDKYLHLYVYKIAGENW

SEQ ID NO: 2090528 - protein, 19 aa, Staphylococcus
AIIESLKRKIKKLEKENKS

SEQ ID NO: 2090529 - protein, 17 aa, Staphylococcus
AIIKLLYSYGVRNMIMC

SEQ ID NO: 2090530 - protein, 18 aa, Staphylococcus
AIIVLKLITLIFGKRSRL

SEQ ID NO: 2090531 - protein, 17 aa, Staphylococcus
AIIYACDLILKGELDGH

SEQ ID NO: 2090532 - protein, 17 aa, Staphylococcus
AIKKDMLFIPFKGENVD

SEQ ID NO: 2090533 - protein, 17 aa, Staphylococcus
AIKPWILPNFESLVNHE

SEQ ID NO: 2090534 - protein, 17 aa, Staphylococcus
AIKTAFRMKGNQHFYLI

SEQ ID NO: 2090535 - protein, 18 aa, Staphylococcus
AIKTNMLFIPFKGENVDG

SEQ ID NO: 2090536 - protein, 24 aa, Staphylococcus
AINNNVYKWAYVNSILVSWYQEGI

SEQ ID NO: 2090537 - protein, 24 aa, Staphylococcus
AISDIIMHQYYLTKHYLPGNILVM

SEQ ID NO: 2090538 - protein, 27 aa, Staphylococcus
AIYEFLTLRIPMLLIPLGLDQSRGDQI

SEQ ID NO: 2090539 - protein, 27 aa, Staphylococcus
AKANSLEHLLFGLGIRHLGVKASQVLA

SEQ ID NO: 2090540 - protein, 27 aa, Staphylococcus
AKDNSLEHLLFGLGIRHLGVKASQVLA

SEQ ID NO: 2090541 - protein, 23 aa, Staphylococcus
AKEGYSFFGVLYIGAIITKDGPK

SEQ ID NO: 2090542 - protein, 18 aa, Staphylococcus
AKIIRRKLKKLGITKGIP

SEQ ID NO: 2090543 - protein, 22 aa, Staphylococcus
AKPRIHVFIATSPIHRDSKLMM

SEQ ID NO: 2090544 - protein, 27 aa, Staphylococcus
AKQNSLEHLLFGLGIRHLGAKASQILA

SEQ ID NO: 2090545 - protein, 17 aa, Staphylococcus
AKRWIRYIHEIEEPDFL

SEQ ID NO: 2090546 - protein, 22 aa, Staphylococcus
AKSKRLMVMKQSFKKVVIKNCE

SEQ ID NO: 2090547 - protein, 23 aa, Staphylococcus
AKSLLDMVIPLLVKYGIALEAHL

SEQ ID NO: 2090548 - protein, 28 aa, Staphylococcus
AKSNSLEHLLFGLGIRHLGAKASYVLAE

SEQ ID NO: 2090549 - protein, 27 aa, Staphylococcus
AKSNSLEQLLFGLGIRHLGVKASQVIA

SEQ ID NO: 2090550 - protein, 26 aa, Staphylococcus
AKSQSLEHLLFGLGIRHLGVKASRVL

SEQ ID NO: 2090551 - protein, 25 aa, Staphylococcus
AKTGQYYFHLFSKKQPDLNWNNKDV

SEQ ID NO: 2090552 - protein, 24 aa, Staphylococcus
AKYLYIHRNTLLYRLEKCKLQTGL

SEQ ID NO: 2090553 - protein, 20 aa, Staphylococcus
ALAMSILDYTRALGALVMAT

SEQ ID NO: 2090554 - protein, 19 aa, Staphylococcus
AMIPKFNLFIALGIRDAIQ

SEQ ID NO: 2090555 - protein, 19 aa, Staphylococcus
AMIQYLLPKATVVTPNLFE

SEQ ID NO: 2090556 - protein, 24 aa, Staphylococcus
AMMTYRIMLLFEPYFRENNLIFVN

SEQ ID NO: 2090557 - protein, 17 aa, Staphylococcus
AMRMILPRKWTLSYLVD

SEQ ID NO: 2090558 - protein, 24 aa, Staphylococcus
ANCLVHPLFIDPYHLIYPSEKYNK

SEQ ID NO: 2090559 - protein, 18 aa, Staphylococcus
ANEEWLTAFLAPTTSRYF

SEQ ID NO: 2090560 - protein, 24 aa, Staphylococcus
ANEWKNYFHPFRASKRFTIVPSWE

SEQ ID NO: 2090561 - protein, 23 aa, Staphylococcus
ANHKAPIRRGPNIKLPSLDLLED

SEQ ID NO: 2090562 - protein, 24 aa, Staphylococcus
ANSLKFMLKVFLELGFINEDDGII

SEQ ID NO: 2090563 - protein, 24 aa, Staphylococcus
ANVIRYAQFLKELSIQTQFIVITH

SEQ ID NO: 2090564 - protein, 28 aa, Staphylococcus
ANVSRAMHLLPFNVFFVPARGGLGENMV

SEQ ID NO: 2090565 - protein, 28 aa, Staphylococcus
ANVSRAMHLLPFNVFFVPARGGLGENVI

SEQ ID NO: 2090566 - protein, 23 aa, Staphylococcus
APGWQKWVWSPFLSILGTGATAF

SEQ ID NO: 2090567 - protein, 23 aa, Staphylococcus
APHQIDLLQWLCGLPKKVYANVK

SEQ ID NO: 2090568 - protein, 17 aa, Staphylococcus
APILVLMRKVIPAIVTG

SEQ ID NO: 2090569 - protein, 19 aa, Staphylococcus
APKRRVMLDFLIGSALVDK

SEQ ID NO: 2090570 - protein, 23 aa, Staphylococcus
APSPIWMQARLIKAGIRPINNVV

SEQ ID NO: 2090571 - protein, 23 aa, Staphylococcus
AQAATIFEFLKYSPGRYAQEINN

SEQ ID NO: 2090572 - protein, 23 aa, Staphylococcus
AQFEEIIFLLWNYRLPNKEELKE

SEQ ID NO: 2090573 - protein, 23 aa, Staphylococcus
AQFEEIIFLLWNYRLPNKEELQE

SEQ ID NO: 2090574 - protein, 20 aa, Staphylococcus
AQFEEIMFLLWNYRLPTQEE

SEQ ID NO: 2090575 - protein, 19 aa, Staphylococcus
AQLILQAMLVSLQTIEDEY

SEQ ID NO: 2090576 - protein, 18 aa, Staphylococcus
AQMIFDNFLFSSRAKWGE

SEQ ID NO: 2090577 - protein, 18 aa, Staphylococcus
AQMKMFLTRLGFDSKMVV

SEQ ID NO: 2090578 - protein, 23 aa, Staphylococcus
AQSKKFFELYTPLLKEGGVVITD

SEQ ID NO: 2090579 - protein, 17 aa, Staphylococcus
AQSKKFFELYTPLLRKG

SEQ ID NO: 2090580 - protein, 23 aa, Staphylococcus
AQSRKFFELYTPLLNNGGIVITD

SEQ ID NO: 2090581 - protein, 19 aa, Staphylococcus
AQVLIYKKLFNAYKELHDL

SEQ ID NO: 2090582 - protein, 19 aa, Staphylococcus
AQWEAMLLGWKVVGAVKSN

SEQ ID NO: 2090583 - protein, 18 aa, Staphylococcus
ARGYIFFGQPLDIPIVAN

SEQ ID NO: 2090584 - protein, 17 aa, Staphylococcus
ARLNLPAVFVYGGTILP

SEQ ID NO: 2090585 - protein, 21 aa, Staphylococcus
ARQCALVWGIFPVVKEGRKTT

SEQ ID NO: 2090586 - protein, 21 aa, Staphylococcus
ARQLALVWGVFPVVKKGRKTT

SEQ ID NO: 2090587 - protein, 19 aa, Staphylococcus
ARTIYLPNAFHPLLDKETV

SEQ ID NO: 2090588 - protein, 17 aa, Staphylococcus
ARTYDLHFFTPSSIGAF

SEQ ID NO: 2090589 - protein, 26 aa, Staphylococcus
ASEFRNYILGLIFYRFLSEKAEAEVA

SEQ ID NO: 2090590 - protein, 26 aa, Staphylococcus
ASEFRNYILGLIFYRFLSEKAETEVA

SEQ ID NO: 2090591 - protein, 25 aa, Staphylococcus
ASHSYKLFIILSPSGAYYGGDTLKS

SEQ ID NO: 2090592 - protein, 23 aa, Staphylococcus
ASKAFITLINAKIPFYQTTTSEI

SEQ ID NO: 2090593 - protein, 23 aa, Staphylococcus
ASNHWYEWLASNLMLEGYNVTLF

SEQ ID NO: 2090594 - protein, 17 aa, Staphylococcus
ASRIAQYIRRDIYEATM

SEQ ID NO: 2090595 - protein, 21 aa, Staphylococcus
ASSCYIISLAAALERARFTSV

SEQ ID NO: 2090596 - protein, 22 aa, Staphylococcus
ATGDFAFPYQPFQYGRHYSKIH

SEQ ID NO: 2090597 - protein, 18 aa, Staphylococcus
ATGYFDDFDFIYGHHLWT

SEQ ID NO: 2090598 - protein, 25 aa, Staphylococcus
ATILKYVRLGVLFPLSYYDGEWFEN

SEQ ID NO: 2090599 - protein, 20 aa, Staphylococcus
ATLPLYLNALSGHGAFLVTT

SEQ ID NO: 2090600 - protein, 19 aa, Staphylococcus
ATLPLYLNALTGKSVFLLT

SEQ ID NO: 2090601 - protein, 17 aa, Staphylococcus
ATQLLFQFLFSQGRLND

SEQ ID NO: 2090602 - protein, 18 aa, Staphylococcus
AVCKILLKQLGINVLSRV

SEQ ID NO: 2090603 - protein, 26 aa, Staphylococcus
AVESDFIIWLIYKFYNSLNVYSINED

SEQ ID NO: 2090604 - protein, 19 aa, Staphylococcus
AVFDLYFRKMPFDSGYAVF

SEQ ID NO: 2090605 - protein, 22 aa, Staphylococcus
AVKPVIHVFIATSPIHLTHKLK

SEQ ID NO: 2090606 - protein, 22 aa, Staphylococcus
AVLGLVHTLWKPMPGRFKDYIA

SEQ ID NO: 2090607 - protein, 23 aa, Staphylococcus
AVLHLLYARFWHKVLYDLGVVPT

SEQ ID NO: 2090608 - protein, 21 aa, Staphylococcus
AVLHLLYSRFWHKVLYDLGVV

SEQ ID NO: 2090609 - protein, 18 aa, Staphylococcus
AVLLRPFLTHAPKEIFKQ

SEQ ID NO: 2090610 - protein, 18 aa, Staphylococcus
AVPVMKFFKYFYSNRGPV

SEQ ID NO: 2090611 - protein, 19 aa, Staphylococcus
AVQLFYPFFNSVNIKYVAA

SEQ ID NO: 2090612 - protein, 18 aa, Staphylococcus
AVTPLKWKDTFIAHNHFI

SEQ ID NO: 2090613 - protein, 27 aa, Staphylococcus
AVVAWNFPILLASWKLAPALAAGNTIV

SEQ ID NO: 2090614 - protein, 27 aa, Staphylococcus
AVVAWNFPMLLATWKVAPALAAGDTVV

SEQ ID NO: 2090615 - protein, 21 aa, Staphylococcus
AVYDAYTILYLLHPENFTVED

SEQ ID NO: 2090616 - protein, 23 aa, Staphylococcus
AWITTPLNIFYFTGYLSDPHERL

SEQ ID NO: 2090617 - protein, 18 aa, Staphylococcus
AWMILDVLPIIPPEIRPM

SEQ ID NO: 2090618 - protein, 18 aa, Staphylococcus
AYAALIGAGLYGIEHKET

SEQ ID NO: 2090619 - protein, 22 aa, Staphylococcus
AYAYYFKLPFHETVRRHHLKDE

SEQ ID NO: 2090620 - protein, 19 aa, Staphylococcus
AYFGIRFFYEGDKLDLYLS

SEQ ID NO: 2090621 - protein, 18 aa, Staphylococcus
AYIRPLFCEGKGPFRFAA

SEQ ID NO: 2090622 - protein, 17 aa, Staphylococcus
AYLLSLFDWSRPQIKNK

SEQ ID NO: 2090623 - protein, 18 aa, Staphylococcus
AYYLKEIPGTFYIVGCKP

SEQ ID NO: 2090624 - protein, 17 aa, Staphylococcus
CDETFLQTLLKLNPKRI

SEQ ID NO: 2090625 - protein, 17 aa, Staphylococcus
CDQVFIETLLELAPKRI

SEQ ID NO: 2090626 - protein, 18 aa, Staphylococcus
CENIEFYFGLRKALPAPF

SEQ ID NO: 2090627 - protein, 24 aa, Staphylococcus
CFDLANQYWLYLFNHGLKGVGAAD

SEQ ID NO: 2090628 - protein, 18 aa, Staphylococcus
CGLLIKYGKPIDTPVALI

SEQ ID NO: 2090629 - protein, 18 aa, Staphylococcus
CHAGYLIKVLNNWAKENV

SEQ ID NO: 2090630 - protein, 17 aa, Staphylococcus
CIDGIIVILPIQGDLTI

SEQ ID NO: 2090631 - protein, 35 aa, Staphylococcus
CIRFIDKWYFPVQPFQKFIIAFLFLMDEELDTPYF

SEQ ID NO: 2090632 - protein, 20 aa, Staphylococcus
CKVYLKREDLQWVRSFKLRG

SEQ ID NO: 2090633 - protein, 17 aa, Staphylococcus
CLLYALTHLYRDTYRKL

SEQ ID NO: 2090634 - protein, 17 aa, Staphylococcus
CLYVKLDPYWIYQVHDK

SEQ ID NO: 2090635 - protein, 17 aa, Staphylococcus
CRAQLIDLPFTATAKEL

SEQ ID NO: 2090636 - protein, 22 aa, Staphylococcus
CVQTLIIYYAPKVIGGSGKYQF

SEQ ID NO: 2090637 - protein, 19 aa, Staphylococcus
DADGYFWFEGRKDDIIISS

SEQ ID NO: 2090638 - protein, 20 aa, Staphylococcus
DAHFLMFKYRKLHQVIILGP

SEQ ID NO: 2090639 - protein, 17 aa, Staphylococcus
DAHTAYMLILGETLIEM

SEQ ID NO: 2090640 - protein, 19 aa, Staphylococcus
DAKFIIWTTTPWTIPSNVA

SEQ ID NO: 2090641 - protein, 23 aa, Staphylococcus
DAMNMALICPTSMIFIPCKDGIS

SEQ ID NO: 2090642 - protein, 18 aa, Staphylococcus
DAPMPVYIAIYQPLVTYG

SEQ ID NO: 2090643 - protein, 24 aa, Staphylococcus
DAQWEAMLLGWKVIPSVKSNAIIL

SEQ ID NO: 2090644 - protein, 18 aa, Staphylococcus
DARIFKVFKYFYTHRGPV

SEQ ID NO: 2090645 - protein, 17 aa, Staphylococcus
DARNYLSYLYNKNLKRT

SEQ ID NO: 2090646 - protein, 17 aa, Staphylococcus
DARNYLSYLYSNNLKRT

SEQ ID NO: 2090647 - protein, 18 aa, Staphylococcus
DARNYLSYLYSQNLKRTT

SEQ ID NO: 2090648 - protein, 21 aa, Staphylococcus
DCQFLLLRSPLKRQYEDLIKE

SEQ ID NO: 2090649 - protein, 18 aa, Staphylococcus
DDFDFIYGHHLWTQLELG

SEQ ID NO: 2090650 - protein, 24 aa, Staphylococcus
DDFQILFVLPLWHKEDKYPFEILI

SEQ ID NO: 2090651 - protein, 17 aa, Staphylococcus
DDFSCRIGMPFLRSPHV

SEQ ID NO: 2090652 - protein, 17 aa, Staphylococcus
DDFYHFRKVNQSHWEAF

SEQ ID NO: 2090653 - protein, 20 aa, Staphylococcus
DDIADIVLFLSSDSAKFMIA

SEQ ID NO: 2090654 - protein, 23 aa, Staphylococcus
DDIRKNFQFLDYAQIAFVSAKER

SEQ ID NO: 2090655 - protein, 26 aa, Staphylococcus
DDISTDLVWYLWTGKYSSLFGKRAMT

SEQ ID NO: 2090656 - protein, 25 aa, Staphylococcus
DDKIKWLIPFLSYSGPTIIYISSKK

SEQ ID NO: 2090657 - protein, 18 aa, Staphylococcus
DDLFNYLHKLGFKTLLLS

SEQ ID NO: 2090658 - protein, 24 aa, Staphylococcus
DDQYWIYPPFQLTEHQDWLYGRGV

SEQ ID NO: 2090659 - protein, 23 aa, Staphylococcus
DDRYPFYLDPMPNLYFTRDPQAS

SEQ ID NO: 2090660 - protein, 21 aa, Staphylococcus
DDVLLRRIYKLPIGFKWENQS

SEQ ID NO: 2090661 - protein, 24 aa, Staphylococcus
DDWSEIYALYLLEAYQRHMIGYAL

SEQ ID NO: 2090662 - protein, 25 aa, Staphylococcus
DDYQVLLVLPLWHKGDQFPFDDLLA

SEQ ID NO: 2090663 - protein, 24 aa, Staphylococcus
DDYVILLRMHYLIAIALNLEGYED

SEQ ID NO: 2090664 - protein, 18 aa, Staphylococcus
DEETFGYVVYFFELACAM

SEQ ID NO: 2090665 - protein, 23 aa, Staphylococcus
DEHQILLVLPLWHENDVFPFELL

SEQ ID NO: 2090666 - protein, 26 aa, Staphylococcus
DEKVIDLFIFIFPYYLKKAMRKGLYK

SEQ ID NO: 2090667 - protein, 20 aa, Staphylococcus
DELILYIYKIVYNGPLRLLS

SEQ ID NO: 2090668 - protein, 23 aa, Staphylococcus
DELPLGVYRYLINTPKVYARTLD

SEQ ID NO: 2090669 - protein, 24 aa, Staphylococcus
DERLAHIPYILLSLGKNGALLRYK

SEQ ID NO: 2090670 - protein, 26 aa, Staphylococcus
DEYVVLRFGWLYGPGTWYGKDGMIYN

SEQ ID NO: 2090671 - protein, 20 aa, Staphylococcus
DFANIFFMTMNYYSIERSMQ

SEQ ID NO: 2090672 - protein, 21 aa, Staphylococcus
DFESINWLINYVKQYPYTVLF

SEQ ID NO: 2090673 - protein, 20 aa, Staphylococcus
DFFYLGFIFNYYFTNTILKF

SEQ ID NO: 2090674 - protein, 19 aa, Staphylococcus
DFIHPLPHISFVRGKNNVQ

SEQ ID NO: 2090675 - protein, 21 aa, Staphylococcus
DFILPGYRDVPQLIWQGLPLT

SEQ ID NO: 2090676 - protein, 21 aa, Staphylococcus
DFKFDYIIPERLQSFVQIGVR

SEQ ID NO: 2090677 - protein, 19 aa, Staphylococcus
DFKFDYLIPDHLKDFIKVG

SEQ ID NO: 2090678 - protein, 19 aa, Staphylococcus
DFLDKLIAVSLPRVRDFQG

SEQ ID NO: 2090679 - protein, 18 aa, Staphylococcus
DFLGDYYFFLIETGQIEQ

SEQ ID NO: 2090680 - protein, 19 aa, Staphylococcus
DFMASFYYLKGQNFIVTHI

SEQ ID NO: 2090681 - protein, 19 aa, Staphylococcus
DFQIKHLMVSKVKGAFEKF

SEQ ID NO: 2090682 - protein, 18 aa, Staphylococcus
DFRKLWITRINAAARKHD

SEQ ID NO: 2090683 - protein, 17 aa, Staphylococcus
DFRKLWITRINAAARNH

SEQ ID NO: 2090684 - protein, 23 aa, Staphylococcus
DFRTIIKSLYYFSIANPNPFEWL

SEQ ID NO: 2090685 - protein, 19 aa, Staphylococcus
DFSNPNLLFPLLEEEFQLP

SEQ ID NO: 2090686 - protein, 21 aa, Staphylococcus
DFTFDYIIPIRLQSMIQIGMR

SEQ ID NO: 2090687 - protein, 20 aa, Staphylococcus
DFTFDYLIPERLAPIIQVGV

SEQ ID NO: 2090688 - protein, 17 aa, Staphylococcus
DFYIRLLKQTGFNRIET

SEQ ID NO: 2090689 - protein, 22 aa, Staphylococcus
DGIFVQIGLVPNTAWLGNAVEL

SEQ ID NO: 2090690 - protein, 24 aa, Staphylococcus
DGKNAIIESLKRKIKKLEKENKAL

SEQ ID NO: 2090691 - protein, 23 aa, Staphylococcus
DGNEYIDYVLSWGPLILGHENPQ

SEQ ID NO: 2090692 - protein, 23 aa, Staphylococcus
DGNEYIDYVLSWGPLILGHKNEQ

SEQ ID NO: 2090693 - protein, 24 aa, Staphylococcus
DGNEYIDYVLSWGPLILGHKNKQV

SEQ ID NO: 2090694 - protein, 23 aa, Staphylococcus
DGNEYIDYVLSWGPLILGHKNKR

SEQ ID NO: 2090695 - protein, 17 aa, Staphylococcus
DGRLFICYLGDFKSTGG

SEQ ID NO: 2090696 - protein, 22 aa, Staphylococcus
DGTIIYFDRSWMKIGLQLVDDF

SEQ ID NO: 2090697 - protein, 24 aa, Staphylococcus
DGTKLGFMSFFTKAAVAALKKYPA

SEQ ID NO: 2090698 - protein, 22 aa, Staphylococcus
DGTSTIPLIKALSAKQVRLNVT

SEQ ID NO: 2090699 - protein, 17 aa, Staphylococcus
DGWSMFTLLSQWNQLYL

SEQ ID NO: 2090700 - protein, 19 aa, Staphylococcus
DHFYFLPSYMSPLKDHKQH

SEQ ID NO: 2090701 - protein, 21 aa, Staphylococcus
DHIVFLGFDYGFRGNSRYLFN

SEQ ID NO: 2090702 - protein, 23 aa, Staphylococcus
DIAYAQYLAMRKAYPDSSIGVIN

SEQ ID NO: 2090703 - protein, 25 aa, Staphylococcus
DIDRALVWGFNWKQGPFQLWDLMGF

SEQ ID NO: 2090704 - protein, 17 aa, Staphylococcus
DIEKLWIKNINITTGLV

SEQ ID NO: 2090705 - protein, 19 aa, Staphylococcus
DIFQIYLNKIYYSDGVYGV

SEQ ID NO: 2090706 - protein, 20 aa, Staphylococcus
DIFRPQLRALLRASAYGKLN

SEQ ID NO: 2090707 - protein, 18 aa, Staphylococcus
DIHRMLPHPINLVRVRLT

SEQ ID NO: 2090708 - protein, 25 aa, Staphylococcus
DIIKKPFILITILNEPIVLKSNQNG

SEQ ID NO: 2090709 - protein, 25 aa, Staphylococcus
DIIKRHRLLELFLIEILQYNWEEVH

SEQ ID NO: 2090710 - protein, 26 aa, Staphylococcus
DIIKRHRLLELFLIEVLKYNWEEVHQ

SEQ ID NO: 2090711 - protein, 25 aa, Staphylococcus
DIIKRHRLLELFLIEVLQYNWEEVH

SEQ ID NO: 2090712 - protein, 27 aa, Staphylococcus
DIIKRHRLLELFLIKILQYNWEEVHQE

SEQ ID NO: 2090713 - protein, 17 aa, Staphylococcus
DIILPAVSVFKVLFNKI

SEQ ID NO: 2090714 - protein, 19 aa, Staphylococcus
DIKMWDYKLLPTVFGGKDE

SEQ ID NO: 2090715 - protein, 17 aa, Staphylococcus
DILLKKYHLPTIDILKV

SEQ ID NO: 2090716 - protein, 19 aa, Staphylococcus
DIMVYLMYNGLEPSLAFKT

SEQ ID NO: 2090717 - protein, 23 aa, Staphylococcus
DINRGTFYLHYEDKYILLESMED

SEQ ID NO: 2090718 - protein, 23 aa, Staphylococcus
DINTINLFFYESDFWRFQQTKVI

SEQ ID NO: 2090719 - protein, 23 aa, Staphylococcus
DIPGELIMKVLAFNPDLGKMDRV

SEQ ID NO: 2090720 - protein, 17 aa, Staphylococcus
DIQFLYYRMKLLNFRKF

SEQ ID NO: 2090721 - protein, 22 aa, Staphylococcus
DIQNKIWYKLLVNLGINSITAI

SEQ ID NO: 2090722 - protein, 21 aa, Staphylococcus
DIQRIEHMLRYALIIEDNGDN

SEQ ID NO: 2090723 - protein, 20 aa, Staphylococcus
DIQRIEHMLRYALIIEDTGD

SEQ ID NO: 2090724 - protein, 21 aa, Staphylococcus
DIQRIEHMLRYALIIEDTGDN

SEQ ID NO: 2090725 - protein, 26 aa, Staphylococcus
DIRDPNLWMLFGTLPIYPCIKDENDQ

SEQ ID NO: 2090726 - protein, 23 aa, Staphylococcus
DISKLQTILFLRQLNLSLENIQN

SEQ ID NO: 2090727 - protein, 22 aa, Staphylococcus
DKDGYLSFNPIGGWWNQVMLSQ

SEQ ID NO: 2090728 - protein, 18 aa, Staphylococcus
DKEYFVFYLLCQGKSLNE

SEQ ID NO: 2090729 - protein, 19 aa, Staphylococcus
DKHIILMTHIVTHPKFIVP

SEQ ID NO: 2090730 - protein, 17 aa, Staphylococcus
DKLFKTVKVKPGDFYYV

SEQ ID NO: 2090731 - protein, 18 aa, Staphylococcus
DKMDLPGITLYPETERFY

SEQ ID NO: 2090732 - protein, 18 aa, Staphylococcus
DKNYKALHYISEGTDLVI

SEQ ID NO: 2090733 - protein, 23 aa, Staphylococcus
DKPLYVKFLLDQLSEYPHGKLEP

SEQ ID NO: 2090734 - protein, 17 aa, Staphylococcus
DKQWDLLRLLENELQAF

SEQ ID NO: 2090735 - protein, 23 aa, Staphylococcus
DKTAYFILGGLWLALNEEKDIPR

SEQ ID NO: 2090736 - protein, 25 aa, Staphylococcus
DKVQILMNYFWPGPISFILPLKRGY

SEQ ID NO: 2090737 - protein, 24 aa, Staphylococcus
DKYDLLKLLIRKLIFRVREKHFST

SEQ ID NO: 2090738 - protein, 17 aa, Staphylococcus
DLDIGFISLYRALGDFN

SEQ ID NO: 2090739 - protein, 21 aa, Staphylococcus
DLDLMFAVNLKGPIWFSQSVA

SEQ ID NO: 2090740 - protein, 19 aa, Staphylococcus
DLDYLILDLPPGTGDIALD

SEQ ID NO: 2090741 - protein, 17 aa, Staphylococcus
DLDYLLLDLPPGTGDVA

SEQ ID NO: 2090742 - protein, 23 aa, Staphylococcus
DLFESILPLYQIPFNIDTKRSMT

SEQ ID NO: 2090743 - protein, 20 aa, Staphylococcus
DLFIDLIFSPIYFNILIKPN

SEQ ID NO: 2090744 - protein, 21 aa, Staphylococcus
DLFTCLRPVRWFQGVPSPVKR

SEQ ID NO: 2090745 - protein, 19 aa, Staphylococcus
DLFTPIFAISRTSGWLAHI

SEQ ID NO: 2090746 - protein, 20 aa, Staphylococcus
DLGFIFQDYSVLPTLTVKEN

SEQ ID NO: 2090747 - protein, 20 aa, Staphylococcus
DLIFLYLEKSFLTEDFYDVP

SEQ ID NO: 2090748 - protein, 17 aa, Staphylococcus
DLLIQMPAALMYPAGNK

SEQ ID NO: 2090749 - protein, 17 aa, Staphylococcus
DLLIRLYEKVINHLDYQ

SEQ ID NO: 2090750 - protein, 17 aa, Staphylococcus
DLLNLLESELKALGLET

SEQ ID NO: 2090751 - protein, 23 aa, Staphylococcus
DLLQAQLYLLLHNKLPFSQEDIV

SEQ ID NO: 2090752 - protein, 17 aa, Staphylococcus
DLLRLLENELQAFGLST

SEQ ID NO: 2090753 - protein, 20 aa, Staphylococcus
DLNWIYLVKNLRLAGVKIEL

SEQ ID NO: 2090754 - protein, 22 aa, Staphylococcus
DLTPMKCLRILSIFRLINPTKE

SEQ ID NO: 2090755 - protein, 17 aa, Staphylococcus
DLVVHRLIRKYLIDETM

SEQ ID NO: 2090756 - protein, 21 aa, Staphylococcus
DLWQRLIKLWKDQTVLIVEHK

SEQ ID NO: 2090757 - protein, 17 aa, Staphylococcus
DMDIVISAPFYPAYMTK

SEQ ID NO: 2090758 - protein, 18 aa, Staphylococcus
DMIFTHFGISGPAALRCS

SEQ ID NO: 2090759 - protein, 20 aa, Staphylococcus
DMIFTHFGISGPAALRCSQF

SEQ ID NO: 2090760 - protein, 22 aa, Staphylococcus
DMVLTFFNWPNQYRGRIGSGQI

SEQ ID NO: 2090761 - protein, 22 aa, Staphylococcus
DMVLTFFNWPNQYRGRIGSGQV

SEQ ID NO: 2090762 - protein, 18 aa, Staphylococcus
DMYLCPDLDTWVIFPWTA

SEQ ID NO: 2090763 - protein, 17 aa, Staphylococcus
DNAFLLRTFSKAYGLAG

SEQ ID NO: 2090764 - protein, 18 aa, Staphylococcus
DNAFLLRTFSKAYGLAGL

SEQ ID NO: 2090765 - protein, 20 aa, Staphylococcus
DNAIWYKLLVNLAINSVTAL

SEQ ID NO: 2090766 - protein, 17 aa, Staphylococcus
DNARLMDFILDKLIELS

SEQ ID NO: 2090767 - protein, 18 aa, Staphylococcus
DNFLFSSYAKWGERSGLT

SEQ ID NO: 2090768 - protein, 24 aa, Staphylococcus
DNGLKLFIIPKKGFQKTFVTYTTQ

SEQ ID NO: 2090769 - protein, 23 aa, Staphylococcus
DNGLTRLIFMVPARGLIGYTTEF

SEQ ID NO: 2090770 - protein, 18 aa, Staphylococcus
DNGLTRLIFMVPARGMIG

SEQ ID NO: 2090771 - protein, 20 aa, Staphylococcus
DNIKYYFGLTCEKPYDFGEN

SEQ ID NO: 2090772 - protein, 20 aa, Staphylococcus
DNLIWYLSEIFKSELKLALG

SEQ ID NO: 2090773 - protein, 22 aa, Staphylococcus
DNLVLLGIKTRGAFLANRIQEK

SEQ ID NO: 2090774 - protein, 18 aa, Staphylococcus
DNLVWYFSELFKSELRVT

SEQ ID NO: 2090775 - protein, 20 aa, Staphylococcus
DNLYQLLRKLPPREYSISSS

SEQ ID NO: 2090776 - protein, 23 aa, Staphylococcus
DNNGFIKFQPIGGWWSQVMLSQK

SEQ ID NO: 2090777 - protein, 24 aa, Staphylococcus
DNYDGHLLIQWYSKGIYAFRDTIL

SEQ ID NO: 2090778 - protein, 23 aa, Staphylococcus
DNYDSHLLIQWYSKGIYKFRYLI

SEQ ID NO: 2090779 - protein, 26 aa, Staphylococcus
DNYVVLRFGWLYGPGTWYGKDGMIYN

SEQ ID NO: 2090780 - protein, 25 aa, Staphylococcus
DPDGSFYIWFKFSISINVKTLFNES

SEQ ID NO: 2090781 - protein, 23 aa, Staphylococcus
DPETFGYLVYFFELACAMSGYQL

SEQ ID NO: 2090782 - protein, 18 aa, Staphylococcus
DPKLWYFSAGSTSTTIKQ

SEQ ID NO: 2090783 - protein, 18 aa, Staphylococcus
DQEDIEFLEGLGGPEDEL

SEQ ID NO: 2090784 - protein, 23 aa, Staphylococcus
DQINWLGFYLIENNELILGPFQG

SEQ ID NO: 2090785 - protein, 26 aa, Staphylococcus
DQYVVLRFGWLYGPGTWYGKDGMIYN

SEQ ID NO: 2090786 - protein, 17 aa, Staphylococcus
DRGHSIFLDLKLHDIPN

SEQ ID NO: 2090787 - protein, 22 aa, Staphylococcus
DRLVNPFILQLAPPEIEIIDVG

SEQ ID NO: 2090788 - protein, 22 aa, Staphylococcus
DRQLFYQFILRLPDNVLRLKGY

SEQ ID NO: 2090789 - protein, 21 aa, Staphylococcus
DRSVLRLLKLIDRYTLEGEMP

SEQ ID NO: 2090790 - protein, 21 aa, Staphylococcus
DRTQLILEIFALRARSKEGKL

SEQ ID NO: 2090791 - protein, 21 aa, Staphylococcus
DRTQLILEIFALRARSREGKL

SEQ ID NO: 2090792 - protein, 23 aa, Staphylococcus
DSDGRIILFIDELHMLVGAGKTD

SEQ ID NO: 2090793 - protein, 22 aa, Staphylococcus
DSEFMLQILPYLLMVSYNSGIN

SEQ ID NO: 2090794 - protein, 20 aa, Staphylococcus
DSTTFYAHFPKKGMYKIWAE

SEQ ID NO: 2090795 - protein, 17 aa, Staphylococcus
DSYLLQRGLKTLHLRID

SEQ ID NO: 2090796 - protein, 23 aa, Staphylococcus
DTEFYYYAILREGLYRIADTSTI

SEQ ID NO: 2090797 - protein, 23 aa, Staphylococcus
DTGYFFNTAYLPNGALNKGHYNN

SEQ ID NO: 2090798 - protein, 21 aa, Staphylococcus
DTIMNPFDWYKAHDINLIIDD

SEQ ID NO: 2090799 - protein, 18 aa, Staphylococcus
DTPLRYVLPFNEGNRYLV

SEQ ID NO: 2090800 - protein, 25 aa, Staphylococcus
DTTKQYYFHLFSKKQPDLNWSNPDV

SEQ ID NO: 2090801 - protein, 23 aa, Staphylococcus
DVEYPLFFVLNRSLGINLEKVLK

SEQ ID NO: 2090802 - protein, 18 aa, Staphylococcus
DVHTAYMLILAETLIEMK

SEQ ID NO: 2090803 - protein, 19 aa, Staphylococcus
DVHTLFFMFRVTVTSFATQ

SEQ ID NO: 2090804 - protein, 21 aa, Staphylococcus
DVIKFLKYFTFLSKEDINRLE

SEQ ID NO: 2090805 - protein, 24 aa, Staphylococcus
DVLMYDFLKYYDLPVLIIATKEDK

SEQ ID NO: 2090806 - protein, 18 aa, Staphylococcus
DVLMYNYLKHFDLPTLVI

SEQ ID NO: 2090807 - protein, 32 aa, Staphylococcus
DVLNYQIFYPYNKNIFYKRYWTSNGWADWSKF

SEQ ID NO: 2090808 - protein, 19 aa, Staphylococcus
DVNLLFELINIGALSQLTA

SEQ ID NO: 2090809 - protein, 17 aa, Staphylococcus
DVPQLIWHGLPLTDAFL

SEQ ID NO: 2090810 - protein, 23 aa, Staphylococcus
DVRNQFQFLDYAPIAFVSAKERL

SEQ ID NO: 2090811 - protein, 20 aa, Staphylococcus
DVRSYLPFESLILDINQAFD

SEQ ID NO: 2090812 - protein, 21 aa, Staphylococcus
DVTALTLYWTAILILQGNVKQ

SEQ ID NO: 2090813 - protein, 24 aa, Staphylococcus
DVTQPLLVKFLWDNLTDQPIGQVK

SEQ ID NO: 2090814 - protein, 19 aa, Staphylococcus
DWLSGFKLLSIPMTKFKKK

SEQ ID NO: 2090815 - protein, 26 aa, Staphylococcus
DWVMDVANIHYLAIASWGRHIYQNTS

SEQ ID NO: 2090816 - protein, 23 aa, Staphylococcus
DYENLLFYFAYKTFINTADEIIE

SEQ ID NO: 2090817 - protein, 18 aa, Staphylococcus
DYFFLNKFQNIINIEHEL

SEQ ID NO: 2090818 - protein, 22 aa, Staphylococcus
DYIKSFFITKYLASPLGKKQID

SEQ ID NO: 2090819 - protein, 24 aa, Staphylococcus
DYIPKMFWPVYYFVQAPLQGIMMR

SEQ ID NO: 2090820 - protein, 23 aa, Staphylococcus
DYLDLYLMHWPGMNEALMIDTWQ

SEQ ID NO: 2090821 - protein, 19 aa, Staphylococcus
DYLNFIDLFEDLLVEYLDE

SEQ ID NO: 2090822 - protein, 25 aa, Staphylococcus
DYQILIVLPLWHFNDRYPFETLLHR

SEQ ID NO: 2090823 - protein, 22 aa, Staphylococcus
DYTPLLQPITLPNGVQLNNRFV

SEQ ID NO: 2090824 - protein, 22 aa, Staphylococcus
DYVILLRMHYLIANALDLNGYE

SEQ ID NO: 2090825 - protein, 26 aa, Staphylococcus
DYYKWTQWIFIQLYNKGLAYVDEVAV

SEQ ID NO: 2090826 - protein, 18 aa, Staphylococcus
EAERLVIHGFLDPVVREL

SEQ ID NO: 2090827 - protein, 24 aa, Staphylococcus
EAGRVFIALPPLYKLEKGKGASRK

SEQ ID NO: 2090828 - protein, 24 aa, Staphylococcus
EAHAVLRQSLLPHLIDAAAYNVAR

SEQ ID NO: 2090829 - protein, 17 aa, Staphylococcus
EAIPNVLFQMLLRASNA

SEQ ID NO: 2090830 - protein, 17 aa, Staphylococcus
EALFIFLAPPSLDDLRD

SEQ ID NO: 2090831 - protein, 17 aa, Staphylococcus
EALLKPLFRHLTETYSE

SEQ ID NO: 2090832 - protein, 17 aa, Staphylococcus
EAMAHYLAWFDKKLYQN

SEQ ID NO: 2090833 - protein, 18 aa, Staphylococcus
EAPYLFKLIVIHYLFEYL

SEQ ID NO: 2090834 - protein, 18 aa, Staphylococcus
EAQPPSEDFAYYAKALPS

SEQ ID NO: 2090835 - protein, 21 aa, Staphylococcus
EAQWDAMLLGWKVVASVKSNA

SEQ ID NO: 2090836 - protein, 24 aa, Staphylococcus
EASQKLLFPLYKKGKFISLQLFHA

SEQ ID NO: 2090837 - protein, 24 aa, Staphylococcus
EASQKLLLPLYRKSKFPSPQMYNA

SEQ ID NO: 2090838 - protein, 21 aa, Staphylococcus
EAYFDRVLLLNKTLRYLGPTK

SEQ ID NO: 2090839 - protein, 17 aa, Staphylococcus
ECIHAGLPVILSPVKEH

SEQ ID NO: 2090840 - protein, 23 aa, Staphylococcus
EDDYAKIYLFTPNLEKITTFRDE

SEQ ID NO: 2090841 - protein, 24 aa, Staphylococcus
EDEEAFYRALGRYVHTLNGRYYTA

SEQ ID NO: 2090842 - protein, 22 aa, Staphylococcus
EDFILPGYRDVPQLIWHGLPLT

SEQ ID NO: 2090843 - protein, 19 aa, Staphylococcus
EDIELFRDIADKVKQTNSY

SEQ ID NO: 2090844 - protein, 24 aa, Staphylococcus
EDQDLFIDLIFSPIYFNILIKPET

SEQ ID NO: 2090845 - protein, 24 aa, Staphylococcus
EDQMVDFLFVASLFGRVVANNASV

SEQ ID NO: 2090846 - protein, 23 aa, Staphylococcus
EDQQELFQYLWLQYLRTDMGRIN

SEQ ID NO: 2090847 - protein, 21 aa, Staphylococcus
EDRIYRSLGLLRYSRLMSVEE

SEQ ID NO: 2090848 - protein, 24 aa, Staphylococcus
EDTVYNIPFLWRLSSELNVEQLKR

SEQ ID NO: 2090849 - protein, 24 aa, Staphylococcus
EEGKLADLVIWDPAFFGVKPEMIL

SEQ ID NO: 2090850 - protein, 25 aa, Staphylococcus
EEGSRFPFAFWGSKNFFNLADEEDV

SEQ ID NO: 2090851 - protein, 25 aa, Staphylococcus
EEGYNLTFFAFFVKAAAEALKEFPM

SEQ ID NO: 2090852 - protein, 22 aa, Staphylococcus
EEIYNIVVYQLGALNGFCQIHD

SEQ ID NO: 2090853 - protein, 18 aa, Staphylococcus
EEKDMFLSLIKVTGIGPK

SEQ ID NO: 2090854 - protein, 23 aa, Staphylococcus
EEMRPLYEWLGLTTSLGFIGDPD

SEQ ID NO: 2090855 - protein, 24 aa, Staphylococcus
EEQDLFIDLIFSPIYFNILIKPDS

SEQ ID NO: 2090856 - protein, 25 aa, Staphylococcus
EERNFKFHPLVRQLKPFGFFDYNAL

SEQ ID NO: 2090857 - protein, 19 aa, Staphylococcus
EFEFVPQLKLWMATNHKPY

SEQ ID NO: 2090858 - protein, 23 aa, Staphylococcus
EFKCQIIGLPFWKTKYSTQEIQK

SEQ ID NO: 2090859 - protein, 22 aa, Staphylococcus
EFKNYILGLIFYRFLSEKNEDI

SEQ ID NO: 2090860 - protein, 21 aa, Staphylococcus
EFKNYILGMIFYRFLSEKIEE

SEQ ID NO: 2090861 - protein, 20 aa, Staphylococcus
EFLNRFNGIVEFTHLDKHAL

SEQ ID NO: 2090862 - protein, 28 aa, Staphylococcus
EFQYFKEGLILFTYLHLANEEKLTRALL

SEQ ID NO: 2090863 - protein, 20 aa, Staphylococcus
EFRRSWWHFDFLENLDGVEG

SEQ ID NO: 2090864 - protein, 21 aa, Staphylococcus
EFRRSWWHFDFLENLNGVEGY

SEQ ID NO: 2090865 - protein, 25 aa, Staphylococcus
EFRTMPMVWYCPPLSPIMSYFEGQN

SEQ ID NO: 2090866 - protein, 17 aa, Staphylococcus
EFYFIPAGTIHSIGSGI

SEQ ID NO: 2090867 - protein, 22 aa, Staphylococcus
EGAELFGFIYYADNKKIYIHDN

SEQ ID NO: 2090868 - protein, 19 aa, Staphylococcus
EGAFYIFPSLAPFGIDDDF

SEQ ID NO: 2090869 - protein, 23 aa, Staphylococcus
EGALTRLLAYSKLQGRPITTELA

SEQ ID NO: 2090870 - protein, 25 aa, Staphylococcus
EGFEAFFMMKKMGAPFLLFGDPRLE

SEQ ID NO: 2090871 - protein, 19 aa, Staphylococcus
EGNFLYFEQFFITLGRGGG

SEQ ID NO: 2090872 - protein, 22 aa, Staphylococcus
EGNLATFWLLLDERMSLIHDAL

SEQ ID NO: 2090873 - protein, 26 aa, Staphylococcus
EGYNLTFFAFFVKAVAEGLKAYPLLN

SEQ ID NO: 2090874 - protein, 23 aa, Staphylococcus
EHAVLHLLYARFWHKVLYDMGVV

SEQ ID NO: 2090875 - protein, 17 aa, Staphylococcus
EHFFTDKGFYPVAVDAK

SEQ ID NO: 2090876 - protein, 18 aa, Staphylococcus
EHRLPFILFSASGGARMQ

SEQ ID NO: 2090877 - protein, 19 aa, Staphylococcus
EHRLPFILFSASGGARMQE

SEQ ID NO: 2090878 - protein, 19 aa, Staphylococcus
EHRLPFVLFSASGGARMQE

SEQ ID NO: 2090879 - protein, 24 aa, Staphylococcus
EHTARQLALVWGAYPVIKKGRKTT

SEQ ID NO: 2090880 - protein, 22 aa, Staphylococcus
EHTARQLALVWGAYPVVKKGRK

SEQ ID NO: 2090881 - protein, 20 aa, Staphylococcus
EIAIPLLLGLGLDEFSMSAT

SEQ ID NO: 2090882 - protein, 18 aa, Staphylococcus
EIGFIFQDYNLLSTLTVK

SEQ ID NO: 2090883 - protein, 18 aa, Staphylococcus
EIIIPKFPPVIGAYVLSL

SEQ ID NO: 2090884 - protein, 20 aa, Staphylococcus
EIIKKLFLLGIVANINQSLD

SEQ ID NO: 2090885 - protein, 24 aa, Staphylococcus
EIKSSMVGTFFLQDSKELTDPQIK

SEQ ID NO: 2090886 - protein, 24 aa, Staphylococcus
EIKTQMLEWILPYYKSLSREGMKD

SEQ ID NO: 2090887 - protein, 18 aa, Staphylococcus
EIMYVDRGFIFTSHRGNS

SEQ ID NO: 2090888 - protein, 18 aa, Staphylococcus
EIREIRIIKSVLLKGKKS

SEQ ID NO: 2090889 - protein, 19 aa, Staphylococcus
EIRFARFRPFPFWKRVHDS

SEQ ID NO: 2090890 - protein, 19 aa, Staphylococcus
EIVDHFIMKLRLVKFARTP

SEQ ID NO: 2090891 - protein, 21 aa, Staphylococcus
EIYLFDYASWDVPRGEFFIWL

SEQ ID NO: 2090892 - protein, 22 aa, Staphylococcus
EKALWLHLKLDTGMGRLGMKDV

SEQ ID NO: 2090893 - protein, 22 aa, Staphylococcus
EKDFFTFFRNFFNIKFNREITV

SEQ ID NO: 2090894 - protein, 23 aa, Staphylococcus
EKEKDFLQVLVKEDNSQLPTDQN

SEQ ID NO: 2090895 - protein, 23 aa, Staphylococcus
EKEKYLRFIDYYKELLITYLNEY

SEQ ID NO: 2090896 - protein, 23 aa, Staphylococcus
EKENKFILFIYDWRVLESESRNA

SEQ ID NO: 2090897 - protein, 32 aa, Staphylococcus
EKERLIPYFILNDYWFLFYHDADYFAVKFDKK

SEQ ID NO: 2090898 - protein, 20 aa, Staphylococcus
EKERLLPGGYLFLSDLMGNP

SEQ ID NO: 2090899 - protein, 19 aa, Staphylococcus
EKFYQLPKVFFTNPKYVNL

SEQ ID NO: 2090900 - protein, 23 aa, Staphylococcus
EKKHIFLYLMYVYKQMMIDDIDR

SEQ ID NO: 2090901 - protein, 18 aa, Staphylococcus
EKKNLPGITLYPETERFY

SEQ ID NO: 2090902 - protein, 19 aa, Staphylococcus
EKKWQCFWLDNQTFKTSDN

SEQ ID NO: 2090903 - protein, 23 aa, Staphylococcus
EKMKLPGITLYPETERFYPNGNF

SEQ ID NO: 2090904 - protein, 27 aa, Staphylococcus
EKNNYMINYFMRLAYLGQPLTVMGASD

SEQ ID NO: 2090905 - protein, 22 aa, Staphylococcus
EKPKARWLFLTLSTRNAIDGET

SEQ ID NO: 2090906 - protein, 25 aa, Staphylococcus
EKPTLKFELFYFDIFRYATSFVTLQ

SEQ ID NO: 2090907 - protein, 23 aa, Staphylococcus
EKQCGDMFLLRFNADIFSHTDYL

SEQ ID NO: 2090908 - protein, 17 aa, Staphylococcus
EKQIVNRVAPWNFKRTK

SEQ ID NO: 2090909 - protein, 17 aa, Staphylococcus
EKQKNYLELFYLNDYSL

SEQ ID NO: 2090910 - protein, 18 aa, Staphylococcus
EKRMILERILPILSDREK

SEQ ID NO: 2090911 - protein, 26 aa, Staphylococcus
EKSRLQFVLLFFSNANLLILDEPTNY

SEQ ID NO: 2090912 - protein, 23 aa, Staphylococcus
EKTAKILLLIYLEIMPLLSEWYE

SEQ ID NO: 2090913 - protein, 22 aa, Staphylococcus
EKYLRLYAEFENYKRRIQKENQ

SEQ ID NO: 2090914 - protein, 29 aa, Staphylococcus
ELAAPVSHIWYFKGIPSRMGLLLDMSPRS

SEQ ID NO: 2090915 - protein, 30 aa, Staphylococcus
ELAAPVSHIWYFKGIPSRMGLLLDMSPRSL

SEQ ID NO: 2090916 - protein, 23 aa, Staphylococcus
ELERPYILVTDKKISSFQDILPL

SEQ ID NO: 2090917 - protein, 19 aa, Staphylococcus
ELFEQWFHPKGASIEVYHF

SEQ ID NO: 2090918 - protein, 17 aa, Staphylococcus
ELGIPEHLVWRQPFPGP

SEQ ID NO: 2090919 - protein, 24 aa, Staphylococcus
ELHDLAFLLLVYPLSEAEGALNSA

SEQ ID NO: 2090920 - protein, 25 aa, Staphylococcus
ELHDLAFLLLVYPLSEIEGALDSAY

SEQ ID NO: 2090921 - protein, 24 aa, Staphylococcus
ELHDLAFLLLVYPLSEVEGALDSA

SEQ ID NO: 2090922 - protein, 20 aa, Staphylococcus
ELIHKWINGRMPLIGIGSVF

SEQ ID NO: 2090923 - protein, 17 aa, Staphylococcus
ELILYLAPKLIGGSGKH

SEQ ID NO: 2090924 - protein, 17 aa, Staphylococcus
ELKPDLILMDLLMDDMD

SEQ ID NO: 2090925 - protein, 25 aa, Staphylococcus
ELPTLKFELFYFDIFKYGTSFVTLQ

SEQ ID NO: 2090926 - protein, 20 aa, Staphylococcus
ELQNLLLDPYFKDIVTNYQD

SEQ ID NO: 2090927 - protein, 22 aa, Staphylococcus
ELSDILRYIGPQTLLIIGNRRN

SEQ ID NO: 2090928 - protein, 18 aa, Staphylococcus
ELSRLYVYAHYKGLKSLY

SEQ ID NO: 2090929 - protein, 25 aa, Staphylococcus
ELTFPSFIKQLLLQIPYFEKNQSQI

SEQ ID NO: 2090930 - protein, 25 aa, Staphylococcus
ELTNQYYFHLFSKKQPDLNWDNPEV

SEQ ID NO: 2090931 - protein, 24 aa, Staphylococcus
ELTYADYLIIWGNVFQFLKQEHIT

SEQ ID NO: 2090932 - protein, 20 aa, Staphylococcus
ELVHFFFKSLTSYLKKHNCL

SEQ ID NO: 2090933 - protein, 23 aa, Staphylococcus
ELYFAFLGILKVGAIVGPLFEAF

SEQ ID NO: 2090934 - protein, 25 aa, Staphylococcus
EMHDLAFLLLVYPLSELHGALDSAF

SEQ ID NO: 2090935 - protein, 20 aa, Staphylococcus
EMHFYRYVFPYYDTLYTLEK

SEQ ID NO: 2090936 - protein, 23 aa, Staphylococcus
EMHFYRYVFPYYDTLYTLEKLSE

SEQ ID NO: 2090937 - protein, 23 aa, Staphylococcus
EMHFYRYVFPYYDTLYTLEKLTE

SEQ ID NO: 2090938 - protein, 19 aa, Staphylococcus
EMIQLIKKPIGVTAGIVPW

SEQ ID NO: 2090939 - protein, 18 aa, Staphylococcus
EMKPLYEWLGLTTSLGFV

SEQ ID NO: 2090940 - protein, 20 aa, Staphylococcus
EMKVIYSYMITMIKAAQKMP

SEQ ID NO: 2090941 - protein, 21 aa, Staphylococcus
EMNPFLGYRAIRLCLAQPDIF

SEQ ID NO: 2090942 - protein, 17 aa, Staphylococcus
EMQKWEHFFTDKGFYPV

SEQ ID NO: 2090943 - protein, 22 aa, Staphylococcus
EMQKWESFFIDKGYYPVSVDAK

SEQ ID NO: 2090944 - protein, 20 aa, Staphylococcus
EMSLLLYISSDWFHERGYSF

SEQ ID NO: 2090945 - protein, 24 aa, Staphylococcus
EMTKIDYFFLHKFQNIINIEHELK

SEQ ID NO: 2090946 - protein, 21 aa, Staphylococcus
EMYEELRFLTFTGFRIGRFKE

SEQ ID NO: 2090947 - protein, 18 aa, Staphylococcus
ENAQVRVLPYASITIRQA

SEQ ID NO: 2090948 - protein, 17 aa, Staphylococcus
ENGTILTFFNWPNAHKG

SEQ ID NO: 2090949 - protein, 19 aa, Staphylococcus
ENIVLVPKLLKWSKEKKDA

SEQ ID NO: 2090950 - protein, 17 aa, Staphylococcus
ENLDLFFSYRIEKGQTG

SEQ ID NO: 2090951 - protein, 22 aa, Staphylococcus
ENLKHLLLQPPMKGKQILGIDP

SEQ ID NO: 2090952 - protein, 24 aa, Staphylococcus
ENLLKPFAVTYFTLFTATMPVQLN

SEQ ID NO: 2090953 - protein, 17 aa, Staphylococcus
ENMYQLLRKLPPREYSI

SEQ ID NO: 2090954 - protein, 23 aa, Staphylococcus
ENNLMFLTTQLLLDYIHHTQKRD

SEQ ID NO: 2090955 - protein, 18 aa, Staphylococcus
ENQILLIKSPLRGWEIPG

SEQ ID NO: 2090956 - protein, 20 aa, Staphylococcus
ENRLPFILFSASGGARMQEG

SEQ ID NO: 2090957 - protein, 17 aa, Staphylococcus
ENSNIVFWYGWNKQAFD

SEQ ID NO: 2090958 - protein, 23 aa, Staphylococcus
ENTKLFVVIGQLNQLIKGGRVSK

SEQ ID NO: 2090959 - protein, 20 aa, Staphylococcus
ENVILAPKLLKNVDLKKLEI

SEQ ID NO: 2090960 - protein, 23 aa, Staphylococcus
ENYVLIYYLERIIHQANIRLDIM

SEQ ID NO: 2090961 - protein, 20 aa, Staphylococcus
EPALDYVISKIPRFPFDKFE

SEQ ID NO: 2090962 - protein, 17 aa, Staphylococcus
EPEALLKPLFRHLTETY

SEQ ID NO: 2090963 - protein, 25 aa, Staphylococcus
EPGKFADLVVWDPAFFGVKPELIVK

SEQ ID NO: 2090964 - protein, 18 aa, Staphylococcus
EPIRFQWIDDYVVGVMLA

SEQ ID NO: 2090965 - protein, 17 aa, Staphylococcus
EPITLSNGITLANRFVL

SEQ ID NO: 2090966 - protein, 29 aa, Staphylococcus
EPKNQGAWLFVYPYLKSIVGHQYNLSYQG

SEQ ID NO: 2090967 - protein, 27 aa, Staphylococcus
EPKNQGAWLFVYPYLKSLVGNQFNLSY

SEQ ID NO: 2090968 - protein, 28 aa, Staphylococcus
EPKNQGAWLFVYPYLRALVADRYDLSYH

SEQ ID NO: 2090969 - protein, 27 aa, Staphylococcus
EPKNQGAWLFVYPYLRALVGDKYDLSY

SEQ ID NO: 2090970 - protein, 21 aa, Staphylococcus
EPLYIKIGMELYYQTGPELIN

SEQ ID NO: 2090971 - protein, 19 aa, Staphylococcus
EPMFQFCLGIPWGADNDPE

SEQ ID NO: 2090972 - protein, 20 aa, Staphylococcus
EPMKGGIFLWLKTPPNFDGE

SEQ ID NO: 2090973 - protein, 20 aa, Staphylococcus
EPMVLPSRFPNLLVNGSTGI

SEQ ID NO: 2090974 - protein, 22 aa, Staphylococcus
EPQWMLDFRLKALKLFYKMPMP

SEQ ID NO: 2090975 - protein, 17 aa, Staphylococcus
EPRLLVVSPYDKTSLSD

SEQ ID NO: 2090976 - protein, 23 aa, Staphylococcus
EPSPIWVQARLIKAGIRPINNVV

SEQ ID NO: 2090977 - protein, 24 aa, Staphylococcus
EPSRKDMLNFLLTSGAFGFVVANN

SEQ ID NO: 2090978 - protein, 21 aa, Staphylococcus
EPTLDYVISKIPRFPFDKFEK

SEQ ID NO: 2090979 - protein, 24 aa, Staphylococcus
EPVKPLKMLLLLHGLSSDATSYMR

SEQ ID NO: 2090980 - protein, 24 aa, Staphylococcus
EQEDKIYILFYKPTQVITSVSDDR

SEQ ID NO: 2090981 - protein, 24 aa, Staphylococcus
EQHQITDFMFFASAIMVLLHKYTR

SEQ ID NO: 2090982 - protein, 17 aa, Staphylococcus
EQHWAVMKYSPGMPPGA

SEQ ID NO: 2090983 - protein, 21 aa, Staphylococcus
EQITLPHLFADILIYSSERNV

SEQ ID NO: 2090984 - protein, 17 aa, Staphylococcus
EQMFLGLRMNKGVSKKT

SEQ ID NO: 2090985 - protein, 24 aa, Staphylococcus
EQTQEYYFHLFSKKQPDLNWDNPA

SEQ ID NO: 2090986 - protein, 17 aa, Staphylococcus
EQVYLAVTVWTAGLRGP

SEQ ID NO: 2090987 - protein, 24 aa, Staphylococcus
EREDLIEDLKKFFRPEFLNRFDGI

SEQ ID NO: 2090988 - protein, 24 aa, Staphylococcus
EREFKFHPLVRQLKPFGFFDYNAL

SEQ ID NO: 2090989 - protein, 17 aa, Staphylococcus
ERGIIEVAPLAYMRGRT

SEQ ID NO: 2090990 - protein, 23 aa, Staphylococcus
ERLPLIHRWIDGRMPLIGIGSIF

SEQ ID NO: 2090991 - protein, 25 aa, Staphylococcus
ERLRKAIPNILFQILLRASNAVGYK

SEQ ID NO: 2090992 - protein, 23 aa, Staphylococcus
ERLRQFFDFVTNFGLMIKGTGED

SEQ ID NO: 2090993 - protein, 22 aa, Staphylococcus
ERLRQIIKSVYYFAVANPQPEQ

SEQ ID NO: 2090994 - protein, 20 aa, Staphylococcus
ERNMRMPALPRFGMIWKLQK

SEQ ID NO: 2090995 - protein, 25 aa, Staphylococcus
ERPTLKFELFYFDIFRYGTSFITLQ

SEQ ID NO: 2090996 - protein, 22 aa, Staphylococcus
ERVQLLLEWMDGRMPLIGIGSI

SEQ ID NO: 2090997 - protein, 24 aa, Staphylococcus
ERYINLLRLFYALDVYIEQSGPIT

SEQ ID NO: 2090998 - protein, 30 aa, Staphylococcus
ESEYQFFKERLILFTYLHLANEEKLTQALV

SEQ ID NO: 2090999 - protein, 18 aa, Staphylococcus
ESKWWLMSPNELKSKNFS

SEQ ID NO: 2091000 - protein, 25 aa, Staphylococcus
ESTFFDHQLLRRLVAFMYDQPSTII

SEQ ID NO: 2091001 - protein, 25 aa, Staphylococcus
ESTFFDHQLLRRLVAFMYDTPSTLI

SEQ ID NO: 2091002 - protein, 23 aa, Staphylococcus
ESTFFDHQLLRRLVAFMYEQPST

SEQ ID NO: 2091003 - protein, 17 aa, Staphylococcus
ETANIVINWLKANDIKV

SEQ ID NO: 2091004 - protein, 17 aa, Staphylococcus
ETAQVRVLPYAAITVRQ

SEQ ID NO: 2091005 - protein, 17 aa, Staphylococcus
ETGITFAGIPLGHEFNS

SEQ ID NO: 2091006 - protein, 21 aa, Staphylococcus
ETLKLFNPSKLFLATPAIDLE

SEQ ID NO: 2091007 - protein, 22 aa, Staphylococcus
ETLLPSILAYNFAMLWNGNNVA

SEQ ID NO: 2091008 - protein, 21 aa, Staphylococcus
ETNIFGMMFLSQAAVPHLKEG

SEQ ID NO: 2091009 - protein, 21 aa, Staphylococcus
ETNVYPIFWTVQKALEYLQPG

SEQ ID NO: 2091010 - protein, 23 aa, Staphylococcus
ETNVYPVFWTIQKALDYLQPGAS

SEQ ID NO: 2091011 - protein, 23 aa, Staphylococcus
ETNVYPVFWTIQKALDYLQPGAT

SEQ ID NO: 2091012 - protein, 17 aa, Staphylococcus
ETSRFYQYWLDHVDQDL

SEQ ID NO: 2091013 - protein, 21 aa, Staphylococcus
ETTFFDHQLLRRLVAFMYEQP

SEQ ID NO: 2091014 - protein, 22 aa, Staphylococcus
ETTKWLEDYLKYFKGAIIIISH

SEQ ID NO: 2091015 - protein, 25 aa, Staphylococcus
ETTNQYYFHLFSKKQPDLNWDNPEV

SEQ ID NO: 2091016 - protein, 18 aa, Staphylococcus
ETVLEYQPLFIKPNKDEL

SEQ ID NO: 2091017 - protein, 24 aa, Staphylococcus
ETWEGSIYLRPWAGGRVGANEFSF

SEQ ID NO: 2091018 - protein, 21 aa, Staphylococcus
EVAYTCAYLYHPMAQSVTGTV

SEQ ID NO: 2091019 - protein, 18 aa, Staphylococcus
EVEREFLLILMKNNKLDL

SEQ ID NO: 2091020 - protein, 20 aa, Staphylococcus
EVEWIILAGYMRLIGPDLLD

SEQ ID NO: 2091021 - protein, 21 aa, Staphylococcus
EVEWIILAGYMRLIGPDLLDA

SEQ ID NO: 2091022 - protein, 22 aa, Staphylococcus
EVKRRIFLGTFALSSGYYDAFY

SEQ ID NO: 2091023 - protein, 17 aa, Staphylococcus
EVLPSRFPNLLVNGASG

SEQ ID NO: 2091024 - protein, 25 aa, Staphylococcus
EVNKRYDIILLLTKQVFNQQVIPKV

SEQ ID NO: 2091025 - protein, 24 aa, Staphylococcus
EVPIELLPYLFFQFAKDGKRMYDD

SEQ ID NO: 2091026 - protein, 25 aa, Staphylococcus
EVPLDLLPYLFFQFAKYGKRLYDDN

SEQ ID NO: 2091027 - protein, 19 aa, Staphylococcus
EVRAWTFIKGMTAPQCAGI

SEQ ID NO: 2091028 - protein, 18 aa, Staphylococcus
EVYNLIVYQLGALEGFCK

SEQ ID NO: 2091029 - protein, 20 aa, Staphylococcus
EWLLMDLFDWSFTDYVMKRE

SEQ ID NO: 2091030 - protein, 21 aa, Staphylococcus
EWLMLDLFGWSRTDYLIHMYD

SEQ ID NO: 2091031 - protein, 20 aa, Staphylococcus
EWYRVLPLINELPIKDLDKG

SEQ ID NO: 2091032 - protein, 23 aa, Staphylococcus
EYDALLHFDLDTLYRMIDIINDT

SEQ ID NO: 2091033 - protein, 23 aa, Staphylococcus
EYDDCLLFFRLGDFYEMFFDDAK

SEQ ID NO: 2091034 - protein, 19 aa, Staphylococcus
EYFFKLGISTVLITLGEQG

SEQ ID NO: 2091035 - protein, 23 aa, Staphylococcus
EYFNGLYIITPFQRIDYSLELAA

SEQ ID NO: 2091036 - protein, 23 aa, Staphylococcus
EYFNGLYLITPFQKVDYTLELAN

SEQ ID NO: 2091037 - protein, 17 aa, Staphylococcus
EYFTPILNLGETGILGV

SEQ ID NO: 2091038 - protein, 28 aa, Staphylococcus
EYKYFKEGLILFTYLHLANEEKLTQALV

SEQ ID NO: 2091039 - protein, 28 aa, Staphylococcus
EYKYFREGLILFTYLHLANEEKLTQALV

SEQ ID NO: 2091040 - protein, 28 aa, Staphylococcus
EYQYFKEGLILFTYLHLANEEKLTQALI

SEQ ID NO: 2091041 - protein, 28 aa, Staphylococcus
EYQYFKEGLILFTYLHLANEEKLTQALV

SEQ ID NO: 2091042 - protein, 25 aa, Staphylococcus
EYQYFREDLILFTYLHLANDKELTE

SEQ ID NO: 2091043 - protein, 25 aa, Staphylococcus
EYRTLPMVWYCPPLSPIMNYFEGKD

SEQ ID NO: 2091044 - protein, 25 aa, Staphylococcus
EYRTMPMVWYCPPLSPIMSYFEGKG

SEQ ID NO: 2091045 - protein, 25 aa, Staphylococcus
EYRTMPMVWYCPPLSPIMSYFEGKN

SEQ ID NO: 2091046 - protein, 20 aa, Staphylococcus
FAAAFITHFSGQTPHIHFDI

SEQ ID NO: 2091047 - protein, 18 aa, Staphylococcus
FAEGYYLTKEGMEWFWNQ

SEQ ID NO: 2091048 - protein, 18 aa, Staphylococcus
FAGDLFRMYSKYAETLNY

SEQ ID NO: 2091049 - protein, 23 aa, Staphylococcus
FAHHILTYYWMLERDKSRFQDSL

SEQ ID NO: 2091050 - protein, 17 aa, Staphylococcus
FALWPHMTVFQNVAYPL

SEQ ID NO: 2091051 - protein, 20 aa, Staphylococcus
FATVLLRPFLTHAPKEIFKQ

SEQ ID NO: 2091052 - protein, 19 aa, Staphylococcus
FAVQLLFQYLFAQGRLQEA

SEQ ID NO: 2091053 - protein, 17 aa, Staphylococcus
FAWDLNMGGLMNALEAA

SEQ ID NO: 2091054 - protein, 17 aa, Staphylococcus
FAWDLNMGGLMNALEVA

SEQ ID NO: 2091055 - protein, 19 aa, Staphylococcus
FDLIYYRTYTNALMPYNFL

SEQ ID NO: 2091056 - protein, 19 aa, Staphylococcus
FDNFLFSSRAKWGERSGLT

SEQ ID NO: 2091057 - protein, 23 aa, Staphylococcus
FDSDLPYKLIAKLLNDFNKRVDN

SEQ ID NO: 2091058 - protein, 17 aa, Staphylococcus
FEEMKHYFILNFPQRPG

SEQ ID NO: 2091059 - protein, 18 aa, Staphylococcus
FEEMKHYFILNFPQRPGA

SEQ ID NO: 2091060 - protein, 17 aa, Staphylococcus
FEFRWIDQFNLSLDPER

SEQ ID NO: 2091061 - protein, 23 aa, Staphylococcus
FEIITTMMFLYFGEIRPVDFVVI

SEQ ID NO: 2091062 - protein, 18 aa, Staphylococcus
FEKDFYIRLLKQTGFNRI

SEQ ID NO: 2091063 - protein, 23 aa, Staphylococcus
FEMHFYRYVFPYYDTLYTLEQLT

SEQ ID NO: 2091064 - protein, 18 aa, Staphylococcus
FEQLRSFDYIVITDKGLL

SEQ ID NO: 2091065 - protein, 19 aa, Staphylococcus
FERMILLRSIDTHWTDHID

SEQ ID NO: 2091066 - protein, 20 aa, Staphylococcus
FESSLPWWLYMGTQALIHDI

SEQ ID NO: 2091067 - protein, 24 aa, Staphylococcus
FETNIFGMFFLSQAAVPYLSDNDT

SEQ ID NO: 2091068 - protein, 17 aa, Staphylococcus
FEWVIEKDAWYGEELEH

SEQ ID NO: 2091069 - protein, 21 aa, Staphylococcus
FFEEMPTLRWVAWYAAGVNNL

SEQ ID NO: 2091070 - protein, 20 aa, Staphylococcus
FFKHSTLPEQLTIVGGGVIA

SEQ ID NO: 2091071 - protein, 19 aa, Staphylococcus
FFKSLYYRHNKIMYEFATE

SEQ ID NO: 2091072 - protein, 22 aa, Staphylococcus
FFLKYPYIKLASAPILIRKGHT

SEQ ID NO: 2091073 - protein, 18 aa, Staphylococcus
FFLLERLRKAYPDKLIFS

SEQ ID NO: 2091074 - protein, 18 aa, Staphylococcus
FGHMSPFMIVGMIGAIKA

SEQ ID NO: 2091075 - protein, 18 aa, Staphylococcus
FGIKEDVDFIAASFVRRP

SEQ ID NO: 2091076 - protein, 18 aa, Staphylococcus
FGIKENVDFIAASFVRRP

SEQ ID NO: 2091077 - protein, 27 aa, Staphylococcus
FHDKYEWLLEFFPFLDPQQFVFCGRKN

SEQ ID NO: 2091078 - protein, 27 aa, Staphylococcus
FHDKYEWLLEFFPFLNPQHFVFCGRKN

SEQ ID NO: 2091079 - protein, 27 aa, Staphylococcus
FHDKYEWLLEYFPFLDPQHFIFCGRKN

SEQ ID NO: 2091080 - protein, 18 aa, Staphylococcus
FHGIFNEPIACSKINSGL

SEQ ID NO: 2091081 - protein, 21 aa, Staphylococcus
FHIGYLRGLFDKGLDLRKVDY

SEQ ID NO: 2091082 - protein, 17 aa, Staphylococcus
FHLFRKYERRIANKQYD

SEQ ID NO: 2091083 - protein, 23 aa, Staphylococcus
FHSIVWPILLMALDLPLPKRVFA

SEQ ID NO: 2091084 - protein, 20 aa, Staphylococcus
FHTAAPLYYRAEPLGCTATI

SEQ ID NO: 2091085 - protein, 17 aa, Staphylococcus
FHYTPLHKFSYYKSKNL

SEQ ID NO: 2091086 - protein, 19 aa, Staphylococcus
FIANKLRLLKLAPKVKQKL

SEQ ID NO: 2091087 - protein, 20 aa, Staphylococcus
FIDKFKFPYLLGKADYIFVD

SEQ ID NO: 2091088 - protein, 19 aa, Staphylococcus
FIEYLLFQYKFKSRISVWL

SEQ ID NO: 2091089 - protein, 20 aa, Staphylococcus
FIGILLEHFGGNLPLWLAPV

SEQ ID NO: 2091090 - protein, 18 aa, Staphylococcus
FIGIMPIASYNNALFLHN

SEQ ID NO: 2091091 - protein, 17 aa, Staphylococcus
FIKVLKKKGFNIGEPDD

SEQ ID NO: 2091092 - protein, 17 aa, Staphylococcus
FIMKLRIVKFARTPDYN

SEQ ID NO: 2091093 - protein, 17 aa, Staphylococcus
FIMKLRLVKFARTPDYN

SEQ ID NO: 2091094 - protein, 19 aa, Staphylococcus
FINERIIPVIPQQGSLGAS

SEQ ID NO: 2091095 - protein, 19 aa, Staphylococcus
FINGRYIKNFLLNKAILEG

SEQ ID NO: 2091096 - protein, 24 aa, Staphylococcus
FINRDLFKFLPFDGSIITMNELRE

SEQ ID NO: 2091097 - protein, 24 aa, Staphylococcus
FINRDLFKYIPFDGSIITITELQE

SEQ ID NO: 2091098 - protein, 22 aa, Staphylococcus
FINRLFDIDGVKSIFYVMDFIS

SEQ ID NO: 2091099 - protein, 18 aa, Staphylococcus
FINYLMYNVYLIMTTAPS

SEQ ID NO: 2091100 - protein, 17 aa, Staphylococcus
FIPVHKLADTRWKELGQ

SEQ ID NO: 2091101 - protein, 18 aa, Staphylococcus
FISLLKKLSKTKTIILTS

SEQ ID NO: 2091102 - protein, 18 aa, Staphylococcus
FIYPLYWFNVPPIMKSFI

SEQ ID NO: 2091103 - protein, 20 aa, Staphylococcus
FKEQIEEQMFLGLRMNKGVS

SEQ ID NO: 2091104 - protein, 17 aa, Staphylococcus
FKKPVITPIKPYKNFYP

SEQ ID NO: 2091105 - protein, 21 aa, Staphylococcus
FKQIFLMFNPVSKLNWVYKYF

SEQ ID NO: 2091106 - protein, 17 aa, Staphylococcus
FKSFALIPLPFVKESIK

SEQ ID NO: 2091107 - protein, 18 aa, Staphylococcus
FKSYRLLRPLEGNTYKLY

SEQ ID NO: 2091108 - protein, 17 aa, Staphylococcus
FLDKLISVSLPRVRDFQ

SEQ ID NO: 2091109 - protein, 19 aa, Staphylococcus
FLEKYFHTKILDRQLRRVI

SEQ ID NO: 2091110 - protein, 18 aa, Staphylococcus
FLHRFYFETFKIPNIINN

SEQ ID NO: 2091111 - protein, 17 aa, Staphylococcus
FLIMIPTMYYSTIRQDN

SEQ ID NO: 2091112 - protein, 24 aa, Staphylococcus
FLMDKGCLYLPYNGNLLIHGCIPI

SEQ ID NO: 2091113 - protein, 17 aa, Staphylococcus
FLNPDHLPLILGIEKGW

SEQ ID NO: 2091114 - protein, 17 aa, Staphylococcus
FLSILRKLEIHLIAFDE

SEQ ID NO: 2091115 - protein, 17 aa, Staphylococcus
FLSLIKVTGIGPKSALA

SEQ ID NO: 2091116 - protein, 18 aa, Staphylococcus
FLTLNIPMLLIPLGLDQS

SEQ ID NO: 2091117 - protein, 19 aa, Staphylococcus
FLTLPSNVLPKYAFSFLAR

SEQ ID NO: 2091118 - protein, 21 aa, Staphylococcus
FLTRDQYRLYKLIWDRFVASQ

SEQ ID NO: 2091119 - protein, 18 aa, Staphylococcus
FNFVLPYMLQFIENLPVV

SEQ ID NO: 2091120 - protein, 24 aa, Staphylococcus
FNGLKGQGLLLVRNIHNLEPVIHG

SEQ ID NO: 2091121 - protein, 17 aa, Staphylococcus
FNGPLDLLLHLIHKYEI

SEQ ID NO: 2091122 - protein, 19 aa, Staphylococcus
FNIFNFRFMAINAGPYFVK

SEQ ID NO: 2091123 - protein, 24 aa, Staphylococcus
FNKLKIPILLNRFIKKIKPDIVQT

SEQ ID NO: 2091124 - protein, 24 aa, Staphylococcus
FNNLKHFMAFKYIPFFKHYDITKF

SEQ ID NO: 2091125 - protein, 25 aa, Staphylococcus
FNYTGLFRFIQLFVISNKMETRYYA

SEQ ID NO: 2091126 - protein, 22 aa, Staphylococcus
FPARIKCATLAWKALEKGTVER

SEQ ID NO: 2091127 - protein, 18 aa, Staphylococcus
FPWVVAAFPSKDWARRVY

SEQ ID NO: 2091128 - protein, 19 aa, Staphylococcus
FPWVVAAFPTKDWARRVYP

SEQ ID NO: 2091129 - protein, 23 aa, Staphylococcus
FQEKQLIELLTRLGIKLNLPSLD

SEQ ID NO: 2091130 - protein, 17 aa, Staphylococcus
FQILTEIGLLPGALLHN

SEQ ID NO: 2091131 - protein, 17 aa, Staphylococcus
FQKFIVPFIFLFEKEGN

SEQ ID NO: 2091132 - protein, 22 aa, Staphylococcus
FQKLNIEWVYRLLIDWKRIGRM

SEQ ID NO: 2091133 - protein, 20 aa, Staphylococcus
FQLLFLLCGQPKHIFTRDTL

SEQ ID NO: 2091134 - protein, 23 aa, Staphylococcus
FQTNIFGMIFLSQAAVPYLNDGD

SEQ ID NO: 2091135 - protein, 17 aa, Staphylococcus
FQTVYPYMLQFIGDLPV

SEQ ID NO: 2091136 - protein, 17 aa, Staphylococcus
FQYLIENVLKIPYVIDL

SEQ ID NO: 2091137 - protein, 20 aa, Staphylococcus
FQYPMYWMNYPPLLQKWFDE

SEQ ID NO: 2091138 - protein, 21 aa, Staphylococcus
FRKLNIEWVYRLLIDWKRIGR

SEQ ID NO: 2091139 - protein, 24 aa, Staphylococcus
FRKMNLEWVYRLLIDWKRIGRIKA

SEQ ID NO: 2091140 - protein, 22 aa, Staphylococcus
FRNLNMEWVYRLLIDWKRIGRI

SEQ ID NO: 2091141 - protein, 18 aa, Staphylococcus
FRPEFLNRFNGIVEFTHL

SEQ ID NO: 2091142 - protein, 18 aa, Staphylococcus
FRPQLRALLRASAFGKLN

SEQ ID NO: 2091143 - protein, 18 aa, Staphylococcus
FRPQLRALLRASAYGKLN

SEQ ID NO: 2091144 - protein, 19 aa, Staphylococcus
FRRSWWHFDFLENINGVEG

SEQ ID NO: 2091145 - protein, 18 aa, Staphylococcus
FSFAYLLDDGSSYSYLIF

SEQ ID NO: 2091146 - protein, 17 aa, Staphylococcus
FSFLYKPVIYYQFDKER

SEQ ID NO: 2091147 - protein, 18 aa, Staphylococcus
FSKKLRAAIPSLEKIRFV

SEQ ID NO: 2091148 - protein, 17 aa, Staphylococcus
FSNPKLLLPLLDEDFEL

SEQ ID NO: 2091149 - protein, 24 aa, Staphylococcus
FSNPNLLLPLLDEGFELPLVIATT

SEQ ID NO: 2091150 - protein, 18 aa, Staphylococcus
FSNPNLLLPLLDESFELP

SEQ ID NO: 2091151 - protein, 18 aa, Staphylococcus
FSNYRPQFYFRTTDVTGV

SEQ ID NO: 2091152 - protein, 21 aa, Staphylococcus
FTDLLFLNLERAFLSQNFYDV

SEQ ID NO: 2091153 - protein, 19 aa, Staphylococcus
FTFDYVIPKRLAAFVQVGV

SEQ ID NO: 2091154 - protein, 18 aa, Staphylococcus
FTFLLYPESIPENWEMEL

SEQ ID NO: 2091155 - protein, 17 aa, Staphylococcus
FTHFGISGPAALRCSQF

SEQ ID NO: 2091156 - protein, 24 aa, Staphylococcus
FTKLHNFHWYVKGPNFFSLHTKFE

SEQ ID NO: 2091157 - protein, 22 aa, Staphylococcus
FTYTFLGFLPRKEKEKVNILSQ

SEQ ID NO: 2091158 - protein, 18 aa, Staphylococcus
FVDGPLDLTFLFGLVDHL

SEQ ID NO: 2091159 - protein, 17 aa, Staphylococcus
FVFLTYLSAQTSKIALG

SEQ ID NO: 2091160 - protein, 18 aa, Staphylococcus
FVIISFKHRIILIGGTEY

SEQ ID NO: 2091161 - protein, 17 aa, Staphylococcus
FVNKVYLMLNKPKDYIS

SEQ ID NO: 2091162 - protein, 22 aa, Staphylococcus
FVNLLAFIEQFPHYFIGSNADI

SEQ ID NO: 2091163 - protein, 19 aa, Staphylococcus
FVVEGPLWIQVHAFEKGVE

SEQ ID NO: 2091164 - protein, 19 aa, Staphylococcus
FVVPTMLYQFILKGLHTAE

SEQ ID NO: 2091165 - protein, 19 aa, Staphylococcus
FVYGLFIYNKWRGMGTLNS

SEQ ID NO: 2091166 - protein, 19 aa, Staphylococcus
FVYGLFIYNQWRGMGTLNS

SEQ ID NO: 2091167 - protein, 17 aa, Staphylococcus
FVYSRRLPFHAKRFNDW

SEQ ID NO: 2091168 - protein, 18 aa, Staphylococcus
FYAIDWTTFRLVPEDDRH

SEQ ID NO: 2091169 - protein, 18 aa, Staphylococcus
FYIYDGMKWKIDDKGSIR

SEQ ID NO: 2091170 - protein, 18 aa, Staphylococcus
FYMLHKVLFINEKYKKLS

SEQ ID NO: 2091171 - protein, 27 aa, Staphylococcus
GAHIQVLLLTFFFKYMKPLVEAGRVFI

SEQ ID NO: 2091172 - protein, 29 aa, Staphylococcus
GAHIQVLLLTFFFKYMRPLVQAGRVFIAL

SEQ ID NO: 2091173 - protein, 29 aa, Staphylococcus
GAHIRTLLLTFFYRFMRPLIEAGYVYIAQ

SEQ ID NO: 2091174 - protein, 30 aa, Staphylococcus
GAHIRTLLLTFFYRFMRPLLEAGYVYIAQP

SEQ ID NO: 2091175 - protein, 17 aa, Staphylococcus
GAQPPFTYLVPESYLAM

SEQ ID NO: 2091176 - protein, 17 aa, Staphylococcus
GATIPYYFTGHEGPDSV

SEQ ID NO: 2091177 - protein, 28 aa, Staphylococcus
GAVVAWNFPILLASWKLGPALAAGNTVV

SEQ ID NO: 2091178 - protein, 29 aa, Staphylococcus
GAVVAWNFPLLLASWKLAPALAAGNTVVI

SEQ ID NO: 2091179 - protein, 17 aa, Staphylococcus
GDEIAIPLLLGLGLDEF

SEQ ID NO: 2091180 - protein, 18 aa, Staphylococcus
GDEKLMKVLQFLNNYEGE

SEQ ID NO: 2091181 - protein, 19 aa, Staphylococcus
GDLDYLLLDLPPGTGDVAL

SEQ ID NO: 2091182 - protein, 24 aa, Staphylococcus
GDLPTIIRRLLVISYEDIGLASPS

SEQ ID NO: 2091183 - protein, 17 aa, Staphylococcus
GDQQLMLRLIQPKFFLP

SEQ ID NO: 2091184 - protein, 17 aa, Staphylococcus
GDQQLMLRLIQPKYFLP

SEQ ID NO: 2091185 - protein, 24 aa, Staphylococcus
GDQQLMLRLIRPKFFMPIHGEYRM

SEQ ID NO: 2091186 - protein, 22 aa, Staphylococcus
GDRYIRTIFSFLGVPKYKLIAV

SEQ ID NO: 2091187 - protein, 22 aa, Staphylococcus
GDWILPGYRDVPQLIWHGLPLT

SEQ ID NO: 2091188 - protein, 26 aa, Staphylococcus
GDYGFGYDPIFYLPEKNKTMAELTTE

SEQ ID NO: 2091189 - protein, 24 aa, Staphylococcus
GDYQRFVMIAYLDNKVHALYTNQN

SEQ ID NO: 2091190 - protein, 24 aa, Staphylococcus
GEDKLFFFQLFGKVDDITMSTIPM

SEQ ID NO: 2091191 - protein, 23 aa, Staphylococcus
GEKITWRLLYIADPSYMVKPPFF

SEQ ID NO: 2091192 - protein, 22 aa, Staphylococcus
GELKMLLTYQFPLILGNDFAGE

SEQ ID NO: 2091193 - protein, 18 aa, Staphylococcus
GELKQRIYFMYGGKWQRV

SEQ ID NO: 2091194 - protein, 25 aa, Staphylococcus
GEQKRLYLLRLLVHQPNVLLLDEPT

SEQ ID NO: 2091195 - protein, 23 aa, Staphylococcus
GERPTIIRLLDPPLHEFLPNSNN

SEQ ID NO: 2091196 - protein, 24 aa, Staphylococcus
GEYKNKYPLILVHGFFGGVGENRP

SEQ ID NO: 2091197 - protein, 17 aa, Staphylococcus
GEYLIYYDDVLIGGLYD

SEQ ID NO: 2091198 - protein, 24 aa, Staphylococcus
GFEGFFMMNRLNAPFILISDPRIE

SEQ ID NO: 2091199 - protein, 23 aa, Staphylococcus
GFGYDPIFYVPEKGKTMAQLTTT

SEQ ID NO: 2091200 - protein, 22 aa, Staphylococcus
GFGYDPIFYVPEKNKTMAQLSA

SEQ ID NO: 2091201 - protein, 23 aa, Staphylococcus
GFGYDPIFYVPSLNKTMAQLSDS

SEQ ID NO: 2091202 - protein, 18 aa, Staphylococcus
GFIDFYHKRLLLADKQPN

SEQ ID NO: 2091203 - protein, 18 aa, Staphylococcus
GFISLYRALGDFNTTNSN

SEQ ID NO: 2091204 - protein, 18 aa, Staphylococcus
GFVRAQWVFPIQTHENRV

SEQ ID NO: 2091205 - protein, 17 aa, Staphylococcus
GFYDRFLSKFKPNTISL

SEQ ID NO: 2091206 - protein, 22 aa, Staphylococcus
GGEPLLQMPFLEALFKELQANG

SEQ ID NO: 2091207 - protein, 23 aa, Staphylococcus
GGEPLLQMPFLEALFKSLKAYGI

SEQ ID NO: 2091208 - protein, 29 aa, Staphylococcus
GGERALSAIALLFALLKVRSAPFVILDEV

SEQ ID NO: 2091209 - protein, 18 aa, Staphylococcus
GGILFMFALKWLPIEEVK

SEQ ID NO: 2091210 - protein, 28 aa, Staphylococcus
GGMGAKPLIFLKWALPDKAFDALWMGVL

SEQ ID NO: 2091211 - protein, 21 aa, Staphylococcus
GGMLQRLMIALALSLQPKLII

SEQ ID NO: 2091212 - protein, 22 aa, Staphylococcus
GGQLPLFRRLPKRGFTNINRKE

SEQ ID NO: 2091213 - protein, 23 aa, Staphylococcus
GGRLPGGIRIKRAKLRGERSEGM

SEQ ID NO: 2091214 - protein, 17 aa, Staphylococcus
GGVASLFYVLERLNLEG

SEQ ID NO: 2091215 - protein, 23 aa, Staphylococcus
GHILNLYFPFIDVETMLTLLDLS

SEQ ID NO: 2091216 - protein, 19 aa, Staphylococcus
GHLLADIYPINPPKRTHLP

SEQ ID NO: 2091217 - protein, 22 aa, Staphylococcus
GHMSPYMIVGMLASLKAGCGYV

SEQ ID NO: 2091218 - protein, 23 aa, Staphylococcus
GHQRNPFYLLKRANLFALTSHYE

SEQ ID NO: 2091219 - protein, 21 aa, Staphylococcus
GHQSVLIWFTGLSGSGKSTVS

SEQ ID NO: 2091220 - protein, 25 aa, Staphylococcus
GIDELPFGVYKFLKQHPFVYTRTLD

SEQ ID NO: 2091221 - protein, 22 aa, Staphylococcus
GIIKKLFLLGIMANINQSLDEE

SEQ ID NO: 2091222 - protein, 17 aa, Staphylococcus
GIIRDWDAKWYAEKDFS

SEQ ID NO: 2091223 - protein, 17 aa, Staphylococcus
GIKIHLLHLLKGTPMVK

SEQ ID NO: 2091224 - protein, 24 aa, Staphylococcus
GIKLYDVFTILYLIDADLFNVFDA

SEQ ID NO: 2091225 - protein, 22 aa, Staphylococcus
GIVFLIIRFKLLDEVYLLPFSK

SEQ ID NO: 2091226 - protein, 21 aa, Staphylococcus
GIVKKLFLLGIVANINQSLDQ

SEQ ID NO: 2091227 - protein, 23 aa, Staphylococcus
GIVKTYLDLLPRGAFTGKTVLPL

SEQ ID NO: 2091228 - protein, 26 aa, Staphylococcus
GIVPWNAPILVLLRKVIPAIVTGCSV

SEQ ID NO: 2091229 - protein, 22 aa, Staphylococcus
GIWRRFVIIPFDKQIPLKEVDR

SEQ ID NO: 2091230 - protein, 17 aa, Staphylococcus
GIYDYDILVVALGFESE

SEQ ID NO: 2091231 - protein, 27 aa, Staphylococcus
GKGGLLITLARFSAFYGLGVDAKLDVT

SEQ ID NO: 2091232 - protein, 25 aa, Staphylococcus
GKKGVLFWQIIRFIQNTYPKYLLLE

SEQ ID NO: 2091233 - protein, 23 aa, Staphylococcus
GKKLAMHIIPYPPGIPVYLKGER

SEQ ID NO: 2091234 - protein, 21 aa, Staphylococcus
GKKLLFIHYEIENQKLETGIE

SEQ ID NO: 2091235 - protein, 23 aa, Staphylococcus
GKQNGIIVIIKDGDGKEISRQNI

SEQ ID NO: 2091236 - protein, 22 aa, Staphylococcus
GKRIRPLLLIETLKMLSNNSDY

SEQ ID NO: 2091237 - protein, 22 aa, Staphylococcus
GKRIRPVLLLLTLNMLNEDYHK

SEQ ID NO: 2091238 - protein, 23 aa, Staphylococcus
GKRPLICFFSNDLNIHRTKTEKA

SEQ ID NO: 2091239 - protein, 22 aa, Staphylococcus
GKRPMDRILKPLKLMNANINGI

SEQ ID NO: 2091240 - protein, 18 aa, Staphylococcus
GKSAIIESLKRKIKKLEK

SEQ ID NO: 2091241 - protein, 22 aa, Staphylococcus
GKSHAFLLPLIDLINTDIKEPQ

SEQ ID NO: 2091242 - protein, 22 aa, Staphylococcus
GKSHAFLLPLLNSIDTDYKEPQ

SEQ ID NO: 2091243 - protein, 24 aa, Staphylococcus
GKSHAFLLPLMHLIDIDLQEPQVI

SEQ ID NO: 2091244 - protein, 18 aa, Staphylococcus
GKSRSIPIFVFLNDNYEQ

SEQ ID NO: 2091245 - protein, 18 aa, Staphylococcus
GLAAYFFTNDYRTGFHLY

SEQ ID NO: 2091246 - protein, 24 aa, Staphylococcus
GLDYLDLYLIHWPGTDNDLMIDTW

SEQ ID NO: 2091247 - protein, 24 aa, Staphylococcus
GLEGNRLFYLAMAPNFFGVVTDYL

SEQ ID NO: 2091248 - protein, 24 aa, Staphylococcus
GLEPFVDWLLLPKLDVDITTKAAS

SEQ ID NO: 2091249 - protein, 27 aa, Staphylococcus
GLFATYLYPKRMFWIKGQSFAINIDPF

SEQ ID NO: 2091250 - protein, 19 aa, Staphylococcus
GLFGGPLYTFHKIFSLITL

SEQ ID NO: 2091251 - protein, 25 aa, Staphylococcus
GLIYYDGYYYISHQWFPLGAVHGLK

SEQ ID NO: 2091252 - protein, 24 aa, Staphylococcus
GLKGNRLFYLAMAPQFFGVISDYL

SEQ ID NO: 2091253 - protein, 17 aa, Staphylococcus
GLKYYLQLKFPDKDIYA

SEQ ID NO: 2091254 - protein, 18 aa, Staphylococcus
GLLFGFIHVPFIPEQVTD

SEQ ID NO: 2091255 - protein, 18 aa, Staphylococcus
GLLFGFIHVPFIPEQVTT

SEQ ID NO: 2091256 - protein, 17 aa, Staphylococcus
GLLLTLARISAHYQLGL

SEQ ID NO: 2091257 - protein, 24 aa, Staphylococcus
GLQGNRLFYLAMAPQFFGVISDFL

SEQ ID NO: 2091258 - protein, 19 aa, Staphylococcus
GLRLHYIPLTVDRLTGIVS

SEQ ID NO: 2091259 - protein, 18 aa, Staphylococcus
GLRVGIIRDWDAKWYAEK

SEQ ID NO: 2091260 - protein, 17 aa, Staphylococcus
GLRVGIIRDWEAKWYAE

SEQ ID NO: 2091261 - protein, 17 aa, Staphylococcus
GMELFYQTGPQLIASIK

SEQ ID NO: 2091262 - protein, 17 aa, Staphylococcus
GMIFQHFNLLNSKTVFS

SEQ ID NO: 2091263 - protein, 17 aa, Staphylococcus
GMINICFELFDDKIKII

SEQ ID NO: 2091264 - protein, 21 aa, Staphylococcus
GMINLCFELFDDKIKIVISDQ

SEQ ID NO: 2091265 - protein, 22 aa, Staphylococcus
GNEYIDYVLSWGPLILGHKNPQ

SEQ ID NO: 2091266 - protein, 21 aa, Staphylococcus
GNLLFGDKVAVFGAGPIGLLT

SEQ ID NO: 2091267 - protein, 24 aa, Staphylococcus
GNTDAMIKYLLPKATVTTPNLFEA

SEQ ID NO: 2091268 - protein, 17 aa, Staphylococcus
GPGRRKTFAFVNNRPLA

SEQ ID NO: 2091269 - protein, 18 aa, Staphylococcus
GPMLPGFYHIPFPDNYRG

SEQ ID NO: 2091270 - protein, 22 aa, Staphylococcus
GPQDSYLLIRGIKTLGLRMEQI

SEQ ID NO: 2091271 - protein, 20 aa, Staphylococcus
GQHQMWVAQFYPFKNHGQLV

SEQ ID NO: 2091272 - protein, 20 aa, Staphylococcus
GQKYYIIWHGTPLKNMGKDM

SEQ ID NO: 2091273 - protein, 19 aa, Staphylococcus
GRECKFIAVKLPYGVQKDA

SEQ ID NO: 2091274 - protein, 19 aa, Staphylococcus
GRECQFIAVKLPYGVQSDA

SEQ ID NO: 2091275 - protein, 20 aa, Staphylococcus
GRHELMDSVFLWQSGNKYRV

SEQ ID NO: 2091276 - protein, 24 aa, Staphylococcus
GRHELMDSVFLWQSGTKYREMVHN

SEQ ID NO: 2091277 - protein, 24 aa, Staphylococcus
GRHELMDSVFLWQSGTKYRLNVHD

SEQ ID NO: 2091278 - protein, 20 aa, Staphylococcus
GRHELMDSVFLWQSGTKYRV

SEQ ID NO: 2091279 - protein, 24 aa, Staphylococcus
GRHELMDSVFLWQSGTKYRVNVHD

SEQ ID NO: 2091280 - protein, 23 aa, Staphylococcus
GRPRRVGWFDSVVLRHARRVSGI

SEQ ID NO: 2091281 - protein, 23 aa, Staphylococcus
GRYLYLPVHKLPDVKWKDLGQHI

SEQ ID NO: 2091282 - protein, 20 aa, Staphylococcus
GRYYVQRFLARKFGFEVDDI

SEQ ID NO: 2091283 - protein, 23 aa, Staphylococcus
GSDFDVLPLIYQLPNSPIKYHEF

SEQ ID NO: 2091284 - protein, 21 aa, Staphylococcus
GSDIPYLYYYMGPSGKFIKRS

SEQ ID NO: 2091285 - protein, 25 aa, Staphylococcus
GSNIIFYFMPYLYEYGKLLTQNEKN

SEQ ID NO: 2091286 - protein, 23 aa, Staphylococcus
GSQPMDLPFLPFDHKIVLSSDDI

SEQ ID NO: 2091287 - protein, 24 aa, Staphylococcus
GSTYLDIFLAPTQLYVKPILTLKE

SEQ ID NO: 2091288 - protein, 23 aa, Staphylococcus
GTGIALLAFFSAALTRGIDVVLK

SEQ ID NO: 2091289 - protein, 26 aa, Staphylococcus
GTHGFGYDPIFFVPDKKRTMAELTNE

SEQ ID NO: 2091290 - protein, 18 aa, Staphylococcus
GTNFPYANYLPKKNIKAI

SEQ ID NO: 2091291 - protein, 18 aa, Staphylococcus
GTNYPYVDYLPKKNIKAV

SEQ ID NO: 2091292 - protein, 19 aa, Staphylococcus
GTSRSIPIFIFLNDNYEQE

SEQ ID NO: 2091293 - protein, 23 aa, Staphylococcus
GTVNLPMDVSLVKALKLANEHLL

SEQ ID NO: 2091294 - protein, 23 aa, Staphylococcus
GTVNLPMNVSLVKAITLAIDNLN

SEQ ID NO: 2091295 - protein, 17 aa, Staphylococcus
GVCALITPWNFPGAMVA

SEQ ID NO: 2091296 - protein, 25 aa, Staphylococcus
GVDSVFTPIKLRKLVWRRLAKDLKP

SEQ ID NO: 2091297 - protein, 25 aa, Staphylococcus
GVDYFTIHAGLLLHYIPLTVDRLTG

SEQ ID NO: 2091298 - protein, 23 aa, Staphylococcus
GVLYGIGAVLPYMRKQKSGHIIN

SEQ ID NO: 2091299 - protein, 24 aa, Staphylococcus
GVNAGLYLLKFLSSLNLDKSAKDF

SEQ ID NO: 2091300 - protein, 17 aa, Staphylococcus
GVRLVDKLLETFPVHDK

SEQ ID NO: 2091301 - protein, 28 aa, Staphylococcus
GVRPSYSYKLLIILSPSGSYYGGASLNP

SEQ ID NO: 2091302 - protein, 20 aa, Staphylococcus
GVTIPPWNFPFAIMAGTTLA

SEQ ID NO: 2091303 - protein, 21 aa, Staphylococcus
GVTIPPWNFPFAIMAGTTLAP

SEQ ID NO: 2091304 - protein, 22 aa, Staphylococcus
GVTRFRIVPLLIFRAMHYIGDI

SEQ ID NO: 2091305 - protein, 19 aa, Staphylococcus
GWTDIFIFPGFNFKAIDGL

SEQ ID NO: 2091306 - protein, 21 aa, Staphylococcus
GWYSLHLFYAVDWPTLRLVPD

SEQ ID NO: 2091307 - protein, 21 aa, Staphylococcus
GYHVIMDIPLLFENNLQDTVD

SEQ ID NO: 2091308 - protein, 20 aa, Staphylococcus
GYKMLPHFQIGLFRDQLFVM

SEQ ID NO: 2091309 - protein, 21 aa, Staphylococcus
GYNVIMDIPLLFENNLQDTVD

SEQ ID NO: 2091310 - protein, 20 aa, Staphylococcus
GYSMFWSKILLATQSKRKLI

SEQ ID NO: 2091311 - protein, 17 aa, Staphylococcus
GYVLRRLLRRAVRFSQS

SEQ ID NO: 2091312 - protein, 17 aa, Staphylococcus
GYVLRRLLRRAVRFSQT

SEQ ID NO: 2091313 - protein, 18 aa, Staphylococcus
GYVVYFFELACSMSGYQL

SEQ ID NO: 2091314 - protein, 21 aa, Staphylococcus
GYYLTKEGMEWFWNQYTTSEQ

SEQ ID NO: 2091315 - protein, 26 aa, Staphylococcus
HAKDLKMYLLNRQHFLLNDTPINLAS

SEQ ID NO: 2091316 - protein, 23 aa, Staphylococcus
HAVLHLLYARFWHKVLFDLGVVP

SEQ ID NO: 2091317 - protein, 17 aa, Staphylococcus
HCAQPLMKWLNVSSTAR

SEQ ID NO: 2091318 - protein, 17 aa, Staphylococcus
HDGYLIRFEPLQVFKYI

SEQ ID NO: 2091319 - protein, 24 aa, Staphylococcus
HDHIIFQYPLYWYSSPPLMKQYLD

SEQ ID NO: 2091320 - protein, 22 aa, Staphylococcus
HDIPDKLWRISPLKSFWGINKK

SEQ ID NO: 2091321 - protein, 24 aa, Staphylococcus
HDKKGLFIVPLNGLKKWLTPVELW

SEQ ID NO: 2091322 - protein, 25 aa, Staphylococcus
HDKYEWLLQHFPFLDPQHFVFCGRK

SEQ ID NO: 2091323 - protein, 18 aa, Staphylococcus
HDLAFLLLVYPMSEYEGA

SEQ ID NO: 2091324 - protein, 26 aa, Staphylococcus
HDMTKIDYFFLNKFLNIIHIEHELKA

SEQ ID NO: 2091325 - protein, 17 aa, Staphylococcus
HEDLRIRKFIDNELKEA

SEQ ID NO: 2091326 - protein, 21 aa, Staphylococcus
HEFEKHMYAIHTITSLYTTSS

SEQ ID NO: 2091327 - protein, 24 aa, Staphylococcus
HEYFNGLYLITPFQRIDYSLELAA

SEQ ID NO: 2091328 - protein, 20 aa, Staphylococcus
HFIQPDHFYFLPSYMSPLKD

SEQ ID NO: 2091329 - protein, 21 aa, Staphylococcus
HFKGAFPLWMAPVQVNLIGVS

SEQ ID NO: 2091330 - protein, 17 aa, Staphylococcus
HFYLITDAMRAKGMPDG

SEQ ID NO: 2091331 - protein, 17 aa, Staphylococcus
HFYNTIIKYIKKGVLYP

SEQ ID NO: 2091332 - protein, 24 aa, Staphylococcus
HGEKGLFIVPLNGLKKWLTPVEMW

SEQ ID NO: 2091333 - protein, 23 aa, Staphylococcus
HGFGYDPIFYLDDKNKTMAQLSA

SEQ ID NO: 2091334 - protein, 23 aa, Staphylococcus
HGFKTYVALLFFKGALIEDSKNT

SEQ ID NO: 2091335 - protein, 24 aa, Staphylococcus
HGIYEPLMYLYQFVKPFISKYTAI

SEQ ID NO: 2091336 - protein, 21 aa, Staphylococcus
HHELYIYHPYFNSGILPNVKE

SEQ ID NO: 2091337 - protein, 17 aa, Staphylococcus
HHFLRPEIKFDGIDPLV

SEQ ID NO: 2091338 - protein, 22 aa, Staphylococcus
HHVMTYFWMLERDKGRFKDSLK

SEQ ID NO: 2091339 - protein, 22 aa, Staphylococcus
HHVMTYFWMLERDKNRFEDALK

SEQ ID NO: 2091340 - protein, 22 aa, Staphylococcus
HIETTIWYKLLVNLGINSITAL

SEQ ID NO: 2091341 - protein, 19 aa, Staphylococcus
HIGHLLPLLTLRRFQNHGH

SEQ ID NO: 2091342 - protein, 23 aa, Staphylococcus
HIGYRLIWIIPNPYYDKLRHILI

SEQ ID NO: 2091343 - protein, 21 aa, Staphylococcus
HIINLYFPFIDVETMLTLLDL

SEQ ID NO: 2091344 - protein, 19 aa, Staphylococcus
HIINLYLPFVDVETMLTLL

SEQ ID NO: 2091345 - protein, 21 aa, Staphylococcus
HILNLYFPFIDVETLLTLLDL

SEQ ID NO: 2091346 - protein, 21 aa, Staphylococcus
HILNLYFPFIDVETMLTLLDL

SEQ ID NO: 2091347 - protein, 17 aa, Staphylococcus
HIMTYFWMLERDYTRFA

SEQ ID NO: 2091348 - protein, 19 aa, Staphylococcus
HKFLSGLPYIKVLDSYIFV

SEQ ID NO: 2091349 - protein, 17 aa, Staphylococcus
HKITITGILYMLDWLNT

SEQ ID NO: 2091350 - protein, 17 aa, Staphylococcus
HKVGNGPVLILIPGANG

SEQ ID NO: 2091351 - protein, 21 aa, Staphylococcus
HKYLPLLHRYTKLRKELLGIE

SEQ ID NO: 2091352 - protein, 21 aa, Staphylococcus
HKYLPLLHRYTKLRQELLGLD

SEQ ID NO: 2091353 - protein, 17 aa, Staphylococcus
HLFPIEYGLKGLPHIRI

SEQ ID NO: 2091354 - protein, 17 aa, Staphylococcus
HLFYKYLEYVNVKHIAV

SEQ ID NO: 2091355 - protein, 17 aa, Staphylococcus
HLLIQWYSKGIYKFRYH

SEQ ID NO: 2091356 - protein, 20 aa, Staphylococcus
HLNIPIFIGIMPIASYNNAL

SEQ ID NO: 2091357 - protein, 20 aa, Staphylococcus
HLRQFIRLSRFFVDILRRSE

SEQ ID NO: 2091358 - protein, 24 aa, Staphylococcus
HLTNELLQRFKFDKAFISCGSFDK

SEQ ID NO: 2091359 - protein, 18 aa, Staphylococcus
HMASELEFYLFNDSFKDI

SEQ ID NO: 2091360 - protein, 23 aa, Staphylococcus
HMFFGAERLVQMRRFILASSKEE

SEQ ID NO: 2091361 - protein, 17 aa, Staphylococcus
HMKYICLAGLAFNFMCF

SEQ ID NO: 2091362 - protein, 24 aa, Staphylococcus
HNKKGLFIVPLNGLKKWLTPFELW

SEQ ID NO: 2091363 - protein, 23 aa, Staphylococcus
HNKQFDYLLKRYLLNIERENDIS

SEQ ID NO: 2091364 - protein, 19 aa, Staphylococcus
HNRLNLLMAVLEKKESYLL

SEQ ID NO: 2091365 - protein, 17 aa, Staphylococcus
HPFINLLNYILLESIGA

SEQ ID NO: 2091366 - protein, 18 aa, Staphylococcus
HPFQYQNALSLLRKLYLN

SEQ ID NO: 2091367 - protein, 17 aa, Staphylococcus
HPVLFKKAKKITTFDEN

SEQ ID NO: 2091368 - protein, 18 aa, Staphylococcus
HQLYQLPTVSLRFFNVYG

SEQ ID NO: 2091369 - protein, 21 aa, Staphylococcus
HQMWAAQFYPFKSHSQWVTSG

SEQ ID NO: 2091370 - protein, 19 aa, Staphylococcus
HRLIVSNYLAAHGWRVLHI

SEQ ID NO: 2091371 - protein, 24 aa, Staphylococcus
HRVDVAHIVLAFYLTKPSLDIVIP

SEQ ID NO: 2091372 - protein, 17 aa, Staphylococcus
HSKYLYYFLIDQKTVNY

SEQ ID NO: 2091373 - protein, 28 aa, Staphylococcus
HTEPTYLIYMLGFMPGFPYLGGLDERLY

SEQ ID NO: 2091374 - protein, 28 aa, Staphylococcus
HTQQAYLIYMLGFMPGFPYLGGLDKRIH

SEQ ID NO: 2091375 - protein, 17 aa, Staphylococcus
HVGSWRYKFFKEREGKY

SEQ ID NO: 2091376 - protein, 22 aa, Staphylococcus
HVPSTIVYLPEYIRILKGGFKD

SEQ ID NO: 2091377 - protein, 17 aa, Staphylococcus
HVYLKSHYFIYKKLLNT

SEQ ID NO: 2091378 - protein, 17 aa, Staphylococcus
HWYQWLKHNLALEGYNV

SEQ ID NO: 2091379 - protein, 24 aa, Staphylococcus
HYANRLFFELQSEGYIPIIAHPER

SEQ ID NO: 2091380 - protein, 17 aa, Staphylococcus
HYDLPVFIINYPTSIKP

SEQ ID NO: 2091381 - protein, 17 aa, Staphylococcus
HYFTIVPLLLFSGRHYL

SEQ ID NO: 2091382 - protein, 17 aa, Staphylococcus
HYRFGIHIALHYLSFKK

SEQ ID NO: 2091383 - protein, 24 aa, Staphylococcus
HYTKRLFFDLQSNGYIPIIAHPER

SEQ ID NO: 2091384 - protein, 26 aa, Staphylococcus
IADKKALFIVYANPLALGLLTPPGTF

SEQ ID NO: 2091385 - protein, 18 aa, Staphylococcus
IAEHAFVPHFTIAQGLSS

SEQ ID NO: 2091386 - protein, 23 aa, Staphylococcus
IAEKNFFHFFRNFFTQKWEREVD

SEQ ID NO: 2091387 - protein, 24 aa, Staphylococcus
IAGPGFINFYLDNQYLTAVIPEAI

SEQ ID NO: 2091388 - protein, 23 aa, Staphylococcus
IAGPGFINFYLDNQYLTAVISEA

SEQ ID NO: 2091389 - protein, 24 aa, Staphylococcus
IAGPGFINFYLNNQYLTAVIPEAL

SEQ ID NO: 2091390 - protein, 17 aa, Staphylococcus
IALPLDFPGLFKGYYKD

SEQ ID NO: 2091391 - protein, 20 aa, Staphylococcus
IANIVLAFYLTRPALDVVIP

SEQ ID NO: 2091392 - protein, 19 aa, Staphylococcus
IANVVLAFYLTRPALDVVI

SEQ ID NO: 2091393 - protein, 19 aa, Staphylococcus
IANVVLAFYLTRPSLDVVI

SEQ ID NO: 2091394 - protein, 17 aa, Staphylococcus
IAPFGASIPYYFTGHEG

SEQ ID NO: 2091395 - protein, 18 aa, Staphylococcus
IAPFGATIPYYFTGHEGP

SEQ ID NO: 2091396 - protein, 21 aa, Staphylococcus
IAPHPFINVLLHALLQTSGAQ

SEQ ID NO: 2091397 - protein, 17 aa, Staphylococcus
IAQFWIQQMLNNGLLED

SEQ ID NO: 2091398 - protein, 19 aa, Staphylococcus
IARRLLVISYEDIGLASPG

SEQ ID NO: 2091399 - protein, 18 aa, Staphylococcus
IASWLVDLIHFNTTYFSK

SEQ ID NO: 2091400 - protein, 19 aa, Staphylococcus
IATELLWFIKGDTNIKYLL

SEQ ID NO: 2091401 - protein, 19 aa, Staphylococcus
IATELLWFIKGDTNIQYLL

SEQ ID NO: 2091402 - protein, 17 aa, Staphylococcus
ICFELFDDKIKIIISDQ

SEQ ID NO: 2091403 - protein, 19 aa, Staphylococcus
ICGKKVLFIHYEIANDKLS

SEQ ID NO: 2091404 - protein, 26 aa, Staphylococcus
IDEGKLADIILWEPAFFGVKPDVIVK

SEQ ID NO: 2091405 - protein, 23 aa, Staphylococcus
IDESKLNFLWVTDWPLLEYDEDA

SEQ ID NO: 2091406 - protein, 25 aa, Staphylococcus
IDKDGYIYFTPIGGWWNQVMLSQKV

SEQ ID NO: 2091407 - protein, 24 aa, Staphylococcus
IDKTFQFLYNDFFYLGFIFNYYFT

SEQ ID NO: 2091408 - protein, 18 aa, Staphylococcus
IDKYGIAPFILANKQKNI

SEQ ID NO: 2091409 - protein, 18 aa, Staphylococcus
IDLFLIHWPCEKDGLYIE

SEQ ID NO: 2091410 - protein, 18 aa, Staphylococcus
IDLIFIMMRYLPTTNIQA

SEQ ID NO: 2091411 - protein, 21 aa, Staphylococcus
IDLPMFKLYSEGYKITRVERR

SEQ ID NO: 2091412 - protein, 24 aa, Staphylococcus
IDNEGFIKFQPIGGWWSQVMLSQK

SEQ ID NO: 2091413 - protein, 18 aa, Staphylococcus
IDNFRWAGVPFYIRTGKR

SEQ ID NO: 2091414 - protein, 23 aa, Staphylococcus
IDRQLFYQFIMRLPDEVFRLKGF

SEQ ID NO: 2091415 - protein, 22 aa, Staphylococcus
IDRTQLILEIFALRARSREGKL

SEQ ID NO: 2091416 - protein, 20 aa, Staphylococcus
IDSLSYYQFFILKLVVGEKR

SEQ ID NO: 2091417 - protein, 22 aa, Staphylococcus
IDSLSYYQFYILKLVVGKKRIE

SEQ ID NO: 2091418 - protein, 21 aa, Staphylococcus
IDSYNLWWYGGIEGKTISVNI

SEQ ID NO: 2091419 - protein, 20 aa, Staphylococcus
IDVFRIFDSLNWLDQMKVAN

SEQ ID NO: 2091420 - protein, 26 aa, Staphylococcus
IDVPLDLLPYLFFQFAKDGKRLYEDN

SEQ ID NO: 2091421 - protein, 26 aa, Staphylococcus
IEDKKALFIVYANPLALGLLTPPGSF

SEQ ID NO: 2091422 - protein, 21 aa, Staphylococcus
IEEKIWYKLLVNLGINSITAL

SEQ ID NO: 2091423 - protein, 23 aa, Staphylococcus
IEFYKLYLLLVHLVKFGLMYESS

SEQ ID NO: 2091424 - protein, 23 aa, Staphylococcus
IEHNAHVLVIFQGPDAYISSTWY

SEQ ID NO: 2091425 - protein, 26 aa, Staphylococcus
IEIPIDLLPYLFFQFAKDGKRLYEDY

SEQ ID NO: 2091426 - protein, 26 aa, Staphylococcus
IEIPLELLPYLFFQFAKDGKRLYDDN

SEQ ID NO: 2091427 - protein, 27 aa, Staphylococcus
IEIPVELLPYLFFQFAKDGKRLYSDNA

SEQ ID NO: 2091428 - protein, 17 aa, Staphylococcus
IEIVLSWKLNRISRSMR

SEQ ID NO: 2091429 - protein, 26 aa, Staphylococcus
IEKGKLADLVLWNPAFFGVKPELVVK

SEQ ID NO: 2091430 - protein, 27 aa, Staphylococcus
IEKLDYLHFLGVDYIWLTPIYESPMND

SEQ ID NO: 2091431 - protein, 29 aa, Staphylococcus
IEKMDYLEYLGVGYLWLTPVYQSPMNDNG

SEQ ID NO: 2091432 - protein, 26 aa, Staphylococcus
IENKKALFIVYANPLALGLLTPPGSF

SEQ ID NO: 2091433 - protein, 26 aa, Staphylococcus
IENKKALFIVYSNPLALGVLTPPGQF

SEQ ID NO: 2091434 - protein, 17 aa, Staphylococcus
IENRPMMYLALSYDHRI

SEQ ID NO: 2091435 - protein, 23 aa, Staphylococcus
IENRPMMYLALSYDHRIIDGKEA

SEQ ID NO: 2091436 - protein, 25 aa, Staphylococcus
IEQFRQLFILPQGEFKKFLFSKSSA

SEQ ID NO: 2091437 - protein, 23 aa, Staphylococcus
IERLLKLKWWQYGFADFKGVTAD

SEQ ID NO: 2091438 - protein, 26 aa, Staphylococcus
IESGKLADLVLWDPAFFGVKPELVVK

SEQ ID NO: 2091439 - protein, 22 aa, Staphylococcus
IETSNIVIQWLKGLNLEVDLLN

SEQ ID NO: 2091440 - protein, 25 aa, Staphylococcus
IEYVDKVYIMLNKPAGYISATEDEE

SEQ ID NO: 2091441 - protein, 20 aa, Staphylococcus
IFGRYWNFWCNGNAIHMAWY

SEQ ID NO: 2091442 - protein, 17 aa, Staphylococcus
IFHYFQPKFMLGMTATP

SEQ ID NO: 2091443 - protein, 19 aa, Staphylococcus
IFIDLIFSPIYFNILIKPE

SEQ ID NO: 2091444 - protein, 18 aa, Staphylococcus
IFINHDCYFMDGGKIFIG

SEQ ID NO: 2091445 - protein, 17 aa, Staphylococcus
IFKIIYNGPLRIMVQHQ

SEQ ID NO: 2091446 - protein, 23 aa, Staphylococcus
IFKKPIITPVLPYKNFYPAEDYH

SEQ ID NO: 2091447 - protein, 23 aa, Staphylococcus
IFKKPVITPILPYKNFYPAEDYH

SEQ ID NO: 2091448 - protein, 17 aa, Staphylococcus
IFKVETLFPYITLSHFC

SEQ ID NO: 2091449 - protein, 18 aa, Staphylococcus
IFLWLKTPPNFDGESFVD

SEQ ID NO: 2091450 - protein, 18 aa, Staphylococcus
IFNDIEWVIVSLGAKGMF

SEQ ID NO: 2091451 - protein, 24 aa, Staphylococcus
IFNSLAMPFIALYRMNTIGKGILV

SEQ ID NO: 2091452 - protein, 17 aa, Staphylococcus
IFNTELLSWIEQRGLDI

SEQ ID NO: 2091453 - protein, 18 aa, Staphylococcus
IFVDDFHPLLYTVKFRKS

SEQ ID NO: 2091454 - protein, 18 aa, Staphylococcus
IFVNINFFKTLMSKVNYS

SEQ ID NO: 2091455 - protein, 17 aa, Staphylococcus
IGDFIKPLRPWLYKFYL

SEQ ID NO: 2091456 - protein, 19 aa, Staphylococcus
IGKKLLLHLFDYAKQKGYK

SEQ ID NO: 2091457 - protein, 22 aa, Staphylococcus
IGKYPPYYFLINFTISHVNMKE

SEQ ID NO: 2091458 - protein, 24 aa, Staphylococcus
IGLNAGLFLIHFLNELNLDSQAAK

SEQ ID NO: 2091459 - protein, 24 aa, Staphylococcus
IGQRRLFEWLRQNGFLIKRKGVDY

SEQ ID NO: 2091460 - protein, 17 aa, Staphylococcus
IGSFLFGGNFDSPKFKL

SEQ ID NO: 2091461 - protein, 24 aa, Staphylococcus
IGTGVTIPPWNFPFAIMAGTTLAP

SEQ ID NO: 2091462 - protein, 18 aa, Staphylococcus
IHFPKEHLLPYKLKDHPP

SEQ ID NO: 2091463 - protein, 17 aa, Staphylococcus
IHHIPFPDSYRGMFNST

SEQ ID NO: 2091464 - protein, 17 aa, Staphylococcus
IHKIKYAGAMFLGPYAP

SEQ ID NO: 2091465 - protein, 20 aa, Staphylococcus
IHKRFYLFVALMTEFQALNG

SEQ ID NO: 2091466 - protein, 17 aa, Staphylococcus
IHLIYRKLNKNSAYLGT

SEQ ID NO: 2091467 - protein, 17 aa, Staphylococcus
IIDHRLDYALDLADNIY

SEQ ID NO: 2091468 - protein, 20 aa, Staphylococcus
IIDIEVLFPYITLAHFGKKV

SEQ ID NO: 2091469 - protein, 18 aa, Staphylococcus
IIFIIKHLSYRNGRNNDV

SEQ ID NO: 2091470 - protein, 20 aa, Staphylococcus
IIHFALAEMLYFDGQYLRAT

SEQ ID NO: 2091471 - protein, 18 aa, Staphylococcus
IIHYALAELLYYDGQYLR

SEQ ID NO: 2091472 - protein, 24 aa, Staphylococcus
IIKAFDIYLKKGYSSKLLVYGKDK

SEQ ID NO: 2091473 - protein, 22 aa, Staphylococcus
IIKIEMHFLPDVYVPCEVCGGT

SEQ ID NO: 2091474 - protein, 18 aa, Staphylococcus
IIKLTWWDDKKYTDEVIA

SEQ ID NO: 2091475 - protein, 24 aa, Staphylococcus
IIKRHRLLELFLIEILKYNWEEVH

SEQ ID NO: 2091476 - protein, 17 aa, Staphylococcus
IILLLDYLYIDQAAFIG

SEQ ID NO: 2091477 - protein, 20 aa, Staphylococcus
IILLLDYLYIEQAAFIGHEL

SEQ ID NO: 2091478 - protein, 19 aa, Staphylococcus
IISRLYFLNNVGLDYLTLN

SEQ ID NO: 2091479 - protein, 17 aa, Staphylococcus
IIWHGTPLKNMGKDMEV

SEQ ID NO: 2091480 - protein, 23 aa, Staphylococcus
IKALRPFYYPLNKLFSISEMIKK

SEQ ID NO: 2091481 - protein, 24 aa, Staphylococcus
IKAMKILALYIRKNYRNPIVCITG

SEQ ID NO: 2091482 - protein, 18 aa, Staphylococcus
IKASMVGTFFLQDSKELT

SEQ ID NO: 2091483 - protein, 24 aa, Staphylococcus
IKASRLDFTIIKPSFFMDNFLRIT

SEQ ID NO: 2091484 - protein, 27 aa, Staphylococcus
IKFTEKWYFPLQPFQKFIVPFIFLFEK

SEQ ID NO: 2091485 - protein, 21 aa, Staphylococcus
IKGYAWEFLYYSPELETLPKD

SEQ ID NO: 2091486 - protein, 19 aa, Staphylococcus
IKHHQFPHILAANPPLYDS

SEQ ID NO: 2091487 - protein, 18 aa, Staphylococcus
IKIDRYPIFVPNALIGEV

SEQ ID NO: 2091488 - protein, 21 aa, Staphylococcus
IKNFRVTKIFGFFGLKREEVN

SEQ ID NO: 2091489 - protein, 26 aa, Staphylococcus
IKNKKTLFIVYTNPLSLGLLTPPGDF

SEQ ID NO: 2091490 - protein, 19 aa, Staphylococcus
IKPSFFMDNFLRITKVENG

SEQ ID NO: 2091491 - protein, 23 aa, Staphylococcus
IKRKFTLDYYLRPFVQTKIKGWV

SEQ ID NO: 2091492 - protein, 21 aa, Staphylococcus
IKSLIDLFLIWSKEVLLKSDI

SEQ ID NO: 2091493 - protein, 17 aa, Staphylococcus
IKSLYNDILIDLNLDKI

SEQ ID NO: 2091494 - protein, 18 aa, Staphylococcus
IKSPMVGTFFLQDSKELT

SEQ ID NO: 2091495 - protein, 23 aa, Staphylococcus
IKVKPGDFYFIPAGTIHSIGAGI

SEQ ID NO: 2091496 - protein, 25 aa, Staphylococcus
IKVQDVMFLLLYALKDLGAQLNMDP

SEQ ID NO: 2091497 - protein, 17 aa, Staphylococcus
IKYLGVDYIWLTPIYES

SEQ ID NO: 2091498 - protein, 22 aa, Staphylococcus
IKYPAIPSVLYSLPRLSQIGVT

SEQ ID NO: 2091499 - protein, 17 aa, Staphylococcus
ILESLRPILLQYAKERT

SEQ ID NO: 2091500 - protein, 28 aa, Staphylococcus
ILHLSFDFLILDWTSIWILLKSFESAYF

SEQ ID NO: 2091501 - protein, 17 aa, Staphylococcus
ILHNILQSIYLLADGMQ

SEQ ID NO: 2091502 - protein, 17 aa, Staphylococcus
ILKFVKKGVLYPLSYYD

SEQ ID NO: 2091503 - protein, 17 aa, Staphylococcus
ILLAFGKNKQQAIKALL

SEQ ID NO: 2091504 - protein, 17 aa, Staphylococcus
ILLFPIEGQLILQHFTK

SEQ ID NO: 2091505 - protein, 17 aa, Staphylococcus
ILLFPIEGSLEIQHFAK

SEQ ID NO: 2091506 - protein, 18 aa, Staphylococcus
ILLPLYKKGKFASIQMFN

SEQ ID NO: 2091507 - protein, 19 aa, Staphylococcus
ILLTPLFPTYFFPTHSDRQ

SEQ ID NO: 2091508 - protein, 18 aa, Staphylococcus
ILMYNYLKHFDIPTLVIC

SEQ ID NO: 2091509 - protein, 17 aa, Staphylococcus
ILPLDYAYDFLKFCFKN

SEQ ID NO: 2091510 - protein, 19 aa, Staphylococcus
ILQPIVLRKTISGYHIVVG

SEQ ID NO: 2091511 - protein, 18 aa, Staphylococcus
ILSFLRTIDNPLQDIYLV

SEQ ID NO: 2091512 - protein, 26 aa, Staphylococcus
ILTSIPLWKNQMAIALTLMRQRNAVS

SEQ ID NO: 2091513 - protein, 26 aa, Staphylococcus
ILTSIPLWKNQMAIALTLMRQRQAMS

SEQ ID NO: 2091514 - protein, 18 aa, Staphylococcus
ILYDRLVNPLILQYSSFQ

SEQ ID NO: 2091515 - protein, 17 aa, Staphylococcus
IMGHLDFLIAKARYARA

SEQ ID NO: 2091516 - protein, 18 aa, Staphylococcus
IMHLLIQGECSVGHIAHT

SEQ ID NO: 2091517 - protein, 26 aa, Staphylococcus
IMIGTNFPFVKYLPKKNIKAIQIDTK

SEQ ID NO: 2091518 - protein, 23 aa, Staphylococcus
INELAWHNLFAHNMFIRPESKEE

SEQ ID NO: 2091519 - protein, 18 aa, Staphylococcus
INERIIPVIPQQGSLGAS

SEQ ID NO: 2091520 - protein, 17 aa, Staphylococcus
INEVGIPVVFIINQIDK

SEQ ID NO: 2091521 - protein, 17 aa, Staphylococcus
INICFELFDDKIKIIIS

SEQ ID NO: 2091522 - protein, 18 aa, Staphylococcus
INIRKICVLLWKKNSRKK

SEQ ID NO: 2091523 - protein, 23 aa, Staphylococcus
INKPLWMNPLLKLYQLAPRKIEK

SEQ ID NO: 2091524 - protein, 22 aa, Staphylococcus
INKQIFLMFNPVSKLNWVYKYF

SEQ ID NO: 2091525 - protein, 18 aa, Staphylococcus
INNVLAFPGIFRGALDVE

SEQ ID NO: 2091526 - protein, 19 aa, Staphylococcus
INNVLAFPGIFRGALEVEA

SEQ ID NO: 2091527 - protein, 23 aa, Staphylococcus
INRDLFKYIPFDGSIITITELQD

SEQ ID NO: 2091528 - protein, 23 aa, Staphylococcus
INRDLFKYIPFDGSIITITELQE

SEQ ID NO: 2091529 - protein, 17 aa, Staphylococcus
INRLQWMKDVLGPVLGK

SEQ ID NO: 2091530 - protein, 19 aa, Staphylococcus
INSILMSLLYKNHPEELRL

SEQ ID NO: 2091531 - protein, 17 aa, Staphylococcus
INWLINYVKQYPYTVLF

SEQ ID NO: 2091532 - protein, 18 aa, Staphylococcus
IPIFIFLNDNYEQETVWG

SEQ ID NO: 2091533 - protein, 18 aa, Staphylococcus
IPILLAISYLHQALIIEN

SEQ ID NO: 2091534 - protein, 19 aa, Staphylococcus
IQFALYKRKIPLVLVFEGM

SEQ ID NO: 2091535 - protein, 22 aa, Staphylococcus
IQPGQWIGIFGIGGLGNLALQY

SEQ ID NO: 2091536 - protein, 30 aa, Staphylococcus
IQSSILTSIPLWKNQMSIALTLMRQRNAVS

SEQ ID NO: 2091537 - protein, 17 aa, Staphylococcus
IQYPAIPSVLYSLPRLS

SEQ ID NO: 2091538 - protein, 25 aa, Staphylococcus
IRDEDIWMLFGTLPIYPCINDENDQ

SEQ ID NO: 2091539 - protein, 22 aa, Staphylococcus
IRDKFMIQLLYETGLRIGELLS

SEQ ID NO: 2091540 - protein, 25 aa, Staphylococcus
IRHDDVWMLFGTLPIYPCINDEDDQ

SEQ ID NO: 2091541 - protein, 19 aa, Staphylococcus
IRPVLLLLTLDMLNEDYRQ

SEQ ID NO: 2091542 - protein, 26 aa, Staphylococcus
IRRTNWIITTWWRPQAYYDQSSWRAT

SEQ ID NO: 2091543 - protein, 19 aa, Staphylococcus
IRYARYLNELSDETQFIVI

SEQ ID NO: 2091544 - protein, 18 aa, Staphylococcus
IRYDLQIGVLPLPRSTNP

SEQ ID NO: 2091545 - protein, 26 aa, Staphylococcus
ISKARFEFRWIDQFNLALDPDRAREF

SEQ ID NO: 2091546 - protein, 24 aa, Staphylococcus
ISKYTFFLTTFYYTLLHITGEDYF

SEQ ID NO: 2091547 - protein, 21 aa, Staphylococcus
ISLLDDILPYDFELALDANES

SEQ ID NO: 2091548 - protein, 18 aa, Staphylococcus
ISSPMVGTFFLQDSKELT

SEQ ID NO: 2091549 - protein, 23 aa, Staphylococcus
ISVWKQFKSVFYFGTFDSPKQHD

SEQ ID NO: 2091550 - protein, 19 aa, Staphylococcus
ITALWLKQTPLLQNREREW

SEQ ID NO: 2091551 - protein, 18 aa, Staphylococcus
ITDKWIIQIAYDKLIIMA

SEQ ID NO: 2091552 - protein, 26 aa, Staphylococcus
ITEDQMIDFLFTAALFGRVVANNASV

SEQ ID NO: 2091553 - protein, 19 aa, Staphylococcus
ITEFAVLELLFHKGPQQVQ

SEQ ID NO: 2091554 - protein, 20 aa, Staphylococcus
ITFAGIPLGHEFNSLVLAIL

SEQ ID NO: 2091555 - protein, 21 aa, Staphylococcus
ITNCLPVYKILLEKQTTNFRV

SEQ ID NO: 2091556 - protein, 20 aa, Staphylococcus
ITQFRIVPLLIFRAMHYIGD

SEQ ID NO: 2091557 - protein, 18 aa, Staphylococcus
ITTPILLNLMQQKLPIDG

SEQ ID NO: 2091558 - protein, 17 aa, Staphylococcus
ITTPLNVFYFTGYLSEP

SEQ ID NO: 2091559 - protein, 19 aa, Staphylococcus
IVAHPFHPVYILPLVEIVP

SEQ ID NO: 2091560 - protein, 29 aa, Staphylococcus
IVDLPIIPIWVSRYWVQLISKVPKEMVYP

SEQ ID NO: 2091561 - protein, 18 aa, Staphylococcus
IVLPRIKITYLYTRIEKL

SEQ ID NO: 2091562 - protein, 18 aa, Staphylococcus
IVLPRMRITYLYHRTQKL

SEQ ID NO: 2091563 - protein, 17 aa, Staphylococcus
IVPLPKGLTLEEAMIYG

SEQ ID NO: 2091564 - protein, 17 aa, Staphylococcus
IVRLLDPPLHEFLPSSD

SEQ ID NO: 2091565 - protein, 19 aa, Staphylococcus
IVRRLLVISFEDVGLASPS

SEQ ID NO: 2091566 - protein, 19 aa, Staphylococcus
IVRRLLVISYEDIGLASPG

SEQ ID NO: 2091567 - protein, 24 aa, Staphylococcus
IVTLQFLFIPPLSWSNKKRLAMVG

SEQ ID NO: 2091568 - protein, 22 aa, Staphylococcus
IVWLFNHILFDGWSLSILINEM

SEQ ID NO: 2091569 - protein, 18 aa, Staphylococcus
IVYIPYKTPILIAAEKKG

SEQ ID NO: 2091570 - protein, 17 aa, Staphylococcus
IYDYIRLLYARVGKAFC

SEQ ID NO: 2091571 - protein, 18 aa, Staphylococcus
IYEISKRTVLYLINKDIN

SEQ ID NO: 2091572 - protein, 17 aa, Staphylococcus
IYFVLKETPFYAVSGGQ

SEQ ID NO: 2091573 - protein, 20 aa, Staphylococcus
IYLIKSLYKSTFWKIVKEDA

SEQ ID NO: 2091574 - protein, 17 aa, Staphylococcus
IYPLYWLNMPMLLKGFI

SEQ ID NO: 2091575 - protein, 22 aa, Staphylococcus
KADYNMFLPFTVTGNVIGKATE

SEQ ID NO: 2091576 - protein, 18 aa, Staphylococcus
KAIKPWILPNFESLVNHE

SEQ ID NO: 2091577 - protein, 19 aa, Staphylococcus
KAKKPVIIYFYGGGFINGH

SEQ ID NO: 2091578 - protein, 21 aa, Staphylococcus
KAKSLSCQFAFYGHTHVAKYE

SEQ ID NO: 2091579 - protein, 17 aa, Staphylococcus
KALKLFYKMPMPQWGGD

SEQ ID NO: 2091580 - protein, 21 aa, Staphylococcus
KALMKWPIPRRMLWLRKVQST

SEQ ID NO: 2091581 - protein, 21 aa, Staphylococcus
KANLIRFIFEEGFIALRPSGT

SEQ ID NO: 2091582 - protein, 22 aa, Staphylococcus
KAQALGCQFAFYGHTHIAKYEK

SEQ ID NO: 2091583 - protein, 17 aa, Staphylococcus
KAQQLMDVFWPGPISFI

SEQ ID NO: 2091584 - protein, 24 aa, Staphylococcus
KARTWLFQITLPHFLSHEDYLLFT

SEQ ID NO: 2091585 - protein, 20 aa, Staphylococcus
KAVAEGLKAYPLLNSSWQDS

SEQ ID NO: 2091586 - protein, 17 aa, Staphylococcus
KAYQLQYSKAYKGYMEA

SEQ ID NO: 2091587 - protein, 17 aa, Staphylococcus
KCQSFMISVAFITESGL

SEQ ID NO: 2091588 - protein, 20 aa, Staphylococcus
KDAILYIETIFPMITIQNFK

SEQ ID NO: 2091589 - protein, 23 aa, Staphylococcus
KDARNYLSFLYSKGLKRTTVSRK

SEQ ID NO: 2091590 - protein, 24 aa, Staphylococcus
KDARNYLSFLYSKNLKRTTVSRKI

SEQ ID NO: 2091591 - protein, 24 aa, Staphylococcus
KDARNYLSYLYSKNLKRTSVSRKI

SEQ ID NO: 2091592 - protein, 25 aa, Staphylococcus
KDDTTMPAFWFDPIVNLTAISQVTN

SEQ ID NO: 2091593 - protein, 21 aa, Staphylococcus
KDFESFINQFEWHDASFPIVQ

SEQ ID NO: 2091594 - protein, 22 aa, Staphylococcus
KDGRLFICYLGDFKTTGGIFST

SEQ ID NO: 2091595 - protein, 20 aa, Staphylococcus
KDGYWWCRFKFDNKGEYFYV

SEQ ID NO: 2091596 - protein, 20 aa, Staphylococcus
KDIELLRIMGMPFGRKTIEK

SEQ ID NO: 2091597 - protein, 18 aa, Staphylococcus
KDIIELFLDSGLGKEAFS

SEQ ID NO: 2091598 - protein, 17 aa, Staphylococcus
KDILINEYIYFASKNKK

SEQ ID NO: 2091599 - protein, 25 aa, Staphylococcus
KDKRNFLYLELLKVIELKKPKFFVA

SEQ ID NO: 2091600 - protein, 18 aa, Staphylococcus
KDLFQYIESLFARPISPY

SEQ ID NO: 2091601 - protein, 19 aa, Staphylococcus
KDLNWIYLVKHLRQAGVTI

SEQ ID NO: 2091602 - protein, 24 aa, Staphylococcus
KDLVESVLGYHPLFIKPNKDELEV

SEQ ID NO: 2091603 - protein, 18 aa, Staphylococcus
KDMTFIGQPLWGSIGYTL

SEQ ID NO: 2091604 - protein, 25 aa, Staphylococcus
KDNPGLFKRLIASTFFLKMNEKQQP

SEQ ID NO: 2091605 - protein, 24 aa, Staphylococcus
KDTVYNIPFLWRLTSELNVNQLQR

SEQ ID NO: 2091606 - protein, 23 aa, Staphylococcus
KDVKLPVIFWMHGGGFIAGDKQY

SEQ ID NO: 2091607 - protein, 23 aa, Staphylococcus
KDWKYPRRILWLRKVQSTIKDSL

SEQ ID NO: 2091608 - protein, 23 aa, Staphylococcus
KEEILILLTLWQKGSMTLKEMDS

SEQ ID NO: 2091609 - protein, 21 aa, Staphylococcus
KEFAKILFWTLKTKPLEKITI

SEQ ID NO: 2091610 - protein, 21 aa, Staphylococcus
KEFDLLWYLATHENVALSKTD

SEQ ID NO: 2091611 - protein, 23 aa, Staphylococcus
KEFQLLFLLCTHPRQIYTRESII

SEQ ID NO: 2091612 - protein, 26 aa, Staphylococcus
KEGYNLTFFAFFVKAVADALKANPIL

SEQ ID NO: 2091613 - protein, 17 aa, Staphylococcus
KEIAPMTYFIHDEYILS

SEQ ID NO: 2091614 - protein, 24 aa, Staphylococcus
KEIKSLLQMLLLYAIPDPIISDSE

SEQ ID NO: 2091615 - protein, 23 aa, Staphylococcus
KEIMPLFDKSLPYYKEFIKEVAQ

SEQ ID NO: 2091616 - protein, 21 aa, Staphylococcus
KEIYNLVVYQLGALDGFCKVH

SEQ ID NO: 2091617 - protein, 23 aa, Staphylococcus
KEIYNLVVYQLGALNGFCKIHGT

SEQ ID NO: 2091618 - protein, 18 aa, Staphylococcus
KENGSLLKLKFITHSYPH

SEQ ID NO: 2091619 - protein, 18 aa, Staphylococcus
KERGHHLFLDLKLHDIPN

SEQ ID NO: 2091620 - protein, 30 aa, Staphylococcus
KERLIPYYIYQDYWFLYYHDNVFFAAQYER

SEQ ID NO: 2091621 - protein, 18 aa, Staphylococcus
KFFELYTPLLREGGIVIT

SEQ ID NO: 2091622 - protein, 27 aa, Staphylococcus
KFFRKLNIEWIYRLLIDWKRLGRLKSI

SEQ ID NO: 2091623 - protein, 18 aa, Staphylococcus
KFNNAFIIGLKYKSGFIR

SEQ ID NO: 2091624 - protein, 24 aa, Staphylococcus
KFSEKWFFPLQDFQKFISCFVFLY

SEQ ID NO: 2091625 - protein, 21 aa, Staphylococcus
KFYDMQLSNLYIYKLAVIANM

SEQ ID NO: 2091626 - protein, 19 aa, Staphylococcus
KFYEFSLFLYEEYHGCYID

SEQ ID NO: 2091627 - protein, 17 aa, Staphylococcus
KFYKILFGNNNFILWKY

SEQ ID NO: 2091628 - protein, 21 aa, Staphylococcus
KFYPNLLFGFIHVPFIPEQVI

SEQ ID NO: 2091629 - protein, 20 aa, Staphylococcus
KFYQIFPRFIESLFPFLFKN

SEQ ID NO: 2091630 - protein, 18 aa, Staphylococcus
KGALFTSLLLEKMDMRTS

SEQ ID NO: 2091631 - protein, 25 aa, Staphylococcus
KGDQQLMLRLLRPKFFLPIHGEYRM

SEQ ID NO: 2091632 - protein, 20 aa, Staphylococcus
KGDVWAAWYADLLNVNPQLN

SEQ ID NO: 2091633 - protein, 17 aa, Staphylococcus
KGKIRYWGVSNYSGWNL

SEQ ID NO: 2091634 - protein, 20 aa, Staphylococcus
KGLYLYGPFGTGKSFILGAI

SEQ ID NO: 2091635 - protein, 23 aa, Staphylococcus
KGPGTFMTLLLDALYQVTYDDYS

SEQ ID NO: 2091636 - protein, 24 aa, Staphylococcus
KGQKYFIVWHGTPLKYMGKDMPVV

SEQ ID NO: 2091637 - protein, 19 aa, Staphylococcus
KGRFEAYGWKHILVKDGND

SEQ ID NO: 2091638 - protein, 22 aa, Staphylococcus
KGRYLFIPVHKLADIRWKELGQ

SEQ ID NO: 2091639 - protein, 19 aa, Staphylococcus
KGRYLFIPVHKLADTRWKE

SEQ ID NO: 2091640 - protein, 19 aa, Staphylococcus
KGYGLMMMVDILSGSLLGL

SEQ ID NO: 2091641 - protein, 18 aa, Staphylococcus
KHFLPSQTNFIFVKTNNS

SEQ ID NO: 2091642 - protein, 19 aa, Staphylococcus
KHFPDYNKYLILWKLEVLP

SEQ ID NO: 2091643 - protein, 27 aa, Staphylococcus
KHLVEAVLPYHPFFIKPNKDELEVMFD

SEQ ID NO: 2091644 - protein, 23 aa, Staphylococcus
KHQMTDFMFFASAIMVLLHKYTR

SEQ ID NO: 2091645 - protein, 17 aa, Staphylococcus
KHYKYDLFKFSNSFVLG

SEQ ID NO: 2091646 - protein, 24 aa, Staphylococcus
KIAQTLNAPIYLLSDIPGVMIDNK

SEQ ID NO: 2091647 - protein, 20 aa, Staphylococcus
KIEMHFLPDVYVPCEVCGGK

SEQ ID NO: 2091648 - protein, 26 aa, Staphylococcus
KIFMSYLQFFQLPYKKKIKTFSTGMK

SEQ ID NO: 2091649 - protein, 25 aa, Staphylococcus
KIFRSRFRMLVEAQLDLLKNDDWDY

SEQ ID NO: 2091650 - protein, 25 aa, Staphylococcus
KIFRSRFRMLVEAQLDLLKSEDWDY

SEQ ID NO: 2091651 - protein, 23 aa, Staphylococcus
KIGKYPPYFFLINFTIAHKEMKK

SEQ ID NO: 2091652 - protein, 17 aa, Staphylococcus
KIGVRLVDKLLETFPVH

SEQ ID NO: 2091653 - protein, 21 aa, Staphylococcus
KIGYEIPFTRLFYKYTPPEPS

SEQ ID NO: 2091654 - protein, 19 aa, Staphylococcus
KIHKFFVIVLKYIQRKKAF

SEQ ID NO: 2091655 - protein, 17 aa, Staphylococcus
KIIPSCPFAKKVIEETP

SEQ ID NO: 2091656 - protein, 18 aa, Staphylococcus
KIKKIIIAIPTLSQKRLR

SEQ ID NO: 2091657 - protein, 23 aa, Staphylococcus
KIKPGQWIGIFGIGGLGNLALQY

SEQ ID NO: 2091658 - protein, 17 aa, Staphylococcus
KIMKMTWPKSSKILYAP

SEQ ID NO: 2091659 - protein, 21 aa, Staphylococcus
KINLFPMQKWFFSQEFHNIHH

SEQ ID NO: 2091660 - protein, 17 aa, Staphylococcus
KIRQEFQFLDYAPIAFV

SEQ ID NO: 2091661 - protein, 20 aa, Staphylococcus
KIVKALKWNILKDGKVLYNL

SEQ ID NO: 2091662 - protein, 23 aa, Staphylococcus
KKDGNYTYFLPDIAYHFDKVQRG

SEQ ID NO: 2091663 - protein, 23 aa, Staphylococcus
KKDGSYTYFLPDVAYHYDKFHRD

SEQ ID NO: 2091664 - protein, 18 aa, Staphylococcus
KKDKFYKILFGNNNFILW

SEQ ID NO: 2091665 - protein, 20 aa, Staphylococcus
KKFFELYTPLLRKGGIVVTD

SEQ ID NO: 2091666 - protein, 17 aa, Staphylococcus
KKGVLYPLSYYDGDWFG

SEQ ID NO: 2091667 - protein, 23 aa, Staphylococcus
KKMKVFDLCLINWIPRAQNKEAN

SEQ ID NO: 2091668 - protein, 17 aa, Staphylococcus
KKPYLLEISYFKFLNKF

SEQ ID NO: 2091669 - protein, 21 aa, Staphylococcus
KKQYKALHYLSEGTDLVVGLP

SEQ ID NO: 2091670 - protein, 20 aa, Staphylococcus
KKRGHDIFLDLKLHDIPNTV

SEQ ID NO: 2091671 - protein, 22 aa, Staphylococcus
KLDERLWLLNRAGKIPFVVSGQ

SEQ ID NO: 2091672 - protein, 17 aa, Staphylococcus
KLDPYWIYQIYDKDINP

SEQ ID NO: 2091673 - protein, 18 aa, Staphylococcus
KLDPYWIYQIYDKDVNPL

SEQ ID NO: 2091674 - protein, 19 aa, Staphylococcus
KLFDIDGVKSIFYVMDFIS

SEQ ID NO: 2091675 - protein, 19 aa, Staphylococcus
KLKGPLWFVARDLYQELYL

SEQ ID NO: 2091676 - protein, 17 aa, Staphylococcus
KLKHWLPVDLYIGGVEH

SEQ ID NO: 2091677 - protein, 20 aa, Staphylococcus
KLLALITSNFRLYYQCKILA

SEQ ID NO: 2091678 - protein, 18 aa, Staphylococcus
KLLALITSNYRLYYQCKI

SEQ ID NO: 2091679 - protein, 17 aa, Staphylococcus
KLMDLLIFMIPGYKKEG

SEQ ID NO: 2091680 - protein, 23 aa, Staphylococcus
KLNILIGPLVKLWRIGFEDAQLP

SEQ ID NO: 2091681 - protein, 18 aa, Staphylococcus
KLPFAFKIYNDPFNVVYL

SEQ ID NO: 2091682 - protein, 19 aa, Staphylococcus
KLPFAFKIYNDPFNVVYLV

SEQ ID NO: 2091683 - protein, 18 aa, Staphylococcus
KLPKLPFTLCYISRGFVT

SEQ ID NO: 2091684 - protein, 18 aa, Staphylococcus
KLPRYFFLAESEAFEPGE

SEQ ID NO: 2091685 - protein, 19 aa, Staphylococcus
KLPRYFFLSETESFESGEY

SEQ ID NO: 2091686 - protein, 18 aa, Staphylococcus
KLRKKYLEAFRKGFKQQI

SEQ ID NO: 2091687 - protein, 24 aa, Staphylococcus
KLTFLPYVVKALVSALKKYPALNS

SEQ ID NO: 2091688 - protein, 22 aa, Staphylococcus
KLTIDNFRWAGVPFYIRTGKRM

SEQ ID NO: 2091689 - protein, 30 aa, Staphylococcus
KLTLENYVLIYYLEKIIAQANLRLATMSGQ

SEQ ID NO: 2091690 - protein, 29 aa, Staphylococcus
KLTLENYVLIYYLEKIIFQANQRLLTMSG

SEQ ID NO: 2091691 - protein, 27 aa, Staphylococcus
KLTLENYVLIYYLERILTQANQRLAIM

SEQ ID NO: 2091692 - protein, 20 aa, Staphylococcus
KLTLENYVLVYYLEMILEFA

SEQ ID NO: 2091693 - protein, 23 aa, Staphylococcus
KLVIPFERLKWFNPQTSLWQIDN

SEQ ID NO: 2091694 - protein, 20 aa, Staphylococcus
KLVRIYYQGQLYPAAWTNEY

SEQ ID NO: 2091695 - protein, 20 aa, Staphylococcus
KLWHLIRYRKADGRVKIIDE

SEQ ID NO: 2091696 - protein, 21 aa, Staphylococcus
KLYDRLIYRYGSSNSAFSLEQ

SEQ ID NO: 2091697 - protein, 18 aa, Staphylococcus
KMAIDYAFLVLNLHKIYL

SEQ ID NO: 2091698 - protein, 18 aa, Staphylococcus
KMDPYWIYQIYDKDINPL

SEQ ID NO: 2091699 - protein, 22 aa, Staphylococcus
KMDPYWIYQIYDKDVNPFPSRQ

SEQ ID NO: 2091700 - protein, 17 aa, Staphylococcus
KMKLPGITLYPETERFY

SEQ ID NO: 2091701 - protein, 17 aa, Staphylococcus
KMPFIGLQWIFGRKGAA

SEQ ID NO: 2091702 - protein, 23 aa, Staphylococcus
KMTKIDFFFLNKFQNIINIEHEL

SEQ ID NO: 2091703 - protein, 25 aa, Staphylococcus
KNAGKLFAVKYLLDLFDVPATEVLG

SEQ ID NO: 2091704 - protein, 24 aa, Staphylococcus
KNDGNYTYFLPDIAYHFDKIKRGN

SEQ ID NO: 2091705 - protein, 21 aa, Staphylococcus
KNEILTGFYLAIAPAGEYHYK

SEQ ID NO: 2091706 - protein, 20 aa, Staphylococcus
KNFRVTKIFGFFGLKREEIE

SEQ ID NO: 2091707 - protein, 18 aa, Staphylococcus
KNIKLFVVIGQLNQLIKG

SEQ ID NO: 2091708 - protein, 17 aa, Staphylococcus
KNKPFIRILRTMPQLNE

SEQ ID NO: 2091709 - protein, 23 aa, Staphylococcus
KNKQTHHDAKFEKGVITHQHQPS

SEQ ID NO: 2091710 - protein, 17 aa, Staphylococcus
KNMSFIGQPLWGSIGYT

SEQ ID NO: 2091711 - protein, 19 aa, Staphylococcus
KNPLFAWDLNMGGLMNALE

SEQ ID NO: 2091712 - protein, 23 aa, Staphylococcus
KNQFPWVVAAFPSKAWAQRVYPN

SEQ ID NO: 2091713 - protein, 20 aa, Staphylococcus
KNQILSFYLNNIYFGDNQYT

SEQ ID NO: 2091714 - protein, 21 aa, Staphylococcus
KNQLLIIPTWRDWLINSEQLI

SEQ ID NO: 2091715 - protein, 17 aa, Staphylococcus
KPHFGHRANLINALVLL

SEQ ID NO: 2091716 - protein, 17 aa, Staphylococcus
KPHPFINLLNYILLESI

SEQ ID NO: 2091717 - protein, 17 aa, Staphylococcus
KPILLYAPTWHATKDST

SEQ ID NO: 2091718 - protein, 19 aa, Staphylococcus
KPMIEFFDYVFEKIGKDKR

SEQ ID NO: 2091719 - protein, 21 aa, Staphylococcus
KPNFIFLNTQYLVEIGLDLPF

SEQ ID NO: 2091720 - protein, 23 aa, Staphylococcus
KPNILKFMLKVFYELGFVTEENG

SEQ ID NO: 2091721 - protein, 21 aa, Staphylococcus
KPQIMPVWSLKNRALKVRDED

SEQ ID NO: 2091722 - protein, 22 aa, Staphylococcus
KPQVLIFMLKVFNELNFIHDNN

SEQ ID NO: 2091723 - protein, 17 aa, Staphylococcus
KPSFFMDNFLRITKVSD

SEQ ID NO: 2091724 - protein, 20 aa, Staphylococcus
KPTDFLIRRTGMLYFDIEDV

SEQ ID NO: 2091725 - protein, 23 aa, Staphylococcus
KPTLKFELFYFDIFRYATSFITL

SEQ ID NO: 2091726 - protein, 19 aa, Staphylococcus
KQCPNLNWIAWYATGVNNL

SEQ ID NO: 2091727 - protein, 18 aa, Staphylococcus
KQGVLYPLSYYDGDWFGK

SEQ ID NO: 2091728 - protein, 24 aa, Staphylococcus
KQKGNARFFLITDAMRAKGMPDGE

SEQ ID NO: 2091729 - protein, 21 aa, Staphylococcus
KQLGFIFQDYSVLPTLTVKEN

SEQ ID NO: 2091730 - protein, 23 aa, Staphylococcus
KQRLGIAMALIKKPKLLILDEPS

SEQ ID NO: 2091731 - protein, 21 aa, Staphylococcus
KQTRLYLFYGLVFKRYFDEAL

SEQ ID NO: 2091732 - protein, 18 aa, Staphylococcus
KQVVIAYEPIWAIGTGKS

SEQ ID NO: 2091733 - protein, 31 aa, Staphylococcus
KRAPLIFRKLNLEWFYRLITDWKRMARMQRL

SEQ ID NO: 2091734 - protein, 25 aa, Staphylococcus
KRDIQFDFIFLDPPYNKGLIDKALD

SEQ ID NO: 2091735 - protein, 25 aa, Staphylococcus
KRDIQFDYIFLDPPYKKGLIDEALK

SEQ ID NO: 2091736 - protein, 23 aa, Staphylococcus
KRDYLFFKLAIHTGIRLTDLLKL

SEQ ID NO: 2091737 - protein, 25 aa, Staphylococcus
KREIQFDIIFLDPPYQKGLIDDALA

SEQ ID NO: 2091738 - protein, 25 aa, Staphylococcus
KRIEFYRLYLLMVHLVKFGNMYAGS

SEQ ID NO: 2091739 - protein, 24 aa, Staphylococcus
KRKFPTIRTLFLLLVGFKNSKLND

SEQ ID NO: 2091740 - protein, 18 aa, Staphylococcus
KRKHFIKVLKKKGFNIGE

SEQ ID NO: 2091741 - protein, 17 aa, Staphylococcus
KRMILERILPILSERER

SEQ ID NO: 2091742 - protein, 24 aa, Staphylococcus
KRNFPSIRTLFLLLVGFKNSKLSN

SEQ ID NO: 2091743 - protein, 24 aa, Staphylococcus
KRRISIYPFVWWFATKPSYDGKGI

SEQ ID NO: 2091744 - protein, 18 aa, Staphylococcus
KSAKYVGLIPRFSRIFLG

SEQ ID NO: 2091745 - protein, 20 aa, Staphylococcus
KSAKYVGLIPRFSRIFLGDK

SEQ ID NO: 2091746 - protein, 19 aa, Staphylococcus
KSDIGMFFPFTVTGNVIGK

SEQ ID NO: 2091747 - protein, 21 aa, Staphylococcus
KSEALLILFPYIYKKNDVAMK

SEQ ID NO: 2091748 - protein, 19 aa, Staphylococcus
KSFINIKDLGFALLETDEL

SEQ ID NO: 2091749 - protein, 18 aa, Staphylococcus
KSFTLLSKALRPLPDKFH

SEQ ID NO: 2091750 - protein, 18 aa, Staphylococcus
KSFTLLTKALRPLPDKFH

SEQ ID NO: 2091751 - protein, 23 aa, Staphylococcus
KSLLAIYRIYWLSKVYPNDRIVL

SEQ ID NO: 2091752 - protein, 24 aa, Staphylococcus
KSVKGLYIYGPFGTGKSFILGAMA

SEQ ID NO: 2091753 - protein, 22 aa, Staphylococcus
KSYQLLLDLGFSRDIMSLSPFQ

SEQ ID NO: 2091754 - protein, 17 aa, Staphylococcus
KTAFRMKGNQHFYLITD

SEQ ID NO: 2091755 - protein, 17 aa, Staphylococcus
KTFLLEEGIIDEAWLEK

SEQ ID NO: 2091756 - protein, 22 aa, Staphylococcus
KTISLIIYWSVKTIYKMIRSKI

SEQ ID NO: 2091757 - protein, 17 aa, Staphylococcus
KTQLKTYFDIKPFHFEL

SEQ ID NO: 2091758 - protein, 24 aa, Staphylococcus
KTSLKFELFYFDIFRYANSFITLQ

SEQ ID NO: 2091759 - protein, 21 aa, Staphylococcus
KTTIPLKWLQKYSYHLAIVFK

SEQ ID NO: 2091760 - protein, 19 aa, Staphylococcus
KTTYTDLIFLYLEKSFLTE

SEQ ID NO: 2091761 - protein, 18 aa, Staphylococcus
KTYFDIKPFHFELTQDAP

SEQ ID NO: 2091762 - protein, 17 aa, Staphylococcus
KTYIFYQLFDKYVIDYS

SEQ ID NO: 2091763 - protein, 17 aa, Staphylococcus
KTYIFYQLFETFVIDQS

SEQ ID NO: 2091764 - protein, 22 aa, Staphylococcus
KVDERLWLLNRAGKIPFVVSGQ

SEQ ID NO: 2091765 - protein, 19 aa, Staphylococcus
KVEWIVLAGYMKLIGENIL

SEQ ID NO: 2091766 - protein, 25 aa, Staphylococcus
KVFRSRFRMLVEAQLDLLKNEDWDY

SEQ ID NO: 2091767 - protein, 25 aa, Staphylococcus
KVFRSRFRMLVEAQLDLLKSEDWDY

SEQ ID NO: 2091768 - protein, 18 aa, Staphylococcus
KVHDLLFSYLAIRIAMEW

SEQ ID NO: 2091769 - protein, 17 aa, Staphylococcus
KVHHPLYYYASYFTIRA

SEQ ID NO: 2091770 - protein, 18 aa, Staphylococcus
KVILFFTESIWFGNENIP

SEQ ID NO: 2091771 - protein, 19 aa, Staphylococcus
KVILLLNYPNNPTGYTPTA

SEQ ID NO: 2091772 - protein, 20 aa, Staphylococcus
KVIRPVYLNFSKIPTFYIVN

SEQ ID NO: 2091773 - protein, 18 aa, Staphylococcus
KVIYIKRLRFLDNQLLCI

SEQ ID NO: 2091774 - protein, 23 aa, Staphylococcus
KVKGLYLYGPFGTGKSFILGAVA

SEQ ID NO: 2091775 - protein, 23 aa, Staphylococcus
KVKPGEFYFIPAGMLHSIGSGVL

SEQ ID NO: 2091776 - protein, 19 aa, Staphylococcus
KVRFARFRPFPFWKRVHDS

SEQ ID NO: 2091777 - protein, 24 aa, Staphylococcus
KVSMIFQHFNLLWSRTVISNIMFP

SEQ ID NO: 2091778 - protein, 25 aa, Staphylococcus
KVTQTNIPLYLYLSVLGMTGQTAYH

SEQ ID NO: 2091779 - protein, 17 aa, Staphylococcus
KVYLMLNKPKDYISATT

SEQ ID NO: 2091780 - protein, 17 aa, Staphylococcus
KWFFDRYSPVTNIKAVG

SEQ ID NO: 2091781 - protein, 24 aa, Staphylococcus
KYDDLIIVPLFLFDGRLVNKVKRL

SEQ ID NO: 2091782 - protein, 17 aa, Staphylococcus
KYDSDVLFILLQDKIFG

SEQ ID NO: 2091783 - protein, 19 aa, Staphylococcus
KYLHLYVYKIAGENWQFHY

SEQ ID NO: 2091784 - protein, 19 aa, Staphylococcus
KYLPLLHRYTRLRQELLGI

SEQ ID NO: 2091785 - protein, 21 aa, Staphylococcus
KYLRLYAEFENYKRRIRNENE

SEQ ID NO: 2091786 - protein, 17 aa, Staphylococcus
KYNNTPIFYSLGNTTSD

SEQ ID NO: 2091787 - protein, 24 aa, Staphylococcus
KYTLDFYLKPFLKTKIKGWVRELL

SEQ ID NO: 2091788 - protein, 17 aa, Staphylococcus
KYVGLIPRFSRIFLGDK

SEQ ID NO: 2091789 - protein, 18 aa, Staphylococcus
KYYKIMFMYYFANTMRTN

SEQ ID NO: 2091790 - protein, 17 aa, Staphylococcus
LAAGYSLNWLKRTFFDN

SEQ ID NO: 2091791 - protein, 26 aa, Staphylococcus
LADLVMWDPIFFGVKPELVVKGGLIN

SEQ ID NO: 2091792 - protein, 25 aa, Staphylococcus
LAHAFHLWLLRINYLDQPKFYPSTS

SEQ ID NO: 2091793 - protein, 19 aa, Staphylococcus
LAKVFYYFKEAHPYFDQNV

SEQ ID NO: 2091794 - protein, 19 aa, Staphylococcus
LALGLLTPPGSFGADIVVG

SEQ ID NO: 2091795 - protein, 19 aa, Staphylococcus
LALGLLTPPGTFGADIVVG

SEQ ID NO: 2091796 - protein, 17 aa, Staphylococcus
LAMIWREGCIIRAQFLQ

SEQ ID NO: 2091797 - protein, 20 aa, Staphylococcus
LATLFGIKYPQEVLGFVSCG

SEQ ID NO: 2091798 - protein, 19 aa, Staphylococcus
LAWHNLFAQNMFIRPSTNE

SEQ ID NO: 2091799 - protein, 17 aa, Staphylococcus
LCYKTFYHPSNMVMFVV

SEQ ID NO: 2091800 - protein, 24 aa, Staphylococcus
LDALNLWLIRINYLKQPKVYPSIE

SEQ ID NO: 2091801 - protein, 18 aa, Staphylococcus
LDCFSEHLGLMFQIKDDL

SEQ ID NO: 2091802 - protein, 24 aa, Staphylococcus
LDDSYPFYMNPMPNLYFTRDPQAS

SEQ ID NO: 2091803 - protein, 25 aa, Staphylococcus
LDEETFGYLVYFFELACAMSGYQLG

SEQ ID NO: 2091804 - protein, 27 aa, Staphylococcus
LDELPLGIYRFLIQQPLVYTRTLDHPV

SEQ ID NO: 2091805 - protein, 20 aa, Staphylococcus
LDFDSIKWLINYVKQYPHTV

SEQ ID NO: 2091806 - protein, 20 aa, Staphylococcus
LDHTIVVAPFVRLAGKMEGA

SEQ ID NO: 2091807 - protein, 27 aa, Staphylococcus
LDIIKRHRLLELFLIEILKYNWEEVHQ

SEQ ID NO: 2091808 - protein, 22 aa, Staphylococcus
LDIIKRHRLLEQFLIEVLNYNW

SEQ ID NO: 2091809 - protein, 20 aa, Staphylococcus
LDIMTYFYKIVKWLMQYMKQ

SEQ ID NO: 2091810 - protein, 17 aa, Staphylococcus
LDLFLIHWPCEADDLFI

SEQ ID NO: 2091811 - protein, 17 aa, Staphylococcus
LDLLKNDDWDYLLNYDI

SEQ ID NO: 2091812 - protein, 22 aa, Staphylococcus
LDLLKNDDWDYLLNYDLDAQQV

SEQ ID NO: 2091813 - protein, 17 aa, Staphylococcus
LDLLKNEDWDYLLNYDL

SEQ ID NO: 2091814 - protein, 19 aa, Staphylococcus
LDLYLIHWPCEKDGLYIES

SEQ ID NO: 2091815 - protein, 25 aa, Staphylococcus
LDNGLKLFIIPKPGFQKTFVTYTTQ

SEQ ID NO: 2091816 - protein, 20 aa, Staphylococcus
LDTPLFIGIMPIASYNNALF

SEQ ID NO: 2091817 - protein, 17 aa, Staphylococcus
LEAIFFGHEEIKRLVAF

SEQ ID NO: 2091818 - protein, 17 aa, Staphylococcus
LEAPLDIKVLPKALKLL

SEQ ID NO: 2091819 - protein, 24 aa, Staphylococcus
LEDCPNLKWIAWYATGVNSLPLNY

SEQ ID NO: 2091820 - protein, 23 aa, Staphylococcus
LEDIKAFPFILYDRNFYKKNIQK

SEQ ID NO: 2091821 - protein, 23 aa, Staphylococcus
LEECKNLKWIAWYATGVNNLPLD

SEQ ID NO: 2091822 - protein, 18 aa, Staphylococcus
LEEELKMLLIPKDPNDDK

SEQ ID NO: 2091823 - protein, 22 aa, Staphylococcus
LEEGKGWLVFYSHTNIFKQNTM

SEQ ID NO: 2091824 - protein, 22 aa, Staphylococcus
LEENVHNYLIKLSLDKVKAARH

SEQ ID NO: 2091825 - protein, 20 aa, Staphylococcus
LEESLALYQRGMTLSAACDT

SEQ ID NO: 2091826 - protein, 17 aa, Staphylococcus
LEGNRLFYLAMAPQFFG

SEQ ID NO: 2091827 - protein, 21 aa, Staphylococcus
LEIQYHCHVLYMTVIRKSSFQ

SEQ ID NO: 2091828 - protein, 17 aa, Staphylococcus
LEISYFKFLNKFLNKIG

SEQ ID NO: 2091829 - protein, 23 aa, Staphylococcus
LEKKVWILKEYLLINGQIYTESQ

SEQ ID NO: 2091830 - protein, 19 aa, Staphylococcus
LENESLYCLMPFANSIKKK

SEQ ID NO: 2091831 - protein, 18 aa, Staphylococcus
LEPEALLLPLFQNLKQTF

SEQ ID NO: 2091832 - protein, 25 aa, Staphylococcus
LEPEQLLLPLFQFYQNKYPNICGHI

SEQ ID NO: 2091833 - protein, 23 aa, Staphylococcus
LEPKTQFYNLYRKGKLKLPNEDL

SEQ ID NO: 2091834 - protein, 18 aa, Staphylococcus
LEQLQVKFLWDQLTDYPH

SEQ ID NO: 2091835 - protein, 18 aa, Staphylococcus
LERLVYMNKYRQTTIIMV

SEQ ID NO: 2091836 - protein, 24 aa, Staphylococcus
LESCPNLKWIAWYATGVNSLPLNY

SEQ ID NO: 2091837 - protein, 19 aa, Staphylococcus
LEYLLFQYRFKSRITVWVL

SEQ ID NO: 2091838 - protein, 25 aa, Staphylococcus
LEYQILSSLIKLLKKYPLPTTPNNI

SEQ ID NO: 2091839 - protein, 21 aa, Staphylococcus
LFAIQLIFQYLFSQGRLPEAR

SEQ ID NO: 2091840 - protein, 18 aa, Staphylococcus
LFEQWFHPQGGKTKVYRF

SEQ ID NO: 2091841 - protein, 19 aa, Staphylococcus
LFERWFHPQGAKTKVYRFN

SEQ ID NO: 2091842 - protein, 18 aa, Staphylococcus
LFFIDKVPGITIRDLLKS

SEQ ID NO: 2091843 - protein, 17 aa, Staphylococcus
LFFSYRIEKGQTGRMLA

SEQ ID NO: 2091844 - protein, 17 aa, Staphylococcus
LFGGPLYTFHKIFSIIT

SEQ ID NO: 2091845 - protein, 24 aa, Staphylococcus
LFGNNNFILWKYNNVIYNVFSDNF

SEQ ID NO: 2091846 - protein, 20 aa, Staphylococcus
LFIDIIFSPIYFNILIKPQS

SEQ ID NO: 2091847 - protein, 22 aa, Staphylococcus
LFIKLNIEWVYRLLIDWKRIGR

SEQ ID NO: 2091848 - protein, 17 aa, Staphylococcus
LFKLAIHTGIRLTDLLN

SEQ ID NO: 2091849 - protein, 17 aa, Staphylococcus
LFKTTRFNKPLIAMKLK

SEQ ID NO: 2091850 - protein, 17 aa, Staphylococcus
LFLLGIMANINQSLDDE

SEQ ID NO: 2091851 - protein, 18 aa, Staphylococcus
LFQFIRFIDELIDRGKDF

SEQ ID NO: 2091852 - protein, 19 aa, Staphylococcus
LFVKVGMELFYQTGPELIK

SEQ ID NO: 2091853 - protein, 19 aa, Staphylococcus
LFVYGLFIYSKWKGMGTLS

SEQ ID NO: 2091854 - protein, 22 aa, Staphylococcus
LGAPLWKKWLMAFAARKINKAA

SEQ ID NO: 2091855 - protein, 17 aa, Staphylococcus
LGDSNLPALFWQNGAYA

SEQ ID NO: 2091856 - protein, 27 aa, Staphylococcus
LGEYVVLRFGWLYGPGTWYGKDGMIYN

SEQ ID NO: 2091857 - protein, 24 aa, Staphylococcus
LGFELDVHWIWRAGLNPIEVIPNY

SEQ ID NO: 2091858 - protein, 20 aa, Staphylococcus
LGFKGFVDLKLSLSRNLPQH

SEQ ID NO: 2091859 - protein, 23 aa, Staphylococcus
LHDLAFLLLVYPLSEVEGALEAA

SEQ ID NO: 2091860 - protein, 18 aa, Staphylococcus
LHEAPSYVLNYFDPKDKT

SEQ ID NO: 2091861 - protein, 18 aa, Staphylococcus
LHEDLRIRKFIDNELKEA

SEQ ID NO: 2091862 - protein, 21 aa, Staphylococcus
LHIGHLLPFLTLRRFQQHGHR

SEQ ID NO: 2091863 - protein, 18 aa, Staphylococcus
LHLTWLYDDPSNTSYELV

SEQ ID NO: 2091864 - protein, 18 aa, Staphylococcus
LHYLVDNNFYFNVFDKYS

SEQ ID NO: 2091865 - protein, 18 aa, Staphylococcus
LHYQLPPVDVALLRGTYA

SEQ ID NO: 2091866 - protein, 21 aa, Staphylococcus
LIATELLWFIKGDTNIKYLLQ

SEQ ID NO: 2091867 - protein, 20 aa, Staphylococcus
LICRKADWHVVIFDIGRGNT

SEQ ID NO: 2091868 - protein, 24 aa, Staphylococcus
LIDENKLNFLWVTDWPLLEYDEDA

SEQ ID NO: 2091869 - protein, 24 aa, Staphylococcus
LIDESKLNFLWVTDWPLLEYDDES

SEQ ID NO: 2091870 - protein, 24 aa, Staphylococcus
LIDESKLNFLWVTDWPLLEYDEDA

SEQ ID NO: 2091871 - protein, 25 aa, Staphylococcus
LIDESKLNFLWVTDWPLLEYDEDLK

SEQ ID NO: 2091872 - protein, 24 aa, Staphylococcus
LIDETKLNFLWVTDWPLLEYDEDA

SEQ ID NO: 2091873 - protein, 20 aa, Staphylococcus
LIDLALPLYVKYGIALEAHL

SEQ ID NO: 2091874 - protein, 17 aa, Staphylococcus
LIDLVVVNLYPFQKTVE

SEQ ID NO: 2091875 - protein, 24 aa, Staphylococcus
LIDNNKLNFLWVTDWPLLEYDEDE

SEQ ID NO: 2091876 - protein, 22 aa, Staphylococcus
LIDRPIRPLFPKGYKYDVQIMN

SEQ ID NO: 2091877 - protein, 19 aa, Staphylococcus
LIDTLPYYEWLDHLSDALE

SEQ ID NO: 2091878 - protein, 17 aa, Staphylococcus
LIEDVFRAFQSLYNAHH

SEQ ID NO: 2091879 - protein, 24 aa, Staphylococcus
LIEDYRYLDLFPVGRLDKDTEGLL

SEQ ID NO: 2091880 - protein, 18 aa, Staphylococcus
LIFLIGMAGERDLTKTPE

SEQ ID NO: 2091881 - protein, 18 aa, Staphylococcus
LIIDLMNPAFFYKNFEEQ

SEQ ID NO: 2091882 - protein, 17 aa, Staphylococcus
LIIIMAQSGLLIPTLDG

SEQ ID NO: 2091883 - protein, 19 aa, Staphylococcus
LIKIPIKLSYYSALLANKV

SEQ ID NO: 2091884 - protein, 17 aa, Staphylococcus
LILKAMLVSLQTIEEEY

SEQ ID NO: 2091885 - protein, 18 aa, Staphylococcus
LILLQPLIRQRIQNRSIA

SEQ ID NO: 2091886 - protein, 17 aa, Staphylococcus
LILQAMLVSLQTIEEEY

SEQ ID NO: 2091887 - protein, 20 aa, Staphylococcus
LINLKIITSLKLTIAPTLLT

SEQ ID NO: 2091888 - protein, 22 aa, Staphylococcus
LINLNILTSMRLTLAPKLLGQG

SEQ ID NO: 2091889 - protein, 19 aa, Staphylococcus
LIQPTFIYGHPIDISPLAK

SEQ ID NO: 2091890 - protein, 19 aa, Staphylococcus
LIQPTFIYGHPIEISPLAK

SEQ ID NO: 2091891 - protein, 20 aa, Staphylococcus
LIRLRYWECPIGCYEWEDIA

SEQ ID NO: 2091892 - protein, 24 aa, Staphylococcus
LKASRLNYAIIKPSFFMDNFLRIV

SEQ ID NO: 2091893 - protein, 30 aa, Staphylococcus
LKDALPLLEEKLKFLLIPKDPNDDKDVIVE

SEQ ID NO: 2091894 - protein, 18 aa, Staphylococcus
LKDNILKFGLYTGEHHVV

SEQ ID NO: 2091895 - protein, 21 aa, Staphylococcus
LKEIISRLTFLYNVGLEYLTL

SEQ ID NO: 2091896 - protein, 18 aa, Staphylococcus
LKFFKYFYSQKGPILDFN

SEQ ID NO: 2091897 - protein, 17 aa, Staphylococcus
LKFFKYFYSQRGPILDY

SEQ ID NO: 2091898 - protein, 24 aa, Staphylococcus
LKGALFTSLLLTKLNMRTVPAYDT

SEQ ID NO: 2091899 - protein, 23 aa, Staphylococcus
LKGTDVLVCTVIGFPLGASTKEV

SEQ ID NO: 2091900 - protein, 19 aa, Staphylococcus
LKLLNDLAMIFLKAAYEEI

SEQ ID NO: 2091901 - protein, 24 aa, Staphylococcus
LKMPNNILAITYLKAIQQFAPHMK

SEQ ID NO: 2091902 - protein, 23 aa, Staphylococcus
LKPETFYKLLRKLPAREYSIASS

SEQ ID NO: 2091903 - protein, 24 aa, Staphylococcus
LKRKYTLDYLLKPFVQTKLKGWVR

SEQ ID NO: 2091904 - protein, 19 aa, Staphylococcus
LKSHYFIYKKLLNTSYEEH

SEQ ID NO: 2091905 - protein, 25 aa, Staphylococcus
LKTIYDYPFILFYRGNIHLLSSTYT

SEQ ID NO: 2091906 - protein, 17 aa, Staphylococcus
LKYMPFDGSIITISELT

SEQ ID NO: 2091907 - protein, 22 aa, Staphylococcus
LLDALHLWLLRINYLNQPKSYP

SEQ ID NO: 2091908 - protein, 17 aa, Staphylococcus
LLDYGAIYNLKDLYEKY

SEQ ID NO: 2091909 - protein, 18 aa, Staphylococcus
LLEDWLFEYKDMFPIEAS

SEQ ID NO: 2091910 - protein, 17 aa, Staphylococcus
LLELGLIIGKDARRKRE

SEQ ID NO: 2091911 - protein, 17 aa, Staphylococcus
LLERFLFPSSTHGKKVY

SEQ ID NO: 2091912 - protein, 20 aa, Staphylococcus
LLFYLLFYKAVDELLKYSKN

SEQ ID NO: 2091913 - protein, 20 aa, Staphylococcus
LLHLYFDDYLLIWAPNHHHL

SEQ ID NO: 2091914 - protein, 18 aa, Staphylococcus
LLHYIPLTVDRLTGIVSR

SEQ ID NO: 2091915 - protein, 18 aa, Staphylococcus
LLIFAFKETAHNSVWIDD

SEQ ID NO: 2091916 - protein, 17 aa, Staphylococcus
LLIKKYLKTGKSLAGPT

SEQ ID NO: 2091917 - protein, 19 aa, Staphylococcus
LLILPLWHEHDTFPFELLK

SEQ ID NO: 2091918 - protein, 25 aa, Staphylococcus
LLKNPILEGFTLPKLLWLQENEPTH

SEQ ID NO: 2091919 - protein, 17 aa, Staphylococcus
LLKPLFRHLTETYSEAM

SEQ ID NO: 2091920 - protein, 17 aa, Staphylococcus
LLNIIERYKSLPILGVC

SEQ ID NO: 2091921 - protein, 20 aa, Staphylococcus
LLNQLIILPALLHKTTLTYE

SEQ ID NO: 2091922 - protein, 18 aa, Staphylococcus
LLNRSLLYSGIILHDIGK

SEQ ID NO: 2091923 - protein, 17 aa, Staphylococcus
LLPLFQNLKQTFPEVMD

SEQ ID NO: 2091924 - protein, 17 aa, Staphylococcus
LLPLYKKGKFASIQMFN

SEQ ID NO: 2091925 - protein, 17 aa, Staphylococcus
LLPMYLKYKLKSKSKSV

SEQ ID NO: 2091926 - protein, 20 aa, Staphylococcus
LLPVNLSQLLRKLPPREYSI

SEQ ID NO: 2091927 - protein, 18 aa, Staphylococcus
LLQMPFLEQLFKQLKAED

SEQ ID NO: 2091928 - protein, 17 aa, Staphylococcus
LLRMHYLISNALDLTGY

SEQ ID NO: 2091929 - protein, 17 aa, Staphylococcus
LLSFAIHTGVKLSTLLG

SEQ ID NO: 2091930 - protein, 17 aa, Staphylococcus
LLTLKLAELFRASTIPA

SEQ ID NO: 2091931 - protein, 17 aa, Staphylococcus
LLTLWKEGSMTLKEMDD

SEQ ID NO: 2091932 - protein, 17 aa, Staphylococcus
LLVTTFLKAYPPGPTKK

SEQ ID NO: 2091933 - protein, 17 aa, Staphylococcus
LMHFDLEVLYKMIGIIN

SEQ ID NO: 2091934 - protein, 24 aa, Staphylococcus
LMIPLKIEIPYYAGLSFRTLMPKF

SEQ ID NO: 2091935 - protein, 19 aa, Staphylococcus
LMKKNFIEYLLFQYKFKSR

SEQ ID NO: 2091936 - protein, 26 aa, Staphylococcus
LMLRLIQPKFFLPIHGEYRMLTAHGQ

SEQ ID NO: 2091937 - protein, 20 aa, Staphylococcus
LMLRLIQPKYFLPIHGEYRM

SEQ ID NO: 2091938 - protein, 17 aa, Staphylococcus
LMLYYKDMLKQICQSWF

SEQ ID NO: 2091939 - protein, 18 aa, Staphylococcus
LMNQLGAPFLLISDPRIQ

SEQ ID NO: 2091940 - protein, 20 aa, Staphylococcus
LNDLFKYYDFILIDTPPVNT

SEQ ID NO: 2091941 - protein, 20 aa, Staphylococcus
LNDLYRIHLLLDKYSFNEDI

SEQ ID NO: 2091942 - protein, 18 aa, Staphylococcus
LNERLLNMIGVHTVSIDI

SEQ ID NO: 2091943 - protein, 19 aa, Staphylococcus
LNEWYILTIERLIDLITYC

SEQ ID NO: 2091944 - protein, 22 aa, Staphylococcus
LNFFNYVPFFRSLDMKQTKVNS

SEQ ID NO: 2091945 - protein, 20 aa, Staphylococcus
LNHTKLYYKWLKNLSSAIES

SEQ ID NO: 2091946 - protein, 21 aa, Staphylococcus
LNHVRYVGALFLGYYSPEVIG

SEQ ID NO: 2091947 - protein, 24 aa, Staphylococcus
LNKYYGIPLYYKKGKHFKLTEAGE

SEQ ID NO: 2091948 - protein, 23 aa, Staphylococcus
LNNKLLPSSLLLNANRKVKFPFS

SEQ ID NO: 2091949 - protein, 24 aa, Staphylococcus
LNRQHHRFLFFIEKVPGITIKDLL

SEQ ID NO: 2091950 - protein, 25 aa, Staphylococcus
LNSNFKKELFPFWKIRDFHEGFNFF

SEQ ID NO: 2091951 - protein, 20 aa, Staphylococcus
LNTESIFLWLRGYNLKLNYN

SEQ ID NO: 2091952 - protein, 17 aa, Staphylococcus
LNTPFFIGIMPIASYNN

SEQ ID NO: 2091953 - protein, 19 aa, Staphylococcus
LNVFKPVILHNILQSIYLL

SEQ ID NO: 2091954 - protein, 17 aa, Staphylococcus
LNVPLFIGIMPIASYNN

SEQ ID NO: 2091955 - protein, 20 aa, Staphylococcus
LPEALNFFTWLQHLADNGVT

SEQ ID NO: 2091956 - protein, 25 aa, Staphylococcus
LPEEIIPIIWIAFKTGLRISDVLTL

SEQ ID NO: 2091957 - protein, 21 aa, Staphylococcus
LPEYMIPRKFVWMDHLPLTSN

SEQ ID NO: 2091958 - protein, 23 aa, Staphylococcus
LPEYMIPRKFVWMEQLPLTSNGK

SEQ ID NO: 2091959 - protein, 24 aa, Staphylococcus
LPEYMIPRKFVWMKQLPLTSNGKL

SEQ ID NO: 2091960 - protein, 17 aa, Staphylococcus
LPFSIRMARTLLGSTDF

SEQ ID NO: 2091961 - protein, 18 aa, Staphylococcus
LPIYFLKQALRSLGYMGI

SEQ ID NO: 2091962 - protein, 24 aa, Staphylococcus
LPKTNLIRFIFENGFIALRPSGTE

SEQ ID NO: 2091963 - protein, 24 aa, Staphylococcus
LPNKEFHLLFLLVSHPKQIFSREE

SEQ ID NO: 2091964 - protein, 25 aa, Staphylococcus
LPNKEFQLLFLLASNPRQVFNRDAL

SEQ ID NO: 2091965 - protein, 24 aa, Staphylococcus
LPVENQILIIFALTKGYLDDIPVE

SEQ ID NO: 2091966 - protein, 17 aa, Staphylococcus
LPWLIVERGFEIPSFNF

SEQ ID NO: 2091967 - protein, 22 aa, Staphylococcus
LQDKLFPIEYGLKGLPQISIDD

SEQ ID NO: 2091968 - protein, 18 aa, Staphylococcus
LQFALYDRKIPLILVFEG

SEQ ID NO: 2091969 - protein, 17 aa, Staphylococcus
LQNLLLDPYFKNIVTEY

SEQ ID NO: 2091970 - protein, 24 aa, Staphylococcus
LQSNYLDHLIIYYAPKIIGGIGKN

SEQ ID NO: 2091971 - protein, 24 aa, Staphylococcus
LRGAWNVIVFYPADFSFVCPTELE

SEQ ID NO: 2091972 - protein, 20 aa, Staphylococcus
LRKFDYLVFPDNVAIVLGIA

SEQ ID NO: 2091973 - protein, 18 aa, Staphylococcus
LRLIQPKYFLPIHGEYRM

SEQ ID NO: 2091974 - protein, 18 aa, Staphylococcus
LRLYAEFENYKRRIQNEN

SEQ ID NO: 2091975 - protein, 18 aa, Staphylococcus
LRPLILITILNESLGMQS

SEQ ID NO: 2091976 - protein, 26 aa, Staphylococcus
LRQTLDLFACLRPVRWFKGVPSPVKR

SEQ ID NO: 2091977 - protein, 22 aa, Staphylococcus
LSFRAFYALPLLSNKAGIHTNA

SEQ ID NO: 2091978 - protein, 19 aa, Staphylococcus
LSFRTLMPKLPILTPHVKL

SEQ ID NO: 2091979 - protein, 19 aa, Staphylococcus
LSIQYIPQRLLPDKALDIL

SEQ ID NO: 2091980 - protein, 26 aa, Staphylococcus
LSPTKCLRILALFRLINPTKEIRIAG

SEQ ID NO: 2091981 - protein, 25 aa, Staphylococcus
LSQADLILFVLNYNEPLTKEDRTLF

SEQ ID NO: 2091982 - protein, 18 aa, Staphylococcus
LTAFIRKATQIGIPVMAH

SEQ ID NO: 2091983 - protein, 18 aa, Staphylococcus
LTEDIAYGLVLWSSLGRV

SEQ ID NO: 2091984 - protein, 19 aa, Staphylococcus
LTEDIAYGLVLWSSLGRVI

SEQ ID NO: 2091985 - protein, 25 aa, Staphylococcus
LTEEQMIDFLFVSSLFGRVVANNAS

SEQ ID NO: 2091986 - protein, 18 aa, Staphylococcus
LTFALVLAVARRIPEGDK

SEQ ID NO: 2091987 - protein, 18 aa, Staphylococcus
LTFALVLAVARRIPEGDQ

SEQ ID NO: 2091988 - protein, 19 aa, Staphylococcus
LTFGLVLAIARRIVEGDKL

SEQ ID NO: 2091989 - protein, 18 aa, Staphylococcus
LTFGLVLAVARRIVEGDK

SEQ ID NO: 2091990 - protein, 23 aa, Staphylococcus
LTHKDIVFSPKLLSWIEQRGLDI

SEQ ID NO: 2091991 - protein, 18 aa, Staphylococcus
LTIYEWPEKLLVKELKKL

SEQ ID NO: 2091992 - protein, 22 aa, Staphylococcus
LTKHIFNIIYNGPLRIMIQNHY

SEQ ID NO: 2091993 - protein, 26 aa, Staphylococcus
LTLENYVLIYYLERIIHQANIRLERM

SEQ ID NO: 2091994 - protein, 19 aa, Staphylococcus
LTLPLKEKFMKLGYADGGI

SEQ ID NO: 2091995 - protein, 20 aa, Staphylococcus
LTNYKWLGILLRFVPNIIRD

SEQ ID NO: 2091996 - protein, 24 aa, Staphylococcus
LTTEYYWHWDLKSAKLDVFEYKKM

SEQ ID NO: 2091997 - protein, 22 aa, Staphylococcus
LTTFKWLGILLKLVPKPLRDCG

SEQ ID NO: 2091998 - protein, 24 aa, Staphylococcus
LTTPEPIYPLWHRAMNAYDKASDS

SEQ ID NO: 2091999 - protein, 21 aa, Staphylococcus
LVATELLWFIKGDTNIKYLLQ

SEQ ID NO: 2092000 - protein, 21 aa, Staphylococcus
LVATELLWFIKGDTNIQYLLK

SEQ ID NO: 2092001 - protein, 21 aa, Staphylococcus
LVATELLWFIKGDTNIRYLLQ

SEQ ID NO: 2092002 - protein, 21 aa, Staphylococcus
LVDQLIYFINHRIIPIIPQQG

SEQ ID NO: 2092003 - protein, 17 aa, Staphylococcus
LVDRFYFEALYARLGHI

SEQ ID NO: 2092004 - protein, 18 aa, Staphylococcus
LVEIFKGFKFKVNGTLPI

SEQ ID NO: 2092005 - protein, 20 aa, Staphylococcus
LVEYLYYYLNYIRDKGVLEK

SEQ ID NO: 2092006 - protein, 17 aa, Staphylococcus
LVFYLYGGAIKGFSKWI

SEQ ID NO: 2092007 - protein, 24 aa, Staphylococcus
LVKEYLYVILIKTFQYWSANKDSI

SEQ ID NO: 2092008 - protein, 18 aa, Staphylococcus
LVKRAFIGSFLFGGNFDS

SEQ ID NO: 2092009 - protein, 22 aa, Staphylococcus
LVNLFYQYLLTCELTDLVYQYT

SEQ ID NO: 2092010 - protein, 19 aa, Staphylococcus
LVNTVLKYQPLFIKPNKDE

SEQ ID NO: 2092011 - protein, 17 aa, Staphylococcus
LVPLLKIQGLGSKKIAK

SEQ ID NO: 2092012 - protein, 22 aa, Staphylococcus
LVPQTLKWLMDAGLEKPYQLEK

SEQ ID NO: 2092013 - protein, 17 aa, Staphylococcus
LWQPLDAYLYHMKVELL

SEQ ID NO: 2092014 - protein, 19 aa, Staphylococcus
LYCLMPFANSIKKKLEQLI

SEQ ID NO: 2092015 - protein, 17 aa, Staphylococcus
LYINNKLFYIGANKNKD

SEQ ID NO: 2092016 - protein, 17 aa, Staphylococcus
LYLLMVHLVKFGEMYAG

SEQ ID NO: 2092017 - protein, 20 aa, Staphylococcus
LYLTYLIKELKLVKLDFIHR

SEQ ID NO: 2092018 - protein, 19 aa, Staphylococcus
LYQLGYLNATRFPNLLFGF

SEQ ID NO: 2092019 - protein, 17 aa, Staphylococcus
LYTVQAALPKLLEQSSG

SEQ ID NO: 2092020 - protein, 18 aa, Staphylococcus
MAGIPKHKIWLDPGIGFA

SEQ ID NO: 2092021 - protein, 21 aa, Staphylococcus
MAKEGHHFFGLLYIGAILTQE

SEQ ID NO: 2092022 - protein, 17 aa, Staphylococcus
MCYLLQLLYFNDYTYET

SEQ ID NO: 2092023 - protein, 17 aa, Staphylococcus
MDDGILSVILPIKQTKT

SEQ ID NO: 2092024 - protein, 24 aa, Staphylococcus
MDDKYPFYLDPMPNLYFTRDPQAS

SEQ ID NO: 2092025 - protein, 26 aa, Staphylococcus
MDDRYPFYLDPIPNLYFTRDPQASVG

SEQ ID NO: 2092026 - protein, 24 aa, Staphylococcus
MDDRYPFYLDPMPNLYFTRDPQAS

SEQ ID NO: 2092027 - protein, 21 aa, Staphylococcus
MDMLFTHFGISGPAALRCSQF

SEQ ID NO: 2092028 - protein, 18 aa, Staphylococcus
MEEELKILLIPKDPNDEK

SEQ ID NO: 2092029 - protein, 18 aa, Staphylococcus
MEEQLKLLLIPKDPNDEK

SEQ ID NO: 2092030 - protein, 20 aa, Staphylococcus
MEKRYKLFAQFHVRNITAFN

SEQ ID NO: 2092031 - protein, 24 aa, Staphylococcus
MEMKPLYEWLGLTASLGFIDIPDY

SEQ ID NO: 2092032 - protein, 17 aa, Staphylococcus
MFTRVFRKHLDGGIIQD

SEQ ID NO: 2092033 - protein, 20 aa, Staphylococcus
MFVYGLFIYNKWRGMGTLNS

SEQ ID NO: 2092034 - protein, 24 aa, Staphylococcus
MHDLAFLLLVYPLSDYEGALHSAY

SEQ ID NO: 2092035 - protein, 18 aa, Staphylococcus
MHFYRYVFPYYDTLYTLE

SEQ ID NO: 2092036 - protein, 17 aa, Staphylococcus
MHHYNFPNFSVGETGPV

SEQ ID NO: 2092037 - protein, 20 aa, Staphylococcus
MIAKLPFMNKYNTKYWLMDS

SEQ ID NO: 2092038 - protein, 20 aa, Staphylococcus
MICAALADIPFFVTGGIGGV

SEQ ID NO: 2092039 - protein, 18 aa, Staphylococcus
MIDIMLVGTFLMTKHVLP

SEQ ID NO: 2092040 - protein, 17 aa, Staphylococcus
MIDLVFSPIYFNILIKP

SEQ ID NO: 2092041 - protein, 18 aa, Staphylococcus
MIEKLEIYLFDYASWDVP

SEQ ID NO: 2092042 - protein, 17 aa, Staphylococcus
MIFQHFNLLWSRTVLDN

SEQ ID NO: 2092043 - protein, 23 aa, Staphylococcus
MIGKPTFFNLIGPIINPFALTYQ

SEQ ID NO: 2092044 - protein, 17 aa, Staphylococcus
MINIMKPEYFIPVNGEF

SEQ ID NO: 2092045 - protein, 17 aa, Staphylococcus
MIPKFNLFIALGIRDAI

SEQ ID NO: 2092046 - protein, 18 aa, Staphylococcus
MKAKRIILLAFGKNKQQA

SEQ ID NO: 2092047 - protein, 21 aa, Staphylococcus
MKYIQPIRKLIHEPTIFNIVG

SEQ ID NO: 2092048 - protein, 18 aa, Staphylococcus
MLEAIFFGHDEIKRLVAF

SEQ ID NO: 2092049 - protein, 18 aa, Staphylococcus
MLEAIFFGHEEIKRLVAF

SEQ ID NO: 2092050 - protein, 20 aa, Staphylococcus
MLERSFVLIPLNDIATNVIE

SEQ ID NO: 2092051 - protein, 19 aa, Staphylococcus
MLFDAIVFALYGKASTSSR

SEQ ID NO: 2092052 - protein, 17 aa, Staphylococcus
MLFIPFKGENVDGHCFV

SEQ ID NO: 2092053 - protein, 18 aa, Staphylococcus
MLVGMLFIHSIHPYIAKI

SEQ ID NO: 2092054 - protein, 17 aa, Staphylococcus
MMIGRYPICYINIKMDP

SEQ ID NO: 2092055 - protein, 18 aa, Staphylococcus
MMINIMKPEYFIPVQGEF

SEQ ID NO: 2092056 - protein, 17 aa, Staphylococcus
MMYLALSYDHRIIDGKE

SEQ ID NO: 2092057 - protein, 18 aa, Staphylococcus
MMYLPRYVQTLFPNFNHL

SEQ ID NO: 2092058 - protein, 20 aa, Staphylococcus
MNAFWPGPISFILPLKQGYL

SEQ ID NO: 2092059 - protein, 22 aa, Staphylococcus
MNAGLYLIDFLSTLNLNQTAKE

SEQ ID NO: 2092060 - protein, 18 aa, Staphylococcus
MNIPHDLFTPIFAISRTS

SEQ ID NO: 2092061 - protein, 19 aa, Staphylococcus
MNPFLGYRAIRLCLAQQDI

SEQ ID NO: 2092062 - protein, 17 aa, Staphylococcus
MPGFPFLGGLDSRLHTP

SEQ ID NO: 2092063 - protein, 26 aa, Staphylococcus
MPIVKQYYRMLQRPIIYTGLTRAKQS

SEQ ID NO: 2092064 - protein, 25 aa, Staphylococcus
MPKDDSYFLFYVNRPSIIIGKNQNT

SEQ ID NO: 2092065 - protein, 26 aa, Staphylococcus
MPMVKQYFRMLQKPILYTGLTRAKQS

SEQ ID NO: 2092066 - protein, 25 aa, Staphylococcus
MPVVKQYFRMLQKPILYTGLTRAKQ

SEQ ID NO: 2092067 - protein, 17 aa, Staphylococcus
MQNYKPIFWENPNFRKP

SEQ ID NO: 2092068 - protein, 23 aa, Staphylococcus
MRAKRIILLAFGERKRDAIHQLL

SEQ ID NO: 2092069 - protein, 18 aa, Staphylococcus
MRLRIIPELSFEYDKSID

SEQ ID NO: 2092070 - protein, 25 aa, Staphylococcus
MSKEGYHFFGLLYIGAILTKEGPKV

SEQ ID NO: 2092071 - protein, 17 aa, Staphylococcus
MSLERRNLLKAYGAEVV

SEQ ID NO: 2092072 - protein, 26 aa, Staphylococcus
MSMVDTWLFHQFLNAVPIDAQVILVG

SEQ ID NO: 2092073 - protein, 26 aa, Staphylococcus
MSMVDTWLFHQFLSAVPLDAQIVFVG

SEQ ID NO: 2092074 - protein, 25 aa, Staphylococcus
MSRQHHRFLFFINKLPGITIKQLLK

SEQ ID NO: 2092075 - protein, 24 aa, Staphylococcus
MTADLYYLLQLLYCNNYTYETLIE

SEQ ID NO: 2092076 - protein, 18 aa, Staphylococcus
MTFKLFPDIAPKTVENFV

SEQ ID NO: 2092077 - protein, 23 aa, Staphylococcus
MTPMKLRQRVWRRLATDLKSNKL

SEQ ID NO: 2092078 - protein, 17 aa, Staphylococcus
MTTLLLKDLMKHLIELY

SEQ ID NO: 2092079 - protein, 17 aa, Staphylococcus
MTYFWMLERDYTRFADS

SEQ ID NO: 2092080 - protein, 26 aa, Staphylococcus
MVADLERPYILITDKKISSFQDILPL

SEQ ID NO: 2092081 - protein, 19 aa, Staphylococcus
MVEPFFEWVIEKDAWYGEE

SEQ ID NO: 2092082 - protein, 18 aa, Staphylococcus
MVFQHFNLLWSRTVLRNI

SEQ ID NO: 2092083 - protein, 19 aa, Staphylococcus
MVGTFFLQDSKELTDPQIK

SEQ ID NO: 2092084 - protein, 19 aa, Staphylococcus
MYQLLRKLPPREYSISSSY

SEQ ID NO: 2092085 - protein, 24 aa, Staphylococcus
NAEFEKHIYAIHTLTSLVSDNSSS

SEQ ID NO: 2092086 - protein, 23 aa, Staphylococcus
NAFPWVVAAFPSKAWAKRVYPNL

SEQ ID NO: 2092087 - protein, 23 aa, Staphylococcus
NAGLYLLEFLATLNLNKSAKDFV

SEQ ID NO: 2092088 - protein, 22 aa, Staphylococcus
NAGLYLLNFLATLNLDKTAANF

SEQ ID NO: 2092089 - protein, 23 aa, Staphylococcus
NASFEEIIFLLWNYRLPTQEELD

SEQ ID NO: 2092090 - protein, 26 aa, Staphylococcus
NATLILIKLYLYKLSKNKARYGKAIS

SEQ ID NO: 2092091 - protein, 22 aa, Staphylococcus
NAYHILMKLMLKFDFVYDGDKL

SEQ ID NO: 2092092 - protein, 17 aa, Staphylococcus
NCNELEHFIPSLKLKKV

SEQ ID NO: 2092093 - protein, 22 aa, Staphylococcus
NCNVYLKREDLQWVRSFKLRGA

SEQ ID NO: 2092094 - protein, 24 aa, Staphylococcus
NDAYSKIYLFNKKLNKIKTFRDEL

SEQ ID NO: 2092095 - protein, 17 aa, Staphylococcus
NDDFTHWRKIMGAAPIS

SEQ ID NO: 2092096 - protein, 23 aa, Staphylococcus
NDGPALEFTIIGPSIQFLKENSF

SEQ ID NO: 2092097 - protein, 17 aa, Staphylococcus
NDPALVDLLISTLGWDP

SEQ ID NO: 2092098 - protein, 21 aa, Staphylococcus
NDRMVWVFPLTFNNSEYYIPG

SEQ ID NO: 2092099 - protein, 25 aa, Staphylococcus
NDSSAMPAFWFDPLINLTAISQVTQ

SEQ ID NO: 2092100 - protein, 23 aa, Staphylococcus
NDVYFLNGPLDLTFLFGLVDHLS

SEQ ID NO: 2092101 - protein, 17 aa, Staphylococcus
NEALFSYFKKGAVFVNC

SEQ ID NO: 2092102 - protein, 23 aa, Staphylococcus
NEANRYLVMPALSDTLKVAGVKT

SEQ ID NO: 2092103 - protein, 21 aa, Staphylococcus
NEEIIWLYQYFTDIKIAPTSV

SEQ ID NO: 2092104 - protein, 26 aa, Staphylococcus
NEGYNLTFFAFFVKAVADALKAHPLL

SEQ ID NO: 2092105 - protein, 26 aa, Staphylococcus
NEGYNLTFFAFFVKAVAEALKSNPLL

SEQ ID NO: 2092106 - protein, 27 aa, Staphylococcus
NEGYNLTFFAFFVKAVAKALKAYPMLN

SEQ ID NO: 2092107 - protein, 17 aa, Staphylococcus
NELAWHNLFAQNMFIRP

SEQ ID NO: 2092108 - protein, 23 aa, Staphylococcus
NELNRLLKIYSTTGKILVNKGGF

SEQ ID NO: 2092109 - protein, 18 aa, Staphylococcus
NEMLFKQYPYFNPSLLHI

SEQ ID NO: 2092110 - protein, 20 aa, Staphylococcus
NEMRALIWQLKPIGLEHGLV

SEQ ID NO: 2092111 - protein, 22 aa, Staphylococcus
NEWKNYFHPFKASKNFTIVPSW

SEQ ID NO: 2092112 - protein, 19 aa, Staphylococcus
NEWKNYFHPFKASNRFTIV

SEQ ID NO: 2092113 - protein, 23 aa, Staphylococcus
NEWKNYFHPFRASEKFTIVPSWE

SEQ ID NO: 2092114 - protein, 17 aa, Staphylococcus
NFKDLFQYIESLFARPI

SEQ ID NO: 2092115 - protein, 25 aa, Staphylococcus
NFKEAVQWLYLAYLAAIKEQNGAAM

SEQ ID NO: 2092116 - protein, 17 aa, Staphylococcus
NFLLLLFAKVLSEQMGR

SEQ ID NO: 2092117 - protein, 18 aa, Staphylococcus
NFRDIFNKIAWLNKGKME

SEQ ID NO: 2092118 - protein, 20 aa, Staphylococcus
NFTYHYMHLINEIYIDEALV

SEQ ID NO: 2092119 - protein, 18 aa, Staphylococcus
NGENTIFSELLRFAGIGE

SEQ ID NO: 2092120 - protein, 20 aa, Staphylococcus
NGFIKFQPIGGWWNQVMLSQ

SEQ ID NO: 2092121 - protein, 25 aa, Staphylococcus
NGKSRSIPIFVFLNDNFEQENVWGP

SEQ ID NO: 2092122 - protein, 18 aa, Staphylococcus
NGKYYVSHQWFPLGAVHG

SEQ ID NO: 2092123 - protein, 24 aa, Staphylococcus
NGLKGQGILFVRNIHQLEPIVHGG

SEQ ID NO: 2092124 - protein, 20 aa, Staphylococcus
NGLRLFIIPKKGFQKTFVTY

SEQ ID NO: 2092125 - protein, 18 aa, Staphylococcus
NGLRLFVIPKKGFQKTYV

SEQ ID NO: 2092126 - protein, 22 aa, Staphylococcus
NGLTRIIFMVPARGLIGYTTEF

SEQ ID NO: 2092127 - protein, 17 aa, Staphylococcus
NGLTRLIFMVPARGMIG

SEQ ID NO: 2092128 - protein, 22 aa, Staphylococcus
NGPLPFLQLVYFLLAFGEFSGT

SEQ ID NO: 2092129 - protein, 25 aa, Staphylococcus
NGRHELLNSVFLWHSGTKYKVNVHD

SEQ ID NO: 2092130 - protein, 25 aa, Staphylococcus
NGSQLPYGTLLFATGRRPNLQAFES

SEQ ID NO: 2092131 - protein, 21 aa, Staphylococcus
NGWILHIPSCYLGIAQAARDY

SEQ ID NO: 2092132 - protein, 17 aa, Staphylococcus
NGWILHIPSVYLGIAQA

SEQ ID NO: 2092133 - protein, 19 aa, Staphylococcus
NGWILHIPSVYLGIAQAAA

SEQ ID NO: 2092134 - protein, 22 aa, Staphylococcus
NGYLFVFVMDYYRHSIINEESK

SEQ ID NO: 2092135 - protein, 23 aa, Staphylococcus
NHEINLVGIFRYANTYDTGIQIL

SEQ ID NO: 2092136 - protein, 24 aa, Staphylococcus
NHQLFKGIEWIIVSLGANGAFAKH

SEQ ID NO: 2092137 - protein, 25 aa, Staphylococcus
NHVPPWIIILPHNFGLTIKWLSILK

SEQ ID NO: 2092138 - protein, 20 aa, Staphylococcus
NICRRMLLLMLAWDKGYKFD

SEQ ID NO: 2092139 - protein, 21 aa, Staphylococcus
NIDVQLRLLKYQQDKEKILND

SEQ ID NO: 2092140 - protein, 22 aa, Staphylococcus
NIEEKIWYKLLVNLGINSITAL

SEQ ID NO: 2092141 - protein, 21 aa, Staphylococcus
NIIGFNLLLHALLPYLSKHAS

SEQ ID NO: 2092142 - protein, 21 aa, Staphylococcus
NIIKRLYFFSIANPNPFEWLD

SEQ ID NO: 2092143 - protein, 17 aa, Staphylococcus
NIIQLIWNDGKYNMVEF

SEQ ID NO: 2092144 - protein, 17 aa, Staphylococcus
NIKKIIIAIPTLSQQRL

SEQ ID NO: 2092145 - protein, 18 aa, Staphylococcus
NILKLYQLAPRTLENCLP

SEQ ID NO: 2092146 - protein, 20 aa, Staphylococcus
NILSPTYKLLMGVPGRSNAF

SEQ ID NO: 2092147 - protein, 18 aa, Staphylococcus
NINLLYELINNGALSQIT

SEQ ID NO: 2092148 - protein, 18 aa, Staphylococcus
NIPMLLIPLGLDQSRGDQ

SEQ ID NO: 2092149 - protein, 19 aa, Staphylococcus
NIRDWTISRQLWWGHQIPA

SEQ ID NO: 2092150 - protein, 18 aa, Staphylococcus
NIVFWYGWNKQAFDVVSE

SEQ ID NO: 2092151 - protein, 20 aa, Staphylococcus
NIVKKLFLLGIMANINQSLD

SEQ ID NO: 2092152 - protein, 19 aa, Staphylococcus
NIYDWLSNFRLLTGSYYSS

SEQ ID NO: 2092153 - protein, 24 aa, Staphylococcus
NKAKAIHALFLWLDQHHFDYNGIV

SEQ ID NO: 2092154 - protein, 17 aa, Staphylococcus
NKALLNHASPSAKFMYC

SEQ ID NO: 2092155 - protein, 22 aa, Staphylococcus
NKAQYTLIKLLANKFKNLCVVG

SEQ ID NO: 2092156 - protein, 23 aa, Staphylococcus
NKEFQLLFLLASNEKQIFSRTHL

SEQ ID NO: 2092157 - protein, 23 aa, Staphylococcus
NKGRYLFIPIHKIADVRWKELGQ

SEQ ID NO: 2092158 - protein, 23 aa, Staphylococcus
NKGRYLFIPVHKLADIRWKELGQ

SEQ ID NO: 2092159 - protein, 24 aa, Staphylococcus
NKKTILLFCRLPLALAHKSLKAMQ

SEQ ID NO: 2092160 - protein, 23 aa, Staphylococcus
NKKYYFKILISSVNEFKFTKEVG

SEQ ID NO: 2092161 - protein, 19 aa, Staphylococcus
NKLIIYYAPKIIGGSGKYQ

SEQ ID NO: 2092162 - protein, 19 aa, Staphylococcus
NKSLLKFYCKETHWFGSKE

SEQ ID NO: 2092163 - protein, 19 aa, Staphylococcus
NKYLILWKLEVLPSFQSRG

SEQ ID NO: 2092164 - protein, 17 aa, Staphylococcus
NKYQIYPYFKFDIEKKF

SEQ ID NO: 2092165 - protein, 19 aa, Staphylococcus
NLEMLFIDPKYFRKGYGTQ

SEQ ID NO: 2092166 - protein, 17 aa, Staphylococcus
NLIVYQLGALEGFCKVH

SEQ ID NO: 2092167 - protein, 18 aa, Staphylococcus
NLLQRLWDGIVEIIQSII

SEQ ID NO: 2092168 - protein, 19 aa, Staphylococcus
NLMFHFLPIAVRYDGQKAD

SEQ ID NO: 2092169 - protein, 21 aa, Staphylococcus
NLMFHFLPIAVRYDGTKAPAA

SEQ ID NO: 2092170 - protein, 24 aa, Staphylococcus
NLNGNRLFYLAMAPKFFGVISDYL

SEQ ID NO: 2092171 - protein, 17 aa, Staphylococcus
NLPLEWLKGKIIVDSLG

SEQ ID NO: 2092172 - protein, 24 aa, Staphylococcus
NLRDKFMIQLLYETGLRIGELLSL

SEQ ID NO: 2092173 - protein, 17 aa, Staphylococcus
NLRFPLWDSLDDLRETV

SEQ ID NO: 2092174 - protein, 18 aa, Staphylococcus
NLRTRLLEMIGVNEVVIN

SEQ ID NO: 2092175 - protein, 20 aa, Staphylococcus
NLSEENFLLLLFAKVLSEQM

SEQ ID NO: 2092176 - protein, 20 aa, Staphylococcus
NLTYPQFLVLSILWDESPVN

SEQ ID NO: 2092177 - protein, 25 aa, Staphylococcus
NLVNFYYPKLTFKSSILPLIKDNKV

SEQ ID NO: 2092178 - protein, 24 aa, Staphylococcus
NLVNFYYPKLTFKSSILPLIKENK

SEQ ID NO: 2092179 - protein, 21 aa, Staphylococcus
NLVNFYYPKLTFKSSILQLIK

SEQ ID NO: 2092180 - protein, 24 aa, Staphylococcus
NLVNFYYPKLTFKSSILSLIKENK

SEQ ID NO: 2092181 - protein, 17 aa, Staphylococcus
NMKELLQLIPPDKLKPF

SEQ ID NO: 2092182 - protein, 23 aa, Staphylococcus
NMLIFIYPIYWLNVPMLLKGFID

SEQ ID NO: 2092183 - protein, 23 aa, Staphylococcus
NMNPLWHIYRLVKFPKVLRQTII

SEQ ID NO: 2092184 - protein, 23 aa, Staphylococcus
NNAPFLPRFGLLITLPSTYEQIN

SEQ ID NO: 2092185 - protein, 22 aa, Staphylococcus
NNEKWIYDLLDMDATSPNDIIN

SEQ ID NO: 2092186 - protein, 23 aa, Staphylococcus
NNEPLLMDISKTPHALIAGATGS

SEQ ID NO: 2092187 - protein, 24 aa, Staphylococcus
NNFCTFCIIPWARGLMRSRDPKKV

SEQ ID NO: 2092188 - protein, 21 aa, Staphylococcus
NNGFLKFTPIGGWWNQVMLSQ

SEQ ID NO: 2092189 - protein, 24 aa, Staphylococcus
NNGLKLFIIPKKGFQKTFVTYTTK

SEQ ID NO: 2092190 - protein, 23 aa, Staphylococcus
NNIRFPEMIFGEDLQFFAEVFFN

SEQ ID NO: 2092191 - protein, 23 aa, Staphylococcus
NNKFLFFIDFIPKKTNVYDISPI

SEQ ID NO: 2092192 - protein, 25 aa, Staphylococcus
NNQSLVRFFFKSLTDYLKKRNCLYV

SEQ ID NO: 2092193 - protein, 23 aa, Staphylococcus
NNSRKWLGQLPGKTSSWFKSAKK

SEQ ID NO: 2092194 - protein, 17 aa, Staphylococcus
NPQLWWPIGYGEQPLYT

SEQ ID NO: 2092195 - protein, 28 aa, Staphylococcus
NQAVFFTRQLWNMLVLARVITIGAYNRN

SEQ ID NO: 2092196 - protein, 18 aa, Staphylococcus
NQFDAHFLMFKYRKLHQV

SEQ ID NO: 2092197 - protein, 24 aa, Staphylococcus
NRDKGLFYAWRRLVAYDPALTKDQ

SEQ ID NO: 2092198 - protein, 18 aa, Staphylococcus
NRDLLKYMPFDGSIITIS

SEQ ID NO: 2092199 - protein, 23 aa, Staphylococcus
NRKGYYLYGYRHFSSRIKGGHTN

SEQ ID NO: 2092200 - protein, 23 aa, Staphylococcus
NRLDSALIIYGAWLAGIEAVMIN

SEQ ID NO: 2092201 - protein, 20 aa, Staphylococcus
NRLFYLAMAPQFFGPISDYL

SEQ ID NO: 2092202 - protein, 25 aa, Staphylococcus
NSETFYPMPFLSPQTMWYYKSAFNT

SEQ ID NO: 2092203 - protein, 24 aa, Staphylococcus
NSLSFRAFYALPLLQNKAGIHTNA

SEQ ID NO: 2092204 - protein, 24 aa, Staphylococcus
NSLSFRAFYALPLLTNRAGIHTNA

SEQ ID NO: 2092205 - protein, 21 aa, Staphylococcus
NSMLLSLLYKNHPEELKLLLI

SEQ ID NO: 2092206 - protein, 24 aa, Staphylococcus
NSNWDMLFIVFSIHFIHILKELSK

SEQ ID NO: 2092207 - protein, 24 aa, Staphylococcus
NSQIATHFLLDLVSYILLGDPYMH

SEQ ID NO: 2092208 - protein, 24 aa, Staphylococcus
NSVVLRYGLLYGPGTWYGKDGMIY

SEQ ID NO: 2092209 - protein, 20 aa, Staphylococcus
NTIIKYIKKGVLYPLSYYDG

SEQ ID NO: 2092210 - protein, 25 aa, Staphylococcus
NTIILNYNPLLRLFLHRHELYEMNY

SEQ ID NO: 2092211 - protein, 23 aa, Staphylococcus
NTKGRMIMLYLTSDWFTEQGFSF

SEQ ID NO: 2092212 - protein, 23 aa, Staphylococcus
NTKKPLLFFTYDLEFYKNKLRGF

SEQ ID NO: 2092213 - protein, 21 aa, Staphylococcus
NTKLLQHQLLYKDIPELNQAL

SEQ ID NO: 2092214 - protein, 22 aa, Staphylococcus
NTPDSWYYSKRLLYSKLEALRA

SEQ ID NO: 2092215 - protein, 22 aa, Staphylococcus
NTPESWYFSKRLLYGKLNEIKE

SEQ ID NO: 2092216 - protein, 22 aa, Staphylococcus
NTPFFIGIMPIASYNNALFLHN

SEQ ID NO: 2092217 - protein, 24 aa, Staphylococcus
NTQLFVHGLFIYAKLRGLGILNSI

SEQ ID NO: 2092218 - protein, 17 aa, Staphylococcus
NTSRFYQYWLDRVEADI

SEQ ID NO: 2092219 - protein, 19 aa, Staphylococcus
NTVLEYHPLFIKPNKDELE

SEQ ID NO: 2092220 - protein, 25 aa, Staphylococcus
NVFGIVRMMNTFIPLLEKSEQPVVV

SEQ ID NO: 2092221 - protein, 25 aa, Staphylococcus
NVYDAYTILYLLHPEKFDVKEADVQ

SEQ ID NO: 2092222 - protein, 24 aa, Staphylococcus
NVYGIVRMMNTFIPLLEQSEQPVV

SEQ ID NO: 2092223 - protein, 19 aa, Staphylococcus
NWTYPPFELTQLDDWLYGR

SEQ ID NO: 2092224 - protein, 17 aa, Staphylococcus
NYILGLIFYRFLSEKVE

SEQ ID NO: 2092225 - protein, 22 aa, Staphylococcus
NYKLRDWLFSRQRYWGEPIPII

SEQ ID NO: 2092226 - protein, 23 aa, Staphylococcus
NYLKPVIIYFYGGGFINGHGTAE

SEQ ID NO: 2092227 - protein, 24 aa, Staphylococcus
NYTGLFRYIQLFIISNGIDTRYIS

SEQ ID NO: 2092228 - protein, 19 aa, Staphylococcus
NYTIPPYYDSMVAKLIIHE

SEQ ID NO: 2092229 - protein, 19 aa, Staphylococcus
NYWKTFAEKWLLDLGIKND

SEQ ID NO: 2092230 - protein, 26 aa, Staphylococcus
NYYKWTQWIFIQLYNKGLAYVDEVAV

SEQ ID NO: 2092231 - protein, 23 aa, Staphylococcus
PADDSYFLFYVNEPSIIVGKNQN

SEQ ID NO: 2092232 - protein, 17 aa, Staphylococcus
PANLFFGTSIPTSILVF

SEQ ID NO: 2092233 - protein, 22 aa, Staphylococcus
PAPIRMLVMFGLKLSDLVKFVE

SEQ ID NO: 2092234 - protein, 17 aa, Staphylococcus
PDKFKSFALIPLPFVKE

SEQ ID NO: 2092235 - protein, 23 aa, Staphylococcus
PDLDTWVIFPWTAGQGKVARLIC

SEQ ID NO: 2092236 - protein, 21 aa, Staphylococcus
PDLEFDFIYWLVSGVKDHEPV

SEQ ID NO: 2092237 - protein, 21 aa, Staphylococcus
PDLEFYFFKKAVDIPTELKNE

SEQ ID NO: 2092238 - protein, 21 aa, Staphylococcus
PDTGFFRFWIQGIFARWTDNP

SEQ ID NO: 2092239 - protein, 25 aa, Staphylococcus
PDTQIYLYSYWFYITANLGTKLKYD

SEQ ID NO: 2092240 - protein, 22 aa, Staphylococcus
PEELRLLLIDPKMVELAPYNDL

SEQ ID NO: 2092241 - protein, 18 aa, Staphylococcus
PEGLIPLMKIQGLGSKKI

SEQ ID NO: 2092242 - protein, 19 aa, Staphylococcus
PELLKFPFIPVSDASGIVV

SEQ ID NO: 2092243 - protein, 26 aa, Staphylococcus
PEWMLNFRLKALKLFYKIPMPQWGGD

SEQ ID NO: 2092244 - protein, 22 aa, Staphylococcus
PEYMIPRKFVWMDQLPLTSNGK

SEQ ID NO: 2092245 - protein, 27 aa, Staphylococcus
PFERALYSTFLSYLPKEDFSYPLKMNV

SEQ ID NO: 2092246 - protein, 17 aa, Staphylococcus
PFHWRFMDKLALSTLYE

SEQ ID NO: 2092247 - protein, 22 aa, Staphylococcus
PFLTRDQHRLYKLIWERFVASQ

SEQ ID NO: 2092248 - protein, 17 aa, Staphylococcus
PFMNKYNTKYWLMDSEF

SEQ ID NO: 2092249 - protein, 18 aa, Staphylococcus
PFPYFVSFIGHAPSKNPK

SEQ ID NO: 2092250 - protein, 26 aa, Staphylococcus
PFRTMGLYNMFLFKQKPADLYRQFID

SEQ ID NO: 2092251 - protein, 20 aa, Staphylococcus
PGEIIMKILAFNPDLEKLTK

SEQ ID NO: 2092252 - protein, 19 aa, Staphylococcus
PGFINFYLDNQYLTQIIPE

SEQ ID NO: 2092253 - protein, 21 aa, Staphylococcus
PGIRYILFTQGCLLRCLYCHN

SEQ ID NO: 2092254 - protein, 18 aa, Staphylococcus
PGITLYPETERFYPNGNF

SEQ ID NO: 2092255 - protein, 18 aa, Staphylococcus
PGITLYPETERFYPNGVF

SEQ ID NO: 2092256 - protein, 21 aa, Staphylococcus
PGLRYILFTQGCLLRCLYCHN

SEQ ID NO: 2092257 - protein, 18 aa, Staphylococcus
PHPFINFLNYVLLAKSDA

SEQ ID NO: 2092258 - protein, 24 aa, Staphylococcus
PIDRQLFYQFILKLPQNVFRLKGF

SEQ ID NO: 2092259 - protein, 19 aa, Staphylococcus
PIIHFALAEILYYDGQYLR

SEQ ID NO: 2092260 - protein, 20 aa, Staphylococcus
PIITTFLYPDKDFVFEDFYQ

SEQ ID NO: 2092261 - protein, 17 aa, Staphylococcus
PIKIILIDIPSNNYPLL

SEQ ID NO: 2092262 - protein, 20 aa, Staphylococcus
PILHFALAELLYFDGQYLRA

SEQ ID NO: 2092263 - protein, 20 aa, Staphylococcus
PILLTPLFPTYFFPTHSDRL

SEQ ID NO: 2092264 - protein, 20 aa, Staphylococcus
PILLTPLFPTYFFPTHSDRQ

SEQ ID NO: 2092265 - protein, 17 aa, Staphylococcus
PIRDLLPVIPEFKDFTL

SEQ ID NO: 2092266 - protein, 18 aa, Staphylococcus
PIRFNLLFERFLNPERVT

SEQ ID NO: 2092267 - protein, 19 aa, Staphylococcus
PISFELWIAILLTVEQTNT

SEQ ID NO: 2092268 - protein, 18 aa, Staphylococcus
PITDLYVHLTRHAHGNYT

SEQ ID NO: 2092269 - protein, 23 aa, Staphylococcus
PITYPAIPSVLYTLPRLSNIGVS

SEQ ID NO: 2092270 - protein, 20 aa, Staphylococcus
PIWMQARLMKAGIRPINNVV

SEQ ID NO: 2092271 - protein, 19 aa, Staphylococcus
PIYWQLQLLYLLVKTPQNL

SEQ ID NO: 2092272 - protein, 22 aa, Staphylococcus
PKAIKPWILPNFESLVRHEKID

SEQ ID NO: 2092273 - protein, 22 aa, Staphylococcus
PKLEEELKFLLIPKDPNDDKDV

SEQ ID NO: 2092274 - protein, 24 aa, Staphylococcus
PKTIYPLLNKVKFITKLYGNLVYG

SEQ ID NO: 2092275 - protein, 22 aa, Staphylococcus
PKTLLDLIRYFVLFQDDGKGHI

SEQ ID NO: 2092276 - protein, 17 aa, Staphylococcus
PLFAWDLNMGGLMNALE

SEQ ID NO: 2092277 - protein, 17 aa, Staphylococcus
PLFVFYKKIFWGKKKLF

SEQ ID NO: 2092278 - protein, 20 aa, Staphylococcus
PLFVKIGMELFYQAGPDLIK

SEQ ID NO: 2092279 - protein, 21 aa, Staphylococcus
PLFVKIGMELFYQTGPQLIAS

SEQ ID NO: 2092280 - protein, 24 aa, Staphylococcus
PLNIERYFYLLTHTNKYIDQNMEL

SEQ ID NO: 2092281 - protein, 21 aa, Staphylococcus
PLPVPIFQYLKFKPKQVQFKL

SEQ ID NO: 2092282 - protein, 17 aa, Staphylococcus
PLQFPLIALIVSGGHTE

SEQ ID NO: 2092283 - protein, 19 aa, Staphylococcus
PLSLMYMHYDYWLTYEYKK

SEQ ID NO: 2092284 - protein, 19 aa, Staphylococcus
PLYDIGAVGMRLLTKFMNE

SEQ ID NO: 2092285 - protein, 17 aa, Staphylococcus
PLYLYLSTLGMTGQTAY

SEQ ID NO: 2092286 - protein, 18 aa, Staphylococcus
PMLFFTYDLDYYKNQLRG

SEQ ID NO: 2092287 - protein, 17 aa, Staphylococcus
PMMKLPYDFYLGGKLGS

SEQ ID NO: 2092288 - protein, 18 aa, Staphylococcus
PMVLPARLPNLLINGSTG

SEQ ID NO: 2092289 - protein, 23 aa, Staphylococcus
PNILKFILKVFLDLSFIYEENGI

SEQ ID NO: 2092290 - protein, 24 aa, Staphylococcus
PNKEFQLLFLLVSNPKHIFTRNDI

SEQ ID NO: 2092291 - protein, 19 aa, Staphylococcus
PNQYKLLGLLLYAIPKSIR

SEQ ID NO: 2092292 - protein, 20 aa, Staphylococcus
PNVAVLRRYWNGEWLNETVD

SEQ ID NO: 2092293 - protein, 27 aa, Staphylococcus
PPPGYAFNWPHPGIDLPYIYEPVYSTI

SEQ ID NO: 2092294 - protein, 24 aa, Staphylococcus
PQDSDYFLFYINRPSIIIGKNQNT

SEQ ID NO: 2092295 - protein, 21 aa, Staphylococcus
PQDSYLLIRGIKTLGLRMEQV

SEQ ID NO: 2092296 - protein, 22 aa, Staphylococcus
PQDSYLLVRGIKTLGLRMEQIN

SEQ ID NO: 2092297 - protein, 19 aa, Staphylococcus
PQFDYVFPYMLQFIANLPV

SEQ ID NO: 2092298 - protein, 22 aa, Staphylococcus
PQLFKQLLMISGFDKYYQIVKC

SEQ ID NO: 2092299 - protein, 20 aa, Staphylococcus
PQNQGAWLYAYPHLKSITPE

SEQ ID NO: 2092300 - protein, 17 aa, Staphylococcus
PQRLLPDKAIDVLDITS

SEQ ID NO: 2092301 - protein, 17 aa, Staphylococcus
PQRLLPDKALDILDITA

SEQ ID NO: 2092302 - protein, 18 aa, Staphylococcus
PQTLKWLMDAGLNKPYSI

SEQ ID NO: 2092303 - protein, 20 aa, Staphylococcus
PQYMGYAPFYAVEKLLDKTD

SEQ ID NO: 2092304 - protein, 20 aa, Staphylococcus
PQYMGYAPFYAVEKLLEKTQ

SEQ ID NO: 2092305 - protein, 20 aa, Staphylococcus
PQYMIPVHFMKIDKIPITIN

SEQ ID NO: 2092306 - protein, 17 aa, Staphylococcus
PRRVGWFDSVVLRHSRR

SEQ ID NO: 2092307 - protein, 24 aa, Staphylococcus
PSATWHNFLLETRFLFFVVKDESE

SEQ ID NO: 2092308 - protein, 17 aa, Staphylococcus
PSCRIAFMVLPQNLMQR

SEQ ID NO: 2092309 - protein, 23 aa, Staphylococcus
PSDDSYFLFYVNGPSIIVGKNQN

SEQ ID NO: 2092310 - protein, 19 aa, Staphylococcus
PSEDFAYYAKALPSTFIYA

SEQ ID NO: 2092311 - protein, 21 aa, Staphylococcus
PSIDYVMFVDDFKIDGLNRAQ

SEQ ID NO: 2092312 - protein, 19 aa, Staphylococcus
PSKDLFWRLILSIAQIGCC

SEQ ID NO: 2092313 - protein, 25 aa, Staphylococcus
PSVKTLHPFFYPLNKLFSINDMIKE

SEQ ID NO: 2092314 - protein, 25 aa, Staphylococcus
PSYTSMPSFWFDPLINLTAISQVTQ

SEQ ID NO: 2092315 - protein, 20 aa, Staphylococcus
PTIVRLLDPPLHEFLPNSDE

SEQ ID NO: 2092316 - protein, 21 aa, Staphylococcus
PTKIEMLNFLLTAGAFGFVIA

SEQ ID NO: 2092317 - protein, 25 aa, Staphylococcus
PTVKQYFRMLQRPILYTGLTRAKQS

SEQ ID NO: 2092318 - protein, 19 aa, Staphylococcus
PVEKLFYIKQYLGIFTIKN

SEQ ID NO: 2092319 - protein, 17 aa, Staphylococcus
PVFIINYPTSIKPFYMQ

SEQ ID NO: 2092320 - protein, 17 aa, Staphylococcus
PVFQILFEKRSLNFKVY

SEQ ID NO: 2092321 - protein, 17 aa, Staphylococcus
PVTLLFTGPLTDLAKAL

SEQ ID NO: 2092322 - protein, 19 aa, Staphylococcus
PVWMQARLMKAGIRPINNV

SEQ ID NO: 2092323 - protein, 20 aa, Staphylococcus
PVWMQARLMKAGIRPINNVV

SEQ ID NO: 2092324 - protein, 18 aa, Staphylococcus
PWMIYRTVHYLETGELMD

SEQ ID NO: 2092325 - protein, 18 aa, Staphylococcus
PWNAPILVLMRKVIPAIV

SEQ ID NO: 2092326 - protein, 26 aa, Staphylococcus
PYGATFFVFSDYLKPALRLSSIMGLN

SEQ ID NO: 2092327 - protein, 19 aa, Staphylococcus
PYNDIFMWDYKALPAVFGG

SEQ ID NO: 2092328 - protein, 21 aa, Staphylococcus
PYVGKLTFFRVYSGTLTSGSY

SEQ ID NO: 2092329 - protein, 17 aa, Staphylococcus
QAIPNVLFQMLLRASNA

SEQ ID NO: 2092330 - protein, 21 aa, Staphylococcus
QAKSLGCQFAFYGHTHVAKHE

SEQ ID NO: 2092331 - protein, 20 aa, Staphylococcus
QALHFFSLVFKNPYLRQEEE

SEQ ID NO: 2092332 - protein, 18 aa, Staphylococcus
QALLRGHYYLRELSTPDT

SEQ ID NO: 2092333 - protein, 17 aa, Staphylococcus
QAWHKFLSGLPYIKVLD

SEQ ID NO: 2092334 - protein, 26 aa, Staphylococcus
QCFDLANQWWLYLFNHTLKGVGAADI

SEQ ID NO: 2092335 - protein, 17 aa, Staphylococcus
QCFWLDNQTFKTSDNLG

SEQ ID NO: 2092336 - protein, 18 aa, Staphylococcus
QDARWILLDLANVVVHIF

SEQ ID NO: 2092337 - protein, 17 aa, Staphylococcus
QDGIILLFPIEGSLEIQ

SEQ ID NO: 2092338 - protein, 17 aa, Staphylococcus
QDILSIESYYQDIKAKQ

SEQ ID NO: 2092339 - protein, 23 aa, Staphylococcus
QDNEIIWLYQYFTDIPIAPTTYT

SEQ ID NO: 2092340 - protein, 25 aa, Staphylococcus
QDTLQPHLFPLEYGLKSLPKIYVSD

SEQ ID NO: 2092341 - protein, 21 aa, Staphylococcus
QDVMFLLLYAIKDLGGRLNMD

SEQ ID NO: 2092342 - protein, 17 aa, Staphylococcus
QDYILISTPFQVPSKAT

SEQ ID NO: 2092343 - protein, 17 aa, Staphylococcus
QEDKIYILFHKPAQVIT

SEQ ID NO: 2092344 - protein, 24 aa, Staphylococcus
QEEGYPFFGVLYIGAILTDEGPKV

SEQ ID NO: 2092345 - protein, 24 aa, Staphylococcus
QEERGLFIVPLNGLKKWLTPVDMW

SEQ ID NO: 2092346 - protein, 26 aa, Staphylococcus
QEGYNLTFFAFFVKAVAEALKSNPLL

SEQ ID NO: 2092347 - protein, 22 aa, Staphylococcus
QEKDFLQVLVKEDNSKLPTNQN

SEQ ID NO: 2092348 - protein, 23 aa, Staphylococcus
QEMKPLYEWLGLSASLGFVDIPN

SEQ ID NO: 2092349 - protein, 24 aa, Staphylococcus
QEMRPLYEWLGLTASLGFVDIPDY

SEQ ID NO: 2092350 - protein, 17 aa, Staphylococcus
QENTVCYLWLDIQLNDV

SEQ ID NO: 2092351 - protein, 24 aa, Staphylococcus
QEQTFLDAFLKPTRLYVKPVLAVK

SEQ ID NO: 2092352 - protein, 18 aa, Staphylococcus
QETVEYFFKLGISTVLIT

SEQ ID NO: 2092353 - protein, 21 aa, Staphylococcus
QEVRAWTFRKGMTAPQCAGII

SEQ ID NO: 2092354 - protein, 18 aa, Staphylococcus
QEVRAWTFRQGMTAPQCA

SEQ ID NO: 2092355 - protein, 20 aa, Staphylococcus
QEVRAWTFRQGMTAPQCAGI

SEQ ID NO: 2092356 - protein, 21 aa, Staphylococcus
QEVRAWTFRQGMTAPQCAGII

SEQ ID NO: 2092357 - protein, 19 aa, Staphylococcus
QFAFLNLMKHMFKNEAYRF

SEQ ID NO: 2092358 - protein, 22 aa, Staphylococcus
QFEGFTFDYYISNPPFGVDWKK

SEQ ID NO: 2092359 - protein, 18 aa, Staphylococcus
QFESSVFPLILRGISILG

SEQ ID NO: 2092360 - protein, 17 aa, Staphylococcus
QFFLFDTTSRIIGSEPD

SEQ ID NO: 2092361 - protein, 18 aa, Staphylococcus
QFGFLLDAFKYGAPPHGG

SEQ ID NO: 2092362 - protein, 21 aa, Staphylococcus
QFLYYRMKLLNFRKFIIGSTI

SEQ ID NO: 2092363 - protein, 22 aa, Staphylococcus
QFPYISFIPVIYPTVISLKGFK

SEQ ID NO: 2092364 - protein, 18 aa, Staphylococcus
QFQFLDYAQIAFVSAKEG

SEQ ID NO: 2092365 - protein, 26 aa, Staphylococcus
QFRNIIKQLYFFSIANPDPFQWLNQL

SEQ ID NO: 2092366 - protein, 20 aa, Staphylococcus
QFTTGWIFFIDDSGHHELVA

SEQ ID NO: 2092367 - protein, 17 aa, Staphylococcus
QFWIQQMLNNGLLEDVV

SEQ ID NO: 2092368 - protein, 21 aa, Staphylococcus
QGAWSFVYPYLKELTTDKYDL

SEQ ID NO: 2092369 - protein, 26 aa, Staphylococcus
QGIKLTFLPYVVKALVSALKKYPALN

SEQ ID NO: 2092370 - protein, 27 aa, Staphylococcus
QGIKLTFLPYVVKALVSALKKYPALNT

SEQ ID NO: 2092371 - protein, 23 aa, Staphylococcus
QGQRGLFIVPLNGFKKWLTPVDM

SEQ ID NO: 2092372 - protein, 23 aa, Staphylococcus
QIAGPGFINFYLDNAYLTEVISE

SEQ ID NO: 2092373 - protein, 18 aa, Staphylococcus
QIFKQLLMISGFDKYYQI

SEQ ID NO: 2092374 - protein, 20 aa, Staphylococcus
QIFNYLWGYIISHLSKKSKV

SEQ ID NO: 2092375 - protein, 20 aa, Staphylococcus
QIKSPMVGTFFLQDEKELTN

SEQ ID NO: 2092376 - protein, 17 aa, Staphylococcus
QIMLAIPDIFWSIELDL

SEQ ID NO: 2092377 - protein, 21 aa, Staphylococcus
QINNVLAFPGIFRGALDTEAT

SEQ ID NO: 2092378 - protein, 20 aa, Staphylococcus
QINNVLAFPGIFRGALDTES

SEQ ID NO: 2092379 - protein, 17 aa, Staphylococcus
QINWVGFYLIDNQELIL

SEQ ID NO: 2092380 - protein, 23 aa, Staphylococcus
QIYIVPYLWFTGILDQQIIDTVT

SEQ ID NO: 2092381 - protein, 17 aa, Staphylococcus
QKADLLLWFLRPEMKDL

SEQ ID NO: 2092382 - protein, 23 aa, Staphylococcus
QKKYPYYNYVWSLKKPSAHVVPG

SEQ ID NO: 2092383 - protein, 31 aa, Staphylococcus
QKLTLETYVLIYYLERIIAQANLRLATMSGQ

SEQ ID NO: 2092384 - protein, 25 aa, Staphylococcus
QKNQFPWCVAAFPSKAWAQRVYPDL

SEQ ID NO: 2092385 - protein, 21 aa, Staphylococcus
QKRLYLLKLLVHQPNVLLLDE

SEQ ID NO: 2092386 - protein, 17 aa, Staphylococcus
QKTSFPRLIKVKELYKL

SEQ ID NO: 2092387 - protein, 21 aa, Staphylococcus
QKVIVFWNPWDSDVSLQPVDS

SEQ ID NO: 2092388 - protein, 17 aa, Staphylococcus
QKYFYLKYLKQSSSTHR

SEQ ID NO: 2092389 - protein, 19 aa, Staphylococcus
QLAALYWSYGHFAKEIEMG

SEQ ID NO: 2092390 - protein, 22 aa, Staphylococcus
QLETIFYRLFSGRATRSRLGMS

SEQ ID NO: 2092391 - protein, 20 aa, Staphylococcus
QLFKQLLMISGFDKYYQIVK

SEQ ID NO: 2092392 - protein, 17 aa, Staphylococcus
QLIETILLNIINFHTLI

SEQ ID NO: 2092393 - protein, 19 aa, Staphylococcus
QLILPIQFNKVFMIDFKAF

SEQ ID NO: 2092394 - protein, 19 aa, Staphylococcus
QLLANLYYLKEITPVDMFP

SEQ ID NO: 2092395 - protein, 19 aa, Staphylococcus
QLLIKRLIKTYGMTAIFVT

SEQ ID NO: 2092396 - protein, 18 aa, Staphylococcus
QLLTRYLIDLGHKTFLFL

SEQ ID NO: 2092397 - protein, 19 aa, Staphylococcus
QLMKAFKILKPHGTVVSIN

SEQ ID NO: 2092398 - protein, 23 aa, Staphylococcus
QLQGNRLFYLAMAPQFFGIISDF

SEQ ID NO: 2092399 - protein, 17 aa, Staphylococcus
QLVIAYEPIWAIGTGKS

SEQ ID NO: 2092400 - protein, 29 aa, Staphylococcus
QLYDYIPKLLWPLYYFFQAPVQGLIMRGF

SEQ ID NO: 2092401 - protein, 17 aa, Staphylococcus
QMDLLGHDFFIFTDRET

SEQ ID NO: 2092402 - protein, 17 aa, Staphylococcus
QMELLGHDFYIFTDRET

SEQ ID NO: 2092403 - protein, 18 aa, Staphylococcus
QMNLLKDLELPLARILSK

SEQ ID NO: 2092404 - protein, 22 aa, Staphylococcus
QMSQFIFAYILDDYKKMAVSRR

SEQ ID NO: 2092405 - protein, 23 aa, Staphylococcus
QNDKQRALYKQELAWMRAGAKAR

SEQ ID NO: 2092406 - protein, 22 aa, Staphylococcus
QNEKGLFIVPLNGLKKWQTPID

SEQ ID NO: 2092407 - protein, 25 aa, Staphylococcus
QNEYLVYMLGFMPGFPFLGGLDSRL

SEQ ID NO: 2092408 - protein, 23 aa, Staphylococcus
QNGLRLFVIPKPGFQKTFVTYTT

SEQ ID NO: 2092409 - protein, 23 aa, Staphylococcus
QNGRPINPIKWLKAHPGKKGGKS

SEQ ID NO: 2092410 - protein, 17 aa, Staphylococcus
QNLILLFLESWYLRASF

SEQ ID NO: 2092411 - protein, 20 aa, Staphylococcus
QNMFVTMFYGLYEELNHLLY

SEQ ID NO: 2092412 - protein, 23 aa, Staphylococcus
QNQKQRALYKQELSWMRAGAKAR

SEQ ID NO: 2092413 - protein, 20 aa, Staphylococcus
QNVHFEVLLVKLAEMIKAQP

SEQ ID NO: 2092414 - protein, 24 aa, Staphylococcus
QPDFDRPWNYLNVLAQSALGDDVF

SEQ ID NO: 2092415 - protein, 17 aa, Staphylococcus
QPDNLYQLLRKLPPREY

SEQ ID NO: 2092416 - protein, 17 aa, Staphylococcus
QPENMYQLLRKLPPREY

SEQ ID NO: 2092417 - protein, 19 aa, Staphylococcus
QPIFEGIEWIIVSLGSKGA

SEQ ID NO: 2092418 - protein, 25 aa, Staphylococcus
QPNTLKFMLKVFLELGFIIDSNGII

SEQ ID NO: 2092419 - protein, 22 aa, Staphylococcus
QQFEKHIYAIHTLTSLYTTTTS

SEQ ID NO: 2092420 - protein, 23 aa, Staphylococcus
QQFEKHMYAIHTLTSIYANNESK

SEQ ID NO: 2092421 - protein, 21 aa, Staphylococcus
QQFEKHMYAIHTLTSLYSDVS

SEQ ID NO: 2092422 - protein, 30 aa, Staphylococcus
QQLMDVFWPGPISFILPLKEGFLCKRVSGG

SEQ ID NO: 2092423 - protein, 17 aa, Staphylococcus
QQQLIVQNLSRQYDFAK

SEQ ID NO: 2092424 - protein, 24 aa, Staphylococcus
QQSDAFLWQLLADNLQQLNLPLNK

SEQ ID NO: 2092425 - protein, 17 aa, Staphylococcus
QQYLKYLKKQFPNRLYV

SEQ ID NO: 2092426 - protein, 18 aa, Staphylococcus
QRAYIAMTIAQDTDYILL

SEQ ID NO: 2092427 - protein, 19 aa, Staphylococcus
QRLFEEGAYIYYLGSFIDS

SEQ ID NO: 2092428 - protein, 19 aa, Staphylococcus
QRQMELIKILFKKAQKLDS

SEQ ID NO: 2092429 - protein, 20 aa, Staphylococcus
QRVALMMALISKPQCLVLDE

SEQ ID NO: 2092430 - protein, 18 aa, Staphylococcus
QRVWIAMALAQKTDIIFL

SEQ ID NO: 2092431 - protein, 22 aa, Staphylococcus
QSFIANKLRLLKLAPKVLERLR

SEQ ID NO: 2092432 - protein, 17 aa, Staphylococcus
QSFTLLTKALRPLPDKF

SEQ ID NO: 2092433 - protein, 19 aa, Staphylococcus
QSHHLDELILYLAPKLIGG

SEQ ID NO: 2092434 - protein, 25 aa, Staphylococcus
QSHIETYIWYKLLVNLGINSVTAAG

SEQ ID NO: 2092435 - protein, 17 aa, Staphylococcus
QSQLNHTKLYYKWLKNL

SEQ ID NO: 2092436 - protein, 19 aa, Staphylococcus
QSTLIKHQALMRGFLVAEF

SEQ ID NO: 2092437 - protein, 24 aa, Staphylococcus
QTDFINQLIIYYAPKIIGGSGKNQ

SEQ ID NO: 2092438 - protein, 22 aa, Staphylococcus
QTEIWFMSITKHNIKWINNADL

SEQ ID NO: 2092439 - protein, 19 aa, Staphylococcus
QTLMKILFLLLPKSKFAVE

SEQ ID NO: 2092440 - protein, 26 aa, Staphylococcus
QTRAEWLLLDLFKWSRTDYLIHREEQ

SEQ ID NO: 2092441 - protein, 18 aa, Staphylococcus
QTVIKYRVPVCCFTFGIP

SEQ ID NO: 2092442 - protein, 17 aa, Staphylococcus
QVTILYFYPRDNTPTCT

SEQ ID NO: 2092443 - protein, 17 aa, Staphylococcus
QVVIAYEPIWAIGTGKS

SEQ ID NO: 2092444 - protein, 17 aa, Staphylococcus
QWDLLRLLENELQAFGL

SEQ ID NO: 2092445 - protein, 23 aa, Staphylococcus
QYDELIIVPLFLFDGRLVNKVKR

SEQ ID NO: 2092446 - protein, 19 aa, Staphylococcus
QYMGYAPFYAVEKLLEKTH

SEQ ID NO: 2092447 - protein, 23 aa, Staphylococcus
QYNDCLLFFRLGDFYEMFFDDAK

SEQ ID NO: 2092448 - protein, 23 aa, Staphylococcus
QYQDCLLFFRLGDFYEMFFEDAK

SEQ ID NO: 2092449 - protein, 19 aa, Staphylococcus
QYTLVQLLAKKFKNLCVVG

SEQ ID NO: 2092450 - protein, 22 aa, Staphylococcus
RADLEILLYDRGPRILRNFPEK

SEQ ID NO: 2092451 - protein, 23 aa, Staphylococcus
RAEWLMLDLFEWSRTDYLMHMYD

SEQ ID NO: 2092452 - protein, 23 aa, Staphylococcus
RAEWLMLDLFHWTRTDYLMHMYD

SEQ ID NO: 2092453 - protein, 20 aa, Staphylococcus
RAEWLMLDLFNWSKANYLMH

SEQ ID NO: 2092454 - protein, 22 aa, Staphylococcus
RAFDLLLELGFPRNVMSLSPFQ

SEQ ID NO: 2092455 - protein, 20 aa, Staphylococcus
RAFIGSFLFGGRYSSSKFKI

SEQ ID NO: 2092456 - protein, 18 aa, Staphylococcus
RAFVLIPLNDIAPTQIEP

SEQ ID NO: 2092457 - protein, 18 aa, Staphylococcus
RALTKVFTRFGIDVDFVD

SEQ ID NO: 2092458 - protein, 23 aa, Staphylococcus
RAQIFELYPLYDNDIRLALNRAL

SEQ ID NO: 2092459 - protein, 17 aa, Staphylococcus
RAQYTLVQLLAKKFKNL

SEQ ID NO: 2092460 - protein, 24 aa, Staphylococcus
RAVQPQMLFIPFKGEHVDGHRFVK

SEQ ID NO: 2092461 - protein, 17 aa, Staphylococcus
RAWTFRQGMTAPQCAGI

SEQ ID NO: 2092462 - protein, 23 aa, Staphylococcus
RAYKLLIDFGFSRDILQQSPFQM

SEQ ID NO: 2092463 - protein, 18 aa, Staphylococcus
RCCRYFIDILRKSTNGRI

SEQ ID NO: 2092464 - protein, 17 aa, Staphylococcus
RCCRYFIDLIRQSEFGR

SEQ ID NO: 2092465 - protein, 24 aa, Staphylococcus
RDEDTWMLFGTLPIYPCINDENDQ

SEQ ID NO: 2092466 - protein, 24 aa, Staphylococcus
RDENVWMLFGTLPIYPCINDENDQ

SEQ ID NO: 2092467 - protein, 22 aa, Staphylococcus
RDIQFDVIFLDPPYKKGLIDEA

SEQ ID NO: 2092468 - protein, 25 aa, Staphylococcus
RDIQFDYIFLDPPYNKGLIDKALIQ

SEQ ID NO: 2092469 - protein, 23 aa, Staphylococcus
RDKAPFKKALLFAPLYPIDASTS

SEQ ID NO: 2092470 - protein, 24 aa, Staphylococcus
RDKDTWMLFGTLPIYPCIQDEDDK

SEQ ID NO: 2092471 - protein, 24 aa, Staphylococcus
RDKNTWMLFGTLPIYPCINDENDQ

SEQ ID NO: 2092472 - protein, 19 aa, Staphylococcus
RDLLPVIPEFKDFTLIGGN

SEQ ID NO: 2092473 - protein, 24 aa, Staphylococcus
RDLNEIYDFILIDTPPVISVTDAQ

SEQ ID NO: 2092474 - protein, 17 aa, Staphylococcus
RDQHRLYKLIWERFVAS

SEQ ID NO: 2092475 - protein, 19 aa, Staphylococcus
RDVPQLIWHGLPLTEAFLF

SEQ ID NO: 2092476 - protein, 17 aa, Staphylococcus
RDYFAARQLLNKAIVNL

SEQ ID NO: 2092477 - protein, 17 aa, Staphylococcus
RDYLFFKFAIHTGVKLS

SEQ ID NO: 2092478 - protein, 17 aa, Staphylococcus
RDYLLFKLAIHTGIRLT

SEQ ID NO: 2092479 - protein, 17 aa, Staphylococcus
RDYLLLSFAIHTGVKLS

SEQ ID NO: 2092480 - protein, 17 aa, Staphylococcus
RDYLPFESLILDLNQPF

SEQ ID NO: 2092481 - protein, 18 aa, Staphylococcus
REEGFYTAWLHLAQHDPA

SEQ ID NO: 2092482 - protein, 24 aa, Staphylococcus
REIQFDYIFLDPPYNKGLIDKALE

SEQ ID NO: 2092483 - protein, 19 aa, Staphylococcus
REKLLFPYQLLAFINNHHQ

SEQ ID NO: 2092484 - protein, 17 aa, Staphylococcus
REKRIVISLTYVYGIGT

SEQ ID NO: 2092485 - protein, 23 aa, Staphylococcus
REKRVVISLTYIYGIGTSTAQKI

SEQ ID NO: 2092486 - protein, 22 aa, Staphylococcus
REYGLNHFVLPKVLISIEGDRT

SEQ ID NO: 2092487 - protein, 23 aa, Staphylococcus
RFDNVYFIRLLQQLSIHLVAFDE

SEQ ID NO: 2092488 - protein, 19 aa, Staphylococcus
RFEFRWIDQFNLSLDPDRA

SEQ ID NO: 2092489 - protein, 24 aa, Staphylococcus
RFENNQFMKLLYGLDIKLVAFDEA

SEQ ID NO: 2092490 - protein, 25 aa, Staphylococcus
RFENSYFLNLLRKVNIHLVAFDEAH

SEQ ID NO: 2092491 - protein, 24 aa, Staphylococcus
RFHSIIWPILLMALDIPLPKKVFA

SEQ ID NO: 2092492 - protein, 28 aa, Staphylococcus
RFREILKRFYYFSIANPSPFKWLDSLVD

SEQ ID NO: 2092493 - protein, 20 aa, Staphylococcus
RGDTLKPLPAYWIPFAQQLF

SEQ ID NO: 2092494 - protein, 18 aa, Staphylococcus
RGEKIRFLKKPPSAWVVL

SEQ ID NO: 2092495 - protein, 24 aa, Staphylococcus
RGKDEHFPFLMFGPGIGPHQVDEC

SEQ ID NO: 2092496 - protein, 23 aa, Staphylococcus
RGPLIRFLIVKLENGYKIIMENH

SEQ ID NO: 2092497 - protein, 22 aa, Staphylococcus
RGSFYIWFEFSISINVKTLFNE

SEQ ID NO: 2092498 - protein, 23 aa, Staphylococcus
RGSKIKLIGVLLPSLTNPFFSTI

SEQ ID NO: 2092499 - protein, 18 aa, Staphylococcus
RGYVLRRLLRRAVRFSQS

SEQ ID NO: 2092500 - protein, 22 aa, Staphylococcus
RHELMDSVFLWQSGSKYRVAAH

SEQ ID NO: 2092501 - protein, 18 aa, Staphylococcus
RHPLPVPRFKYFKLKCNR

SEQ ID NO: 2092502 - protein, 18 aa, Staphylococcus
RHVLPFNKHNRYLVMPAL

SEQ ID NO: 2092503 - protein, 22 aa, Staphylococcus
RIFDFPFYFRGEVYHPFETETL

SEQ ID NO: 2092504 - protein, 21 aa, Staphylococcus
RIKLKYLFKLSDKKKYILYCP

SEQ ID NO: 2092505 - protein, 21 aa, Staphylococcus
RIKLLHEWIGGKMPLIGIGSI

SEQ ID NO: 2092506 - protein, 27 aa, Staphylococcus
RIKNHVILRYGWLYGPGTWYGEDGMIY

SEQ ID NO: 2092507 - protein, 19 aa, Staphylococcus
RIVISLTYVYGIGTSTAKK

SEQ ID NO: 2092508 - protein, 19 aa, Staphylococcus
RIVISLTYVYGIGTSTANK

SEQ ID NO: 2092509 - protein, 24 aa, Staphylococcus
RKDYDLIFYRSYTNALMPYNFLNA

SEQ ID NO: 2092510 - protein, 21 aa, Staphylococcus
RKEPILFQWQDDFVVGVMLAS

SEQ ID NO: 2092511 - protein, 23 aa, Staphylococcus
RKGPNIKLPSFDLLEEPEPHEVD

SEQ ID NO: 2092512 - protein, 18 aa, Staphylococcus
RKIEKDMLFIPFKGENVD

SEQ ID NO: 2092513 - protein, 17 aa, Staphylococcus
RKIKADVPIYYYGLEKN

SEQ ID NO: 2092514 - protein, 24 aa, Staphylococcus
RKLDERLWLLNRAGKIPFVVSGQG

SEQ ID NO: 2092515 - protein, 20 aa, Staphylococcus
RKNIPFDELVLFSSPRSAGT

SEQ ID NO: 2092516 - protein, 20 aa, Staphylococcus
RKWIPLMMQGRFDDGLMAAS

SEQ ID NO: 2092517 - protein, 18 aa, Staphylococcus
RLAQLVIVPIWKPELEPV

SEQ ID NO: 2092518 - protein, 25 aa, Staphylococcus
RLEFYRLYLFMVHLLKFGGMYANSV

SEQ ID NO: 2092519 - protein, 24 aa, Staphylococcus
RLEFYRLYLFMVHLVKFGGMYASS

SEQ ID NO: 2092520 - protein, 26 aa, Staphylococcus
RLEFYRLYLLMIHLLKFGGMYASSVN

SEQ ID NO: 2092521 - protein, 21 aa, Staphylococcus
RLEFYRLYLLMVHLVKFGEMY

SEQ ID NO: 2092522 - protein, 17 aa, Staphylococcus
RLFVIPKKGFQKTYVTY

SEQ ID NO: 2092523 - protein, 29 aa, Staphylococcus
RLIPYFIYHNYWFLYYHDHQYFACKFQSN

SEQ ID NO: 2092524 - protein, 20 aa, Staphylococcus
RLKDIIEIFLDSGLGKEAFS

SEQ ID NO: 2092525 - protein, 22 aa, Staphylococcus
RLKLIHHWINGRMPLIGIGSIF

SEQ ID NO: 2092526 - protein, 20 aa, Staphylococcus
RLLEQFLIEVLNYNWEEVHQ

SEQ ID NO: 2092527 - protein, 17 aa, Staphylococcus
RLLVISPYDKTSVADIE

SEQ ID NO: 2092528 - protein, 17 aa, Staphylococcus
RLLVVSPYDKTSLSDIE

SEQ ID NO: 2092529 - protein, 25 aa, Staphylococcus
RLPEYMIPRKFVWMKQLPLTSNGKL

SEQ ID NO: 2092530 - protein, 18 aa, Staphylococcus
RLPLYYRFVSNLKSKGID

SEQ ID NO: 2092531 - protein, 18 aa, Staphylococcus
RLSEICGLLIKYGKPIDT

SEQ ID NO: 2092532 - protein, 17 aa, Staphylococcus
RLVIFRFSKDAGLNELL

SEQ ID NO: 2092533 - protein, 17 aa, Staphylococcus
RLWDGIVEIIQSIIQFF

SEQ ID NO: 2092534 - protein, 21 aa, Staphylococcus
RMEEEMFLGLRMNKGVDKVKF

SEQ ID NO: 2092535 - protein, 25 aa, Staphylococcus
RNSRRSLLWLWYDDDWKLYFHQGTP

SEQ ID NO: 2092536 - protein, 17 aa, Staphylococcus
RNTPFMRLYETDGIRNE

SEQ ID NO: 2092537 - protein, 18 aa, Staphylococcus
RPLLVFLTLDVLNQDYKK

SEQ ID NO: 2092538 - protein, 18 aa, Staphylococcus
RPLVCYFSNDLNIHRTKT

SEQ ID NO: 2092539 - protein, 21 aa, Staphylococcus
RPTIVRLLDPPLHEFLPKSEE

SEQ ID NO: 2092540 - protein, 18 aa, Staphylococcus
RPWNYLNVLAQQALGETY

SEQ ID NO: 2092541 - protein, 19 aa, Staphylococcus
RQCAIVWGVYPVVKEGRKN

SEQ ID NO: 2092542 - protein, 19 aa, Staphylococcus
RQFGLNHFVLPKVLITMEE

SEQ ID NO: 2092543 - protein, 21 aa, Staphylococcus
RQLFYQFIMQLPKNVMRLKGY

SEQ ID NO: 2092544 - protein, 17 aa, Staphylococcus
RQLLPMYLKYKLKSKSK

SEQ ID NO: 2092545 - protein, 25 aa, Staphylococcus
RQQLDLFTCLRPVRWFKGVPSPVKR

SEQ ID NO: 2092546 - protein, 22 aa, Staphylococcus
RQRVWIAMALAQKTDIIFLDEP

SEQ ID NO: 2092547 - protein, 18 aa, Staphylococcus
RQYDFRWQPSILSRSIRD

SEQ ID NO: 2092548 - protein, 21 aa, Staphylococcus
RRAIQYYLKTKKLLSSRKKVQ

SEQ ID NO: 2092549 - protein, 18 aa, Staphylococcus
RRESIFFTYILKHHPRFK

SEQ ID NO: 2092550 - protein, 20 aa, Staphylococcus
RREYYIFFLLCEGKSINEIA

SEQ ID NO: 2092551 - protein, 20 aa, Staphylococcus
RREYYIFFLLCEGKSMNEIA

SEQ ID NO: 2092552 - protein, 17 aa, Staphylococcus
RRKSMLEDIAILTGAQF

SEQ ID NO: 2092553 - protein, 24 aa, Staphylococcus
RRVSPFFVPMLIPDMATGQVSIDT

SEQ ID NO: 2092554 - protein, 23 aa, Staphylococcus
RRYPDLIVHRLIRKYIIEQSMDR

SEQ ID NO: 2092555 - protein, 17 aa, Staphylococcus
RSAAFFALGLIKGSKKP

SEQ ID NO: 2092556 - protein, 22 aa, Staphylococcus
RSDLEILLYDRGPRILRNFPEK

SEQ ID NO: 2092557 - protein, 21 aa, Staphylococcus
RSDYFWDLFIQMPAALMFPSG

SEQ ID NO: 2092558 - protein, 23 aa, Staphylococcus
RSDYPWDLFIQMPAALMFPSGNR

SEQ ID NO: 2092559 - protein, 24 aa, Staphylococcus
RSETYKKVLFMPYNRHRIYSRNMM

SEQ ID NO: 2092560 - protein, 26 aa, Staphylococcus
RSISGYPFIWWFATKPSYDGQGYGSQ

SEQ ID NO: 2092561 - protein, 21 aa, Staphylococcus
RSLTLPHLFSEILIYSNERHV

SEQ ID NO: 2092562 - protein, 19 aa, Staphylococcus
RSVFKYVFKYYDLQDISVL

SEQ ID NO: 2092563 - protein, 24 aa, Staphylococcus
RSWEFQITLPYFLSNEDYLIFTHA

SEQ ID NO: 2092564 - protein, 19 aa, Staphylococcus
RSYLAEWLPFVAYTNQVED

SEQ ID NO: 2092565 - protein, 24 aa, Staphylococcus
RTHGYDFPMWFIRPFYAKETTKNK

SEQ ID NO: 2092566 - protein, 27 aa, Staphylococcus
RTHGYDFPMWFIRPFYAKSTKLNAVKS

SEQ ID NO: 2092567 - protein, 25 aa, Staphylococcus
RTINYQLFLNLYYRLFPKYTGEGLA

SEQ ID NO: 2092568 - protein, 25 aa, Staphylococcus
RTLMPFAYIFRCIYGRAMKARWKKW

SEQ ID NO: 2092569 - protein, 18 aa, Staphylococcus
RTQLILEIFALRAKSKEG

SEQ ID NO: 2092570 - protein, 18 aa, Staphylococcus
RTQLILEIFALRAKSREG

SEQ ID NO: 2092571 - protein, 20 aa, Staphylococcus
RTQLILEIFALRASSREGKL

SEQ ID NO: 2092572 - protein, 17 aa, Staphylococcus
RTRKLPLTVLLRALGFS

SEQ ID NO: 2092573 - protein, 23 aa, Staphylococcus
RTRKLPLTVLLRALGYSTDQSII

SEQ ID NO: 2092574 - protein, 23 aa, Staphylococcus
RTWEFHITLPYFLSHEDYLLFNH

SEQ ID NO: 2092575 - protein, 24 aa, Staphylococcus
RTYAFTELFLFELRMQWLNRLEKA

SEQ ID NO: 2092576 - protein, 17 aa, Staphylococcus
RVEYFVSFYDYYQPEAY

SEQ ID NO: 2092577 - protein, 20 aa, Staphylococcus
RVFNMIPFKVQVMGGIAIHK

SEQ ID NO: 2092578 - protein, 17 aa, Staphylococcus
RVGWFDSVVLRHSRRAS

SEQ ID NO: 2092579 - protein, 17 aa, Staphylococcus
RVGWFDSVVLRHSRRVS

SEQ ID NO: 2092580 - protein, 18 aa, Staphylococcus
RVGYKFVDGKKIRIAKKS

SEQ ID NO: 2092581 - protein, 19 aa, Staphylococcus
RVGYKFVDGKKVRIAKKSG

SEQ ID NO: 2092582 - protein, 17 aa, Staphylococcus
RVLPYASITIRQAGKEH

SEQ ID NO: 2092583 - protein, 22 aa, Staphylococcus
RVPEGLIPLLKIQGLGSKKIAK

SEQ ID NO: 2092584 - protein, 18 aa, Staphylococcus
RVPEYFITLIYQLLDDTA

SEQ ID NO: 2092585 - protein, 17 aa, Staphylococcus
RVTVYWHYFLRPEVKFS

SEQ ID NO: 2092586 - protein, 18 aa, Staphylococcus
RWGAPFPVIEIVKRGINK

SEQ ID NO: 2092587 - protein, 18 aa, Staphylococcus
RWKLLYIADPDYMVRPPF

SEQ ID NO: 2092588 - protein, 18 aa, Staphylococcus
RYRLLIGGYFRIIDNERG

SEQ ID NO: 2092589 - protein, 17 aa, Staphylococcus
RYVFPYYDTLYTLEKLS

SEQ ID NO: 2092590 - protein, 18 aa, Staphylococcus
RYVLPFNEGNRYLVMPAL

SEQ ID NO: 2092591 - protein, 17 aa, Staphylococcus
RYWECPIGCYEWEDLAE

SEQ ID NO: 2092592 - protein, 23 aa, Staphylococcus
SADYLCGFGQLFQYLRKEMIAEA

SEQ ID NO: 2092593 - protein, 19 aa, Staphylococcus
SAIKPWILPNFESLVRHEK

SEQ ID NO: 2092594 - protein, 23 aa, Staphylococcus
SALDYFLVHLKKWNYSYAYSMRL

SEQ ID NO: 2092595 - protein, 23 aa, Staphylococcus
SALQLWLLRINYLDQPQFYPSIE

SEQ ID NO: 2092596 - protein, 17 aa, Staphylococcus
SARWILIDLVNVVVHVF

SEQ ID NO: 2092597 - protein, 27 aa, Staphylococcus
SAYHILDMIFWFGHLYILKANGLDVTT

SEQ ID NO: 2092598 - protein, 22 aa, Staphylococcus
SAYHILDMIFWFGNLNILSANN

SEQ ID NO: 2092599 - protein, 21 aa, Staphylococcus
SCPNLKWIAWYATGVNNLPLE

SEQ ID NO: 2092600 - protein, 18 aa, Staphylococcus
SCYIISLAAALERARFDN

SEQ ID NO: 2092601 - protein, 24 aa, Staphylococcus
SDFTTGWIFFIDDFGHHELVSSVN

SEQ ID NO: 2092602 - protein, 25 aa, Staphylococcus
SDKKYIYNWIKLEKLLFEKLHDFIE

SEQ ID NO: 2092603 - protein, 17 aa, Staphylococcus
SDLILYVSYFNHSFTEN

SEQ ID NO: 2092604 - protein, 22 aa, Staphylococcus
SDPYLKRRFLQKSFLKAIDSEW

SEQ ID NO: 2092605 - protein, 23 aa, Staphylococcus
SDRLRQFFDFITNFGIMVKGTGE

SEQ ID NO: 2092606 - protein, 23 aa, Staphylococcus
SDSMHVLPFKTFFVPARGGLGEN

SEQ ID NO: 2092607 - protein, 18 aa, Staphylococcus
SDYPWDLLIQMPAALMYP

SEQ ID NO: 2092608 - protein, 23 aa, Staphylococcus
SEADLILFVLNYNEGLTEEDRKL

SEQ ID NO: 2092609 - protein, 23 aa, Staphylococcus
SECKRAIILPNNKNILMASEQAA

SEQ ID NO: 2092610 - protein, 24 aa, Staphylococcus
SEEKVRFKLYKAGKHWIKAGLKDI

SEQ ID NO: 2092611 - protein, 25 aa, Staphylococcus
SEHGITFIPYFPLVSGLLAGKYNEN

SEQ ID NO: 2092612 - protein, 23 aa, Staphylococcus
SEHPDFLIVIYHGGLYKINQTNT

SEQ ID NO: 2092613 - protein, 18 aa, Staphylococcus
SEKHKIIMFILAQIEYFS

SEQ ID NO: 2092614 - protein, 20 aa, Staphylococcus
SEKWPIFLERSLVDQIITVS

SEQ ID NO: 2092615 - protein, 24 aa, Staphylococcus
SENLKHLLLQPPMKGKQILGVDPA

SEQ ID NO: 2092616 - protein, 24 aa, Staphylococcus
SENLRHLLLQPPMRGKQILGIDPA

SEQ ID NO: 2092617 - protein, 17 aa, Staphylococcus
SERAFVLIPLNDIAPTQ

SEQ ID NO: 2092618 - protein, 25 aa, Staphylococcus
SESIHLLPFNVFFVPARGGLGENMV

SEQ ID NO: 2092619 - protein, 26 aa, Staphylococcus
SESIHLLPFNVFFVPARGGLGENMVY

SEQ ID NO: 2092620 - protein, 22 aa, Staphylococcus
SETAFPLLYTHFVRRGNWSLQQ

SEQ ID NO: 2092621 - protein, 23 aa, Staphylococcus
SETLPVIIWFYGGGFLNGHGSAE

SEQ ID NO: 2092622 - protein, 22 aa, Staphylococcus
SFCSILIHHGFSILYISKHLGH

SEQ ID NO: 2092623 - protein, 19 aa, Staphylococcus
SFEYVFPYMMQFIDKLPVV

SEQ ID NO: 2092624 - protein, 19 aa, Staphylococcus
SFFMPKIHFIIYGTQKYSI

SEQ ID NO: 2092625 - protein, 21 aa, Staphylococcus
SFFVKFHWRPVHGLESLVWDE

SEQ ID NO: 2092626 - protein, 20 aa, Staphylococcus
SFIANKLRLLKLAPKVINRL

SEQ ID NO: 2092627 - protein, 20 aa, Staphylococcus
SFIANKLRLLKLAPKVITRL

SEQ ID NO: 2092628 - protein, 20 aa, Staphylococcus
SFIANKLRLLKLAPNVIKRL

SEQ ID NO: 2092629 - protein, 18 aa, Staphylococcus
SFIDFYHKRLLIADKKPN

SEQ ID NO: 2092630 - protein, 18 aa, Staphylococcus
SFNKVFGYFIEITRANLK

SEQ ID NO: 2092631 - protein, 22 aa, Staphylococcus
SFQQWLVLFLNEQLTYADGLTM

SEQ ID NO: 2092632 - protein, 20 aa, Staphylococcus
SFRAFYALPLLSNKAGIHTN

SEQ ID NO: 2092633 - protein, 25 aa, Staphylococcus
SFSLTDLYLFIFNNSIKTLTIVTNK

SEQ ID NO: 2092634 - protein, 26 aa, Staphylococcus
SFSSMLFAIYILFGGKYNASFFDKAK

SEQ ID NO: 2092635 - protein, 24 aa, Staphylococcus
SFSTLYEWAINKRNFFSTTFMSLY

SEQ ID NO: 2092636 - protein, 23 aa, Staphylococcus
SFTYTFLGFLPRKEKEKLDVLQE

SEQ ID NO: 2092637 - protein, 22 aa, Staphylococcus
SFTYTFLGFLPRKEKQKHSILE

SEQ ID NO: 2092638 - protein, 21 aa, Staphylococcus
SGDFEPLRFFPKDKSAAVLGL

SEQ ID NO: 2092639 - protein, 21 aa, Staphylococcus
SGIIKKLFLLGIMANINQSLD

SEQ ID NO: 2092640 - protein, 17 aa, Staphylococcus
SGKWFFDRFSPVTNIKA

SEQ ID NO: 2092641 - protein, 23 aa, Staphylococcus
SGKYYLIEPPFRGFPDFIETTVD

SEQ ID NO: 2092642 - protein, 21 aa, Staphylococcus
SGNIHGMLLRILLGDGPSDLV

SEQ ID NO: 2092643 - protein, 17 aa, Staphylococcus
SGTIPGVLFKLEKTHDL

SEQ ID NO: 2092644 - protein, 21 aa, Staphylococcus
SGTLYIPAGKYLIGKRLIIYE

SEQ ID NO: 2092645 - protein, 18 aa, Staphylococcus
SHLRLIVRTLLGIAVPTQ

SEQ ID NO: 2092646 - protein, 23 aa, Staphylococcus
SHQYKLLIILSPSGAYYGGDTLK

SEQ ID NO: 2092647 - protein, 24 aa, Staphylococcus
SHQYKLLIILSPSGAYYGGDTLKT

SEQ ID NO: 2092648 - protein, 18 aa, Staphylococcus
SHYHFFEANPALQFDHEK

SEQ ID NO: 2092649 - protein, 23 aa, Staphylococcus
SHYKHLFALLDLAKKQGLEKVYV

SEQ ID NO: 2092650 - protein, 21 aa, Staphylococcus
SIANIVLAFYLTRPSLDVVIP

SEQ ID NO: 2092651 - protein, 22 aa, Staphylococcus
SIATMIHLIYRKLHKNSAYLGT

SEQ ID NO: 2092652 - protein, 20 aa, Staphylococcus
SIEELFKDFLGKPVRVTVKN

SEQ ID NO: 2092653 - protein, 28 aa, Staphylococcus
SIELLTGWLIKQLFNLHLERLQLIKLGQ

SEQ ID NO: 2092654 - protein, 20 aa, Staphylococcus
SIEQLLEMFRGKPVRVFVKQ

SEQ ID NO: 2092655 - protein, 20 aa, Staphylococcus
SIHDLMHYLFEIIDPYSLNK

SEQ ID NO: 2092656 - protein, 22 aa, Staphylococcus
SIILLIVNILTDEKLRQLYQYA

SEQ ID NO: 2092657 - protein, 27 aa, Staphylococcus
SILTSIPLWKNQMAIALTLLRQRHAVR

SEQ ID NO: 2092658 - protein, 27 aa, Staphylococcus
SILTSIPLWKNQMAIALTLMRQKNAVT

SEQ ID NO: 2092659 - protein, 23 aa, Staphylococcus
SITQLLERFLFPSATHGKKIYKL

SEQ ID NO: 2092660 - protein, 17 aa, Staphylococcus
SITQLLERFLFPSSTHG

SEQ ID NO: 2092661 - protein, 23 aa, Staphylococcus
SIYTKLLTFMKFQAGLDVSTHQI

SEQ ID NO: 2092662 - protein, 17 aa, Staphylococcus
SKARFEFRWIDQFNLSL

SEQ ID NO: 2092663 - protein, 20 aa, Staphylococcus
SKDNLAMLYKEGFHICNGEL

SEQ ID NO: 2092664 - protein, 23 aa, Staphylococcus
SKDYLWSVLIRKLNEWNLNNEQY

SEQ ID NO: 2092665 - protein, 22 aa, Staphylococcus
SKEEILILLTLWKEGSMTLKEM

SEQ ID NO: 2092666 - protein, 18 aa, Staphylococcus
SKGGIYCWLKTPPGYESE

SEQ ID NO: 2092667 - protein, 22 aa, Staphylococcus
SKKKYWYRLPKFKQISKYAQYI

SEQ ID NO: 2092668 - protein, 27 aa, Staphylococcus
SKKNSLEHLLFGLGIRHLGVKASQVIA

SEQ ID NO: 2092669 - protein, 22 aa, Staphylococcus
SKKVDVGFLPPTAYTLAHDQKA

SEQ ID NO: 2092670 - protein, 24 aa, Staphylococcus
SKKYKLLIILSPSGAYYGGDTLKS

SEQ ID NO: 2092671 - protein, 24 aa, Staphylococcus
SKPPILFTPLFPTYFFPTHSDRKE

SEQ ID NO: 2092672 - protein, 23 aa, Staphylococcus
SKPPILLTPLFPTYFFPTHSDRL

SEQ ID NO: 2092673 - protein, 23 aa, Staphylococcus
SKPPILLTPLFPTYFFPTHSDRQ

SEQ ID NO: 2092674 - protein, 24 aa, Staphylococcus
SKSDMPAFWFDPLVNLAAISQVTQ

SEQ ID NO: 2092675 - protein, 23 aa, Staphylococcus
SKSEFELIRWFGKKGRGLYQKVR

SEQ ID NO: 2092676 - protein, 17 aa, Staphylococcus
SLENYVLIYYLERIIHQ

SEQ ID NO: 2092677 - protein, 22 aa, Staphylococcus
SLERLWRVTSLNQAIALGIDDV

SEQ ID NO: 2092678 - protein, 21 aa, Staphylococcus
SLFEQWFHPPGAKIKVYHFEA

SEQ ID NO: 2092679 - protein, 23 aa, Staphylococcus
SLFPSCRIAYIVLPYPILNIYNH

SEQ ID NO: 2092680 - protein, 23 aa, Staphylococcus
SLFSTLLGLFRLYASKHFNKETL

SEQ ID NO: 2092681 - protein, 18 aa, Staphylococcus
SLGFIFQDYSVLPTLTVK

SEQ ID NO: 2092682 - protein, 21 aa, Staphylococcus
SLHIGHLLPFLTLRRFQEHGH

SEQ ID NO: 2092683 - protein, 20 aa, Staphylococcus
SLLKFYLIKNVFFKSLPNIE

SEQ ID NO: 2092684 - protein, 26 aa, Staphylococcus
SLPEEIIPIIWIAFKTGLRISDVLTL

SEQ ID NO: 2092685 - protein, 22 aa, Staphylococcus
SLPIEGKLWLKCDSHLAISGSI

SEQ ID NO: 2092686 - protein, 24 aa, Staphylococcus
SLSFRAFYALPLLSNKAGIHTNAV

SEQ ID NO: 2092687 - protein, 25 aa, Staphylococcus
SLTEKWIIQIAYDKFIILAKNEPSL

SEQ ID NO: 2092688 - protein, 18 aa, Staphylococcus
SLTFHKLPIDVQKDLLGL

SEQ ID NO: 2092689 - protein, 24 aa, Staphylococcus
SLTNQVLQQFKFDKAFLSCGAFDT

SEQ ID NO: 2092690 - protein, 27 aa, Staphylococcus
SLTPNNYFLLLWSLTLKYLFGKNDILF

SEQ ID NO: 2092691 - protein, 20 aa, Staphylococcus
SMLSASIYRASEKWCHGFSD

SEQ ID NO: 2092692 - protein, 17 aa, Staphylococcus
SMMGYAPGFPYLTGMNE

SEQ ID NO: 2092693 - protein, 21 aa, Staphylococcus
SMPIVLPRLRISYLYPRTEKL

SEQ ID NO: 2092694 - protein, 25 aa, Staphylococcus
SMVDSWLFHQFLSAVPLDAQIILVG

SEQ ID NO: 2092695 - protein, 25 aa, Staphylococcus
SMVDTWLFHQFLNAVPLDAQIVFVG

SEQ ID NO: 2092696 - protein, 24 aa, Staphylococcus
SMVDTWLFHQFLSAVPIDAQIILV

SEQ ID NO: 2092697 - protein, 29 aa, Staphylococcus
SNAIYEFLALRIPMLLIPLGLDQSRGDQI

SEQ ID NO: 2092698 - protein, 29 aa, Staphylococcus
SNAIYEFLTLRLPMLLIPLGLDQSRGDQI

SEQ ID NO: 2092699 - protein, 18 aa, Staphylococcus
SNDFFTIVKWNISGTLNY

SEQ ID NO: 2092700 - protein, 24 aa, Staphylococcus
SNELQYHRGLLFLKAMELQKLILI

SEQ ID NO: 2092701 - protein, 22 aa, Staphylococcus
SNIKLIYWLKGSGRVILNLKKF

SEQ ID NO: 2092702 - protein, 20 aa, Staphylococcus
SNIKLIYWLKGTGKVFINLK

SEQ ID NO: 2092703 - protein, 20 aa, Staphylococcus
SNLPALFWQNGAYATQLETG

SEQ ID NO: 2092704 - protein, 18 aa, Staphylococcus
SNQYIPQRLLPDKAIDVL

SEQ ID NO: 2092705 - protein, 22 aa, Staphylococcus
SNTIRLVIFKFSKTAGLNEILN

SEQ ID NO: 2092706 - protein, 23 aa, Staphylococcus
SNWDMLFIALSIHLIDLLKNVSP

SEQ ID NO: 2092707 - protein, 23 aa, Staphylococcus
SNWDMLFIVFSIHLIDLAKQLDQ

SEQ ID NO: 2092708 - protein, 23 aa, Staphylococcus
SNWDMLFVVFSIHFIHLLKQLDS

SEQ ID NO: 2092709 - protein, 22 aa, Staphylococcus
SNWDMLFVVLAIHFIEICKTLP

SEQ ID NO: 2092710 - protein, 23 aa, Staphylococcus
SNWDMLYIVFSLHYIQILKALPS

SEQ ID NO: 2092711 - protein, 23 aa, Staphylococcus
SNWTPLMQTFVDALYKSINNIYP

SEQ ID NO: 2092712 - protein, 17 aa, Staphylococcus
SNYRPQFYFRTTDVTGV

SEQ ID NO: 2092713 - protein, 19 aa, Staphylococcus
SPFHWRLMDKLTLATLYEV

SEQ ID NO: 2092714 - protein, 22 aa, Staphylococcus
SPKPRLPFELIFHKNVYNSNKA

SEQ ID NO: 2092715 - protein, 31 aa, Staphylococcus
SPLNYTIIKPAFFMDNFLRIITVEDGVIYIP

SEQ ID NO: 2092716 - protein, 24 aa, Staphylococcus
SQQYKLLIILSPSGAYYGGDTLKT

SEQ ID NO: 2092717 - protein, 24 aa, Staphylococcus
SQRDYLFFKFAIHTGIKLTDLLNM

SEQ ID NO: 2092718 - protein, 24 aa, Staphylococcus
SQRDYLLFKFAIHTGIKLSELLNM

SEQ ID NO: 2092719 - protein, 23 aa, Staphylococcus
SRQHHRFLFFINKLPGITIKELL

SEQ ID NO: 2092720 - protein, 24 aa, Staphylococcus
SRQHHRFLFFINKLPGITIKQLLN

SEQ ID NO: 2092721 - protein, 22 aa, Staphylococcus
SRYLTWLTTQLLPYVREQYRVS

SEQ ID NO: 2092722 - protein, 27 aa, Staphylococcus
SSASIEILMGWLLKALFNLEVERLELI

SEQ ID NO: 2092723 - protein, 23 aa, Staphylococcus
SSDIIKKLFLLGIVANINQSLDE

SEQ ID NO: 2092724 - protein, 23 aa, Staphylococcus
SSEWYLIMIIKYDQPTFAELTHK

SEQ ID NO: 2092725 - protein, 26 aa, Staphylococcus
SSGIIKKLFLLGIVANINQALDEETL

SEQ ID NO: 2092726 - protein, 22 aa, Staphylococcus
SSGTIPGVLFKLEKTHDLTEDQ

SEQ ID NO: 2092727 - protein, 23 aa, Staphylococcus
SSGTIPGVLFKLEKTHDLTEEQM

SEQ ID NO: 2092728 - protein, 21 aa, Staphylococcus
SSKALLLYRLIEGLISENSNA

SEQ ID NO: 2092729 - protein, 19 aa, Staphylococcus
SSLLFPPYKGKFKYIKTFF

SEQ ID NO: 2092730 - protein, 17 aa, Staphylococcus
SSNLLKDLILQLALKRI

SEQ ID NO: 2092731 - protein, 24 aa, Staphylococcus
SSTNGWLFKLVWSDSQLSTIYFQP

SEQ ID NO: 2092732 - protein, 20 aa, Staphylococcus
SSVFPLILRGISILGVDSVF

SEQ ID NO: 2092733 - protein, 23 aa, Staphylococcus
SSVMFDFGILKRPQFFFAYDIEK

SEQ ID NO: 2092734 - protein, 30 aa, Staphylococcus
SSVMFDYAYLKRPMLFFAYDLEKYLYSERG

SEQ ID NO: 2092735 - protein, 24 aa, Staphylococcus
STAQIDFLLPERFELTYIGSDGEN

SEQ ID NO: 2092736 - protein, 25 aa, Staphylococcus
STAQLDFLLPERFDLAYIGKDGEEH

SEQ ID NO: 2092737 - protein, 24 aa, Staphylococcus
STAQLDFLLPERFDLSYIGSDGEN

SEQ ID NO: 2092738 - protein, 24 aa, Staphylococcus
STAQLDFLLPERFELTYIGQDGEQ

SEQ ID NO: 2092739 - protein, 24 aa, Staphylococcus
STAQLDFLLPERFELTYIGSDGEQ

SEQ ID NO: 2092740 - protein, 24 aa, Staphylococcus
STAQLDFLLPERFELTYIGSDGEY

SEQ ID NO: 2092741 - protein, 24 aa, Staphylococcus
STAQLDFLLPQKFELTYIGNDGEQ

SEQ ID NO: 2092742 - protein, 18 aa, Staphylococcus
STGWIFFINAEGIQEMVA

SEQ ID NO: 2092743 - protein, 17 aa, Staphylococcus
STHPVLFKKAKKITTFD

SEQ ID NO: 2092744 - protein, 18 aa, Staphylococcus
STIIPMCHPLPLTGIDVQ

SEQ ID NO: 2092745 - protein, 20 aa, Staphylococcus
STIIPMCHPLSLTGIDIAFE

SEQ ID NO: 2092746 - protein, 23 aa, Staphylococcus
STLIFIYPLYWFNVTPILKSFID

SEQ ID NO: 2092747 - protein, 23 aa, Staphylococcus
STLLKIILGLLPLQSGEIFIDGH

SEQ ID NO: 2092748 - protein, 20 aa, Staphylococcus
STMHLPLRLAESTITVVPSR

SEQ ID NO: 2092749 - protein, 20 aa, Staphylococcus
STMIPMCHPLPLTGIDITFS

SEQ ID NO: 2092750 - protein, 20 aa, Staphylococcus
STPFDILIHFPLHVGPDAKL

SEQ ID NO: 2092751 - protein, 23 aa, Staphylococcus
STSMLLLEPLLQQGYHKFYSYIS

SEQ ID NO: 2092752 - protein, 22 aa, Staphylococcus
STYYGIALALMRISKAILNNEN

SEQ ID NO: 2092753 - protein, 27 aa, Staphylococcus
SVEDISKLQYILFLRELDLTLKEINDY

SEQ ID NO: 2092754 - protein, 24 aa, Staphylococcus
SVFHLHFHFLPRYKDDIDGFGYKW

SEQ ID NO: 2092755 - protein, 19 aa, Staphylococcus
SVFHLHFHLLPRYKDDVDG

SEQ ID NO: 2092756 - protein, 27 aa, Staphylococcus
SVFLETFLFYSGFYYPLYLAGQGRMTT

SEQ ID NO: 2092757 - protein, 19 aa, Staphylococcus
SVFPFILRGVSIIGIDSVY

SEQ ID NO: 2092758 - protein, 24 aa, Staphylococcus
SVKALHPFYYPLNKLFSISEMITC

SEQ ID NO: 2092759 - protein, 24 aa, Staphylococcus
SVKKQPPFFYPLDKLVSISNMIEE

SEQ ID NO: 2092760 - protein, 22 aa, Staphylococcus
SVKSLPPFFYPLNELISITEMI

SEQ ID NO: 2092761 - protein, 18 aa, Staphylococcus
SVLKLWLRNYKKGKSNKH

SEQ ID NO: 2092762 - protein, 24 aa, Staphylococcus
SVNLKHLLLQPPLKGKQILGVDPA

SEQ ID NO: 2092763 - protein, 24 aa, Staphylococcus
SVTLDFVLLKKYFKNAIPRVGDVV

SEQ ID NO: 2092764 - protein, 23 aa, Staphylococcus
SVTQLLERFLFPSATHGKKIYKL

SEQ ID NO: 2092765 - protein, 17 aa, Staphylococcus
SVTQLLERFLFPSSTHG

SEQ ID NO: 2092766 - protein, 23 aa, Staphylococcus
SVTQLLERFLFPSSTHGKKVYKL

SEQ ID NO: 2092767 - protein, 19 aa, Staphylococcus
SWDFAHCLPYFKKLEKTFG

SEQ ID NO: 2092768 - protein, 18 aa, Staphylococcus
SWMILDVLPIIPPEIRPM

SEQ ID NO: 2092769 - protein, 23 aa, Staphylococcus
SWNNLKPLMLCLILLSMRKRMRE

SEQ ID NO: 2092770 - protein, 20 aa, Staphylococcus
SYFVKFHWKPKQGLESLVWD

SEQ ID NO: 2092771 - protein, 21 aa, Staphylococcus
SYIYTFLGFLPRKSKEKTAVL

SEQ ID NO: 2092772 - protein, 20 aa, Staphylococcus
SYLDTFLEPTRLYVKPVLAV

SEQ ID NO: 2092773 - protein, 17 aa, Staphylococcus
SYPIMKYIQPIRKLIHE

SEQ ID NO: 2092774 - protein, 21 aa, Staphylococcus
TADVYDFWRPTGYKYPLVAGA

SEQ ID NO: 2092775 - protein, 22 aa, Staphylococcus
TAPHPYLNFLNYILMEASNAPI

SEQ ID NO: 2092776 - protein, 22 aa, Staphylococcus
TARQLALVWGAYPVIKKGRKTT

SEQ ID NO: 2092777 - protein, 22 aa, Staphylococcus
TARSIPIFIFMNDQFEQVSVWG

SEQ ID NO: 2092778 - protein, 17 aa, Staphylococcus
TATTYLMIIEKLKLFLK

SEQ ID NO: 2092779 - protein, 18 aa, Staphylococcus
TCFVVIPDDLKMFGPNWV

SEQ ID NO: 2092780 - protein, 28 aa, Staphylococcus
TDGEFRRSWWHLDFFWGLNGVEAIKDAG

SEQ ID NO: 2092781 - protein, 19 aa, Staphylococcus
TDKSTIMLYILLITGARFS

SEQ ID NO: 2092782 - protein, 21 aa, Staphylococcus
TDLLFLYLEKAFLSQNFFDIP

SEQ ID NO: 2092783 - protein, 22 aa, Staphylococcus
TDLLFLYLERAFLTQNFFEIPT

SEQ ID NO: 2092784 - protein, 20 aa, Staphylococcus
TDLLIRLYEKVINNIDYQHK

SEQ ID NO: 2092785 - protein, 26 aa, Staphylococcus
TDNKLLDFFIIDILNKLYLPSLNKRI

SEQ ID NO: 2092786 - protein, 22 aa, Staphylococcus
TDVLPVIYYIHGAGWVFGSPET

SEQ ID NO: 2092787 - protein, 20 aa, Staphylococcus
TEFELIRWFGKRGRGLYLKA

SEQ ID NO: 2092788 - protein, 25 aa, Staphylococcus
TEGERLIGFIWARYDKTLKTALIEM

SEQ ID NO: 2092789 - protein, 18 aa, Staphylococcus
TEIGLDLPFPMKINQMLG

SEQ ID NO: 2092790 - protein, 21 aa, Staphylococcus
TEIYDYIRLLYARIGKPYCPN

SEQ ID NO: 2092791 - protein, 21 aa, Staphylococcus
TEKIYMHLKPWDRVQLARLQE

SEQ ID NO: 2092792 - protein, 26 aa, Staphylococcus
TENTYLIYMLGFMPGFPFLGGLNKQL

SEQ ID NO: 2092793 - protein, 22 aa, Staphylococcus
TESQWEAMLLGWKVVSSVKSNA

SEQ ID NO: 2092794 - protein, 18 aa, Staphylococcus
TESTLLIGFLKDTEPRPG

SEQ ID NO: 2092795 - protein, 23 aa, Staphylococcus
TESTLLIGFLKDTKPRPGSMGKA

SEQ ID NO: 2092796 - protein, 22 aa, Staphylococcus
TESTLLIGFLKDTKSRPGSMGK

SEQ ID NO: 2092797 - protein, 17 aa, Staphylococcus
TFFRVYSGTLTSGSYIK

SEQ ID NO: 2092798 - protein, 17 aa, Staphylococcus
TFFRVYSGTLTSGSYVK

SEQ ID NO: 2092799 - protein, 24 aa, Staphylococcus
TFKTNIFGMFFLTQAAVPHLSKGD

SEQ ID NO: 2092800 - protein, 19 aa, Staphylococcus
TFLPLNVIQPRYLAADIKS

SEQ ID NO: 2092801 - protein, 23 aa, Staphylococcus
TFMTNIFGMMFLSQAAVPHLSKG

SEQ ID NO: 2092802 - protein, 18 aa, Staphylococcus
TFPSWKRAHPNRLLMHNG

SEQ ID NO: 2092803 - protein, 21 aa, Staphylococcus
TFYFPYRLIIRFNPTPSLNIE

SEQ ID NO: 2092804 - protein, 18 aa, Staphylococcus
TFYLHYLDKYDLLEKIFI

SEQ ID NO: 2092805 - protein, 22 aa, Staphylococcus
TGDLTVAFLLAKLSWHERHHLE

SEQ ID NO: 2092806 - protein, 21 aa, Staphylococcus
TGFFRFWYQGIVARWPETEIE

SEQ ID NO: 2092807 - protein, 22 aa, Staphylococcus
TGFYRFWYQGLVQRWPDMDIED

SEQ ID NO: 2092808 - protein, 20 aa, Staphylococcus
TGIMNTIWLLGLALNNENLI

SEQ ID NO: 2092809 - protein, 23 aa, Staphylococcus
TGKEDFYFMPLLQFSDDVSEYAS

SEQ ID NO: 2092810 - protein, 20 aa, Staphylococcus
TGLFRYIQMFIISNGIETRY

SEQ ID NO: 2092811 - protein, 23 aa, Staphylococcus
TGRYYIQRFLARKFGLEVDEIKE

SEQ ID NO: 2092812 - protein, 23 aa, Staphylococcus
TGRYYIQRFLARSFGFDVDDIKN

SEQ ID NO: 2092813 - protein, 24 aa, Staphylococcus
TGRYYIQRFLARSFGFDVDDIKVM

SEQ ID NO: 2092814 - protein, 24 aa, Staphylococcus
TGRYYIQRFLARSFGLDVEDIKNM

SEQ ID NO: 2092815 - protein, 23 aa, Staphylococcus
TGSSLKPFLAYGPAIENMQWATN

SEQ ID NO: 2092816 - protein, 24 aa, Staphylococcus
TGSSLKPFLAYGPAIENMSWATNH

SEQ ID NO: 2092817 - protein, 17 aa, Staphylococcus
THELEWLPHLFVAGGLA

SEQ ID NO: 2092818 - protein, 19 aa, Staphylococcus
TIDNFRWAGVPFYIRTGKR

SEQ ID NO: 2092819 - protein, 20 aa, Staphylococcus
TIDNFRWAGVPFYIRTGKRM

SEQ ID NO: 2092820 - protein, 17 aa, Staphylococcus
TIFNLVGPLINPFKLTY

SEQ ID NO: 2092821 - protein, 18 aa, Staphylococcus
TIITLWVKLLTLAGKYNE

SEQ ID NO: 2092822 - protein, 18 aa, Staphylococcus
TILKYVKKGVLYPLSYYD

SEQ ID NO: 2092823 - protein, 18 aa, Staphylococcus
TINKLLESKWWLMSPNEL

SEQ ID NO: 2092824 - protein, 22 aa, Staphylococcus
TIPKRIRVLKKCKLYTDVTFKN

SEQ ID NO: 2092825 - protein, 18 aa, Staphylococcus
TIPPWNFPFAIMAGTTLA

SEQ ID NO: 2092826 - protein, 25 aa, Staphylococcus
TIRKGPNIKLPSFDLLEEPEPHEVN

SEQ ID NO: 2092827 - protein, 18 aa, Staphylococcus
TISPFIHLTIGDTTFDMK

SEQ ID NO: 2092828 - protein, 17 aa, Staphylococcus
TITMVLNNTLIAEKMRR

SEQ ID NO: 2092829 - protein, 24 aa, Staphylococcus
TITSPMVGTFFLQDSKELTDPIIQ

SEQ ID NO: 2092830 - protein, 20 aa, Staphylococcus
TKFKLPKWMFKPFKNHSLKK

SEQ ID NO: 2092831 - protein, 23 aa, Staphylococcus
TKFVHQQLAIISYWRSGYIHSIS

SEQ ID NO: 2092832 - protein, 25 aa, Staphylococcus
TKGDIVIGMLPWKRFHTLPSNQVNK

SEQ ID NO: 2092833 - protein, 23 aa, Staphylococcus
TKGESMIPLIKKLSADNVRLNVT

SEQ ID NO: 2092834 - protein, 23 aa, Staphylococcus
TKIHNFHWFVKGPHFFSLHVKFE

SEQ ID NO: 2092835 - protein, 18 aa, Staphylococcus
TKIIIVTTFKRPGYFEKA

SEQ ID NO: 2092836 - protein, 21 aa, Staphylococcus
TKIIIVTTFKRPGYFEKAVAN

SEQ ID NO: 2092837 - protein, 30 aa, Staphylococcus
TKIKSWVRQLLWMSLYQYIYLDKVPNHAII

SEQ ID NO: 2092838 - protein, 26 aa, Staphylococcus
TKPTLKFELFYFDIFKYATSFITLQV

SEQ ID NO: 2092839 - protein, 17 aa, Staphylococcus
TKRLIFVTALNTLHEVP

SEQ ID NO: 2092840 - protein, 17 aa, Staphylococcus
TLDFYLRPFVKTKIKSW

SEQ ID NO: 2092841 - protein, 23 aa, Staphylococcus
TLEDLALVDFFFQPDFDRPWNYL

SEQ ID NO: 2092842 - protein, 24 aa, Staphylococcus
TLEQKVFFKLLFYSGARKGEVRAL

SEQ ID NO: 2092843 - protein, 23 aa, Staphylococcus
TLKIDLTKPIPYFKQMLAFGTFM

SEQ ID NO: 2092844 - protein, 22 aa, Staphylococcus
TLKRLPLYYRFVNSLKIKGIDR

SEQ ID NO: 2092845 - protein, 17 aa, Staphylococcus
TLLIGFLKDTEPRPGSM

SEQ ID NO: 2092846 - protein, 19 aa, Staphylococcus
TLLKIILGLLPLQKGEIYI

SEQ ID NO: 2092847 - protein, 20 aa, Staphylococcus
TLLKIILGLLPLQTGDIYVD

SEQ ID NO: 2092848 - protein, 18 aa, Staphylococcus
TLLTLRLAELFRASTIPA

SEQ ID NO: 2092849 - protein, 18 aa, Staphylococcus
TLQLVIYYLMGKASQNPT

SEQ ID NO: 2092850 - protein, 19 aa, Staphylococcus
TLVELVEYWSFEKELHKGN

SEQ ID NO: 2092851 - protein, 18 aa, Staphylococcus
TLVSDIVYIPYKTPILIA

SEQ ID NO: 2092852 - protein, 23 aa, Staphylococcus
TLVSDIVYIPYKTPILKLAEAKG

SEQ ID NO: 2092853 - protein, 18 aa, Staphylococcus
TMPLYLNALTGKSAFLIT

SEQ ID NO: 2092854 - protein, 18 aa, Staphylococcus
TMPLYLNGLTGKGAYLIT

SEQ ID NO: 2092855 - protein, 21 aa, Staphylococcus
TNCLPVFKILFEKRSLHFNVY

SEQ ID NO: 2092856 - protein, 24 aa, Staphylococcus
TNEYLVYMLGFMPGFPFLGGLDER

SEQ ID NO: 2092857 - protein, 23 aa, Staphylococcus
TNGYIYNVKSYDALLHCIDVTYA

SEQ ID NO: 2092858 - protein, 23 aa, Staphylococcus
TNKTLYGFNFLIKGSLSLSNVNF

SEQ ID NO: 2092859 - protein, 21 aa, Staphylococcus
TNQLFPYLKYKILSTSSDDLR

SEQ ID NO: 2092860 - protein, 26 aa, Staphylococcus
TNQLLNAFHLWLIRIFYANQPKSYPS

SEQ ID NO: 2092861 - protein, 17 aa, Staphylococcus
TNVYPIFWTVQKAVDYL

SEQ ID NO: 2092862 - protein, 17 aa, Staphylococcus
TNYRPQFYFRTTDVTGV

SEQ ID NO: 2092863 - protein, 26 aa, Staphylococcus
TPEGSFYIWFQFKFSIDMKRLFDEAI

SEQ ID NO: 2092864 - protein, 25 aa, Staphylococcus
TPELYFALFGILKIGAIVGPLFEAF

SEQ ID NO: 2092865 - protein, 21 aa, Staphylococcus
TPFFIGIMPIASYNNALFLHN

SEQ ID NO: 2092866 - protein, 23 aa, Staphylococcus
TPGPWHLHRMLLAAESLPLNIGF

SEQ ID NO: 2092867 - protein, 17 aa, Staphylococcus
TPLIIKPASISGITYEM

SEQ ID NO: 2092868 - protein, 17 aa, Staphylococcus
TPLLFKASGPSFVTETI

SEQ ID NO: 2092869 - protein, 18 aa, Staphylococcus
TPLNVFYFTGYLSEPHER

SEQ ID NO: 2092870 - protein, 18 aa, Staphylococcus
TPLRHVLPFNKHNRYLVM

SEQ ID NO: 2092871 - protein, 18 aa, Staphylococcus
TPMKLRERVWRRLATDLK

SEQ ID NO: 2092872 - protein, 23 aa, Staphylococcus
TPNLEVLKFLYFKMNKLGADIVK

SEQ ID NO: 2092873 - protein, 17 aa, Staphylococcus
TQLLERFLFPSSTHGKK

SEQ ID NO: 2092874 - protein, 20 aa, Staphylococcus
TQLLERFLFPSSTHGKKIYK

SEQ ID NO: 2092875 - protein, 24 aa, Staphylococcus
TQTQQYYFHLFSKKQPDLNWHNPE

SEQ ID NO: 2092876 - protein, 23 aa, Staphylococcus
TREHILLSRNVGVPALVVFLNKA

SEQ ID NO: 2092877 - protein, 24 aa, Staphylococcus
TREHILLSRNVGVPALVVFLNKVD

SEQ ID NO: 2092878 - protein, 28 aa, Staphylococcus
TRIKGWMRHLLWMSIYQYQYLDKVPDHA

SEQ ID NO: 2092879 - protein, 25 aa, Staphylococcus
TRQPYLIYMLGFMPGFPYLGGLDER

SEQ ID NO: 2092880 - protein, 22 aa, Staphylococcus
TRREYYIFFLLCEGKSMNEIAK

SEQ ID NO: 2092881 - protein, 26 aa, Staphylococcus
TSGFYYYDINAIPFPAGISFVKVFST

SEQ ID NO: 2092882 - protein, 22 aa, Staphylococcus
TSIANIVLAFYLTRPALDVVIP

SEQ ID NO: 2092883 - protein, 23 aa, Staphylococcus
TSTIIPMCHPLPLTGIDVSFEWN

SEQ ID NO: 2092884 - protein, 23 aa, Staphylococcus
TTAGKLALLMRKKYNKKPLLVAA

SEQ ID NO: 2092885 - protein, 17 aa, Staphylococcus
TTDKWIIHIAYDKFIIM

SEQ ID NO: 2092886 - protein, 19 aa, Staphylococcus
TTDLLIRLYEKVIDRLDYT

SEQ ID NO: 2092887 - protein, 22 aa, Staphylococcus
TTDTFFNLQSLPKRLAVIGGGV

SEQ ID NO: 2092888 - protein, 18 aa, Staphylococcus
TTEYYWHWDLKNSKLDVY

SEQ ID NO: 2092889 - protein, 18 aa, Staphylococcus
TTFYPFFNKRKGQKYFIV

SEQ ID NO: 2092890 - protein, 21 aa, Staphylococcus
TTKWLEDYLKYFKGAIIIISH

SEQ ID NO: 2092891 - protein, 17 aa, Staphylococcus
TTLEPMVLPSRFPNLLV

SEQ ID NO: 2092892 - protein, 25 aa, Staphylococcus
TTLGNSLRRILLSSLPGSAVKYIEI

SEQ ID NO: 2092893 - protein, 23 aa, Staphylococcus
TTPEWMLLPMHKGGTFGKFSTSI

SEQ ID NO: 2092894 - protein, 23 aa, Staphylococcus
TTPEWMLLPMHKGGTFGKFTTNL

SEQ ID NO: 2092895 - protein, 22 aa, Staphylococcus
TTYHNLYFLLKLMEDIRQAIRE

SEQ ID NO: 2092896 - protein, 17 aa, Staphylococcus
TTYLMIIEKLKLFLKED

SEQ ID NO: 2092897 - protein, 22 aa, Staphylococcus
TVARLLAQIFKHLGLLSKGHLI

SEQ ID NO: 2092898 - protein, 24 aa, Staphylococcus
TVHEYLPLLHRYTKLRKELLGLDD

SEQ ID NO: 2092899 - protein, 23 aa, Staphylococcus
TVHKYLPLLHKYTQLRKELLGID

SEQ ID NO: 2092900 - protein, 22 aa, Staphylococcus
TVHKYLPLLHRYTALRKEVLGL

SEQ ID NO: 2092901 - protein, 22 aa, Staphylococcus
TVHLNLPLEWLKGKIIVDSLGL

SEQ ID NO: 2092902 - protein, 24 aa, Staphylococcus
TVLNPAPAIDLPKSLLALTDIIIP

SEQ ID NO: 2092903 - protein, 20 aa, Staphylococcus
TVNAPMVGTFFLQDTKDLTE

SEQ ID NO: 2092904 - protein, 17 aa, Staphylococcus
TVYTDLLFLYLERAFLS

SEQ ID NO: 2092905 - protein, 21 aa, Staphylococcus
TVYWHYFLRPEVKFSGIDPLV

SEQ ID NO: 2092906 - protein, 19 aa, Staphylococcus
TWDFAHCLPYFKKLEKTFG

SEQ ID NO: 2092907 - protein, 25 aa, Staphylococcus
TWDFQIKLPRFLSKEDYLIFTHAIV

SEQ ID NO: 2092908 - protein, 23 aa, Staphylococcus
TWEFQITLPYFLSHEDYLIFTNA

SEQ ID NO: 2092909 - protein, 17 aa, Staphylococcus
TWKMVLGLFPKEDKIKA

SEQ ID NO: 2092910 - protein, 23 aa, Staphylococcus
TWMHQLLKLYQLAPRFLEKHFSH

SEQ ID NO: 2092911 - protein, 28 aa, Staphylococcus
TWVFQITFPHFLTIENYLLFTGAIIEEF

SEQ ID NO: 2092912 - protein, 18 aa, Staphylococcus
TYFLSWTTTPWTLPANVA

SEQ ID NO: 2092913 - protein, 24 aa, Staphylococcus
TYKFKQIYFLRISTLPLSLGIESC

SEQ ID NO: 2092914 - protein, 23 aa, Staphylococcus
TYKLQNMYYLRISTLPLSLGNES

SEQ ID NO: 2092915 - protein, 23 aa, Staphylococcus
TYKLRSVYYLRISTLPLSIGSES

SEQ ID NO: 2092916 - protein, 20 aa, Staphylococcus
TYLDTFLTPTRLYVKPILDL

SEQ ID NO: 2092917 - protein, 19 aa, Staphylococcus
TYLIDGDWDYAYTGPQNHS

SEQ ID NO: 2092918 - protein, 19 aa, Staphylococcus
TYMPLPIFLSHQLAKRLSD

SEQ ID NO: 2092919 - protein, 20 aa, Staphylococcus
TYPQFLVLTILWEDSPVNVK

SEQ ID NO: 2092920 - protein, 21 aa, Staphylococcus
TYRALTKVFTRFGLDVDFVDT

SEQ ID NO: 2092921 - protein, 18 aa, Staphylococcus
TYRQTFEQLLYLIGKLRT

SEQ ID NO: 2092922 - protein, 19 aa, Staphylococcus
TYSKLLTFMKFQAGLDVSN

SEQ ID NO: 2092923 - protein, 24 aa, Staphylococcus
VANEKIRFARFRPFPFWKRVHDSF

SEQ ID NO: 2092924 - protein, 20 aa, Staphylococcus
VANWLKMNYAEIIKAALYEA

SEQ ID NO: 2092925 - protein, 24 aa, Staphylococcus
VASKAFITLINAKIPFYQTTTSEI

SEQ ID NO: 2092926 - protein, 18 aa, Staphylococcus
VDFPKLFKAFKDMGIIVN

SEQ ID NO: 2092927 - protein, 19 aa, Staphylococcus
VDIILPAVAVFKALFKQVE

SEQ ID NO: 2092928 - protein, 23 aa, Staphylococcus
VDKNGDIFFIYTNEKLKSILNIS

SEQ ID NO: 2092929 - protein, 23 aa, Staphylococcus
VDKQGFLYLMSRHNERLIIGGNN

SEQ ID NO: 2092930 - protein, 23 aa, Staphylococcus
VDLANMYWYKLFGHGLKGEGAAD

SEQ ID NO: 2092931 - protein, 18 aa, Staphylococcus
VDMLRMCGYPWKTKQRIL

SEQ ID NO: 2092932 - protein, 20 aa, Staphylococcus
VDMLRMCRYPWKTKQRILGD

SEQ ID NO: 2092933 - protein, 22 aa, Staphylococcus
VDMLRMCRYPWKTKQRILGDMG

SEQ ID NO: 2092934 - protein, 19 aa, Staphylococcus
VDPFYILSKKFNLLTIIDN

SEQ ID NO: 2092935 - protein, 18 aa, Staphylococcus
VEENGYLFIFVMDYHRHE

SEQ ID NO: 2092936 - protein, 17 aa, Staphylococcus
VEFKLYLGLKHISPYIE

SEQ ID NO: 2092937 - protein, 18 aa, Staphylococcus
VEFKLYLGLKHISPYIEE

SEQ ID NO: 2092938 - protein, 17 aa, Staphylococcus
VEGLLMLNAIHIPLHAG

SEQ ID NO: 2092939 - protein, 18 aa, Staphylococcus
VETWWRWYRNGESYRFSQ

SEQ ID NO: 2092940 - protein, 19 aa, Staphylococcus
VEWIILAGYMRLVGPDLLN

SEQ ID NO: 2092941 - protein, 18 aa, Staphylococcus
VEWIVLAGYMRLIGADLL

SEQ ID NO: 2092942 - protein, 17 aa, Staphylococcus
VFDPNLRFPLWDSLDDL

SEQ ID NO: 2092943 - protein, 25 aa, Staphylococcus
VFDVRFLPNPFYVEALRPLTGVDDE

SEQ ID NO: 2092944 - protein, 21 aa, Staphylococcus
VFGIVRMMHTFIPLLEKSEQP

SEQ ID NO: 2092945 - protein, 19 aa, Staphylococcus
VFHLHFHFLPRYKDDIDGF

SEQ ID NO: 2092946 - protein, 17 aa, Staphylococcus
VFKYFYTHRGPVMDFTN

SEQ ID NO: 2092947 - protein, 23 aa, Staphylococcus
VFRSRFRMLVEAQLDLLKNDDWD

SEQ ID NO: 2092948 - protein, 30 aa, Staphylococcus
VGAVVAWNFPFLLSSWKLAPALAAGNTVVI

SEQ ID NO: 2092949 - protein, 19 aa, Staphylococcus
VGKGGLLLTLARISAHYQL

SEQ ID NO: 2092950 - protein, 24 aa, Staphylococcus
VGNNTPVFFFRDPKLFASLNHAIK

SEQ ID NO: 2092951 - protein, 24 aa, Staphylococcus
VGNNTPVFFFRDPKLFASLNHAVK

SEQ ID NO: 2092952 - protein, 24 aa, Staphylococcus
VGNNTPVFFFRDPKLFISLNRAVK

SEQ ID NO: 2092953 - protein, 23 aa, Staphylococcus
VGNNTPVFFFRDSKLFVSLNRAV

SEQ ID NO: 2092954 - protein, 17 aa, Staphylococcus
VGQFLEILGFDIPLDQK

SEQ ID NO: 2092955 - protein, 24 aa, Staphylococcus
VGTNYPYVDYLPKKNIKAIQIDTN

SEQ ID NO: 2092956 - protein, 24 aa, Staphylococcus
VGTNYPYVDYLPKKNIKAIQVDTN

SEQ ID NO: 2092957 - protein, 18 aa, Staphylococcus
VHINLPLEWLKGKIIVDS

SEQ ID NO: 2092958 - protein, 23 aa, Staphylococcus
VHKYLPLLHRYTKLRKELLAVDE

SEQ ID NO: 2092959 - protein, 20 aa, Staphylococcus
VHLNLPLEWLKDKIIVDSLG

SEQ ID NO: 2092960 - protein, 30 aa, Staphylococcus
VHLYDYIPKLFWPIYYFIQAPIQGLLMRGF

SEQ ID NO: 2092961 - protein, 25 aa, Staphylococcus
VHQYFNGLYIITPFQRVDYSLELAA

SEQ ID NO: 2092962 - protein, 20 aa, Staphylococcus
VHTKWHCPIIFYTCIRENDL

SEQ ID NO: 2092963 - protein, 18 aa, Staphylococcus
VIISFKHKVILIGGTEYA

SEQ ID NO: 2092964 - protein, 17 aa, Staphylococcus
VIIYFYGGGFINGHGSA

SEQ ID NO: 2092965 - protein, 17 aa, Staphylococcus
VILIDTYYLMLGGYRKK

SEQ ID NO: 2092966 - protein, 23 aa, Staphylococcus
VIPNYMIPAHIYFLNVFPLNKNG

SEQ ID NO: 2092967 - protein, 23 aa, Staphylococcus
VITNCLPVFKILMNKQSLHFRVY

SEQ ID NO: 2092968 - protein, 31 aa, Staphylococcus
VIVHLYDYIPKLLWPIYYFVQAPLQGLIMRG

SEQ ID NO: 2092969 - protein, 31 aa, Staphylococcus
VIVHLYDYIPRLFWPIYYVIQAPLQGLIMRG

SEQ ID NO: 2092970 - protein, 22 aa, Staphylococcus
VKDKLVFIGKFKMFYISEDELN

SEQ ID NO: 2092971 - protein, 24 aa, Staphylococcus
VKESQPFFYPLDKLLSIGKMIEKE

SEQ ID NO: 2092972 - protein, 24 aa, Staphylococcus
VKIDPYWIYQIYDKDINPLEDREK

SEQ ID NO: 2092973 - protein, 20 aa, Staphylococcus
VKIQQIIKLTWWDDKKYTDE

SEQ ID NO: 2092974 - protein, 25 aa, Staphylococcus
VKIYDVFTILYLLQPQAFNVKEADV

SEQ ID NO: 2092975 - protein, 25 aa, Staphylococcus
VKMDPYWIYQIYDKDIKPLDNHEKN

SEQ ID NO: 2092976 - protein, 23 aa, Staphylococcus
VKNFRVTKLFGFFGLKREEIQEA

SEQ ID NO: 2092977 - protein, 19 aa, Staphylococcus
VKPFYGNFGIYLRAYTYIR

SEQ ID NO: 2092978 - protein, 23 aa, Staphylococcus
VKPFYGNFGIYLRAYTYIRTMGA

SEQ ID NO: 2092979 - protein, 18 aa, Staphylococcus
VKQFSHCELIPQLKLIES

SEQ ID NO: 2092980 - protein, 17 aa, Staphylococcus
VKRAFIGSFLFGGRYSS

SEQ ID NO: 2092981 - protein, 20 aa, Staphylococcus
VKRRILLGTFALSSGYYDAY

SEQ ID NO: 2092982 - protein, 27 aa, Staphylococcus
VKTRIKGWVRQLLWMSLYQYVFLDKIP

SEQ ID NO: 2092983 - protein, 18 aa, Staphylococcus
VLDTWFSSALWPFSTLGW

SEQ ID NO: 2092984 - protein, 18 aa, Staphylococcus
VLDTWFSSGLWPFSTLGW

SEQ ID NO: 2092985 - protein, 21 aa, Staphylococcus
VLGLVHTLWKPMPGRFKDYIA

SEQ ID NO: 2092986 - protein, 24 aa, Staphylococcus
VLGNPLNAVLWLIKKLHSHRKQIK

SEQ ID NO: 2092987 - protein, 21 aa, Staphylococcus
VLHLLYARFWHKVLYDLGVVP

SEQ ID NO: 2092988 - protein, 23 aa, Staphylococcus
VLIIGPFNYPFQLLIEPLIGAIA

SEQ ID NO: 2092989 - protein, 24 aa, Staphylococcus
VLVEPFFEWVVEADAWYGPQLEHI

SEQ ID NO: 2092990 - protein, 23 aa, Staphylococcus
VLVPLQMLVLFNKTIFKDEKQFT

SEQ ID NO: 2092991 - protein, 17 aa, Staphylococcus
VLVYYLEMILEFANKRF

SEQ ID NO: 2092992 - protein, 18 aa, Staphylococcus
VMGPLLARLGHAIVALPG

SEQ ID NO: 2092993 - protein, 24 aa, Staphylococcus
VMIAKLPFMNKNNAKYWLMDSEFE

SEQ ID NO: 2092994 - protein, 20 aa, Staphylococcus
VMYHLFVLLHALNIKFEDVE

SEQ ID NO: 2092995 - protein, 18 aa, Staphylococcus
VMYPPYKGKFKYIRTFFK

SEQ ID NO: 2092996 - protein, 19 aa, Staphylococcus
VNEWPYEALVKIFYRYGEE

SEQ ID NO: 2092997 - protein, 17 aa, Staphylococcus
VNGPLDLTFLFGLVDHL

SEQ ID NO: 2092998 - protein, 24 aa, Staphylococcus
VNKFMRIFNFPFYFRGEVYDPFET

SEQ ID NO: 2092999 - protein, 20 aa, Staphylococcus
VNLGGVFWGIQAALEQFNKL

SEQ ID NO: 2093000 - protein, 21 aa, Staphylococcus
VNQWPYEALVKIFYRYGEEKF

SEQ ID NO: 2093001 - protein, 19 aa, Staphylococcus
VPDIGQFFLFDTTSRIIGS

SEQ ID NO: 2093002 - protein, 22 aa, Staphylococcus
VPEARLLVISPYDKSSVADIEK

SEQ ID NO: 2093003 - protein, 23 aa, Staphylococcus
VPEARLLVISPYDKSSVGNIEKA

SEQ ID NO: 2093004 - protein, 19 aa, Staphylococcus
VPEARLLVISPYDKTSVAD

SEQ ID NO: 2093005 - protein, 23 aa, Staphylococcus
VPEGLIPLLKIQGLGSKKIAKLY

SEQ ID NO: 2093006 - protein, 17 aa, Staphylococcus
VPELDVPAYLFLGVLGM

SEQ ID NO: 2093007 - protein, 22 aa, Staphylococcus
VPEPIYPLWHRAMNSSARASDA

SEQ ID NO: 2093008 - protein, 21 aa, Staphylococcus
VPEPPMITIPLFGNPGIEDTV

SEQ ID NO: 2093009 - protein, 17 aa, Staphylococcus
VPNISIGLPILDSVRKG

SEQ ID NO: 2093010 - protein, 31 aa, Staphylococcus
VPQTLKWLMDAGLHRPFYIEKILLGGAKLSR

SEQ ID NO: 2093011 - protein, 25 aa, Staphylococcus
VQAGRVFIALPPLYKLEKGKGKAKQ

SEQ ID NO: 2093012 - protein, 25 aa, Staphylococcus
VQAGRVFIALPPLYKLEKGKGKSKQ

SEQ ID NO: 2093013 - protein, 25 aa, Staphylococcus
VQAGRVFIALPPLYKLEKGKGKTKK

SEQ ID NO: 2093014 - protein, 17 aa, Staphylococcus
VQKNIIFIIKHLSYRNG

SEQ ID NO: 2093015 - protein, 19 aa, Staphylococcus
VQPGEFYFIPAGTIHSIGS

SEQ ID NO: 2093016 - protein, 25 aa, Staphylococcus
VRFHSIIWPILLMALDLPLPKKVFA

SEQ ID NO: 2093017 - protein, 19 aa, Staphylococcus
VRIFYKYLNQLDVKYVAVI

SEQ ID NO: 2093018 - protein, 26 aa, Staphylococcus
VRKKFPDALFIFLAPPSLDDLRERLV

SEQ ID NO: 2093019 - protein, 27 aa, Staphylococcus
VRKKFPDALFIFLAPPSLDHLKERLIG

SEQ ID NO: 2093020 - protein, 27 aa, Staphylococcus
VRKKFPDALFIFLAPPSLDHLKERLVG

SEQ ID NO: 2093021 - protein, 26 aa, Staphylococcus
VRKKFPDALFIFLAPPSLDHLRERLI

SEQ ID NO: 2093022 - protein, 26 aa, Staphylococcus
VRKKFPDALFIFLAPPSLDHLRERLV

SEQ ID NO: 2093023 - protein, 27 aa, Staphylococcus
VRKKFPDALFIFLAPPSLEHLRERLVG

SEQ ID NO: 2093024 - protein, 21 aa, Staphylococcus
VRKKFPEALFIFLAPPSLDDL

SEQ ID NO: 2093025 - protein, 17 aa, Staphylococcus
VRQLIRLSRYFVDTLRQ

SEQ ID NO: 2093026 - protein, 17 aa, Staphylococcus
VRQVVFDLGKRLGNKNS

SEQ ID NO: 2093027 - protein, 23 aa, Staphylococcus
VRVKKVIDLLLDDAKLVEPSEDA

SEQ ID NO: 2093028 - protein, 21 aa, Staphylococcus
VSALKIMKWLHDLHFHIPYDV

SEQ ID NO: 2093029 - protein, 24 aa, Staphylococcus
VSAWRPEVMQALRLAGLPANSAYA

SEQ ID NO: 2093030 - protein, 21 aa, Staphylococcus
VSDIIYIPYKTKFLKEAEFKG

SEQ ID NO: 2093031 - protein, 26 aa, Staphylococcus
VSEAMHLLPFNVFFVPARGGLGENMV

SEQ ID NO: 2093032 - protein, 31 aa, Staphylococcus
VSEQPSLNLLRWPWIGLQWIFSRKGPAASNH

SEQ ID NO: 2093033 - protein, 23 aa, Staphylococcus
VSFAMIPKFNLFIALGIRDAIQA

SEQ ID NO: 2093034 - protein, 25 aa, Staphylococcus
VSGKLMIDNFRWAGVPFYIRTGKRM

SEQ ID NO: 2093035 - protein, 20 aa, Staphylococcus
VSHDIYFLNKLFNTTYLLKN

SEQ ID NO: 2093036 - protein, 20 aa, Staphylococcus
VSMIFQHFNLLWSRTVLKNI

SEQ ID NO: 2093037 - protein, 22 aa, Staphylococcus
VSMIFQHFNLLWSRTVLKNITF

SEQ ID NO: 2093038 - protein, 22 aa, Staphylococcus
VSMIFQHFNLLWSRTVLNNITF

SEQ ID NO: 2093039 - protein, 26 aa, Staphylococcus
VSPDLFIKRLNFYDFLLLCSDGLTDY

SEQ ID NO: 2093040 - protein, 23 aa, Staphylococcus
VTDGILLLFPLKDAVEVQHFITN

SEQ ID NO: 2093041 - protein, 23 aa, Staphylococcus
VTEIYDYIRLLYARIGKPFCPNH

SEQ ID NO: 2093042 - protein, 24 aa, Staphylococcus
VTIAPSPIWMQMRLIKAGIRPINN

SEQ ID NO: 2093043 - protein, 19 aa, Staphylococcus
VTIPPWNFPFAIMAGTTLA

SEQ ID NO: 2093044 - protein, 17 aa, Staphylococcus
VTLAAGYSLNWLKRTFF

SEQ ID NO: 2093045 - protein, 17 aa, Staphylococcus
VTLPRLFGFQAEGASPI

SEQ ID NO: 2093046 - protein, 24 aa, Staphylococcus
VTTPEWMLLPMHKGGTFGKFSTAI

SEQ ID NO: 2093047 - protein, 24 aa, Staphylococcus
VTTPEWMLLPMHKGGTFGKFSTSI

SEQ ID NO: 2093048 - protein, 24 aa, Staphylococcus
VTTPEWMLLPMHKGGTFGKFTTAI

SEQ ID NO: 2093049 - protein, 24 aa, Staphylococcus
VTTPEWMLLPMHKGGTFGKFTTNI

SEQ ID NO: 2093050 - protein, 17 aa, Staphylococcus
VTVISKAFWPEFFEHSY

SEQ ID NO: 2093051 - protein, 19 aa, Staphylococcus
VVAHPFHPVYILPLVEIVP

SEQ ID NO: 2093052 - protein, 24 aa, Staphylococcus
VVDNTFMTPYFQNPLTLGIDIVLH

SEQ ID NO: 2093053 - protein, 17 aa, Staphylococcus
VVEGPLWIQVHAFEKGV

SEQ ID NO: 2093054 - protein, 18 aa, Staphylococcus
VVEGPLWIQVHAFEKGVE

SEQ ID NO: 2093055 - protein, 24 aa, Staphylococcus
VVGIAFIIELKYLHGIDKLDGYDV

SEQ ID NO: 2093056 - protein, 17 aa, Staphylococcus
VVGYLFKIIFNGPLRLM

SEQ ID NO: 2093057 - protein, 28 aa, Staphylococcus
VVIPTKWIPQGIGALFQYLPDASLEDNK

SEQ ID NO: 2093058 - protein, 19 aa, Staphylococcus
VVIVAHIIWIRCCLYYSGV

SEQ ID NO: 2093059 - protein, 18 aa, Staphylococcus
VVKALKWNIIKDGKLLYN

SEQ ID NO: 2093060 - protein, 30 aa, Staphylococcus
VVTQITPWNYPLLQASWKLAPALATGCSLV

SEQ ID NO: 2093061 - protein, 18 aa, Staphylococcus
VWGIFPVVKEGRKTTDAL

SEQ ID NO: 2093062 - protein, 22 aa, Staphylococcus
VYDVFTILYLLNPNQYHTVSAR

SEQ ID NO: 2093063 - protein, 17 aa, Staphylococcus
VYKPTDFLIRRTGMLYF

SEQ ID NO: 2093064 - protein, 18 aa, Staphylococcus
WAKYRGLIASELILEDLT

SEQ ID NO: 2093065 - protein, 17 aa, Staphylococcus
WCVVVYPNKPWAQRVYP

SEQ ID NO: 2093066 - protein, 18 aa, Staphylococcus
WDVPRGEFFIWLKLNGNV

SEQ ID NO: 2093067 - protein, 26 aa, Staphylococcus
WFDDNGDIFFIFTNEKLKAILNCHDG

SEQ ID NO: 2093068 - protein, 18 aa, Staphylococcus
WHHYLRPEIKFDGIDPLV

SEQ ID NO: 2093069 - protein, 17 aa, Staphylococcus
WIAMALAQKTDIIFLDE

SEQ ID NO: 2093070 - protein, 17 aa, Staphylococcus
WIFFINAEGIQEMVADY

SEQ ID NO: 2093071 - protein, 19 aa, Staphylococcus
WIIHIAYDKFIIMANYDVK

SEQ ID NO: 2093072 - protein, 17 aa, Staphylococcus
WILHIPSVYLGIAQAAR

SEQ ID NO: 2093073 - protein, 18 aa, Staphylococcus
WLSQISLISFLRDHGKHV

SEQ ID NO: 2093074 - protein, 18 aa, Staphylococcus
WLTPFELWKDHQITLRVG

SEQ ID NO: 2093075 - protein, 17 aa, Staphylococcus
WLVDLIHFNTTYFSKSG

SEQ ID NO: 2093076 - protein, 19 aa, Staphylococcus
WQFDPLMRLFKTNILTKKF

SEQ ID NO: 2093077 - protein, 19 aa, Staphylococcus
WSFEPLMRLFKTQVLTKKF

SEQ ID NO: 2093078 - protein, 21 aa, Staphylococcus
WSLKQLIDYLTIKPATIFNLN

SEQ ID NO: 2093079 - protein, 17 aa, Staphylococcus
WTMPKREHGFYAAWLHL

SEQ ID NO: 2093080 - protein, 19 aa, Staphylococcus
WTPKFLSIPVLSGLKKADH

SEQ ID NO: 2093081 - protein, 19 aa, Staphylococcus
WTYLPFKLTEQDGKLYGRG

SEQ ID NO: 2093082 - protein, 19 aa, Staphylococcus
WVEYEFQLNKKYFKIIRQG

SEQ ID NO: 2093083 - protein, 18 aa, Staphylococcus
WVVLAKPNLGISSPDVFK

SEQ ID NO: 2093084 - protein, 25 aa, Staphylococcus
YAATFFVFSDYLKPALRLSAIMGLN

SEQ ID NO: 2093085 - protein, 22 aa, Staphylococcus
YAFTELFMFELRMQWLNRLEKA

SEQ ID NO: 2093086 - protein, 22 aa, Staphylococcus
YAFTELFMFELRMQWLNRLEKS

SEQ ID NO: 2093087 - protein, 21 aa, Staphylococcus
YALSRPLFIYVKDKSLKDNKV

SEQ ID NO: 2093088 - protein, 23 aa, Staphylococcus
YAQKPIYLKLNNKFYIISYHNQK

SEQ ID NO: 2093089 - protein, 25 aa, Staphylococcus
YASDDLLLRRIYKLPIGFKWDNQAN

SEQ ID NO: 2093090 - protein, 25 aa, Staphylococcus
YAVNLLGFHLLFYGLAPYLVNGASI

SEQ ID NO: 2093091 - protein, 18 aa, Staphylococcus
YCWLKTPPGYESESFEQF

SEQ ID NO: 2093092 - protein, 19 aa, Staphylococcus
YDKLLDLLKFMIPGYKKEG

SEQ ID NO: 2093093 - protein, 17 aa, Staphylococcus
YDKNQILSFYLNNIYFG

SEQ ID NO: 2093094 - protein, 26 aa, Staphylococcus
YDKYEWLLEHFPFLDPQHFVFCGRKN

SEQ ID NO: 2093095 - protein, 21 aa, Staphylococcus
YDRPWNYLNVLAQQALGDTFG

SEQ ID NO: 2093096 - protein, 17 aa, Staphylococcus
YDVFTVLYLLDPESYET

SEQ ID NO: 2093097 - protein, 19 aa, Staphylococcus
YDVIFLSLVLLHSGDYKAL

SEQ ID NO: 2093098 - protein, 18 aa, Staphylococcus
YDVIMDIPLLFENDLHDT

SEQ ID NO: 2093099 - protein, 21 aa, Staphylococcus
YDYIKYPFTYLSVGAANAFTT

SEQ ID NO: 2093100 - protein, 18 aa, Staphylococcus
YEDGILVVILPKEVSAQD

SEQ ID NO: 2093101 - protein, 20 aa, Staphylococcus
YEDYLVCRPLLNIYKKDIIN

SEQ ID NO: 2093102 - protein, 17 aa, Staphylococcus
YEEMKHYFILNFPQRPG

SEQ ID NO: 2093103 - protein, 18 aa, Staphylococcus
YEHFGRPWIAPPMRVDGS

SEQ ID NO: 2093104 - protein, 24 aa, Staphylococcus
YEHILLIPVFFYDGFLVNKIKKKI

SEQ ID NO: 2093105 - protein, 19 aa, Staphylococcus
YEKLIDLLKFMVPGYKKEG

SEQ ID NO: 2093106 - protein, 24 aa, Staphylococcus
YEKMKHYFIFNFPQRPGALKEFVN

SEQ ID NO: 2093107 - protein, 18 aa, Staphylococcus
YELDPKLWYFSAGSTSTT

SEQ ID NO: 2093108 - protein, 18 aa, Staphylococcus
YERFDFFLEKFNLPVNKK

SEQ ID NO: 2093109 - protein, 20 aa, Staphylococcus
YFINHRIIPIIPQQGSLGAS

SEQ ID NO: 2093110 - protein, 25 aa, Staphylococcus
YFMHHNYWFLFYHDENYFAAKYQDD

SEQ ID NO: 2093111 - protein, 24 aa, Staphylococcus
YFNGNYYISHQWFPLGPVHGLKYW

SEQ ID NO: 2093112 - protein, 26 aa, Staphylococcus
YFVDKYKIKMPFLDQLLINYLNQEIG

SEQ ID NO: 2093113 - protein, 24 aa, Staphylococcus
YGATFFVFSDYLKPALRLSAIMGL

SEQ ID NO: 2093114 - protein, 20 aa, Staphylococcus
YGIPMLAFDTYFDDFKNKHN

SEQ ID NO: 2093115 - protein, 19 aa, Staphylococcus
YGKKYLPRKFKIGIALPPS

SEQ ID NO: 2093116 - protein, 23 aa, Staphylococcus
YGKRIFRLYRNCFYYKEIDKEIQ

SEQ ID NO: 2093117 - protein, 18 aa, Staphylococcus
YGNFGIYLRAYTYIRTMG

SEQ ID NO: 2093118 - protein, 22 aa, Staphylococcus
YGTKWYAYYDGDYQRFVMIAYL

SEQ ID NO: 2093119 - protein, 23 aa, Staphylococcus
YHAKSIFYLRISTLPLSLGIESC

SEQ ID NO: 2093120 - protein, 19 aa, Staphylococcus
YHKVGNGPLLILIPGANGT

SEQ ID NO: 2093121 - protein, 17 aa, Staphylococcus
YHSDIYLQLFKFYSEIL

SEQ ID NO: 2093122 - protein, 25 aa, Staphylococcus
YIDDLYPFYLDPMPNLYFTRDPQAS

SEQ ID NO: 2093123 - protein, 18 aa, Staphylococcus
YIDPLWSHFLRKVIVPAL

SEQ ID NO: 2093124 - protein, 24 aa, Staphylococcus
YIDPLWSHLGWKIVFPAILPNKFQ

SEQ ID NO: 2093125 - protein, 17 aa, Staphylococcus
YIFFGQPLDIPIVANSY

SEQ ID NO: 2093126 - protein, 17 aa, Staphylococcus
YIFPYDIPTTVTSLLRE

SEQ ID NO: 2093127 - protein, 17 aa, Staphylococcus
YIFYQLFETFVIDQSMA

SEQ ID NO: 2093128 - protein, 24 aa, Staphylococcus
YIHQNYWFLYYHDVNYFAVKFDKQ

SEQ ID NO: 2093129 - protein, 25 aa, Staphylococcus
YIPKLVWPVYYLFQSPFQGLMLRGF

SEQ ID NO: 2093130 - protein, 17 aa, Staphylococcus
YIPNFYVDMAELAEARG

SEQ ID NO: 2093131 - protein, 18 aa, Staphylococcus
YIPVLLYSPKLKDKAHEL

SEQ ID NO: 2093132 - protein, 17 aa, Staphylococcus
YIRPLFCEGKGPFRFAA

SEQ ID NO: 2093133 - protein, 19 aa, Staphylococcus
YIVQLISMLDMIGGKKLKI

SEQ ID NO: 2093134 - protein, 18 aa, Staphylococcus
YIYLIFVVHHIIFDGISL

SEQ ID NO: 2093135 - protein, 17 aa, Staphylococcus
YKILFGNNNFILWKYNN

SEQ ID NO: 2093136 - protein, 20 aa, Staphylococcus
YKLYFRFVMPIFGKLFAKSK

SEQ ID NO: 2093137 - protein, 18 aa, Staphylococcus
YKMLPHFQIGLFKDHLFI

SEQ ID NO: 2093138 - protein, 19 aa, Staphylococcus
YKMLPHFQIGLFKDHLFLM

SEQ ID NO: 2093139 - protein, 19 aa, Staphylococcus
YKMLPHFQIGLFRDQLFIM

SEQ ID NO: 2093140 - protein, 17 aa, Staphylococcus
YKPLPMFTAYKNYGFDI

SEQ ID NO: 2093141 - protein, 17 aa, Staphylococcus
YLAYAALIGAGLYGIEH

SEQ ID NO: 2093142 - protein, 17 aa, Staphylococcus
YLDLRRYGSVPHSGFGL

SEQ ID NO: 2093143 - protein, 18 aa, Staphylococcus
YLDLRRYGSVPHSGFGLG

SEQ ID NO: 2093144 - protein, 22 aa, Staphylococcus
YLDLYLIHWPCEADGLFIETYK

SEQ ID NO: 2093145 - protein, 20 aa, Staphylococcus
YLDLYLIHWPGTDQSLMIET

SEQ ID NO: 2093146 - protein, 18 aa, Staphylococcus
YLDLYLMHWPGTDEALMI

SEQ ID NO: 2093147 - protein, 21 aa, Staphylococcus
YLETFLAPTQLYVKPILALKK

SEQ ID NO: 2093148 - protein, 20 aa, Staphylococcus
YLETFLAPTQLYVKPILELK

SEQ ID NO: 2093149 - protein, 17 aa, Staphylococcus
YLFIFVMDYHRHELINE

SEQ ID NO: 2093150 - protein, 19 aa, Staphylococcus
YLKNILKYYYGTLIIVSHD

SEQ ID NO: 2093151 - protein, 20 aa, Staphylococcus
YLKNILKYYYGTLIIVSHDR

SEQ ID NO: 2093152 - protein, 23 aa, Staphylococcus
YLKQYKYIFWLDCDIDVIFKRVT

SEQ ID NO: 2093153 - protein, 21 aa, Staphylococcus
YLKVFGHLFQYLKKNRISHVS

SEQ ID NO: 2093154 - protein, 19 aa, Staphylococcus
YLKYLKKQFPNRLYVTNIN

SEQ ID NO: 2093155 - protein, 25 aa, Staphylococcus
YLLPKYIDIQFLYYRMKLLEFKKYI

SEQ ID NO: 2093156 - protein, 17 aa, Staphylococcus
YLMIIEKLKLFLKEDNY

SEQ ID NO: 2093157 - protein, 21 aa, Staphylococcus
YLPNANLIRLIFDEGFIAIRP

SEQ ID NO: 2093158 - protein, 19 aa, Staphylococcus
YLQDTILKFGFYDGVDHVV

SEQ ID NO: 2093159 - protein, 18 aa, Staphylococcus
YLQERAYLNLKGEQWLIF

SEQ ID NO: 2093160 - protein, 21 aa, Staphylococcus
YLRKFDYLVFPDNVAIVLGIA

SEQ ID NO: 2093161 - protein, 18 aa, Staphylococcus
YLSYLYSQNLKRTTVSRK

SEQ ID NO: 2093162 - protein, 23 aa, Staphylococcus
YLTEDIAFGLVLWSSLGREIDVA

SEQ ID NO: 2093163 - protein, 21 aa, Staphylococcus
YLTEDIAYGLVLWSSIGRVID

SEQ ID NO: 2093164 - protein, 18 aa, Staphylococcus
YLTFIDLYTEFFPTYLKS

SEQ ID NO: 2093165 - protein, 18 aa, Staphylococcus
YLTFIDLYTQMLPQYLND

SEQ ID NO: 2093166 - protein, 17 aa, Staphylococcus
YLWKQLVQRLKTLQLNQ

SEQ ID NO: 2093167 - protein, 17 aa, Staphylococcus
YMIVGMLGAIKAGCGYV

SEQ ID NO: 2093168 - protein, 17 aa, Staphylococcus
YMLILAETLIELKSQFK

SEQ ID NO: 2093169 - protein, 18 aa, Staphylococcus
YMLILAETLIEMKDQFKG

SEQ ID NO: 2093170 - protein, 18 aa, Staphylococcus
YMLILAETLIEMKDQFNG

SEQ ID NO: 2093171 - protein, 17 aa, Staphylococcus
YMLILAETLIEMKSQFS

SEQ ID NO: 2093172 - protein, 18 aa, Staphylococcus
YMLILGETLIEMKEQFKG

SEQ ID NO: 2093173 - protein, 26 aa, Staphylococcus
YMRHPYPFYMDPLPNLYFTRDPQAFI

SEQ ID NO: 2093174 - protein, 27 aa, Staphylococcus
YNDLSLVKFFFKHLTRYLKKQRGLFVL

SEQ ID NO: 2093175 - protein, 20 aa, Staphylococcus
YNFKIPFIDQFLLKTLQSDN

SEQ ID NO: 2093176 - protein, 23 aa, Staphylococcus
YNLTYPQFLVLSILWEESPVNVK

SEQ ID NO: 2093177 - protein, 25 aa, Staphylococcus
YNNLSLVHFFFKSLTSYLKKHHCLY

SEQ ID NO: 2093178 - protein, 17 aa, Staphylococcus
YNSYPNWAKQFPFWSER

SEQ ID NO: 2093179 - protein, 18 aa, Staphylococcus
YNVIMDIPLLFENDLQDT

SEQ ID NO: 2093180 - protein, 21 aa, Staphylococcus
YNVPDFCQLIFITTPDKLHSE

SEQ ID NO: 2093181 - protein, 21 aa, Staphylococcus
YNVPDFCQLIFITTPNKLKED

SEQ ID NO: 2093182 - protein, 21 aa, Staphylococcus
YNVPDFCQLILITSPQHLKIQ

SEQ ID NO: 2093183 - protein, 23 aa, Staphylococcus
YPDLDTWVIFPWTAGQGKVARLI

SEQ ID NO: 2093184 - protein, 24 aa, Staphylococcus
YPDLDTWVIFPWTAGQGKVARLIC

SEQ ID NO: 2093185 - protein, 17 aa, Staphylococcus
YPDLVVHRLIRKYLIDE

SEQ ID NO: 2093186 - protein, 20 aa, Staphylococcus
YPSCRIAYIVLPPKLLEQYH

SEQ ID NO: 2093187 - protein, 19 aa, Staphylococcus
YPSKVILLAWNRYLTDTAS

SEQ ID NO: 2093188 - protein, 17 aa, Staphylococcus
YQLLRKLPPREYSISSS

SEQ ID NO: 2093189 - protein, 23 aa, Staphylococcus
YQVPPRWLFLKIITDEGLEGWGE

SEQ ID NO: 2093190 - protein, 17 aa, Staphylococcus
YQYATIRNLLYSKGYTT

SEQ ID NO: 2093191 - protein, 25 aa, Staphylococcus
YRDVPQLIWQGLPLTEAFLFSRGHF

SEQ ID NO: 2093192 - protein, 18 aa, Staphylococcus
YRGLFRFIQLFVVSNKKE

SEQ ID NO: 2093193 - protein, 18 aa, Staphylococcus
YRKFNYTGLFRFIQLFVI

SEQ ID NO: 2093194 - protein, 21 aa, Staphylococcus
YRVYPYFPFEKSKSFEFFYVE

SEQ ID NO: 2093195 - protein, 19 aa, Staphylococcus
YSFINLLKYMFKSEAYRYL

SEQ ID NO: 2093196 - protein, 17 aa, Staphylococcus
YSKDDIFQIYLNKIYYS

SEQ ID NO: 2093197 - protein, 25 aa, Staphylococcus
YSNIKLVHFFFKSLTEYLKKQNCLF

SEQ ID NO: 2093198 - protein, 20 aa, Staphylococcus
YSQRVLLALINKGLAREAAY

SEQ ID NO: 2093199 - protein, 18 aa, Staphylococcus
YTAWLHLAQHDPALTKEA

SEQ ID NO: 2093200 - protein, 19 aa, Staphylococcus
YTCGYYLIKYYLEKTKSSI

SEQ ID NO: 2093201 - protein, 24 aa, Staphylococcus
YTDLLFLYLERAFLSQNFFDIPTI

SEQ ID NO: 2093202 - protein, 17 aa, Staphylococcus
YTFGRYFPLLKGTSIDY

SEQ ID NO: 2093203 - protein, 24 aa, Staphylococcus
YTKLHNFHWYVKGPNFFSLHTKFE

SEQ ID NO: 2093204 - protein, 22 aa, Staphylococcus
YTKRPDIVLFINGLPIVVIELK

SEQ ID NO: 2093205 - protein, 21 aa, Staphylococcus
YTVVPMWVFKIGSLFNKQVKE

SEQ ID NO: 2093206 - protein, 17 aa, Staphylococcus
YVDFYKSDCWYHAKAYK

SEQ ID NO: 2093207 - protein, 17 aa, Staphylococcus
YVDYLPKKNIKAVQIDV

SEQ ID NO: 2093208 - protein, 19 aa, Staphylococcus
YVFVSPMWNLSFPPVLKAY

SEQ ID NO: 2093209 - protein, 19 aa, Staphylococcus
YVGKLTFFRVYSGTLNSGS

SEQ ID NO: 2093210 - protein, 22 aa, Staphylococcus
YVIATPMWNLSFPPAVKRYFDA

SEQ ID NO: 2093211 - protein, 21 aa, Staphylococcus
YVILLRMHYLIANALDLHGYD

SEQ ID NO: 2093212 - protein, 20 aa, Staphylococcus
YVILLRMHYLIANALDLSGY

SEQ ID NO: 2093213 - protein, 21 aa, Staphylococcus
YVILLRMHYLIANALDLTGYD

SEQ ID NO: 2093214 - protein, 17 aa, Staphylococcus
YVLPFNKENRYLVMPAL

SEQ ID NO: 2093215 - protein, 18 aa, Staphylococcus
YVTWAYLRSLLDIEHDSW

SEQ ID NO: 2093216 - protein, 18 aa, Staphylococcus
YWECPIGCYHWEDLAAYF

SEQ ID NO: 2093217 - protein, 19 aa, Staphylococcus
YYEYKKFGILPEKEYAINK

SEQ ID NO: 2093218 - protein, 25 aa, Staphylococcus
YYQNQVYIHFIIHHLVIDGVSWRII

SEQ ID NO: 2093219 - protein, 19 aa, Staphylococcus
YYTPIFMKKGRPSTQLTLI

SEQ ID NO: 2093220 - protein, 5 aa, Staphylococcus
VKIED

SEQ ID NO: 2093221 - protein, 9 aa, Staphylococcus
ESPGASTSV

SEQ ID NO: 2093222 - protein, 4 aa, Staphylococcus
APGF

SEQ ID NO: 2093223 - protein, 8 aa, Staphylococcus
DDGAETDL

SEQ ID NO: 2093224 - protein, 8 aa, Staphylococcus
DPGTMSPY

SEQ ID NO: 2093225 - protein, 7 aa, Staphylococcus
GESTNAD

SEQ ID NO: 2093226 - protein, 7 aa, Staphylococcus
RPNRPQP

SEQ ID NO: 2093227 - protein, 8 aa, Staphylococcus
SNNPAEEG

SEQ ID NO: 2093228 - protein, 4 aa, Staphylococcus
TVGS

SEQ ID NO: 2093229 - protein, 7 aa, Staphylococcus
YSNVTAG

SEQ ID NO: 2093230 - protein, 6 aa, Staphylococcus
AIPGDD

SEQ ID NO: 2093231 - protein, 7 aa, Staphylococcus
EDTQTWS

SEQ ID NO: 2093232 - protein, 10 aa, Staphylococcus
EQKDIEDLGG

SEQ ID NO: 2093233 - protein, 9 aa, Staphylococcus
ESARGEGGR

SEQ ID NO: 2093234 - protein, 8 aa, Staphylococcus
KERRGDYL

SEQ ID NO: 2093235 - protein, 7 aa, Staphylococcus
NGLNANN

SEQ ID NO: 2093236 - protein, 5 aa, Staphylococcus
PESYL

SEQ ID NO: 2093237 - protein, 7 aa, Staphylococcus
SGPSHAE

SEQ ID NO: 2093238 - protein, 8 aa, Staphylococcus
TGIPESKH

SEQ ID NO: 2093239 - protein, 11 aa, Staphylococcus
TNSMINTGSAA

SEQ ID NO: 2093240 - protein, 4 aa, Staphylococcus
AGGF

SEQ ID NO: 2093241 - protein, 15 aa, Staphylococcus
ALSAARPGARKETLE

SEQ ID NO: 2093242 - protein, 6 aa, Staphylococcus
ATANTI

SEQ ID NO: 2093243 - protein, 7 aa, Staphylococcus
DHEVEGS

SEQ ID NO: 2093244 - protein, 4 aa, Staphylococcus
DTPE

SEQ ID NO: 2093245 - protein, 8 aa, Staphylococcus
DVTSTAGY

SEQ ID NO: 2093246 - protein, 7 aa, Staphylococcus
EKLGADP

SEQ ID NO: 2093247 - protein, 6 aa, Staphylococcus
FGDNAK

SEQ ID NO: 2093248 - protein, 12 aa, Staphylococcus
FSQHGGNRLGAN

SEQ ID NO: 2093249 - protein, 12 aa, Staphylococcus
GEMKTKPTQHSV

SEQ ID NO: 2093250 - protein, 5 aa, Staphylococcus
GRMEE

SEQ ID NO: 2093251 - protein, 5 aa, Staphylococcus
IEGAQ

SEQ ID NO: 2093252 - protein, 7 aa, Staphylococcus
IPAPGDI

SEQ ID NO: 2093253 - protein, 7 aa, Staphylococcus
KARKEVD

SEQ ID NO: 2093254 - protein, 4 aa, Staphylococcus
KSMP

SEQ ID NO: 2093255 - protein, 15 aa, Staphylococcus
PPRKRDYTSKSKGGK

SEQ ID NO: 2093256 - protein, 17 aa, Staphylococcus
QGGINGAVNTKGEGDSP

SEQ ID NO: 2093257 - protein, 8 aa, Staphylococcus
SNNPAEQG

SEQ ID NO: 2093258 - protein, 5 aa, Staphylococcus
TGGPG

SEQ ID NO: 2093259 - protein, 5 aa, Staphylococcus
VSTNY

SEQ ID NO: 2093260 - protein, 6 aa, Staphylococcus
YTGTEL

SEQ ID NO: 2093261 - protein, 6 aa, Staphylococcus
AAEQGA

SEQ ID NO: 2093262 - protein, 13 aa, Staphylococcus
ADHSTGGLSIAKG

SEQ ID NO: 2093263 - protein, 7 aa, Staphylococcus
AGATTGQ

SEQ ID NO: 2093264 - protein, 9 aa, Staphylococcus
AIAPGTIET

SEQ ID NO: 2093265 - protein, 9 aa, Staphylococcus
AQRESGGDI

SEQ ID NO: 2093266 - protein, 8 aa, Staphylococcus
ASTHPGAG

SEQ ID NO: 2093267 - protein, 6 aa, Staphylococcus
ATSESQ

SEQ ID NO: 2093268 - protein, 10 aa, Staphylococcus
AYDKEDGDLT

SEQ ID NO: 2093269 - protein, 7 aa, Staphylococcus
DAGEQAT

SEQ ID NO: 2093270 - protein, 6 aa, Staphylococcus
DKGDVD

SEQ ID NO: 2093271 - protein, 7 aa, Staphylococcus
DKNIKKY

SEQ ID NO: 2093272 - protein, 7 aa, Staphylococcus
DLDPKID

SEQ ID NO: 2093273 - protein, 6 aa, Staphylococcus
DLDPVA

SEQ ID NO: 2093274 - protein, 5 aa, Staphylococcus
ETGNG

SEQ ID NO: 2093275 - protein, 11 aa, Staphylococcus
FAYASTSKAIN

SEQ ID NO: 2093276 - protein, 12 aa, Staphylococcus
FPPYDGSPLATE

SEQ ID NO: 2093277 - protein, 10 aa, Staphylococcus
GAGSLATGSA

SEQ ID NO: 2093278 - protein, 4 aa, Staphylococcus
GGAI

SEQ ID NO: 2093279 - protein, 4 aa, Staphylococcus
GING

SEQ ID NO: 2093280 - protein, 8 aa, Staphylococcus
GKLSKENK

SEQ ID NO: 2093281 - protein, 8 aa, Staphylococcus
GNTKNPKN

SEQ ID NO: 2093282 - protein, 8 aa, Staphylococcus
GTVAGPNA

SEQ ID NO: 2093283 - protein, 6 aa, Staphylococcus
HDQKAA

SEQ ID NO: 2093284 - protein, 6 aa, Staphylococcus
HSGSYM

SEQ ID NO: 2093285 - protein, 7 aa, Staphylococcus
IDQQGNY

SEQ ID NO: 2093286 - protein, 8 aa, Staphylococcus
IGGTTGDI

SEQ ID NO: 2093287 - protein, 6 aa, Staphylococcus
KAGQNT

SEQ ID NO: 2093288 - protein, 8 aa, Staphylococcus
KAKEINEQ

SEQ ID NO: 2093289 - protein, 7 aa, Staphylococcus
KATKRRK

SEQ ID NO: 2093290 - protein, 23 aa, Staphylococcus
KDNKSDKPNDKLISETAKSVMKE

SEQ ID NO: 2093291 - protein, 6 aa, Staphylococcus
KGQSEP

SEQ ID NO: 2093292 - protein, 6 aa, Staphylococcus
KINGQH

SEQ ID NO: 2093293 - protein, 8 aa, Staphylococcus
KKAAPKAK

SEQ ID NO: 2093294 - protein, 5 aa, Staphylococcus
KNGSN

SEQ ID NO: 2093295 - protein, 4 aa, Staphylococcus
MTQD

SEQ ID NO: 2093296 - protein, 9 aa, Staphylococcus
NDYTTPNKL

SEQ ID NO: 2093297 - protein, 8 aa, Staphylococcus
NKSGDTLI

SEQ ID NO: 2093298 - protein, 7 aa, Staphylococcus
PEARDED

SEQ ID NO: 2093299 - protein, 5 aa, Staphylococcus
QRGDV

SEQ ID NO: 2093300 - protein, 14 aa, Staphylococcus
QRLKELGDKVTNPV

SEQ ID NO: 2093301 - protein, 8 aa, Staphylococcus
RASEGKIS

SEQ ID NO: 2093302 - protein, 6 aa, Staphylococcus
RGTENA

SEQ ID NO: 2093303 - protein, 5 aa, Staphylococcus
RNPDQ

SEQ ID NO: 2093304 - protein, 10 aa, Staphylococcus
RSSNEIGSDG

SEQ ID NO: 2093305 - protein, 6 aa, Staphylococcus
RTSYGQ

SEQ ID NO: 2093306 - protein, 6 aa, Staphylococcus
SAGGQI

SEQ ID NO: 2093307 - protein, 6 aa, Staphylococcus
SDLGRE

SEQ ID NO: 2093308 - protein, 9 aa, Staphylococcus
SLGKGITAA

SEQ ID NO: 2093309 - protein, 8 aa, Staphylococcus
SNPMPPRT

SEQ ID NO: 2093310 - protein, 7 aa, Staphylococcus
SNRHKGI

SEQ ID NO: 2093311 - protein, 11 aa, Staphylococcus
STSKITGEEEI

SEQ ID NO: 2093312 - protein, 6 aa, Staphylococcus
VNDDGS

SEQ ID NO: 2093313 - protein, 6 aa, Staphylococcus
VNGDGS

SEQ ID NO: 2093314 - protein, 6 aa, Staphylococcus
VNSDGS

SEQ ID NO: 2093315 - protein, 13 aa, Staphylococcus
VYGKEPPGTPPMT

SEQ ID NO: 2093316 - protein, 12 aa, Staphylococcus
YEADGKGKEPAV

SEQ ID NO: 2093317 - protein, 5 aa, Staphylococcus
YGSEY

SEQ ID NO: 2093318 - protein, 17 aa, Staphylococcus
YSPKSKKDTSTPAAFGK

SEQ ID NO: 2093319 - protein, 11 aa, Staphylococcus
ADDGGSTGKIR

SEQ ID NO: 2093320 - protein, 9 aa, Staphylococcus
ADHTTESTV

SEQ ID NO: 2093321 - protein, 7 aa, Staphylococcus
AFGSNYD

SEQ ID NO: 2093322 - protein, 6 aa, Staphylococcus
AGGTKA

SEQ ID NO: 2093323 - protein, 5 aa, Staphylococcus
AGYPF

SEQ ID NO: 2093324 - protein, 5 aa, Staphylococcus
AGYPL

SEQ ID NO: 2093325 - protein, 17 aa, Staphylococcus
AHATTPNMGQGAGQAME

SEQ ID NO: 2093326 - protein, 8 aa, Staphylococcus
AHTKTLDE

SEQ ID NO: 2093327 - protein, 7 aa, Staphylococcus
AKYDTQL

SEQ ID NO: 2093328 - protein, 8 aa, Staphylococcus
APPYSHPK

SEQ ID NO: 2093329 - protein, 4 aa, Staphylococcus
ARPM

SEQ ID NO: 2093330 - protein, 6 aa, Staphylococcus
ASSNAE

SEQ ID NO: 2093331 - protein, 7 aa, Staphylococcus
DDSSFIT

SEQ ID NO: 2093332 - protein, 22 aa, Staphylococcus
DGVPKDYKVADKSGQAITYASR

SEQ ID NO: 2093333 - protein, 5 aa, Staphylococcus
DKPGM

SEQ ID NO: 2093334 - protein, 7 aa, Staphylococcus
DKVRVPT

SEQ ID NO: 2093335 - protein, 4 aa, Staphylococcus
DNQK

SEQ ID NO: 2093336 - protein, 7 aa, Staphylococcus
DNWGRGG

SEQ ID NO: 2093337 - protein, 6 aa, Staphylococcus
DQQGNY

SEQ ID NO: 2093338 - protein, 7 aa, Staphylococcus
DSNEAME

SEQ ID NO: 2093339 - protein, 5 aa, Staphylococcus
DSTTV

SEQ ID NO: 2093340 - protein, 11 aa, Staphylococcus
DTSGSGLNRRG

SEQ ID NO: 2093341 - protein, 13 aa, Staphylococcus
EADPTDDVEGIDA

SEQ ID NO: 2093342 - protein, 5 aa, Staphylococcus
EDTDA

SEQ ID NO: 2093343 - protein, 8 aa, Staphylococcus
EEAVDPDD

SEQ ID NO: 2093344 - protein, 5 aa, Staphylococcus
EEELS

SEQ ID NO: 2093345 - protein, 6 aa, Staphylococcus
ERYGSI

SEQ ID NO: 2093346 - protein, 7 aa, Staphylococcus
ESQARGL

SEQ ID NO: 2093347 - protein, 6 aa, Staphylococcus
ETAPTD

SEQ ID NO: 2093348 - protein, 5 aa, Staphylococcus
ETQVE

SEQ ID NO: 2093349 - protein, 4 aa, Staphylococcus
EYTR

SEQ ID NO: 2093350 - protein, 9 aa, Staphylococcus
FTGDDPRKV

SEQ ID NO: 2093351 - protein, 7 aa, Staphylococcus
GAKYANG

SEQ ID NO: 2093352 - protein, 17 aa, Staphylococcus
GDTADGYPGVKGIGEKT

SEQ ID NO: 2093353 - protein, 5 aa, Staphylococcus
GETYG

SEQ ID NO: 2093354 - protein, 6 aa, Staphylococcus
GGATCA

SEQ ID NO: 2093355 - protein, 5 aa, Staphylococcus
GGTEE

SEQ ID NO: 2093356 - protein, 4 aa, Staphylococcus
GHDQ

SEQ ID NO: 2093357 - protein, 4 aa, Staphylococcus
GLIE

SEQ ID NO: 2093358 - protein, 5 aa, Staphylococcus
GMPDE

SEQ ID NO: 2093359 - protein, 8 aa, Staphylococcus
GREGRNIR

SEQ ID NO: 2093360 - protein, 7 aa, Staphylococcus
GTSPDGR

SEQ ID NO: 2093361 - protein, 9 aa, Staphylococcus
GVDNGAGRI

SEQ ID NO: 2093362 - protein, 12 aa, Staphylococcus
HEGYTDAKDSDF

SEQ ID NO: 2093363 - protein, 7 aa, Staphylococcus
HGDVEPT

SEQ ID NO: 2093364 - protein, 6 aa, Staphylococcus
HKDPHE

SEQ ID NO: 2093365 - protein, 6 aa, Staphylococcus
HKRAIE

SEQ ID NO: 2093366 - protein, 4 aa, Staphylococcus
IAPT

SEQ ID NO: 2093367 - protein, 6 aa, Staphylococcus
IENGTF

SEQ ID NO: 2093368 - protein, 9 aa, Staphylococcus
IGGTTGDIE

SEQ ID NO: 2093369 - protein, 7 aa, Staphylococcus
ISGPQSK

SEQ ID NO: 2093370 - protein, 8 aa, Staphylococcus
KAAKKGSK

SEQ ID NO: 2093371 - protein, 8 aa, Staphylococcus
KAKEINEE

SEQ ID NO: 2093372 - protein, 5 aa, Staphylococcus
KDPHE

SEQ ID NO: 2093373 - protein, 7 aa, Staphylococcus
KKAAPNA

SEQ ID NO: 2093374 - protein, 9 aa, Staphylococcus
KKQKPNAKI

SEQ ID NO: 2093375 - protein, 14 aa, Staphylococcus
KKYKSLKDLPKGAT

SEQ ID NO: 2093376 - protein, 6 aa, Staphylococcus
KLLETD

SEQ ID NO: 2093377 - protein, 8 aa, Staphylococcus
KPLLEKKG

SEQ ID NO: 2093378 - protein, 5 aa, Staphylococcus
LDDDE

SEQ ID NO: 2093379 - protein, 6 aa, Staphylococcus
LSKDQL

SEQ ID NO: 2093380 - protein, 6 aa, Staphylococcus
MGGQTI

SEQ ID NO: 2093381 - protein, 6 aa, Staphylococcus
MGPSFN

SEQ ID NO: 2093382 - protein, 10 aa, Staphylococcus
MTTSEIQSFG

SEQ ID NO: 2093383 - protein, 8 aa, Staphylococcus
NDYTTPNK

SEQ ID NO: 2093384 - protein, 6 aa, Staphylococcus
NGKSGW

SEQ ID NO: 2093385 - protein, 4 aa, Staphylococcus
NKLR

SEQ ID NO: 2093386 - protein, 6 aa, Staphylococcus
NLDPVA

SEQ ID NO: 2093387 - protein, 7 aa, Staphylococcus
NQPPVKA

SEQ ID NO: 2093388 - protein, 4 aa, Staphylococcus
NVKG

SEQ ID NO: 2093389 - protein, 5 aa, Staphylococcus
NYEAD

SEQ ID NO: 2093390 - protein, 7 aa, Staphylococcus
NYQPQNS

SEQ ID NO: 2093391 - protein, 7 aa, Staphylococcus
PFTTPEG

SEQ ID NO: 2093392 - protein, 12 aa, Staphylococcus
PMAGSHKSGVLN

SEQ ID NO: 2093393 - protein, 5 aa, Staphylococcus
PNDEM

SEQ ID NO: 2093394 - protein, 17 aa, Staphylococcus
PSQNADKLEAKAKPLEK

SEQ ID NO: 2093395 - protein, 5 aa, Staphylococcus
PTKHD

SEQ ID NO: 2093396 - protein, 7 aa, Staphylococcus
QDKLTGY

SEQ ID NO: 2093397 - protein, 7 aa, Staphylococcus
RSEPVAE

SEQ ID NO: 2093398 - protein, 5 aa, Staphylococcus
RTKDG

SEQ ID NO: 2093399 - protein, 8 aa, Staphylococcus
SDNSTPRS

SEQ ID NO: 2093400 - protein, 8 aa, Staphylococcus
SGTSPDGR

SEQ ID NO: 2093401 - protein, 5 aa, Staphylococcus
SLNGL

SEQ ID NO: 2093402 - protein, 9 aa, Staphylococcus
SNRSSGKMG

SEQ ID NO: 2093403 - protein, 4 aa, Staphylococcus
SNVK

SEQ ID NO: 2093404 - protein, 12 aa, Staphylococcus
SNYYRPPNVSRD

SEQ ID NO: 2093405 - protein, 5 aa, Staphylococcus
SPRYG

SEQ ID NO: 2093406 - protein, 10 aa, Staphylococcus
SSLGKGITAA

SEQ ID NO: 2093407 - protein, 7 aa, Staphylococcus
STHSRNY

SEQ ID NO: 2093408 - protein, 10 aa, Staphylococcus
SVGSDGSVTV

SEQ ID NO: 2093409 - protein, 8 aa, Staphylococcus
SVNPGGGM

SEQ ID NO: 2093410 - protein, 4 aa, Staphylococcus
TAGY

SEQ ID NO: 2093411 - protein, 8 aa, Staphylococcus
TGDDPRKV

SEQ ID NO: 2093412 - protein, 5 aa, Staphylococcus
TSQGA

SEQ ID NO: 2093413 - protein, 9 aa, Staphylococcus
VEKNKEGIG

SEQ ID NO: 2093414 - protein, 6 aa, Staphylococcus
VNSEDH

SEQ ID NO: 2093415 - protein, 10 aa, Staphylococcus
VQQPDGSIDI

SEQ ID NO: 2093416 - protein, 10 aa, Staphylococcus
WLNESGAKYP

SEQ ID NO: 2093417 - protein, 5 aa, Staphylococcus
YPDYG

SEQ ID NO: 2093418 - protein, 6 aa, Staphylococcus
YPDYGN

SEQ ID NO: 2093419 - protein, 5 aa, Staphylococcus
YPIPG

SEQ ID NO: 2093420 - protein, 10 aa, Staphylococcus
YRNGVGKPEG

SEQ ID NO: 2093421 - protein, 7 aa, Staphylococcus
YSTDGRI

SEQ ID NO: 2093422 - protein, 11 aa, Staphylococcus
AAGKDPEKVIN

SEQ ID NO: 2093423 - protein, 15 aa, Staphylococcus
AAKYGHERYGKTYEG

SEQ ID NO: 2093424 - protein, 4 aa, Staphylococcus
AALD

SEQ ID NO: 2093425 - protein, 5 aa, Staphylococcus
AAQRA

SEQ ID NO: 2093426 - protein, 12 aa, Staphylococcus
AATLADKSTRNA

SEQ ID NO: 2093427 - protein, 10 aa, Staphylococcus
ADGKKDRGHV

SEQ ID NO: 2093428 - protein, 13 aa, Staphylococcus
ADNPNTKELDQTA

SEQ ID NO: 2093429 - protein, 4 aa, Staphylococcus
ADYA

SEQ ID NO: 2093430 - protein, 5 aa, Staphylococcus
ADYAA

SEQ ID NO: 2093431 - protein, 5 aa, Staphylococcus
AEAKP

SEQ ID NO: 2093432 - protein, 5 aa, Staphylococcus
AEANG

SEQ ID NO: 2093433 - protein, 9 aa, Staphylococcus
AEHTSESTV

SEQ ID NO: 2093434 - protein, 9 aa, Staphylococcus
AEKDNPKAD

SEQ ID NO: 2093435 - protein, 10 aa, Staphylococcus
AEKKSHGYKI

SEQ ID NO: 2093436 - protein, 7 aa, Staphylococcus
AELGKPI

SEQ ID NO: 2093437 - protein, 15 aa, Staphylococcus
AFKKDAEAKYKDAWP

SEQ ID NO: 2093438 - protein, 13 aa, Staphylococcus
AGEMKTKPTQHSV

SEQ ID NO: 2093439 - protein, 22 aa, Staphylococcus
AGGENVIKDTSKQYISSNTENL

SEQ ID NO: 2093440 - protein, 6 aa, Staphylococcus
AGGTEE

SEQ ID NO: 2093441 - protein, 6 aa, Staphylococcus
AGPDDL

SEQ ID NO: 2093442 - protein, 16 aa, Staphylococcus
AGYDVTTTPVTASGPL

SEQ ID NO: 2093443 - protein, 5 aa, Staphylococcus
AIGKG

SEQ ID NO: 2093444 - protein, 10 aa, Staphylococcus
AITDPDKAKG

SEQ ID NO: 2093445 - protein, 5 aa, Staphylococcus
AKEII

SEQ ID NO: 2093446 - protein, 11 aa, Staphylococcus
AKKKLDQAGLP

SEQ ID NO: 2093447 - protein, 7 aa, Staphylococcus
AKYETQL

SEQ ID NO: 2093448 - protein, 7 aa, Staphylococcus
AKYGTTY

SEQ ID NO: 2093449 - protein, 9 aa, Staphylococcus
ANEPQSTKA

SEQ ID NO: 2093450 - protein, 8 aa, Staphylococcus
ANGGTEAA

SEQ ID NO: 2093451 - protein, 10 aa, Staphylococcus
ANSYNGEDFE

SEQ ID NO: 2093452 - protein, 7 aa, Staphylococcus
APPYSHP

SEQ ID NO: 2093453 - protein, 10 aa, Staphylococcus
AQGEAPIKET

SEQ ID NO: 2093454 - protein, 6 aa, Staphylococcus
AQIGKG

SEQ ID NO: 2093455 - protein, 13 aa, Staphylococcus
AQLGKPVSNRWGN

SEQ ID NO: 2093456 - protein, 21 aa, Staphylococcus
AQRESGGDLKAVNPSSGAAGK

SEQ ID NO: 2093457 - protein, 6 aa, Staphylococcus
AQSIDE

SEQ ID NO: 2093458 - protein, 4 aa, Staphylococcus
ARAG

SEQ ID NO: 2093459 - protein, 17 aa, Staphylococcus
ARDKGYQVSNHPSEHTA

SEQ ID NO: 2093460 - protein, 8 aa, Staphylococcus
ASFSGQAA

SEQ ID NO: 2093461 - protein, 4 aa, Staphylococcus
AVKN

SEQ ID NO: 2093462 - protein, 18 aa, Staphylococcus
CNSNSSHAKELNDLEKKY

SEQ ID NO: 2093463 - protein, 18 aa, Staphylococcus
CSGNSNKSTSDQSDKDTM

SEQ ID NO: 2093464 - protein, 19 aa, Staphylococcus
CSQSSKHTKGDNVDQQGNA

SEQ ID NO: 2093465 - protein, 6 aa, Staphylococcus
DAKNEE

SEQ ID NO: 2093466 - protein, 7 aa, Staphylococcus
DAPQQNP

SEQ ID NO: 2093467 - protein, 5 aa, Staphylococcus
DATFN

SEQ ID NO: 2093468 - protein, 25 aa, Staphylococcus
DDFGEREYGDNARKKQGKTNPEKMA

SEQ ID NO: 2093469 - protein, 13 aa, Staphylococcus
DDISQKSTKTIQD

SEQ ID NO: 2093470 - protein, 8 aa, Staphylococcus
DEDNAARG

SEQ ID NO: 2093471 - protein, 17 aa, Staphylococcus
DEHPDQAKKRGFRGAGS

SEQ ID NO: 2093472 - protein, 26 aa, Staphylococcus
DEILEQKESKIEERQQQVDAKESSVQ

SEQ ID NO: 2093473 - protein, 10 aa, Staphylococcus
DEYSAPENGK

SEQ ID NO: 2093474 - protein, 8 aa, Staphylococcus
DHAQPSSW

SEQ ID NO: 2093475 - protein, 6 aa, Staphylococcus
DHPEID

SEQ ID NO: 2093476 - protein, 8 aa, Staphylococcus
DKDGELAG

SEQ ID NO: 2093477 - protein, 8 aa, Staphylococcus
DKDGNLAG

SEQ ID NO: 2093478 - protein, 10 aa, Staphylococcus
DKEKEDRYGR

SEQ ID NO: 2093479 - protein, 5 aa, Staphylococcus
DKGEI

SEQ ID NO: 2093480 - protein, 6 aa, Staphylococcus
DKGELD

SEQ ID NO: 2093481 - protein, 8 aa, Staphylococcus
DKIPNDTI

SEQ ID NO: 2093482 - protein, 4 aa, Staphylococcus
DKKD

SEQ ID NO: 2093483 - protein, 15 aa, Staphylococcus
DKKKNKGFKFPKQSE

SEQ ID NO: 2093484 - protein, 9 aa, Staphylococcus
DKSKKRPLN

SEQ ID NO: 2093485 - protein, 5 aa, Staphylococcus
DKSYI

SEQ ID NO: 2093486 - protein, 13 aa, Staphylococcus
DMKEEKKEDKWTG

SEQ ID NO: 2093487 - protein, 4 aa, Staphylococcus
DNIQ

SEQ ID NO: 2093488 - protein, 13 aa, Staphylococcus
DNLSQNSSKTIED

SEQ ID NO: 2093489 - protein, 11 aa, Staphylococcus
DPDNIYGNNNQ

SEQ ID NO: 2093490 - protein, 18 aa, Staphylococcus
DRPGIESSNERHNAGTGH

SEQ ID NO: 2093491 - protein, 16 aa, Staphylococcus
DSADGYPGVKGIGEKT

SEQ ID NO: 2093492 - protein, 7 aa, Staphylococcus
DSAGGQI

SEQ ID NO: 2093493 - protein, 6 aa, Staphylococcus
DSSFIT

SEQ ID NO: 2093494 - protein, 5 aa, Staphylococcus
DSTSV

SEQ ID NO: 2093495 - protein, 13 aa, Staphylococcus
DTKSGKEVKFNSD

SEQ ID NO: 2093496 - protein, 14 aa, Staphylococcus
DTKSGKEVKFNSDK

SEQ ID NO: 2093497 - protein, 24 aa, Staphylococcus
DTSGSGLNKRGYRLAQGEAPIKET

SEQ ID NO: 2093498 - protein, 7 aa, Staphylococcus
DVSNQAR

SEQ ID NO: 2093499 - protein, 6 aa, Staphylococcus
DWKPGQ

SEQ ID NO: 2093500 - protein, 19 aa, Staphylococcus
DYVDDNDNKVDEWLEGIET

SEQ ID NO: 2093501 - protein, 13 aa, Staphylococcus
EADPTDDVEGVDA

SEQ ID NO: 2093502 - protein, 7 aa, Staphylococcus
EDIAENK

SEQ ID NO: 2093503 - protein, 7 aa, Staphylococcus
EDKAKAD

SEQ ID NO: 2093504 - protein, 14 aa, Staphylococcus
EENLERKSDLLDKK

SEQ ID NO: 2093505 - protein, 4 aa, Staphylococcus
EEVP

SEQ ID NO: 2093506 - protein, 10 aa, Staphylococcus
EGHKKDKKFQ

SEQ ID NO: 2093507 - protein, 6 aa, Staphylococcus
EHGDSQ

SEQ ID NO: 2093508 - protein, 8 aa, Staphylococcus
EHKGEKNQ

SEQ ID NO: 2093509 - protein, 6 aa, Staphylococcus
EKGNAQ

SEQ ID NO: 2093510 - protein, 11 aa, Staphylococcus
ELSTFGPGGRF

SEQ ID NO: 2093511 - protein, 9 aa, Staphylococcus
ENPDNISKT

SEQ ID NO: 2093512 - protein, 10 aa, Staphylococcus
ENRQQIKDTI

SEQ ID NO: 2093513 - protein, 10 aa, Staphylococcus
ENRQQIKDTL

SEQ ID NO: 2093514 - protein, 4 aa, Staphylococcus
EQGH

SEQ ID NO: 2093515 - protein, 6 aa, Staphylococcus
EQIGGK

SEQ ID NO: 2093516 - protein, 15 aa, Staphylococcus
ESDSGNSALASAPHN

SEQ ID NO: 2093517 - protein, 5 aa, Staphylococcus
ESGNG

SEQ ID NO: 2093518 - protein, 10 aa, Staphylococcus
ESWTQKPKYN

SEQ ID NO: 2093519 - protein, 6 aa, Staphylococcus
ETAKKY

SEQ ID NO: 2093520 - protein, 9 aa, Staphylococcus
ETKGKIKPT

SEQ ID NO: 2093521 - protein, 6 aa, Staphylococcus
ETLYPD

SEQ ID NO: 2093522 - protein, 8 aa, Staphylococcus
ETQNIEAY

SEQ ID NO: 2093523 - protein, 7 aa, Staphylococcus
FDKGEEL

SEQ ID NO: 2093524 - protein, 25 aa, Staphylococcus
FKDDNGKEITPIGPTAWGGSDRTAF

SEQ ID NO: 2093525 - protein, 9 aa, Staphylococcus
FKEENPQEI

SEQ ID NO: 2093526 - protein, 10 aa, Staphylococcus
FKPGQLNADR

SEQ ID NO: 2093527 - protein, 8 aa, Staphylococcus
FNNQQGAE

SEQ ID NO: 2093528 - protein, 12 aa, Staphylococcus
FNRESKAKALNQ

SEQ ID NO: 2093529 - protein, 11 aa, Staphylococcus
FPTTDKSYYDK

SEQ ID NO: 2093530 - protein, 11 aa, Staphylococcus
GAYQGETTNFN

SEQ ID NO: 2093531 - protein, 6 aa, Staphylococcus
GDVEPT

SEQ ID NO: 2093532 - protein, 10 aa, Staphylococcus
GEAHLTNPQV

SEQ ID NO: 2093533 - protein, 8 aa, Staphylococcus
GGADEKFQ

SEQ ID NO: 2093534 - protein, 4 aa, Staphylococcus
GGQT

SEQ ID NO: 2093535 - protein, 9 aa, Staphylococcus
GGSANSEKY

SEQ ID NO: 2093536 - protein, 6 aa, Staphylococcus
GGYQSS

SEQ ID NO: 2093537 - protein, 20 aa, Staphylococcus
GKDEDEEKRRADAKGKPKTW

SEQ ID NO: 2093538 - protein, 15 aa, Staphylococcus
GKPGDTVVDDHTDEE

SEQ ID NO: 2093539 - protein, 27 aa, Staphylococcus
GKPTTYKTLPKRYKDVPEVGQPMQPSV

SEQ ID NO: 2093540 - protein, 7 aa, Staphylococcus
GKSTQMV

SEQ ID NO: 2093541 - protein, 7 aa, Staphylococcus
GLESPGH

SEQ ID NO: 2093542 - protein, 8 aa, Staphylococcus
GLNGPKAR

SEQ ID NO: 2093543 - protein, 7 aa, Staphylococcus
GNEQIAN

SEQ ID NO: 2093544 - protein, 8 aa, Staphylococcus
GNGPQVGS

SEQ ID NO: 2093545 - protein, 37 aa, Staphylococcus
GNNNIYQGSWKTPGMTYEDATKSLVGTYSTDPDYDKK

SEQ ID NO: 2093546 - protein, 15 aa, Staphylococcus
GNPPYGERIGDREEV

SEQ ID NO: 2093547 - protein, 4 aa, Staphylococcus
GNVT

SEQ ID NO: 2093548 - protein, 17 aa, Staphylococcus
GQDPHEYEVKPKDIKAL

SEQ ID NO: 2093549 - protein, 18 aa, Staphylococcus
GQDPHEYEVKPKDIKKLT

SEQ ID NO: 2093550 - protein, 18 aa, Staphylococcus
GQDPHEYEVKPKDIKQLT

SEQ ID NO: 2093551 - protein, 6 aa, Staphylococcus
GQQVAD

SEQ ID NO: 2093552 - protein, 5 aa, Staphylococcus
GRIHP

SEQ ID NO: 2093553 - protein, 6 aa, Staphylococcus
GRIHPG

SEQ ID NO: 2093554 - protein, 4 aa, Staphylococcus
GRQK

SEQ ID NO: 2093555 - protein, 12 aa, Staphylococcus
GRTASQKNLDEF

SEQ ID NO: 2093556 - protein, 4 aa, Staphylococcus
GSGF

SEQ ID NO: 2093557 - protein, 4 aa, Staphylococcus
GSII

SEQ ID NO: 2093558 - protein, 13 aa, Staphylococcus
GSLITKNGKVVGS

SEQ ID NO: 2093559 - protein, 20 aa, Staphylococcus
GSQNLAPLEDKTTKLRDDNH

SEQ ID NO: 2093560 - protein, 6 aa, Staphylococcus
GSSTIQ

SEQ ID NO: 2093561 - protein, 7 aa, Staphylococcus
GTDTLEE

SEQ ID NO: 2093562 - protein, 8 aa, Staphylococcus
GTVDYGAA

SEQ ID NO: 2093563 - protein, 4 aa, Staphylococcus
GVIP

SEQ ID NO: 2093564 - protein, 8 aa, Staphylococcus
GYSTDGRI

SEQ ID NO: 2093565 - protein, 40 aa, Staphylococcus
HDEESNDVQSKQLTTSKAQHQQVNNPQTSENESSQRRAAQ

SEQ ID NO: 2093566 - protein, 4 aa, Staphylococcus
HPEI

SEQ ID NO: 2093567 - protein, 29 aa, Staphylococcus
HQHKNKKVHKQDEDAYLSPKDKHIESTEV

SEQ ID NO: 2093568 - protein, 4 aa, Staphylococcus
HRDY

SEQ ID NO: 2093569 - protein, 5 aa, Staphylococcus
HRKTE

SEQ ID NO: 2093570 - protein, 7 aa, Staphylococcus
IAPTIST

SEQ ID NO: 2093571 - protein, 17 aa, Staphylococcus
IGNYTSVGARKQPNLEE

SEQ ID NO: 2093572 - protein, 9 aa, Staphylococcus
IGSGTSLDT

SEQ ID NO: 2093573 - protein, 10 aa, Staphylococcus
IIGSRAGHAV

SEQ ID NO: 2093574 - protein, 16 aa, Staphylococcus
IKDAPKDGFSKGDTVK

SEQ ID NO: 2093575 - protein, 17 aa, Staphylococcus
INKDREKKYKFSNPYTY

SEQ ID NO: 2093576 - protein, 7 aa, Staphylococcus
IRGKSTI

SEQ ID NO: 2093577 - protein, 9 aa, Staphylococcus
KAAKKGSKV

SEQ ID NO: 2093578 - protein, 9 aa, Staphylococcus
KAAKQGQLT

SEQ ID NO: 2093579 - protein, 4 aa, Staphylococcus
KAMP

SEQ ID NO: 2093580 - protein, 7 aa, Staphylococcus
KAYDEKG

SEQ ID NO: 2093581 - protein, 9 aa, Staphylococcus
KDGNTPRAL

SEQ ID NO: 2093582 - protein, 11 aa, Staphylococcus
KDIAKTKEGHK

SEQ ID NO: 2093583 - protein, 4 aa, Staphylococcus
KEDR

SEQ ID NO: 2093584 - protein, 4 aa, Staphylococcus
KEGS

SEQ ID NO: 2093585 - protein, 4 aa, Staphylococcus
KEIK

SEQ ID NO: 2093586 - protein, 7 aa, Staphylococcus
KEKRSYK

SEQ ID NO: 2093587 - protein, 7 aa, Staphylococcus
KEQKGLG

SEQ ID NO: 2093588 - protein, 5 aa, Staphylococcus
KESIP

SEQ ID NO: 2093589 - protein, 4 aa, Staphylococcus
KESL

SEQ ID NO: 2093590 - protein, 11 aa, Staphylococcus
KGAGSLATGSA

SEQ ID NO: 2093591 - protein, 13 aa, Staphylococcus
KGDIKAEKNADTN

SEQ ID NO: 2093592 - protein, 9 aa, Staphylococcus
KGHKDDKKI

SEQ ID NO: 2093593 - protein, 8 aa, Staphylococcus
KGIPTNGV

SEQ ID NO: 2093594 - protein, 8 aa, Staphylococcus
KGLDSGTA

SEQ ID NO: 2093595 - protein, 15 aa, Staphylococcus
KGRDYNLDKKGNPVV

SEQ ID NO: 2093596 - protein, 6 aa, Staphylococcus
KGTTNF

SEQ ID NO: 2093597 - protein, 8 aa, Staphylococcus
KINEGTDV

SEQ ID NO: 2093598 - protein, 8 aa, Staphylococcus
KKAAPDAK

SEQ ID NO: 2093599 - protein, 8 aa, Staphylococcus
KKATLNNK

SEQ ID NO: 2093600 - protein, 15 aa, Staphylococcus
KKDIQDKAAKQKKHP

SEQ ID NO: 2093601 - protein, 8 aa, Staphylococcus
KKDQPNVF

SEQ ID NO: 2093602 - protein, 17 aa, Staphylococcus
KKESMDSSSAKKDGSLG

SEQ ID NO: 2093603 - protein, 8 aa, Staphylococcus
KKNTENLG

SEQ ID NO: 2093604 - protein, 5 aa, Staphylococcus
KLAGN

SEQ ID NO: 2093605 - protein, 8 aa, Staphylococcus
KLLETDKK

SEQ ID NO: 2093606 - protein, 7 aa, Staphylococcus
KLTQAGY

SEQ ID NO: 2093607 - protein, 23 aa, Staphylococcus
KNDVSPEMNKEIEKELKKKTGIT

SEQ ID NO: 2093608 - protein, 5 aa, Staphylococcus
KNGKY

SEQ ID NO: 2093609 - protein, 6 aa, Staphylococcus
KNGSNL

SEQ ID NO: 2093610 - protein, 28 aa, Staphylococcus
KNIGADLQTEQALADKNIAQAKAEERRA

SEQ ID NO: 2093611 - protein, 6 aa, Staphylococcus
KNIKKY

SEQ ID NO: 2093612 - protein, 9 aa, Staphylococcus
KNNQVSTDL

SEQ ID NO: 2093613 - protein, 7 aa, Staphylococcus
KPIPNDT

SEQ ID NO: 2093614 - protein, 8 aa, Staphylococcus
KQKPNESY

SEQ ID NO: 2093615 - protein, 19 aa, Staphylococcus
KSGYGGWSIPKSTKHPEDV

SEQ ID NO: 2093616 - protein, 4 aa, Staphylococcus
KSKK

SEQ ID NO: 2093617 - protein, 6 aa, Staphylococcus
KSLPMA

SEQ ID NO: 2093618 - protein, 9 aa, Staphylococcus
KTAQNKEGA

SEQ ID NO: 2093619 - protein, 9 aa, Staphylococcus
KVENDEYGL

SEQ ID NO: 2093620 - protein, 7 aa, Staphylococcus
KVGPHYP

SEQ ID NO: 2093621 - protein, 6 aa, Staphylococcus
KYDDKV

SEQ ID NO: 2093622 - protein, 6 aa, Staphylococcus
KYDPIS

SEQ ID NO: 2093623 - protein, 6 aa, Staphylococcus
KYNTTY

SEQ ID NO: 2093624 - protein, 10 aa, Staphylococcus
LAGANKPALE

SEQ ID NO: 2093625 - protein, 11 aa, Staphylococcus
LAQGEAPIKET

SEQ ID NO: 2093626 - protein, 6 aa, Staphylococcus
LDGEEM

SEQ ID NO: 2093627 - protein, 8 aa, Staphylococcus
LDGMEKSI

SEQ ID NO: 2093628 - protein, 15 aa, Staphylococcus
LDPSSIKTSKDMKAL

SEQ ID NO: 2093629 - protein, 6 aa, Staphylococcus
LDSQSY

SEQ ID NO: 2093630 - protein, 12 aa, Staphylococcus
LEENGYKSYEAS

SEQ ID NO: 2093631 - protein, 6 aa, Staphylococcus
LEQQEE

SEQ ID NO: 2093632 - protein, 10 aa, Staphylococcus
LGKERKADKL

SEQ ID NO: 2093633 - protein, 10 aa, Staphylococcus
LGSEDKDEDF

SEQ ID NO: 2093634 - protein, 7 aa, Staphylococcus
LGTPDEV

SEQ ID NO: 2093635 - protein, 17 aa, Staphylococcus
LKDTTIVGQEPTPNLEE

SEQ ID NO: 2093636 - protein, 19 aa, Staphylococcus
LKTESKEKGYKIESAGDVE

SEQ ID NO: 2093637 - protein, 14 aa, Staphylococcus
LLSSRKKVQQFTEN

SEQ ID NO: 2093638 - protein, 12 aa, Staphylococcus
LNEPNSDDTGRI

SEQ ID NO: 2093639 - protein, 9 aa, Staphylococcus
LNETGAKYP

SEQ ID NO: 2093640 - protein, 7 aa, Staphylococcus
LNGPKAR

SEQ ID NO: 2093641 - protein, 17 aa, Staphylococcus
LPPNETSTVASQHDDET

SEQ ID NO: 2093642 - protein, 16 aa, Staphylococcus
LPTEAKADKLDAQGYD

SEQ ID NO: 2093643 - protein, 6 aa, Staphylococcus
MGPAYN

SEQ ID NO: 2093644 - protein, 12 aa, Staphylococcus
MGTTEIKGQPKR

SEQ ID NO: 2093645 - protein, 4 aa, Staphylococcus
NADG

SEQ ID NO: 2093646 - protein, 12 aa, Staphylococcus
NANQAETLQYIQ

SEQ ID NO: 2093647 - protein, 6 aa, Staphylococcus
NDYKVP

SEQ ID NO: 2093648 - protein, 6 aa, Staphylococcus
NETREY

SEQ ID NO: 2093649 - protein, 4 aa, Staphylococcus
NETS

SEQ ID NO: 2093650 - protein, 9 aa, Staphylococcus
NGNQEEIDY

SEQ ID NO: 2093651 - protein, 9 aa, Staphylococcus
NIENTYNGT

SEQ ID NO: 2093652 - protein, 6 aa, Staphylococcus
NKDNDF

SEQ ID NO: 2093653 - protein, 8 aa, Staphylococcus
NKDVTKGL

SEQ ID NO: 2093654 - protein, 4 aa, Staphylococcus
NKEL

SEQ ID NO: 2093655 - protein, 9 aa, Staphylococcus
NKNPEQVAK

SEQ ID NO: 2093656 - protein, 28 aa, Staphylococcus
NNQEVNSNGGPASGGSNFGNSNPKLKQR

SEQ ID NO: 2093657 - protein, 14 aa, Staphylococcus
NPPYGERIGDRDEV

SEQ ID NO: 2093658 - protein, 5 aa, Staphylococcus
NPVYT

SEQ ID NO: 2093659 - protein, 12 aa, Staphylococcus
NQPPVKAMTEAA

SEQ ID NO: 2093660 - protein, 7 aa, Staphylococcus
NQVEGHS

SEQ ID NO: 2093661 - protein, 21 aa, Staphylococcus
NRNESRGAHYKPEFPDRNDDE

SEQ ID NO: 2093662 - protein, 4 aa, Staphylococcus
NRTG

SEQ ID NO: 2093663 - protein, 5 aa, Staphylococcus
NSDGS

SEQ ID NO: 2093664 - protein, 7 aa, Staphylococcus
NSGRPEM

SEQ ID NO: 2093665 - protein, 5 aa, Staphylococcus
NSNGS

SEQ ID NO: 2093666 - protein, 10 aa, Staphylococcus
NTDYSFQSDG

SEQ ID NO: 2093667 - protein, 5 aa, Staphylococcus
NTKDV

SEQ ID NO: 2093668 - protein, 10 aa, Staphylococcus
NWGQSQRADL

SEQ ID NO: 2093669 - protein, 4 aa, Staphylococcus
NYEA

SEQ ID NO: 2093670 - protein, 10 aa, Staphylococcus
PDFSLNGQKG

SEQ ID NO: 2093671 - protein, 6 aa, Staphylococcus
PEARDE

SEQ ID NO: 2093672 - protein, 5 aa, Staphylococcus
PEEID

SEQ ID NO: 2093673 - protein, 6 aa, Staphylococcus
PFTTPE

SEQ ID NO: 2093674 - protein, 15 aa, Staphylococcus
PGMKGAEATVKGAYK

SEQ ID NO: 2093675 - protein, 4 aa, Staphylococcus
PLSS

SEQ ID NO: 2093676 - protein, 11 aa, Staphylococcus
PMAGSHKSGVL

SEQ ID NO: 2093677 - protein, 6 aa, Staphylococcus
PNDEMK

SEQ ID NO: 2093678 - protein, 12 aa, Staphylococcus
PNTGGTKAYDDI

SEQ ID NO: 2093679 - protein, 4 aa, Staphylococcus
PQDP

SEQ ID NO: 2093680 - protein, 10 aa, Staphylococcus
PTASGKTELS

SEQ ID NO: 2093681 - protein, 24 aa, Staphylococcus
QAPDTDDDKVETQYEVAQSSDTRE

SEQ ID NO: 2093682 - protein, 37 aa, Staphylococcus; identical to SEQ ID NO: 1836440

SEQ ID NO: 2093683 - protein, 6 aa, Staphylococcus
QGTTGE

SEQ ID NO: 2093684 - protein, 5 aa, Staphylococcus
QHPFN

SEQ ID NO: 2093685 - protein, 5 aa, Staphylococcus
QIGKG

SEQ ID NO: 2093686 - protein, 11 aa, Staphylococcus
QITQGDQSLEN

SEQ ID NO: 2093687 - protein, 13 aa, Staphylococcus
QKPINDESHTGWT

SEQ ID NO: 2093688 - protein, 8 aa, Staphylococcus
QLGADTQY

SEQ ID NO: 2093689 - protein, 8 aa, Staphylococcus
QNKDKLKE

SEQ ID NO: 2093690 - protein, 9 aa, Staphylococcus
QNKDKLKEV

SEQ ID NO: 2093691 - protein, 4 aa, Staphylococcus
QNQD

SEQ ID NO: 2093692 - protein, 15 aa, Staphylococcus
QPTTVAASSKDEKVS

SEQ ID NO: 2093693 - protein, 24 aa, Staphylococcus
QQEGKARSVDAVTASASGLDPDIT

SEQ ID NO: 2093694 - protein, 4 aa, Staphylococcus
QQIG

SEQ ID NO: 2093695 - protein, 10 aa, Staphylococcus
QRAENNQKIY

SEQ ID NO: 2093696 - protein, 11 aa, Staphylococcus
QRVNQHKPPKV

SEQ ID NO: 2093697 - protein, 5 aa, Staphylococcus
QVNPT

SEQ ID NO: 2093698 - protein, 8 aa, Staphylococcus
RAETGQPI

SEQ ID NO: 2093699 - protein, 8 aa, Staphylococcus
RAGDGYPA

SEQ ID NO: 2093700 - protein, 11 aa, Staphylococcus
RAQAGKPISTY

SEQ ID NO: 2093701 - protein, 7 aa, Staphylococcus
RASEGKI

SEQ ID NO: 2093702 - protein, 5 aa, Staphylococcus
RDIDV

SEQ ID NO: 2093703 - protein, 6 aa, Staphylococcus
REGRNI

SEQ ID NO: 2093704 - protein, 4 aa, Staphylococcus
RENN

SEQ ID NO: 2093705 - protein, 5 aa, Staphylococcus
RENNV

SEQ ID NO: 2093706 - protein, 7 aa, Staphylococcus
RENSDLK

SEQ ID NO: 2093707 - protein, 8 aa, Staphylococcus
RKATKRRK

SEQ ID NO: 2093708 - protein, 6 aa, Staphylococcus
RKDGKW

SEQ ID NO: 2093709 - protein, 15 aa, Staphylococcus
RKEEGAGGDFGRQER

SEQ ID NO: 2093710 - protein, 15 aa, Staphylococcus
RKPGDPGRKVVGGPY

SEQ ID NO: 2093711 - protein, 6 aa, Staphylococcus
RNAEEV

SEQ ID NO: 2093712 - protein, 7 aa, Staphylococcus
RNAEEVG

SEQ ID NO: 2093713 - protein, 14 aa, Staphylococcus
RNKALQKEVDKGKD

SEQ ID NO: 2093714 - protein, 5 aa, Staphylococcus
RNPVY

SEQ ID NO: 2093715 - protein, 12 aa, Staphylococcus
RNYPDTKAALED

SEQ ID NO: 2093716 - protein, 17 aa, Staphylococcus
RPGIESSNERNNAGTGH

SEQ ID NO: 2093717 - protein, 11 aa, Staphylococcus
RQRNSGDVQTE

SEQ ID NO: 2093718 - protein, 11 aa, Staphylococcus
RSQAGKPISTY

SEQ ID NO: 2093719 - protein, 12 aa, Staphylococcus
RSQTQSPPEQYV

SEQ ID NO: 2093720 - protein, 10 aa, Staphylococcus
RTANQKNLDE

SEQ ID NO: 2093721 - protein, 7 aa, Staphylococcus
RVDYGAA

SEQ ID NO: 2093722 - protein, 9 aa, Staphylococcus
RVKTGANLS

SEQ ID NO: 2093723 - protein, 7 aa, Staphylococcus
RVNPDGS

SEQ ID NO: 2093724 - protein, 11 aa, Staphylococcus
SALSKLEKNDK

SEQ ID NO: 2093725 - protein, 7 aa, Staphylococcus
SDINPNI

SEQ ID NO: 2093726 - protein, 8 aa, Staphylococcus
SDINPNIE

SEQ ID NO: 2093727 - protein, 23 aa, Staphylococcus
SDPTAKDAGLVKKTEDEWTSSKE

SEQ ID NO: 2093728 - protein, 10 aa, Staphylococcus
SENQAKEGLV

SEQ ID NO: 2093729 - protein, 7 aa, Staphylococcus
SESYDGV

SEQ ID NO: 2093730 - protein, 7 aa, Staphylococcus
SFSGQAA

SEQ ID NO: 2093731 - protein, 4 aa, Staphylococcus
SGAA

SEQ ID NO: 2093732 - protein, 5 aa, Staphylococcus
SGPVE

SEQ ID NO: 2093733 - protein, 9 aa, Staphylococcus
SHAQTAGAA

SEQ ID NO: 2093734 - protein, 8 aa, Staphylococcus
SIAPYETD

SEQ ID NO: 2093735 - protein, 12 aa, Staphylococcus
SIDKAAHPNDVT

SEQ ID NO: 2093736 - protein, 12 aa, Staphylococcus
SIDKSGHPNDIT

SEQ ID NO: 2093737 - protein, 12 aa, Staphylococcus
SIGKKGSKGDSY

SEQ ID NO: 2093738 - protein, 8 aa, Staphylococcus
SIKDNEDI

SEQ ID NO: 2093739 - protein, 13 aa, Staphylococcus
SISDLKNSDFGKS

SEQ ID NO: 2093740 - protein, 7 aa, Staphylococcus
SKDGKVK

SEQ ID NO: 2093741 - protein, 8 aa, Staphylococcus
SKITDKDD

SEQ ID NO: 2093742 - protein, 8 aa, Staphylococcus
SKLTQAGY

SEQ ID NO: 2093743 - protein, 7 aa, Staphylococcus
SKYEPIS

SEQ ID NO: 2093744 - protein, 8 aa, Staphylococcus
SMGNGGDW

SEQ ID NO: 2093745 - protein, 5 aa, Staphylococcus
SNVDN

SEQ ID NO: 2093746 - protein, 16 aa, Staphylococcus
SQNADTLEAKAKPLEK

SEQ ID NO: 2093747 - protein, 7 aa, Staphylococcus
SQYPYQT

SEQ ID NO: 2093748 - protein, 5 aa, Staphylococcus
SREGK

SEQ ID NO: 2093749 - protein, 6 aa, Staphylococcus
SRYGSL

SEQ ID NO: 2093750 - protein, 9 aa, Staphylococcus
SSDSDYITG

SEQ ID NO: 2093751 - protein, 4 aa, Staphylococcus
SSEE

SEQ ID NO: 2093752 - protein, 5 aa, Staphylococcus
SSEEM

SEQ ID NO: 2093753 - protein, 10 aa, Staphylococcus
SSGKYTDKID

SEQ ID NO: 2093754 - protein, 7 aa, Staphylococcus
SSSYDAP

SEQ ID NO: 2093755 - protein, 6 aa, Staphylococcus
STAGAY

SEQ ID NO: 2093756 - protein, 6 aa, Staphylococcus
STHSRN

SEQ ID NO: 2093757 - protein, 8 aa, Staphylococcus
STHSRNYT

SEQ ID NO: 2093758 - protein, 22 aa, Staphylococcus
SVAPSEYQGVSPTEAPEAVQDA

SEQ ID NO: 2093759 - protein, 18 aa, Staphylococcus
SVDKKSMNSLSEETGKSI

SEQ ID NO: 2093760 - protein, 10 aa, Staphylococcus
SVGSNGSVTV

SEQ ID NO: 2093761 - protein, 25 aa, Staphylococcus
SYDDNQGDYKPFKEMDSQSKNFYPQ

SEQ ID NO: 2093762 - protein, 5 aa, Staphylococcus
TAGPT

SEQ ID NO: 2093763 - protein, 6 aa, Staphylococcus
TAGPTV

SEQ ID NO: 2093764 - protein, 9 aa, Staphylococcus
TAKSPVKVN

SEQ ID NO: 2093765 - protein, 24 aa, Staphylococcus
TARNVTKTHTSNINTFQSPNHGPL

SEQ ID NO: 2093766 - protein, 20 aa, Staphylococcus
TASGNDSTEALTSGLASGDL

SEQ ID NO: 2093767 - protein, 6 aa, Staphylococcus
TDTLEE

SEQ ID NO: 2093768 - protein, 11 aa, Staphylococcus
TEAQAQESIEP

SEQ ID NO: 2093769 - protein, 7 aa, Staphylococcus
TEGTYAP

SEQ ID NO: 2093770 - protein, 10 aa, Staphylococcus
TEKQGTPSQM

SEQ ID NO: 2093771 - protein, 5 aa, Staphylococcus
TENQS

SEQ ID NO: 2093772 - protein, 9 aa, Staphylococcus
TIGSSEHHT

SEQ ID NO: 2093773 - protein, 5 aa, Staphylococcus
TKAMP

SEQ ID NO: 2093774 - protein, 13 aa, Staphylococcus
TLEADSEGKMYQT

SEQ ID NO: 2093775 - protein, 27 aa, Staphylococcus
TNEAMNKADELTQERLGKHTQGLNIPG

SEQ ID NO: 2093776 - protein, 8 aa, Staphylococcus
TNQTGQSY

SEQ ID NO: 2093777 - protein, 8 aa, Staphylococcus
TNTTGQSY

SEQ ID NO: 2093778 - protein, 14 aa, Staphylococcus
TRHHDSDLKRGQRQ

SEQ ID NO: 2093779 - protein, 12 aa, Staphylococcus
TSGSGLNKRGYR

SEQ ID NO: 2093780 - protein, 6 aa, Staphylococcus
TSQTDI

SEQ ID NO: 2093781 - protein, 4 aa, Staphylococcus
TTKL

SEQ ID NO: 2093782 - protein, 12 aa, Staphylococcus
TVPAGKYAKQYL

SEQ ID NO: 2093783 - protein, 8 aa, Staphylococcus
TYKNGEGA

SEQ ID NO: 2093784 - protein, 10 aa, Staphylococcus
TYSDNTANNK

SEQ ID NO: 2093785 - protein, 17 aa, Staphylococcus
VDADDAMKQLYDVFYNQ

SEQ ID NO: 2093786 - protein, 10 aa, Staphylococcus
VDAQQTARAL

SEQ ID NO: 2093787 - protein, 7 aa, Staphylococcus
VDGTFND

SEQ ID NO: 2093788 - protein, 17 aa, Staphylococcus
VDKKAMQSLSEETNKDI

SEQ ID NO: 2093789 - protein, 8 aa, Staphylococcus
VESDNPAI

SEQ ID NO: 2093790 - protein, 8 aa, Staphylococcus
VGQEGVDK

SEQ ID NO: 2093791 - protein, 9 aa, Staphylococcus
VGRGTTEKI

SEQ ID NO: 2093792 - protein, 7 aa, Staphylococcus
VIPSTNT

SEQ ID NO: 2093793 - protein, 9 aa, Staphylococcus
VIPSTNTSV

SEQ ID NO: 2093794 - protein, 14 aa, Staphylococcus
VKGLPKGENNESLP

SEQ ID NO: 2093795 - protein, 11 aa, Staphylococcus
VKHESDTDYGM

SEQ ID NO: 2093796 - protein, 12 aa, Staphylococcus
VKNAEQQAQRIA

SEQ ID NO: 2093797 - protein, 6 aa, Staphylococcus
VKNNRV

SEQ ID NO: 2093798 - protein, 7 aa, Staphylococcus
VKSPEWS

SEQ ID NO: 2093799 - protein, 13 aa, Staphylococcus
VPKANNAVNGGSY

SEQ ID NO: 2093800 - protein, 7 aa, Staphylococcus
VRNEKVY

SEQ ID NO: 2093801 - protein, 7 aa, Staphylococcus
VSENKAN

SEQ ID NO: 2093802 - protein, 14 aa, Staphylococcus
VTKQGDSSTNGYRD

SEQ ID NO: 2093803 - protein, 11 aa, Staphylococcus
WDNAAAADGYT

SEQ ID NO: 2093804 - protein, 6 aa, Staphylococcus
WKPGQK

SEQ ID NO: 2093805 - protein, 5 aa, Staphylococcus
YDESL

SEQ ID NO: 2093806 - protein, 6 aa, Staphylococcus
YDQKYY

SEQ ID NO: 2093807 - protein, 6 aa, Staphylococcus
YGGPNM

SEQ ID NO: 2093808 - protein, 9 aa, Staphylococcus
YGHGPGVVT

SEQ ID NO: 2093809 - protein, 10 aa, Staphylococcus
YKDRDIKKAV

SEQ ID NO: 2093810 - protein, 12 aa, Staphylococcus
YKSLKDLPKGAT

SEQ ID NO: 2093811 - protein, 5 aa, Staphylococcus
YLDKD

SEQ ID NO: 2093812 - protein, 8 aa, Staphylococcus
YLPKDTRD

SEQ ID NO: 2093813 - protein, 5 aa, Staphylococcus
YNSGK

SEQ ID NO: 2093814 - protein, 7 aa, Staphylococcus
YNTGKKY

SEQ ID NO: 2093815 - protein, 13 aa, Staphylococcus
YNVPNKALSDGDI

SEQ ID NO: 2093816 - protein, 10 aa, Staphylococcus
YRSGYNAAKG

SEQ ID NO: 2093817 - protein, 12 aa, Staphylococcus
YRSGYNAAKGGV

SEQ ID NO: 2093818 - protein, 7 aa, Staphylococcus
YSASPGI

SEQ ID NO: 2093819 - protein, 9 aa, Staphylococcus
YSDNTANNK

SEQ ID NO: 2093820 - protein, 4 aa, Staphylococcus
YTAY

SEQ ID NO: 2093821 - protein, 14 aa, Staphylococcus
YYAKTDKESERILE

SEQ ID NO: 2093822 - protein, 11 aa, Staphylococcus
AAAGKSGADKR

SEQ ID NO: 2093823 - protein, 5 aa, Staphylococcus
AAAKP

SEQ ID NO: 2093824 - protein, 6 aa, Staphylococcus
AAAKPD

SEQ ID NO: 2093825 - protein, 22 aa, Staphylococcus
AAASLSDVSKALKKEFEKTHKN

SEQ ID NO: 2093826 - protein, 25 aa, Staphylococcus
AADTPQPVIKPKAREAINNKVTDQK

SEQ ID NO: 2093827 - protein, 7 aa, Staphylococcus
AAEKGAH

SEQ ID NO: 2093828 - protein, 14 aa, Staphylococcus
AAELDDQKEEISKI

SEQ ID NO: 2093829 - protein, 55 aa, Staphylococcus
AAELTQNQATQQVNQQKQYNNSEQQQNLNHQQNQNQLQKQGYNHQQTSQSNIAHQ

SEQ ID NO: 2093830 - protein, 64 aa, Staphylococcus
AAENTQDQTNNKNVLDDQATLKQAEQVKEKVSQPAQNVSGTQTYQDPTKVQSNDDTTSNTYDAS

SEQ ID NO: 2093831 - protein, 7 aa, Staphylococcus
AAEQGAH

SEQ ID NO: 2093832 - protein, 53 aa, Staphylococcus
AAEVAPKVNPVSNQKVNQGQASTIKPTSQTNTVNKANETKANYNNAPTTQSNQ

SEQ ID NO: 2093833 - protein, 4 aa, Staphylococcus
AAGI

SEQ ID NO: 2093834 - protein, 15 aa, Staphylococcus
AAGNHDEYPFNEDDK

SEQ ID NO: 2093835 - protein, 38 aa, Staphylococcus
AAGNSADASEQGVDKAQLAQQAQSNPESLNAAPVQDGA

SEQ ID NO: 2093836 - protein, 38 aa, Staphylococcus
AAGNSADASEQGVDKAQLAQQAQSNPESLNEAPVQDGA

SEQ ID NO: 2093837 - protein, 77 aa, Staphylococcus
AAGSNASAQPTQATTTQAAPAQQAAPVAQQTQTYSTTTQTTQTTTSYSAPVQQQSYSAPARSYSTASVSTGGSTKAQ

SEQ ID NO: 2093838 - protein, 285 aa, Staphylococcus
AAHAAEQDVQGNSESHTAQSHGADNENLSEPQTNDQKDSQTVETKNDTSSAIHKDETQNQAQTNTANHLSNNDNQSNEDLTTDQSTSEQTDKDQSKGQPVDNQTTEDKQSKQDINQSNLQKQSSENNDGQESKTQQDTVNKQESAAETTPAKENQDNKQQNLDENANTTTQESSSEVAKVRNNEETSKSEDTQSDNEKEQTTSEDLKDQASSYENTSESSQNNKADETTPNNDKDKTNKTQPEQRNHKVSSSTQNKELNRETTQQSKDNEQQSDVAEKEAPVEAL

SEQ ID NO: 2093839 - protein, 10 aa, Staphylococcus
AAKDNNFEQA

SEQ ID NO: 2093840 - protein, 5 aa, Staphylococcus
AAKEL

SEQ ID NO: 2093841 - protein, 16 aa, Staphylococcus
AAKYGHDRYGKTYAGA

SEQ ID NO: 2093842 - protein, 17 aa, Staphylococcus
AAKYGHERYGKSYAGAY

SEQ ID NO: 2093843 - protein, 8 aa, Staphylococcus
AAKYGTTY

SEQ ID NO: 2093844 - protein, 5 aa, Staphylococcus
AALDY

SEQ ID NO: 2093845 - protein, 9 aa, Staphylococcus
AALPSSNSA

SEQ ID NO: 2093846 - protein, 28 aa, Staphylococcus
AANAQESEASQQDVNSPDVVTTNQSNLG

SEQ ID NO: 2093847 - protein, 17 aa, Staphylococcus
AANNGVAQIKTSNSGVY

SEQ ID NO: 2093848 - protein, 7 aa, Staphylococcus
AANSYNG

SEQ ID NO: 2093849 - protein, 5 aa, Staphylococcus
AAPGY

SEQ ID NO: 2093850 - protein, 17 aa, Staphylococcus
AAPPTKDTDKAMSESQR

SEQ ID NO: 2093851 - protein, 8 aa, Staphylococcus
AAPVQEGA

SEQ ID NO: 2093852 - protein, 11 aa, Staphylococcus
AAQEKNDDKEW

SEQ ID NO: 2093853 - protein, 9 aa, Staphylococcus
AAQGYTKAH

SEQ ID NO: 2093854 - protein, 8 aa, Staphylococcus
AAQRQALQ

SEQ ID NO: 2093855 - protein, 8 aa, Staphylococcus
AARLASQG

SEQ ID NO: 2093856 - protein, 26 aa, Staphylococcus
AASAGIQADTNTNTAHAAEQSSTQSV

SEQ ID NO: 2093857 - protein, 5 aa, Staphylococcus
AASDG

SEQ ID NO: 2093858 - protein, 6 aa, Staphylococcus
AASGGY

SEQ ID NO: 2093859 - protein, 24 aa, Staphylococcus
AASGNTSQTVEQLTHGQKNLEDVN

SEQ ID NO: 2093860 - protein, 21 aa, Staphylococcus
AATIKDDKKKVSLQDKLDRST

SEQ ID NO: 2093861 - protein, 35 aa, Staphylococcus
AATLADKSTRNSLKQSFSNVKEGKKSQKPSKVSSI

SEQ ID NO: 2093862 - protein, 16 aa, Staphylococcus
AATLADKSTRNSLTQS

SEQ ID NO: 2093863 - protein, 16 aa, Staphylococcus
AATLADKSTRQSLAQS

SEQ ID NO: 2093864 - protein, 34 aa, Staphylococcus
AATLADKSTRQSLKQSIKDRKEGTRSQKPSAINN

SEQ ID NO: 2093865 - protein, 12 aa, Staphylococcus
AATPTGKDVSDK

SEQ ID NO: 2093866 - protein, 16 aa, Staphylococcus
AATTGTGKGVLGDTKQ

SEQ ID NO: 2093867 - protein, 17 aa, Staphylococcus
AAYISTNNTDTQAAEQV

SEQ ID NO: 2093868 - protein, 17 aa, Staphylococcus
AAYISTNSTDTQAAEQV

SEQ ID NO: 2093869 - protein, 16 aa, Staphylococcus
AAYQVEGSSTVDGKGR

SEQ ID NO: 2093870 - protein, 18 aa, Staphylococcus
ADAAENNNGYNPNDPYSY

SEQ ID NO: 2093871 - protein, 19 aa, Staphylococcus
ADAAENNNNGYNPNDPYSY

SEQ ID NO: 2093872 - protein, 29 aa, Staphylococcus
ADAAENTQGTPQVEQQQQQTQEAKGYSYG

SEQ ID NO: 2093873 - protein, 266 aa, Staphylococcus
ADAAETAQDQTQNKNVLDDQATLKQANNAKQEVSNPTQNISGTQTYQDPTKVKPVKTTSTENNDASINQQKTENTSTNENTNVKAQTTDASNQNNNQIKENSTVEETQKQEESNQALDNNEKQQSSQQNSTEESKQEVAQQNAKQETQTAQEETSETTTQKQAQQQTNTTNQNAKQTVKDNGGYRLDDDEDDVDDEANSVEPSQKAHATQQSKENVATSSNTKTQSATPKANELKANNVVNESAKVSSTQSNDNATKENAKQVTTF

SEQ ID NO: 2093874 - protein, 15 aa, Staphylococcus
ADAQDDAAKQSNDID

SEQ ID NO: 2093875 - protein, 28 aa, Staphylococcus
ADAQEETAVPNVNTSENIASVGTENASQ

SEQ ID NO: 2093876 - protein, 15 aa, Staphylococcus
ADASHKADYHKQGDA

SEQ ID NO: 2093877 - protein, 12 aa, Staphylococcus
ADDGGSTGKIRD

SEQ ID NO: 2093878 - protein, 12 aa, Staphylococcus
ADDGGSTGKIRS

SEQ ID NO: 2093879 - protein, 10 aa, Staphylococcus
ADDGGSTGVI

SEQ ID NO: 2093880 - protein, 11 aa, Staphylococcus
ADDIEKAKSLY

SEQ ID NO: 2093881 - protein, 17 aa, Staphylococcus
ADDKDYVKSMKQNTENL

SEQ ID NO: 2093882 - protein, 11 aa, Staphylococcus
ADDMDKAKELY

SEQ ID NO: 2093883 - protein, 8 aa, Staphylococcus
ADESQLDK

SEQ ID NO: 2093884 - protein, 4 aa, Staphylococcus
ADFQ

SEQ ID NO: 2093885 - protein, 11 aa, Staphylococcus
ADGKKNNGKIT

SEQ ID NO: 2093886 - protein, 7 aa, Staphylococcus
ADGNDAT

SEQ ID NO: 2093887 - protein, 16 aa, Staphylococcus
ADGVGPEYHDATPAQV

SEQ ID NO: 2093888 - protein, 9 aa, Staphylococcus
ADHPTLDRT

SEQ ID NO: 2093889 - protein, 9 aa, Staphylococcus
ADHSTGGMT

SEQ ID NO: 2093890 - protein, 21 aa, Staphylococcus
ADHSTGGMTIGKGKDYKWNPQ

SEQ ID NO: 2093891 - protein, 19 aa, Staphylococcus
ADHSTGGMTIGSGEEYKWN

SEQ ID NO: 2093892 - protein, 18 aa, Staphylococcus
ADINEPVYPGPATPEQLN

SEQ ID NO: 2093893 - protein, 34 aa, Staphylococcus
ADITNPDYGVRTPATPVTAAASTSPTTRALSSNY

SEQ ID NO: 2093894 - protein, 19 aa, Staphylococcus
ADKTAEKKKGKAKRKDIKE

SEQ ID NO: 2093895 - protein, 7 aa, Staphylococcus
ADNDKQI

SEQ ID NO: 2093896 - protein, 10 aa, Staphylococcus
ADNGGSTGKI

SEQ ID NO: 2093897 - protein, 13 aa, Staphylococcus
ADNPKTKELDQTA

SEQ ID NO: 2093898 - protein, 13 aa, Staphylococcus
ADNPKTKEMDKTA

SEQ ID NO: 2093899 - protein, 9 aa, Staphylococcus
ADNSRTSIT

SEQ ID NO: 2093900 - protein, 13 aa, Staphylococcus
ADNYAKPATGPFN

SEQ ID NO: 2093901 - protein, 15 aa, Staphylococcus
ADQIHTVKEDAKLTD

SEQ ID NO: 2093902 - protein, 4 aa, Staphylococcus
ADQY

SEQ ID NO: 2093903 - protein, 18 aa, Staphylococcus
ADRNLNRIDSSEAMNGYR

SEQ ID NO: 2093904 - protein, 10 aa, Staphylococcus
ADRSTWSRSR

SEQ ID NO: 2093905 - protein, 16 aa, Staphylococcus
ADSDRKTNYDDAVTNA

SEQ ID NO: 2093906 - protein, 6 aa, Staphylococcus
ADSNAQ

SEQ ID NO: 2093907 - protein, 16 aa, Staphylococcus
ADSSHKADYEKQGKTY

SEQ ID NO: 2093908 - protein, 214 aa, Staphylococcus
ADSSTGTNTNTDSNRTADQTQQPTNQTKSTQVQTNDSNNKVAGTQAYKDPSQVQPVNDNQNLNYDSKLEDLDSKADNSNVTAAGQTSDEQPSNVSNTSEDNSTNTSQQPEQSAKDEVQNPTNQTNVDNNQAQQSTNDATKPQQEQDAVQPQSNEKTLDNSNDQQSNIEQNKDQIDNTATVNPEQQKSEQSNKEAVQQSVQSETANTESKAAPKL

SEQ ID NO: 2093909 - protein, 15 aa, Staphylococcus
ADTAMKANSAGNSIT

SEQ ID NO: 2093910 - protein, 16 aa, Staphylococcus
ADTIDNNSTLTAQDRQ

SEQ ID NO: 2093911 - protein, 12 aa, Staphylococcus
ADTSGNTTNQSF

SEQ ID NO: 2093912 - protein, 8 aa, Staphylococcus
ADTSQLDK

SEQ ID NO: 2093913 - protein, 6 aa, Staphylococcus
ADYAAT

SEQ ID NO: 2093914 - protein, 5 aa, Staphylococcus
ADYAP

SEQ ID NO: 2093915 - protein, 4 aa, Staphylococcus
AEAA

SEQ ID NO: 2093916 - protein, 5 aa, Staphylococcus
AEAAP

SEQ ID NO: 2093917 - protein, 15 aa, Staphylococcus
AEAATTHTVKAGESV

SEQ ID NO: 2093918 - protein, 15 aa, Staphylococcus
AEAATTHTVKSGESL

SEQ ID NO: 2093919 - protein, 11 aa, Staphylococcus
AEADESLDDQN

SEQ ID NO: 2093920 - protein, 15 aa, Staphylococcus
AEADPTDDVDGVDAA

SEQ ID NO: 2093921 - protein, 14 aa, Staphylococcus
AEADPTDDVEGIDA

SEQ ID NO: 2093922 - protein, 14 aa, Staphylococcus
AEASTTHTVRSGES

SEQ ID NO: 2093923 - protein, 6 aa, Staphylococcus
AEDVAD

SEQ ID NO: 2093924 - protein, 16 aa, Staphylococcus
AEEADYYSGKSLNSAI

SEQ ID NO: 2093925 - protein, 10 aa, Staphylococcus
AEEAKDKYGR

SEQ ID NO: 2093926 - protein, 5 aa, Staphylococcus
AEEKG

SEQ ID NO: 2093927 - protein, 9 aa, Staphylococcus
AEHDQGPAF

SEQ ID NO: 2093928 - protein, 10 aa, Staphylococcus
AEHEQGPPFP

SEQ ID NO: 2093929 - protein, 8 aa, Staphylococcus
AEHNTVEA

SEQ ID NO: 2093930 - protein, 8 aa, Staphylococcus
AEHSYQKM

SEQ ID NO: 2093931 - protein, 13 aa, Staphylococcus
AEKIESGTEFIMN

SEQ ID NO: 2093932 - protein, 12 aa, Staphylococcus
AEKKDHNYKIEE

SEQ ID NO: 2093933 - protein, 7 aa, Staphylococcus
AELDEDD

SEQ ID NO: 2093934 - protein, 26 aa, Staphylococcus
AELTDATPAAYASHVDDRDKKDEIAQ

SEQ ID NO: 2093935 - protein, 15 aa, Staphylococcus
AEMKDEIKDYIKNLE

SEQ ID NO: 2093936 - protein, 72 aa, Staphylococcus
AEMKRQDEAYAREEAQRQKQEAADQKAYEAEQKRIEEQEAREAAAAEKQEQELARQEAEQQKQLDKEASMTE

SEQ ID NO: 2093937 - protein, 4 aa, Staphylococcus
AEMP

SEQ ID NO: 2093938 - protein, 7 aa, Staphylococcus
AENADSF

SEQ ID NO: 2093939 - protein, 8 aa, Staphylococcus
AENASMSE

SEQ ID NO: 2093940 - protein, 4 aa, Staphylococcus
AENG

SEQ ID NO: 2093941 - protein, 10 aa, Staphylococcus
AENSKKNTEW

SEQ ID NO: 2093942 - protein, 10 aa, Staphylococcus
AENYNERTQN

SEQ ID NO: 2093943 - protein, 8 aa, Staphylococcus
AEQDGFSI

SEQ ID NO: 2093944 - protein, 5 aa, Staphylococcus
AEQQG

SEQ ID NO: 2093945 - protein, 7 aa, Staphylococcus
AERDENT

SEQ ID NO: 2093946 - protein, 10 aa, Staphylococcus
AERKSHGYKI

SEQ ID NO: 2093947 - protein, 12 aa, Staphylococcus
AESKKDNNGYKN

SEQ ID NO: 2093948 - protein, 5 aa, Staphylococcus
AESNG

SEQ ID NO: 2093949 - protein, 6 aa, Staphylococcus
AETGEI

SEQ ID NO: 2093950 - protein, 4 aa, Staphylococcus
AETI

SEQ ID NO: 2093951 - protein, 5 aa, Staphylococcus
AETIG

SEQ ID NO: 2093952 - protein, 91 aa, Staphylococcus
AEVSEESPTQLKEKDIDDNKKQSSSDENNESTKDTNNTNKETTKNDDDEINQPSSSTKTRNKNTLDKKESTYNKQDEETLDNQKLNPHQDI

SEQ ID NO: 2093953 - protein, 9 aa, Staphylococcus
AEVTDATPA

SEQ ID NO: 2093954 - protein, 10 aa, Staphylococcus
AEVTDATPAV

SEQ ID NO: 2093955 - protein, 28 aa, Staphylococcus
AEYEKEYQKQLDQEEAEWQKEQDRLDKE

SEQ ID NO: 2093956 - protein, 8 aa, Staphylococcus
AEYETERG

SEQ ID NO: 2093957 - protein, 22 aa, Staphylococcus
AEYFGKENGNLTDKLKKDGYDI

SEQ ID NO: 2093958 - protein, 14 aa, Staphylococcus
AEYQGREEAPKFTY

SEQ ID NO: 2093959 - protein, 5 aa, Staphylococcus
AEYYQ

SEQ ID NO: 2093960 - protein, 10 aa, Staphylococcus
AFGNKDSRVD

SEQ ID NO: 2093961 - protein, 20 aa, Staphylococcus
AFGPGSDRFQGNIDNTDNAK

SEQ ID NO: 2093962 - protein, 13 aa, Staphylococcus
AFKDISKTKEGHK

SEQ ID NO: 2093963 - protein, 12 aa, Staphylococcus
AFKPRSKRDLDN

SEQ ID NO: 2093964 - protein, 5 aa, Staphylococcus
AFKQQ

SEQ ID NO: 2093965 - protein, 8 aa, Staphylococcus
AFPPGEQY

SEQ ID NO: 2093966 - protein, 7 aa, Staphylococcus
AFQDEVN

SEQ ID NO: 2093967 - protein, 5 aa, Staphylococcus
AFQDK

SEQ ID NO: 2093968 - protein, 14 aa, Staphylococcus
AFSGSPQEAKGNND

SEQ ID NO: 2093969 - protein, 10 aa, Staphylococcus
AFSPDQSHGT

SEQ ID NO: 2093970 - protein, 11 aa, Staphylococcus
AFSPNSSHGTY

SEQ ID NO: 2093971 - protein, 28 aa, Staphylococcus
AFSTYKSSVDNDSDSEEDKQKRKEISKF

SEQ ID NO: 2093972 - protein, 16 aa, Staphylococcus
AGAGFNKTTEQATDEE

SEQ ID NO: 2093973 - protein, 7 aa, Staphylococcus
AGANANP

SEQ ID NO: 2093974 - protein, 7 aa, Staphylococcus
AGANGKV

SEQ ID NO: 2093975 - protein, 10 aa, Staphylococcus
AGASGSPMLD

SEQ ID NO: 2093976 - protein, 10 aa, Staphylococcus
AGATSDNKLA

SEQ ID NO: 2093977 - protein, 8 aa, Staphylococcus
AGDGYPAF

SEQ ID NO: 2093978 - protein, 9 aa, Staphylococcus
AGDKQYKNP

SEQ ID NO: 2093979 - protein, 12 aa, Staphylococcus
AGEASGFGGGGV

SEQ ID NO: 2093980 - protein, 4 aa, Staphylococcus
AGEL

SEQ ID NO: 2093981 - protein, 7 aa, Staphylococcus
AGGATCA

SEQ ID NO: 2093982 - protein, 8 aa, Staphylococcus
AGGITSSA

SEQ ID NO: 2093983 - protein, 8 aa, Staphylococcus
AGGSTTSI

SEQ ID NO: 2093984 - protein, 6 aa, Staphylococcus
AGGTED

SEQ ID NO: 2093985 - protein, 10 aa, Staphylococcus
AGIEEDDAGY

SEQ ID NO: 2093986 - protein, 5 aa, Staphylococcus
AGIGI

SEQ ID NO: 2093987 - protein, 23 aa, Staphylococcus
AGLESGQAHAEEVSTSPSQQHQY

SEQ ID NO: 2093988 - protein, 26 aa, Staphylococcus
AGLESGQAHASEMTHGQQNQSCQYNQ

SEQ ID NO: 2093989 - protein, 7 aa, Staphylococcus
AGLGKGI

SEQ ID NO: 2093990 - protein, 9 aa, Staphylococcus
AGLNLTTNQ

SEQ ID NO: 2093991 - protein, 11 aa, Staphylococcus
AGNAAADGYTV

SEQ ID NO: 2093992 - protein, 18 aa, Staphylococcus
AGNAANDGYRVDNSPEVG

SEQ ID NO: 2093993 - protein, 5 aa, Staphylococcus
AGNVT

SEQ ID NO: 2093994 - protein, 6 aa, Staphylococcus
AGPGGY

SEQ ID NO: 2093995 - protein, 8 aa, Staphylococcus
AGPKANPY

SEQ ID NO: 2093996 - protein, 7 aa, Staphylococcus
AGPQAND

SEQ ID NO: 2093997 - protein, 7 aa, Staphylococcus
AGPTVEE

SEQ ID NO: 2093998 - protein, 6 aa, Staphylococcus
AGPVAN

SEQ ID NO: 2093999 - protein, 7 aa, Staphylococcus
AGPYGNN

SEQ ID NO: 2094000 - protein, 10 aa, Staphylococcus
AGQAGASSYY

SEQ ID NO: 2094001 - protein, 9 aa, Staphylococcus
AGQQGADQI

SEQ ID NO: 2094002 - protein, 9 aa, Staphylococcus
AGQSGASAL

SEQ ID NO: 2094003 - protein, 6 aa, Staphylococcus
AGQTGA

SEQ ID NO: 2094004 - protein, 6 aa, Staphylococcus
AGRGYR

SEQ ID NO: 2094005 - protein, 4 aa, Staphylococcus
AGSD

SEQ ID NO: 2094006 - protein, 13 aa, Staphylococcus
AGSSEKGTEFASK

SEQ ID NO: 2094007 - protein, 4 aa, Staphylococcus
AGST

SEQ ID NO: 2094008 - protein, 6 aa, Staphylococcus
AGTAAG

SEQ ID NO: 2094009 - protein, 14 aa, Staphylococcus
AGTAQDEAGQTFRE

SEQ ID NO: 2094010 - protein, 11 aa, Staphylococcus
AGTNPTFEPRT

SEQ ID NO: 2094011 - protein, 15 aa, Staphylococcus
AGTSEDEAGKTFRDN

SEQ ID NO: 2094012 - protein, 16 aa, Staphylococcus
AGTSVAAKARRNSEDV

SEQ ID NO: 2094013 - protein, 25 aa, Staphylococcus
AGTVSKSNQSPFKASASQQVGKSTY

SEQ ID NO: 2094014 - protein, 16 aa, Staphylococcus
AGYDVTTTPVPASGPL

SEQ ID NO: 2094015 - protein, 16 aa, Staphylococcus
AGYDVTTTPVQASGPL

SEQ ID NO: 2094016 - protein, 18 aa, Staphylococcus
AGYHKNSDGIFEKTGKPL

SEQ ID NO: 2094017 - protein, 15 aa, Staphylococcus
AGYHRNKQGMYEKDG

SEQ ID NO: 2094018 - protein, 4 aa, Staphylococcus
AGYN

SEQ ID NO: 2094019 - protein, 16 aa, Staphylococcus
AGYNVTTTPVQASGPL

SEQ ID NO: 2094020 - protein, 19 aa, Staphylococcus
AHAAENNGYNPNDPTSYSY

SEQ ID NO: 2094021 - protein, 24 aa, Staphylococcus
AHAAENNQSSQQNYSESNESTNSV

SEQ ID NO: 2094022 - protein, 21 aa, Staphylococcus
AHAAEQNNGGYNPNDPTSYSY

SEQ ID NO: 2094023 - protein, 8 aa, Staphylococcus
AHAATQPY

SEQ ID NO: 2094024 - protein, 41 aa, Staphylococcus
AHAETTSSTDNHQQTTQSQQQKTPKIDKGNNVKPVEKKERA

SEQ ID NO: 2094025 - protein, 28 aa, Staphylococcus
AHAQENNSIKPESLKKPINTKVHNDQDV

SEQ ID NO: 2094026 - protein, 13 aa, Staphylococcus
AHASTTQQHQSAY

SEQ ID NO: 2094027 - protein, 17 aa, Staphylococcus
AHATTPNLGQSAGQAME

SEQ ID NO: 2094028 - protein, 16 aa, Staphylococcus
AHATTPNMGQGAGQAM

SEQ ID NO: 2094029 - protein, 6 aa, Staphylococcus
AHEDNV

SEQ ID NO: 2094030 - protein, 5 aa, Staphylococcus
AHENG

SEQ ID NO: 2094031 - protein, 11 aa, Staphylococcus
AHGPNTSQTNV

SEQ ID NO: 2094032 - protein, 6 aa, Staphylococcus
AHLPSV

SEQ ID NO: 2094033 - protein, 5 aa, Staphylococcus
AHNNN

SEQ ID NO: 2094034 - protein, 18 aa, Staphylococcus
AHPEYAKPEYKNAKVPTL

SEQ ID NO: 2094035 - protein, 9 aa, Staphylococcus
AHPNQAFKK

SEQ ID NO: 2094036 - protein, 8 aa, Staphylococcus
AHQQDEKK

SEQ ID NO: 2094037 - protein, 12 aa, Staphylococcus
AHRGASGYAPEH

SEQ ID NO: 2094038 - protein, 13 aa, Staphylococcus
AHRGASGYAPEHT

SEQ ID NO: 2094039 - protein, 13 aa, Staphylococcus
AHSAELDPNTPHP

SEQ ID NO: 2094040 - protein, 13 aa, Staphylococcus
AHSAELDPSTPHP

SEQ ID NO: 2094041 - protein, 12 aa, Staphylococcus
AHSAELDPSTPY

SEQ ID NO: 2094042 - protein, 14 aa, Staphylococcus
AHTEGNGKSVLNKT

SEQ ID NO: 2094043 - protein, 8 aa, Staphylococcus
AHTKTIDE

SEQ ID NO: 2094044 - protein, 9 aa, Staphylococcus
AHYKDSDKT

SEQ ID NO: 2094045 - protein, 9 aa, Staphylococcus
AHYKNSDKT

SEQ ID NO: 2094046 - protein, 32 aa, Staphylococcus
AIADKNDTLTSGNYINASDDKRPAYSNQVANA

SEQ ID NO: 2094047 - protein, 28 aa, Staphylococcus
AIATPKKKSAQQAETKVKKQGDKSFPQI

SEQ ID NO: 2094048 - protein, 10 aa, Staphylococcus
AIDSQSKIQY

SEQ ID NO: 2094049 - protein, 10 aa, Staphylococcus
AIEGKSSPFA

SEQ ID NO: 2094050 - protein, 8 aa, Staphylococcus
AIEPGSTH

SEQ ID NO: 2094051 - protein, 8 aa, Staphylococcus
AIEYGREN

SEQ ID NO: 2094052 - protein, 5 aa, Staphylococcus
AIGTG

SEQ ID NO: 2094053 - protein, 6 aa, Staphylococcus
AIKDDK

SEQ ID NO: 2094054 - protein, 7 aa, Staphylococcus
AIKDKHT

SEQ ID NO: 2094055 - protein, 13 aa, Staphylococcus
AIKGDAEKNKSAF

SEQ ID NO: 2094056 - protein, 7 aa, Staphylococcus
AIKQEAD

SEQ ID NO: 2094057 - protein, 15 aa, Staphylococcus
AIMTSTPDDKLKDDI

SEQ ID NO: 2094058 - protein, 17 aa, Staphylococcus
AINSTPDATTDEKNEAI

SEQ ID NO: 2094059 - protein, 10 aa, Staphylococcus
AINTNQLSDQ

SEQ ID NO: 2094060 - protein, 11 aa, Staphylococcus
AIPDPSESGTA

SEQ ID NO: 2094061 - protein, 11 aa, Staphylococcus
AIPNPSESGTA

SEQ ID NO: 2094062 - protein, 4 aa, Staphylococcus
AIRE

SEQ ID NO: 2094063 - protein, 11 aa, Staphylococcus
AITDPKKAKGI

SEQ ID NO: 2094064 - protein, 9 aa, Staphylococcus
AITDPTKAK

SEQ ID NO: 2094065 - protein, 22 aa, Staphylococcus
AITGINKNDLKQTDAALSKFIQ

SEQ ID NO: 2094066 - protein, 5 aa, Staphylococcus
AITQP

SEQ ID NO: 2094067 - protein, 6 aa, Staphylococcus
AKAEGY

SEQ ID NO: 2094068 - protein, 14 aa, Staphylococcus
AKAGSILQTTAGSL

SEQ ID NO: 2094069 - protein, 8 aa, Staphylococcus
AKAKDANI

SEQ ID NO: 2094070 - protein, 5 aa, Staphylococcus
AKAKP

SEQ ID NO: 2094071 - protein, 6 aa, Staphylococcus
AKAKPD

SEQ ID NO: 2094072 - protein, 5 aa, Staphylococcus
AKALD

SEQ ID NO: 2094073 - protein, 21 aa, Staphylococcus
AKANDKSSKDAKNTSNPITHD

SEQ ID NO: 2094074 - protein, 18 aa, Staphylococcus
AKAPTREVQGGQLSQGTE

SEQ ID NO: 2094075 - protein, 53 aa, Staphylococcus
AKARDQEQTSNETSNKQVQSNTEPKASPVSESQKGNNETLNKVQTTDTLTNDL

SEQ ID NO: 2094076 - protein, 5 aa, Staphylococcus
AKDEG

SEQ ID NO: 2094077 - protein, 7 aa, Staphylococcus
AKDNPYA

SEQ ID NO: 2094078 - protein, 13 aa, Staphylococcus
AKDPKHKNEYEKN

SEQ ID NO: 2094079 - protein, 13 aa, Staphylococcus
AKDSKHKQYYEDN

SEQ ID NO: 2094080 - protein, 11 aa, Staphylococcus
AKEAAKNDIGQ

SEQ ID NO: 2094081 - protein, 8 aa, Staphylococcus
AKEAGWDS

SEQ ID NO: 2094082 - protein, 5 aa, Staphylococcus
AKEEG

SEQ ID NO: 2094083 - protein, 7 aa, Staphylococcus
AKEEGYK

SEQ ID NO: 2094084 - protein, 11 aa, Staphylococcus
AKEEMKKKGYD

SEQ ID NO: 2094085 - protein, 17 aa, Staphylococcus
AKEENQRLKEQTENELR

SEQ ID NO: 2094086 - protein, 12 aa, Staphylococcus
AKEFKKDHKNAD

SEQ ID NO: 2094087 - protein, 10 aa, Staphylococcus
AKEGYTKDHP

SEQ ID NO: 2094088 - protein, 4 aa, Staphylococcus
AKEI

SEQ ID NO: 2094089 - protein, 7 aa, Staphylococcus
AKEKGYK

SEQ ID NO: 2094090 - protein, 7 aa, Staphylococcus
AKELDAK

SEQ ID NO: 2094091 - protein, 13 aa, Staphylococcus
AKELDAKADTLDI

SEQ ID NO: 2094092 - protein, 13 aa, Staphylococcus
AKELDAKADTLEI

SEQ ID NO: 2094093 - protein, 12 aa, Staphylococcus
AKELDAKADTLK

SEQ ID NO: 2094094 - protein, 11 aa, Staphylococcus
AKELGKSTGIV

SEQ ID NO: 2094095 - protein, 4 aa, Staphylococcus
AKEM

SEQ ID NO: 2094096 - protein, 16 aa, Staphylococcus
AKENDATMQSYGKPHL

SEQ ID NO: 2094097 - protein, 10 aa, Staphylococcus
AKENNQPEEW

SEQ ID NO: 2094098 - protein, 11 aa, Staphylococcus
AKEQGKSTGLV

SEQ ID NO: 2094099 - protein, 12 aa, Staphylococcus
AKERDPKYQTFG

SEQ ID NO: 2094100 - protein, 9 aa, Staphylococcus
AKESGATLY

SEQ ID NO: 2094101 - protein, 7 aa, Staphylococcus
AKESNLS

SEQ ID NO: 2094102 - protein, 8 aa, Staphylococcus
AKFPEGTE

SEQ ID NO: 2094103 - protein, 4 aa, Staphylococcus
AKFV

SEQ ID NO: 2094104 - protein, 10 aa, Staphylococcus
AKGKDYKWNP

SEQ ID NO: 2094105 - protein, 9 aa, Staphylococcus
AKGKGAAFL

SEQ ID NO: 2094106 - protein, 15 aa, Staphylococcus
AKGKLNAGEEFNGKY

SEQ ID NO: 2094107 - protein, 9 aa, Staphylococcus
AKGQGASFL

SEQ ID NO: 2094108 - protein, 8 aa, Staphylococcus
AKGQGDAF

SEQ ID NO: 2094109 - protein, 6 aa, Staphylococcus
AKGVKV

SEQ ID NO: 2094110 - protein, 19 aa, Staphylococcus
AKGYNVSEASVSAFGSNYD

SEQ ID NO: 2094111 - protein, 6 aa, Staphylococcus
AKINNE

SEQ ID NO: 2094112 - protein, 9 aa, Staphylococcus
AKKAGWDSV

SEQ ID NO: 2094113 - protein, 5 aa, Staphylococcus
AKKDH

SEQ ID NO: 2094114 - protein, 18 aa, Staphylococcus
AKKESMDKASAKKDGSLG

SEQ ID NO: 2094115 - protein, 19 aa, Staphylococcus
AKKESMDKSTAKKDGSLGY

SEQ ID NO: 2094116 - protein, 18 aa, Staphylococcus
AKKESMDSASAKKGGSLG

SEQ ID NO: 2094117 - protein, 12 aa, Staphylococcus
AKKMNKETTVET

SEQ ID NO: 2094118 - protein, 8 aa, Staphylococcus
AKKQNEKA

SEQ ID NO: 2094119 - protein, 9 aa, Staphylococcus
AKKSNGEQI

SEQ ID NO: 2094120 - protein, 14 aa, Staphylococcus
AKLEPSIKATTDLS

SEQ ID NO: 2094121 - protein, 15 aa, Staphylococcus
AKLNADSADISINKG

SEQ ID NO: 2094122 - protein, 8 aa, Staphylococcus
AKLSEKQK

SEQ ID NO: 2094123 - protein, 5 aa, Staphylococcus
AKLTG

SEQ ID NO: 2094124 - protein, 7 aa, Staphylococcus
AKNELGA

SEQ ID NO: 2094125 - protein, 4 aa, Staphylococcus
AKNG

SEQ ID NO: 2094126 - protein, 14 aa, Staphylococcus
AKNGYESATSGIAH

SEQ ID NO: 2094127 - protein, 7 aa, Staphylococcus
AKNHKDT

SEQ ID NO: 2094128 - protein, 11 aa, Staphylococcus
AKNKVDKEIDP

SEQ ID NO: 2094129 - protein, 8 aa, Staphylococcus
AKNSFSDI

SEQ ID NO: 2094130 - protein, 9 aa, Staphylococcus
AKNTTGDNR

SEQ ID NO: 2094131 - protein, 6 aa, Staphylococcus
AKNTTI

SEQ ID NO: 2094132 - protein, 17 aa, Staphylococcus
AKPKKVNSKYLERDDSG

SEQ ID NO: 2094133 - protein, 9 aa, Staphylococcus
AKPKRVYQT

SEQ ID NO: 2094134 - protein, 15 aa, Staphylococcus
AKPTKDPKKAMAESQ

SEQ ID NO: 2094135 - protein, 15 aa, Staphylococcus
AKPTKDPKKAMSETQ

SEQ ID NO: 2094136 - protein, 6 aa, Staphylococcus
AKPVYG

SEQ ID NO: 2094137 - protein, 7 aa, Staphylococcus
AKQEELV

SEQ ID NO: 2094138 - protein, 48 aa, Staphylococcus
AKQELNGEEKVSEAKTNALQTLNNDTHLNQHQREAATNAINGATTLSQ

SEQ ID NO: 2094139 - protein, 9 aa, Staphylococcus
AKQGDPKFN

SEQ ID NO: 2094140 - protein, 6 aa, Staphylococcus
AKQHKD

SEQ ID NO: 2094141 - protein, 9 aa, Staphylococcus
AKQRLNEAG

SEQ ID NO: 2094142 - protein, 8 aa, Staphylococcus
AKQSGWNS

SEQ ID NO: 2094143 - protein, 6 aa, Staphylococcus
AKRRKT

SEQ ID NO: 2094144 - protein, 5 aa, Staphylococcus
AKRYD

SEQ ID NO: 2094145 - protein, 10 aa, Staphylococcus
AKSDAVRKHP

SEQ ID NO: 2094146 - protein, 16 aa, Staphylococcus
AKSDLRDEIQSQLESR

SEQ ID NO: 2094147 - protein, 11 aa, Staphylococcus
AKSQGNKFSRA

SEQ ID NO: 2094148 - protein, 7 aa, Staphylococcus
AKTINKK

SEQ ID NO: 2094149 - protein, 8 aa, Staphylococcus
AKTLDENQ

SEQ ID NO: 2094150 - protein, 28 aa, Staphylococcus
AKTNSTTVKEKYNQKFTGVTSNGKKANK

SEQ ID NO: 2094151 - protein, 10 aa, Staphylococcus
AKTSESISGA

SEQ ID NO: 2094152 - protein, 7 aa, Staphylococcus
AKTTTID

SEQ ID NO: 2094153 - protein, 9 aa, Staphylococcus
AKVGSNKYD

SEQ ID NO: 2094154 - protein, 9 aa, Staphylococcus
AKVTETEME

SEQ ID NO: 2094155 - protein, 11 aa, Staphylococcus
AKWSNGDPVTA

SEQ ID NO: 2094156 - protein, 5 aa, Staphylococcus
AKYAP

SEQ ID NO: 2094157 - protein, 35 aa, Staphylococcus
AKYKNNDDTKTVSAKKYNDLADKVNKELDDDSQVP

SEQ ID NO: 2094158 - protein, 6 aa, Staphylococcus
AKYPIG

SEQ ID NO: 2094159 - protein, 13 aa, Staphylococcus
ALAEAGGTPNYNS

SEQ ID NO: 2094160 - protein, 4 aa, Staphylococcus
ALDD

SEQ ID NO: 2094161 - protein, 19 aa, Staphylococcus
ALDGDENLTHAKQQATQTI

SEQ ID NO: 2094162 - protein, 13 aa, Staphylococcus
ALDKLEKDGELAK

SEQ ID NO: 2094163 - protein, 20 aa, Staphylococcus
ALDRKTEIERQANEDYENGL

SEQ ID NO: 2094164 - protein, 13 aa, Staphylococcus
ALEKEFKKDHKNV

SEQ ID NO: 2094165 - protein, 9 aa, Staphylococcus
ALENAKGVD

SEQ ID NO: 2094166 - protein, 9 aa, Staphylococcus
ALETATEGI

SEQ ID NO: 2094167 - protein, 5 aa, Staphylococcus
ALETY

SEQ ID NO: 2094168 - protein, 13 aa, Staphylococcus
ALGEPLSKMAVIT

SEQ ID NO: 2094169 - protein, 13 aa, Staphylococcus
ALGEPLSKMAVVT

SEQ ID NO: 2094170 - protein, 10 aa, Staphylococcus
ALGESPKEQL

SEQ ID NO: 2094171 - protein, 10 aa, Staphylococcus
ALGQSPKEQL

SEQ ID NO: 2094172 - protein, 17 aa, Staphylococcus
ALNGNTNLNNAKQQALT

SEQ ID NO: 2094173 - protein, 15 aa, Staphylococcus
ALNKEKQGQKRLDKH

SEQ ID NO: 2094174 - protein, 12 aa, Staphylococcus
ALPDGEIKARTS

SEQ ID NO: 2094175 - protein, 29 aa, Staphylococcus
ALPDSANDKGNPLASNDLEKSGSVNTRYR

SEQ ID NO: 2094176 - protein, 11 aa, Staphylococcus
ALPKGEGVSSV

SEQ ID NO: 2094177 - protein, 12 aa, Staphylococcus
ALQTKADTLGSI

SEQ ID NO: 2094178 - protein, 5 aa, Staphylococcus
ALRNH

SEQ ID NO: 2094179 - protein, 19 aa, Staphylococcus
ALSDEDIQKVRNELTKEID

SEQ ID NO: 2094180 - protein, 10 aa, Staphylococcus
ALSPDVTKGL

SEQ ID NO: 2094181 - protein, 7 aa, Staphylococcus
ALTDEDI

SEQ ID NO: 2094182 - protein, 8 aa, Staphylococcus
ALTDGEKM

SEQ ID NO: 2094183 - protein, 11 aa, Staphylococcus
ALTDGEKMNHV

SEQ ID NO: 2094184 - protein, 13 aa, Staphylococcus
AMKNSGGNPDLQN

SEQ ID NO: 2094185 - protein, 13 aa, Staphylococcus
AMKVGEPRPKYQD

SEQ ID NO: 2094186 - protein, 6 aa, Staphylococcus
AMQDGD

SEQ ID NO: 2094187 - protein, 11 aa, Staphylococcus
AMQTNDKLREE

SEQ ID NO: 2094188 - protein, 5 aa, Staphylococcus
AMRNH

SEQ ID NO: 2094189 - protein, 13 aa, Staphylococcus
AMTDKNGKYISDK

SEQ ID NO: 2094190 - protein, 15 aa, Staphylococcus
AMTPNMGQGAGQAME

SEQ ID NO: 2094191 - protein, 13 aa, Staphylococcus
AMTVDGKPLALGN

SEQ ID NO: 2094192 - protein, 16 aa, Staphylococcus
ANAANDGYQVDNNPTV

SEQ ID NO: 2094193 - protein, 20 aa, Staphylococcus
ANAEESSKSQSTSEKGTMGY

SEQ ID NO: 2094194 - protein, 20 aa, Staphylococcus
ANAMNDKNKTLSLESSLNKA

SEQ ID NO: 2094195 - protein, 4 aa, Staphylococcus
ANAQ

SEQ ID NO: 2094196 - protein, 8 aa, Staphylococcus
ANAQSLDQ

SEQ ID NO: 2094197 - protein, 33 aa, Staphylococcus
ANASTKSDKLDVQQTSQQPVVKQQNKSVNVSKD

SEQ ID NO: 2094198 - protein, 16 aa, Staphylococcus
ANDAQSALDTARNGLT

SEQ ID NO: 2094199 - protein, 6 aa, Staphylococcus
ANDDLK

SEQ ID NO: 2094200 - protein, 7 aa, Staphylococcus
ANDGIKA

SEQ ID NO: 2094201 - protein, 4 aa, Staphylococcus
ANDQ

SEQ ID NO: 2094202 - protein, 18 aa, Staphylococcus
ANEASKEGYKVNDNPSVG

SEQ ID NO: 2094203 - protein, 6 aa, Staphylococcus
ANEDLK

SEQ ID NO: 2094204 - protein, 25 aa, Staphylococcus
ANEGLDNYEKNELNKATEQYLSKGA

SEQ ID NO: 2094205 - protein, 9 aa, Staphylococcus
ANEKDPKYV

SEQ ID NO: 2094206 - protein, 7 aa, Staphylococcus
ANETQLD

SEQ ID NO: 2094207 - protein, 56 aa, Staphylococcus
ANEVKESGGPASGGSNYGNSNPELKKRVQETIKQEGQKLSSDAVTTSGSGLDPDIT

SEQ ID NO: 2094208 - protein, 8 aa, Staphylococcus
ANGGTEEA

SEQ ID NO: 2094209 - protein, 7 aa, Staphylococcus
ANGLPTD

SEQ ID NO: 2094210 - protein, 14 aa, Staphylococcus
ANGPNTSQDKVEEA

SEQ ID NO: 2094211 - protein, 23 aa, Staphylococcus
ANGPYNTNTRTIPASVVSSYNFI

SEQ ID NO: 2094212 - protein, 9 aa, Staphylococcus
ANGQKDHGY

SEQ ID NO: 2094213 - protein, 7 aa, Staphylococcus
ANGQSEN

SEQ ID NO: 2094214 - protein, 8 aa, Staphylococcus
ANGTAPIE

SEQ ID NO: 2094215 - protein, 6 aa, Staphylococcus
ANGTEI

SEQ ID NO: 2094216 - protein, 14 aa, Staphylococcus
ANIESKVAKQKKHP

SEQ ID NO: 2094217 - protein, 6 aa, Staphylococcus
ANIKEV

SEQ ID NO: 2094218 - protein, 28 aa, Staphylococcus
ANIQNNSYYNPQVQRTAGKWEDANYDEI

SEQ ID NO: 2094219 - protein, 28 aa, Staphylococcus
ANKSEDDNDHDSHSSAHAPKNAKQLKEK

SEQ ID NO: 2094220 - protein, 7 aa, Staphylococcus
ANKVSAL

SEQ ID NO: 2094221 - protein, 16 aa, Staphylococcus
ANKVTDTIRKETDAKP

SEQ ID NO: 2094222 - protein, 16 aa, Staphylococcus
ANKVTETIRKETNAKP

SEQ ID NO: 2094223 - protein, 20 aa, Staphylococcus
ANNASADGYTVNNAPTAGSI

SEQ ID NO: 2094224 - protein, 12 aa, Staphylococcus
ANNATAKKTLNN

SEQ ID NO: 2094225 - protein, 15 aa, Staphylococcus
ANNHSLDQGDSGVTN

SEQ ID NO: 2094226 - protein, 11 aa, Staphylococcus
ANNPFKEKEQQ

SEQ ID NO: 2094227 - protein, 8 aa, Staphylococcus
ANNQTPFT

SEQ ID NO: 2094228 - protein, 6 aa, Staphylococcus
ANNTKN

SEQ ID NO: 2094229 - protein, 11 aa, Staphylococcus
ANPEYDGPRYD

SEQ ID NO: 2094230 - protein, 18 aa, Staphylococcus
ANPKYANKNYKNAKVPTL

SEQ ID NO: 2094231 - protein, 14 aa, Staphylococcus
ANQGEHAGYYPGNT

SEQ ID NO: 2094232 - protein, 12 aa, Staphylococcus
ANQLDQAMGRLK

SEQ ID NO: 2094233 - protein, 5 aa, Staphylococcus
ANQND

SEQ ID NO: 2094234 - protein, 13 aa, Staphylococcus
ANQPSQNKDTSTL

SEQ ID NO: 2094235 - protein, 8 aa, Staphylococcus
ANQSTKHK

SEQ ID NO: 2094236 - protein, 8 aa, Staphylococcus
ANQSVSPH

SEQ ID NO: 2094237 - protein, 7 aa, Staphylococcus
ANQTFNA

SEQ ID NO: 2094238 - protein, 22 aa, Staphylococcus
ANRATSSLPKYQPQVKSSINDY

SEQ ID NO: 2094239 - protein, 7 aa, Staphylococcus
ANRIEQK

SEQ ID NO: 2094240 - protein, 15 aa, Staphylococcus
ANRPGGKIQTYRQDG

SEQ ID NO: 2094241 - protein, 6 aa, Staphylococcus
ANSNEV

SEQ ID NO: 2094242 - protein, 9 aa, Staphylococcus
ANSPVTEQY

SEQ ID NO: 2094243 - protein, 10 aa, Staphylococcus
ANSYNGDDFE

SEQ ID NO: 2094244 - protein, 10 aa, Staphylococcus
ANSYNSEGFE

SEQ ID NO: 2094245 - protein, 6 aa, Staphylococcus
ANTHKD

SEQ ID NO: 2094246 - protein, 12 aa, Staphylococcus
ANTPFKSSEQQA

SEQ ID NO: 2094247 - protein, 7 aa, Staphylococcus
ANVDESI

SEQ ID NO: 2094248 - protein, 14 aa, Staphylococcus
ANYVGPGVETSWFT

SEQ ID NO: 2094249 - protein, 15 aa, Staphylococcus
APADKIYAGPQTMTG

SEQ ID NO: 2094250 - protein, 5 aa, Staphylococcus
APDEE

SEQ ID NO: 2094251 - protein, 28 aa, Staphylococcus
APDLTSSKVTDVTSSKTITYDNNRSTVN

SEQ ID NO: 2094252 - protein, 6 aa, Staphylococcus
APESAI

SEQ ID NO: 2094253 - protein, 5 aa, Staphylococcus
APGDY

SEQ ID NO: 2094254 - protein, 10 aa, Staphylococcus
APGTFSPSDN

SEQ ID NO: 2094255 - protein, 14 aa, Staphylococcus
APHNGTHAADIGNE

SEQ ID NO: 2094256 - protein, 4 aa, Staphylococcus
APIY

SEQ ID NO: 2094257 - protein, 4 aa, Staphylococcus
APKA

SEQ ID NO: 2094258 - protein, 77 aa, Staphylococcus
APKQGSNQHTQATHETAKETEKTKTDTKQPAPAQTQPKQPQQPVQPQQNQTQNQNNTPVQKTQPAPQKQAEPNQSNG

SEQ ID NO: 2094259 - protein, 11 aa, Staphylococcus
APKSADFTVTP

SEQ ID NO: 2094260 - protein, 4 aa, Staphylococcus
APLA

SEQ ID NO: 2094261 - protein, 30 aa, Staphylococcus
APNNDNNEDNHNQSNGVNAPKHAKNLTEND

SEQ ID NO: 2094262 - protein, 11 aa, Staphylococcus
APNVSTPMSKQ

SEQ ID NO: 2094263 - protein, 12 aa, Staphylococcus
APNVTSSSDKTV

SEQ ID NO: 2094264 - protein, 10 aa, Staphylococcus
APPFSTTKDP

SEQ ID NO: 2094265 - protein, 8 aa, Staphylococcus
APPYSRPK

SEQ ID NO: 2094266 - protein, 16 aa, Staphylococcus
APQSQTGKKYDDKIES

SEQ ID NO: 2094267 - protein, 6 aa, Staphylococcus
APSELN

SEQ ID NO: 2094268 - protein, 36 aa, Staphylococcus
APSEYKGVSPANAPEHVQDAAAQKLYDTEGAGHWTT

SEQ ID NO: 2094269 - protein, 9 aa, Staphylococcus
APTQSTQTV

SEQ ID NO: 2094270 - protein, 23 aa, Staphylococcus
APWGTTSTNNSTPTTKPSINNKK

SEQ ID NO: 2094271 - protein, 10 aa, Staphylococcus
APYQGQNAVP

SEQ ID NO: 2094272 - protein, 12 aa, Staphylococcus
APYQSQNAVPAA

SEQ ID NO: 2094273 - protein, 5 aa, Staphylococcus
AQAKP

SEQ ID NO: 2094274 - protein, 6 aa, Staphylococcus
AQAKPD

SEQ ID NO: 2094275 - protein, 10 aa, Staphylococcus
AQAKQTAQDL

SEQ ID NO: 2094276 - protein, 26 aa, Staphylococcus
AQAQEGNHKQTTEKNEKENTSKPINF

SEQ ID NO: 2094277 - protein, 9 aa, Staphylococcus
AQARSPIST

SEQ ID NO: 2094278 - protein, 5 aa, Staphylococcus
AQDII

SEQ ID NO: 2094279 - protein, 9 aa, Staphylococcus
AQDKMNTVD

SEQ ID NO: 2094280 - protein, 9 aa, Staphylococcus
AQDRDTPAY

SEQ ID NO: 2094281 - protein, 10 aa, Staphylococcus
AQDRGSAGYQ

SEQ ID NO: 2094282 - protein, 11 aa, Staphylococcus
AQEAMKKKGYD

SEQ ID NO: 2094283 - protein, 40 aa, Staphylococcus
AQEINNKAQDMSDEAEANNELTTEEKEALTERIDNDKNEI

SEQ ID NO: 2094284 - protein, 5 aa, Staphylococcus
AQEND

SEQ ID NO: 2094285 - protein, 5 aa, Staphylococcus
AQENG

SEQ ID NO: 2094286 - protein, 6 aa, Staphylococcus
AQESEA

SEQ ID NO: 2094287 - protein, 16 aa, Staphylococcus
AQHNPSELNAHPVKAG

SEQ ID NO: 2094288 - protein, 17 aa, Staphylococcus
AQHPSNQKYVDATDQIQ

SEQ ID NO: 2094289 - protein, 6 aa, Staphylococcus
AQKDGI

SEQ ID NO: 2094290 - protein, 7 aa, Staphylococcus
AQKGPRI

SEQ ID NO: 2094291 - protein, 5 aa, Staphylococcus
AQKHM

SEQ ID NO: 2094292 - protein, 10 aa, Staphylococcus
AQKINEGKMP

SEQ ID NO: 2094293 - protein, 16 aa, Staphylococcus
AQKQAQDQNLNIWSRS

SEQ ID NO: 2094294 - protein, 20 aa, Staphylococcus
AQLAESNDQSLNQHPIQEGA

SEQ ID NO: 2094295 - protein, 20 aa, Staphylococcus
AQLAQSNDQSLNEKPVQSGA

SEQ ID NO: 2094296 - protein, 13 aa, Staphylococcus
AQNEAQKKKINLW

SEQ ID NO: 2094297 - protein, 9 aa, Staphylococcus
AQNGKISTY

SEQ ID NO: 2094298 - protein, 9 aa, Staphylococcus
AQNLSTSSV

SEQ ID NO: 2094299 - protein, 10 aa, Staphylococcus
AQNNINSNYK

SEQ ID NO: 2094300 - protein, 16 aa, Staphylococcus
AQNNPEQLNEKPLHAG

SEQ ID NO: 2094301 - protein, 16 aa, Staphylococcus
AQNNPSELNAHPVQAG

SEQ ID NO: 2094302 - protein, 4 aa, Staphylococcus
AQNV

SEQ ID NO: 2094303 - protein, 10 aa, Staphylococcus
AQPLTDTNSK

SEQ ID NO: 2094304 - protein, 4 aa, Staphylococcus
AQPS

SEQ ID NO: 2094305 - protein, 10 aa, Staphylococcus
AQPTTNTTQK

SEQ ID NO: 2094306 - protein, 11 aa, Staphylococcus
AQQGKDGRDRV

SEQ ID NO: 2094307 - protein, 18 aa, Staphylococcus
AQQKKDAPSAPQATKHNK

SEQ ID NO: 2094308 - protein, 7 aa, Staphylococcus
AQQPELK

SEQ ID NO: 2094309 - protein, 21 aa, Staphylococcus
AQRESGGDIHATNPSSGASGK

SEQ ID NO: 2094310 - protein, 22 aa, Staphylococcus
AQRESGGDIHATNPSTGASGKY

SEQ ID NO: 2094311 - protein, 21 aa, Staphylococcus
AQRESGGDITAINPSSGAAGK

SEQ ID NO: 2094312 - protein, 78 aa, Staphylococcus
AQSGQASQQQDVSAQASTVSNQTSAEQVGSQQQSSQAQPTQTQQAPQTEQTQQPQTEATTSNSSSSNNNASSGSSVNV

SEQ ID NO: 2094313 - protein, 8 aa, Staphylococcus
AQSINETY

SEQ ID NO: 2094314 - protein, 9 aa, Staphylococcus
AQSLDQTYE

SEQ ID NO: 2094315 - protein, 10 aa, Staphylococcus
AQSLKETYET

SEQ ID NO: 2094316 - protein, 6 aa, Staphylococcus
AQSLNQ

SEQ ID NO: 2094317 - protein, 7 aa, Staphylococcus
AQTYSDQ

SEQ ID NO: 2094318 - protein, 13 aa, Staphylococcus
AQVGKPVSNRWGN

SEQ ID NO: 2094319 - protein, 25 aa, Staphylococcus
ARADELDNASSQNNDGNKDKSEPVD

SEQ ID NO: 2094320 - protein, 5 aa, Staphylococcus
ARAGA

SEQ ID NO: 2094321 - protein, 25 aa, Staphylococcus
ARDGEQAADRYSARPGTSEHQSGLS

SEQ ID NO: 2094322 - protein, 23 aa, Staphylococcus
ARDGKKAADKYSARPGYSEHQTG

SEQ ID NO: 2094323 - protein, 10 aa, Staphylococcus
ARDPETGGIS

SEQ ID NO: 2094324 - protein, 6 aa, Staphylococcus
ARENNV

SEQ ID NO: 2094325 - protein, 8 aa, Staphylococcus
ARGNENQP

SEQ ID NO: 2094326 - protein, 8 aa, Staphylococcus
ARGTDSYT

SEQ ID NO: 2094327 - protein, 8 aa, Staphylococcus
ARKATGID

SEQ ID NO: 2094328 - protein, 10 aa, Staphylococcus
ARNAESAKKL

SEQ ID NO: 2094329 - protein, 9 aa, Staphylococcus
ARNSKGQQL

SEQ ID NO: 2094330 - protein, 8 aa, Staphylococcus
ARTTPNQI

SEQ ID NO: 2094331 - protein, 5 aa, Staphylococcus
ARYQT

SEQ ID NO: 2094332 - protein, 10 aa, Staphylococcus
ASDAYGTGTP

SEQ ID NO: 2094333 - protein, 52 aa, Staphylococcus
ASDLNDSNTNESSTSENSNQSTSQQTTKNTTSQTSQEEQATPNKDRQQSEDV

SEQ ID NO: 2094334 - protein, 12 aa, Staphylococcus
ASEKDPKYQTFE

SEQ ID NO: 2094335 - protein, 8 aa, Staphylococcus
ASEKNYVN

SEQ ID NO: 2094336 - protein, 7 aa, Staphylococcus
ASEQEMK

SEQ ID NO: 2094337 - protein, 13 aa, Staphylococcus
ASESSIKAMKANT

SEQ ID NO: 2094338 - protein, 12 aa, Staphylococcus
ASETVGKALKEG

SEQ ID NO: 2094339 - protein, 11 aa, Staphylococcus
ASFGKTKEGQW

SEQ ID NO: 2094340 - protein, 17 aa, Staphylococcus
ASGAGQGAQDQQGQNGD

SEQ ID NO: 2094341 - protein, 12 aa, Staphylococcus
ASGDTKGKKIKG

SEQ ID NO: 2094342 - protein, 5 aa, Staphylococcus
ASGIG

SEQ ID NO: 2094343 - protein, 8 aa, Staphylococcus
ASGIPDNV

SEQ ID NO: 2094344 - protein, 18 aa, Staphylococcus
ASGNKGVTIGHTTAKEAN

SEQ ID NO: 2094345 - protein, 16 aa, Staphylococcus
ASGQDEKGAKTSENGN

SEQ ID NO: 2094346 - protein, 17 aa, Staphylococcus
ASGSGEGNQGQQGQNED

SEQ ID NO: 2094347 - protein, 10 aa, Staphylococcus
ASGYNGEDFE

SEQ ID NO: 2094348 - protein, 10 aa, Staphylococcus
ASHGQTAGAA

SEQ ID NO: 2094349 - protein, 16 aa, Staphylococcus
ASHNADAAELNTTEQA

SEQ ID NO: 2094350 - protein, 19 aa, Staphylococcus
ASISSTSSSSEKGNDFKLQ

SEQ ID NO: 2094351 - protein, 23 aa, Staphylococcus
ASLADVSKALEKEFKKDHKDAKV

SEQ ID NO: 2094352 - protein, 14 aa, Staphylococcus
ASLDKDDIKEEMLA

SEQ ID NO: 2094353 - protein, 15 aa, Staphylococcus
ASLENMTELLRSNLD

SEQ ID NO: 2094354 - protein, 7 aa, Staphylococcus
ASLGDVS

SEQ ID NO: 2094355 - protein, 6 aa, Staphylococcus
ASLKDY

SEQ ID NO: 2094356 - protein, 6 aa, Staphylococcus
ASLTDV

SEQ ID NO: 2094357 - protein, 22 aa, Staphylococcus
ASLTDVSKDLEKEFKKDHPDAK

SEQ ID NO: 2094358 - protein, 22 aa, Staphylococcus
ASLTDVSKELKKEFEKEHKEAK

SEQ ID NO: 2094359 - protein, 21 aa, Staphylococcus
ASLTDVTKDLEKAFKKDHKDV

SEQ ID NO: 2094360 - protein, 19 aa, Staphylococcus
ASNNEATAYPKAKKISNSS

SEQ ID NO: 2094361 - protein, 5 aa, Staphylococcus
ASNRL

SEQ ID NO: 2094362 - protein, 8 aa, Staphylococcus
ASNSVGQY

SEQ ID NO: 2094363 - protein, 28 aa, Staphylococcus
ASNVSHASGSGAGPGENAQGQQGQDDAV

SEQ ID NO: 2094364 - protein, 8 aa, Staphylococcus
ASPAPHAE

SEQ ID NO: 2094365 - protein, 7 aa, Staphylococcus
ASPAPHG

SEQ ID NO: 2094366 - protein, 8 aa, Staphylococcus
ASPARGPF

SEQ ID NO: 2094367 - protein, 11 aa, Staphylococcus
ASPHNGTHASD

SEQ ID NO: 2094368 - protein, 8 aa, Staphylococcus
ASPPSGSF

SEQ ID NO: 2094369 - protein, 37 aa, Staphylococcus
ASPTMDPDAITQAATQVTTAEKALNGTENLRHAQQDA

SEQ ID NO: 2094370 - protein, 7 aa, Staphylococcus
ASPVATD

SEQ ID NO: 2094371 - protein, 13 aa, Staphylococcus
ASQASQEKKNNVQ

SEQ ID NO: 2094372 - protein, 7 aa, Staphylococcus
ASQDEID

SEQ ID NO: 2094373 - protein, 4 aa, Staphylococcus
ASQT

SEQ ID NO: 2094374 - protein, 6 aa, Staphylococcus
ASRAGI

SEQ ID NO: 2094375 - protein, 4 aa, Staphylococcus
ASSN

SEQ ID NO: 2094376 - protein, 10 aa, Staphylococcus
ASSNDASGKG

SEQ ID NO: 2094377 - protein, 7 aa, Staphylococcus
ASSNNSY

SEQ ID NO: 2094378 - protein, 10 aa, Staphylococcus
ASSSDANDKG

SEQ ID NO: 2094379 - protein, 7 aa, Staphylococcus
ASSSPEM

SEQ ID NO: 2094380 - protein, 7 aa, Staphylococcus
ASSTDAG

SEQ ID NO: 2094381 - protein, 7 aa, Staphylococcus
ASSVATN

SEQ ID NO: 2094382 - protein, 11 aa, Staphylococcus
ASTGIGQGSAK

SEQ ID NO: 2094383 - protein, 7 aa, Staphylococcus
ASVDNEY

SEQ ID NO: 2094384 - protein, 4 aa, Staphylococcus
ASVE

SEQ ID NO: 2094385 - protein, 4 aa, Staphylococcus
ASVG

SEQ ID NO: 2094386 - protein, 12 aa, Staphylococcus
ASVGKAVPNGWG

SEQ ID NO: 2094387 - protein, 11 aa, Staphylococcus
ASVQSSDNSYH

SEQ ID NO: 2094388 - protein, 20 aa, Staphylococcus
ASYPSVKAEKKSSGLFGWLS

SEQ ID NO: 2094389 - protein, 12 aa, Staphylococcus
ATADDDKTKINE

SEQ ID NO: 2094390 - protein, 11 aa, Staphylococcus
ATADDGQTKIN

SEQ ID NO: 2094391 - protein, 8 aa, Staphylococcus
ATAEKYNL

SEQ ID NO: 2094392 - protein, 18 aa, Staphylococcus
ATAGNHDEHAFNEDDPKL

SEQ ID NO: 2094393 - protein, 16 aa, Staphylococcus
ATAKRENAINDKGSYN

SEQ ID NO: 2094394 - protein, 6 aa, Staphylococcus
ATDDTA

SEQ ID NO: 2094395 - protein, 9 aa, Staphylococcus
ATDKNGKEI

SEQ ID NO: 2094396 - protein, 15 aa, Staphylococcus
ATDNANNTTNNRQSK

SEQ ID NO: 2094397 - protein, 61 aa, Staphylococcus
ATELTNQSHNESNHASVDKSDNDDTSDTNDEQTTKKQEKSAKTTKFKQYTRAKKASHDEDD

SEQ ID NO: 2094398 - protein, 6 aa, Staphylococcus
ATETPK

SEQ ID NO: 2094399 - protein, 10 aa, Staphylococcus
ATETQNTRIH

SEQ ID NO: 2094400 - protein, 17 aa, Staphylococcus
ATGAANDGYQVDHSPEV

SEQ ID NO: 2094401 - protein, 6 aa, Staphylococcus
ATGMEA

SEQ ID NO: 2094402 - protein, 5 aa, Staphylococcus
ATGMT

SEQ ID NO: 2094403 - protein, 6 aa, Staphylococcus
ATGNKN

SEQ ID NO: 2094404 - protein, 14 aa, Staphylococcus
ATGSKNHLSELDED

SEQ ID NO: 2094405 - protein, 14 aa, Staphylococcus
ATGSKTHLGQLDED

SEQ ID NO: 2094406 - protein, 41 aa, Staphylococcus
ATHPEMNADTINSKAQQVTTAKTNLNGDENLDAAKQAAQQY

SEQ ID NO: 2094407 - protein, 8 aa, Staphylococcus
ATKKSNEL

SEQ ID NO: 2094408 - protein, 10 aa, Staphylococcus
ATKNTDKYNA

SEQ ID NO: 2094409 - protein, 5 aa, Staphylococcus
ATKRN

SEQ ID NO: 2094410 - protein, 7 aa, Staphylococcus
ATNNPYA

SEQ ID NO: 2094411 - protein, 10 aa, Staphylococcus
ATNPTGEKYT

SEQ ID NO: 2094412 - protein, 15 aa, Staphylococcus
ATNPTLDQSQIEQAT

SEQ ID NO: 2094413 - protein, 6 aa, Staphylococcus
ATNQLE

SEQ ID NO: 2094414 - protein, 16 aa, Staphylococcus
ATNRAGGKIQTYRKDG

SEQ ID NO: 2094415 - protein, 16 aa, Staphylococcus
ATNRPGGKIQTYRKDG

SEQ ID NO: 2094416 - protein, 20 aa, Staphylococcus
ATNRTGGKIQTYRKDGYTIE

SEQ ID NO: 2094417 - protein, 9 aa, Staphylococcus
ATNSEGKEI

SEQ ID NO: 2094418 - protein, 8 aa, Staphylococcus
ATPAPHGD

SEQ ID NO: 2094419 - protein, 14 aa, Staphylococcus
ATPDATDEEKATAI

SEQ ID NO: 2094420 - protein, 5 aa, Staphylococcus
ATPFG

SEQ ID NO: 2094421 - protein, 7 aa, Staphylococcus
ATPKFNN

SEQ ID NO: 2094422 - protein, 15 aa, Staphylococcus
ATPNKAAAQKLPAEI

SEQ ID NO: 2094423 - protein, 31 aa, Staphylococcus
ATPNKAAREKLPDEVKNDKRFYPTQQDQNRL

SEQ ID NO: 2094424 - protein, 10 aa, Staphylococcus
ATPNKAARQL

SEQ ID NO: 2094425 - protein, 10 aa, Staphylococcus
ATPNKEARKM

SEQ ID NO: 2094426 - protein, 16 aa, Staphylococcus
ATQGNGELISDEQPSQ

SEQ ID NO: 2094427 - protein, 9 aa, Staphylococcus
ATQSPIRNY

SEQ ID NO: 2094428 - protein, 9 aa, Staphylococcus
ATSGRTINA

SEQ ID NO: 2094429 - protein, 10 aa, Staphylococcus
ATSKEAQNKG

SEQ ID NO: 2094430 - protein, 8 aa, Staphylococcus
ATSPSEHD

SEQ ID NO: 2094431 - protein, 7 aa, Staphylococcus
ATSPYKN

SEQ ID NO: 2094432 - protein, 30 aa, Staphylococcus
ATSQPNMSATEINQAATKVNETKAALNGAQ

SEQ ID NO: 2094433 - protein, 10 aa, Staphylococcus
ATTGRRITGN

SEQ ID NO: 2094434 - protein, 12 aa, Staphylococcus
ATTPLSGNEDVD

SEQ ID NO: 2094435 - protein, 37 aa, Staphylococcus
ATTSANTAVATRSAVTKEATTRAALPKYSPKVNSSIN

SEQ ID NO: 2094436 - protein, 7 aa, Staphylococcus
ATYHYNG

SEQ ID NO: 2094437 - protein, 18 aa, Staphylococcus
ATYQDARADLKKDYPQIY

SEQ ID NO: 2094438 - protein, 18 aa, Staphylococcus
ATYQDARADLKKEYPNIY

SEQ ID NO: 2094439 - protein, 18 aa, Staphylococcus
ATYQDARADLKQDYPKIY

SEQ ID NO: 2094440 - protein, 14 aa, Staphylococcus
ATYQGKTEAPKFTY

SEQ ID NO: 2094441 - protein, 22 aa, Staphylococcus
AVDAENSAFKAIGKNKADVNNI

SEQ ID NO: 2094442 - protein, 24 aa, Staphylococcus
AVDDLTKKAGFAEVKQEKVDKYAG

SEQ ID NO: 2094443 - protein, 11 aa, Staphylococcus
AVDRPNTELEK

SEQ ID NO: 2094444 - protein, 11 aa, Staphylococcus
AVEGGKVDGKF

SEQ ID NO: 2094445 - protein, 8 aa, Staphylococcus
AVENKDFT

SEQ ID NO: 2094446 - protein, 15 aa, Staphylococcus
AVGKEDKGKERLKEH

SEQ ID NO: 2094447 - protein, 5 aa, Staphylococcus
AVGNK

SEQ ID NO: 2094448 - protein, 11 aa, Staphylococcus
AVKDGKVTGQF

SEQ ID NO: 2094449 - protein, 5 aa, Staphylococcus
AVKND

SEQ ID NO: 2094450 - protein, 9 aa, Staphylococcus
AVKNNNVYE

SEQ ID NO: 2094451 - protein, 8 aa, Staphylococcus
AVKNQGTE

SEQ ID NO: 2094452 - protein, 8 aa, Staphylococcus
AVKNQGVD

SEQ ID NO: 2094453 - protein, 6 aa, Staphylococcus
AVNHGT

SEQ ID NO: 2094454 - protein, 13 aa, Staphylococcus
AVPNPATVTQNDV

SEQ ID NO: 2094455 - protein, 10 aa, Staphylococcus
AVQGGKITGK

SEQ ID NO: 2094456 - protein, 79 aa, Staphylococcus
AVQPTAQINDDERNKAENNTIRNVRTSGNITPSATQTWQNNDYSASDRQQVSNTTANEQVTSNYQYSPVSHASNGSNYY

SEQ ID NO: 2094457 - protein, 13 aa, Staphylococcus
AVSIEKGKKQQLA

SEQ ID NO: 2094458 - protein, 5 aa, Staphylococcus
AVSKA

SEQ ID NO: 2094459 - protein, 5 aa, Staphylococcus
AVSSY

SEQ ID NO: 2094460 - protein, 8 aa, Staphylococcus
AVTPHDNN

SEQ ID NO: 2094461 - protein, 5 aa, Staphylococcus
AVYGE

SEQ ID NO: 2094462 - protein, 9 aa, Staphylococcus
AYAGATTGQ

SEQ ID NO: 2094463 - protein, 10 aa, Staphylococcus
AYDKSGKKLS

SEQ ID NO: 2094464 - protein, 6 aa, Staphylococcus
AYDVPE

SEQ ID NO: 2094465 - protein, 8 aa, Staphylococcus
AYHNGETI

SEQ ID NO: 2094466 - protein, 8 aa, Staphylococcus
AYNHSSER

SEQ ID NO: 2094467 - protein, 6 aa, Staphylococcus
AYQPTL

SEQ ID NO: 2094468 - protein, 6 aa, Staphylococcus
AYRKRY

SEQ ID NO: 2094469 - protein, 4 aa, Staphylococcus
AYSH

SEQ ID NO: 2094470 - protein, 10 aa, Staphylococcus
AYTPATKDIK

SEQ ID NO: 2094471 - protein, 12 aa, Staphylococcus
AYYEKGYKTDIS

SEQ ID NO: 2094472 - protein, 30 aa, Staphylococcus
CAPEDDNDTTDHHSNGVNAPKHAKNLTESD

SEQ ID NO: 2094473 - protein, 14 aa, Staphylococcus
CDKERTKTYEGDID

SEQ ID NO: 2094474 - protein, 15 aa, Staphylococcus
CEENKKKKVAKKPVN

SEQ ID NO: 2094475 - protein, 18 aa, Staphylococcus
CGEKGKDHSQENQKPEIK

SEQ ID NO: 2094476 - protein, 22 aa, Staphylococcus
CGGAGDKEKTITVGASPAPHAE

SEQ ID NO: 2094477 - protein, 30 aa, Staphylococcus
CGGGDSSGSGSGDGKDLKGEAKGEGSSTVA

SEQ ID NO: 2094478 - protein, 26 aa, Staphylococcus
CGGGGNADSGKGEGEVKGDGSSTVGP

SEQ ID NO: 2094479 - protein, 17 aa, Staphylococcus
CGGGKSEDNKKVSADNK

SEQ ID NO: 2094480 - protein, 29 aa, Staphylococcus
CGGGNNGGSGEGKDVSGKVKGDGSSTVGP

SEQ ID NO: 2094481 - protein, 30 aa, Staphylococcus
CGGGNSGGSGSGDGKDLEGSAKGEGSSTVA

SEQ ID NO: 2094482 - protein, 21 aa, Staphylococcus
CGGKDDDKTIKVGASPAPHAE

SEQ ID NO: 2094483 - protein, 22 aa, Staphylococcus
CGGNGEQKEPSKESKKSDKYEY

SEQ ID NO: 2094484 - protein, 26 aa, Staphylococcus
CGGNGSGNGKDVSGEVKGDGSSTVGP

SEQ ID NO: 2094485 - protein, 52 aa, Staphylococcus
CGKDDEKASLEKDIDKLEKQNKDLKKQKEKLEKEQDKLKDKSDDLEKDINAK

SEQ ID NO: 2094486 - protein, 23 aa, Staphylococcus
CGKDKSQDEAKRKADAKGKPDTW

SEQ ID NO: 2094487 - protein, 13 aa, Staphylococcus
CGKDNKEASKTIT

SEQ ID NO: 2094488 - protein, 17 aa, Staphylococcus
CGKEEVKSPQATKDGKP

SEQ ID NO: 2094489 - protein, 12 aa, Staphylococcus
CGKGDKYDKDID

SEQ ID NO: 2094490 - protein, 17 aa, Staphylococcus
CGKGDSDKSSDYKGKLE

SEQ ID NO: 2094491 - protein, 22 aa, Staphylococcus
CGKGDSEDKTIKVGASPAPHAE

SEQ ID NO: 2094492 - protein, 16 aa, Staphylococcus
CGKGESDNTKSNEKIK

SEQ ID NO: 2094493 - protein, 141 aa, Staphylococcus
CGKSEEKASLEKSVDKLEKENKSLKAQKKKLKKQKEDLKDQQDKLQKEVDNSASSAASSADSSDEDSGNQSQEDNDASKSSSQKNDQQSTEGKDASKQTQNQSSTPTQSKNNQNQSNQTSQQNGSNKANTNQTNQKQSSST

SEQ ID NO: 2094494 - protein, 32 aa, Staphylococcus
CGNDSKDSNHDTDTFKKEKKTNETKSQDDVES

SEQ ID NO: 2094495 - protein, 11 aa, Staphylococcus
CGNEGANEFKD

SEQ ID NO: 2094496 - protein, 16 aa, Staphylococcus
CGNGDDHKKGDKLKVN

SEQ ID NO: 2094497 - protein, 20 aa, Staphylococcus
CGNGDSGSSSDGNTSLGKKD

SEQ ID NO: 2094498 - protein, 18 aa, Staphylococcus
CGNGGSKSDSSTELGGKE

SEQ ID NO: 2094499 - protein, 38 aa, Staphylococcus
CGNGNSDKSKESSKKDSKDTITIKNDGGETKVKKGAKR

SEQ ID NO: 2094500 - protein, 39 aa, Staphylococcus
CGNGNSDSNEKKADSKSSSKNKKELKHATAEYKKYTDKQ

SEQ ID NO: 2094501 - protein, 23 aa, Staphylococcus
CGNGSNDKDSSSSKDKKEYSEKH

SEQ ID NO: 2094502 - protein, 19 aa, Staphylococcus
CGNGSSDNKSSKSKDDNKT

SEQ ID NO: 2094503 - protein, 26 aa, Staphylococcus
CGNKDKTSSENSKTITVGASPAPHAE

SEQ ID NO: 2094504 - protein, 48 aa, Staphylococcus
CGNKEKEEKHEHDNKTEEHQHSNKSHKTLTGKFKSGEEHVEGNAKIEN

SEQ ID NO: 2094505 - protein, 12 aa, Staphylococcus
CGNKTNKDFNDF

SEQ ID NO: 2094506 - protein, 12 aa, Staphylococcus
CGNQSSADLKDF

SEQ ID NO: 2094507 - protein, 22 aa, Staphylococcus
CGNSGSGSGSSDDSQTSLGNKE

SEQ ID NO: 2094508 - protein, 51 aa, Staphylococcus
CGNSNSNNEHAHDKDKQQEESKVKTDKSKKLSGTFKSKNGEKVEGTAKIEN

SEQ ID NO: 2094509 - protein, 38 aa, Staphylococcus
CGNVSDNGSSSSNKKSSSKDTIEVKTEQGNVKVPKDAK

SEQ ID NO: 2094510 - protein, 87 aa, Staphylococcus
CGQKDNGQDEGPKNKQEQKKKDSKKEKSKEKTTNNSTKNNPSETSQQNNNNGETVNTSNNQQETQAEANQRMQEESRSEHNGLSNAE

SEQ ID NO: 2094511 - protein, 16 aa, Staphylococcus
CGQKNSSNDNGKTTTM

SEQ ID NO: 2094512 - protein, 10 aa, Staphylococcus
CGQNNNEDLN

SEQ ID NO: 2094513 - protein, 13 aa, Staphylococcus
CGSAEGVYSDKGQ

SEQ ID NO: 2094514 - protein, 30 aa, Staphylococcus
CGSGGNGGGDSKESDAKGEVKGDGSSTVGP

SEQ ID NO: 2094515 - protein, 35 aa, Staphylococcus
CGSNGSNNSSNKSASKDGVEIKHDEGKTKVPKHPK

SEQ ID NO: 2094516 - protein, 23 aa, Staphylococcus
CGSSQKENTKTESSKKEFSREAQ

SEQ ID NO: 2094517 - protein, 21 aa, Staphylococcus
CGTSDKKDNDNKNKTASENKT

SEQ ID NO: 2094518 - protein, 11 aa, Staphylococcus
CGYDGKTQYAG

SEQ ID NO: 2094519 - protein, 32 aa, Staphylococcus
CNSSKTSEIDSEKVKEENQSKKLRTKELKNNT

SEQ ID NO: 2094520 - protein, 5 aa, Staphylococcus
CPDLR

SEQ ID NO: 2094521 - protein, 11 aa, Staphylococcus
CQTASMNPSPV

SEQ ID NO: 2094522 - protein, 26 aa, Staphylococcus
CSAPTKTDKKDNQDKAENAQKSKPKY

SEQ ID NO: 2094523 - protein, 68 aa, Staphylococcus
CSDDDKTSHKKDKQTSKSEKKDKNKASKKEKSKHDTRGSNEKIAEKNQDDSSVDTKNQSSTQHQNPQV

SEQ ID NO: 2094524 - protein, 45 aa, Staphylococcus
CSGNNDKKTSDAHAQTQQQHSKEASTSKDIKINKEKLSDQAHENM

SEQ ID NO: 2094525 - protein, 13 aa, Staphylococcus
CSGSGNESKGKTL

SEQ ID NO: 2094526 - protein, 30 aa, Staphylococcus
CSKDSHNDKQADNKQQSTNKQKNNKYQSKI

SEQ ID NO: 2094527 - protein, 17 aa, Staphylococcus
CSKEQTKTYEGDVNGKN

SEQ ID NO: 2094528 - protein, 134 aa, Staphylococcus
CSNDDSSKDKDSSKDDQSKTEQKDKASNDHSKDKSSDKESDKDDKNKDKDKNDNVASNDSNSTSSNQDSDHNQQASSNNNGSSSDQQAQNTNGNNNGATNNNQQPSNTNNNQGTPNQGSSNQDTQQPTQGNNGY

SEQ ID NO: 2094529 - protein, 157 aa, Staphylococcus
CSNGSDDDSSKKDDSSKDNQSSDDKSKDSKNDDKKNNDSDKDKDNNSDSDKNSDSKSDDSSSSDRNNGDDENSSDNASGSDSSSSNNDSNANSDGSSSNADGDNASGNNDNANNATSSESNGNENGAMNDANGSNSNDNASADANNGASSANTSQYV

SEQ ID NO: 2094530 - protein, 11 aa, Staphylococcus
CSNKTDSDLSH

SEQ ID NO: 2094531 - protein, 21 aa, Staphylococcus
CSNNDEKDKNTKDQKSETHMK

SEQ ID NO: 2094532 - protein, 21 aa, Staphylococcus
CSNNSGNKSNNENDSKDTVSI

SEQ ID NO: 2094533 - protein, 29 aa, Staphylococcus
CSNSSNSSKDSDKKDESSSDNSKKQELQI

SEQ ID NO: 2094534 - protein, 25 aa, Staphylococcus
CSNSSTDNGKKSDKADNGKKQELQI

SEQ ID NO: 2094535 - protein, 127 aa, Staphylococcus
CSQDDAKEDENKKSESTTEKKADDKKDKKTKEDKKSKEEKKSQENEDNESTQEDNSTEEQDTQETATNEQVQSQQQTQETATQEQQQTQQANNTQQTPQQQQNNQNYNQTQQTNQNVKLPKNTEIDD

SEQ ID NO: 2094536 - protein, 14 aa, Staphylococcus
CSQGGGIYDGKGQV

SEQ ID NO: 2094537 - protein, 22 aa, Staphylococcus
CSQGSNQSSDSNSTSKKGNNKV

SEQ ID NO: 2094538 - protein, 28 aa, Staphylococcus
CSQKDDENHNSKKDHVKTVQQGKGTKHQ

SEQ ID NO: 2094539 - protein, 15 aa, Staphylococcus
CSQKDPDLNSKNGKI

SEQ ID NO: 2094540 - protein, 23 aa, Staphylococcus
CSQSDKTQRSQHQNADKQSHTPY

SEQ ID NO: 2094541 - protein, 18 aa, Staphylococcus
CSQTSDQSNQNSKDTVSI

SEQ ID NO: 2094542 - protein, 7 aa, Staphylococcus
CSSDQSL

SEQ ID NO: 2094543 - protein, 23 aa, Staphylococcus
CSSDSTDSKDNTLISSKAGNVTV

SEQ ID NO: 2094544 - protein, 24 aa, Staphylococcus
CSSGGNDKKDDKKSSSSDSKQELR

SEQ ID NO: 2094545 - protein, 60 aa, Staphylococcus
CSTGQSNDNKGSSNLSDDKSQSSKSNKNSKNNNSNHALSQSSNDKSQEDANQENTHSNTY

SEQ ID NO: 2094546 - protein, 19 aa, Staphylococcus
CSTGQYSDAKKKDVSTNNK

SEQ ID NO: 2094547 - protein, 18 aa, Staphylococcus
CTNPEDTHKDDKTTSDGK

SEQ ID NO: 2094548 - protein, 15 aa, Staphylococcus
CTQSRSKTYEGDIDG

SEQ ID NO: 2094549 - protein, 41 aa, Staphylococcus
CTTDKGEIKDYNEQVQKAFDEEKPVSSVGKKLNSLEQDKQK

SEQ ID NO: 2094550 - protein, 6 aa, Staphylococcus
DAAESY

SEQ ID NO: 2094551 - protein, 92 aa, Staphylococcus
DAATSGGSSSSSSSSSSSSSSSSASSSAARGSTSSSSSMSRSSAANASRAAQQSSQRAAQQATRTSSIASSRNASKYKQGAYHTKSQQARSM

SEQ ID NO: 2094552 - protein, 23 aa, Staphylococcus
DADAAENNNSGYNPNDPSSYSYS

SEQ ID NO: 2094553 - protein, 14 aa, Staphylococcus
DADAATELSYITGN

SEQ ID NO: 2094554 - protein, 13 aa, Staphylococcus
DADDAAQLDYITG

SEQ ID NO: 2094555 - protein, 13 aa, Staphylococcus
DADDAAQLSYIKG

SEQ ID NO: 2094556 - protein, 13 aa, Staphylococcus
DADEPTKLKQKNS

SEQ ID NO: 2094557 - protein, 9 aa, Staphylococcus
DADKDQLEK

SEQ ID NO: 2094558 - protein, 15 aa, Staphylococcus
DAEASTQHKVKSGES

SEQ ID NO: 2094559 - protein, 13 aa, Staphylococcus
DAEDANDLDYIQG

SEQ ID NO: 2094560 - protein, 19 aa, Staphylococcus
DAEIEEPVYPGPATPEQLN

SEQ ID NO: 2094561 - protein, 17 aa, Staphylococcus
DAEIKEPVYPGPATLEQ

SEQ ID NO: 2094562 - protein, 19 aa, Staphylococcus
DAEIKEPVYPGPATPEQLN

SEQ ID NO: 2094563 - protein, 17 aa, Staphylococcus
DAEIKTPVYPGPATPEL

SEQ ID NO: 2094564 - protein, 8 aa, Staphylococcus
DAEKDGVS

SEQ ID NO: 2094565 - protein, 4 aa, Staphylococcus
DAEP

SEQ ID NO: 2094566 - protein, 5 aa, Staphylococcus
DAEPI

SEQ ID NO: 2094567 - protein, 5 aa, Staphylococcus
DAEPV

SEQ ID NO: 2094568 - protein, 7 aa, Staphylococcus
DAETGQV

SEQ ID NO: 2094569 - protein, 7 aa, Staphylococcus
DAGRGYR

SEQ ID NO: 2094570 - protein, 4 aa, Staphylococcus
DAGS

SEQ ID NO: 2094571 - protein, 10 aa, Staphylococcus
DAHKIGQDND

SEQ ID NO: 2094572 - protein, 10 aa, Staphylococcus
DAHQIGQKED

SEQ ID NO: 2094573 - protein, 13 aa, Staphylococcus
DAHSAELDPNTPY

SEQ ID NO: 2094574 - protein, 6 aa, Staphylococcus
DAIPLG

SEQ ID NO: 2094575 - protein, 22 aa, Staphylococcus
DAITNAKTRDEVAQKVAQAEAL

SEQ ID NO: 2094576 - protein, 7 aa, Staphylococcus
DAKDEDW

SEQ ID NO: 2094577 - protein, 4 aa, Staphylococcus
DAKG

SEQ ID NO: 2094578 - protein, 10 aa, Staphylococcus
DAKGSNAAKY

SEQ ID NO: 2094579 - protein, 14 aa, Staphylococcus
DAKKAGENKSADAL

SEQ ID NO: 2094580 - protein, 16 aa, Staphylococcus
DAKNMGQGVPFQNDSS

SEQ ID NO: 2094581 - protein, 9 aa, Staphylococcus
DAKNSFSNI

SEQ ID NO: 2094582 - protein, 23 aa, Staphylococcus
DAKSTISDNSKKDSDKKKAIKQV

SEQ ID NO: 2094583 - protein, 12 aa, Staphylococcus
DAKWSNGDPVTA

SEQ ID NO: 2094584 - protein, 10 aa, Staphylococcus
DALKSGDEYD

SEQ ID NO: 2094585 - protein, 26 aa, Staphylococcus
DALKTGEEHDTKEVYDKYKDSNEFKQ

SEQ ID NO: 2094586 - protein, 19 aa, Staphylococcus
DANGNEIDRVTTDENGNYK

SEQ ID NO: 2094587 - protein, 10 aa, Staphylococcus
DANKQAAEKI

SEQ ID NO: 2094588 - protein, 10 aa, Staphylococcus
DANRTNYQNN

SEQ ID NO: 2094589 - protein, 12 aa, Staphylococcus
DANSGQVIDIIE

SEQ ID NO: 2094590 - protein, 13 aa, Staphylococcus
DANTADQLSYISG

SEQ ID NO: 2094591 - protein, 26 aa, Staphylococcus
DANVSGPEWTSGDQHGKASLKNEKEY

SEQ ID NO: 2094592 - protein, 7 aa, Staphylococcus
DAPESNP

SEQ ID NO: 2094593 - protein, 8 aa, Staphylococcus
DAPKKNPM

SEQ ID NO: 2094594 - protein, 9 aa, Staphylococcus
DAPKQNPKL

SEQ ID NO: 2094595 - protein, 5 aa, Staphylococcus
DAPLD

SEQ ID NO: 2094596 - protein, 16 aa, Staphylococcus
DAPPTKDTKKAMDESQ

SEQ ID NO: 2094597 - protein, 16 aa, Staphylococcus
DAPPTKDTKKAMSESQ

SEQ ID NO: 2094598 - protein, 7 aa, Staphylococcus
DAPQSNP

SEQ ID NO: 2094599 - protein, 7 aa, Staphylococcus
DAPSKNP

SEQ ID NO: 2094600 - protein, 22 aa, Staphylococcus
DAQAAENNNGGYNPNDPTSYSY

SEQ ID NO: 2094601 - protein, 6 aa, Staphylococcus
DAQGNY

SEQ ID NO: 2094602 - protein, 10 aa, Staphylococcus
DAQKQALTTQ

SEQ ID NO: 2094603 - protein, 9 aa, Staphylococcus
DAQNDFSSA

SEQ ID NO: 2094604 - protein, 9 aa, Staphylococcus
DAQQTARAL

SEQ ID NO: 2094605 - protein, 10 aa, Staphylococcus
DAQQTARSLD

SEQ ID NO: 2094606 - protein, 10 aa, Staphylococcus
DAQRHDLETQ

SEQ ID NO: 2094607 - protein, 7 aa, Staphylococcus
DAQRQAF

SEQ ID NO: 2094608 - protein, 13 aa, Staphylococcus
DARDDSAKQTNDI

SEQ ID NO: 2094609 - protein, 9 aa, Staphylococcus
DASKDNSYS

SEQ ID NO: 2094610 - protein, 8 aa, Staphylococcus
DASTGEIL

SEQ ID NO: 2094611 - protein, 14 aa, Staphylococcus
DATDSDSVAFTEDT

SEQ ID NO: 2094612 - protein, 9 aa, Staphylococcus
DATHGNPRA

SEQ ID NO: 2094613 - protein, 4 aa, Staphylococcus
DATN

SEQ ID NO: 2094614 - protein, 6 aa, Staphylococcus
DATTNP

SEQ ID NO: 2094615 - protein, 31 aa, Staphylococcus
DDAYNTYNSDIDEDSMTSEDKQTKKNISSLN

SEQ ID NO: 2094616 - protein, 4 aa, Staphylococcus
DDDE

SEQ ID NO: 2094617 - protein, 7 aa, Staphylococcus
DDDNMAR

SEQ ID NO: 2094618 - protein, 8 aa, Staphylococcus
DDDNTARG

SEQ ID NO: 2094619 - protein, 15 aa, Staphylococcus
DDDVSYSVKPKSADV

SEQ ID NO: 2094620 - protein, 5 aa, Staphylococcus
DDEAG

SEQ ID NO: 2094621 - protein, 8 aa, Staphylococcus
DDEDAARG

SEQ ID NO: 2094622 - protein, 38 aa, Staphylococcus
DDEKNIKSFDDVKGKKLAQTFTSNYGKLAKDKGANITK

SEQ ID NO: 2094623 - protein, 8 aa, Staphylococcus
DDENAARG

SEQ ID NO: 2094624 - protein, 15 aa, Staphylococcus
DDETEGKAVSKDEVS

SEQ ID NO: 2094625 - protein, 7 aa, Staphylococcus
DDGSHVS

SEQ ID NO: 2094626 - protein, 9 aa, Staphylococcus
DDGSTEQIT

SEQ ID NO: 2094627 - protein, 6 aa, Staphylococcus
DDIKAT

SEQ ID NO: 2094628 - protein, 4 aa, Staphylococcus
DDIN

SEQ ID NO: 2094629 - protein, 5 aa, Staphylococcus
DDINP

SEQ ID NO: 2094630 - protein, 6 aa, Staphylococcus
DDKEWR

SEQ ID NO: 2094631 - protein, 11 aa, Staphylococcus
DDKGKATNQVH

SEQ ID NO: 2094632 - protein, 23 aa, Staphylococcus
DDKGKSAEDAGYVASPSKVYKDE

SEQ ID NO: 2094633 - protein, 9 aa, Staphylococcus
DDKGNPTNK

SEQ ID NO: 2094634 - protein, 14 aa, Staphylococcus
DDKGNQTKKLGDYY

SEQ ID NO: 2094635 - protein, 11 aa, Staphylococcus
DDKNGKAASAK

SEQ ID NO: 2094636 - protein, 10 aa, Staphylococcus
DDKYLNTGSL

SEQ ID NO: 2094637 - protein, 9 aa, Staphylococcus
DDKYVNTGN

SEQ ID NO: 2094638 - protein, 4 aa, Staphylococcus
DDLA

SEQ ID NO: 2094639 - protein, 10 aa, Staphylococcus
DDLIKKGKSV

SEQ ID NO: 2094640 - protein, 4 aa, Staphylococcus
DDLR

SEQ ID NO: 2094641 - protein, 19 aa, Staphylococcus
DDLSKTDTTDKDKKAFNDL

SEQ ID NO: 2094642 - protein, 7 aa, Staphylococcus
DDMDPVA

SEQ ID NO: 2094643 - protein, 6 aa, Staphylococcus
DDMNDW

SEQ ID NO: 2094644 - protein, 5 aa, Staphylococcus
DDNKV

SEQ ID NO: 2094645 - protein, 5 aa, Staphylococcus
DDNPL

SEQ ID NO: 2094646 - protein, 7 aa, Staphylococcus
DDNTIST

SEQ ID NO: 2094647 - protein, 6 aa, Staphylococcus
DDNVQR

SEQ ID NO: 2094648 - protein, 19 aa, Staphylococcus
DDQTTDEGVEQVKNTGLTT

SEQ ID NO: 2094649 - protein, 24 aa, Staphylococcus
DDQVEQSQIDKKSEAVSKSYKDMN

SEQ ID NO: 2094650 - protein, 17 aa, Staphylococcus
DDRNNMGQGVPFQNDSS

SEQ ID NO: 2094651 - protein, 33 aa, Staphylococcus
DDTILDPDKIKQQEQQSSQGGASMQQGAPGMTG

SEQ ID NO: 2094652 - protein, 19 aa, Staphylococcus
DDTLSSNYLNPRGQQDSLS

SEQ ID NO: 2094653 - protein, 7 aa, Staphylococcus
DDVEPME

SEQ ID NO: 2094654 - protein, 7 aa, Staphylococcus
DDVNEDD

SEQ ID NO: 2094655 - protein, 12 aa, Staphylococcus
DDVQDLSNTDLG

SEQ ID NO: 2094656 - protein, 8 aa, Staphylococcus
DDVQESDD

SEQ ID NO: 2094657 - protein, 10 aa, Staphylococcus
DDVSEPQRLE

SEQ ID NO: 2094658 - protein, 6 aa, Staphylococcus
DDWKPK

SEQ ID NO: 2094659 - protein, 12 aa, Staphylococcus
DDYKEQKKLAAY

SEQ ID NO: 2094660 - protein, 12 aa, Staphylococcus
DDYKEQKKLSAY

SEQ ID NO: 2094661 - protein, 12 aa, Staphylococcus
DDYKQQKKLAAY

SEQ ID NO: 2094662 - protein, 14 aa, Staphylococcus
DDYPKNIKKGRKQF

SEQ ID NO: 2094663 - protein, 14 aa, Staphylococcus
DDYPKNVKKGKQQF

SEQ ID NO: 2094664 - protein, 12 aa, Staphylococcus
DEADQQADYDKD

SEQ ID NO: 2094665 - protein, 75 aa, Staphylococcus
DEANSSIKESHSESVQENENQEEDSLSQQDIPEQDKSEQSKTEQDNTPSDNEADSETQNKKATDTSQQENEHDDS

SEQ ID NO: 2094666 - protein, 4 aa, Staphylococcus
DEAQ

SEQ ID NO: 2094667 - protein, 18 aa, Staphylococcus
DEATIKKDVRKAKEHSDA

SEQ ID NO: 2094668 - protein, 14 aa, Staphylococcus
DEDRVAEDSNTPTF

SEQ ID NO: 2094669 - protein, 17 aa, Staphylococcus
DEEANNKPINERVSQAE

SEQ ID NO: 2094670 - protein, 10 aa, Staphylococcus
DEELAPEGKT

SEQ ID NO: 2094671 - protein, 22 aa, Staphylococcus
DEFPPIRTGNDYRIDTTRTDNN

SEQ ID NO: 2094672 - protein, 11 aa, Staphylococcus
DEGKSAEDAGY

SEQ ID NO: 2094673 - protein, 7 aa, Staphylococcus
DEGKYGT

SEQ ID NO: 2094674 - protein, 8 aa, Staphylococcus
DEGQRDQR

SEQ ID NO: 2094675 - protein, 4 aa, Staphylococcus
DEID

SEQ ID NO: 2094676 - protein, 5 aa, Staphylococcus
DEIDD

SEQ ID NO: 2094677 - protein, 26 aa, Staphylococcus
DEILEQKESKIEEKQQQVDTKESSVQ

SEQ ID NO: 2094678 - protein, 26 aa, Staphylococcus
DEILEQKESKLEERQQQVDAKESSVQ

SEQ ID NO: 2094679 - protein, 27 aa, Staphylococcus
DEILEQKESKLEERQQQVDAKESSVQT

SEQ ID NO: 2094680 - protein, 80 aa, Staphylococcus
DEINGETTTDKKKKYEDTLPPINQNLEKTEQTTEEMHRRPTDYDDSIPKPDPTPYHNEKDIREPVKPTSSRDENSENLRK

SEQ ID NO: 2094681 - protein, 12 aa, Staphylococcus
DEIRRNNPELEK

SEQ ID NO: 2094682 - protein, 14 aa, Staphylococcus
DEKHKEDIESHSKD

SEQ ID NO: 2094683 - protein, 5 aa, Staphylococcus
DEKNL

SEQ ID NO: 2094684 - protein, 9 aa, Staphylococcus
DEKPLQNEM

SEQ ID NO: 2094685 - protein, 7 aa, Staphylococcus
DELEKTV

SEQ ID NO: 2094686 - protein, 20 aa, Staphylococcus
DELEKTVDDINQEGGKATAY

SEQ ID NO: 2094687 - protein, 16 aa, Staphylococcus
DELNDEPEKKQRREFE

SEQ ID NO: 2094688 - protein, 157 aa, Staphylococcus
DELNDQTSEQTSNQDTYNQETDVQEDQQDVSSDNDTKSLDTEQTSVEDNNQENEENNTDSIQSETNSTNEASQTSNDVSSNAEETNTDENSSDVANQNEPVAQNDKAETSNEDVASSDVKQDGTHSDANTSDVADKNESETQDDKAETSNEDVASSY

SEQ ID NO: 2094689 - protein, 199 aa, Staphylococcus
DELNGSSSKTSQDQSNNSAQTDQQTQDANVTISNKEDASTQDDHKEASQSEQHEQHEQDATSPSTKEDLKSDNNEDVSQPEQQNHESSLDKNEVTSQSEEVAHPSNTEDSKSNESQQVDNSSTNEQYASQTQSNDNKELDTTQSSLNKTNEKENSETSISNSSHSNHQTTKNSNSQQPTDEETNQSSAKVSSTNQSGYN

SEQ ID NO: 2094690 - protein, 8 aa, Staphylococcus
DELTPRNA

SEQ ID NO: 2094691 - protein, 13 aa, Staphylococcus
DEMRQRTKGIAGS

SEQ ID NO: 2094692 - protein, 11 aa, Staphylococcus
DENPEASITES

SEQ ID NO: 2094693 - protein, 4 aa, Staphylococcus
DENT

SEQ ID NO: 2094694 - protein, 5 aa, Staphylococcus
DEPGM

SEQ ID NO: 2094695 - protein, 6 aa, Staphylococcus
DEPKDY

SEQ ID NO: 2094696 - protein, 19 aa, Staphylococcus
DEQGRTIATTVTDKNGKYG

SEQ ID NO: 2094697 - protein, 10 aa, Staphylococcus
DEQKGKKNQL

SEQ ID NO: 2094698 - protein, 4 aa, Staphylococcus
DEQY

SEQ ID NO: 2094699 - protein, 6 aa, Staphylococcus
DESDIE

SEQ ID NO: 2094700 - protein, 4 aa, Staphylococcus
DESG

SEQ ID NO: 2094701 - protein, 5 aa, Staphylococcus
DESMH

SEQ ID NO: 2094702 - protein, 17 aa, Staphylococcus
DESMKDELKQFIKKLNI

SEQ ID NO: 2094703 - protein, 6 aa, Staphylococcus
DESTRY

SEQ ID NO: 2094704 - protein, 4 aa, Staphylococcus
DETF

SEQ ID NO: 2094705 - protein, 8 aa, Staphylococcus
DETGPKYP

SEQ ID NO: 2094706 - protein, 7 aa, Staphylococcus
DETKHNV

SEQ ID NO: 2094707 - protein, 6 aa, Staphylococcus
DETNKS

SEQ ID NO: 2094708 - protein, 7 aa, Staphylococcus
DETREYK

SEQ ID NO: 2094709 - protein, 14 aa, Staphylococcus
DETSAKDIHPNNRK

SEQ ID NO: 2094710 - protein, 26 aa, Staphylococcus
DEVDTKFSYQEKERIKKSMLDLNNMT

SEQ ID NO: 2094711 - protein, 11 aa, Staphylococcus
DEVNQKQDKLE

SEQ ID NO: 2094712 - protein, 8 aa, Staphylococcus
DEVSQSDD

SEQ ID NO: 2094713 - protein, 4 aa, Staphylococcus
DEWR

SEQ ID NO: 2094714 - protein, 6 aa, Staphylococcus
DEYASA

SEQ ID NO: 2094715 - protein, 12 aa, Staphylococcus
DEYKDQKRLSAY

SEQ ID NO: 2094716 - protein, 10 aa, Staphylococcus
DFDNSDEAPV

SEQ ID NO: 2094717 - protein, 41 aa, Staphylococcus
DFDTKGAKDFNDLSEKDKEKLAKEINKSYKDNFKKITKKLE

SEQ ID NO: 2094718 - protein, 19 aa, Staphylococcus
DFEQEGVNGMNDDEPSQKK

SEQ ID NO: 2094719 - protein, 22 aa, Staphylococcus
DFKNGTTKDGVKAFDGTGPFKM

SEQ ID NO: 2094720 - protein, 7 aa, Staphylococcus
DFNSSDE

SEQ ID NO: 2094721 - protein, 12 aa, Staphylococcus
DFPKKSNGGKTL

SEQ ID NO: 2094722 - protein, 15 aa, Staphylococcus
DFPTTVSKKEQQRSF

SEQ ID NO: 2094723 - protein, 12 aa, Staphylococcus
DFQSQSLNQHSR

SEQ ID NO: 2094724 - protein, 10 aa, Staphylococcus
DFSLNGQKGV

SEQ ID NO: 2094725 - protein, 11 aa, Staphylococcus
DFSRRKDGKWE

SEQ ID NO: 2094726 - protein, 11 aa, Staphylococcus
DFTANKGDGYD

SEQ ID NO: 2094727 - protein, 22 aa, Staphylococcus
DGATQSEVDSKSKDLSKAYKDM

SEQ ID NO: 2094728 - protein, 10 aa, Staphylococcus
DGDEDTPNVE

SEQ ID NO: 2094729 - protein, 14 aa, Staphylococcus
DGDGQTFKALSGAN

SEQ ID NO: 2094730 - protein, 10 aa, Staphylococcus
DGDYKENINA

SEQ ID NO: 2094731 - protein, 13 aa, Staphylococcus
DGEKPPKDMRGKK

SEQ ID NO: 2094732 - protein, 5 aa, Staphylococcus
DGESV

SEQ ID NO: 2094733 - protein, 41 aa, Staphylococcus
DGEVQYKSGNFGNYSTLNSEDCYTGQDITTKPYKEPKHVAK

SEQ ID NO: 2094734 - protein, 4 aa, Staphylococcus
DGFN

SEQ ID NO: 2094735 - protein, 5 aa, Staphylococcus
DGFNQ

SEQ ID NO: 2094736 - protein, 10 aa, Staphylococcus
DGGEDTPNVE

SEQ ID NO: 2094737 - protein, 4 aa, Staphylococcus
DGKH

SEQ ID NO: 2094738 - protein, 4 aa, Staphylococcus
DGKW

SEQ ID NO: 2094739 - protein, 10 aa, Staphylococcus
DGMEKSITEL

SEQ ID NO: 2094740 - protein, 12 aa, Staphylococcus
DGNEDAIKSVEN

SEQ ID NO: 2094741 - protein, 12 aa, Staphylococcus
DGNFPVQGRSVK

SEQ ID NO: 2094742 - protein, 9 aa, Staphylococcus
DGNIKEGKQ

SEQ ID NO: 2094743 - protein, 22 aa, Staphylococcus
DGNIKSGKKISTVDYNKSQQTF

SEQ ID NO: 2094744 - protein, 7 aa, Staphylococcus
DGNNARA

SEQ ID NO: 2094745 - protein, 9 aa, Staphylococcus
DGNQSALDE

SEQ ID NO: 2094746 - protein, 7 aa, Staphylococcus
DGNYNQN

SEQ ID NO: 2094747 - protein, 22 aa, Staphylococcus
DGNYTNASPQEQGAYTDAYQRA

SEQ ID NO: 2094748 - protein, 7 aa, Staphylococcus
DGQKDHG

SEQ ID NO: 2094749 - protein, 17 aa, Staphylococcus
DGQLQVSNQNKPGPKAF

SEQ ID NO: 2094750 - protein, 12 aa, Staphylococcus
DGQVDTSKVGKY

SEQ ID NO: 2094751 - protein, 10 aa, Staphylococcus
DGRDMPESKV

SEQ ID NO: 2094752 - protein, 8 aa, Staphylococcus
DGRPELPK

SEQ ID NO: 2094753 - protein, 15 aa, Staphylococcus
DGSFPVQGKSVKSTL

SEQ ID NO: 2094754 - protein, 11 aa, Staphylococcus
DGSKSERAQKI

SEQ ID NO: 2094755 - protein, 7 aa, Staphylococcus
DGSTRII

SEQ ID NO: 2094756 - protein, 13 aa, Staphylococcus
DGSVEKFDAKGQP

SEQ ID NO: 2094757 - protein, 41 aa, Staphylococcus
DGTTITIPKGKDGVDGKKGEDGKTPKIEQTPITDSSGKQIG

SEQ ID NO: 2094758 - protein, 11 aa, Staphylococcus
DGVSESTEKTV

SEQ ID NO: 2094759 - protein, 22 aa, Staphylococcus
DGVSKDYKVADKSGQAITYASR

SEQ ID NO: 2094760 - protein, 25 aa, Staphylococcus
DGVTQSQVDEKNDALNKAQKNFQNK

SEQ ID NO: 2094761 - protein, 23 aa, Staphylococcus
DGVTQSQVDEKNNALNKAQENFK

SEQ ID NO: 2094762 - protein, 7 aa, Staphylococcus
DGWAEVK

SEQ ID NO: 2094763 - protein, 8 aa, Staphylococcus
DGYAGQNA

SEQ ID NO: 2094764 - protein, 13 aa, Staphylococcus
DGYDDKAKTDLPV

SEQ ID NO: 2094765 - protein, 4 aa, Staphylococcus
DGYF

SEQ ID NO: 2094766 - protein, 9 aa, Staphylococcus
DGYGNEETL

SEQ ID NO: 2094767 - protein, 20 aa, Staphylococcus
DHDHEDHDQHHSHEEESHDP

SEQ ID NO: 2094768 - protein, 13 aa, Staphylococcus
DHDVTAEATNYYN

SEQ ID NO: 2094769 - protein, 9 aa, Staphylococcus
DHKPEKGAI

SEQ ID NO: 2094770 - protein, 17 aa, Staphylococcus
DHKSMQSLSEETGVPIS

SEQ ID NO: 2094771 - protein, 12 aa, Staphylococcus
DHKTLKDTKIRE

SEQ ID NO: 2094772 - protein, 12 aa, Staphylococcus
DHNGKPSKMTDN

SEQ ID NO: 2094773 - protein, 5 aa, Staphylococcus
DHNQG

SEQ ID NO: 2094774 - protein, 14 aa, Staphylococcus
DHNSQNNASQDDIA

SEQ ID NO: 2094775 - protein, 28 aa, Staphylococcus
DHQQVENSSPFINEDSPEQNAYTNAVQQ

SEQ ID NO: 2094776 - protein, 16 aa, Staphylococcus
DIAPNNTPNNLVNPTT

SEQ ID NO: 2094777 - protein, 14 aa, Staphylococcus
DIDGQANIDEQTLN

SEQ ID NO: 2094778 - protein, 11 aa, Staphylococcus
DIKQQGGQATA

SEQ ID NO: 2094779 - protein, 6 aa, Staphylococcus
DINPNI

SEQ ID NO: 2094780 - protein, 17 aa, Staphylococcus
DINPVSQNNHTAHAEGK

SEQ ID NO: 2094781 - protein, 18 aa, Staphylococcus
DINQTNISDKNVNDARKN

SEQ ID NO: 2094782 - protein, 18 aa, Staphylococcus
DINQTNISDQHVDNARKN

SEQ ID NO: 2094783 - protein, 33 aa, Staphylococcus
DINTATQNVNNAEQGLNGNTNLANAKQEATNAL

SEQ ID NO: 2094784 - protein, 25 aa, Staphylococcus
DINTRNLSKTTAKNGQYTVKATNNG

SEQ ID NO: 2094785 - protein, 10 aa, Staphylococcus
DIPAETKNGG

SEQ ID NO: 2094786 - protein, 6 aa, Staphylococcus
DIPQDA

SEQ ID NO: 2094787 - protein, 25 aa, Staphylococcus
DIQGNDKLAIGEAKSVPAGKYAEQY

SEQ ID NO: 2094788 - protein, 30 aa, Staphylococcus
DIREGYNGKDKKKIQKGQNALSTISINNSQ

SEQ ID NO: 2094789 - protein, 11 aa, Staphylococcus
DIRKTNNQENA

SEQ ID NO: 2094790 - protein, 7 aa, Staphylococcus
DISEDPS

SEQ ID NO: 2094791 - protein, 10 aa, Staphylococcus
DISKGEPRSV

SEQ ID NO: 2094792 - protein, 10 aa, Staphylococcus
DISKLTDTEL

SEQ ID NO: 2094793 - protein, 10 aa, Staphylococcus
DITESTNKTL

SEQ ID NO: 2094794 - protein, 7 aa, Staphylococcus
DITGGAL

SEQ ID NO: 2094795 - protein, 7 aa, Staphylococcus
DITGKKA

SEQ ID NO: 2094796 - protein, 18 aa, Staphylococcus
DKAAEKKKGKAKRQDIKE

SEQ ID NO: 2094797 - protein, 13 aa, Staphylococcus
DKAKDILKKYQFD

SEQ ID NO: 2094798 - protein, 13 aa, Staphylococcus
DKAKQIIKDYQFS

SEQ ID NO: 2094799 - protein, 46 aa, Staphylococcus
DKAPLEAAKQALQQSINQPTNTTGMTQSSVNAYNEKLEQAKAKLAS

SEQ ID NO: 2094800 - protein, 15 aa, Staphylococcus
DKATGPNSDKQAVEQ

SEQ ID NO: 2094801 - protein, 8 aa, Staphylococcus
DKAWREND

SEQ ID NO: 2094802 - protein, 6 aa, Staphylococcus
DKDAWD

SEQ ID NO: 2094803 - protein, 24 aa, Staphylococcus
DKDDKAQPGVAKAMPKESNGGKTL

SEQ ID NO: 2094804 - protein, 15 aa, Staphylococcus
DKDHGDDLTQSQVEQ

SEQ ID NO: 2094805 - protein, 10 aa, Staphylococcus
DKDKAHDTYK

SEQ ID NO: 2094806 - protein, 10 aa, Staphylococcus
DKDKGVKAGL

SEQ ID NO: 2094807 - protein, 7 aa, Staphylococcus
DKDKTSA

SEQ ID NO: 2094808 - protein, 8 aa, Staphylococcus
DKDKTSAL

SEQ ID NO: 2094809 - protein, 33 aa, Staphylococcus
DKDNSDKIENYDKTVSKANKNDKPTIPKDKAEM

SEQ ID NO: 2094810 - protein, 7 aa, Staphylococcus
DKDQTVT

SEQ ID NO: 2094811 - protein, 19 aa, Staphylococcus
DKDSTQSSVKDLKGNEKLA

SEQ ID NO: 2094812 - protein, 16 aa, Staphylococcus
DKDVDGTVNPKQANIN

SEQ ID NO: 2094813 - protein, 11 aa, Staphylococcus
DKEDPQKVAEE

SEQ ID NO: 2094814 - protein, 6 aa, Staphylococcus
DKEINS

SEQ ID NO: 2094815 - protein, 9 aa, Staphylococcus
DKEKNDRYG

SEQ ID NO: 2094816 - protein, 15 aa, Staphylococcus
DKENDFDKEKGKLKA

SEQ ID NO: 2094817 - protein, 15 aa, Staphylococcus
DKENDFNKEKSNLKE

SEQ ID NO: 2094818 - protein, 13 aa, Staphylococcus
DKEQSKTYEGDLQ

SEQ ID NO: 2094819 - protein, 15 aa, Staphylococcus
DKESDFDKQKSKLKA

SEQ ID NO: 2094820 - protein, 15 aa, Staphylococcus
DKESDFNSEKANIKE

SEQ ID NO: 2094821 - protein, 16 aa, Staphylococcus
DKETDFNSEKSNLKSK

SEQ ID NO: 2094822 - protein, 14 aa, Staphylococcus
DKGDIKAEKNADTN

SEQ ID NO: 2094823 - protein, 7 aa, Staphylococcus
DKGDKVT

SEQ ID NO: 2094824 - protein, 9 aa, Staphylococcus
DKGDVDANA

SEQ ID NO: 2094825 - protein, 5 aa, Staphylococcus
DKGEL

SEQ ID NO: 2094826 - protein, 7 aa, Staphylococcus
DKGELDA

SEQ ID NO: 2094827 - protein, 9 aa, Staphylococcus
DKGKEASLE

SEQ ID NO: 2094828 - protein, 10 aa, Staphylococcus
DKGKIKLTDE

SEQ ID NO: 2094829 - protein, 10 aa, Staphylococcus
DKGKSAEDAG

SEQ ID NO: 2094830 - protein, 11 aa, Staphylococcus
DKGKSAEKAGY

SEQ ID NO: 2094831 - protein, 7 aa, Staphylococcus
DKGKTEL

SEQ ID NO: 2094832 - protein, 6 aa, Staphylococcus
DKGNAY

SEQ ID NO: 2094833 - protein, 12 aa, Staphylococcus
DKGSSSQKEQAE

SEQ ID NO: 2094834 - protein, 7 aa, Staphylococcus
DKGSYRT

SEQ ID NO: 2094835 - protein, 7 aa, Staphylococcus
DKGTVSF

SEQ ID NO: 2094836 - protein, 7 aa, Staphylococcus
DKISAKR

SEQ ID NO: 2094837 - protein, 4 aa, Staphylococcus
DKKA

SEQ ID NO: 2094838 - protein, 6 aa, Staphylococcus
DKKATY

SEQ ID NO: 2094839 - protein, 5 aa, Staphylococcus
DKKDA

SEQ ID NO: 2094840 - protein, 9 aa, Staphylococcus
DKKGNKTNK

SEQ ID NO: 2094841 - protein, 17 aa, Staphylococcus
DKKGVKRKEIKNPGGLK

SEQ ID NO: 2094842 - protein, 10 aa, Staphylococcus
DKKKGIKAGL

SEQ ID NO: 2094843 - protein, 10 aa, Staphylococcus
DKKKNKGFKF

SEQ ID NO: 2094844 - protein, 6 aa, Staphylococcus
DKKNQE

SEQ ID NO: 2094845 - protein, 28 aa, Staphylococcus
DKKPITIEAKNPDGYTTKEIGKKIIKLE

SEQ ID NO: 2094846 - protein, 9 aa, Staphylococcus
DKKSKKASL

SEQ ID NO: 2094847 - protein, 10 aa, Staphylococcus
DKKVGNGSKK

SEQ ID NO: 2094848 - protein, 12 aa, Staphylococcus
DKKVTAKQISDK

SEQ ID NO: 2094849 - protein, 6 aa, Staphylococcus
DKKYNN

SEQ ID NO: 2094850 - protein, 6 aa, Staphylococcus
DKLAEK

SEQ ID NO: 2094851 - protein, 8 aa, Staphylococcus
DKLARKNA

SEQ ID NO: 2094852 - protein, 20 aa, Staphylococcus
DKLDDTVKEINETGGQATAY

SEQ ID NO: 2094853 - protein, 6 aa, Staphylococcus
DKLKNG

SEQ ID NO: 2094854 - protein, 33 aa, Staphylococcus
DKLNEMNEEISGEHTKHKKVQHDKNTSQPVYKD

SEQ ID NO: 2094855 - protein, 29 aa, Staphylococcus
DKLQKENKSLKATKDKLKKQKKDTQERVD

SEQ ID NO: 2094856 - protein, 5 aa, Staphylococcus
DKMGG

SEQ ID NO: 2094857 - protein, 19 aa, Staphylococcus
DKNGKKDDKKDKDKKDKKD

SEQ ID NO: 2094858 - protein, 4 aa, Staphylococcus
DKNI

SEQ ID NO: 2094859 - protein, 15 aa, Staphylococcus
DKNMGQGVPFQNDSS

SEQ ID NO: 2094860 - protein, 15 aa, Staphylococcus
DKNRNGIQDIGEEGI

SEQ ID NO: 2094861 - protein, 19 aa, Staphylococcus
DKNSDKSSVKDLKDNEKLA

SEQ ID NO: 2094862 - protein, 19 aa, Staphylococcus
DKNSDQASVKDLKDNEKLA

SEQ ID NO: 2094863 - protein, 16 aa, Staphylococcus
DKNTANQVADAWDDVG

SEQ ID NO: 2094864 - protein, 9 aa, Staphylococcus
DKNTKKEWR

SEQ ID NO: 2094865 - protein, 29 aa, Staphylococcus
DKNTRTALKNSYSNLKEGKRNENAQPSKF

SEQ ID NO: 2094866 - protein, 8 aa, Staphylococcus
DKPLEMRK

SEQ ID NO: 2094867 - protein, 13 aa, Staphylococcus
DKPLLEKQENDKV

SEQ ID NO: 2094868 - protein, 15 aa, Staphylococcus
DKPTDFSSERSKLKS

SEQ ID NO: 2094869 - protein, 26 aa, Staphylococcus
DKQATKDSTPTDNDDDQSKDGLNTLT

SEQ ID NO: 2094870 - protein, 9 aa, Staphylococcus
DKQDKLTGY

SEQ ID NO: 2094871 - protein, 9 aa, Staphylococcus
DKQEKPATQ

SEQ ID NO: 2094872 - protein, 27 aa, Staphylococcus
DKQGRTNMGSRPYGGMPPKGMTSEQYN

SEQ ID NO: 2094873 - protein, 17 aa, Staphylococcus
DKQGVQKSYVNGQTYKL

SEQ ID NO: 2094874 - protein, 4 aa, Staphylococcus
DKQM

SEQ ID NO: 2094875 - protein, 15 aa, Staphylococcus
DKQNQSTYKNHGKTY

SEQ ID NO: 2094876 - protein, 21 aa, Staphylococcus
DKQSDSSPKITKSQANKLSEL

SEQ ID NO: 2094877 - protein, 7 aa, Staphylococcus
DKQSETD

SEQ ID NO: 2094878 - protein, 7 aa, Staphylococcus
DKQSETG

SEQ ID NO: 2094879 - protein, 8 aa, Staphylococcus
DKQSETGI

SEQ ID NO: 2094880 - protein, 29 aa, Staphylococcus
DKQTGTDTKITDKQAKRLSELSHNSVKND

SEQ ID NO: 2094881 - protein, 8 aa, Staphylococcus
DKQVGASL

SEQ ID NO: 2094882 - protein, 10 aa, Staphylococcus
DKRAKQKGLA

SEQ ID NO: 2094883 - protein, 9 aa, Staphylococcus
DKREKTFDK

SEQ ID NO: 2094884 - protein, 6 aa, Staphylococcus
DKRELI

SEQ ID NO: 2094885 - protein, 6 aa, Staphylococcus
DKRGFN

SEQ ID NO: 2094886 - protein, 7 aa, Staphylococcus
DKRPVGK

SEQ ID NO: 2094887 - protein, 8 aa, Staphylococcus
DKSHKELG

SEQ ID NO: 2094888 - protein, 4 aa, Staphylococcus
DKSI

SEQ ID NO: 2094889 - protein, 10 aa, Staphylococcus
DKSITATSNL

SEQ ID NO: 2094890 - protein, 15 aa, Staphylococcus
DKSKAQKDEVKSENK

SEQ ID NO: 2094891 - protein, 9 aa, Staphylococcus
DKSKKRPIN

SEQ ID NO: 2094892 - protein, 27 aa, Staphylococcus
DKSQRVEHKKSEKGDQDHSDDQDTFKY

SEQ ID NO: 2094893 - protein, 7 aa, Staphylococcus
DKSQWDA

SEQ ID NO: 2094894 - protein, 10 aa, Staphylococcus
DKSRHQGRTG

SEQ ID NO: 2094895 - protein, 7 aa, Staphylococcus
DKSRPSF

SEQ ID NO: 2094896 - protein, 16 aa, Staphylococcus
DKSTADKVNQSWEDVG

SEQ ID NO: 2094897 - protein, 6 aa, Staphylococcus
DKSTYQ

SEQ ID NO: 2094898 - protein, 5 aa, Staphylococcus
DKSYV

SEQ ID NO: 2094899 - protein, 24 aa, Staphylococcus
DKTGKKTNQVQKTLSVTKQATLGN

SEQ ID NO: 2094900 - protein, 12 aa, Staphylococcus
DKTGKSTDQVQK

SEQ ID NO: 2094901 - protein, 5 aa, Staphylococcus
DKTGM

SEQ ID NO: 2094902 - protein, 8 aa, Staphylococcus
DKTPLENA

SEQ ID NO: 2094903 - protein, 7 aa, Staphylococcus
DKTTDMQ

SEQ ID NO: 2094904 - protein, 20 aa, Staphylococcus
DKVESVKNDKPNAKYVKEDN

SEQ ID NO: 2094905 - protein, 13 aa, Staphylococcus
DKVSSDSSFSGKR

SEQ ID NO: 2094906 - protein, 17 aa, Staphylococcus
DKVTDTDPSDIKAYLSN

SEQ ID NO: 2094907 - protein, 6 aa, Staphylococcus
DKVTPN

SEQ ID NO: 2094908 - protein, 9 aa, Staphylococcus
DKVVKDNRH

SEQ ID NO: 2094909 - protein, 18 aa, Staphylococcus
DKVYSKEDRSYFKGEKGY

SEQ ID NO: 2094910 - protein, 23 aa, Staphylococcus
DKWKSQTKKDGQEIKDKIGEDAT

SEQ ID NO: 2094911 - protein, 10 aa, Staphylococcus
DKYETNSDDK

SEQ ID NO: 2094912 - protein, 8 aa, Staphylococcus
DKYINSGN

SEQ ID NO: 2094913 - protein, 8 aa, Staphylococcus
DKYINTGK

SEQ ID NO: 2094914 - protein, 8 aa, Staphylococcus
DKYINTGS

SEQ ID NO: 2094915 - protein, 30 aa, Staphylococcus
DKYKDDVNTKDIDKEVEKEQKQYGGKDQFE

SEQ ID NO: 2094916 - protein, 39 aa, Staphylococcus
DKYKDKVDTKDIDDEIKQEQKKYGGKDQFESTLKQQGMS

SEQ ID NO: 2094917 - protein, 8 aa, Staphylococcus
DKYPNESF

SEQ ID NO: 2094918 - protein, 6 aa, Staphylococcus
DKYWDR

SEQ ID NO: 2094919 - protein, 7 aa, Staphylococcus
DKYYRGD

SEQ ID NO: 2094920 - protein, 17 aa, Staphylococcus
DLDKDMKRAVKGQEGKT

SEQ ID NO: 2094921 - protein, 5 aa, Staphylococcus
DLDKY

SEQ ID NO: 2094922 - protein, 11 aa, Staphylococcus
DLDQSTQSQWY

SEQ ID NO: 2094923 - protein, 23 aa, Staphylococcus
DLEGQDLQQTENDLGVDDNYETY

SEQ ID NO: 2094924 - protein, 16 aa, Staphylococcus
DLEKHKDDLRLGTDST

SEQ ID NO: 2094925 - protein, 8 aa, Staphylococcus
DLEKHKDE

SEQ ID NO: 2094926 - protein, 14 aa, Staphylococcus
DLEQANSNNPATPY

SEQ ID NO: 2094927 - protein, 11 aa, Staphylococcus
DLGSEDKDEDF

SEQ ID NO: 2094928 - protein, 49 aa, Staphylococcus
DLKDSKKFDKEIQGTDARNGVMKQTKSELDEDNLDGYSLKESSDQDQFK

SEQ ID NO: 2094929 - protein, 8 aa, Staphylococcus
DLKENDKL

SEQ ID NO: 2094930 - protein, 8 aa, Staphylococcus
DLKKYKDE

SEQ ID NO: 2094931 - protein, 27 aa, Staphylococcus
DLKNDKATDHPSPSDKDDQSKKGLNTL

SEQ ID NO: 2094932 - protein, 14 aa, Staphylococcus
DLNDPQKSALKEQV

SEQ ID NO: 2094933 - protein, 8 aa, Staphylococcus
DLNQAQKN

SEQ ID NO: 2094934 - protein, 18 aa, Staphylococcus
DLNQTNITDSHVNNARKN

SEQ ID NO: 2094935 - protein, 19 aa, Staphylococcus
DLNSTTKTPSVTKSAVTPI

SEQ ID NO: 2094936 - protein, 17 aa, Staphylococcus
DLNTQNIVSSSDSFGIT

SEQ ID NO: 2094937 - protein, 18 aa, Staphylococcus
DLNTSNLVSSDESFGITK

SEQ ID NO: 2094938 - protein, 9 aa, Staphylococcus
DLPKSTEMN

SEQ ID NO: 2094939 - protein, 8 aa, Staphylococcus
DLQKRGEV

SEQ ID NO: 2094940 - protein, 13 aa, Staphylococcus
DLQNNADALNTSM

SEQ ID NO: 2094941 - protein, 4 aa, Staphylococcus
DLQQ

SEQ ID NO: 2094942 - protein, 7 aa, Staphylococcus
DLSKESI

SEQ ID NO: 2094943 - protein, 4 aa, Staphylococcus
DLSQ

SEQ ID NO: 2094944 - protein, 4 aa, Staphylococcus
DLTK

SEQ ID NO: 2094945 - protein, 14 aa, Staphylococcus
DLTQNSTDAQATPY

SEQ ID NO: 2094946 - protein, 5 aa, Staphylococcus
DLTYD

SEQ ID NO: 2094947 - protein, 13 aa, Staphylococcus
DLVNSGKKPVSEL

SEQ ID NO: 2094948 - protein, 19 aa, Staphylococcus
DMDPAAGKIAKTIKNKDDV

SEQ ID NO: 2094949 - protein, 13 aa, Staphylococcus
DMKEEKKEDQWTG

SEQ ID NO: 2094950 - protein, 13 aa, Staphylococcus
DMKQISKDKKRDK

SEQ ID NO: 2094951 - protein, 4 aa, Staphylococcus
DMNT

SEQ ID NO: 2094952 - protein, 5 aa, Staphylococcus
DMSSL

SEQ ID NO: 2094953 - protein, 13 aa, Staphylococcus
DNALEGKIGTLIK

SEQ ID NO: 2094954 - protein, 13 aa, Staphylococcus
DNAPHLNEQQKNV

SEQ ID NO: 2094955 - protein, 20 aa, Staphylococcus
DNATTEVNGLNGQSNPYNDY

SEQ ID NO: 2094956 - protein, 5 aa, Staphylococcus
DNDGK

SEQ ID NO: 2094957 - protein, 18 aa, Staphylococcus
DNDKNFTDDNQRAGVDAN

SEQ ID NO: 2094958 - protein, 18 aa, Staphylococcus
DNDSRRKNGQSTEHSRTD

SEQ ID NO: 2094959 - protein, 4 aa, Staphylococcus
DNDV

SEQ ID NO: 2094960 - protein, 41 aa, Staphylococcus
DNEAKAAEENHMENTSLNSIENDNDKNNQKIDSSNETATTS

SEQ ID NO: 2094961 - protein, 17 aa, Staphylococcus
DNEGREKNGQSIEHSRS

SEQ ID NO: 2094962 - protein, 18 aa, Staphylococcus
DNEGREKNGQSLEHSRSD

SEQ ID NO: 2094963 - protein, 38 aa, Staphylococcus
DNEKDIKSFDDVKGKKLAQTFTSNYGKLAKDKGADITK

SEQ ID NO: 2094964 - protein, 7 aa, Staphylococcus
DNEKEKQ

SEQ ID NO: 2094965 - protein, 19 aa, Staphylococcus
DNETTRTAVKNDVTEAQQL

SEQ ID NO: 2094966 - protein, 13 aa, Staphylococcus
DNGDKQSDSRTYG

SEQ ID NO: 2094967 - protein, 12 aa, Staphylococcus
DNGQVGENHSHM

SEQ ID NO: 2094968 - protein, 10 aa, Staphylococcus
DNGVEGAPSN

SEQ ID NO: 2094969 - protein, 12 aa, Staphylococcus
DNHKSNPYNDYG

SEQ ID NO: 2094970 - protein, 31 aa, Staphylococcus
DNHSSESLQKIGEAETESTVNAARDEGINNI

SEQ ID NO: 2094971 - protein, 9 aa, Staphylococcus
DNKADFGEI

SEQ ID NO: 2094972 - protein, 8 aa, Staphylococcus
DNKDRQQP

SEQ ID NO: 2094973 - protein, 28 aa, Staphylococcus
DNKETQSDSKRKDAGTVTIDDGTDNYDI

SEQ ID NO: 2094974 - protein, 11 aa, Staphylococcus
DNKGKKTDQVQ

SEQ ID NO: 2094975 - protein, 8 aa, Staphylococcus
DNKGNQTH

SEQ ID NO: 2094976 - protein, 5 aa, Staphylococcus
DNKKH

SEQ ID NO: 2094977 - protein, 5 aa, Staphylococcus
DNKTQ

SEQ ID NO: 2094978 - protein, 64 aa, Staphylococcus
DNLDDASNHAQDTQRRHDSEASKDDDKETSSEEKPHQEAPSHDTAQDKQNDSNKEATDSASDAV

SEQ ID NO: 2094979 - protein, 119 aa, Staphylococcus
DNLNQSASSQNNSTRSNTNDTVKNSDTISNYQSDNTKHNNNEVATTSTTSTDSTKLVTSEDSNHKLNSNHITTETPSTHNESAQVSNTHKLNTDEPKTTLNNVENQNNSISKAQLSTTV

SEQ ID NO: 2094980 - protein, 13 aa, Staphylococcus
DNLSQKSSETIQD

SEQ ID NO: 2094981 - protein, 11 aa, Staphylococcus
DNNAKYNRNRI

SEQ ID NO: 2094982 - protein, 11 aa, Staphylococcus
DNNIQKAKELY

SEQ ID NO: 2094983 - protein, 8 aa, Staphylococcus
DNNTGVKN

SEQ ID NO: 2094984 - protein, 11 aa, Staphylococcus
DNPETKEMDKT

SEQ ID NO: 2094985 - protein, 16 aa, Staphylococcus
DNQVVAKTPKNGGQFN

SEQ ID NO: 2094986 - protein, 12 aa, Staphylococcus
DNRDSKLSIANG

SEQ ID NO: 2094987 - protein, 21 aa, Staphylococcus
DNRTNQDEQTTATLKYDGKKA

SEQ ID NO: 2094988 - protein, 19 aa, Staphylococcus
DNSNEDKIENKVNVQAEQK

SEQ ID NO: 2094989 - protein, 5 aa, Staphylococcus
DNSNK

SEQ ID NO: 2094990 - protein, 8 aa, Staphylococcus
DNSPYQAY

SEQ ID NO: 2094991 - protein, 38 aa, Staphylococcus
DNTANATDEEKQEAKNRVKTEENTGNQNIDQAQTNQQV

SEQ ID NO: 2094992 - protein, 9 aa, Staphylococcus
DNTNEGTDW

SEQ ID NO: 2094993 - protein, 8 aa, Staphylococcus
DNTNTSKP

SEQ ID NO: 2094994 - protein, 4 aa, Staphylococcus
DNTT

SEQ ID NO: 2094995 - protein, 8 aa, Staphylococcus
DNVDPASI

SEQ ID NO: 2094996 - protein, 72 aa, Staphylococcus
DNVDQRKKEFKKEENAFDASEKKFDEAKKRTSKIRNDKRKSGIEKTNKAMEDNYKAHDAYAKAYTNSLDKEK

SEQ ID NO: 2094997 - protein, 9 aa, Staphylococcus
DNVEGGKMA

SEQ ID NO: 2094998 - protein, 10 aa, Staphylococcus
DNVKGGEMGG

SEQ ID NO: 2094999 - protein, 11 aa, Staphylococcus
DNVKTQSQTLD

SEQ ID NO: 2095000 - protein, 4 aa, Staphylococcus
DNVN

SEQ ID NO: 2095001 - protein, 17 aa, Staphylococcus
DNVNQATNTKDALNDAR

SEQ ID NO: 2095002 - protein, 8 aa, Staphylococcus
DNVPEFKN

SEQ ID NO: 2095003 - protein, 12 aa, Staphylococcus
DNWSKDDEEKLA

SEQ ID NO: 2095004 - protein, 9 aa, Staphylococcus
DNYDQTGTY

SEQ ID NO: 2095005 - protein, 7 aa, Staphylococcus
DPALYSR

SEQ ID NO: 2095006 - protein, 11 aa, Staphylococcus
DPDKIYGKEDQ

SEQ ID NO: 2095007 - protein, 11 aa, Staphylococcus
DPDKIYGNNKQ

SEQ ID NO: 2095008 - protein, 11 aa, Staphylococcus
DPDKVYGSGDE

SEQ ID NO: 2095009 - protein, 15 aa, Staphylococcus
DPDYLDKSYDKGNQY

SEQ ID NO: 2095010 - protein, 7 aa, Staphylococcus
DPEESYN

SEQ ID NO: 2095011 - protein, 28 aa, Staphylococcus
DPEKIKQQQQQQQQQQSMQQSGAGMSTG

SEQ ID NO: 2095012 - protein, 7 aa, Staphylococcus
DPESPWH

SEQ ID NO: 2095013 - protein, 6 aa, Staphylococcus
DPITDT

SEQ ID NO: 2095014 - protein, 8 aa, Staphylococcus
DPKQGPSI

SEQ ID NO: 2095015 - protein, 8 aa, Staphylococcus
DPKQGPSL

SEQ ID NO: 2095016 - protein, 8 aa, Staphylococcus
DPKRGPSL

SEQ ID NO: 2095017 - protein, 7 aa, Staphylococcus
DPKTASE

SEQ ID NO: 2095018 - protein, 48 aa, Staphylococcus
DPKYTKKEIEKMSEKDKKDKKANENLGLNPSHQGETNPTKIAEKSPAY

SEQ ID NO: 2095019 - protein, 48 aa, Staphylococcus
DPKYTKSEIDKMSGDEKEEKNANENLGLNPSHNGEKDEKKIAEKSPAY

SEQ ID NO: 2095020 - protein, 8 aa, Staphylococcus
DPNNQTVT

SEQ ID NO: 2095021 - protein, 17 aa, Staphylococcus
DPNSKADTTTPRAAAQT

SEQ ID NO: 2095022 - protein, 7 aa, Staphylococcus
DPQQNGV

SEQ ID NO: 2095023 - protein, 6 aa, Staphylococcus
DPQVPV

SEQ ID NO: 2095024 - protein, 8 aa, Staphylococcus
DPSEGNFS

SEQ ID NO: 2095025 - protein, 4 aa, Staphylococcus
DPVW

SEQ ID NO: 2095026 - protein, 7 aa, Staphylococcus
DPYEQAA

SEQ ID NO: 2095027 - protein, 6 aa, Staphylococcus
DQADAA

SEQ ID NO: 2095028 - protein, 16 aa, Staphylococcus
DQAIKQAKADGYNGDE

SEQ ID NO: 2095029 - protein, 4 aa, Staphylococcus
DQDM

SEQ ID NO: 2095030 - protein, 6 aa, Staphylococcus
DQFAKG

SEQ ID NO: 2095031 - protein, 6 aa, Staphylococcus
DQHLSS

SEQ ID NO: 2095032 - protein, 15 aa, Staphylococcus
DQHSHEEEGHDHDEH

SEQ ID NO: 2095033 - protein, 20 aa, Staphylococcus
DQIHAADKQDGISNLTQKNK

SEQ ID NO: 2095034 - protein, 4 aa, Staphylococcus
DQIS

SEQ ID NO: 2095035 - protein, 13 aa, Staphylococcus
DQKGKKTDRVNQT

SEQ ID NO: 2095036 - protein, 16 aa, Staphylococcus
DQKSNKQLSEKELKKS

SEQ ID NO: 2095037 - protein, 18 aa, Staphylococcus
DQLESAKDAVNQAPTRND

SEQ ID NO: 2095038 - protein, 19 aa, Staphylococcus
DQLHGEQKLAQDKQLANET

SEQ ID NO: 2095039 - protein, 8 aa, Staphylococcus
DQPNAVKK

SEQ ID NO: 2095040 - protein, 32 aa, Staphylococcus
DQQAGASLYDTGSVDNTGITSEQVDKYKDSPA

SEQ ID NO: 2095041 - protein, 7 aa, Staphylococcus
DQQQFQK

SEQ ID NO: 2095042 - protein, 25 aa, Staphylococcus
DQQRYNANASGQKVPTGARSELERE

SEQ ID NO: 2095043 - protein, 22 aa, Staphylococcus
DQQSKQTQQNTNVYKTDREDKN

SEQ ID NO: 2095044 - protein, 16 aa, Staphylococcus
DQSDHLRDQIGSATSV

SEQ ID NO: 2095045 - protein, 8 aa, Staphylococcus
DQSDRKQK

SEQ ID NO: 2095046 - protein, 17 aa, Staphylococcus
DQSFSGVNTKKTRAGSV

SEQ ID NO: 2095047 - protein, 6 aa, Staphylococcus
DQSRPS

SEQ ID NO: 2095048 - protein, 6 aa, Staphylococcus
DQSVSL

SEQ ID NO: 2095049 - protein, 8 aa, Staphylococcus
DQVQQAND

SEQ ID NO: 2095050 - protein, 17 aa, Staphylococcus
DQYDGNQKVSKKLDSDL

SEQ ID NO: 2095051 - protein, 10 aa, Staphylococcus
DQYGRAAAPK

SEQ ID NO: 2095052 - protein, 25 aa, Staphylococcus
DRDKDTELEATSKNLKAQGLPQNDK

SEQ ID NO: 2095053 - protein, 6 aa, Staphylococcus
DRELTD

SEQ ID NO: 2095054 - protein, 12 aa, Staphylococcus
DRENPGPSTIKT

SEQ ID NO: 2095055 - protein, 11 aa, Staphylococcus
DRENPGPSTLK

SEQ ID NO: 2095056 - protein, 12 aa, Staphylococcus
DRENPGPSTLKK

SEQ ID NO: 2095057 - protein, 22 aa, Staphylococcus
DRESIAKNVSKNHATPATGPFN

SEQ ID NO: 2095058 - protein, 6 aa, Staphylococcus
DRHNLD

SEQ ID NO: 2095059 - protein, 7 aa, Staphylococcus
DRIDRTR

SEQ ID NO: 2095060 - protein, 5 aa, Staphylococcus
DRNFQ

SEQ ID NO: 2095061 - protein, 18 aa, Staphylococcus
DRPGLESSNERHNAGTGH

SEQ ID NO: 2095062 - protein, 7 aa, Staphylococcus
DRPHELR

SEQ ID NO: 2095063 - protein, 21 aa, Staphylococcus
DRQSDSSTKITKKQSKQLSEL

SEQ ID NO: 2095064 - protein, 14 aa, Staphylococcus
DRRGISDVESEDIQ

SEQ ID NO: 2095065 - protein, 25 aa, Staphylococcus
DRSDEDKERHVQHAKESTLYKGPYD

SEQ ID NO: 2095066 - protein, 10 aa, Staphylococcus
DRSEQNPSRF

SEQ ID NO: 2095067 - protein, 10 aa, Staphylococcus
DRSMAPEGQT

SEQ ID NO: 2095068 - protein, 7 aa, Staphylococcus
DRTGNFG

SEQ ID NO: 2095069 - protein, 7 aa, Staphylococcus
DRVDRTR

SEQ ID NO: 2095070 - protein, 6 aa, Staphylococcus
DRYGSI

SEQ ID NO: 2095071 - protein, 8 aa, Staphylococcus
DSAEYDGV

SEQ ID NO: 2095072 - protein, 16 aa, Staphylococcus
DSDAERKHQGGGERSD

SEQ ID NO: 2095073 - protein, 16 aa, Staphylococcus
DSDAQRKSENDGERSD

SEQ ID NO: 2095074 - protein, 19 aa, Staphylococcus
DSDAVKQGFATAKNNGWNT

SEQ ID NO: 2095075 - protein, 15 aa, Staphylococcus
DSDGAEETSTRYIEV

SEQ ID NO: 2095076 - protein, 15 aa, Staphylococcus
DSDGAEKTSTRYIEV

SEQ ID NO: 2095077 - protein, 15 aa, Staphylococcus
DSDGALETSTRYIEV

SEQ ID NO: 2095078 - protein, 5 aa, Staphylococcus
DSDIS

SEQ ID NO: 2095079 - protein, 8 aa, Staphylococcus
DSDKSIEK

SEQ ID NO: 2095080 - protein, 8 aa, Staphylococcus
DSDYKDNI

SEQ ID NO: 2095081 - protein, 15 aa, Staphylococcus
DSEGAEESSTRYIKV

SEQ ID NO: 2095082 - protein, 12 aa, Staphylococcus
DSEIQERVSGVK

SEQ ID NO: 2095083 - protein, 12 aa, Staphylococcus
DSEKSTYKDHAK

SEQ ID NO: 2095084 - protein, 5 aa, Staphylococcus
DSGDI

SEQ ID NO: 2095085 - protein, 15 aa, Staphylococcus
DSGINSLKDLKGKKI

SEQ ID NO: 2095086 - protein, 7 aa, Staphylococcus
DSGRPEM

SEQ ID NO: 2095087 - protein, 17 aa, Staphylococcus
DSHGDKQTEASGTPHVE

SEQ ID NO: 2095088 - protein, 81 aa, Staphylococcus
DSIANNEQIKSGINYTDATPSIKSSYDNAVDDAKGTIDSQTQPVMDPTTINQQAETVKSSQAALNGQQNLQRAKDEATATI

SEQ ID NO: 2095089 - protein, 10 aa, Staphylococcus
DSIKNAPKGM

SEQ ID NO: 2095090 - protein, 5 aa, Staphylococcus
DSILS

SEQ ID NO: 2095091 - protein, 10 aa, Staphylococcus
DSISNQASIK

SEQ ID NO: 2095092 - protein, 24 aa, Staphylococcus
DSKGHSTDQAQKTLSVTKSATLGN

SEQ ID NO: 2095093 - protein, 10 aa, Staphylococcus
DSKGKTTNQV

SEQ ID NO: 2095094 - protein, 8 aa, Staphylococcus
DSKKNYDE

SEQ ID NO: 2095095 - protein, 7 aa, Staphylococcus
DSKRNYR

SEQ ID NO: 2095096 - protein, 5 aa, Staphylococcus
DSKSA

SEQ ID NO: 2095097 - protein, 6 aa, Staphylococcus
DSKSEE

SEQ ID NO: 2095098 - protein, 7 aa, Staphylococcus
DSKSTRD

SEQ ID NO: 2095099 - protein, 7 aa, Staphylococcus
DSLEKNG

SEQ ID NO: 2095100 - protein, 21 aa, Staphylococcus
DSLNKYDSSNQKDYKHQGNQY

SEQ ID NO: 2095101 - protein, 21 aa, Staphylococcus
DSLNNELTSYRSDIDREKEKQ

SEQ ID NO: 2095102 - protein, 13 aa, Staphylococcus
DSLSSIASRYGTT

SEQ ID NO: 2095103 - protein, 17 aa, Staphylococcus
DSNAQRKSTNDGERSDT

SEQ ID NO: 2095104 - protein, 16 aa, Staphylococcus
DSNEAMEAKIKNGGTH

SEQ ID NO: 2095105 - protein, 5 aa, Staphylococcus
DSNIN

SEQ ID NO: 2095106 - protein, 10 aa, Staphylococcus
DSNITGKIND

SEQ ID NO: 2095107 - protein, 6 aa, Staphylococcus
DSNPVH

SEQ ID NO: 2095108 - protein, 14 aa, Staphylococcus
DSNRTNYKNKETFR

SEQ ID NO: 2095109 - protein, 9 aa, Staphylococcus
DSNTGYSNS

SEQ ID NO: 2095110 - protein, 27 aa, Staphylococcus
DSPKSYKESQYTGATAQHSQLHENNKV

SEQ ID NO: 2095111 - protein, 7 aa, Staphylococcus
DSQDTRK

SEQ ID NO: 2095112 - protein, 6 aa, Staphylococcus
DSQISD

SEQ ID NO: 2095113 - protein, 6 aa, Staphylococcus
DSQLDS

SEQ ID NO: 2095114 - protein, 5 aa, Staphylococcus
DSQTV

SEQ ID NO: 2095115 - protein, 4 aa, Staphylococcus
DSRN

SEQ ID NO: 2095116 - protein, 8 aa, Staphylococcus
DSRTGKVT

SEQ ID NO: 2095117 - protein, 14 aa, Staphylococcus
DSSKPDHTTSTESH

SEQ ID NO: 2095118 - protein, 14 aa, Staphylococcus
DSSLNDVKNKEKEL

SEQ ID NO: 2095119 - protein, 10 aa, Staphylococcus
DSSSPINIPS

SEQ ID NO: 2095120 - protein, 8 aa, Staphylococcus
DSTQNTPL

SEQ ID NO: 2095121 - protein, 8 aa, Staphylococcus
DSVNPTLN

SEQ ID NO: 2095122 - protein, 12 aa, Staphylococcus
DSVSKNHKNGVG

SEQ ID NO: 2095123 - protein, 7 aa, Staphylococcus
DSYKNKD

SEQ ID NO: 2095124 - protein, 16 aa, Staphylococcus
DTADGYAGVKGIGEKT

SEQ ID NO: 2095125 - protein, 12 aa, Staphylococcus
DTAKGSAANPKY

SEQ ID NO: 2095126 - protein, 5 aa, Staphylococcus
DTDAP

SEQ ID NO: 2095127 - protein, 8 aa, Staphylococcus
DTEEHGKG

SEQ ID NO: 2095128 - protein, 9 aa, Staphylococcus
DTEGKIKPS

SEQ ID NO: 2095129 - protein, 6 aa, Staphylococcus
DTERWK

SEQ ID NO: 2095130 - protein, 9 aa, Staphylococcus
DTFAESKND

SEQ ID NO: 2095131 - protein, 8 aa, Staphylococcus
DTGHNGGY

SEQ ID NO: 2095132 - protein, 11 aa, Staphylococcus
DTGSTKGTIQN

SEQ ID NO: 2095133 - protein, 11 aa, Staphylococcus
DTGSTKSNIQS

SEQ ID NO: 2095134 - protein, 11 aa, Staphylococcus
DTGSTKSTIQT

SEQ ID NO: 2095135 - protein, 9 aa, Staphylococcus
DTHGKVKPS

SEQ ID NO: 2095136 - protein, 5 aa, Staphylococcus
DTIDD

SEQ ID NO: 2095137 - protein, 20 aa, Staphylococcus
DTKADSDVTKAPVGTGPYQI

SEQ ID NO: 2095138 - protein, 8 aa, Staphylococcus
DTKEHGKG

SEQ ID NO: 2095139 - protein, 7 aa, Staphylococcus
DTKEHGR

SEQ ID NO: 2095140 - protein, 9 aa, Staphylococcus
DTKNSFDDI

SEQ ID NO: 2095141 - protein, 7 aa, Staphylococcus
DTKQGKR

SEQ ID NO: 2095142 - protein, 7 aa, Staphylococcus
DTKTPVT

SEQ ID NO: 2095143 - protein, 5 aa, Staphylococcus
DTLDI

SEQ ID NO: 2095144 - protein, 131 aa, Staphylococcus
DTLTDQTHAQTSQQQNAKNQQQTEQAKQQAATTTARQNAQTYNQNAAQSNKTKQQANANTSTTTKQQATQAANTSLKSQNNVETTNQKAVSTQNTAQKQSNSVTTYQGRVGGMGSSATKAQTAKSTSGFTG

SEQ ID NO: 2095145 - protein, 13 aa, Staphylococcus
DTLTNASRTGNPI

SEQ ID NO: 2095146 - protein, 16 aa, Staphylococcus
DTNGVSKSDAKKILNK

SEQ ID NO: 2095147 - protein, 27 aa, Staphylococcus
DTNKIKADPSIEKQVNKANNEFKKETS

SEQ ID NO: 2095148 - protein, 16 aa, Staphylococcus
DTNKNGIQDDGEKGLA

SEQ ID NO: 2095149 - protein, 12 aa, Staphylococcus
DTNSTSPYPQGQ

SEQ ID NO: 2095150 - protein, 6 aa, Staphylococcus
DTPEFG

SEQ ID NO: 2095151 - protein, 8 aa, Staphylococcus
DTPEHGKG

SEQ ID NO: 2095152 - protein, 30 aa, Staphylococcus
DTPETVKPNTPVQPYGKEASHFSKKNLTNK

SEQ ID NO: 2095153 - protein, 29 aa, Staphylococcus
DTPETVKPNTPVQPYGKEASNYSKQHLNG

SEQ ID NO: 2095154 - protein, 29 aa, Staphylococcus
DTPETVKPNTPVQPYGKEASNYSKQHLNN

SEQ ID NO: 2095155 - protein, 7 aa, Staphylococcus
DTPEYGK

SEQ ID NO: 2095156 - protein, 6 aa, Staphylococcus
DTPIED

SEQ ID NO: 2095157 - protein, 6 aa, Staphylococcus
DTPLED

SEQ ID NO: 2095158 - protein, 15 aa, Staphylococcus
DTPPVNQAHAATAPY

SEQ ID NO: 2095159 - protein, 10 aa, Staphylococcus
DTPWGTAKQV

SEQ ID NO: 2095160 - protein, 5 aa, Staphylococcus
DTQNA

SEQ ID NO: 2095161 - protein, 6 aa, Staphylococcus
DTQVEN

SEQ ID NO: 2095162 - protein, 8 aa, Staphylococcus
DTRETTIE

SEQ ID NO: 2095163 - protein, 7 aa, Staphylococcus
DTRQTVT

SEQ ID NO: 2095164 - protein, 6 aa, Staphylococcus
DTSSCD

SEQ ID NO: 2095165 - protein, 6 aa, Staphylococcus
DTTKES

SEQ ID NO: 2095166 - protein, 9 aa, Staphylococcus
DTTKKRPIN

SEQ ID NO: 2095167 - protein, 6 aa, Staphylococcus
DTTVEN

SEQ ID NO: 2095168 - protein, 4 aa, Staphylococcus
DTWA

SEQ ID NO: 2095169 - protein, 14 aa, Staphylococcus
DVDASELKDKGYSN

SEQ ID NO: 2095170 - protein, 19 aa, Staphylococcus
DVEKIGDNDVEKVAKQKPD

SEQ ID NO: 2095171 - protein, 8 aa, Staphylococcus
DVENDQYG

SEQ ID NO: 2095172 - protein, 29 aa, Staphylococcus
DVEQSVDYTDADTDKQQAYTDAVTKAQSI

SEQ ID NO: 2095173 - protein, 8 aa, Staphylococcus
DVESTSGY

SEQ ID NO: 2095174 - protein, 17 aa, Staphylococcus
DVGSNYEDPLKNTTSIS

SEQ ID NO: 2095175 - protein, 21 aa, Staphylococcus
DVIKSEKDNPKLKEVEDKVDM

SEQ ID NO: 2095176 - protein, 7 aa, Staphylococcus
DVKDKGS

SEQ ID NO: 2095177 - protein, 17 aa, Staphylococcus
DVKEGNRSRKPSKFNSI

SEQ ID NO: 2095178 - protein, 17 aa, Staphylococcus
DVKEGNRSRKPSKINSI

SEQ ID NO: 2095179 - protein, 10 aa, Staphylococcus
DVKENTSQTV

SEQ ID NO: 2095180 - protein, 4 aa, Staphylococcus
DVKK

SEQ ID NO: 2095181 - protein, 13 aa, Staphylococcus
DVKKNYDNYTIIQ

SEQ ID NO: 2095182 - protein, 7 aa, Staphylococcus
DVKPMEE

SEQ ID NO: 2095183 - protein, 6 aa, Staphylococcus
DVNPDE

SEQ ID NO: 2095184 - protein, 7 aa, Staphylococcus
DVNPDEV

SEQ ID NO: 2095185 - protein, 7 aa, Staphylococcus
DVNPEDV

SEQ ID NO: 2095186 - protein, 16 aa, Staphylococcus
DVNPNQDAHAATTPYY

SEQ ID NO: 2095187 - protein, 9 aa, Staphylococcus
DVPTAPQSL

SEQ ID NO: 2095188 - protein, 18 aa, Staphylococcus
DVPTKYAGDVNGKQQDKI

SEQ ID NO: 2095189 - protein, 7 aa, Staphylococcus
DVPVNPK

SEQ ID NO: 2095190 - protein, 8 aa, Staphylococcus
DVQANTPF

SEQ ID NO: 2095191 - protein, 11 aa, Staphylococcus
DVSKKKEQEEL

SEQ ID NO: 2095192 - protein, 11 aa, Staphylococcus
DVSPEQSLKQA

SEQ ID NO: 2095193 - protein, 12 aa, Staphylococcus
DVSTITDDESRD

SEQ ID NO: 2095194 - protein, 22 aa, Staphylococcus
DVSYNAAKAAAKINKTYKINPG

SEQ ID NO: 2095195 - protein, 15 aa, Staphylococcus
DVTKNKGDKKIQEKL

SEQ ID NO: 2095196 - protein, 22 aa, Staphylococcus
DVTRTTNSSGLVKNKTNNEIKK

SEQ ID NO: 2095197 - protein, 4 aa, Staphylococcus
DVTS

SEQ ID NO: 2095198 - protein, 14 aa, Staphylococcus
DVTYNTAKSPISVN

SEQ ID NO: 2095199 - protein, 10 aa, Staphylococcus
DWDQKDEERL

SEQ ID NO: 2095200 - protein, 12 aa, Staphylococcus
DWNEEDENKLSK

SEQ ID NO: 2095201 - protein, 6 aa, Staphylococcus
DWQPGQ

SEQ ID NO: 2095202 - protein, 10 aa, Staphylococcus
DWSKSDEDKL

SEQ ID NO: 2095203 - protein, 11 aa, Staphylococcus
DWSKSDEDKLA

SEQ ID NO: 2095204 - protein, 5 aa, Staphylococcus
DYAAT

SEQ ID NO: 2095205 - protein, 27 aa, Staphylococcus
DYADSMKNKGYNVKELDGEANISNETL

SEQ ID NO: 2095206 - protein, 9 aa, Staphylococcus
DYDTEDGSC

SEQ ID NO: 2095207 - protein, 14 aa, Staphylococcus
DYEKSAKQLPAETH

SEQ ID NO: 2095208 - protein, 10 aa, Staphylococcus
DYETGNVKKM

SEQ ID NO: 2095209 - protein, 10 aa, Staphylococcus
DYGKDKETCH

SEQ ID NO: 2095210 - protein, 7 aa, Staphylococcus
DYIDKGK

SEQ ID NO: 2095211 - protein, 5 aa, Staphylococcus
DYIQG

SEQ ID NO: 2095212 - protein, 7 aa, Staphylococcus
DYKDRDL

SEQ ID NO: 2095213 - protein, 11 aa, Staphylococcus
DYKDSDIKKAV

SEQ ID NO: 2095214 - protein, 15 aa, Staphylococcus
DYKDSDIKKSVEDTI

SEQ ID NO: 2095215 - protein, 11 aa, Staphylococcus
DYKEQKKLQAY

SEQ ID NO: 2095216 - protein, 11 aa, Staphylococcus
DYKEQKRLSAY

SEQ ID NO: 2095217 - protein, 6 aa, Staphylococcus
DYKGNW

SEQ ID NO: 2095218 - protein, 12 aa, Staphylococcus
DYKQNRPAPPEE

SEQ ID NO: 2095219 - protein, 9 aa, Staphylococcus
DYKQSQNIK

SEQ ID NO: 2095220 - protein, 8 aa, Staphylococcus
DYNEKTGV

SEQ ID NO: 2095221 - protein, 8 aa, Staphylococcus
DYNKDTGV

SEQ ID NO: 2095222 - protein, 14 aa, Staphylococcus
DYNVPNKALNDGDI

SEQ ID NO: 2095223 - protein, 5 aa, Staphylococcus
DYNVQ

SEQ ID NO: 2095224 - protein, 7 aa, Staphylococcus
DYQPQNK

SEQ ID NO: 2095225 - protein, 16 aa, Staphylococcus
DYRDQLPAKQQGALTT

SEQ ID NO: 2095226 - protein, 13 aa, Staphylococcus
DYSQHGGNRLGAN

SEQ ID NO: 2095227 - protein, 10 aa, Staphylococcus
DYTKSETKRI

SEQ ID NO: 2095228 - protein, 17 aa, Staphylococcus
DYYDPQLKEDRLASIGK

SEQ ID NO: 2095229 - protein, 8 aa, Staphylococcus
EAAGEASD

SEQ ID NO: 2095230 - protein, 10 aa, Staphylococcus
EAATGNSIQT

SEQ ID NO: 2095231 - protein, 16 aa, Staphylococcus
EADDINKKKDKAESKD

SEQ ID NO: 2095232 - protein, 9 aa, Staphylococcus
EADKETAKQ

SEQ ID NO: 2095233 - protein, 17 aa, Staphylococcus
EADVTKNKGKKDIQDKL

SEQ ID NO: 2095234 - protein, 75 aa, Staphylococcus
EAEAAEKQQSISQNHSDEQESSQADTTVTTEQTTNNNVSSQTNATSPSTQDKTTIDHTENPSSTNQQITENQSLH

SEQ ID NO: 2095235 - protein, 5 aa, Staphylococcus
EAEAE

SEQ ID NO: 2095236 - protein, 11 aa, Staphylococcus
EAEKDNPKADV

SEQ ID NO: 2095237 - protein, 6 aa, Staphylococcus
EAESEV

SEQ ID NO: 2095238 - protein, 7 aa, Staphylococcus
EAGVKPE

SEQ ID NO: 2095239 - protein, 4 aa, Staphylococcus
EAID

SEQ ID NO: 2095240 - protein, 5 aa, Staphylococcus
EAIGD

SEQ ID NO: 2095241 - protein, 13 aa, Staphylococcus
EAIKGTHGRPGSI

SEQ ID NO: 2095242 - protein, 13 aa, Staphylococcus
EAINMGKKDVDEL

SEQ ID NO: 2095243 - protein, 6 aa, Staphylococcus
EAIPTN

SEQ ID NO: 2095244 - protein, 4 aa, Staphylococcus
EAIQ

SEQ ID NO: 2095245 - protein, 11 aa, Staphylococcus
EAISSNDNFKT

SEQ ID NO: 2095246 - protein, 8 aa, Staphylococcus
EAKKRKTE

SEQ ID NO: 2095247 - protein, 4 aa, Staphylococcus
EAKR

SEQ ID NO: 2095248 - protein, 17 aa, Staphylococcus
EAKSKKIVTNKQAPSHF

SEQ ID NO: 2095249 - protein, 15 aa, Staphylococcus
EALDSDAVKNSTSIP

SEQ ID NO: 2095250 - protein, 13 aa, Staphylococcus
EALRQEEASVQSN

SEQ ID NO: 2095251 - protein, 5 aa, Staphylococcus
EAMKQ

SEQ ID NO: 2095252 - protein, 11 aa, Staphylococcus
EAMPSSGNDYI

SEQ ID NO: 2095253 - protein, 16 aa, Staphylococcus
EANGPLLKKPNERINE

SEQ ID NO: 2095254 - protein, 20 aa, Staphylococcus
EANGSLLREPDKRNEALQKA

SEQ ID NO: 2095255 - protein, 12 aa, Staphylococcus
EANQPHKYTDQE

SEQ ID NO: 2095256 - protein, 4 aa, Staphylococcus
EAQK

SEQ ID NO: 2095257 - protein, 40 aa, Staphylococcus
EASGNGNTYTEQSNTTKQQSGSSNQSQHNQKKVQNLTGEK

SEQ ID NO: 2095258 - protein, 12 aa, Staphylococcus
EASGSSPYPQGQ

SEQ ID NO: 2095259 - protein, 13 aa, Staphylococcus
EASTQYTVQPGDS

SEQ ID NO: 2095260 - protein, 9 aa, Staphylococcus
EATDQNQKG

SEQ ID NO: 2095261 - protein, 8 aa, Staphylococcus
EATYNSKE

SEQ ID NO: 2095262 - protein, 4 aa, Staphylococcus
EAVD

SEQ ID NO: 2095263 - protein, 6 aa, Staphylococcus
EAVGAS

SEQ ID NO: 2095264 - protein, 21 aa, Staphylococcus
EAVTNAKNHLHGDEKLQNDKQ

SEQ ID NO: 2095265 - protein, 8 aa, Staphylococcus
EDAGANIV

SEQ ID NO: 2095266 - protein, 21 aa, Staphylococcus
EDAKQVTGKDGVKYYDNPKGS

SEQ ID NO: 2095267 - protein, 14 aa, Staphylococcus
EDAPKAPTNPYGES

SEQ ID NO: 2095268 - protein, 4 aa, Staphylococcus
EDDT

SEQ ID NO: 2095269 - protein, 5 aa, Staphylococcus
EDELS

SEQ ID NO: 2095270 - protein, 7 aa, Staphylococcus
EDELTRF

SEQ ID NO: 2095271 - protein, 20 aa, Staphylococcus
EDGDARQSAIQSGAVDITGG

SEQ ID NO: 2095272 - protein, 14 aa, Staphylococcus
EDGNVTKYDENGDE

SEQ ID NO: 2095273 - protein, 4 aa, Staphylococcus
EDHH

SEQ ID NO: 2095274 - protein, 4 aa, Staphylococcus
EDHY

SEQ ID NO: 2095275 - protein, 9 aa, Staphylococcus
EDIAENKKN

SEQ ID NO: 2095276 - protein, 8 aa, Staphylococcus
EDIQRDNN

SEQ ID NO: 2095277 - protein, 4 aa, Staphylococcus
EDIT

SEQ ID NO: 2095278 - protein, 20 aa, Staphylococcus
EDITENKKDIKFNNKQSAEY

SEQ ID NO: 2095279 - protein, 20 aa, Staphylococcus
EDITENKKDIKFNSKQSAEY

SEQ ID NO: 2095280 - protein, 9 aa, Staphylococcus
EDKDTKTMH

SEQ ID NO: 2095281 - protein, 11 aa, Staphylococcus
EDKGKAAEDAG

SEQ ID NO: 2095282 - protein, 23 aa, Staphylococcus
EDKGKSAEDAGYVASPEKTYKDE

SEQ ID NO: 2095283 - protein, 9 aa, Staphylococcus
EDKKNTMDM

SEQ ID NO: 2095284 - protein, 9 aa, Staphylococcus
EDKSYENTV

SEQ ID NO: 2095285 - protein, 8 aa, Staphylococcus
EDLENDDA

SEQ ID NO: 2095286 - protein, 6 aa, Staphylococcus
EDLKTQ

SEQ ID NO: 2095287 - protein, 20 aa, Staphylococcus
EDLNQSTVTDNETTKARQSA

SEQ ID NO: 2095288 - protein, 5 aa, Staphylococcus
EDLNS

SEQ ID NO: 2095289 - protein, 5 aa, Staphylococcus
EDMDQ

SEQ ID NO: 2095290 - protein, 4 aa, Staphylococcus
EDME

SEQ ID NO: 2095291 - protein, 6 aa, Staphylococcus
EDMSEW

SEQ ID NO: 2095292 - protein, 15 aa, Staphylococcus
EDNKNGDTEQNAKNI

SEQ ID NO: 2095293 - protein, 14 aa, Staphylococcus
EDNLERKSDLLDKK

SEQ ID NO: 2095294 - protein, 10 aa, Staphylococcus
EDNPNGSHEN

SEQ ID NO: 2095295 - protein, 19 aa, Staphylococcus
EDPIKDPKKALKATQEGFQ

SEQ ID NO: 2095296 - protein, 23 aa, Staphylococcus
EDPKAQTAQSRTDLVNEKKEEFG

SEQ ID NO: 2095297 - protein, 13 aa, Staphylococcus
EDRGGYYESSGAL

SEQ ID NO: 2095298 - protein, 5 aa, Staphylococcus
EDRMK

SEQ ID NO: 2095299 - protein, 7 aa, Staphylococcus
EDRYGSI

SEQ ID NO: 2095300 - protein, 11 aa, Staphylococcus
EDSHDIGQNRD

SEQ ID NO: 2095301 - protein, 7 aa, Staphylococcus
EDSYTDL

SEQ ID NO: 2095302 - protein, 6 aa, Staphylococcus
EDTDAI

SEQ ID NO: 2095303 - protein, 8 aa, Staphylococcus
EDTDDIES

SEQ ID NO: 2095304 - protein, 7 aa, Staphylococcus
EDTDQID

SEQ ID NO: 2095305 - protein, 26 aa, Staphylococcus
EDYEGHKLDTSTYTYKEPEQKSDGSW

SEQ ID NO: 2095306 - protein, 26 aa, Staphylococcus
EDYEGHQLDTDTYTYKEPEQDENGDW

SEQ ID NO: 2095307 - protein, 26 aa, Staphylococcus
EDYEGHQLDTSTYTYKEPEKNSDGEW

SEQ ID NO: 2095308 - protein, 6 aa, Staphylococcus
EDYSEQ

SEQ ID NO: 2095309 - protein, 6 aa, Staphylococcus
EDYSKK

SEQ ID NO: 2095310 - protein, 5 aa, Staphylococcus
EDYWD

SEQ ID NO: 2095311 - protein, 11 aa, Staphylococcus
EEAAKRGGNVR

SEQ ID NO: 2095312 - protein, 5 aa, Staphylococcus
EEADM

SEQ ID NO: 2095313 - protein, 14 aa, Staphylococcus
EEDLKNNHNALDDR

SEQ ID NO: 2095314 - protein, 5 aa, Staphylococcus
EEEIK

SEQ ID NO: 2095315 - protein, 5 aa, Staphylococcus
EEELE

SEQ ID NO: 2095316 - protein, 13 aa, Staphylococcus
EEELKNNSNKHDG

SEQ ID NO: 2095317 - protein, 10 aa, Staphylococcus
EEHYKDTDKT

SEQ ID NO: 2095318 - protein, 8 aa, Staphylococcus
EEINSSLS

SEQ ID NO: 2095319 - protein, 14 aa, Staphylococcus
EEITAEKKREVAKK

SEQ ID NO: 2095320 - protein, 43 aa, Staphylococcus
EEKKRKAKQKEKQAKWEAEKAHENGEPSDESANHHSNAEKEVK

SEQ ID NO: 2095321 - protein, 31 aa, Staphylococcus
EEKRRKKNEAAKKASNDTQTDSNQSQHQDKS

SEQ ID NO: 2095322 - protein, 20 aa, Staphylococcus
EEKTKDDGNEIKDAIGEDTT

SEQ ID NO: 2095323 - protein, 6 aa, Staphylococcus
EELGAD

SEQ ID NO: 2095324 - protein, 6 aa, Staphylococcus
EELKNK

SEQ ID NO: 2095325 - protein, 4 aa, Staphylococcus
EELS

SEQ ID NO: 2095326 - protein, 11 aa, Staphylococcus
EENGEVHDEDR

SEQ ID NO: 2095327 - protein, 10 aa, Staphylococcus
EENKAKEGLV

SEQ ID NO: 2095328 - protein, 15 aa, Staphylococcus
EENKSSFKDPKEAEI

SEQ ID NO: 2095329 - protein, 13 aa, Staphylococcus
EENLDRKSDLLDK

SEQ ID NO: 2095330 - protein, 6 aa, Staphylococcus
EENPAE

SEQ ID NO: 2095331 - protein, 7 aa, Staphylococcus
EENPEEI

SEQ ID NO: 2095332 - protein, 14 aa, Staphylococcus
EEPPIRTRTSDWSE

SEQ ID NO: 2095333 - protein, 8 aa, Staphylococcus
EESGKKFE

SEQ ID NO: 2095334 - protein, 7 aa, Staphylococcus
EETGNSV

SEQ ID NO: 2095335 - protein, 6 aa, Staphylococcus
EETKES

SEQ ID NO: 2095336 - protein, 8 aa, Staphylococcus
EETTYAQP

SEQ ID NO: 2095337 - protein, 13 aa, Staphylococcus
EETVNSQKNINVN

SEQ ID NO: 2095338 - protein, 5 aa, Staphylococcus
EEVPE

SEQ ID NO: 2095339 - protein, 26 aa, Staphylococcus
EEYEGHKLDTDTYTYKEPEQKSDGSW

SEQ ID NO: 2095340 - protein, 26 aa, Staphylococcus
EEYEGHTLDTDTYTYKEPEKNSDGDW

SEQ ID NO: 2095341 - protein, 24 aa, Staphylococcus
EEYETAAKKLPAESEETKNLKSTY

SEQ ID NO: 2095342 - protein, 82 aa, Staphylococcus
EFDEEEQTKKTSSPKPSSKKETVHSDKNLKKNVTPEHHRGESKRFETKQSHTGKVPSKDRYSTSRERSQSEKNIKKQLEDSL

SEQ ID NO: 2095343 - protein, 16 aa, Staphylococcus
EFKGDKNIARTQETNL

SEQ ID NO: 2095344 - protein, 10 aa, Staphylococcus
EFNPNQLDAQ

SEQ ID NO: 2095345 - protein, 5 aa, Staphylococcus
EFPAF

SEQ ID NO: 2095346 - protein, 19 aa, Staphylococcus
EFQHEQDASDEAKTNGEQN

SEQ ID NO: 2095347 - protein, 8 aa, Staphylococcus
EGAPANKD

SEQ ID NO: 2095348 - protein, 5 aa, Staphylococcus
EGEVT

SEQ ID NO: 2095349 - protein, 4 aa, Staphylococcus
EGEY

SEQ ID NO: 2095350 - protein, 5 aa, Staphylococcus
EGEYG

SEQ ID NO: 2095351 - protein, 7 aa, Staphylococcus
EGGALPT

SEQ ID NO: 2095352 - protein, 7 aa, Staphylococcus
EGGGYQL

SEQ ID NO: 2095353 - protein, 23 aa, Staphylococcus
EGHKLDTDTYTYKEPEEDSDGNW

SEQ ID NO: 2095354 - protein, 9 aa, Staphylococcus
EGHKNDKKF

SEQ ID NO: 2095355 - protein, 17 aa, Staphylococcus
EGIQNMNAEDPSQKELT

SEQ ID NO: 2095356 - protein, 7 aa, Staphylococcus
EGISKEE

SEQ ID NO: 2095357 - protein, 10 aa, Staphylococcus
EGISKSEYND

SEQ ID NO: 2095358 - protein, 8 aa, Staphylococcus
EGKSIDAD

SEQ ID NO: 2095359 - protein, 8 aa, Staphylococcus
EGKVSDVV

SEQ ID NO: 2095360 - protein, 6 aa, Staphylococcus
EGKVSK

SEQ ID NO: 2095361 - protein, 8 aa, Staphylococcus
EGLSKSDY

SEQ ID NO: 2095362 - protein, 24 aa, Staphylococcus
EGNAEKSQSALTFSKKEDDATIEK

SEQ ID NO: 2095363 - protein, 16 aa, Staphylococcus
EGNFPVQGRSVKSTLH

SEQ ID NO: 2095364 - protein, 14 aa, Staphylococcus
EGQFPVQGRSVKST

SEQ ID NO: 2095365 - protein, 17 aa, Staphylococcus
EGQFPVQGRSVKSTLHS

SEQ ID NO: 2095366 - protein, 5 aa, Staphylococcus
EGQIS

SEQ ID NO: 2095367 - protein, 6 aa, Staphylococcus
EGQVSD

SEQ ID NO: 2095368 - protein, 6 aa, Staphylococcus
EGQVSK

SEQ ID NO: 2095369 - protein, 13 aa, Staphylococcus
EGRTAHTNASGQR

SEQ ID NO: 2095370 - protein, 21 aa, Staphylococcus
EGSDERGKYVDTVSTKSSLKS

SEQ ID NO: 2095371 - protein, 9 aa, Staphylococcus
EGSEERAQY

SEQ ID NO: 2095372 - protein, 9 aa, Staphylococcus
EGSTFSADG

SEQ ID NO: 2095373 - protein, 5 aa, Staphylococcus
EGTFN

SEQ ID NO: 2095374 - protein, 15 aa, Staphylococcus
EGVSGMNNEEPSQKD

SEQ ID NO: 2095375 - protein, 7 aa, Staphylococcus
EGWAEVK

SEQ ID NO: 2095376 - protein, 14 aa, Staphylococcus
EGWAEVSQEKIEDV

SEQ ID NO: 2095377 - protein, 7 aa, Staphylococcus
EGWEEKV

SEQ ID NO: 2095378 - protein, 4 aa, Staphylococcus
EGYD

SEQ ID NO: 2095379 - protein, 23 aa, Staphylococcus
EGYEKAHDKDFDKVREYRQKIEN

SEQ ID NO: 2095380 - protein, 22 aa, Staphylococcus
EGYEKTSEADFKKVRDNRILID

SEQ ID NO: 2095381 - protein, 4 aa, Staphylococcus
EGYT

SEQ ID NO: 2095382 - protein, 5 aa, Staphylococcus
EHAGM

SEQ ID NO: 2095383 - protein, 8 aa, Staphylococcus
EHEGETNQ

SEQ ID NO: 2095384 - protein, 11 aa, Staphylococcus
EHHPNDPTVRD

SEQ ID NO: 2095385 - protein, 6 aa, Staphylococcus
EHIPKS

SEQ ID NO: 2095386 - protein, 6 aa, Staphylococcus
EHKESQ

SEQ ID NO: 2095387 - protein, 9 aa, Staphylococcus
EHKSSKKQL

SEQ ID NO: 2095388 - protein, 20 aa, Staphylococcus
EHNGVSNEAHAQTQTSQGYH

SEQ ID NO: 2095389 - protein, 10 aa, Staphylococcus
EHNTQAAKTL

SEQ ID NO: 2095390 - protein, 4 aa, Staphylococcus
EHPN

SEQ ID NO: 2095391 - protein, 8 aa, Staphylococcus
EHRGDKNR

SEQ ID NO: 2095392 - protein, 6 aa, Staphylococcus
EIDETT

SEQ ID NO: 2095393 - protein, 10 aa, Staphylococcus
EIDREKEKQL

SEQ ID NO: 2095394 - protein, 16 aa, Staphylococcus
EIDREKEKQLSRIENN

SEQ ID NO: 2095395 - protein, 23 aa, Staphylococcus
EIGERRAGDPSKLVASSDKAQRV

SEQ ID NO: 2095396 - protein, 5 aa, Staphylococcus
EIGSS

SEQ ID NO: 2095397 - protein, 9 aa, Staphylococcus
EIKQSNDIN

SEQ ID NO: 2095398 - protein, 23 aa, Staphylococcus
EIKVPEDMKSTNEGEFKAGDKVT

SEQ ID NO: 2095399 - protein, 13 aa, Staphylococcus
EINHNGGKATAYK

SEQ ID NO: 2095400 - protein, 12 aa, Staphylococcus
EIPYKGDNSAAR

SEQ ID NO: 2095401 - protein, 29 aa, Staphylococcus
EIRRNNPELEKSIKDAKDTFVERKNNRIG

SEQ ID NO: 2095402 - protein, 28 aa, Staphylococcus
EIRRNNPELEKSIKDAKDTFVNRKNNRL

SEQ ID NO: 2095403 - protein, 12 aa, Staphylococcus
EIRRNNPELERA

SEQ ID NO: 2095404 - protein, 29 aa, Staphylococcus
EIRRNNPELERSIKDAKETFVNRKNQRLG

SEQ ID NO: 2095405 - protein, 12 aa, Staphylococcus
EIRTTSEDTATS

SEQ ID NO: 2095406 - protein, 9 aa, Staphylococcus
EISGPQSQV

SEQ ID NO: 2095407 - protein, 23 aa, Staphylococcus
EISPTTTIKSEARKAVQNKVNEQ

SEQ ID NO: 2095408 - protein, 10 aa, Staphylococcus
EITDATPAAY

SEQ ID NO: 2095409 - protein, 11 aa, Staphylococcus
EITDATPAAYA

SEQ ID NO: 2095410 - protein, 17 aa, Staphylococcus
EITEGTGGGLFGGEGYN

SEQ ID NO: 2095411 - protein, 7 aa, Staphylococcus
EITMNKD

SEQ ID NO: 2095412 - protein, 16 aa, Staphylococcus
EIVSGESSIPKRNKQI

SEQ ID NO: 2095413 - protein, 33 aa, Staphylococcus
EIYSGKAKTWKDVNPKWPSKEIKAYSPDQSHGT

SEQ ID NO: 2095414 - protein, 10 aa, Staphylococcus
EKAGIDATKD

SEQ ID NO: 2095415 - protein, 10 aa, Staphylococcus
EKAGYSKKHP

SEQ ID NO: 2095416 - protein, 6 aa, Staphylococcus
EKAIGT

SEQ ID NO: 2095417 - protein, 19 aa, Staphylococcus
EKAKNKPTAKFKDNKFTSN

SEQ ID NO: 2095418 - protein, 10 aa, Staphylococcus
EKANKGTHIT

SEQ ID NO: 2095419 - protein, 11 aa, Staphylococcus
EKDFKDKKEVS

SEQ ID NO: 2095420 - protein, 22 aa, Staphylococcus
EKDGKQKTTKYAAKPGHSEHQT

SEQ ID NO: 2095421 - protein, 36 aa, Staphylococcus
EKDNDNKIEKYDNDEKKDTSTKQKTPTIPKDKSKMA

SEQ ID NO: 2095422 - protein, 33 aa, Staphylococcus
EKDNDNKIEQYDKQDKSSNKQTPTIPKDKTKMA

SEQ ID NO: 2095423 - protein, 38 aa, Staphylococcus
EKDNNDKIENYDKKESKDSNQSKDKAPEIPKDKSKMAG

SEQ ID NO: 2095424 - protein, 12 aa, Staphylococcus
EKDNYPTSKAIN

SEQ ID NO: 2095425 - protein, 35 aa, Staphylococcus
EKDSDIKSVKDLKDGQKLAIGEAKSVPAGKYATQY

SEQ ID NO: 2095426 - protein, 62 aa, Staphylococcus
EKDSPLLSKDNPSKKDKEQKDGLQALKSNSVATLNNQSKNKVAVADKDQTNKKAKQQQYKNH

SEQ ID NO: 2095427 - protein, 16 aa, Staphylococcus
EKEAEAKEKVDKTAKE

SEQ ID NO: 2095428 - protein, 14 aa, Staphylococcus
EKEEKWKVLENYNL

SEQ ID NO: 2095429 - protein, 16 aa, Staphylococcus
EKEKEAKEKVDKTAKE

SEQ ID NO: 2095430 - protein, 21 aa, Staphylococcus
EKELNSQRNKKTTNDSSDNQI

SEQ ID NO: 2095431 - protein, 17 aa, Staphylococcus
EKENEAKEKVDKSAKEL

SEQ ID NO: 2095432 - protein, 7 aa, Staphylococcus
EKEQEFK

SEQ ID NO: 2095433 - protein, 9 aa, Staphylococcus
EKEQPEFKN

SEQ ID NO: 2095434 - protein, 17 aa, Staphylococcus
EKEREAKEAVDKNAKEL

SEQ ID NO: 2095435 - protein, 16 aa, Staphylococcus
EKEREAKEKVDKTAKE

SEQ ID NO: 2095436 - protein, 32 aa, Staphylococcus
EKESEEKIETYDKDAANKKENKQEIPKDKSEM

SEQ ID NO: 2095437 - protein, 5 aa, Staphylococcus
EKESG

SEQ ID NO: 2095438 - protein, 5 aa, Staphylococcus
EKETG

SEQ ID NO: 2095439 - protein, 4 aa, Staphylococcus
EKFN

SEQ ID NO: 2095440 - protein, 6 aa, Staphylococcus
EKGESI

SEQ ID NO: 2095441 - protein, 8 aa, Staphylococcus
EKGKFPPK

SEQ ID NO: 2095442 - protein, 8 aa, Staphylococcus
EKGKSDLL

SEQ ID NO: 2095443 - protein, 6 aa, Staphylococcus
EKGNAE

SEQ ID NO: 2095444 - protein, 8 aa, Staphylococcus
EKGNAQEG

SEQ ID NO: 2095445 - protein, 7 aa, Staphylococcus
EKGNAQL

SEQ ID NO: 2095446 - protein, 8 aa, Staphylococcus
EKGNNIQS

SEQ ID NO: 2095447 - protein, 7 aa, Staphylococcus
EKHPAAY

SEQ ID NO: 2095448 - protein, 6 aa, Staphylococcus
EKIADY

SEQ ID NO: 2095449 - protein, 12 aa, Staphylococcus
EKIGATGSEDVE

SEQ ID NO: 2095450 - protein, 19 aa, Staphylococcus
EKIGDYKSVGARKQPNLEE

SEQ ID NO: 2095451 - protein, 7 aa, Staphylococcus
EKIPEYA

SEQ ID NO: 2095452 - protein, 6 aa, Staphylococcus
EKIQDI

SEQ ID NO: 2095453 - protein, 7 aa, Staphylococcus
EKKDITV

SEQ ID NO: 2095454 - protein, 14 aa, Staphylococcus
EKKDQLKTNLIFEN

SEQ ID NO: 2095455 - protein, 10 aa, Staphylococcus
EKKLKDNKGF

SEQ ID NO: 2095456 - protein, 22 aa, Staphylococcus
EKKRSKVEEDIKNAQNQEDAKQ

SEQ ID NO: 2095457 - protein, 9 aa, Staphylococcus
EKKSHGYKI

SEQ ID NO: 2095458 - protein, 10 aa, Staphylococcus
EKKTAKNLNS

SEQ ID NO: 2095459 - protein, 6 aa, Staphylococcus
EKLDRN

SEQ ID NO: 2095460 - protein, 7 aa, Staphylococcus
EKLGANP

SEQ ID NO: 2095461 - protein, 16 aa, Staphylococcus
EKLGKGHTLKHGSDVI

SEQ ID NO: 2095462 - protein, 20 aa, Staphylococcus
EKLKQQQSSSDSSSAASGLS

SEQ ID NO: 2095463 - protein, 12 aa, Staphylococcus
EKMSKYAKPIRI

SEQ ID NO: 2095464 - protein, 22 aa, Staphylococcus
EKNDEGEPVKDKNGKEKINGYY

SEQ ID NO: 2095465 - protein, 5 aa, Staphylococcus
EKNIY

SEQ ID NO: 2095466 - protein, 7 aa, Staphylococcus
EKNLPGV

SEQ ID NO: 2095467 - protein, 9 aa, Staphylococcus
EKNNKQNTE

SEQ ID NO: 2095468 - protein, 11 aa, Staphylococcus
EKPAPGTAPSN

SEQ ID NO: 2095469 - protein, 18 aa, Staphylococcus
EKPDEKPDDSERKFEKIK

SEQ ID NO: 2095470 - protein, 11 aa, Staphylococcus
EKPEQGTAPSN

SEQ ID NO: 2095471 - protein, 9 aa, Staphylococcus
EKPESKENM

SEQ ID NO: 2095472 - protein, 17 aa, Staphylococcus
EKPEVAPIPKKNSPNRI

SEQ ID NO: 2095473 - protein, 11 aa, Staphylococcus
EKPKQGTAPSN

SEQ ID NO: 2095474 - protein, 9 aa, Staphylococcus
EKPNNNPYA

SEQ ID NO: 2095475 - protein, 4 aa, Staphylococcus
EKPV

SEQ ID NO: 2095476 - protein, 22 aa, Staphylococcus
EKPYKSGANGWAVPSTTEHPED

SEQ ID NO: 2095477 - protein, 11 aa, Staphylococcus
EKQGGNVSANI

SEQ ID NO: 2095478 - protein, 10 aa, Staphylococcus
EKQLQSDGKV

SEQ ID NO: 2095479 - protein, 7 aa, Staphylococcus
EKQRQEY

SEQ ID NO: 2095480 - protein, 7 aa, Staphylococcus
EKQTGKK

SEQ ID NO: 2095481 - protein, 5 aa, Staphylococcus
EKRSY

SEQ ID NO: 2095482 - protein, 7 aa, Staphylococcus
EKRSYKS

SEQ ID NO: 2095483 - protein, 7 aa, Staphylococcus
EKRSYQS

SEQ ID NO: 2095484 - protein, 7 aa, Staphylococcus
EKRSYRS

SEQ ID NO: 2095485 - protein, 6 aa, Staphylococcus
EKRTGT

SEQ ID NO: 2095486 - protein, 19 aa, Staphylococcus
EKSALLPSSTAEDYNETLN

SEQ ID NO: 2095487 - protein, 9 aa, Staphylococcus
EKSESDAVK

SEQ ID NO: 2095488 - protein, 8 aa, Staphylococcus
EKSGTVNT

SEQ ID NO: 2095489 - protein, 5 aa, Staphylococcus
EKSLS

SEQ ID NO: 2095490 - protein, 13 aa, Staphylococcus
EKSLTNKTGMQGW

SEQ ID NO: 2095491 - protein, 6 aa, Staphylococcus
EKSNGE

SEQ ID NO: 2095492 - protein, 14 aa, Staphylococcus
EKTIKKDIKTYSNI

SEQ ID NO: 2095493 - protein, 9 aa, Staphylococcus
EKTSKGVTV

SEQ ID NO: 2095494 - protein, 24 aa, Staphylococcus
EKVEKATKKNDLADISEEQIPEMS

SEQ ID NO: 2095495 - protein, 14 aa, Staphylococcus
EKVKDKVNVGTDTT

SEQ ID NO: 2095496 - protein, 7 aa, Staphylococcus
EKVKQDY

SEQ ID NO: 2095497 - protein, 5 aa, Staphylococcus
EKYKN

SEQ ID NO: 2095498 - protein, 7 aa, Staphylococcus
EKYNDNS

SEQ ID NO: 2095499 - protein, 6 aa, Staphylococcus
ELAKKD

SEQ ID NO: 2095500 - protein, 9 aa, Staphylococcus
ELAKKDDID

SEQ ID NO: 2095501 - protein, 9 aa, Staphylococcus
ELAKKDGIN

SEQ ID NO: 2095502 - protein, 5 aa, Staphylococcus
ELASP

SEQ ID NO: 2095503 - protein, 6 aa, Staphylococcus
ELASSR

SEQ ID NO: 2095504 - protein, 9 aa, Staphylococcus
ELDSQYQLK

SEQ ID NO: 2095505 - protein, 16 aa, Staphylococcus
ELEKKDKKLSSTIKDN

SEQ ID NO: 2095506 - protein, 4 aa, Staphylococcus
ELER

SEQ ID NO: 2095507 - protein, 11 aa, Staphylococcus
ELKKSKPNVYK

SEQ ID NO: 2095508 - protein, 8 aa, Staphylococcus
ELKTTKID

SEQ ID NO: 2095509 - protein, 16 aa, Staphylococcus
ELNKKDKKLSADIQKN

SEQ ID NO: 2095510 - protein, 17 aa, Staphylococcus
ELNKKDKKLSADIQKNF

SEQ ID NO: 2095511 - protein, 12 aa, Staphylococcus
ELNREQIKQYFE

SEQ ID NO: 2095512 - protein, 7 aa, Staphylococcus
ELPFQSE

SEQ ID NO: 2095513 - protein, 5 aa, Staphylococcus
ELPNK

SEQ ID NO: 2095514 - protein, 5 aa, Staphylococcus
ELPPK

SEQ ID NO: 2095515 - protein, 15 aa, Staphylococcus
ELRGQASITPEKLKD

SEQ ID NO: 2095516 - protein, 9 aa, Staphylococcus
ELRSKGRVA

SEQ ID NO: 2095517 - protein, 10 aa, Staphylococcus
ELSTFGPGGR

SEQ ID NO: 2095518 - protein, 11 aa, Staphylococcus
ELSTFGPGSRF

SEQ ID NO: 2095519 - protein, 11 aa, Staphylococcus
ELSTFGPKGRF

SEQ ID NO: 2095520 - protein, 11 aa, Staphylococcus
ELSTFGSGERF

SEQ ID NO: 2095521 - protein, 11 aa, Staphylococcus
ELSTYGPKERF

SEQ ID NO: 2095522 - protein, 13 aa, Staphylococcus
ELSVTEKNALQTL

SEQ ID NO: 2095523 - protein, 9 aa, Staphylococcus
ELTDATPAV

SEQ ID NO: 2095524 - protein, 4 aa, Staphylococcus
ELTG

SEQ ID NO: 2095525 - protein, 11 aa, Staphylococcus
ELYPGSPKGQF

SEQ ID NO: 2095526 - protein, 7 aa, Staphylococcus
EMKTKPG

SEQ ID NO: 2095527 - protein, 12 aa, Staphylococcus
EMPKKSNGGKTL

SEQ ID NO: 2095528 - protein, 7 aa, Staphylococcus
EMPNAAQ

SEQ ID NO: 2095529 - protein, 5 aa, Staphylococcus
EMTQD

SEQ ID NO: 2095530 - protein, 21 aa, Staphylococcus
ENADDARNEAQTLYSRAPKAS

SEQ ID NO: 2095531 - protein, 10 aa, Staphylococcus
ENADDARYEA

SEQ ID NO: 2095532 - protein, 8 aa, Staphylococcus
ENAYGTDY

SEQ ID NO: 2095533 - protein, 20 aa, Staphylococcus
ENDPNKISKKAYETITDKKR

SEQ ID NO: 2095534 - protein, 7 aa, Staphylococcus
ENDYSND

SEQ ID NO: 2095535 - protein, 7 aa, Staphylococcus
ENEMSEL

SEQ ID NO: 2095536 - protein, 10 aa, Staphylococcus
ENENDGSGYW

SEQ ID NO: 2095537 - protein, 8 aa, Staphylococcus
ENENDTNF

SEQ ID NO: 2095538 - protein, 18 aa, Staphylococcus
ENGLTPSLADNNQGTGTI

SEQ ID NO: 2095539 - protein, 6 aa, Staphylococcus
ENISVE

SEQ ID NO: 2095540 - protein, 5 aa, Staphylococcus
ENKAL

SEQ ID NO: 2095541 - protein, 8 aa, Staphylococcus
ENKETKTM

SEQ ID NO: 2095542 - protein, 7 aa, Staphylococcus
ENKGTRD

SEQ ID NO: 2095543 - protein, 10 aa, Staphylococcus
ENKKVDPASL

SEQ ID NO: 2095544 - protein, 10 aa, Staphylococcus
ENKQASPMAD

SEQ ID NO: 2095545 - protein, 8 aa, Staphylococcus
ENKTGDTL

SEQ ID NO: 2095546 - protein, 6 aa, Staphylococcus
ENNGVT

SEQ ID NO: 2095547 - protein, 27 aa, Staphylococcus
ENNNEDLKNAAKKYLNNSQKAHPEDEV

SEQ ID NO: 2095548 - protein, 9 aa, Staphylococcus
ENNNSNQTL

SEQ ID NO: 2095549 - protein, 22 aa, Staphylococcus
ENPDHSNKISSLGVGAGEGQSL

SEQ ID NO: 2095550 - protein, 5 aa, Staphylococcus
ENPED

SEQ ID NO: 2095551 - protein, 35 aa, Staphylococcus
ENPNKSTNTSRSDQSAHQNNQKDDGNPKPKEGIGT

SEQ ID NO: 2095552 - protein, 10 aa, Staphylococcus
ENQFPEISDG

SEQ ID NO: 2095553 - protein, 11 aa, Staphylococcus
ENQFPEVSDGS

SEQ ID NO: 2095554 - protein, 15 aa, Staphylococcus
ENQGQAFSQAAKQYG

SEQ ID NO: 2095555 - protein, 15 aa, Staphylococcus
ENQKKAAEAKIQQLN

SEQ ID NO: 2095556 - protein, 12 aa, Staphylococcus
ENQRDKKGTQII

SEQ ID NO: 2095557 - protein, 10 aa, Staphylococcus
ENQSGALNES

SEQ ID NO: 2095558 - protein, 5 aa, Staphylococcus
ENQTG

SEQ ID NO: 2095559 - protein, 12 aa, Staphylococcus
ENREQIKETMNK

SEQ ID NO: 2095560 - protein, 4 aa, Staphylococcus
ENSI

SEQ ID NO: 2095561 - protein, 9 aa, Staphylococcus
ENSKPFKAT

SEQ ID NO: 2095562 - protein, 4 aa, Staphylococcus
ENSN

SEQ ID NO: 2095563 - protein, 9 aa, Staphylococcus
ENSQTEDEW

SEQ ID NO: 2095564 - protein, 5 aa, Staphylococcus
ENTDD

SEQ ID NO: 2095565 - protein, 14 aa, Staphylococcus
ENTQSSKDASGQIK

SEQ ID NO: 2095566 - protein, 28 aa, Staphylococcus
ENTSDRSASILSKGGVTKTNKNQYKDTL

SEQ ID NO: 2095567 - protein, 16 aa, Staphylococcus
ENTVTSGTPEESTDAW

SEQ ID NO: 2095568 - protein, 8 aa, Staphylococcus
ENVPKDNQ

SEQ ID NO: 2095569 - protein, 18 aa, Staphylococcus
ENVSNKVADTVRKETHAK

SEQ ID NO: 2095570 - protein, 13 aa, Staphylococcus
ENYQANREINKEK

SEQ ID NO: 2095571 - protein, 6 aa, Staphylococcus
ENYSKD

SEQ ID NO: 2095572 - protein, 11 aa, Staphylococcus
EPENDAASEKI

SEQ ID NO: 2095573 - protein, 5 aa, Staphylococcus
EPFGA

SEQ ID NO: 2095574 - protein, 12 aa, Staphylococcus
EPGERVSNEELN

SEQ ID NO: 2095575 - protein, 8 aa, Staphylococcus
EPGKTYKN

SEQ ID NO: 2095576 - protein, 10 aa, Staphylococcus
EPGSSGGAIL

SEQ ID NO: 2095577 - protein, 15 aa, Staphylococcus
EPGSSGGAVLNSKNE

SEQ ID NO: 2095578 - protein, 6 aa, Staphylococcus
EPGSTH

SEQ ID NO: 2095579 - protein, 7 aa, Staphylococcus
EPIPNDT

SEQ ID NO: 2095580 - protein, 4 aa, Staphylococcus
EPIS

SEQ ID NO: 2095581 - protein, 7 aa, Staphylococcus
EPPKGNF

SEQ ID NO: 2095582 - protein, 11 aa, Staphylococcus
EPQAQAVKQDG

SEQ ID NO: 2095583 - protein, 8 aa, Staphylococcus
EPQATAVK

SEQ ID NO: 2095584 - protein, 17 aa, Staphylococcus
EPVKDGVKKLMGRDKKS

SEQ ID NO: 2095585 - protein, 9 aa, Staphylococcus
EPVTGEGAL

SEQ ID NO: 2095586 - protein, 67 aa, Staphylococcus
EPVTKQAETIQPAEKNADESSQSKAASESTSSEKTIPTTDAAASTDSSKNTSTESSTEKEAVAGSQN

SEQ ID NO: 2095587 - protein, 4 aa, Staphylococcus
EPYN

SEQ ID NO: 2095588 - protein, 5 aa, Staphylococcus
EPYSK

SEQ ID NO: 2095589 - protein, 13 aa, Staphylococcus
EQAEKTKEEKGYT

SEQ ID NO: 2095590 - protein, 13 aa, Staphylococcus
EQAGKNTKDKSVV

SEQ ID NO: 2095591 - protein, 12 aa, Staphylococcus
EQAGKSKDDKSV

SEQ ID NO: 2095592 - protein, 15 aa, Staphylococcus
EQAKENGKSTGLVST

SEQ ID NO: 2095593 - protein, 14 aa, Staphylococcus
EQAKENGKSTGLVT

SEQ ID NO: 2095594 - protein, 13 aa, Staphylococcus
EQAKESGKSTGLV

SEQ ID NO: 2095595 - protein, 15 aa, Staphylococcus
EQANGSLVKQDGKVI

SEQ ID NO: 2095596 - protein, 5 aa, Staphylococcus
EQELE

SEQ ID NO: 2095597 - protein, 5 aa, Staphylococcus
EQEQS

SEQ ID NO: 2095598 - protein, 9 aa, Staphylococcus
EQGDTLSNY

SEQ ID NO: 2095599 - protein, 13 aa, Staphylococcus
EQGQEMTPNNKQQ

SEQ ID NO: 2095600 - protein, 6 aa, Staphylococcus
EQHKAN

SEQ ID NO: 2095601 - protein, 10 aa, Staphylococcus
EQIENEYNTK

SEQ ID NO: 2095602 - protein, 7 aa, Staphylococcus
EQITSKI

SEQ ID NO: 2095603 - protein, 4 aa, Staphylococcus
EQLE

SEQ ID NO: 2095604 - protein, 14 aa, Staphylococcus
EQLPKEGKDLSKLD

SEQ ID NO: 2095605 - protein, 33 aa, Staphylococcus
EQNKDKLKEVKVKDDSGKTTEPTKKTIQDGSYA

SEQ ID NO: 2095606 - protein, 7 aa, Staphylococcus
EQNPQEI

SEQ ID NO: 2095607 - protein, 21 aa, Staphylococcus
EQPQNSTEPQKEPWSQPPEGY

SEQ ID NO: 2095608 - protein, 22 aa, Staphylococcus
EQPQQSTEPEKEPWSQPPSGYK

SEQ ID NO: 2095609 - protein, 7 aa, Staphylococcus
EQQATLD

SEQ ID NO: 2095610 - protein, 12 aa, Staphylococcus
EQQDTKNNKESE

SEQ ID NO: 2095611 - protein, 12 aa, Staphylococcus
EQQNPQNHNESE

SEQ ID NO: 2095612 - protein, 7 aa, Staphylococcus
EQQPQES

SEQ ID NO: 2095613 - protein, 17 aa, Staphylococcus
EQQTVKSGDENTATQAW

SEQ ID NO: 2095614 - protein, 15 aa, Staphylococcus
EQQTVTSGDANTATV

SEQ ID NO: 2095615 - protein, 9 aa, Staphylococcus
EQSESVTAW

SEQ ID NO: 2095616 - protein, 11 aa, Staphylococcus
EQSKPMDKRTR

SEQ ID NO: 2095617 - protein, 16 aa, Staphylococcus
EQSSVTSGDENTATQA

SEQ ID NO: 2095618 - protein, 5 aa, Staphylococcus
EQTHV

SEQ ID NO: 2095619 - protein, 7 aa, Staphylococcus
EQVDNSK

SEQ ID NO: 2095620 - protein, 58 aa, Staphylococcus
ERDGENSEKNKQKENTHTDSNNTSSNESDTSKQSSQENTINQTEQNQPADNNSSSQQD

SEQ ID NO: 2095621 - protein, 14 aa, Staphylococcus
ERGGASASGHGNSV

SEQ ID NO: 2095622 - protein, 6 aa, Staphylococcus
ERGREL

SEQ ID NO: 2095623 - protein, 32 aa, Staphylococcus
ERKRKKKTEQKEAEFEKEKNKVSNPEYDDDHK

SEQ ID NO: 2095624 - protein, 33 aa, Staphylococcus
ERKRKKNTQHKENKFEQEKNKMSNPNDNNDHDA

SEQ ID NO: 2095625 - protein, 7 aa, Staphylococcus
ERNIDAS

SEQ ID NO: 2095626 - protein, 7 aa, Staphylococcus
ERNQDGT

SEQ ID NO: 2095627 - protein, 28 aa, Staphylococcus
ERRRSKKAQDQKDQIEKDKNKVYDSEEN

SEQ ID NO: 2095628 - protein, 10 aa, Staphylococcus
ERSGETNQDI

SEQ ID NO: 2095629 - protein, 8 aa, Staphylococcus
ERVGSKNV

SEQ ID NO: 2095630 - protein, 5 aa, Staphylococcus
ERYDA

SEQ ID NO: 2095631 - protein, 5 aa, Staphylococcus
ERYEA

SEQ ID NO: 2095632 - protein, 5 aa, Staphylococcus
ERYGS

SEQ ID NO: 2095633 - protein, 30 aa, Staphylococcus
ESAEPAPKEDDSSSDSKSSSSDSGEKVTRA

SEQ ID NO: 2095634 - protein, 13 aa, Staphylococcus
ESAKEKGKSTGLV

SEQ ID NO: 2095635 - protein, 12 aa, Staphylococcus
ESALSKLEKNDK

SEQ ID NO: 2095636 - protein, 5 aa, Staphylococcus
ESAQK

SEQ ID NO: 2095637 - protein, 7 aa, Staphylococcus
ESDELDN

SEQ ID NO: 2095638 - protein, 24 aa, Staphylococcus
ESDFSNASRPIKPEEKKKLDDKKV

SEQ ID NO: 2095639 - protein, 15 aa, Staphylococcus
ESDSGKSSLAQSPNY

SEQ ID NO: 2095640 - protein, 14 aa, Staphylococcus
ESDSGNSALAQKPN

SEQ ID NO: 2095641 - protein, 14 aa, Staphylococcus
ESDSGNSALAQSPH

SEQ ID NO: 2095642 - protein, 13 aa, Staphylococcus
ESDSGQSTLAKAP

SEQ ID NO: 2095643 - protein, 13 aa, Staphylococcus
ESDSGTSDLASSP

SEQ ID NO: 2095644 - protein, 9 aa, Staphylococcus
ESEDDKLNE

SEQ ID NO: 2095645 - protein, 6 aa, Staphylococcus
ESFPTE

SEQ ID NO: 2095646 - protein, 7 aa, Staphylococcus
ESGEYAI

SEQ ID NO: 2095647 - protein, 14 aa, Staphylococcus
ESGGNPNAVSPNGY

SEQ ID NO: 2095648 - protein, 34 aa, Staphylococcus
ESGGNVNASNGQYHGLGQTNQSWGYGSVSNQTKG

SEQ ID NO: 2095649 - protein, 7 aa, Staphylococcus
ESGRFDD

SEQ ID NO: 2095650 - protein, 12 aa, Staphylococcus
ESHDADYKEENM

SEQ ID NO: 2095651 - protein, 13 aa, Staphylococcus
ESIAGSDDNFSHN

SEQ ID NO: 2095652 - protein, 9 aa, Staphylococcus
ESIEPGTTH

SEQ ID NO: 2095653 - protein, 7 aa, Staphylococcus
ESIPNDT

SEQ ID NO: 2095654 - protein, 7 aa, Staphylococcus
ESKARGI

SEQ ID NO: 2095655 - protein, 8 aa, Staphylococcus
ESKARGVL

SEQ ID NO: 2095656 - protein, 11 aa, Staphylococcus
ESKIPKKNKKI

SEQ ID NO: 2095657 - protein, 9 aa, Staphylococcus
ESKNADGSI

SEQ ID NO: 2095658 - protein, 5 aa, Staphylococcus
ESKQV

SEQ ID NO: 2095659 - protein, 9 aa, Staphylococcus
ESKVGKSDN

SEQ ID NO: 2095660 - protein, 17 aa, Staphylococcus
ESKVPEDMKSTNEGEFK

SEQ ID NO: 2095661 - protein, 158 aa, Staphylococcus
ESKYSNTDSNKDNQKTEEKHKKKNKSNQDSDQYNGNNNANQSQENAQSEPASGTYNGNSNINQSNNTTKQPSNNQYQNDKQQTNTNETKDKPSKNNYKPSMQNNTNNNNYNNHSQQNSQNSTQPSTSEKPNNQQSSSQNSENKPSNQQNNNNSTQNKH

SEQ ID NO: 2095662 - protein, 54 aa, Staphylococcus
ESNRSQVETQIKKANNQEDANQLTSKIESNNQNLKEAAQKYLESDDSNSKKAID

SEQ ID NO: 2095663 - protein, 16 aa, Staphylococcus
ESNSVKTSLTSTKKLI

SEQ ID NO: 2095664 - protein, 20 aa, Staphylococcus
ESPLKNDKNGKTNKKKSEIT

SEQ ID NO: 2095665 - protein, 5 aa, Staphylococcus
ESQAG

SEQ ID NO: 2095666 - protein, 7 aa, Staphylococcus
ESQARGV

SEQ ID NO: 2095667 - protein, 10 aa, Staphylococcus
ESQKASSDKV

SEQ ID NO: 2095668 - protein, 10 aa, Staphylococcus
ESQKGTSKKV

SEQ ID NO: 2095669 - protein, 18 aa, Staphylococcus
ESQKSSAKKTLDSLADSG

SEQ ID NO: 2095670 - protein, 10 aa, Staphylococcus
ESQKSSSGKV

SEQ ID NO: 2095671 - protein, 11 aa, Staphylococcus
ESQKSSSGKVL

SEQ ID NO: 2095672 - protein, 11 aa, Staphylococcus
ESQKSTDGKVL

SEQ ID NO: 2095673 - protein, 7 aa, Staphylococcus
ESQSRGL

SEQ ID NO: 2095674 - protein, 6 aa, Staphylococcus
ESSDDI

SEQ ID NO: 2095675 - protein, 7 aa, Staphylococcus
ESSFNGK

SEQ ID NO: 2095676 - protein, 10 aa, Staphylococcus
ESSIPKRQKK

SEQ ID NO: 2095677 - protein, 43 aa, Staphylococcus
ESSKEDHKSKSNQNNVQKAKKNESDKKDETSSTNTSKLSTKER

SEQ ID NO: 2095678 - protein, 14 aa, Staphylococcus
ESSSGNSALAQAPN

SEQ ID NO: 2095679 - protein, 14 aa, Staphylococcus
ESSSGNSTLAQAPN

SEQ ID NO: 2095680 - protein, 9 aa, Staphylococcus
ESSTSDAVK

SEQ ID NO: 2095681 - protein, 6 aa, Staphylococcus
ESVEKP

SEQ ID NO: 2095682 - protein, 29 aa, Staphylococcus
ESVKDHQQVETSSQFTNEDPKQKDDYNQA

SEQ ID NO: 2095683 - protein, 13 aa, Staphylococcus
ESVNATKQALNGV

SEQ ID NO: 2095684 - protein, 14 aa, Staphylococcus
ESWGTGSVASQTKG

SEQ ID NO: 2095685 - protein, 4 aa, Staphylococcus
ESYA

SEQ ID NO: 2095686 - protein, 27 aa, Staphylococcus
ESYEGEKLDTDTYTFKEPEKTSDGKWG

SEQ ID NO: 2095687 - protein, 4 aa, Staphylococcus
ETAD

SEQ ID NO: 2095688 - protein, 5 aa, Staphylococcus
ETADM

SEQ ID NO: 2095689 - protein, 6 aa, Staphylococcus
ETAEKY

SEQ ID NO: 2095690 - protein, 9 aa, Staphylococcus
ETAERIEKE

SEQ ID NO: 2095691 - protein, 5 aa, Staphylococcus
ETAIA

SEQ ID NO: 2095692 - protein, 7 aa, Staphylococcus
ETAKKYN

SEQ ID NO: 2095693 - protein, 4 aa, Staphylococcus
ETAN

SEQ ID NO: 2095694 - protein, 7 aa, Staphylococcus
ETAPTDY

SEQ ID NO: 2095695 - protein, 17 aa, Staphylococcus
ETDFSDASRPIKDEEKK

SEQ ID NO: 2095696 - protein, 25 aa, Staphylococcus
ETDFSNASRPIKDEEKKKLEDKNIK

SEQ ID NO: 2095697 - protein, 24 aa, Staphylococcus
ETDFSQASRPIKDEEKQKLEDKDI

SEQ ID NO: 2095698 - protein, 24 aa, Staphylococcus
ETDFSQASRPIKDEEKQKLEDKNI

SEQ ID NO: 2095699 - protein, 8 aa, Staphylococcus
ETDNDAAF

SEQ ID NO: 2095700 - protein, 19 aa, Staphylococcus
ETEAGRANGSTHDLDGQYD

SEQ ID NO: 2095701 - protein, 7 aa, Staphylococcus
ETEGKVN

SEQ ID NO: 2095702 - protein, 15 aa, Staphylococcus
ETGNGQSKLAKGANL

SEQ ID NO: 2095703 - protein, 14 aa, Staphylococcus
ETGNGQSQLAKGAN

SEQ ID NO: 2095704 - protein, 27 aa, Staphylococcus
ETGNGQSQLAKGANITNGAVNTRSATK

SEQ ID NO: 2095705 - protein, 16 aa, Staphylococcus
ETGNGTSDLAKGGDIV

SEQ ID NO: 2095706 - protein, 28 aa, Staphylococcus
ETGNGTSELSNGGYVDNNNKVVTNSSKK

SEQ ID NO: 2095707 - protein, 16 aa, Staphylococcus
ETGNGTSKLANGGDVV

SEQ ID NO: 2095708 - protein, 16 aa, Staphylococcus
ETGRGQSQLAKGANIV

SEQ ID NO: 2095709 - protein, 26 aa, Staphylococcus
ETGYQEKDKKKIDKGQQKLSTIQTDA

SEQ ID NO: 2095710 - protein, 6 aa, Staphylococcus
ETHKEM

SEQ ID NO: 2095711 - protein, 11 aa, Staphylococcus
ETKSPDVYPGM

SEQ ID NO: 2095712 - protein, 8 aa, Staphylococcus
ETLSDVNP

SEQ ID NO: 2095713 - protein, 7 aa, Staphylococcus
ETLSEIN

SEQ ID NO: 2095714 - protein, 5 aa, Staphylococcus
ETLYP

SEQ ID NO: 2095715 - protein, 9 aa, Staphylococcus
ETNGKIKPT

SEQ ID NO: 2095716 - protein, 7 aa, Staphylococcus
ETNIEER

SEQ ID NO: 2095717 - protein, 8 aa, Staphylococcus
ETNKGKKV

SEQ ID NO: 2095718 - protein, 10 aa, Staphylococcus
ETNTQLDGAS

SEQ ID NO: 2095719 - protein, 7 aa, Staphylococcus
ETPVPIK

SEQ ID NO: 2095720 - protein, 9 aa, Staphylococcus
ETQDIERYA

SEQ ID NO: 2095721 - protein, 18 aa, Staphylococcus
ETQDVEKYAKDKLDRKNA

SEQ ID NO: 2095722 - protein, 17 aa, Staphylococcus
ETQIKKDVKEAKKHSDA

SEQ ID NO: 2095723 - protein, 4 aa, Staphylococcus
ETQN

SEQ ID NO: 2095724 - protein, 18 aa, Staphylococcus
ETQNIEAYAQDKLKRKNA

SEQ ID NO: 2095725 - protein, 18 aa, Staphylococcus
ETQNIEKYAQDKLKRKNA

SEQ ID NO: 2095726 - protein, 18 aa, Staphylococcus
ETQNINAYAQDKLKRKNA

SEQ ID NO: 2095727 - protein, 5 aa, Staphylococcus
ETQYQ

SEQ ID NO: 2095728 - protein, 7 aa, Staphylococcus
ETRETTI

SEQ ID NO: 2095729 - protein, 8 aa, Staphylococcus
ETRKDKIT

SEQ ID NO: 2095730 - protein, 8 aa, Staphylococcus
ETSEIEDE

SEQ ID NO: 2095731 - protein, 7 aa, Staphylococcus
ETSLDGY

SEQ ID NO: 2095732 - protein, 19 aa, Staphylococcus
ETSSGGTQYPTDKPKTYGT

SEQ ID NO: 2095733 - protein, 11 aa, Staphylococcus
ETSYSELDDSI

SEQ ID NO: 2095734 - protein, 7 aa, Staphylococcus
ETSYTDL

SEQ ID NO: 2095735 - protein, 7 aa, Staphylococcus
ETSYTEL

SEQ ID NO: 2095736 - protein, 7 aa, Staphylococcus
ETTLPQP

SEQ ID NO: 2095737 - protein, 7 aa, Staphylococcus
ETTPIVK

SEQ ID NO: 2095738 - protein, 7 aa, Staphylococcus
ETTYTEL

SEQ ID NO: 2095739 - protein, 6 aa, Staphylococcus
EVAKGK

SEQ ID NO: 2095740 - protein, 15 aa, Staphylococcus
EVDPDDEAFSHPTKP

SEQ ID NO: 2095741 - protein, 7 aa, Staphylococcus
EVDSVDG

SEQ ID NO: 2095742 - protein, 9 aa, Staphylococcus
EVEDGGKTY

SEQ ID NO: 2095743 - protein, 12 aa, Staphylococcus
EVEKNPDKFGEI

SEQ ID NO: 2095744 - protein, 6 aa, Staphylococcus
EVKETD

SEQ ID NO: 2095745 - protein, 12 aa, Staphylococcus
EVKTNGEPPESF

SEQ ID NO: 2095746 - protein, 13 aa, Staphylococcus
EVNEGQSIIYDFE

SEQ ID NO: 2095747 - protein, 9 aa, Staphylococcus
EVPESETHR

SEQ ID NO: 2095748 - protein, 5 aa, Staphylococcus
EVQTV

SEQ ID NO: 2095749 - protein, 8 aa, Staphylococcus
EVTDATPA

SEQ ID NO: 2095750 - protein, 15 aa, Staphylococcus
EVTDGQTIAYGFEDY

SEQ ID NO: 2095751 - protein, 13 aa, Staphylococcus
EVVGGESTAKKVL

SEQ ID NO: 2095752 - protein, 5 aa, Staphylococcus
EWQPG

SEQ ID NO: 2095753 - protein, 17 aa, Staphylococcus
EWRKNTGDGLSSGEKQT

SEQ ID NO: 2095754 - protein, 10 aa, Staphylococcus
EYEKDSGKKV

SEQ ID NO: 2095755 - protein, 20 aa, Staphylococcus
EYEKEAKHLPAKTNKTRQLK

SEQ ID NO: 2095756 - protein, 9 aa, Staphylococcus
EYGDKEGQQ

SEQ ID NO: 2095757 - protein, 4 aa, Staphylococcus
EYGE

SEQ ID NO: 2095758 - protein, 22 aa, Staphylococcus
EYGENSQTLSVTKEAKADTDLK

SEQ ID NO: 2095759 - protein, 7 aa, Staphylococcus
EYGLEPK

SEQ ID NO: 2095760 - protein, 9 aa, Staphylococcus
EYIQDRSDR

SEQ ID NO: 2095761 - protein, 9 aa, Staphylococcus
EYITSKDPD

SEQ ID NO: 2095762 - protein, 13 aa, Staphylococcus
EYNYNRPSAYGTR

SEQ ID NO: 2095763 - protein, 10 aa, Staphylococcus
EYQGEYEAPK

SEQ ID NO: 2095764 - protein, 7 aa, Staphylococcus
EYREQLE

SEQ ID NO: 2095765 - protein, 5 aa, Staphylococcus
EYRTS

SEQ ID NO: 2095766 - protein, 33 aa, Staphylococcus
EYSDNAKKTQQDYTQDKTSDKHKQSNATTTTHQ

SEQ ID NO: 2095767 - protein, 4 aa, Staphylococcus
EYSK

SEQ ID NO: 2095768 - protein, 11 aa, Staphylococcus
EYTFTSDGQTW

SEQ ID NO: 2095769 - protein, 6 aa, Staphylococcus
EYWGRR

SEQ ID NO: 2095770 - protein, 12 aa, Staphylococcus
FAEEQESLDDQN

SEQ ID NO: 2095771 - protein, 13 aa, Staphylococcus
FAEGDESLDDQNI

SEQ ID NO: 2095772 - protein, 12 aa, Staphylococcus
FAEGDESLDQQN

SEQ ID NO: 2095773 - protein, 12 aa, Staphylococcus
FAEGNESLTDQN

SEQ ID NO: 2095774 - protein, 13 aa, Staphylococcus
FAEKDESLSDQNI

SEQ ID NO: 2095775 - protein, 6 aa, Staphylococcus
FAEPGE

SEQ ID NO: 2095776 - protein, 5 aa, Staphylococcus
FAKGS

SEQ ID NO: 2095777 - protein, 7 aa, Staphylococcus
FAPNGKY

SEQ ID NO: 2095778 - protein, 12 aa, Staphylococcus
FASEKNSKDTGM

SEQ ID NO: 2095779 - protein, 9 aa, Staphylococcus
FASPEQVTQ

SEQ ID NO: 2095780 - protein, 8 aa, Staphylococcus
FATTTTEI

SEQ ID NO: 2095781 - protein, 8 aa, Staphylococcus
FDGDYNDN

SEQ ID NO: 2095782 - protein, 8 aa, Staphylococcus
FDGDYNEN

SEQ ID NO: 2095783 - protein, 8 aa, Staphylococcus
FDGNYDDN

SEQ ID NO: 2095784 - protein, 11 aa, Staphylococcus
FDKEDGDLTDQ

SEQ ID NO: 2095785 - protein, 11 aa, Staphylococcus
FDKEQSINSIS

SEQ ID NO: 2095786 - protein, 4 aa, Staphylococcus
FDKG

SEQ ID NO: 2095787 - protein, 5 aa, Staphylococcus
FDKKD

SEQ ID NO: 2095788 - protein, 10 aa, Staphylococcus
FDNKKAKQLS

SEQ ID NO: 2095789 - protein, 6 aa, Staphylococcus
FDPEQE

SEQ ID NO: 2095790 - protein, 28 aa, Staphylococcus
FDPQNEKIAKKYGESYGTKANKAVYNGP

SEQ ID NO: 2095791 - protein, 26 aa, Staphylococcus
FDPQNSKIAKKYGEKYGTKADRAVYN

SEQ ID NO: 2095792 - protein, 10 aa, Staphylococcus
FDPTDNGGQF

SEQ ID NO: 2095793 - protein, 17 aa, Staphylococcus
FDPVPLKKDKQSTSEHK

SEQ ID NO: 2095794 - protein, 16 aa, Staphylococcus
FDPVPLKKDNKHCQHK

SEQ ID NO: 2095795 - protein, 19 aa, Staphylococcus
FDPVPLKKDNNHQHCEHHH

SEQ ID NO: 2095796 - protein, 8 aa, Staphylococcus
FDTHKAQQ

SEQ ID NO: 2095797 - protein, 8 aa, Staphylococcus
FEKEQGKW

SEQ ID NO: 2095798 - protein, 9 aa, Staphylococcus
FEKESGKKV

SEQ ID NO: 2095799 - protein, 8 aa, Staphylococcus
FEKTKEAQ

SEQ ID NO: 2095800 - protein, 11 aa, Staphylococcus
FENEDNRNNAA

SEQ ID NO: 2095801 - protein, 14 aa, Staphylococcus
FENVNEAKKALEEV

SEQ ID NO: 2095802 - protein, 28 aa, Staphylococcus
FENVQDAEKALEETKYETAGKYSGTDYE

SEQ ID NO: 2095803 - protein, 6 aa, Staphylococcus
FEPLKS

SEQ ID NO: 2095804 - protein, 5 aa, Staphylococcus
FEPTQ

SEQ ID NO: 2095805 - protein, 18 aa, Staphylococcus
FEQEGVNGMNNDEPSQKE

SEQ ID NO: 2095806 - protein, 6 aa, Staphylococcus
FEQQYN

SEQ ID NO: 2095807 - protein, 5 aa, Staphylococcus
FETNI

SEQ ID NO: 2095808 - protein, 9 aa, Staphylococcus
FETPEGTLE

SEQ ID NO: 2095809 - protein, 5 aa, Staphylococcus
FFPPY

SEQ ID NO: 2095810 - protein, 7 aa, Staphylococcus
FGDGKND

SEQ ID NO: 2095811 - protein, 6 aa, Staphylococcus
FGKGTK

SEQ ID NO: 2095812 - protein, 9 aa, Staphylococcus
FGKTKEGQW

SEQ ID NO: 2095813 - protein, 18 aa, Staphylococcus
FGLKGSKKDIVENKKDLD

SEQ ID NO: 2095814 - protein, 6 aa, Staphylococcus
FGLSGS

SEQ ID NO: 2095815 - protein, 16 aa, Staphylococcus
FGLSGTTKDIKDNPKH

SEQ ID NO: 2095816 - protein, 9 aa, Staphylococcus
FGNKNSRVD

SEQ ID NO: 2095817 - protein, 57 aa, Staphylococcus
FGNNDKGSSKVSDDSTSKSHQSSDNKGDQSSQSNQSSSQSSSKSSKTQQENTNTQDY

SEQ ID NO: 2095818 - protein, 9 aa, Staphylococcus
FGNTKNPKN

SEQ ID NO: 2095819 - protein, 12 aa, Staphylococcus
FGQADRSYRYSD

SEQ ID NO: 2095820 - protein, 15 aa, Staphylococcus
FGRESYDDKGSPIDS

SEQ ID NO: 2095821 - protein, 5 aa, Staphylococcus
FGRGT

SEQ ID NO: 2095822 - protein, 10 aa, Staphylococcus
FIETTAKEHD

SEQ ID NO: 2095823 - protein, 34 aa, Staphylococcus
FKAPKNKQPIRKSENRSQNGGKQYSLNDQRTFTT

SEQ ID NO: 2095824 - protein, 9 aa, Staphylococcus
FKAPNYEQD

SEQ ID NO: 2095825 - protein, 10 aa, Staphylococcus
FKAPQIEEDY

SEQ ID NO: 2095826 - protein, 10 aa, Staphylococcus
FKAPQIEENY

SEQ ID NO: 2095827 - protein, 10 aa, Staphylococcus
FKAPTYEQDI

SEQ ID NO: 2095828 - protein, 9 aa, Staphylococcus
FKASTQHGD

SEQ ID NO: 2095829 - protein, 10 aa, Staphylococcus
FKDANPQLNL

SEQ ID NO: 2095830 - protein, 25 aa, Staphylococcus
FKDDNGKEITPIGPTAWGGDDRTKF

SEQ ID NO: 2095831 - protein, 8 aa, Staphylococcus
FKDEDQAL

SEQ ID NO: 2095832 - protein, 9 aa, Staphylococcus
FKDSQVKDI

SEQ ID NO: 2095833 - protein, 21 aa, Staphylococcus
FKDTTKIGEADVEKVAKKKPD

SEQ ID NO: 2095834 - protein, 9 aa, Staphylococcus
FKEETPEEI

SEQ ID NO: 2095835 - protein, 8 aa, Staphylococcus
FKENKGVT

SEQ ID NO: 2095836 - protein, 10 aa, Staphylococcus
FKEQEEKYGS

SEQ ID NO: 2095837 - protein, 6 aa, Staphylococcus
FKHKPD

SEQ ID NO: 2095838 - protein, 37 aa, Staphylococcus
FKIEPDVSNYDLNSNYKISEQSVSPDTVKVTGGQKQL

SEQ ID NO: 2095839 - protein, 7 aa, Staphylococcus
FKKREQQ

SEQ ID NO: 2095840 - protein, 4 aa, Staphylococcus
FKNS

SEQ ID NO: 2095841 - protein, 8 aa, Staphylococcus
FKNTQSIR

SEQ ID NO: 2095842 - protein, 232 aa, Staphylococcus
FKQDDTQSDDNASDDVKDQNESETQNDKAESSNEDDVASSDVKQDDTHSDANTSDVADQNESETQDDKAETSNEDDVASSDVNQDDTHSDANASDDVKDQNESETQNDKAETSNEDDVASSDVKQDDTHSDANASDIADQNESVAQNDKAETSNEDVASSDKQDDTHSDANASDIADQNESATQDDKATSKEDDVVSNDKQDNAKVSTSSKEASTAENKVQPATFSAKVTPK

SEQ ID NO: 2095843 - protein, 12 aa, Staphylococcus
FKTIPHEQYSKY

SEQ ID NO: 2095844 - protein, 12 aa, Staphylococcus
FKTSQLKGSDDY

SEQ ID NO: 2095845 - protein, 10 aa, Staphylococcus
FKTTSQNVGY

SEQ ID NO: 2095846 - protein, 15 aa, Staphylococcus
FKVKTNDQEQQLEAN

SEQ ID NO: 2095847 - protein, 15 aa, Staphylococcus
FKYNGKTYAGISPYD

SEQ ID NO: 2095848 - protein, 4 aa, Staphylococcus
FNEG

SEQ ID NO: 2095849 - protein, 4 aa, Staphylococcus
FNGP

SEQ ID NO: 2095850 - protein, 10 aa, Staphylococcus
FNKATDEEIN

SEQ ID NO: 2095851 - protein, 6 aa, Staphylococcus
FNSDNE

SEQ ID NO: 2095852 - protein, 8 aa, Staphylococcus
FNSSKPIG

SEQ ID NO: 2095853 - protein, 9 aa, Staphylococcus
FNTPSDVTK

SEQ ID NO: 2095854 - protein, 6 aa, Staphylococcus
FNTTVS

SEQ ID NO: 2095855 - protein, 16 aa, Staphylococcus
FNVPNDKDEDISYNKV

SEQ ID NO: 2095856 - protein, 41 aa, Staphylococcus
FNYNQSTTTSTTSDGSSSSSSSSTTTSSSTQTTSSTSGNLY

SEQ ID NO: 2095857 - protein, 5 aa, Staphylococcus
FPEQI

SEQ ID NO: 2095858 - protein, 11 aa, Staphylococcus
FPETDKRYYDK

SEQ ID NO: 2095859 - protein, 11 aa, Staphylococcus
FPEYESEWTPK

SEQ ID NO: 2095860 - protein, 6 aa, Staphylococcus
FPGGTY

SEQ ID NO: 2095861 - protein, 12 aa, Staphylococcus
FPINQGQISREA

SEQ ID NO: 2095862 - protein, 13 aa, Staphylococcus
FPNWKDKAEQVQA

SEQ ID NO: 2095863 - protein, 10 aa, Staphylococcus
FPPYDGSPLV

SEQ ID NO: 2095864 - protein, 20 aa, Staphylococcus
FPSAVNQNNYPNGGFTGEQI

SEQ ID NO: 2095865 - protein, 7 aa, Staphylococcus
FPSKSHT

SEQ ID NO: 2095866 - protein, 4 aa, Staphylococcus
FPSQ

SEQ ID NO: 2095867 - protein, 8 aa, Staphylococcus
FPSTDKSF

SEQ ID NO: 2095868 - protein, 12 aa, Staphylococcus
FPSTDKSYYNQY

SEQ ID NO: 2095869 - protein, 15 aa, Staphylococcus
FPSWKDKAEKVQRQL

SEQ ID NO: 2095870 - protein, 14 aa, Staphylococcus
FPVQGRSVKSTLHS

SEQ ID NO: 2095871 - protein, 8 aa, Staphylococcus
FQDGPDYD

SEQ ID NO: 2095872 - protein, 4 aa, Staphylococcus
FQEH

SEQ ID NO: 2095873 - protein, 10 aa, Staphylococcus
FQGQNQADEL

SEQ ID NO: 2095874 - protein, 11 aa, Staphylococcus
FQGSDNRNNAA

SEQ ID NO: 2095875 - protein, 10 aa, Staphylococcus
FQGSKHSKVD

SEQ ID NO: 2095876 - protein, 22 aa, Staphylococcus
FQKDGYDYVTNKTDLANSKSDQ

SEQ ID NO: 2095877 - protein, 17 aa, Staphylococcus
FQTAEEAYKESLKLKYD

SEQ ID NO: 2095878 - protein, 6 aa, Staphylococcus
FRKDDN

SEQ ID NO: 2095879 - protein, 13 aa, Staphylococcus
FSDYADSMKKQGF

SEQ ID NO: 2095880 - protein, 13 aa, Staphylococcus
FSDYADSMRQQGY

SEQ ID NO: 2095881 - protein, 14 aa, Staphylococcus
FSDYANQIAKQGYQ

SEQ ID NO: 2095882 - protein, 11 aa, Staphylococcus
FSEYESKWTPK

SEQ ID NO: 2095883 - protein, 6 aa, Staphylococcus
FSGGGV

SEQ ID NO: 2095884 - protein, 19 aa, Staphylococcus
FSGQTDAPINFDKLKVSNH

SEQ ID NO: 2095885 - protein, 15 aa, Staphylococcus
FSGVTKSGKSASTVS

SEQ ID NO: 2095886 - protein, 13 aa, Staphylococcus
FSITNDDKNNPTI

SEQ ID NO: 2095887 - protein, 16 aa, Staphylococcus
FSLPSSDTELRDANGA

SEQ ID NO: 2095888 - protein, 40 aa, Staphylococcus
FSNEDKEEDHSKSKSSSQNKKENDDTKKKNDQHSDSKSSK

SEQ ID NO: 2095889 - protein, 47 aa, Staphylococcus
FSNSDNNDDNNDDNNDDNNDDNDNNNVTDDNNNNNNDDDNNYDNPDA

SEQ ID NO: 2095890 - protein, 17 aa, Staphylococcus
FSPAAQNENTMPYGTFS

SEQ ID NO: 2095891 - protein, 29 aa, Staphylococcus
FSQDGQNYDTVGYSQEQSVTTDDQGNATL

SEQ ID NO: 2095892 - protein, 9 aa, Staphylococcus
FSQNDQIDP

SEQ ID NO: 2095893 - protein, 19 aa, Staphylococcus
FSSKAEEEHKFNQKEVDEL

SEQ ID NO: 2095894 - protein, 17 aa, Staphylococcus
FSSNKQNKKLSEKEMNQ

SEQ ID NO: 2095895 - protein, 7 aa, Staphylococcus
FSSNYDR

SEQ ID NO: 2095896 - protein, 20 aa, Staphylococcus
FSSSSPSDKNIKLYRIDLTE

SEQ ID NO: 2095897 - protein, 7 aa, Staphylococcus
FSTPYTY

SEQ ID NO: 2095898 - protein, 17 aa, Staphylococcus
FTADNGPGLGDSNYWGG

SEQ ID NO: 2095899 - protein, 4 aa, Staphylococcus
FTDR

SEQ ID NO: 2095900 - protein, 4 aa, Staphylococcus
FTEG

SEQ ID NO: 2095901 - protein, 13 aa, Staphylococcus
FTGEANQAKGNND

SEQ ID NO: 2095902 - protein, 6 aa, Staphylococcus
FTNPEI

SEQ ID NO: 2095903 - protein, 6 aa, Staphylococcus
FTPEQL

SEQ ID NO: 2095904 - protein, 11 aa, Staphylococcus
FTQEKNQAKGN

SEQ ID NO: 2095905 - protein, 15 aa, Staphylococcus
FTQSQYELPFNEMQY

SEQ ID NO: 2095906 - protein, 8 aa, Staphylococcus
FTSDGQSW

SEQ ID NO: 2095907 - protein, 12 aa, Staphylococcus
FTSKDHSASGEK

SEQ ID NO: 2095908 - protein, 8 aa, Staphylococcus
FTSNGNTW

SEQ ID NO: 2095909 - protein, 32 aa, Staphylococcus
FTSPAGADTELLGSSAPQKYKNQGKTSSTSKD

SEQ ID NO: 2095910 - protein, 15 aa, Staphylococcus
FTSTGYRNETTSSGI

SEQ ID NO: 2095911 - protein, 6 aa, Staphylococcus
FTVNPN

SEQ ID NO: 2095912 - protein, 89 aa, Staphylococcus
GAAQAAETHQEVGNPESAVAQSIGDHKKQSDNQETQQDNVQSDEQATSTSQSVTNENEAQRLHNENKASTQVKDSTDQLNTNEGTTDNI

SEQ ID NO: 2095913 - protein, 6 aa, Staphylococcus
GAAQGI

SEQ ID NO: 2095914 - protein, 12 aa, Staphylococcus
GAASAETYTHTA

SEQ ID NO: 2095915 - protein, 9 aa, Staphylococcus
GAASLRNPQ

SEQ ID NO: 2095916 - protein, 19 aa, Staphylococcus
GADDKDELNSLKKNAENLG

SEQ ID NO: 2095917 - protein, 7 aa, Staphylococcus
GADLPDG

SEQ ID NO: 2095918 - protein, 71 aa, Staphylococcus
GADTVATTQAAPAAQSTDYSASYSNEASTQSVSSNQQSSNTNVEAVSAPKTTSYSASTSSSSSASTGGSVK

SEQ ID NO: 2095919 - protein, 12 aa, Staphylococcus
GAEGDESKQDPH

SEQ ID NO: 2095920 - protein, 12 aa, Staphylococcus
GAEGDKSKQDPH

SEQ ID NO: 2095921 - protein, 9 aa, Staphylococcus
GAENDPETI

SEQ ID NO: 2095922 - protein, 10 aa, Staphylococcus
GAGDTTAKNK

SEQ ID NO: 2095923 - protein, 9 aa, Staphylococcus
GAGPAGNER

SEQ ID NO: 2095924 - protein, 9 aa, Staphylococcus
GAGPNANGR

SEQ ID NO: 2095925 - protein, 8 aa, Staphylococcus
GAGPNANN

SEQ ID NO: 2095926 - protein, 9 aa, Staphylococcus
GAGPNANNR

SEQ ID NO: 2095927 - protein, 7 aa, Staphylococcus
GAGSANT

SEQ ID NO: 2095928 - protein, 13 aa, Staphylococcus
GAHSAELDPETPY

SEQ ID NO: 2095929 - protein, 14 aa, Staphylococcus
GAHSAELDPNTPHP

SEQ ID NO: 2095930 - protein, 13 aa, Staphylococcus
GAHSAELNPSTPY

SEQ ID NO: 2095931 - protein, 16 aa, Staphylococcus
GAKEDGSIGEDHNPET

SEQ ID NO: 2095932 - protein, 7 aa, Staphylococcus
GAKGDDP

SEQ ID NO: 2095933 - protein, 21 aa, Staphylococcus
GALGRKTKQGFYKKDKEKKQR

SEQ ID NO: 2095934 - protein, 12 aa, Staphylococcus
GAPFESAQADFG

SEQ ID NO: 2095935 - protein, 21 aa, Staphylococcus
GAPPQVQRNNSGWSNATYSEI

SEQ ID NO: 2095936 - protein, 33 aa, Staphylococcus
GAPQNAEADANNQAASQQTQQNNQSQQATNQDG

SEQ ID NO: 2095937 - protein, 9 aa, Staphylococcus
GAQAAGSYP

SEQ ID NO: 2095938 - protein, 10 aa, Staphylococcus
GAQDRGSKAY

SEQ ID NO: 2095939 - protein, 9 aa, Staphylococcus
GASPAPHAE

SEQ ID NO: 2095940 - protein, 13 aa, Staphylococcus
GASPKEPSYQEMK

SEQ ID NO: 2095941 - protein, 5 aa, Staphylococcus
GASSD

SEQ ID NO: 2095942 - protein, 12 aa, Staphylococcus
GASSNESSYQEL

SEQ ID NO: 2095943 - protein, 8 aa, Staphylococcus
GASSTVRK

SEQ ID NO: 2095944 - protein, 11 aa, Staphylococcus
GASTGIGAASA

SEQ ID NO: 2095945 - protein, 11 aa, Staphylococcus
GASTGIGQASA

SEQ ID NO: 2095946 - protein, 18 aa, Staphylococcus
GASTGIGQASAKALANEG

SEQ ID NO: 2095947 - protein, 11 aa, Staphylococcus
GATADDGQTRI

SEQ ID NO: 2095948 - protein, 43 aa, Staphylococcus
GATGLEAGNAHAAENTNQNYNSTATQTSSSHSSNASSESTSEV

SEQ ID NO: 2095949 - protein, 20 aa, Staphylococcus
GAYEGQSATFNTLEDNGNHT

SEQ ID NO: 2095950 - protein, 4 aa, Staphylococcus
GAYG

SEQ ID NO: 2095951 - protein, 9 aa, Staphylococcus
GAYGSNYDR

SEQ ID NO: 2095952 - protein, 20 aa, Staphylococcus
GAYKGESSEFNTLEATANNQ

SEQ ID NO: 2095953 - protein, 12 aa, Staphylococcus
GCGADKAGNKGF

SEQ ID NO: 2095954 - protein, 11 aa, Staphylococcus
GCGADSVGNKG

SEQ ID NO: 2095955 - protein, 4 aa, Staphylococcus
GCSA

SEQ ID NO: 2095956 - protein, 9 aa, Staphylococcus
GCSANSLNL

SEQ ID NO: 2095957 - protein, 14 aa, Staphylococcus
GCSDNQEENKYQSK

SEQ ID NO: 2095958 - protein, 11 aa, Staphylococcus
GCSQSQHNHKQ

SEQ ID NO: 2095959 - protein, 13 aa, Staphylococcus
GCTSADGKSVPDE

SEQ ID NO: 2095960 - protein, 14 aa, Staphylococcus
GDADVSSTRYTGTD

SEQ ID NO: 2095961 - protein, 15 aa, Staphylococcus
GDAENWAEGAKRDGY

SEQ ID NO: 2095962 - protein, 7 aa, Staphylococcus
GDAFQGL

SEQ ID NO: 2095963 - protein, 4 aa, Staphylococcus
GDAN

SEQ ID NO: 2095964 - protein, 13 aa, Staphylococcus
GDANISGVRYTGT

SEQ ID NO: 2095965 - protein, 40 aa, Staphylococcus
GDANLSGARYNGTDLTGALNEDPIKDPKKAMKATQDGFQK

SEQ ID NO: 2095966 - protein, 6 aa, Staphylococcus
GDARRE

SEQ ID NO: 2095967 - protein, 11 aa, Staphylococcus
GDATLAPEGQT

SEQ ID NO: 2095968 - protein, 16 aa, Staphylococcus
GDDDVEGKAVSKDEVS

SEQ ID NO: 2095969 - protein, 8 aa, Staphylococcus
GDEQIANT

SEQ ID NO: 2095970 - protein, 9 aa, Staphylococcus
GDEQIASTS

SEQ ID NO: 2095971 - protein, 23 aa, Staphylococcus
GDEVSRPGPRIDEGLKDLKEAIY

SEQ ID NO: 2095972 - protein, 10 aa, Staphylococcus
GDGDPFYSQN

SEQ ID NO: 2095973 - protein, 26 aa, Staphylococcus
GDGSKPFDGFTSKKTDILPDGKDYAD

SEQ ID NO: 2095974 - protein, 4 aa, Staphylococcus
GDHS

SEQ ID NO: 2095975 - protein, 32 aa, Staphylococcus
GDKSHKQRQNQKPPKKKAQSKPTSRQPQKGSF

SEQ ID NO: 2095976 - protein, 6 aa, Staphylococcus
GDKVIK

SEQ ID NO: 2095977 - protein, 4 aa, Staphylococcus
GDLD

SEQ ID NO: 2095978 - protein, 8 aa, Staphylococcus
GDLDPKID

SEQ ID NO: 2095979 - protein, 28 aa, Staphylococcus
GDLGDAHNWNNRAQSEGYHVDTTPKTHS

SEQ ID NO: 2095980 - protein, 19 aa, Staphylococcus
GDNHLSSYNHQSSLNQDEY

SEQ ID NO: 2095981 - protein, 11 aa, Staphylococcus
GDNKNNPLNAS

SEQ ID NO: 2095982 - protein, 6 aa, Staphylococcus
GDNPER

SEQ ID NO: 2095983 - protein, 4 aa, Staphylococcus
GDPD

SEQ ID NO: 2095984 - protein, 5 aa, Staphylococcus
GDPDF

SEQ ID NO: 2095985 - protein, 11 aa, Staphylococcus
GDQKLAQAQQQ

SEQ ID NO: 2095986 - protein, 7 aa, Staphylococcus
GDQSLEG

SEQ ID NO: 2095987 - protein, 7 aa, Staphylococcus
GDRYDVG

SEQ ID NO: 2095988 - protein, 17 aa, Staphylococcus
GDSADGYPGVKGIGEKT

SEQ ID NO: 2095989 - protein, 4 aa, Staphylococcus
GDSI

SEQ ID NO: 2095990 - protein, 5 aa, Staphylococcus
GDSPL

SEQ ID NO: 2095991 - protein, 14 aa, Staphylococcus
GDTDAKKVRPANEV

SEQ ID NO: 2095992 - protein, 5 aa, Staphylococcus
GDTDL

SEQ ID NO: 2095993 - protein, 15 aa, Staphylococcus
GDTGGSEIKPSNTVQ

SEQ ID NO: 2095994 - protein, 4 aa, Staphylococcus
GDTP

SEQ ID NO: 2095995 - protein, 5 aa, Staphylococcus
GDTPF

SEQ ID NO: 2095996 - protein, 11 aa, Staphylococcus
GDTTLAPEGQT

SEQ ID NO: 2095997 - protein, 12 aa, Staphylococcus
GDVDTTKSGTYE

SEQ ID NO: 2095998 - protein, 7 aa, Staphylococcus
GDVEPME

SEQ ID NO: 2095999 - protein, 11 aa, Staphylococcus
GDVNGKQQDKI

SEQ ID NO: 2096000 - protein, 11 aa, Staphylococcus
GDVNGNQQNKI

SEQ ID NO: 2096001 - protein, 6 aa, Staphylococcus
GDYKQN

SEQ ID NO: 2096002 - protein, 76 aa, Staphylococcus
GEADSQPSTQGYTEGSTQAVSSNAQASNTNVQAVSAPRSSYQTSTTSYSAPATSSYSSSVRLSNGNTAGATGSSAA

SEQ ID NO: 2096003 - protein, 4 aa, Staphylococcus
GEAN

SEQ ID NO: 2096004 - protein, 6 aa, Staphylococcus
GEDEII

SEQ ID NO: 2096005 - protein, 7 aa, Staphylococcus
GEDNRPL

SEQ ID NO: 2096006 - protein, 7 aa, Staphylococcus
GEDNRTL

SEQ ID NO: 2096007 - protein, 5 aa, Staphylococcus
GEDVS

SEQ ID NO: 2096008 - protein, 11 aa, Staphylococcus
GEEGNKDKLDP

SEQ ID NO: 2096009 - protein, 6 aa, Staphylococcus
GEETLS

SEQ ID NO: 2096010 - protein, 7 aa, Staphylococcus
GEHGDSQ

SEQ ID NO: 2096011 - protein, 5 aa, Staphylococcus
GEHNT

SEQ ID NO: 2096012 - protein, 4 aa, Staphylococcus
GEHY

SEQ ID NO: 2096013 - protein, 5 aa, Staphylococcus
GEINQ

SEQ ID NO: 2096014 - protein, 6 aa, Staphylococcus
GEISSG

SEQ ID NO: 2096015 - protein, 17 aa, Staphylococcus
GEIVEGESKIPKKNKKI

SEQ ID NO: 2096016 - protein, 13 aa, Staphylococcus
GEKEKDEKDDSNY

SEQ ID NO: 2096017 - protein, 12 aa, Staphylococcus
GELAQQSEADLQ

SEQ ID NO: 2096018 - protein, 6 aa, Staphylococcus
GELSND

SEQ ID NO: 2096019 - protein, 13 aa, Staphylococcus
GELTTQEVKDLKE

SEQ ID NO: 2096020 - protein, 8 aa, Staphylococcus
GENEGQKA

SEQ ID NO: 2096021 - protein, 12 aa, Staphylococcus
GENGNKNKQDPH

SEQ ID NO: 2096022 - protein, 6 aa, Staphylococcus
GENHDH

SEQ ID NO: 2096023 - protein, 8 aa, Staphylococcus
GENKAVYG

SEQ ID NO: 2096024 - protein, 6 aa, Staphylococcus
GENYPE

SEQ ID NO: 2096025 - protein, 4 aa, Staphylococcus
GEPD

SEQ ID NO: 2096026 - protein, 10 aa, Staphylococcus
GEPPHEGTQA

SEQ ID NO: 2096027 - protein, 25 aa, Staphylococcus
GEQPQKTAAFNDSHENNRDSSDQNF

SEQ ID NO: 2096028 - protein, 7 aa, Staphylococcus
GERYDVG

SEQ ID NO: 2096029 - protein, 9 aa, Staphylococcus
GESGAIQTN

SEQ ID NO: 2096030 - protein, 25 aa, Staphylococcus
GESINKVTKKYGTPIYSKEPSGKEH

SEQ ID NO: 2096031 - protein, 30 aa, Staphylococcus
GESKETKNKVKQLEAKNQRLEADNKKFKKE

SEQ ID NO: 2096032 - protein, 4 aa, Staphylococcus
GESM

SEQ ID NO: 2096033 - protein, 13 aa, Staphylococcus
GESTDASFGKAIY

SEQ ID NO: 2096034 - protein, 29 aa, Staphylococcus
GETAGPTSGNYWGGDRTDLQKDLENNGYN

SEQ ID NO: 2096035 - protein, 26 aa, Staphylococcus
GETDFSNASRPIKDEEKKKLEDKGIK

SEQ ID NO: 2096036 - protein, 19 aa, Staphylococcus
GETGKQKEPSKESQKSDKY

SEQ ID NO: 2096037 - protein, 11 aa, Staphylococcus
GETGNKDKIDP

SEQ ID NO: 2096038 - protein, 9 aa, Staphylococcus
GETTPIEKE

SEQ ID NO: 2096039 - protein, 5 aa, Staphylococcus
GETVY

SEQ ID NO: 2096040 - protein, 7 aa, Staphylococcus
GEVSNQN

SEQ ID NO: 2096041 - protein, 4 aa, Staphylococcus
GEYL

SEQ ID NO: 2096042 - protein, 30 aa, Staphylococcus
GFENEADSLTYSKGDYKNSKLSSGDQRVDT

SEQ ID NO: 2096043 - protein, 11 aa, Staphylococcus
GFKPTPYPTYN

SEQ ID NO: 2096044 - protein, 8 aa, Staphylococcus
GFSSDENE

SEQ ID NO: 2096045 - protein, 11 aa, Staphylococcus
GFTQGSDYDQR

SEQ ID NO: 2096046 - protein, 48 aa, Staphylococcus
GGADAAEASPEKQSDAAQVQESVDTTQLPDKQSESQQQATQNQTETLL

SEQ ID NO: 2096047 - protein, 7 aa, Staphylococcus
GGAGEET

SEQ ID NO: 2096048 - protein, 7 aa, Staphylococcus
GGATCAS

SEQ ID NO: 2096049 - protein, 6 aa, Staphylococcus
GGATFA

SEQ ID NO: 2096050 - protein, 7 aa, Staphylococcus
GGATVAS

SEQ ID NO: 2096051 - protein, 4 aa, Staphylococcus
GGDK

SEQ ID NO: 2096052 - protein, 8 aa, Staphylococcus
GGDLPRNT

SEQ ID NO: 2096053 - protein, 9 aa, Staphylococcus
GGDSAGAQL

SEQ ID NO: 2096054 - protein, 8 aa, Staphylococcus
GGDTTLKD

SEQ ID NO: 2096055 - protein, 7 aa, Staphylococcus
GGENVIQ

SEQ ID NO: 2096056 - protein, 5 aa, Staphylococcus
GGETT

SEQ ID NO: 2096057 - protein, 4 aa, Staphylococcus
GGGF

SEQ ID NO: 2096058 - protein, 6 aa, Staphylococcus
GGGGIP

SEQ ID NO: 2096059 - protein, 6 aa, Staphylococcus
GGGGVP

SEQ ID NO: 2096060 - protein, 12 aa, Staphylococcus
GGGHSQSSSDHK

SEQ ID NO: 2096061 - protein, 20 aa, Staphylococcus
GGGNNKKVTIGVASNDTAAW

SEQ ID NO: 2096062 - protein, 23 aa, Staphylococcus
GGHDAHAAEQNNNGYNPNDPYSY

SEQ ID NO: 2096063 - protein, 16 aa, Staphylococcus
GGIDGAGPGTAPSGYT

SEQ ID NO: 2096064 - protein, 11 aa, Staphylococcus
GGIDSSRASNF

SEQ ID NO: 2096065 - protein, 13 aa, Staphylococcus
GGIEGESNSAVAM

SEQ ID NO: 2096066 - protein, 4 aa, Staphylococcus
GGIG

SEQ ID NO: 2096067 - protein, 5 aa, Staphylococcus
GGINE

SEQ ID NO: 2096068 - protein, 7 aa, Staphylococcus
GGIQSEF

SEQ ID NO: 2096069 - protein, 57 aa, Staphylococcus
GGKDDSSKDSSDSDSSNKSSESKKDSGKTDSVKVDSSDDDKKKSDSKFENDKLTSKD

SEQ ID NO: 2096070 - protein, 35 aa, Staphylococcus
GGKIGSNWGNASNWANAAAQDGYNVSNSPKQGAIM

SEQ ID NO: 2096071 - protein, 34 aa, Staphylococcus
GGKIGSTWGNANNWANAAASAGYTVNNRPSAGAI

SEQ ID NO: 2096072 - protein, 34 aa, Staphylococcus
GGKIGSTWGNANNWANAAASAGYTVNNSPSQGAI

SEQ ID NO: 2096073 - protein, 43 aa, Staphylococcus
GGKIGSTWGNANNWASAAAASGYTVNNSPASGSVLQSTAGGYG

SEQ ID NO: 2096074 - protein, 43 aa, Staphylococcus
GGKIGSTWGNANNWASAASAAGYTVNNTPEKGSILQTSEGSYG

SEQ ID NO: 2096075 - protein, 42 aa, Staphylococcus
GGKIGSTWGNANNWATAAAADGYTVNNTPKAGAVMQTSQGAY

SEQ ID NO: 2096076 - protein, 24 aa, Staphylococcus
GGKIGSTWGNANNWATSAQSAGYT

SEQ ID NO: 2096077 - protein, 43 aa, Staphylococcus
GGKIGSTWGNASNWASAAASEGYNVSNSPKQGAVMQTSQGAYG

SEQ ID NO: 2096078 - protein, 34 aa, Staphylococcus
GGKISSTWGNANNWANAAASSGYTVNNTPKQGAI

SEQ ID NO: 2096079 - protein, 11 aa, Staphylococcus
GGKSNSDKNTL

SEQ ID NO: 2096080 - protein, 24 aa, Staphylococcus
GGKVGSTWGDARNWASAAQQAGYT

SEQ ID NO: 2096081 - protein, 32 aa, Staphylococcus
GGKVGSTWGNANNWANAAAAAGYTVNNRPAAG

SEQ ID NO: 2096082 - protein, 10 aa, Staphylococcus
GGNAKKYVKD

SEQ ID NO: 2096083 - protein, 11 aa, Staphylococcus
GGNIEQGTSEL

SEQ ID NO: 2096084 - protein, 35 aa, Staphylococcus
GGNIGSTWGNANNWASAASSAGYTVNNSPEAGSIL

SEQ ID NO: 2096085 - protein, 13 aa, Staphylococcus
GGNKKDDKTVTVG

SEQ ID NO: 2096086 - protein, 4 aa, Staphylococcus
GGNN

SEQ ID NO: 2096087 - protein, 6 aa, Staphylococcus
GGNNDK

SEQ ID NO: 2096088 - protein, 26 aa, Staphylococcus
GGNNGGSGSGSDLKGSAKGEGSSTVA

SEQ ID NO: 2096089 - protein, 26 aa, Staphylococcus
GGNSSLDNNSKSSNSESGKGNYKPKE

SEQ ID NO: 2096090 - protein, 5 aa, Staphylococcus
GGQTI

SEQ ID NO: 2096091 - protein, 5 aa, Staphylococcus
GGRGI

SEQ ID NO: 2096092 - protein, 272 aa, Staphylococcus
GGSAQAAENQDKGNVDSEAQQAQSIGEQQGNDVKNEQTNQSSELKKQNDSVEAQNDNQQDATPTSLHKETSEKDTTQTSQDNTEEKQPKDATVESDQSVDQVQQDVKTAPKEKTTEDQATKSVEKPDTTTPNQKDKANGKAVKEETPTPSPKAQDKASSTQTHQHDVDPEFNSRHKASQVDPEFSHKQAQKKADVDSEFNKNHKAQQVDPDFSRRHATEKATHATVNKEKSDATINQKDQHKVTAQSVDQTATAPNQTDSSQKSKQKQPVSL

SEQ ID NO: 2096093 - protein, 342 aa, Staphylococcus
GGSAQAAEQNQEQGNPEKATAQSIGDENEDSNGQQATEDDTSQSAKETTSEQPNVEKDNSENANDNQTSLHNENNQNTEQQDSETEEQDTAQNTEQTKSTEEQGKEEKTSAQDATQNSTKSSDEQVESSEDSQVDNSKEDAKQEDANQADSKSEQTEEQTDVQSQPTEKSDEDKSTQSKPEVNQNQESEKDSSETQDNLKQDNPKTEDKTEEVSDSQKDLQKDTQNNQKEDDLSSDKETTQSDRAVKNQAKDETEASQTDKDQDQSQTATKPKASQQDKENDAEEQQKVSAQDEATSEETPAETDNHKTQALSVSDKANPKSEKDESSNNDKDSKDGLGTLK

SEQ ID NO: 2096094 - protein, 30 aa, Staphylococcus
GGSASQSSNSNASSNTGSASTHTVKAGESL

SEQ ID NO: 2096095 - protein, 29 aa, Staphylococcus
GGSASQSSSSNTSSQSGSPSTHTVQSGES

SEQ ID NO: 2096096 - protein, 43 aa, Staphylococcus
GGSIGNTWGNANNWANAAAQSGYTVNNTPKAGAVMQTTQGGYG

SEQ ID NO: 2096097 - protein, 30 aa, Staphylococcus
GGSTDAYAKQEMSGGESFKGYAGRFVRQHI

SEQ ID NO: 2096098 - protein, 10 aa, Staphylococcus
GGTDHADPHA

SEQ ID NO: 2096099 - protein, 9 aa, Staphylococcus
GGTDHSDPV

SEQ ID NO: 2096100 - protein, 9 aa, Staphylococcus
GGTNNSEKY

SEQ ID NO: 2096101 - protein, 11 aa, Staphylococcus
GGTQSQIPSYK

SEQ ID NO: 2096102 - protein, 8 aa, Staphylococcus
GGTTTTIK

SEQ ID NO: 2096103 - protein, 18 aa, Staphylococcus
GGVGNEYSVNPDSYINSK

SEQ ID NO: 2096104 - protein, 12 aa, Staphylococcus
GHDLTQSEVEQA

SEQ ID NO: 2096105 - protein, 21 aa, Staphylococcus
GHEAHAAEQGYNPNDPTSYSY

SEQ ID NO: 2096106 - protein, 4 aa, Staphylococcus
GHES

SEQ ID NO: 2096107 - protein, 4 aa, Staphylococcus
GHGG

SEQ ID NO: 2096108 - protein, 8 aa, Staphylococcus
GHGTTEKI

SEQ ID NO: 2096109 - protein, 14 aa, Staphylococcus
GHHAEAASGNSMQT

SEQ ID NO: 2096110 - protein, 12 aa, Staphylococcus
GHNAVDEMLEEL

SEQ ID NO: 2096111 - protein, 16 aa, Staphylococcus
GHRTSAEGAPLKRGAA

SEQ ID NO: 2096112 - protein, 36 aa, Staphylococcus
GHSDNKSSDSKKDNKQEAKHKDNKTSEKQTNKERFS

SEQ ID NO: 2096113 - protein, 11 aa, Staphylococcus
GIADDKKKERI

SEQ ID NO: 2096114 - protein, 11 aa, Staphylococcus
GIADDNKKNRM

SEQ ID NO: 2096115 - protein, 8 aa, Staphylococcus
GIDGNATI

SEQ ID NO: 2096116 - protein, 9 aa, Staphylococcus
GIDGNPNIY

SEQ ID NO: 2096117 - protein, 24 aa, Staphylococcus
GIDGNSDIYRPTWKSEASSYRDAT

SEQ ID NO: 2096118 - protein, 21 aa, Staphylococcus
GIDQSQAKEMLKKDEKAFKGV

SEQ ID NO: 2096119 - protein, 11 aa, Staphylococcus
GIEKDAKAQGM

SEQ ID NO: 2096120 - protein, 6 aa, Staphylococcus
GIESPG

SEQ ID NO: 2096121 - protein, 4 aa, Staphylococcus
GIET

SEQ ID NO: 2096122 - protein, 5 aa, Staphylococcus
GIETT

SEQ ID NO: 2096123 - protein, 17 aa, Staphylococcus
GILEGQGAAFAQAAQKY

SEQ ID NO: 2096124 - protein, 18 aa, Staphylococcus
GINDERKEKYKFSEPYTY

SEQ ID NO: 2096125 - protein, 5 aa, Staphylococcus
GINGE

SEQ ID NO: 2096126 - protein, 14 aa, Staphylococcus
GINKPNTDFDKPRW

SEQ ID NO: 2096127 - protein, 15 aa, Staphylococcus
GIPGASATRERGKGF

SEQ ID NO: 2096128 - protein, 5 aa, Staphylococcus
GIQPG

SEQ ID NO: 2096129 - protein, 11 aa, Staphylococcus
GISAEAKKQGI

SEQ ID NO: 2096130 - protein, 7 aa, Staphylococcus
GISQTTL

SEQ ID NO: 2096131 - protein, 5 aa, Staphylococcus
GISRS

SEQ ID NO: 2096132 - protein, 12 aa, Staphylococcus
GITGPAKGEDYV

SEQ ID NO: 2096133 - protein, 17 aa, Staphylococcus
GITPTLADDNAGKGSVI

SEQ ID NO: 2096134 - protein, 12 aa, Staphylococcus
GIYNGGGIAEGP

SEQ ID NO: 2096135 - protein, 13 aa, Staphylococcus
GIYSGGGTKEGPY

SEQ ID NO: 2096136 - protein, 12 aa, Staphylococcus
GKAAEKEWREND

SEQ ID NO: 2096137 - protein, 13 aa, Staphylococcus
GKADEKEWRENDG

SEQ ID NO: 2096138 - protein, 9 aa, Staphylococcus
GKAEDAKTL

SEQ ID NO: 2096139 - protein, 12 aa, Staphylococcus
GKAKEKEWREND

SEQ ID NO: 2096140 - protein, 12 aa, Staphylococcus
GKANEKEWREND

SEQ ID NO: 2096141 - protein, 25 aa, Staphylococcus
GKASYQFSSNSPKDKNVKLYRIDLS

SEQ ID NO: 2096142 - protein, 7 aa, Staphylococcus
GKATNPY

SEQ ID NO: 2096143 - protein, 18 aa, Staphylococcus
GKDETLKDSIENELTENG

SEQ ID NO: 2096144 - protein, 8 aa, Staphylococcus
GKDKAEQI

SEQ ID NO: 2096145 - protein, 22 aa, Staphylococcus
GKDKEDSKKITVAASPAPHGDV

SEQ ID NO: 2096146 - protein, 12 aa, Staphylococcus
GKDNQKGLGDVT

SEQ ID NO: 2096147 - protein, 9 aa, Staphylococcus
GKDQIASKS

SEQ ID NO: 2096148 - protein, 9 aa, Staphylococcus
GKDQIASTS

SEQ ID NO: 2096149 - protein, 11 aa, Staphylococcus
GKDQTIRQSQM

SEQ ID NO: 2096150 - protein, 20 aa, Staphylococcus
GKDSGNKSSDAKSSNTKDTV

SEQ ID NO: 2096151 - protein, 9 aa, Staphylococcus
GKEDAVKKW

SEQ ID NO: 2096152 - protein, 9 aa, Staphylococcus
GKEDEVKKW

SEQ ID NO: 2096153 - protein, 10 aa, Staphylococcus
GKEDEVKKWE

SEQ ID NO: 2096154 - protein, 10 aa, Staphylococcus
GKEDEVKSWE

SEQ ID NO: 2096155 - protein, 9 aa, Staphylococcus
GKEDEVQKW

SEQ ID NO: 2096156 - protein, 34 aa, Staphylococcus
GKEDKAKKWTEDWKKETSKDGKEIKDKIGKDSTV

SEQ ID NO: 2096157 - protein, 19 aa, Staphylococcus
GKEDSSNKGSKDGDKINVS

SEQ ID NO: 2096158 - protein, 8 aa, Staphylococcus
GKETLSEY

SEQ ID NO: 2096159 - protein, 10 aa, Staphylococcus
GKGGDEKDKK

SEQ ID NO: 2096160 - protein, 10 aa, Staphylococcus
GKGKTTEEAL

SEQ ID NO: 2096161 - protein, 13 aa, Staphylococcus
GKGNDEKQSLEQD

SEQ ID NO: 2096162 - protein, 16 aa, Staphylococcus
GKGTDGWQQTSGTYRK

SEQ ID NO: 2096163 - protein, 5 aa, Staphylococcus
GKIGQ

SEQ ID NO: 2096164 - protein, 33 aa, Staphylococcus
GKIGSTWGNANNWASAAAASGYTVNNSPSAGAI

SEQ ID NO: 2096165 - protein, 23 aa, Staphylococcus
GKIGSTWGNANNWASAAQAAGYT

SEQ ID NO: 2096166 - protein, 30 aa, Staphylococcus
GKIGSTWGNASNWANAAAAAGYTVNNRPSV

SEQ ID NO: 2096167 - protein, 7 aa, Staphylococcus
GKIKPTI

SEQ ID NO: 2096168 - protein, 8 aa, Staphylococcus
GKISTKDM

SEQ ID NO: 2096169 - protein, 28 aa, Staphylococcus
GKKAHYKENFNSKGYYEEHEPDYKEENM

SEQ ID NO: 2096170 - protein, 10 aa, Staphylococcus
GKKAKRIDNF

SEQ ID NO: 2096171 - protein, 28 aa, Staphylococcus
GKKAKYKENFNSKGYYQEHDPDYKEENM

SEQ ID NO: 2096172 - protein, 14 aa, Staphylococcus
GKKGYIKTPYPTYN

SEQ ID NO: 2096173 - protein, 8 aa, Staphylococcus
GKKKPISR

SEQ ID NO: 2096174 - protein, 10 aa, Staphylococcus
GKKNHNGTYT

SEQ ID NO: 2096175 - protein, 8 aa, Staphylococcus
GKKNQGYV

SEQ ID NO: 2096176 - protein, 8 aa, Staphylococcus
GKKNTGYV

SEQ ID NO: 2096177 - protein, 7 aa, Staphylococcus
GKKNVPQ

SEQ ID NO: 2096178 - protein, 9 aa, Staphylococcus
GKKQDEPYL

SEQ ID NO: 2096179 - protein, 6 aa, Staphylococcus
GKKVEI

SEQ ID NO: 2096180 - protein, 11 aa, Staphylococcus
GKKVGSDWGDA

SEQ ID NO: 2096181 - protein, 8 aa, Staphylococcus
GKLAQRSN

SEQ ID NO: 2096182 - protein, 8 aa, Staphylococcus
GKLSTTTA

SEQ ID NO: 2096183 - protein, 12 aa, Staphylococcus
GKNAKHNLTTKQ

SEQ ID NO: 2096184 - protein, 5 aa, Staphylococcus
GKNAW

SEQ ID NO: 2096185 - protein, 12 aa, Staphylococcus
GKNDEKAALQKD

SEQ ID NO: 2096186 - protein, 14 aa, Staphylococcus
GKNDKNKESRRDYV

SEQ ID NO: 2096187 - protein, 7 aa, Staphylococcus
GKNQHQT

SEQ ID NO: 2096188 - protein, 18 aa, Staphylococcus
GKNSTSESSSSSKDTITV

SEQ ID NO: 2096189 - protein, 7 aa, Staphylococcus
GKNVPET

SEQ ID NO: 2096190 - protein, 6 aa, Staphylococcus
GKPGDH

SEQ ID NO: 2096191 - protein, 15 aa, Staphylococcus
GKPGDTVVADHTDDE

SEQ ID NO: 2096192 - protein, 15 aa, Staphylococcus
GKPGDTVVDDHTDDE

SEQ ID NO: 2096193 - protein, 16 aa, Staphylococcus
GKPGDTVVEDHTDDEI

SEQ ID NO: 2096194 - protein, 15 aa, Staphylococcus
GKPGDTVVKDHSDEE

SEQ ID NO: 2096195 - protein, 9 aa, Staphylococcus
GKPGESIEV

SEQ ID NO: 2096196 - protein, 27 aa, Staphylococcus
GKPTSYKKLPDRYKNVPEVGQPMEPSV

SEQ ID NO: 2096197 - protein, 12 aa, Staphylococcus
GKQETDKPKQKK

SEQ ID NO: 2096198 - protein, 25 aa, Staphylococcus
GKQPQKTSAFKNKHANNRDSSAQNF

SEQ ID NO: 2096199 - protein, 4 aa, Staphylococcus
GKRG

SEQ ID NO: 2096200 - protein, 11 aa, Staphylococcus
GKRMAAPDYPG

SEQ ID NO: 2096201 - protein, 12 aa, Staphylococcus
GKSDERASLEKD

SEQ ID NO: 2096202 - protein, 8 aa, Staphylococcus
GKSDLTTD

SEQ ID NO: 2096203 - protein, 11 aa, Staphylococcus
GKSEEKVSLEN

SEQ ID NO: 2096204 - protein, 7 aa, Staphylococcus
GKSINKN

SEQ ID NO: 2096205 - protein, 47 aa, Staphylococcus
GKSNEKASLEKSIDQLEKENKDLKKQKKDLENQKNKLKDQQDNLQKD

SEQ ID NO: 2096206 - protein, 13 aa, Staphylococcus
GKSNGEKEDKEIT

SEQ ID NO: 2096207 - protein, 17 aa, Staphylococcus
GKSSDSNNDTSKKIDNK

SEQ ID NO: 2096208 - protein, 7 aa, Staphylococcus
GKSSPFA

SEQ ID NO: 2096209 - protein, 8 aa, Staphylococcus
GKSSPFAN

SEQ ID NO: 2096210 - protein, 9 aa, Staphylococcus
GKTDITTNV

SEQ ID NO: 2096211 - protein, 8 aa, Staphylococcus
GKTTGTDA

SEQ ID NO: 2096212 - protein, 4 aa, Staphylococcus
GKTV

SEQ ID NO: 2096213 - protein, 20 aa, Staphylococcus
GKTYKYNDYSDHYPLSAYAS

SEQ ID NO: 2096214 - protein, 20 aa, Staphylococcus
GKTYRYNDYSDHYPVSAYAA

SEQ ID NO: 2096215 - protein, 24 aa, Staphylococcus
GKTYTDSNNTTSESSSSTEKVTRA

SEQ ID NO: 2096216 - protein, 19 aa, Staphylococcus
GKVDGGPSQVIKPGKEKTI

SEQ ID NO: 2096217 - protein, 16 aa, Staphylococcus
GKVKSVPIDQSAEVPT

SEQ ID NO: 2096218 - protein, 12 aa, Staphylococcus
GKVNNDSGDIEL

SEQ ID NO: 2096219 - protein, 13 aa, Staphylococcus
GKVTGKEKEANAL

SEQ ID NO: 2096220 - protein, 14 aa, Staphylococcus
GKYESVGTRKQPNL

SEQ ID NO: 2096221 - protein, 15 aa, Staphylococcus
GKYPGTWGVEQGKPY

SEQ ID NO: 2096222 - protein, 8 aa, Staphylococcus
GKYSNEKV

SEQ ID NO: 2096223 - protein, 7 aa, Staphylococcus
GKYTMPA

SEQ ID NO: 2096224 - protein, 4 aa, Staphylococcus
GLAK

SEQ ID NO: 2096225 - protein, 5 aa, Staphylococcus
GLASA

SEQ ID NO: 2096226 - protein, 13 aa, Staphylococcus
GLASAARLAAKGH

SEQ ID NO: 2096227 - protein, 6 aa, Staphylococcus
GLGPMT

SEQ ID NO: 2096228 - protein, 12 aa, Staphylococcus
GLGPTKDDLTKH

SEQ ID NO: 2096229 - protein, 20 aa, Staphylococcus
GLGQTKEAWGTGSVATQTQG

SEQ ID NO: 2096230 - protein, 20 aa, Staphylococcus
GLGQTKEAWGTGSVEEQTKG

SEQ ID NO: 2096231 - protein, 7 aa, Staphylococcus
GLKDSGV

SEQ ID NO: 2096232 - protein, 10 aa, Staphylococcus
GLKNKEKPDL

SEQ ID NO: 2096233 - protein, 8 aa, Staphylococcus
GLNETNQA

SEQ ID NO: 2096234 - protein, 16 aa, Staphylococcus
GLNGTTKDIESNPKDL

SEQ ID NO: 2096235 - protein, 12 aa, Staphylococcus
GLNPLKSENLQQ

SEQ ID NO: 2096236 - protein, 5 aa, Staphylococcus
GLPEK

SEQ ID NO: 2096237 - protein, 18 aa, Staphylococcus
GLPSNYNPGEDPKAQQAL

SEQ ID NO: 2096238 - protein, 5 aa, Staphylococcus
GLQSG

SEQ ID NO: 2096239 - protein, 23 aa, Staphylococcus
GLSDAQRQRIQDQIDQAQQLPDI

SEQ ID NO: 2096240 - protein, 10 aa, Staphylococcus
GLSEKEGKAL

SEQ ID NO: 2096241 - protein, 6 aa, Staphylococcus
GLSTST

SEQ ID NO: 2096242 - protein, 15 aa, Staphylococcus
GLTPSFADKNKGIGT

SEQ ID NO: 2096243 - protein, 11 aa, Staphylococcus
GLTQEEAVNEQ

SEQ ID NO: 2096244 - protein, 11 aa, Staphylococcus
GLTQEEAVREQ

SEQ ID NO: 2096245 - protein, 5 aa, Staphylococcus
GLTTP

SEQ ID NO: 2096246 - protein, 13 aa, Staphylococcus
GLTTQSADSNVIP

SEQ ID NO: 2096247 - protein, 5 aa, Staphylococcus
GLYDG

SEQ ID NO: 2096248 - protein, 5 aa, Staphylococcus
GLYGE

SEQ ID NO: 2096249 - protein, 8 aa, Staphylococcus
GMGPSYNS

SEQ ID NO: 2096250 - protein, 12 aa, Staphylococcus
GMSGEEAHAAGD

SEQ ID NO: 2096251 - protein, 27 aa, Staphylococcus
GMSKQEGKTSFKDYRPLKGKKGVTYTL

SEQ ID NO: 2096252 - protein, 42 aa, Staphylococcus
GNAEASGAGQGPDQATNQNEIKVTQTKPHVAPIPTKNSPNRI

SEQ ID NO: 2096253 - protein, 17 aa, Staphylococcus
GNAGHADASEAQVNKAE

SEQ ID NO: 2096254 - protein, 20 aa, Staphylococcus
GNAGHDADASELNVNTKAEL

SEQ ID NO: 2096255 - protein, 39 aa, Staphylococcus
GNAGHDAHASEANINEAELAQKAQSNDQSLNESPIQEGA

SEQ ID NO: 2096256 - protein, 40 aa, Staphylococcus
GNAGHDAHASEATNVDKAELAQKAQSNDQSLNESPIQKGA

SEQ ID NO: 2096257 - protein, 8 aa, Staphylococcus
GNANEMPN

SEQ ID NO: 2096258 - protein, 6 aa, Staphylococcus
GNASYT

SEQ ID NO: 2096259 - protein, 13 aa, Staphylococcus
GNDDNKKEDGKIT

SEQ ID NO: 2096260 - protein, 144 aa, Staphylococcus
GNDDSKKEDDNKDKDKTTQESDSSKKTDSKDNKDKDKSSKDENSKDSNTKDSKSNENNASSSSSDNSNSDNSTSDNASTNNDSNSASNSEGNSTSDNASDNQSQSNQQATNNNDSQNQANQNGNNASTTNVNGNQNANTTQTGY

SEQ ID NO: 2096261 - protein, 92 aa, Staphylococcus
GNDDTSNENSDTKSESKTEKKSEDKKENKSKEDKKSKEEKKSQENEDNSTEEQNTSNVEEKNNEKQNNQSDNEQNIQYNSSSEKSQNTQNVD

SEQ ID NO: 2096262 - protein, 10 aa, Staphylococcus
GNDEYANKID

SEQ ID NO: 2096263 - protein, 38 aa, Staphylococcus
GNDNNSKDSSSSTNNSSGGNKKELNEATKKYEKYTDKQ

SEQ ID NO: 2096264 - protein, 8 aa, Staphylococcus
GNDQIANS

SEQ ID NO: 2096265 - protein, 10 aa, Staphylococcus
GNDQKEDKNI

SEQ ID NO: 2096266 - protein, 25 aa, Staphylococcus
GNEDAMKSIKNGKLDATIAQQPELM

SEQ ID NO: 2096267 - protein, 15 aa, Staphylococcus
GNEGHHKENKTQEKY

SEQ ID NO: 2096268 - protein, 9 aa, Staphylococcus
GNENTALKQ

SEQ ID NO: 2096269 - protein, 7 aa, Staphylococcus
GNESGFD

SEQ ID NO: 2096270 - protein, 22 aa, Staphylococcus
GNGGGGKDKTITVGASPAPHAE

SEQ ID NO: 2096271 - protein, 19 aa, Staphylococcus
GNGGGSSSKDGNTSLGNKE

SEQ ID NO: 2096272 - protein, 22 aa, Staphylococcus
GNGGSDSASNKKDEGTKDATVA

SEQ ID NO: 2096273 - protein, 33 aa, Staphylococcus
GNGGSSDKNSDSKSSSSNSDSKTLKVGTEGTYA

SEQ ID NO: 2096274 - protein, 27 aa, Staphylococcus
GNGGSSKDDKASSDKTLKVGTEGTYAP

SEQ ID NO: 2096275 - protein, 36 aa, Staphylococcus
GNGNDKNSQSNNKQQEQNSNNVKTVATDQEVQGDNY

SEQ ID NO: 2096276 - protein, 10 aa, Staphylococcus
GNGSGDKDKK

SEQ ID NO: 2096277 - protein, 25 aa, Staphylococcus
GNGSSLDNKKESDKEGGSGDYKPKE

SEQ ID NO: 2096278 - protein, 5 aa, Staphylococcus
GNHDL

SEQ ID NO: 2096279 - protein, 16 aa, Staphylococcus
GNHDLQKGIKNAGQNL

SEQ ID NO: 2096280 - protein, 8 aa, Staphylococcus
GNIAGGDR

SEQ ID NO: 2096281 - protein, 20 aa, Staphylococcus
GNIEAGTSEAAKLTANKGAY

SEQ ID NO: 2096282 - protein, 14 aa, Staphylococcus
GNKADRVSNKKEVS

SEQ ID NO: 2096283 - protein, 36 aa, Staphylococcus
GNKDEQDKSDKNESSNKTDSNNVKQIATDKDVQGDD

SEQ ID NO: 2096284 - protein, 10 aa, Staphylococcus
GNKEADPASL

SEQ ID NO: 2096285 - protein, 10 aa, Staphylococcus
GNKKADVKVG

SEQ ID NO: 2096286 - protein, 6 aa, Staphylococcus
GNKNNV

SEQ ID NO: 2096287 - protein, 35 aa, Staphylococcus
GNKSDSDSNSDKKEETKSYKLDSGKSIDIPKNPER

SEQ ID NO: 2096288 - protein, 33 aa, Staphylococcus
GNKSGDQKDSKKETRSYTMDNGKKIDVPKDPKR

SEQ ID NO: 2096289 - protein, 7 aa, Staphylococcus
GNLDGKT

SEQ ID NO: 2096290 - protein, 9 aa, Staphylococcus
GNLKDNAVN

SEQ ID NO: 2096291 - protein, 9 aa, Staphylococcus
GNLQKQEAR

SEQ ID NO: 2096292 - protein, 8 aa, Staphylococcus
GNLTDAQV

SEQ ID NO: 2096293 - protein, 11 aa, Staphylococcus
GNLTDAQVKQL

SEQ ID NO: 2096294 - protein, 12 aa, Staphylococcus
GNLTDSQVKQLK

SEQ ID NO: 2096295 - protein, 39 aa, Staphylococcus
GNNDDSVDNVKKSSHKKDNPKAHKDKGESDRTDGKKIND

SEQ ID NO: 2096296 - protein, 37 aa, Staphylococcus
GNNDEKSKEQSNEKEQQKESGSVKEIATDKNVQGDNY

SEQ ID NO: 2096297 - protein, 6 aa, Staphylococcus
GNNDNM

SEQ ID NO: 2096298 - protein, 30 aa, Staphylococcus
GNNDSSSDKDSKSSSKDDNTLRVGTEGTYA

SEQ ID NO: 2096299 - protein, 12 aa, Staphylococcus
GNNEVLKPKRID

SEQ ID NO: 2096300 - protein, 34 aa, Staphylococcus
GNNGGSGKSDSKEETKSYKLDSGKTIKIPKDPKR

SEQ ID NO: 2096301 - protein, 38 aa, Staphylococcus
GNNNDNKNNQSVNKQETKTDSNNVKTIATDKNVQGDNY

SEQ ID NO: 2096302 - protein, 10 aa, Staphylococcus
GNNQVDPASM

SEQ ID NO: 2096303 - protein, 36 aa, Staphylococcus
GNNSGNGSKESDKKAETKSYKTDDGKKIDIPKNPKR

SEQ ID NO: 2096304 - protein, 36 aa, Staphylococcus
GNNSGNSSKDSDKKAETKSYKTDDGKTIKIPKDPKR

SEQ ID NO: 2096305 - protein, 41 aa, Staphylococcus
GNNSHSDDNSNKDKQSQSSKGENKASLQKATKEYEKYTDGQ

SEQ ID NO: 2096306 - protein, 5 aa, Staphylococcus
GNNSP

SEQ ID NO: 2096307 - protein, 33 aa, Staphylococcus
GNNSSDDASKKDKKEKTYTQDSGKKVKIPKDPK

SEQ ID NO: 2096308 - protein, 27 aa, Staphylococcus
GNNSSKDSKSSSKDDNTIRVGTEGTYA

SEQ ID NO: 2096309 - protein, 29 aa, Staphylococcus
GNNSSLDNNKSSNSDGGSSSSKDGYTPKE

SEQ ID NO: 2096310 - protein, 28 aa, Staphylococcus
GNNSSLDSNNKSSDSGSDSGKDGYKPKE

SEQ ID NO: 2096311 - protein, 5 aa, Staphylococcus
GNPEF

SEQ ID NO: 2096312 - protein, 16 aa, Staphylococcus
GNPPYGERIGDRDEVE

SEQ ID NO: 2096313 - protein, 148 aa, Staphylococcus
GNQDSEQKDEHKKTEHKKSNDSKKDKENSKNKRSNDPKKDNIKDYDEEKKDSKKDKDKKKDKTKKQSSSQSKPKQNKQTPTQNNGQNAQQGSQSQQSNGQNQQQSQSQQPQQSNGQNQQQSQSQQPQQSTGQNTQQSQSSGQNTMPAS

SEQ ID NO: 2096314 - protein, 14 aa, Staphylococcus
GNQHNKDHSSTEGK

SEQ ID NO: 2096315 - protein, 22 aa, Staphylococcus
GNQKEDNKKITVAASPAPHGDV

SEQ ID NO: 2096316 - protein, 47 aa, Staphylococcus
GNQRTNPDDPKENVTDSAAGATAFSSGHKTYNGAIGVDENKKDVKTV

SEQ ID NO: 2096317 - protein, 20 aa, Staphylococcus
GNQSKDSETKSGESKGTVKI

SEQ ID NO: 2096318 - protein, 56 aa, Staphylococcus
GNQSNNSQSNSKSKKSDSKDTVKIENNYEAQGKEKDGSDAKKVKETVEVPKNPKNA

SEQ ID NO: 2096319 - protein, 10 aa, Staphylococcus
GNRTQSDLNQ

SEQ ID NO: 2096320 - protein, 22 aa, Staphylococcus
GNSATDSKEDTIISSKAGDVKV

SEQ ID NO: 2096321 - protein, 121 aa, Staphylococcus
GNSEESKSEDKKETKSSSKNENKKSNDDKKASKDKKTDKEDNSDNNNQTTSNHSQSQNSDDQQTNVDNQNQTTSNTQQANSDQQDQQNQQMNTDQQQDNANTQQTQQENQQANGYDPNNPY

SEQ ID NO: 2096322 - protein, 21 aa, Staphylococcus
GNSGSGSGSSDDSQTSLGNKE

SEQ ID NO: 2096323 - protein, 33 aa, Staphylococcus
GNSGSSDKNSDSKSSSSNSDKKTLRVGTEGTYA

SEQ ID NO: 2096324 - protein, 7 aa, Staphylococcus
GNSINEN

SEQ ID NO: 2096325 - protein, 43 aa, Staphylococcus
GNSNHDSDTKKDEKKTESQKSNHTTAEKGMFKGENKETVEGKA

SEQ ID NO: 2096326 - protein, 18 aa, Staphylococcus
GNSQGRDIQHQSGMPSYN

SEQ ID NO: 2096327 - protein, 16 aa, Staphylococcus
GNSQSNSSTQSKTILG

SEQ ID NO: 2096328 - protein, 30 aa, Staphylococcus
GNSSSLDNNKKSSDSGSDSGSSSGDYKPKE

SEQ ID NO: 2096329 - protein, 16 aa, Staphylococcus
GNTDIKTSQLEGKDDY

SEQ ID NO: 2096330 - protein, 4 aa, Staphylococcus
GNTF

SEQ ID NO: 2096331 - protein, 4 aa, Staphylococcus
GNTP

SEQ ID NO: 2096332 - protein, 16 aa, Staphylococcus
GNTTSDDFLSKNQKGM

SEQ ID NO: 2096333 - protein, 29 aa, Staphylococcus
GNTYAATQTHQSTDQSAQSEDAKVGTNQI

SEQ ID NO: 2096334 - protein, 4 aa, Staphylococcus
GNVD

SEQ ID NO: 2096335 - protein, 4 aa, Staphylococcus
GNVE

SEQ ID NO: 2096336 - protein, 11 aa, Staphylococcus
GNVNINQAGKY

SEQ ID NO: 2096337 - protein, 5 aa, Staphylococcus
GNYDG

SEQ ID NO: 2096338 - protein, 17 aa, Staphylococcus
GPALESSYDTSNAGTGH

SEQ ID NO: 2096339 - protein, 5 aa, Staphylococcus
GPDNL

SEQ ID NO: 2096340 - protein, 22 aa, Staphylococcus
GPFKNNGSQSSNSTNIKDKEKV

SEQ ID NO: 2096341 - protein, 4 aa, Staphylococcus
GPHR

SEQ ID NO: 2096342 - protein, 10 aa, Staphylococcus
GPIRDSDGGI

SEQ ID NO: 2096343 - protein, 5 aa, Staphylococcus
GPLPN

SEQ ID NO: 2096344 - protein, 14 aa, Staphylococcus
GPNNFTDIGEDSVY

SEQ ID NO: 2096345 - protein, 15 aa, Staphylococcus
GPNNFTDIGNDSVYQ

SEQ ID NO: 2096346 - protein, 5 aa, Staphylococcus
GPNYS

SEQ ID NO: 2096347 - protein, 6 aa, Staphylococcus
GPPGKI

SEQ ID NO: 2096348 - protein, 9 aa, Staphylococcus
GPPSEMKPM

SEQ ID NO: 2096349 - protein, 16 aa, Staphylococcus
GPRPSPLGNEARYPDY

SEQ ID NO: 2096350 - protein, 5 aa, Staphylococcus
GPTGR

SEQ ID NO: 2096351 - protein, 9 aa, Staphylococcus
GPTHLTPPK

SEQ ID NO: 2096352 - protein, 8 aa, Staphylococcus
GPTQLADP

SEQ ID NO: 2096353 - protein, 10 aa, Staphylococcus
GPTQLADPEG

SEQ ID NO: 2096354 - protein, 10 aa, Staphylococcus
GPTQLDDPQG

SEQ ID NO: 2096355 - protein, 10 aa, Staphylococcus
GPTQLDNPEN

SEQ ID NO: 2096356 - protein, 10 aa, Staphylococcus
GPTQLTDPTG

SEQ ID NO: 2096357 - protein, 7 aa, Staphylococcus
GQAGAHD

SEQ ID NO: 2096358 - protein, 15 aa, Staphylococcus
GQAIGEKSTAKQTLG

SEQ ID NO: 2096359 - protein, 11 aa, Staphylococcus
GQATGNESNDL

SEQ ID NO: 2096360 - protein, 17 aa, Staphylococcus
GQAVSDNATAKKALGND

SEQ ID NO: 2096361 - protein, 18 aa, Staphylococcus
GQDPHEYEVKPKDIKALT

SEQ ID NO: 2096362 - protein, 13 aa, Staphylococcus
GQDSSDTKRTRAE

SEQ ID NO: 2096363 - protein, 13 aa, Staphylococcus
GQDSSDTVRSREE

SEQ ID NO: 2096364 - protein, 13 aa, Staphylococcus
GQDSSDTVRTREE

SEQ ID NO: 2096365 - protein, 19 aa, Staphylococcus
GQDTLSDYNESFLNFKMSL

SEQ ID NO: 2096366 - protein, 8 aa, Staphylococcus
GQEYTIGP

SEQ ID NO: 2096367 - protein, 73 aa, Staphylococcus
GQGEKNEDTKSESKSDSGNKNDGSGFSNSKKKDDNNSSSEHSTSHSDSKDNSNSSHESSNSDNSKNEDTNSTQ

SEQ ID NO: 2096368 - protein, 41 aa, Staphylococcus
GQGGSSDEGKKSDNDNNKTEQKQSGDTSSTSETGKNSKTIK

SEQ ID NO: 2096369 - protein, 23 aa, Staphylococcus
GQGHEAHAAEQGYNPNDPTSYSY

SEQ ID NO: 2096370 - protein, 9 aa, Staphylococcus
GQGKTMDEA

SEQ ID NO: 2096371 - protein, 10 aa, Staphylococcus
GQGKTTDEAL

SEQ ID NO: 2096372 - protein, 9 aa, Staphylococcus
GQGKTVDEA

SEQ ID NO: 2096373 - protein, 6 aa, Staphylococcus
GQGNLP

SEQ ID NO: 2096374 - protein, 8 aa, Staphylococcus
GQGQTMDE

SEQ ID NO: 2096375 - protein, 80 aa, Staphylococcus
GQGSTNAPAQETAEQPQLVEQPQQTEQASTEQPAQEAAPQTEETQQPQQEATTQTTSSSNESTSNESSSSEASEGSSVNV

SEQ ID NO: 2096376 - protein, 80 aa, Staphylococcus
GQGSTNAPAQETAEQPQQVEQPQQTEQASTEQPAEEAAPQTEETQQPQQEATTQTTSSSNESTSNESSSSEASEGSSVNV

SEQ ID NO: 2096377 - protein, 16 aa, Staphylococcus
GQGTEGWQKTSGSYRK

SEQ ID NO: 2096378 - protein, 6 aa, Staphylococcus
GQIENP

SEQ ID NO: 2096379 - protein, 125 aa, Staphylococcus
GQKEDNKSDDKKSETTKKETKKVDKEKSDKKKDKPKEKNNDNENADNNQQSDTAMQNVQQENDLQNNNQQNTQQNVSDQNGVQQQNNQSNTSEQTEQQPVPQTQQNESLTKDEMSQKLKSGQNVN

SEQ ID NO: 2096380 - protein, 4 aa, Staphylococcus
GQLN

SEQ ID NO: 2096381 - protein, 31 aa, Staphylococcus
GQLNATNSGIKTTVYDPKGKDASKFSGKTFT

SEQ ID NO: 2096382 - protein, 15 aa, Staphylococcus
GQMTPQQVKESYRNK

SEQ ID NO: 2096383 - protein, 5 aa, Staphylococcus
GQNGV

SEQ ID NO: 2096384 - protein, 27 aa, Staphylococcus
GQNKDSNKETKTFKTQSGKSIKIPKHP

SEQ ID NO: 2096385 - protein, 33 aa, Staphylococcus
GQNNDDGNETKHNTNTESTTKPKETTSEQNYKD

SEQ ID NO: 2096386 - protein, 23 aa, Staphylococcus
GQNQDEQQSHNGKYAPKNATPLS

SEQ ID NO: 2096387 - protein, 29 aa, Staphylococcus
GQNQSSEKGHHSTHSTEQETMDHNDNTHT

SEQ ID NO: 2096388 - protein, 68 aa, Staphylococcus
GQNTDNNNKKDNDQTQERDKKSDETEKQSNDEVAENNQNTKNQSQGESNAAEATNEANSQNSRTITID

SEQ ID NO: 2096389 - protein, 13 aa, Staphylococcus
GQPFPSGKGTNNN

SEQ ID NO: 2096390 - protein, 7 aa, Staphylococcus
GQPTVAD

SEQ ID NO: 2096391 - protein, 55 aa, Staphylococcus
GQQKESKFDDKKSKSKKKETKPTEAKKKDEKQNKTISEKQEDTTQKVDQQPQHEQ

SEQ ID NO: 2096392 - protein, 8 aa, Staphylococcus
GQQNADPI

SEQ ID NO: 2096393 - protein, 44 aa, Staphylococcus
GQQRRGSNDNHKPQSHAHGQAGANQGQRTSQAPGSTSQSPLGVQ

SEQ ID NO: 2096394 - protein, 6 aa, Staphylococcus
GQQYHP

SEQ ID NO: 2096395 - protein, 8 aa, Staphylococcus
GQREEGIS

SEQ ID NO: 2096396 - protein, 8 aa, Staphylococcus
GQRTLGNY

SEQ ID NO: 2096397 - protein, 154 aa, Staphylococcus
GQSEDHSKKDDDKKSESKSDKKSNDPKKNKDKKSEENKEKDNNKEKDQSSEDNQQNEQSNAQNNSQNNSNQNNQQAQQSQQQPAQNQQANARQNSGDLNQEQMEANAKVAKQNGYTGEANGDMGGVPTSDKAFSNDQLDPETGLPKDDAVPQDT

SEQ ID NO: 2096398 - protein, 31 aa, Staphylococcus
GQSKDADKKEDTKSYTMDDGKKVDIPKNPKR

SEQ ID NO: 2096399 - protein, 11 aa, Staphylococcus
GQSKSAENKKI

SEQ ID NO: 2096400 - protein, 9 aa, Staphylococcus
GQSKTMDEA

SEQ ID NO: 2096401 - protein, 8 aa, Staphylococcus
GQSQGRNV

SEQ ID NO: 2096402 - protein, 8 aa, Staphylococcus
GQTSTHSN

SEQ ID NO: 2096403 - protein, 4 aa, Staphylococcus
GRAL

SEQ ID NO: 2096404 - protein, 10 aa, Staphylococcus
GRDKNKNVRV

SEQ ID NO: 2096405 - protein, 20 aa, Staphylococcus
GRDPNETVAASKIDEGTDVN

SEQ ID NO: 2096406 - protein, 15 aa, Staphylococcus
GRDYTLDKKGNPHVK

SEQ ID NO: 2096407 - protein, 6 aa, Staphylococcus
GRMEEP

SEQ ID NO: 2096408 - protein, 12 aa, Staphylococcus
GRPVNGNTQANE

SEQ ID NO: 2096409 - protein, 6 aa, Staphylococcus
GRQPNV

SEQ ID NO: 2096410 - protein, 5 aa, Staphylococcus
GRSAT

SEQ ID NO: 2096411 - protein, 11 aa, Staphylococcus
GRTANQKNLDE

SEQ ID NO: 2096412 - protein, 16 aa, Staphylococcus
GRYTTQTSDGKKTEEL

SEQ ID NO: 2096413 - protein, 14 aa, Staphylococcus
GSAHAQTNQTNMSS

SEQ ID NO: 2096414 - protein, 7 aa, Staphylococcus
GSAYYAP

SEQ ID NO: 2096415 - protein, 22 aa, Staphylococcus
GSDSTDSKENTLISSKAGDVKV

SEQ ID NO: 2096416 - protein, 5 aa, Staphylococcus
GSERP

SEQ ID NO: 2096417 - protein, 13 aa, Staphylococcus
GSGKKVGNTNYPE

SEQ ID NO: 2096418 - protein, 5 aa, Staphylococcus
GSHDG

SEQ ID NO: 2096419 - protein, 10 aa, Staphylococcus
GSIAQSDAGY

SEQ ID NO: 2096420 - protein, 10 aa, Staphylococcus
GSKDTSHNHK

SEQ ID NO: 2096421 - protein, 23 aa, Staphylococcus
GSKKGKQSQVGQFKTGGSAKDPF

SEQ ID NO: 2096422 - protein, 39 aa, Staphylococcus
GSKKSDSDNANGESGSTGKSNAKGGTLKIGSGAPPEGNF

SEQ ID NO: 2096423 - protein, 31 aa, Staphylococcus
GSKSHSESNSSEKKSSESKSATDKSESVDSC

SEQ ID NO: 2096424 - protein, 15 aa, Staphylococcus
GSKYFGKENGHLTEK

SEQ ID NO: 2096425 - protein, 23 aa, Staphylococcus
GSKYFGKENGNLDKKFKKDGYDL

SEQ ID NO: 2096426 - protein, 24 aa, Staphylococcus
GSKYFGKENGNLDKKFKKDGYDVV

SEQ ID NO: 2096427 - protein, 24 aa, Staphylococcus
GSKYFGKENGNLDQKFKKDGYDVV

SEQ ID NO: 2096428 - protein, 37 aa, Staphylococcus
GSKYFGKENGNLTDKFQKDGYDYVTNKDELANSQSDQ

SEQ ID NO: 2096429 - protein, 37 aa, Staphylococcus
GSKYFGKNNGNLTKKFQNDGYDYVTNKTDLAHSQSNQ

SEQ ID NO: 2096430 - protein, 4 aa, Staphylococcus
GSLP

SEQ ID NO: 2096431 - protein, 5 aa, Staphylococcus
GSMSA

SEQ ID NO: 2096432 - protein, 21 aa, Staphylococcus
GSNAADSKDNTLMSSKAGDVK

SEQ ID NO: 2096433 - protein, 7 aa, Staphylococcus
GSNARDL

SEQ ID NO: 2096434 - protein, 22 aa, Staphylococcus
GSNATDSESNTLISSKAGDVKV

SEQ ID NO: 2096435 - protein, 21 aa, Staphylococcus
GSNATESKDNTLISSKAGDVK

SEQ ID NO: 2096436 - protein, 10 aa, Staphylococcus
GSNAVTREHY

SEQ ID NO: 2096437 - protein, 34 aa, Staphylococcus
GSNDGSKEDSAKTKSNAEQTKSKKSKKEQKLEKE

SEQ ID NO: 2096438 - protein, 7 aa, Staphylococcus
GSNHSFS

SEQ ID NO: 2096439 - protein, 17 aa, Staphylococcus
GSNNHAMDQGESGINNS

SEQ ID NO: 2096440 - protein, 14 aa, Staphylococcus
GSNSSEQHSKGHGK

SEQ ID NO: 2096441 - protein, 12 aa, Staphylococcus
GSNYYNAPNGKV

SEQ ID NO: 2096442 - protein, 38 aa, Staphylococcus
GSQDGGQDSHSKNKSSKSNNTAELKKATKEYEKYTDKQ

SEQ ID NO: 2096443 - protein, 66 aa, Staphylococcus
GSQEKSDNDTKHEEKTKKDDNQKTEKKESNSTSSSTNKNQSSKSSESKKESNSNVKPVSQLTPQEK

SEQ ID NO: 2096444 - protein, 20 aa, Staphylococcus
GSQNLGPLEDKTTQLRDDNH

SEQ ID NO: 2096445 - protein, 20 aa, Staphylococcus
GSQNLGPLEHKTTKLREENH

SEQ ID NO: 2096446 - protein, 8 aa, Staphylococcus
GSREDLQG

SEQ ID NO: 2096447 - protein, 8 aa, Staphylococcus
GSSEKNYL

SEQ ID NO: 2096448 - protein, 18 aa, Staphylococcus
GSSPAPNKYKSVANQGNL

SEQ ID NO: 2096449 - protein, 9 aa, Staphylococcus
GSSSYDAPA

SEQ ID NO: 2096450 - protein, 26 aa, Staphylococcus
GSTDFSNASRPIKDEEKKKLDDKGIK

SEQ ID NO: 2096451 - protein, 18 aa, Staphylococcus
GSTTTAIKQIDEVEKAME

SEQ ID NO: 2096452 - protein, 18 aa, Staphylococcus
GSTTTTMKQIDELEEVVD

SEQ ID NO: 2096453 - protein, 17 aa, Staphylococcus
GSTTTTMKQIDELKKVV

SEQ ID NO: 2096454 - protein, 8 aa, Staphylococcus
GSTTTTVK

SEQ ID NO: 2096455 - protein, 9 aa, Staphylococcus
GSVETQTKG

SEQ ID NO: 2096456 - protein, 14 aa, Staphylococcus
GSVVGGKSTAKQVL

SEQ ID NO: 2096457 - protein, 61 aa, Staphylococcus
GSYGSTSSQLNSNHKNHGSHNGNNKANSTKDNTTENNHSQEDTNTSQSSQDTTTSNSMISS

SEQ ID NO: 2096458 - protein, 8 aa, Staphylococcus
GSYKGASV

SEQ ID NO: 2096459 - protein, 8 aa, Staphylococcus
GSYKGQSV

SEQ ID NO: 2096460 - protein, 8 aa, Staphylococcus
GSYNGESV

SEQ ID NO: 2096461 - protein, 20 aa, Staphylococcus
GSYQGKSADFNTLEDSGNSM

SEQ ID NO: 2096462 - protein, 4 aa, Staphylococcus
GSYW

SEQ ID NO: 2096463 - protein, 12 aa, Staphylococcus
GTADYSETKDSD

SEQ ID NO: 2096464 - protein, 6 aa, Staphylococcus
GTAGGG

SEQ ID NO: 2096465 - protein, 5 aa, Staphylococcus
GTAKS

SEQ ID NO: 2096466 - protein, 12 aa, Staphylococcus
GTDATEAQIKTE

SEQ ID NO: 2096467 - protein, 15 aa, Staphylococcus
GTDGLKTGTSDKGYN

SEQ ID NO: 2096468 - protein, 9 aa, Staphylococcus
GTDHADPHG

SEQ ID NO: 2096469 - protein, 9 aa, Staphylococcus
GTDHADPHQ

SEQ ID NO: 2096470 - protein, 9 aa, Staphylococcus
GTDHSDPHA

SEQ ID NO: 2096471 - protein, 8 aa, Staphylococcus
GTDHTDPH

SEQ ID NO: 2096472 - protein, 5 aa, Staphylococcus
GTDSG

SEQ ID NO: 2096473 - protein, 23 aa, Staphylococcus
GTENDEAKSADKDSDKSKATSKM

SEQ ID NO: 2096474 - protein, 18 aa, Staphylococcus
GTESPKDRNLKLYRIDIE

SEQ ID NO: 2096475 - protein, 4 aa, Staphylococcus
GTGL

SEQ ID NO: 2096476 - protein, 5 aa, Staphylococcus
GTHPH

SEQ ID NO: 2096477 - protein, 6 aa, Staphylococcus
GTHPHS

SEQ ID NO: 2096478 - protein, 8 aa, Staphylococcus
GTHPNSKF

SEQ ID NO: 2096479 - protein, 8 aa, Staphylococcus
GTHPNSSF

SEQ ID NO: 2096480 - protein, 6 aa, Staphylococcus
GTIGNG

SEQ ID NO: 2096481 - protein, 15 aa, Staphylococcus
GTKPADSRYHDYCAR

SEQ ID NO: 2096482 - protein, 9 aa, Staphylococcus
GTKPNSEFI

SEQ ID NO: 2096483 - protein, 10 aa, Staphylococcus
GTKSQQLDTL

SEQ ID NO: 2096484 - protein, 6 aa, Staphylococcus
GTLADS

SEQ ID NO: 2096485 - protein, 7 aa, Staphylococcus
GTLAESI

SEQ ID NO: 2096486 - protein, 4 aa, Staphylococcus
GTLD

SEQ ID NO: 2096487 - protein, 13 aa, Staphylococcus
GTLSNPDAKTYER

SEQ ID NO: 2096488 - protein, 4 aa, Staphylococcus
GTMG

SEQ ID NO: 2096489 - protein, 7 aa, Staphylococcus
GTMGSGY

SEQ ID NO: 2096490 - protein, 10 aa, Staphylococcus
GTNGQISQYP

SEQ ID NO: 2096491 - protein, 10 aa, Staphylococcus
GTNPSNSDFK

SEQ ID NO: 2096492 - protein, 26 aa, Staphylococcus
GTPSQVAGTVSGSSNQTFKATKSQMI

SEQ ID NO: 2096493 - protein, 27 aa, Staphylococcus
GTPSQVASKVSGSGNQTFKATKQQQID

SEQ ID NO: 2096494 - protein, 6 aa, Staphylococcus
GTQGGI

SEQ ID NO: 2096495 - protein, 9 aa, Staphylococcus
GTQSPGKYR

SEQ ID NO: 2096496 - protein, 14 aa, Staphylococcus
GTRPYAKAGANEIR

SEQ ID NO: 2096497 - protein, 20 aa, Staphylococcus
GTSNSGSDKDKKSENNEKLE

SEQ ID NO: 2096498 - protein, 7 aa, Staphylococcus
GTSQPLN

SEQ ID NO: 2096499 - protein, 29 aa, Staphylococcus
GTSSQKAGSVSGKSAQTFKATKQQQIGKT

SEQ ID NO: 2096500 - protein, 4 aa, Staphylococcus
GTTD

SEQ ID NO: 2096501 - protein, 15 aa, Staphylococcus
GTTFTKGQSTHVDGD

SEQ ID NO: 2096502 - protein, 10 aa, Staphylococcus
GTTQATEEIK

SEQ ID NO: 2096503 - protein, 26 aa, Staphylococcus
GTTQQQLEQANSLAQRTFKATKSVTI

SEQ ID NO: 2096504 - protein, 7 aa, Staphylococcus
GTTSGIT

SEQ ID NO: 2096505 - protein, 19 aa, Staphylococcus
GTTTNAHAAENSHGNQQWN

SEQ ID NO: 2096506 - protein, 9 aa, Staphylococcus
GTVAGPNAV

SEQ ID NO: 2096507 - protein, 7 aa, Staphylococcus
GTVDYGA

SEQ ID NO: 2096508 - protein, 23 aa, Staphylococcus
GTVDYGAAHAEKYGHERYGKTYE

SEQ ID NO: 2096509 - protein, 11 aa, Staphylococcus
GTVSDNQPFNS

SEQ ID NO: 2096510 - protein, 7 aa, Staphylococcus
GTYQGQS

SEQ ID NO: 2096511 - protein, 11 aa, Staphylococcus
GVADDGDKNRI

SEQ ID NO: 2096512 - protein, 11 aa, Staphylococcus
GVADDNKPNRI

SEQ ID NO: 2096513 - protein, 14 aa, Staphylococcus
GVASKSGLDPKKDP

SEQ ID NO: 2096514 - protein, 15 aa, Staphylococcus
GVATKAGKDAKKDPI

SEQ ID NO: 2096515 - protein, 16 aa, Staphylococcus
GVATKAGLDAKKDPIY

SEQ ID NO: 2096516 - protein, 16 aa, Staphylococcus
GVATKSGLDAKKDPIY

SEQ ID NO: 2096517 - protein, 9 aa, Staphylococcus
GVDNAAGRI

SEQ ID NO: 2096518 - protein, 5 aa, Staphylococcus
GVDQN

SEQ ID NO: 2096519 - protein, 7 aa, Staphylococcus
GVDQTAF

SEQ ID NO: 2096520 - protein, 19 aa, Staphylococcus
GVEKIGENDVEKVAKTKPD

SEQ ID NO: 2096521 - protein, 19 aa, Staphylococcus
GVGQKSYRTIHNTGQYNYI

SEQ ID NO: 2096522 - protein, 40 aa, Staphylococcus
GVKANQSQTQQTTNTTQDNHFKRQPESDSVSGKTNDSHPH

SEQ ID NO: 2096523 - protein, 15 aa, Staphylococcus
GVKGQDGKDGRSPSI

SEQ ID NO: 2096524 - protein, 18 aa, Staphylococcus
GVLEGQGASFSQAAKKYG

SEQ ID NO: 2096525 - protein, 18 aa, Staphylococcus
GVLENQGAAFSQAAKQYG

SEQ ID NO: 2096526 - protein, 19 aa, Staphylococcus
GVLENQGQAFSQAAATSGI

SEQ ID NO: 2096527 - protein, 9 aa, Staphylococcus
GVNGDGSVR

SEQ ID NO: 2096528 - protein, 18 aa, Staphylococcus
GVNKDREKKYKFSTPYTY

SEQ ID NO: 2096529 - protein, 8 aa, Staphylococcus
GVNSDKNL

SEQ ID NO: 2096530 - protein, 8 aa, Staphylococcus
GVPDSTDG

SEQ ID NO: 2096531 - protein, 5 aa, Staphylococcus
GVPNK

SEQ ID NO: 2096532 - protein, 10 aa, Staphylococcus
GVSDTTEKKV

SEQ ID NO: 2096533 - protein, 6 aa, Staphylococcus
GVSIED

SEQ ID NO: 2096534 - protein, 8 aa, Staphylococcus
GVSPKELS

SEQ ID NO: 2096535 - protein, 6 aa, Staphylococcus
GVSPSD

SEQ ID NO: 2096536 - protein, 7 aa, Staphylococcus
GVSTEGK

SEQ ID NO: 2096537 - protein, 18 aa, Staphylococcus
GVTKVGDDDVEKVAKQKP

SEQ ID NO: 2096538 - protein, 12 aa, Staphylococcus
GVTPAANPSAPV

SEQ ID NO: 2096539 - protein, 14 aa, Staphylococcus
GVYAGGGKAEGPYV

SEQ ID NO: 2096540 - protein, 13 aa, Staphylococcus
GVYNNGGVEEGPY

SEQ ID NO: 2096541 - protein, 9 aa, Staphylococcus
GWGPDYPDP

SEQ ID NO: 2096542 - protein, 12 aa, Staphylococcus
GWGSTATVNDQI

SEQ ID NO: 2096543 - protein, 18 aa, Staphylococcus
GWKASSKEGSIREKEGKA

SEQ ID NO: 2096544 - protein, 21 aa, Staphylococcus
GWKKGSRDASVRKQDSMGTGT

SEQ ID NO: 2096545 - protein, 20 aa, Staphylococcus
GYAATADHNQAHASEENIDQ

SEQ ID NO: 2096546 - protein, 7 aa, Staphylococcus
GYEHEQS

SEQ ID NO: 2096547 - protein, 9 aa, Staphylococcus
GYGDNAKAA

SEQ ID NO: 2096548 - protein, 10 aa, Staphylococcus
GYGDNAKAAL

SEQ ID NO: 2096549 - protein, 8 aa, Staphylococcus
GYGPGVVT

SEQ ID NO: 2096550 - protein, 25 aa, Staphylococcus
GYGVTSTADAAETPVQQSSQSNSDV

SEQ ID NO: 2096551 - protein, 4 aa, Staphylococcus
GYIP

SEQ ID NO: 2096552 - protein, 5 aa, Staphylococcus
GYNKR

SEQ ID NO: 2096553 - protein, 7 aa, Staphylococcus
GYPPSLQ

SEQ ID NO: 2096554 - protein, 10 aa, Staphylococcus
GYQKLNGDEA

SEQ ID NO: 2096555 - protein, 10 aa, Staphylococcus
GYQKLNGDQA

SEQ ID NO: 2096556 - protein, 23 aa, Staphylococcus
GYSGGHTDNPTYESVSTNQTGHV

SEQ ID NO: 2096557 - protein, 9 aa, Staphylococcus
GYSTDGRIA

SEQ ID NO: 2096558 - protein, 9 aa, Staphylococcus
GYTADNGPV

SEQ ID NO: 2096559 - protein, 7 aa, Staphylococcus
GYTANDS

SEQ ID NO: 2096560 - protein, 8 aa, Staphylococcus
GYTASGGN

SEQ ID NO: 2096561 - protein, 11 aa, Staphylococcus
GYTKPDGTTCT

SEQ ID NO: 2096562 - protein, 8 aa, Staphylococcus
GYTSSQSD

SEQ ID NO: 2096563 - protein, 11 aa, Staphylococcus
GYTTYDPSFTQ

SEQ ID NO: 2096564 - protein, 30 aa, Staphylococcus
GYVHTTTRKSDNGGPKRKYYTISDSGLDEL

SEQ ID NO: 2096565 - protein, 7 aa, Staphylococcus
GYYPGAE

SEQ ID NO: 2096566 - protein, 19 aa, Staphylococcus
HAAEQTNHDGYNPNDPYSY

SEQ ID NO: 2096567 - protein, 16 aa, Staphylococcus
HAAKYGHKRYGKTYEG

SEQ ID NO: 2096568 - protein, 16 aa, Staphylococcus
HADNNMKANSAGNQIS

SEQ ID NO: 2096569 - protein, 12 aa, Staphylococcus
HAEAASGNSIQT

SEQ ID NO: 2096570 - protein, 11 aa, Staphylococcus
HAEAASGNTIQ

SEQ ID NO: 2096571 - protein, 15 aa, Staphylococcus
HAEAATQHTVKSGES

SEQ ID NO: 2096572 - protein, 26 aa, Staphylococcus
HAEASENKQNAANNVIDDQQNIENAN

SEQ ID NO: 2096573 - protein, 100 aa, Staphylococcus
HAEDTNEDDKMKSSSTQEEQTNHNEDVNDNNTNEASQPDDTQSDNTSSEAPTKEDSKNKIKREKSKSSNTSSEEKDDDNTSVSRSHQKRDKDTNNTYRTP

SEQ ID NO: 2096574 - protein, 13 aa, Staphylococcus
HAEGTTKVPKHPK

SEQ ID NO: 2096575 - protein, 41 aa, Staphylococcus
HAEKTEKESADKRNDKKEIKDKHRDKDVDKQLDGKKSDKKN

SEQ ID NO: 2096576 - protein, 9 aa, Staphylococcus
HAEQPYSDA

SEQ ID NO: 2096577 - protein, 13 aa, Staphylococcus
HAETTSAPSTKTV

SEQ ID NO: 2096578 - protein, 44 aa, Staphylococcus
HAHAAESTTDQSTNKNVIDQQNDVVKANKAKKAVSNAAQNVSGV

SEQ ID NO: 2096579 - protein, 24 aa, Staphylococcus
HAKDDLNGDENLAQAKQDATANLN

SEQ ID NO: 2096580 - protein, 37 aa, Staphylococcus
HAKDKSVKQDIDAKVTQQTDAPKALKALPGSENVKNH

SEQ ID NO: 2096581 - protein, 42 aa, Staphylococcus
HANATTSSQSHVTSGTAGSQSYHNNTQASSYNGQQTSAPAHH

SEQ ID NO: 2096582 - protein, 34 aa, Staphylococcus
HANDLTNEQQKSTPPTTQSIQTTTSSPESDNDVD

SEQ ID NO: 2096583 - protein, 31 aa, Staphylococcus
HANSNVNQETTQSNSTQVKVENKDVPKDVDR

SEQ ID NO: 2096584 - protein, 67 aa, Staphylococcus
HAQAASNTQDQTPNKNVLDDEKALNQSEQIKSEISKPTTNISGTQTYQDPTQVKDASSNEDTNYDAQ

SEQ ID NO: 2096585 - protein, 5 aa, Staphylococcus
HAQQA

SEQ ID NO: 2096586 - protein, 30 aa, Staphylococcus
HAQTAGAADWTSDGAFSDYADSFKSQGYQV

SEQ ID NO: 2096587 - protein, 15 aa, Staphylococcus
HASERTNKQQTQSLT

SEQ ID NO: 2096588 - protein, 4 aa, Staphylococcus
HASQ

SEQ ID NO: 2096589 - protein, 8 aa, Staphylococcus
HATKVDTQ

SEQ ID NO: 2096590 - protein, 17 aa, Staphylococcus
HDAKAYGKEPPGTPPMT

SEQ ID NO: 2096591 - protein, 4 aa, Staphylococcus
HDFT

SEQ ID NO: 2096592 - protein, 22 aa, Staphylococcus
HDGTKFDAEAVKKNIDAVQQNK

SEQ ID NO: 2096593 - protein, 9 aa, Staphylococcus
HDKERQQLK

SEQ ID NO: 2096594 - protein, 7 aa, Staphylococcus
HDKGAAD

SEQ ID NO: 2096595 - protein, 10 aa, Staphylococcus
HDKQDKLTGY

SEQ ID NO: 2096596 - protein, 16 aa, Staphylococcus
HDLKENETGQANLPQF

SEQ ID NO: 2096597 - protein, 6 aa, Staphylococcus
HDQGAA

SEQ ID NO: 2096598 - protein, 5 aa, Staphylococcus
HDQKA

SEQ ID NO: 2096599 - protein, 11 aa, Staphylococcus
HDRAGNTTNVS

SEQ ID NO: 2096600 - protein, 6 aa, Staphylococcus
HDSDGD

SEQ ID NO: 2096601 - protein, 5 aa, Staphylococcus
HDSFK

SEQ ID NO: 2096602 - protein, 10 aa, Staphylococcus
HDTDGKVKGS

SEQ ID NO: 2096603 - protein, 8 aa, Staphylococcus
HDYEPTQK

SEQ ID NO: 2096604 - protein, 17 aa, Staphylococcus
HEADASTQHTVKSGESL

SEQ ID NO: 2096605 - protein, 7 aa, Staphylococcus
HEDGNTR

SEQ ID NO: 2096606 - protein, 18 aa, Staphylococcus
HEGEEEHHGEEEHHHHGK

SEQ ID NO: 2096607 - protein, 12 aa, Staphylococcus
HEGYTDTKDSNF

SEQ ID NO: 2096608 - protein, 9 aa, Staphylococcus
HEKAERIKK

SEQ ID NO: 2096609 - protein, 9 aa, Staphylococcus
HEKAKSGKK

SEQ ID NO: 2096610 - protein, 11 aa, Staphylococcus
HENQSKTSSVK

SEQ ID NO: 2096611 - protein, 15 aa, Staphylococcus
HEQRDQLKTNLIFDN

SEQ ID NO: 2096612 - protein, 10 aa, Staphylococcus
HEQRKELEEY

SEQ ID NO: 2096613 - protein, 4 aa, Staphylococcus
HEYA

SEQ ID NO: 2096614 - protein, 9 aa, Staphylococcus
HGAEQDQWD

SEQ ID NO: 2096615 - protein, 6 aa, Staphylococcus
HGDVSG

SEQ ID NO: 2096616 - protein, 9 aa, Staphylococcus
HGEEHEEHE

SEQ ID NO: 2096617 - protein, 6 aa, Staphylococcus
HGGRYN

SEQ ID NO: 2096618 - protein, 31 aa, Staphylococcus
HGNEADAAEQTQPTNQSTTQSTSGSSANLYT

SEQ ID NO: 2096619 - protein, 14 aa, Staphylococcus
HGPGGKIAEFIEGI

SEQ ID NO: 2096620 - protein, 14 aa, Staphylococcus
HGPGKQIAEYIEGI

SEQ ID NO: 2096621 - protein, 14 aa, Staphylococcus
HGQDLDKKDVPKYD

SEQ ID NO: 2096622 - protein, 6 aa, Staphylococcus
HGSADE

SEQ ID NO: 2096623 - protein, 5 aa, Staphylococcus
HGSVE

SEQ ID NO: 2096624 - protein, 5 aa, Staphylococcus
HGTNA

SEQ ID NO: 2096625 - protein, 4 aa, Staphylococcus
HGVT

SEQ ID NO: 2096626 - protein, 6 aa, Staphylococcus
HGYPNS

SEQ ID NO: 2096627 - protein, 17 aa, Staphylococcus
HHDAEASTQHKVQSGES

SEQ ID NO: 2096628 - protein, 15 aa, Staphylococcus
HHDERKKLNSSQGKN

SEQ ID NO: 2096629 - protein, 11 aa, Staphylococcus
HHEEESNKPIR

SEQ ID NO: 2096630 - protein, 6 aa, Staphylococcus
HHHGGY

SEQ ID NO: 2096631 - protein, 14 aa, Staphylococcus
HHSKQTESLSPSDF

SEQ ID NO: 2096632 - protein, 7 aa, Staphylococcus
HIAQKDN

SEQ ID NO: 2096633 - protein, 6 aa, Staphylococcus
HIDGNE

SEQ ID NO: 2096634 - protein, 5 aa, Staphylococcus
HIENP

SEQ ID NO: 2096635 - protein, 6 aa, Staphylococcus
HIPKNE

SEQ ID NO: 2096636 - protein, 12 aa, Staphylococcus
HIPQEYKDPTQR

SEQ ID NO: 2096637 - protein, 10 aa, Staphylococcus
HKAAQADQQL

SEQ ID NO: 2096638 - protein, 25 aa, Staphylococcus
HKAEDDDSMSAKAYKSYYEKGYKTD

SEQ ID NO: 2096639 - protein, 9 aa, Staphylococcus
HKASSIKVA

SEQ ID NO: 2096640 - protein, 10 aa, Staphylococcus
HKEAANSPME

SEQ ID NO: 2096641 - protein, 8 aa, Staphylococcus
HKEESYGS

SEQ ID NO: 2096642 - protein, 7 aa, Staphylococcus
HKEQTQM

SEQ ID NO: 2096643 - protein, 15 aa, Staphylococcus
HKKYNDYSLEATNDG

SEQ ID NO: 2096644 - protein, 20 aa, Staphylococcus
HKLTGNAVKSSLEEGMKKVI

SEQ ID NO: 2096645 - protein, 20 aa, Staphylococcus
HKLTGQAVKDSLEKGLKESD

SEQ ID NO: 2096646 - protein, 20 aa, Staphylococcus
HKQEAPQSFENDFKQSNTRA

SEQ ID NO: 2096647 - protein, 5 aa, Staphylococcus
HKRAI

SEQ ID NO: 2096648 - protein, 4 aa, Staphylococcus
HKRQ

SEQ ID NO: 2096649 - protein, 15 aa, Staphylococcus
HKSEEDSAMTEKEYK

SEQ ID NO: 2096650 - protein, 18 aa, Staphylococcus
HKSTEKEDDYDKNKSFEY

SEQ ID NO: 2096651 - protein, 13 aa, Staphylococcus
HKTLPKESEDLEK

SEQ ID NO: 2096652 - protein, 17 aa, Staphylococcus
HLDDPISTDGKTPASIT

SEQ ID NO: 2096653 - protein, 10 aa, Staphylococcus
HLDTSKVGTY

SEQ ID NO: 2096654 - protein, 8 aa, Staphylococcus
HLGNNAKW

SEQ ID NO: 2096655 - protein, 5 aa, Staphylococcus
HLNEN

SEQ ID NO: 2096656 - protein, 9 aa, Staphylococcus
HLQQSTFKG

SEQ ID NO: 2096657 - protein, 16 aa, Staphylococcus
HNAEASTQHTVKSGES

SEQ ID NO: 2096658 - protein, 5 aa, Staphylococcus
HNATR

SEQ ID NO: 2096659 - protein, 29 aa, Staphylococcus
HNDDTKENITDSAAAGTALSTGKKTFNGA

SEQ ID NO: 2096660 - protein, 6 aa, Staphylococcus
HNDNGV

SEQ ID NO: 2096661 - protein, 12 aa, Staphylococcus
HNGNAGQNASYL

SEQ ID NO: 2096662 - protein, 11 aa, Staphylococcus
HNGTGDKGTSV

SEQ ID NO: 2096663 - protein, 7 aa, Staphylococcus
HNIEPKK

SEQ ID NO: 2096664 - protein, 8 aa, Staphylococcus
HNKANAGL

SEQ ID NO: 2096665 - protein, 22 aa, Staphylococcus
HNNHDNANEKTSKKSTNENKVA

SEQ ID NO: 2096666 - protein, 29 aa, Staphylococcus
HNNKSKAQATQPTKDQTNKVAPQQQYKNH

SEQ ID NO: 2096667 - protein, 15 aa, Staphylococcus
HNPLDRSKSELRKEK

SEQ ID NO: 2096668 - protein, 5 aa, Staphylococcus
HNPLN

SEQ ID NO: 2096669 - protein, 5 aa, Staphylococcus
HNPSL

SEQ ID NO: 2096670 - protein, 8 aa, Staphylococcus
HNQAHNTY

SEQ ID NO: 2096671 - protein, 7 aa, Staphylococcus
HNQNTPI

SEQ ID NO: 2096672 - protein, 6 aa, Staphylococcus
HNQPIY

SEQ ID NO: 2096673 - protein, 6 aa, Staphylococcus
HNSSDI

SEQ ID NO: 2096674 - protein, 16 aa, Staphylococcus
HNSVSKSNTEIEKDNK

SEQ ID NO: 2096675 - protein, 5 aa, Staphylococcus
HNTSI

SEQ ID NO: 2096676 - protein, 13 aa, Staphylococcus
HNVQAETNQPDQY

SEQ ID NO: 2096677 - protein, 22 aa, Staphylococcus
HNWDNRAESDNYDVSQTPSTHS

SEQ ID NO: 2096678 - protein, 14 aa, Staphylococcus
HNYEPTQKDIINAS

SEQ ID NO: 2096679 - protein, 9 aa, Staphylococcus
HNYRSNRGA

SEQ ID NO: 2096680 - protein, 12 aa, Staphylococcus
HPDLTGKDASKL

SEQ ID NO: 2096681 - protein, 8 aa, Staphylococcus
HPELKPTI

SEQ ID NO: 2096682 - protein, 6 aa, Staphylococcus
HPENTY

SEQ ID NO: 2096683 - protein, 34 aa, Staphylococcus
HPIGTEEEVKDKAAKVRDEKRNGKFDSSKYYDDY

SEQ ID NO: 2096684 - protein, 5 aa, Staphylococcus
HPKNT

SEQ ID NO: 2096685 - protein, 5 aa, Staphylococcus
HPLTD

SEQ ID NO: 2096686 - protein, 15 aa, Staphylococcus
HPLTKEQVETIAKSF

SEQ ID NO: 2096687 - protein, 8 aa, Staphylococcus
HPQPISQI

SEQ ID NO: 2096688 - protein, 13 aa, Staphylococcus
HPSPNTAKQVYNG

SEQ ID NO: 2096689 - protein, 4 aa, Staphylococcus
HQGQ

SEQ ID NO: 2096690 - protein, 22 aa, Staphylococcus
HQGYEKAKDSDFDTVRKYRDIV

SEQ ID NO: 2096691 - protein, 145 aa, Staphylococcus
HQNKSSLHKAEHKTEEKDKKKASKDKTEKTTTNQESVQAEPTNSQQNNVNSSNHSANQQPTQKSSQANHQTSPSQSAQSKPSNQPAQKSNNQPARTQQSEPVNKPKTSTESAQGQGGQGGQGSNNNNNANRSAQNNSTSNKQSKS

SEQ ID NO: 2096692 - protein, 13 aa, Staphylococcus
HQQGQGYQQPQFK

SEQ ID NO: 2096693 - protein, 7 aa, Staphylococcus
HQQIKDT

SEQ ID NO: 2096694 - protein, 7 aa, Staphylococcus
HQQQQAF

SEQ ID NO: 2096695 - protein, 7 aa, Staphylococcus
HQRAPKA

SEQ ID NO: 2096696 - protein, 14 aa, Staphylococcus
HQRGPNATQPEVEQ

SEQ ID NO: 2096697 - protein, 5 aa, Staphylococcus
HQSVE

SEQ ID NO: 2096698 - protein, 11 aa, Staphylococcus
HQTKEQVKASL

SEQ ID NO: 2096699 - protein, 12 aa, Staphylococcus
HRDSYDNAGGKI

SEQ ID NO: 2096700 - protein, 10 aa, Staphylococcus
HRGASGYAPE

SEQ ID NO: 2096701 - protein, 12 aa, Staphylococcus
HRGASGYAPEHT

SEQ ID NO: 2096702 - protein, 14 aa, Staphylococcus
HRTTEETPLKRGAA

SEQ ID NO: 2096703 - protein, 166 aa, Staphylococcus
HSDHSDKKDSDKNSSKTESKKSDKKDSKGDKKVNNAKDNIKDSKLGKKSKDKSSKSKDSKPKNKETNQQSSNSASQANNTSNQPQNNNANNANNTNSNNQNSYNNQANSQNQQQNQTNNTQQNNSQRQQPSQNNQQQYSTGNNQSANNSQAMNNSQGQTNTNTQRG

SEQ ID NO: 2096704 - protein, 7 aa, Staphylococcus
HSEQGDY

SEQ ID NO: 2096705 - protein, 19 aa, Staphylococcus
HSGGGAQSAIAGASGDSKL

SEQ ID NO: 2096706 - protein, 10 aa, Staphylococcus
HSKQSDIEKG

SEQ ID NO: 2096707 - protein, 5 aa, Staphylococcus
HSLNQ

SEQ ID NO: 2096708 - protein, 26 aa, Staphylococcus
HSMNQDEAQLKKSRTSTSCIEPSATR

SEQ ID NO: 2096709 - protein, 13 aa, Staphylococcus
HSNKISSDNFNQQ

SEQ ID NO: 2096710 - protein, 27 aa, Staphylococcus
HSNKKLEKYNQTFTGVSKDGKKANKVQ

SEQ ID NO: 2096711 - protein, 141 aa, Staphylococcus
HSNQSDPNQTQSTKKKDKKETTSESHTVQSNETSQSDNGTTAQSESTSQSIQEQQQTTQRPSTVQTTQPKTSESSTTSQSQHRSESNTSKQPTSQSTEDKPSSEQTSTEQPSTEEKPSSQQSTKSSTESHTNRSSESNNKS

SEQ ID NO: 2096712 - protein, 4 aa, Staphylococcus
HSQE

SEQ ID NO: 2096713 - protein, 10 aa, Staphylococcus
HSQFDSPRSE

SEQ ID NO: 2096714 - protein, 7 aa, Staphylococcus
HSRQYAK

SEQ ID NO: 2096715 - protein, 6 aa, Staphylococcus
HSSSDI

SEQ ID NO: 2096716 - protein, 8 aa, Staphylococcus
HSSVNTPV

SEQ ID NO: 2096717 - protein, 4 aa, Staphylococcus
HSTQ

SEQ ID NO: 2096718 - protein, 10 aa, Staphylococcus
HSYEPTQKDI

SEQ ID NO: 2096719 - protein, 14 aa, Staphylococcus
HSYEPTQKDMMSAA

SEQ ID NO: 2096720 - protein, 6 aa, Staphylococcus
HSYNDA

SEQ ID NO: 2096721 - protein, 23 aa, Staphylococcus
HTDVSGEAINPYNKEASEKYPDG

SEQ ID NO: 2096722 - protein, 13 aa, Staphylococcus
HTEAVTANNYSEN

SEQ ID NO: 2096723 - protein, 5 aa, Staphylococcus
HTGSI

SEQ ID NO: 2096724 - protein, 7 aa, Staphylococcus
HTKKGKH

SEQ ID NO: 2096725 - protein, 4 aa, Staphylococcus
HTLP

SEQ ID NO: 2096726 - protein, 6 aa, Staphylococcus
HTNPQG

SEQ ID NO: 2096727 - protein, 7 aa, Staphylococcus
HTRSING

SEQ ID NO: 2096728 - protein, 15 aa, Staphylococcus
HTTEDVASATSTMNK

SEQ ID NO: 2096729 - protein, 20 aa, Staphylococcus
HTVYSGESFTNTITANDNYA

SEQ ID NO: 2096730 - protein, 6 aa, Staphylococcus
HTYEPV

SEQ ID NO: 2096731 - protein, 10 aa, Staphylococcus
HVDTSKVGKY

SEQ ID NO: 2096732 - protein, 11 aa, Staphylococcus
HVDTTKAGKYK

SEQ ID NO: 2096733 - protein, 25 aa, Staphylococcus
HVESETHNSMQQESDLKQPTQINKD

SEQ ID NO: 2096734 - protein, 4 aa, Staphylococcus
HVGS

SEQ ID NO: 2096735 - protein, 22 aa, Staphylococcus
HVQPNDKNEKKISGRIAKEDVD

SEQ ID NO: 2096736 - protein, 7 aa, Staphylococcus
HVSGETY

SEQ ID NO: 2096737 - protein, 4 aa, Staphylococcus
HVSR

SEQ ID NO: 2096738 - protein, 14 aa, Staphylococcus
HYRKQRQKKQSSQN

SEQ ID NO: 2096739 - protein, 6 aa, Staphylococcus
HYTKES

SEQ ID NO: 2096740 - protein, 39 aa, Staphylococcus
IAAGNSADASEQGVDKAQLAQQAQSNPESLNAAPIQDGA

SEQ ID NO: 2096741 - protein, 20 aa, Staphylococcus
IAATQADAATTHKVKSGESL

SEQ ID NO: 2096742 - protein, 16 aa, Staphylococcus
IADASPAKPVKAQTTI

SEQ ID NO: 2096743 - protein, 12 aa, Staphylococcus
IADGKDPEKVIN

SEQ ID NO: 2096744 - protein, 11 aa, Staphylococcus
IADGKDPETVI

SEQ ID NO: 2096745 - protein, 33 aa, Staphylococcus
IADQTTVKDNEDYHDASPDQQQAYNTAVTDAES

SEQ ID NO: 2096746 - protein, 4 aa, Staphylococcus
IADV

SEQ ID NO: 2096747 - protein, 8 aa, Staphylococcus
IAEGKDVE

SEQ ID NO: 2096748 - protein, 4 aa, Staphylococcus
IAFN

SEQ ID NO: 2096749 - protein, 7 aa, Staphylococcus
IAGNSNI

SEQ ID NO: 2096750 - protein, 12 aa, Staphylococcus
IAIPDPSESGTA

SEQ ID NO: 2096751 - protein, 12 aa, Staphylococcus
IAKGKDPETVIN

SEQ ID NO: 2096752 - protein, 11 aa, Staphylococcus
IAKKGKGVSPY

SEQ ID NO: 2096753 - protein, 19 aa, Staphylococcus
IAKNVSKNYAKPASGPFND

SEQ ID NO: 2096754 - protein, 13 aa, Staphylococcus
IANQNDVKQQSQF

SEQ ID NO: 2096755 - protein, 18 aa, Staphylococcus
IANSNEQVKEAKDNGLNK

SEQ ID NO: 2096756 - protein, 4 aa, Staphylococcus
IANV

SEQ ID NO: 2096757 - protein, 7 aa, Staphylococcus
IAPEHNA

SEQ ID NO: 2096758 - protein, 26 aa, Staphylococcus
IAPETEKQAYNEEGQSSKQPTSSNYH

SEQ ID NO: 2096759 - protein, 4 aa, Staphylococcus
IAPK

SEQ ID NO: 2096760 - protein, 7 aa, Staphylococcus
IAQATDI

SEQ ID NO: 2096761 - protein, 5 aa, Staphylococcus
IAQDG

SEQ ID NO: 2096762 - protein, 7 aa, Staphylococcus
IAQDGVT

SEQ ID NO: 2096763 - protein, 18 aa, Staphylococcus
IAQSTPTKVKKQYNVKGN

SEQ ID NO: 2096764 - protein, 11 aa, Staphylococcus
IASGKDAAKVI

SEQ ID NO: 2096765 - protein, 7 aa, Staphylococcus
IASSNAD

SEQ ID NO: 2096766 - protein, 19 aa, Staphylococcus
IATAGAADAATYRVQSGDS

SEQ ID NO: 2096767 - protein, 7 aa, Staphylococcus
IATDSEI

SEQ ID NO: 2096768 - protein, 14 aa, Staphylococcus
IATHDSDYAKLDDG

SEQ ID NO: 2096769 - protein, 14 aa, Staphylococcus
IDADTASSLHYIQP

SEQ ID NO: 2096770 - protein, 14 aa, Staphylococcus
IDASTAEDLHYIEP

SEQ ID NO: 2096771 - protein, 5 aa, Staphylococcus
IDETT

SEQ ID NO: 2096772 - protein, 9 aa, Staphylococcus
IDGKSGVLA

SEQ ID NO: 2096773 - protein, 8 aa, Staphylococcus
IDGNPTIY

SEQ ID NO: 2096774 - protein, 21 aa, Staphylococcus
IDGNQDIYKPTWKSEAYSYRS

SEQ ID NO: 2096775 - protein, 6 aa, Staphylococcus
IDGTDA

SEQ ID NO: 2096776 - protein, 7 aa, Staphylococcus
IDGVSKN

SEQ ID NO: 2096777 - protein, 23 aa, Staphylococcus
IDKAQAKDMLKKDEKAFKGDKGV

SEQ ID NO: 2096778 - protein, 13 aa, Staphylococcus
IDKDIDPKTGKKK

SEQ ID NO: 2096779 - protein, 22 aa, Staphylococcus
IDKEGYVNSVKNNGSEATNGFT

SEQ ID NO: 2096780 - protein, 16 aa, Staphylococcus
IDKKHASSYDKHGNKY

SEQ ID NO: 2096781 - protein, 10 aa, Staphylococcus
IDKPTVKVDN

SEQ ID NO: 2096782 - protein, 7 aa, Staphylococcus
IDKRTGE

SEQ ID NO: 2096783 - protein, 33 aa, Staphylococcus
IDKSIDQKKVSTKNIDEIKDDSKKVNGKEQAKI

SEQ ID NO: 2096784 - protein, 22 aa, Staphylococcus
IDNGLKPSKDAIAFEGKSSPFA

SEQ ID NO: 2096785 - protein, 6 aa, Staphylococcus
IDPNEV

SEQ ID NO: 2096786 - protein, 23 aa, Staphylococcus
IDQAPDIATTNKIKQNAESLDNA

SEQ ID NO: 2096787 - protein, 11 aa, Staphylococcus
IDQDKEDNIEY

SEQ ID NO: 2096788 - protein, 6 aa, Staphylococcus
IDQEGP

SEQ ID NO: 2096789 - protein, 7 aa, Staphylococcus
IDQQGDY

SEQ ID NO: 2096790 - protein, 6 aa, Staphylococcus
IDQQGN

SEQ ID NO: 2096791 - protein, 6 aa, Staphylococcus
IDQQGQ

SEQ ID NO: 2096792 - protein, 20 aa, Staphylococcus
IDRQSSGQTKITDKQAKKLS

SEQ ID NO: 2096793 - protein, 22 aa, Staphylococcus
IDRQSTGQTRVTDKQAKKLSKL

SEQ ID NO: 2096794 - protein, 6 aa, Staphylococcus
IDSEED

SEQ ID NO: 2096795 - protein, 7 aa, Staphylococcus
IDSEGPV

SEQ ID NO: 2096796 - protein, 12 aa, Staphylococcus
IDSRDKKDEIAQ

SEQ ID NO: 2096797 - protein, 20 aa, Staphylococcus
IDSTSHDNANSNKHEYSSEE

SEQ ID NO: 2096798 - protein, 6 aa, Staphylococcus
IDTDEP

SEQ ID NO: 2096799 - protein, 5 aa, Staphylococcus
IDTEE

SEQ ID NO: 2096800 - protein, 4 aa, Staphylococcus
IDTN

SEQ ID NO: 2096801 - protein, 18 aa, Staphylococcus
IDTPDNITKVTSEQYQNA

SEQ ID NO: 2096802 - protein, 14 aa, Staphylococcus
IDTVNNAKELANNI

SEQ ID NO: 2096803 - protein, 4 aa, Staphylococcus
IEAS

SEQ ID NO: 2096804 - protein, 22 aa, Staphylococcus
IEDGDSRNSAIQSGSVDISGGS

SEQ ID NO: 2096805 - protein, 21 aa, Staphylococcus
IEDGDSRNSAVQSGSVDISGG

SEQ ID NO: 2096806 - protein, 11 aa, Staphylococcus
IEDGKVSDDNF

SEQ ID NO: 2096807 - protein, 8 aa, Staphylococcus
IEDSDSRH

SEQ ID NO: 2096808 - protein, 10 aa, Staphylococcus
IEDSTLTDGD

SEQ ID NO: 2096809 - protein, 10 aa, Staphylococcus
IEDYSEGVKN

SEQ ID NO: 2096810 - protein, 33 aa, Staphylococcus
IEETSRDVTYSGTQHDNNIKINKNGKVENDKNT

SEQ ID NO: 2096811 - protein, 4 aa, Staphylococcus
IEEV

SEQ ID NO: 2096812 - protein, 17 aa, Staphylococcus
IEGAKEKHEGKAETISG

SEQ ID NO: 2096813 - protein, 9 aa, Staphylococcus
IEGPGDKPI

SEQ ID NO: 2096814 - protein, 12 aa, Staphylococcus
IEGPGDKPITES

SEQ ID NO: 2096815 - protein, 10 aa, Staphylococcus
IEGPGDKPIV

SEQ ID NO: 2096816 - protein, 4 aa, Staphylococcus
IEGQ

SEQ ID NO: 2096817 - protein, 14 aa, Staphylococcus
IEGQHASYKAGGML

SEQ ID NO: 2096818 - protein, 8 aa, Staphylococcus
IEGSEGNY

SEQ ID NO: 2096819 - protein, 8 aa, Staphylococcus
IEKEGYNK

SEQ ID NO: 2096820 - protein, 34 aa, Staphylococcus
IEKETARDAVKQKANEQTDVINNNNNSTEEEKVE

SEQ ID NO: 2096821 - protein, 5 aa, Staphylococcus
IENAT

SEQ ID NO: 2096822 - protein, 6 aa, Staphylococcus
IENDTF

SEQ ID NO: 2096823 - protein, 8 aa, Staphylococcus
IENDTYKR

SEQ ID NO: 2096824 - protein, 9 aa, Staphylococcus
IENSREGSA

SEQ ID NO: 2096825 - protein, 7 aa, Staphylococcus
IENTQRD

SEQ ID NO: 2096826 - protein, 8 aa, Staphylococcus
IENTYDGT

SEQ ID NO: 2096827 - protein, 10 aa, Staphylococcus
IEQDNEDNIE

SEQ ID NO: 2096828 - protein, 9 aa, Staphylococcus
IEQQAGTLN

SEQ ID NO: 2096829 - protein, 9 aa, Staphylococcus
IEQRDSSSY

SEQ ID NO: 2096830 - protein, 18 aa, Staphylococcus
IERQTTALQKELNELAKN

SEQ ID NO: 2096831 - protein, 18 aa, Staphylococcus
IESDEDRYQDEEEQANSV

SEQ ID NO: 2096832 - protein, 8 aa, Staphylococcus
IESEDSDG

SEQ ID NO: 2096833 - protein, 6 aa, Staphylococcus
IESPDD

SEQ ID NO: 2096834 - protein, 7 aa, Staphylococcus
IETNLPG

SEQ ID NO: 2096835 - protein, 12 aa, Staphylococcus
IFPSTDKSYLNQ

SEQ ID NO: 2096836 - protein, 18 aa, Staphylococcus
IFSSNKKGQKISESEMKS

SEQ ID NO: 2096837 - protein, 18 aa, Staphylococcus
IFTSNKNNATISEDEMNK

SEQ ID NO: 2096838 - protein, 6 aa, Staphylococcus
IGARAG

SEQ ID NO: 2096839 - protein, 24 aa, Staphylococcus
IGDAGKEKTTLKPNPYFKGNKPLN

SEQ ID NO: 2096840 - protein, 4 aa, Staphylococcus
IGDK

SEQ ID NO: 2096841 - protein, 24 aa, Staphylococcus
IGDYTSVGARKQPNLEEISNQKPD

SEQ ID NO: 2096842 - protein, 11 aa, Staphylococcus
IGEPPHEGTQQ

SEQ ID NO: 2096843 - protein, 6 aa, Staphylococcus
IGESKV

SEQ ID NO: 2096844 - protein, 30 aa, Staphylococcus
IGGSSNNSNNASSNATTSSSTYTVKAGDSL

SEQ ID NO: 2096845 - protein, 29 aa, Staphylococcus
IGGSSSQESGSTSNNTSNGSSHTVQSGES

SEQ ID NO: 2096846 - protein, 17 aa, Staphylococcus
IGKAINKHDKKLQLTKD

SEQ ID NO: 2096847 - protein, 16 aa, Staphylococcus
IGKANSNIKADDIDLS

SEQ ID NO: 2096848 - protein, 30 aa, Staphylococcus
IGKDDIDPNYKVKDSSVEPNSVKVTGGREQ

SEQ ID NO: 2096849 - protein, 8 aa, Staphylococcus
IGKDKAEQ

SEQ ID NO: 2096850 - protein, 13 aa, Staphylococcus
IGKDSKKDDDKDS

SEQ ID NO: 2096851 - protein, 8 aa, Staphylococcus
IGKGKAQQ

SEQ ID NO: 2096852 - protein, 8 aa, Staphylococcus
IGNEEVEK

SEQ ID NO: 2096853 - protein, 5 aa, Staphylococcus
IGNEN

SEQ ID NO: 2096854 - protein, 5 aa, Staphylococcus
IGNET

SEQ ID NO: 2096855 - protein, 10 aa, Staphylococcus
IGNSTEQSRE

SEQ ID NO: 2096856 - protein, 8 aa, Staphylococcus
IGRDKGTV

SEQ ID NO: 2096857 - protein, 6 aa, Staphylococcus
IGRTTK

SEQ ID NO: 2096858 - protein, 9 aa, Staphylococcus
IGSRAQQAV

SEQ ID NO: 2096859 - protein, 24 aa, Staphylococcus
IGSVTGTGAQQFKAQKQTEVGTST

SEQ ID NO: 2096860 - protein, 6 aa, Staphylococcus
IGTQEA

SEQ ID NO: 2096861 - protein, 14 aa, Staphylococcus
IHSPAGGQGMNTGI

SEQ ID NO: 2096862 - protein, 9 aa, Staphylococcus
IIGSRAGHA

SEQ ID NO: 2096863 - protein, 5 aa, Staphylococcus
IISKD

SEQ ID NO: 2096864 - protein, 14 aa, Staphylococcus
IITEQNSSDTIENA

SEQ ID NO: 2096865 - protein, 13 aa, Staphylococcus
IKADEDEDTQHDP

SEQ ID NO: 2096866 - protein, 5 aa, Staphylococcus
IKAEN

SEQ ID NO: 2096867 - protein, 7 aa, Staphylococcus
IKANEDI

SEQ ID NO: 2096868 - protein, 12 aa, Staphylococcus
IKATSDIKEAAN

SEQ ID NO: 2096869 - protein, 8 aa, Staphylococcus
IKATTDIN

SEQ ID NO: 2096870 - protein, 22 aa, Staphylococcus
IKDDKGKDTEPTKKTIQDNSYA

SEQ ID NO: 2096871 - protein, 11 aa, Staphylococcus
IKDIKDNPKHL

SEQ ID NO: 2096872 - protein, 23 aa, Staphylococcus
IKDKYKSHSDYAKAYKKALGKEK

SEQ ID NO: 2096873 - protein, 7 aa, Staphylococcus
IKDRGTL

SEQ ID NO: 2096874 - protein, 7 aa, Staphylococcus
IKDSGAK

SEQ ID NO: 2096875 - protein, 4 aa, Staphylococcus
IKED

SEQ ID NO: 2096876 - protein, 20 aa, Staphylococcus
IKEDQNGNQIKSAPIKNDSA

SEQ ID NO: 2096877 - protein, 16 aa, Staphylococcus
IKEGNRSRKPSKITSI

SEQ ID NO: 2096878 - protein, 10 aa, Staphylococcus
IKENNYGNVP

SEQ ID NO: 2096879 - protein, 11 aa, Staphylococcus
IKGNAEQNKSA

SEQ ID NO: 2096880 - protein, 12 aa, Staphylococcus
IKGNAEQSKSAF

SEQ ID NO: 2096881 - protein, 13 aa, Staphylococcus
IKGQAEQSKSGFA

SEQ ID NO: 2096882 - protein, 25 aa, Staphylococcus
IKGYTSVGTRKQPNLEEISKTKPDV

SEQ ID NO: 2096883 - protein, 17 aa, Staphylococcus
IKKNSKDSDKKSDKKED

SEQ ID NO: 2096884 - protein, 15 aa, Staphylococcus
IKKSNKANIQSTSGF

SEQ ID NO: 2096885 - protein, 4 aa, Staphylococcus
IKND

SEQ ID NO: 2096886 - protein, 6 aa, Staphylococcus
IKNDEE

SEQ ID NO: 2096887 - protein, 13 aa, Staphylococcus
IKNKNRSELESIN

SEQ ID NO: 2096888 - protein, 4 aa, Staphylococcus
IKNS

SEQ ID NO: 2096889 - protein, 12 aa, Staphylococcus
IKNTNGFVPNED

SEQ ID NO: 2096890 - protein, 27 aa, Staphylococcus
IKNVSNKYGTPIYSKNPSNNEGYYEYR

SEQ ID NO: 2096891 - protein, 5 aa, Staphylococcus
IKPEE

SEQ ID NO: 2096892 - protein, 18 aa, Staphylococcus
IKPKSKKVDDSKYLTYNP

SEQ ID NO: 2096893 - protein, 5 aa, Staphylococcus
IKPNE

SEQ ID NO: 2096894 - protein, 6 aa, Staphylococcus
IKPNNV

SEQ ID NO: 2096895 - protein, 4 aa, Staphylococcus
IKPS

SEQ ID NO: 2096896 - protein, 19 aa, Staphylococcus
IKQAKSTQKLSVSENPSTV

SEQ ID NO: 2096897 - protein, 9 aa, Staphylococcus
IKQARKKGA

SEQ ID NO: 2096898 - protein, 11 aa, Staphylococcus
IKQEAQSLDGA

SEQ ID NO: 2096899 - protein, 5 aa, Staphylococcus
IKQKH

SEQ ID NO: 2096900 - protein, 9 aa, Staphylococcus
IKQNAQTLD

SEQ ID NO: 2096901 - protein, 9 aa, Staphylococcus
IKQNSKGKI

SEQ ID NO: 2096902 - protein, 8 aa, Staphylococcus
IKQPTQTV

SEQ ID NO: 2096903 - protein, 5 aa, Staphylococcus
IKQSF

SEQ ID NO: 2096904 - protein, 11 aa, Staphylococcus
IKQTANELNTA

SEQ ID NO: 2096905 - protein, 6 aa, Staphylococcus
IKRSRK

SEQ ID NO: 2096906 - protein, 7 aa, Staphylococcus
IKRSRKI

SEQ ID NO: 2096907 - protein, 9 aa, Staphylococcus
IKSDNVAKE

SEQ ID NO: 2096908 - protein, 9 aa, Staphylococcus
IKSGAQADY

SEQ ID NO: 2096909 - protein, 22 aa, Staphylococcus
IKSGEHKDILSSSREMTSEERD

SEQ ID NO: 2096910 - protein, 28 aa, Staphylococcus
IKSGYENNNTNKLNKGKTKLSQVNMSNN

SEQ ID NO: 2096911 - protein, 31 aa, Staphylococcus
IKSGYQSKDTKKLKKGQSELGQVNLSDNQTT

SEQ ID NO: 2096912 - protein, 8 aa, Staphylococcus
IKSNAGNL

SEQ ID NO: 2096913 - protein, 10 aa, Staphylococcus
IKSTTSNKSV

SEQ ID NO: 2096914 - protein, 9 aa, Staphylococcus
IKTAGNPDF

SEQ ID NO: 2096915 - protein, 9 aa, Staphylococcus
IKTKNASII

SEQ ID NO: 2096916 - protein, 32 aa, Staphylococcus
IKTKPEDAIKKAQQTYKNQDLKDISYEKSNGD

SEQ ID NO: 2096917 - protein, 20 aa, Staphylococcus
IKTSPEDAVKTAKKEYDGEV

SEQ ID NO: 2096918 - protein, 24 aa, Staphylococcus
IKTSTQDLNGVENLNQAKQTATGA

SEQ ID NO: 2096919 - protein, 16 aa, Staphylococcus
IKTVKKGSLPDDESLD

SEQ ID NO: 2096920 - protein, 7 aa, Staphylococcus
INAAPNH

SEQ ID NO: 2096921 - protein, 16 aa, Staphylococcus
INANNKATNEEKETAI

SEQ ID NO: 2096922 - protein, 4 aa, Staphylococcus
INDA

SEQ ID NO: 2096923 - protein, 20 aa, Staphylococcus
INDGDLESVKETIKSKIEGI

SEQ ID NO: 2096924 - protein, 4 aa, Staphylococcus
INDP

SEQ ID NO: 2096925 - protein, 5 aa, Staphylococcus
INDSA

SEQ ID NO: 2096926 - protein, 18 aa, Staphylococcus
INEDTPEQEAYKQAVSNA

SEQ ID NO: 2096927 - protein, 4 aa, Staphylococcus
INEK

SEQ ID NO: 2096928 - protein, 4 aa, Staphylococcus
INET

SEQ ID NO: 2096929 - protein, 9 aa, Staphylococcus
INETTNPIM

SEQ ID NO: 2096930 - protein, 13 aa, Staphylococcus
INETTQPTLNPES

SEQ ID NO: 2096931 - protein, 18 aa, Staphylococcus
INGATYTEVSSSNQPQDI

SEQ ID NO: 2096932 - protein, 18 aa, Staphylococcus
INGETSDKVAERRTSGDY

SEQ ID NO: 2096933 - protein, 10 aa, Staphylococcus
INGEVISGDS

SEQ ID NO: 2096934 - protein, 5 aa, Staphylococcus
INGQH

SEQ ID NO: 2096935 - protein, 6 aa, Staphylococcus
INGQHK

SEQ ID NO: 2096936 - protein, 4 aa, Staphylococcus
INGT

SEQ ID NO: 2096937 - protein, 8 aa, Staphylococcus
INHSNLNN

SEQ ID NO: 2096938 - protein, 19 aa, Staphylococcus
INHTAKNFNGTTNANHDLR

SEQ ID NO: 2096939 - protein, 10 aa, Staphylococcus
INKDREAKYK

SEQ ID NO: 2096940 - protein, 10 aa, Staphylococcus
INKEREQKYQ

SEQ ID NO: 2096941 - protein, 18 aa, Staphylococcus
INKERKEKYKFSNPYTYS

SEQ ID NO: 2096942 - protein, 10 aa, Staphylococcus
INKLEEEKQK

SEQ ID NO: 2096943 - protein, 6 aa, Staphylococcus
INKQGF

SEQ ID NO: 2096944 - protein, 13 aa, Staphylococcus
INKRTEQNDDESP

SEQ ID NO: 2096945 - protein, 7 aa, Staphylococcus
INNAQGE

SEQ ID NO: 2096946 - protein, 23 aa, Staphylococcus
INNDSSSTKPSTDNSKKLNVSNL

SEQ ID NO: 2096947 - protein, 6 aa, Staphylococcus
INPGQV

SEQ ID NO: 2096948 - protein, 4 aa, Staphylococcus
INPS

SEQ ID NO: 2096949 - protein, 6 aa, Staphylococcus
INPSEV

SEQ ID NO: 2096950 - protein, 5 aa, Staphylococcus
INPSN

SEQ ID NO: 2096951 - protein, 10 aa, Staphylococcus
INPSSGAAGK

SEQ ID NO: 2096952 - protein, 9 aa, Staphylococcus
INPSTGAAG

SEQ ID NO: 2096953 - protein, 4 aa, Staphylococcus
INPT

SEQ ID NO: 2096954 - protein, 6 aa, Staphylococcus
INQGQN

SEQ ID NO: 2096955 - protein, 7 aa, Staphylococcus
INQGQNT

SEQ ID NO: 2096956 - protein, 4 aa, Staphylococcus
INQK

SEQ ID NO: 2096957 - protein, 7 aa, Staphylococcus
INQNGDT

SEQ ID NO: 2096958 - protein, 8 aa, Staphylococcus
INQQPQYV

SEQ ID NO: 2096959 - protein, 25 aa, Staphylococcus
INSGAGGRGGMPTKPRANVSSSSKR

SEQ ID NO: 2096960 - protein, 15 aa, Staphylococcus
INTTVNKKPQAKENI

SEQ ID NO: 2096961 - protein, 6 aa, Staphylococcus
IPAMNG

SEQ ID NO: 2096962 - protein, 12 aa, Staphylococcus
IPASQKGYFNYI

SEQ ID NO: 2096963 - protein, 12 aa, Staphylococcus
IPASQVSSYVYI

SEQ ID NO: 2096964 - protein, 7 aa, Staphylococcus
IPEAKQF

SEQ ID NO: 2096965 - protein, 8 aa, Staphylococcus
IPENAEYQ

SEQ ID NO: 2096966 - protein, 8 aa, Staphylococcus
IPFEQNPN

SEQ ID NO: 2096967 - protein, 7 aa, Staphylococcus
IPHKTTD

SEQ ID NO: 2096968 - protein, 16 aa, Staphylococcus
IPKSPGKGKEAENGVS

SEQ ID NO: 2096969 - protein, 4 aa, Staphylococcus
IPNM

SEQ ID NO: 2096970 - protein, 6 aa, Staphylococcus
IPPEQV

SEQ ID NO: 2096971 - protein, 22 aa, Staphylococcus
IPQTTFESTSTDESGVTYENYE

SEQ ID NO: 2096972 - protein, 6 aa, Staphylococcus
IPRGDT

SEQ ID NO: 2096973 - protein, 5 aa, Staphylococcus
IPSKV

SEQ ID NO: 2096974 - protein, 8 aa, Staphylococcus
IPSTNTSV

SEQ ID NO: 2096975 - protein, 6 aa, Staphylococcus
IQDADS

SEQ ID NO: 2096976 - protein, 29 aa, Staphylococcus
IQDNPSIKAGQNYLDASNSNQNDYNTAID

SEQ ID NO: 2096977 - protein, 24 aa, Staphylococcus
IQEPINDASHTGWTTNGHTGEDVN

SEQ ID NO: 2096978 - protein, 4 aa, Staphylococcus
IQFD

SEQ ID NO: 2096979 - protein, 59 aa, Staphylococcus
IQGDNKPSTTHLEQSDNLNNSQITGNTLDQTQSLTNNESNELENETNTLATNTNSTIDE

SEQ ID NO: 2096980 - protein, 17 aa, Staphylococcus
IQGKADKSILDTYEPER

SEQ ID NO: 2096981 - protein, 9 aa, Staphylococcus
IQGTATNEQ

SEQ ID NO: 2096982 - protein, 38 aa, Staphylococcus
IQGTDNRNGVMQQTNDELDRDDLSKYSLDKSSDQEQFK

SEQ ID NO: 2096983 - protein, 5 aa, Staphylococcus
IQHGD

SEQ ID NO: 2096984 - protein, 9 aa, Staphylococcus
IQISGQNNK

SEQ ID NO: 2096985 - protein, 8 aa, Staphylococcus
IQKDPKLL

SEQ ID NO: 2096986 - protein, 13 aa, Staphylococcus
IQKHDPDYKEENM

SEQ ID NO: 2096987 - protein, 15 aa, Staphylococcus
IQKPINDESHTGWTT

SEQ ID NO: 2096988 - protein, 15 aa, Staphylococcus
IQKPINDKSRTGWTT

SEQ ID NO: 2096989 - protein, 12 aa, Staphylococcus
IQNEPQVESSSQ

SEQ ID NO: 2096990 - protein, 5 aa, Staphylococcus
IQPNQ

SEQ ID NO: 2096991 - protein, 4 aa, Staphylococcus
IQPS

SEQ ID NO: 2096992 - protein, 13 aa, Staphylococcus
IQQGDTALNTETN

SEQ ID NO: 2096993 - protein, 10 aa, Staphylococcus
IQQQTKNANY

SEQ ID NO: 2096994 - protein, 8 aa, Staphylococcus
IQQSHAPK

SEQ ID NO: 2096995 - protein, 14 aa, Staphylococcus
IQSKDGKISKDDMN

SEQ ID NO: 2096996 - protein, 12 aa, Staphylococcus
IQSSGQEVTIKT

SEQ ID NO: 2096997 - protein, 4 aa, Staphylococcus
IQTN

SEQ ID NO: 2096998 - protein, 5 aa, Staphylococcus
IQTPF

SEQ ID NO: 2096999 - protein, 10 aa, Staphylococcus
IQTTTPINDG

SEQ ID NO: 2097000 - protein, 9 aa, Staphylococcus
IRETQGQNG

SEQ ID NO: 2097001 - protein, 8 aa, Staphylococcus
IRNDGGQA

SEQ ID NO: 2097002 - protein, 7 aa, Staphylococcus
IRNGGTH

SEQ ID NO: 2097003 - protein, 10 aa, Staphylococcus
IRPSDNSDLH

SEQ ID NO: 2097004 - protein, 13 aa, Staphylococcus
IRQGNKEAENIKK

SEQ ID NO: 2097005 - protein, 28 aa, Staphylococcus
IRRNNPELERSIKDAKNTFVERKNNRLN

SEQ ID NO: 2097006 - protein, 8 aa, Staphylococcus
ISADGKTY

SEQ ID NO: 2097007 - protein, 36 aa, Staphylococcus
ISDAAETPVDITNKEGNVAVSSNYEPDGVTLTTQQG

SEQ ID NO: 2097008 - protein, 28 aa, Staphylococcus
ISDASESPVTIANKEKNSSISTKYQPSG

SEQ ID NO: 2097009 - protein, 19 aa, Staphylococcus
ISDDKQVQDFADKARDEYG

SEQ ID NO: 2097010 - protein, 89 aa, Staphylococcus
ISDYEQPASTNETDDDTHSTNEQDTDSQDQDQTEHSASSSDTTNREHDDVQQSSEKANQSDKTSRQDEIDTKQQSTANQDKDDASVSKA

SEQ ID NO: 2097011 - protein, 7 aa, Staphylococcus
ISESEKD

SEQ ID NO: 2097012 - protein, 10 aa, Staphylococcus
ISESGQEELK

SEQ ID NO: 2097013 - protein, 15 aa, Staphylococcus
ISESIQTKALSSQPL

SEQ ID NO: 2097014 - protein, 9 aa, Staphylococcus
ISESTEKTV

SEQ ID NO: 2097015 - protein, 6 aa, Staphylococcus
ISGETY

SEQ ID NO: 2097016 - protein, 29 aa, Staphylococcus
ISGTLGDARNWNNRAENKGYTVTSTPEKY

SEQ ID NO: 2097017 - protein, 17 aa, Staphylococcus
ISHTSDDAQYPKDGTYV

SEQ ID NO: 2097018 - protein, 23 aa, Staphylococcus
ISISGGSNSAHSANSNDKNTKEY

SEQ ID NO: 2097019 - protein, 9 aa, Staphylococcus
ISKETSPAF

SEQ ID NO: 2097020 - protein, 8 aa, Staphylococcus
ISKGEPRD

SEQ ID NO: 2097021 - protein, 10 aa, Staphylococcus
ISKNPTGDNR

SEQ ID NO: 2097022 - protein, 7 aa, Staphylococcus
ISKQNTE

SEQ ID NO: 2097023 - protein, 16 aa, Staphylococcus
ISKSKDDKEPQVHIYN

SEQ ID NO: 2097024 - protein, 17 aa, Staphylococcus
ISKTDTTDKNKKSFERL

SEQ ID NO: 2097025 - protein, 35 aa, Staphylococcus
ISNAASQVNSAKQDLNGDENLRKAKQNATTAVGGL

SEQ ID NO: 2097026 - protein, 38 aa, Staphylococcus
ISNKQKADIKKDYKTKNSKSWKDAEKDKAFAKKKNIDT

SEQ ID NO: 2097027 - protein, 34 aa, Staphylococcus
ISNKTKDKIKTNYKTKNSTSWKAAEKDKKLGKEH

SEQ ID NO: 2097028 - protein, 11 aa, Staphylococcus
ISNNNVKKAPI

SEQ ID NO: 2097029 - protein, 20 aa, Staphylococcus
ISNSQSNDNVDQAQTNGIQT

SEQ ID NO: 2097030 - protein, 79 aa, Staphylococcus
ISNYEQSDEHTSQSSSASNRDDSTDSDNNNSKEVTSNKNTNSDIPSEGSHSSHSEDQSHQSSTSSSKAETDDSKVSDAL

SEQ ID NO: 2097031 - protein, 9 aa, Staphylococcus
ISPKGKLRA

SEQ ID NO: 2097032 - protein, 7 aa, Staphylococcus
ISQAPDG

SEQ ID NO: 2097033 - protein, 10 aa, Staphylococcus
ISQDQQVKDF

SEQ ID NO: 2097034 - protein, 37 aa, Staphylococcus
ISQKQKDRIKKEYKTKNSDAWKEAEKQKKLTKENHIQ

SEQ ID NO: 2097035 - protein, 31 aa, Staphylococcus
ISQQQKHKIKADYKQENSQSWKAADKDKQLY

SEQ ID NO: 2097036 - protein, 18 aa, Staphylococcus
ISSAKSKEKTLNVKGNSA

SEQ ID NO: 2097037 - protein, 5 aa, Staphylococcus
ISSDE

SEQ ID NO: 2097038 - protein, 6 aa, Staphylococcus
ISSEEM

SEQ ID NO: 2097039 - protein, 6 aa, Staphylococcus
ISSEQM

SEQ ID NO: 2097040 - protein, 7 aa, Staphylococcus
ISSQAPK

SEQ ID NO: 2097041 - protein, 13 aa, Staphylococcus
ISTHDSDYKEENL

SEQ ID NO: 2097042 - protein, 7 aa, Staphylococcus
ISTNAQH

SEQ ID NO: 2097043 - protein, 38 aa, Staphylococcus
ISTRANREARAVRSSRRPVRGQGGTRPPSNTANTYTPP

SEQ ID NO: 2097044 - protein, 8 aa, Staphylococcus
ISTTAEEH

SEQ ID NO: 2097045 - protein, 13 aa, Staphylococcus
ITAEAMLEDIKNM

SEQ ID NO: 2097046 - protein, 11 aa, Staphylococcus
ITAGKYSGTRY

SEQ ID NO: 2097047 - protein, 20 aa, Staphylococcus
ITAKGQDVTIKTKEPYPELK

SEQ ID NO: 2097048 - protein, 12 aa, Staphylococcus
ITDKQAQNIGRE

SEQ ID NO: 2097049 - protein, 12 aa, Staphylococcus
ITDSSSPYPQGQ

SEQ ID NO: 2097050 - protein, 15 aa, Staphylococcus
ITENSKGNDNDTIEK

SEQ ID NO: 2097051 - protein, 32 aa, Staphylococcus
ITEQNNSGSVVNSTRSESIESDLSASSPVTKQ

SEQ ID NO: 2097052 - protein, 16 aa, Staphylococcus
ITFEKDGKKETGKYVY

SEQ ID NO: 2097053 - protein, 15 aa, Staphylococcus
ITFEKNGKKVTGTYK

SEQ ID NO: 2097054 - protein, 10 aa, Staphylococcus
ITGNEQQESS

SEQ ID NO: 2097055 - protein, 22 aa, Staphylococcus
ITGREHQAQDLVDETKKNVDKV

SEQ ID NO: 2097056 - protein, 23 aa, Staphylococcus
ITGTDDRNGVMKETNEALQDDDF

SEQ ID NO: 2097057 - protein, 12 aa, Staphylococcus
ITKDDNKKDGNK

SEQ ID NO: 2097058 - protein, 15 aa, Staphylococcus
ITKPSSGSKTPTVDN

SEQ ID NO: 2097059 - protein, 14 aa, Staphylococcus
ITNDTKTEPMYLYE

SEQ ID NO: 2097060 - protein, 24 aa, Staphylococcus
ITNTEQALNGAQNLHDAQTQAIQS

SEQ ID NO: 2097061 - protein, 26 aa, Staphylococcus
ITQEARAKGYNVSEASVSALGSNYDR

SEQ ID NO: 2097062 - protein, 5 aa, Staphylococcus
ITQET

SEQ ID NO: 2097063 - protein, 29 aa, Staphylococcus
ITQKDPRMDESDTERKQRELKESGTEMAH

SEQ ID NO: 2097064 - protein, 9 aa, Staphylococcus
ITQSMTNDD

SEQ ID NO: 2097065 - protein, 18 aa, Staphylococcus
ITSAYDQLSKKPNLTSVP

SEQ ID NO: 2097066 - protein, 37 aa, Staphylococcus
ITSDTPRQPEHYDSSNSDDSSSEDSDSSSSDETVTRD

SEQ ID NO: 2097067 - protein, 6 aa, Staphylococcus
ITSSNA

SEQ ID NO: 2097068 - protein, 38 aa, Staphylococcus
ITTQQKSDIKKQYKTKNSDAWKKAEEQKKMTEDNNIDT

SEQ ID NO: 2097069 - protein, 11 aa, Staphylococcus
ITTSNNRHKPE

SEQ ID NO: 2097070 - protein, 20 aa, Staphylococcus
ITVKETAKKPAATQTQTVSK

SEQ ID NO: 2097071 - protein, 16 aa, Staphylococcus
IVGSRAGNAVQKVAPN

SEQ ID NO: 2097072 - protein, 10 aa, Staphylococcus
IVHESQTDYP

SEQ ID NO: 2097073 - protein, 10 aa, Staphylococcus
IVPTKGTKTV

SEQ ID NO: 2097074 - protein, 16 aa, Staphylococcus
IYDKEDKAKDLTKQLD

SEQ ID NO: 2097075 - protein, 13 aa, Staphylococcus
IYGNKDDLKDIND

SEQ ID NO: 2097076 - protein, 11 aa, Staphylococcus
IYGSRDDLQSI

SEQ ID NO: 2097077 - protein, 10 aa, Staphylococcus
IYKKTETIES

SEQ ID NO: 2097078 - protein, 7 aa, Staphylococcus
IYPAGSD

SEQ ID NO: 2097079 - protein, 21 aa, Staphylococcus
IYPKGTDIHSYEPTQKEMTNI

SEQ ID NO: 2097080 - protein, 16 aa, Staphylococcus
IYPPGADTHSYEPTQR

SEQ ID NO: 2097081 - protein, 7 aa, Staphylococcus
IYPPGSD

SEQ ID NO: 2097082 - protein, 19 aa, Staphylococcus
IYSGEAKTWKDVNSSWPNK

SEQ ID NO: 2097083 - protein, 20 aa, Staphylococcus
IYSGQAKTWKDVNPKYPAKQ

SEQ ID NO: 2097084 - protein, 8 aa, Staphylococcus
KAAAKAGF

SEQ ID NO: 2097085 - protein, 13 aa, Staphylococcus
KAAKAIHDQKTTL

SEQ ID NO: 2097086 - protein, 9 aa, Staphylococcus
KAAKQGRLT

SEQ ID NO: 2097087 - protein, 5 aa, Staphylococcus
KAAPQ

SEQ ID NO: 2097088 - protein, 8 aa, Staphylococcus
KAASYNYY

SEQ ID NO: 2097089 - protein, 8 aa, Staphylococcus
KAAYNSAK

SEQ ID NO: 2097090 - protein, 6 aa, Staphylococcus
KADIDQ

SEQ ID NO: 2097091 - protein, 6 aa, Staphylococcus
KADIQK

SEQ ID NO: 2097092 - protein, 6 aa, Staphylococcus
KADTHS

SEQ ID NO: 2097093 - protein, 11 aa, Staphylococcus
KAEDYKEAAAE

SEQ ID NO: 2097094 - protein, 4 aa, Staphylococcus
KAEN

SEQ ID NO: 2097095 - protein, 27 aa, Staphylococcus
KAEQYRDGVAERGRATIAAKAGAKSIK

SEQ ID NO: 2097096 - protein, 14 aa, Staphylococcus
KAFKDISKTKEGHK

SEQ ID NO: 2097097 - protein, 6 aa, Staphylococcus
KAFSAA

SEQ ID NO: 2097098 - protein, 11 aa, Staphylococcus
KAFSPDQSHGT

SEQ ID NO: 2097099 - protein, 12 aa, Staphylococcus
KAFSPDQSHGTY

SEQ ID NO: 2097100 - protein, 12 aa, Staphylococcus
KAFSPNSSHGTY

SEQ ID NO: 2097101 - protein, 9 aa, Staphylococcus
KAGDSLNSI

SEQ ID NO: 2097102 - protein, 9 aa, Staphylococcus
KAGDSLSSI

SEQ ID NO: 2097103 - protein, 13 aa, Staphylococcus
KAGFEEKKPLKDN

SEQ ID NO: 2097104 - protein, 14 aa, Staphylococcus
KAGKEKTTMKPNKY

SEQ ID NO: 2097105 - protein, 14 aa, Staphylococcus
KAGSDEEVVKAKKV

SEQ ID NO: 2097106 - protein, 18 aa, Staphylococcus
KAGSGNSESTNTNTYNIP

SEQ ID NO: 2097107 - protein, 15 aa, Staphylococcus
KAGVQKPSVNNRTYR

SEQ ID NO: 2097108 - protein, 14 aa, Staphylococcus
KAGYKMNNKKQSVE

SEQ ID NO: 2097109 - protein, 7 aa, Staphylococcus
KAHGGTI

SEQ ID NO: 2097110 - protein, 11 aa, Staphylococcus
KAHKDAKISAI

SEQ ID NO: 2097111 - protein, 15 aa, Staphylococcus
KAHQDDYQKRGDDYL

SEQ ID NO: 2097112 - protein, 7 aa, Staphylococcus
KAIEQDM

SEQ ID NO: 2097113 - protein, 5 aa, Staphylococcus
KAIGT

SEQ ID NO: 2097114 - protein, 8 aa, Staphylococcus
KAIGTGPF

SEQ ID NO: 2097115 - protein, 7 aa, Staphylococcus
KAIKDNK

SEQ ID NO: 2097116 - protein, 45 aa, Staphylococcus
KAINDKDKTLSLESTLDKNSDLLKGEEDEHEHEHGEEHEHGEEHE

SEQ ID NO: 2097117 - protein, 7 aa, Staphylococcus
KAIPNRL

SEQ ID NO: 2097118 - protein, 13 aa, Staphylococcus
KAKEEMKKKGYDL

SEQ ID NO: 2097119 - protein, 13 aa, Staphylococcus
KAKEQLKKKGYDL

SEQ ID NO: 2097120 - protein, 8 aa, Staphylococcus
KAKGEPVD

SEQ ID NO: 2097121 - protein, 27 aa, Staphylococcus
KAKKAGYRVGKKPAKRAVMQSTSGTYG

SEQ ID NO: 2097122 - protein, 8 aa, Staphylococcus
KAKKRPIN

SEQ ID NO: 2097123 - protein, 9 aa, Staphylococcus
KAKNSFSNL

SEQ ID NO: 2097124 - protein, 8 aa, Staphylococcus
KAKNSSLT

SEQ ID NO: 2097125 - protein, 28 aa, Staphylococcus
KAKQLLDEAGYKDKDGDGFREDPKGKKF

SEQ ID NO: 2097126 - protein, 6 aa, Staphylococcus
KAKQLT

SEQ ID NO: 2097127 - protein, 11 aa, Staphylococcus
KALDGDKMKDI

SEQ ID NO: 2097128 - protein, 23 aa, Staphylococcus
KALGKEDEGKKRLKEHDEKIEKY

SEQ ID NO: 2097129 - protein, 24 aa, Staphylococcus
KALGKEDQGKKRLKEHDKKIAEYK

SEQ ID NO: 2097130 - protein, 13 aa, Staphylococcus
KALPKGEGGKSLP

SEQ ID NO: 2097131 - protein, 14 aa, Staphylococcus
KALPKGEGNKSLPD

SEQ ID NO: 2097132 - protein, 6 aa, Staphylococcus
KALSSL

SEQ ID NO: 2097133 - protein, 48 aa, Staphylococcus
KAMNASNKEFKKASKHINQIKDDSKRKELKELDDALKDKYKKHDDYAA

SEQ ID NO: 2097134 - protein, 11 aa, Staphylococcus
KAMNKDTTVET

SEQ ID NO: 2097135 - protein, 11 aa, Staphylococcus
KAMNKETTVET

SEQ ID NO: 2097136 - protein, 8 aa, Staphylococcus
KANGEPVD

SEQ ID NO: 2097137 - protein, 7 aa, Staphylococcus
KANHPAA

SEQ ID NO: 2097138 - protein, 13 aa, Staphylococcus
KANKDNKALPELT

SEQ ID NO: 2097139 - protein, 6 aa, Staphylococcus
KANLKD

SEQ ID NO: 2097140 - protein, 5 aa, Staphylococcus
KANSL

SEQ ID NO: 2097141 - protein, 5 aa, Staphylococcus
KANTP

SEQ ID NO: 2097142 - protein, 11 aa, Staphylococcus
KAPAKKKEDQV

SEQ ID NO: 2097143 - protein, 4 aa, Staphylococcus
KAPK

SEQ ID NO: 2097144 - protein, 34 aa, Staphylococcus
KAPLEAAKDALQQSIQAADNTDTNGMTQDSINTF

SEQ ID NO: 2097145 - protein, 31 aa, Staphylococcus
KAPLQQAKTELEQSINQTTDTNGMTQESVAN

SEQ ID NO: 2097146 - protein, 17 aa, Staphylococcus
KAPSNNGDISGDTHTVV

SEQ ID NO: 2097147 - protein, 13 aa, Staphylococcus
KAPVNIQRTTSDY

SEQ ID NO: 2097148 - protein, 8 aa, Staphylococcus
KAQNDFDG

SEQ ID NO: 2097149 - protein, 70 aa, Staphylococcus
KAQNDTTNKKHKKDNSNDANQQSDSSNDQSQSNDMDAQQSDMNAQQPNDTVNNQNNQQQPQQGQEIDTTA

SEQ ID NO: 2097150 - protein, 21 aa, Staphylococcus
KAQNVQQANDIKQNAGNLNNA

SEQ ID NO: 2097151 - protein, 36 aa, Staphylococcus
KAQVQTANSFQPETSLQNTSQTPESDNLNQSPSQNV

SEQ ID NO: 2097152 - protein, 24 aa, Staphylococcus
KARDGEKAANKYSSKPGHSEHQTG

SEQ ID NO: 2097153 - protein, 6 aa, Staphylococcus
KARGEL

SEQ ID NO: 2097154 - protein, 7 aa, Staphylococcus
KASGWDS

SEQ ID NO: 2097155 - protein, 9 aa, Staphylococcus
KASPDEPTF

SEQ ID NO: 2097156 - protein, 16 aa, Staphylococcus
KASPEEPSYKEFQKDP

SEQ ID NO: 2097157 - protein, 13 aa, Staphylococcus
KASPNEPSLKELE

SEQ ID NO: 2097158 - protein, 12 aa, Staphylococcus
KATIQDDDNMTV

SEQ ID NO: 2097159 - protein, 12 aa, Staphylococcus
KATTSSKNVKKY

SEQ ID NO: 2097160 - protein, 14 aa, Staphylococcus
KATVPSSGKQLKSI

SEQ ID NO: 2097161 - protein, 6 aa, Staphylococcus
KAVKED

SEQ ID NO: 2097162 - protein, 8 aa, Staphylococcus
KAVKNDKV

SEQ ID NO: 2097163 - protein, 11 aa, Staphylococcus
KAVKPSENNYR

SEQ ID NO: 2097164 - protein, 7 aa, Staphylococcus
KAVSEQV

SEQ ID NO: 2097165 - protein, 6 aa, Staphylococcus
KAYGKD

SEQ ID NO: 2097166 - protein, 20 aa, Staphylococcus
KAYGKDLKKVKGNNNVKGSG

SEQ ID NO: 2097167 - protein, 14 aa, Staphylococcus
KAYGKEPEGTPPMT

SEQ ID NO: 2097168 - protein, 7 aa, Staphylococcus
KAYGSDF

SEQ ID NO: 2097169 - protein, 7 aa, Staphylococcus
KAYKQQK

SEQ ID NO: 2097170 - protein, 7 aa, Staphylococcus
KAYKQQQ

SEQ ID NO: 2097171 - protein, 7 aa, Staphylococcus
KAYNEED

SEQ ID NO: 2097172 - protein, 7 aa, Staphylococcus
KAYNEKG

SEQ ID NO: 2097173 - protein, 7 aa, Staphylococcus
KAYPNDH

SEQ ID NO: 2097174 - protein, 7 aa, Staphylococcus
KAYQQQQ

SEQ ID NO: 2097175 - protein, 6 aa, Staphylococcus
KAYSKA

SEQ ID NO: 2097176 - protein, 11 aa, Staphylococcus
KDAHKIGQDKD

SEQ ID NO: 2097177 - protein, 11 aa, Staphylococcus
KDAHKIGQKEK

SEQ ID NO: 2097178 - protein, 18 aa, Staphylococcus
KDAKNTFQERKKNDKHLN

SEQ ID NO: 2097179 - protein, 13 aa, Staphylococcus
KDAKWSNGDPVTA

SEQ ID NO: 2097180 - protein, 7 aa, Staphylococcus
KDANGKL

SEQ ID NO: 2097181 - protein, 15 aa, Staphylococcus
KDASSISQDTTDTGQ

SEQ ID NO: 2097182 - protein, 9 aa, Staphylococcus
KDAYPSDKL

SEQ ID NO: 2097183 - protein, 7 aa, Staphylococcus
KDDEGNI

SEQ ID NO: 2097184 - protein, 5 aa, Staphylococcus
KDDEV

SEQ ID NO: 2097185 - protein, 5 aa, Staphylococcus
KDDEY

SEQ ID NO: 2097186 - protein, 7 aa, Staphylococcus
KDDHPAA

SEQ ID NO: 2097187 - protein, 6 aa, Staphylococcus
KDDKAV

SEQ ID NO: 2097188 - protein, 10 aa, Staphylococcus
KDDKDATYQS

SEQ ID NO: 2097189 - protein, 8 aa, Staphylococcus
KDDLKNDD

SEQ ID NO: 2097190 - protein, 6 aa, Staphylococcus
KDDRVA

SEQ ID NO: 2097191 - protein, 7 aa, Staphylococcus
KDEHPAA

SEQ ID NO: 2097192 - protein, 4 aa, Staphylococcus
KDEL

SEQ ID NO: 2097193 - protein, 19 aa, Staphylococcus
KDELVKKDAKHKDDYEKNY

SEQ ID NO: 2097194 - protein, 8 aa, Staphylococcus
KDENMQEY

SEQ ID NO: 2097195 - protein, 14 aa, Staphylococcus
KDEQQAKKDKVNLW

SEQ ID NO: 2097196 - protein, 23 aa, Staphylococcus
KDGATQDQVDEKSKELGKAYKDM

SEQ ID NO: 2097197 - protein, 10 aa, Staphylococcus
KDGDQNKKKI

SEQ ID NO: 2097198 - protein, 17 aa, Staphylococcus
KDGGESGAFNLGSSQGY

SEQ ID NO: 2097199 - protein, 38 aa, Staphylococcus
KDGGKQIGSFSSDGSQFSQPGYSKDQTVKTDSNGEATL

SEQ ID NO: 2097200 - protein, 10 aa, Staphylococcus
KDGHKDDKKI

SEQ ID NO: 2097201 - protein, 11 aa, Staphylococcus
KDGHKDDKKIK

SEQ ID NO: 2097202 - protein, 16 aa, Staphylococcus
KDGKTTFKKDFNSRGY

SEQ ID NO: 2097203 - protein, 13 aa, Staphylococcus
KDGKVQPQDINKA

SEQ ID NO: 2097204 - protein, 27 aa, Staphylococcus
KDGNNPKALISKTKDDKEPQVHIYKNN

SEQ ID NO: 2097205 - protein, 9 aa, Staphylococcus
KDGNNPRAL

SEQ ID NO: 2097206 - protein, 9 aa, Staphylococcus
KDGNTSRAL

SEQ ID NO: 2097207 - protein, 9 aa, Staphylococcus
KDGSTDRIS

SEQ ID NO: 2097208 - protein, 18 aa, Staphylococcus
KDGTHSDGRVSNASSQSL

SEQ ID NO: 2097209 - protein, 13 aa, Staphylococcus
KDHGQNLDKDAVA

SEQ ID NO: 2097210 - protein, 9 aa, Staphylococcus
KDHKDDEKI

SEQ ID NO: 2097211 - protein, 31 aa, Staphylococcus
KDHQQTLNSEDYHDATADRQNDYNNAVNDAN

SEQ ID NO: 2097212 - protein, 11 aa, Staphylococcus
KDIAKSKKGHK

SEQ ID NO: 2097213 - protein, 10 aa, Staphylococcus
KDIENTYDGT

SEQ ID NO: 2097214 - protein, 10 aa, Staphylococcus
KDIKDLKKGA

SEQ ID NO: 2097215 - protein, 6 aa, Staphylococcus
KDIKEV

SEQ ID NO: 2097216 - protein, 13 aa, Staphylococcus
KDIKFNNKQSAEY

SEQ ID NO: 2097217 - protein, 6 aa, Staphylococcus
KDIKNA

SEQ ID NO: 2097218 - protein, 8 aa, Staphylococcus
KDINAKDA

SEQ ID NO: 2097219 - protein, 8 aa, Staphylococcus
KDIPDGST

SEQ ID NO: 2097220 - protein, 8 aa, Staphylococcus
KDIPTNGI

SEQ ID NO: 2097221 - protein, 11 aa, Staphylococcus
KDISKNKKRDK

SEQ ID NO: 2097222 - protein, 14 aa, Staphylococcus
KDKDGNIYPIEEAI

SEQ ID NO: 2097223 - protein, 8 aa, Staphylococcus
KDKDYHSV

SEQ ID NO: 2097224 - protein, 7 aa, Staphylococcus
KDKGVSL

SEQ ID NO: 2097225 - protein, 4 aa, Staphylococcus
KDKI

SEQ ID NO: 2097226 - protein, 9 aa, Staphylococcus
KDKIGSNKT

SEQ ID NO: 2097227 - protein, 10 aa, Staphylococcus
KDKKIRQSQM

SEQ ID NO: 2097228 - protein, 13 aa, Staphylococcus
KDKNIANGREQAK

SEQ ID NO: 2097229 - protein, 18 aa, Staphylococcus
KDKNYKSVKDLKDGDKLA

SEQ ID NO: 2097230 - protein, 7 aa, Staphylococcus
KDKPTSQ

SEQ ID NO: 2097231 - protein, 5 aa, Staphylococcus
KDKRV

SEQ ID NO: 2097232 - protein, 8 aa, Staphylococcus
KDKSNNDE

SEQ ID NO: 2097233 - protein, 18 aa, Staphylococcus
KDKTVNLKSDNSGGYTFE

SEQ ID NO: 2097234 - protein, 20 aa, Staphylococcus
KDKVENQLGKPKRVTSNEYG

SEQ ID NO: 2097235 - protein, 14 aa, Staphylococcus
KDKVSVSTDLPQLS

SEQ ID NO: 2097236 - protein, 12 aa, Staphylococcus
KDLKDDKDFGKS

SEQ ID NO: 2097237 - protein, 17 aa, Staphylococcus
KDLKEGNRSRKPSKFNT

SEQ ID NO: 2097238 - protein, 18 aa, Staphylococcus
KDLKGKKVGLQDADSAAG

SEQ ID NO: 2097239 - protein, 20 aa, Staphylococcus
KDLNKAEITNNYVNSARKNA

SEQ ID NO: 2097240 - protein, 8 aa, Staphylococcus
KDLNPNTQ

SEQ ID NO: 2097241 - protein, 69 aa, Staphylococcus
KDLQTSNQNNVSHKDTANKSTEKEARQHQNHKSTIQQQESSEKLVTAAQNASATNQAVSTNTNETHVQY

SEQ ID NO: 2097242 - protein, 7 aa, Staphylococcus
KDLSGAM

SEQ ID NO: 2097243 - protein, 11 aa, Staphylococcus
KDLTKPEYKNE

SEQ ID NO: 2097244 - protein, 20 aa, Staphylococcus
KDLTNEEKHSKAMRNVKSSD

SEQ ID NO: 2097245 - protein, 21 aa, Staphylococcus
KDMNSGEKNSKAMQGVKSSDW

SEQ ID NO: 2097246 - protein, 11 aa, Staphylococcus
KDMPSELKQRY

SEQ ID NO: 2097247 - protein, 4 aa, Staphylococcus
KDND

SEQ ID NO: 2097248 - protein, 5 aa, Staphylococcus
KDNDF

SEQ ID NO: 2097249 - protein, 6 aa, Staphylococcus
KDNDFV

SEQ ID NO: 2097250 - protein, 14 aa, Staphylococcus
KDNHRSAENHFTPR

SEQ ID NO: 2097251 - protein, 14 aa, Staphylococcus
KDNKNGNVKQNASH

SEQ ID NO: 2097252 - protein, 36 aa, Staphylococcus
KDNKNIKSFDDVKGKKLAQTFTSNYGELAKSKGAEL

SEQ ID NO: 2097253 - protein, 11 aa, Staphylococcus
KDNKNPEDVAK

SEQ ID NO: 2097254 - protein, 8 aa, Staphylococcus
KDNNDGTV

SEQ ID NO: 2097255 - protein, 8 aa, Staphylococcus
KDNPKIDK

SEQ ID NO: 2097256 - protein, 9 aa, Staphylococcus
KDNPKIDTA

SEQ ID NO: 2097257 - protein, 16 aa, Staphylococcus
KDNQVKDRALSDYEGK

SEQ ID NO: 2097258 - protein, 5 aa, Staphylococcus
KDNTT

SEQ ID NO: 2097259 - protein, 15 aa, Staphylococcus
KDNVLSKAKLKKNTV

SEQ ID NO: 2097260 - protein, 4 aa, Staphylococcus
KDPI

SEQ ID NO: 2097261 - protein, 17 aa, Staphylococcus
KDPKKKEGAKLAAYESA

SEQ ID NO: 2097262 - protein, 18 aa, Staphylococcus
KDPLSSAKGAIKEMDGKA

SEQ ID NO: 2097263 - protein, 18 aa, Staphylococcus
KDPNDYSNDNLAKKEIKL

SEQ ID NO: 2097264 - protein, 7 aa, Staphylococcus
KDPRMDT

SEQ ID NO: 2097265 - protein, 10 aa, Staphylococcus
KDPSNPKGRY

SEQ ID NO: 2097266 - protein, 7 aa, Staphylococcus
KDQIEEE

SEQ ID NO: 2097267 - protein, 10 aa, Staphylococcus
KDQKNPEQVA

SEQ ID NO: 2097268 - protein, 7 aa, Staphylococcus
KDQLTGY

SEQ ID NO: 2097269 - protein, 36 aa, Staphylococcus
KDQQAGASLYDTDSVDDTIVTSEQVNKYKNSKALNH

SEQ ID NO: 2097270 - protein, 36 aa, Staphylococcus
KDQQAGASLYDTGSIDDTTITADQVNKYKKSSGLKY

SEQ ID NO: 2097271 - protein, 35 aa, Staphylococcus
KDQQAGASLYDTGSVDDTTITADRVDKYADNPGLK

SEQ ID NO: 2097272 - protein, 4 aa, Staphylococcus
KDQV

SEQ ID NO: 2097273 - protein, 12 aa, Staphylococcus
KDRDIKKAVDDS

SEQ ID NO: 2097274 - protein, 8 aa, Staphylococcus
KDSDIKKL

SEQ ID NO: 2097275 - protein, 19 aa, Staphylococcus
KDSEDGQKEADEKEKDFDN

SEQ ID NO: 2097276 - protein, 16 aa, Staphylococcus
KDSGIKSLKDLKGKKI

SEQ ID NO: 2097277 - protein, 16 aa, Staphylococcus
KDSGIKSVKDLKGKKI

SEQ ID NO: 2097278 - protein, 7 aa, Staphylococcus
KDSNYHS

SEQ ID NO: 2097279 - protein, 11 aa, Staphylococcus
KDTAKKNEYTL

SEQ ID NO: 2097280 - protein, 20 aa, Staphylococcus
KDTATKVYQSGKTLEEYVGL

SEQ ID NO: 2097281 - protein, 9 aa, Staphylococcus
KDTEENGKG

SEQ ID NO: 2097282 - protein, 9 aa, Staphylococcus
KDTEKEGKG

SEQ ID NO: 2097283 - protein, 10 aa, Staphylococcus
KDTGIDATKD

SEQ ID NO: 2097284 - protein, 11 aa, Staphylococcus
KDTKLDETIQA

SEQ ID NO: 2097285 - protein, 4 aa, Staphylococcus
KDTY

SEQ ID NO: 2097286 - protein, 14 aa, Staphylococcus
KDVDKVDAENVESV

SEQ ID NO: 2097287 - protein, 10 aa, Staphylococcus
KDVENTYDGT

SEQ ID NO: 2097288 - protein, 66 aa, Staphylococcus
KDVPEKSAHVTTTSTPGNPLEKPQPQKNQQPQSSTPANTTASQRTSSQTDGQSTTKEAKAAQEQAI

SEQ ID NO: 2097289 - protein, 32 aa, Staphylococcus
KDWAKNAKKDQYKVNQHPKEGSILQTTEGKYG

SEQ ID NO: 2097290 - protein, 23 aa, Staphylococcus
KDWKNQTAKDGKEIKDKIGKDKT

SEQ ID NO: 2097291 - protein, 7 aa, Staphylococcus
KDWQDKD

SEQ ID NO: 2097292 - protein, 4 aa, Staphylococcus
KDYK

SEQ ID NO: 2097293 - protein, 18 aa, Staphylococcus
KDYKNGDISYNPNVPSYS

SEQ ID NO: 2097294 - protein, 30 aa, Staphylococcus
KDYKNGDISYNPNVPSYSAKYQLNNDDYNV

SEQ ID NO: 2097295 - protein, 8 aa, Staphylococcus
KDYNNAAW

SEQ ID NO: 2097296 - protein, 11 aa, Staphylococcus
KDYQKEDDSIK

SEQ ID NO: 2097297 - protein, 19 aa, Staphylococcus
KDYSKAMNTVNKEKQDVDN

SEQ ID NO: 2097298 - protein, 14 aa, Staphylococcus
KEAAHSLPADTKAV

SEQ ID NO: 2097299 - protein, 4 aa, Staphylococcus
KEAF

SEQ ID NO: 2097300 - protein, 6 aa, Staphylococcus
KEAHPA

SEQ ID NO: 2097301 - protein, 7 aa, Staphylococcus
KEAHPAA

SEQ ID NO: 2097302 - protein, 10 aa, Staphylococcus
KEAKKGSEVR

SEQ ID NO: 2097303 - protein, 7 aa, Staphylococcus
KEALPEA

SEQ ID NO: 2097304 - protein, 32 aa, Staphylococcus
KEAQEALKKDTKDGEKAVDLSQKEIKDIEDSL

SEQ ID NO: 2097305 - protein, 9 aa, Staphylococcus
KEAQNEVDD

SEQ ID NO: 2097306 - protein, 7 aa, Staphylococcus
KEAYGKG

SEQ ID NO: 2097307 - protein, 5 aa, Staphylococcus
KEDIG

SEQ ID NO: 2097308 - protein, 13 aa, Staphylococcus
KEDIKAEKNADTN

SEQ ID NO: 2097309 - protein, 13 aa, Staphylococcus
KEDIKAEKNGDTN

SEQ ID NO: 2097310 - protein, 4 aa, Staphylococcus
KEDK

SEQ ID NO: 2097311 - protein, 9 aa, Staphylococcus
KEDTSTSLK

SEQ ID NO: 2097312 - protein, 11 aa, Staphylococcus
KEEAGIDATKD

SEQ ID NO: 2097313 - protein, 9 aa, Staphylococcus
KEEKAKALN

SEQ ID NO: 2097314 - protein, 14 aa, Staphylococcus
KEELEAEGITPLTD

SEQ ID NO: 2097315 - protein, 5 aa, Staphylococcus
KEELS

SEQ ID NO: 2097316 - protein, 10 aa, Staphylococcus
KEEMKKKGYD

SEQ ID NO: 2097317 - protein, 15 aa, Staphylococcus
KEENLDRKSDLLDKK

SEQ ID NO: 2097318 - protein, 25 aa, Staphylococcus
KEETGKSPRDFTDAEMAEAQAYADA

SEQ ID NO: 2097319 - protein, 5 aa, Staphylococcus
KEEVS

SEQ ID NO: 2097320 - protein, 53 aa, Staphylococcus
KEFDDSSKNVSNDKKPNTSQSRRIENVDRSRDRTNRQVEENRTQSRNVSQKDL

SEQ ID NO: 2097321 - protein, 8 aa, Staphylococcus
KEFKPDFT

SEQ ID NO: 2097322 - protein, 78 aa, Staphylococcus
KEFTNEDKTSNQQKKDKQTNTKRVYQDQKLEKEIEKESVPEELERSARQRGRVERETRQSANSRESNRDSNKLQKELE

SEQ ID NO: 2097323 - protein, 16 aa, Staphylococcus
KEGFRDQEFDKDDKGT

SEQ ID NO: 2097324 - protein, 16 aa, Staphylococcus
KEGFRDQEFDKGDKGT

SEQ ID NO: 2097325 - protein, 36 aa, Staphylococcus
KEGNGGSDETEVTKTSSSKDDDSDSDSKDYPYTADE

SEQ ID NO: 2097326 - protein, 5 aa, Staphylococcus
KEGSN

SEQ ID NO: 2097327 - protein, 4 aa, Staphylococcus
KEGV

SEQ ID NO: 2097328 - protein, 7 aa, Staphylococcus
KEHAEPV

SEQ ID NO: 2097329 - protein, 5 aa, Staphylococcus
KEHDY

SEQ ID NO: 2097330 - protein, 12 aa, Staphylococcus
KEHKADYKDIKV

SEQ ID NO: 2097331 - protein, 58 aa, Staphylococcus
KEIDKTDNTSEEELSDYKKTVAKTDKANKKIKKDFKDYKDSFDKDALDNKKNKKIYTG

SEQ ID NO: 2097332 - protein, 9 aa, Staphylococcus
KEIEDSATE

SEQ ID NO: 2097333 - protein, 7 aa, Staphylococcus
KEIEERH

SEQ ID NO: 2097334 - protein, 9 aa, Staphylococcus
KEISANEAE

SEQ ID NO: 2097335 - protein, 4 aa, Staphylococcus
KEIT

SEQ ID NO: 2097336 - protein, 11 aa, Staphylococcus
KEITKDKQGNA

SEQ ID NO: 2097337 - protein, 6 aa, Staphylococcus
KEITMD

SEQ ID NO: 2097338 - protein, 14 aa, Staphylococcus
KEIYSGKAKTWKDV

SEQ ID NO: 2097339 - protein, 23 aa, Staphylococcus
KEKAKEVKDSGQSLESYLGLYPK

SEQ ID NO: 2097340 - protein, 11 aa, Staphylococcus
KEKDGETFSKK

SEQ ID NO: 2097341 - protein, 26 aa, Staphylococcus
KEKDGETYSENLDDKEIEKQGKSMAS

SEQ ID NO: 2097342 - protein, 25 aa, Staphylococcus
KEKDGETYSKELDDKEIEKQGKQMA

SEQ ID NO: 2097343 - protein, 26 aa, Staphylococcus
KEKDGETYSKKLDDKEIEKQGKQMAS

SEQ ID NO: 2097344 - protein, 9 aa, Staphylococcus
KEKDKENKN

SEQ ID NO: 2097345 - protein, 7 aa, Staphylococcus
KEKEEAF

SEQ ID NO: 2097346 - protein, 8 aa, Staphylococcus
KEKEEQFG

SEQ ID NO: 2097347 - protein, 8 aa, Staphylococcus
KEKHDQYG

SEQ ID NO: 2097348 - protein, 5 aa, Staphylococcus
KEKHE

SEQ ID NO: 2097349 - protein, 8 aa, Staphylococcus
KEKKLDDH

SEQ ID NO: 2097350 - protein, 5 aa, Staphylococcus
KEKPD

SEQ ID NO: 2097351 - protein, 7 aa, Staphylococcus
KEKPKDT

SEQ ID NO: 2097352 - protein, 8 aa, Staphylococcus
KEKQLTQP

SEQ ID NO: 2097353 - protein, 7 aa, Staphylococcus
KEKVESL

SEQ ID NO: 2097354 - protein, 10 aa, Staphylococcus
KEKVNETKRM

SEQ ID NO: 2097355 - protein, 22 aa, Staphylococcus
KEKYEAHDAYAKAYKKALNKEK

SEQ ID NO: 2097356 - protein, 6 aa, Staphylococcus
KELGKK

SEQ ID NO: 2097357 - protein, 7 aa, Staphylococcus
KELHAKA

SEQ ID NO: 2097358 - protein, 6 aa, Staphylococcus
KELKPM

SEQ ID NO: 2097359 - protein, 7 aa, Staphylococcus
KEMDSYD

SEQ ID NO: 2097360 - protein, 24 aa, Staphylococcus
KENAADIRNEDGSTFNSDNDPRVT

SEQ ID NO: 2097361 - protein, 8 aa, Staphylococcus
KENGDGTV

SEQ ID NO: 2097362 - protein, 4 aa, Staphylococcus
KENI

SEQ ID NO: 2097363 - protein, 54 aa, Staphylococcus
KENKDDKEGLSDKEAKAKAEKIQKEVEKHPDKFGEIAKKESMDKASAKKDGSLG

SEQ ID NO: 2097364 - protein, 4 aa, Staphylococcus
KENN

SEQ ID NO: 2097365 - protein, 5 aa, Staphylococcus
KENND

SEQ ID NO: 2097366 - protein, 8 aa, Staphylococcus
KENQEAAK

SEQ ID NO: 2097367 - protein, 9 aa, Staphylococcus
KENSGPYGF

SEQ ID NO: 2097368 - protein, 14 aa, Staphylococcus
KENYGHDASQSTHE

SEQ ID NO: 2097369 - protein, 15 aa, Staphylococcus
KENYGTGSSQTSEEV

SEQ ID NO: 2097370 - protein, 13 aa, Staphylococcus
KEPLDPKKVKNAW

SEQ ID NO: 2097371 - protein, 6 aa, Staphylococcus
KEPMYG

SEQ ID NO: 2097372 - protein, 15 aa, Staphylococcus
KEPPIRTRTSDWSET

SEQ ID NO: 2097373 - protein, 12 aa, Staphylococcus
KEPVYPGPATLE

SEQ ID NO: 2097374 - protein, 6 aa, Staphylococcus
KEQEGQ

SEQ ID NO: 2097375 - protein, 139 aa, Staphylococcus
KEQGYDNESNQSTSNNNQSQNEKENNQTSDNSKQSTKKDAKVDQNRENIETNNDESNQKQNNEEQQENSNEEASQNEEREDPNQQIEQPSSEDKQNPDAAQENNNQNNDENTDGNNYENEQSQDVESKSSENDKETSNA

SEQ ID NO: 2097376 - protein, 6 aa, Staphylococcus
KEQKGL

SEQ ID NO: 2097377 - protein, 36 aa, Staphylococcus
KEQLDKVKKEAKKLKKLTKSGKDEKDPKVVEQTTRL

SEQ ID NO: 2097378 - protein, 9 aa, Staphylococcus
KEQSQEEMD

SEQ ID NO: 2097379 - protein, 13 aa, Staphylococcus
KERDAQYQSFGKP

SEQ ID NO: 2097380 - protein, 16 aa, Staphylococcus
KEREADIEAGKYDQYK

SEQ ID NO: 2097381 - protein, 8 aa, Staphylococcus
KEREEQFG

SEQ ID NO: 2097382 - protein, 9 aa, Staphylococcus
KEREEQYGS

SEQ ID NO: 2097383 - protein, 8 aa, Staphylococcus
KEREEQYN

SEQ ID NO: 2097384 - protein, 8 aa, Staphylococcus
KERNAHPV

SEQ ID NO: 2097385 - protein, 9 aa, Staphylococcus
KERRGDYLG

SEQ ID NO: 2097386 - protein, 16 aa, Staphylococcus
KESDGSVWTNGKGDSF

SEQ ID NO: 2097387 - protein, 7 aa, Staphylococcus
KESIIRK

SEQ ID NO: 2097388 - protein, 10 aa, Staphylococcus
KESKGASMKE

SEQ ID NO: 2097389 - protein, 11 aa, Staphylococcus
KESQLKQLKNN

SEQ ID NO: 2097390 - protein, 5 aa, Staphylococcus
KETGI

SEQ ID NO: 2097391 - protein, 9 aa, Staphylococcus
KETGINATK

SEQ ID NO: 2097392 - protein, 8 aa, Staphylococcus
KETKNNIK

SEQ ID NO: 2097393 - protein, 8 aa, Staphylococcus
KETNNAVS

SEQ ID NO: 2097394 - protein, 8 aa, Staphylococcus
KETNTKPL

SEQ ID NO: 2097395 - protein, 8 aa, Staphylococcus
KETPLPQP

SEQ ID NO: 2097396 - protein, 8 aa, Staphylococcus
KETQRIAD

SEQ ID NO: 2097397 - protein, 6 aa, Staphylococcus
KEVFPT

SEQ ID NO: 2097398 - protein, 4 aa, Staphylococcus
KEYE

SEQ ID NO: 2097399 - protein, 7 aa, Staphylococcus
KEYEEEM

SEQ ID NO: 2097400 - protein, 12 aa, Staphylococcus
KEYGDDVIPYEN

SEQ ID NO: 2097401 - protein, 12 aa, Staphylococcus
KEYSNRKFDGEA

SEQ ID NO: 2097402 - protein, 22 aa, Staphylococcus
KFAKDNKDVTVSSGTSGTGGGF

SEQ ID NO: 2097403 - protein, 22 aa, Staphylococcus
KFAKDYPDVTVSSGTSGTGGGF

SEQ ID NO: 2097404 - protein, 22 aa, Staphylococcus
KFAKDYPNATVSSGTSGTGGGF

SEQ ID NO: 2097405 - protein, 10 aa, Staphylococcus
KFDGKKPTQL

SEQ ID NO: 2097406 - protein, 6 aa, Staphylococcus
KFDKDE

SEQ ID NO: 2097407 - protein, 7 aa, Staphylococcus
KFDKNEK

SEQ ID NO: 2097408 - protein, 5 aa, Staphylococcus
KFETN

SEQ ID NO: 2097409 - protein, 5 aa, Staphylococcus
KFNDI

SEQ ID NO: 2097410 - protein, 4 aa, Staphylococcus
KFNE

SEQ ID NO: 2097411 - protein, 7 aa, Staphylococcus
KFNTYSK

SEQ ID NO: 2097412 - protein, 28 aa, Staphylococcus
KFQNGKKVTGQAVKASLEESIKKSDLVK

SEQ ID NO: 2097413 - protein, 14 aa, Staphylococcus
KFQTSADDKNQYYQ

SEQ ID NO: 2097414 - protein, 6 aa, Staphylococcus
KFRDQL

SEQ ID NO: 2097415 - protein, 11 aa, Staphylococcus
KFSDGSALDAK

SEQ ID NO: 2097416 - protein, 11 aa, Staphylococcus
KFSDGSKLDAK

SEQ ID NO: 2097417 - protein, 21 aa, Staphylococcus
KFSIKEKGNEDKKVNSSVKNG

SEQ ID NO: 2097418 - protein, 11 aa, Staphylococcus
KFSKKKSEVNE

SEQ ID NO: 2097419 - protein, 47 aa, Staphylococcus
KFTKDEIDKMSESEQKDKNANENLGLNPSHHGETDKAKIAKKSPAYL

SEQ ID NO: 2097420 - protein, 10 aa, Staphylococcus
KFTNKSAKKY

SEQ ID NO: 2097421 - protein, 5 aa, Staphylococcus
KFVKD

SEQ ID NO: 2097422 - protein, 5 aa, Staphylococcus
KGAFP

SEQ ID NO: 2097423 - protein, 12 aa, Staphylococcus
KGAGSLATGSAV

SEQ ID NO: 2097424 - protein, 9 aa, Staphylococcus
KGAKSGIQN

SEQ ID NO: 2097425 - protein, 7 aa, Staphylococcus
KGAVSKE

SEQ ID NO: 2097426 - protein, 5 aa, Staphylococcus
KGDEV

SEQ ID NO: 2097427 - protein, 6 aa, Staphylococcus
KGDNDV

SEQ ID NO: 2097428 - protein, 7 aa, Staphylococcus
KGDNDVV

SEQ ID NO: 2097429 - protein, 20 aa, Staphylococcus
KGDRLPGSVKNDLHKADRKL

SEQ ID NO: 2097430 - protein, 8 aa, Staphylococcus
KGDSVNKQ

SEQ ID NO: 2097431 - protein, 16 aa, Staphylococcus
KGENDPNLKKQENNPV

SEQ ID NO: 2097432 - protein, 6 aa, Staphylococcus
KGENIS

SEQ ID NO: 2097433 - protein, 6 aa, Staphylococcus
KGETNF

SEQ ID NO: 2097434 - protein, 18 aa, Staphylococcus
KGEYQSKFSDGVKKKHLP

SEQ ID NO: 2097435 - protein, 5 aa, Staphylococcus
KGGHL

SEQ ID NO: 2097436 - protein, 7 aa, Staphylococcus
KGGKDNM

SEQ ID NO: 2097437 - protein, 17 aa, Staphylococcus
KGGYDPVPLAKNKSKHH

SEQ ID NO: 2097438 - protein, 4 aa, Staphylococcus
KGHD

SEQ ID NO: 2097439 - protein, 6 aa, Staphylococcus
KGHDQG

SEQ ID NO: 2097440 - protein, 9 aa, Staphylococcus
KGHKDDEKI

SEQ ID NO: 2097441 - protein, 18 aa, Staphylococcus
KGIDKDMKEAVKGNEGKT

SEQ ID NO: 2097442 - protein, 9 aa, Staphylococcus
KGIKKSDIQ

SEQ ID NO: 2097443 - protein, 8 aa, Staphylococcus
KGIKNAGQ

SEQ ID NO: 2097444 - protein, 10 aa, Staphylococcus
KGIKNAGQNL

SEQ ID NO: 2097445 - protein, 12 aa, Staphylococcus
KGIKNAGQNLTS

SEQ ID NO: 2097446 - protein, 8 aa, Staphylococcus
KGIPTNGI

SEQ ID NO: 2097447 - protein, 39 aa, Staphylococcus
KGISKNDLLPGEEHEHEHEHGDHEEHGEEHEHEHEHGKY

SEQ ID NO: 2097448 - protein, 10 aa, Staphylococcus
KGISKTTLSD

SEQ ID NO: 2097449 - protein, 9 aa, Staphylococcus
KGKDGNKTL

SEQ ID NO: 2097450 - protein, 10 aa, Staphylococcus
KGKEKITGYQ

SEQ ID NO: 2097451 - protein, 10 aa, Staphylococcus
KGKENETGYQ

SEQ ID NO: 2097452 - protein, 9 aa, Staphylococcus
KGKEQITGY

SEQ ID NO: 2097453 - protein, 4 aa, Staphylococcus
KGKI

SEQ ID NO: 2097454 - protein, 9 aa, Staphylococcus
KGKKAGVSN

SEQ ID NO: 2097455 - protein, 7 aa, Staphylococcus
KGKKIDV

SEQ ID NO: 2097456 - protein, 7 aa, Staphylococcus
KGKKVQL

SEQ ID NO: 2097457 - protein, 31 aa, Staphylococcus
KGKNNKVSLDKTVSQMKRNGLKEKSNMTDHD

SEQ ID NO: 2097458 - protein, 6 aa, Staphylococcus
KGKTDL

SEQ ID NO: 2097459 - protein, 8 aa, Staphylococcus
KGKTITRK

SEQ ID NO: 2097460 - protein, 26 aa, Staphylococcus
KGKTSYQFGSNSPQDKNLKLYRIDLA

SEQ ID NO: 2097461 - protein, 5 aa, Staphylococcus
KGKVD

SEQ ID NO: 2097462 - protein, 14 aa, Staphylococcus
KGKYDSNTNKTTYT

SEQ ID NO: 2097463 - protein, 6 aa, Staphylococcus
KGLARE

SEQ ID NO: 2097464 - protein, 8 aa, Staphylococcus
KGLEGKKI

SEQ ID NO: 2097465 - protein, 13 aa, Staphylococcus
KGLPKGENNASLP

SEQ ID NO: 2097466 - protein, 4 aa, Staphylococcus
KGLV

SEQ ID NO: 2097467 - protein, 13 aa, Staphylococcus
KGMPKKSDGGKTL

SEQ ID NO: 2097468 - protein, 8 aa, Staphylococcus
KGNAGYDA

SEQ ID NO: 2097469 - protein, 6 aa, Staphylococcus
KGNAQL

SEQ ID NO: 2097470 - protein, 15 aa, Staphylococcus
KGNAQNNTDWGNEEY

SEQ ID NO: 2097471 - protein, 8 aa, Staphylococcus
KGNEKNLQ

SEQ ID NO: 2097472 - protein, 4 aa, Staphylococcus
KGNG

SEQ ID NO: 2097473 - protein, 4 aa, Staphylococcus
KGNI

SEQ ID NO: 2097474 - protein, 8 aa, Staphylococcus
KGNIDGNK

SEQ ID NO: 2097475 - protein, 11 aa, Staphylococcus
KGNIDTNKIGK

SEQ ID NO: 2097476 - protein, 9 aa, Staphylococcus
KGNKDGVKS

SEQ ID NO: 2097477 - protein, 28 aa, Staphylococcus
KGNPEEVKYQKKHGGDISPLYKGGQDNM

SEQ ID NO: 2097478 - protein, 4 aa, Staphylococcus
KGPI

SEQ ID NO: 2097479 - protein, 6 aa, Staphylococcus
KGQDKP

SEQ ID NO: 2097480 - protein, 6 aa, Staphylococcus
KGQDYN

SEQ ID NO: 2097481 - protein, 10 aa, Staphylococcus
KGQPANQTLN

SEQ ID NO: 2097482 - protein, 9 aa, Staphylococcus
KGQRTDKYG

SEQ ID NO: 2097483 - protein, 10 aa, Staphylococcus
KGQTPTGPVR

SEQ ID NO: 2097484 - protein, 7 aa, Staphylococcus
KGRKISG

SEQ ID NO: 2097485 - protein, 10 aa, Staphylococcus
KGSAEYQKMS

SEQ ID NO: 2097486 - protein, 10 aa, Staphylococcus
KGSEEYQQMS

SEQ ID NO: 2097487 - protein, 9 aa, Staphylococcus
KGSKAGIKN

SEQ ID NO: 2097488 - protein, 9 aa, Staphylococcus
KGSKSGIKN

SEQ ID NO: 2097489 - protein, 8 aa, Staphylococcus
KGSNGQWT

SEQ ID NO: 2097490 - protein, 4 aa, Staphylococcus
KGSY

SEQ ID NO: 2097491 - protein, 7 aa, Staphylococcus
KGTENAY

SEQ ID NO: 2097492 - protein, 6 aa, Staphylococcus
KGTHPS

SEQ ID NO: 2097493 - protein, 6 aa, Staphylococcus
KGTINN

SEQ ID NO: 2097494 - protein, 5 aa, Staphylococcus
KGTLD

SEQ ID NO: 2097495 - protein, 48 aa, Staphylococcus
KGTNRTNPDDPKENVTDSAAGGTAFATGHKTYNGAISVDTNKKPLKSV

SEQ ID NO: 2097496 - protein, 47 aa, Staphylococcus
KGTNRTNPNDPKENVTDSAAGGTAFATGHKTYNGSISVDNDKKPLKS

SEQ ID NO: 2097497 - protein, 35 aa, Staphylococcus
KGTNRTNPNDPKENVTDSAAGGTAFATGYKTYNGA

SEQ ID NO: 2097498 - protein, 35 aa, Staphylococcus
KGTNRTYPNDPKENVTDSAAGATAFSSGHKTYNGA

SEQ ID NO: 2097499 - protein, 35 aa, Staphylococcus; identical to SEQ ID NO: 1838251

SEQ ID NO: 2097500 - protein, 6 aa, Staphylococcus
KGTNVK

SEQ ID NO: 2097501 - protein, 7 aa, Staphylococcus
KGTYENG

SEQ ID NO: 2097502 - protein, 17 aa, Staphylococcus
KGTYENGNIEASVSPTL

SEQ ID NO: 2097503 - protein, 12 aa, Staphylococcus
KGTYENGQVQAS

SEQ ID NO: 2097504 - protein, 16 aa, Staphylococcus
KGTYNNGKVNASVEPT

SEQ ID NO: 2097505 - protein, 15 aa, Staphylococcus
KGTYQNSKVNASVEP

SEQ ID NO: 2097506 - protein, 11 aa, Staphylococcus
KGVKAFGPTGR

SEQ ID NO: 2097507 - protein, 5 aa, Staphylococcus
KGVNL

SEQ ID NO: 2097508 - protein, 8 aa, Staphylococcus
KGVPTNGI

SEQ ID NO: 2097509 - protein, 20 aa, Staphylococcus
KGVTKVGDDDVEKVAKEKPD

SEQ ID NO: 2097510 - protein, 4 aa, Staphylococcus
KGYA

SEQ ID NO: 2097511 - protein, 7 aa, Staphylococcus
KGYAGQD

SEQ ID NO: 2097512 - protein, 10 aa, Staphylococcus
KGYDANSTIN

SEQ ID NO: 2097513 - protein, 6 aa, Staphylococcus
KGYEGE

SEQ ID NO: 2097514 - protein, 19 aa, Staphylococcus
KGYVTSVSKKSMTGGPKHK

SEQ ID NO: 2097515 - protein, 6 aa, Staphylococcus
KHAKSN

SEQ ID NO: 2097516 - protein, 6 aa, Staphylococcus
KHDLAK

SEQ ID NO: 2097517 - protein, 15 aa, Staphylococcus
KHDLAKGIKNAGQNL

SEQ ID NO: 2097518 - protein, 14 aa, Staphylococcus
KHDPDYKEENMDLD

SEQ ID NO: 2097519 - protein, 8 aa, Staphylococcus
KHKDAAKD

SEQ ID NO: 2097520 - protein, 26 aa, Staphylococcus
KHKKDEQANFNKNNDYWGTKPKLNQV

SEQ ID NO: 2097521 - protein, 15 aa, Staphylococcus
KHKSLKDIKNGQTIA

SEQ ID NO: 2097522 - protein, 6 aa, Staphylococcus
KHMPDL

SEQ ID NO: 2097523 - protein, 14 aa, Staphylococcus
KHNANIEAHNEWIK

SEQ ID NO: 2097524 - protein, 11 aa, Staphylococcus
KHNKDNKALPE

SEQ ID NO: 2097525 - protein, 30 aa, Staphylococcus
KHPDKASQQKQESGSKSMQAESGTTQSGER

SEQ ID NO: 2097526 - protein, 30 aa, Staphylococcus
KHPEKAKNDTQNRSTFSTKSRAATTNSGER

SEQ ID NO: 2097527 - protein, 17 aa, Staphylococcus
KHPLSEDQVNKIVNSFN

SEQ ID NO: 2097528 - protein, 30 aa, Staphylococcus
KHPNQKSNATQNRSTFSTKSRSAVTNTGER

SEQ ID NO: 2097529 - protein, 36 aa, Staphylococcus
KHQVSNAAQNISGVQTYQDPTLVKSNTTNNTYNTYT

SEQ ID NO: 2097530 - protein, 8 aa, Staphylococcus
KHRNQDHS

SEQ ID NO: 2097531 - protein, 6 aa, Staphylococcus
KHTGNS

SEQ ID NO: 2097532 - protein, 5 aa, Staphylococcus
KIAPT

SEQ ID NO: 2097533 - protein, 15 aa, Staphylococcus
KIASNQTKFLYKSKE

SEQ ID NO: 2097534 - protein, 8 aa, Staphylococcus
KIDEGTDV

SEQ ID NO: 2097535 - protein, 10 aa, Staphylococcus
KIDEGTDVNY

SEQ ID NO: 2097536 - protein, 13 aa, Staphylococcus
KIDEGTDVNYGEL

SEQ ID NO: 2097537 - protein, 7 aa, Staphylococcus
KIDNSNS

SEQ ID NO: 2097538 - protein, 14 aa, Staphylococcus
KIDREQSDNKKVAQ

SEQ ID NO: 2097539 - protein, 13 aa, Staphylococcus
KIDRNAKKVETTH

SEQ ID NO: 2097540 - protein, 17 aa, Staphylococcus
KIEEEDTTDEDTSEDDA

SEQ ID NO: 2097541 - protein, 10 aa, Staphylococcus
KIEESGELKK

SEQ ID NO: 2097542 - protein, 12 aa, Staphylococcus
KIEESKNLGGFP

SEQ ID NO: 2097543 - protein, 7 aa, Staphylococcus
KIEGTGY

SEQ ID NO: 2097544 - protein, 17 aa, Staphylococcus
KIENNNRNLRKTAQKYL

SEQ ID NO: 2097545 - protein, 4 aa, Staphylococcus
KIER

SEQ ID NO: 2097546 - protein, 18 aa, Staphylococcus
KIGNYTSVGTRKQPNLEE

SEQ ID NO: 2097547 - protein, 6 aa, Staphylococcus
KIGSAE

SEQ ID NO: 2097548 - protein, 24 aa, Staphylococcus
KIKDDKGKTTEPTKKTIKDGSYAL

SEQ ID NO: 2097549 - protein, 7 aa, Staphylococcus
KIKDEQN

SEQ ID NO: 2097550 - protein, 10 aa, Staphylococcus
KIKDSGELAK

SEQ ID NO: 2097551 - protein, 11 aa, Staphylococcus
KIKEESSFKGK

SEQ ID NO: 2097552 - protein, 24 aa, Staphylococcus
KIKGDDGKSVEPTKKTIQDGSYPL

SEQ ID NO: 2097553 - protein, 23 aa, Staphylococcus
KIKGKDGKAIAPTKKTIQDSSYA

SEQ ID NO: 2097554 - protein, 9 aa, Staphylococcus
KILSGRNGR

SEQ ID NO: 2097555 - protein, 10 aa, Staphylococcus
KINDSDQTIT

SEQ ID NO: 2097556 - protein, 68 aa, Staphylococcus
KINEQDKENQSSKKTETHQKTTSNKEIDSEKQTTKVSEEENQKKDNIEDKKRKEEIQNNTPLSDQEIK

SEQ ID NO: 2097557 - protein, 17 aa, Staphylococcus
KINGKDQQEVQETSKKV

SEQ ID NO: 2097558 - protein, 6 aa, Staphylococcus
KINGKH

SEQ ID NO: 2097559 - protein, 12 aa, Staphylococcus
KININSNDDRYE

SEQ ID NO: 2097560 - protein, 7 aa, Staphylococcus
KINKDDK

SEQ ID NO: 2097561 - protein, 13 aa, Staphylococcus
KIPAPDNIPHIKA

SEQ ID NO: 2097562 - protein, 20 aa, Staphylococcus
KIPNDTISARSDMSPSWKDK

SEQ ID NO: 2097563 - protein, 33 aa, Staphylococcus
KIPNGGSGAGAGSGSGGATATQGNTSTQSPSFN

SEQ ID NO: 2097564 - protein, 33 aa, Staphylococcus
KIPNGSTTTPSKTNPSTNNNVGGSGGYSSPTFS

SEQ ID NO: 2097565 - protein, 6 aa, Staphylococcus
KIPNIK

SEQ ID NO: 2097566 - protein, 9 aa, Staphylococcus
KIQKDPKLL

SEQ ID NO: 2097567 - protein, 10 aa, Staphylococcus
KIRDNGELAK

SEQ ID NO: 2097568 - protein, 8 aa, Staphylococcus
KIRNGGTH

SEQ ID NO: 2097569 - protein, 9 aa, Staphylococcus
KIRNGGTNY

SEQ ID NO: 2097570 - protein, 12 aa, Staphylococcus
KIRSDDNNLKST

SEQ ID NO: 2097571 - protein, 10 aa, Staphylococcus
KISKAKDVDT

SEQ ID NO: 2097572 - protein, 11 aa, Staphylococcus
KISPHGQNINN

SEQ ID NO: 2097573 - protein, 9 aa, Staphylococcus
KISSPQKIG

SEQ ID NO: 2097574 - protein, 7 aa, Staphylococcus
KISTSEM

SEQ ID NO: 2097575 - protein, 5 aa, Staphylococcus
KITNK

SEQ ID NO: 2097576 - protein, 7 aa, Staphylococcus
KITQIQG

SEQ ID NO: 2097577 - protein, 26 aa, Staphylococcus
KITSKQAQLSQKSNLSSVPLEAGQTY

SEQ ID NO: 2097578 - protein, 21 aa, Staphylococcus
KIYSGEAKTWKDVDSSWPNKE

SEQ ID NO: 2097579 - protein, 17 aa, Staphylococcus
KKAANQLPANTNDVKNL

SEQ ID NO: 2097580 - protein, 7 aa, Staphylococcus
KKAAPDA

SEQ ID NO: 2097581 - protein, 8 aa, Staphylococcus
KKAAPNAK

SEQ ID NO: 2097582 - protein, 14 aa, Staphylococcus
KKAARNNKKQRKWL

SEQ ID NO: 2097583 - protein, 8 aa, Staphylococcus
KKAHKDAK

SEQ ID NO: 2097584 - protein, 11 aa, Staphylococcus
KKAHKDAKIEA

SEQ ID NO: 2097585 - protein, 8 aa, Staphylococcus
KKAKNDKE

SEQ ID NO: 2097586 - protein, 13 aa, Staphylococcus
KKAKNILKEYHFK

SEQ ID NO: 2097587 - protein, 8 aa, Staphylococcus
KKALDSKI

SEQ ID NO: 2097588 - protein, 18 aa, Staphylococcus
KKANEKDQQTREKAADDI

SEQ ID NO: 2097589 - protein, 8 aa, Staphylococcus
KKARKNGS

SEQ ID NO: 2097590 - protein, 15 aa, Staphylococcus
KKASKISKDTNDVAE

SEQ ID NO: 2097591 - protein, 7 aa, Staphylococcus
KKASNRL

SEQ ID NO: 2097592 - protein, 8 aa, Staphylococcus
KKATKRRK

SEQ ID NO: 2097593 - protein, 7 aa, Staphylococcus
KKATLNN

SEQ ID NO: 2097594 - protein, 49 aa, Staphylococcus
KKDAKENKTDKDKSDKKKKVEAKRVDAPIQEDTTQYQQDTSQSQQTHQR

SEQ ID NO: 2097595 - protein, 6 aa, Staphylococcus
KKDDYV

SEQ ID NO: 2097596 - protein, 16 aa, Staphylococcus
KKDEPFKGTEVSRKSV

SEQ ID NO: 2097597 - protein, 6 aa, Staphylococcus
KKDGNM

SEQ ID NO: 2097598 - protein, 11 aa, Staphylococcus
KKDGPGADAAQ

SEQ ID NO: 2097599 - protein, 15 aa, Staphylococcus
KKDIKFNNKQSAEYL

SEQ ID NO: 2097600 - protein, 11 aa, Staphylococcus
KKDKANTLNRE

SEQ ID NO: 2097601 - protein, 13 aa, Staphylococcus
KKDKKLSETIQTD

SEQ ID NO: 2097602 - protein, 14 aa, Staphylococcus
KKDLKFNNKQGAEF

SEQ ID NO: 2097603 - protein, 8 aa, Staphylococcus
KKDMPSLD

SEQ ID NO: 2097604 - protein, 13 aa, Staphylococcus
KKDPDNASDESRD

SEQ ID NO: 2097605 - protein, 17 aa, Staphylococcus
KKDPKHKKEYEKNYKKL

SEQ ID NO: 2097606 - protein, 26 aa, Staphylococcus
KKDPKHKKTYEKNYEKLNKDLKEIDK

SEQ ID NO: 2097607 - protein, 7 aa, Staphylococcus
KKDQAIP

SEQ ID NO: 2097608 - protein, 43 aa, Staphylococcus
KKDRETRHQIDNPQLPSKDSVSHATVPAQSFEEATKQANTRAT

SEQ ID NO: 2097609 - protein, 17 aa, Staphylococcus
KKDVKRQKMDAGEDGIK

SEQ ID NO: 2097610 - protein, 6 aa, Staphylococcus
KKDWEA

SEQ ID NO: 2097611 - protein, 15 aa, Staphylococcus
KKDYDDQLKKLKDLT

SEQ ID NO: 2097612 - protein, 9 aa, Staphylococcus
KKDYKEELK

SEQ ID NO: 2097613 - protein, 11 aa, Staphylococcus
KKDYTEQQSKL

SEQ ID NO: 2097614 - protein, 5 aa, Staphylococcus
KKDYY

SEQ ID NO: 2097615 - protein, 16 aa, Staphylococcus
KKEATPNLAKSGVKLD

SEQ ID NO: 2097616 - protein, 10 aa, Staphylococcus
KKEDDATIKK

SEQ ID NO: 2097617 - protein, 7 aa, Staphylococcus
KKEDRMK

SEQ ID NO: 2097618 - protein, 4 aa, Staphylococcus
KKEG

SEQ ID NO: 2097619 - protein, 4 aa, Staphylococcus
KKEI

SEQ ID NO: 2097620 - protein, 6 aa, Staphylococcus
KKEPVY

SEQ ID NO: 2097621 - protein, 6 aa, Staphylococcus
KKEQPF

SEQ ID NO: 2097622 - protein, 26 aa, Staphylococcus
KKERIGKHTLDGDTTEYSKKDYDKSM

SEQ ID NO: 2097623 - protein, 9 aa, Staphylococcus
KKETRDQGS

SEQ ID NO: 2097624 - protein, 7 aa, Staphylococcus
KKEVEKM

SEQ ID NO: 2097625 - protein, 13 aa, Staphylococcus
KKEYGDDVIPYES

SEQ ID NO: 2097626 - protein, 6 aa, Staphylococcus
KKFQEK

SEQ ID NO: 2097627 - protein, 6 aa, Staphylococcus
KKGDKV

SEQ ID NO: 2097628 - protein, 23 aa, Staphylococcus
KKGHSTNQAQKALSVTKTATLGN

SEQ ID NO: 2097629 - protein, 14 aa, Staphylococcus
KKGMKDHDKKSVDR

SEQ ID NO: 2097630 - protein, 8 aa, Staphylococcus
KKGNLTGY

SEQ ID NO: 2097631 - protein, 34 aa, Staphylococcus
KKGRVEAVDGDKISRPGPRIDQGLKELRDAIYRY

SEQ ID NO: 2097632 - protein, 12 aa, Staphylococcus
KKGYQKLNGDQA

SEQ ID NO: 2097633 - protein, 4 aa, Staphylococcus
KKIA

SEQ ID NO: 2097634 - protein, 8 aa, Staphylococcus
KKINDTMN

SEQ ID NO: 2097635 - protein, 8 aa, Staphylococcus
KKIPNDTI

SEQ ID NO: 2097636 - protein, 8 aa, Staphylococcus
KKISNSSI

SEQ ID NO: 2097637 - protein, 29 aa, Staphylococcus
KKKAAEKLNNKLSTQVAETKKQLKMNVCY

SEQ ID NO: 2097638 - protein, 10 aa, Staphylococcus
KKKAHNTYNY

SEQ ID NO: 2097639 - protein, 8 aa, Staphylococcus
KKKGEPVD

SEQ ID NO: 2097640 - protein, 7 aa, Staphylococcus
KKKGQTV

SEQ ID NO: 2097641 - protein, 8 aa, Staphylococcus
KKKKRPLN

SEQ ID NO: 2097642 - protein, 14 aa, Staphylococcus
KKKTDKEDVTASSA

SEQ ID NO: 2097643 - protein, 9 aa, Staphylococcus
KKKTFKPGL

SEQ ID NO: 2097644 - protein, 6 aa, Staphylococcus
KKLGGN

SEQ ID NO: 2097645 - protein, 9 aa, Staphylococcus
KKLKDNKAF

SEQ ID NO: 2097646 - protein, 10 aa, Staphylococcus
KKLKDTDLTK

SEQ ID NO: 2097647 - protein, 130 aa, Staphylococcus
KKLQKENDDLKNQKKDLEKQKEKLNDQREKLQKEVDDSVATESAKDDSESDESDSSDSNQSSDSDTYKQSKSQSTTENSTSSNETNTSETNGGSDSQQSNQSSNTQERQSNSGESDTSEQSSSDDTSSSS

SEQ ID NO: 2097648 - protein, 8 aa, Staphylococcus
KKLQQDLK

SEQ ID NO: 2097649 - protein, 8 aa, Staphylococcus
KKLSDAMS

SEQ ID NO: 2097650 - protein, 6 aa, Staphylococcus
KKLSQI

SEQ ID NO: 2097651 - protein, 22 aa, Staphylococcus
KKMAQEQEKLKDERIVGTAGGG

SEQ ID NO: 2097652 - protein, 25 aa, Staphylococcus
KKMDEEDKALEEEMEQDEKEYEEEM

SEQ ID NO: 2097653 - protein, 7 aa, Staphylococcus
KKMPDLD

SEQ ID NO: 2097654 - protein, 7 aa, Staphylococcus
KKMREAI

SEQ ID NO: 2097655 - protein, 6 aa, Staphylococcus
KKNGQL

SEQ ID NO: 2097656 - protein, 5 aa, Staphylococcus
KKNSP

SEQ ID NO: 2097657 - protein, 16 aa, Staphylococcus
KKPITYKAATTTDKKL

SEQ ID NO: 2097658 - protein, 68 aa, Staphylococcus
KKPQAKEEIASKVNDKQREITNDNEGTTEEKQSAIESVNQAKVEADSGISQAQTNIEVEKAKNAGLSN

SEQ ID NO: 2097659 - protein, 6 aa, Staphylococcus
KKPRQL

SEQ ID NO: 2097660 - protein, 7 aa, Staphylococcus
KKPRQLT

SEQ ID NO: 2097661 - protein, 8 aa, Staphylococcus
KKPSNQVL

SEQ ID NO: 2097662 - protein, 18 aa, Staphylococcus
KKPYNTPGVKVQEKQRTN

SEQ ID NO: 2097663 - protein, 8 aa, Staphylococcus
KKQDGTLS

SEQ ID NO: 2097664 - protein, 23 aa, Staphylococcus
KKQKPDAKIKEIKGNAEKSKTAF

SEQ ID NO: 2097665 - protein, 9 aa, Staphylococcus
KKQKPNADV

SEQ ID NO: 2097666 - protein, 22 aa, Staphylococcus
KKQKPNAKIKAIKGDAEQNKSA

SEQ ID NO: 2097667 - protein, 7 aa, Staphylococcus
KKQMPDL

SEQ ID NO: 2097668 - protein, 9 aa, Staphylococcus
KKQNAEPVA

SEQ ID NO: 2097669 - protein, 7 aa, Staphylococcus
KKQNGDL

SEQ ID NO: 2097670 - protein, 6 aa, Staphylococcus
KKQPVL

SEQ ID NO: 2097671 - protein, 12 aa, Staphylococcus
KKQYGDDVIPYE

SEQ ID NO: 2097672 - protein, 7 aa, Staphylococcus
KKREGDL

SEQ ID NO: 2097673 - protein, 13 aa, Staphylococcus
KKREIPEAANKNL

SEQ ID NO: 2097674 - protein, 5 aa, Staphylococcus
KKRGA

SEQ ID NO: 2097675 - protein, 7 aa, Staphylococcus
KKRHTHR

SEQ ID NO: 2097676 - protein, 7 aa, Staphylococcus
KKRNEKV

SEQ ID NO: 2097677 - protein, 7 aa, Staphylococcus
KKSEYST

SEQ ID NO: 2097678 - protein, 10 aa, Staphylococcus
KKSGNKGVTI

SEQ ID NO: 2097679 - protein, 7 aa, Staphylococcus
KKSKQPY

SEQ ID NO: 2097680 - protein, 13 aa, Staphylococcus
KKSNNTDFNERET

SEQ ID NO: 2097681 - protein, 9 aa, Staphylococcus
KKSNTRSTS

SEQ ID NO: 2097682 - protein, 8 aa, Staphylococcus
KKSRKIGK

SEQ ID NO: 2097683 - protein, 9 aa, Staphylococcus
KKSTQNKKD

SEQ ID NO: 2097684 - protein, 7 aa, Staphylococcus
KKTEKEL

SEQ ID NO: 2097685 - protein, 17 aa, Staphylococcus
KKTITYEAGATSDKKLA

SEQ ID NO: 2097686 - protein, 8 aa, Staphylococcus
KKTKRAHI

SEQ ID NO: 2097687 - protein, 25 aa, Staphylococcus
KKTLKEKDKEYSKQKEKKLSIKPEK

SEQ ID NO: 2097688 - protein, 8 aa, Staphylococcus
KKTTKPYQ

SEQ ID NO: 2097689 - protein, 22 aa, Staphylococcus
KKTTSKATSSLPKYTPQVNSSI

SEQ ID NO: 2097690 - protein, 5 aa, Staphylococcus
KKTYE

SEQ ID NO: 2097691 - protein, 22 aa, Staphylococcus
KKTYQKGQTQPQPTSITPEKQK

SEQ ID NO: 2097692 - protein, 11 aa, Staphylococcus
KKVAETKKVIN

SEQ ID NO: 2097693 - protein, 13 aa, Staphylococcus
KKVDRNDSNTYVY

SEQ ID NO: 2097694 - protein, 14 aa, Staphylococcus
KKVDTMKNKTSKFD

SEQ ID NO: 2097695 - protein, 13 aa, Staphylococcus
KKVGPPKPSKKVK

SEQ ID NO: 2097696 - protein, 4 aa, Staphylococcus
KKVQ

SEQ ID NO: 2097697 - protein, 16 aa, Staphylococcus
KKVQEKNKIPLEMKKQ

SEQ ID NO: 2097698 - protein, 10 aa, Staphylococcus
KKVTKDKKDN

SEQ ID NO: 2097699 - protein, 18 aa, Staphylococcus
KKYGEDMRNNINKDGEVT

SEQ ID NO: 2097700 - protein, 8 aa, Staphylococcus
KKYGENDT

SEQ ID NO: 2097701 - protein, 8 aa, Staphylococcus
KKYGENET

SEQ ID NO: 2097702 - protein, 10 aa, Staphylococcus
KKYGENETVT

SEQ ID NO: 2097703 - protein, 8 aa, Staphylococcus
KKYKKQEP

SEQ ID NO: 2097704 - protein, 14 aa, Staphylococcus
KKYKSLKDLPNGAT

SEQ ID NO: 2097705 - protein, 4 aa, Staphylococcus
KKYN

SEQ ID NO: 2097706 - protein, 32 aa, Staphylococcus
KKYNGGLSSGEMQTKTAIEQGYYDGDDGPEVY

SEQ ID NO: 2097707 - protein, 19 aa, Staphylococcus
KKYPNITVSSATSGTGGGF

SEQ ID NO: 2097708 - protein, 8 aa, Staphylococcus
KKYPPQKI

SEQ ID NO: 2097709 - protein, 32 aa, Staphylococcus
KKYSDKVDTKDIDQQIKDEQKQYGGKDQFESA

SEQ ID NO: 2097710 - protein, 20 aa, Staphylococcus
KKYSDTMNKVNKEKEDVDSL

SEQ ID NO: 2097711 - protein, 13 aa, Staphylococcus
KLAEDKQHAGETM

SEQ ID NO: 2097712 - protein, 8 aa, Staphylococcus
KLAEEHPE

SEQ ID NO: 2097713 - protein, 18 aa, Staphylococcus
KLAKSTPAKTKEAKTLKK

SEQ ID NO: 2097714 - protein, 5 aa, Staphylococcus
KLATK

SEQ ID NO: 2097715 - protein, 22 aa, Staphylococcus
KLDAQGDTNGKTPSSVSAYNNE

SEQ ID NO: 2097716 - protein, 6 aa, Staphylococcus
KLDDNE

SEQ ID NO: 2097717 - protein, 5 aa, Staphylococcus
KLDDP

SEQ ID NO: 2097718 - protein, 8 aa, Staphylococcus
KLDKGDTR

SEQ ID NO: 2097719 - protein, 10 aa, Staphylococcus
KLDKTAKKNY

SEQ ID NO: 2097720 - protein, 7 aa, Staphylococcus
KLDQPTP

SEQ ID NO: 2097721 - protein, 11 aa, Staphylococcus
KLEDTVSTKEM

SEQ ID NO: 2097722 - protein, 10 aa, Staphylococcus
KLEGQISTEQ

SEQ ID NO: 2097723 - protein, 11 aa, Staphylococcus
KLEGTVTTKEM

SEQ ID NO: 2097724 - protein, 7 aa, Staphylococcus
KLEKNNN

SEQ ID NO: 2097725 - protein, 5 aa, Staphylococcus
KLGKL

SEQ ID NO: 2097726 - protein, 7 aa, Staphylococcus
KLHNKNA

SEQ ID NO: 2097727 - protein, 11 aa, Staphylococcus
KLKEAARTGRP

SEQ ID NO: 2097728 - protein, 6 aa, Staphylococcus
KLKEDY

SEQ ID NO: 2097729 - protein, 7 aa, Staphylococcus
KLKEGTL

SEQ ID NO: 2097730 - protein, 10 aa, Staphylococcus
KLKENGELAK

SEQ ID NO: 2097731 - protein, 25 aa, Staphylococcus
KLKQQSQGGAEGSFSSESSGEGIST

SEQ ID NO: 2097732 - protein, 10 aa, Staphylococcus
KLNAAKEKLR

SEQ ID NO: 2097733 - protein, 11 aa, Staphylococcus
KLNAAKENIKE

SEQ ID NO: 2097734 - protein, 18 aa, Staphylococcus
KLNGRGTDGGFEWSPDGK

SEQ ID NO: 2097735 - protein, 18 aa, Staphylococcus
KLNKDSHDKFDDIPKNQR

SEQ ID NO: 2097736 - protein, 24 aa, Staphylococcus
KLNKDSKDKFNDIPKQERAMVTSE

SEQ ID NO: 2097737 - protein, 17 aa, Staphylococcus
KLNKESKDKFNDIPKER

SEQ ID NO: 2097738 - protein, 15 aa, Staphylococcus
KLNKESKNKFNDIPK

SEQ ID NO: 2097739 - protein, 12 aa, Staphylococcus
KLNPHKSEDLQQ

SEQ ID NO: 2097740 - protein, 7 aa, Staphylococcus
KLNSEGI

SEQ ID NO: 2097741 - protein, 31 aa, Staphylococcus
KLNSLEEKKQGLYKKANSNDSNTRSKAADDV

SEQ ID NO: 2097742 - protein, 27 aa, Staphylococcus
KLPKEGKDIDRKDKAFNSELKKVKQKS

SEQ ID NO: 2097743 - protein, 27 aa, Staphylococcus
KLPKEGKDISSKDKEFNKQYYEFKENV

SEQ ID NO: 2097744 - protein, 8 aa, Staphylococcus
KLPKGKKP

SEQ ID NO: 2097745 - protein, 17 aa, Staphylococcus
KLPKGSKVNPQAEDSAV

SEQ ID NO: 2097746 - protein, 22 aa, Staphylococcus
KLPKTGKDLSKGNHNFKTKLEK

SEQ ID NO: 2097747 - protein, 25 aa, Staphylococcus
KLPKTGKELSKDNNDFYEDLKKLKK

SEQ ID NO: 2097748 - protein, 21 aa, Staphylococcus
KLQEKKQTKIAKRDAGDEVKH

SEQ ID NO: 2097749 - protein, 14 aa, Staphylococcus
KLQEYGQYHGGGAH

SEQ ID NO: 2097750 - protein, 11 aa, Staphylococcus
KLQGKINTKEM

SEQ ID NO: 2097751 - protein, 11 aa, Staphylococcus
KLQGQISTKEM

SEQ ID NO: 2097752 - protein, 22 aa, Staphylococcus
KLQKEGKDDKDPKVAEATTKLQ

SEQ ID NO: 2097753 - protein, 4 aa, Staphylococcus
KLQP

SEQ ID NO: 2097754 - protein, 13 aa, Staphylococcus
KLSSSQQQQLTER

SEQ ID NO: 2097755 - protein, 8 aa, Staphylococcus
KLTAKEEK

SEQ ID NO: 2097756 - protein, 22 aa, Staphylococcus
KLTGDAVKRSLEQGVKKSDLLS

SEQ ID NO: 2097757 - protein, 12 aa, Staphylococcus
KLTQGQQTKINS

SEQ ID NO: 2097758 - protein, 14 aa, Staphylococcus
KLTTAQLKNAYGKA

SEQ ID NO: 2097759 - protein, 10 aa, Staphylococcus
KLWQTKDNGF

SEQ ID NO: 2097760 - protein, 7 aa, Staphylococcus
KLWTTTD

SEQ ID NO: 2097761 - protein, 21 aa, Staphylococcus
KMAQEQEKLKDERIVGTAGGG

SEQ ID NO: 2097762 - protein, 13 aa, Staphylococcus
KMAQEQEKLKEER

SEQ ID NO: 2097763 - protein, 4 aa, Staphylococcus
KMPG

SEQ ID NO: 2097764 - protein, 20 aa, Staphylococcus
KMQDKKQEKIAKHDTGDEVK

SEQ ID NO: 2097765 - protein, 18 aa, Staphylococcus
KMQDQKQEQMAKNDTGDM

SEQ ID NO: 2097766 - protein, 22 aa, Staphylococcus
KMSDKEIEKVAKNGHQTTINNQ

SEQ ID NO: 2097767 - protein, 8 aa, Staphylococcus
KMSQYATP

SEQ ID NO: 2097768 - protein, 8 aa, Staphylococcus
KMTSPTSI

SEQ ID NO: 2097769 - protein, 6 aa, Staphylococcus
KNADKL

SEQ ID NO: 2097770 - protein, 8 aa, Staphylococcus
KNAHVKSS

SEQ ID NO: 2097771 - protein, 72 aa, Staphylococcus
KNASATGKGTGVNDDEKSPLNLTENNGEYTLKDTTQNAEMHTQTANNTTDDFSEITNDSNNFDKEEHKAGVD

SEQ ID NO: 2097772 - protein, 25 aa, Staphylococcus
KNASYQFSSNSPKDKNVKLYRVDLG

SEQ ID NO: 2097773 - protein, 14 aa, Staphylococcus
KNATNISEDTTDVA

SEQ ID NO: 2097774 - protein, 12 aa, Staphylococcus
KNDDMEKAKSLY

SEQ ID NO: 2097775 - protein, 13 aa, Staphylococcus
KNDEKIEKGETRK

SEQ ID NO: 2097776 - protein, 18 aa, Staphylococcus
KNDGNVEGRIDKDKKTMT

SEQ ID NO: 2097777 - protein, 23 aa, Staphylococcus
KNDINKEKMSSDDKEKNKDITKL

SEQ ID NO: 2097778 - protein, 7 aa, Staphylococcus
KNDKATL

SEQ ID NO: 2097779 - protein, 39 aa, Staphylococcus
KNDLQSSIDQQPSLDGMTQQSIDNYNAKRQAAQSEITKA

SEQ ID NO: 2097780 - protein, 5 aa, Staphylococcus
KNDPL

SEQ ID NO: 2097781 - protein, 8 aa, Staphylococcus
KNDQIGGR

SEQ ID NO: 2097782 - protein, 7 aa, Staphylococcus
KNEANMF

SEQ ID NO: 2097783 - protein, 15 aa, Staphylococcus
KNEATYSDPSSLKKL

SEQ ID NO: 2097784 - protein, 51 aa, Staphylococcus
KNENHSNEQSEQPDYNTETAIKQPTQSITEQAQPPEPQSAPKSTSSNQDNN

SEQ ID NO: 2097785 - protein, 5 aa, Staphylococcus
KNESV

SEQ ID NO: 2097786 - protein, 5 aa, Staphylococcus
KNEVY

SEQ ID NO: 2097787 - protein, 4 aa, Staphylococcus
KNGE

SEQ ID NO: 2097788 - protein, 33 aa, Staphylococcus
KNGKPELDMDENPLKYKKSHKADYEEENVEVKE

SEQ ID NO: 2097789 - protein, 16 aa, Staphylococcus
KNGQTKKIKNALDSDI

SEQ ID NO: 2097790 - protein, 5 aa, Staphylococcus
KNGQV

SEQ ID NO: 2097791 - protein, 33 aa, Staphylococcus
KNGRIETVNGDEISRPGPRIDEGLKQLRDAIYK

SEQ ID NO: 2097792 - protein, 6 aa, Staphylococcus
KNGRTY

SEQ ID NO: 2097793 - protein, 16 aa, Staphylococcus
KNGYESNNKKKINQGK

SEQ ID NO: 2097794 - protein, 5 aa, Staphylococcus
KNHPK

SEQ ID NO: 2097795 - protein, 12 aa, Staphylococcus
KNIKFNNKQSAE

SEQ ID NO: 2097796 - protein, 9 aa, Staphylococcus
KNIPKDEPV

SEQ ID NO: 2097797 - protein, 11 aa, Staphylococcus
KNIQGIDTEPV

SEQ ID NO: 2097798 - protein, 13 aa, Staphylococcus
KNIVSSDESMGIT

SEQ ID NO: 2097799 - protein, 10 aa, Staphylococcus
KNKDEQSVGD

SEQ ID NO: 2097800 - protein, 10 aa, Staphylococcus
KNKGPGTASR

SEQ ID NO: 2097801 - protein, 14 aa, Staphylococcus
KNKLSHRSHTSFEG

SEQ ID NO: 2097802 - protein, 11 aa, Staphylococcus
KNKSSEKITAS

SEQ ID NO: 2097803 - protein, 12 aa, Staphylococcus
KNLESHDNAELN

SEQ ID NO: 2097804 - protein, 7 aa, Staphylococcus
KNLGQNA

SEQ ID NO: 2097805 - protein, 9 aa, Staphylococcus
KNLKATPEG

SEQ ID NO: 2097806 - protein, 7 aa, Staphylococcus
KNLQSGF

SEQ ID NO: 2097807 - protein, 8 aa, Staphylococcus
KNLSEHDN

SEQ ID NO: 2097808 - protein, 9 aa, Staphylococcus
KNLSERTKR

SEQ ID NO: 2097809 - protein, 9 aa, Staphylococcus
KNLTGEAHT

SEQ ID NO: 2097810 - protein, 14 aa, Staphylococcus
KNMVTGKDAMGITD

SEQ ID NO: 2097811 - protein, 13 aa, Staphylococcus
KNNAAKVQHSGQA

SEQ ID NO: 2097812 - protein, 19 aa, Staphylococcus
KNNDGKSGVLANDKTLTQQ

SEQ ID NO: 2097813 - protein, 10 aa, Staphylococcus
KNNDSIAYPY

SEQ ID NO: 2097814 - protein, 11 aa, Staphylococcus
KNNGDKPGVLA

SEQ ID NO: 2097815 - protein, 8 aa, Staphylococcus
KNNHKVNM

SEQ ID NO: 2097816 - protein, 38 aa, Staphylococcus
KNNKDIKSFDDVKGKKLAQTFTSNYGKLAKSKGAELTK

SEQ ID NO: 2097817 - protein, 15 aa, Staphylococcus
KNNKVEVSNENEKEV

SEQ ID NO: 2097818 - protein, 12 aa, Staphylococcus
KNNLNENQSIWS

SEQ ID NO: 2097819 - protein, 8 aa, Staphylococcus
KNNMDGMD

SEQ ID NO: 2097820 - protein, 11 aa, Staphylococcus
KNNNAPNNNIA

SEQ ID NO: 2097821 - protein, 7 aa, Staphylococcus
KNNNAYY

SEQ ID NO: 2097822 - protein, 8 aa, Staphylococcus
KNNNEDQV

SEQ ID NO: 2097823 - protein, 8 aa, Staphylococcus
KNNQNQWS

SEQ ID NO: 2097824 - protein, 6 aa, Staphylococcus
KNNSKL

SEQ ID NO: 2097825 - protein, 6 aa, Staphylococcus
KNNTSY

SEQ ID NO: 2097826 - protein, 6 aa, Staphylococcus
KNNVIT

SEQ ID NO: 2097827 - protein, 9 aa, Staphylococcus
KNPEDRERG

SEQ ID NO: 2097828 - protein, 20 aa, Staphylococcus
KNPEDRERGIQALDQFDTYI

SEQ ID NO: 2097829 - protein, 7 aa, Staphylococcus
KNPKGSV

SEQ ID NO: 2097830 - protein, 20 aa, Staphylococcus
KNPQDRKDGADALSDFDTYF

SEQ ID NO: 2097831 - protein, 18 aa, Staphylococcus
KNPQYANPKYAGAKVPTL

SEQ ID NO: 2097832 - protein, 7 aa, Staphylococcus
KNPVYTN

SEQ ID NO: 2097833 - protein, 7 aa, Staphylococcus
KNQIEEE

SEQ ID NO: 2097834 - protein, 29 aa, Staphylococcus
KNQKTTVDKIKADNKLNSNSIKVGQILKM

SEQ ID NO: 2097835 - protein, 9 aa, Staphylococcus
KNQLTSKNA

SEQ ID NO: 2097836 - protein, 8 aa, Staphylococcus
KNQPAYKN

SEQ ID NO: 2097837 - protein, 13 aa, Staphylococcus
KNQPGAKKMNATA

SEQ ID NO: 2097838 - protein, 7 aa, Staphylococcus
KNQQLLP

SEQ ID NO: 2097839 - protein, 23 aa, Staphylococcus
KNQSDNTNYIEKRDKSVKAPEKL

SEQ ID NO: 2097840 - protein, 10 aa, Staphylococcus
KNQSKQTGYA

SEQ ID NO: 2097841 - protein, 6 aa, Staphylococcus
KNQSTI

SEQ ID NO: 2097842 - protein, 32 aa, Staphylococcus
KNQTSPDATDEEKAEANSKVEEAKAEANSNIQ

SEQ ID NO: 2097843 - protein, 11 aa, Staphylococcus
KNRNTGDVFEQ

SEQ ID NO: 2097844 - protein, 57 aa, Staphylococcus
KNRSEVESDINKATNKSDADQLTSKLEENNKQLKSTAKKYLNSSTTNSDSAKKAIND

SEQ ID NO: 2097845 - protein, 56 aa, Staphylococcus
KNRSQVEKKIKNASNQEDADQLTSKLESNNKDLKETAQKHLDTSSSNAKSAKKAIK

SEQ ID NO: 2097846 - protein, 7 aa, Staphylococcus
KNRVRHN

SEQ ID NO: 2097847 - protein, 46 aa, Staphylococcus
KNSEKQFKKGDSHINDIKNDNKRKEVKQLDDAIKNKYKTHDDYAKA

SEQ ID NO: 2097848 - protein, 8 aa, Staphylococcus
KNSTITEV

SEQ ID NO: 2097849 - protein, 8 aa, Staphylococcus
KNTDITVD

SEQ ID NO: 2097850 - protein, 14 aa, Staphylococcus
KNTEAVKNGKTFKV

SEQ ID NO: 2097851 - protein, 27 aa, Staphylococcus
KNTGKIIKTGGAITSPDGPIKAENGYI

SEQ ID NO: 2097852 - protein, 18 aa, Staphylococcus
KNTLGQVSTKNKGTYTTV

SEQ ID NO: 2097853 - protein, 33 aa, Staphylococcus
KNTRIESVNGDEISRPGPRIDEGLKELRDVIYK

SEQ ID NO: 2097854 - protein, 7 aa, Staphylococcus
KNTSKIW

SEQ ID NO: 2097855 - protein, 6 aa, Staphylococcus
KNVDRG

SEQ ID NO: 2097856 - protein, 4 aa, Staphylococcus
KNVM

SEQ ID NO: 2097857 - protein, 12 aa, Staphylococcus
KNVPKASDDFRD

SEQ ID NO: 2097858 - protein, 7 aa, Staphylococcus
KNVTTDL

SEQ ID NO: 2097859 - protein, 22 aa, Staphylococcus
KNYGTENRVTNQYRVNSKNQGL

SEQ ID NO: 2097860 - protein, 13 aa, Staphylococcus
KNYNQASSALQID

SEQ ID NO: 2097861 - protein, 15 aa, Staphylococcus
KNYRDRLPAKQRGAL

SEQ ID NO: 2097862 - protein, 6 aa, Staphylococcus
KNYRTL

SEQ ID NO: 2097863 - protein, 5 aa, Staphylococcus
KPADK

SEQ ID NO: 2097864 - protein, 27 aa, Staphylococcus
KPADKDVKPSPHGQNVNNEYITKKDPE

SEQ ID NO: 2097865 - protein, 7 aa, Staphylococcus
KPADKLS

SEQ ID NO: 2097866 - protein, 19 aa, Staphylococcus
KPADKNVKAGSHGQNVTNE

SEQ ID NO: 2097867 - protein, 17 aa, Staphylococcus
KPADQHVKASPHGQNIN

SEQ ID NO: 2097868 - protein, 17 aa, Staphylococcus
KPAIESSNERHNAGTGH

SEQ ID NO: 2097869 - protein, 11 aa, Staphylococcus
KPDIYTAGKGT

SEQ ID NO: 2097870 - protein, 9 aa, Staphylococcus
KPDKYDDSF

SEQ ID NO: 2097871 - protein, 6 aa, Staphylococcus
KPDPMG

SEQ ID NO: 2097872 - protein, 13 aa, Staphylococcus
KPDSAENDGNGTV

SEQ ID NO: 2097873 - protein, 12 aa, Staphylococcus
KPDSAENDGQGT

SEQ ID NO: 2097874 - protein, 11 aa, Staphylococcus
KPDSAEYDAKG

SEQ ID NO: 2097875 - protein, 39 aa, Staphylococcus
KPDSVSKATFKKAHASNEITEEGKLGNKDGSYVKYATND

SEQ ID NO: 2097876 - protein, 10 aa, Staphylococcus
KPEIGTAPSN

SEQ ID NO: 2097877 - protein, 6 aa, Staphylococcus
KPEIYT

SEQ ID NO: 2097878 - protein, 9 aa, Staphylococcus
KPEKQDGRL

SEQ ID NO: 2097879 - protein, 20 aa, Staphylococcus
KPENSTEPQHEPWSQPEKGY

SEQ ID NO: 2097880 - protein, 9 aa, Staphylococcus
KPETTIQDG

SEQ ID NO: 2097881 - protein, 8 aa, Staphylococcus
KPFKKEEY

SEQ ID NO: 2097882 - protein, 5 aa, Staphylococcus
KPFSK

SEQ ID NO: 2097883 - protein, 10 aa, Staphylococcus
KPILKKEGYD

SEQ ID NO: 2097884 - protein, 8 aa, Staphylococcus
KPIPNDTI

SEQ ID NO: 2097885 - protein, 6 aa, Staphylococcus
KPITKY

SEQ ID NO: 2097886 - protein, 16 aa, Staphylococcus
KPITYKAGATSEKKLA

SEQ ID NO: 2097887 - protein, 16 aa, Staphylococcus
KPITYKAGATSNSKLA

SEQ ID NO: 2097888 - protein, 7 aa, Staphylococcus
KPLLEKK

SEQ ID NO: 2097889 - protein, 10 aa, Staphylococcus
KPLLKDKGYD

SEQ ID NO: 2097890 - protein, 11 aa, Staphylococcus
KPLLKKKGYDL

SEQ ID NO: 2097891 - protein, 6 aa, Staphylococcus
KPLQQQ

SEQ ID NO: 2097892 - protein, 7 aa, Staphylococcus
KPMNRRQ

SEQ ID NO: 2097893 - protein, 7 aa, Staphylococcus
KPNPPVI

SEQ ID NO: 2097894 - protein, 8 aa, Staphylococcus
KPNRPEYM

SEQ ID NO: 2097895 - protein, 13 aa, Staphylococcus
KPNSAENDGSGTV

SEQ ID NO: 2097896 - protein, 6 aa, Staphylococcus
KPNSIS

SEQ ID NO: 2097897 - protein, 5 aa, Staphylococcus
KPNTE

SEQ ID NO: 2097898 - protein, 13 aa, Staphylococcus
KPNTISKDTFKEA

SEQ ID NO: 2097899 - protein, 4 aa, Staphylococcus
KPPN

SEQ ID NO: 2097900 - protein, 5 aa, Staphylococcus
KPSEF

SEQ ID NO: 2097901 - protein, 15 aa, Staphylococcus
KPSSIKTSEDVEKLA

SEQ ID NO: 2097902 - protein, 6 aa, Staphylococcus
KPSYIS

SEQ ID NO: 2097903 - protein, 15 aa, Staphylococcus
KPTGKYKNDPAGTMY

SEQ ID NO: 2097904 - protein, 11 aa, Staphylococcus
KPTNGNEKVNN

SEQ ID NO: 2097905 - protein, 11 aa, Staphylococcus
KPTNGNKKVNN

SEQ ID NO: 2097906 - protein, 23 aa, Staphylococcus
KPTTPSIDTLSTKYKADLSGQSI

SEQ ID NO: 2097907 - protein, 8 aa, Staphylococcus
KPVDKEGI

SEQ ID NO: 2097908 - protein, 17 aa, Staphylococcus
KPVKDSVKDLMGRDKKA

SEQ ID NO: 2097909 - protein, 17 aa, Staphylococcus
KPVTANTTTYSVQPGTK

SEQ ID NO: 2097910 - protein, 4 aa, Staphylococcus
KPYD

SEQ ID NO: 2097911 - protein, 6 aa, Staphylococcus
KPYEVT

SEQ ID NO: 2097912 - protein, 11 aa, Staphylococcus
KPYQSPNAAYV

SEQ ID NO: 2097913 - protein, 10 aa, Staphylococcus
KQAGKSLKDK

SEQ ID NO: 2097914 - protein, 11 aa, Staphylococcus
KQAGKSTDDKS

SEQ ID NO: 2097915 - protein, 20 aa, Staphylococcus
KQAGKSTKDKSVVATSKDVT

SEQ ID NO: 2097916 - protein, 7 aa, Staphylococcus
KQAGWNS

SEQ ID NO: 2097917 - protein, 6 aa, Staphylococcus
KQDADL

SEQ ID NO: 2097918 - protein, 13 aa, Staphylococcus
KQDIKAQKNGDTN

SEQ ID NO: 2097919 - protein, 16 aa, Staphylococcus
KQDKKVLKQSADWTSY

SEQ ID NO: 2097920 - protein, 4 aa, Staphylococcus
KQDM

SEQ ID NO: 2097921 - protein, 13 aa, Staphylococcus
KQDNTPNLKETGI

SEQ ID NO: 2097922 - protein, 25 aa, Staphylococcus
KQDQKDAKPNDKVISDSAREVIKYL

SEQ ID NO: 2097923 - protein, 8 aa, Staphylococcus
KQDVQDGG

SEQ ID NO: 2097924 - protein, 26 aa, Staphylococcus
KQEANLYGNHNKTYNDYGIEGNNGNY

SEQ ID NO: 2097925 - protein, 8 aa, Staphylococcus
KQEDAETI

SEQ ID NO: 2097926 - protein, 19 aa, Staphylococcus
KQEGIENMNAEEPSQKDLT

SEQ ID NO: 2097927 - protein, 4 aa, Staphylococcus
KQEM

SEQ ID NO: 2097928 - protein, 6 aa, Staphylococcus
KQFPPT

SEQ ID NO: 2097929 - protein, 14 aa, Staphylococcus
KQGDTNYYKEKNLH

SEQ ID NO: 2097930 - protein, 4 aa, Staphylococcus
KQGG

SEQ ID NO: 2097931 - protein, 6 aa, Staphylococcus
KQGVTN

SEQ ID NO: 2097932 - protein, 7 aa, Staphylococcus
KQGYEGK

SEQ ID NO: 2097933 - protein, 24 aa, Staphylococcus
KQHDVQASQPYVDANTSNQDDYNH

SEQ ID NO: 2097934 - protein, 4 aa, Staphylococcus
KQHG

SEQ ID NO: 2097935 - protein, 7 aa, Staphylococcus
KQHQSIN

SEQ ID NO: 2097936 - protein, 9 aa, Staphylococcus
KQHSRQYAK

SEQ ID NO: 2097937 - protein, 6 aa, Staphylococcus
KQIEDE

SEQ ID NO: 2097938 - protein, 6 aa, Staphylococcus
KQIGGK

SEQ ID NO: 2097939 - protein, 7 aa, Staphylococcus
KQIQNPQ

SEQ ID NO: 2097940 - protein, 6 aa, Staphylococcus
KQKANA

SEQ ID NO: 2097941 - protein, 6 aa, Staphylococcus
KQKGNA

SEQ ID NO: 2097942 - protein, 9 aa, Staphylococcus
KQKPNESRI

SEQ ID NO: 2097943 - protein, 7 aa, Staphylococcus
KQKRAKI

SEQ ID NO: 2097944 - protein, 9 aa, Staphylococcus
KQKSDDTLT

SEQ ID NO: 2097945 - protein, 26 aa, Staphylococcus
KQKYGNNYDYQNPLTGPAKKKGDGIY

SEQ ID NO: 2097946 - protein, 93 aa, Staphylococcus
KQLEKENKDLKNEKNNLEKQKEKLNAQREKLQKEVDSSVAKESVKQETEKSKKDNSKQTNLSNESSSSTEERSSDSNSEQSNNNTSSSSSTKS

SEQ ID NO: 2097947 - protein, 74 aa, Staphylococcus
KQLNEDPMSQEREKPRAPQPTKTQAEPVETRAEKMETPSPERSSRTMRTDNETEAEKAKRSQQQQDDKLQQELE

SEQ ID NO: 2097948 - protein, 19 aa, Staphylococcus
KQLRQSQKKLYPGAPKGQF

SEQ ID NO: 2097949 - protein, 6 aa, Staphylococcus
KQLSGN

SEQ ID NO: 2097950 - protein, 13 aa, Staphylococcus
KQMADDKKELSPL

SEQ ID NO: 2097951 - protein, 37 aa, Staphylococcus
KQMDKVKDATKELKEAQDKAKSEDDEKVAAATTKLQD

SEQ ID NO: 2097952 - protein, 23 aa, Staphylococcus
KQNDDRIDEADTKEVKSEIDPAL

SEQ ID NO: 2097953 - protein, 16 aa, Staphylococcus
KQNGKQPGAFADNQKL

SEQ ID NO: 2097954 - protein, 9 aa, Staphylococcus
KQNGTGNGI

SEQ ID NO: 2097955 - protein, 6 aa, Staphylococcus
KQNMSK

SEQ ID NO: 2097956 - protein, 11 aa, Staphylococcus
KQNRPAPPEEL

SEQ ID NO: 2097957 - protein, 11 aa, Staphylococcus
KQNRPAPPNEL

SEQ ID NO: 2097958 - protein, 10 aa, Staphylococcus
KQNRPEPPAE

SEQ ID NO: 2097959 - protein, 11 aa, Staphylococcus
KQNRSAPPEEL

SEQ ID NO: 2097960 - protein, 5 aa, Staphylococcus
KQPAQ

SEQ ID NO: 2097961 - protein, 11 aa, Staphylococcus
KQPLQQSDFST

SEQ ID NO: 2097962 - protein, 7 aa, Staphylococcus
KQPSNQV

SEQ ID NO: 2097963 - protein, 14 aa, Staphylococcus
KQPSSIKAKQDGKP

SEQ ID NO: 2097964 - protein, 37 aa, Staphylococcus
KQQARAKINEKFKTKQDQINQTPNATQEEKNEALTRL

SEQ ID NO: 2097965 - protein, 11 aa, Staphylococcus
KQQDASNDSQV

SEQ ID NO: 2097966 - protein, 6 aa, Staphylococcus
KQQGMS

SEQ ID NO: 2097967 - protein, 18 aa, Staphylococcus
KQQISPETVKVTGGEEQL

SEQ ID NO: 2097968 - protein, 6 aa, Staphylococcus
KQQNGV

SEQ ID NO: 2097969 - protein, 8 aa, Staphylococcus
KQQPNESY

SEQ ID NO: 2097970 - protein, 9 aa, Staphylococcus
KQRNEGDQT

SEQ ID NO: 2097971 - protein, 8 aa, Staphylococcus
KQRPDETY

SEQ ID NO: 2097972 - protein, 9 aa, Staphylococcus
KQRTEGNNT

SEQ ID NO: 2097973 - protein, 8 aa, Staphylococcus
KQRTVGNN

SEQ ID NO: 2097974 - protein, 9 aa, Staphylococcus
KQSDNGEQV

SEQ ID NO: 2097975 - protein, 6 aa, Staphylococcus
KQSETG

SEQ ID NO: 2097976 - protein, 8 aa, Staphylococcus
KQSETGIQ

SEQ ID NO: 2097977 - protein, 7 aa, Staphylococcus
KQSIDEV

SEQ ID NO: 2097978 - protein, 7 aa, Staphylococcus
KQSTIGT

SEQ ID NO: 2097979 - protein, 8 aa, Staphylococcus
KQSTIGTV

SEQ ID NO: 2097980 - protein, 6 aa, Staphylococcus
KQSVND

SEQ ID NO: 2097981 - protein, 5 aa, Staphylococcus
KQSYT

SEQ ID NO: 2097982 - protein, 14 aa, Staphylococcus
KQTTNDSISEKTMK

SEQ ID NO: 2097983 - protein, 17 aa, Staphylococcus
KQVKKSEFNEVTAHVNL

SEQ ID NO: 2097984 - protein, 16 aa, Staphylococcus
KQVKNDGVQQGSDIAN

SEQ ID NO: 2097985 - protein, 17 aa, Staphylococcus
KQVKNDGVSYGSEIGDE

SEQ ID NO: 2097986 - protein, 23 aa, Staphylococcus
KQWKEKTAKDGKEIKNKIGKDAT

SEQ ID NO: 2097987 - protein, 19 aa, Staphylococcus
KQYDKIKTGKNVKIKNGIV

SEQ ID NO: 2097988 - protein, 19 aa, Staphylococcus
KQYDKIQKGQHVKIKNGVV

SEQ ID NO: 2097989 - protein, 8 aa, Staphylococcus
KQYISSNT

SEQ ID NO: 2097990 - protein, 8 aa, Staphylococcus
KRADGLRV

SEQ ID NO: 2097991 - protein, 10 aa, Staphylococcus
KRAGDGYPAF

SEQ ID NO: 2097992 - protein, 14 aa, Staphylococcus
KRDPKTIPDDGSGD

SEQ ID NO: 2097993 - protein, 14 aa, Staphylococcus
KRDPKTLPDDESRD

SEQ ID NO: 2097994 - protein, 6 aa, Staphylococcus
KREPHQ

SEQ ID NO: 2097995 - protein, 10 aa, Staphylococcus
KRGGDGYAPF

SEQ ID NO: 2097996 - protein, 10 aa, Staphylococcus
KRGGFDKTNA

SEQ ID NO: 2097997 - protein, 7 aa, Staphylococcus
KRGGFNQ

SEQ ID NO: 2097998 - protein, 6 aa, Staphylococcus
KRGIDD

SEQ ID NO: 2097999 - protein, 20 aa, Staphylococcus
KRHSYSENGNGGKTQKSIDK

SEQ ID NO: 2098000 - protein, 25 aa, Staphylococcus
KRIEELKSNYDRTNEVTTEDLKETK

SEQ ID NO: 2098001 - protein, 6 aa, Staphylococcus
KRLTGN

SEQ ID NO: 2098002 - protein, 7 aa, Staphylococcus
KRMKSKS

SEQ ID NO: 2098003 - protein, 6 aa, Staphylococcus
KRMPNL

SEQ ID NO: 2098004 - protein, 8 aa, Staphylococcus
KRNAEEVG

SEQ ID NO: 2098005 - protein, 13 aa, Staphylococcus
KRNGLKEKSKMND

SEQ ID NO: 2098006 - protein, 63 aa, Staphylococcus
KRQLDEATAEQDPTPGMTQVTSDNYRAKKAEAERISSEAQGVINNGDATAEEIRNEKAKVEEA

SEQ ID NO: 2098007 - protein, 8 aa, Staphylococcus
KRSGVSVD

SEQ ID NO: 2098008 - protein, 13 aa, Staphylococcus
KRSGYRTGHTPKR

SEQ ID NO: 2098009 - protein, 21 aa, Staphylococcus
KRSQKIDLSQNKDYWQGKPKL

SEQ ID NO: 2098010 - protein, 7 aa, Staphylococcus
KRTGAEL

SEQ ID NO: 2098011 - protein, 7 aa, Staphylococcus
KRTGISE

SEQ ID NO: 2098012 - protein, 7 aa, Staphylococcus
KRTPNRL

SEQ ID NO: 2098013 - protein, 7 aa, Staphylococcus
KRTQHNI

SEQ ID NO: 2098014 - protein, 9 aa, Staphylococcus
KRVDEEQER

SEQ ID NO: 2098015 - protein, 23 aa, Staphylococcus
KRYAAKATTSSLPKYKPQVSSSI

SEQ ID NO: 2098016 - protein, 7 aa, Staphylococcus
KRYIKDS

SEQ ID NO: 2098017 - protein, 7 aa, Staphylococcus
KSAMDTS

SEQ ID NO: 2098018 - protein, 8 aa, Staphylococcus
KSAQLDKD

SEQ ID NO: 2098019 - protein, 7 aa, Staphylococcus
KSATLGN

SEQ ID NO: 2098020 - protein, 23 aa, Staphylococcus
KSDDKDKEGLSDKEAKKKAEEIH

SEQ ID NO: 2098021 - protein, 14 aa, Staphylococcus
KSDDSGNETSKEKF

SEQ ID NO: 2098022 - protein, 14 aa, Staphylococcus
KSDEKNKKLTEKEM

SEQ ID NO: 2098023 - protein, 7 aa, Staphylococcus
KSDGTSL

SEQ ID NO: 2098024 - protein, 7 aa, Staphylococcus
KSDQASA

SEQ ID NO: 2098025 - protein, 35 aa, Staphylococcus
KSDSDKEGLSDKKAKAKAEKIQKEVEKNPNKFDEL

SEQ ID NO: 2098026 - protein, 20 aa, Staphylococcus
KSDSHESMKDTGVKLDNKTP

SEQ ID NO: 2098027 - protein, 27 aa, Staphylococcus
KSEASNYQSATSHLSRTYATDPNYAKK

SEQ ID NO: 2098028 - protein, 8 aa, Staphylococcus
KSEDRGSI

SEQ ID NO: 2098029 - protein, 12 aa, Staphylococcus
KSEVYTQTYTPI

SEQ ID NO: 2098030 - protein, 12 aa, Staphylococcus
KSEYNNAKVPTL

SEQ ID NO: 2098031 - protein, 4 aa, Staphylococcus
KSFL

SEQ ID NO: 2098032 - protein, 5 aa, Staphylococcus
KSGDV

SEQ ID NO: 2098033 - protein, 5 aa, Staphylococcus
KSGKH

SEQ ID NO: 2098034 - protein, 5 aa, Staphylococcus
KSGKI

SEQ ID NO: 2098035 - protein, 7 aa, Staphylococcus
KSGKLAG

SEQ ID NO: 2098036 - protein, 6 aa, Staphylococcus
KSGQNT

SEQ ID NO: 2098037 - protein, 7 aa, Staphylococcus
KSHNELG

SEQ ID NO: 2098038 - protein, 10 aa, Staphylococcus
KSHNKNKDGG

SEQ ID NO: 2098039 - protein, 5 aa, Staphylococcus
KSIQK

SEQ ID NO: 2098040 - protein, 8 aa, Staphylococcus
KSISNPKE

SEQ ID NO: 2098041 - protein, 20 aa, Staphylococcus
KSITNRNYVTDGSNEIRSRE

SEQ ID NO: 2098042 - protein, 8 aa, Staphylococcus
KSKDNGKF

SEQ ID NO: 2098043 - protein, 8 aa, Staphylococcus
KSKDNGKI

SEQ ID NO: 2098044 - protein, 54 aa, Staphylococcus
KSKDSDKEGLSDKKAKEKAEEIQKQVEKDPSKFGEIAKKESMDSSSAKKDGSLG

SEQ ID NO: 2098045 - protein, 36 aa, Staphylococcus
KSKDSDKEGLSDKKAKQKAEEIQKEVSKDPSKFGEI

SEQ ID NO: 2098046 - protein, 7 aa, Staphylococcus
KSKKSGY

SEQ ID NO: 2098047 - protein, 36 aa, Staphylococcus; identical to SEQ ID NO: 1838424

SEQ ID NO: 2098048 - protein, 7 aa, Staphylococcus
KSLEDND

SEQ ID NO: 2098049 - protein, 9 aa, Staphylococcus
KSLEENKGF

SEQ ID NO: 2098050 - protein, 7 aa, Staphylococcus
KSLKDND

SEQ ID NO: 2098051 - protein, 8 aa, Staphylococcus
KSLKDNKA

SEQ ID NO: 2098052 - protein, 4 aa, Staphylococcus
KSLP

SEQ ID NO: 2098053 - protein, 19 aa, Staphylococcus
KSLQQGDTTLEGAKIGEPV

SEQ ID NO: 2098054 - protein, 57 aa, Staphylococcus
KSNDTTNNEAAKAQSPTNVNTTQATKQIGQVKANNTGIRSSVYDKTAKSGTKYADRT

SEQ ID NO: 2098055 - protein, 17 aa, Staphylococcus
KSNELPESGKDDTIPTD

SEQ ID NO: 2098056 - protein, 7 aa, Staphylococcus
KSNESAN

SEQ ID NO: 2098057 - protein, 40 aa, Staphylococcus
KSNEVPSSQSVKKQENHDSTNSQSSLPETGHSDSEQSTQL

SEQ ID NO: 2098058 - protein, 20 aa, Staphylococcus
KSPEDRESGIKSLHEFDTYS

SEQ ID NO: 2098059 - protein, 11 aa, Staphylococcus
KSPNDGSGYPV

SEQ ID NO: 2098060 - protein, 10 aa, Staphylococcus
KSPSKNNQPI

SEQ ID NO: 2098061 - protein, 7 aa, Staphylococcus
KSPSNQV

SEQ ID NO: 2098062 - protein, 17 aa, Staphylococcus
KSPVKVNQSYNIKSGAT

SEQ ID NO: 2098063 - protein, 7 aa, Staphylococcus
KSQIEDE

SEQ ID NO: 2098064 - protein, 9 aa, Staphylococcus
KSQNISSAD

SEQ ID NO: 2098065 - protein, 12 aa, Staphylococcus
KSRKIGKQAQLA

SEQ ID NO: 2098066 - protein, 8 aa, Staphylococcus
KSRQRPIN

SEQ ID NO: 2098067 - protein, 8 aa, Staphylococcus
KSRSQVEA

SEQ ID NO: 2098068 - protein, 7 aa, Staphylococcus
KSRYGSW

SEQ ID NO: 2098069 - protein, 10 aa, Staphylococcus
KSSDGLAGRE

SEQ ID NO: 2098070 - protein, 22 aa, Staphylococcus
KSSDLPKHSKSSLPETGHNDTH

SEQ ID NO: 2098071 - protein, 33 aa, Staphylococcus
KSSEKAFESSQDKSNADRQSNLRSSKIDPEKDP

SEQ ID NO: 2098072 - protein, 33 aa, Staphylococcus
KSSESAFEKSQDQHNAQRQSTLRDSKVNPEKQP

SEQ ID NO: 2098073 - protein, 10 aa, Staphylococcus
KSSGLTDTTG

SEQ ID NO: 2098074 - protein, 7 aa, Staphylococcus
KSSIQKH

SEQ ID NO: 2098075 - protein, 8 aa, Staphylococcus
KSSKGPDL

SEQ ID NO: 2098076 - protein, 21 aa, Staphylococcus
KSSNGTELQTKDKFRAGASGS

SEQ ID NO: 2098077 - protein, 6 aa, Staphylococcus
KSSPFA

SEQ ID NO: 2098078 - protein, 36 aa, Staphylococcus
KSSSSDKEGLSDKKAKEKAEKIQKEVEKNPDKFGEI

SEQ ID NO: 2098079 - protein, 14 aa, Staphylococcus
KSTRTITPSFTTNG

SEQ ID NO: 2098080 - protein, 11 aa, Staphylococcus
KSVKDKKAAIN

SEQ ID NO: 2098081 - protein, 18 aa, Staphylococcus
KSVKSSKNAELKATSGFR

SEQ ID NO: 2098082 - protein, 6 aa, Staphylococcus
KSVNNQ

SEQ ID NO: 2098083 - protein, 7 aa, Staphylococcus
KSVNNQA

SEQ ID NO: 2098084 - protein, 7 aa, Staphylococcus
KSVSKES

SEQ ID NO: 2098085 - protein, 8 aa, Staphylococcus
KSVSKESI

SEQ ID NO: 2098086 - protein, 28 aa, Staphylococcus
KSVVDGTKLKGTVGHDPKSKKSTVSLSP

SEQ ID NO: 2098087 - protein, 12 aa, Staphylococcus
KSYAAQKSNQLE

SEQ ID NO: 2098088 - protein, 4 aa, Staphylococcus
KSYI

SEQ ID NO: 2098089 - protein, 7 aa, Staphylococcus
KSYNELG

SEQ ID NO: 2098090 - protein, 6 aa, Staphylococcus
KTAIKD

SEQ ID NO: 2098091 - protein, 9 aa, Staphylococcus
KTAQNKAGA

SEQ ID NO: 2098092 - protein, 12 aa, Staphylococcus
KTASVLQQTPKG

SEQ ID NO: 2098093 - protein, 7 aa, Staphylococcus
KTATLGN

SEQ ID NO: 2098094 - protein, 12 aa, Staphylococcus
KTDEQQAPQGYE

SEQ ID NO: 2098095 - protein, 52 aa, Staphylococcus
KTDIKEASVANSNESNDEAETDTNVESEDSEEPKITDEDSEDTESEETGYSA

SEQ ID NO: 2098096 - protein, 8 aa, Staphylococcus
KTDIKEVG

SEQ ID NO: 2098097 - protein, 8 aa, Staphylococcus
KTDQTKEL

SEQ ID NO: 2098098 - protein, 22 aa, Staphylococcus
KTEKTKELMDESETVSLKEKES

SEQ ID NO: 2098099 - protein, 14 aa, Staphylococcus
KTESKEKGYKIEDA

SEQ ID NO: 2098100 - protein, 15 aa, Staphylococcus
KTESKEKGYKIEDAG

SEQ ID NO: 2098101 - protein, 15 aa, Staphylococcus
KTESTEFGSSIGDEV

SEQ ID NO: 2098102 - protein, 5 aa, Staphylococcus
KTETL

SEQ ID NO: 2098103 - protein, 29 aa, Staphylococcus
KTFENEADAKKALEETKEITAGKYGGTSY

SEQ ID NO: 2098104 - protein, 4 aa, Staphylococcus
KTFN

SEQ ID NO: 2098105 - protein, 11 aa, Staphylococcus
KTFSDENVQDI

SEQ ID NO: 2098106 - protein, 8 aa, Staphylococcus
KTGEQTAS

SEQ ID NO: 2098107 - protein, 12 aa, Staphylococcus
KTGKEKTTMKPN

SEQ ID NO: 2098108 - protein, 7 aa, Staphylococcus
KTGKVIN

SEQ ID NO: 2098109 - protein, 6 aa, Staphylococcus
KTGQID

SEQ ID NO: 2098110 - protein, 11 aa, Staphylococcus
KTIEQAKTLEQ

SEQ ID NO: 2098111 - protein, 17 aa, Staphylococcus
KTINEKNTNLESYYHLN

SEQ ID NO: 2098112 - protein, 13 aa, Staphylococcus
KTITKNPKREKVT

SEQ ID NO: 2098113 - protein, 7 aa, Staphylococcus
KTKLGKH

SEQ ID NO: 2098114 - protein, 21 aa, Staphylococcus
KTKPEDAIKKAQNSYKNQQVT

SEQ ID NO: 2098115 - protein, 12 aa, Staphylococcus
KTLADNRTSLTD

SEQ ID NO: 2098116 - protein, 5 aa, Staphylococcus
KTLDE

SEQ ID NO: 2098117 - protein, 12 aa, Staphylococcus
KTLKENGKLAEI

SEQ ID NO: 2098118 - protein, 5 aa, Staphylococcus
KTLKI

SEQ ID NO: 2098119 - protein, 149 aa, Staphylococcus
KTNDVSHETTKANDTDQTSSQVNSEQSLEVDSNEKTTSNDKSTQTKQEPTNSKQDIDETSNSNEDSKLVPSKSNITSKADKQEQSSKEPVKDNTQIDKHVSQEDSSLEKQGTQEVPQTDSHKDVNVAPSKSSSTQHITAKDSSASQEVP

SEQ ID NO: 2098120 - protein, 6 aa, Staphylococcus
KTNVEA

SEQ ID NO: 2098121 - protein, 20 aa, Staphylococcus
KTPEDRDKGIKALHEFDTYV

SEQ ID NO: 2098122 - protein, 20 aa, Staphylococcus
KTPEDRERGIKALSDFETYI

SEQ ID NO: 2098123 - protein, 7 aa, Staphylococcus
KTPKDRE

SEQ ID NO: 2098124 - protein, 7 aa, Staphylococcus
KTPSNQV

SEQ ID NO: 2098125 - protein, 20 aa, Staphylococcus
KTQADPTGKEQQRRVVKLLG

SEQ ID NO: 2098126 - protein, 6 aa, Staphylococcus
KTQIED

SEQ ID NO: 2098127 - protein, 5 aa, Staphylococcus
KTQRD

SEQ ID NO: 2098128 - protein, 18 aa, Staphylococcus
KTRRQTSKDLELGYYDDE

SEQ ID NO: 2098129 - protein, 9 aa, Staphylococcus
KTSGSSQDR

SEQ ID NO: 2098130 - protein, 5 aa, Staphylococcus
KTSRK

SEQ ID NO: 2098131 - protein, 9 aa, Staphylococcus
KTSSDGKIK

SEQ ID NO: 2098132 - protein, 7 aa, Staphylococcus
KTTGTDA

SEQ ID NO: 2098133 - protein, 8 aa, Staphylococcus
KTTHYEQA

SEQ ID NO: 2098134 - protein, 16 aa, Staphylococcus
KTTKNQKISESTIKKD

SEQ ID NO: 2098135 - protein, 23 aa, Staphylococcus
KTTPTTKVTTASTTQKAASAVQT

SEQ ID NO: 2098136 - protein, 5 aa, Staphylococcus
KTTTL

SEQ ID NO: 2098137 - protein, 12 aa, Staphylococcus
KTVDKTERNRLT

SEQ ID NO: 2098138 - protein, 9 aa, Staphylococcus
KTVKENPLL

SEQ ID NO: 2098139 - protein, 12 aa, Staphylococcus
KTVPAGKYAKQY

SEQ ID NO: 2098140 - protein, 6 aa, Staphylococcus
KTVPEF

SEQ ID NO: 2098141 - protein, 8 aa, Staphylococcus
KTVTDDVR

SEQ ID NO: 2098142 - protein, 7 aa, Staphylococcus
KTYADLD

SEQ ID NO: 2098143 - protein, 7 aa, Staphylococcus
KTYGHGS

SEQ ID NO: 2098144 - protein, 9 aa, Staphylococcus
KTYNNSEGA

SEQ ID NO: 2098145 - protein, 9 aa, Staphylococcus
KTYNSKEGA

SEQ ID NO: 2098146 - protein, 6 aa, Staphylococcus
KTYRDA

SEQ ID NO: 2098147 - protein, 4 aa, Staphylococcus
KVAP

SEQ ID NO: 2098148 - protein, 12 aa, Staphylococcus
KVAQEKQDVDQL

SEQ ID NO: 2098149 - protein, 24 aa, Staphylococcus
KVASTIKKDDKKLALEDKLDKSQL

SEQ ID NO: 2098150 - protein, 12 aa, Staphylococcus
KVDDKTVQKFND

SEQ ID NO: 2098151 - protein, 6 aa, Staphylococcus
KVDETN

SEQ ID NO: 2098152 - protein, 8 aa, Staphylococcus
KVDQPTLD

SEQ ID NO: 2098153 - protein, 10 aa, Staphylococcus
KVEDEKEDLK

SEQ ID NO: 2098154 - protein, 6 aa, Staphylococcus
KVEDPY

SEQ ID NO: 2098155 - protein, 17 aa, Staphylococcus
KVEDPYDFENYKKILEK

SEQ ID NO: 2098156 - protein, 10 aa, Staphylococcus
KVENDEYGLS

SEQ ID NO: 2098157 - protein, 11 aa, Staphylococcus
KVETKQKSVEK

SEQ ID NO: 2098158 - protein, 49 aa, Staphylococcus
KVETQDKARPTVQRSSRQLTQSQNSNNDTLQTQPSSRDVVNKQPSNQDL

SEQ ID NO: 2098159 - protein, 10 aa, Staphylococcus
KVGKGKAAFI

SEQ ID NO: 2098160 - protein, 11 aa, Staphylococcus
KVGKGKAAFIG

SEQ ID NO: 2098161 - protein, 5 aa, Staphylococcus
KVGPH

SEQ ID NO: 2098162 - protein, 6 aa, Staphylococcus
KVGPHY

SEQ ID NO: 2098163 - protein, 18 aa, Staphylococcus
KVHDTVKEINNAGNTASG

SEQ ID NO: 2098164 - protein, 20 aa, Staphylococcus
KVIHKETEKGESNQSNDAFK

SEQ ID NO: 2098165 - protein, 12 aa, Staphylococcus
KVKDEEHEHEHE

SEQ ID NO: 2098166 - protein, 16 aa, Staphylococcus
KVKDPYDFSSYHKLLE

SEQ ID NO: 2098167 - protein, 16 aa, Staphylococcus
KVKDPYDIKSWEQQLD

SEQ ID NO: 2098168 - protein, 14 aa, Staphylococcus
KVKDPYEVEEWKKY

SEQ ID NO: 2098169 - protein, 14 aa, Staphylococcus
KVKDPYKIKEWKKY

SEQ ID NO: 2098170 - protein, 13 aa, Staphylococcus
KVKGTPSDKKSGI

SEQ ID NO: 2098171 - protein, 15 aa, Staphylococcus
KVKTEAEAKKAQKDI

SEQ ID NO: 2098172 - protein, 7 aa, Staphylococcus
KVLANEG

SEQ ID NO: 2098173 - protein, 7 aa, Staphylococcus
KVNASAS

SEQ ID NO: 2098174 - protein, 11 aa, Staphylococcus
KVNGITAEDSA

SEQ ID NO: 2098175 - protein, 13 aa, Staphylococcus
KVNKEKGDIDKIS

SEQ ID NO: 2098176 - protein, 11 aa, Staphylococcus
KVNNDSGDIST

SEQ ID NO: 2098177 - protein, 4 aa, Staphylococcus
KVNP

SEQ ID NO: 2098178 - protein, 5 aa, Staphylococcus
KVNPT

SEQ ID NO: 2098179 - protein, 8 aa, Staphylococcus
KVNQAQTV

SEQ ID NO: 2098180 - protein, 16 aa, Staphylococcus
KVNTKTTGNLDGNKKV

SEQ ID NO: 2098181 - protein, 7 aa, Staphylococcus
KVPEKEW

SEQ ID NO: 2098182 - protein, 25 aa, Staphylococcus
KVPGGGSGGSSSSSTSKSTTSGGYY

SEQ ID NO: 2098183 - protein, 29 aa, Staphylococcus
KVPNGGSGAGAAGTATPSTGNDYNSPSFN

SEQ ID NO: 2098184 - protein, 7 aa, Staphylococcus
KVPNQAI

SEQ ID NO: 2098185 - protein, 10 aa, Staphylococcus
KVPQSGKRAT

SEQ ID NO: 2098186 - protein, 10 aa, Staphylococcus
KVQKKPKLLT

SEQ ID NO: 2098187 - protein, 9 aa, Staphylococcus
KVQKNPKLL

SEQ ID NO: 2098188 - protein, 16 aa, Staphylococcus
KVRTKSTGKLDNDREL

SEQ ID NO: 2098189 - protein, 15 aa, Staphylococcus
KVSDKDVKDNSKKAS

SEQ ID NO: 2098190 - protein, 15 aa, Staphylococcus
KVSDKEIKDDTKKAS

SEQ ID NO: 2098191 - protein, 15 aa, Staphylococcus
KVSDKELKENTKKAS

SEQ ID NO: 2098192 - protein, 36 aa, Staphylococcus
KVSGAASSSSSNTSGNTSSGSTTTYTVKSGDSLSAI

SEQ ID NO: 2098193 - protein, 22 aa, Staphylococcus
KVSGDNNTFTNKMNQQAKSFNM

SEQ ID NO: 2098194 - protein, 6 aa, Staphylococcus
KVSGGV

SEQ ID NO: 2098195 - protein, 31 aa, Staphylococcus
KVSGNDNTFEIKGTSKKKDNTYKDKYTLTSS

SEQ ID NO: 2098196 - protein, 6 aa, Staphylococcus
KVSGRY

SEQ ID NO: 2098197 - protein, 31 aa, Staphylococcus
KVSGSTSSSTSSNTSTGSTYTVKSGDTLSGI

SEQ ID NO: 2098198 - protein, 19 aa, Staphylococcus
KVSGSTSTFTDKMNQQAKT

SEQ ID NO: 2098199 - protein, 32 aa, Staphylococcus
KVSGSVSTSKSTSGSKKTTSSSSGRTSTYTVQ

SEQ ID NO: 2098200 - protein, 26 aa, Staphylococcus
KVSGTASTSNSSSNTANSSKNGCNTP

SEQ ID NO: 2098201 - protein, 43 aa, Staphylococcus
KVSGTVSTSKPSSSASTTGSSSTYTVQAGDSLSSIAAKYGTTY

SEQ ID NO: 2098202 - protein, 21 aa, Staphylococcus
KVSNNGSKSSNHTSSSKDTIE

SEQ ID NO: 2098203 - protein, 12 aa, Staphylococcus
KVSSEAEAKTVQ

SEQ ID NO: 2098204 - protein, 12 aa, Staphylococcus
KVTDGSDNETTA

SEQ ID NO: 2098205 - protein, 9 aa, Staphylococcus
KVTESLKGA

SEQ ID NO: 2098206 - protein, 11 aa, Staphylococcus
KVTGREHEANE

SEQ ID NO: 2098207 - protein, 12 aa, Staphylococcus
KVTGRESQASTL

SEQ ID NO: 2098208 - protein, 25 aa, Staphylococcus
KVTGSTATVTNSPSPAASTGTGGYY

SEQ ID NO: 2098209 - protein, 30 aa, Staphylococcus
KVTGTAAKNNTKPSQSSKSSIYTVQPGDSL

SEQ ID NO: 2098210 - protein, 22 aa, Staphylococcus
KVTGTASGSSTRTSNSNSYRTP

SEQ ID NO: 2098211 - protein, 13 aa, Staphylococcus
KVTNEAEAKKVQS

SEQ ID NO: 2098212 - protein, 6 aa, Staphylococcus
KVTTNL

SEQ ID NO: 2098213 - protein, 29 aa, Staphylococcus
KVTTTTAPSSQSTGVSISRTSSSGSNLYT

SEQ ID NO: 2098214 - protein, 64 aa, Staphylococcus
KVVATQTKVQTPSKVTNRNQASLQKTMAPSKRAHVTSTHVTPKSTKVKPSSQNFSKQKQPTKVN

SEQ ID NO: 2098215 - protein, 16 aa, Staphylococcus
KVVKPDKYADSKNPNL

SEQ ID NO: 2098216 - protein, 10 aa, Staphylococcus
KVVKQSTVTT

SEQ ID NO: 2098217 - protein, 25 aa, Staphylococcus
KVVSTNKKPQKASKVTRTQSARPQL

SEQ ID NO: 2098218 - protein, 6 aa, Staphylococcus
KVYDTT

SEQ ID NO: 2098219 - protein, 14 aa, Staphylococcus
KVYGKEPKGTPPMT

SEQ ID NO: 2098220 - protein, 14 aa, Staphylococcus
KVYGKEPPGTPPMT

SEQ ID NO: 2098221 - protein, 17 aa, Staphylococcus
KVYSETDRQYFKGDKSY

SEQ ID NO: 2098222 - protein, 21 aa, Staphylococcus
KWAKDHPNATISSGQAGTGAG

SEQ ID NO: 2098223 - protein, 21 aa, Staphylococcus
KWAKDHPSATISSGQAGTGAG

SEQ ID NO: 2098224 - protein, 21 aa, Staphylococcus
KWAKNHKDAKISSGQAGTGAG

SEQ ID NO: 2098225 - protein, 23 aa, Staphylococcus
KWKKQTEKDGKEIKDAIGKDSTV

SEQ ID NO: 2098226 - protein, 10 aa, Staphylococcus
KWKYDSKNNV

SEQ ID NO: 2098227 - protein, 9 aa, Staphylococcus
KWQNGDPLT

SEQ ID NO: 2098228 - protein, 7 aa, Staphylococcus
KYAENET

SEQ ID NO: 2098229 - protein, 10 aa, Staphylococcus
KYDKDKNHEV

SEQ ID NO: 2098230 - protein, 12 aa, Staphylococcus
KYEEKNSKPVEV

SEQ ID NO: 2098231 - protein, 101 aa, Staphylococcus
KYEHVESDSSSSNTNDDKNATNTTSSDEDRTESSHQHTTIDPSPQDSSDKSNSPTTPSNQSEVLTENNQSDQSSESSFKYSNSNDNHSTDDSSVSKALDSL

SEQ ID NO: 2098232 - protein, 19 aa, Staphylococcus
KYEKSAKQLPAEHQDVKDL

SEQ ID NO: 2098233 - protein, 7 aa, Staphylococcus
KYEQDID

SEQ ID NO: 2098234 - protein, 6 aa, Staphylococcus
KYEQNI

SEQ ID NO: 2098235 - protein, 6 aa, Staphylococcus
KYETQL

SEQ ID NO: 2098236 - protein, 9 aa, Staphylococcus
KYFAPNGKY

SEQ ID NO: 2098237 - protein, 28 aa, Staphylococcus
KYFSPNGKYRSTFEKDEQQAKKDKVNLW

SEQ ID NO: 2098238 - protein, 6 aa, Staphylococcus
KYGTSY

SEQ ID NO: 2098239 - protein, 7 aa, Staphylococcus
KYGTSYQ

SEQ ID NO: 2098240 - protein, 7 aa, Staphylococcus
KYHESET

SEQ ID NO: 2098241 - protein, 7 aa, Staphylococcus
KYINTGN

SEQ ID NO: 2098242 - protein, 9 aa, Staphylococcus
KYIPSAPQN

SEQ ID NO: 2098243 - protein, 8 aa, Staphylococcus
KYKATSQI

SEQ ID NO: 2098244 - protein, 24 aa, Staphylococcus
KYKDGDGYKPYGDVSKADRKALAD

SEQ ID NO: 2098245 - protein, 24 aa, Staphylococcus
KYKDGDGYKSYNDVTKKDRKALAD

SEQ ID NO: 2098246 - protein, 28 aa, Staphylococcus
KYKDKVDTKDIDDEIKKEQKQYGGKDQF

SEQ ID NO: 2098247 - protein, 28 aa, Staphylococcus
KYKDKVDTKDIDKDIKKEEKQYGGKEQF

SEQ ID NO: 2098248 - protein, 28 aa, Staphylococcus
KYKDKVDTKDVDEDIKKEEKQYGGKDQF

SEQ ID NO: 2098249 - protein, 29 aa, Staphylococcus
KYKDKVDTKRIDDDIKKEEKQYGGKDQFE

SEQ ID NO: 2098250 - protein, 11 aa, Staphylococcus
KYKKSSKSGYI

SEQ ID NO: 2098251 - protein, 5 aa, Staphylococcus
KYKNT

SEQ ID NO: 2098252 - protein, 8 aa, Staphylococcus
KYKPENEF

SEQ ID NO: 2098253 - protein, 9 aa, Staphylococcus
KYKQADGVR

SEQ ID NO: 2098254 - protein, 11 aa, Staphylococcus
KYKRADGIRGN

SEQ ID NO: 2098255 - protein, 13 aa, Staphylococcus
KYKRQGTGDNDVK

SEQ ID NO: 2098256 - protein, 13 aa, Staphylococcus
KYKSLKDLPKGAT

SEQ ID NO: 2098257 - protein, 7 aa, Staphylococcus
KYNEMGG

SEQ ID NO: 2098258 - protein, 8 aa, Staphylococcus
KYNGDNKV

SEQ ID NO: 2098259 - protein, 9 aa, Staphylococcus
KYNTAKQHG

SEQ ID NO: 2098260 - protein, 16 aa, Staphylococcus
KYNTSVDSIKKSNNLS

SEQ ID NO: 2098261 - protein, 13 aa, Staphylococcus
KYPESGTAISPRP

SEQ ID NO: 2098262 - protein, 10 aa, Staphylococcus
KYPNKKASLE

SEQ ID NO: 2098263 - protein, 6 aa, Staphylococcus
KYPNLK

SEQ ID NO: 2098264 - protein, 12 aa, Staphylococcus
KYPNLKSSLQDY

SEQ ID NO: 2098265 - protein, 7 aa, Staphylococcus
KYPSTET

SEQ ID NO: 2098266 - protein, 8 aa, Staphylococcus
KYQRSQKI

SEQ ID NO: 2098267 - protein, 71 aa, Staphylococcus
KYSEDAKKTHQDFESSKKDNETNTSKGEKTKNNTTKASNPQLPTKKELEHKTTPAQSFEDDFKQSNTRSTS

SEQ ID NO: 2098268 - protein, 8 aa, Staphylococcus
KYSPEGQD

SEQ ID NO: 2098269 - protein, 18 aa, Staphylococcus
KYSTSTGSSGTDVSGSAF

SEQ ID NO: 2098270 - protein, 5 aa, Staphylococcus
KYWDK

SEQ ID NO: 2098271 - protein, 7 aa, Staphylococcus
KYYKGEQ

SEQ ID NO: 2098272 - protein, 18 aa, Staphylococcus
LAAEGSDIQTPEERHEPI

SEQ ID NO: 2098273 - protein, 22 aa, Staphylococcus
LAENQRVYRSTTKNLSNDEITQ

SEQ ID NO: 2098274 - protein, 18 aa, Staphylococcus
LAEQHKGDIERKFDKKDA

SEQ ID NO: 2098275 - protein, 7 aa, Staphylococcus
LAESGQN

SEQ ID NO: 2098276 - protein, 31 aa, Staphylococcus
LAESGSARGFKPVGYSKGNSIYSDGEHPFTY

SEQ ID NO: 2098277 - protein, 4 aa, Staphylococcus
LAGD

SEQ ID NO: 2098278 - protein, 7 aa, Staphylococcus
LAGDKSI

SEQ ID NO: 2098279 - protein, 4 aa, Staphylococcus
LAGN

SEQ ID NO: 2098280 - protein, 16 aa, Staphylococcus
LAGTSEDEAGKTFRDN

SEQ ID NO: 2098281 - protein, 16 aa, Staphylococcus
LAGTSEDEAGKTFREN

SEQ ID NO: 2098282 - protein, 5 aa, Staphylococcus
LAKEG

SEQ ID NO: 2098283 - protein, 7 aa, Staphylococcus
LAKERGV

SEQ ID NO: 2098284 - protein, 7 aa, Staphylococcus
LAKGETR

SEQ ID NO: 2098285 - protein, 8 aa, Staphylococcus
LAKKDDID

SEQ ID NO: 2098286 - protein, 6 aa, Staphylococcus
LAKNAI

SEQ ID NO: 2098287 - protein, 4 aa, Staphylococcus
LAKR

SEQ ID NO: 2098288 - protein, 7 aa, Staphylococcus
LAKRGAE

SEQ ID NO: 2098289 - protein, 7 aa, Staphylococcus
LAKRGAK

SEQ ID NO: 2098290 - protein, 13 aa, Staphylococcus
LANANSKSNVIPK

SEQ ID NO: 2098291 - protein, 8 aa, Staphylococcus
LANDGKPV

SEQ ID NO: 2098292 - protein, 4 aa, Staphylococcus
LANE

SEQ ID NO: 2098293 - protein, 7 aa, Staphylococcus
LAPSERK

SEQ ID NO: 2098294 - protein, 15 aa, Staphylococcus
LAQDGTNDPASVPRN

SEQ ID NO: 2098295 - protein, 4 aa, Staphylococcus
LAQE

SEQ ID NO: 2098296 - protein, 17 aa, Staphylococcus
LAQNNPSELNAHPVQAG

SEQ ID NO: 2098297 - protein, 25 aa, Staphylococcus
LAQQQYKGYTQALDKQKNSQPGDYQ

SEQ ID NO: 2098298 - protein, 4 aa, Staphylococcus
LARE

SEQ ID NO: 2098299 - protein, 12 aa, Staphylococcus
LASKKDNGTKLN

SEQ ID NO: 2098300 - protein, 4 aa, Staphylococcus
LATT

SEQ ID NO: 2098301 - protein, 20 aa, Staphylococcus
LATTQAHAATTHTVKSGESV

SEQ ID NO: 2098302 - protein, 10 aa, Staphylococcus
LDAEDPKQTK

SEQ ID NO: 2098303 - protein, 26 aa, Staphylococcus
LDAGSSFNEQNPQLAKDSYKGATVPT

SEQ ID NO: 2098304 - protein, 11 aa, Staphylococcus
LDAPDTEPYKT

SEQ ID NO: 2098305 - protein, 17 aa, Staphylococcus
LDAYPKKINRDEQQQAM

SEQ ID NO: 2098306 - protein, 25 aa, Staphylococcus
LDDDDFKKGDKEKVKIDGETKKIKP

SEQ ID NO: 2098307 - protein, 7 aa, Staphylococcus
LDEDASL

SEQ ID NO: 2098308 - protein, 9 aa, Staphylococcus
LDINSDSQK

SEQ ID NO: 2098309 - protein, 7 aa, Staphylococcus
LDIQESG

SEQ ID NO: 2098310 - protein, 7 aa, Staphylococcus
LDKDSEI

SEQ ID NO: 2098311 - protein, 29 aa, Staphylococcus
LDKQSDSQNKVTDKQAKELSQLSNNAVKN

SEQ ID NO: 2098312 - protein, 11 aa, Staphylococcus
LDNGLKPSKDA

SEQ ID NO: 2098313 - protein, 17 aa, Staphylococcus
LDPDGKQQQKQVYKLLG

SEQ ID NO: 2098314 - protein, 32 aa, Staphylococcus
LDPDKIKQQQQQQQSSQGGASGSGSAGLTSSG

SEQ ID NO: 2098315 - protein, 10 aa, Staphylococcus
LDPKSTVNYQ

SEQ ID NO: 2098316 - protein, 8 aa, Staphylococcus
LDPQTASE

SEQ ID NO: 2098317 - protein, 6 aa, Staphylococcus
LDQQRE

SEQ ID NO: 2098318 - protein, 7 aa, Staphylococcus
LDQSSEI

SEQ ID NO: 2098319 - protein, 15 aa, Staphylococcus
LDRAKVEKEGKRMSD

SEQ ID NO: 2098320 - protein, 6 aa, Staphylococcus
LDRPDE

SEQ ID NO: 2098321 - protein, 24 aa, Staphylococcus
LDSNIKVEDEKAEHKHDKAISDGY

SEQ ID NO: 2098322 - protein, 4 aa, Staphylococcus
LDTE

SEQ ID NO: 2098323 - protein, 9 aa, Staphylococcus
LDTTPPTFS

SEQ ID NO: 2098324 - protein, 8 aa, Staphylococcus
LEADSSNN

SEQ ID NO: 2098325 - protein, 8 aa, Staphylococcus
LEAGSDNQ

SEQ ID NO: 2098326 - protein, 8 aa, Staphylococcus
LEAGSDNS

SEQ ID NO: 2098327 - protein, 9 aa, Staphylococcus
LEAKEENQI

SEQ ID NO: 2098328 - protein, 11 aa, Staphylococcus
LEAKEENQIIK

SEQ ID NO: 2098329 - protein, 10 aa, Staphylococcus
LEAKEENQIL

SEQ ID NO: 2098330 - protein, 6 aa, Staphylococcus
LEASGT

SEQ ID NO: 2098331 - protein, 8 aa, Staphylococcus
LEASSNNN

SEQ ID NO: 2098332 - protein, 15 aa, Staphylococcus
LEDDEQSSKSRIKHS

SEQ ID NO: 2098333 - protein, 7 aa, Staphylococcus
LEEATQH

SEQ ID NO: 2098334 - protein, 14 aa, Staphylococcus
LEEDVVDEDRTTSQ

SEQ ID NO: 2098335 - protein, 11 aa, Staphylococcus
LEENGYESYEA

SEQ ID NO: 2098336 - protein, 29 aa, Staphylococcus
LEENNKELRHTAEKELDSTDSAKVKQSIE

SEQ ID NO: 2098337 - protein, 14 aa, Staphylococcus
LEEQKNDVRLVETN

SEQ ID NO: 2098338 - protein, 10 aa, Staphylococcus
LEGKVSTKEM

SEQ ID NO: 2098339 - protein, 4 aa, Staphylococcus
LEGM

SEQ ID NO: 2098340 - protein, 16 aa, Staphylococcus
LEGQGEAFSEAAKAYN

SEQ ID NO: 2098341 - protein, 9 aa, Staphylococcus
LEIHPNNRK

SEQ ID NO: 2098342 - protein, 9 aa, Staphylococcus
LEKKTTKTM

SEQ ID NO: 2098343 - protein, 6 aa, Staphylococcus
LENDGG

SEQ ID NO: 2098344 - protein, 5 aa, Staphylococcus
LENNH

SEQ ID NO: 2098345 - protein, 11 aa, Staphylococcus
LEQAGKSMDDK

SEQ ID NO: 2098346 - protein, 6 aa, Staphylococcus
LEQANA

SEQ ID NO: 2098347 - protein, 6 aa, Staphylococcus
LEQQAR

SEQ ID NO: 2098348 - protein, 7 aa, Staphylococcus
LEQTNSK

SEQ ID NO: 2098349 - protein, 10 aa, Staphylococcus
LERETKEGID

SEQ ID NO: 2098350 - protein, 5 aa, Staphylococcus
LESGD

SEQ ID NO: 2098351 - protein, 7 aa, Staphylococcus
LESPGHT

SEQ ID NO: 2098352 - protein, 20 aa, Staphylococcus
LESPLEKQDSGKSDKKKSDI

SEQ ID NO: 2098353 - protein, 4 aa, Staphylococcus
LETD

SEQ ID NO: 2098354 - protein, 6 aa, Staphylococcus
LETHGK

SEQ ID NO: 2098355 - protein, 8 aa, Staphylococcus
LETINQED

SEQ ID NO: 2098356 - protein, 10 aa, Staphylococcus
LGEGKSLDTA

SEQ ID NO: 2098357 - protein, 12 aa, Staphylococcus
LGEPLSKMAVVT

SEQ ID NO: 2098358 - protein, 9 aa, Staphylococcus
LGETSKIDT

SEQ ID NO: 2098359 - protein, 14 aa, Staphylococcus
LGFESAKAKKKDYV

SEQ ID NO: 2098360 - protein, 4 aa, Staphylococcus
LGGI

SEQ ID NO: 2098361 - protein, 19 aa, Staphylococcus
LGGIQTNLDGQALNPSMQP

SEQ ID NO: 2098362 - protein, 11 aa, Staphylococcus
LGGTDHSDPHA

SEQ ID NO: 2098363 - protein, 9 aa, Staphylococcus
LGKARQTLN

SEQ ID NO: 2098364 - protein, 21 aa, Staphylococcus
LGKEKQGEKRLKEHNEKMDNY

SEQ ID NO: 2098365 - protein, 10 aa, Staphylococcus
LGKENHIPAP

SEQ ID NO: 2098366 - protein, 4 aa, Staphylococcus
LGKG

SEQ ID NO: 2098367 - protein, 6 aa, Staphylococcus
LGKGKE

SEQ ID NO: 2098368 - protein, 8 aa, Staphylococcus
LGKPEEVG

SEQ ID NO: 2098369 - protein, 51 aa, Staphylococcus
LGNGASDDKNKSSQTDKSNKDSNSKSDNSTNNKKNNDANSENSVKDLNQAE

SEQ ID NO: 2098370 - protein, 9 aa, Staphylococcus
LGNKDSRVD

SEQ ID NO: 2098371 - protein, 18 aa, Staphylococcus
LGNPGRPKYDNLAKSKPD

SEQ ID NO: 2098372 - protein, 10 aa, Staphylococcus
LGNPGRPNFD

SEQ ID NO: 2098373 - protein, 10 aa, Staphylococcus
LGNQQNQNLR

SEQ ID NO: 2098374 - protein, 5 aa, Staphylococcus
LGNTE

SEQ ID NO: 2098375 - protein, 11 aa, Staphylococcus
LGQEDKKELDN

SEQ ID NO: 2098376 - protein, 9 aa, Staphylococcus
LGQEHGIDA

SEQ ID NO: 2098377 - protein, 7 aa, Staphylococcus
LGQPEEV

SEQ ID NO: 2098378 - protein, 4 aa, Staphylococcus
LGQR

SEQ ID NO: 2098379 - protein, 5 aa, Staphylococcus
LGRGT

SEQ ID NO: 2098380 - protein, 5 aa, Staphylococcus
LGSHT

SEQ ID NO: 2098381 - protein, 10 aa, Staphylococcus
LGSKATSPVE

SEQ ID NO: 2098382 - protein, 12 aa, Staphylococcus
LGTGHRQAVPET

SEQ ID NO: 2098383 - protein, 7 aa, Staphylococcus
LGTPEEV

SEQ ID NO: 2098384 - protein, 12 aa, Staphylococcus
LGTPHNGTHASD

SEQ ID NO: 2098385 - protein, 12 aa, Staphylococcus
LGTTKVPKDAKR

SEQ ID NO: 2098386 - protein, 12 aa, Staphylococcus
LGTTKVSKGSKR

SEQ ID NO: 2098387 - protein, 8 aa, Staphylococcus
LIKDPTQK

SEQ ID NO: 2098388 - protein, 13 aa, Staphylococcus
LIQETDALKSQGY

SEQ ID NO: 2098389 - protein, 9 aa, Staphylococcus
LKAENGENI

SEQ ID NO: 2098390 - protein, 8 aa, Staphylococcus
LKAHSDKL

SEQ ID NO: 2098391 - protein, 8 aa, Staphylococcus
LKAPSIEE

SEQ ID NO: 2098392 - protein, 7 aa, Staphylococcus
LKAQAQT

SEQ ID NO: 2098393 - protein, 10 aa, Staphylococcus
LKAQKGKTEF

SEQ ID NO: 2098394 - protein, 9 aa, Staphylococcus
LKASSNYYD

SEQ ID NO: 2098395 - protein, 28 aa, Staphylococcus
LKATSEPTKINENQAAEADQDNQVQYEN

SEQ ID NO: 2098396 - protein, 16 aa, Staphylococcus
LKDKYQVTTNATVGNP

SEQ ID NO: 2098397 - protein, 17 aa, Staphylococcus
LKDNGMKQAGANKPALE

SEQ ID NO: 2098398 - protein, 6 aa, Staphylococcus
LKDNGV

SEQ ID NO: 2098399 - protein, 11 aa, Staphylococcus
LKDNNKKLQEV

SEQ ID NO: 2098400 - protein, 9 aa, Staphylococcus
LKDSATSLN

SEQ ID NO: 2098401 - protein, 21 aa, Staphylococcus
LKEEGYKKNHNGIYEKDGKPL

SEQ ID NO: 2098402 - protein, 29 aa, Staphylococcus
LKGEEDEHEHGEHEEHGEHEEHEHHHGKY

SEQ ID NO: 2098403 - protein, 17 aa, Staphylococcus
LKGSQSKVLKAEQSDDI

SEQ ID NO: 2098404 - protein, 17 aa, Staphylococcus
LKGTKVGLQDPESTSGY

SEQ ID NO: 2098405 - protein, 5 aa, Staphylococcus
LKKDG

SEQ ID NO: 2098406 - protein, 16 aa, Staphylococcus
LKKDGAISNKEYKGKM

SEQ ID NO: 2098407 - protein, 10 aa, Staphylococcus
LKKDSEPQPS

SEQ ID NO: 2098408 - protein, 10 aa, Staphylococcus
LKKGNKSKFL

SEQ ID NO: 2098409 - protein, 8 aa, Staphylococcus
LKKHEKDL

SEQ ID NO: 2098410 - protein, 14 aa, Staphylococcus
LKKPEERNAAMKQA

SEQ ID NO: 2098411 - protein, 5 aa, Staphylococcus
LKKYK

SEQ ID NO: 2098412 - protein, 7 aa, Staphylococcus
LKKYKDE

SEQ ID NO: 2098413 - protein, 8 aa, Staphylococcus
LKKYKDEL

SEQ ID NO: 2098414 - protein, 9 aa, Staphylococcus
LKLPKGKKP

SEQ ID NO: 2098415 - protein, 8 aa, Staphylococcus
LKNGEYTL

SEQ ID NO: 2098416 - protein, 25 aa, Staphylococcus
LKNGNTTLSLTKSKNGQYTEGSYAK

SEQ ID NO: 2098417 - protein, 6 aa, Staphylococcus
LKNNGM

SEQ ID NO: 2098418 - protein, 6 aa, Staphylococcus
LKNNTL

SEQ ID NO: 2098419 - protein, 9 aa, Staphylococcus
LKNSDFSSA

SEQ ID NO: 2098420 - protein, 4 aa, Staphylococcus
LKQD

SEQ ID NO: 2098421 - protein, 13 aa, Staphylococcus
LKQGDKTLKTEKL

SEQ ID NO: 2098422 - protein, 8 aa, Staphylococcus
LKQGQTYT

SEQ ID NO: 2098423 - protein, 13 aa, Staphylococcus
LKQGSKTLATGSI

SEQ ID NO: 2098424 - protein, 5 aa, Staphylococcus
LKQNG

SEQ ID NO: 2098425 - protein, 20 aa, Staphylococcus
LKQNVDANYVSQNLNQNFFI

SEQ ID NO: 2098426 - protein, 24 aa, Staphylococcus
LKQPKALKQATQKKVATPINEEQF

SEQ ID NO: 2098427 - protein, 7 aa, Staphylococcus
LKQQGAL

SEQ ID NO: 2098428 - protein, 9 aa, Staphylococcus
LKQQGALNT

SEQ ID NO: 2098429 - protein, 4 aa, Staphylococcus
LKQR

SEQ ID NO: 2098430 - protein, 20 aa, Staphylococcus
LKRSQAENEVFGTSGSDSKL

SEQ ID NO: 2098431 - protein, 9 aa, Staphylococcus
LKSDDDTSI

SEQ ID NO: 2098432 - protein, 12 aa, Staphylococcus
LKSITENKEGNT

SEQ ID NO: 2098433 - protein, 17 aa, Staphylococcus
LKTESKEKGYKIESAGN

SEQ ID NO: 2098434 - protein, 5 aa, Staphylococcus
LKTGN

SEQ ID NO: 2098435 - protein, 7 aa, Staphylococcus
LKTKKVE

SEQ ID NO: 2098436 - protein, 25 aa, Staphylococcus
LKVSGKASTGGSGSSSTGSAGYKTP

SEQ ID NO: 2098437 - protein, 23 aa, Staphylococcus
LKVTTEGETAEGSIKDDKDHKDL

SEQ ID NO: 2098438 - protein, 22 aa, Staphylococcus
LKYNPKSAKSHWDKAKNELGKN

SEQ ID NO: 2098439 - protein, 4 aa, Staphylococcus
LLGD

SEQ ID NO: 2098440 - protein, 17 aa, Staphylococcus
LLPSEEAGELDENLNSD

SEQ ID NO: 2098441 - protein, 9 aa, Staphylococcus
LNAAKEKLE

SEQ ID NO: 2098442 - protein, 11 aa, Staphylococcus
LNADQANQDAF

SEQ ID NO: 2098443 - protein, 14 aa, Staphylococcus
LNAEATDNSVPELK

SEQ ID NO: 2098444 - protein, 19 aa, Staphylococcus
LNANASEQTEGSQKGTMGY

SEQ ID NO: 2098445 - protein, 4 aa, Staphylococcus
LNAS

SEQ ID NO: 2098446 - protein, 14 aa, Staphylococcus
LNDALEGKIGTRIT

SEQ ID NO: 2098447 - protein, 9 aa, Staphylococcus
LNDDVTKGL

SEQ ID NO: 2098448 - protein, 7 aa, Staphylococcus
LNESDYA

SEQ ID NO: 2098449 - protein, 7 aa, Staphylococcus
LNESEYA

SEQ ID NO: 2098450 - protein, 7 aa, Staphylococcus
LNESSYA

SEQ ID NO: 2098451 - protein, 4 aa, Staphylococcus
LNGA

SEQ ID NO: 2098452 - protein, 4 aa, Staphylococcus
LNGL

SEQ ID NO: 2098453 - protein, 16 aa, Staphylococcus
LNGNSNLAQAKQEANQ

SEQ ID NO: 2098454 - protein, 63 aa, Staphylococcus
LNGQDGAKGNPGEKGEKGDPGTKGDKGEKGDTGAAGRDGQNGQDGKSVIANTERGTKDGQEGA

SEQ ID NO: 2098455 - protein, 11 aa, Staphylococcus
LNGSDVTDGDI

SEQ ID NO: 2098456 - protein, 19 aa, Staphylococcus
LNKATKGIKRIDNTSVEQV

SEQ ID NO: 2098457 - protein, 17 aa, Staphylococcus
LNKDSKDKFNDIPKEER

SEQ ID NO: 2098458 - protein, 21 aa, Staphylococcus
LNKEDEGKKRLDEHKEKIAKY

SEQ ID NO: 2098459 - protein, 15 aa, Staphylococcus
LNKEKQGDKRLDEHK

SEQ ID NO: 2098460 - protein, 12 aa, Staphylococcus
LNKEQSKDESMD

SEQ ID NO: 2098461 - protein, 10 aa, Staphylococcus
LNKGNTGSGY

SEQ ID NO: 2098462 - protein, 12 aa, Staphylococcus
LNKGTSKDLPKY

SEQ ID NO: 2098463 - protein, 10 aa, Staphylococcus
LNKSQQQDYK

SEQ ID NO: 2098464 - protein, 11 aa, Staphylococcus
LNKTKTDNLSK

SEQ ID NO: 2098465 - protein, 34 aa, Staphylococcus
LNNAQKEALTQQINGATTVADVNQQSDKATELNT

SEQ ID NO: 2098466 - protein, 22 aa, Staphylococcus
LNNHSKAKFNDIPKKERTMITS

SEQ ID NO: 2098467 - protein, 9 aa, Staphylococcus
LNNPAELNQ

SEQ ID NO: 2098468 - protein, 4 aa, Staphylococcus
LNPG

SEQ ID NO: 2098469 - protein, 16 aa, Staphylococcus
LNPQQGTNEDQSTIEA

SEQ ID NO: 2098470 - protein, 10 aa, Staphylococcus
LNQESTEAFE

SEQ ID NO: 2098471 - protein, 4 aa, Staphylococcus
LNQP

SEQ ID NO: 2098472 - protein, 9 aa, Staphylococcus
LNQSDDAKN

SEQ ID NO: 2098473 - protein, 27 aa, Staphylococcus
LNRKDRNNTNIKITKSKDSKEKPQKQL

SEQ ID NO: 2098474 - protein, 12 aa, Staphylococcus
LNRSGYNAAKGG

SEQ ID NO: 2098475 - protein, 30 aa, Staphylococcus
LNSLEEKKQGLYKKANSDNEDTRKKAADDI

SEQ ID NO: 2098476 - protein, 17 aa, Staphylococcus
LNTEKKDKGYKIESAGN

SEQ ID NO: 2098477 - protein, 11 aa, Staphylococcus
LNTEKKSKGYK

SEQ ID NO: 2098478 - protein, 16 aa, Staphylococcus
LNTQNIVSSKESFGIT

SEQ ID NO: 2098479 - protein, 24 aa, Staphylococcus
LNTVRSYEEVKKDEIPKKAMSKLE

SEQ ID NO: 2098480 - protein, 16 aa, Staphylococcus
LPAKYKPGENKIAKKQ

SEQ ID NO: 2098481 - protein, 19 aa, Staphylococcus
LPANNDAGNEAHAATQPYY

SEQ ID NO: 2098482 - protein, 8 aa, Staphylococcus
LPANQSLD

SEQ ID NO: 2098483 - protein, 6 aa, Staphylococcus
LPDSIK

SEQ ID NO: 2098484 - protein, 24 aa, Staphylococcus
LPGLGDGDGKDSVKITATETSETK

SEQ ID NO: 2098485 - protein, 25 aa, Staphylococcus
LPGLGDGNAKDDVKITTTETSETKI

SEQ ID NO: 2098486 - protein, 24 aa, Staphylococcus
LPGLGDGNSKDDVKITTTETSETK

SEQ ID NO: 2098487 - protein, 24 aa, Staphylococcus
LPGLGDGNSKNDVKITTTETSETK

SEQ ID NO: 2098488 - protein, 24 aa, Staphylococcus
LPGLGDSNSKDSVKITSTETSETK

SEQ ID NO: 2098489 - protein, 14 aa, Staphylococcus
LPGLGDSRSDDDVK

SEQ ID NO: 2098490 - protein, 14 aa, Staphylococcus
LPGLGGNSSDDEVK

SEQ ID NO: 2098491 - protein, 17 aa, Staphylococcus
LPGTDGLKTGTSNKGYN

SEQ ID NO: 2098492 - protein, 15 aa, Staphylococcus
LPKDYNHGENPKAVK

SEQ ID NO: 2098493 - protein, 10 aa, Staphylococcus
LPKGGYDKFT

SEQ ID NO: 2098494 - protein, 4 aa, Staphylococcus
LPNE

SEQ ID NO: 2098495 - protein, 10 aa, Staphylococcus
LPNGQGTRNV

SEQ ID NO: 2098496 - protein, 9 aa, Staphylococcus
LPNNTPSYL

SEQ ID NO: 2098497 - protein, 5 aa, Staphylococcus
LPPHI

SEQ ID NO: 2098498 - protein, 4 aa, Staphylococcus
LPQP

SEQ ID NO: 2098499 - protein, 4 aa, Staphylococcus
LPQT

SEQ ID NO: 2098500 - protein, 14 aa, Staphylococcus
LPSDDADKLNETLN

SEQ ID NO: 2098501 - protein, 8 aa, Staphylococcus
LPSGGGLA

SEQ ID NO: 2098502 - protein, 6 aa, Staphylococcus
LPSGTN

SEQ ID NO: 2098503 - protein, 15 aa, Staphylococcus
LPSSTAGKYDESLNN

SEQ ID NO: 2098504 - protein, 14 aa, Staphylococcus
LPSSTAKKYNENLN

SEQ ID NO: 2098505 - protein, 5 aa, Staphylococcus
LPYEE

SEQ ID NO: 2098506 - protein, 23 aa, Staphylococcus
LQAGQTAEDIIEQGNKEAENIKK

SEQ ID NO: 2098507 - protein, 10 aa, Staphylococcus
LQARQTADDI

SEQ ID NO: 2098508 - protein, 15 aa, Staphylococcus
LQATGEAVEDAPEGM

SEQ ID NO: 2098509 - protein, 7 aa, Staphylococcus
LQETDNV

SEQ ID NO: 2098510 - protein, 10 aa, Staphylococcus
LQGSGGIQDD

SEQ ID NO: 2098511 - protein, 68 aa, Staphylococcus
LQHNQPSHQSQHTNVASASTTQANTTNVTTNTSSSNTECTADNSSSSNTSSDDSSSNESSSSESTSSV

SEQ ID NO: 2098512 - protein, 18 aa, Staphylococcus
LQKDELKRQIQQAQNVAN

SEQ ID NO: 2098513 - protein, 4 aa, Staphylococcus
LQKN

SEQ ID NO: 2098514 - protein, 7 aa, Staphylococcus
LQKRGAN

SEQ ID NO: 2098515 - protein, 85 aa, Staphylococcus
LQNEVNEKVASESVKQKSDAKSKEEDKKKSTSEDTKNKPENASGQNQTAKDKQTKDKQTKDKPAASTTTKDKTSGTAADKKNGNT

SEQ ID NO: 2098516 - protein, 24 aa, Staphylococcus
LQNNTSKIIKESKESGNANVQDNA

SEQ ID NO: 2098517 - protein, 16 aa, Staphylococcus
LQNRGEEISKAFDKDE

SEQ ID NO: 2098518 - protein, 16 aa, Staphylococcus
LQNRGEEISNTFSKDN

SEQ ID NO: 2098519 - protein, 15 aa, Staphylococcus
LQNRGEEISNTFSKE

SEQ ID NO: 2098520 - protein, 10 aa, Staphylococcus
LQQDPDEAPY

SEQ ID NO: 2098521 - protein, 20 aa, Staphylococcus
LQQSIDQATDTTGMTQDTIN

SEQ ID NO: 2098522 - protein, 9 aa, Staphylococcus
LQSEKDHAK

SEQ ID NO: 2098523 - protein, 9 aa, Staphylococcus
LQTGNGPYG

SEQ ID NO: 2098524 - protein, 4 aa, Staphylococcus
LRGK

SEQ ID NO: 2098525 - protein, 22 aa, Staphylococcus
LRHTSTKNSFVNARKEDAKQIL

SEQ ID NO: 2098526 - protein, 14 aa, Staphylococcus
LRNEADQQADYDKE

SEQ ID NO: 2098527 - protein, 6 aa, Staphylococcus
LRNRGA

SEQ ID NO: 2098528 - protein, 9 aa, Staphylococcus
LSAKQGNIN

SEQ ID NO: 2098529 - protein, 7 aa, Staphylococcus
LSCSPKE

SEQ ID NO: 2098530 - protein, 5 aa, Staphylococcus
LSDAG

SEQ ID NO: 2098531 - protein, 7 aa, Staphylococcus
LSDDKPV

SEQ ID NO: 2098532 - protein, 22 aa, Staphylococcus
LSDNKDKAESEEANNKAKATDK

SEQ ID NO: 2098533 - protein, 15 aa, Staphylococcus
LSDPNTAKEYWGPKG

SEQ ID NO: 2098534 - protein, 13 aa, Staphylococcus
LSDVKKKQKNVEE

SEQ ID NO: 2098535 - protein, 11 aa, Staphylococcus
LSEDESADETM

SEQ ID NO: 2098536 - protein, 7 aa, Staphylococcus
LSEFKND

SEQ ID NO: 2098537 - protein, 9 aa, Staphylococcus
LSEKTKRYK

SEQ ID NO: 2098538 - protein, 13 aa, Staphylococcus
LSEPNKEDSGKIK

SEQ ID NO: 2098539 - protein, 6 aa, Staphylococcus
LSERTK

SEQ ID NO: 2098540 - protein, 7 aa, Staphylococcus
LSERTKQ

SEQ ID NO: 2098541 - protein, 7 aa, Staphylococcus
LSERTKR

SEQ ID NO: 2098542 - protein, 5 aa, Staphylococcus
LSESQ

SEQ ID NO: 2098543 - protein, 8 aa, Staphylococcus
LSESYDGV

SEQ ID NO: 2098544 - protein, 8 aa, Staphylococcus
LSESYEGV

SEQ ID NO: 2098545 - protein, 4 aa, Staphylococcus
LSET

SEQ ID NO: 2098546 - protein, 8 aa, Staphylococcus
LSETESTL

SEQ ID NO: 2098547 - protein, 7 aa, Staphylococcus
LSGAGKS

SEQ ID NO: 2098548 - protein, 10 aa, Staphylococcus
LSGGNKNYQR

SEQ ID NO: 2098549 - protein, 13 aa, Staphylococcus
LSGGNNDAITGAT

SEQ ID NO: 2098550 - protein, 7 aa, Staphylococcus
LSGPQSK

SEQ ID NO: 2098551 - protein, 8 aa, Staphylococcus
LSGPSHAE

SEQ ID NO: 2098552 - protein, 7 aa, Staphylococcus
LSKDDGK

SEQ ID NO: 2098553 - protein, 6 aa, Staphylococcus
LSKDPS

SEQ ID NO: 2098554 - protein, 5 aa, Staphylococcus
LSKDQ

SEQ ID NO: 2098555 - protein, 6 aa, Staphylococcus
LSKEKF

SEQ ID NO: 2098556 - protein, 15 aa, Staphylococcus
LSKNKKEDKKQNLEK

SEQ ID NO: 2098557 - protein, 7 aa, Staphylococcus
LSKNQKG

SEQ ID NO: 2098558 - protein, 8 aa, Staphylococcus
LSKPEDVA

SEQ ID NO: 2098559 - protein, 20 aa, Staphylococcus
LSKSDLTDRNKEDFEQMSKD

SEQ ID NO: 2098560 - protein, 12 aa, Staphylococcus
LSKSSAAKYNYI

SEQ ID NO: 2098561 - protein, 15 aa, Staphylococcus
LSKTDTTDKNKREFE

SEQ ID NO: 2098562 - protein, 69 aa, Staphylococcus
LSKYTAPKTATKTVAAPKTQVKAASTTTPSTTKTAAKPVAKTNTATKTAAKPVAKANTATKTTAKTNVV

SEQ ID NO: 2098563 - protein, 26 aa, Staphylococcus
LSLKGQPKYYKGTDGLKTGTSDSGYS

SEQ ID NO: 2098564 - protein, 8 aa, Staphylococcus
LSMPETGA

SEQ ID NO: 2098565 - protein, 10 aa, Staphylococcus
LSNENTELKN

SEQ ID NO: 2098566 - protein, 6 aa, Staphylococcus
LSNGKS

SEQ ID NO: 2098567 - protein, 15 aa, Staphylococcus
LSNKDKENNNPLSAE

SEQ ID NO: 2098568 - protein, 8 aa, Staphylococcus
LSNKQKWS

SEQ ID NO: 2098569 - protein, 21 aa, Staphylococcus
LSNNDENNSDFNVAENSDTRQ

SEQ ID NO: 2098570 - protein, 7 aa, Staphylococcus
LSNRAKQ

SEQ ID NO: 2098571 - protein, 12 aa, Staphylococcus
LSPFNGNEGQAL

SEQ ID NO: 2098572 - protein, 19 aa, Staphylococcus
LSPKKDSIALEKPKDNPYA

SEQ ID NO: 2098573 - protein, 8 aa, Staphylococcus
LSPRAKQY

SEQ ID NO: 2098574 - protein, 5 aa, Staphylococcus
LSPTQ

SEQ ID NO: 2098575 - protein, 14 aa, Staphylococcus
LSQANKSTKDDSVV

SEQ ID NO: 2098576 - protein, 12 aa, Staphylococcus
LSQDTQKGYTFN

SEQ ID NO: 2098577 - protein, 4 aa, Staphylococcus
LSQK

SEQ ID NO: 2098578 - protein, 31 aa, Staphylococcus
LSRESSRNKLKAEYNKYKENPEGYKQNAKGL

SEQ ID NO: 2098579 - protein, 7 aa, Staphylococcus
LSRNPDQ

SEQ ID NO: 2098580 - protein, 16 aa, Staphylococcus
LSSNNDVSSHAKRNAK

SEQ ID NO: 2098581 - protein, 20 aa, Staphylococcus
LSSNNDVSTHAKKNAKREVK

SEQ ID NO: 2098582 - protein, 8 aa, Staphylococcus
LSSSDQQL

SEQ ID NO: 2098583 - protein, 8 aa, Staphylococcus
LSTTEKEL

SEQ ID NO: 2098584 - protein, 4 aa, Staphylococcus
LSVY

SEQ ID NO: 2098585 - protein, 13 aa, Staphylococcus
LSYGPQVQRTPGV

SEQ ID NO: 2098586 - protein, 4 aa, Staphylococcus
LSYN

SEQ ID NO: 2098587 - protein, 39 aa, Staphylococcus
LTAETPDAKDFSESIDSPLTYNPKAAKKHFEKAKKDLGV

SEQ ID NO: 2098588 - protein, 13 aa, Staphylococcus
LTAPDAAGQREFT

SEQ ID NO: 2098589 - protein, 16 aa, Staphylococcus
LTAPSTTPSKPSTTAK

SEQ ID NO: 2098590 - protein, 14 aa, Staphylococcus
LTDAPIDYKHLKVK

SEQ ID NO: 2098591 - protein, 14 aa, Staphylococcus
LTDAPVDYKKLEVN

SEQ ID NO: 2098592 - protein, 6 aa, Staphylococcus
LTDAQV

SEQ ID NO: 2098593 - protein, 10 aa, Staphylococcus
LTDDVTKGLS

SEQ ID NO: 2098594 - protein, 16 aa, Staphylococcus
LTGCGNKESLYSDKGN

SEQ ID NO: 2098595 - protein, 7 aa, Staphylococcus
LTGGNLE

SEQ ID NO: 2098596 - protein, 16 aa, Staphylococcus
LTGNEAHASETTNVDQ

SEQ ID NO: 2098597 - protein, 16 aa, Staphylococcus
LTGTAEDEAGKAFRDN

SEQ ID NO: 2098598 - protein, 20 aa, Staphylococcus
LTHREKQANQLVNETKDNVD

SEQ ID NO: 2098599 - protein, 9 aa, Staphylococcus
LTKANQEVN

SEQ ID NO: 2098600 - protein, 8 aa, Staphylococcus
LTKPNAAQ

SEQ ID NO: 2098601 - protein, 49 aa, Staphylococcus
LTKTSSKVKKENLDKLDEIDNKLSEAYSNYQSSVNEHDLNSDNKKKHKV

SEQ ID NO: 2098602 - protein, 6 aa, Staphylococcus
LTNQEV

SEQ ID NO: 2098603 - protein, 224 aa, Staphylococcus
LTNTNETASTEDQATDKATTNVSEEANHADQTAATTQDTSQTEKSNTEETQNTEQANTEKASSNQTTKDSSNIEQDTINKTNDKTSTTTEDNKGVTSVTDEKSDASSTTDKNNDDKTTTAEESKTSEEPTTETTTTKETQSTDNKSASTTKETSSQDQSTNENSTTDNSSQEKQTTSTKETANTSKKASSTEKVNEPQTTTYENKVDTELGKQLAASDNKEQAV

SEQ ID NO: 2098604 - protein, 56 aa, Staphylococcus
LTPAQGQIAEKGTEIEDTATKKPQPIEPAQNDKKREEPITEKATKQQKEQPAPEVQ

SEQ ID NO: 2098605 - protein, 9 aa, Staphylococcus
LTPAQQQAL

SEQ ID NO: 2098606 - protein, 48 aa, Staphylococcus
LTPDVSPLERAKADLENDINQVTSTTGMTDQSVANYNEKLNAAKQQLK

SEQ ID NO: 2098607 - protein, 13 aa, Staphylococcus
LTPERDELPPEEH

SEQ ID NO: 2098608 - protein, 7 aa, Staphylococcus
LTPGQQK

SEQ ID NO: 2098609 - protein, 12 aa, Staphylococcus
LTPGQRKKINDN

SEQ ID NO: 2098610 - protein, 4 aa, Staphylococcus
LTPP

SEQ ID NO: 2098611 - protein, 5 aa, Staphylococcus
LTPPS

SEQ ID NO: 2098612 - protein, 13 aa, Staphylococcus
LTQAEAAQEQLQR

SEQ ID NO: 2098613 - protein, 4 aa, Staphylococcus
LTQD

SEQ ID NO: 2098614 - protein, 10 aa, Staphylococcus
LTQEEAVNEQ

SEQ ID NO: 2098615 - protein, 11 aa, Staphylococcus
LTQTANDLNQA

SEQ ID NO: 2098616 - protein, 12 aa, Staphylococcus
LTQVEEGSDKGK

SEQ ID NO: 2098617 - protein, 21 aa, Staphylococcus
LTRDTQRGNTFKSTNLSLKGQ

SEQ ID NO: 2098618 - protein, 7 aa, Staphylococcus
LTREEAI

SEQ ID NO: 2098619 - protein, 11 aa, Staphylococcus
LTSEDKALPHY

SEQ ID NO: 2098620 - protein, 10 aa, Staphylococcus
LTSLSSNTAY

SEQ ID NO: 2098621 - protein, 31 aa, Staphylococcus
LTSPNDSWKNMSNKAVQLGEKRSTSNGYGIR

SEQ ID NO: 2098622 - protein, 5 aa, Staphylococcus
LTSQE

SEQ ID NO: 2098623 - protein, 17 aa, Staphylococcus
LTTDNSAHASESTTNYA

SEQ ID NO: 2098624 - protein, 24 aa, Staphylococcus
LTTPSTSNTTKPTTPSKPATNSQL

SEQ ID NO: 2098625 - protein, 11 aa, Staphylococcus
LTTSEIKSFGS

SEQ ID NO: 2098626 - protein, 20 aa, Staphylococcus
LTVTSNNGLAQIKSDNSGLY

SEQ ID NO: 2098627 - protein, 10 aa, Staphylococcus
LTYKEATSHL

SEQ ID NO: 2098628 - protein, 32 aa, Staphylococcus
LVEDRSPKYKREDTGENKKTYNGFHEEDNGKL

SEQ ID NO: 2098629 - protein, 31 aa, Staphylococcus
LVEDSSPKYLREDTGKTKKTYDGFKEEDNAQ

SEQ ID NO: 2098630 - protein, 32 aa, Staphylococcus
LVEDSTPKYKREDSGDTKKTYDGFKEADNQQL

SEQ ID NO: 2098631 - protein, 32 aa, Staphylococcus
LVEDSTPKYVREDNGRTKKTYDGFKEQDNSKL

SEQ ID NO: 2098632 - protein, 7 aa, Staphylococcus
LVQEGDK

SEQ ID NO: 2098633 - protein, 14 aa, Staphylococcus
LYPNKTKNDKVREI

SEQ ID NO: 2098634 - protein, 7 aa, Staphylococcus
LYRDDRQ

SEQ ID NO: 2098635 - protein, 10 aa, Staphylococcus
LYRDPKTNQQ

SEQ ID NO: 2098636 - protein, 17 aa, Staphylococcus
LYSNGQNTGTVQITTKD

SEQ ID NO: 2098637 - protein, 11 aa, Staphylococcus
MAERTGVSASQ

SEQ ID NO: 2098638 - protein, 4 aa, Staphylococcus
MAGA

SEQ ID NO: 2098639 - protein, 19 aa, Staphylococcus
MAGGEAMNGATGNFVRTHI

SEQ ID NO: 2098640 - protein, 10 aa, Staphylococcus
MAGSHKSGVL

SEQ ID NO: 2098641 - protein, 19 aa, Staphylococcus
MANKQKSTETLATPPKTRT

SEQ ID NO: 2098642 - protein, 11 aa, Staphylococcus
MANSYNGEDFE

SEQ ID NO: 2098643 - protein, 15 aa, Staphylococcus
MDDGNKVKIPKNPKR

SEQ ID NO: 2098644 - protein, 12 aa, Staphylococcus
MDEQDVPDPYYT

SEQ ID NO: 2098645 - protein, 12 aa, Staphylococcus
MEGPASAAYESS

SEQ ID NO: 2098646 - protein, 12 aa, Staphylococcus
MEGPASAAYQSS

SEQ ID NO: 2098647 - protein, 4 aa, Staphylococcus
MGGQ

SEQ ID NO: 2098648 - protein, 8 aa, Staphylococcus
MGKDEAPK

SEQ ID NO: 2098649 - protein, 8 aa, Staphylococcus
MGNTKNPK

SEQ ID NO: 2098650 - protein, 9 aa, Staphylococcus
MGNTKNPKN

SEQ ID NO: 2098651 - protein, 8 aa, Staphylococcus
MGPSYNSA

SEQ ID NO: 2098652 - protein, 5 aa, Staphylococcus
MGRGT

SEQ ID NO: 2098653 - protein, 9 aa, Staphylococcus
MKAFGQTGR

SEQ ID NO: 2098654 - protein, 9 aa, Staphylococcus
MKDEKEQRI

SEQ ID NO: 2098655 - protein, 11 aa, Staphylococcus
MKDEKEQRIKQ

SEQ ID NO: 2098656 - protein, 11 aa, Staphylococcus
MKEDNKENEWT

SEQ ID NO: 2098657 - protein, 12 aa, Staphylococcus
MKEEKKEDQWTG

SEQ ID NO: 2098658 - protein, 5 aa, Staphylococcus
MKGEK

SEQ ID NO: 2098659 - protein, 12 aa, Staphylococcus
MKKLKDNGELAK

SEQ ID NO: 2098660 - protein, 7 aa, Staphylococcus
MKKQDGD

SEQ ID NO: 2098661 - protein, 8 aa, Staphylococcus
MKKQDGDL

SEQ ID NO: 2098662 - protein, 9 aa, Staphylococcus
MKKQDGNLS

SEQ ID NO: 2098663 - protein, 11 aa, Staphylococcus
MKKSQLEGKDD

SEQ ID NO: 2098664 - protein, 5 aa, Staphylococcus
MKPHE

SEQ ID NO: 2098665 - protein, 23 aa, Staphylococcus
MKQPKALEKATQDKFATPINPEN

SEQ ID NO: 2098666 - protein, 4 aa, Staphylococcus
MKRD

SEQ ID NO: 2098667 - protein, 11 aa, Staphylococcus
MLENQGQAFAN

SEQ ID NO: 2098668 - protein, 12 aa, Staphylococcus
MNAKTLAKNPAL

SEQ ID NO: 2098669 - protein, 16 aa, Staphylococcus
MNGHKGKGKDSMGTGT

SEQ ID NO: 2098670 - protein, 20 aa, Staphylococcus
MNKGYGYKDIEKGKKNTANT

SEQ ID NO: 2098671 - protein, 14 aa, Staphylococcus
MNKVNKEKQDVDQL

SEQ ID NO: 2098672 - protein, 4 aa, Staphylococcus
MNTK

SEQ ID NO: 2098673 - protein, 26 aa, Staphylococcus
MNYNGGPGVVSSRTISAGQAGSYNYI

SEQ ID NO: 2098674 - protein, 26 aa, Staphylococcus
MNYNGGPGVVSTRTISASQAGAYNYI

SEQ ID NO: 2098675 - protein, 26 aa, Staphylococcus
MNYNGGPGVVSTRTISASQASSYNYI

SEQ ID NO: 2098676 - protein, 5 aa, Staphylococcus
MPAGE

SEQ ID NO: 2098677 - protein, 18 aa, Staphylococcus
MPEFETATSDVPEQKYKE

SEQ ID NO: 2098678 - protein, 7 aa, Staphylococcus
MPENTPV

SEQ ID NO: 2098679 - protein, 8 aa, Staphylococcus
MPKGQQDL

SEQ ID NO: 2098680 - protein, 20 aa, Staphylococcus
MPNSYTVGDKSGQALTYATR

SEQ ID NO: 2098681 - protein, 6 aa, Staphylococcus
MPSTTV

SEQ ID NO: 2098682 - protein, 8 aa, Staphylococcus
MQIDTSDV

SEQ ID NO: 2098683 - protein, 5 aa, Staphylococcus
MQRDM

SEQ ID NO: 2098684 - protein, 18 aa, Staphylococcus
MQRQKQRQLYPGAPKGQF

SEQ ID NO: 2098685 - protein, 38 aa, Staphylococcus
MQSESPKAKYSFSDANGKQHTNISVDEDGHVNNEQSHS

SEQ ID NO: 2098686 - protein, 13 aa, Staphylococcus
MRDEADKHANYDR

SEQ ID NO: 2098687 - protein, 13 aa, Staphylococcus
MRDEADQQANYDR

SEQ ID NO: 2098688 - protein, 33 aa, Staphylococcus
MRTSPKRQLQERRKHEIKERSTDPKSSESYQSA

SEQ ID NO: 2098689 - protein, 12 aa, Staphylococcus
MSAEDPSQKDLT

SEQ ID NO: 2098690 - protein, 11 aa, Staphylococcus
MSEGQKKLVEK

SEQ ID NO: 2098691 - protein, 15 aa, Staphylococcus
MSIGDYKEQKKLQAY

SEQ ID NO: 2098692 - protein, 10 aa, Staphylococcus
MSKENDQNFE

SEQ ID NO: 2098693 - protein, 10 aa, Staphylococcus
MSKKEAKKTF

SEQ ID NO: 2098694 - protein, 8 aa, Staphylococcus
MSNKDYEK

SEQ ID NO: 2098695 - protein, 12 aa, Staphylococcus
MSSDKAKNFKND

SEQ ID NO: 2098696 - protein, 25 aa, Staphylococcus
MTDVRGKKHPDTDTYELKSPKTGFY

SEQ ID NO: 2098697 - protein, 12 aa, Staphylococcus
MTETDVPDPYYT

SEQ ID NO: 2098698 - protein, 18 aa, Staphylococcus
MTNAQNEINTAKAQADQV

SEQ ID NO: 2098699 - protein, 11 aa, Staphylococcus
MTNGYNGEDFE

SEQ ID NO: 2098700 - protein, 10 aa, Staphylococcus
MTTADESHPI

SEQ ID NO: 2098701 - protein, 10 aa, Staphylococcus
MTTSEIESFG

SEQ ID NO: 2098702 - protein, 11 aa, Staphylococcus
MTTSEIKSFGS

SEQ ID NO: 2098703 - protein, 7 aa, Staphylococcus
MVQGSDE

SEQ ID NO: 2098704 - protein, 35 aa, Staphylococcus
NAAATTNNKNTVANAKPVTDQTNKQAAQKQYKNQD

SEQ ID NO: 2098705 - protein, 14 aa, Staphylococcus
NAAGRTNNNSERNL

SEQ ID NO: 2098706 - protein, 11 aa, Staphylococcus
NAAISQADQQK

SEQ ID NO: 2098707 - protein, 7 aa, Staphylococcus
NAAREKL

SEQ ID NO: 2098708 - protein, 16 aa, Staphylococcus
NADAATTYKVKSGDSL

SEQ ID NO: 2098709 - protein, 4 aa, Staphylococcus
NADD

SEQ ID NO: 2098710 - protein, 8 aa, Staphylococcus
NADDARYE

SEQ ID NO: 2098711 - protein, 9 aa, Staphylococcus
NADDARYEA

SEQ ID NO: 2098712 - protein, 15 aa, Staphylococcus
NADDINAGKKPVESL

SEQ ID NO: 2098713 - protein, 7 aa, Staphylococcus
NADEEAI

SEQ ID NO: 2098714 - protein, 5 aa, Staphylococcus
NADGS

SEQ ID NO: 2098715 - protein, 4 aa, Staphylococcus
NADN

SEQ ID NO: 2098716 - protein, 13 aa, Staphylococcus
NADPDKQSAYSDA

SEQ ID NO: 2098717 - protein, 13 aa, Staphylococcus
NADRNLNRFDSSE

SEQ ID NO: 2098718 - protein, 26 aa, Staphylococcus
NADRNLNRIDSSEAMNGYRRGAYADM

SEQ ID NO: 2098719 - protein, 46 aa, Staphylococcus
NADRNLNRIDSSEAMNGYRRGAYNDMTKDMSQDEKQSEAMQGVNSS

SEQ ID NO: 2098720 - protein, 26 aa, Staphylococcus
NADRNLNRIDSSESMNGYRRGAYQDM

SEQ ID NO: 2098721 - protein, 75 aa, Staphylococcus
NADSSAQQAPAQSTTQEQAPAAQQAPAQSTTQEQAPAAQQAPAQEQTQQPAQQPAQQQTQQPAQQSADSGSNVQV

SEQ ID NO: 2098722 - protein, 13 aa, Staphylococcus
NAEATTNSEPQLR

SEQ ID NO: 2098723 - protein, 13 aa, Staphylococcus
NAEATTNTEPQLR

SEQ ID NO: 2098724 - protein, 7 aa, Staphylococcus
NAEDKQA

SEQ ID NO: 2098725 - protein, 8 aa, Staphylococcus
NAENSFKD

SEQ ID NO: 2098726 - protein, 7 aa, Staphylococcus
NAGGDNV

SEQ ID NO: 2098727 - protein, 35 aa, Staphylococcus
NAHAAEDNNVNQDQLAQTALNNTQQLNDAPVQEGA

SEQ ID NO: 2098728 - protein, 4 aa, Staphylococcus
NAIK

SEQ ID NO: 2098729 - protein, 7 aa, Staphylococcus
NAISNPR

SEQ ID NO: 2098730 - protein, 4 aa, Staphylococcus
NAKF

SEQ ID NO: 2098731 - protein, 12 aa, Staphylococcus
NAKHNLTKKEIQ

SEQ ID NO: 2098732 - protein, 12 aa, Staphylococcus
NAKHNLTKSEIK

SEQ ID NO: 2098733 - protein, 6 aa, Staphylococcus
NAKLSD

SEQ ID NO: 2098734 - protein, 12 aa, Staphylococcus
NAKWSNGDDVTA

SEQ ID NO: 2098735 - protein, 12 aa, Staphylococcus
NAKWSNGDPVTA

SEQ ID NO: 2098736 - protein, 10 aa, Staphylococcus
NAKYNRNRIG

SEQ ID NO: 2098737 - protein, 14 aa, Staphylococcus
NAMNTEKLAKDDTL

SEQ ID NO: 2098738 - protein, 7 aa, Staphylococcus
NANGSIT

SEQ ID NO: 2098739 - protein, 30 aa, Staphylococcus
NANHADAAEYNHNPAPQHNQFGQQGPHGQN

SEQ ID NO: 2098740 - protein, 8 aa, Staphylococcus
NANNSTNV

SEQ ID NO: 2098741 - protein, 9 aa, Staphylococcus
NAPGIGQSF

SEQ ID NO: 2098742 - protein, 9 aa, Staphylococcus
NAPPDPGAV

SEQ ID NO: 2098743 - protein, 8 aa, Staphylococcus
NAPPDVGA

SEQ ID NO: 2098744 - protein, 5 aa, Staphylococcus
NAPQG

SEQ ID NO: 2098745 - protein, 14 aa, Staphylococcus
NAQDLNPAQQEALK

SEQ ID NO: 2098746 - protein, 20 aa, Staphylococcus
NAQQALEKVKDETKALYEGT

SEQ ID NO: 2098747 - protein, 22 aa, Staphylococcus
NARDDQGGKISIESSNQPLPKP

SEQ ID NO: 2098748 - protein, 8 aa, Staphylococcus
NASDSEIN

SEQ ID NO: 2098749 - protein, 4 aa, Staphylococcus
NASE

SEQ ID NO: 2098750 - protein, 15 aa, Staphylococcus
NASQINTGKKPVKDL

SEQ ID NO: 2098751 - protein, 6 aa, Staphylococcus
NASVEP

SEQ ID NO: 2098752 - protein, 23 aa, Staphylococcus
NATKDEVKTAIDPKTITEDATQK

SEQ ID NO: 2098753 - protein, 9 aa, Staphylococcus
NATLSNENL

SEQ ID NO: 2098754 - protein, 4 aa, Staphylococcus
NATR

SEQ ID NO: 2098755 - protein, 13 aa, Staphylococcus
NATSLNDAQRHRL

SEQ ID NO: 2098756 - protein, 14 aa, Staphylococcus
NATSQAGVEGNAGL

SEQ ID NO: 2098757 - protein, 6 aa, Staphylococcus
NAVSSY

SEQ ID NO: 2098758 - protein, 8 aa, Staphylococcus
NAYPKEDF

SEQ ID NO: 2098759 - protein, 5 aa, Staphylococcus
NCDRD

SEQ ID NO: 2098760 - protein, 14 aa, Staphylococcus
NDAKKVNGYSARTA

SEQ ID NO: 2098761 - protein, 10 aa, Staphylococcus
NDAKTGKNSF

SEQ ID NO: 2098762 - protein, 11 aa, Staphylococcus
NDAYRQDQAPL

SEQ ID NO: 2098763 - protein, 8 aa, Staphylococcus
NDDAERTI

SEQ ID NO: 2098764 - protein, 6 aa, Staphylococcus
NDDDYY

SEQ ID NO: 2098765 - protein, 9 aa, Staphylococcus
NDDTNAGFS

SEQ ID NO: 2098766 - protein, 8 aa, Staphylococcus
NDDTQQLP

SEQ ID NO: 2098767 - protein, 165 aa, Staphylococcus
NDEAKAAEKDQVSTTTNSNEEQNVKAKGNVQTSESTTLSQVNPEQVDVTKQNVETDVDNNSSENASNNEISNETSKQESTENSSNQDVSSQEVTNENNSIETSKNSNSTETLSSEEPSQNNSAEKSISEKTTKKASTEESQSTLNSNNDATNEAKSEQPSTEETT

SEQ ID NO: 2098768 - protein, 5 aa, Staphylococcus
NDENF

SEQ ID NO: 2098769 - protein, 43 aa, Staphylococcus
NDGSLASDNFTGIGTAKTPDGKDFASTVSSPLKYNTKEAKQNW

SEQ ID NO: 2098770 - protein, 9 aa, Staphylococcus
NDGSNFDAS

SEQ ID NO: 2098771 - protein, 7 aa, Staphylococcus
NDHIGGK

SEQ ID NO: 2098772 - protein, 4 aa, Staphylococcus
NDHY

SEQ ID NO: 2098773 - protein, 5 aa, Staphylococcus
NDIND

SEQ ID NO: 2098774 - protein, 6 aa, Staphylococcus
NDIPES

SEQ ID NO: 2098775 - protein, 68 aa, Staphylococcus
NDISSKANETIQNVKNDPQGYANRLKNDPKSLLQDEKSKFTNVNTKKNDTHELAEGKFDDEGGATVNN

SEQ ID NO: 2098776 - protein, 5 aa, Staphylococcus
NDISY

SEQ ID NO: 2098777 - protein, 12 aa, Staphylococcus
NDKDKDNKTYKK

SEQ ID NO: 2098778 - protein, 11 aa, Staphylococcus
NDKDKDNKTYQ

SEQ ID NO: 2098779 - protein, 6 aa, Staphylococcus
NDKHQT

SEQ ID NO: 2098780 - protein, 6 aa, Staphylococcus
NDKQER

SEQ ID NO: 2098781 - protein, 32 aa, Staphylococcus
NDKSHKKRQNQQPRTQQPRQQPSAERKEKKSI

SEQ ID NO: 2098782 - protein, 8 aa, Staphylococcus
NDKVPQKV

SEQ ID NO: 2098783 - protein, 7 aa, Staphylococcus
NDKYDDK

SEQ ID NO: 2098784 - protein, 5 aa, Staphylococcus
NDKYV

SEQ ID NO: 2098785 - protein, 11 aa, Staphylococcus
NDLQAQNYGNV

SEQ ID NO: 2098786 - protein, 13 aa, Staphylococcus
NDLSQNSSKTIED

SEQ ID NO: 2098787 - protein, 16 aa, Staphylococcus
NDLTSSNISSDNGEKY

SEQ ID NO: 2098788 - protein, 7 aa, Staphylococcus
NDMSNKW

SEQ ID NO: 2098789 - protein, 5 aa, Staphylococcus
NDNYS

SEQ ID NO: 2098790 - protein, 6 aa, Staphylococcus
NDPEDM

SEQ ID NO: 2098791 - protein, 10 aa, Staphylococcus
NDPGDTNTAL

SEQ ID NO: 2098792 - protein, 6 aa, Staphylococcus
NDPSAM

SEQ ID NO: 2098793 - protein, 8 aa, Staphylococcus
NDPSVSNY

SEQ ID NO: 2098794 - protein, 4 aa, Staphylococcus
NDPV

SEQ ID NO: 2098795 - protein, 8 aa, Staphylococcus
NDQLGGRM

SEQ ID NO: 2098796 - protein, 17 aa, Staphylococcus
NDQQAHKPMSPSKTQNL

SEQ ID NO: 2098797 - protein, 16 aa, Staphylococcus
NDQSAHKPLTPSQPQN

SEQ ID NO: 2098798 - protein, 18 aa, Staphylococcus
NDQYQNGTSTTTKYDQTF

SEQ ID NO: 2098799 - protein, 9 aa, Staphylococcus
NDRHQITDT

SEQ ID NO: 2098800 - protein, 13 aa, Staphylococcus
NDSGDISTSNINS

SEQ ID NO: 2098801 - protein, 8 aa, Staphylococcus
NDSGDSYV

SEQ ID NO: 2098802 - protein, 12 aa, Staphylococcus
NDSGESKFDNKE

SEQ ID NO: 2098803 - protein, 16 aa, Staphylococcus
NDSLETTGAITDKGSY

SEQ ID NO: 2098804 - protein, 11 aa, Staphylococcus
NDTDEALTDEN

SEQ ID NO: 2098805 - protein, 21 aa, Staphylococcus
NDTKNVQKRLETGFAEDSDLY

SEQ ID NO: 2098806 - protein, 5 aa, Staphylococcus
NDTNE

SEQ ID NO: 2098807 - protein, 6 aa, Staphylococcus
NDVRSK

SEQ ID NO: 2098808 - protein, 4 aa, Staphylococcus
NDVT

SEQ ID NO: 2098809 - protein, 5 aa, Staphylococcus
NDYKV

SEQ ID NO: 2098810 - protein, 6 aa, Staphylococcus
NDYPNY

SEQ ID NO: 2098811 - protein, 8 aa, Staphylococcus
NEAKPNTY

SEQ ID NO: 2098812 - protein, 10 aa, Staphylococcus
NEANGPTYNQ

SEQ ID NO: 2098813 - protein, 4 aa, Staphylococcus
NEAQ

SEQ ID NO: 2098814 - protein, 9 aa, Staphylococcus
NEAQFGADT

SEQ ID NO: 2098815 - protein, 8 aa, Staphylococcus
NEAQFGAN

SEQ ID NO: 2098816 - protein, 11 aa, Staphylococcus
NEDGSSRTDHV

SEQ ID NO: 2098817 - protein, 7 aa, Staphylococcus
NEDQETE

SEQ ID NO: 2098818 - protein, 16 aa, Staphylococcus
NEDSVKELNDHHQNKR

SEQ ID NO: 2098819 - protein, 60 aa, Staphylococcus
NEEANNRGANNPYKGATLGDDGHYYSPSGRDLGNPEAGGSTPTVGSDSDSGQRAFNPDID

SEQ ID NO: 2098820 - protein, 6 aa, Staphylococcus
NEEEQQ

SEQ ID NO: 2098821 - protein, 28 aa, Staphylococcus
NEELSEASEYYEDKVDSEEPLNKSEINK

SEQ ID NO: 2098822 - protein, 8 aa, Staphylococcus
NEERGQLS

SEQ ID NO: 2098823 - protein, 5 aa, Staphylococcus
NEGET

SEQ ID NO: 2098824 - protein, 4 aa, Staphylococcus
NEGN

SEQ ID NO: 2098825 - protein, 4 aa, Staphylococcus
NEGS

SEQ ID NO: 2098826 - protein, 4 aa, Staphylococcus
NEGY

SEQ ID NO: 2098827 - protein, 14 aa, Staphylococcus
NEITAREAEVTTLS

SEQ ID NO: 2098828 - protein, 27 aa, Staphylococcus
NEKEYNKSIKDALKDAQDAQDKDFPKI

SEQ ID NO: 2098829 - protein, 37 aa, Staphylococcus
NEKNIKSFNDVKGKKLAQTFTSNYGKLAKDKGADITK

SEQ ID NO: 2098830 - protein, 37 aa, Staphylococcus
NEKNIKSFNDVKGKKLAQTFTSNYGQLAKDKGAKITK

SEQ ID NO: 2098831 - protein, 37 aa, Staphylococcus
NEKNIKSFNDVKGKKMAQTFTSNYGQLAKDKGADITK

SEQ ID NO: 2098832 - protein, 8 aa, Staphylococcus
NEKRKQVE

SEQ ID NO: 2098833 - protein, 13 aa, Staphylococcus
NEKRQPYWTENYT

SEQ ID NO: 2098834 - protein, 4 aa, Staphylococcus
NEKV

SEQ ID NO: 2098835 - protein, 25 aa, Staphylococcus
NEKVTLSSGFAPKDHNDKDPNLKPD

SEQ ID NO: 2098836 - protein, 78 aa, Staphylococcus
NELPAEDSSSKSSEKDSSNSSEDKNSEDSPTTNSEQSTNSTKSKQSNQGQTPNKETQKSDSTSKNNDSKTTSNTQNSD

SEQ ID NO: 2098837 - protein, 24 aa, Staphylococcus
NELPKGYKEGTELTGKYTKETNDY

SEQ ID NO: 2098838 - protein, 11 aa, Staphylococcus
NELQQQSEADL

SEQ ID NO: 2098839 - protein, 6 aa, Staphylococcus
NENDIE

SEQ ID NO: 2098840 - protein, 14 aa, Staphylococcus
NENHTMPNEKQQKY

SEQ ID NO: 2098841 - protein, 38 aa, Staphylococcus
NENIDKDGRQAYTGSYNRAALKQQTVKQMGPQNREAFK

SEQ ID NO: 2098842 - protein, 14 aa, Staphylococcus
NENTGSPSEPRNVG

SEQ ID NO: 2098843 - protein, 17 aa, Staphylococcus
NENTVDEINQSHQNKRY

SEQ ID NO: 2098844 - protein, 7 aa, Staphylococcus
NEPVNAK

SEQ ID NO: 2098845 - protein, 7 aa, Staphylococcus
NEQNVNN

SEQ ID NO: 2098846 - protein, 5 aa, Staphylococcus
NESAD

SEQ ID NO: 2098847 - protein, 5 aa, Staphylococcus
NESAF

SEQ ID NO: 2098848 - protein, 12 aa, Staphylococcus
NESIDKLKDQLK

SEQ ID NO: 2098849 - protein, 9 aa, Staphylococcus
NESQTTNAA

SEQ ID NO: 2098850 - protein, 17 aa, Staphylococcus
NESSKGQMTEVLNNNLK

SEQ ID NO: 2098851 - protein, 5 aa, Staphylococcus
NETEM

SEQ ID NO: 2098852 - protein, 6 aa, Staphylococcus
NETRKY

SEQ ID NO: 2098853 - protein, 9 aa, Staphylococcus
NETSQPTLD

SEQ ID NO: 2098854 - protein, 7 aa, Staphylococcus
NETTINE

SEQ ID NO: 2098855 - protein, 13 aa, Staphylococcus
NEVPAKEKEDITR

SEQ ID NO: 2098856 - protein, 9 aa, Staphylococcus
NEYRYGKPE

SEQ ID NO: 2098857 - protein, 49 aa, Staphylococcus
NEYTEGANYNPKKGSAKERDPEGVEQDTKQQDNKDDNKKDSNEENGNSN

SEQ ID NO: 2098858 - protein, 30 aa, Staphylococcus
NFEAQGDKRDGSDAKKVKNTVKVPKNPKKA

SEQ ID NO: 2098859 - protein, 30 aa, Staphylococcus
NFEASGKERDGSDAKKVSNTVEVPKNPKNA

SEQ ID NO: 2098860 - protein, 13 aa, Staphylococcus
NFGEPSDVDNNGK

SEQ ID NO: 2098861 - protein, 18 aa, Staphylococcus
NFKPTNDNIVKPKNALPL

SEQ ID NO: 2098862 - protein, 17 aa, Staphylococcus
NFNKAQKQQFMAFEVIP

SEQ ID NO: 2098863 - protein, 5 aa, Staphylococcus
NFPEQ

SEQ ID NO: 2098864 - protein, 13 aa, Staphylococcus
NFRQGNPLNRSEF

SEQ ID NO: 2098865 - protein, 20 aa, Staphylococcus
NFSPATDGKFETDPENPNLK

SEQ ID NO: 2098866 - protein, 24 aa, Staphylococcus
NGAIGSTWGTANNWANAAKAAGYT

SEQ ID NO: 2098867 - protein, 7 aa, Staphylococcus
NGAPLKR

SEQ ID NO: 2098868 - protein, 4 aa, Staphylococcus
NGDG

SEQ ID NO: 2098869 - protein, 23 aa, Staphylococcus
NGDIKTGKKIDAVKYDEKEQTFD

SEQ ID NO: 2098870 - protein, 6 aa, Staphylococcus
NGDITF

SEQ ID NO: 2098871 - protein, 4 aa, Staphylococcus
NGDL

SEQ ID NO: 2098872 - protein, 4 aa, Staphylococcus
NGED

SEQ ID NO: 2098873 - protein, 8 aa, Staphylococcus
NGEEDNSY

SEQ ID NO: 2098874 - protein, 5 aa, Staphylococcus
NGEII

SEQ ID NO: 2098875 - protein, 12 aa, Staphylococcus
NGENGNKDKLDP

SEQ ID NO: 2098876 - protein, 12 aa, Staphylococcus
NGETGNKDKIDP

SEQ ID NO: 2098877 - protein, 13 aa, Staphylococcus
NGEVQYKSGNFGD

SEQ ID NO: 2098878 - protein, 8 aa, Staphylococcus
NGGNFNKN

SEQ ID NO: 2098879 - protein, 9 aa, Staphylococcus
NGGTIEKIP

SEQ ID NO: 2098880 - protein, 4 aa, Staphylococcus
NGIA

SEQ ID NO: 2098881 - protein, 33 aa, Staphylococcus
NGIDDAYGKYKGAVTKKDLSSANKNEDKNIRQI

SEQ ID NO: 2098882 - protein, 10 aa, Staphylococcus
NGIDGNPTIY

SEQ ID NO: 2098883 - protein, 10 aa, Staphylococcus
NGIEGNPTIY

SEQ ID NO: 2098884 - protein, 6 aa, Staphylococcus
NGKNGW

SEQ ID NO: 2098885 - protein, 11 aa, Staphylococcus
NGKQVATRNEP

SEQ ID NO: 2098886 - protein, 6 aa, Staphylococcus
NGKTGW

SEQ ID NO: 2098887 - protein, 26 aa, Staphylococcus
NGKTSYQFGSSSPKDKVLKLYRIDIN

SEQ ID NO: 2098888 - protein, 26 aa, Staphylococcus
NGKTTYQFASNSPKDKNIKLYRIDIA

SEQ ID NO: 2098889 - protein, 4 aa, Staphylococcus
NGKV

SEQ ID NO: 2098890 - protein, 9 aa, Staphylococcus
NGKVGGRMN

SEQ ID NO: 2098891 - protein, 8 aa, Staphylococcus
NGLKPSKD

SEQ ID NO: 2098892 - protein, 9 aa, Staphylococcus
NGLKPSKDA

SEQ ID NO: 2098893 - protein, 8 aa, Staphylococcus
NGLNANNI

SEQ ID NO: 2098894 - protein, 7 aa, Staphylococcus
NGLPTDG

SEQ ID NO: 2098895 - protein, 7 aa, Staphylococcus
NGLTPHK

SEQ ID NO: 2098896 - protein, 13 aa, Staphylococcus
NGNAGKNASYLTS

SEQ ID NO: 2098897 - protein, 4 aa, Staphylococcus
NGNP

SEQ ID NO: 2098898 - protein, 9 aa, Staphylococcus
NGNPEEQEY

SEQ ID NO: 2098899 - protein, 7 aa, Staphylococcus
NGNPQKE

SEQ ID NO: 2098900 - protein, 30 aa, Staphylococcus
NGNPTVDDINTNTSASKDVTNALNQARQQL

SEQ ID NO: 2098901 - protein, 9 aa, Staphylococcus
NGNQSHGWI

SEQ ID NO: 2098902 - protein, 7 aa, Staphylococcus
NGNTQKE

SEQ ID NO: 2098903 - protein, 11 aa, Staphylococcus
NGPDINSTTVG

SEQ ID NO: 2098904 - protein, 4 aa, Staphylococcus
NGPV

SEQ ID NO: 2098905 - protein, 8 aa, Staphylococcus
NGQATTDF

SEQ ID NO: 2098906 - protein, 24 aa, Staphylococcus
NGQDIPNNSFTTINGSSIPSPQAI

SEQ ID NO: 2098907 - protein, 7 aa, Staphylococcus
NGQEDGN

SEQ ID NO: 2098908 - protein, 6 aa, Staphylococcus
NGQEHR

SEQ ID NO: 2098909 - protein, 15 aa, Staphylococcus
NGQGQPSIIEPAYQP

SEQ ID NO: 2098910 - protein, 4 aa, Staphylococcus
NGQH

SEQ ID NO: 2098911 - protein, 5 aa, Staphylococcus
NGQVD

SEQ ID NO: 2098912 - protein, 15 aa, Staphylococcus
NGQVEYKNDKYSNFN

SEQ ID NO: 2098913 - protein, 31 aa, Staphylococcus
NGSSQQNSGSNTTSNTGGQGGATHTVQAGES

SEQ ID NO: 2098914 - protein, 30 aa, Staphylococcus
NGSSTTTSSSLSSKASTTYTVQSGDSLSRI

SEQ ID NO: 2098915 - protein, 7 aa, Staphylococcus
NGTASLE

SEQ ID NO: 2098916 - protein, 6 aa, Staphylococcus
NGTPNA

SEQ ID NO: 2098917 - protein, 30 aa, Staphylococcus
NGTPSVADINSNTNEANIAKDALNQARQQL

SEQ ID NO: 2098918 - protein, 8 aa, Staphylococcus
NGTPTAAG

SEQ ID NO: 2098919 - protein, 4 aa, Staphylococcus
NGYA

SEQ ID NO: 2098920 - protein, 8 aa, Staphylococcus
NGYPGGRM

SEQ ID NO: 2098921 - protein, 7 aa, Staphylococcus
NGYTTDA

SEQ ID NO: 2098922 - protein, 17 aa, Staphylococcus
NGYYYDDPSSAKATSLK

SEQ ID NO: 2098923 - protein, 16 aa, Staphylococcus
NHADPKMKANSAGNIV

SEQ ID NO: 2098924 - protein, 18 aa, Staphylococcus
NHAEREGYTVTHSPKNHT

SEQ ID NO: 2098925 - protein, 4 aa, Staphylococcus
NHAK

SEQ ID NO: 2098926 - protein, 17 aa, Staphylococcus
NHAQSNTAQDRINNAQT

SEQ ID NO: 2098927 - protein, 9 aa, Staphylococcus
NHATDSKED

SEQ ID NO: 2098928 - protein, 5 aa, Staphylococcus
NHDGS

SEQ ID NO: 2098929 - protein, 12 aa, Staphylococcus
NHHPNNKDVKSL

SEQ ID NO: 2098930 - protein, 32 aa, Staphylococcus
NHHSEGKNEASKQDSNKQNQSHKKVKKDGKTY

SEQ ID NO: 2098931 - protein, 6 aa, Staphylococcus
NHIGGK

SEQ ID NO: 2098932 - protein, 8 aa, Staphylococcus
NHKNEIDL

SEQ ID NO: 2098933 - protein, 4 aa, Staphylococcus
NHNK

SEQ ID NO: 2098934 - protein, 55 aa, Staphylococcus
NHNNQAAAQNKQNSVPVSKVEKTNAAPTKNTVVPSNKVQAKPQIKANQNIQTAPK

SEQ ID NO: 2098935 - protein, 6 aa, Staphylococcus
NHPEQL

SEQ ID NO: 2098936 - protein, 7 aa, Staphylococcus
NHPISEK

SEQ ID NO: 2098937 - protein, 30 aa, Staphylococcus
NHPNEQSNATSNRSTFSTKSKAITTQNGDR

SEQ ID NO: 2098938 - protein, 4 aa, Staphylococcus
NHTI

SEQ ID NO: 2098939 - protein, 7 aa, Staphylococcus
NIAPKKA

SEQ ID NO: 2098940 - protein, 13 aa, Staphylococcus
NIAPSYRSATRHL

SEQ ID NO: 2098941 - protein, 14 aa, Staphylococcus
NIDLNNPRTYINSN

SEQ ID NO: 2098942 - protein, 8 aa, Staphylococcus
NIEAHPNA

SEQ ID NO: 2098943 - protein, 9 aa, Staphylococcus
NIENTYDGT

SEQ ID NO: 2098944 - protein, 25 aa, Staphylococcus
NIEPNAQQKPTAKQDIETKVTEQNR

SEQ ID NO: 2098945 - protein, 10 aa, Staphylococcus
NIEQHPNANV

SEQ ID NO: 2098946 - protein, 10 aa, Staphylococcus
NIEQHPSANV

SEQ ID NO: 2098947 - protein, 22 aa, Staphylococcus
NIKDVKKGAQVAIPNDVSNQAR

SEQ ID NO: 2098948 - protein, 4 aa, Staphylococcus
NIKN

SEQ ID NO: 2098949 - protein, 6 aa, Staphylococcus
NIKPAQ

SEQ ID NO: 2098950 - protein, 16 aa, Staphylococcus
NIKTETFNEDSNHIDI

SEQ ID NO: 2098951 - protein, 12 aa, Staphylococcus
NINERSKEFNKE

SEQ ID NO: 2098952 - protein, 6 aa, Staphylococcus
NINNEY

SEQ ID NO: 2098953 - protein, 7 aa, Staphylococcus
NINQRGN

SEQ ID NO: 2098954 - protein, 29 aa, Staphylococcus
NIPSGSGNGAGSGGTTVTPSNTNTTPTFN

SEQ ID NO: 2098955 - protein, 8 aa, Staphylococcus
NIPTPRQV

SEQ ID NO: 2098956 - protein, 12 aa, Staphylococcus
NIQAPKIEEDYT

SEQ ID NO: 2098957 - protein, 4 aa, Staphylococcus
NIQI

SEQ ID NO: 2098958 - protein, 5 aa, Staphylococcus
NIQTS

SEQ ID NO: 2098959 - protein, 10 aa, Staphylococcus
NITESTDQNV

SEQ ID NO: 2098960 - protein, 6 aa, Staphylococcus
NITGDH

SEQ ID NO: 2098961 - protein, 4 aa, Staphylococcus
NITH

SEQ ID NO: 2098962 - protein, 13 aa, Staphylococcus
NITSGTPDSQAAL

SEQ ID NO: 2098963 - protein, 9 aa, Staphylococcus
NKADGPTYK

SEQ ID NO: 2098964 - protein, 9 aa, Staphylococcus
NKADNSALV

SEQ ID NO: 2098965 - protein, 16 aa, Staphylococcus
NKAKAGLTADTEALQQ

SEQ ID NO: 2098966 - protein, 10 aa, Staphylococcus
NKANGPTYNA

SEQ ID NO: 2098967 - protein, 8 aa, Staphylococcus
NKANPGTF

SEQ ID NO: 2098968 - protein, 5 aa, Staphylococcus
NKAQT

SEQ ID NO: 2098969 - protein, 6 aa, Staphylococcus
NKATRE

SEQ ID NO: 2098970 - protein, 9 aa, Staphylococcus
NKDDLEEQV

SEQ ID NO: 2098971 - protein, 16 aa, Staphylococcus
NKDEHKNKMTKAREDI

SEQ ID NO: 2098972 - protein, 7 aa, Staphylococcus
NKDGEIL

SEQ ID NO: 2098973 - protein, 7 aa, Staphylococcus
NKDGKAY

SEQ ID NO: 2098974 - protein, 8 aa, Staphylococcus
NKDGSFDV

SEQ ID NO: 2098975 - protein, 8 aa, Staphylococcus
NKDLTSAL

SEQ ID NO: 2098976 - protein, 17 aa, Staphylococcus
NKDNQQAHDYDVKEAEK

SEQ ID NO: 2098977 - protein, 11 aa, Staphylococcus
NKDQQEEKDLS

SEQ ID NO: 2098978 - protein, 16 aa, Staphylococcus
NKDVINSVKDNTEKLG

SEQ ID NO: 2098979 - protein, 9 aa, Staphylococcus
NKEADNIKK

SEQ ID NO: 2098980 - protein, 15 aa, Staphylococcus
NKEDDFNKQKSQLKT

SEQ ID NO: 2098981 - protein, 9 aa, Staphylococcus
NKEGRTNQF

SEQ ID NO: 2098982 - protein, 16 aa, Staphylococcus
NKEKSSNKSNTPKVSK

SEQ ID NO: 2098983 - protein, 13 aa, Staphylococcus
NKENEAKKQIKDM

SEQ ID NO: 2098984 - protein, 11 aa, Staphylococcus
NKERSNYKDKV

SEQ ID NO: 2098985 - protein, 5 aa, Staphylococcus
NKEYE

SEQ ID NO: 2098986 - protein, 10 aa, Staphylococcus
NKFPDGYEEN

SEQ ID NO: 2098987 - protein, 4 aa, Staphylococcus
NKGT

SEQ ID NO: 2098988 - protein, 25 aa, Staphylococcus
NKGTPFALPNTPWKPLRASDSKGIA

SEQ ID NO: 2098989 - protein, 10 aa, Staphylococcus
NKGTTGNAAQ

SEQ ID NO: 2098990 - protein, 5 aa, Staphylococcus
NKGYY

SEQ ID NO: 2098991 - protein, 15 aa, Staphylococcus
NKIDATTKKDADQLL

SEQ ID NO: 2098992 - protein, 13 aa, Staphylococcus
NKIPSEYKDPTNR

SEQ ID NO: 2098993 - protein, 29 aa, Staphylococcus
NKISEYTKASNKIDKKSYELSKKDDASVL

SEQ ID NO: 2098994 - protein, 7 aa, Staphylococcus
NKKGEIL

SEQ ID NO: 2098995 - protein, 13 aa, Staphylococcus
NKKGRLPDGASLD

SEQ ID NO: 2098996 - protein, 7 aa, Staphylococcus
NKKGTWI

SEQ ID NO: 2098997 - protein, 5 aa, Staphylococcus
NKKGY

SEQ ID NO: 2098998 - protein, 21 aa, Staphylococcus
NKKMPDLDNYKANKDDYDSAF

SEQ ID NO: 2098999 - protein, 8 aa, Staphylococcus
NKLKQNDK

SEQ ID NO: 2099000 - protein, 28 aa, Staphylococcus
NKLTNEKNDLAKKINGKDTNKVVDTSKK

SEQ ID NO: 2099001 - protein, 151 aa, Staphylococcus
NKMKQTSTIENNDVQNEKNDSHNDNTSIDQINPNTTYSDDSDESNTNNLEKNSDKGSLQDDIDDVQSSEKSENDDIDNKSESNKLPVDKNQKKDDGESKQSSQQDQSYEEANNDADNLDNKDNDTPATENDNANSDNENADKSDTKSDDKV

SEQ ID NO: 2099002 - protein, 8 aa, Staphylococcus
NKNEIEDA

SEQ ID NO: 2099003 - protein, 12 aa, Staphylococcus
NKNELANSKSDQ

SEQ ID NO: 2099004 - protein, 12 aa, Staphylococcus
NKNELNQSKSNQ

SEQ ID NO: 2099005 - protein, 9 aa, Staphylococcus
NKNENSTGV

SEQ ID NO: 2099006 - protein, 27 aa, Staphylococcus
NKNESKVSQTEFDNSTRELKQATNNLS

SEQ ID NO: 2099007 - protein, 22 aa, Staphylococcus
NKNKISKGDKVVTSGLADQLPS

SEQ ID NO: 2099008 - protein, 6 aa, Staphylococcus
NKNTNV

SEQ ID NO: 2099009 - protein, 8 aa, Staphylococcus
NKPEQTFD

SEQ ID NO: 2099010 - protein, 19 aa, Staphylococcus
NKPESKSKVSNSVSQSKYN

SEQ ID NO: 2099011 - protein, 9 aa, Staphylococcus
NKPQTLEKC

SEQ ID NO: 2099012 - protein, 7 aa, Staphylococcus
NKQDGKI

SEQ ID NO: 2099013 - protein, 7 aa, Staphylococcus
NKQDQLR

SEQ ID NO: 2099014 - protein, 6 aa, Staphylococcus
NKQGDV

SEQ ID NO: 2099015 - protein, 11 aa, Staphylococcus
NKQGEQHKRAV

SEQ ID NO: 2099016 - protein, 19 aa, Staphylococcus
NKQLKEAVNKENAAVKVGE

SEQ ID NO: 2099017 - protein, 13 aa, Staphylococcus
NKQNETRKQKLQD

SEQ ID NO: 2099018 - protein, 7 aa, Staphylococcus
NKQSDGN

SEQ ID NO: 2099019 - protein, 17 aa, Staphylococcus
NKQSDSNSSSSKNTITV

SEQ ID NO: 2099020 - protein, 6 aa, Staphylococcus
NKRTQH

SEQ ID NO: 2099021 - protein, 7 aa, Staphylococcus
NKRTQHN

SEQ ID NO: 2099022 - protein, 9 aa, Staphylococcus
NKSGAGVGA

SEQ ID NO: 2099023 - protein, 8 aa, Staphylococcus
NKSGAHMT

SEQ ID NO: 2099024 - protein, 8 aa, Staphylococcus
NKSKQAQY

SEQ ID NO: 2099025 - protein, 12 aa, Staphylococcus
NKSQMQNSNSKQ

SEQ ID NO: 2099026 - protein, 9 aa, Staphylococcus
NKSSDEEML

SEQ ID NO: 2099027 - protein, 13 aa, Staphylococcus
NKTDPTQAPQGYE

SEQ ID NO: 2099028 - protein, 65 aa, Staphylococcus
NKTEQGQNNENKTENKSDHSIITDSDEEKTSTSQNESHTDITNNQEDELSNTHENNKLSQDDNEV

SEQ ID NO: 2099029 - protein, 7 aa, Staphylococcus
NKTGKYD

SEQ ID NO: 2099030 - protein, 5 aa, Staphylococcus
NKTHP

SEQ ID NO: 2099031 - protein, 13 aa, Staphylococcus
NKTKKDDKNQNFE

SEQ ID NO: 2099032 - protein, 7 aa, Staphylococcus
NKTNTNL

SEQ ID NO: 2099033 - protein, 19 aa, Staphylococcus
NKTYGKDLQKVNNQKHNTT

SEQ ID NO: 2099034 - protein, 4 aa, Staphylococcus
NKVA

SEQ ID NO: 2099035 - protein, 8 aa, Staphylococcus
NKVDGHSL

SEQ ID NO: 2099036 - protein, 24 aa, Staphylococcus
NKVDGTYKNDEMSIKASKDSDRAT

SEQ ID NO: 2099037 - protein, 10 aa, Staphylococcus
NKVEQKHGNA

SEQ ID NO: 2099038 - protein, 9 aa, Staphylococcus
NKVGGTYVN

SEQ ID NO: 2099039 - protein, 11 aa, Staphylococcus
NKVISQSTIST

SEQ ID NO: 2099040 - protein, 8 aa, Staphylococcus
NKYGTSVT

SEQ ID NO: 2099041 - protein, 11 aa, Staphylococcus
NKYNTNNPERI

SEQ ID NO: 2099042 - protein, 98 aa, Staphylococcus
NLATTQQTSQDQQSTQNQSTANTSATNSNSELAKVQDNEQEVSTSNKSDQTTNINNTHSNTDANKQTLQASKNALSSSQVQSNDDTSANSNQNTTQYV

SEQ ID NO: 2099043 - protein, 7 aa, Staphylococcus
NLAYGQQ

SEQ ID NO: 2099044 - protein, 21 aa, Staphylococcus
NLDEEQKVKGTYTVNQNNNGL

SEQ ID NO: 2099045 - protein, 11 aa, Staphylococcus
NLDGESPFDRL

SEQ ID NO: 2099046 - protein, 12 aa, Staphylococcus
NLDKSLSSNVKE

SEQ ID NO: 2099047 - protein, 6 aa, Staphylococcus
NLEQNG

SEQ ID NO: 2099048 - protein, 6 aa, Staphylococcus
NLESEA

SEQ ID NO: 2099049 - protein, 13 aa, Staphylococcus
NLESKEDSETDKI

SEQ ID NO: 2099050 - protein, 8 aa, Staphylococcus
NLGGSTGY

SEQ ID NO: 2099051 - protein, 9 aa, Staphylococcus
NLHDSSNVE

SEQ ID NO: 2099052 - protein, 12 aa, Staphylococcus
NLKSDSISKGQT

SEQ ID NO: 2099053 - protein, 11 aa, Staphylococcus
NLKSNSLSVGQ

SEQ ID NO: 2099054 - protein, 13 aa, Staphylococcus
NLNGEQRLQDSKL

SEQ ID NO: 2099055 - protein, 11 aa, Staphylococcus
NLNKDEVKKDT

SEQ ID NO: 2099056 - protein, 17 aa, Staphylococcus
NLNPAQKAALKEQVNQA

SEQ ID NO: 2099057 - protein, 12 aa, Staphylococcus
NLQAPKIEENYS

SEQ ID NO: 2099058 - protein, 20 aa, Staphylococcus
NLQNRGEEISNTFSEDKNNN

SEQ ID NO: 2099059 - protein, 10 aa, Staphylococcus
NLREKGKDEL

SEQ ID NO: 2099060 - protein, 17 aa, Staphylococcus
NLSDKSEKVLKQFTELM

SEQ ID NO: 2099061 - protein, 8 aa, Staphylococcus
NLSEGNMN

SEQ ID NO: 2099062 - protein, 4 aa, Staphylococcus
NLSG

SEQ ID NO: 2099063 - protein, 14 aa, Staphylococcus
NLSKTDTTDKNKKE

SEQ ID NO: 2099064 - protein, 23 aa, Staphylococcus
NLSSNTTNSSLTNVNESARNGVP

SEQ ID NO: 2099065 - protein, 9 aa, Staphylococcus
NLTGERHTT

SEQ ID NO: 2099066 - protein, 4 aa, Staphylococcus
NLTT

SEQ ID NO: 2099067 - protein, 5 aa, Staphylococcus
NLYTA

SEQ ID NO: 2099068 - protein, 16 aa, Staphylococcus
NMGNSYTNSGNSSNYV

SEQ ID NO: 2099069 - protein, 7 aa, Staphylococcus
NMPNTTI

SEQ ID NO: 2099070 - protein, 7 aa, Staphylococcus
NMTKERL

SEQ ID NO: 2099071 - protein, 4 aa, Staphylococcus
NNAH

SEQ ID NO: 2099072 - protein, 10 aa, Staphylococcus
NNAKQEALDN

SEQ ID NO: 2099073 - protein, 15 aa, Staphylococcus
NNANASTTKNPTDKV

SEQ ID NO: 2099074 - protein, 16 aa, Staphylococcus
NNANQNDHTYAPAEAQ

SEQ ID NO: 2099075 - protein, 4 aa, Staphylococcus
NNAT

SEQ ID NO: 2099076 - protein, 36 aa, Staphylococcus
NNAVATTNTQSKSQAATGTKDQTNKVAKQAQYKNQD

SEQ ID NO: 2099077 - protein, 5 aa, Staphylococcus
NNDDL

SEQ ID NO: 2099078 - protein, 26 aa, Staphylococcus
NNDFPKSKYINEKGAKRVGSEDVEGV

SEQ ID NO: 2099079 - protein, 19 aa, Staphylococcus
NNDQQFNSSQKDAKDKQLK

SEQ ID NO: 2099080 - protein, 5 aa, Staphylococcus
NNDSL

SEQ ID NO: 2099081 - protein, 7 aa, Staphylococcus
NNDSVNE

SEQ ID NO: 2099082 - protein, 6 aa, Staphylococcus
NNDSYI

SEQ ID NO: 2099083 - protein, 80 aa, Staphylococcus
NNEASENNEPKEKSENTDNTSNSDKDKSENNKDNSKQNEQKTEQQNTNTNNDGRNQSAQDKNETTDEDEGALNQYNNEEI

SEQ ID NO: 2099084 - protein, 5 aa, Staphylococcus
NNEKK

SEQ ID NO: 2099085 - protein, 18 aa, Staphylococcus
NNENKKGNLIGNKTKKRN

SEQ ID NO: 2099086 - protein, 5 aa, Staphylococcus
NNENY

SEQ ID NO: 2099087 - protein, 5 aa, Staphylococcus
NNFSV

SEQ ID NO: 2099088 - protein, 16 aa, Staphylococcus
NNGDGTITTYGTPSHF

SEQ ID NO: 2099089 - protein, 60 aa, Staphylococcus
NNGDSSSDSKGASKVEDTQKSEDSKKGNDSKSSSSKESSNQSSKSKQSSTNDISNLSEKE

SEQ ID NO: 2099090 - protein, 5 aa, Staphylococcus
NNGGG

SEQ ID NO: 2099091 - protein, 33 aa, Staphylococcus
NNGGSKEDKNKIKQLEAKNQKLETENKKFKKEL

SEQ ID NO: 2099092 - protein, 16 aa, Staphylococcus
NNGHYYDEPSAKNGYS

SEQ ID NO: 2099093 - protein, 6 aa, Staphylococcus
NNGSIK

SEQ ID NO: 2099094 - protein, 4 aa, Staphylococcus
NNHG

SEQ ID NO: 2099095 - protein, 7 aa, Staphylococcus
NNHIGGK

SEQ ID NO: 2099096 - protein, 47 aa, Staphylococcus
NNIDNADTDAQVDSAVTTGTQTINSITPATTVKTNAKNEIAKKAESI

SEQ ID NO: 2099097 - protein, 7 aa, Staphylococcus
NNIEERH

SEQ ID NO: 2099098 - protein, 7 aa, Staphylococcus
NNKARDF

SEQ ID NO: 2099099 - protein, 23 aa, Staphylococcus
NNKDKISKGDKVVTSGLADQLPS

SEQ ID NO: 2099100 - protein, 23 aa, Staphylococcus
NNKDSIKKGDKVVTSGLADQLPS

SEQ ID NO: 2099101 - protein, 23 aa, Staphylococcus
NNKDSISKGDKVVTSGLADQLPS

SEQ ID NO: 2099102 - protein, 22 aa, Staphylococcus
NNKDSVKKGDKVVTSGLADQLP

SEQ ID NO: 2099103 - protein, 23 aa, Staphylococcus
NNKNKISAGDKVVTSGLGDQLPS

SEQ ID NO: 2099104 - protein, 10 aa, Staphylococcus
NNKSGAGVGT

SEQ ID NO: 2099105 - protein, 16 aa, Staphylococcus
NNKTTNNQTSYKFTPQ

SEQ ID NO: 2099106 - protein, 16 aa, Staphylococcus
NNLDTDTKNNQQKQKL

SEQ ID NO: 2099107 - protein, 7 aa, Staphylococcus
NNLSKEN

SEQ ID NO: 2099108 - protein, 101 aa, Staphylococcus
NNMTDEEKAKRKQMNESKLEQSNRQRNNDVQNNETQHTSSNEENQNSAQSETQNDVQTSNQSENNDSTSTDASTQTKEEPTTSQIDRNEQAQPNHQSTNNE

SEQ ID NO: 2099109 - protein, 15 aa, Staphylococcus
NNNATTEEKDDAKNL

SEQ ID NO: 2099110 - protein, 4 aa, Staphylococcus
NNNI

SEQ ID NO: 2099111 - protein, 7 aa, Staphylococcus
NNNKDQV

SEQ ID NO: 2099112 - protein, 5 aa, Staphylococcus
NNNMT

SEQ ID NO: 2099113 - protein, 39 aa, Staphylococcus
NNNQKDNQSDKDESGSKNSQNTNQVKQIATDKNVQGDNY

SEQ ID NO: 2099114 - protein, 5 aa, Staphylococcus
NNPDE

SEQ ID NO: 2099115 - protein, 7 aa, Staphylococcus
NNPKGSV

SEQ ID NO: 2099116 - protein, 14 aa, Staphylococcus
NNQMPNKEYEQYTK

SEQ ID NO: 2099117 - protein, 23 aa, Staphylococcus
NNQPTVQATQNYLDTDQPKQTDY

SEQ ID NO: 2099118 - protein, 5 aa, Staphylococcus
NNQTG

SEQ ID NO: 2099119 - protein, 6 aa, Staphylococcus
NNRRTE

SEQ ID NO: 2099120 - protein, 6 aa, Staphylococcus
NNRTQH

SEQ ID NO: 2099121 - protein, 8 aa, Staphylococcus
NNSISEVS

SEQ ID NO: 2099122 - protein, 7 aa, Staphylococcus
NNSKAAS

SEQ ID NO: 2099123 - protein, 14 aa, Staphylococcus
NNSPDKNNTRIGES

SEQ ID NO: 2099124 - protein, 59 aa, Staphylococcus
NNSSEKSEHTTSQSNQSSNKNTSDNHKNNTQQDSNKSSNDSNQRENKTNSNIDNLSQAE

SEQ ID NO: 2099125 - protein, 26 aa, Staphylococcus
NNTGKWTKASDSINTPGLSVSPDGNE

SEQ ID NO: 2099126 - protein, 53 aa, Staphylococcus
NNTHVNNKATTSTQSNDASVSDSTSSVHKGIGGKGGPATVSTYSTTSSLPKYV

SEQ ID NO: 2099127 - protein, 36 aa, Staphylococcus
NNTLGQVAKKNNGAYTTVYDSSGKINPSINGNTYRV

SEQ ID NO: 2099128 - protein, 12 aa, Staphylococcus
NNTLPDGYKDNV

SEQ ID NO: 2099129 - protein, 13 aa, Staphylococcus
NNTLPKGYEANTE

SEQ ID NO: 2099130 - protein, 14 aa, Staphylococcus
NNTLPSGYNENTER

SEQ ID NO: 2099131 - protein, 16 aa, Staphylococcus
NNTSPWTKETSAQNVT

SEQ ID NO: 2099132 - protein, 6 aa, Staphylococcus
NNTTFP

SEQ ID NO: 2099133 - protein, 9 aa, Staphylococcus
NNTTYNTSN

SEQ ID NO: 2099134 - protein, 7 aa, Staphylococcus
NNVPNNA

SEQ ID NO: 2099135 - protein, 4 aa, Staphylococcus
NNVT

SEQ ID NO: 2099136 - protein, 20 aa, Staphylococcus
NNWASAAQQSGYQVNNTPEV

SEQ ID NO: 2099137 - protein, 11 aa, Staphylococcus
NNWASSARNAG

SEQ ID NO: 2099138 - protein, 7 aa, Staphylococcus
NNYADYA

SEQ ID NO: 2099139 - protein, 21 aa, Staphylococcus
NNYELSGKDPKGSDAKQVKNT

SEQ ID NO: 2099140 - protein, 7 aa, Staphylococcus
NNYKDKQ

SEQ ID NO: 2099141 - protein, 5 aa, Staphylococcus
NNYKN

SEQ ID NO: 2099142 - protein, 29 aa, Staphylococcus
NNYQPSSKENASDFKPFAESTSDSPYPHG

SEQ ID NO: 2099143 - protein, 5 aa, Staphylococcus
NNYWD

SEQ ID NO: 2099144 - protein, 31 aa, Staphylococcus
NPAGAANDLLGQQAPKKYRKDIYPKSTSEDI

SEQ ID NO: 2099145 - protein, 9 aa, Staphylococcus
NPAGAQNSL

SEQ ID NO: 2099146 - protein, 7 aa, Staphylococcus
NPATSKG

SEQ ID NO: 2099147 - protein, 9 aa, Staphylococcus
NPDGSRGTM

SEQ ID NO: 2099148 - protein, 20 aa, Staphylococcus
NPDKIKQQQQAQSGGSAAGL

SEQ ID NO: 2099149 - protein, 9 aa, Staphylococcus
NPDKKKTEI

SEQ ID NO: 2099150 - protein, 11 aa, Staphylococcus
NPDQPGTHQYA

SEQ ID NO: 2099151 - protein, 7 aa, Staphylococcus
NPDTASE

SEQ ID NO: 2099152 - protein, 23 aa, Staphylococcus
NPEKGKANVNNKTFANDRVGAGN

SEQ ID NO: 2099153 - protein, 12 aa, Staphylococcus
NPENPGKHQYAT

SEQ ID NO: 2099154 - protein, 10 aa, Staphylococcus
NPENPGTHQY

SEQ ID NO: 2099155 - protein, 9 aa, Staphylococcus
NPENPGVHQ

SEQ ID NO: 2099156 - protein, 7 aa, Staphylococcus
NPFTKDP

SEQ ID NO: 2099157 - protein, 27 aa, Staphylococcus
NPKKAKNMKEDAVKTNKVEIDGKTNKY

SEQ ID NO: 2099158 - protein, 8 aa, Staphylococcus
NPKQQGTY

SEQ ID NO: 2099159 - protein, 7 aa, Staphylococcus
NPKTGSE

SEQ ID NO: 2099160 - protein, 8 aa, Staphylococcus
NPKTGSEY

SEQ ID NO: 2099161 - protein, 8 aa, Staphylococcus
NPKYETQL

SEQ ID NO: 2099162 - protein, 48 aa, Staphylococcus
NPKYSKDEIDHMSESEKESKKATENLGLNPSHDGETKPEKIAESSPAY

SEQ ID NO: 2099163 - protein, 48 aa, Staphylococcus
NPKYTKKEIDKMSEKEKESNKASENLGLNPSHKGEDDPEKIAEQSPAY

SEQ ID NO: 2099164 - protein, 6 aa, Staphylococcus
NPKYWD

SEQ ID NO: 2099165 - protein, 8 aa, Staphylococcus
NPLEPTKE

SEQ ID NO: 2099166 - protein, 26 aa, Staphylococcus
NPNHQSQSSNIAVNKTGKIEALSNNA

SEQ ID NO: 2099167 - protein, 15 aa, Staphylococcus
NPPYGERIGDRDKVE

SEQ ID NO: 2099168 - protein, 14 aa, Staphylococcus
NPPYGERIGDREEV

SEQ ID NO: 2099169 - protein, 6 aa, Staphylococcus
NPRTQH

SEQ ID NO: 2099170 - protein, 11 aa, Staphylococcus
NPSSPGNHQYA

SEQ ID NO: 2099171 - protein, 6 aa, Staphylococcus
NPSVSL

SEQ ID NO: 2099172 - protein, 15 aa, Staphylococcus
NPTTKKLTYGTGTAI

SEQ ID NO: 2099173 - protein, 14 aa, Staphylococcus
NPTVGSIAQTDAGY

SEQ ID NO: 2099174 - protein, 17 aa, Staphylococcus
NPVKDSVKDLMGRDKKS

SEQ ID NO: 2099175 - protein, 11 aa, Staphylococcus
NPVKRKQAINE

SEQ ID NO: 2099176 - protein, 4 aa, Staphylococcus
NPVY

SEQ ID NO: 2099177 - protein, 38 aa, Staphylococcus
NPYNANNSVKFPEGTQTLSGSPTAAGSVTYSNNGDGTI

SEQ ID NO: 2099178 - protein, 14 aa, Staphylococcus
NQAGPNKNKAQVEE

SEQ ID NO: 2099179 - protein, 13 aa, Staphylococcus
NQAIDAEKDGEPI

SEQ ID NO: 2099180 - protein, 9 aa, Staphylococcus
NQAKNGELV

SEQ ID NO: 2099181 - protein, 19 aa, Staphylococcus
NQANGPSYKSVKNEFGNKA

SEQ ID NO: 2099182 - protein, 12 aa, Staphylococcus
NQANKEADNLKK

SEQ ID NO: 2099183 - protein, 16 aa, Staphylococcus
NQAQATDTTGMTQDSI

SEQ ID NO: 2099184 - protein, 11 aa, Staphylococcus
NQAQKARLTDN

SEQ ID NO: 2099185 - protein, 9 aa, Staphylococcus
NQAQPGTYT

SEQ ID NO: 2099186 - protein, 6 aa, Staphylococcus
NQDGSV

SEQ ID NO: 2099187 - protein, 7 aa, Staphylococcus
NQDLTDL

SEQ ID NO: 2099188 - protein, 8 aa, Staphylococcus
NQDMTEPK

SEQ ID NO: 2099189 - protein, 15 aa, Staphylococcus
NQDMTEPTIHFWEKI

SEQ ID NO: 2099190 - protein, 6 aa, Staphylococcus
NQDMTQ

SEQ ID NO: 2099191 - protein, 5 aa, Staphylococcus
NQDSA

SEQ ID NO: 2099192 - protein, 18 aa, Staphylococcus
NQDSSLKNNTLKTPTEQD

SEQ ID NO: 2099193 - protein, 25 aa, Staphylococcus
NQEASKVSGSGNQTFKATKQQQIDK

SEQ ID NO: 2099194 - protein, 7 aa, Staphylococcus
NQELDRK

SEQ ID NO: 2099195 - protein, 7 aa, Staphylococcus
NQEQIEK

SEQ ID NO: 2099196 - protein, 5 aa, Staphylococcus
NQFSS

SEQ ID NO: 2099197 - protein, 9 aa, Staphylococcus
NQGNTATGT

SEQ ID NO: 2099198 - protein, 8 aa, Staphylococcus
NQGQATWD

SEQ ID NO: 2099199 - protein, 7 aa, Staphylococcus
NQIEGHS

SEQ ID NO: 2099200 - protein, 7 aa, Staphylococcus
NQISGHS

SEQ ID NO: 2099201 - protein, 29 aa, Staphylococcus
NQKANEAKNNIQTATDNEGVAQAKTNGIS

SEQ ID NO: 2099202 - protein, 16 aa, Staphylococcus
NQKGEASVLDPAYNGQ

SEQ ID NO: 2099203 - protein, 11 aa, Staphylococcus
NQKLSNTEANK

SEQ ID NO: 2099204 - protein, 4 aa, Staphylococcus
NQKY

SEQ ID NO: 2099205 - protein, 6 aa, Staphylococcus
NQMPNN

SEQ ID NO: 2099206 - protein, 33 aa, Staphylococcus
NQNDSKDEHKKETSEKTSQKKEASQDESGEGFK

SEQ ID NO: 2099207 - protein, 12 aa, Staphylococcus
NQNNEATHEEKN

SEQ ID NO: 2099208 - protein, 5 aa, Staphylococcus
NQPLN

SEQ ID NO: 2099209 - protein, 12 aa, Staphylococcus
NQPPVQAMTEAA

SEQ ID NO: 2099210 - protein, 7 aa, Staphylococcus
NQQGTEH

SEQ ID NO: 2099211 - protein, 4 aa, Staphylococcus
NQQN

SEQ ID NO: 2099212 - protein, 9 aa, Staphylococcus
NQQNQQQSN

SEQ ID NO: 2099213 - protein, 6 aa, Staphylococcus
NQSKQP

SEQ ID NO: 2099214 - protein, 11 aa, Staphylococcus
NQSNATPVSTK

SEQ ID NO: 2099215 - protein, 12 aa, Staphylococcus
NQSSYKDTTKKL

SEQ ID NO: 2099216 - protein, 11 aa, Staphylococcus
NQSTKQSISQQ

SEQ ID NO: 2099217 - protein, 6 aa, Staphylococcus
NQTRKY

SEQ ID NO: 2099218 - protein, 16 aa, Staphylococcus
NQTTEGVNNSKQALQG

SEQ ID NO: 2099219 - protein, 6 aa, Staphylococcus
NQVDQS

SEQ ID NO: 2099220 - protein, 8 aa, Staphylococcus
NQVDQSDV

SEQ ID NO: 2099221 - protein, 8 aa, Staphylococcus
NQVDQSKV

SEQ ID NO: 2099222 - protein, 8 aa, Staphylococcus
NQVDQSPI

SEQ ID NO: 2099223 - protein, 9 aa, Staphylococcus
NQVKGNTAA

SEQ ID NO: 2099224 - protein, 22 aa, Staphylococcus
NQVPTRDEVAQKVAQAEALDQS

SEQ ID NO: 2099225 - protein, 11 aa, Staphylococcus
NQYEVEDAEQK

SEQ ID NO: 2099226 - protein, 12 aa, Staphylococcus
NQYYNEAKSGEL

SEQ ID NO: 2099227 - protein, 7 aa, Staphylococcus
NRAPKAS

SEQ ID NO: 2099228 - protein, 10 aa, Staphylococcus
NRATGQVQTQ

SEQ ID NO: 2099229 - protein, 17 aa, Staphylococcus
NRATREGYQVSSTPKKH

SEQ ID NO: 2099230 - protein, 5 aa, Staphylococcus
NRAYQ

SEQ ID NO: 2099231 - protein, 27 aa, Staphylococcus
NRDDHSVKHNTIDASQPTGAQSELERE

SEQ ID NO: 2099232 - protein, 7 aa, Staphylococcus
NRDDLQD

SEQ ID NO: 2099233 - protein, 7 aa, Staphylococcus
NRDGSRM

SEQ ID NO: 2099234 - protein, 10 aa, Staphylococcus
NREGDGYPGF

SEQ ID NO: 2099235 - protein, 10 aa, Staphylococcus
NREGTPTNGV

SEQ ID NO: 2099236 - protein, 11 aa, Staphylococcus
NREVSKDSRSF

SEQ ID NO: 2099237 - protein, 4 aa, Staphylococcus
NRKF

SEQ ID NO: 2099238 - protein, 11 aa, Staphylococcus
NRKGDGYPGFK

SEQ ID NO: 2099239 - protein, 21 aa, Staphylococcus
NRNESRGAHYKPEFPERNDEE

SEQ ID NO: 2099240 - protein, 4 aa, Staphylococcus
NRNG

SEQ ID NO: 2099241 - protein, 6 aa, Staphylococcus
NRNGAD

SEQ ID NO: 2099242 - protein, 9 aa, Staphylococcus
NRNPEEIEY

SEQ ID NO: 2099243 - protein, 7 aa, Staphylococcus
NRNTGDV

SEQ ID NO: 2099244 - protein, 4 aa, Staphylococcus
NRPR

SEQ ID NO: 2099245 - protein, 7 aa, Staphylococcus
NRSSGKI

SEQ ID NO: 2099246 - protein, 14 aa, Staphylococcus
NRTGTTSGMRPASI

SEQ ID NO: 2099247 - protein, 13 aa, Staphylococcus
NRTITNTSSYNFI

SEQ ID NO: 2099248 - protein, 13 aa, Staphylococcus
NRTIYNSSSYNFI

SEQ ID NO: 2099249 - protein, 8 aa, Staphylococcus
NRVEGTFN

SEQ ID NO: 2099250 - protein, 11 aa, Staphylococcus
NSAKKKEVTQL

SEQ ID NO: 2099251 - protein, 18 aa, Staphylococcus
NSATMNQAVTSAKNEGIN

SEQ ID NO: 2099252 - protein, 5 aa, Staphylococcus
NSCQD

SEQ ID NO: 2099253 - protein, 7 aa, Staphylococcus
NSDGTNW

SEQ ID NO: 2099254 - protein, 19 aa, Staphylococcus
NSDKSGETLSEAEAKKAIK

SEQ ID NO: 2099255 - protein, 6 aa, Staphylococcus
NSDMSD

SEQ ID NO: 2099256 - protein, 8 aa, Staphylococcus
NSEDIRAE

SEQ ID NO: 2099257 - protein, 6 aa, Staphylococcus
NSEEKP

SEQ ID NO: 2099258 - protein, 7 aa, Staphylococcus
NSENVEE

SEQ ID NO: 2099259 - protein, 10 aa, Staphylococcus
NSERKQHGLN

SEQ ID NO: 2099260 - protein, 32 aa, Staphylococcus
NSEVTSEKEKVKALEKDKNNKKQAASNNQEAK

SEQ ID NO: 2099261 - protein, 31 aa, Staphylococcus
NSFSASGNDESSNEGKKISNTVKVPKNPKNA

SEQ ID NO: 2099262 - protein, 33 aa, Staphylococcus
NSGDSKDNKAKIKQLEAENEQLKADNKKYKKEL

SEQ ID NO: 2099263 - protein, 8 aa, Staphylococcus
NSGDYKKY

SEQ ID NO: 2099264 - protein, 11 aa, Staphylococcus
NSGGIVSSEPL

SEQ ID NO: 2099265 - protein, 15 aa, Staphylococcus
NSGIKSLKDLKGKKI

SEQ ID NO: 2099266 - protein, 15 aa, Staphylococcus
NSGINSLKDLKGKKI

SEQ ID NO: 2099267 - protein, 9 aa, Staphylococcus
NSGKIDGAS

SEQ ID NO: 2099268 - protein, 16 aa, Staphylococcus
NSGSKDSAVKDKTVRQ

SEQ ID NO: 2099269 - protein, 7 aa, Staphylococcus
NSGSSYL

SEQ ID NO: 2099270 - protein, 4 aa, Staphylococcus
NSHL

SEQ ID NO: 2099271 - protein, 8 aa, Staphylococcus
NSISNPKE

SEQ ID NO: 2099272 - protein, 4 aa, Staphylococcus
NSKD

SEQ ID NO: 2099273 - protein, 11 aa, Staphylococcus
NSKDKDNKTYK

SEQ ID NO: 2099274 - protein, 10 aa, Staphylococcus
NSKEIKNYSI

SEQ ID NO: 2099275 - protein, 4 aa, Staphylococcus
NSKG

SEQ ID NO: 2099276 - protein, 18 aa, Staphylococcus
NSKPIKKKSLKLPKGKKP

SEQ ID NO: 2099277 - protein, 8 aa, Staphylococcus
NSKWPDKK

SEQ ID NO: 2099278 - protein, 5 aa, Staphylococcus
NSLDG

SEQ ID NO: 2099279 - protein, 5 aa, Staphylococcus
NSLEN

SEQ ID NO: 2099280 - protein, 17 aa, Staphylococcus
NSLKSVDDKASYKETIN

SEQ ID NO: 2099281 - protein, 18 aa, Staphylococcus
NSNDNHERAKDHSNTKAM

SEQ ID NO: 2099282 - protein, 7 aa, Staphylococcus
NSNNDEN

SEQ ID NO: 2099283 - protein, 5 aa, Staphylococcus
NSNNL

SEQ ID NO: 2099284 - protein, 39 aa, Staphylococcus
NSNPTVDQINTNTTAANDAKTELNNARSNLTPDQAPLQQ

SEQ ID NO: 2099285 - protein, 5 aa, Staphylococcus
NSNQI

SEQ ID NO: 2099286 - protein, 16 aa, Staphylococcus
NSNSPHAKELNDLEKK

SEQ ID NO: 2099287 - protein, 16 aa, Staphylococcus
NSNSSHAKELNDLEKK

SEQ ID NO: 2099288 - protein, 5 aa, Staphylococcus
NSQDH

SEQ ID NO: 2099289 - protein, 14 aa, Staphylococcus
NSQGQPVVVDPAYG

SEQ ID NO: 2099290 - protein, 4 aa, Staphylococcus
NSQN

SEQ ID NO: 2099291 - protein, 19 aa, Staphylococcus
NSQNYADANPDKKQAFDQA

SEQ ID NO: 2099292 - protein, 21 aa, Staphylococcus
NSQNYQDASPDNKANYTSAVQ

SEQ ID NO: 2099293 - protein, 7 aa, Staphylococcus
NSQTGHE

SEQ ID NO: 2099294 - protein, 14 aa, Staphylococcus
NSQYTSDTATKTIY

SEQ ID NO: 2099295 - protein, 6 aa, Staphylococcus
NSRDTF

SEQ ID NO: 2099296 - protein, 21 aa, Staphylococcus
NSRPKPGSKVKKNSDLYNNAK

SEQ ID NO: 2099297 - protein, 7 aa, Staphylococcus
NSSAPKL

SEQ ID NO: 2099298 - protein, 9 aa, Staphylococcus
NSSSGAAGK

SEQ ID NO: 2099299 - protein, 6 aa, Staphylococcus
NSSYDQ

SEQ ID NO: 2099300 - protein, 29 aa, Staphylococcus
NSTDKYAKQEIAGGESFKGKAGQFIKDNI

SEQ ID NO: 2099301 - protein, 8 aa, Staphylococcus
NSTFSTDG

SEQ ID NO: 2099302 - protein, 7 aa, Staphylococcus
NSTTNYA

SEQ ID NO: 2099303 - protein, 11 aa, Staphylococcus
NSVPKDAKSQK

SEQ ID NO: 2099304 - protein, 6 aa, Staphylococcus
NSVSGN

SEQ ID NO: 2099305 - protein, 9 aa, Staphylococcus
NSWDNNSEN

SEQ ID NO: 2099306 - protein, 9 aa, Staphylococcus
NTAKDNLDK

SEQ ID NO: 2099307 - protein, 5 aa, Staphylococcus
NTAKS

SEQ ID NO: 2099308 - protein, 20 aa, Staphylococcus
NTAKSPVKVNQSYSVKPGTK

SEQ ID NO: 2099309 - protein, 15 aa, Staphylococcus
NTDNQKALKTLTPEE

SEQ ID NO: 2099310 - protein, 46 aa, Staphylococcus
NTDNSTDHKNDKAENPTKKDKNNKASNKDESMTKNKDDKHTQTTLE

SEQ ID NO: 2099311 - protein, 13 aa, Staphylococcus
NTDYSFQSDGENF

SEQ ID NO: 2099312 - protein, 10 aa, Staphylococcus
NTEDTPDAKI

SEQ ID NO: 2099313 - protein, 13 aa, Staphylococcus
NTEDTPDAKISAE

SEQ ID NO: 2099314 - protein, 14 aa, Staphylococcus
NTENGKAYQHNADE

SEQ ID NO: 2099315 - protein, 20 aa, Staphylococcus
NTESTTGNGELTSEAAISAT

SEQ ID NO: 2099316 - protein, 4 aa, Staphylococcus
NTEY

SEQ ID NO: 2099317 - protein, 5 aa, Staphylococcus
NTGDE

SEQ ID NO: 2099318 - protein, 11 aa, Staphylococcus
NTGNKQVDKNT

SEQ ID NO: 2099319 - protein, 9 aa, Staphylococcus
NTIKPNSDI

SEQ ID NO: 2099320 - protein, 11 aa, Staphylococcus
NTITGNNSPVY

SEQ ID NO: 2099321 - protein, 8 aa, Staphylococcus
NTKDGIKP

SEQ ID NO: 2099322 - protein, 6 aa, Staphylococcus
NTKDVD

SEQ ID NO: 2099323 - protein, 20 aa, Staphylococcus
NTKDVDALKDKKKAHDTYNY

SEQ ID NO: 2099324 - protein, 16 aa, Staphylococcus
NTKDVDALKDNVHDTY

SEQ ID NO: 2099325 - protein, 21 aa, Staphylococcus
NTKDVDGLVDKDKAQNTYEYA

SEQ ID NO: 2099326 - protein, 20 aa, Staphylococcus
NTKDVDQLKDKKKAHDTYNY

SEQ ID NO: 2099327 - protein, 9 aa, Staphylococcus
NTLAPYDTD

SEQ ID NO: 2099328 - protein, 12 aa, Staphylococcus
NTLPKDYNKETL

SEQ ID NO: 2099329 - protein, 20 aa, Staphylococcus
NTNDNKKSKDNPDEKAIGKE

SEQ ID NO: 2099330 - protein, 20 aa, Staphylococcus
NTNDNKKSKDNPDEKAIGKQ

SEQ ID NO: 2099331 - protein, 6 aa, Staphylococcus
NTNGQY

SEQ ID NO: 2099332 - protein, 28 aa, Staphylococcus
NTNKDLADNITDLGSETKLNKKDQKKLN

SEQ ID NO: 2099333 - protein, 9 aa, Staphylococcus
NTNQANTTD

SEQ ID NO: 2099334 - protein, 5 aa, Staphylococcus
NTPDY

SEQ ID NO: 2099335 - protein, 13 aa, Staphylococcus
NTPGGGTYPSDEI

SEQ ID NO: 2099336 - protein, 16 aa, Staphylococcus
NTPGYAEQSAPTSYRY

SEQ ID NO: 2099337 - protein, 7 aa, Staphylococcus
NTPKNTY

SEQ ID NO: 2099338 - protein, 8 aa, Staphylococcus
NTPSSVAQ

SEQ ID NO: 2099339 - protein, 23 aa, Staphylococcus
NTQSDNGGVHTNSGIPNKAAYNT

SEQ ID NO: 2099340 - protein, 4 aa, Staphylococcus
NTRH

SEQ ID NO: 2099341 - protein, 6 aa, Staphylococcus
NTRQFE

SEQ ID NO: 2099342 - protein, 8 aa, Staphylococcus
NTRTTKGN

SEQ ID NO: 2099343 - protein, 30 aa, Staphylococcus
NTSSSGVERGNNHSLDTHTPENNTVNLLPI

SEQ ID NO: 2099344 - protein, 10 aa, Staphylococcus
NTTASHSEQW

SEQ ID NO: 2099345 - protein, 38 aa, Staphylococcus
NTTLKKEIKDDYKQENSKSWVAAKKDQKQYKDNHIETA

SEQ ID NO: 2099346 - protein, 7 aa, Staphylococcus
NTTLSDI

SEQ ID NO: 2099347 - protein, 5 aa, Staphylococcus
NTTQH

SEQ ID NO: 2099348 - protein, 7 aa, Staphylococcus
NTTTNTP

SEQ ID NO: 2099349 - protein, 14 aa, Staphylococcus
NTVNKEKQDVDHLI

SEQ ID NO: 2099350 - protein, 6 aa, Staphylococcus
NTYQKG

SEQ ID NO: 2099351 - protein, 49 aa, Staphylococcus
NVAQANNVKSDLDQAKAHLTPDKAPLEAAKNSLETSINRPTDTDGMTAA

SEQ ID NO: 2099352 - protein, 10 aa, Staphylococcus
NVDNTDQPKN

SEQ ID NO: 2099353 - protein, 7 aa, Staphylococcus
NVDPSDV

SEQ ID NO: 2099354 - protein, 4 aa, Staphylococcus
NVEE

SEQ ID NO: 2099355 - protein, 6 aa, Staphylococcus
NVEPME

SEQ ID NO: 2099356 - protein, 6 aa, Staphylococcus
NVEQKG

SEQ ID NO: 2099357 - protein, 16 aa, Staphylococcus
NVGDKTIGFKSDDNEL

SEQ ID NO: 2099358 - protein, 14 aa, Staphylococcus
NVGDQSIGFSSDDN

SEQ ID NO: 2099359 - protein, 16 aa, Staphylococcus
NVGDQTIGFQSDDNEL

SEQ ID NO: 2099360 - protein, 16 aa, Staphylococcus
NVGDTSIGFSSDDNEL

SEQ ID NO: 2099361 - protein, 11 aa, Staphylococcus
NVHRSGNNANV

SEQ ID NO: 2099362 - protein, 66 aa, Staphylococcus
NVKETTESSNSDQTQQQHLESTKAKDSDTNNTSVERPESNSTQTSNQDTDNMQDTSTNQTNENSKH

SEQ ID NO: 2099363 - protein, 13 aa, Staphylococcus
NVKHPKEAYTPKS

SEQ ID NO: 2099364 - protein, 9 aa, Staphylococcus
NVKKDDSIK

SEQ ID NO: 2099365 - protein, 9 aa, Staphylococcus
NVKQEKQSI

SEQ ID NO: 2099366 - protein, 4 aa, Staphylococcus
NVKS

SEQ ID NO: 2099367 - protein, 12 aa, Staphylococcus
NVNDSDIKANSA

SEQ ID NO: 2099368 - protein, 5 aa, Staphylococcus
NVNQN

SEQ ID NO: 2099369 - protein, 26 aa, Staphylococcus
NVNQTKDALDGEERLDQAKTTATTAL

SEQ ID NO: 2099370 - protein, 9 aa, Staphylococcus
NVNSDGSIN

SEQ ID NO: 2099371 - protein, 11 aa, Staphylococcus
NVNSDGSVEVS

SEQ ID NO: 2099372 - protein, 10 aa, Staphylococcus
NVNSDGSVTV

SEQ ID NO: 2099373 - protein, 10 aa, Staphylococcus
NVNSNDGTFT

SEQ ID NO: 2099374 - protein, 7 aa, Staphylococcus
NVPADPN

SEQ ID NO: 2099375 - protein, 12 aa, Staphylococcus
NVPNKALSDGDI

SEQ ID NO: 2099376 - protein, 16 aa, Staphylococcus
NVQAQDLSKQVEAQTD

SEQ ID NO: 2099377 - protein, 7 aa, Staphylococcus
NVQDKGV

SEQ ID NO: 2099378 - protein, 7 aa, Staphylococcus
NVQNKGV

SEQ ID NO: 2099379 - protein, 33 aa, Staphylococcus
NVSEAKADEVTANNAKDVAQQAMKNSGGNPNLQ

SEQ ID NO: 2099380 - protein, 16 aa, Staphylococcus
NVSEEELPQFSTNPQQ

SEQ ID NO: 2099381 - protein, 18 aa, Staphylococcus
NVSNKVADTVRRETDAKT

SEQ ID NO: 2099382 - protein, 21 aa, Staphylococcus
NVSNNGSGDSGNKSSSKDSIK

SEQ ID NO: 2099383 - protein, 7 aa, Staphylococcus
NVTLDDK

SEQ ID NO: 2099384 - protein, 4 aa, Staphylococcus
NVTP

SEQ ID NO: 2099385 - protein, 12 aa, Staphylococcus
NWAGQASGDGFK

SEQ ID NO: 2099386 - protein, 21 aa, Staphylococcus
NWANAAAAAGRTVNNTPTAGA

SEQ ID NO: 2099387 - protein, 19 aa, Staphylococcus
NWAYSAKRAGFTVNNTPAV

SEQ ID NO: 2099388 - protein, 21 aa, Staphylococcus
NWDNSAEDAGYNVSTTPKNHT

SEQ ID NO: 2099389 - protein, 81 aa, Staphylococcus
NWNPSNSDQGHTSNGYSNANSTNNNATQSYTTNNQGTGGKGAVSHSTSNSNVKVSTTSAPSNSNGSNSISNTSGSSNNLYT

SEQ ID NO: 2099390 - protein, 30 aa, Staphylococcus
NWSPDKVNHNNSYDYGYNTQAYNNYNNYNY

SEQ ID NO: 2099391 - protein, 13 aa, Staphylococcus
NWSPDRLNHSNYN

SEQ ID NO: 2099392 - protein, 102 aa, Staphylococcus
NWSPDRLNHTNDSNHSQSNYNNNYSNNSYNYNSNYSYTTNNNQTSTNNNQSYTTNNTTGGLGANTASTSNSNVKVTTQSAPRTQSTASTQAFSGKTNSGANY

SEQ ID NO: 2099393 - protein, 49 aa, Staphylococcus
NWSPDRLNSHNNYSYSNYSNNNYNSSNYSNSNNQTGGLGANYSSTSRNV

SEQ ID NO: 2099394 - protein, 13 aa, Staphylococcus
NWSPNQAQQGQYY

SEQ ID NO: 2099395 - protein, 15 aa, Staphylococcus
NWSPNQLNQNQGYTY

SEQ ID NO: 2099396 - protein, 19 aa, Staphylococcus
NWSPNQVNHSSQSNYSYNN

SEQ ID NO: 2099397 - protein, 96 aa, Staphylococcus
NWSPQQAQQGNNSNYSNANQSTQSYNSYNNYNNYRTNNQTQSYNSNNGGGLGANYSTSDRNVKVTTQSAPTQKSSSNASAAFAGQTSSGSNLYTSG

SEQ ID NO: 2099398 - protein, 103 aa, Staphylococcus
NWSPSQAQQGGQQNTGNQAVNNTQSNNNYNYNYNNNQSNQNTQSYTANNNAGGGLGASYSTSDRNVKVTTQNAPTTQSTSSNASSSSSSEALAGKSSGGSNLY

SEQ ID NO: 2099399 - protein, 92 aa, Staphylococcus
NWSPSQQQGNNNSYSYGNQATQNYNSNNATNNNQNTQSYTTDNTNNQGGGLGADYSTSDKNIKVTTQNAPSSNNSTAFSGQSGSGSNAYTAG

SEQ ID NO: 2099400 - protein, 12 aa, Staphylococcus
NYAASKEKDEND

SEQ ID NO: 2099401 - protein, 12 aa, Staphylococcus
NYAQQKQQVESH

SEQ ID NO: 2099402 - protein, 7 aa, Staphylococcus
NYEPQNT

SEQ ID NO: 2099403 - protein, 17 aa, Staphylococcus
NYETSYAGWSPDYPDPT

SEQ ID NO: 2099404 - protein, 17 aa, Staphylococcus
NYGGSGALRQQIEKGAP

SEQ ID NO: 2099405 - protein, 19 aa, Staphylococcus
NYGGSGALRQQIEKGAPAD

SEQ ID NO: 2099406 - protein, 17 aa, Staphylococcus
NYGGSGALRQQVESGAP

SEQ ID NO: 2099407 - protein, 25 aa, Staphylococcus
NYGQGAGVVTSRTISASEASGYNYI

SEQ ID NO: 2099408 - protein, 15 aa, Staphylococcus
NYGQPNSYSPTSAWG

SEQ ID NO: 2099409 - protein, 5 aa, Staphylococcus
NYHGS

SEQ ID NO: 2099410 - protein, 7 aa, Staphylococcus
NYIPATK

SEQ ID NO: 2099411 - protein, 8 aa, Staphylococcus
NYIPNSSN

SEQ ID NO: 2099412 - protein, 23 aa, Staphylococcus
NYKDANDNVNRHQLDGEGGIQSD

SEQ ID NO: 2099413 - protein, 7 aa, Staphylococcus
NYKQPVK

SEQ ID NO: 2099414 - protein, 10 aa, Staphylococcus
NYKYPTPLKQ

SEQ ID NO: 2099415 - protein, 27 aa, Staphylococcus
NYNGGPFSVSERTISAGEASSYNYIHL

SEQ ID NO: 2099416 - protein, 25 aa, Staphylococcus
NYNGGPGNVSTRTISASQAGSYNYI

SEQ ID NO: 2099417 - protein, 36 aa, Staphylococcus
NYNNYNNYSNNTQSYSANTQQTGGLGASYSTSDRNI

SEQ ID NO: 2099418 - protein, 10 aa, Staphylococcus
NYNPSKSTDE

SEQ ID NO: 2099419 - protein, 5 aa, Staphylococcus
NYNTS

SEQ ID NO: 2099420 - protein, 15 aa, Staphylococcus
NYPHENKIDNPSGYI

SEQ ID NO: 2099421 - protein, 20 aa, Staphylococcus
NYPSDQQAYQKAKKISKSSI

SEQ ID NO: 2099422 - protein, 4 aa, Staphylococcus
NYQD

SEQ ID NO: 2099423 - protein, 11 aa, Staphylococcus
NYQNQSSKYQY

SEQ ID NO: 2099424 - protein, 7 aa, Staphylococcus
NYQPQNT

SEQ ID NO: 2099425 - protein, 17 aa, Staphylococcus
NYRNQLPAKTPGAVSSS

SEQ ID NO: 2099426 - protein, 10 aa, Staphylococcus
NYSDNTGQHS

SEQ ID NO: 2099427 - protein, 13 aa, Staphylococcus
NYSETAKIQAYNN

SEQ ID NO: 2099428 - protein, 27 aa, Staphylococcus
NYSGGPYVKDTRTISASQASSYNYIHL

SEQ ID NO: 2099429 - protein, 15 aa, Staphylococcus
NYSKTKDEDGTQGDT

SEQ ID NO: 2099430 - protein, 5 aa, Staphylococcus
NYSNL

SEQ ID NO: 2099431 - protein, 28 aa, Staphylococcus
NYSNTYASSNSYRTGGLGASYSTSSSNI

SEQ ID NO: 2099432 - protein, 4 aa, Staphylococcus
NYSY

SEQ ID NO: 2099433 - protein, 5 aa, Staphylococcus
NYTKE

SEQ ID NO: 2099434 - protein, 6 aa, Staphylococcus
NYTTAQ

SEQ ID NO: 2099435 - protein, 10 aa, Staphylococcus
NYVDSKDENF

SEQ ID NO: 2099436 - protein, 18 aa, Staphylococcus
PADENVSNSPHGQNVNNE

SEQ ID NO: 2099437 - protein, 16 aa, Staphylococcus
PADTEIELDTKKDKDV

SEQ ID NO: 2099438 - protein, 11 aa, Staphylococcus
PAGEERPLPTT

SEQ ID NO: 2099439 - protein, 5 aa, Staphylococcus
PAHHK

SEQ ID NO: 2099440 - protein, 9 aa, Staphylococcus
PAHPGTHQY

SEQ ID NO: 2099441 - protein, 9 aa, Staphylococcus
PANNGKGGT

SEQ ID NO: 2099442 - protein, 6 aa, Staphylococcus
PAPGDI

SEQ ID NO: 2099443 - protein, 7 aa, Staphylococcus
PARSGAT

SEQ ID NO: 2099444 - protein, 11 aa, Staphylococcus
PATAKAPQRDV

SEQ ID NO: 2099445 - protein, 27 aa, Staphylococcus
PATLSDNADTNQNQPITVTGYPGDKPL

SEQ ID NO: 2099446 - protein, 17 aa, Staphylococcus
PAVASKSGLLAHPSESY

SEQ ID NO: 2099447 - protein, 12 aa, Staphylococcus
PAYRSSGKSQFD

SEQ ID NO: 2099448 - protein, 4 aa, Staphylococcus
PDAF

SEQ ID NO: 2099449 - protein, 5 aa, Staphylococcus
PDEAF

SEQ ID NO: 2099450 - protein, 5 aa, Staphylococcus
PDERS

SEQ ID NO: 2099451 - protein, 6 aa, Staphylococcus
PDESFS

SEQ ID NO: 2099452 - protein, 14 aa, Staphylococcus
PDGHVTEYDADGNE

SEQ ID NO: 2099453 - protein, 6 aa, Staphylococcus
PDGQAN

SEQ ID NO: 2099454 - protein, 12 aa, Staphylococcus
PDGTGEVNPKGI

SEQ ID NO: 2099455 - protein, 9 aa, Staphylococcus
PDHPATHQY

SEQ ID NO: 2099456 - protein, 34 aa, Staphylococcus
PDISNNDIAGNYKVSEEKVSPETVKVTGGKEQLN

SEQ ID NO: 2099457 - protein, 12 aa, Staphylococcus
PDKDDEKIELKK

SEQ ID NO: 2099458 - protein, 7 aa, Staphylococcus
PDKPGMI

SEQ ID NO: 2099459 - protein, 7 aa, Staphylococcus
PDKSGMI

SEQ ID NO: 2099460 - protein, 18 aa, Staphylococcus
PDKVKKSDPDEITAHISL

SEQ ID NO: 2099461 - protein, 10 aa, Staphylococcus
PDLNQPQHDA

SEQ ID NO: 2099462 - protein, 20 aa, Staphylococcus
PDLTHYNSSNPGMDNTGNDF

SEQ ID NO: 2099463 - protein, 12 aa, Staphylococcus
PDLTQARQNADA

SEQ ID NO: 2099464 - protein, 7 aa, Staphylococcus
PDNDDYI

SEQ ID NO: 2099465 - protein, 40 aa, Staphylococcus
PDNQLDKVKEAAKELKEVKSKVKNEKDPKLAAATTKLQDA

SEQ ID NO: 2099466 - protein, 7 aa, Staphylococcus
PDQYDNS

SEQ ID NO: 2099467 - protein, 7 aa, Staphylococcus
PDTIAKH

SEQ ID NO: 2099468 - protein, 13 aa, Staphylococcus
PDVSQSDISNEYK

SEQ ID NO: 2099469 - protein, 11 aa, Staphylococcus
PDYQNKNVPNG

SEQ ID NO: 2099470 - protein, 4 aa, Staphylococcus
PEDV

SEQ ID NO: 2099471 - protein, 14 aa, Staphylococcus
PEFSKSESKRIMDN

SEQ ID NO: 2099472 - protein, 10 aa, Staphylococcus
PEGLSSEQKW

SEQ ID NO: 2099473 - protein, 4 aa, Staphylococcus
PEIY

SEQ ID NO: 2099474 - protein, 10 aa, Staphylococcus
PEKIYGKDDE

SEQ ID NO: 2099475 - protein, 17 aa, Staphylococcus
PEKLKEQQSSGASSGLS

SEQ ID NO: 2099476 - protein, 5 aa, Staphylococcus
PELKT

SEQ ID NO: 2099477 - protein, 9 aa, Staphylococcus
PELKTGPLE

SEQ ID NO: 2099478 - protein, 9 aa, Staphylococcus
PENKQLQHK

SEQ ID NO: 2099479 - protein, 13 aa, Staphylococcus
PEPFRSDKDGLSE

SEQ ID NO: 2099480 - protein, 9 aa, Staphylococcus
PERINPGDK

SEQ ID NO: 2099481 - protein, 4 aa, Staphylococcus
PESF

SEQ ID NO: 2099482 - protein, 25 aa, Staphylococcus
PESGGDPNASNGQYHGLGQTNQSWG

SEQ ID NO: 2099483 - protein, 26 aa, Staphylococcus
PESGGDPNASNGQYHGLGQTNQSWGY

SEQ ID NO: 2099484 - protein, 11 aa, Staphylococcus
PESGGNPDAVN

SEQ ID NO: 2099485 - protein, 14 aa, Staphylococcus
PESGGNPHAKNGEY

SEQ ID NO: 2099486 - protein, 35 aa, Staphylococcus
PESGGNPNASNGQYHGLGQTNQSWGYGSVENQTKG

SEQ ID NO: 2099487 - protein, 35 aa, Staphylococcus
PESGGNPNASNGQYHGLGQTNQSWGYGSVETQTKG

SEQ ID NO: 2099488 - protein, 19 aa, Staphylococcus
PESGGNPNAVNPAGYRGLG

SEQ ID NO: 2099489 - protein, 36 aa, Staphylococcus
PESGGNPNAVNPAGYRGLGQTKESWGTGSVASQTKG

SEQ ID NO: 2099490 - protein, 13 aa, Staphylococcus
PESGGNPNAVNPI

SEQ ID NO: 2099491 - protein, 11 aa, Staphylococcus
PESSGNPDAVN

SEQ ID NO: 2099492 - protein, 6 aa, Staphylococcus
PESYLG

SEQ ID NO: 2099493 - protein, 7 aa, Staphylococcus
PETGDYL

SEQ ID NO: 2099494 - protein, 8 aa, Staphylococcus
PETLAPQG

SEQ ID NO: 2099495 - protein, 16 aa, Staphylococcus
PETTYPRVNAKKVWKW

SEQ ID NO: 2099496 - protein, 9 aa, Staphylococcus
PETVNENSK

SEQ ID NO: 2099497 - protein, 10 aa, Staphylococcus
PEYTSDWKPK

SEQ ID NO: 2099498 - protein, 6 aa, Staphylococcus
PFATSQ

SEQ ID NO: 2099499 - protein, 14 aa, Staphylococcus
PFESVENAKEAIEE

SEQ ID NO: 2099500 - protein, 15 aa, Staphylococcus
PFGSDLKSAEQLNNQ

SEQ ID NO: 2099501 - protein, 12 aa, Staphylococcus
PFKEQKNSTPSL

SEQ ID NO: 2099502 - protein, 10 aa, Staphylococcus
PFKTSEQEAI

SEQ ID NO: 2099503 - protein, 8 aa, Staphylococcus
PFKTTEQQ

SEQ ID NO: 2099504 - protein, 7 aa, Staphylococcus
PFQNDSD

SEQ ID NO: 2099505 - protein, 14 aa, Staphylococcus
PFSETTNDSPYPHG

SEQ ID NO: 2099506 - protein, 7 aa, Staphylococcus
PFTTPKG

SEQ ID NO: 2099507 - protein, 6 aa, Staphylococcus
PFTTPQ

SEQ ID NO: 2099508 - protein, 9 aa, Staphylococcus
PGAGANNLG

SEQ ID NO: 2099509 - protein, 9 aa, Staphylococcus
PGAGERAAK

SEQ ID NO: 2099510 - protein, 17 aa, Staphylococcus
PGANQAIDTRTGQVDTY

SEQ ID NO: 2099511 - protein, 20 aa, Staphylococcus
PGAVQTELPQQGSDQEIKDN

SEQ ID NO: 2099512 - protein, 9 aa, Staphylococcus
PGDKVQYKK

SEQ ID NO: 2099513 - protein, 4 aa, Staphylococcus
PGDT

SEQ ID NO: 2099514 - protein, 9 aa, Staphylococcus
PGDVPETYA

SEQ ID NO: 2099515 - protein, 118 aa, Staphylococcus
PGGNNDSSEDKQKTEKNDHKNKTPNNSNKNNDTNNDKNINSSDTQKNNNDENTNYNQTEDIQPNDNKSIQSSEQNTQNQSENGINGNNETTTNESHSTSGNQSNDSSNKELTPKQAED

SEQ ID NO: 2099516 - protein, 5 aa, Staphylococcus
PGITG

SEQ ID NO: 2099517 - protein, 11 aa, Staphylococcus
PGLGGGPSKNV

SEQ ID NO: 2099518 - protein, 13 aa, Staphylococcus
PGLGGGQSKSTVR

SEQ ID NO: 2099519 - protein, 4 aa, Staphylococcus
PGQT

SEQ ID NO: 2099520 - protein, 7 aa, Staphylococcus
PGVATPV

SEQ ID NO: 2099521 - protein, 10 aa, Staphylococcus
PGVGKNLGVN

SEQ ID NO: 2099522 - protein, 5 aa, Staphylococcus
PHATY

SEQ ID NO: 2099523 - protein, 5 aa, Staphylococcus
PHETW

SEQ ID NO: 2099524 - protein, 25 aa, Staphylococcus
PHLESSGSGPLKKVQSGEAAVGAGL

SEQ ID NO: 2099525 - protein, 4 aa, Staphylococcus
PHPS

SEQ ID NO: 2099526 - protein, 5 aa, Staphylococcus
PHRDY

SEQ ID NO: 2099527 - protein, 6 aa, Staphylococcus
PHRDYR

SEQ ID NO: 2099528 - protein, 10 aa, Staphylococcus
PHSSTDSNDG

SEQ ID NO: 2099529 - protein, 17 aa, Staphylococcus
PIAKGYNKGEDAVAKTQ

SEQ ID NO: 2099530 - protein, 10 aa, Staphylococcus
PIDTANLPEH

SEQ ID NO: 2099531 - protein, 17 aa, Staphylococcus
PIDTSNLPKDLKRNEKV

SEQ ID NO: 2099532 - protein, 17 aa, Staphylococcus
PIETKNLPKTMKRNEKL

SEQ ID NO: 2099533 - protein, 8 aa, Staphylococcus
PINGDLEG

SEQ ID NO: 2099534 - protein, 11 aa, Staphylococcus
PIPNDKLKKEI

SEQ ID NO: 2099535 - protein, 14 aa, Staphylococcus
PKAKQLTYGTGTAI

SEQ ID NO: 2099536 - protein, 12 aa, Staphylococcus
PKDDYKKEQKQL

SEQ ID NO: 2099537 - protein, 4 aa, Staphylococcus
PKDL

SEQ ID NO: 2099538 - protein, 6 aa, Staphylococcus
PKEGSN

SEQ ID NO: 2099539 - protein, 12 aa, Staphylococcus
PKEIDKQSQKKA

SEQ ID NO: 2099540 - protein, 7 aa, Staphylococcus
PKEKKTE

SEQ ID NO: 2099541 - protein, 15 aa, Staphylococcus
PKENNDAVKNNKQFE

SEQ ID NO: 2099542 - protein, 19 aa, Staphylococcus
PKGANNKGNYNNKEVTQQI

SEQ ID NO: 2099543 - protein, 18 aa, Staphylococcus
PKGELQVSNQGSPGPKAF

SEQ ID NO: 2099544 - protein, 7 aa, Staphylococcus
PKGGVGE

SEQ ID NO: 2099545 - protein, 11 aa, Staphylococcus
PKGKEKITGYQ

SEQ ID NO: 2099546 - protein, 9 aa, Staphylococcus
PKGKNMESR

SEQ ID NO: 2099547 - protein, 8 aa, Staphylococcus
PKGKYSLT

SEQ ID NO: 2099548 - protein, 6 aa, Staphylococcus
PKGQAN

SEQ ID NO: 2099549 - protein, 7 aa, Staphylococcus
PKGQHGH

SEQ ID NO: 2099550 - protein, 9 aa, Staphylococcus
PKGRNMESR

SEQ ID NO: 2099551 - protein, 5 aa, Staphylococcus
PKHDD

SEQ ID NO: 2099552 - protein, 7 aa, Staphylococcus
PKHQKQP

SEQ ID NO: 2099553 - protein, 8 aa, Staphylococcus
PKKKTTEL

SEQ ID NO: 2099554 - protein, 7 aa, Staphylococcus
PKKNGEA

SEQ ID NO: 2099555 - protein, 13 aa, Staphylococcus
PKKNPKAEDEKVQ

SEQ ID NO: 2099556 - protein, 39 aa, Staphylococcus
PKKQLDKVKNAAKELKDVKDKAKNDDDPKIAEATTQLQD

SEQ ID NO: 2099557 - protein, 17 aa, Staphylococcus
PKKTNKLSVNANDGDLK

SEQ ID NO: 2099558 - protein, 7 aa, Staphylococcus
PKKVSLE

SEQ ID NO: 2099559 - protein, 6 aa, Staphylococcus
PKLEPQ

SEQ ID NO: 2099560 - protein, 7 aa, Staphylococcus
PKMSENV

SEQ ID NO: 2099561 - protein, 7 aa, Staphylococcus
PKPVSYG

SEQ ID NO: 2099562 - protein, 9 aa, Staphylococcus
PKQINKQTS

SEQ ID NO: 2099563 - protein, 5 aa, Staphylococcus
PKQNG

SEQ ID NO: 2099564 - protein, 20 aa, Staphylococcus
PKQYEGNAYSWDTQTNGIAN

SEQ ID NO: 2099565 - protein, 7 aa, Staphylococcus
PKRGPSL

SEQ ID NO: 2099566 - protein, 5 aa, Staphylococcus
PKTTH

SEQ ID NO: 2099567 - protein, 21 aa, Staphylococcus
PKVATPYNGDEATISAYASTV

SEQ ID NO: 2099568 - protein, 8 aa, Staphylococcus
PKYNYKSG

SEQ ID NO: 2099569 - protein, 20 aa, Staphylococcus
PKYTIQGQDFPNGKGASPND

SEQ ID NO: 2099570 - protein, 47 aa, Staphylococcus
PKYTKDEVNKMDESDRKEKKANENLGLNPSHKGETDPEKIAEQSPAY

SEQ ID NO: 2099571 - protein, 47 aa, Staphylococcus
PKYTKKEIDKMSENEKKSKKANENLGLNPSHNGETDEEKIAKQSPAY

SEQ ID NO: 2099572 - protein, 78 aa, Staphylococcus
PLADNSELKTAKAKLDDEINQTVSTDGMTTESINAYQQAKQAAQTESKAAQQVINNGDATEQDIANEKAKVEDKYNTL

SEQ ID NO: 2099573 - protein, 23 aa, Staphylococcus
PLKYNKSEAKTHLDKAKKALGKD

SEQ ID NO: 2099574 - protein, 11 aa, Staphylococcus
PLNIEASPQGY

SEQ ID NO: 2099575 - protein, 6 aa, Staphylococcus
PLSDDA

SEQ ID NO: 2099576 - protein, 8 aa, Staphylococcus
PLSDDEEV

SEQ ID NO: 2099577 - protein, 7 aa, Staphylococcus
PLSDNDE

SEQ ID NO: 2099578 - protein, 7 aa, Staphylococcus
PLSNNDE

SEQ ID NO: 2099579 - protein, 7 aa, Staphylococcus
PLSNNEE

SEQ ID NO: 2099580 - protein, 13 aa, Staphylococcus
PLTGKDLSEYHQK

SEQ ID NO: 2099581 - protein, 5 aa, Staphylococcus
PLTPP

SEQ ID NO: 2099582 - protein, 9 aa, Staphylococcus
PLVQGSDKY

SEQ ID NO: 2099583 - protein, 10 aa, Staphylococcus
PLYKGNNDNM

SEQ ID NO: 2099584 - protein, 10 aa, Staphylococcus
PLYQGQNDNM

SEQ ID NO: 2099585 - protein, 11 aa, Staphylococcus
PMAGSHKSGIL

SEQ ID NO: 2099586 - protein, 20 aa, Staphylococcus
PMPASGPMYATTSENANTFN

SEQ ID NO: 2099587 - protein, 19 aa, Staphylococcus
PMTPAEARKKYQLRDPQGG

SEQ ID NO: 2099588 - protein, 7 aa, Staphylococcus
PNANTTI

SEQ ID NO: 2099589 - protein, 9 aa, Staphylococcus
PNAYTTTLG

SEQ ID NO: 2099590 - protein, 17 aa, Staphylococcus
PNDDRTQIENTTNGHYQ

SEQ ID NO: 2099591 - protein, 11 aa, Staphylococcus
PNDKNAKKQFK

SEQ ID NO: 2099592 - protein, 17 aa, Staphylococcus
PNDPVNQERAFRIFEKE

SEQ ID NO: 2099593 - protein, 4 aa, Staphylococcus
PNEG

SEQ ID NO: 2099594 - protein, 14 aa, Staphylococcus
PNERNVTDRQKEYA

SEQ ID NO: 2099595 - protein, 15 aa, Staphylococcus
PNFPNYESGTNGPLE

SEQ ID NO: 2099596 - protein, 27 aa, Staphylococcus
PNFPQSLTTAQNAADSLNGQQNAYNDY

SEQ ID NO: 2099597 - protein, 4 aa, Staphylococcus
PNGE

SEQ ID NO: 2099598 - protein, 7 aa, Staphylococcus
PNKDGLA

SEQ ID NO: 2099599 - protein, 7 aa, Staphylococcus
PNKTGMA

SEQ ID NO: 2099600 - protein, 10 aa, Staphylococcus
PNKYYRNGHP

SEQ ID NO: 2099601 - protein, 16 aa, Staphylococcus
PNLSAEATTNHAPELK

SEQ ID NO: 2099602 - protein, 16 aa, Staphylococcus
PNLSAEATTNHSPELR

SEQ ID NO: 2099603 - protein, 16 aa, Staphylococcus
PNLSAEATTNHTPQLK

SEQ ID NO: 2099604 - protein, 23 aa, Staphylococcus
PNLSDDNNNSNDITITESKNTRD

SEQ ID NO: 2099605 - protein, 5 aa, Staphylococcus
PNQTI

SEQ ID NO: 2099606 - protein, 15 aa, Staphylococcus
PNSLSSEEIKEEMLA

SEQ ID NO: 2099607 - protein, 5 aa, Staphylococcus
PNSMP

SEQ ID NO: 2099608 - protein, 10 aa, Staphylococcus
PNTNTSGITA

SEQ ID NO: 2099609 - protein, 14 aa, Staphylococcus
PNWKDKAEQVQDQL

SEQ ID NO: 2099610 - protein, 6 aa, Staphylococcus
PNYETK

SEQ ID NO: 2099611 - protein, 6 aa, Staphylococcus
PNYKTK

SEQ ID NO: 2099612 - protein, 5 aa, Staphylococcus
PNYQT

SEQ ID NO: 2099613 - protein, 6 aa, Staphylococcus
PPNNTY

SEQ ID NO: 2099614 - protein, 14 aa, Staphylococcus
PPRKRDYSSVSKGG

SEQ ID NO: 2099615 - protein, 14 aa, Staphylococcus
PPRTPERDEEPPPV

SEQ ID NO: 2099616 - protein, 14 aa, Staphylococcus
PPRTPEREKETPPM

SEQ ID NO: 2099617 - protein, 16 aa, Staphylococcus
PQAHASEQLQKDGQVI

SEQ ID NO: 2099618 - protein, 13 aa, Staphylococcus
PQASDNASSTDDL

SEQ ID NO: 2099619 - protein, 19 aa, Staphylococcus
PQDEKISEKYGEKYGTKVE

SEQ ID NO: 2099620 - protein, 26 aa, Staphylococcus
PQIQHTAGKWEDASATEIKNAMDSSK

SEQ ID NO: 2099621 - protein, 25 aa, Staphylococcus
PQNEKVAKKYGKQYGTTADKAVYNG

SEQ ID NO: 2099622 - protein, 8 aa, Staphylococcus
PQPNQATS

SEQ ID NO: 2099623 - protein, 5 aa, Staphylococcus
PQRQV

SEQ ID NO: 2099624 - protein, 5 aa, Staphylococcus
PQSTI

SEQ ID NO: 2099625 - protein, 7 aa, Staphylococcus
PRDTQAE

SEQ ID NO: 2099626 - protein, 8 aa, Staphylococcus
PRDTQAEI

SEQ ID NO: 2099627 - protein, 7 aa, Staphylococcus
PRDTQAQ

SEQ ID NO: 2099628 - protein, 6 aa, Staphylococcus
PRGDTG

SEQ ID NO: 2099629 - protein, 6 aa, Staphylococcus
PRHHRS

SEQ ID NO: 2099630 - protein, 6 aa, Staphylococcus
PRNNVT

SEQ ID NO: 2099631 - protein, 27 aa, Staphylococcus
PRQYAKSDKNLTKESAVRYSNEFNQTS

SEQ ID NO: 2099632 - protein, 6 aa, Staphylococcus
PRYGTL

SEQ ID NO: 2099633 - protein, 9 aa, Staphylococcus
PSDVKPMDE

SEQ ID NO: 2099634 - protein, 5 aa, Staphylococcus
PSGET

SEQ ID NO: 2099635 - protein, 5 aa, Staphylococcus
PSGKG

SEQ ID NO: 2099636 - protein, 12 aa, Staphylococcus
PSGKKIGKSNIP

SEQ ID NO: 2099637 - protein, 4 aa, Staphylococcus
PSGL

SEQ ID NO: 2099638 - protein, 11 aa, Staphylococcus
PSGNFKNDPMG

SEQ ID NO: 2099639 - protein, 22 aa, Staphylococcus
PSHLEGEYSQNIANKNAENAGV

SEQ ID NO: 2099640 - protein, 15 aa, Staphylococcus
PSHSPVKKYKPSKIE

SEQ ID NO: 2099641 - protein, 13 aa, Staphylococcus
PSKATQLDDQQQL

SEQ ID NO: 2099642 - protein, 8 aa, Staphylococcus
PSKGKADG

SEQ ID NO: 2099643 - protein, 5 aa, Staphylococcus
PSKLN

SEQ ID NO: 2099644 - protein, 16 aa, Staphylococcus
PSKQMDKVKQAAKDLR

SEQ ID NO: 2099645 - protein, 18 aa, Staphylococcus
PSKVGTDVTKDSNGDEVP

SEQ ID NO: 2099646 - protein, 17 aa, Staphylococcus
PSLPTNRYRGVGKAPLN

SEQ ID NO: 2099647 - protein, 19 aa, Staphylococcus
PSLSSESEKVLKKFMDMMK

SEQ ID NO: 2099648 - protein, 13 aa, Staphylococcus
PSMGTDRQHLNES

SEQ ID NO: 2099649 - protein, 4 aa, Staphylococcus
PSNE

SEQ ID NO: 2099650 - protein, 75 aa, Staphylococcus
PSNGAADDTTMNSQAQQGTMSSSQGAATQQSTSAQPAQTEQAPQSESTQQPQTQATSHSQSSSASQASSHSSVNV

SEQ ID NO: 2099651 - protein, 90 aa, Staphylococcus
PSNGSTVNSANQNVASTQTAQNVSYQNNNYKNINQSASTSNVSQHYANEAQTQQAPKTTQTKQATQTQQAPANATTNQPKQSTSGSSVNV

SEQ ID NO: 2099652 - protein, 5 aa, Staphylococcus
PSPQI

SEQ ID NO: 2099653 - protein, 6 aa, Staphylococcus
PSPQPI

SEQ ID NO: 2099654 - protein, 39 aa, Staphylococcus
PSQASASELDSTQPESSEGTVQNGSGQNVSTEESSAQLN

SEQ ID NO: 2099655 - protein, 13 aa, Staphylococcus
PSQEAGDLDEGLN

SEQ ID NO: 2099656 - protein, 6 aa, Staphylococcus
PSQGQI

SEQ ID NO: 2099657 - protein, 11 aa, Staphylococcus
PSQNSKTLNAK

SEQ ID NO: 2099658 - protein, 26 aa, Staphylococcus
PSSSSTTNSSSTTASQSTGYSSPTFN

SEQ ID NO: 2099659 - protein, 19 aa, Staphylococcus
PSTFKAGSYGSQHQHNTQT

SEQ ID NO: 2099660 - protein, 7 aa, Staphylococcus
PSYAGGI

SEQ ID NO: 2099661 - protein, 13 aa, Staphylococcus
PSYAGGLKKLGGN

SEQ ID NO: 2099662 - protein, 4 aa, Staphylococcus
PSYG

SEQ ID NO: 2099663 - protein, 9 aa, Staphylococcus
PTDGQGQRG

SEQ ID NO: 2099664 - protein, 8 aa, Staphylococcus
PTDRYRGN

SEQ ID NO: 2099665 - protein, 12 aa, Staphylococcus
PTDSDAISGSVQ

SEQ ID NO: 2099666 - protein, 19 aa, Staphylococcus
PTDSSAISSAVESANNEGI

SEQ ID NO: 2099667 - protein, 9 aa, Staphylococcus
PTEETDPSV

SEQ ID NO: 2099668 - protein, 18 aa, Staphylococcus
PTEPDTSKIETITAKPQY

SEQ ID NO: 2099669 - protein, 6 aa, Staphylococcus
PTGKHN

SEQ ID NO: 2099670 - protein, 10 aa, Staphylococcus
PTMRKQQSGH

SEQ ID NO: 2099671 - protein, 15 aa, Staphylococcus
PTNYAGDVNHKQQKK

SEQ ID NO: 2099672 - protein, 10 aa, Staphylococcus
PTSAPTNTMH

SEQ ID NO: 2099673 - protein, 5 aa, Staphylococcus
PTYAG

SEQ ID NO: 2099674 - protein, 7 aa, Staphylococcus
PTYAGGL

SEQ ID NO: 2099675 - protein, 8 aa, Staphylococcus
PTYLTPPE

SEQ ID NO: 2099676 - protein, 26 aa, Staphylococcus
PVDKDVSKGPHGQNVNNEYINKNNPD

SEQ ID NO: 2099677 - protein, 5 aa, Staphylococcus
PVETS

SEQ ID NO: 2099678 - protein, 10 aa, Staphylococcus
PVKKYPPQKI

SEQ ID NO: 2099679 - protein, 12 aa, Staphylococcus
PVKSDAKSGNSL

SEQ ID NO: 2099680 - protein, 9 aa, Staphylococcus
PVMNPTDIN

SEQ ID NO: 2099681 - protein, 5 aa, Staphylococcus
PVPKS

SEQ ID NO: 2099682 - protein, 6 aa, Staphylococcus
PVSERQ

SEQ ID NO: 2099683 - protein, 34 aa, Staphylococcus
PWGTTTTTKPSTGGTTTKPSTGGSTTKPSTNDKL

SEQ ID NO: 2099684 - protein, 14 aa, Staphylococcus
PWTQGEQPIMDETN

SEQ ID NO: 2099685 - protein, 14 aa, Staphylococcus
PYEISNRTIPANDV

SEQ ID NO: 2099686 - protein, 19 aa, Staphylococcus
PYGKKGLQALSGAACATFL

SEQ ID NO: 2099687 - protein, 7 aa, Staphylococcus
PYGPPAY

SEQ ID NO: 2099688 - protein, 9 aa, Staphylococcus
PYKTETSSS

SEQ ID NO: 2099689 - protein, 13 aa, Staphylococcus
PYPPQSYVGPSKW

SEQ ID NO: 2099690 - protein, 17 aa, Staphylococcus
PYQQAALNSKTLKDGIE

SEQ ID NO: 2099691 - protein, 6 aa, Staphylococcus
PYSKKV

SEQ ID NO: 2099692 - protein, 5 aa, Staphylococcus
PYTQQ

SEQ ID NO: 2099693 - protein, 11 aa, Staphylococcus
PYTTGKNHVNK

SEQ ID NO: 2099694 - protein, 9 aa, Staphylococcus
QAAKVESSE

SEQ ID NO: 2099695 - protein, 21 aa, Staphylococcus
QAANIQSSSPWPPQVQHTPGK

SEQ ID NO: 2099696 - protein, 16 aa, Staphylococcus
QADEDHKKLKYKKNSA

SEQ ID NO: 2099697 - protein, 7 aa, Staphylococcus
QADTPAI

SEQ ID NO: 2099698 - protein, 8 aa, Staphylococcus
QAEEPTRE

SEQ ID NO: 2099699 - protein, 6 aa, Staphylococcus
QAEKRN

SEQ ID NO: 2099700 - protein, 9 aa, Staphylococcus
QAFSETKAE

SEQ ID NO: 2099701 - protein, 4 aa, Staphylococcus
QAGA

SEQ ID NO: 2099702 - protein, 5 aa, Staphylococcus
QAGQS

SEQ ID NO: 2099703 - protein, 357 aa, Staphylococcus
QAHAAEETNQQINTPSHSNETTQTAQKNLKENESRPSESELSSSKTSQPQQSESTQHSQPQQTESTQSTQAQQTNPTQHPQDKENSQNQSLESTKEATNHNDTSDTSEAIDTKKEESDNQDVLPSKKTNNSERKANNTSTQDNVSSTDNKQYESESKPTETQSTETTQENNKVTQSKSSDNPSESQESTKSQDQQDPQDKPDSQHSQKSEDNLSTRDTTYPKESKQNSSSSQTQETTQESRNNKDETDNDNPQSKGAHQSSQNTQLRSTENNDDPKDSTQLKSSNKEQDTREQNNEKEVDQPIKKTPSMKQENKNTTKQSVKTDKTEKPTSTAPKTLQSHQPNKLSKQTLQAQYKNQ

SEQ ID NO: 2099704 - protein, 23 aa, Staphylococcus
QAHKEADNTKKEKLLEAKEENQI

SEQ ID NO: 2099705 - protein, 11 aa, Staphylococcus
QAIQTAGNPNF

SEQ ID NO: 2099706 - protein, 12 aa, Staphylococcus
QAKEQGKSTGLV

SEQ ID NO: 2099707 - protein, 13 aa, Staphylococcus
QAKTNATNAVNDL

SEQ ID NO: 2099708 - protein, 17 aa, Staphylococcus
QALDDRKNRDKEVPTQF

SEQ ID NO: 2099709 - protein, 19 aa, Staphylococcus
QALNGDQKLNDTKTNAQQY

SEQ ID NO: 2099710 - protein, 8 aa, Staphylococcus
QAQEAGYE

SEQ ID NO: 2099711 - protein, 8 aa, Staphylococcus
QAQEPTRE

SEQ ID NO: 2099712 - protein, 9 aa, Staphylococcus
QAQNTLDKD

SEQ ID NO: 2099713 - protein, 48 aa, Staphylococcus
QAQQALNGERNLEDAKRNATNTINNSPDLNNAQKDALKAQVSNGKRVA

SEQ ID NO: 2099714 - protein, 11 aa, Staphylococcus
QAQRQALETQI

SEQ ID NO: 2099715 - protein, 7 aa, Staphylococcus
QASHLEE

SEQ ID NO: 2099716 - protein, 13 aa, Staphylococcus
QASHTSKSAYTLG

SEQ ID NO: 2099717 - protein, 4 aa, Staphylococcus
QATH

SEQ ID NO: 2099718 - protein, 12 aa, Staphylococcus
QATTGTNTESWD

SEQ ID NO: 2099719 - protein, 8 aa, Staphylococcus
QAVDADGV

SEQ ID NO: 2099720 - protein, 13 aa, Staphylococcus
QAVDAKDEPIQKA

SEQ ID NO: 2099721 - protein, 7 aa, Staphylococcus
QAYPDAS

SEQ ID NO: 2099722 - protein, 20 aa, Staphylococcus
QDADAAENNNGYNPNDPYSY

SEQ ID NO: 2099723 - protein, 15 aa, Staphylococcus
QDADASTQHTVQSGE

SEQ ID NO: 2099724 - protein, 11 aa, Staphylococcus
QDAHDIGQDED

SEQ ID NO: 2099725 - protein, 13 aa, Staphylococcus
QDANDAGARTDVN

SEQ ID NO: 2099726 - protein, 6 aa, Staphylococcus
QDDNWS

SEQ ID NO: 2099727 - protein, 7 aa, Staphylococcus
QDESTRY

SEQ ID NO: 2099728 - protein, 35 aa, Staphylococcus
QDGIANKQQTLDSQNYIDAEPSKQQAYNQAISTAE

SEQ ID NO: 2099729 - protein, 4 aa, Staphylococcus
QDGN

SEQ ID NO: 2099730 - protein, 18 aa, Staphylococcus
QDGTHSDGRVSNSSSKSL

SEQ ID NO: 2099731 - protein, 31 aa, Staphylococcus
QDINNQKSQLEALNKDKKNVSKTVDNNNEAN

SEQ ID NO: 2099732 - protein, 32 aa, Staphylococcus
QDISNQKAQVEALNKDKKNVSKTVDNNKEAKF

SEQ ID NO: 2099733 - protein, 28 aa, Staphylococcus
QDISNQKSKIAGLKQDKENSKKTSSNKL

SEQ ID NO: 2099734 - protein, 41 aa, Staphylococcus
QDISNQKSTIAGLQKDKENGKQTADNKKKEKNLKASSTYYD

SEQ ID NO: 2099735 - protein, 5 aa, Staphylococcus
QDITQ

SEQ ID NO: 2099736 - protein, 14 aa, Staphylococcus
QDMSTSSRKNEDNW

SEQ ID NO: 2099737 - protein, 15 aa, Staphylococcus
QDNADNWKNNVGNFT

SEQ ID NO: 2099738 - protein, 17 aa, Staphylococcus
QDNKIDSTTKKDADQLL

SEQ ID NO: 2099739 - protein, 17 aa, Staphylococcus
QDNQLNAQTDKDADQLL

SEQ ID NO: 2099740 - protein, 5 aa, Staphylococcus
QDNRM

SEQ ID NO: 2099741 - protein, 5 aa, Staphylococcus
QDPTI

SEQ ID NO: 2099742 - protein, 22 aa, Staphylococcus
QDQSGSQDNGGVHTNSGIPNKA

SEQ ID NO: 2099743 - protein, 6 aa, Staphylococcus
QDRYQG

SEQ ID NO: 2099744 - protein, 8 aa, Staphylococcus
QDTKQNIK

SEQ ID NO: 2099745 - protein, 8 aa, Staphylococcus
QDTQLPQL

SEQ ID NO: 2099746 - protein, 30 aa, Staphylococcus
QDVENKHDRNASTKTTGNEQKKKEVINGRT

SEQ ID NO: 2099747 - protein, 4 aa, Staphylococcus
QEAE

SEQ ID NO: 2099748 - protein, 85 aa, Staphylococcus
QEAGSTSAQTSNTAVQSADYTTSYNQEAGTQSVSSNQQSSNTNVEAVSAPTTSNNGSSHNYSTKTTSYSAPSTSSASTGGSTKAQ

SEQ ID NO: 2099749 - protein, 24 aa, Staphylococcus
QEAGTVSGKANQTFKATKQQQIDK

SEQ ID NO: 2099750 - protein, 24 aa, Staphylococcus
QEALNNVTNAHSNSDVKNVQQDGI

SEQ ID NO: 2099751 - protein, 17 aa, Staphylococcus
QEDTQISAYDSNPSQLD

SEQ ID NO: 2099752 - protein, 10 aa, Staphylococcus
QEGHKNDEKF

SEQ ID NO: 2099753 - protein, 10 aa, Staphylococcus
QEGHKNDKKF

SEQ ID NO: 2099754 - protein, 18 aa, Staphylococcus
QEGIENMNAEEPSQKDLT

SEQ ID NO: 2099755 - protein, 7 aa, Staphylococcus
QEGPEYY

SEQ ID NO: 2099756 - protein, 10 aa, Staphylococcus
QEIGRGGEIQ

SEQ ID NO: 2099757 - protein, 18 aa, Staphylococcus
QEKEGDNLAPSMTTTDNF

SEQ ID NO: 2099758 - protein, 9 aa, Staphylococcus
QEKLTRKNA

SEQ ID NO: 2099759 - protein, 5 aa, Staphylococcus
QELGH

SEQ ID NO: 2099760 - protein, 7 aa, Staphylococcus
QENTPVK

SEQ ID NO: 2099761 - protein, 9 aa, Staphylococcus
QEPRQAIGG

SEQ ID NO: 2099762 - protein, 51 aa, Staphylococcus
QEPTKSPSKRNITPYNPKTTAIGYGKQETIHHQQSPAASEASSNEADKAET

SEQ ID NO: 2099763 - protein, 6 aa, Staphylococcus
QEQEMK

SEQ ID NO: 2099764 - protein, 8 aa, Staphylococcus
QEQEPNRE

SEQ ID NO: 2099765 - protein, 5 aa, Staphylococcus
QESEA

SEQ ID NO: 2099766 - protein, 15 aa, Staphylococcus
QESPIGGDDKPYSGF

SEQ ID NO: 2099767 - protein, 13 aa, Staphylococcus
QESPLGGDDRPYH

SEQ ID NO: 2099768 - protein, 14 aa, Staphylococcus
QEVRATSDDTATSI

SEQ ID NO: 2099769 - protein, 10 aa, Staphylococcus
QFDRPDDEDY

SEQ ID NO: 2099770 - protein, 5 aa, Staphylococcus
QFEAD

SEQ ID NO: 2099771 - protein, 9 aa, Staphylococcus
QFGETKEGQ

SEQ ID NO: 2099772 - protein, 10 aa, Staphylococcus
QFKQSGNVSN

SEQ ID NO: 2099773 - protein, 12 aa, Staphylococcus
QFNREKKAKELN

SEQ ID NO: 2099774 - protein, 11 aa, Staphylococcus
QFSTNGTEIQT

SEQ ID NO: 2099775 - protein, 9 aa, Staphylococcus
QFSTTADEI

SEQ ID NO: 2099776 - protein, 11 aa, Staphylococcus
QGADPDPSGLY

SEQ ID NO: 2099777 - protein, 13 aa, Staphylococcus
QGAHAGYYPGNTP

SEQ ID NO: 2099778 - protein, 30 aa, Staphylococcus
QGALASGGGMGPVSSDSSASQNNAQQNKNV

SEQ ID NO: 2099779 - protein, 4 aa, Staphylococcus
QGAS

SEQ ID NO: 2099780 - protein, 4 aa, Staphylococcus
QGDA

SEQ ID NO: 2099781 - protein, 9 aa, Staphylococcus
QGEAPIKET

SEQ ID NO: 2099782 - protein, 28 aa, Staphylococcus
QGEKLEKEDSYNDKVTTNLSKKYKKDIR

SEQ ID NO: 2099783 - protein, 11 aa, Staphylococcus
QGFESSQSMQA

SEQ ID NO: 2099784 - protein, 6 aa, Staphylococcus
QGFGNR

SEQ ID NO: 2099785 - protein, 20 aa, Staphylococcus
QGGINGAVNTKGEGDSPSVH

SEQ ID NO: 2099786 - protein, 28 aa, Staphylococcus
QGIADKDQTIADGNYTNANPDKQQAYSD

SEQ ID NO: 2099787 - protein, 29 aa, Staphylococcus
QGIANKNDILGSENYHDADPDKQTAYQDA

SEQ ID NO: 2099788 - protein, 10 aa, Staphylococcus
QGKNESYPDY

SEQ ID NO: 2099789 - protein, 6 aa, Staphylococcus
QGKPKL

SEQ ID NO: 2099790 - protein, 4 aa, Staphylococcus
QGKQ

SEQ ID NO: 2099791 - protein, 14 aa, Staphylococcus
QGKYPVEKVYPVEG

SEQ ID NO: 2099792 - protein, 9 aa, Staphylococcus
QGLSPQKDS

SEQ ID NO: 2099793 - protein, 21 aa, Staphylococcus
QGLSPQKDSIAIEKPNNNPYA

SEQ ID NO: 2099794 - protein, 39 aa, Staphylococcus
QGLSSKQATLYQQNPKDTNTQVSGKLNNSKETKANDTAT

SEQ ID NO: 2099795 - protein, 5 aa, Staphylococcus
QGMSM

SEQ ID NO: 2099796 - protein, 14 aa, Staphylococcus
QGNFPVQGRSVKST

SEQ ID NO: 2099797 - protein, 9 aa, Staphylococcus
QGNKGLTDY

SEQ ID NO: 2099798 - protein, 8 aa, Staphylococcus
QGNKYSQV

SEQ ID NO: 2099799 - protein, 8 aa, Staphylococcus
QGNLPPSC

SEQ ID NO: 2099800 - protein, 7 aa, Staphylococcus
QGNLPPT

SEQ ID NO: 2099801 - protein, 6 aa, Staphylococcus
QGNLPT

SEQ ID NO: 2099802 - protein, 7 aa, Staphylococcus
QGNPSLQ

SEQ ID NO: 2099803 - protein, 5 aa, Staphylococcus
QGNRY

SEQ ID NO: 2099804 - protein, 14 aa, Staphylococcus
QGQHQAVPNSTKNI

SEQ ID NO: 2099805 - protein, 12 aa, Staphylococcus
QGRFSPDPASDF

SEQ ID NO: 2099806 - protein, 10 aa, Staphylococcus
QGRTEAPKFT

SEQ ID NO: 2099807 - protein, 13 aa, Staphylococcus
QGSHNLKTQSITI

SEQ ID NO: 2099808 - protein, 9 aa, Staphylococcus
QGSKDGIQN

SEQ ID NO: 2099809 - protein, 24 aa, Staphylococcus
QGTDARNGVMKQTKSELDDGQLDK

SEQ ID NO: 2099810 - protein, 17 aa, Staphylococcus
QGTGHYSPLNNKKVQDV

SEQ ID NO: 2099811 - protein, 13 aa, Staphylococcus
QGVYNGGGKAEGA

SEQ ID NO: 2099812 - protein, 22 aa, Staphylococcus
QGYEKAKDSDFDTVRKYRKLVE

SEQ ID NO: 2099813 - protein, 9 aa, Staphylococcus
QGYTKSGGE

SEQ ID NO: 2099814 - protein, 4 aa, Staphylococcus
QHDS

SEQ ID NO: 2099815 - protein, 5 aa, Staphylococcus
QHDSK

SEQ ID NO: 2099816 - protein, 14 aa, Staphylococcus
QHEHGDEEHADSHE

SEQ ID NO: 2099817 - protein, 8 aa, Staphylococcus
QHGETDDF

SEQ ID NO: 2099818 - protein, 15 aa, Staphylococcus
QHNPEQLNSKPVQAG

SEQ ID NO: 2099819 - protein, 16 aa, Staphylococcus
QHNTTVNDIKQSNNLS

SEQ ID NO: 2099820 - protein, 16 aa, Staphylococcus
QHPFGQNATPATDEVQ

SEQ ID NO: 2099821 - protein, 18 aa, Staphylococcus
QHPFNQKYTQATDKNQKG

SEQ ID NO: 2099822 - protein, 15 aa, Staphylococcus
QHQTATTEEKDTAVQ

SEQ ID NO: 2099823 - protein, 12 aa, Staphylococcus
QHRPAPPDELKP

SEQ ID NO: 2099824 - protein, 9 aa, Staphylococcus
QHTSTKNSF

SEQ ID NO: 2099825 - protein, 12 aa, Staphylococcus
QHYGAPSSTLEQ

SEQ ID NO: 2099826 - protein, 4 aa, Staphylococcus
QHYK

SEQ ID NO: 2099827 - protein, 118 aa, Staphylococcus
QIDESSSNSQQENSLTSSNKNQLNSSSVTPSQSNQVAQSNNQIESKQSSDKKVSTYSNNDNNATQVNVDQAKTSQEANTKNASASKTTQTSTSNSTQSGYSGFRSVGGKGGPATSVKT

SEQ ID NO: 2099828 - protein, 13 aa, Staphylococcus
QIDGESNITPNTL

SEQ ID NO: 2099829 - protein, 12 aa, Staphylococcus
QIDKSGTNGEYQ

SEQ ID NO: 2099830 - protein, 16 aa, Staphylococcus
QIDNLQDAKAEKSLNK

SEQ ID NO: 2099831 - protein, 8 aa, Staphylococcus
QIEPGTTH

SEQ ID NO: 2099832 - protein, 27 aa, Staphylococcus
QIGAPQQYTEAPIQQESQHNKPSMSED

SEQ ID NO: 2099833 - protein, 4 aa, Staphylococcus
QIGG

SEQ ID NO: 2099834 - protein, 6 aa, Staphylococcus
QIGGHS

SEQ ID NO: 2099835 - protein, 6 aa, Staphylococcus
QIKGYD

SEQ ID NO: 2099836 - protein, 11 aa, Staphylococcus
QILNTNTTEFE

SEQ ID NO: 2099837 - protein, 11 aa, Staphylococcus
QINGNKANSVT

SEQ ID NO: 2099838 - protein, 7 aa, Staphylococcus
QINPNIK

SEQ ID NO: 2099839 - protein, 22 aa, Staphylococcus
QINRSTSNNDVDNAKTNATQTI

SEQ ID NO: 2099840 - protein, 8 aa, Staphylococcus
QITDQQKA

SEQ ID NO: 2099841 - protein, 4 aa, Staphylococcus
QITG

SEQ ID NO: 2099842 - protein, 14 aa, Staphylococcus
QKAAKEYRKYTNEQ

SEQ ID NO: 2099843 - protein, 15 aa, Staphylococcus
QKALEKTEQEFKENG

SEQ ID NO: 2099844 - protein, 22 aa, Staphylococcus
QKAQDKITEINQNTQATQDERN

SEQ ID NO: 2099845 - protein, 35 aa, Staphylococcus
QKAQERKATLNQTPDATDEEKNAANTKVDQALNDG

SEQ ID NO: 2099846 - protein, 7 aa, Staphylococcus
QKASPNT

SEQ ID NO: 2099847 - protein, 10 aa, Staphylococcus
QKAVPASSSF

SEQ ID NO: 2099848 - protein, 64 aa, Staphylococcus
QKDDEGNVIKDKNGKEKVNGYYTDANAHGPEWTSGNEHGEATLTSQTEYTYKAKATGLKPNTKY

SEQ ID NO: 2099849 - protein, 7 aa, Staphylococcus
QKDEDKK

SEQ ID NO: 2099850 - protein, 9 aa, Staphylococcus
QKDIEDLGG

SEQ ID NO: 2099851 - protein, 6 aa, Staphylococcus
QKDIQR

SEQ ID NO: 2099852 - protein, 35 aa, Staphylococcus
QKDNNDKVEQYDKNDKSNTSKERPTIPKDKSKMAG

SEQ ID NO: 2099853 - protein, 5 aa, Staphylococcus
QKDPV

SEQ ID NO: 2099854 - protein, 6 aa, Staphylococcus
QKEDAD

SEQ ID NO: 2099855 - protein, 26 aa, Staphylococcus
QKEKDGETYSKDLDDKEIEKQGKQMA

SEQ ID NO: 2099856 - protein, 26 aa, Staphylococcus
QKEKDGETYSKKLNDKEIEKQGKAMA

SEQ ID NO: 2099857 - protein, 82 aa, Staphylococcus
QKENRDKLKDEYSKYKSNPESYKQNAKDIASQISSKAGETYNEVKQDPKGYASKVKQDPKGFINEQKDRFSNVSEQEEEHVE

SEQ ID NO: 2099858 - protein, 6 aa, Staphylococcus
QKESAA

SEQ ID NO: 2099859 - protein, 5 aa, Staphylococcus
QKETG

SEQ ID NO: 2099860 - protein, 4 aa, Staphylococcus
QKFT

SEQ ID NO: 2099861 - protein, 5 aa, Staphylococcus
QKFTT

SEQ ID NO: 2099862 - protein, 5 aa, Staphylococcus
QKGEN

SEQ ID NO: 2099863 - protein, 24 aa, Staphylococcus
QKGKEKHEVTVDAKTGKVLDNQKD

SEQ ID NO: 2099864 - protein, 24 aa, Staphylococcus
QKGKEQRDITVDAQTGKVIDNQQD

SEQ ID NO: 2099865 - protein, 8 aa, Staphylococcus
QKGKFPKR

SEQ ID NO: 2099866 - protein, 8 aa, Staphylococcus
QKGNAQQG

SEQ ID NO: 2099867 - protein, 24 aa, Staphylococcus
QKGNNKHEFSYDAKTGKLLSNEKD

SEQ ID NO: 2099868 - protein, 12 aa, Staphylococcus
QKIDNDNNNTTG

SEQ ID NO: 2099869 - protein, 8 aa, Staphylococcus
QKKEIETL

SEQ ID NO: 2099870 - protein, 13 aa, Staphylococcus
QKKKETTPAHTRN

SEQ ID NO: 2099871 - protein, 31 aa, Staphylococcus
QKLDKKDTKEIDKLNSKYKDKVNGKQQKKVE

SEQ ID NO: 2099872 - protein, 117 aa, Staphylococcus
QKLEKEKKDLEKQEEKLKSDKEKYKSQRETLEKEVEEMQSTSSDDDKDNKEKTSDKSKEKSSQHQTTHHQNKDQQNQHQNSNNTDNTQTDKDKTHKQQSSQSTKNDTQKQSKQPKQQ

SEQ ID NO: 2099873 - protein, 21 aa, Staphylococcus
QKLNPKKDSIAYEKAKDNPYA

SEQ ID NO: 2099874 - protein, 9 aa, Staphylococcus
QKLSPKDDS

SEQ ID NO: 2099875 - protein, 9 aa, Staphylococcus
QKLSPKKDS

SEQ ID NO: 2099876 - protein, 21 aa, Staphylococcus
QKLSPKKDSIALEKAKDNPYA

SEQ ID NO: 2099877 - protein, 10 aa, Staphylococcus
QKMDQHAKHD

SEQ ID NO: 2099878 - protein, 16 aa, Staphylococcus
QKMSPQALKDQLTPED

SEQ ID NO: 2099879 - protein, 13 aa, Staphylococcus
QKPINDASHTGWT

SEQ ID NO: 2099880 - protein, 6 aa, Staphylococcus
QKPIPN

SEQ ID NO: 2099881 - protein, 11 aa, Staphylococcus
QKPITDSTKAM

SEQ ID NO: 2099882 - protein, 12 aa, Staphylococcus
QKPSFSKEGKVN

SEQ ID NO: 2099883 - protein, 6 aa, Staphylococcus
QKQDAD

SEQ ID NO: 2099884 - protein, 27 aa, Staphylococcus
QKQDDTRLSSGFAPKDHNDKDPNLSPN

SEQ ID NO: 2099885 - protein, 8 aa, Staphylococcus
QKQGEEAE

SEQ ID NO: 2099886 - protein, 19 aa, Staphylococcus
QKQHGGDISPLYKGGQDNM

SEQ ID NO: 2099887 - protein, 13 aa, Staphylococcus
QKQKAKGITTETQ

SEQ ID NO: 2099888 - protein, 5 aa, Staphylococcus
QKQRW

SEQ ID NO: 2099889 - protein, 9 aa, Staphylococcus
QKSFTSNAT

SEQ ID NO: 2099890 - protein, 8 aa, Staphylococcus
QKSGSRVR

SEQ ID NO: 2099891 - protein, 20 aa, Staphylococcus
QKSYGKDLKKVDNGKNNTTG

SEQ ID NO: 2099892 - protein, 22 aa, Staphylococcus
QKTHQDMVKSSDKVNPEFKKER

SEQ ID NO: 2099893 - protein, 8 aa, Staphylococcus
QKTHVDGD

SEQ ID NO: 2099894 - protein, 10 aa, Staphylococcus
QKVQKDPKIL

SEQ ID NO: 2099895 - protein, 10 aa, Staphylococcus
QKVQKNPKLL

SEQ ID NO: 2099896 - protein, 5 aa, Staphylococcus
QKVSS

SEQ ID NO: 2099897 - protein, 4 aa, Staphylococcus
QKYE

SEQ ID NO: 2099898 - protein, 5 aa, Staphylococcus
QLAGN

SEQ ID NO: 2099899 - protein, 12 aa, Staphylococcus
QLAKDKKALAPM

SEQ ID NO: 2099900 - protein, 19 aa, Staphylococcus
QLAQSNDQSLNDSPIQEGA

SEQ ID NO: 2099901 - protein, 101 aa, Staphylococcus
QLDAASTSGGSSSSSSSSSSSSSSSASSRGASSTSSSSSMSRSSAANASRAAQQSSQRASQQAAKSSQSKSAQSKQYKNNSNTKSLVSPRRPYSSSAAYQT

SEQ ID NO: 2099902 - protein, 28 aa, Staphylococcus
QLDAGSKFNSQNPQYANSNYKGAKIPTL

SEQ ID NO: 2099903 - protein, 11 aa, Staphylococcus
QLDGNNVTNGD

SEQ ID NO: 2099904 - protein, 8 aa, Staphylococcus
QLDPQEVK

SEQ ID NO: 2099905 - protein, 13 aa, Staphylococcus
QLEEKADFDLERS

SEQ ID NO: 2099906 - protein, 12 aa, Staphylococcus
QLERTYEPASSG

SEQ ID NO: 2099907 - protein, 13 aa, Staphylococcus
QLGQKGGKKPTIT

SEQ ID NO: 2099908 - protein, 10 aa, Staphylococcus
QLLNSQSDKV

SEQ ID NO: 2099909 - protein, 26 aa, Staphylococcus
QLNDAKDALNGNSNVEHAKQEAIEQI

SEQ ID NO: 2099910 - protein, 5 aa, Staphylococcus
QLNDE

SEQ ID NO: 2099911 - protein, 17 aa, Staphylococcus
QLNEDRDVVNGREQKKI

SEQ ID NO: 2099912 - protein, 7 aa, Staphylococcus
QLNQTVE

SEQ ID NO: 2099913 - protein, 4 aa, Staphylococcus
QLPL

SEQ ID NO: 2099914 - protein, 7 aa, Staphylococcus
QLPNGHD

SEQ ID NO: 2099915 - protein, 6 aa, Staphylococcus
QLPPGR

SEQ ID NO: 2099916 - protein, 7 aa, Staphylococcus
QLQAGQT

SEQ ID NO: 2099917 - protein, 9 aa, Staphylococcus
QLQSGETHV

SEQ ID NO: 2099918 - protein, 13 aa, Staphylococcus
QLRGKGGTKPTIT

SEQ ID NO: 2099919 - protein, 8 aa, Staphylococcus
QLSGNKNI

SEQ ID NO: 2099920 - protein, 15 aa, Staphylococcus
QLSNTDTTDKNKKDF

SEQ ID NO: 2099921 - protein, 30 aa, Staphylococcus
QLTEAKNALKADKSVLEQKRPGLNHVGVTE

SEQ ID NO: 2099922 - protein, 9 aa, Staphylococcus
QLTKDNKGA

SEQ ID NO: 2099923 - protein, 19 aa, Staphylococcus
QLTPAQRKKIEADKDNLTL

SEQ ID NO: 2099924 - protein, 13 aa, Staphylococcus
QLTPGQRTKIEAN

SEQ ID NO: 2099925 - protein, 11 aa, Staphylococcus
QLTQGEKSLEN

SEQ ID NO: 2099926 - protein, 11 aa, Staphylococcus
QLTQGQKTLEN

SEQ ID NO: 2099927 - protein, 11 aa, Staphylococcus
QLYPGAPKGQF

SEQ ID NO: 2099928 - protein, 5 aa, Staphylococcus
QMEDK

SEQ ID NO: 2099929 - protein, 16 aa, Staphylococcus
QNANQWKNTIGTTTKR

SEQ ID NO: 2099930 - protein, 14 aa, Staphylococcus
QNANTNNDVTNAKD

SEQ ID NO: 2099931 - protein, 24 aa, Staphylococcus
QNAYGAPPQVQRNGYGWSNATYSE

SEQ ID NO: 2099932 - protein, 16 aa, Staphylococcus
QNDDNSSNHDGKTITV

SEQ ID NO: 2099933 - protein, 10 aa, Staphylococcus
QNDKQRSAKY

SEQ ID NO: 2099934 - protein, 5 aa, Staphylococcus
QNDPH

SEQ ID NO: 2099935 - protein, 14 aa, Staphylococcus
QNDPSAKSMKPTTF

SEQ ID NO: 2099936 - protein, 24 aa, Staphylococcus
QNDQHKQEDKQSNQSDSNSKEHSY

SEQ ID NO: 2099937 - protein, 9 aa, Staphylococcus
QNDTNGERI

SEQ ID NO: 2099938 - protein, 4 aa, Staphylococcus
QNED

SEQ ID NO: 2099939 - protein, 8 aa, Staphylococcus
QNEFKEDS

SEQ ID NO: 2099940 - protein, 10 aa, Staphylococcus
QNGNGGDIQR

SEQ ID NO: 2099941 - protein, 78 aa, Staphylococcus
QNGQATPQQDVSNQTSADQVSSQQQTSQAQPEQTSAPQTEQTQQPQAKATTSYSAPTNNTASSQASTNQASSGSSVNL

SEQ ID NO: 2099942 - protein, 4 aa, Staphylococcus
QNHS

SEQ ID NO: 2099943 - protein, 7 aa, Staphylococcus
QNIERNM

SEQ ID NO: 2099944 - protein, 8 aa, Staphylococcus
QNIERNMS

SEQ ID NO: 2099945 - protein, 9 aa, Staphylococcus
QNITNQSEI

SEQ ID NO: 2099946 - protein, 9 aa, Staphylococcus
QNKADNHEL

SEQ ID NO: 2099947 - protein, 8 aa, Staphylococcus
QNKADTTN

SEQ ID NO: 2099948 - protein, 32 aa, Staphylococcus
QNKDKLKEVKIKDDKGKDTKPTKKTIQDNSYA

SEQ ID NO: 2099949 - protein, 23 aa, Staphylococcus
QNKPEGDDKKSSSDSGSSSSKDK

SEQ ID NO: 2099950 - protein, 26 aa, Staphylococcus
QNKPENGDKGSNSSKSSSNDGNSKDK

SEQ ID NO: 2099951 - protein, 116 aa, Staphylococcus
QNKQPQKTIKAVNNKTKSVSQPIKKKNTAAATKPNNTSKVVTQKTSLKKPNTSVKSTKANTKKVQPTKKVTVNKKQPAPVNKKKVKQTAKPKQSKVIKATPKAVKNKKTKSASTKK

SEQ ID NO: 2099952 - protein, 20 aa, Staphylococcus
QNKSEDGNNKSDSSSGSKDK

SEQ ID NO: 2099953 - protein, 22 aa, Staphylococcus
QNLGNEAKLTGQYKVNNNNNGL

SEQ ID NO: 2099954 - protein, 18 aa, Staphylococcus
QNLGPLEDKTTKLRDQNH

SEQ ID NO: 2099955 - protein, 18 aa, Staphylococcus
QNLGPLEDKTTNLRDENH

SEQ ID NO: 2099956 - protein, 13 aa, Staphylococcus
QNMNAEDPSQKAL

SEQ ID NO: 2099957 - protein, 14 aa, Staphylococcus
QNMNAEDPSQKSLS

SEQ ID NO: 2099958 - protein, 7 aa, Staphylococcus
QNNETIS

SEQ ID NO: 2099959 - protein, 19 aa, Staphylococcus
QNNKINTIDKNITDKSIDS

SEQ ID NO: 2099960 - protein, 9 aa, Staphylococcus
QNNSYPTYS

SEQ ID NO: 2099961 - protein, 4 aa, Staphylococcus
QNPH

SEQ ID NO: 2099962 - protein, 4 aa, Staphylococcus
QNPI

SEQ ID NO: 2099963 - protein, 5 aa, Staphylococcus
QNQKA

SEQ ID NO: 2099964 - protein, 14 aa, Staphylococcus
QNRGEDISNAFSKD

SEQ ID NO: 2099965 - protein, 11 aa, Staphylococcus
QNRVDEEQKRF

SEQ ID NO: 2099966 - protein, 7 aa, Staphylococcus
QNSAEAK

SEQ ID NO: 2099967 - protein, 65 aa, Staphylococcus
QNSDSSQQENQKKTSQADNKKDEKHTSKHQTENNEKQNKTSGQQHSDKEDKGQTKSSAGQLSDKT

SEQ ID NO: 2099968 - protein, 39 aa, Staphylococcus
QNSEFSDAKTALKEAANKLYGDNSAEADAIDKAWTEVGV

SEQ ID NO: 2099969 - protein, 17 aa, Staphylococcus
QNSITSGDADTATKAWA

SEQ ID NO: 2099970 - protein, 8 aa, Staphylococcus
QNSKQNTE

SEQ ID NO: 2099971 - protein, 17 aa, Staphylococcus
QNSSKVTLTEENGAQSD

SEQ ID NO: 2099972 - protein, 40 aa, Staphylococcus
QNVGPVKAPEPSQPVPSIATRQYAADASLAAESQNEQADF

SEQ ID NO: 2099973 - protein, 8 aa, Staphylococcus
QNVKTDLS

SEQ ID NO: 2099974 - protein, 17 aa, Staphylococcus
QNYEETKINKSYPNSNF

SEQ ID NO: 2099975 - protein, 21 aa, Staphylococcus
QNYEYQEPMNGEKKANGDGLY

SEQ ID NO: 2099976 - protein, 14 aa, Staphylococcus
QPATLKDASAVTKD

SEQ ID NO: 2099977 - protein, 11 aa, Staphylococcus
QPDTEDHKKPW

SEQ ID NO: 2099978 - protein, 15 aa, Staphylococcus
QPDVNTNIKNDSGDI

SEQ ID NO: 2099979 - protein, 33 aa, Staphylococcus
QPDVSQSDIDAKYKVSKQSISPETVKVTGGEQQ

SEQ ID NO: 2099980 - protein, 6 aa, Staphylococcus
QPFSQE

SEQ ID NO: 2099981 - protein, 11 aa, Staphylococcus
QPFTEEQYSDF

SEQ ID NO: 2099982 - protein, 8 aa, Staphylococcus
QPGKGKAL

SEQ ID NO: 2099983 - protein, 5 aa, Staphylococcus
QPKRL

SEQ ID NO: 2099984 - protein, 4 aa, Staphylococcus
QPME

SEQ ID NO: 2099985 - protein, 26 aa, Staphylococcus
QPNGSNYTNKNHYKDNPQDIVADPES

SEQ ID NO: 2099986 - protein, 21 aa, Staphylococcus
QPQHSTEPEKEPWSQPPSGYK

SEQ ID NO: 2099987 - protein, 10 aa, Staphylococcus
QPQSTSELGG

SEQ ID NO: 2099988 - protein, 13 aa, Staphylococcus
QPTAPQISESKQG

SEQ ID NO: 2099989 - protein, 15 aa, Staphylococcus
QPTTVAASSKDEAVS

SEQ ID NO: 2099990 - protein, 15 aa, Staphylococcus
QPTTVAASSKDEKIS

SEQ ID NO: 2099991 - protein, 15 aa, Staphylococcus
QPTTVAASSKDERIS

SEQ ID NO: 2099992 - protein, 16 aa, Staphylococcus
QPTTVAASSKSESVRQ

SEQ ID NO: 2099993 - protein, 15 aa, Staphylococcus
QPTTVAASSPDPKVS

SEQ ID NO: 2099994 - protein, 15 aa, Staphylococcus
QPTWKSETSSYRDAT

SEQ ID NO: 2099995 - protein, 7 aa, Staphylococcus
QPVKHAP

SEQ ID NO: 2099996 - protein, 6 aa, Staphylococcus
QPYKQQ

SEQ ID NO: 2099997 - protein, 18 aa, Staphylococcus
QPYTIKGDSMDPTLKDGE

SEQ ID NO: 2099998 - protein, 28 aa, Staphylococcus
QQASAHATLEKTTPQDRGVVKDKPEDIQ

SEQ ID NO: 2099999 - protein, 58 aa, Staphylococcus
QQATAHASTLQTTYNHTSAQNQTRTSSTTPHISQSKKAVKRVTTTVKAPTTVKTTTKV

SEQ ID NO: 2100000 - protein, 8 aa, Staphylococcus
QQDEKKAW

SEQ ID NO: 2100001 - protein, 6 aa, Staphylococcus
QQDGID

SEQ ID NO: 2100002 - protein, 4 aa, Staphylococcus
QQGA

SEQ ID NO: 2100003 - protein, 5 aa, Staphylococcus
QQGGY

SEQ ID NO: 2100004 - protein, 14 aa, Staphylococcus
QQGKDAVEELAATV

SEQ ID NO: 2100005 - protein, 13 aa, Staphylococcus
QQGKNAVEEILEE

SEQ ID NO: 2100006 - protein, 13 aa, Staphylococcus
QQGKNAVEELIDE

SEQ ID NO: 2100007 - protein, 13 aa, Staphylococcus
QQGKNAVEELLDE

SEQ ID NO: 2100008 - protein, 11 aa, Staphylococcus
QQGNKSPQFEQ

SEQ ID NO: 2100009 - protein, 96 aa, Staphylococcus
QQHDGGTNISQSDSNLQTSNQLTNKESVTSEQPSKETVMSQADTEHTETQSTENVSIDNDKSIQTTDQTANSNHSNDLDQINQTHSAEVNNTENKL

SEQ ID NO: 2100010 - protein, 21 aa, Staphylococcus
QQIKQDKKNKNLTVEDKPSTV

SEQ ID NO: 2100011 - protein, 19 aa, Staphylococcus
QQINTEHTSQGVNSVKANA

SEQ ID NO: 2100012 - protein, 41 aa, Staphylococcus
QQISKEKSNITALEKDKKNIATAKNNNKKVTNLKASSTYYQ

SEQ ID NO: 2100013 - protein, 6 aa, Staphylococcus
QQLGRS

SEQ ID NO: 2100014 - protein, 7 aa, Staphylococcus
QQLGRSV

SEQ ID NO: 2100015 - protein, 21 aa, Staphylococcus
QQLKQDKKNKDLTIEDRPSTV

SEQ ID NO: 2100016 - protein, 13 aa, Staphylococcus
QQNAALNQKNWDK

SEQ ID NO: 2100017 - protein, 7 aa, Staphylococcus
QQNKAKM

SEQ ID NO: 2100018 - protein, 10 aa, Staphylococcus
QQPNLMGEES

SEQ ID NO: 2100019 - protein, 8 aa, Staphylococcus
QQPNSEKA

SEQ ID NO: 2100020 - protein, 14 aa, Staphylococcus
QQPTAHAATSSYYN

SEQ ID NO: 2100021 - protein, 72 aa, Staphylococcus
QQQQPVKSQQSAEQQKSNETPKKNNNANSNHGNNAKSQQHSGQGSGGNDSDSNTTRSASHSSAASTTQSKTN

SEQ ID NO: 2100022 - protein, 6 aa, Staphylococcus
QQQSGR

SEQ ID NO: 2100023 - protein, 4 aa, Staphylococcus
QQRL

SEQ ID NO: 2100024 - protein, 7 aa, Staphylococcus
QQSELRS

SEQ ID NO: 2100025 - protein, 8 aa, Staphylococcus
QQTEPQSE

SEQ ID NO: 2100026 - protein, 5 aa, Staphylococcus
QQTND

SEQ ID NO: 2100027 - protein, 8 aa, Staphylococcus
QQTPKGTM

SEQ ID NO: 2100028 - protein, 12 aa, Staphylococcus
QQVQKQDIDEAK

SEQ ID NO: 2100029 - protein, 7 aa, Staphylococcus
QQYSDQN

SEQ ID NO: 2100030 - protein, 5 aa, Staphylococcus
QRCPT

SEQ ID NO: 2100031 - protein, 10 aa, Staphylococcus
QRDDETNAEY

SEQ ID NO: 2100032 - protein, 5 aa, Staphylococcus
QRDGR

SEQ ID NO: 2100033 - protein, 5 aa, Staphylococcus
QREGL

SEQ ID NO: 2100034 - protein, 5 aa, Staphylococcus
QREGR

SEQ ID NO: 2100035 - protein, 18 aa, Staphylococcus
QRESGGNANAVNASSGAY

SEQ ID NO: 2100036 - protein, 6 aa, Staphylococcus
QRGSYQ

SEQ ID NO: 2100037 - protein, 9 aa, Staphylococcus
QRHKGIKKE

SEQ ID NO: 2100038 - protein, 6 aa, Staphylococcus
QRINIK

SEQ ID NO: 2100039 - protein, 5 aa, Staphylococcus
QRLAN

SEQ ID NO: 2100040 - protein, 6 aa, Staphylococcus
QRNHQQ

SEQ ID NO: 2100041 - protein, 5 aa, Staphylococcus
QRPDI

SEQ ID NO: 2100042 - protein, 10 aa, Staphylococcus
QRPNGEEVTE

SEQ ID NO: 2100043 - protein, 9 aa, Staphylococcus
QRQETFDKE

SEQ ID NO: 2100044 - protein, 30 aa, Staphylococcus
QSAHDKYKLDREQGEMSDSDKADDKNIQNL

SEQ ID NO: 2100045 - protein, 12 aa, Staphylococcus
QSAKFDRAEGLN

SEQ ID NO: 2100046 - protein, 9 aa, Staphylococcus
QSDAKKANI

SEQ ID NO: 2100047 - protein, 10 aa, Staphylococcus
QSDAKKANID

SEQ ID NO: 2100048 - protein, 9 aa, Staphylococcus
QSDNTANNK

SEQ ID NO: 2100049 - protein, 10 aa, Staphylococcus
QSDQNSITPG

SEQ ID NO: 2100050 - protein, 9 aa, Staphylococcus
QSEAAADKY

SEQ ID NO: 2100051 - protein, 10 aa, Staphylococcus
QSEAKKANID

SEQ ID NO: 2100052 - protein, 19 aa, Staphylococcus
QSEIELRERRGDLQKQEAR

SEQ ID NO: 2100053 - protein, 12 aa, Staphylococcus
QSEKLTSEQKAQ

SEQ ID NO: 2100054 - protein, 16 aa, Staphylococcus
QSFSSIKPGKKQATSV

SEQ ID NO: 2100055 - protein, 8 aa, Staphylococcus
QSGENSIV

SEQ ID NO: 2100056 - protein, 10 aa, Staphylococcus
QSGGAENKKD

SEQ ID NO: 2100057 - protein, 11 aa, Staphylococcus
QSGQDSISPGS

SEQ ID NO: 2100058 - protein, 11 aa, Staphylococcus
QSGQDSITPGE

SEQ ID NO: 2100059 - protein, 6 aa, Staphylococcus
QSHNGR

SEQ ID NO: 2100060 - protein, 25 aa, Staphylococcus
QSHTSNLNISSSNTTTSSTLSRTQS

SEQ ID NO: 2100061 - protein, 33 aa, Staphylococcus
QSIADKQTTLDSSPYINADPNKKQDYDNAIQNA

SEQ ID NO: 2100062 - protein, 34 aa, Staphylococcus
QSIANKADVKQGEDYIDAEQQKQLNYNDAVTNAE

SEQ ID NO: 2100063 - protein, 27 aa, Staphylococcus
QSIDDNAKVKASSAYINEDPTEQHNYD

SEQ ID NO: 2100064 - protein, 8 aa, Staphylococcus
QSIQPKHP

SEQ ID NO: 2100065 - protein, 12 aa, Staphylococcus
QSKMTKDWQTYD

SEQ ID NO: 2100066 - protein, 7 aa, Staphylococcus
QSKPVPY

SEQ ID NO: 2100067 - protein, 14 aa, Staphylococcus
QSKQQTQKKDYKPE

SEQ ID NO: 2100068 - protein, 18 aa, Staphylococcus
QSKSNNSSNYQSNDKKQV

SEQ ID NO: 2100069 - protein, 6 aa, Staphylococcus
QSLDSI

SEQ ID NO: 2100070 - protein, 5 aa, Staphylococcus
QSLKN

SEQ ID NO: 2100071 - protein, 6 aa, Staphylococcus
QSLNNG

SEQ ID NO: 2100072 - protein, 4 aa, Staphylococcus
QSLS

SEQ ID NO: 2100073 - protein, 16 aa, Staphylococcus
QSMSEVDKKQDHVKKT

SEQ ID NO: 2100074 - protein, 8 aa, Staphylococcus
QSMSSTDN

SEQ ID NO: 2100075 - protein, 13 aa, Staphylococcus
QSNPGTNGSGGYG

SEQ ID NO: 2100076 - protein, 22 aa, Staphylococcus
QSNYNAQNQPTQHLNQQKQNQN

SEQ ID NO: 2100077 - protein, 7 aa, Staphylococcus
QSPEDVL

SEQ ID NO: 2100078 - protein, 22 aa, Staphylococcus
QSPEDVLNKSGYEVEKIYPVEG

SEQ ID NO: 2100079 - protein, 6 aa, Staphylococcus
QSPEQL

SEQ ID NO: 2100080 - protein, 7 aa, Staphylococcus
QSPESLL

SEQ ID NO: 2100081 - protein, 6 aa, Staphylococcus
QSPHIS

SEQ ID NO: 2100082 - protein, 7 aa, Staphylococcus
QSPIPDY

SEQ ID NO: 2100083 - protein, 13 aa, Staphylococcus
QSQEDKEKEFRKQ

SEQ ID NO: 2100084 - protein, 28 aa, Staphylococcus
QSQIDKINEEAKKLKDLDEDDEKYKDQL

SEQ ID NO: 2100085 - protein, 5 aa, Staphylococcus
QSQSH

SEQ ID NO: 2100086 - protein, 10 aa, Staphylococcus
QSSIKSEGKI

SEQ ID NO: 2100087 - protein, 10 aa, Staphylococcus
QSSQESITPG

SEQ ID NO: 2100088 - protein, 17 aa, Staphylococcus
QSSSQSKQNSSSYNHSH

SEQ ID NO: 2100089 - protein, 23 aa, Staphylococcus
QSSTSTKTNAKSDIDRKLSEQIE

SEQ ID NO: 2100090 - protein, 8 aa, Staphylococcus
QSTAGGYG

SEQ ID NO: 2100091 - protein, 11 aa, Staphylococcus
QSTDYKTSVEN

SEQ ID NO: 2100092 - protein, 13 aa, Staphylococcus
QSTGGLKDDEYKP

SEQ ID NO: 2100093 - protein, 8 aa, Staphylococcus
QSTPGPYG

SEQ ID NO: 2100094 - protein, 19 aa, Staphylococcus
QSVDYTDADTNKQSAYTNA

SEQ ID NO: 2100095 - protein, 12 aa, Staphylococcus
QSVSASTTNVTG

SEQ ID NO: 2100096 - protein, 10 aa, Staphylococcus
QSVYDNANPI

SEQ ID NO: 2100097 - protein, 5 aa, Staphylococcus
QSWGN

SEQ ID NO: 2100098 - protein, 11 aa, Staphylococcus
QSYDKSHNELG

SEQ ID NO: 2100099 - protein, 20 aa, Staphylococcus
QTAEQTHVSEAASYKNYYNK

SEQ ID NO: 2100100 - protein, 12 aa, Staphylococcus
QTEREDNRQQHQ

SEQ ID NO: 2100101 - protein, 12 aa, Staphylococcus
QTFGQPEREQLT

SEQ ID NO: 2100102 - protein, 9 aa, Staphylococcus
QTGETFDET

SEQ ID NO: 2100103 - protein, 9 aa, Staphylococcus
QTGGIQEDE

SEQ ID NO: 2100104 - protein, 10 aa, Staphylococcus
QTGINNENDI

SEQ ID NO: 2100105 - protein, 9 aa, Staphylococcus
QTGLTEKEA

SEQ ID NO: 2100106 - protein, 14 aa, Staphylococcus
QTGNVRSVGPQEHG

SEQ ID NO: 2100107 - protein, 8 aa, Staphylococcus
QTGTALEN

SEQ ID NO: 2100108 - protein, 17 aa, Staphylococcus
QTKEGWGTGSVSAQTKG

SEQ ID NO: 2100109 - protein, 39 aa, Staphylococcus
QTLQANTQVPQTTDYTQASTDKQTAYDNAVEQAQQVVNG

SEQ ID NO: 2100110 - protein, 4 aa, Staphylococcus
QTNI

SEQ ID NO: 2100111 - protein, 16 aa, Staphylococcus
QTNITDKNVNSARKNA

SEQ ID NO: 2100112 - protein, 6 aa, Staphylococcus
QTNKGK

SEQ ID NO: 2100113 - protein, 11 aa, Staphylococcus
QTNPTSKDEPT

SEQ ID NO: 2100114 - protein, 9 aa, Staphylococcus
QTPYPTYNT

SEQ ID NO: 2100115 - protein, 4 aa, Staphylococcus
QTRN

SEQ ID NO: 2100116 - protein, 8 aa, Staphylococcus
QTSEGSYG

SEQ ID NO: 2100117 - protein, 6 aa, Staphylococcus
QTSETG

SEQ ID NO: 2100118 - protein, 25 aa, Staphylococcus
QTSNQNEPNTKQPEDNKKNDNQKGI

SEQ ID NO: 2100119 - protein, 8 aa, Staphylococcus
QTSQGAYG

SEQ ID NO: 2100120 - protein, 20 aa, Staphylococcus
QTSYDGLRSISNAGNLYTDG

SEQ ID NO: 2100121 - protein, 11 aa, Staphylococcus
QTTADDGQTTI

SEQ ID NO: 2100122 - protein, 23 aa, Staphylococcus
QTTKTRSKPTSSKVSASKPSTKV

SEQ ID NO: 2100123 - protein, 7 aa, Staphylococcus
QTTTVQE

SEQ ID NO: 2100124 - protein, 12 aa, Staphylococcus
QTYAETTAFNQS

SEQ ID NO: 2100125 - protein, 7 aa, Staphylococcus
QTYSTDN

SEQ ID NO: 2100126 - protein, 8 aa, Staphylococcus
QVDETLQE

SEQ ID NO: 2100127 - protein, 25 aa, Staphylococcus
QVDQTKGDLNGNDNLHDAQQQASTM

SEQ ID NO: 2100128 - protein, 9 aa, Staphylococcus
QVEKNLPGV

SEQ ID NO: 2100129 - protein, 9 aa, Staphylococcus
QVENDQYGL

SEQ ID NO: 2100130 - protein, 8 aa, Staphylococcus
QVESTLPG

SEQ ID NO: 2100131 - protein, 43 aa, Staphylococcus
QVGDNSIKNDNKKSNAPKRNKDSDAKSENQSSKKQSRTYTAQQ

SEQ ID NO: 2100132 - protein, 10 aa, Staphylococcus
QVKATTSALD

SEQ ID NO: 2100133 - protein, 30 aa, Staphylococcus
QVNANNSGARATVYDKTGKNATKYANRTFN

SEQ ID NO: 2100134 - protein, 17 aa, Staphylococcus
QVNKDQDIVNDQEKQDI

SEQ ID NO: 2100135 - protein, 28 aa, Staphylococcus
QVNQAKDNLNGDTKLTTKKQNATNDVNG

SEQ ID NO: 2100136 - protein, 12 aa, Staphylococcus
QVNSTNDGIRSS

SEQ ID NO: 2100137 - protein, 17 aa, Staphylococcus
QVNTATQHINDAQTLEA

SEQ ID NO: 2100138 - protein, 26 aa, Staphylococcus
QVNTTKDQLNGNTNLQNAKNEANTQL

SEQ ID NO: 2100139 - protein, 17 aa, Staphylococcus
QVSGNTSTFTDKMNAQA

SEQ ID NO: 2100140 - protein, 11 aa, Staphylococcus
QVSKTEAKEIL

SEQ ID NO: 2100141 - protein, 13 aa, Staphylococcus
QVTSTKDALDGTQ

SEQ ID NO: 2100142 - protein, 6 aa, Staphylococcus
QWKPED

SEQ ID NO: 2100143 - protein, 18 aa, Staphylococcus
QWPKSTRTITPSFTSNGF

SEQ ID NO: 2100144 - protein, 9 aa, Staphylococcus
QYAKANPDT

SEQ ID NO: 2100145 - protein, 7 aa, Staphylococcus
QYDQLKG

SEQ ID NO: 2100146 - protein, 8 aa, Staphylococcus
QYETTGKS

SEQ ID NO: 2100147 - protein, 5 aa, Staphylococcus
QYGIE

SEQ ID NO: 2100148 - protein, 27 aa, Staphylococcus
QYGNEGNRKKNSFQKQLSTDLASSYAS

SEQ ID NO: 2100149 - protein, 7 aa, Staphylococcus
QYGTSAE

SEQ ID NO: 2100150 - protein, 8 aa, Staphylococcus
QYHSNSRY

SEQ ID NO: 2100151 - protein, 8 aa, Staphylococcus
QYKNNPEL

SEQ ID NO: 2100152 - protein, 4 aa, Staphylococcus
QYLS

SEQ ID NO: 2100153 - protein, 8 aa, Staphylococcus
QYNDRKTK

SEQ ID NO: 2100154 - protein, 9 aa, Staphylococcus
QYRQANTPI

SEQ ID NO: 2100155 - protein, 5 aa, Staphylococcus
QYSEQ

SEQ ID NO: 2100156 - protein, 6 aa, Staphylococcus
QYTSTE

SEQ ID NO: 2100157 - protein, 4 aa, Staphylococcus
QYYG

SEQ ID NO: 2100158 - protein, 11 aa, Staphylococcus
RAATQKNLDEF

SEQ ID NO: 2100159 - protein, 9 aa, Staphylococcus
RAEDTYQSM

SEQ ID NO: 2100160 - protein, 4 aa, Staphylococcus
RAEQ

SEQ ID NO: 2100161 - protein, 9 aa, Staphylococcus
RAGDGYPAF

SEQ ID NO: 2100162 - protein, 10 aa, Staphylococcus
RAGGKAGSLW

SEQ ID NO: 2100163 - protein, 13 aa, Staphylococcus
RAKATDKTDPMET

SEQ ID NO: 2100164 - protein, 5 aa, Staphylococcus
RALGG

SEQ ID NO: 2100165 - protein, 21 aa, Staphylococcus
RALPNKHKGTKTYAYSPGNKH

SEQ ID NO: 2100166 - protein, 10 aa, Staphylococcus
RANAEGQLDA

SEQ ID NO: 2100167 - protein, 13 aa, Staphylococcus
RANAISPGTIETP

SEQ ID NO: 2100168 - protein, 7 aa, Staphylococcus
RAQAGHT

SEQ ID NO: 2100169 - protein, 4 aa, Staphylococcus
RASK

SEQ ID NO: 2100170 - protein, 5 aa, Staphylococcus
RAYET

SEQ ID NO: 2100171 - protein, 8 aa, Staphylococcus
RDAGEQAT

SEQ ID NO: 2100172 - protein, 10 aa, Staphylococcus
RDAQALDSTM

SEQ ID NO: 2100173 - protein, 9 aa, Staphylococcus
RDASGDAGT

SEQ ID NO: 2100174 - protein, 13 aa, Staphylococcus
RDASSLPKDESED

SEQ ID NO: 2100175 - protein, 6 aa, Staphylococcus
RDATRH

SEQ ID NO: 2100176 - protein, 7 aa, Staphylococcus
RDDNDQR

SEQ ID NO: 2100177 - protein, 27 aa, Staphylococcus
RDDQSVKNNTIDAKEPTGSRSELEREI

SEQ ID NO: 2100178 - protein, 13 aa, Staphylococcus
RDEADQQADYDKE

SEQ ID NO: 2100179 - protein, 12 aa, Staphylococcus
RDEADQQANYDK

SEQ ID NO: 2100180 - protein, 10 aa, Staphylococcus
RDEADRMADY

SEQ ID NO: 2100181 - protein, 12 aa, Staphylococcus
RDERTCRKRKSS

SEQ ID NO: 2100182 - protein, 10 aa, Staphylococcus
RDETNAEPVS

SEQ ID NO: 2100183 - protein, 15 aa, Staphylococcus
RDGATDLNRKTSLNP

SEQ ID NO: 2100184 - protein, 5 aa, Staphylococcus
RDGFR

SEQ ID NO: 2100185 - protein, 7 aa, Staphylococcus
RDGFSEV

SEQ ID NO: 2100186 - protein, 9 aa, Staphylococcus
RDGSRKPYT

SEQ ID NO: 2100187 - protein, 9 aa, Staphylococcus
RDHKQDSPL

SEQ ID NO: 2100188 - protein, 4 aa, Staphylococcus
RDII

SEQ ID NO: 2100189 - protein, 27 aa, Staphylococcus
RDKKDSSLNTARAKRPTGAESEVDREI

SEQ ID NO: 2100190 - protein, 29 aa, Staphylococcus
RDKSHEHRKNQRPPHPKKSTSDKKETHEK

SEQ ID NO: 2100191 - protein, 30 aa, Staphylococcus
RDKSHEQRKNQMPPHKNTQSPTQNTPRKKG

SEQ ID NO: 2100192 - protein, 28 aa, Staphylococcus
RDKSHESRQNQKPPQNTQGDNQPKKGGF

SEQ ID NO: 2100193 - protein, 8 aa, Staphylococcus
RDLAEKGI

SEQ ID NO: 2100194 - protein, 4 aa, Staphylococcus
RDNI

SEQ ID NO: 2100195 - protein, 28 aa, Staphylococcus
RDNSHKERQNQKPPQSPKDNQQPKTGGF

SEQ ID NO: 2100196 - protein, 5 aa, Staphylococcus
RDRGA

SEQ ID NO: 2100197 - protein, 11 aa, Staphylococcus
RDRQKNQTFEA

SEQ ID NO: 2100198 - protein, 5 aa, Staphylococcus
RDRST

SEQ ID NO: 2100199 - protein, 14 aa, Staphylococcus
RDSEGRLIPIEELY

SEQ ID NO: 2100200 - protein, 21 aa, Staphylococcus
RDSRTDANMKEATTKAIEENV

SEQ ID NO: 2100201 - protein, 5 aa, Staphylococcus
RDYTN

SEQ ID NO: 2100202 - protein, 15 aa, Staphylococcus
REGATNLNRQTSLNP

SEQ ID NO: 2100203 - protein, 5 aa, Staphylococcus
REIPE

SEQ ID NO: 2100204 - protein, 8 aa, Staphylococcus
REKHSEPV

SEQ ID NO: 2100205 - protein, 4 aa, Staphylococcus
RENI

SEQ ID NO: 2100206 - protein, 7 aa, Staphylococcus
RENKDLK

SEQ ID NO: 2100207 - protein, 8 aa, Staphylococcus
RENNGGVM

SEQ ID NO: 2100208 - protein, 6 aa, Staphylococcus
REQKGL

SEQ ID NO: 2100209 - protein, 22 aa, Staphylococcus
REQTENELRERRGELQKQETRL

SEQ ID NO: 2100210 - protein, 21 aa, Staphylococcus
REQTESELRERRGELQKQEAR

SEQ ID NO: 2100211 - protein, 20 aa, Staphylococcus
REQTESELRERRGELQRQET

SEQ ID NO: 2100212 - protein, 14 aa, Staphylococcus
REQTSFEDALDEAQ

SEQ ID NO: 2100213 - protein, 7 aa, Staphylococcus
REQTTFE

SEQ ID NO: 2100214 - protein, 18 aa, Staphylococcus
RESNGQANARNASGASGL

SEQ ID NO: 2100215 - protein, 5 aa, Staphylococcus
REVTS

SEQ ID NO: 2100216 - protein, 7 aa, Staphylococcus
RFGEGKD

SEQ ID NO: 2100217 - protein, 14 aa, Staphylococcus
RFTDEGAADPSNNL

SEQ ID NO: 2100218 - protein, 13 aa, Staphylococcus
RGASGKAPEHTYA

SEQ ID NO: 2100219 - protein, 9 aa, Staphylococcus
RGASGYAPE

SEQ ID NO: 2100220 - protein, 10 aa, Staphylococcus
RGASGYAPEH

SEQ ID NO: 2100221 - protein, 9 aa, Staphylococcus
RGDKAELGV

SEQ ID NO: 2100222 - protein, 5 aa, Staphylococcus
RGEAT

SEQ ID NO: 2100223 - protein, 13 aa, Staphylococcus
RGESQIPKKNKRI

SEQ ID NO: 2100224 - protein, 12 aa, Staphylococcus
RGETNIPKTNKK

SEQ ID NO: 2100225 - protein, 6 aa, Staphylococcus
RGGFDK

SEQ ID NO: 2100226 - protein, 6 aa, Staphylococcus
RGGFED

SEQ ID NO: 2100227 - protein, 6 aa, Staphylococcus
RGGFES

SEQ ID NO: 2100228 - protein, 21 aa, Staphylococcus
RGLGQTKEAWGKGSVEEQTKG

SEQ ID NO: 2100229 - protein, 27 aa, Staphylococcus
RGRSMSMGNNSSNASTKSYETGSPWGV

SEQ ID NO: 2100230 - protein, 11 aa, Staphylococcus
RGRTEKPEFTY

SEQ ID NO: 2100231 - protein, 7 aa, Staphylococcus
RGSENAY

SEQ ID NO: 2100232 - protein, 4 aa, Staphylococcus
RGSQ

SEQ ID NO: 2100233 - protein, 11 aa, Staphylococcus
RGVTNKEYNDL

SEQ ID NO: 2100234 - protein, 8 aa, Staphylococcus
RGYGAKDI

SEQ ID NO: 2100235 - protein, 15 aa, Staphylococcus
RHPGQEERRTVGGPY

SEQ ID NO: 2100236 - protein, 8 aa, Staphylococcus
RIENDGNF

SEQ ID NO: 2100237 - protein, 9 aa, Staphylococcus
RIGNGDNNV

SEQ ID NO: 2100238 - protein, 4 aa, Staphylococcus
RIHP

SEQ ID NO: 2100239 - protein, 15 aa, Staphylococcus
RIPHTNSDTNHPNDG

SEQ ID NO: 2100240 - protein, 8 aa, Staphylococcus
RISDNELK

SEQ ID NO: 2100241 - protein, 8 aa, Staphylococcus
RKELTKEI

SEQ ID NO: 2100242 - protein, 16 aa, Staphylococcus
RKETGAGGDFGRQERQ

SEQ ID NO: 2100243 - protein, 15 aa, Staphylococcus
RKGANELNERTSLNP

SEQ ID NO: 2100244 - protein, 6 aa, Staphylococcus
RKGNIG

SEQ ID NO: 2100245 - protein, 5 aa, Staphylococcus
RKIKS

SEQ ID NO: 2100246 - protein, 5 aa, Staphylococcus
RKIVD

SEQ ID NO: 2100247 - protein, 6 aa, Staphylococcus
RKKDEE

SEQ ID NO: 2100248 - protein, 6 aa, Staphylococcus
RKLADG

SEQ ID NO: 2100249 - protein, 6 aa, Staphylococcus
RKLERE

SEQ ID NO: 2100250 - protein, 54 aa, Staphylococcus
RKNQKDSTASNDDKESSNQDNSANQTNNQQNGNTGNTQYNNDANNQSQTNSAQT

SEQ ID NO: 2100251 - protein, 5 aa, Staphylococcus
RKNTK

SEQ ID NO: 2100252 - protein, 9 aa, Staphylococcus
RKPDGSIDI

SEQ ID NO: 2100253 - protein, 8 aa, Staphylococcus
RKPGMSRD

SEQ ID NO: 2100254 - protein, 12 aa, Staphylococcus
RKPQGANIGEQR

SEQ ID NO: 2100255 - protein, 13 aa, Staphylococcus
RKPQGANIGEQRD

SEQ ID NO: 2100256 - protein, 5 aa, Staphylococcus
RKPSD

SEQ ID NO: 2100257 - protein, 17 aa, Staphylococcus
RKQTSKDLELGYYDKAK

SEQ ID NO: 2100258 - protein, 15 aa, Staphylococcus
RKQTSKDLELNYYEN

SEQ ID NO: 2100259 - protein, 15 aa, Staphylococcus
RKQTSKDLKLGFYGE

SEQ ID NO: 2100260 - protein, 8 aa, Staphylococcus
RKQTYADY

SEQ ID NO: 2100261 - protein, 12 aa, Staphylococcus
RKSEDDSKHKLQ

SEQ ID NO: 2100262 - protein, 12 aa, Staphylococcus
RKSEDEDSTELQ

SEQ ID NO: 2100263 - protein, 11 aa, Staphylococcus
RKSEKDKKYAL

SEQ ID NO: 2100264 - protein, 14 aa, Staphylococcus
RKSGDDTSNDRQVD

SEQ ID NO: 2100265 - protein, 12 aa, Staphylococcus
RKYPDTKASLED

SEQ ID NO: 2100266 - protein, 13 aa, Staphylococcus
RKYPSTKASLEDY

SEQ ID NO: 2100267 - protein, 8 aa, Staphylococcus
RLASQGNN

SEQ ID NO: 2100268 - protein, 5 aa, Staphylococcus
RLDKE

SEQ ID NO: 2100269 - protein, 5 aa, Staphylococcus
RLDQE

SEQ ID NO: 2100270 - protein, 5 aa, Staphylococcus
RLEKQ

SEQ ID NO: 2100271 - protein, 7 aa, Staphylococcus
RLENERA

SEQ ID NO: 2100272 - protein, 5 aa, Staphylococcus
RLETE

SEQ ID NO: 2100273 - protein, 4 aa, Staphylococcus
RLGE

SEQ ID NO: 2100274 - protein, 6 aa, Staphylococcus
RLGKPL

SEQ ID NO: 2100275 - protein, 9 aa, Staphylococcus
RLGNPPKTM

SEQ ID NO: 2100276 - protein, 6 aa, Staphylococcus
RLKDGY

SEQ ID NO: 2100277 - protein, 7 aa, Staphylococcus
RLNQDDQ

SEQ ID NO: 2100278 - protein, 7 aa, Staphylococcus
RLPDYAS

SEQ ID NO: 2100279 - protein, 14 aa, Staphylococcus
RLPKASEVSTKEYN

SEQ ID NO: 2100280 - protein, 7 aa, Staphylococcus
RLPKDPS

SEQ ID NO: 2100281 - protein, 8 aa, Staphylococcus
RLTKQNKG

SEQ ID NO: 2100282 - protein, 13 aa, Staphylococcus
RLTSERDKIDEKV

SEQ ID NO: 2100283 - protein, 5 aa, Staphylococcus
RLTTS

SEQ ID NO: 2100284 - protein, 7 aa, Staphylococcus
RNAAEVG

SEQ ID NO: 2100285 - protein, 4 aa, Staphylococcus
RNAG

SEQ ID NO: 2100286 - protein, 13 aa, Staphylococcus
RNANKIDKDTTDI

SEQ ID NO: 2100287 - protein, 12 aa, Staphylococcus
RNATIKTGTPLP

SEQ ID NO: 2100288 - protein, 6 aa, Staphylococcus
RNDADD

SEQ ID NO: 2100289 - protein, 7 aa, Staphylococcus
RNDTTYA

SEQ ID NO: 2100290 - protein, 11 aa, Staphylococcus
RNEIDREKEKQ

SEQ ID NO: 2100291 - protein, 7 aa, Staphylococcus
RNFENQE

SEQ ID NO: 2100292 - protein, 5 aa, Staphylococcus
RNGDP

SEQ ID NO: 2100293 - protein, 19 aa, Staphylococcus
RNGNPEEVKYQKEHGGEIS

SEQ ID NO: 2100294 - protein, 19 aa, Staphylococcus
RNGNQEEIEYQKKHGGTIS

SEQ ID NO: 2100295 - protein, 8 aa, Staphylococcus
RNGVGRPE

SEQ ID NO: 2100296 - protein, 27 aa, Staphylococcus
RNGYQSKDAKQIKKGQQKLTTVSSNIS

SEQ ID NO: 2100297 - protein, 5 aa, Staphylococcus
RNNHL

SEQ ID NO: 2100298 - protein, 7 aa, Staphylococcus
RNQLENQ

SEQ ID NO: 2100299 - protein, 28 aa, Staphylococcus
RNRDDQSVKNNTIDGGQPTGAQSELQRE

SEQ ID NO: 2100300 - protein, 17 aa, Staphylococcus
RNRETGKFEKLNPNKTY

SEQ ID NO: 2100301 - protein, 6 aa, Staphylococcus
RNSIDE

SEQ ID NO: 2100302 - protein, 10 aa, Staphylococcus
RNSNGEGGTL

SEQ ID NO: 2100303 - protein, 7 aa, Staphylococcus
RNTRTTK

SEQ ID NO: 2100304 - protein, 17 aa, Staphylococcus
RPALESSNERHNAGTGH

SEQ ID NO: 2100305 - protein, 22 aa, Staphylococcus
RPAQPNPEWSGDNPDPSSSYAP

SEQ ID NO: 2100306 - protein, 9 aa, Staphylococcus
RPDPPRIDS

SEQ ID NO: 2100307 - protein, 11 aa, Staphylococcus
RPELKGLTQRQ

SEQ ID NO: 2100308 - protein, 11 aa, Staphylococcus
RPLGSTANKMG

SEQ ID NO: 2100309 - protein, 14 aa, Staphylococcus
RPLNEDERKLVDKE

SEQ ID NO: 2100310 - protein, 12 aa, Staphylococcus
RPQSESAVKGKA

SEQ ID NO: 2100311 - protein, 6 aa, Staphylococcus
RPSLET

SEQ ID NO: 2100312 - protein, 8 aa, Staphylococcus
RPSNNTQL

SEQ ID NO: 2100313 - protein, 17 aa, Staphylococcus
RPVDESVKDLMGRGKKA

SEQ ID NO: 2100314 - protein, 12 aa, Staphylococcus
RQASNAELELNH

SEQ ID NO: 2100315 - protein, 5 aa, Staphylococcus
RQDQI

SEQ ID NO: 2100316 - protein, 9 aa, Staphylococcus
RQGDGYPAF

SEQ ID NO: 2100317 - protein, 13 aa, Staphylococcus
RQGQPTLIDPNYH

SEQ ID NO: 2100318 - protein, 7 aa, Staphylococcus
RQHGGTV

SEQ ID NO: 2100319 - protein, 7 aa, Staphylococcus
RQHSDRL

SEQ ID NO: 2100320 - protein, 5 aa, Staphylococcus
RQKHA

SEQ ID NO: 2100321 - protein, 8 aa, Staphylococcus
RQNDDGYM

SEQ ID NO: 2100322 - protein, 75 aa, Staphylococcus
RQNQKDTTSDDDNNNNDTMNDNSNNEATFNNNDQNDGQEDTSNNNQTTDDNNYQNQYQQNNEQNNTLNDDANMNV

SEQ ID NO: 2100323 - protein, 7 aa, Staphylococcus
RQPTLTT

SEQ ID NO: 2100324 - protein, 7 aa, Staphylococcus
RQQLGKS

SEQ ID NO: 2100325 - protein, 16 aa, Staphylococcus
RQQTSKDLELNYYQNN

SEQ ID NO: 2100326 - protein, 10 aa, Staphylococcus
RQTGETFEES

SEQ ID NO: 2100327 - protein, 10 aa, Staphylococcus
RQTNEKFEAS

SEQ ID NO: 2100328 - protein, 25 aa, Staphylococcus
RRANEVLSNDRATNTDVANVTNNIN

SEQ ID NO: 2100329 - protein, 27 aa, Staphylococcus
RRNNPELERSIKDAKDTFVNRKNERIG

SEQ ID NO: 2100330 - protein, 16 aa, Staphylococcus
RRQTSKDLELGYYEDA

SEQ ID NO: 2100331 - protein, 7 aa, Staphylococcus
RRSGNHI

SEQ ID NO: 2100332 - protein, 12 aa, Staphylococcus
RRSGYATGHTPR

SEQ ID NO: 2100333 - protein, 8 aa, Staphylococcus
RRTGDTIK

SEQ ID NO: 2100334 - protein, 5 aa, Staphylococcus
RRTGH

SEQ ID NO: 2100335 - protein, 7 aa, Staphylococcus
RRTGNHI

SEQ ID NO: 2100336 - protein, 8 aa, Staphylococcus
RRVSNPQL

SEQ ID NO: 2100337 - protein, 12 aa, Staphylococcus
RRYSSGAPYTSQ

SEQ ID NO: 2100338 - protein, 7 aa, Staphylococcus
RSDLGRD

SEQ ID NO: 2100339 - protein, 6 aa, Staphylococcus
RSEPVA

SEQ ID NO: 2100340 - protein, 9 aa, Staphylococcus
RSEPVAESF

SEQ ID NO: 2100341 - protein, 10 aa, Staphylococcus
RSGASGSPML

SEQ ID NO: 2100342 - protein, 6 aa, Staphylococcus
RSGNLG

SEQ ID NO: 2100343 - protein, 10 aa, Staphylococcus
RSHSELRSGK

SEQ ID NO: 2100344 - protein, 12 aa, Staphylococcus
RSKYKDANENVR

SEQ ID NO: 2100345 - protein, 16 aa, Staphylococcus
RSLTQTAAKELAEKGI

SEQ ID NO: 2100346 - protein, 6 aa, Staphylococcus
RSNTFD

SEQ ID NO: 2100347 - protein, 17 aa, Staphylococcus
RSPNVKKPIKKINRQNV

SEQ ID NO: 2100348 - protein, 7 aa, Staphylococcus
RSQLQLS

SEQ ID NO: 2100349 - protein, 12 aa, Staphylococcus
RSQNQSPPEQYV

SEQ ID NO: 2100350 - protein, 11 aa, Staphylococcus
RSQSQSPVEQY

SEQ ID NO: 2100351 - protein, 16 aa, Staphylococcus
RSRGTDVNDHGGFNGV

SEQ ID NO: 2100352 - protein, 10 aa, Staphylococcus
RSRKGSRKKF

SEQ ID NO: 2100353 - protein, 13 aa, Staphylococcus
RSRKIGKIAQKDN

SEQ ID NO: 2100354 - protein, 13 aa, Staphylococcus
RSRKIGKVAQKRN

SEQ ID NO: 2100355 - protein, 11 aa, Staphylococcus
RSSTQSPPEQF

SEQ ID NO: 2100356 - protein, 11 aa, Staphylococcus
RSTQLPSVRGN

SEQ ID NO: 2100357 - protein, 7 aa, Staphylococcus
RSTREPV

SEQ ID NO: 2100358 - protein, 10 aa, Staphylococcus
RSVSPNASSR

SEQ ID NO: 2100359 - protein, 12 aa, Staphylococcus
RSYPSEKESLED

SEQ ID NO: 2100360 - protein, 13 aa, Staphylococcus
RSYPSKKESLEDY

SEQ ID NO: 2100361 - protein, 5 aa, Staphylococcus
RTAKP

SEQ ID NO: 2100362 - protein, 10 aa, Staphylococcus
RTANQKNIDE

SEQ ID NO: 2100363 - protein, 10 aa, Staphylococcus
RTAQNKEGAY

SEQ ID NO: 2100364 - protein, 16 aa, Staphylococcus
RTELQKSRLHKKELQS

SEQ ID NO: 2100365 - protein, 7 aa, Staphylococcus
RTGNTIQ

SEQ ID NO: 2100366 - protein, 8 aa, Staphylococcus
RTGVPAST

SEQ ID NO: 2100367 - protein, 14 aa, Staphylococcus
RTISASQAASYNYI

SEQ ID NO: 2100368 - protein, 16 aa, Staphylococcus
RTISSSEASSYNYIHL

SEQ ID NO: 2100369 - protein, 12 aa, Staphylococcus
RTITNPGSYNYI

SEQ ID NO: 2100370 - protein, 6 aa, Staphylococcus
RTKDGQ

SEQ ID NO: 2100371 - protein, 20 aa, Staphylococcus
RTKHGKIQKLDEKGNIVNEE

SEQ ID NO: 2100372 - protein, 5 aa, Staphylococcus
RTKSW

SEQ ID NO: 2100373 - protein, 26 aa, Staphylococcus
RTNETDSKHYKDRKAKATKVADAMKR

SEQ ID NO: 2100374 - protein, 8 aa, Staphylococcus
RTRKGGAE

SEQ ID NO: 2100375 - protein, 15 aa, Staphylococcus
RTTGLNDEDADPSVR

SEQ ID NO: 2100376 - protein, 12 aa, Staphylococcus
RTYATDPNYATK

SEQ ID NO: 2100377 - protein, 9 aa, Staphylococcus
RTYGSNKGA

SEQ ID NO: 2100378 - protein, 6 aa, Staphylococcus
RVDYGA

SEQ ID NO: 2100379 - protein, 39 aa, Staphylococcus
RVESGAEKSVYDQSQSSEQDEPTEDVNTEINNAQTEDEY

SEQ ID NO: 2100380 - protein, 44 aa, Staphylococcus
RVESGQEKSVYDRPYEEDFEPDEDTDDTDYTNDVQSSDSSYPRS

SEQ ID NO: 2100381 - protein, 8 aa, Staphylococcus
RVKEEQER

SEQ ID NO: 2100382 - protein, 8 aa, Staphylococcus
RVKTGADL

SEQ ID NO: 2100383 - protein, 9 aa, Staphylococcus
RVKTGADLS

SEQ ID NO: 2100384 - protein, 6 aa, Staphylococcus
RVNRSE

SEQ ID NO: 2100385 - protein, 8 aa, Staphylococcus
RVQEEQEK

SEQ ID NO: 2100386 - protein, 12 aa, Staphylococcus
RVREGDATNFED

SEQ ID NO: 2100387 - protein, 22 aa, Staphylococcus
RVSGSASSNTYSTRSAQSTYYS

SEQ ID NO: 2100388 - protein, 21 aa, Staphylococcus
RVSGTASSSSNTNRTSSSSNY

SEQ ID NO: 2100389 - protein, 6 aa, Staphylococcus
RYDQQY

SEQ ID NO: 2100390 - protein, 6 aa, Staphylococcus
RYGGGF

SEQ ID NO: 2100391 - protein, 7 aa, Staphylococcus
RYGKNAN

SEQ ID NO: 2100392 - protein, 6 aa, Staphylococcus
RYGKPE

SEQ ID NO: 2100393 - protein, 7 aa, Staphylococcus
RYGPDTN

SEQ ID NO: 2100394 - protein, 6 aa, Staphylococcus
RYGTKA

SEQ ID NO: 2100395 - protein, 6 aa, Staphylococcus
RYGTSA

SEQ ID NO: 2100396 - protein, 11 aa, Staphylococcus
RYPNASQNNLK

SEQ ID NO: 2100397 - protein, 8 aa, Staphylococcus
RYQEPQDV

SEQ ID NO: 2100398 - protein, 4 aa, Staphylococcus
RYTD

SEQ ID NO: 2100399 - protein, 16 aa, Staphylococcus
SADAAEQNGENNVEAI

SEQ ID NO: 2100400 - protein, 36 aa, Staphylococcus
SADQKEKIKSEYKTKNSAAWKAANKDKKDTKAHHIE

SEQ ID NO: 2100401 - protein, 9 aa, Staphylococcus
SADYPDPTA

SEQ ID NO: 2100402 - protein, 14 aa, Staphylococcus
SAEEHQDRLDKYPD

SEQ ID NO: 2100403 - protein, 6 aa, Staphylococcus
SAFKQQ

SEQ ID NO: 2100404 - protein, 18 aa, Staphylococcus
SAGASVFSNQAEAASYGA

SEQ ID NO: 2100405 - protein, 12 aa, Staphylococcus
SAGFNKSETQRI

SEQ ID NO: 2100406 - protein, 6 aa, Staphylococcus
SAGGNI

SEQ ID NO: 2100407 - protein, 6 aa, Staphylococcus
SAGPGV

SEQ ID NO: 2100408 - protein, 6 aa, Staphylococcus
SAGTLN

SEQ ID NO: 2100409 - protein, 19 aa, Staphylococcus
SAHATTQSTSSSSGQSDQT

SEQ ID NO: 2100410 - protein, 22 aa, Staphylococcus
SAHKQTGIDSRAQNLSNVEGYA

SEQ ID NO: 2100411 - protein, 13 aa, Staphylococcus
SAHQSGATTGVYS

SEQ ID NO: 2100412 - protein, 6 aa, Staphylococcus
SAKDED

SEQ ID NO: 2100413 - protein, 6 aa, Staphylococcus
SAKGPD

SEQ ID NO: 2100414 - protein, 5 aa, Staphylococcus
SAKGR

SEQ ID NO: 2100415 - protein, 18 aa, Staphylococcus
SAKSVTGQAILIDGGYTV

SEQ ID NO: 2100416 - protein, 7 aa, Staphylococcus
SALATDT

SEQ ID NO: 2100417 - protein, 5 aa, Staphylococcus
SALDI

SEQ ID NO: 2100418 - protein, 8 aa, Staphylococcus
SALNNQGN

SEQ ID NO: 2100419 - protein, 11 aa, Staphylococcus
SALSKLDKNNK

SEQ ID NO: 2100420 - protein, 11 aa, Staphylococcus
SALSKLEKNNK

SEQ ID NO: 2100421 - protein, 31 aa, Staphylococcus
SALTDTSIAHAESKATTNTTHSKANATSAYY

SEQ ID NO: 2100422 - protein, 12 aa, Staphylococcus
SALTQSTTRTIQ

SEQ ID NO: 2100423 - protein, 8 aa, Staphylococcus
SANLPSVR

SEQ ID NO: 2100424 - protein, 12 aa, Staphylococcus
SAPGQNGAGAYG

SEQ ID NO: 2100425 - protein, 16 aa, Staphylococcus
SAQAAETEPQAQTTIQ

SEQ ID NO: 2100426 - protein, 13 aa, Staphylococcus
SAQHQEAKAVETN

SEQ ID NO: 2100427 - protein, 6 aa, Staphylococcus
SASMEE

SEQ ID NO: 2100428 - protein, 24 aa, Staphylococcus
SASPDTYAQSTTDAPTIGEAEKGK

SEQ ID NO: 2100429 - protein, 5 aa, Staphylococcus
SASPG

SEQ ID NO: 2100430 - protein, 5 aa, Staphylococcus
SASVA

SEQ ID NO: 2100431 - protein, 4 aa, Staphylococcus
SATI

SEQ ID NO: 2100432 - protein, 5 aa, Staphylococcus
SATIE

SEQ ID NO: 2100433 - protein, 17 aa, Staphylococcus
SATPISHATPTQTTTQT

SEQ ID NO: 2100434 - protein, 14 aa, Staphylococcus
SATPTSTSNSVTFN

SEQ ID NO: 2100435 - protein, 6 aa, Staphylococcus
SAVAPN

SEQ ID NO: 2100436 - protein, 24 aa, Staphylococcus
SAVDKYNDIKPDVTKNKGSQSIQK

SEQ ID NO: 2100437 - protein, 29 aa, Staphylococcus
SAVTKEDRKALSDAVNSLGEPLSKMAVVT

SEQ ID NO: 2100438 - protein, 11 aa, Staphylococcus
SAYDKEDGDLT

SEQ ID NO: 2100439 - protein, 6 aa, Staphylococcus
SCGTGK

SEQ ID NO: 2100440 - protein, 13 aa, Staphylococcus
SCSQNKGMYSDEG

SEQ ID NO: 2100441 - protein, 5 aa, Staphylococcus
SDAGY

SEQ ID NO: 2100442 - protein, 6 aa, Staphylococcus
SDAKTF

SEQ ID NO: 2100443 - protein, 17 aa, Staphylococcus
SDASKNSNTQLLRDNLD

SEQ ID NO: 2100444 - protein, 5 aa, Staphylococcus
SDCQD

SEQ ID NO: 2100445 - protein, 6 aa, Staphylococcus
SDDGYE

SEQ ID NO: 2100446 - protein, 12 aa, Staphylococcus
SDDKLTTSQQDE

SEQ ID NO: 2100447 - protein, 12 aa, Staphylococcus
SDDSISKDNDVK

SEQ ID NO: 2100448 - protein, 7 aa, Staphylococcus
SDDSVSN

SEQ ID NO: 2100449 - protein, 13 aa, Staphylococcus
SDDWSKKDEDQLA

SEQ ID NO: 2100450 - protein, 5 aa, Staphylococcus
SDEHQ

SEQ ID NO: 2100451 - protein, 6 aa, Staphylococcus
SDENID

SEQ ID NO: 2100452 - protein, 7 aa, Staphylococcus
SDEQQVQ

SEQ ID NO: 2100453 - protein, 52 aa, Staphylococcus
SDETDDDKDNQGSNNTDTTNHQSYNDDTSTDSKNDSSKTSSSDSNSLSESAL

SEQ ID NO: 2100454 - protein, 6 aa, Staphylococcus
SDFNDG

SEQ ID NO: 2100455 - protein, 12 aa, Staphylococcus
SDGGQLKNAKKL

SEQ ID NO: 2100456 - protein, 13 aa, Staphylococcus
SDGKTTKQIGINV

SEQ ID NO: 2100457 - protein, 10 aa, Staphylococcus
SDGNKKPYIV

SEQ ID NO: 2100458 - protein, 10 aa, Staphylococcus
SDGNKKPYMI

SEQ ID NO: 2100459 - protein, 7 aa, Staphylococcus
SDGRKEG

SEQ ID NO: 2100460 - protein, 5 aa, Staphylococcus
SDGTN

SEQ ID NO: 2100461 - protein, 6 aa, Staphylococcus
SDGTNW

SEQ ID NO: 2100462 - protein, 20 aa, Staphylococcus
SDIEENKKDIKFNNKQSAEY

SEQ ID NO: 2100463 - protein, 17 aa, Staphylococcus
SDIRIENDEPLSNHPSR

SEQ ID NO: 2100464 - protein, 7 aa, Staphylococcus
SDISQLE

SEQ ID NO: 2100465 - protein, 6 aa, Staphylococcus
SDISTL

SEQ ID NO: 2100466 - protein, 19 aa, Staphylococcus
SDITENKKDIKFNNKQSAE

SEQ ID NO: 2100467 - protein, 14 aa, Staphylococcus
SDKAKAILKDYKFS

SEQ ID NO: 2100468 - protein, 14 aa, Staphylococcus
SDKAKKILKEYQFS

SEQ ID NO: 2100469 - protein, 14 aa, Staphylococcus
SDKAKKIMKEYKFE

SEQ ID NO: 2100470 - protein, 6 aa, Staphylococcus
SDKGAA

SEQ ID NO: 2100471 - protein, 12 aa, Staphylococcus
SDKGRGIPPKDL

SEQ ID NO: 2100472 - protein, 10 aa, Staphylococcus
SDKGSATLES

SEQ ID NO: 2100473 - protein, 9 aa, Staphylococcus
SDKKAGEYH

SEQ ID NO: 2100474 - protein, 15 aa, Staphylococcus
SDKSEKVLKKFTELM

SEQ ID NO: 2100475 - protein, 11 aa, Staphylococcus
SDKYENTGNLK

SEQ ID NO: 2100476 - protein, 9 aa, Staphylococcus
SDLENADKS

SEQ ID NO: 2100477 - protein, 6 aa, Staphylococcus
SDLGRD

SEQ ID NO: 2100478 - protein, 37 aa, Staphylococcus
SDLNEKEKSLTADKKNTKEAAVNELKTKSAKASSKYY

SEQ ID NO: 2100479 - protein, 5 aa, Staphylococcus
SDLSR

SEQ ID NO: 2100480 - protein, 17 aa, Staphylococcus
SDNATDNKENSPESQAA

SEQ ID NO: 2100481 - protein, 20 aa, Staphylococcus
SDNAYGSGVEDASITGNSGL

SEQ ID NO: 2100482 - protein, 24 aa, Staphylococcus
SDNDASPKMNKEVAKELKKKTGIT

SEQ ID NO: 2100483 - protein, 18 aa, Staphylococcus
SDNKALENKKSEKTLSYT

SEQ ID NO: 2100484 - protein, 8 aa, Staphylococcus
SDNSAPRT

SEQ ID NO: 2100485 - protein, 30 aa, Staphylococcus
SDNSHKERQNQKPPVNKRSNDHGGEPQKRG

SEQ ID NO: 2100486 - protein, 8 aa, Staphylococcus
SDNSTARS

SEQ ID NO: 2100487 - protein, 8 aa, Staphylococcus
SDQDHQSN

SEQ ID NO: 2100488 - protein, 7 aa, Staphylococcus
SDSESTL

SEQ ID NO: 2100489 - protein, 6 aa, Staphylococcus
SDSESV

SEQ ID NO: 2100490 - protein, 63 aa, Staphylococcus
SDSETTEHTAQDTSDDMEPAAEQQDKASTTDSTEQHSTTTSEQNDQSAKDATTDDNKVSDALD

SEQ ID NO: 2100491 - protein, 23 aa, Staphylococcus
SDSIQTEDDKEQSKHDKAISDGY

SEQ ID NO: 2100492 - protein, 16 aa, Staphylococcus
SDSKHNQKTTKNNKFK

SEQ ID NO: 2100493 - protein, 7 aa, Staphylococcus
SDTEPTL

SEQ ID NO: 2100494 - protein, 12 aa, Staphylococcus
SDVATPAKSAVR

SEQ ID NO: 2100495 - protein, 13 aa, Staphylococcus
SDVERGEKSSRTV

SEQ ID NO: 2100496 - protein, 117 aa, Staphylococcus
SDYEQPSHEEDDTNTTSENEQSNNNDAMTDNGQVTDNSDSSEKDPQQDESIKDNQSINNNEDENSNLTDQDHHSQSDEVQDHQQGDNNQQDHASNQSNGSNENDKSTSHQSISDSAI

SEQ ID NO: 2100497 - protein, 14 aa, Staphylococcus
SDYRHTSSNSTVMS

SEQ ID NO: 2100498 - protein, 13 aa, Staphylococcus
SEAKAEEVTADNA

SEQ ID NO: 2100499 - protein, 8 aa, Staphylococcus
SEARAKAE

SEQ ID NO: 2100500 - protein, 15 aa, Staphylococcus
SEDEAMERDEQASEI

SEQ ID NO: 2100501 - protein, 5 aa, Staphylococcus
SEESL

SEQ ID NO: 2100502 - protein, 13 aa, Staphylococcus
SEEVKETKKVMNN

SEQ ID NO: 2100503 - protein, 28 aa, Staphylococcus
SEFKNDKYTNLGNPGQPNYDNLAKAKPE

SEQ ID NO: 2100504 - protein, 28 aa, Staphylococcus
SEFKNSKYTNLGNPGRPNYDELAKSKPN

SEQ ID NO: 2100505 - protein, 18 aa, Staphylococcus
SEGTAPMAKQIKESKTDN

SEQ ID NO: 2100506 - protein, 19 aa, Staphylococcus
SEIDRETEKKLQRTERKAR

SEQ ID NO: 2100507 - protein, 6 aa, Staphylococcus
SEIGKG

SEQ ID NO: 2100508 - protein, 12 aa, Staphylococcus
SEINKNKRNEKI

SEQ ID NO: 2100509 - protein, 7 aa, Staphylococcus
SEKDYQQ

SEQ ID NO: 2100510 - protein, 10 aa, Staphylococcus
SEKEPEPINY

SEQ ID NO: 2100511 - protein, 13 aa, Staphylococcus
SEKGAAKLENKEI

SEQ ID NO: 2100512 - protein, 9 aa, Staphylococcus
SEKGSAHLN

SEQ ID NO: 2100513 - protein, 14 aa, Staphylococcus
SELGRSIGSTWGNA

SEQ ID NO: 2100514 - protein, 4 aa, Staphylococcus
SELN

SEQ ID NO: 2100515 - protein, 9 aa, Staphylococcus
SELNQSSEW

SEQ ID NO: 2100516 - protein, 20 aa, Staphylococcus
SELNQTNITDPKVNSARKNA

SEQ ID NO: 2100517 - protein, 5 aa, Staphylococcus
SENID

SEQ ID NO: 2100518 - protein, 8 aa, Staphylococcus
SENRISGY

SEQ ID NO: 2100519 - protein, 5 aa, Staphylococcus
SENYT

SEQ ID NO: 2100520 - protein, 8 aa, Staphylococcus
SEPEIYTA

SEQ ID NO: 2100521 - protein, 5 aa, Staphylococcus
SEPSL

SEQ ID NO: 2100522 - protein, 16 aa, Staphylococcus
SEQHTHSNDNQSKTEH

SEQ ID NO: 2100523 - protein, 4 aa, Staphylococcus
SESD

SEQ ID NO: 2100524 - protein, 16 aa, Staphylococcus
SESDQYDIDRIKAEVS

SEQ ID NO: 2100525 - protein, 13 aa, Staphylococcus
SESGVNPAQFESE

SEQ ID NO: 2100526 - protein, 25 aa, Staphylococcus
SESTTSDTNPFTEKVEKEGNSSKRI

SEQ ID NO: 2100527 - protein, 141 aa, Staphylococcus
SESVEQPEQPEIERPSEQPNLHKDTVNPDKSSEEANTNQPAPSAQPQPVSSQKEQSESTNKNEVSQTDQHQTQTDIQNDINNQTSSTSDNTSEQPKETSETEKTPAALKQTPEKEDAKAQSNAATEQASQTTSNKDSQYPI

SEQ ID NO: 2100528 - protein, 8 aa, Staphylococcus
SETLADVN

SEQ ID NO: 2100529 - protein, 9 aa, Staphylococcus
SETNSKNHT

SEQ ID NO: 2100530 - protein, 9 aa, Staphylococcus
SETQYNDPI

SEQ ID NO: 2100531 - protein, 5 aa, Staphylococcus
SETTL

SEQ ID NO: 2100532 - protein, 7 aa, Staphylococcus
SEVKEGT

SEQ ID NO: 2100533 - protein, 11 aa, Staphylococcus
SEVTDNNVESY

SEQ ID NO: 2100534 - protein, 5 aa, Staphylococcus
SEYNY

SEQ ID NO: 2100535 - protein, 28 aa, Staphylococcus
SFDNVEGAKKALERTKDETAGKYGGTSY

SEQ ID NO: 2100536 - protein, 8 aa, Staphylococcus
SFDSADKS

SEQ ID NO: 2100537 - protein, 8 aa, Staphylococcus
SFEGNGNI

SEQ ID NO: 2100538 - protein, 9 aa, Staphylococcus
SFKSGKKEQ

SEQ ID NO: 2100539 - protein, 10 aa, Staphylococcus
SFLGHPSESY

SEQ ID NO: 2100540 - protein, 13 aa, Staphylococcus
SFNKEAQIKKSFN

SEQ ID NO: 2100541 - protein, 11 aa, Staphylococcus
SFNSRSDQSNW

SEQ ID NO: 2100542 - protein, 5 aa, Staphylococcus
SFSSI

SEQ ID NO: 2100543 - protein, 6 aa, Staphylococcus
SFSYDS

SEQ ID NO: 2100544 - protein, 6 aa, Staphylococcus
SGAAAA

SEQ ID NO: 2100545 - protein, 6 aa, Staphylococcus
SGAADG

SEQ ID NO: 2100546 - protein, 13 aa, Staphylococcus
SGAHAEYYPGNTP

SEQ ID NO: 2100547 - protein, 5 aa, Staphylococcus
SGAND

SEQ ID NO: 2100548 - protein, 9 aa, Staphylococcus
SGANSGTRY

SEQ ID NO: 2100549 - protein, 5 aa, Staphylococcus
SGDHV

SEQ ID NO: 2100550 - protein, 29 aa, Staphylococcus
SGDLGDARNWNNRAERKDYAVSSTPKAHT

SEQ ID NO: 2100551 - protein, 10 aa, Staphylococcus
SGDPRNYQAS

SEQ ID NO: 2100552 - protein, 8 aa, Staphylococcus
SGDPVPDA

SEQ ID NO: 2100553 - protein, 5 aa, Staphylococcus
SGDSL

SEQ ID NO: 2100554 - protein, 8 aa, Staphylococcus
SGDSLNSI

SEQ ID NO: 2100555 - protein, 12 aa, Staphylococcus
SGDTHNNFIYNE

SEQ ID NO: 2100556 - protein, 7 aa, Staphylococcus
SGDYQKY

SEQ ID NO: 2100557 - protein, 7 aa, Staphylococcus
SGEISTG

SEQ ID NO: 2100558 - protein, 10 aa, Staphylococcus
SGEKAGKHTA

SEQ ID NO: 2100559 - protein, 10 aa, Staphylococcus
SGEKAGKYHE

SEQ ID NO: 2100560 - protein, 11 aa, Staphylococcus
SGELDKEAQTI

SEQ ID NO: 2100561 - protein, 18 aa, Staphylococcus
SGEPINPYNEDASEVYPE

SEQ ID NO: 2100562 - protein, 11 aa, Staphylococcus
SGEVNDNNVED

SEQ ID NO: 2100563 - protein, 13 aa, Staphylococcus
SGFPKSKVIGTGT

SEQ ID NO: 2100564 - protein, 21 aa, Staphylococcus
SGGGNSKKVTVGVASNDTAAW

SEQ ID NO: 2100565 - protein, 5 aa, Staphylococcus
SGGPG

SEQ ID NO: 2100566 - protein, 6 aa, Staphylococcus
SGGTLN

SEQ ID NO: 2100567 - protein, 21 aa, Staphylococcus
SGHDDHEKINKNDDEKLPPIP

SEQ ID NO: 2100568 - protein, 7 aa, Staphylococcus
SGHSEQY

SEQ ID NO: 2100569 - protein, 7 aa, Staphylococcus
SGIGEAT

SEQ ID NO: 2100570 - protein, 4 aa, Staphylococcus
SGIT

SEQ ID NO: 2100571 - protein, 10 aa, Staphylococcus
SGKANAETVK

SEQ ID NO: 2100572 - protein, 6 aa, Staphylococcus
SGKEMR

SEQ ID NO: 2100573 - protein, 6 aa, Staphylococcus
SGKVEN

SEQ ID NO: 2100574 - protein, 19 aa, Staphylococcus
SGKVTFEDNDTHKTENAGH

SEQ ID NO: 2100575 - protein, 11 aa, Staphylococcus
SGKYQAPTNSK

SEQ ID NO: 2100576 - protein, 36 aa, Staphylococcus
SGLANAQEYTNSTHTTSQQSNTYNSQVEQETNLGLT

SEQ ID NO: 2100577 - protein, 22 aa, Staphylococcus
SGLNDAQRDAFESQINQAPTRN

SEQ ID NO: 2100578 - protein, 13 aa, Staphylococcus
SGLNPHKSEQLQQ

SEQ ID NO: 2100579 - protein, 13 aa, Staphylococcus
SGMKGATANIDNV

SEQ ID NO: 2100580 - protein, 16 aa, Staphylococcus
SGMKGATANIDNVKKT

SEQ ID NO: 2100581 - protein, 18 aa, Staphylococcus
SGMSTGSVDAASGNSIQN

SEQ ID NO: 2100582 - protein, 7 aa, Staphylococcus
SGNIEDP

SEQ ID NO: 2100583 - protein, 4 aa, Staphylococcus
SGNK

SEQ ID NO: 2100584 - protein, 6 aa, Staphylococcus
SGNMPP

SEQ ID NO: 2100585 - protein, 6 aa, Staphylococcus
SGNTED

SEQ ID NO: 2100586 - protein, 4 aa, Staphylococcus
SGNY

SEQ ID NO: 2100587 - protein, 35 aa, Staphylococcus
SGPANAHAAGGSQASTAVKEQQTTQQEGNLGEQNT

SEQ ID NO: 2100588 - protein, 22 aa, Staphylococcus
SGPFKNSGSHISGGSMGDKEEV

SEQ ID NO: 2100589 - protein, 15 aa, Staphylococcus
SGPTPNLNTVEYKIV

SEQ ID NO: 2100590 - protein, 83 aa, Staphylococcus
SGQSNEASNTQAQPQQDVSEQASASTNQTSAEEVSNQQQSNSAQPEQVSAPQTEQTQQPQQEATTSNNESSSSEASSGSSVNV

SEQ ID NO: 2100591 - protein, 6 aa, Staphylococcus
SGQTPE

SEQ ID NO: 2100592 - protein, 12 aa, Staphylococcus
SGSEQNPDLTDK

SEQ ID NO: 2100593 - protein, 8 aa, Staphylococcus
SGSIDNPR

SEQ ID NO: 2100594 - protein, 5 aa, Staphylococcus
SGSLD

SEQ ID NO: 2100595 - protein, 10 aa, Staphylococcus
SGSTSTTIKQ

SEQ ID NO: 2100596 - protein, 18 aa, Staphylococcus
SGSTTTTMKQIDELEKVV

SEQ ID NO: 2100597 - protein, 16 aa, Staphylococcus
SGTAAANYTPAIAESQ

SEQ ID NO: 2100598 - protein, 33 aa, Staphylococcus
SGTAPASSNTSTTRTQTTTTATSSTYTVQPGDS

SEQ ID NO: 2100599 - protein, 13 aa, Staphylococcus
SGTHAGYYPGNTN

SEQ ID NO: 2100600 - protein, 31 aa, Staphylococcus
SGTNEEADNEKEPQKKAAQKQPTEKDTSKIN

SEQ ID NO: 2100601 - protein, 6 aa, Staphylococcus
SGTTYK

SEQ ID NO: 2100602 - protein, 10 aa, Staphylococcus
SGWGPDYPDP

SEQ ID NO: 2100603 - protein, 9 aa, Staphylococcus
SGYTSKGGD

SEQ ID NO: 2100604 - protein, 93 aa, Staphylococcus
SHDDGNSNKEDTNKSEQHDSQKTDKNKQKDKKDKKSNVQKDDDEQATNDSKDNSSEKNSNKQNNASQSQSGAQQGQATNQNNQANNNKGQSHY

SEQ ID NO: 2100605 - protein, 7 aa, Staphylococcus
SHGKIKP

SEQ ID NO: 2100606 - protein, 9 aa, Staphylococcus
SHGQTAGAA

SEQ ID NO: 2100607 - protein, 54 aa, Staphylococcus
SHHDNDNKESSTKSDKSSKTDTETVKIKDDDKMTDKEKEYKELEKKASKKEKVD

SEQ ID NO: 2100608 - protein, 6 aa, Staphylococcus
SHLSSK

SEQ ID NO: 2100609 - protein, 6 aa, Staphylococcus
SHNAIG

SEQ ID NO: 2100610 - protein, 10 aa, Staphylococcus
SHRPDGKEHY

SEQ ID NO: 2100611 - protein, 7 aa, Staphylococcus
SHSASSV

SEQ ID NO: 2100612 - protein, 93 aa, Staphylococcus
SHSGSDENEKNDDSSKKEQKEKKSKTDSKDKSKNHKDKDSTSKSSSNNNELSSSDSQTENTNTSKQQPQSNQDNSKNKDYVAPYQSNHATQVA

SEQ ID NO: 2100613 - protein, 31 aa, Staphylococcus
SHSNDNNGKNENNTKQTSQPNKSDDNQQRHT

SEQ ID NO: 2100614 - protein, 39 aa, Staphylococcus
SHSNDTVKDVNESAHKKNNPKAHKSKGNSERVDSKKINK

SEQ ID NO: 2100615 - protein, 8 aa, Staphylococcus
SHSPDQLD

SEQ ID NO: 2100616 - protein, 13 aa, Staphylococcus
SHSPLKKYTPAKI

SEQ ID NO: 2100617 - protein, 4 aa, Staphylococcus
SHTD

SEQ ID NO: 2100618 - protein, 15 aa, Staphylococcus
SHTKQQDDDKNTYQS

SEQ ID NO: 2100619 - protein, 15 aa, Staphylococcus
SHTKQQDNDSNTYQS

SEQ ID NO: 2100620 - protein, 26 aa, Staphylococcus
SHTPSELEDKMKKDGPPEYKESKWQE

SEQ ID NO: 2100621 - protein, 11 aa, Staphylococcus
SHTQSPPEQYV

SEQ ID NO: 2100622 - protein, 14 aa, Staphylococcus
SHVDSRDKKDEIAK

SEQ ID NO: 2100623 - protein, 14 aa, Staphylococcus
SHYPRVAADKKWKW

SEQ ID NO: 2100624 - protein, 50 aa, Staphylococcus
SIANHNDVQQSVNYTDADTDKQQVYDNAVSQAEAITNPTSGTNATQSQVE

SEQ ID NO: 2100625 - protein, 9 aa, Staphylococcus
SIASQTTQV

SEQ ID NO: 2100626 - protein, 14 aa, Staphylococcus
SIDDLKDNKDLGKS

SEQ ID NO: 2100627 - protein, 11 aa, Staphylococcus
SIDKSGHPNDI

SEQ ID NO: 2100628 - protein, 12 aa, Staphylococcus
SIDKSGHPNDVT

SEQ ID NO: 2100629 - protein, 11 aa, Staphylococcus
SIDKTAHANDV

SEQ ID NO: 2100630 - protein, 12 aa, Staphylococcus
SIDRETGKKKKD

SEQ ID NO: 2100631 - protein, 19 aa, Staphylococcus
SIDTVDQKQSSEENGKYKV

SEQ ID NO: 2100632 - protein, 8 aa, Staphylococcus
SIESNNSN

SEQ ID NO: 2100633 - protein, 7 aa, Staphylococcus
SIETTTQ

SEQ ID NO: 2100634 - protein, 12 aa, Staphylococcus
SIGEEGSKGDSY

SEQ ID NO: 2100635 - protein, 12 aa, Staphylococcus
SIGEKGSKGDSY

SEQ ID NO: 2100636 - protein, 15 aa, Staphylococcus
SIGESGKYFDVDNYK

SEQ ID NO: 2100637 - protein, 12 aa, Staphylococcus
SIGKEGTKGDSY

SEQ ID NO: 2100638 - protein, 4 aa, Staphylococcus
SIGN

SEQ ID NO: 2100639 - protein, 13 aa, Staphylococcus
SIGQEGSKGDSYY

SEQ ID NO: 2100640 - protein, 8 aa, Staphylococcus
SIKANEDI

SEQ ID NO: 2100641 - protein, 8 aa, Staphylococcus
SIKANEEI

SEQ ID NO: 2100642 - protein, 9 aa, Staphylococcus
SIKQDNNLS

SEQ ID NO: 2100643 - protein, 11 aa, Staphylococcus
SIKYDKDKKQL

SEQ ID NO: 2100644 - protein, 12 aa, Staphylococcus
SINKEQASKKAF

SEQ ID NO: 2100645 - protein, 8 aa, Staphylococcus
SIPAPGDI

SEQ ID NO: 2100646 - protein, 8 aa, Staphylococcus
SIPNAPEG

SEQ ID NO: 2100647 - protein, 8 aa, Staphylococcus
SIPQHQRQ

SEQ ID NO: 2100648 - protein, 30 aa, Staphylococcus
SIRDGYSEKDKKKINQGQNQLSQINVKNPQ

SEQ ID NO: 2100649 - protein, 6 aa, Staphylococcus
SIRQND

SEQ ID NO: 2100650 - protein, 25 aa, Staphylococcus
SISDLNSKKSTTSSNTGNSSNSFGK

SEQ ID NO: 2100651 - protein, 10 aa, Staphylococcus
SISEDHNGGI

SEQ ID NO: 2100652 - protein, 9 aa, Staphylococcus
SISNRTTQI

SEQ ID NO: 2100653 - protein, 8 aa, Staphylococcus
SISPEHNA

SEQ ID NO: 2100654 - protein, 9 aa, Staphylococcus
SISPKHNAG

SEQ ID NO: 2100655 - protein, 8 aa, Staphylococcus
SISQANAL

SEQ ID NO: 2100656 - protein, 8 aa, Staphylococcus
SISQFTNE

SEQ ID NO: 2100657 - protein, 9 aa, Staphylococcus
SISSEHNAG

SEQ ID NO: 2100658 - protein, 12 aa, Staphylococcus
SITDTGKNELNQ

SEQ ID NO: 2100659 - protein, 7 aa, Staphylococcus
SIYPTAQ

SEQ ID NO: 2100660 - protein, 8 aa, Staphylococcus
SKAGDVKV

SEQ ID NO: 2100661 - protein, 10 aa, Staphylococcus
SKARAGNYKE

SEQ ID NO: 2100662 - protein, 8 aa, Staphylococcus
SKDDDQGK

SEQ ID NO: 2100663 - protein, 8 aa, Staphylococcus
SKDGKTAS

SEQ ID NO: 2100664 - protein, 9 aa, Staphylococcus
SKDMDNKTY

SEQ ID NO: 2100665 - protein, 27 aa, Staphylococcus
SKDMKNAKTFEAEAKQVDSQYIERDKT

SEQ ID NO: 2100666 - protein, 7 aa, Staphylococcus
SKDNSIK

SEQ ID NO: 2100667 - protein, 33 aa, Staphylococcus
SKDQATPLKDFEQPKQSTEPQKEPWSEPKAGYK

SEQ ID NO: 2100668 - protein, 18 aa, Staphylococcus
SKEAQEALKKDIKDGEKY

SEQ ID NO: 2100669 - protein, 35 aa, Staphylococcus
SKEAQKALKEDTKDGEKAVDLSKKEIKEIEDDLVK

SEQ ID NO: 2100670 - protein, 18 aa, Staphylococcus
SKEARKALKEDTKDGEKI

SEQ ID NO: 2100671 - protein, 39 aa, Staphylococcus
SKEESDPSDNAKTQEEHSTEENKSSDDQDISLEPDTKIP

SEQ ID NO: 2100672 - protein, 16 aa, Staphylococcus
SKEIKNYSVTDKEFES

SEQ ID NO: 2100673 - protein, 9 aa, Staphylococcus
SKEKGSNIK

SEQ ID NO: 2100674 - protein, 9 aa, Staphylococcus
SKEKTIDGN

SEQ ID NO: 2100675 - protein, 9 aa, Staphylococcus
SKENTDTNQ

SEQ ID NO: 2100676 - protein, 10 aa, Staphylococcus
SKEQANDKDL

SEQ ID NO: 2100677 - protein, 16 aa, Staphylococcus
SKEQTKTFEGDVNGKQ

SEQ ID NO: 2100678 - protein, 13 aa, Staphylococcus
SKERSKTYEGDME

SEQ ID NO: 2100679 - protein, 8 aa, Staphylococcus
SKESIIKK

SEQ ID NO: 2100680 - protein, 10 aa, Staphylococcus
SKGDKNYGKL

SEQ ID NO: 2100681 - protein, 15 aa, Staphylococcus
SKGEHKIGGKTYKVD

SEQ ID NO: 2100682 - protein, 15 aa, Staphylococcus
SKGEHQIDGKKYTVK

SEQ ID NO: 2100683 - protein, 22 aa, Staphylococcus
SKGMTNDEKHSKAMQDVKSSDW

SEQ ID NO: 2100684 - protein, 16 aa, Staphylococcus
SKGQNDLTKKAGWAEV

SEQ ID NO: 2100685 - protein, 15 aa, Staphylococcus
SKHDKKHSRDHEPKE

SEQ ID NO: 2100686 - protein, 7 aa, Staphylococcus
SKHKDLA

SEQ ID NO: 2100687 - protein, 7 aa, Staphylococcus
SKHKELA

SEQ ID NO: 2100688 - protein, 4 aa, Staphylococcus
SKHN

SEQ ID NO: 2100689 - protein, 5 aa, Staphylococcus
SKHQK

SEQ ID NO: 2100690 - protein, 7 aa, Staphylococcus
SKHVPTT

SEQ ID NO: 2100691 - protein, 9 aa, Staphylococcus
SKIEEGGHL

SEQ ID NO: 2100692 - protein, 8 aa, Staphylococcus
SKIKKDTL

SEQ ID NO: 2100693 - protein, 8 aa, Staphylococcus
SKIPKMQK

SEQ ID NO: 2100694 - protein, 11 aa, Staphylococcus
SKIQASKDAGM

SEQ ID NO: 2100695 - protein, 9 aa, Staphylococcus
SKITDKDDF

SEQ ID NO: 2100696 - protein, 14 aa, Staphylococcus
SKKAKDILKEYHFE

SEQ ID NO: 2100697 - protein, 8 aa, Staphylococcus
SKKATLGS

SEQ ID NO: 2100698 - protein, 8 aa, Staphylococcus
SKKERRYE

SEQ ID NO: 2100699 - protein, 8 aa, Staphylococcus
SKKKEGRQ

SEQ ID NO: 2100700 - protein, 9 aa, Staphylococcus
SKKMNKNVR

SEQ ID NO: 2100701 - protein, 10 aa, Staphylococcus
SKKMTKPVRE

SEQ ID NO: 2100702 - protein, 14 aa, Staphylococcus
SKKNNYPSNYGKND

SEQ ID NO: 2100703 - protein, 14 aa, Staphylococcus
SKLDPSETNAEITI

SEQ ID NO: 2100704 - protein, 11 aa, Staphylococcus
SKLEESKKVAQ

SEQ ID NO: 2100705 - protein, 7 aa, Staphylococcus
SKLTQAG

SEQ ID NO: 2100706 - protein, 8 aa, Staphylococcus
SKLTQANY

SEQ ID NO: 2100707 - protein, 8 aa, Staphylococcus
SKLTQSGY

SEQ ID NO: 2100708 - protein, 19 aa, Staphylococcus
SKNGTTGFDSKAKSLTNIE

SEQ ID NO: 2100709 - protein, 6 aa, Staphylococcus
SKNGVT

SEQ ID NO: 2100710 - protein, 15 aa, Staphylococcus
SKNKDDKEPQVHIYH

SEQ ID NO: 2100711 - protein, 31 aa, Staphylococcus
SKNNDTTYKSVQKYTNNHSSKTGITSTNNKT

SEQ ID NO: 2100712 - protein, 9 aa, Staphylococcus
SKNPEQVAK

SEQ ID NO: 2100713 - protein, 11 aa, Staphylococcus
SKNQKDDLNKN

SEQ ID NO: 2100714 - protein, 7 aa, Staphylococcus
SKNRDTY

SEQ ID NO: 2100715 - protein, 13 aa, Staphylococcus
SKNYKKVTMDGTV

SEQ ID NO: 2100716 - protein, 9 aa, Staphylococcus
SKPDIYTAG

SEQ ID NO: 2100717 - protein, 9 aa, Staphylococcus
SKPEIYTAG

SEQ ID NO: 2100718 - protein, 17 aa, Staphylococcus
SKPITYKAGATSDKKLA

SEQ ID NO: 2100719 - protein, 7 aa, Staphylococcus
SKPYTYS

SEQ ID NO: 2100720 - protein, 38 aa, Staphylococcus
SKQIDKIKDEADKLKDVKDKAKNEDDPKIEKQQGKLQD

SEQ ID NO: 2100721 - protein, 16 aa, Staphylococcus
SKQKDSHTEDSENENM

SEQ ID NO: 2100722 - protein, 14 aa, Staphylococcus
SKQSAKFNRTEGLN

SEQ ID NO: 2100723 - protein, 6 aa, Staphylococcus
SKRHKR

SEQ ID NO: 2100724 - protein, 9 aa, Staphylococcus
SKRHKRRNT

SEQ ID NO: 2100725 - protein, 6 aa, Staphylococcus
SKRNYR

SEQ ID NO: 2100726 - protein, 8 aa, Staphylococcus
SKRSGVTI

SEQ ID NO: 2100727 - protein, 9 aa, Staphylococcus
SKSEKGKKI

SEQ ID NO: 2100728 - protein, 12 aa, Staphylococcus
SKSGDVIQQPSL

SEQ ID NO: 2100729 - protein, 7 aa, Staphylococcus
SKSGVPI

SEQ ID NO: 2100730 - protein, 15 aa, Staphylococcus
SKSIDTKDIAGKSVN

SEQ ID NO: 2100731 - protein, 8 aa, Staphylococcus
SKSIEKNM

SEQ ID NO: 2100732 - protein, 15 aa, Staphylococcus
SKSKDDKEPQVHIYH

SEQ ID NO: 2100733 - protein, 15 aa, Staphylococcus
SKSKEDKEPQVHIYN

SEQ ID NO: 2100734 - protein, 9 aa, Staphylococcus
SKSVPDQPL

SEQ ID NO: 2100735 - protein, 6 aa, Staphylococcus
SKSYRT

SEQ ID NO: 2100736 - protein, 12 aa, Staphylococcus
SKTDTTDKNRKE

SEQ ID NO: 2100737 - protein, 20 aa, Staphylococcus
SKTQEDNGGVHTNSGIPNKA

SEQ ID NO: 2100738 - protein, 10 aa, Staphylococcus
SKYAEDDKPN

SEQ ID NO: 2100739 - protein, 4 aa, Staphylococcus
SKYK

SEQ ID NO: 2100740 - protein, 5 aa, Staphylococcus
SKYKN

SEQ ID NO: 2100741 - protein, 4 aa, Staphylococcus
SLDG

SEQ ID NO: 2100742 - protein, 15 aa, Staphylococcus
SLDGEANISQESLKN

SEQ ID NO: 2100743 - protein, 5 aa, Staphylococcus
SLDGT

SEQ ID NO: 2100744 - protein, 7 aa, Staphylococcus
SLDNGTY

SEQ ID NO: 2100745 - protein, 15 aa, Staphylococcus
SLDYERKDLKEKLLN

SEQ ID NO: 2100746 - protein, 9 aa, Staphylococcus
SLEPGQKAK

SEQ ID NO: 2100747 - protein, 6 aa, Staphylococcus
SLEQGK

SEQ ID NO: 2100748 - protein, 12 aa, Staphylococcus
SLEVQGKENIPQ

SEQ ID NO: 2100749 - protein, 5 aa, Staphylococcus
SLGGW

SEQ ID NO: 2100750 - protein, 20 aa, Staphylococcus
SLGSPTETKDGKKQLSPNGG

SEQ ID NO: 2100751 - protein, 16 aa, Staphylococcus
SLIQDGKSPTPTTEGL

SEQ ID NO: 2100752 - protein, 6 aa, Staphylococcus
SLKDKG

SEQ ID NO: 2100753 - protein, 12 aa, Staphylococcus
SLKESSDQDQFK

SEQ ID NO: 2100754 - protein, 7 aa, Staphylococcus
SLKSDGA

SEQ ID NO: 2100755 - protein, 12 aa, Staphylococcus
SLMGSRAGNAIQ

SEQ ID NO: 2100756 - protein, 16 aa, Staphylococcus
SLNDKNPQHIKKAESD

SEQ ID NO: 2100757 - protein, 16 aa, Staphylococcus
SLNDTNPKHLQEAEND

SEQ ID NO: 2100758 - protein, 23 aa, Staphylococcus
SLNDTNSQHLAEAEKTLSHLGPN

SEQ ID NO: 2100759 - protein, 24 aa, Staphylococcus
SLNDTNSQHLRQAEQDLKKLGPQV

SEQ ID NO: 2100760 - protein, 18 aa, Staphylococcus
SLNKESHEKFNDIPKDRR

SEQ ID NO: 2100761 - protein, 5 aa, Staphylococcus
SLNNL

SEQ ID NO: 2100762 - protein, 10 aa, Staphylococcus
SLNNRWTDDY

SEQ ID NO: 2100763 - protein, 16 aa, Staphylococcus
SLPENTQMDNTPTGTK

SEQ ID NO: 2100764 - protein, 8 aa, Staphylococcus
SLPKGETR

SEQ ID NO: 2100765 - protein, 7 aa, Staphylococcus
SLPNAAQ

SEQ ID NO: 2100766 - protein, 18 aa, Staphylococcus
SLPTEAKAAKLDAQGYDA

SEQ ID NO: 2100767 - protein, 21 aa, Staphylococcus
SLQGGQSTVGQFQTSGNKGDA

SEQ ID NO: 2100768 - protein, 6 aa, Staphylococcus
SLQQDT

SEQ ID NO: 2100769 - protein, 7 aa, Staphylococcus
SLSEDPS

SEQ ID NO: 2100770 - protein, 8 aa, Staphylococcus
SLSKDDGK

SEQ ID NO: 2100771 - protein, 12 aa, Staphylococcus
SLSKDGTLKRET

SEQ ID NO: 2100772 - protein, 18 aa, Staphylococcus
SLSKKDTILETLKAQNID

SEQ ID NO: 2100773 - protein, 36 aa, Staphylococcus
SLSNDIDDAYSKYKSDTDKGNISNDNTNEDKNIKQI

SEQ ID NO: 2100774 - protein, 9 aa, Staphylococcus
SLSPEHNGG

SEQ ID NO: 2100775 - protein, 13 aa, Staphylococcus
SLTAGKYDGTDYE

SEQ ID NO: 2100776 - protein, 6 aa, Staphylococcus
SLTKDR

SEQ ID NO: 2100777 - protein, 12 aa, Staphylococcus
SLTPNQQKKIAI

SEQ ID NO: 2100778 - protein, 13 aa, Staphylococcus
SLTRDNVNQSEAL

SEQ ID NO: 2100779 - protein, 20 aa, Staphylococcus
SLYQDNKIDETTKKDADQLL

SEQ ID NO: 2100780 - protein, 20 aa, Staphylococcus
SLYQENKIDEMTKKDANQLL

SEQ ID NO: 2100781 - protein, 12 aa, Staphylococcus
SMADKASEYDAE

SEQ ID NO: 2100782 - protein, 11 aa, Staphylococcus
SMPKKSKDGKT

SEQ ID NO: 2100783 - protein, 11 aa, Staphylococcus
SNAKAGKYKED

SEQ ID NO: 2100784 - protein, 10 aa, Staphylococcus
SNAKSGNYKE

SEQ ID NO: 2100785 - protein, 5 aa, Staphylococcus
SNAPK

SEQ ID NO: 2100786 - protein, 6 aa, Staphylococcus
SNAQIN

SEQ ID NO: 2100787 - protein, 35 aa, Staphylococcus
SNAVATTNKKSKQQTTKQQKDQTNKAAKQSQYKNH

SEQ ID NO: 2100788 - protein, 4 aa, Staphylococcus
SNDD

SEQ ID NO: 2100789 - protein, 25 aa, Staphylococcus
SNDESDDDKGYSGKNAPKNVKTITE

SEQ ID NO: 2100790 - protein, 34 aa, Staphylococcus
SNDGSKEQSKKLKQLEAENERLESENKKYKKELD

SEQ ID NO: 2100791 - protein, 5 aa, Staphylococcus
SNDIN

SEQ ID NO: 2100792 - protein, 37 aa, Staphylococcus
SNDKDKSSDQEADHTKGSHSSQVKQVATDKNVQGDNY

SEQ ID NO: 2100793 - protein, 7 aa, Staphylococcus
SNDKNRF

SEQ ID NO: 2100794 - protein, 26 aa, Staphylococcus
SNDKQSAAKQFEKDLAPAEAKQEDVE

SEQ ID NO: 2100795 - protein, 10 aa, Staphylococcus
SNDPKTNIKK

SEQ ID NO: 2100796 - protein, 8 aa, Staphylococcus
SNDSGDIT

SEQ ID NO: 2100797 - protein, 22 aa, Staphylococcus
SNDSSSKDESKKGESDQKTVKI

SEQ ID NO: 2100798 - protein, 8 aa, Staphylococcus
SNDTKAWE

SEQ ID NO: 2100799 - protein, 17 aa, Staphylococcus
SNDVKSSSDDKAQKLAN

SEQ ID NO: 2100800 - protein, 8 aa, Staphylococcus
SNEDFNDN

SEQ ID NO: 2100801 - protein, 6 aa, Staphylococcus
SNEGTF

SEQ ID NO: 2100802 - protein, 8 aa, Staphylococcus
SNEMNESN

SEQ ID NO: 2100803 - protein, 5 aa, Staphylococcus
SNFPK

SEQ ID NO: 2100804 - protein, 14 aa, Staphylococcus
SNGAKEISERYIEV

SEQ ID NO: 2100805 - protein, 28 aa, Staphylococcus
SNGDIDDNDHHANGIHAPKNVKKITEKD

SEQ ID NO: 2100806 - protein, 21 aa, Staphylococcus
SNGDNKDDSKTKSDEKAKQEL

SEQ ID NO: 2100807 - protein, 48 aa, Staphylococcus
SNGDNSSSSGQKGDSQKNEQTNSQSEKLKKNNDKNKNENKVDYPKDGV

SEQ ID NO: 2100808 - protein, 8 aa, Staphylococcus
SNGETRTV

SEQ ID NO: 2100809 - protein, 58 aa, Staphylococcus
SNGGSEDKKSSDTDSKSKDSNETVKIENNYKANGEKRDGSDAKTVKETVEVPKNPEKA

SEQ ID NO: 2100810 - protein, 15 aa, Staphylococcus
SNGKSDSNSNSNEKL

SEQ ID NO: 2100811 - protein, 25 aa, Staphylococcus
SNGKVTMQDNDLRDEEVVGSLDLSK

SEQ ID NO: 2100812 - protein, 33 aa, Staphylococcus
SNGNQDDRKDKSADHPNSANQIATDKDVQGDNY

SEQ ID NO: 2100813 - protein, 5 aa, Staphylococcus
SNGQN

SEQ ID NO: 2100814 - protein, 6 aa, Staphylococcus
SNGSIK

SEQ ID NO: 2100815 - protein, 23 aa, Staphylococcus
SNGSSSNDSGSKSDSKDSKETVK

SEQ ID NO: 2100816 - protein, 21 aa, Staphylococcus
SNHAQKKTVDTFTSAAKQNKR

SEQ ID NO: 2100817 - protein, 4 aa, Staphylococcus
SNHN

SEQ ID NO: 2100818 - protein, 82 aa, Staphylococcus
SNHQPSKSLTSQQPTSLEMQNTTKESTQNETSVKAPKSNTASEEQTQNSVPAPKAPEKDSISPSATEKTTEQQTEQPAPEVQ

SEQ ID NO: 2100819 - protein, 11 aa, Staphylococcus
SNHSKGEEMAK

SEQ ID NO: 2100820 - protein, 24 aa, Staphylococcus
SNHTAEASEKNQTQHKADIRQNQN

SEQ ID NO: 2100821 - protein, 10 aa, Staphylococcus
SNIENTYDGT

SEQ ID NO: 2100822 - protein, 28 aa, Staphylococcus
SNIKTSQNYTDANQNLQEAYNRQVDNAN

SEQ ID NO: 2100823 - protein, 5 aa, Staphylococcus
SNIQQ

SEQ ID NO: 2100824 - protein, 7 aa, Staphylococcus
SNISEVG

SEQ ID NO: 2100825 - protein, 59 aa, Staphylococcus
SNKDSSSENSNKSSINKSDKKLHDNKKKKDKSKEKKKEYKKNSSSKENQASQEQAQLQQ

SEQ ID NO: 2100826 - protein, 15 aa, Staphylococcus
SNKSDPTQAPEGHEN

SEQ ID NO: 2100827 - protein, 41 aa, Staphylococcus
SNKSNHNEVNQLKAKNEALEAENKNLKKELDMTDASKYDAI

SEQ ID NO: 2100828 - protein, 8 aa, Staphylococcus
SNKVSAKD

SEQ ID NO: 2100829 - protein, 9 aa, Staphylococcus
SNLKPGEAF

SEQ ID NO: 2100830 - protein, 12 aa, Staphylococcus
SNNASLSETDRQ

SEQ ID NO: 2100831 - protein, 35 aa, Staphylococcus
SNNDEKDKDTKDQKSETHMQHNDESKVPEDMKSTN

SEQ ID NO: 2100832 - protein, 19 aa, Staphylococcus
SNNDEKDKDTNDQKSESHM

SEQ ID NO: 2100833 - protein, 22 aa, Staphylococcus
SNNENSEDFASDPMSYAKTPSL

SEQ ID NO: 2100834 - protein, 8 aa, Staphylococcus
SNNHTNPN

SEQ ID NO: 2100835 - protein, 12 aa, Staphylococcus
SNNKSLYSDDGQ

SEQ ID NO: 2100836 - protein, 15 aa, Staphylococcus
SNNNNEKQPPKTKNG

SEQ ID NO: 2100837 - protein, 5 aa, Staphylococcus
SNNQS

SEQ ID NO: 2100838 - protein, 5 aa, Staphylococcus
SNNVT

SEQ ID NO: 2100839 - protein, 9 aa, Staphylococcus
SNPMPPRTA

SEQ ID NO: 2100840 - protein, 10 aa, Staphylococcus
SNQAHADTDY

SEQ ID NO: 2100841 - protein, 9 aa, Staphylococcus
SNQKDEDKK

SEQ ID NO: 2100842 - protein, 28 aa, Staphylococcus
SNQSEDDNDQNSHSSTHAPKKAKNMKEK

SEQ ID NO: 2100843 - protein, 9 aa, Staphylococcus
SNRASGKMG

SEQ ID NO: 2100844 - protein, 11 aa, Staphylococcus
SNRDTEGKKIK

SEQ ID NO: 2100845 - protein, 10 aa, Staphylococcus
SNRPGGKIQT

SEQ ID NO: 2100846 - protein, 8 aa, Staphylococcus
SNRSSGKM

SEQ ID NO: 2100847 - protein, 25 aa, Staphylococcus
SNSDSGDKKDSKKSDSNDKKQELQI

SEQ ID NO: 2100848 - protein, 5 aa, Staphylococcus
SNSEG

SEQ ID NO: 2100849 - protein, 12 aa, Staphylococcus
SNSGGNHNQANN

SEQ ID NO: 2100850 - protein, 28 aa, Staphylococcus
SNSGSNDSGNKSSDSNKKDNDKKQELQI

SEQ ID NO: 2100851 - protein, 27 aa, Staphylococcus
SNSKDNENSKQSSKSNNSDNPKTELKV

SEQ ID NO: 2100852 - protein, 11 aa, Staphylococcus
SNSNKFNQNLD

SEQ ID NO: 2100853 - protein, 51 aa, Staphylococcus
SNSNNDKDSHKNDEKKSESKAKSKSERFKEYDDNSEAYEEAKKKYNKQKPI

SEQ ID NO: 2100854 - protein, 6 aa, Staphylococcus
SNTLGY

SEQ ID NO: 2100855 - protein, 5 aa, Staphylococcus
SNTNL

SEQ ID NO: 2100856 - protein, 7 aa, Staphylococcus
SNVDDTK

SEQ ID NO: 2100857 - protein, 7 aa, Staphylococcus
SNVDETA

SEQ ID NO: 2100858 - protein, 5 aa, Staphylococcus
SNVEG

SEQ ID NO: 2100859 - protein, 7 aa, Staphylococcus
SNVEPMQ

SEQ ID NO: 2100860 - protein, 24 aa, Staphylococcus
SNVSATKDIEVSEDELKSKFGKTQ

SEQ ID NO: 2100861 - protein, 13 aa, Staphylococcus
SNWAASASQAGFN

SEQ ID NO: 2100862 - protein, 11 aa, Staphylococcus
SNYYRPPNVAR

SEQ ID NO: 2100863 - protein, 4 aa, Staphylococcus
SPEF

SEQ ID NO: 2100864 - protein, 11 aa, Staphylococcus
SPGAGANSLGF

SEQ ID NO: 2100865 - protein, 14 aa, Staphylococcus
SPGANANKLNSDSP

SEQ ID NO: 2100866 - protein, 10 aa, Staphylococcus
SPGASANTLG

SEQ ID NO: 2100867 - protein, 9 aa, Staphylococcus
SPGSRSTPL

SEQ ID NO: 2100868 - protein, 6 aa, Staphylococcus
SPINGD

SEQ ID NO: 2100869 - protein, 9 aa, Staphylococcus
SPINGDLEG

SEQ ID NO: 2100870 - protein, 9 aa, Staphylococcus
SPINGTLQG

SEQ ID NO: 2100871 - protein, 5 aa, Staphylococcus
SPISG

SEQ ID NO: 2100872 - protein, 9 aa, Staphylococcus
SPKGTPRLK

SEQ ID NO: 2100873 - protein, 6 aa, Staphylococcus
SPKKEQ

SEQ ID NO: 2100874 - protein, 5 aa, Staphylococcus
SPKQF

SEQ ID NO: 2100875 - protein, 18 aa, Staphylococcus
SPKSEDDLKQSKENANYS

SEQ ID NO: 2100876 - protein, 4 aa, Staphylococcus
SPLT

SEQ ID NO: 2100877 - protein, 11 aa, Staphylococcus
SPNDKNQNIGE

SEQ ID NO: 2100878 - protein, 31 aa, Staphylococcus
SPNLSAEATDNSIPELKGTNDTIIDKGEEYN

SEQ ID NO: 2100879 - protein, 11 aa, Staphylococcus
SPNPSNKAKYS

SEQ ID NO: 2100880 - protein, 13 aa, Staphylococcus
SPNSAHASAQNSN

SEQ ID NO: 2100881 - protein, 18 aa, Staphylococcus
SPNTFSKYNADNKGNPGL

SEQ ID NO: 2100882 - protein, 16 aa, Staphylococcus
SPRSDIKASTKKGDIH

SEQ ID NO: 2100883 - protein, 6 aa, Staphylococcus
SPYLPK

SEQ ID NO: 2100884 - protein, 8 aa, Staphylococcus
SPYPTYNT

SEQ ID NO: 2100885 - protein, 6 aa, Staphylococcus
SPYPYG

SEQ ID NO: 2100886 - protein, 12 aa, Staphylococcus
SQADAASGNTIQ

SEQ ID NO: 2100887 - protein, 5 aa, Staphylococcus
SQAEG

SEQ ID NO: 2100888 - protein, 13 aa, Staphylococcus
SQAKKAADEIYHE

SEQ ID NO: 2100889 - protein, 13 aa, Staphylococcus
SQAQSEEKLEKEL

SEQ ID NO: 2100890 - protein, 9 aa, Staphylococcus
SQDAEGYPM

SEQ ID NO: 2100891 - protein, 14 aa, Staphylococcus
SQDISSNQRLRTTT

SEQ ID NO: 2100892 - protein, 14 aa, Staphylococcus
SQEARDNIPTKTVN

SEQ ID NO: 2100893 - protein, 13 aa, Staphylococcus
SQEEQNQLDTSAL

SEQ ID NO: 2100894 - protein, 8 aa, Staphylococcus
SQFNSTRQ

SEQ ID NO: 2100895 - protein, 5 aa, Staphylococcus
SQFPK

SEQ ID NO: 2100896 - protein, 69 aa, Staphylococcus
SQHAHAAEANQNSNNTNNVIDDQQNIENAEQAKKEVTNSAQNVSGVQTYQNPSDVKASVATVSKTYDAK

SEQ ID NO: 2100897 - protein, 8 aa, Staphylococcus
SQHSETLN

SEQ ID NO: 2100898 - protein, 17 aa, Staphylococcus
SQIKNEGTEFGSSIGDE

SEQ ID NO: 2100899 - protein, 17 aa, Staphylococcus
SQIKNESVEYGSSIGDE

SEQ ID NO: 2100900 - protein, 5 aa, Staphylococcus
SQIQQ

SEQ ID NO: 2100901 - protein, 9 aa, Staphylococcus
SQKESEAVH

SEQ ID NO: 2100902 - protein, 7 aa, Staphylococcus
SQKGMDG

SEQ ID NO: 2100903 - protein, 9 aa, Staphylococcus
SQLKPKALK

SEQ ID NO: 2100904 - protein, 23 aa, Staphylococcus
SQNDQHQSDKGSKNQSTTGKTPY

SEQ ID NO: 2100905 - protein, 8 aa, Staphylococcus
SQNLGPLE

SEQ ID NO: 2100906 - protein, 7 aa, Staphylococcus
SQPEIYT

SEQ ID NO: 2100907 - protein, 10 aa, Staphylococcus
SQQFPEISDG

SEQ ID NO: 2100908 - protein, 7 aa, Staphylococcus
SQRHKGI

SEQ ID NO: 2100909 - protein, 60 aa, Staphylococcus
SQSDHDSKQDEKKSTQKDKKDSKSSNDDTVKKVKDSAKKKDNPKSQDDKGNKERVDGDKA

SEQ ID NO: 2100910 - protein, 20 aa, Staphylococcus
SQSDNHTTTSNHQKDSHQGT

SEQ ID NO: 2100911 - protein, 16 aa, Staphylococcus
SQSKQQSSTDLKGKEK

SEQ ID NO: 2100912 - protein, 13 aa, Staphylococcus
SQSNGDKQQADGH

SEQ ID NO: 2100913 - protein, 14 aa, Staphylococcus
SQTIPGRQTDGGFQ

SEQ ID NO: 2100914 - protein, 18 aa, Staphylococcus
SQTKGKDGKFTQSESNDI

SEQ ID NO: 2100915 - protein, 13 aa, Staphylococcus
SQTYATDPNYATK

SEQ ID NO: 2100916 - protein, 8 aa, Staphylococcus
SQVDDSKV

SEQ ID NO: 2100917 - protein, 8 aa, Staphylococcus
SRDFGNSN

SEQ ID NO: 2100918 - protein, 10 aa, Staphylococcus
SREDQKDFDK

SEQ ID NO: 2100919 - protein, 4 aa, Staphylococcus
SREG

SEQ ID NO: 2100920 - protein, 14 aa, Staphylococcus
SREGTSKLNHHTSL

SEQ ID NO: 2100921 - protein, 9 aa, Staphylococcus
SREKAKKIT

SEQ ID NO: 2100922 - protein, 5 aa, Staphylococcus
SREKF

SEQ ID NO: 2100923 - protein, 6 aa, Staphylococcus
SRIEDE

SEQ ID NO: 2100924 - protein, 5 aa, Staphylococcus
SRMNT

SEQ ID NO: 2100925 - protein, 12 aa, Staphylococcus
SRSAQLPSVRGN

SEQ ID NO: 2100926 - protein, 10 aa, Staphylococcus
SRSASLPSVR

SEQ ID NO: 2100927 - protein, 15 aa, Staphylococcus
SRTISASQAGSYNYI

SEQ ID NO: 2100928 - protein, 15 aa, Staphylococcus
SRTLSAGQAASYNFI

SEQ ID NO: 2100929 - protein, 15 aa, Staphylococcus
SRTLSSSEAASYNFI

SEQ ID NO: 2100930 - protein, 6 aa, Staphylococcus
SRYGSI

SEQ ID NO: 2100931 - protein, 18 aa, Staphylococcus
SRYGSLSNATAFRASHGW

SEQ ID NO: 2100932 - protein, 10 aa, Staphylococcus
SRYNNPESDK

SEQ ID NO: 2100933 - protein, 305 aa, Staphylococcus
SSAQAAEKQQEVGTPETASAQSIGDKDTHATQKGQVQSTEQDKSQASQTENNTNNSQTSLHNEHNQTDDASTTNETTSTSDETHQSTTVKSEKPTSNSDNQQNEAKQTSQQSLSTDTQTSKPTTNDGITTQQSESSKQEKPSTQSTDTASKEDDTTKKTTAHTQSQTDETSDNKKEALNQPHSNVVKSEDANTSSNEINPNTIKSTEQQQSTESNTSDKPKVDNQQAQSQPKDNDDNQGDALKTATQAQQQTLTKKEATTSEVTNRLNTQNSDNNISIDGQTNPTLDSDKSSKQNKDAQSGLNTL

SEQ ID NO: 2100934 - protein, 6 aa, Staphylococcus
SSDAVK

SEQ ID NO: 2100935 - protein, 15 aa, Staphylococcus
SSDIPNPQQKAEARR

SEQ ID NO: 2100936 - protein, 12 aa, Staphylococcus
SSDKIIQTAPSN

SEQ ID NO: 2100937 - protein, 4 aa, Staphylococcus
SSEA

SEQ ID NO: 2100938 - protein, 6 aa, Staphylococcus
SSEDYV

SEQ ID NO: 2100939 - protein, 12 aa, Staphylococcus
SSELNKRDPFNP

SEQ ID NO: 2100940 - protein, 23 aa, Staphylococcus
SSELNQNVDANYVDSNVSTNWFT

SEQ ID NO: 2100941 - protein, 33 aa, Staphylococcus
SSEPTSYGDPIDTQSNSDSDDDNSSDSTTVTRS

SEQ ID NO: 2100942 - protein, 32 aa, Staphylococcus
SSESAFQTSYSKNDAQRQSNLREGKVDPSKDA

SEQ ID NO: 2100943 - protein, 5 aa, Staphylococcus
SSETF

SEQ ID NO: 2100944 - protein, 6 aa, Staphylococcus
SSETLD

SEQ ID NO: 2100945 - protein, 10 aa, Staphylococcus
SSEVTDENAA

SEQ ID NO: 2100946 - protein, 9 aa, Staphylococcus
SSEVTDENV

SEQ ID NO: 2100947 - protein, 12 aa, Staphylococcus
SSEVTDENVESY

SEQ ID NO: 2100948 - protein, 9 aa, Staphylococcus
SSGIPTNGV

SEQ ID NO: 2100949 - protein, 20 aa, Staphylococcus
SSGKYADKIDKAVNKQQHYQ

SEQ ID NO: 2100950 - protein, 10 aa, Staphylococcus
SSGKYTEKID

SEQ ID NO: 2100951 - protein, 6 aa, Staphylococcus
SSGKYV

SEQ ID NO: 2100952 - protein, 6 aa, Staphylococcus
SSGLGF

SEQ ID NO: 2100953 - protein, 7 aa, Staphylococcus
SSHAKDH

SEQ ID NO: 2100954 - protein, 9 aa, Staphylococcus
SSHTKDDHN

SEQ ID NO: 2100955 - protein, 6 aa, Staphylococcus
SSKYYQ

SEQ ID NO: 2100956 - protein, 5 aa, Staphylococcus
SSLKN

SEQ ID NO: 2100957 - protein, 38 aa, Staphylococcus
SSLNSSDNYTGQGISAKNYEENHESQQENASVDSTKEL

SEQ ID NO: 2100958 - protein, 9 aa, Staphylococcus
SSLPGNSSK

SEQ ID NO: 2100959 - protein, 11 aa, Staphylococcus
SSNATNKKNTL

SEQ ID NO: 2100960 - protein, 10 aa, Staphylococcus
SSNEGLSSNV

SEQ ID NO: 2100961 - protein, 21 aa, Staphylococcus
SSNKSEEKAEADEERGEATDK

SEQ ID NO: 2100962 - protein, 6 aa, Staphylococcus
SSNKTL

SEQ ID NO: 2100963 - protein, 31 aa, Staphylococcus
SSNKTTDNKKIKQLEAKNEKLEAENKDLKKE

SEQ ID NO: 2100964 - protein, 19 aa, Staphylococcus
SSNNSSTNTNRRNNSSSTL

SEQ ID NO: 2100965 - protein, 13 aa, Staphylococcus
SSNSNEQHSKHHD

SEQ ID NO: 2100966 - protein, 15 aa, Staphylococcus
SSNSNFADAKKSLHQ

SEQ ID NO: 2100967 - protein, 14 aa, Staphylococcus
SSNSNFSDAKEALY

SEQ ID NO: 2100968 - protein, 5 aa, Staphylococcus
SSNYY

SEQ ID NO: 2100969 - protein, 8 aa, Staphylococcus
SSQAQAVH

SEQ ID NO: 2100970 - protein, 5 aa, Staphylococcus
SSQRG

SEQ ID NO: 2100971 - protein, 13 aa, Staphylococcus
SSRHPDALERGGM

SEQ ID NO: 2100972 - protein, 5 aa, Staphylococcus
SSSIY

SEQ ID NO: 2100973 - protein, 18 aa, Staphylococcus
SSSPTKKAEGKWQNENGD

SEQ ID NO: 2100974 - protein, 28 aa, Staphylococcus
SSSSEEKNSKDTSNDNKQSQNSSKHNHK

SEQ ID NO: 2100975 - protein, 18 aa, Staphylococcus
SSSVYGANTSKPFATTDN

SEQ ID NO: 2100976 - protein, 4 aa, Staphylococcus
SSTS

SEQ ID NO: 2100977 - protein, 7 aa, Staphylococcus
SSVSATE

SEQ ID NO: 2100978 - protein, 45 aa, Staphylococcus
SSVYATPYSSETETAPLSYNSAETASYVASPSYVTSNNYNTETVS

SEQ ID NO: 2100979 - protein, 4 aa, Staphylococcus
SSYD

SEQ ID NO: 2100980 - protein, 7 aa, Staphylococcus
STAGNYG

SEQ ID NO: 2100981 - protein, 5 aa, Staphylococcus
STAGY

SEQ ID NO: 2100982 - protein, 7 aa, Staphylococcus
STAQASE

SEQ ID NO: 2100983 - protein, 16 aa, Staphylococcus
STASPVNGIAQATNSH

SEQ ID NO: 2100984 - protein, 5 aa, Staphylococcus
STDGG

SEQ ID NO: 2100985 - protein, 10 aa, Staphylococcus
STDTHEIKEY

SEQ ID NO: 2100986 - protein, 10 aa, Staphylococcus
STEGKSKSDY

SEQ ID NO: 2100987 - protein, 14 aa, Staphylococcus
STENGLTKDESLKG

SEQ ID NO: 2100988 - protein, 9 aa, Staphylococcus
STENSGTKL

SEQ ID NO: 2100989 - protein, 36 aa, Staphylococcus
STFAAGSYGGSQSETPKEEQPSSPDEDTSSTSINTN

SEQ ID NO: 2100990 - protein, 14 aa, Staphylococcus
STFGGNSGSPVFNE

SEQ ID NO: 2100991 - protein, 4 aa, Staphylococcus
STFR

SEQ ID NO: 2100992 - protein, 14 aa, Staphylococcus
STGEGKSKPSYETT

SEQ ID NO: 2100993 - protein, 6 aa, Staphylococcus
STGLGL

SEQ ID NO: 2100994 - protein, 15 aa, Staphylococcus
STGSKTHLSDLDEED

SEQ ID NO: 2100995 - protein, 11 aa, Staphylococcus
STHQKSDNTLE

SEQ ID NO: 2100996 - protein, 6 aa, Staphylococcus
STHQSD

SEQ ID NO: 2100997 - protein, 12 aa, Staphylococcus
STIKNADEDIEQ

SEQ ID NO: 2100998 - protein, 7 aa, Staphylococcus
STITSDL

SEQ ID NO: 2100999 - protein, 9 aa, Staphylococcus
STKNRDAAQ

SEQ ID NO: 2101000 - protein, 8 aa, Staphylococcus
STNAYEAQ

SEQ ID NO: 2101001 - protein, 5 aa, Staphylococcus
STNFD

SEQ ID NO: 2101002 - protein, 18 aa, Staphylococcus
STNSDKSTKNEQSEKSYD

SEQ ID NO: 2101003 - protein, 8 aa, Staphylococcus
STNTRAGR

SEQ ID NO: 2101004 - protein, 8 aa, Staphylococcus
STNTRANR

SEQ ID NO: 2101005 - protein, 9 aa, Staphylococcus
STNTRTGKL

SEQ ID NO: 2101006 - protein, 23 aa, Staphylococcus
STNVSLASGTNTDNNKKQSNDEA

SEQ ID NO: 2101007 - protein, 7 aa, Staphylococcus
STPDTLN

SEQ ID NO: 2101008 - protein, 7 aa, Staphylococcus
STPGPYG

SEQ ID NO: 2101009 - protein, 12 aa, Staphylococcus
STQAAETNTASR

SEQ ID NO: 2101010 - protein, 7 aa, Staphylococcus
STQDQYP

SEQ ID NO: 2101011 - protein, 36 aa, Staphylococcus
STQDSSKKNDSENKSTEKSFKDDTAKEVKIPKNPKR

SEQ ID NO: 2101012 - protein, 14 aa, Staphylococcus
STRDGKAEPSYTQT

SEQ ID NO: 2101013 - protein, 16 aa, Staphylococcus
STRTISSMEAGSYNYI

SEQ ID NO: 2101014 - protein, 14 aa, Staphylococcus
STSAGKSTPGYEKT

SEQ ID NO: 2101015 - protein, 14 aa, Staphylococcus
STSEGKATPAYEKT

SEQ ID NO: 2101016 - protein, 14 aa, Staphylococcus
STSEGKSTPAYEKT

SEQ ID NO: 2101017 - protein, 14 aa, Staphylococcus
STSEGKTTPGYETT

SEQ ID NO: 2101018 - protein, 7 aa, Staphylococcus
STSFSEP

SEQ ID NO: 2101019 - protein, 9 aa, Staphylococcus
STSGNTPLG

SEQ ID NO: 2101020 - protein, 27 aa, Staphylococcus
STSHQADAAEFQPSHQYSYQQQNFSQQ

SEQ ID NO: 2101021 - protein, 11 aa, Staphylococcus
STSKITGEEEV

SEQ ID NO: 2101022 - protein, 21 aa, Staphylococcus
STSQLSEASGSGEGPANPQND

SEQ ID NO: 2101023 - protein, 32 aa, Staphylococcus
STSQTHEKKAKEETHNKEENIYAKKRSSGQND

SEQ ID NO: 2101024 - protein, 9 aa, Staphylococcus
STSTRAGKL

SEQ ID NO: 2101025 - protein, 14 aa, Staphylococcus
STTGGNSGSPVFNS

SEQ ID NO: 2101026 - protein, 22 aa, Staphylococcus
STTQGSAGDNSTGSGQQTGKYS

SEQ ID NO: 2101027 - protein, 4 aa, Staphylococcus
STTS

SEQ ID NO: 2101028 - protein, 10 aa, Staphylococcus
STTSYDKQHD

SEQ ID NO: 2101029 - protein, 7 aa, Staphylococcus
STYHHSE

SEQ ID NO: 2101030 - protein, 20 aa, Staphylococcus
STYKATSSLPKYKPQVNSSI

SEQ ID NO: 2101031 - protein, 10 aa, Staphylococcus
STYNGRPELP

SEQ ID NO: 2101032 - protein, 5 aa, Staphylococcus
SVAGG

SEQ ID NO: 2101033 - protein, 38 aa, Staphylococcus
SVAPAEYKGQPASSAPEHVQDAAAQKLYDTAGPSQWVT

SEQ ID NO: 2101034 - protein, 38 aa, Staphylococcus
SVAPAEYQGQPAASAPESVQDAAAQKLYDTEGASQWVT

SEQ ID NO: 2101035 - protein, 22 aa, Staphylococcus
SVAPAQYKGVSPAQAPESVQDA

SEQ ID NO: 2101036 - protein, 22 aa, Staphylococcus
SVAPDEYKGVSPAQAPEDVQDA

SEQ ID NO: 2101037 - protein, 22 aa, Staphylococcus
SVAPEQYKGQSPANAPESVQDA

SEQ ID NO: 2101038 - protein, 97 aa, Staphylococcus
SVAQAEETTKQTKTSESNNEDSTSTSETTRTESNETPSSEDSTSDSSDNNKKQDSQSKESQSDTVSNEDAASHSKPSSTHSKNNRSSHTKDEDTYHT

SEQ ID NO: 2101039 - protein, 8 aa, Staphylococcus
SVATQTKG

SEQ ID NO: 2101040 - protein, 6 aa, Staphylococcus
SVDDKV

SEQ ID NO: 2101041 - protein, 5 aa, Staphylococcus
SVDEL

SEQ ID NO: 2101042 - protein, 7 aa, Staphylococcus
SVDKGDV

SEQ ID NO: 2101043 - protein, 18 aa, Staphylococcus
SVDKKSMQSLSEETKKDI

SEQ ID NO: 2101044 - protein, 11 aa, Staphylococcus
SVDNNKKALKS

SEQ ID NO: 2101045 - protein, 12 aa, Staphylococcus
SVDNNKKPLKSV

SEQ ID NO: 2101046 - protein, 9 aa, Staphylococcus
SVENDQYGL

SEQ ID NO: 2101047 - protein, 11 aa, Staphylococcus
SVENGKVNGKF

SEQ ID NO: 2101048 - protein, 8 aa, Staphylococcus
SVEPRNGI

SEQ ID NO: 2101049 - protein, 41 aa, Staphylococcus
SVGEQNAEAKDKAKQKDKNSIKAAMKEEKNEAPYNTTNYQP

SEQ ID NO: 2101050 - protein, 13 aa, Staphylococcus
SVGSLSNGQEVKD

SEQ ID NO: 2101051 - protein, 23 aa, Staphylococcus
SVKKSTHKSDNGKQSSNHTHKKS

SEQ ID NO: 2101052 - protein, 7 aa, Staphylococcus
SVKTNED

SEQ ID NO: 2101053 - protein, 14 aa, Staphylococcus
SVKTTTPNKTNATY

SEQ ID NO: 2101054 - protein, 10 aa, Staphylococcus
SVNDDGSVKV

SEQ ID NO: 2101055 - protein, 4 aa, Staphylococcus
SVNN

SEQ ID NO: 2101056 - protein, 9 aa, Staphylococcus
SVNPNGTLT

SEQ ID NO: 2101057 - protein, 9 aa, Staphylococcus
SVNSDGSIR

SEQ ID NO: 2101058 - protein, 9 aa, Staphylococcus
SVNSDGSIT

SEQ ID NO: 2101059 - protein, 9 aa, Staphylococcus
SVNSDGSVT

SEQ ID NO: 2101060 - protein, 9 aa, Staphylococcus
SVNSNGSIT

SEQ ID NO: 2101061 - protein, 9 aa, Staphylococcus
SVNSNGTVT

SEQ ID NO: 2101062 - protein, 24 aa, Staphylococcus
SVNYTDADTNLKEDYSNAVQQAQQ

SEQ ID NO: 2101063 - protein, 8 aa, Staphylococcus
SVPKHHKK

SEQ ID NO: 2101064 - protein, 6 aa, Staphylococcus
SVQDQM

SEQ ID NO: 2101065 - protein, 9 aa, Staphylococcus
SVQSNFSNS

SEQ ID NO: 2101066 - protein, 13 aa, Staphylococcus
SVRGDMSKQWKTK

SEQ ID NO: 2101067 - protein, 5 aa, Staphylococcus
SVRPD

SEQ ID NO: 2101068 - protein, 6 aa, Staphylococcus
SVRPDM

SEQ ID NO: 2101069 - protein, 13 aa, Staphylococcus
SVRPDMDKDFQKK

SEQ ID NO: 2101070 - protein, 13 aa, Staphylococcus
SVRPDMNKDFQDK

SEQ ID NO: 2101071 - protein, 13 aa, Staphylococcus
SVRSDMDSKFRDK

SEQ ID NO: 2101072 - protein, 176 aa, Staphylococcus
SVSAPKTNQTSTIKTSTSHTQKPTSAKAPTSIHPKSGTTSTKSSTNHATTKSPITKPTVSKTSTTKPTNTTQHTTTTPSKSTTSTKTSTTTRPPSQTSKTVSKTSTSTAKAPTTSTSRSSTKPSTTTVSSTKPVTSTTSTTTPKSANSKETTIPAIGTNTDVKPIKPIESAHKDYY

SEQ ID NO: 2101073 - protein, 37 aa, Staphylococcus
SVSDNDSSKSDKGDDNKDGVTIKHDGGTTKVAKDPKR

SEQ ID NO: 2101074 - protein, 36 aa, Staphylococcus
SVSHTTSSSSSSTSNSSSVTSTSTKTTSSTKNNLYT

SEQ ID NO: 2101075 - protein, 6 aa, Staphylococcus
SVSNKH

SEQ ID NO: 2101076 - protein, 21 aa, Staphylococcus
SVSNNGSDDSKNKSASKDGVE

SEQ ID NO: 2101077 - protein, 10 aa, Staphylococcus
SVSQDSDSFH

SEQ ID NO: 2101078 - protein, 6 aa, Staphylococcus
SVSSSD

SEQ ID NO: 2101079 - protein, 36 aa, Staphylococcus
SVSSYKESKYIGKSAQHSQLHENKQVANEIIEFLWS

SEQ ID NO: 2101080 - protein, 18 aa, Staphylococcus
SVSTDNVSSHQAHAASSQ

SEQ ID NO: 2101081 - protein, 14 aa, Staphylococcus
SVTKEQQNKKGLSY

SEQ ID NO: 2101082 - protein, 12 aa, Staphylococcus
SVTSRGDDKNVK

SEQ ID NO: 2101083 - protein, 5 aa, Staphylococcus
SVTTR

SEQ ID NO: 2101084 - protein, 13 aa, Staphylococcus
SVTYSSNGDGSIN

SEQ ID NO: 2101085 - protein, 12 aa, Staphylococcus
SVVGGKSTAKQV

SEQ ID NO: 2101086 - protein, 13 aa, Staphylococcus
SVVSGKSSAKQVL

SEQ ID NO: 2101087 - protein, 7 aa, Staphylococcus
SYAEQTQ

SEQ ID NO: 2101088 - protein, 12 aa, Staphylococcus
SYAKVEKGTQYY

SEQ ID NO: 2101089 - protein, 12 aa, Staphylococcus
SYASPELNQDVD

SEQ ID NO: 2101090 - protein, 7 aa, Staphylococcus
SYDREEK

SEQ ID NO: 2101091 - protein, 10 aa, Staphylococcus
SYGPNWGRGG

SEQ ID NO: 2101092 - protein, 13 aa, Staphylococcus
SYKQNRPAPPDEL

SEQ ID NO: 2101093 - protein, 4 aa, Staphylococcus
SYNY

SEQ ID NO: 2101094 - protein, 10 aa, Staphylococcus
SYPKSGTSIS

SEQ ID NO: 2101095 - protein, 8 aa, Staphylococcus
SYRGNSDI

SEQ ID NO: 2101096 - protein, 5 aa, Staphylococcus
SYSDN

SEQ ID NO: 2101097 - protein, 8 aa, Staphylococcus
SYSGRPEL

SEQ ID NO: 2101098 - protein, 8 aa, Staphylococcus
SYSPNNTV

SEQ ID NO: 2101099 - protein, 4 aa, Staphylococcus
SYSQ

SEQ ID NO: 2101100 - protein, 6 aa, Staphylococcus
TAADLG

SEQ ID NO: 2101101 - protein, 15 aa, Staphylococcus
TAAGVQNINILILTL

SEQ ID NO: 2101102 - protein, 7 aa, Staphylococcus
TADGEIE

SEQ ID NO: 2101103 - protein, 9 aa, Staphylococcus
TAELNEDIE

SEQ ID NO: 2101104 - protein, 10 aa, Staphylococcus
TAFGSTAEGR

SEQ ID NO: 2101105 - protein, 4 aa, Staphylococcus
TAFT

SEQ ID NO: 2101106 - protein, 4 aa, Staphylococcus
TAGI

SEQ ID NO: 2101107 - protein, 8 aa, Staphylococcus
TAHAATKP

SEQ ID NO: 2101108 - protein, 11 aa, Staphylococcus
TAHAATQTKGY

SEQ ID NO: 2101109 - protein, 23 aa, Staphylococcus
TAKASEKNEDNHNDNQQKTTYLK

SEQ ID NO: 2101110 - protein, 5 aa, Staphylococcus
TAKEN

SEQ ID NO: 2101111 - protein, 52 aa, Staphylococcus
TAKSPVKVNQSYNVKPGTKAYTVPWGTDKQVAGTVSGKGNQTFKATKQQQID

SEQ ID NO: 2101112 - protein, 11 aa, Staphylococcus
TAKVTQEEMEG

SEQ ID NO: 2101113 - protein, 4 aa, Staphylococcus
TALA

SEQ ID NO: 2101114 - protein, 8 aa, Staphylococcus
TALASSNA

SEQ ID NO: 2101115 - protein, 26 aa, Staphylococcus
TALGSAQPTYASGGGQDSNQNDEVSY

SEQ ID NO: 2101116 - protein, 11 aa, Staphylococcus
TANDNSNINGE

SEQ ID NO: 2101117 - protein, 10 aa, Staphylococcus
TANDNSTIDG

SEQ ID NO: 2101118 - protein, 11 aa, Staphylococcus
TANDNSTIDGE

SEQ ID NO: 2101119 - protein, 11 aa, Staphylococcus
TANDNSTIEGE

SEQ ID NO: 2101120 - protein, 11 aa, Staphylococcus
TANDNSTITGE

SEQ ID NO: 2101121 - protein, 10 aa, Staphylococcus
TANENSTIDG

SEQ ID NO: 2101122 - protein, 11 aa, Staphylococcus
TANENSTITGE

SEQ ID NO: 2101123 - protein, 11 aa, Staphylococcus
TANPSSTIDGE

SEQ ID NO: 2101124 - protein, 18 aa, Staphylococcus
TAPFQKNPKAILKGETQG

SEQ ID NO: 2101125 - protein, 98 aa, Staphylococcus
TAPIANAADDHSTTPSSSSQQRDTQSDNDSTNNDDKPTKDTQDDDEMDTPQQKHEKTKKPSREDTKKDGQDKAQQQKHHGTQTSVTDDNYKKSHQSTN

SEQ ID NO: 2101126 - protein, 38 aa, Staphylococcus
TAPTQSKVATSSKVTTANRAASTQSTSKATQSATTQTI

SEQ ID NO: 2101127 - protein, 109 aa, Staphylococcus
TAQAAEEDHHTETKVQQLNGNQLGNDKQEKLVNETSAIPVENDHTQANDEKNTNNASLHTEQQSDQTKTIDNKNTVDPEYNAKDKVQQEHADEVDPEYNAKDKAQQEQA

SEQ ID NO: 2101128 - protein, 64 aa, Staphylococcus
TAQAKEDNSSEPKAESNKSKNNESTNKATTTSVKSTNSTATTSSNKSTNEKATSNNDKKVTTFS

SEQ ID NO: 2101129 - protein, 19 aa, Staphylococcus
TAQNQQQHRFDKKAAQHAF

SEQ ID NO: 2101130 - protein, 14 aa, Staphylococcus
TARNVTKTHTSNIN

SEQ ID NO: 2101131 - protein, 24 aa, Staphylococcus
TARNVTKTHTSNTNTFQSPNHGPL

SEQ ID NO: 2101132 - protein, 7 aa, Staphylococcus
TASAHGK

SEQ ID NO: 2101133 - protein, 7 aa, Staphylococcus
TASNTPL

SEQ ID NO: 2101134 - protein, 11 aa, Staphylococcus
TDAHQLGQEND

SEQ ID NO: 2101135 - protein, 13 aa, Staphylococcus
TDAPIDYKALKVN

SEQ ID NO: 2101136 - protein, 12 aa, Staphylococcus
TDAQKADITQQI

SEQ ID NO: 2101137 - protein, 8 aa, Staphylococcus
TDATREIM

SEQ ID NO: 2101138 - protein, 16 aa, Staphylococcus
TDAVRGGFKTAQNYGW

SEQ ID NO: 2101139 - protein, 32 aa, Staphylococcus
TDDRGTDSLDKDSLKQLKDTGNYQVKRSQAMN

SEQ ID NO: 2101140 - protein, 5 aa, Staphylococcus
TDEFP

SEQ ID NO: 2101141 - protein, 8 aa, Staphylococcus
TDERPEEL

SEQ ID NO: 2101142 - protein, 10 aa, Staphylococcus
TDETREMMDG

SEQ ID NO: 2101143 - protein, 4 aa, Staphylococcus
TDEV

SEQ ID NO: 2101144 - protein, 20 aa, Staphylococcus
TDGANGTGIKSTNISRLPQG

SEQ ID NO: 2101145 - protein, 8 aa, Staphylococcus
TDGEEVNK

SEQ ID NO: 2101146 - protein, 7 aa, Staphylococcus
TDGTANV

SEQ ID NO: 2101147 - protein, 29 aa, Staphylococcus
TDGTVTQAGWSNYGGGNQVTIQEKNSDNY

SEQ ID NO: 2101148 - protein, 4 aa, Staphylococcus
TDHN

SEQ ID NO: 2101149 - protein, 6 aa, Staphylococcus
TDITNK

SEQ ID NO: 2101150 - protein, 8 aa, Staphylococcus
TDKAEQPQ

SEQ ID NO: 2101151 - protein, 9 aa, Staphylococcus
TDKDKANSY

SEQ ID NO: 2101152 - protein, 9 aa, Staphylococcus
TDKDVPQLN

SEQ ID NO: 2101153 - protein, 8 aa, Staphylococcus
TDKNLKKL

SEQ ID NO: 2101154 - protein, 12 aa, Staphylococcus
TDKPVKKEKFGT

SEQ ID NO: 2101155 - protein, 10 aa, Staphylococcus
TDKQQDPTGI

SEQ ID NO: 2101156 - protein, 12 aa, Staphylococcus
TDKYGQDVIPYE

SEQ ID NO: 2101157 - protein, 4 aa, Staphylococcus
TDNL

SEQ ID NO: 2101158 - protein, 9 aa, Staphylococcus
TDPNKAKGI

SEQ ID NO: 2101159 - protein, 6 aa, Staphylococcus
TDPSYP

SEQ ID NO: 2101160 - protein, 20 aa, Staphylococcus
TDQATDIKNQESLKQTKIHP

SEQ ID NO: 2101161 - protein, 8 aa, Staphylococcus
TDQNDQNF

SEQ ID NO: 2101162 - protein, 7 aa, Staphylococcus
TDSEGAT

SEQ ID NO: 2101163 - protein, 14 aa, Staphylococcus
TDSIGKKGSKGDSY

SEQ ID NO: 2101164 - protein, 6 aa, Staphylococcus
TDTGST

SEQ ID NO: 2101165 - protein, 11 aa, Staphylococcus
TDTGSTKSTIQ

SEQ ID NO: 2101166 - protein, 12 aa, Staphylococcus
TDTGSTKSTIQQ

SEQ ID NO: 2101167 - protein, 9 aa, Staphylococcus
TDTGSTKTN

SEQ ID NO: 2101168 - protein, 5 aa, Staphylococcus
TDTQN

SEQ ID NO: 2101169 - protein, 10 aa, Staphylococcus
TDVKQTPKVN

SEQ ID NO: 2101170 - protein, 4 aa, Staphylococcus
TDVP

SEQ ID NO: 2101171 - protein, 6 aa, Staphylococcus
TDVTQL

SEQ ID NO: 2101172 - protein, 9 aa, Staphylococcus
TDYKTAVEK

SEQ ID NO: 2101173 - protein, 4 aa, Staphylococcus
TDYN

SEQ ID NO: 2101174 - protein, 7 aa, Staphylococcus
TEAFTKA

SEQ ID NO: 2101175 - protein, 4 aa, Staphylococcus
TEAT

SEQ ID NO: 2101176 - protein, 7 aa, Staphylococcus
TEDAKEM

SEQ ID NO: 2101177 - protein, 20 aa, Staphylococcus
TEDDHDDDDDSVTKKKIPTQ

SEQ ID NO: 2101178 - protein, 12 aa, Staphylococcus
TEDGYSKQETAR

SEQ ID NO: 2101179 - protein, 18 aa, Staphylococcus
TEDKKGYVHNKDKKYPVK

SEQ ID NO: 2101180 - protein, 17 aa, Staphylococcus
TEDQAINDLTTAGAEKL

SEQ ID NO: 2101181 - protein, 18 aa, Staphylococcus
TEDSKGRPTNNKKKYPVK

SEQ ID NO: 2101182 - protein, 4 aa, Staphylococcus
TEDT

SEQ ID NO: 2101183 - protein, 10 aa, Staphylococcus
TEDTPSSKIS

SEQ ID NO: 2101184 - protein, 9 aa, Staphylococcus
TEEEQYQLQ

SEQ ID NO: 2101185 - protein, 8 aa, Staphylococcus
TEETREMM

SEQ ID NO: 2101186 - protein, 7 aa, Staphylococcus
TEEYPEE

SEQ ID NO: 2101187 - protein, 15 aa, Staphylococcus
TEGAQELNNHTSLNP

SEQ ID NO: 2101188 - protein, 12 aa, Staphylococcus
TEGDHEIDGNKY

SEQ ID NO: 2101189 - protein, 10 aa, Staphylococcus
TEGKSQAEYE

SEQ ID NO: 2101190 - protein, 8 aa, Staphylococcus
TEIPKGDQ

SEQ ID NO: 2101191 - protein, 6 aa, Staphylococcus
TEIPSD

SEQ ID NO: 2101192 - protein, 7 aa, Staphylococcus
TEKAEAD

SEQ ID NO: 2101193 - protein, 8 aa, Staphylococcus
TEKAQEKY

SEQ ID NO: 2101194 - protein, 14 aa, Staphylococcus
TEKGNPINNEFTES

SEQ ID NO: 2101195 - protein, 15 aa, Staphylococcus
TEKGSSNVQSKKTEL

SEQ ID NO: 2101196 - protein, 10 aa, Staphylococcus
TEKQGTPEQM

SEQ ID NO: 2101197 - protein, 13 aa, Staphylococcus
TEKQGTPEQMKQA

SEQ ID NO: 2101198 - protein, 10 aa, Staphylococcus
TEKQGTPGQM

SEQ ID NO: 2101199 - protein, 10 aa, Staphylococcus
TEKQGTPKQM

SEQ ID NO: 2101200 - protein, 11 aa, Staphylococcus
TEKQGTPSQMK

SEQ ID NO: 2101201 - protein, 7 aa, Staphylococcus
TELASDD

SEQ ID NO: 2101202 - protein, 14 aa, Staphylococcus
TENKSNYSKLNGWN

SEQ ID NO: 2101203 - protein, 5 aa, Staphylococcus
TENQN

SEQ ID NO: 2101204 - protein, 14 aa, Staphylococcus
TEPTATRTALAQPK

SEQ ID NO: 2101205 - protein, 5 aa, Staphylococcus
TEQAD

SEQ ID NO: 2101206 - protein, 6 aa, Staphylococcus
TEQADK

SEQ ID NO: 2101207 - protein, 5 aa, Staphylococcus
TEQAE

SEQ ID NO: 2101208 - protein, 5 aa, Staphylococcus
TEQAN

SEQ ID NO: 2101209 - protein, 6 aa, Staphylococcus
TEQANK

SEQ ID NO: 2101210 - protein, 5 aa, Staphylococcus
TEQIG

SEQ ID NO: 2101211 - protein, 4 aa, Staphylococcus
TESQ

SEQ ID NO: 2101212 - protein, 4 aa, Staphylococcus
TETP

SEQ ID NO: 2101213 - protein, 5 aa, Staphylococcus
TETPK

SEQ ID NO: 2101214 - protein, 14 aa, Staphylococcus
TETQYNDPISLEKQ

SEQ ID NO: 2101215 - protein, 51 aa, Staphylococcus
TEVNEGHNHDNRNRTRYEDREASDDTLVSSTSTTIDGDKLQAAYDRSYAEY

SEQ ID NO: 2101216 - protein, 5 aa, Staphylococcus
TEYEL

SEQ ID NO: 2101217 - protein, 27 aa, Staphylococcus
TFAPGSYGSTKSTKDDGDKQPGDQPAV

SEQ ID NO: 2101218 - protein, 15 aa, Staphylococcus
TFEESDYTNPLPNNG

SEQ ID NO: 2101219 - protein, 13 aa, Staphylococcus
TFGRESYDDRGSS

SEQ ID NO: 2101220 - protein, 41 aa, Staphylococcus
TFGTQSSPGYSAAQSVQTDSDGNATLSLKGQTISDASGSAH

SEQ ID NO: 2101221 - protein, 8 aa, Staphylococcus
TFKNNNVN

SEQ ID NO: 2101222 - protein, 38 aa, Staphylococcus
TFKPGSYGSSQSGSDNNDESSSNDNSNSHHDQTGNAEF

SEQ ID NO: 2101223 - protein, 11 aa, Staphylococcus
TFNSDPSLSSQ

SEQ ID NO: 2101224 - protein, 46 aa, Staphylococcus
TFPYKQNSTEQAGMGNGGPSGGKPSGKMGSMPQMRKQSSNKTYKTM

SEQ ID NO: 2101225 - protein, 11 aa, Staphylococcus
TFQSPNQGPLG

SEQ ID NO: 2101226 - protein, 32 aa, Staphylococcus
TFSDDESDDDSSSDDNSSSDSSSDSEEVTRDN

SEQ ID NO: 2101227 - protein, 6 aa, Staphylococcus
TFSDNN

SEQ ID NO: 2101228 - protein, 20 aa, Staphylococcus
TFSETKNAMDSNKLAKDPVS

SEQ ID NO: 2101229 - protein, 13 aa, Staphylococcus
TFSNPDTQKYEKV

SEQ ID NO: 2101230 - protein, 8 aa, Staphylococcus
TFSNPEAK

SEQ ID NO: 2101231 - protein, 13 aa, Staphylococcus
TFSNPEAKKYEKI

SEQ ID NO: 2101232 - protein, 15 aa, Staphylococcus
TFSNPEAKKYEQEDP

SEQ ID NO: 2101233 - protein, 15 aa, Staphylococcus
TFSNPEARKYEKEDP

SEQ ID NO: 2101234 - protein, 6 aa, Staphylococcus
TFSNSG

SEQ ID NO: 2101235 - protein, 11 aa, Staphylococcus
TFTNQKGMQGW

SEQ ID NO: 2101236 - protein, 39 aa, Staphylococcus
TGAASHNAHAAEVSQSQQQLAETALNNPSELNQHPVQAG

SEQ ID NO: 2101237 - protein, 9 aa, Staphylococcus
TGAATHTGP

SEQ ID NO: 2101238 - protein, 6 aa, Staphylococcus
TGAKTH

SEQ ID NO: 2101239 - protein, 12 aa, Staphylococcus
TGASTGIGQASA

SEQ ID NO: 2101240 - protein, 5 aa, Staphylococcus
TGDLS

SEQ ID NO: 2101241 - protein, 5 aa, Staphylococcus
TGDTP

SEQ ID NO: 2101242 - protein, 6 aa, Staphylococcus
TGDTPL

SEQ ID NO: 2101243 - protein, 4 aa, Staphylococcus
TGEL

SEQ ID NO: 2101244 - protein, 10 aa, Staphylococcus
TGGGGEDAGY

SEQ ID NO: 2101245 - protein, 7 aa, Staphylococcus
TGGNTDL

SEQ ID NO: 2101246 - protein, 7 aa, Staphylococcus
TGGQHRS

SEQ ID NO: 2101247 - protein, 13 aa, Staphylococcus
TGGTHAGYYPGND

SEQ ID NO: 2101248 - protein, 13 aa, Staphylococcus
TGIPESKNLGGFP

SEQ ID NO: 2101249 - protein, 16 aa, Staphylococcus
TGISGTTLSDINAADQ

SEQ ID NO: 2101250 - protein, 6 aa, Staphylococcus
TGIYSE

SEQ ID NO: 2101251 - protein, 9 aa, Staphylococcus
TGKAAGSLK

SEQ ID NO: 2101252 - protein, 14 aa, Staphylococcus
TGKAIGRPKTGTYA

SEQ ID NO: 2101253 - protein, 10 aa, Staphylococcus
TGKKGQKQVD

SEQ ID NO: 2101254 - protein, 13 aa, Staphylococcus
TGLEQDNADPSIR

SEQ ID NO: 2101255 - protein, 37 aa, Staphylococcus
TGNAQNNTDWGNKKYDSLIKSAKGDLLQKTNERYQAM

SEQ ID NO: 2101256 - protein, 22 aa, Staphylococcus
TGNGSNPINSKTVQQEIKGKKV

SEQ ID NO: 2101257 - protein, 23 aa, Staphylococcus
TGNGSNPINSKTVQQTVKGKKIA

SEQ ID NO: 2101258 - protein, 16 aa, Staphylococcus
TGNSNNNTAWSSKEYD

SEQ ID NO: 2101259 - protein, 13 aa, Staphylococcus
TGNVGRSNQSPVA

SEQ ID NO: 2101260 - protein, 4 aa, Staphylococcus
TGPF

SEQ ID NO: 2101261 - protein, 26 aa, Staphylococcus
TGPFKDDSQHSSSNSTQTEFKGKEKV

SEQ ID NO: 2101262 - protein, 6 aa, Staphylococcus
TGPGLV

SEQ ID NO: 2101263 - protein, 57 aa, Staphylococcus
TGQAAAWGTTSSGSTGGTGGSTGSGNTGTTPPSKSGTVKVTENNGVGRINSKNDGLY

SEQ ID NO: 2101264 - protein, 11 aa, Staphylococcus
TGQSDEKFLNK

SEQ ID NO: 2101265 - protein, 5 aa, Staphylococcus
TGQTP

SEQ ID NO: 2101266 - protein, 8 aa, Staphylococcus
TGSANWET

SEQ ID NO: 2101267 - protein, 14 aa, Staphylococcus
TGSKTHLKDLDEDD

SEQ ID NO: 2101268 - protein, 9 aa, Staphylococcus
TGSRKNESV

SEQ ID NO: 2101269 - protein, 17 aa, Staphylococcus
TGSSPKELPQLNSEEYN

SEQ ID NO: 2101270 - protein, 147 aa, Staphylococcus
TGTKQSNSSDDHKTEKHDKKEKKDKTKEEQTDEQSTTSDNGENAQSEPASNNTVNTQQSYSTQQNNSTTQTQQSKTKESSSRQNSSESATSEKNTKETQTTQQPSTQQPSTQQPSTSQPSTQNKTTTNSSSTQSSSSSGSSSDSKDK

SEQ ID NO: 2101271 - protein, 10 aa, Staphylococcus
TGVANASDYH

SEQ ID NO: 2101272 - protein, 9 aa, Staphylococcus
TGYPGDKSL

SEQ ID NO: 2101273 - protein, 11 aa, Staphylococcus
THADKSSIRNA

SEQ ID NO: 2101274 - protein, 31 aa, Staphylococcus
THHAQKGQKVIKQSKAGTYSTGGAPQMNGDE

SEQ ID NO: 2101275 - protein, 19 aa, Staphylococcus
THHEKEAKQLVKETKDNVQ

SEQ ID NO: 2101276 - protein, 44 aa, Staphylococcus
THKGNISAYDYNDEDSSSKLMTDKDKDFIDKSQHAGVDANDYAK

SEQ ID NO: 2101277 - protein, 65 aa, Staphylococcus
THQSTKHSVAETEETSTTKTSSDDPESVSTKEEQPSLETQESTKNTIQKDTLASDKKDNTTEIIN

SEQ ID NO: 2101278 - protein, 9 aa, Staphylococcus
THSSGLPAS

SEQ ID NO: 2101279 - protein, 8 aa, Staphylococcus
THSTGTKM

SEQ ID NO: 2101280 - protein, 7 aa, Staphylococcus
THTRAGK

SEQ ID NO: 2101281 - protein, 6 aa, Staphylococcus
THYDDP

SEQ ID NO: 2101282 - protein, 5 aa, Staphylococcus
TIANV

SEQ ID NO: 2101283 - protein, 7 aa, Staphylococcus
TIDEDKP

SEQ ID NO: 2101284 - protein, 4 aa, Staphylococcus
TIDG

SEQ ID NO: 2101285 - protein, 12 aa, Staphylococcus
TIDRETGKKRKS

SEQ ID NO: 2101286 - protein, 28 aa, Staphylococcus
TIHSDDQSQSSFKPFEESEGSSSYPQGQ

SEQ ID NO: 2101287 - protein, 8 aa, Staphylococcus
TIKDDSGS

SEQ ID NO: 2101288 - protein, 6 aa, Staphylococcus
TIKTKH

SEQ ID NO: 2101289 - protein, 20 aa, Staphylococcus
TINQGDDQTIADLAGKIKYS

SEQ ID NO: 2101290 - protein, 4 aa, Staphylococcus
TINS

SEQ ID NO: 2101291 - protein, 13 aa, Staphylococcus
TIPASQASSYNYI

SEQ ID NO: 2101292 - protein, 30 aa, Staphylococcus
TIPGASGGQGGGQGGTPTATENGTTPTFND

SEQ ID NO: 2101293 - protein, 33 aa, Staphylococcus
TIPGTTGTGGSGGTATETPSSNTGGSTASDANL

SEQ ID NO: 2101294 - protein, 6 aa, Staphylococcus
TIPRNG

SEQ ID NO: 2101295 - protein, 6 aa, Staphylococcus
TIPSIE

SEQ ID NO: 2101296 - protein, 10 aa, Staphylococcus
TIQPDSAKLS

SEQ ID NO: 2101297 - protein, 11 aa, Staphylococcus
TISDVDKSIEE

SEQ ID NO: 2101298 - protein, 5 aa, Staphylococcus
TISMS

SEQ ID NO: 2101299 - protein, 6 aa, Staphylococcus
TISMSQ

SEQ ID NO: 2101300 - protein, 23 aa, Staphylococcus
TISMSQDASNKVVTNDDNPISKH

SEQ ID NO: 2101301 - protein, 23 aa, Staphylococcus
TISMSQDSSNRVITNKENPISQH

SEQ ID NO: 2101302 - protein, 21 aa, Staphylococcus
TITDSDDKKITIKGTNKIDDD

SEQ ID NO: 2101303 - protein, 5 aa, Staphylococcus
TITER

SEQ ID NO: 2101304 - protein, 35 aa, Staphylococcus
TITTSSDLNSSSSSNSSSSSTTSTKTTSSSGNLYT

SEQ ID NO: 2101305 - protein, 53 aa, Staphylococcus
TKAATAVKKAVQPTAKAATTAKPAAKTATNTAVKPAAKTTTATKAKSTSPLNQ

SEQ ID NO: 2101306 - protein, 18 aa, Staphylococcus
TKAKSDMKKTPVGTGPYA

SEQ ID NO: 2101307 - protein, 9 aa, Staphylococcus
TKANQNNLK

SEQ ID NO: 2101308 - protein, 8 aa, Staphylococcus
TKAPDNVD

SEQ ID NO: 2101309 - protein, 8 aa, Staphylococcus
TKAPDTVD

SEQ ID NO: 2101310 - protein, 8 aa, Staphylococcus
TKAPETVN

SEQ ID NO: 2101311 - protein, 4 aa, Staphylococcus
TKAQ

SEQ ID NO: 2101312 - protein, 14 aa, Staphylococcus
TKAQQEANTLNNTM

SEQ ID NO: 2101313 - protein, 8 aa, Staphylococcus
TKASNFAP

SEQ ID NO: 2101314 - protein, 21 aa, Staphylococcus
TKAVKQPPKDVKDLTNAKYKN

SEQ ID NO: 2101315 - protein, 9 aa, Staphylococcus
TKDAQGNYH

SEQ ID NO: 2101316 - protein, 12 aa, Staphylococcus
TKDEAKDKDITY

SEQ ID NO: 2101317 - protein, 13 aa, Staphylococcus
TKDGNDQHLPKEL

SEQ ID NO: 2101318 - protein, 10 aa, Staphylococcus
TKDKSGKGWT

SEQ ID NO: 2101319 - protein, 21 aa, Staphylococcus
TKDMDQGEKQSKAMAGVSSSD

SEQ ID NO: 2101320 - protein, 7 aa, Staphylococcus
TKDNDKL

SEQ ID NO: 2101321 - protein, 6 aa, Staphylococcus
TKDNGF

SEQ ID NO: 2101322 - protein, 4 aa, Staphylococcus
TKDS

SEQ ID NO: 2101323 - protein, 33 aa, Staphylococcus
TKDVEESAKKRKDPKTEVDDKGRVKGEKIEKEL

SEQ ID NO: 2101324 - protein, 13 aa, Staphylococcus
TKEKEEKREDYKN

SEQ ID NO: 2101325 - protein, 4 aa, Staphylococcus
TKEQ

SEQ ID NO: 2101326 - protein, 8 aa, Staphylococcus
TKEQTSFE

SEQ ID NO: 2101327 - protein, 8 aa, Staphylococcus
TKETLYPD

SEQ ID NO: 2101328 - protein, 8 aa, Staphylococcus
TKEYPGSY

SEQ ID NO: 2101329 - protein, 13 aa, Staphylococcus
TKFDENGDKIGSG

SEQ ID NO: 2101330 - protein, 5 aa, Staphylococcus
TKGEL

SEQ ID NO: 2101331 - protein, 48 aa, Staphylococcus
TKGKAEQSKIDEKTKAIDNSYKDVNKKIKDYSKTRNERGKQMEAAEQI

SEQ ID NO: 2101332 - protein, 6 aa, Staphylococcus
TKIDQA

SEQ ID NO: 2101333 - protein, 10 aa, Staphylococcus
TKKPTANREI

SEQ ID NO: 2101334 - protein, 6 aa, Staphylococcus
TKLKEK

SEQ ID NO: 2101335 - protein, 8 aa, Staphylococcus
TKLNKKQH

SEQ ID NO: 2101336 - protein, 7 aa, Staphylococcus
TKLPKNT

SEQ ID NO: 2101337 - protein, 13 aa, Staphylococcus
TKNADDKTLPSAL

SEQ ID NO: 2101338 - protein, 23 aa, Staphylococcus
TKNNAQEVASEALSNSGGNPDLQ

SEQ ID NO: 2101339 - protein, 8 aa, Staphylococcus
TKNNKVTK

SEQ ID NO: 2101340 - protein, 9 aa, Staphylococcus
TKNPNVYPG

SEQ ID NO: 2101341 - protein, 4 aa, Staphylococcus
TKNQ

SEQ ID NO: 2101342 - protein, 6 aa, Staphylococcus
TKNQQL

SEQ ID NO: 2101343 - protein, 19 aa, Staphylococcus
TKNVKNPPKDIKDLTQSKF

SEQ ID NO: 2101344 - protein, 5 aa, Staphylococcus
TKPFV

SEQ ID NO: 2101345 - protein, 9 aa, Staphylococcus
TKPIPNDKL

SEQ ID NO: 2101346 - protein, 7 aa, Staphylococcus
TKPSSVN

SEQ ID NO: 2101347 - protein, 5 aa, Staphylococcus
TKQDQ

SEQ ID NO: 2101348 - protein, 15 aa, Staphylococcus
TKQGAHAGYYPGNTP

SEQ ID NO: 2101349 - protein, 11 aa, Staphylococcus
TKQKPNAKIKA

SEQ ID NO: 2101350 - protein, 9 aa, Staphylococcus
TKQPDVYPG

SEQ ID NO: 2101351 - protein, 5 aa, Staphylococcus
TKRGK

SEQ ID NO: 2101352 - protein, 6 aa, Staphylococcus
TKRWEK

SEQ ID NO: 2101353 - protein, 7 aa, Staphylococcus
TKRWKNE

SEQ ID NO: 2101354 - protein, 9 aa, Staphylococcus
TKSATLGKD

SEQ ID NO: 2101355 - protein, 9 aa, Staphylococcus
TKSATLGKE

SEQ ID NO: 2101356 - protein, 8 aa, Staphylococcus
TKSIEQNM

SEQ ID NO: 2101357 - protein, 60 aa, Staphylococcus
TKSKTAKPSAQTTVKASKKASSTTKKNYYNQAPKRWPSNVPGGDNVRDFGQTTKESGIDD

SEQ ID NO: 2101358 - protein, 9 aa, Staphylococcus
TKSPDVYPA

SEQ ID NO: 2101359 - protein, 9 aa, Staphylococcus
TKSPDVYPG

SEQ ID NO: 2101360 - protein, 9 aa, Staphylococcus
TKSPNVYPG

SEQ ID NO: 2101361 - protein, 4 aa, Staphylococcus
TKTH

SEQ ID NO: 2101362 - protein, 15 aa, Staphylococcus
TKTKDDKKPQVHIYK

SEQ ID NO: 2101363 - protein, 10 aa, Staphylococcus
TKTPEAYPGM

SEQ ID NO: 2101364 - protein, 6 aa, Staphylococcus
TKTPKF

SEQ ID NO: 2101365 - protein, 9 aa, Staphylococcus
TKTSTDFNN

SEQ ID NO: 2101366 - protein, 15 aa, Staphylococcus
TKYAGDVNKKQQDKI

SEQ ID NO: 2101367 - protein, 8 aa, Staphylococcus
TKYPGNAD

SEQ ID NO: 2101368 - protein, 4 aa, Staphylococcus
TLDS

SEQ ID NO: 2101369 - protein, 16 aa, Staphylococcus
TLEKKDKKLSSNIQKN

SEQ ID NO: 2101370 - protein, 13 aa, Staphylococcus
TLGTPHNGTHASD

SEQ ID NO: 2101371 - protein, 18 aa, Staphylococcus
TLGTPHNGTHASDELGNE

SEQ ID NO: 2101372 - protein, 7 aa, Staphylococcus
TLKDVNP

SEQ ID NO: 2101373 - protein, 18 aa, Staphylococcus
TLKRGDAQISATRYTGTD

SEQ ID NO: 2101374 - protein, 6 aa, Staphylococcus
TLKSGK

SEQ ID NO: 2101375 - protein, 18 aa, Staphylococcus
TLNAQQAHAANGLHKEKA

SEQ ID NO: 2101376 - protein, 4 aa, Staphylococcus
TLNH

SEQ ID NO: 2101377 - protein, 5 aa, Staphylococcus
TLNNA

SEQ ID NO: 2101378 - protein, 4 aa, Staphylococcus
TLNS

SEQ ID NO: 2101379 - protein, 76 aa, Staphylococcus
TLPPLSKNLEDEDADSQTENKSSKETHKQSEVKNHPKPDPTPYNQDNPRPQPVTSTSRDESAEKLRKELESNLTQD

SEQ ID NO: 2101380 - protein, 9 aa, Staphylococcus
TLSEGYDGV

SEQ ID NO: 2101381 - protein, 20 aa, Staphylococcus
TLSKGEVKSMASSMPKKYKN

SEQ ID NO: 2101382 - protein, 7 aa, Staphylococcus
TLSKVNP

SEQ ID NO: 2101383 - protein, 17 aa, Staphylococcus
TLSSSKKDTKKDKENIA

SEQ ID NO: 2101384 - protein, 14 aa, Staphylococcus
TLTPAQQKKINDNM

SEQ ID NO: 2101385 - protein, 7 aa, Staphylococcus
TLTTKQG

SEQ ID NO: 2101386 - protein, 4 aa, Staphylococcus
TLYP

SEQ ID NO: 2101387 - protein, 22 aa, Staphylococcus
TMAETSGNSDSNFIKWVESINK

SEQ ID NO: 2101388 - protein, 6 aa, Staphylococcus
TNADEH

SEQ ID NO: 2101389 - protein, 8 aa, Staphylococcus
TNARTGKL

SEQ ID NO: 2101390 - protein, 9 aa, Staphylococcus
TNASEQDLK

SEQ ID NO: 2101391 - protein, 13 aa, Staphylococcus
TNASSFDTAEDYN

SEQ ID NO: 2101392 - protein, 16 aa, Staphylococcus
TNDHSAHASEQTTNYS

SEQ ID NO: 2101393 - protein, 13 aa, Staphylococcus
TNDNTVTAQQTPF

SEQ ID NO: 2101394 - protein, 27 aa, Staphylococcus
TNEAMNKADNLTQERLGKHTQGLNIPG

SEQ ID NO: 2101395 - protein, 6 aa, Staphylococcus
TNEKDI

SEQ ID NO: 2101396 - protein, 17 aa, Staphylococcus
TNELDSKDYSKRKEQAI

SEQ ID NO: 2101397 - protein, 19 aa, Staphylococcus
TNELNNKDYLKRKKDAEKV

SEQ ID NO: 2101398 - protein, 13 aa, Staphylococcus
TNERSVTDRQKEY

SEQ ID NO: 2101399 - protein, 7 aa, Staphylococcus
TNETGQS

SEQ ID NO: 2101400 - protein, 12 aa, Staphylococcus
TNGDQPAPFENT

SEQ ID NO: 2101401 - protein, 9 aa, Staphylococcus
TNGEVKPSI

SEQ ID NO: 2101402 - protein, 10 aa, Staphylococcus
TNGIKPSHPY

SEQ ID NO: 2101403 - protein, 8 aa, Staphylococcus
TNGVNKLR

SEQ ID NO: 2101404 - protein, 5 aa, Staphylococcus
TNHQY

SEQ ID NO: 2101405 - protein, 9 aa, Staphylococcus
TNIGSSDYQ

SEQ ID NO: 2101406 - protein, 10 aa, Staphylococcus
TNKNNPISQH

SEQ ID NO: 2101407 - protein, 10 aa, Staphylococcus
TNKSAPYYAT

SEQ ID NO: 2101408 - protein, 9 aa, Staphylococcus
TNKTRELMD

SEQ ID NO: 2101409 - protein, 5 aa, Staphylococcus
TNKVL

SEQ ID NO: 2101410 - protein, 4 aa, Staphylococcus
TNKY

SEQ ID NO: 2101411 - protein, 20 aa, Staphylococcus
TNNDPKNRADLPESKSAGHP

SEQ ID NO: 2101412 - protein, 9 aa, Staphylococcus
TNNPDTRVK

SEQ ID NO: 2101413 - protein, 4 aa, Staphylococcus
TNNR

SEQ ID NO: 2101414 - protein, 14 aa, Staphylococcus
TNPTINKDNVNQAI

SEQ ID NO: 2101415 - protein, 12 aa, Staphylococcus
TNQIEKNVKTDL

SEQ ID NO: 2101416 - protein, 12 aa, Staphylococcus
TNQIEQAQTIEE

SEQ ID NO: 2101417 - protein, 7 aa, Staphylococcus
TNQNTPI

SEQ ID NO: 2101418 - protein, 14 aa, Staphylococcus
TNQQGTVAKSNHGV

SEQ ID NO: 2101419 - protein, 25 aa, Staphylococcus
TNQQRLDKNNIANQTFKASKSTIVD

SEQ ID NO: 2101420 - protein, 18 aa, Staphylococcus
TNQQRLDNKDLANKSFKV

SEQ ID NO: 2101421 - protein, 7 aa, Staphylococcus
TNQTGQS

SEQ ID NO: 2101422 - protein, 10 aa, Staphylococcus
TNRHKGIQKD

SEQ ID NO: 2101423 - protein, 15 aa, Staphylococcus
TNRPGGKIQTYRKDG

SEQ ID NO: 2101424 - protein, 8 aa, Staphylococcus
TNRSSGKM

SEQ ID NO: 2101425 - protein, 7 aa, Staphylococcus
TNRTGKS

SEQ ID NO: 2101426 - protein, 25 aa, Staphylococcus
TNSETKKVNAKTLEIGGKDGPKEIP

SEQ ID NO: 2101427 - protein, 9 aa, Staphylococcus
TNSRNAQIK

SEQ ID NO: 2101428 - protein, 7 aa, Staphylococcus
TNSYDVE

SEQ ID NO: 2101429 - protein, 5 aa, Staphylococcus
TNTAV

SEQ ID NO: 2101430 - protein, 18 aa, Staphylococcus
TNTLGQVSTDTKGAYTTV

SEQ ID NO: 2101431 - protein, 7 aa, Staphylococcus
TNTSGIP

SEQ ID NO: 2101432 - protein, 9 aa, Staphylococcus
TNTYDSPDI

SEQ ID NO: 2101433 - protein, 16 aa, Staphylococcus
TNYAGDVNKKQQDKIK

SEQ ID NO: 2101434 - protein, 18 aa, Staphylococcus
TPADDNIKDSQHGQNVTN

SEQ ID NO: 2101435 - protein, 4 aa, Staphylococcus
TPAG

SEQ ID NO: 2101436 - protein, 4 aa, Staphylococcus
TPAL

SEQ ID NO: 2101437 - protein, 37 aa, Staphylococcus
TPALASGDGQSTQTSDSTENQTQTQTSNHTNQSHSQW

SEQ ID NO: 2101438 - protein, 36 aa, Staphylococcus
TPAQGQIAEKGTEIEDTATKKPQPIEPSHKTESIEP

SEQ ID NO: 2101439 - protein, 14 aa, Staphylococcus
TPDKKTDNNPNTSE

SEQ ID NO: 2101440 - protein, 12 aa, Staphylococcus
TPDSAEYDGQGT

SEQ ID NO: 2101441 - protein, 21 aa, Staphylococcus
TPETKDPRKPVQKYGPEASAF

SEQ ID NO: 2101442 - protein, 28 aa, Staphylococcus
TPETVKPNTPVQPYGKEASDYSKKTLNH

SEQ ID NO: 2101443 - protein, 4 aa, Staphylococcus
TPFG

SEQ ID NO: 2101444 - protein, 12 aa, Staphylococcus
TPINKHNQPDLT

SEQ ID NO: 2101445 - protein, 15 aa, Staphylococcus
TPIPGIDNPNNPKDY

SEQ ID NO: 2101446 - protein, 17 aa, Staphylococcus
TPKAKVNKSYTIKPGTT

SEQ ID NO: 2101447 - protein, 6 aa, Staphylococcus
TPKHAG

SEQ ID NO: 2101448 - protein, 4 aa, Staphylococcus
TPKL

SEQ ID NO: 2101449 - protein, 18 aa, Staphylococcus
TPKNENDVNANKNSANYS

SEQ ID NO: 2101450 - protein, 17 aa, Staphylococcus
TPLPTNIKDKENNQHMS

SEQ ID NO: 2101451 - protein, 12 aa, Staphylococcus
TPNSAENDGQGT

SEQ ID NO: 2101452 - protein, 7 aa, Staphylococcus
TPNTKLA

SEQ ID NO: 2101453 - protein, 22 aa, Staphylococcus
TPNVKGDALRSMSNPEKYDQPA

SEQ ID NO: 2101454 - protein, 4 aa, Staphylococcus
TPQV

SEQ ID NO: 2101455 - protein, 12 aa, Staphylococcus
TPSSFKEDKNID

SEQ ID NO: 2101456 - protein, 105 aa, Staphylococcus
TPTAVAKDNTDDMNQQTKVTHKSSQSKEDKQEQTDSNQRAHQAEKASSEKSPSKENGKSSKTLNKDNDIKVNKNKTSNQSDQNSNHSHQTTTAVTDQNKQKNTNL

SEQ ID NO: 2101457 - protein, 4 aa, Staphylococcus
TPTG

SEQ ID NO: 2101458 - protein, 12 aa, Staphylococcus
TPTRINGAGAQQ

SEQ ID NO: 2101459 - protein, 5 aa, Staphylococcus
TPTVG

SEQ ID NO: 2101460 - protein, 18 aa, Staphylococcus
TPVRGADGKITKDNMNKM

SEQ ID NO: 2101461 - protein, 15 aa, Staphylococcus
TPYPSETAKLNRNEI

SEQ ID NO: 2101462 - protein, 6 aa, Staphylococcus
TQAAGK

SEQ ID NO: 2101463 - protein, 4 aa, Staphylococcus
TQAK

SEQ ID NO: 2101464 - protein, 18 aa, Staphylococcus
TQAKGKVSDQPVGTGPYK

SEQ ID NO: 2101465 - protein, 11 aa, Staphylococcus
TQDKGSGGEIQ

SEQ ID NO: 2101466 - protein, 9 aa, Staphylococcus
TQDQTTFED

SEQ ID NO: 2101467 - protein, 6 aa, Staphylococcus
TQDREK

SEQ ID NO: 2101468 - protein, 9 aa, Staphylococcus
TQDTPAAKI

SEQ ID NO: 2101469 - protein, 8 aa, Staphylococcus
TQEGASFE

SEQ ID NO: 2101470 - protein, 6 aa, Staphylococcus
TQFEGN

SEQ ID NO: 2101471 - protein, 5 aa, Staphylococcus
TQGDY

SEQ ID NO: 2101472 - protein, 11 aa, Staphylococcus
TQGEGAGGEIQ

SEQ ID NO: 2101473 - protein, 7 aa, Staphylococcus
TQGINPY

SEQ ID NO: 2101474 - protein, 7 aa, Staphylococcus
TQGNTAE

SEQ ID NO: 2101475 - protein, 18 aa, Staphylococcus
TQGNVAEAGAVTTTAYQK

SEQ ID NO: 2101476 - protein, 23 aa, Staphylococcus
TQINKRSSKHDCKPKHPRSSTRE

SEQ ID NO: 2101477 - protein, 16 aa, Staphylococcus
TQKATGYSYKPDKTEH

SEQ ID NO: 2101478 - protein, 14 aa, Staphylococcus
TQKGNDKSLPSALN

SEQ ID NO: 2101479 - protein, 11 aa, Staphylococcus
TQKKGASNEIQ

SEQ ID NO: 2101480 - protein, 9 aa, Staphylococcus
TQPAKGSFS

SEQ ID NO: 2101481 - protein, 10 aa, Staphylococcus
TQPGETDGYD

SEQ ID NO: 2101482 - protein, 11 aa, Staphylococcus
TQPGETDNYDV

SEQ ID NO: 2101483 - protein, 10 aa, Staphylococcus
TQPGETNDYD

SEQ ID NO: 2101484 - protein, 9 aa, Staphylococcus
TQPGETNGY

SEQ ID NO: 2101485 - protein, 11 aa, Staphylococcus
TQPGETNNYSA

SEQ ID NO: 2101486 - protein, 9 aa, Staphylococcus
TQPGETSDY

SEQ ID NO: 2101487 - protein, 5 aa, Staphylococcus
TQPHY

SEQ ID NO: 2101488 - protein, 7 aa, Staphylococcus
TQPSTEL

SEQ ID NO: 2101489 - protein, 16 aa, Staphylococcus
TQSNSQKQSDKKETIK

SEQ ID NO: 2101490 - protein, 8 aa, Staphylococcus
TQSPGTYS

SEQ ID NO: 2101491 - protein, 7 aa, Staphylococcus
TQTTKIN

SEQ ID NO: 2101492 - protein, 5 aa, Staphylococcus
TQVNG

SEQ ID NO: 2101493 - protein, 37 aa, Staphylococcus
TQVPQQNNLQSTSQEQSSQQKQQTNANNQQTQQRYDY

SEQ ID NO: 2101494 - protein, 7 aa, Staphylococcus
TQYDRQG

SEQ ID NO: 2101495 - protein, 9 aa, Staphylococcus
TREAAEAQF

SEQ ID NO: 2101496 - protein, 9 aa, Staphylococcus
TREQTSFED

SEQ ID NO: 2101497 - protein, 14 aa, Staphylococcus
TRHHDSDLKRGERQ

SEQ ID NO: 2101498 - protein, 16 aa, Staphylococcus
TRNGTPRLQTEKGHYL

SEQ ID NO: 2101499 - protein, 12 aa, Staphylococcus
TRQDDVDKITKR

SEQ ID NO: 2101500 - protein, 16 aa, Staphylococcus
TRTISAGEASSYNYIH

SEQ ID NO: 2101501 - protein, 15 aa, Staphylococcus
TRTISASQAASYNFI

SEQ ID NO: 2101502 - protein, 15 aa, Staphylococcus
TRTISASQASSYNYI

SEQ ID NO: 2101503 - protein, 15 aa, Staphylococcus
TSDGSVTKYDENCEE

SEQ ID NO: 2101504 - protein, 7 aa, Staphylococcus
TSDGTNF

SEQ ID NO: 2101505 - protein, 9 aa, Staphylococcus
TSDKDIPNS

SEQ ID NO: 2101506 - protein, 9 aa, Staphylococcus
TSDKGQKQV

SEQ ID NO: 2101507 - protein, 9 aa, Staphylococcus
TSDPLGGSI

SEQ ID NO: 2101508 - protein, 5 aa, Staphylococcus
TSDTH

SEQ ID NO: 2101509 - protein, 6 aa, Staphylococcus
TSDTRI

SEQ ID NO: 2101510 - protein, 9 aa, Staphylococcus
TSEGDRSLG

SEQ ID NO: 2101511 - protein, 24 aa, Staphylococcus
TSESTPQVSATTNQSYRNDTDASL

SEQ ID NO: 2101512 - protein, 31 aa, Staphylococcus
TSFSSQNENKDTSHTTTDLKENNEAKSQLNK

SEQ ID NO: 2101513 - protein, 8 aa, Staphylococcus
TSGGGGDF

SEQ ID NO: 2101514 - protein, 16 aa, Staphylococcus
TSGHEAHAAETTNYDQ

SEQ ID NO: 2101515 - protein, 7 aa, Staphylococcus
TSGQTFK

SEQ ID NO: 2101516 - protein, 12 aa, Staphylococcus
TSHKADDKQASM

SEQ ID NO: 2101517 - protein, 25 aa, Staphylococcus
TSHPTLASAGGQAPDSQNANNSEAI

SEQ ID NO: 2101518 - protein, 20 aa, Staphylococcus
TSHTAKASEKNADERKMETH

SEQ ID NO: 2101519 - protein, 9 aa, Staphylococcus
TSIAPYETD

SEQ ID NO: 2101520 - protein, 5 aa, Staphylococcus
TSIEQ

SEQ ID NO: 2101521 - protein, 10 aa, Staphylococcus
TSINDTENTI

SEQ ID NO: 2101522 - protein, 10 aa, Staphylococcus
TSINPDPTFK

SEQ ID NO: 2101523 - protein, 10 aa, Staphylococcus
TSKIELPKNS

SEQ ID NO: 2101524 - protein, 14 aa, Staphylococcus
TSKKGKKVNMEGTV

SEQ ID NO: 2101525 - protein, 20 aa, Staphylococcus
TSKQQIDNLKQTNSAFQASK

SEQ ID NO: 2101526 - protein, 35 aa, Staphylococcus
TSLNEAQRDQLKQQISQAQTLPDVDTTKNKATTLN

SEQ ID NO: 2101527 - protein, 36 aa, Staphylococcus
TSLTDAQKAQLTQDIDNGQTVSDVQGIQNNADTLNQ

SEQ ID NO: 2101528 - protein, 7 aa, Staphylococcus
TSNGTNW

SEQ ID NO: 2101529 - protein, 16 aa, Staphylococcus
TSNGVNKSSSNQEDAK

SEQ ID NO: 2101530 - protein, 16 aa, Staphylococcus
TSNKENQKLSEDEMNK

SEQ ID NO: 2101531 - protein, 16 aa, Staphylococcus
TSNKSHQKLTEDEMNK

SEQ ID NO: 2101532 - protein, 18 aa, Staphylococcus
TSNSNALSPTEDDFDLQP

SEQ ID NO: 2101533 - protein, 10 aa, Staphylococcus
TSNSTEGDKI

SEQ ID NO: 2101534 - protein, 6 aa, Staphylococcus
TSNTDI

SEQ ID NO: 2101535 - protein, 6 aa, Staphylococcus
TSNTNI

SEQ ID NO: 2101536 - protein, 10 aa, Staphylococcus
TSPKMTKEVR

SEQ ID NO: 2101537 - protein, 4 aa, Staphylococcus
TSPR

SEQ ID NO: 2101538 - protein, 6 aa, Staphylococcus
TSPSTS

SEQ ID NO: 2101539 - protein, 5 aa, Staphylococcus
TSQGY

SEQ ID NO: 2101540 - protein, 12 aa, Staphylococcus
TSRGYGGQPIKY

SEQ ID NO: 2101541 - protein, 14 aa, Staphylococcus
TSRPGGKIQTYRRD

SEQ ID NO: 2101542 - protein, 16 aa, Staphylococcus
TSRTISASQAASYNYI

SEQ ID NO: 2101543 - protein, 10 aa, Staphylococcus
TSSKGQKQVD

SEQ ID NO: 2101544 - protein, 5 aa, Staphylococcus
TSYGQ

SEQ ID NO: 2101545 - protein, 5 aa, Staphylococcus
TSYPG

SEQ ID NO: 2101546 - protein, 44 aa, Staphylococcus
TTAGAQSASSNTIQDVTAQATTHTNETSANEVRTQQQSSNTEVA

SEQ ID NO: 2101547 - protein, 10 aa, Staphylococcus
TTANQGNRYS

SEQ ID NO: 2101548 - protein, 8 aa, Staphylococcus
TTAPKFAA

SEQ ID NO: 2101549 - protein, 43 aa, Staphylococcus
TTDHHADAAEFNQSNNQSYNYNTTQTSTSNTTSERSASGNLYT

SEQ ID NO: 2101550 - protein, 29 aa, Staphylococcus
TTDKKEIKAYDEQVQNAFDKEKPVANVSK

SEQ ID NO: 2101551 - protein, 40 aa, Staphylococcus
TTDKKEIKKYDNQVQKAFDQEKSVNSTSKKINDLEEKKQK

SEQ ID NO: 2101552 - protein, 28 aa, Staphylococcus
TTDKKEVKAYDDNVQKAFDKEQSINEVS

SEQ ID NO: 2101553 - protein, 13 aa, Staphylococcus
TTDKKEVKAYNEN

SEQ ID NO: 2101554 - protein, 42 aa, Staphylococcus
TTDRKEVRAYEDTIQQASSNEQVINSTGQKLNDLEKQKQQYY

SEQ ID NO: 2101555 - protein, 22 aa, Staphylococcus
TTDVNGHETSSSGTGDGRDQAL

SEQ ID NO: 2101556 - protein, 14 aa, Staphylococcus
TTFDPATGEVKQAQ

SEQ ID NO: 2101557 - protein, 5 aa, Staphylococcus
TTGAA

SEQ ID NO: 2101558 - protein, 7 aa, Staphylococcus
TTGESVE

SEQ ID NO: 2101559 - protein, 18 aa, Staphylococcus
TTGNAQNNTGWGSKKYDN

SEQ ID NO: 2101560 - protein, 10 aa, Staphylococcus
TTGTKETLYP

SEQ ID NO: 2101561 - protein, 62 aa, Staphylococcus
TTHHSTSDQKDKVESTKKKNDTHKDNSPEDDAQLDTPQSANNATTAPANNGQNVQQQAPQYH

SEQ ID NO: 2101562 - protein, 5 aa, Staphylococcus
TTIPG

SEQ ID NO: 2101563 - protein, 6 aa, Staphylococcus
TTKGKL

SEQ ID NO: 2101564 - protein, 19 aa, Staphylococcus
TTKLPSDYNPGEKPKAQRA

SEQ ID NO: 2101565 - protein, 15 aa, Staphylococcus
TTKPMKHKPKQYDDV

SEQ ID NO: 2101566 - protein, 5 aa, Staphylococcus
TTKQD

SEQ ID NO: 2101567 - protein, 8 aa, Staphylococcus
TTKSATKY

SEQ ID NO: 2101568 - protein, 68 aa, Staphylococcus
TTKSQPVKKTTVTVTSKTKATPKPTPKVAPKPTTSNYYNQAPKRWPSNIPGSENVRDFGQTTYASGIN

SEQ ID NO: 2101569 - protein, 8 aa, Staphylococcus
TTLASSNA

SEQ ID NO: 2101570 - protein, 15 aa, Staphylococcus
TTPETKIKTSPDAVK

SEQ ID NO: 2101571 - protein, 6 aa, Staphylococcus
TTPFSH

SEQ ID NO: 2101572 - protein, 4 aa, Staphylococcus
TTPK

SEQ ID NO: 2101573 - protein, 45 aa, Staphylococcus
TTPSSSSNSTKPSSGSSSSSTSNNKLTVSANSGVAQIKSKNNGVY

SEQ ID NO: 2101574 - protein, 6 aa, Staphylococcus
TTQGGF

SEQ ID NO: 2101575 - protein, 17 aa, Staphylococcus
TTQLRDENHKLKSNIQD

SEQ ID NO: 2101576 - protein, 18 aa, Staphylococcus
TTQNKSDTQKGQSFESTN

SEQ ID NO: 2101577 - protein, 9 aa, Staphylococcus
TTSAQEHDY

SEQ ID NO: 2101578 - protein, 9 aa, Staphylococcus
TTSSMTSNS

SEQ ID NO: 2101579 - protein, 5 aa, Staphylococcus
TTTGY

SEQ ID NO: 2101580 - protein, 6 aa, Staphylococcus
TTTNEI

SEQ ID NO: 2101581 - protein, 24 aa, Staphylococcus
TTTSAPSSNGISLSRATSNGGNLY

SEQ ID NO: 2101582 - protein, 27 aa, Staphylococcus
TTTSAPSSNGVSLSNASSAGGNLYTSG

SEQ ID NO: 2101583 - protein, 11 aa, Staphylococcus
TTVDDDQTKIN

SEQ ID NO: 2101584 - protein, 11 aa, Staphylococcus
TTVEDGKTRIN

SEQ ID NO: 2101585 - protein, 6 aa, Staphylococcus
TTYATN

SEQ ID NO: 2101586 - protein, 7 aa, Staphylococcus
TTYGPGH

SEQ ID NO: 2101587 - protein, 7 aa, Staphylococcus
TVAGPNA

SEQ ID NO: 2101588 - protein, 12 aa, Staphylococcus
TVAPNSKTQYQG

SEQ ID NO: 2101589 - protein, 13 aa, Staphylococcus
TVDRTTGGKFHGP

SEQ ID NO: 2101590 - protein, 13 aa, Staphylococcus
TVDRTTNGHGRVE

SEQ ID NO: 2101591 - protein, 14 aa, Staphylococcus
TVDRTTNGSGRVED

SEQ ID NO: 2101592 - protein, 14 aa, Staphylococcus
TVDRTTNGTGRVDQ

SEQ ID NO: 2101593 - protein, 14 aa, Staphylococcus
TVDRTTTGTGRVED

SEQ ID NO: 2101594 - protein, 5 aa, Staphylococcus
TVEDE

SEQ ID NO: 2101595 - protein, 10 aa, Staphylococcus
TVKTKKKSIY

SEQ ID NO: 2101596 - protein, 12 aa, Staphylococcus
TVNRTTNGHGRV

SEQ ID NO: 2101597 - protein, 11 aa, Staphylococcus
TVPAGKYAKQY

SEQ ID NO: 2101598 - protein, 12 aa, Staphylococcus
TVPAGKYGKQYL

SEQ ID NO: 2101599 - protein, 9 aa, Staphylococcus
TVPESETHR

SEQ ID NO: 2101600 - protein, 8 aa, Staphylococcus
TVPNDSQI

SEQ ID NO: 2101601 - protein, 15 aa, Staphylococcus
TVPYNTQFDDTKVGA

SEQ ID NO: 2101602 - protein, 9 aa, Staphylococcus
TVSASDDAF

SEQ ID NO: 2101603 - protein, 10 aa, Staphylococcus
TVSENSDSFH

SEQ ID NO: 2101604 - protein, 15 aa, Staphylococcus
TVSGKNRISKLYKVI

SEQ ID NO: 2101605 - protein, 25 aa, Staphylococcus
TVSGTARSSSHTQNSSNSSSSSSYY

SEQ ID NO: 2101606 - protein, 7 aa, Staphylococcus
TVSTGQR

SEQ ID NO: 2101607 - protein, 9 aa, Staphylococcus
TVSTKSSLE

SEQ ID NO: 2101608 - protein, 6 aa, Staphylococcus
TVTADG

SEQ ID NO: 2101609 - protein, 26 aa, Staphylococcus
TVTAPSSTGVSISNSVSSGRNYYTSG

SEQ ID NO: 2101610 - protein, 6 aa, Staphylococcus
TVTPEQ

SEQ ID NO: 2101611 - protein, 5 aa, Staphylococcus
TYAGG

SEQ ID NO: 2101612 - protein, 16 aa, Staphylococcus
TYASDNPSNQKGTMGY

SEQ ID NO: 2101613 - protein, 11 aa, Staphylococcus
TYATDTQYADK

SEQ ID NO: 2101614 - protein, 12 aa, Staphylococcus
TYAYEGGGYDLE

SEQ ID NO: 2101615 - protein, 22 aa, Staphylococcus
TYEFKDKNHTHSRGKNKTETVK

SEQ ID NO: 2101616 - protein, 9 aa, Staphylococcus
TYEGQEKPQ

SEQ ID NO: 2101617 - protein, 10 aa, Staphylococcus
TYGPNWGRGG

SEQ ID NO: 2101618 - protein, 17 aa, Staphylococcus
TYKEANKLSQDTSDVAD

SEQ ID NO: 2101619 - protein, 16 aa, Staphylococcus
TYKNKSKVSKDTTDVA

SEQ ID NO: 2101620 - protein, 8 aa, Staphylococcus
TYKSGEGA

SEQ ID NO: 2101621 - protein, 8 aa, Staphylococcus
TYKTKNNK

SEQ ID NO: 2101622 - protein, 34 aa, Staphylococcus
TYLDTDRKLTDAREPYEDKLDSDEKLSKKKEQKF

SEQ ID NO: 2101623 - protein, 54 aa, Staphylococcus
TYNNYSNTNSTYSYNNYNTNNSNQVASNPTQSYTTSNQQTGGLGAASTSNNNVK

SEQ ID NO: 2101624 - protein, 10 aa, Staphylococcus
TYNPTTNTYT

SEQ ID NO: 2101625 - protein, 20 aa, Staphylococcus
TYNSQVSAKAKVSEHATQSV

SEQ ID NO: 2101626 - protein, 20 aa, Staphylococcus
TYQDGSTKELPGQQPKGLTI

SEQ ID NO: 2101627 - protein, 6 aa, Staphylococcus
TYQPTT

SEQ ID NO: 2101628 - protein, 17 aa, Staphylococcus
VAANSGMAQIKPTNNGL

SEQ ID NO: 2101629 - protein, 10 aa, Staphylococcus
VAASPAPHGE

SEQ ID NO: 2101630 - protein, 10 aa, Staphylococcus
VADDNKPDRI

SEQ ID NO: 2101631 - protein, 4 aa, Staphylococcus
VAGD

SEQ ID NO: 2101632 - protein, 6 aa, Staphylococcus
VAGDKV

SEQ ID NO: 2101633 - protein, 11 aa, Staphylococcus
VAGSTNETVTF

SEQ ID NO: 2101634 - protein, 24 aa, Staphylococcus
VAGTIKDKDKKLSLQDKLSKSSLL

SEQ ID NO: 2101635 - protein, 24 aa, Staphylococcus
VAGTVSKSNTAPFKATKSQQVGKA

SEQ ID NO: 2101636 - protein, 8 aa, Staphylococcus
VAKDQGNA

SEQ ID NO: 2101637 - protein, 10 aa, Staphylococcus
VAKGADLSFE

SEQ ID NO: 2101638 - protein, 14 aa, Staphylococcus
VANDDPAFQSPTKP

SEQ ID NO: 2101639 - protein, 37 aa, Staphylococcus
VAPAEYQGKPASEAPEAVQDAAAQKLYDTAGPSQWVT

SEQ ID NO: 2101640 - protein, 6 aa, Staphylococcus
VAPIYQ

SEQ ID NO: 2101641 - protein, 19 aa, Staphylococcus
VAPQSQVNGTVSNNNQTVT

SEQ ID NO: 2101642 - protein, 6 aa, Staphylococcus
VAPQSV

SEQ ID NO: 2101643 - protein, 41 aa, Staphylococcus
VAPWGTSSSTDPSKPSTPTNPGKLKVSTNSGVAQIKPSNSG

SEQ ID NO: 2101644 - protein, 52 aa, Staphylococcus
VAPWGTTSSSSSSSNTNKGGSSNSGSTTTSPKLTVKSNSGLAQIKTDNSGVY

SEQ ID NO: 2101645 - protein, 45 aa, Staphylococcus
VAPWGTTSSSSTKPSGGSSSSSSDKLTVKANSGVAQIKPSNSGLY

SEQ ID NO: 2101646 - protein, 28 aa, Staphylococcus
VAPWGTTSSTTTNTSNTPKPSTTPSNSQ

SEQ ID NO: 2101647 - protein, 17 aa, Staphylococcus
VAQAQTNEADLNQARTN

SEQ ID NO: 2101648 - protein, 68 aa, Staphylococcus
VAQQQKQNIQRNNEATTEEKTEAESKVERELAQATQNINSAPTNNEVDQAKTSGQNAINSANPNTTVK

SEQ ID NO: 2101649 - protein, 9 aa, Staphylococcus
VAQSVGKKA

SEQ ID NO: 2101650 - protein, 8 aa, Staphylococcus
VASAEQTH

SEQ ID NO: 2101651 - protein, 8 aa, Staphylococcus
VASDDTKV

SEQ ID NO: 2101652 - protein, 15 aa, Staphylococcus
VASPHNGTHAADVGN

SEQ ID NO: 2101653 - protein, 22 aa, Staphylococcus
VASTIKKDDKKLSLQDKISKND

SEQ ID NO: 2101654 - protein, 4 aa, Staphylococcus
VATG

SEQ ID NO: 2101655 - protein, 8 aa, Staphylococcus
VATYDDAR

SEQ ID NO: 2101656 - protein, 9 aa, Staphylococcus
VAVDSTREL

SEQ ID NO: 2101657 - protein, 16 aa, Staphylococcus
VDADDAMTQLYNLFYK

SEQ ID NO: 2101658 - protein, 10 aa, Staphylococcus
VDANKNNVKT

SEQ ID NO: 2101659 - protein, 17 aa, Staphylococcus
VDDGKMAASKIDEGTDV

SEQ ID NO: 2101660 - protein, 18 aa, Staphylococcus
VDDGKMAASKIDEGTDVN

SEQ ID NO: 2101661 - protein, 12 aa, Staphylococcus
VDDKTIKKFNDG

SEQ ID NO: 2101662 - protein, 5 aa, Staphylococcus
VDDKV

SEQ ID NO: 2101663 - protein, 12 aa, Staphylococcus
VDDRDKKDDIAQ

SEQ ID NO: 2101664 - protein, 12 aa, Staphylococcus
VDDRDKKDEIAK

SEQ ID NO: 2101665 - protein, 12 aa, Staphylococcus
VDDRDKKDEIAQ

SEQ ID NO: 2101666 - protein, 5 aa, Staphylococcus
VDDSD

SEQ ID NO: 2101667 - protein, 16 aa, Staphylococcus
VDDYPKDVKKGKEQFN

SEQ ID NO: 2101668 - protein, 16 aa, Staphylococcus
VDDYPKDVKKGKKQFD

SEQ ID NO: 2101669 - protein, 15 aa, Staphylococcus
VDDYPKEVKDKKQFD

SEQ ID NO: 2101670 - protein, 16 aa, Staphylococcus
VDDYPKNVKKGKKQFD

SEQ ID NO: 2101671 - protein, 14 aa, Staphylococcus
VDDYPNDVKHKQKF

SEQ ID NO: 2101672 - protein, 7 aa, Staphylococcus
VDEAQTH

SEQ ID NO: 2101673 - protein, 11 aa, Staphylococcus
VDEEMKQRKEI

SEQ ID NO: 2101674 - protein, 7 aa, Staphylococcus
VDEEQQR

SEQ ID NO: 2101675 - protein, 16 aa, Staphylococcus
VDGHESKKDKWLEGIQ

SEQ ID NO: 2101676 - protein, 5 aa, Staphylococcus
VDGKT

SEQ ID NO: 2101677 - protein, 16 aa, Staphylococcus
VDGQNVSITTKEAYPE

SEQ ID NO: 2101678 - protein, 6 aa, Staphylococcus
VDGTFN

SEQ ID NO: 2101679 - protein, 7 aa, Staphylococcus
VDHGAGR

SEQ ID NO: 2101680 - protein, 9 aa, Staphylococcus
VDHQPEEGA

SEQ ID NO: 2101681 - protein, 16 aa, Staphylococcus
VDKKAMESLSEETHKD

SEQ ID NO: 2101682 - protein, 8 aa, Staphylococcus
VDLNKGEP

SEQ ID NO: 2101683 - protein, 7 aa, Staphylococcus
VDNAKQQ

SEQ ID NO: 2101684 - protein, 18 aa, Staphylococcus
VDNEGDTWYQAPGGGDVV

SEQ ID NO: 2101685 - protein, 6 aa, Staphylococcus
VDNGEL

SEQ ID NO: 2101686 - protein, 6 aa, Staphylococcus
VDNHDH

SEQ ID NO: 2101687 - protein, 30 aa, Staphylococcus
VDNKDHANVNEGVSLPTNLQSDTTQTVPTR

SEQ ID NO: 2101688 - protein, 5 aa, Staphylococcus
VDNLG

SEQ ID NO: 2101689 - protein, 12 aa, Staphylococcus
VDNNKQAQKTVL

SEQ ID NO: 2101690 - protein, 8 aa, Staphylococcus
VDNSGKEY

SEQ ID NO: 2101691 - protein, 63 aa, Staphylococcus
VDNVEQREKEFGKEEKAINNSEEKFKKAEKHLDNISDKAKKKEVKQLNDALKEKYKAHDEYAK

SEQ ID NO: 2101692 - protein, 8 aa, Staphylococcus
VDPQTVTN

SEQ ID NO: 2101693 - protein, 12 aa, Staphylococcus
VDPTLNPDDITQ

SEQ ID NO: 2101694 - protein, 13 aa, Staphylococcus
VDQQEKALKKDRD

SEQ ID NO: 2101695 - protein, 15 aa, Staphylococcus
VDQQGTVRVVDPAYQ

SEQ ID NO: 2101696 - protein, 9 aa, Staphylococcus
VDSATGKVT

SEQ ID NO: 2101697 - protein, 5 aa, Staphylococcus
VDSKV

SEQ ID NO: 2101698 - protein, 8 aa, Staphylococcus
VDSQQTRT

SEQ ID NO: 2101699 - protein, 12 aa, Staphylococcus
VDSRDKKDEIAQ

SEQ ID NO: 2101700 - protein, 8 aa, Staphylococcus
VEADTGMR

SEQ ID NO: 2101701 - protein, 24 aa, Staphylococcus
VEADTGMRNSINQRTNQKDDESPD

SEQ ID NO: 2101702 - protein, 33 aa, Staphylococcus
VEANNNHNNHSNASNSATAHQQFNQSQNKYTSV

SEQ ID NO: 2101703 - protein, 36 aa, Staphylococcus
VEAPKASSNTNVQTAQTSTSTKSTTTTTTTSTSSID

SEQ ID NO: 2101704 - protein, 29 aa, Staphylococcus
VEASGGESSNTTTTNLTNASKTQNNHTNW

SEQ ID NO: 2101705 - protein, 17 aa, Staphylococcus
VEDSNGASSKSIRYIEV

SEQ ID NO: 2101706 - protein, 5 aa, Staphylococcus
VEDSS

SEQ ID NO: 2101707 - protein, 31 aa, Staphylococcus
VEDSSPKYKREDNGKSKKTYDGFKEQDNGTL

SEQ ID NO: 2101708 - protein, 9 aa, Staphylococcus
VEENVSSLG

SEQ ID NO: 2101709 - protein, 12 aa, Staphylococcus
VEGAGQSPILTP

SEQ ID NO: 2101710 - protein, 5 aa, Staphylococcus
VEGEY

SEQ ID NO: 2101711 - protein, 7 aa, Staphylococcus
VEGYTES

SEQ ID NO: 2101712 - protein, 6 aa, Staphylococcus
VEINES

SEQ ID NO: 2101713 - protein, 14 aa, Staphylococcus
VEIYGNKDDLDDID

SEQ ID NO: 2101714 - protein, 21 aa, Staphylococcus
VEKEKTLNQGDKTTTSSVSGF

SEQ ID NO: 2101715 - protein, 9 aa, Staphylococcus
VEKNKESIG

SEQ ID NO: 2101716 - protein, 44 aa, Staphylococcus
VEKREKEFKKEEKALDDSEKEFKKAESHIDNIDNKDKKKEVEEL

SEQ ID NO: 2101717 - protein, 25 aa, Staphylococcus
VEKRQKEFKNEEQALNNSEKEFKKA

SEQ ID NO: 2101718 - protein, 5 aa, Staphylococcus
VENDH

SEQ ID NO: 2101719 - protein, 25 aa, Staphylococcus
VENGGEDDKHQSVKVTDTSIDESSV

SEQ ID NO: 2101720 - protein, 10 aa, Staphylococcus
VENNPNDPHL

SEQ ID NO: 2101721 - protein, 5 aa, Staphylococcus
VENPH

SEQ ID NO: 2101722 - protein, 6 aa, Staphylococcus
VEPAKK

SEQ ID NO: 2101723 - protein, 13 aa, Staphylococcus
VEPTTDNGNLSST

SEQ ID NO: 2101724 - protein, 13 aa, Staphylococcus
VEQHKPDYKDIKV

SEQ ID NO: 2101725 - protein, 19 aa, Staphylococcus
VEQKDGSIDVEKAKEINEQ

SEQ ID NO: 2101726 - protein, 10 aa, Staphylococcus
VEQPDGSIDI

SEQ ID NO: 2101727 - protein, 11 aa, Staphylococcus
VEQPDGSIDVE

SEQ ID NO: 2101728 - protein, 7 aa, Staphylococcus
VEQQRKA

SEQ ID NO: 2101729 - protein, 7 aa, Staphylococcus
VEQQTRG

SEQ ID NO: 2101730 - protein, 9 aa, Staphylococcus
VEQRDEQTY

SEQ ID NO: 2101731 - protein, 4 aa, Staphylococcus
VEQY

SEQ ID NO: 2101732 - protein, 4 aa, Staphylococcus
VERA

SEQ ID NO: 2101733 - protein, 8 aa, Staphylococcus
VESDTPAI

SEQ ID NO: 2101734 - protein, 16 aa, Staphylococcus
VESNYTKPLKNTTSIS

SEQ ID NO: 2101735 - protein, 8 aa, Staphylococcus
VETAPTDY

SEQ ID NO: 2101736 - protein, 44 aa, Staphylococcus
VEYGENGQTLSASNESETNSGSSLPNAAQSLDALKGSAKAPFDA

SEQ ID NO: 2101737 - protein, 4 aa, Staphylococcus
VFPT

SEQ ID NO: 2101738 - protein, 8 aa, Staphylococcus
VGAPQAIN

SEQ ID NO: 2101739 - protein, 10 aa, Staphylococcus
VGAQGSDKNL

SEQ ID NO: 2101740 - protein, 4 aa, Staphylococcus
VGAS

SEQ ID NO: 2101741 - protein, 16 aa, Staphylococcus
VGDRTIGFSSDDNDYT

SEQ ID NO: 2101742 - protein, 14 aa, Staphylococcus
VGDTSIGFNSDDNE

SEQ ID NO: 2101743 - protein, 21 aa, Staphylococcus
VGEHQNNNSNHDAKGVNTSNV

SEQ ID NO: 2101744 - protein, 11 aa, Staphylococcus
VGEPTSTTSQQ

SEQ ID NO: 2101745 - protein, 5 aa, Staphylococcus
VGGDH

SEQ ID NO: 2101746 - protein, 6 aa, Staphylococcus
VGGDKV

SEQ ID NO: 2101747 - protein, 28 aa, Staphylococcus
VGGNNTNSSQYSGQNSSATSHTVQAGES

SEQ ID NO: 2101748 - protein, 8 aa, Staphylococcus
VGGSGEET

SEQ ID NO: 2101749 - protein, 10 aa, Staphylococcus
VGKEDKAEDW

SEQ ID NO: 2101750 - protein, 8 aa, Staphylococcus
VGKGKAAF

SEQ ID NO: 2101751 - protein, 10 aa, Staphylococcus
VGKGKAAFIG

SEQ ID NO: 2101752 - protein, 26 aa, Staphylococcus
VGKNAKVGELEGVPGASATRERGKGF

SEQ ID NO: 2101753 - protein, 9 aa, Staphylococcus
VGKQGADKR

SEQ ID NO: 2101754 - protein, 8 aa, Staphylococcus
VGKQGVDK

SEQ ID NO: 2101755 - protein, 8 aa, Staphylococcus
VGKTGVDK

SEQ ID NO: 2101756 - protein, 12 aa, Staphylococcus
VGLQDVKSTSGY

SEQ ID NO: 2101757 - protein, 4 aa, Staphylococcus
VGNE

SEQ ID NO: 2101758 - protein, 13 aa, Staphylococcus
VGNSKEKRKDIYL

SEQ ID NO: 2101759 - protein, 10 aa, Staphylococcus
VGNTNEQTKT

SEQ ID NO: 2101760 - protein, 6 aa, Staphylococcus
VGPDTT

SEQ ID NO: 2101761 - protein, 15 aa, Staphylococcus
VGPDYTSLNAENTKH

SEQ ID NO: 2101762 - protein, 17 aa, Staphylococcus
VGPEASDLTKQNVKNLK

SEQ ID NO: 2101763 - protein, 15 aa, Staphylococcus
VGPEYSDLNAQNTAH

SEQ ID NO: 2101764 - protein, 6 aa, Staphylococcus
VGPEYT

SEQ ID NO: 2101765 - protein, 16 aa, Staphylococcus
VGPEYTDLNEKNTKHL

SEQ ID NO: 2101766 - protein, 5 aa, Staphylococcus
VGPKK

SEQ ID NO: 2101767 - protein, 15 aa, Staphylococcus
VGPNNFTDVEPDNVY

SEQ ID NO: 2101768 - protein, 5 aa, Staphylococcus
VGQKA

SEQ ID NO: 2101769 - protein, 5 aa, Staphylococcus
VGRPE

SEQ ID NO: 2101770 - protein, 22 aa, Staphylococcus
VGRVSNKDGWKGLGKDSMGTGT

SEQ ID NO: 2101771 - protein, 11 aa, Staphylococcus
VGSDGTEARIS

SEQ ID NO: 2101772 - protein, 11 aa, Staphylococcus
VGSLPNNAKVQ

SEQ ID NO: 2101773 - protein, 5 aa, Staphylococcus
VGSNT

SEQ ID NO: 2101774 - protein, 70 aa, Staphylococcus
VGSTTQSSADYTESYSQESSNQSVSSNQQSSNTSVKAVSAPTTSTHNYSTSTTSYSAPSSSASTGGSTKA

SEQ ID NO: 2101775 - protein, 5 aa, Staphylococcus
VGTAS

SEQ ID NO: 2101776 - protein, 18 aa, Staphylococcus
VGTPHNGTPAADKLGTRK

SEQ ID NO: 2101777 - protein, 11 aa, Staphylococcus
VGTQKDENGIS

SEQ ID NO: 2101778 - protein, 12 aa, Staphylococcus
VGVADDNKKERI

SEQ ID NO: 2101779 - protein, 12 aa, Staphylococcus
VGVADDNKPNRI

SEQ ID NO: 2101780 - protein, 4 aa, Staphylococcus
VGVE

SEQ ID NO: 2101781 - protein, 23 aa, Staphylococcus
VGYDKKGDGKKITYTATKKLKTN

SEQ ID NO: 2101782 - protein, 12 aa, Staphylococcus
VHKQNLKEAKSL

SEQ ID NO: 2101783 - protein, 6 aa, Staphylococcus
VHLDGD

SEQ ID NO: 2101784 - protein, 22 aa, Staphylococcus
VIDNGDATAQQIAEQKQNVDNA

SEQ ID NO: 2101785 - protein, 9 aa, Staphylococcus
VIKQSTVST

SEQ ID NO: 2101786 - protein, 11 aa, Staphylococcus
VIKSETDTKPL

SEQ ID NO: 2101787 - protein, 9 aa, Staphylococcus
VINGNGADR

SEQ ID NO: 2101788 - protein, 9 aa, Staphylococcus
VIPSTNSSI

SEQ ID NO: 2101789 - protein, 9 aa, Staphylococcus
VIPSTNSSV

SEQ ID NO: 2101790 - protein, 17 aa, Staphylococcus
VITSKSKVKYNTPKNVV

SEQ ID NO: 2101791 - protein, 11 aa, Staphylococcus
VKAAENKEDWD

SEQ ID NO: 2101792 - protein, 7 aa, Staphylococcus
VKAENVT

SEQ ID NO: 2101793 - protein, 19 aa, Staphylococcus
VKAKSGDKAHTEITSEIKN

SEQ ID NO: 2101794 - protein, 15 aa, Staphylococcus
VKANATIGGKTYNIT

SEQ ID NO: 2101795 - protein, 12 aa, Staphylococcus
VKANNSGIRTSV

SEQ ID NO: 2101796 - protein, 8 aa, Staphylococcus
VKATNEQL

SEQ ID NO: 2101797 - protein, 10 aa, Staphylococcus
VKDGDGKVIN

SEQ ID NO: 2101798 - protein, 8 aa, Staphylococcus
VKDGDTIK

SEQ ID NO: 2101799 - protein, 7 aa, Staphylococcus
VKDGDTL

SEQ ID NO: 2101800 - protein, 11 aa, Staphylococcus
VKDIKDVKDGA

SEQ ID NO: 2101801 - protein, 13 aa, Staphylococcus
VKDKDTEKAKELY

SEQ ID NO: 2101802 - protein, 8 aa, Staphylococcus
VKDKGDYY

SEQ ID NO: 2101803 - protein, 9 aa, Staphylococcus
VKDLSDKTR

SEQ ID NO: 2101804 - protein, 4 aa, Staphylococcus
VKDN

SEQ ID NO: 2101805 - protein, 33 aa, Staphylococcus
VKDNKEGKAVKNKLKEVESAKTSDDQADKLSDL

SEQ ID NO: 2101806 - protein, 7 aa, Staphylococcus
VKDTDQI

SEQ ID NO: 2101807 - protein, 7 aa, Staphylococcus
VKEEQER

SEQ ID NO: 2101808 - protein, 10 aa, Staphylococcus
VKEKETSIND

SEQ ID NO: 2101809 - protein, 8 aa, Staphylococcus
VKESKDGM

SEQ ID NO: 2101810 - protein, 12 aa, Staphylococcus
VKFSDGSDFDAQ

SEQ ID NO: 2101811 - protein, 9 aa, Staphylococcus
VKGDSGDVT

SEQ ID NO: 2101812 - protein, 14 aa, Staphylococcus
VKGMPKGENNSSLP

SEQ ID NO: 2101813 - protein, 8 aa, Staphylococcus
VKHTEKAI

SEQ ID NO: 2101814 - protein, 5 aa, Staphylococcus
VKIEN

SEQ ID NO: 2101815 - protein, 5 aa, Staphylococcus
VKIQD

SEQ ID NO: 2101816 - protein, 8 aa, Staphylococcus
VKKANGNK

SEQ ID NO: 2101817 - protein, 9 aa, Staphylococcus
VKKDEPKVF

SEQ ID NO: 2101818 - protein, 9 aa, Staphylococcus
VKKDNKGFT

SEQ ID NO: 2101819 - protein, 25 aa, Staphylococcus
VKKDPDHKDYYEKNYKKLDKQIADV

SEQ ID NO: 2101820 - protein, 40 aa, Staphylococcus
VKKDPDHKKYYEKNYKKLNKDLENIDKDMKDATKGKKGNA

SEQ ID NO: 2101821 - protein, 9 aa, Staphylococcus
VKKDQPNVF

SEQ ID NO: 2101822 - protein, 14 aa, Staphylococcus
VKKDSKHKDYYEDN

SEQ ID NO: 2101823 - protein, 7 aa, Staphylococcus
VKKGDTL

SEQ ID NO: 2101824 - protein, 7 aa, Staphylococcus
VKKGNQV

SEQ ID NO: 2101825 - protein, 15 aa, Staphylococcus
VKKNGDQYGTTAAKT

SEQ ID NO: 2101826 - protein, 8 aa, Staphylococcus
VKKSKQPY

SEQ ID NO: 2101827 - protein, 19 aa, Staphylococcus
VKLQDKKQERLAKNEQGDV

SEQ ID NO: 2101828 - protein, 19 aa, Staphylococcus
VKMQDDKQERLAKHDQGDV

SEQ ID NO: 2101829 - protein, 17 aa, Staphylococcus
VKNAAGNYVFQGTNWGY

SEQ ID NO: 2101830 - protein, 17 aa, Staphylococcus
VKNDPDKAKKRGFRGAG

SEQ ID NO: 2101831 - protein, 34 aa, Staphylococcus
VKNERVETVNGDEISRPGPRIDEGMKELRDAIYK

SEQ ID NO: 2101832 - protein, 6 aa, Staphylococcus
VKNGRV

SEQ ID NO: 2101833 - protein, 11 aa, Staphylococcus
VKNIKNVKDGA

SEQ ID NO: 2101834 - protein, 31 aa, Staphylococcus
VKNNGSTPANTFTAKGVAKSPNNKDFASTID

SEQ ID NO: 2101835 - protein, 15 aa, Staphylococcus
VKNNQFNASKSVYVD

SEQ ID NO: 2101836 - protein, 5 aa, Staphylococcus
VKNPE

SEQ ID NO: 2101837 - protein, 13 aa, Staphylococcus
VKNRTTDETFEEP

SEQ ID NO: 2101838 - protein, 14 aa, Staphylococcus
VKNSNLWKSQDNGF

SEQ ID NO: 2101839 - protein, 19 aa, Staphylococcus
VKNYKDAIKSAQKDFDGDV

SEQ ID NO: 2101840 - protein, 10 aa, Staphylococcus
VKPATPSNTT

SEQ ID NO: 2101841 - protein, 6 aa, Staphylococcus
VKPDEL

SEQ ID NO: 2101842 - protein, 9 aa, Staphylococcus
VKPGAGIKA

SEQ ID NO: 2101843 - protein, 9 aa, Staphylococcus
VKPKAANIT

SEQ ID NO: 2101844 - protein, 8 aa, Staphylococcus
VKPKQAHV

SEQ ID NO: 2101845 - protein, 7 aa, Staphylococcus
VKPKQAY

SEQ ID NO: 2101846 - protein, 6 aa, Staphylococcus
VKPNEL

SEQ ID NO: 2101847 - protein, 7 aa, Staphylococcus
VKPNSEF

SEQ ID NO: 2101848 - protein, 8 aa, Staphylococcus
VKPVSGGV

SEQ ID NO: 2101849 - protein, 7 aa, Staphylococcus
VKPYSKK

SEQ ID NO: 2101850 - protein, 10 aa, Staphylococcus
VKQAANDLNQ

SEQ ID NO: 2101851 - protein, 23 aa, Staphylococcus
VKQAQQDLNGEEKVQAAKTAAIQ

SEQ ID NO: 2101852 - protein, 4 aa, Staphylococcus
VKQG

SEQ ID NO: 2101853 - protein, 10 aa, Staphylococcus
VKQPDGSIDI

SEQ ID NO: 2101854 - protein, 6 aa, Staphylococcus
VKQQGA

SEQ ID NO: 2101855 - protein, 10 aa, Staphylococcus
VKRDPQHKAY

SEQ ID NO: 2101856 - protein, 9 aa, Staphylococcus
VKSGDTLNN

SEQ ID NO: 2101857 - protein, 11 aa, Staphylococcus
VKSKSDKYSVT

SEQ ID NO: 2101858 - protein, 15 aa, Staphylococcus
VKSSDTTSGQTYDAK

SEQ ID NO: 2101859 - protein, 17 aa, Staphylococcus
VKSYKSAIKAAQRAFDG

SEQ ID NO: 2101860 - protein, 8 aa, Staphylococcus
VKTAANLS

SEQ ID NO: 2101861 - protein, 9 aa, Staphylococcus
VLEATPESF

SEQ ID NO: 2101862 - protein, 26 aa, Staphylococcus
VLNDATKGIKRIDNTSVEQVTKQKPD

SEQ ID NO: 2101863 - protein, 11 aa, Staphylococcus
VLPAVASKSGL

SEQ ID NO: 2101864 - protein, 19 aa, Staphylococcus
VLPAVASKSGLLAHPSESY

SEQ ID NO: 2101865 - protein, 20 aa, Staphylococcus
VLPAVASKSGLLAHPSSSYV

SEQ ID NO: 2101866 - protein, 22 aa, Staphylococcus
VMQQQEKEKGEAINKAQKTFKQ

SEQ ID NO: 2101867 - protein, 6 aa, Staphylococcus
VNANEH

SEQ ID NO: 2101868 - protein, 27 aa, Staphylococcus
VNDAKQDLNGNRKVEEAKAAAKQALNT

SEQ ID NO: 2101869 - protein, 18 aa, Staphylococcus
VNDKNQQQHDYNIKDTEK

SEQ ID NO: 2101870 - protein, 19 aa, Staphylococcus
VNDNQSPLHSSISPQESEV

SEQ ID NO: 2101871 - protein, 4 aa, Staphylococcus
VNDV

SEQ ID NO: 2101872 - protein, 6 aa, Staphylococcus
VNEDQS

SEQ ID NO: 2101873 - protein, 10 aa, Staphylococcus
VNEESKAKQW

SEQ ID NO: 2101874 - protein, 18 aa, Staphylococcus
VNEISVDKNGKPSKMTEN

SEQ ID NO: 2101875 - protein, 12 aa, Staphylococcus
VNELGYDTEVEN

SEQ ID NO: 2101876 - protein, 26 aa, Staphylococcus
VNGDEISRPGPRIDDGLKELRDAIYQ

SEQ ID NO: 2101877 - protein, 20 aa, Staphylococcus
VNGDNHASSYNNQVTQAQGE

SEQ ID NO: 2101878 - protein, 16 aa, Staphylococcus
VNGKDQNTRKQAAEDI

SEQ ID NO: 2101879 - protein, 16 aa, Staphylococcus
VNGKSEYAGIDIDLAK

SEQ ID NO: 2101880 - protein, 7 aa, Staphylococcus
VNGKTGW

SEQ ID NO: 2101881 - protein, 13 aa, Staphylococcus
VNGNNLSKEQVEA

SEQ ID NO: 2101882 - protein, 19 aa, Staphylococcus
VNHTPEKGSILQSSAGAYG

SEQ ID NO: 2101883 - protein, 19 aa, Staphylococcus
VNHTPKAGSILQSSAGGYG

SEQ ID NO: 2101884 - protein, 8 aa, Staphylococcus
VNITKGDK

SEQ ID NO: 2101885 - protein, 12 aa, Staphylococcus
VNITSNDTFTVQ

SEQ ID NO: 2101886 - protein, 6 aa, Staphylococcus
VNKDGS

SEQ ID NO: 2101887 - protein, 16 aa, Staphylococcus
VNKDGSDSKELTKDYK

SEQ ID NO: 2101888 - protein, 11 aa, Staphylococcus
VNKDGSPTKKL

SEQ ID NO: 2101889 - protein, 10 aa, Staphylococcus
VNKDGTASVT

SEQ ID NO: 2101890 - protein, 10 aa, Staphylococcus
VNKGEADEGT

SEQ ID NO: 2101891 - protein, 9 aa, Staphylococcus
VNKKPKQVS

SEQ ID NO: 2101892 - protein, 5 aa, Staphylococcus
VNKLR

SEQ ID NO: 2101893 - protein, 12 aa, Staphylococcus
VNKYRDSPALKK

SEQ ID NO: 2101894 - protein, 8 aa, Staphylococcus
VNLKEGDP

SEQ ID NO: 2101895 - protein, 6 aa, Staphylococcus
VNNDGS

SEQ ID NO: 2101896 - protein, 9 aa, Staphylococcus
VNNDGSVKV

SEQ ID NO: 2101897 - protein, 12 aa, Staphylococcus
VNNEGDKAWDEY

SEQ ID NO: 2101898 - protein, 12 aa, Staphylococcus
VNNEGSKAWDEY

SEQ ID NO: 2101899 - protein, 64 aa, Staphylococcus
VNNKQQKVEDNATTTNNDNNKVSLSSTTESDSTSKNLSNTSDNTTVNNEDTTLKKNNTQTSPMH

SEQ ID NO: 2101900 - protein, 25 aa, Staphylococcus
VNNSGIRTSVYDKAGKNAAKYGNRT

SEQ ID NO: 2101901 - protein, 7 aa, Staphylococcus
VNNTPEV

SEQ ID NO: 2101902 - protein, 14 aa, Staphylococcus
VNPAGSNTPVQFTR

SEQ ID NO: 2101903 - protein, 13 aa, Staphylococcus
VNPGDLTRAEEKE

SEQ ID NO: 2101904 - protein, 16 aa, Staphylococcus
VNPHTDREPVRSEQVY

SEQ ID NO: 2101905 - protein, 14 aa, Staphylococcus
VNPNSISQSERNDI

SEQ ID NO: 2101906 - protein, 6 aa, Staphylococcus
VNPSDV

SEQ ID NO: 2101907 - protein, 10 aa, Staphylococcus
VNPSSGAAGK

SEQ ID NO: 2101908 - protein, 10 aa, Staphylococcus
VNQAKTQALQ

SEQ ID NO: 2101909 - protein, 7 aa, Staphylococcus
VNQANNI

SEQ ID NO: 2101910 - protein, 29 aa, Staphylococcus
VNQAPQVKTTENYTDADQSKQSDYEQSIT

SEQ ID NO: 2101911 - protein, 5 aa, Staphylococcus
VNQFS

SEQ ID NO: 2101912 - protein, 9 aa, Staphylococcus
VNQPTGDQR

SEQ ID NO: 2101913 - protein, 13 aa, Staphylococcus
VNQQSGPNTPINE

SEQ ID NO: 2101914 - protein, 8 aa, Staphylococcus
VNSDGSIK

SEQ ID NO: 2101915 - protein, 9 aa, Staphylococcus
VNSDGSVKV

SEQ ID NO: 2101916 - protein, 6 aa, Staphylococcus
VNSKDH

SEQ ID NO: 2101917 - protein, 7 aa, Staphylococcus
VNSNGSI

SEQ ID NO: 2101918 - protein, 8 aa, Staphylococcus
VNSNGSIT

SEQ ID NO: 2101919 - protein, 6 aa, Staphylococcus
VNSQDH

SEQ ID NO: 2101920 - protein, 12 aa, Staphylococcus
VNSSTGKNGGFS

SEQ ID NO: 2101921 - protein, 12 aa, Staphylococcus
VNTAKQTAENLN

SEQ ID NO: 2101922 - protein, 6 aa, Staphylococcus
VNTDQL

SEQ ID NO: 2101923 - protein, 4 aa, Staphylococcus
VNTE

SEQ ID NO: 2101924 - protein, 17 aa, Staphylococcus
VNTKATKPSTASTQTVS

SEQ ID NO: 2101925 - protein, 7 aa, Staphylococcus
VNTTDTG

SEQ ID NO: 2101926 - protein, 6 aa, Staphylococcus
VNVTRN

SEQ ID NO: 2101927 - protein, 8 aa, Staphylococcus
VPDSDNYT

SEQ ID NO: 2101928 - protein, 7 aa, Staphylococcus
VPEGQNN

SEQ ID NO: 2101929 - protein, 8 aa, Staphylococcus
VPFQNDSS

SEQ ID NO: 2101930 - protein, 6 aa, Staphylococcus
VPGPYG

SEQ ID NO: 2101931 - protein, 7 aa, Staphylococcus
VPKDKSK

SEQ ID NO: 2101932 - protein, 9 aa, Staphylococcus
VPKHEKKPT

SEQ ID NO: 2101933 - protein, 4 aa, Staphylococcus
VPNA

SEQ ID NO: 2101934 - protein, 7 aa, Staphylococcus
VPNAVSA

SEQ ID NO: 2101935 - protein, 5 aa, Staphylococcus
VPNDT

SEQ ID NO: 2101936 - protein, 5 aa, Staphylococcus
VPNKE

SEQ ID NO: 2101937 - protein, 8 aa, Staphylococcus
VPQDERAK

SEQ ID NO: 2101938 - protein, 8 aa, Staphylococcus
VPSPQPKS

SEQ ID NO: 2101939 - protein, 6 aa, Staphylococcus
VPVNPD

SEQ ID NO: 2101940 - protein, 6 aa, Staphylococcus
VPVNPK

SEQ ID NO: 2101941 - protein, 10 aa, Staphylococcus
VPVTPQEIAE

SEQ ID NO: 2101942 - protein, 22 aa, Staphylococcus
VQAAEQALNGNQNVEHAKTQAL

SEQ ID NO: 2101943 - protein, 11 aa, Staphylococcus
VQAAQAKIDQA

SEQ ID NO: 2101944 - protein, 14 aa, Staphylococcus
VQADNTPPTIGNPV

SEQ ID NO: 2101945 - protein, 10 aa, Staphylococcus
VQAKQTADDI

SEQ ID NO: 2101946 - protein, 10 aa, Staphylococcus
VQARQTADDI

SEQ ID NO: 2101947 - protein, 9 aa, Staphylococcus
VQARQTAED

SEQ ID NO: 2101948 - protein, 18 aa, Staphylococcus
VQDNDGPGNGGPQGDQSY

SEQ ID NO: 2101949 - protein, 5 aa, Staphylococcus
VQEMR

SEQ ID NO: 2101950 - protein, 9 aa, Staphylococcus
VQGPPTGYT

SEQ ID NO: 2101951 - protein, 6 aa, Staphylococcus
VQHGSK

SEQ ID NO: 2101952 - protein, 6 aa, Staphylococcus
VQKDPQ

SEQ ID NO: 2101953 - protein, 35 aa, Staphylococcus
VQKGRIEAVNGDQISRPGPRIDDGLKALRDAIYNE

SEQ ID NO: 2101954 - protein, 8 aa, Staphylococcus
VQKNEQGI

SEQ ID NO: 2101955 - protein, 24 aa, Staphylococcus
VQKPINDKSNTGWTTYGHTGEDVN

SEQ ID NO: 2101956 - protein, 27 aa, Staphylococcus
VQNAEQALNGTQNLEQAKQNAKQQLNS

SEQ ID NO: 2101957 - protein, 48 aa, Staphylococcus
VQNENKANKTNDVSKQAFPNKKTEPPVSKNETAHNPKKVGTDAQTDLS

SEQ ID NO: 2101958 - protein, 23 aa, Staphylococcus
VQNSSSEQKTSGTYKINNKNNGL

SEQ ID NO: 2101959 - protein, 35 aa, Staphylococcus
VQPAAQTAKAPATATAKTAATSSLPKYKPAVNSSI

SEQ ID NO: 2101960 - protein, 9 aa, Staphylococcus
VQPPANNQV

SEQ ID NO: 2101961 - protein, 8 aa, Staphylococcus
VQQAKQSY

SEQ ID NO: 2101962 - protein, 25 aa, Staphylococcus
VQQGQSVNAGDQIGQSGSTGNSTAP

SEQ ID NO: 2101963 - protein, 24 aa, Staphylococcus
VQRDGKKAADKYSAAPGTSEHQTG

SEQ ID NO: 2101964 - protein, 20 aa, Staphylococcus
VQSNAKAATTPVKAQPATAY

SEQ ID NO: 2101965 - protein, 14 aa, Staphylococcus
VQTDDMSPTLNKGD

SEQ ID NO: 2101966 - protein, 18 aa, Staphylococcus
VQTSKYSPSKDNDSTIKI

SEQ ID NO: 2101967 - protein, 16 aa, Staphylococcus
VQTVKTSQKTSSVQTV

SEQ ID NO: 2101968 - protein, 11 aa, Staphylococcus
VQVTGGKNQLD

SEQ ID NO: 2101969 - protein, 16 aa, Staphylococcus
VRDTLTRTTTSNYSLN

SEQ ID NO: 2101970 - protein, 13 aa, Staphylococcus
VREDSAKALDLNE

SEQ ID NO: 2101971 - protein, 46 aa, Staphylococcus
VREESNLPKKRSRRDLPAGDSNNANTATTINDPNLSNTGSNSIKTT

SEQ ID NO: 2101972 - protein, 4 aa, Staphylococcus
VRGE

SEQ ID NO: 2101973 - protein, 7 aa, Staphylococcus
VRGSNHS

SEQ ID NO: 2101974 - protein, 12 aa, Staphylococcus
VRSEIDREKEKQ

SEQ ID NO: 2101975 - protein, 101 aa, Staphylococcus
VSAESLEKSATTSESNDVYKEKDEEQAKQSHSSKNGNDEKNKASDEKENSERKSKLNSTKDERTTEDINNKRHKTSDNKSSNEKIPSSFENSFNDSSSYDS

SEQ ID NO: 2101976 - protein, 8 aa, Staphylococcus
VSDEQSYD

SEQ ID NO: 2101977 - protein, 14 aa, Staphylococcus
VSDKEIKDNTKKAS

SEQ ID NO: 2101978 - protein, 14 aa, Staphylococcus
VSDKELKDDTKKAS

SEQ ID NO: 2101979 - protein, 14 aa, Staphylococcus
VSDKGIKDNSKKAS

SEQ ID NO: 2101980 - protein, 9 aa, Staphylococcus
VSDNAINDQ

SEQ ID NO: 2101981 - protein, 5 aa, Staphylococcus
VSDYA

SEQ ID NO: 2101982 - protein, 11 aa, Staphylococcus
VSDYKTSEQLE

SEQ ID NO: 2101983 - protein, 6 aa, Staphylococcus
VSDYTP

SEQ ID NO: 2101984 - protein, 8 aa, Staphylococcus
VSDYTPAD

SEQ ID NO: 2101985 - protein, 21 aa, Staphylococcus
VSDYTPKEVQPHKVKKQDGEL

SEQ ID NO: 2101986 - protein, 8 aa, Staphylococcus
VSDYTPSE

SEQ ID NO: 2101987 - protein, 9 aa, Staphylococcus
VSDYTPSEV

SEQ ID NO: 2101988 - protein, 7 aa, Staphylococcus
VSEDING

SEQ ID NO: 2101989 - protein, 9 aa, Staphylococcus
VSEDNQASI

SEQ ID NO: 2101990 - protein, 9 aa, Staphylococcus
VSEHSADTA

SEQ ID NO: 2101991 - protein, 9 aa, Staphylococcus
VSENSDSFH

SEQ ID NO: 2101992 - protein, 9 aa, Staphylococcus
VSGDIAGQA

SEQ ID NO: 2101993 - protein, 7 aa, Staphylococcus
VSGPQSK

SEQ ID NO: 2101994 - protein, 32 aa, Staphylococcus
VSGQAVNPNMPAESAKYPQGTKELYGSANAQG

SEQ ID NO: 2101995 - protein, 31 aa, Staphylococcus
VSGSSASTSRNTSNSSAVSGGSTYTVRAGDS

SEQ ID NO: 2101996 - protein, 28 aa, Staphylococcus
VSGSSKSTANRTANTSSSTYTVQPGDSL

SEQ ID NO: 2101997 - protein, 38 aa, Staphylococcus
VSGSSNYSSRSNYGNSSSTYTVRAGDSLSSIASRYGTT

SEQ ID NO: 2101998 - protein, 21 aa, Staphylococcus
VSGSSSSASKSKTSSNSGSVY

SEQ ID NO: 2101999 - protein, 36 aa, Staphylococcus
VSGSSSSHSYSNNSSSTYTVKSGDSLSSIASRYGTT

SEQ ID NO: 2102000 - protein, 34 aa, Staphylococcus
VSGSTSTSKPSSSSSTGTSSSTYTVKAGDSVSSI

SEQ ID NO: 2102001 - protein, 26 aa, Staphylococcus
VSGSVSSNSHSSYNSNSGGSSSTYTV

SEQ ID NO: 2102002 - protein, 43 aa, Staphylococcus
VSGVADASSVHKTAKHQQQTTQGDRPYGGIAPKGMSEKQYEEL

SEQ ID NO: 2102003 - protein, 14 aa, Staphylococcus
VSHADASENQINKE

SEQ ID NO: 2102004 - protein, 11 aa, Staphylococcus
VSIKKGKKVEL

SEQ ID NO: 2102005 - protein, 9 aa, Staphylococcus
VSKDGKTAS

SEQ ID NO: 2102006 - protein, 8 aa, Staphylococcus
VSKDTIND

SEQ ID NO: 2102007 - protein, 10 aa, Staphylococcus
VSKNGNVNFK

SEQ ID NO: 2102008 - protein, 8 aa, Staphylococcus
VSKNSINE

SEQ ID NO: 2102009 - protein, 15 aa, Staphylococcus
VSKVEPEETKAYITV

SEQ ID NO: 2102010 - protein, 6 aa, Staphylococcus
VSMHSG

SEQ ID NO: 2102011 - protein, 17 aa, Staphylococcus
VSMSDKEIKENTKKGSH

SEQ ID NO: 2102012 - protein, 13 aa, Staphylococcus
VSNDDGKSTYNKQ

SEQ ID NO: 2102013 - protein, 8 aa, Staphylococcus
VSNDIAEQ

SEQ ID NO: 2102014 - protein, 19 aa, Staphylococcus
VSNEDSTEALTSGLASGDL

SEQ ID NO: 2102015 - protein, 19 aa, Staphylococcus
VSNEGVSQTEAQVATTQPW

SEQ ID NO: 2102016 - protein, 18 aa, Staphylococcus
VSNKITDTIRKETDAKPL

SEQ ID NO: 2102017 - protein, 17 aa, Staphylococcus
VSNKVTDTIRKETEAKP

SEQ ID NO: 2102018 - protein, 10 aa, Staphylococcus
VSNPQAKNVE

SEQ ID NO: 2102019 - protein, 6 aa, Staphylococcus
VSNQAR

SEQ ID NO: 2102020 - protein, 6 aa, Staphylococcus
VSNSPI

SEQ ID NO: 2102021 - protein, 21 aa, Staphylococcus
VSNTEVPAKAEQQAETQFSSY

SEQ ID NO: 2102022 - protein, 10 aa, Staphylococcus
VSNTPSHPLN

SEQ ID NO: 2102023 - protein, 7 aa, Staphylococcus
VSPDGRR

SEQ ID NO: 2102024 - protein, 8 aa, Staphylococcus
VSPNKGNF

SEQ ID NO: 2102025 - protein, 5 aa, Staphylococcus
VSQKD

SEQ ID NO: 2102026 - protein, 52 aa, Staphylococcus
VSSAIQQAKADGYNGDEYEVEYGEGKETLSVTKEAKEKLGSGSLAMPNAQDS

SEQ ID NO: 2102027 - protein, 8 aa, Staphylococcus
VSSKGAAL

SEQ ID NO: 2102028 - protein, 14 aa, Staphylococcus
VSSRPITAEEAKSY

SEQ ID NO: 2102029 - protein, 9 aa, Staphylococcus
VSTETSPAF

SEQ ID NO: 2102030 - protein, 4 aa, Staphylococcus
VSTL

SEQ ID NO: 2102031 - protein, 40 aa, Staphylococcus
VSTLNDSEKQFKKGKSHIDEIKSDDKKKEVKQLDDAVKNK

SEQ ID NO: 2102032 - protein, 12 aa, Staphylococcus
VSTPSASLKKVY

SEQ ID NO: 2102033 - protein, 14 aa, Staphylococcus
VTAAQNSANDLNTA

SEQ ID NO: 2102034 - protein, 8 aa, Staphylococcus
VTADASKD

SEQ ID NO: 2102035 - protein, 6 aa, Staphylococcus
VTAGPT

SEQ ID NO: 2102036 - protein, 5 aa, Staphylococcus
VTDEA

SEQ ID NO: 2102037 - protein, 9 aa, Staphylococcus
VTDEEKAQI

SEQ ID NO: 2102038 - protein, 5 aa, Staphylococcus
VTDEN

SEQ ID NO: 2102039 - protein, 6 aa, Staphylococcus
VTDEQA

SEQ ID NO: 2102040 - protein, 17 aa, Staphylococcus
VTDSDGAQKTSIRNIKV

SEQ ID NO: 2102041 - protein, 4 aa, Staphylococcus
VTEQ

SEQ ID NO: 2102042 - protein, 7 aa, Staphylococcus
VTERDAH

SEQ ID NO: 2102043 - protein, 20 aa, Staphylococcus
VTERTSNLKYQDQSGALNES

SEQ ID NO: 2102044 - protein, 7 aa, Staphylococcus
VTGKPYV

SEQ ID NO: 2102045 - protein, 5 aa, Staphylococcus
VTGTV

SEQ ID NO: 2102046 - protein, 9 aa, Staphylococcus
VTHREQQAE

SEQ ID NO: 2102047 - protein, 12 aa, Staphylococcus
VTINGNKFDPNR

SEQ ID NO: 2102048 - protein, 21 aa, Staphylococcus
VTKELTVQPDVSNKDIDSDYQ

SEQ ID NO: 2102049 - protein, 11 aa, Staphylococcus
VTKQRTQGNNT

SEQ ID NO: 2102050 - protein, 8 aa, Staphylococcus
VTKRDADT

SEQ ID NO: 2102051 - protein, 15 aa, Staphylococcus
VTKRTRELQKELNEL

SEQ ID NO: 2102052 - protein, 9 aa, Staphylococcus
VTKSPDTVD

SEQ ID NO: 2102053 - protein, 15 aa, Staphylococcus
VTKVNPKETKAYINV

SEQ ID NO: 2102054 - protein, 15 aa, Staphylococcus
VTKVSPKDTTAKITV

SEQ ID NO: 2102055 - protein, 19 aa, Staphylococcus
VTNGGGIRASISKGKVTQN

SEQ ID NO: 2102056 - protein, 11 aa, Staphylococcus
VTNGNNKDYHQ

SEQ ID NO: 2102057 - protein, 8 aa, Staphylococcus
VTNNKEGI

SEQ ID NO: 2102058 - protein, 4 aa, Staphylococcus
VTPV

SEQ ID NO: 2102059 - protein, 20 aa, Staphylococcus
VTQETANLNYRNQSGALNES

SEQ ID NO: 2102060 - protein, 6 aa, Staphylococcus
VTSIQQ

SEQ ID NO: 2102061 - protein, 18 aa, Staphylococcus
VTSPDQDAQKSLATSDNY

SEQ ID NO: 2102062 - protein, 5 aa, Staphylococcus
VTSPK

SEQ ID NO: 2102063 - protein, 24 aa, Staphylococcus
VTSQNLGKQTKSTGKYKVNSENNG

SEQ ID NO: 2102064 - protein, 10 aa, Staphylococcus
VTSRGTGQWN

SEQ ID NO: 2102065 - protein, 71 aa, Staphylococcus
VTTAPQAYYSNENNVEYKAPTRSYTTSYKVPSYTAPTSYSGNYSSTSYSAPAAQSSYSNYSGANYYTSGQC

SEQ ID NO: 2102066 - protein, 5 aa, Staphylococcus
VTTDL

SEQ ID NO: 2102067 - protein, 28 aa, Staphylococcus
VTTTSAPSSHGVSISSASHSGSNLYTSG

SEQ ID NO: 2102068 - protein, 10 aa, Staphylococcus
VTVNKDNDFV

SEQ ID NO: 2102069 - protein, 4 aa, Staphylococcus
VVKE

SEQ ID NO: 2102070 - protein, 10 aa, Staphylococcus
VVKKDQPNVF

SEQ ID NO: 2102071 - protein, 19 aa, Staphylococcus
VVSETKDKNGKVTTSETND

SEQ ID NO: 2102072 - protein, 19 aa, Staphylococcus
VVSETKQKNGKVTHSKDDD

SEQ ID NO: 2102073 - protein, 7 aa, Staphylococcus
VVTDENV

SEQ ID NO: 2102074 - protein, 8 aa, Staphylococcus
VVTNGKDK

SEQ ID NO: 2102075 - protein, 12 aa, Staphylococcus
VYATGENANVAP

SEQ ID NO: 2102076 - protein, 18 aa, Staphylococcus
VYDKQDRSYFKGNKDYQQ

SEQ ID NO: 2102077 - protein, 6 aa, Staphylococcus
VYNESQ

SEQ ID NO: 2102078 - protein, 12 aa, Staphylococcus
VYNNQGAGAWVA

SEQ ID NO: 2102079 - protein, 9 aa, Staphylococcus
VYPGATEED

SEQ ID NO: 2102080 - protein, 6 aa, Staphylococcus
VYPGNE

SEQ ID NO: 2102081 - protein, 5 aa, Staphylococcus
VYPTK

SEQ ID NO: 2102082 - protein, 12 aa, Staphylococcus
VYRTPAEQKAHE

SEQ ID NO: 2102083 - protein, 21 aa, Staphylococcus
WADNARADGYTVNNQPSAGSI

SEQ ID NO: 2102084 - protein, 14 aa, Staphylococcus
WANQAQPSTNQADV

SEQ ID NO: 2102085 - protein, 15 aa, Staphylococcus
WAPGSGQPLSNSPGI

SEQ ID NO: 2102086 - protein, 18 aa, Staphylococcus
WAYSAKNAGLTVDNRPEV

SEQ ID NO: 2102087 - protein, 12 aa, Staphylococcus
WDDGARADGYTV

SEQ ID NO: 2102088 - protein, 29 aa, Staphylococcus
WDNAAAADGYTIDGKPTVGSIAQSDSGYY

SEQ ID NO: 2102089 - protein, 10 aa, Staphylococcus
WDNAAARDGY

SEQ ID NO: 2102090 - protein, 28 aa, Staphylococcus
WDNAAARDGYRIDGNPTVGSIAQSDAGY

SEQ ID NO: 2102091 - protein, 7 aa, Staphylococcus
WDNDQQN

SEQ ID NO: 2102092 - protein, 20 aa, Staphylococcus
WDTAAAADGYTIDRKATVGS

SEQ ID NO: 2102093 - protein, 10 aa, Staphylococcus
WDVSNDGKDY

SEQ ID NO: 2102094 - protein, 55 aa, Staphylococcus
WEHDDDKNTSQSQGQSSQQDESKQSSNQTHQSSSNQTTSHSSSDNNHSSVSDSAL

SEQ ID NO: 2102095 - protein, 5 aa, Staphylococcus
WEPQA

SEQ ID NO: 2102096 - protein, 25 aa, Staphylococcus
WGHGEGGASGASAQGTADLKAQTPW

SEQ ID NO: 2102097 - protein, 25 aa, Staphylococcus
WGHGEGGASGASTQGTTDLKAQTPW

SEQ ID NO: 2102098 - protein, 4 aa, Staphylococcus
WGKG

SEQ ID NO: 2102099 - protein, 5 aa, Staphylococcus
WGRGG

SEQ ID NO: 2102100 - protein, 4 aa, Staphylococcus
WGRP

SEQ ID NO: 2102101 - protein, 21 aa, Staphylococcus
WKAQTAKDGKEIKEKIGQDKT

SEQ ID NO: 2102102 - protein, 8 aa, Staphylococcus
WKGEPKLD

SEQ ID NO: 2102103 - protein, 27 aa, Staphylococcus
WKSKDNGFNDLTRDGATDLNRKTSLNP

SEQ ID NO: 2102104 - protein, 9 aa, Staphylococcus
WLNETGAKF

SEQ ID NO: 2102105 - protein, 5 aa, Staphylococcus
WNGKH

SEQ ID NO: 2102106 - protein, 4 aa, Staphylococcus
WPQH

SEQ ID NO: 2102107 - protein, 8 aa, Staphylococcus
WQGTPKLS

SEQ ID NO: 2102108 - protein, 11 aa, Staphylococcus
WQNGDNTKAYY

SEQ ID NO: 2102109 - protein, 11 aa, Staphylococcus
WQNGDNTKTHW

SEQ ID NO: 2102110 - protein, 10 aa, Staphylococcus
WYGGDGTDGM

SEQ ID NO: 2102111 - protein, 11 aa, Staphylococcus
WYGGDSRRADI

SEQ ID NO: 2102112 - protein, 15 aa, Staphylococcus
YAAKTPTQIAEAEKQ

SEQ ID NO: 2102113 - protein, 21 aa, Staphylococcus
YADENSNNTNDTQSKKGTMGY

SEQ ID NO: 2102114 - protein, 8 aa, Staphylococcus
YADGGRQL

SEQ ID NO: 2102115 - protein, 13 aa, Staphylococcus
YADGNNTKEATVT

SEQ ID NO: 2102116 - protein, 10 aa, Staphylococcus
YADGSTSTIT

SEQ ID NO: 2102117 - protein, 7 aa, Staphylococcus
YAENRDD

SEQ ID NO: 2102118 - protein, 6 aa, Staphylococcus
YAEPPF

SEQ ID NO: 2102119 - protein, 8 aa, Staphylococcus
YAGATTGQ

SEQ ID NO: 2102120 - protein, 11 aa, Staphylococcus
YAGDVNGKVQN

SEQ ID NO: 2102121 - protein, 6 aa, Staphylococcus
YAGGLK

SEQ ID NO: 2102122 - protein, 4 aa, Staphylococcus
YAGN

SEQ ID NO: 2102123 - protein, 16 aa, Staphylococcus
YAKQTSSGEDASGSEF

SEQ ID NO: 2102124 - protein, 7 aa, Staphylococcus
YAKTHKD

SEQ ID NO: 2102125 - protein, 13 aa, Staphylococcus
YANESKSEDSLKI

SEQ ID NO: 2102126 - protein, 11 aa, Staphylococcus
YANRGANGIDG

SEQ ID NO: 2102127 - protein, 7 aa, Staphylococcus
YAPELNQ

SEQ ID NO: 2102128 - protein, 9 aa, Staphylococcus
YAPPFSSPK

SEQ ID NO: 2102129 - protein, 18 aa, Staphylococcus
YAPSKFKKQDFPKSTAKD

SEQ ID NO: 2102130 - protein, 12 aa, Staphylococcus
YASERNTEDSLK

SEQ ID NO: 2102131 - protein, 8 aa, Staphylococcus
YASEVPNK

SEQ ID NO: 2102132 - protein, 14 aa, Staphylococcus
YASSQATFLYKSKE

SEQ ID NO: 2102133 - protein, 10 aa, Staphylococcus
YATDPNYAKK

SEQ ID NO: 2102134 - protein, 10 aa, Staphylococcus
YATDPNYATK

SEQ ID NO: 2102135 - protein, 10 aa, Staphylococcus
YATDSQYADK

SEQ ID NO: 2102136 - protein, 27 aa, Staphylococcus
YAVEKPTPLVNKEENANISTQYEPQSL

SEQ ID NO: 2102137 - protein, 17 aa, Staphylococcus
YAVSGHEAHASETTNVD

SEQ ID NO: 2102138 - protein, 21 aa, Staphylococcus
YAYGPGSSKFKGNMENTKSAQ

SEQ ID NO: 2102139 - protein, 14 aa, Staphylococcus
YDASGKHAKQYANK

SEQ ID NO: 2102140 - protein, 20 aa, Staphylococcus
YDDKDGNLAGSYTVDTDDGY

SEQ ID NO: 2102141 - protein, 14 aa, Staphylococcus
YDDPTSAKAYSLKP

SEQ ID NO: 2102142 - protein, 40 aa, Staphylococcus
YDEDDETEDTDVSNVQASTSNEADSHTTRTNNDKQPQITS

SEQ ID NO: 2102143 - protein, 10 aa, Staphylococcus
YDEGAPMKRG

SEQ ID NO: 2102144 - protein, 9 aa, Staphylococcus
YDKEDGDLT

SEQ ID NO: 2102145 - protein, 29 aa, Staphylococcus
YDKEDKAKDINEDLDEKISEMKDETKKFN

SEQ ID NO: 2102146 - protein, 29 aa, Staphylococcus
YDKEDKAKDLNKDLDNKIADMKDKTKKFD

SEQ ID NO: 2102147 - protein, 31 aa, Staphylococcus
YDKEDKAKSLNKELDDKIASMKEKTKDLKND

SEQ ID NO: 2102148 - protein, 9 aa, Staphylococcus
YDKNSKKDF

SEQ ID NO: 2102149 - protein, 13 aa, Staphylococcus
YDKTAKSGAKYAN

SEQ ID NO: 2102150 - protein, 5 aa, Staphylococcus
YDQKY

SEQ ID NO: 2102151 - protein, 8 aa, Staphylococcus
YDQQTNTL

SEQ ID NO: 2102152 - protein, 18 aa, Staphylococcus
YDSDQNNHRTNNKVQINN

SEQ ID NO: 2102153 - protein, 13 aa, Staphylococcus
YDSGDTKGKNIKG

SEQ ID NO: 2102154 - protein, 7 aa, Staphylococcus
YDSKKQE

SEQ ID NO: 2102155 - protein, 6 aa, Staphylococcus
YDSNPV

SEQ ID NO: 2102156 - protein, 13 aa, Staphylococcus
YDSSISGDLGDAH

SEQ ID NO: 2102157 - protein, 12 aa, Staphylococcus
YDTNDTKGKKLK

SEQ ID NO: 2102158 - protein, 13 aa, Staphylococcus
YDTQQDSENIKEE

SEQ ID NO: 2102159 - protein, 11 aa, Staphylococcus
YDTVPKDNKKW

SEQ ID NO: 2102160 - protein, 9 aa, Staphylococcus
YDVGEKTGF

SEQ ID NO: 2102161 - protein, 5 aa, Staphylococcus
YDYPY

SEQ ID NO: 2102162 - protein, 12 aa, Staphylococcus
YEADGKGKEPAI

SEQ ID NO: 2102163 - protein, 12 aa, Staphylococcus
YEADGQGKEPAI

SEQ ID NO: 2102164 - protein, 12 aa, Staphylococcus
YEADGQGKEPAV

SEQ ID NO: 2102165 - protein, 11 aa, Staphylococcus
YEAGESIENVT

SEQ ID NO: 2102166 - protein, 9 aa, Staphylococcus
YEASTNIKN

SEQ ID NO: 2102167 - protein, 7 aa, Staphylococcus
YEDQTVK

SEQ ID NO: 2102168 - protein, 27 aa, Staphylococcus
YEDRVSKAEYNSMEKRQNEILDEVRPI

SEQ ID NO: 2102169 - protein, 6 aa, Staphylococcus
YEEKGN

SEQ ID NO: 2102170 - protein, 4 aa, Staphylococcus
YEEQ

SEQ ID NO: 2102171 - protein, 8 aa, Staphylococcus
YEETGKSV

SEQ ID NO: 2102172 - protein, 26 aa, Staphylococcus
YEFKDKNNTHDKGEMKTEKVEVPVNP

SEQ ID NO: 2102173 - protein, 28 aa, Staphylococcus
YEFKDKNNTHSRGVKKSETVKVPKNPER

SEQ ID NO: 2102174 - protein, 19 aa, Staphylococcus
YEFKDKNNTHTKGEMKTEK

SEQ ID NO: 2102175 - protein, 30 aa, Staphylococcus
YEGAQEAAAKLNKEGQEAAAYKADVSNRDE

SEQ ID NO: 2102176 - protein, 8 aa, Staphylococcus
YEGGGADL

SEQ ID NO: 2102177 - protein, 4 aa, Staphylococcus
YEGP

SEQ ID NO: 2102178 - protein, 5 aa, Staphylococcus
YEGPV

SEQ ID NO: 2102179 - protein, 4 aa, Staphylococcus
YEKE

SEQ ID NO: 2102180 - protein, 9 aa, Staphylococcus
YEKEQRIKK

SEQ ID NO: 2102181 - protein, 9 aa, Staphylococcus
YEKGNRGVR

SEQ ID NO: 2102182 - protein, 21 aa, Staphylococcus
YEKRERTRKRQLYPGTPKGQF

SEQ ID NO: 2102183 - protein, 12 aa, Staphylococcus
YENPDDARYEAQ

SEQ ID NO: 2102184 - protein, 6 aa, Staphylococcus
YEPAAS

SEQ ID NO: 2102185 - protein, 6 aa, Staphylococcus
YEPASS

SEQ ID NO: 2102186 - protein, 10 aa, Staphylococcus
YEQAKSGELV

SEQ ID NO: 2102187 - protein, 9 aa, Staphylococcus
YEQPSDDTL

SEQ ID NO: 2102188 - protein, 8 aa, Staphylococcus
YESAGAGG

SEQ ID NO: 2102189 - protein, 6 aa, Staphylococcus
YETGSI

SEQ ID NO: 2102190 - protein, 6 aa, Staphylococcus
YETQVE

SEQ ID NO: 2102191 - protein, 8 aa, Staphylococcus
YETRQQTI

SEQ ID NO: 2102192 - protein, 39 aa, Staphylococcus
YFNESDTVPATDDDVSSDSSDDSDDDTSSDSSDTTVTRD

SEQ ID NO: 2102193 - protein, 8 aa, Staphylococcus
YFSPNGKY

SEQ ID NO: 2102194 - protein, 8 aa, Staphylococcus
YGDDAANY

SEQ ID NO: 2102195 - protein, 14 aa, Staphylococcus
YGDEYGKKESQRVL

SEQ ID NO: 2102196 - protein, 10 aa, Staphylococcus
YGDGDGRTFT

SEQ ID NO: 2102197 - protein, 11 aa, Staphylococcus
YGDGDNDNYLP

SEQ ID NO: 2102198 - protein, 15 aa, Staphylococcus
YGDNTKTSKTTPEKI

SEQ ID NO: 2102199 - protein, 94 aa, Staphylococcus
YGEGSGEGSNASSEQATDNSSQQTAEQPQQVEQPQQTEQASTEQPAQEAAPQTEATQQPQQEATTQSASSSNESSSNESSSSEASESSSSGVNA

SEQ ID NO: 2102200 - protein, 12 aa, Staphylococcus
YGENGKIEPGLA

SEQ ID NO: 2102201 - protein, 8 aa, Staphylococcus
YGENSNYK

SEQ ID NO: 2102202 - protein, 4 aa, Staphylococcus
YGGP

SEQ ID NO: 2102203 - protein, 5 aa, Staphylococcus
YGGPI

SEQ ID NO: 2102204 - protein, 6 aa, Staphylococcus
YGGPTM

SEQ ID NO: 2102205 - protein, 16 aa, Staphylococcus
YGGSGALRQQIEKGAP

SEQ ID NO: 2102206 - protein, 18 aa, Staphylococcus
YGGSGALRQQIEKGAPAD

SEQ ID NO: 2102207 - protein, 18 aa, Staphylococcus
YGGSGALRQQIEKGAPTD

SEQ ID NO: 2102208 - protein, 16 aa, Staphylococcus
YGGSGALRQQIETGAP

SEQ ID NO: 2102209 - protein, 31 aa, Staphylococcus
YGHTGEDVNTYAHGPSENKFAGNNDNTDSAK

SEQ ID NO: 2102210 - protein, 31 aa, Staphylococcus
YGHTGEDVNTYAYGPGADKFRGNIDNTDSAK

SEQ ID NO: 2102211 - protein, 41 aa, Staphylococcus
YGHTGEDVNTYAYGPGEDKFLGNKDNTDSAKNIFAFLANNA

SEQ ID NO: 2102212 - protein, 19 aa, Staphylococcus
YGHTGEDVNTYAYGPGSDF

SEQ ID NO: 2102213 - protein, 41 aa, Staphylococcus
YGHTGEDVNTYAYGPGSNQFKGNKENTDSAKNIFDFFANDV

SEQ ID NO: 2102214 - protein, 10 aa, Staphylococcus
YGKDSDYKKV

SEQ ID NO: 2102215 - protein, 30 aa, Staphylococcus
YGKEDKAKALNDELDKKIADTKKRTAKTDK

SEQ ID NO: 2102216 - protein, 5 aa, Staphylococcus
YGKNA

SEQ ID NO: 2102217 - protein, 15 aa, Staphylococcus
YGKPLNKPSGTAHGN

SEQ ID NO: 2102218 - protein, 8 aa, Staphylococcus
YGKPTNSL

SEQ ID NO: 2102219 - protein, 13 aa, Staphylococcus
YGNNDSKAKNIKG

SEQ ID NO: 2102220 - protein, 6 aa, Staphylococcus
YGNNVD

SEQ ID NO: 2102221 - protein, 13 aa, Staphylococcus
YGNRDKKGSNIKG

SEQ ID NO: 2102222 - protein, 13 aa, Staphylococcus
YGNSDTKGKNIKG

SEQ ID NO: 2102223 - protein, 9 aa, Staphylococcus
YGPYNTDTR

SEQ ID NO: 2102224 - protein, 22 aa, Staphylococcus
YGPYNTNTRTIPASEVSSYAFI

SEQ ID NO: 2102225 - protein, 14 aa, Staphylococcus
YGQPIEKPFESAQG

SEQ ID NO: 2102226 - protein, 13 aa, Staphylococcus
YGQPNYYSPTSAW

SEQ ID NO: 2102227 - protein, 12 aa, Staphylococcus
YGQSGKNETPEY

SEQ ID NO: 2102228 - protein, 11 aa, Staphylococcus
YGSEKVDAALE

SEQ ID NO: 2102229 - protein, 11 aa, Staphylococcus
YGSNVTPEDIN

SEQ ID NO: 2102230 - protein, 5 aa, Staphylococcus
YGTDA

SEQ ID NO: 2102231 - protein, 17 aa, Staphylococcus
YGTRTISKGSARHYNYI

SEQ ID NO: 2102232 - protein, 17 aa, Staphylococcus
YGVNEDGSNSKKLVDDY

SEQ ID NO: 2102233 - protein, 16 aa, Staphylococcus
YGVNEDGSSNKKLVKD

SEQ ID NO: 2102234 - protein, 17 aa, Staphylococcus
YGVNKDGSSNKKLVDDY

SEQ ID NO: 2102235 - protein, 26 aa, Staphylococcus
YGYNTQSYNTPQRTGGLGASYSATSH

SEQ ID NO: 2102236 - protein, 12 aa, Staphylococcus
YHGKGKGKKQPA

SEQ ID NO: 2102237 - protein, 5 aa, Staphylococcus
YHQDY

SEQ ID NO: 2102238 - protein, 6 aa, Staphylococcus
YHSTTM

SEQ ID NO: 2102239 - protein, 27 aa, Staphylococcus
YHTTETNTTSTSTSTQSISTSSGNLYT

SEQ ID NO: 2102240 - protein, 7 aa, Staphylococcus
YIAEKDP

SEQ ID NO: 2102241 - protein, 4 aa, Staphylococcus
YIDK

SEQ ID NO: 2102242 - protein, 8 aa, Staphylococcus
YIDTGKAD

SEQ ID NO: 2102243 - protein, 5 aa, Staphylococcus
YIDTN

SEQ ID NO: 2102244 - protein, 5 aa, Staphylococcus
YIEDK

SEQ ID NO: 2102245 - protein, 8 aa, Staphylococcus
YINEKNPD

SEQ ID NO: 2102246 - protein, 12 aa, Staphylococcus
YKAEDNGGTIEI

SEQ ID NO: 2102247 - protein, 29 aa, Staphylococcus
YKARGEKQDGSDAKTIKDTVEVPKNPKRA

SEQ ID NO: 2102248 - protein, 6 aa, Staphylococcus
YKASKI

SEQ ID NO: 2102249 - protein, 7 aa, Staphylococcus
YKDEGKL

SEQ ID NO: 2102250 - protein, 4 aa, Staphylococcus
YKDG

SEQ ID NO: 2102251 - protein, 10 aa, Staphylococcus
YKDGDGFKDY

SEQ ID NO: 2102252 - protein, 12 aa, Staphylococcus
YKDIKDIPKGST

SEQ ID NO: 2102253 - protein, 8 aa, Staphylococcus
YKDKPENT

SEQ ID NO: 2102254 - protein, 13 aa, Staphylococcus
YKDNKGKSHLEKT

SEQ ID NO: 2102255 - protein, 9 aa, Staphylococcus
YKDRDIKKA

SEQ ID NO: 2102256 - protein, 13 aa, Staphylococcus
YKDRKGKSHLEKT

SEQ ID NO: 2102257 - protein, 21 aa, Staphylococcus
YKEANDTVNRHQLEGTGSIQN

SEQ ID NO: 2102258 - protein, 25 aa, Staphylococcus
YKEGDGYASYEKVTKADRKALSDTV

SEQ ID NO: 2102259 - protein, 8 aa, Staphylococcus
YKEQHKEL

SEQ ID NO: 2102260 - protein, 8 aa, Staphylococcus
YKERNAKP

SEQ ID NO: 2102261 - protein, 17 aa, Staphylococcus
YKESRRAHPLNEKGQRS

SEQ ID NO: 2102262 - protein, 5 aa, Staphylococcus
YKGKV

SEQ ID NO: 2102263 - protein, 7 aa, Staphylococcus
YKGQKAV

SEQ ID NO: 2102264 - protein, 27 aa, Staphylococcus
YKGQNKVDINQEGNELSVHETNEKVDK

SEQ ID NO: 2102265 - protein, 8 aa, Staphylococcus
YKGQYSDG

SEQ ID NO: 2102266 - protein, 30 aa, Staphylococcus
YKHPEKYPNHLSKEEQRRQRHREERARQKD

SEQ ID NO: 2102267 - protein, 9 aa, Staphylococcus
YKKDDSGMI

SEQ ID NO: 2102268 - protein, 8 aa, Staphylococcus
YKKEGKSQ

SEQ ID NO: 2102269 - protein, 12 aa, Staphylococcus
YKKEIKKDKAIQ

SEQ ID NO: 2102270 - protein, 7 aa, Staphylococcus
YKKGNRG

SEQ ID NO: 2102271 - protein, 9 aa, Staphylococcus
YKKQEETNK

SEQ ID NO: 2102272 - protein, 17 aa, Staphylococcus
YKNAKRSGYATGHKPRR

SEQ ID NO: 2102273 - protein, 24 aa, Staphylococcus
YKNATKISKDTKDVADVNAYDKDL

SEQ ID NO: 2102274 - protein, 4 aa, Staphylococcus
YKNG

SEQ ID NO: 2102275 - protein, 5 aa, Staphylococcus
YKNGT

SEQ ID NO: 2102276 - protein, 9 aa, Staphylococcus
YKNHKANNI

SEQ ID NO: 2102277 - protein, 12 aa, Staphylococcus
YKNIKDIPEGST

SEQ ID NO: 2102278 - protein, 11 aa, Staphylococcus
YKNKKKIDNVK

SEQ ID NO: 2102279 - protein, 12 aa, Staphylococcus
YKNLKDIPDGST

SEQ ID NO: 2102280 - protein, 12 aa, Staphylococcus
YKNLKDIPEGST

SEQ ID NO: 2102281 - protein, 39 aa, Staphylococcus
YKNNDGYKDYSAVTKEDRKALSDAVNSLGEPLSKMAVVT

SEQ ID NO: 2102282 - protein, 9 aa, Staphylococcus
YKNNGDGTI

SEQ ID NO: 2102283 - protein, 10 aa, Staphylococcus
YKPDAPKLDD

SEQ ID NO: 2102284 - protein, 16 aa, Staphylococcus
YKPEGAINAGGYDNAK

SEQ ID NO: 2102285 - protein, 11 aa, Staphylococcus
YKQPSKSVSAF

SEQ ID NO: 2102286 - protein, 8 aa, Staphylococcus
YKRADGVR

SEQ ID NO: 2102287 - protein, 8 aa, Staphylococcus
YKSSKGPD

SEQ ID NO: 2102288 - protein, 14 aa, Staphylococcus
YKTTGYDDKGNSKK

SEQ ID NO: 2102289 - protein, 14 aa, Staphylococcus
YKVDTDAKKEFDHN

SEQ ID NO: 2102290 - protein, 5 aa, Staphylococcus
YKYGT

SEQ ID NO: 2102291 - protein, 14 aa, Staphylococcus
YKYTKESKGSSLDD

SEQ ID NO: 2102292 - protein, 5 aa, Staphylococcus
YLDKN

SEQ ID NO: 2102293 - protein, 12 aa, Staphylococcus
YLDSNVDASWFT

SEQ ID NO: 2102294 - protein, 12 aa, Staphylococcus
YLGGSDHSDPHG

SEQ ID NO: 2102295 - protein, 9 aa, Staphylococcus
YLPKDTKDN

SEQ ID NO: 2102296 - protein, 5 aa, Staphylococcus
YLSKS

SEQ ID NO: 2102297 - protein, 5 aa, Staphylococcus
YLSNH

SEQ ID NO: 2102298 - protein, 7 aa, Staphylococcus
YLSNPSD

SEQ ID NO: 2102299 - protein, 5 aa, Staphylococcus
YLTND

SEQ ID NO: 2102300 - protein, 9 aa, Staphylococcus
YNDNNSDTL

SEQ ID NO: 2102301 - protein, 8 aa, Staphylococcus
YNDNTKAY

SEQ ID NO: 2102302 - protein, 10 aa, Staphylococcus
YNDTNGPTYK

SEQ ID NO: 2102303 - protein, 7 aa, Staphylococcus
YNEKTGV

SEQ ID NO: 2102304 - protein, 7 aa, Staphylococcus
YNEQTGV

SEQ ID NO: 2102305 - protein, 18 aa, Staphylococcus
YNEQTNTWEDRKIFIAEA

SEQ ID NO: 2102306 - protein, 9 aa, Staphylococcus
YNETEIEER

SEQ ID NO: 2102307 - protein, 18 aa, Staphylococcus
YNGEAKTWKDVNSSWPDK

SEQ ID NO: 2102308 - protein, 12 aa, Staphylococcus
YNGGGEQKSIDT

SEQ ID NO: 2102309 - protein, 6 aa, Staphylococcus
YNGGPY

SEQ ID NO: 2102310 - protein, 9 aa, Staphylococcus
YNGNTSRGW

SEQ ID NO: 2102311 - protein, 36 aa, Staphylococcus
YNGSDSLSSSKDSDSSSEDDSSSDDSSSSEEVTRDN

SEQ ID NO: 2102312 - protein, 30 aa, Staphylococcus
YNIKGNSNIYETPWGSSSQIKATVPSKGDV

SEQ ID NO: 2102313 - protein, 12 aa, Staphylococcus
YNIKSELTKQGY

SEQ ID NO: 2102314 - protein, 28 aa, Staphylococcus
YNIPTKQAPELKLKGDGDLKGSSIGSKD

SEQ ID NO: 2102315 - protein, 28 aa, Staphylococcus
YNIPTKQAPELKLQGDGDLKGSSIGSKD

SEQ ID NO: 2102316 - protein, 31 aa, Staphylococcus
YNKEDKAKDLNKKLDDKIADVKTKAKKVNKS

SEQ ID NO: 2102317 - protein, 29 aa, Staphylococcus
YNKEDKAKDMNTKLDQKISDMKKQTKDLD

SEQ ID NO: 2102318 - protein, 10 aa, Staphylococcus
YNKPDGPTFK

SEQ ID NO: 2102319 - protein, 18 aa, Staphylococcus
YNLKGNKSYIQTPYPTYN

SEQ ID NO: 2102320 - protein, 18 aa, Staphylococcus
YNNDYSKSSQEKDQLRKA

SEQ ID NO: 2102321 - protein, 9 aa, Staphylococcus
YNNSKSIAY

SEQ ID NO: 2102322 - protein, 9 aa, Staphylococcus
YNPGQPTRE

SEQ ID NO: 2102323 - protein, 8 aa, Staphylococcus
YNPNNQEK

SEQ ID NO: 2102324 - protein, 11 aa, Staphylococcus
YNQANGPTYQK

SEQ ID NO: 2102325 - protein, 8 aa, Staphylococcus
YNQAPDNT

SEQ ID NO: 2102326 - protein, 13 aa, Staphylococcus
YNQKKKTDKVKEI

SEQ ID NO: 2102327 - protein, 9 aa, Staphylococcus
YNQKSPTQL

SEQ ID NO: 2102328 - protein, 5 aa, Staphylococcus
YNQKY

SEQ ID NO: 2102329 - protein, 4 aa, Staphylococcus
YNQN

SEQ ID NO: 2102330 - protein, 7 aa, Staphylococcus
YNQQTGV

SEQ ID NO: 2102331 - protein, 8 aa, Staphylococcus
YNRAPKAS

SEQ ID NO: 2102332 - protein, 23 aa, Staphylococcus
YNRNESRGAHYKPEFPDRNDDEW

SEQ ID NO: 2102333 - protein, 23 aa, Staphylococcus
YNRNESRGAHYKPEFPDRNDEEW

SEQ ID NO: 2102334 - protein, 22 aa, Staphylococcus
YNRNESRGAHYKPEFPERNDEE

SEQ ID NO: 2102335 - protein, 7 aa, Staphylococcus
YNRPYGY

SEQ ID NO: 2102336 - protein, 4 aa, Staphylococcus
YNSA

SEQ ID NO: 2102337 - protein, 10 aa, Staphylococcus
YNSDKEPQVA

SEQ ID NO: 2102338 - protein, 8 aa, Staphylococcus
YNSGKKYG

SEQ ID NO: 2102339 - protein, 6 aa, Staphylococcus
YNSTTD

SEQ ID NO: 2102340 - protein, 5 aa, Staphylococcus
YNSVS

SEQ ID NO: 2102341 - protein, 9 aa, Staphylococcus
YNTAPGEVG

SEQ ID NO: 2102342 - protein, 14 aa, Staphylococcus
YNTDKIKKAPTDVK

SEQ ID NO: 2102343 - protein, 6 aa, Staphylococcus
YNTGEK

SEQ ID NO: 2102344 - protein, 6 aa, Staphylococcus
YNTGHY

SEQ ID NO: 2102345 - protein, 6 aa, Staphylococcus
YNTGKT

SEQ ID NO: 2102346 - protein, 9 aa, Staphylococcus
YNTPPGTVD

SEQ ID NO: 2102347 - protein, 15 aa, Staphylococcus
YNTSVDSIKQNNNLD

SEQ ID NO: 2102348 - protein, 15 aa, Staphylococcus
YNTSVENIKQNNNLN

SEQ ID NO: 2102349 - protein, 5 aa, Staphylococcus
YNTTY

SEQ ID NO: 2102350 - protein, 11 aa, Staphylococcus
YNVKPGTKAYT

SEQ ID NO: 2102351 - protein, 10 aa, Staphylococcus
YNVKQGSNGL

SEQ ID NO: 2102352 - protein, 4 aa, Staphylococcus
YNYP

SEQ ID NO: 2102353 - protein, 4 aa, Staphylococcus
YPAG

SEQ ID NO: 2102354 - protein, 5 aa, Staphylococcus
YPAGT

SEQ ID NO: 2102355 - protein, 6 aa, Staphylococcus
YPAGTD

SEQ ID NO: 2102356 - protein, 11 aa, Staphylococcus
YPENKKAEDIT

SEQ ID NO: 2102357 - protein, 5 aa, Staphylococcus
YPEPV

SEQ ID NO: 2102358 - protein, 9 aa, Staphylococcus
YPGAPKGQF

SEQ ID NO: 2102359 - protein, 8 aa, Staphylococcus
YPGVPKGQ

SEQ ID NO: 2102360 - protein, 4 aa, Staphylococcus
YPIP

SEQ ID NO: 2102361 - protein, 24 aa, Staphylococcus
YPITNGDADTAIAQAKKDGFNTDE

SEQ ID NO: 2102362 - protein, 6 aa, Staphylococcus
YPKLEP

SEQ ID NO: 2102363 - protein, 12 aa, Staphylococcus
YPKSGTAISPRP

SEQ ID NO: 2102364 - protein, 12 aa, Staphylococcus
YPNAGQKAANWA

SEQ ID NO: 2102365 - protein, 16 aa, Staphylococcus
YPNGMDPHTYEPSQKQ

SEQ ID NO: 2102366 - protein, 16 aa, Staphylococcus
YPNGVDPHTYDPSQKQ

SEQ ID NO: 2102367 - protein, 8 aa, Staphylococcus
YPSKATDK

SEQ ID NO: 2102368 - protein, 10 aa, Staphylococcus
YPTKDTQNRL

SEQ ID NO: 2102369 - protein, 10 aa, Staphylococcus
YPTKKEQQRL

SEQ ID NO: 2102370 - protein, 9 aa, Staphylococcus
YPTQQEQAR

SEQ ID NO: 2102371 - protein, 12 aa, Staphylococcus
YQADGEGQEPAV

SEQ ID NO: 2102372 - protein, 22 aa, Staphylococcus
YQDGGKQIGQFSTDGKSYSNIG

SEQ ID NO: 2102373 - protein, 7 aa, Staphylococcus
YQDGGRQ

SEQ ID NO: 2102374 - protein, 39 aa, Staphylococcus
YQDSKDVKRELRSGDAYDSELDKKYGDNDTDEINKGGKV

SEQ ID NO: 2102375 - protein, 9 aa, Staphylococcus
YQDTSDSMK

SEQ ID NO: 2102376 - protein, 19 aa, Staphylococcus
YQEDGNARSSDLSSGKADV

SEQ ID NO: 2102377 - protein, 10 aa, Staphylococcus
YQHRDNKEVT

SEQ ID NO: 2102378 - protein, 10 aa, Staphylococcus
YQNKTGKNEK

SEQ ID NO: 2102379 - protein, 7 aa, Staphylococcus
YQPKKDG

SEQ ID NO: 2102380 - protein, 169 aa, Staphylococcus
YQQDDNNYSPSASSEEVQKEGYDVNATPSAEDKAKNPNAAKAEDNNNTQNAQNNNQNTQAQDTTSADEVSSAQGNETSNTVASEDNTTNNTSASLQNNQNTQSASTYNQSSGEESNVQSQNATSNTQQPQTAQAPEVNNTQDNAGGSSEGNTTEAPDTSDNGDGAHAQD

SEQ ID NO: 2102381 - protein, 17 aa, Staphylococcus
YQQPLSKKQADKTEGLY

SEQ ID NO: 2102382 - protein, 8 aa, Staphylococcus
YQRGSGRK

SEQ ID NO: 2102383 - protein, 18 aa, Staphylococcus
YQSQQNGSSKVKEINTAD

SEQ ID NO: 2102384 - protein, 8 aa, Staphylococcus
YRASEGKI

SEQ ID NO: 2102385 - protein, 18 aa, Staphylococcus
YREENAEPVKCNTTDMEA

SEQ ID NO: 2102386 - protein, 6 aa, Staphylococcus
YREQLE

SEQ ID NO: 2102387 - protein, 7 aa, Staphylococcus
YREQLED

SEQ ID NO: 2102388 - protein, 7 aa, Staphylococcus
YREQMED

SEQ ID NO: 2102389 - protein, 9 aa, Staphylococcus
YRGSGEVEN

SEQ ID NO: 2102390 - protein, 7 aa, Staphylococcus
YRKPSDF

SEQ ID NO: 2102391 - protein, 18 aa, Staphylococcus
YRLSDSRPLPPIYGGPEG

SEQ ID NO: 2102392 - protein, 11 aa, Staphylococcus
YRNMSPSSVRG

SEQ ID NO: 2102393 - protein, 8 aa, Staphylococcus
YRNQDGEI

SEQ ID NO: 2102394 - protein, 9 aa, Staphylococcus
YRNTPTFKA

SEQ ID NO: 2102395 - protein, 19 aa, Staphylococcus
YRPQRKSIYTEPGSSNTKE

SEQ ID NO: 2102396 - protein, 7 aa, Staphylococcus
YRQQIED

SEQ ID NO: 2102397 - protein, 8 aa, Staphylococcus
YRRGAYQD

SEQ ID NO: 2102398 - protein, 7 aa, Staphylococcus
YRSNRGA

SEQ ID NO: 2102399 - protein, 7 aa, Staphylococcus
YRSYPTQ

SEQ ID NO: 2102400 - protein, 11 aa, Staphylococcus
YSAQQAKSNGL

SEQ ID NO: 2102401 - protein, 4 aa, Staphylococcus
YSDA

SEQ ID NO: 2102402 - protein, 16 aa, Staphylococcus
YSDADQPKKDAYNDAV

SEQ ID NO: 2102403 - protein, 7 aa, Staphylococcus
YSDCSDA

SEQ ID NO: 2102404 - protein, 52 aa, Staphylococcus
YSDKATQTHKDYTSSKKDSTSQASQNEDSKKDTSTTQDQLDTNKDNPQLPTE

SEQ ID NO: 2102405 - protein, 9 aa, Staphylococcus
YSDKGDLLT

SEQ ID NO: 2102406 - protein, 70 aa, Staphylococcus
YSEDAKKQKDKYDNQNEANDTQEENKKVENQHSNTSTANPQLPTQSQLEDKTDPKQSFEDGLKQSNNRST

SEQ ID NO: 2102407 - protein, 48 aa, Staphylococcus
YSEDAKKTQSNYEQKSKHQKHTSQSSQNNNPQLPTEDELKHKSKPVQS

SEQ ID NO: 2102408 - protein, 74 aa, Staphylococcus
YSEDAKNNKKQYDAQKDDLSNGNSKSKKNNSEKQASNTNANPQLPSESQLAKKEKPAQSFENDINQSNIRSTAT

SEQ ID NO: 2102409 - protein, 71 aa, Staphylococcus
YSEDATKTQKQYQTSKDKHTQDEKQQDTTPNNTKQQDVNPQLPTPDELKHKTKPAQSFEGDFKQSNTRATG

SEQ ID NO: 2102410 - protein, 17 aa, Staphylococcus
YSEGTLREKLGLNQKIH

SEQ ID NO: 2102411 - protein, 10 aa, Staphylococcus
YSENDIEERH

SEQ ID NO: 2102412 - protein, 18 aa, Staphylococcus
YSGESTRPALNGRQKADI

SEQ ID NO: 2102413 - protein, 9 aa, Staphylococcus
YSGGPFSVS

SEQ ID NO: 2102414 - protein, 4 aa, Staphylococcus
YSGL

SEQ ID NO: 2102415 - protein, 27 aa, Staphylococcus
YSGQVNAKNDHSTNQNKLEIKDKNKAF

SEQ ID NO: 2102416 - protein, 10 aa, Staphylococcus
YSGYGKSNVA

SEQ ID NO: 2102417 - protein, 9 aa, Staphylococcus
YSIQDNGQR

SEQ ID NO: 2102418 - protein, 5 aa, Staphylococcus
YSKDN

SEQ ID NO: 2102419 - protein, 16 aa, Staphylococcus
YSKDVSNTARNHSEDM

SEQ ID NO: 2102420 - protein, 5 aa, Staphylococcus
YSNDE

SEQ ID NO: 2102421 - protein, 26 aa, Staphylococcus
YSNGPFSTDTRTISASQASAYNYIHL

SEQ ID NO: 2102422 - protein, 7 aa, Staphylococcus
YSNGRAG

SEQ ID NO: 2102423 - protein, 7 aa, Staphylococcus
YSNKHKD

SEQ ID NO: 2102424 - protein, 8 aa, Staphylococcus
YSNTGRTL

SEQ ID NO: 2102425 - protein, 15 aa, Staphylococcus
YSRNQQGEDIGPKYR

SEQ ID NO: 2102426 - protein, 12 aa, Staphylococcus
YSSEDNQKTGKK

SEQ ID NO: 2102427 - protein, 4 aa, Staphylococcus
YSSN

SEQ ID NO: 2102428 - protein, 15 aa, Staphylococcus
YSSPIYSYNENGSEH

SEQ ID NO: 2102429 - protein, 4 aa, Staphylococcus
YSTA

SEQ ID NO: 2102430 - protein, 8 aa, Staphylococcus
YSTDGRIA

SEQ ID NO: 2102431 - protein, 4 aa, Staphylococcus
YSTE

SEQ ID NO: 2102432 - protein, 27 aa, Staphylococcus
YSTPNGGYSLTKADQSNNDAVDSDAQL

SEQ ID NO: 2102433 - protein, 12 aa, Staphylococcus
YSWDTQSNDIAK

SEQ ID NO: 2102434 - protein, 13 aa, Staphylococcus
YSYTKSSKKQMTD

SEQ ID NO: 2102435 - protein, 18 aa, Staphylococcus
YTAKASEKDKNDKDNEIT

SEQ ID NO: 2102436 - protein, 16 aa, Staphylococcus
YTDKKKTDKVNEIKEA

SEQ ID NO: 2102437 - protein, 22 aa, Staphylococcus
YTEDGREMSNTTMTRNRDGSVS

SEQ ID NO: 2102438 - protein, 6 aa, Staphylococcus
YTEDHE

SEQ ID NO: 2102439 - protein, 13 aa, Staphylococcus
YTENKNNRSLPEM

SEQ ID NO: 2102440 - protein, 10 aa, Staphylococcus
YTGEATHPSL

SEQ ID NO: 2102441 - protein, 15 aa, Staphylococcus
YTGESSDPDKNGIHH

SEQ ID NO: 2102442 - protein, 7 aa, Staphylococcus
YTGESTH

SEQ ID NO: 2102443 - protein, 10 aa, Staphylococcus
YTGESTHKGL

SEQ ID NO: 2102444 - protein, 17 aa, Staphylococcus
YTGESTRPGLNGRQRSD

SEQ ID NO: 2102445 - protein, 78 aa, Staphylococcus
YTGGADTAQSTTDYTDSYNQASTQSVSANNQASTSNVKAVSAPVQKTSSYSNYSARTTSYSAPKTTSYSTASTGGSVK

SEQ ID NO: 2102446 - protein, 26 aa, Staphylococcus
YTGGAYVTDTRTISASEVSSYNYIHL

SEQ ID NO: 2102447 - protein, 4 aa, Staphylococcus
YTIK

SEQ ID NO: 2102448 - protein, 8 aa, Staphylococcus
YTKSQNNG

SEQ ID NO: 2102449 - protein, 24 aa, Staphylococcus
YTNGPYNSDYRTIPASEVSLYAYI

SEQ ID NO: 2102450 - protein, 24 aa, Staphylococcus
YTNGPYNTNYRTIPASEVSSYAFI

SEQ ID NO: 2102451 - protein, 14 aa, Staphylococcus
YTNKQRNDKVNEIK

SEQ ID NO: 2102452 - protein, 34 aa, Staphylococcus
YTNNERTDKVNEIKKADLKKSITYEAGATSDNKF

SEQ ID NO: 2102453 - protein, 80 aa, Staphylococcus
YTNTAGTQNYNYNTQYSQNYQPQTQAYHANNGGGLGASYSTSDRNVKVTTTQAPSSHASNTSGGSAFSGKSGSSSNLYTA

SEQ ID NO: 2102454 - protein, 24 aa, Staphylococcus
YTPGQNGDALRSMSNPERFGQPSH

SEQ ID NO: 2102455 - protein, 22 aa, Staphylococcus
YTPGTEGDGLRSLKDPERYNQP

SEQ ID NO: 2102456 - protein, 13 aa, Staphylococcus
YTPTVGSIAQTDI

SEQ ID NO: 2102457 - protein, 4 aa, Staphylococcus
YTPV

SEQ ID NO: 2102458 - protein, 11 aa, Staphylococcus
YTQATDTNQKG

SEQ ID NO: 2102459 - protein, 14 aa, Staphylococcus
YTQSIGTETSGSDF

SEQ ID NO: 2102460 - protein, 13 aa, Staphylococcus
YTRNGDGYFEKDG

SEQ ID NO: 2102461 - protein, 4 aa, Staphylococcus
YTSG

SEQ ID NO: 2102462 - protein, 16 aa, Staphylococcus
YTSLQEAKKAHPNASF

SEQ ID NO: 2102463 - protein, 7 aa, Staphylococcus
YTSSPGI

SEQ ID NO: 2102464 - protein, 7 aa, Staphylococcus
YTTDGRI

SEQ ID NO: 2102465 - protein, 15 aa, Staphylococcus
YTTQNSQGQVEDVTQ

SEQ ID NO: 2102466 - protein, 10 aa, Staphylococcus
YTTYDPSFTQ

SEQ ID NO: 2102467 - protein, 14 aa, Staphylococcus
YTVDNSVKSGDTFT

SEQ ID NO: 2102468 - protein, 17 aa, Staphylococcus
YTVKPKETTVSLEEKVS

SEQ ID NO: 2102469 - protein, 17 aa, Staphylococcus
YVDDHDTKVDKWLKGID

SEQ ID NO: 2102470 - protein, 17 aa, Staphylococcus
YVDDNDNKVDEWLEGID

SEQ ID NO: 2102471 - protein, 18 aa, Staphylococcus
YVHTTTRKSDNGGPKRKY

SEQ ID NO: 2102472 - protein, 20 aa, Staphylococcus
YVNADPELKSAYNSKYDQAK

SEQ ID NO: 2102473 - protein, 6 aa, Staphylococcus
YVNNDG

SEQ ID NO: 2102474 - protein, 5 aa, Staphylococcus
YVPDR

SEQ ID NO: 2102475 - protein, 20 aa, Staphylococcus
YVSSYKNDLTKTDKLGTSMS

SEQ ID NO: 2102476 - protein, 8 aa, Staphylococcus
YWGGTDHV

SEQ ID NO: 2102477 - protein, 8 aa, Staphylococcus
YYDNPKGS

SEQ ID NO: 2102478 - protein, 4 aa, Staphylococcus
YYQQ

SEQ ID NO: 2102479 - protein, 11 aa, Staphylococcus
YYSPELDQNVD

SEQ ID NO: 2102480 - protein, 8 aa, Staphylococcus
YYSQTPEI

SEQ ID NO: 2102481 - protein, 13 aa, Staphylococcus
YYSRTDKEAKQII

SEQ ID NO: 2102482 - protein, 20 aa, Staphylococcus
DTPEAVILSGFDPIRREIAR

SEQ ID NO: 2102483 - protein, 36 aa, Staphylococcus; identical to SEQ ID NO: 1713109

SEQ ID NO: 2102484 - protein, 20 aa, Staphylococcus
IFDVCINQKLGINGENMVYL

SEQ ID NO: 2102485 - protein, 22 aa, Staphylococcus
ITNEIKERLLLAGESTNADVVI

SEQ ID NO: 2102486 - protein, 24 aa, Staphylococcus
KVPMKIFPAVHYSMGGLYVDYDQM

SEQ ID NO: 2102487 - protein, 20 aa, Staphylococcus
MYVHCTLLPYIKAAGEMKTK

SEQ ID NO: 2102488 - protein, 17 aa, Staphylococcus
ALMTRGLAEISRLGEKL

SEQ ID NO: 2102489 - protein, 19 aa, Staphylococcus
KGQSEPIVLVIFTNKDNKS

SEQ ID NO: 2102490 - protein, 18 aa, Staphylococcus
LFSLVPVKRSHSVCAQGG

SEQ ID NO: 2102491 - protein, 25 aa, Staphylococcus
LIDPFCGSGTIAIEACLIAQNIAPG

SEQ ID NO: 2102492 - protein, 19 aa, Staphylococcus
LKDKIALFCDINKESVIEC

SEQ ID NO: 2102493 - protein, 24 aa, Staphylococcus
PNDEMKGRIIGREGRNIRTLETLT

SEQ ID NO: 2102494 - protein, 18 aa, Staphylococcus
RQLWNMLVLARVITIGAY

SEQ ID NO: 2102495 - protein, 17 aa, Staphylococcus
SRNDVAFVYPKGQSEPI

SEQ ID NO: 2102496 - protein, 20 aa, Staphylococcus
DFFIACQFHPEFLSRPNRPQ

SEQ ID NO: 2102497 - protein, 19 aa, Staphylococcus
ESVIECRDASSLYEIPLQL

SEQ ID NO: 2102498 - protein, 20 aa, Staphylococcus
ITLKALIEASMTYSDNTANN

SEQ ID NO: 2102499 - protein, 22 aa, Staphylococcus
LGADPMTFLGLGGIGDLIVTCT

SEQ ID NO: 2102500 - protein, 19 aa, Staphylococcus
LMVEGASIDKSGHPNDITG

SEQ ID NO: 2102501 - protein, 30 aa, Staphylococcus
NNPAEQGRFLKFFVDEGLIKIKKGVKIEDA

SEQ ID NO: 2102502 - protein, 23 aa, Staphylococcus
VPYFGICLGMQLATVEFARNVLG

SEQ ID NO: 2102503 - protein, 20 aa, Staphylococcus
VRYEIELNYYSPKSKKDTST

SEQ ID NO: 2102504 - protein, 18 aa, Staphylococcus
AALMTRGLAEISRLGEKL

SEQ ID NO: 2102505 - protein, 25 aa, Staphylococcus
AAYTIATRMADDWSKSDEDKLAKKI

SEQ ID NO: 2102506 - protein, 25 aa, Staphylococcus
AGKYQFLQSTWDSVAPSEYQGVSPT

SEQ ID NO: 2102507 - protein, 18 aa, Staphylococcus
AGLGTRFLPATKAMPKEM

SEQ ID NO: 2102508 - protein, 20 aa, Staphylococcus
AKKRGFRGAGSYWADHLGLT

SEQ ID NO: 2102509 - protein, 23 aa, Staphylococcus
ALKNKKLDVAVGYSTDGRIAAYD

SEQ ID NO: 2102510 - protein, 21 aa, Staphylococcus
ASGDLPDFIVYYLDNSGRPEM

SEQ ID NO: 2102511 - protein, 17 aa, Staphylococcus
AVASGIVAGMGFGDNAK

SEQ ID NO: 2102512 - protein, 32 aa, Staphylococcus
AVSFKPGQLNADRYYGHVAFVEKVNSDGSIII

SEQ ID NO: 2102513 - protein, 19 aa, Staphylococcus
CVITVTALSQLISTPLSSY

SEQ ID NO: 2102514 - protein, 20 aa, Staphylococcus
DNAKVGLAVPKYVQDVDSIS

SEQ ID NO: 2102515 - protein, 18 aa, Staphylococcus
DNFYIISIEIVFFSLIQE

SEQ ID NO: 2102516 - protein, 18 aa, Staphylococcus
DNHIKHLLVETSVDKKSM

SEQ ID NO: 2102517 - protein, 26 aa, Staphylococcus
DPDIILRLPHGMPDEVKKMFQKEFKQ

SEQ ID NO: 2102518 - protein, 25 aa, Staphylococcus
DVDGILVPGGFGFRASEGKISAIKY

SEQ ID NO: 2102519 - protein, 18 aa, Staphylococcus
DVKMLKDPDNIYGNNNQH

SEQ ID NO: 2102520 - protein, 18 aa, Staphylococcus
DVLLGGGSKYFGKENGNL

SEQ ID NO: 2102521 - protein, 22 aa, Staphylococcus
DYAKLIRYGIDGNNNIYQGSWK

SEQ ID NO: 2102522 - protein, 24 aa, Staphylococcus
DYGMKRVKYVKSLMDEGLMHKAFY

SEQ ID NO: 2102523 - protein, 18 aa, Staphylococcus
EAHPAAYTIATRMADDWS

SEQ ID NO: 2102524 - protein, 24 aa, Staphylococcus
EAKYKDAWPLSASVVNFRADHTRI

SEQ ID NO: 2102525 - protein, 24 aa, Staphylococcus
EDEEKRRADAKGKPKTWIADRKLK

SEQ ID NO: 2102526 - protein, 17 aa, Staphylococcus
EHAQEFVTPLAFQAISR

SEQ ID NO: 2102527 - protein, 20 aa, Staphylococcus
EKNDKGFFLMVEGASIDKSG

SEQ ID NO: 2102528 - protein, 23 aa, Staphylococcus
EKNKEGIGYFGYNFYQQNKDKLK

SEQ ID NO: 2102529 - protein, 24 aa, Staphylococcus
ENSDSFHASGIFPTTDKSYYDKFK

SEQ ID NO: 2102530 - protein, 20 aa, Staphylococcus
ESGGDLKAVNPSSGAAGKYQ

SEQ ID NO: 2102531 - protein, 24 aa, Staphylococcus
ESIPLMKADHIFVVQSDPTAKDAG

SEQ ID NO: 2102532 - protein, 22 aa, Staphylococcus
ESNVKGLGVISYRKINANQAET

SEQ ID NO: 2102533 - protein, 25 aa, Staphylococcus
FIDPFCGSGTIAIEACLIAQNIAPG

SEQ ID NO: 2102534 - protein, 23 aa, Staphylococcus
FKQNDIWKHFKAVKEDRVYDLEE

SEQ ID NO: 2102535 - protein, 25 aa, Staphylococcus
FSKAFDIKPGYIWEINTEKQGTPSQ

SEQ ID NO: 2102536 - protein, 27 aa, Staphylococcus
FYPQGQCTWYVYNRLQQFNLYVDGSMG

SEQ ID NO: 2102537 - protein, 21 aa, Staphylococcus
GADPMTFLGLGGIGDLIVTCT

SEQ ID NO: 2102538 - protein, 17 aa, Staphylococcus
GKITIGLVGKYVSLQDA

SEQ ID NO: 2102539 - protein, 18 aa, Staphylococcus
GVALKFEASVAGGIPIVN

SEQ ID NO: 2102540 - protein, 20 aa, Staphylococcus
GYAGEILSDLGFKRNKALQK

SEQ ID NO: 2102541 - protein, 28 aa, Staphylococcus
HPDLVKILGRLNYRTSYGQNVLKHSIEV

SEQ ID NO: 2102542 - protein, 17 aa, Staphylococcus
HTGWTTYGHTGEDVNTY

SEQ ID NO: 2102543 - protein, 18 aa, Staphylococcus
IDAARKVVITSYLSFNQV

SEQ ID NO: 2102544 - protein, 22 aa, Staphylococcus
IDPHAWLSLDNGIQYVKNIQEQ

SEQ ID NO: 2102545 - protein, 20 aa, Staphylococcus
IENFKFFVQYGNFKDFKDYK

SEQ ID NO: 2102546 - protein, 18 aa, Staphylococcus
IESLPFLEAIRQIRSDLG

SEQ ID NO: 2102547 - protein, 26 aa, Staphylococcus
IIHLLDRMGVMFSRTKEGLLDFRRFG

SEQ ID NO: 2102548 - protein, 26 aa, Staphylococcus
IIHLLDRMGVMFSRTNEGLLDFRRFG

SEQ ID NO: 2102549 - protein, 18 aa, Staphylococcus
ILGSLLILSACSNNDEKD

SEQ ID NO: 2102550 - protein, 17 aa, Staphylococcus
ILIGAIVGGAATLADKS

SEQ ID NO: 2102551 - protein, 18 aa, Staphylococcus
ILSDLGFKRNKALQKEVD

SEQ ID NO: 2102552 - protein, 17 aa, Staphylococcus
ILTKGPVLFGFFGHSSI

SEQ ID NO: 2102553 - protein, 17 aa, Staphylococcus
IPAAGLGTRFLPATKAM

SEQ ID NO: 2102554 - protein, 22 aa, Staphylococcus
IPRDTISYIPKVGYYDKITHAH

SEQ ID NO: 2102555 - protein, 21 aa, Staphylococcus
ISTPLSSYAMDTQVHQHKNKK

SEQ ID NO: 2102556 - protein, 23 aa, Staphylococcus
ITNEIKERLLLAGESTNADVVIT

SEQ ID NO: 2102557 - protein, 19 aa, Staphylococcus
IYQGSWKTPGMTYEDATKS

SEQ ID NO: 2102558 - protein, 23 aa, Staphylococcus
KNIKGMTIGLAMNSVYYYQKEKD

SEQ ID NO: 2102559 - protein, 17 aa, Staphylococcus
KNLEDFYDKEGFRDQEF

SEQ ID NO: 2102560 - protein, 17 aa, Staphylococcus
KNYDFIIIRGQYGSEYV

SEQ ID NO: 2102561 - protein, 18 aa, Staphylococcus
KPEFPDRNDDEWLKTTLA

SEQ ID NO: 2102562 - protein, 25 aa, Staphylococcus
KQKKHPKVLILMGVPGSYLVATDKS

SEQ ID NO: 2102563 - protein, 21 aa, Staphylococcus
LEVREDIYGALQISFKNPEDR

SEQ ID NO: 2102564 - protein, 17 aa, Staphylococcus
LNGLNNFFIYPGQKLRV

SEQ ID NO: 2102565 - protein, 18 aa, Staphylococcus
LQQFNLYVDGSMGNGGDW

SEQ ID NO: 2102566 - protein, 22 aa, Staphylococcus
MSYKSGYGGWSIPKSTKHPEDV

SEQ ID NO: 2102567 - protein, 20 aa, Staphylococcus
MYYERSEPVAEAFGDLDPKI

SEQ ID NO: 2102568 - protein, 19 aa, Staphylococcus
NFTKSIAIEYGRENIRANA

SEQ ID NO: 2102569 - protein, 18 aa, Staphylococcus
NNMKFGVYSYSMYENADD

SEQ ID NO: 2102570 - protein, 22 aa, Staphylococcus
NSIIKQYRLTELDGEEMPILDE

SEQ ID NO: 2102571 - protein, 18 aa, Staphylococcus
PDEVKKMFQKEFKQNDIW

SEQ ID NO: 2102572 - protein, 18 aa, Staphylococcus
PEAVQDAAAVKLYNTAGA

SEQ ID NO: 2102573 - protein, 24 aa, Staphylococcus
PIKETLAASLVRLANWKGDTPFID

SEQ ID NO: 2102574 - protein, 18 aa, Staphylococcus
PILDEAFFNKSYDDNQGD

SEQ ID NO: 2102575 - protein, 24 aa, Staphylococcus
PKQSEYFDNLFFVGGSVNPGGGMP

SEQ ID NO: 2102576 - protein, 22 aa, Staphylococcus
QQSIWKKICVNGTANALCTILE

SEQ ID NO: 2102577 - protein, 21 aa, Staphylococcus
RADINLPFERGAAIDLAGRDV

SEQ ID NO: 2102578 - protein, 18 aa, Staphylococcus
RGAHYKPEFPDRNDDEWL

SEQ ID NO: 2102579 - protein, 18 aa, Staphylococcus
RGAHYKPEFPERNDEEWL

SEQ ID NO: 2102580 - protein, 18 aa, Staphylococcus
RRLERLEALSESYDGVEK

SEQ ID NO: 2102581 - protein, 17 aa, Staphylococcus
SKLKPDLIIADSNRHKG

SEQ ID NO: 2102582 - protein, 19 aa, Staphylococcus
SLAILLMLLTGCSQSSKHT

SEQ ID NO: 2102583 - protein, 20 aa, Staphylococcus
SLAVGLGVVAGNAGHDAHAS

SEQ ID NO: 2102584 - protein, 26 aa, Staphylococcus
SNYDRAVELYYYIKGGTVDYGAAHAA

SEQ ID NO: 2102585 - protein, 22 aa, Staphylococcus
SREGKLLGEYGIKGRDYNLDKK

SEQ ID NO: 2102586 - protein, 20 aa, Staphylococcus
SRKYFHGRISAVNYNMNNQE

SEQ ID NO: 2102587 - protein, 17 aa, Staphylococcus
SWKTPGMTYEDATKSLV

SEQ ID NO: 2102588 - protein, 20 aa, Staphylococcus
TALACIVILAGCSGNSNKST

SEQ ID NO: 2102589 - protein, 28 aa, Staphylococcus
TDYSFQSDGQYWTWSYGQGSTNAPAQET

SEQ ID NO: 2102590 - protein, 22 aa, Staphylococcus
TLAVGLGVTGFAAGNSADASEQ

SEQ ID NO: 2102591 - protein, 30 aa, Staphylococcus
TRLVIVMLILCGLLFPLTVTAVGQIIFPHQ

SEQ ID NO: 2102592 - protein, 22 aa, Staphylococcus
TSSKEWKHLTAVKNNQVSTDLD

SEQ ID NO: 2102593 - protein, 24 aa, Staphylococcus
TWIADRKLKGLVFQSKNDVSPEMN

SEQ ID NO: 2102594 - protein, 17 aa, Staphylococcus
VGIVPLINNQAYWFITI

SEQ ID NO: 2102595 - protein, 18 aa, Staphylococcus
VLYWKDTIEEIRRNNPEL

SEQ ID NO: 2102596 - protein, 19 aa, Staphylococcus
VNVNSHLQAIAQRESGGDL

SEQ ID NO: 2102597 - protein, 23 aa, Staphylococcus
VTKYEGWEFLGIVKDEDNAARGI

SEQ ID NO: 2102598 - protein, 19 aa, Staphylococcus
WKGDTPFIDPFCGSGTIAI

SEQ ID NO: 2102599 - protein, 20 aa, Staphylococcus
YKDLYFAGASTHPGAGVPIV

SEQ ID NO: 2102600 - protein, 17 aa, Staphylococcus
YRIVPTTVALTMTLDKL

SEQ ID NO: 2102601 - protein, 23 aa, Staphylococcus
YYDSLGFANTYAFMVTKETAKKY

SEQ ID NO: 2102602 - protein, 18 aa, Staphylococcus
YYERSEPVAEAFGDLDPK

SEQ ID NO: 2102603 - protein, 27 aa, Staphylococcus
AAAKAGFQDIQFDYVRFPEGFENEADS

SEQ ID NO: 2102604 - protein, 19 aa, Staphylococcus
AADQLGFKIKLIGKGTYEN

SEQ ID NO: 2102605 - protein, 27 aa, Staphylococcus
AAGGTEELWEKIVLPESGGDPNASNGQ

SEQ ID NO: 2102606 - protein, 26 aa, Staphylococcus
AAGGTEEMWEKIVLPESGGNPNASNG

SEQ ID NO: 2102607 - protein, 21 aa, Staphylococcus
AAGIIRLGYLGKFKKIPAPDN

SEQ ID NO: 2102608 - protein, 26 aa, Staphylococcus
AAGKFQFLQSTWDSVAPEQYKGQSPA

SEQ ID NO: 2102609 - protein, 19 aa, Staphylococcus
AAGLGTRFLPATKAMPKEM

SEQ ID NO: 2102610 - protein, 17 aa, Staphylococcus
AAGYAVSGHEAHASETT

SEQ ID NO: 2102611 - protein, 19 aa, Staphylococcus
AAHAEKYGHERYGKTYEGV

SEQ ID NO: 2102612 - protein, 21 aa, Staphylococcus
AAIICLIIIVVACSQKKKETT

SEQ ID NO: 2102613 - protein, 20 aa, Staphylococcus
AAKELGYKIKLIGKGTYENG

SEQ ID NO: 2102614 - protein, 19 aa, Staphylococcus
AAKKYGINEIYLISHALIE

SEQ ID NO: 2102615 - protein, 17 aa, Staphylococcus
AAKQALNTYANLNHAQV

SEQ ID NO: 2102616 - protein, 24 aa, Staphylococcus
AAKVIKEGYGFDVKQSQIDKINEE

SEQ ID NO: 2102617 - protein, 19 aa, Staphylococcus
AAKYLGYTYDILRERNQDG

SEQ ID NO: 2102618 - protein, 27 aa, Staphylococcus
AARNIVQPPANNQVALKNLPNFPQSLT

SEQ ID NO: 2102619 - protein, 19 aa, Staphylococcus
AAVIVTALLITGIAVSGVI

SEQ ID NO: 2102620 - protein, 20 aa, Staphylococcus
ACGYIAKGRMEEPLQIVKII

SEQ ID NO: 2102621 - protein, 26 aa, Staphylococcus
ADAIINKPIRTVQEVQDALRQVNQVN

SEQ ID NO: 2102622 - protein, 23 aa, Staphylococcus
ADAMKRDGWTFASHSYGHINFEQ

SEQ ID NO: 2102623 - protein, 22 aa, Staphylococcus
ADDWKPKVKEMIPSYGESLITD

SEQ ID NO: 2102624 - protein, 17 aa, Staphylococcus
ADERKMETHYNKIDSTS

SEQ ID NO: 2102625 - protein, 18 aa, Staphylococcus
ADGHSIWTATEASLIQDG

SEQ ID NO: 2102626 - protein, 17 aa, Staphylococcus
ADGSILISEMNYANGPY

SEQ ID NO: 2102627 - protein, 18 aa, Staphylococcus
ADGSIVVSEMNWQGVGQK

SEQ ID NO: 2102628 - protein, 21 aa, Staphylococcus
ADITARGKIPIIAGGTGLYIQ

SEQ ID NO: 2102629 - protein, 20 aa, Staphylococcus
ADLFEKGVIFSNGLNGPKAR

SEQ ID NO: 2102630 - protein, 17 aa, Staphylococcus
ADLKHIRSYAIGVGPDY

SEQ ID NO: 2102631 - protein, 19 aa, Staphylococcus
ADLKKSITYEAGATSDNKF

SEQ ID NO: 2102632 - protein, 19 aa, Staphylococcus
ADLVVPLIKAYLGISSDIF

SEQ ID NO: 2102633 - protein, 19 aa, Staphylococcus
ADPELKSAYNSKYDQAKAI

SEQ ID NO: 2102634 - protein, 24 aa, Staphylococcus
ADPESIRFDPLYKQIMYTSEGDRS

SEQ ID NO: 2102635 - protein, 22 aa, Staphylococcus
ADPIYGHVAFVEKVNSDGSIVI

SEQ ID NO: 2102636 - protein, 22 aa, Staphylococcus
ADQIYGHVAFVEKVNDDGSIVI

SEQ ID NO: 2102637 - protein, 19 aa, Staphylococcus
ADTDYYYRDGLNYPSDQQA

SEQ ID NO: 2102638 - protein, 17 aa, Staphylococcus
ADTKLKEKIDFDTKGAK

SEQ ID NO: 2102639 - protein, 19 aa, Staphylococcus
ADVILGGGSKYFGKENGNL

SEQ ID NO: 2102640 - protein, 29 aa, Staphylococcus
ADYYKNSLDFFKPAPFKEQKNSTPSLWEQ

SEQ ID NO: 2102641 - protein, 19 aa, Staphylococcus
AEAKALYLQGYNTAKDNLD

SEQ ID NO: 2102642 - protein, 20 aa, Staphylococcus
AEAQRLIKQLGYTRNGDGYF

SEQ ID NO: 2102643 - protein, 17 aa, Staphylococcus
AEISSIRQNDGYLWTIN

SEQ ID NO: 2102644 - protein, 21 aa, Staphylococcus
AEKMANLDGTVTFEESDYTNP

SEQ ID NO: 2102645 - protein, 21 aa, Staphylococcus
AENGHTVLMWGKNEDSVKELN

SEQ ID NO: 2102646 - protein, 24 aa, Staphylococcus
AENKEDWDEPVFIKGADLEGQDLQ

SEQ ID NO: 2102647 - protein, 19 aa, Staphylococcus
AENSFKDITGWKKVSKESI

SEQ ID NO: 2102648 - protein, 20 aa, Staphylococcus
AEQNKSAFAFSKKVDDKTIK

SEQ ID NO: 2102649 - protein, 24 aa, Staphylococcus
AETGQPISTYWWNADHWANNASAD

SEQ ID NO: 2102650 - protein, 27 aa, Staphylococcus
AETGQPISTYWWNAENWADNARADGYT

SEQ ID NO: 2102651 - protein, 21 aa, Staphylococcus
AFDNYLKGTMRVHNDDTKENI

SEQ ID NO: 2102652 - protein, 25 aa, Staphylococcus
AFGQKAVSYPVQFVTGSINNLFSND

SEQ ID NO: 2102653 - protein, 21 aa, Staphylococcus
AFGQTGRFGGFLNKDLGIQHA

SEQ ID NO: 2102654 - protein, 28 aa, Staphylococcus
AFIIEITPRFDGCHMHKLIQYYNEDDLL

SEQ ID NO: 2102655 - protein, 18 aa, Staphylococcus
AFNLAWKLSNVIQGKADK

SEQ ID NO: 2102656 - protein, 31 aa, Staphylococcus
AFSAARSVYVGKELFLYGTVDNRTGWIAAKD

SEQ ID NO: 2102657 - protein, 19 aa, Staphylococcus
AFSGHQAFAADIVTKNNAQ

SEQ ID NO: 2102658 - protein, 25 aa, Staphylococcus
AGAHDIYGHVAFVEKVNKDGSIVIS

SEQ ID NO: 2102659 - protein, 23 aa, Staphylococcus
AGALGRKTKQGFYKKDKEKKQRL

SEQ ID NO: 2102660 - protein, 18 aa, Staphylococcus
AGARGHHIVVGTAEDVAD

SEQ ID NO: 2102661 - protein, 24 aa, Staphylococcus
AGASSYYGHVAFVERVNDDGSIVI

SEQ ID NO: 2102662 - protein, 28 aa, Staphylococcus
AGAYRDWKPGQKIHLIGHSMGGQTVRLL

SEQ ID NO: 2102663 - protein, 19 aa, Staphylococcus
AGGIKYLGGKIVAVNEQVD

SEQ ID NO: 2102664 - protein, 23 aa, Staphylococcus
AGGQIALSFAQYIKTLNLAQPSN

SEQ ID NO: 2102665 - protein, 25 aa, Staphylococcus
AGGTEELWEKIVLPESGGNPHAKNG

SEQ ID NO: 2102666 - protein, 24 aa, Staphylococcus
AGGTEELWNAIVMPESGGNVNASN

SEQ ID NO: 2102667 - protein, 19 aa, Staphylococcus
AGIATFAFAQHDADAAENN

SEQ ID NO: 2102668 - protein, 22 aa, Staphylococcus
AGIKAAQWAKAHYKDSDKTYLV

SEQ ID NO: 2102669 - protein, 25 aa, Staphylococcus
AGKYQFLQSTWDSVAPAQYKGVSPA

SEQ ID NO: 2102670 - protein, 25 aa, Staphylococcus
AGKYQFLQSTWDSVAPDEYKGVSPA

SEQ ID NO: 2102671 - protein, 26 aa, Staphylococcus
AGKYQFLQTTWDSVAPAEYQGKPASE

SEQ ID NO: 2102672 - protein, 26 aa, Staphylococcus
AGLERCIQQKIPVIIVSRSFNGIVSP

SEQ ID NO: 2102673 - protein, 17 aa, Staphylococcus
AGNKKVLFYSYENFMLN

SEQ ID NO: 2102674 - protein, 19 aa, Staphylococcus
AGNVCGMMPHPERALEKIL

SEQ ID NO: 2102675 - protein, 27 aa, Staphylococcus
AGQNTLYKMRWNPDHPATHQYATDINW

SEQ ID NO: 2102676 - protein, 17 aa, Staphylococcus
AGRGYRRVVPSPQPINI

SEQ ID NO: 2102677 - protein, 20 aa, Staphylococcus
AGSVPFEITQEADFQTEIDF

SEQ ID NO: 2102678 - protein, 25 aa, Staphylococcus
AGYNPSFLLTHEFKNGIKYKNITFN

SEQ ID NO: 2102679 - protein, 19 aa, Staphylococcus
AGYPFKKDVVVKWIDSSEV

SEQ ID NO: 2102680 - protein, 23 aa, Staphylococcus
AGYRVGKKPAKRAVMQSTSGTYG

SEQ ID NO: 2102681 - protein, 24 aa, Staphylococcus
AHPSESYVGQFLSQLGFKEALNKD

SEQ ID NO: 2102682 - protein, 23 aa, Staphylococcus
AIAKVGKGKAAFIGDSSLVEDSS

SEQ ID NO: 2102683 - protein, 23 aa, Staphylococcus
AIDLRGKELFKSLVKEIDLIKSR

SEQ ID NO: 2102684 - protein, 18 aa, Staphylococcus
AIGSTWGTANNWANAAKA

SEQ ID NO: 2102685 - protein, 26 aa, Staphylococcus
AIGTSSILVASLFFIGSGGADAAEAS

SEQ ID NO: 2102686 - protein, 26 aa, Staphylococcus
AIHQHAGKPFIDYVICSNDAFDEQIL

SEQ ID NO: 2102687 - protein, 19 aa, Staphylococcus
AIHTTGVGGLQIIKVYKSN

SEQ ID NO: 2102688 - protein, 24 aa, Staphylococcus
AIILSICLAFLLFIATNQNALAKV

SEQ ID NO: 2102689 - protein, 24 aa, Staphylococcus
AILSSALVLTACGQSEDHSKKDDD

SEQ ID NO: 2102690 - protein, 18 aa, Staphylococcus
AILTIIFIYGCSKQPSSI

SEQ ID NO: 2102691 - protein, 18 aa, Staphylococcus
AIPVVFANNLFKSSEKAF

SEQ ID NO: 2102692 - protein, 21 aa, Staphylococcus
AIQAGREIRVVVSPEEIDDLK

SEQ ID NO: 2102693 - protein, 23 aa, Staphylococcus
AISKLGKGKAVFIGDSSLVEDRS

SEQ ID NO: 2102694 - protein, 24 aa, Staphylococcus
AISKVGKGKAAFIGDSSLVEDSTP

SEQ ID NO: 2102695 - protein, 24 aa, Staphylococcus
AISKVGKGKAAFIGDTSLVEDSSP

SEQ ID NO: 2102696 - protein, 20 aa, Staphylococcus
AISVIISIISAMGDKSHKQR

SEQ ID NO: 2102697 - protein, 24 aa, Staphylococcus
AITLKDFGIDDCLILEKEEIGSSF

SEQ ID NO: 2102698 - protein, 26 aa, Staphylococcus
AIVNFVKRGGSVIFISDHYNADRNLN

SEQ ID NO: 2102699 - protein, 30 aa, Staphylococcus
AIYLYGSVNGVNGWISKSFLTTPSTSNTTK

SEQ ID NO: 2102700 - protein, 21 aa, Staphylococcus
AKAEDLFHLDLAYAPPFSTTK

SEQ ID NO: 2102701 - protein, 21 aa, Staphylococcus
AKAKPDIIFASFRQAHTKTLD

SEQ ID NO: 2102702 - protein, 18 aa, Staphylococcus
AKARITVRANIARLVGGA

SEQ ID NO: 2102703 - protein, 18 aa, Staphylococcus
AKARITVRANISRLVGGS

SEQ ID NO: 2102704 - protein, 17 aa, Staphylococcus
AKATGLKPNTKYYYKVG

SEQ ID NO: 2102705 - protein, 22 aa, Staphylococcus
AKAVKFSIERAKAMNKDTTVET

SEQ ID NO: 2102706 - protein, 20 aa, Staphylococcus
AKDKYGRIDVIFNNAGVDHG

SEQ ID NO: 2102707 - protein, 18 aa, Staphylococcus
AKELYPKVRMYYERSEPV

SEQ ID NO: 2102708 - protein, 22 aa, Staphylococcus
AKGDDPIVFLGGAKSDLRDEIQ

SEQ ID NO: 2102709 - protein, 27 aa, Staphylococcus
AKGSFSTLIGVGGDRVTIIATQSPGTY

SEQ ID NO: 2102710 - protein, 18 aa, Staphylococcus
AKHLPAKTNKTRQLKKDY

SEQ ID NO: 2102711 - protein, 20 aa, Staphylococcus
AKKALGNDVIKDVKAIKDNK

SEQ ID NO: 2102712 - protein, 18 aa, Staphylococcus
AKKITVAALKKAKNDKEL

SEQ ID NO: 2102713 - protein, 22 aa, Staphylococcus
AKKRGFRGAGSYWADHLGYTDI

SEQ ID NO: 2102714 - protein, 26 aa, Staphylococcus
AKKYKFTLKKGVKWQNGDPLTVNDWI

SEQ ID NO: 2102715 - protein, 24 aa, Staphylococcus
AKLNAAKEKLRAVNQVLNSNPTVD

SEQ ID NO: 2102716 - protein, 24 aa, Staphylococcus
AKMRDIHSANNWGIKTNHIDIDVT

SEQ ID NO: 2102717 - protein, 20 aa, Staphylococcus
AKNAHKYGFIVRYPKGKEKI

SEQ ID NO: 2102718 - protein, 20 aa, Staphylococcus
AKNEGINNINLIQSSTSTKT

SEQ ID NO: 2102719 - protein, 20 aa, Staphylococcus
AKNFKHKPDFAVTNGGGIRA

SEQ ID NO: 2102720 - protein, 27 aa, Staphylococcus
AKNGYSLKTYFEKPFVVIKQKQQNGVT

SEQ ID NO: 2102721 - protein, 18 aa, Staphylococcus
AKNIFDFFGQDVTSNQNQ

SEQ ID NO: 2102722 - protein, 17 aa, Staphylococcus
AKPDLILAHESQKSTDG

SEQ ID NO: 2102723 - protein, 18 aa, Staphylococcus
AKPDVIYISGRTANQKNL

SEQ ID NO: 2102724 - protein, 18 aa, Staphylococcus
AKPDVIYISSRAATQKNL

SEQ ID NO: 2102725 - protein, 22 aa, Staphylococcus
AKPIVKITLGLITASISLGTIS

SEQ ID NO: 2102726 - protein, 18 aa, Staphylococcus
AKPLEKLLSKKLDIPVKV

SEQ ID NO: 2102727 - protein, 17 aa, Staphylococcus
AKPLEKLLSKKLGIPVK

SEQ ID NO: 2102728 - protein, 22 aa, Staphylococcus
AKPLKFNNMESVTKEQQNKKGL

SEQ ID NO: 2102729 - protein, 18 aa, Staphylococcus
AKPLKFYNMESLNKDQQE

SEQ ID NO: 2102730 - protein, 18 aa, Staphylococcus
AKPLKFYNMESLNKEQSK

SEQ ID NO: 2102731 - protein, 20 aa, Staphylococcus
AKPLKFYNMESLNKSQQQDY

SEQ ID NO: 2102732 - protein, 17 aa, Staphylococcus
AKPQYSLSFIGEQQPQE

SEQ ID NO: 2102733 - protein, 20 aa, Staphylococcus
AKQVLKNDVIKDVTAVKNNN

SEQ ID NO: 2102734 - protein, 24 aa, Staphylococcus
AKSAKKAIKNYISPLIEKQIKDIN

SEQ ID NO: 2102735 - protein, 21 aa, Staphylococcus
AKSDIDRKLSEQIENINQHQT

SEQ ID NO: 2102736 - protein, 25 aa, Staphylococcus
AKSGAKYANRTFVISKQRTEGNNTY

SEQ ID NO: 2102737 - protein, 18 aa, Staphylococcus
AKSGKKIYVYNWGEYIDP

SEQ ID NO: 2102738 - protein, 25 aa, Staphylococcus
AKSGNSLRFTYLGNITLNKHIRQNN

SEQ ID NO: 2102739 - protein, 17 aa, Staphylococcus
AKSIITVDHVTITEQNN

SEQ ID NO: 2102740 - protein, 21 aa, Staphylococcus
AKSKPNVIFASFRQAHTKTID

SEQ ID NO: 2102741 - protein, 25 aa, Staphylococcus
AKSPVKVNATYTIKPGVKLYTVPWG

SEQ ID NO: 2102742 - protein, 19 aa, Staphylococcus
AKTALKEAANKLYGDNSAE

SEQ ID NO: 2102743 - protein, 21 aa, Staphylococcus
AKVFADAGVNVVLGMHPHVIE

SEQ ID NO: 2102744 - protein, 20 aa, Staphylococcus
AKVPTLDEILSRYGTKANYY

SEQ ID NO: 2102745 - protein, 17 aa, Staphylococcus
AKYKFSKPYTYSSGVLV

SEQ ID NO: 2102746 - protein, 17 aa, Staphylococcus
AKYLEVVAYHYGISIQT

SEQ ID NO: 2102747 - protein, 24 aa, Staphylococcus
AKYNRNRIGNAIFKHYRKEYEYKK

SEQ ID NO: 2102748 - protein, 18 aa, Staphylococcus
ALAGKSSGGSNLYTAGQC

SEQ ID NO: 2102749 - protein, 23 aa, Staphylococcus
ALAKVHQTICTFSKANKVSALEK

SEQ ID NO: 2102750 - protein, 18 aa, Staphylococcus
ALANEGAHVLALDISDEL

SEQ ID NO: 2102751 - protein, 29 aa, Staphylococcus
ALAQKPNFNLFGIKGTYQGQSVSFNTLEA

SEQ ID NO: 2102752 - protein, 18 aa, Staphylococcus
ALDTARNGLTVDKTPLEN

SEQ ID NO: 2102753 - protein, 18 aa, Staphylococcus
ALESLFKMSKDGKVKPLL

SEQ ID NO: 2102754 - protein, 26 aa, Staphylococcus
ALGEGVKFAKASGWDSVSKAIIGGAK

SEQ ID NO: 2102755 - protein, 18 aa, Staphylococcus
ALILFLGIREKKRHTHRL

SEQ ID NO: 2102756 - protein, 23 aa, Staphylococcus
ALILLVFAIRAIHVDPVKSDAKS

SEQ ID NO: 2102757 - protein, 18 aa, Staphylococcus
ALIQDLFMNDYLRVYTNN

SEQ ID NO: 2102758 - protein, 26 aa, Staphylococcus
ALKDNGVNEFLLWNAGNEYTEGANYN

SEQ ID NO: 2102759 - protein, 22 aa, Staphylococcus
ALKEAKRLGFAEADPTDDVDGV

SEQ ID NO: 2102760 - protein, 23 aa, Staphylococcus
ALKNKKLDVAVGYSTDGRIAAYN

SEQ ID NO: 2102761 - protein, 24 aa, Staphylococcus
ALKNKKLDVAVGYSTDGRIAAYNL

SEQ ID NO: 2102762 - protein, 20 aa, Staphylococcus
ALLFRHFFATSLHKQFMRNS

SEQ ID NO: 2102763 - protein, 21 aa, Staphylococcus
ALLKAKPDLILAHESQKSSSG

SEQ ID NO: 2102764 - protein, 17 aa, Staphylococcus
ALMTRGLAEISRLGEEL

SEQ ID NO: 2102765 - protein, 25 aa, Staphylococcus
ALNESFSDVFGYFVDDEDFLMGEDV

SEQ ID NO: 2102766 - protein, 22 aa, Staphylococcus
ALNKEKELFTFLNQDGATQSEV

SEQ ID NO: 2102767 - protein, 27 aa, Staphylococcus
ALPDGEIKARTSLITRNITYTTQNSQG

SEQ ID NO: 2102768 - protein, 19 aa, Staphylococcus
ALQKNGVKVIYVKDAQSID

SEQ ID NO: 2102769 - protein, 22 aa, Staphylococcus
ALRSMSNPERFGQPSHMDDYVN

SEQ ID NO: 2102770 - protein, 24 aa, Staphylococcus
ALTLSGLCTSSFIEASGNGNTYTE

SEQ ID NO: 2102771 - protein, 19 aa, Staphylococcus
ALVAICLVLAGCSNSDSGD

SEQ ID NO: 2102772 - protein, 17 aa, Staphylococcus
AMEHLRDSIKDHQQTLN

SEQ ID NO: 2102773 - protein, 24 aa, Staphylococcus
AMGLDDLRAHIVFEDMWTPEDIEH

SEQ ID NO: 2102774 - protein, 18 aa, Staphylococcus
AMHALRQSIQDNPSIKAG

SEQ ID NO: 2102775 - protein, 19 aa, Staphylococcus
AMHNLKQGIANKNDILGSE

SEQ ID NO: 2102776 - protein, 17 aa, Staphylococcus
AMLVLCLVLAGCSNSSN

SEQ ID NO: 2102777 - protein, 19 aa, Staphylococcus
AMNGYRRGAYNDMTKDMSQ

SEQ ID NO: 2102778 - protein, 19 aa, Staphylococcus
AMSALKQGIADKDQTIADG

SEQ ID NO: 2102779 - protein, 21 aa, Staphylococcus
ANAAKAAGYTVNHHAKAGSIL

SEQ ID NO: 2102780 - protein, 24 aa, Staphylococcus
ANAMKRDGWTFASHSWGHIDFANS

SEQ ID NO: 2102781 - protein, 22 aa, Staphylococcus
ANAVSSYDGYWLASYQAEEPTR

SEQ ID NO: 2102782 - protein, 22 aa, Staphylococcus
ANAVSSYDGYWLASYQAQEPTR

SEQ ID NO: 2102783 - protein, 27 aa, Staphylococcus
ANCLKEYDFREALARYDKLRVKHTAKV

SEQ ID NO: 2102784 - protein, 19 aa, Staphylococcus
ANDEAKAAEKDQVSTTTNS

SEQ ID NO: 2102785 - protein, 19 aa, Staphylococcus
ANEKEWRENDGLVSVISSQ

SEQ ID NO: 2102786 - protein, 18 aa, Staphylococcus
ANENLGLNPSHHGETDKA

SEQ ID NO: 2102787 - protein, 18 aa, Staphylococcus
ANENLGLNPSHNGEKDEK

SEQ ID NO: 2102788 - protein, 19 aa, Staphylococcus
ANENLGLNPSHNGETDEEK

SEQ ID NO: 2102789 - protein, 18 aa, Staphylococcus
ANGLNGNLIYPGQSLTIP

SEQ ID NO: 2102790 - protein, 17 aa, Staphylococcus
ANIATVYNWNPKAKQLT

SEQ ID NO: 2102791 - protein, 23 aa, Staphylococcus
ANIEGAQKIYTLFKPELNKKDKK

SEQ ID NO: 2102792 - protein, 23 aa, Staphylococcus
ANIKEVEKHFSLMATSKKGKKVN

SEQ ID NO: 2102793 - protein, 17 aa, Staphylococcus
ANIYVFKKGKYVILAYK

SEQ ID NO: 2102794 - protein, 23 aa, Staphylococcus
ANKANPGTFTIVSVNQKGEASVL

SEQ ID NO: 2102795 - protein, 17 aa, Staphylococcus
ANKGTPFALPNTPWKPL

SEQ ID NO: 2102796 - protein, 17 aa, Staphylococcus
ANLPSVRGQMVDIEFTH

SEQ ID NO: 2102797 - protein, 24 aa, Staphylococcus
ANNVKRLIFVTSIGIYNEVPGNFG

SEQ ID NO: 2102798 - protein, 19 aa, Staphylococcus
ANSSIKESHSESVQENENQ

SEQ ID NO: 2102799 - protein, 19 aa, Staphylococcus
ANTPIHMYHYGKPTGKYKN

SEQ ID NO: 2102800 - protein, 18 aa, Staphylococcus
APAIIALTIAGTAITTHQ

SEQ ID NO: 2102801 - protein, 18 aa, Staphylococcus
APEGMTFYSASPARGPFA

SEQ ID NO: 2102802 - protein, 27 aa, Staphylococcus
APIKETLAAALIRLANWNGNTPLIDPF

SEQ ID NO: 2102803 - protein, 26 aa, Staphylococcus
APIKETLAASLIRLANWTGDTPLVDP

SEQ ID NO: 2102804 - protein, 22 aa, Staphylococcus
APLEAAKQALQQSINQPTNTTG

SEQ ID NO: 2102805 - protein, 19 aa, Staphylococcus
APLTLKLKVVDVNQPTGDQ

SEQ ID NO: 2102806 - protein, 26 aa, Staphylococcus
APNFNLFGIKGAYKGESSEFNTLEAT

SEQ ID NO: 2102807 - protein, 25 aa, Staphylococcus
APPDELKPQFDLVKQMSEALGFINI

SEQ ID NO: 2102808 - protein, 30 aa, Staphylococcus
APSNLAIMGRYVLKPDIFDYLERQEIGRGG

SEQ ID NO: 2102809 - protein, 34 aa, Staphylococcus
APSNLAIMGRYVLKPEIFDYLSTQDKGSGGEIQL

SEQ ID NO: 2102810 - protein, 29 aa, Staphylococcus
APSNLAIMGRYVLTPEIFDYLKTQKKGAS

SEQ ID NO: 2102811 - protein, 21 aa, Staphylococcus
APTDYLSWGAGPAGNERFINV

SEQ ID NO: 2102812 - protein, 25 aa, Staphylococcus
APTDYLSWGAGPYGNNRFINVEIVH

SEQ ID NO: 2102813 - protein, 27 aa, Staphylococcus
APYHGTNAVNVARSLTRDNVNQSEALK

SEQ ID NO: 2102814 - protein, 17 aa, Staphylococcus
AQDSLKILKTHAEQPYS

SEQ ID NO: 2102815 - protein, 29 aa, Staphylococcus
AQFLLDESFLKSLDKGTVSFNGYQVVSND

SEQ ID NO: 2102816 - protein, 24 aa, Staphylococcus
AQGNYHYTWKGNWSPNQLNQNQGY

SEQ ID NO: 2102817 - protein, 18 aa, Staphylococcus
AQIGKGISTYWWNANNWD

SEQ ID NO: 2102818 - protein, 21 aa, Staphylococcus
AQKIYELFKPILNKKDKKLSE

SEQ ID NO: 2102819 - protein, 18 aa, Staphylococcus
AQKYDINEIYLISHALLE

SEQ ID NO: 2102820 - protein, 17 aa, Staphylococcus
AQLPSVRGNMKKIEFQY

SEQ ID NO: 2102821 - protein, 18 aa, Staphylococcus
AQPKRLLTADGIQTPFQS

SEQ ID NO: 2102822 - protein, 21 aa, Staphylococcus
AQRVLGWKPKHDDIHEIIETA

SEQ ID NO: 2102823 - protein, 17 aa, Staphylococcus
AQSVGKKAIKRVQYNSV

SEQ ID NO: 2102824 - protein, 19 aa, Staphylococcus
AQVPLAWGAHRAANIIAEQ

SEQ ID NO: 2102825 - protein, 20 aa, Staphylococcus
AQWLAKHAANYGFIIRYPKN

SEQ ID NO: 2102826 - protein, 20 aa, Staphylococcus
ARAGIEDIIIVTGKHKRAIE

SEQ ID NO: 2102827 - protein, 17 aa, Staphylococcus
ARDGSRKPYTFHATKVV

SEQ ID NO: 2102828 - protein, 22 aa, Staphylococcus
AREDIYGALRISFKSPEDRESG

SEQ ID NO: 2102829 - protein, 18 aa, Staphylococcus
AREKLRDIEQVLNGNPTV

SEQ ID NO: 2102830 - protein, 18 aa, Staphylococcus
ARGLKDYPIDITTIVTVA

SEQ ID NO: 2102831 - protein, 22 aa, Staphylococcus
ARGLREFPIDITAIVTVADDGG

SEQ ID NO: 2102832 - protein, 21 aa, Staphylococcus
ARGLREFPIDITAIVTVADNG

SEQ ID NO: 2102833 - protein, 20 aa, Staphylococcus
ARGPFATLIGVSDDKVAVIG

SEQ ID NO: 2102834 - protein, 22 aa, Staphylococcus
ARIKEIIYHKLATIEALENIKQ

SEQ ID NO: 2102835 - protein, 19 aa, Staphylococcus
ARKDLTKMMTFKGEPDFTI

SEQ ID NO: 2102836 - protein, 22 aa, Staphylococcus
ARNVNPIGYYQMMAEPGSSGGA

SEQ ID NO: 2102837 - protein, 23 aa, Staphylococcus
ARQHLVPDKAPLEAAKQALQQSI

SEQ ID NO: 2102838 - protein, 17 aa, Staphylococcus
ARRDLSKMMTFKGDPDF

SEQ ID NO: 2102839 - protein, 20 aa, Staphylococcus
ARTLYNRAPKASFYINDYEQ

SEQ ID NO: 2102840 - protein, 22 aa, Staphylococcus
ARTTYGPGHNAVVVVSDALPDG

SEQ ID NO: 2102841 - protein, 22 aa, Staphylococcus
ARYIHNNVLPKGGYDKFTNKIS

SEQ ID NO: 2102842 - protein, 26 aa, Staphylococcus
ASAKKGGSLGYVIKGQMVDKFDKALF

SEQ ID NO: 2102843 - protein, 22 aa, Staphylococcus
ASDDAFHASGIFPETDKRYYDK

SEQ ID NO: 2102844 - protein, 17 aa, Staphylococcus
ASDISFIMVHGQDHLMT

SEQ ID NO: 2102845 - protein, 17 aa, Staphylococcus
ASEWLLKQSKRHKRFNF

SEQ ID NO: 2102846 - protein, 21 aa, Staphylococcus
ASGDLPDFIVYYLDDSGRPEM

SEQ ID NO: 2102847 - protein, 17 aa, Staphylococcus
ASGYAPEHTFFAYDKAK

SEQ ID NO: 2102848 - protein, 17 aa, Staphylococcus
ASGYAPEHTFFSYDKSH

SEQ ID NO: 2102849 - protein, 22 aa, Staphylococcus
ASILVGATLFLGHHEAEAAEKQ

SEQ ID NO: 2102850 - protein, 24 aa, Staphylococcus
ASILVGATLIFGHADNEAKAAEEN

SEQ ID NO: 2102851 - protein, 19 aa, Staphylococcus
ASLASLVIGTGLFASTAQA

SEQ ID NO: 2102852 - protein, 18 aa, Staphylococcus
ASLDVIRYVTAHHPRLPI

SEQ ID NO: 2102853 - protein, 17 aa, Staphylococcus
ASLEKSVDKLEKENKSL

SEQ ID NO: 2102854 - protein, 18 aa, Staphylococcus
ASMSEAYVSITDAKSTIS

SEQ ID NO: 2102855 - protein, 28 aa, Staphylococcus
ASRTGNPIKLNIGFDIQDGYGNEETLKS

SEQ ID NO: 2102856 - protein, 18 aa, Staphylococcus
ASSAFDLSFEAYQDSKDV

SEQ ID NO: 2102857 - protein, 19 aa, Staphylococcus
ASSIAFSLSQVAHAEQMVN

SEQ ID NO: 2102858 - protein, 18 aa, Staphylococcus
ASSQYWYKYNGYTASGGN

SEQ ID NO: 2102859 - protein, 24 aa, Staphylococcus
ASVIECRDADSLYEIPLQLSKQDM

SEQ ID NO: 2102860 - protein, 19 aa, Staphylococcus
ATAGIATVGFAHHDAHAAE

SEQ ID NO: 2102861 - protein, 18 aa, Staphylococcus
ATDINWANLNAKSLKYLY

SEQ ID NO: 2102862 - protein, 29 aa, Staphylococcus
ATDINWANLNAQVIKGFYDKMGEVGKYFE

SEQ ID NO: 2102863 - protein, 20 aa, Staphylococcus
ATEFPRIQMFMRSYTGSANW

SEQ ID NO: 2102864 - protein, 18 aa, Staphylococcus
ATENLGLNPSHDGETKPE

SEQ ID NO: 2102865 - protein, 25 aa, Staphylococcus
ATHGNPRALKAFPSAVNQNNYPNGG

SEQ ID NO: 2102866 - protein, 35 aa, Staphylococcus
ATHPSLFGRQKADLNMFLPFILTGNVIGKANEKEW

SEQ ID NO: 2102867 - protein, 18 aa, Staphylococcus
ATIILIISILTLSSCSQN

SEQ ID NO: 2102868 - protein, 23 aa, Staphylococcus
ATKGKKGNAVFISHESLGYLSNR

SEQ ID NO: 2102869 - protein, 28 aa, Staphylococcus
ATNPYFYQIEVVRAYTFDDFARSVNNQA

SEQ ID NO: 2102870 - protein, 24 aa, Staphylococcus
ATRIKGFYDSMGKLGKYFDVDTYK

SEQ ID NO: 2102871 - protein, 24 aa, Staphylococcus
ATSEKKLAKEWMKFLKSDKAKKIL

SEQ ID NO: 2102872 - protein, 26 aa, Staphylococcus
ATSKMKKFKIGQAVDADGVQVKLTKI

SEQ ID NO: 2102873 - protein, 19 aa, Staphylococcus
ATSRPGGKIQTYRRDGYTI

SEQ ID NO: 2102874 - protein, 25 aa, Staphylococcus
ATTRAALPKYSPKVNSSINNYIRKN

SEQ ID NO: 2102875 - protein, 19 aa, Staphylococcus
AVAKEMGYKVKFKETQWDS

SEQ ID NO: 2102876 - protein, 18 aa, Staphylococcus
AVASGIVAGMGFGDNAKA

SEQ ID NO: 2102877 - protein, 21 aa, Staphylococcus
AVIASTVLVAGCTTDKGEIKD

SEQ ID NO: 2102878 - protein, 25 aa, Staphylococcus
AVILSICLVGLIFLATNQNALAKVH

SEQ ID NO: 2102879 - protein, 25 aa, Staphylococcus
AVKELSKILNIRGRVIPSTNTSVRL

SEQ ID NO: 2102880 - protein, 18 aa, Staphylococcus
AVKFSIERAKAMNKETTV

SEQ ID NO: 2102881 - protein, 17 aa, Staphylococcus
AVKIGWEAIVPPRTPER

SEQ ID NO: 2102882 - protein, 22 aa, Staphylococcus
AVKNDLHFKKYVENNTLPDGYK

SEQ ID NO: 2102883 - protein, 25 aa, Staphylococcus
AVLHPTYVGALVKFGHKPIAVPKFV

SEQ ID NO: 2102884 - protein, 17 aa, Staphylococcus
AVPAARNIVQPPANNQV

SEQ ID NO: 2102885 - protein, 24 aa, Staphylococcus
AVSKVGKGKAAFIGDSSLVEDSTP

SEQ ID NO: 2102886 - protein, 21 aa, Staphylococcus
AVTHHRYHYGSSPAPNKYKSV

SEQ ID NO: 2102887 - protein, 23 aa, Staphylococcus
AYAHELNEILSICNEHELYVSGK

SEQ ID NO: 2102888 - protein, 17 aa, Staphylococcus
AYDEKGWLNESGAKYPV

SEQ ID NO: 2102889 - protein, 20 aa, Staphylococcus
AYEKGQCTYYAFDKVKKDGN

SEQ ID NO: 2102890 - protein, 22 aa, Staphylococcus
AYEPWHLRYVGPQLAKTINEKN

SEQ ID NO: 2102891 - protein, 17 aa, Staphylococcus
AYKVYKNGEVQYKSGNF

SEQ ID NO: 2102892 - protein, 17 aa, Staphylococcus
AYNIAFDNSGYNFNFNS

SEQ ID NO: 2102893 - protein, 36 aa, Staphylococcus
AYNITFVKDGFKYNFTSDGQSWSWNYTYVGGADTVA

SEQ ID NO: 2102894 - protein, 24 aa, Staphylococcus
AYTIATRISDNWSKDDEEKLAKKI

SEQ ID NO: 2102895 - protein, 21 aa, Staphylococcus
AYTLGEPFKIYKLNKQSDGNF

SEQ ID NO: 2102896 - protein, 17 aa, Staphylococcus
CDYLTGFEGELSNDITK

SEQ ID NO: 2102897 - protein, 28 aa, Staphylococcus
CGALVIGLLCLGISHLFSGHEKAKSGKK

SEQ ID NO: 2102898 - protein, 17 aa, Staphylococcus
CIITTMVVLSSLLLVFS

SEQ ID NO: 2102899 - protein, 22 aa, Staphylococcus
CLLSTSLLIPSFSINDVSAESL

SEQ ID NO: 2102900 - protein, 19 aa, Staphylococcus
CPTGDLLILIGGNNWHIES

SEQ ID NO: 2102901 - protein, 17 aa, Staphylococcus
CTILECRLSNLNESDYA

SEQ ID NO: 2102902 - protein, 17 aa, Staphylococcus
CTILECRLSTLNESEYA

SEQ ID NO: 2102903 - protein, 17 aa, Staphylococcus
CTYYVFDKVGGKIGSTW

SEQ ID NO: 2102904 - protein, 17 aa, Staphylococcus
CTYYVYDKVGGKIGSTW

SEQ ID NO: 2102905 - protein, 22 aa, Staphylococcus
DAEKNKSAFAFSKKVDDKTVQK

SEQ ID NO: 2102906 - protein, 24 aa, Staphylococcus
DAEMKRQDEAYAREEAQRQKQEAA

SEQ ID NO: 2102907 - protein, 17 aa, Staphylococcus
DAIKVYKVNDPSAMVNS

SEQ ID NO: 2102908 - protein, 22 aa, Staphylococcus
DAKKVRPANEVSINKEQASKKA

SEQ ID NO: 2102909 - protein, 20 aa, Staphylococcus
DAKNSFSDINGWKSVSKESI

SEQ ID NO: 2102910 - protein, 31 aa, Staphylococcus
DAKNSFSNIEGWKPVDKEGIIKKNPDILIST

SEQ ID NO: 2102911 - protein, 23 aa, Staphylococcus
DAKRVVVLEYSFIDALAALDVKP

SEQ ID NO: 2102912 - protein, 23 aa, Staphylococcus
DALKYTNVYLFSKFVSESDQYDI

SEQ ID NO: 2102913 - protein, 23 aa, Staphylococcus
DALYRDIDAAFKMQNDKQRSAKY

SEQ ID NO: 2102914 - protein, 23 aa, Staphylococcus
DAMEKRLTQHYGAPSSTLEQSFE

SEQ ID NO: 2102915 - protein, 30 aa, Staphylococcus
DAMTYSALVASGFPKHRVLGQSGVLDSARY

SEQ ID NO: 2102916 - protein, 30 aa, Staphylococcus
DANAIVKCNLWLRTADRLKIVVGRFNAKTF

SEQ ID NO: 2102917 - protein, 17 aa, Staphylococcus
DANYFQHVPYLKTESKE

SEQ ID NO: 2102918 - protein, 19 aa, Staphylococcus
DAPLLKCVYQNHKVYKEML

SEQ ID NO: 2102919 - protein, 37 aa, Staphylococcus
DAQNDFSSAARYIAHLPQGASAVWQDNADNWKNNVGN

SEQ ID NO: 2102920 - protein, 24 aa, Staphylococcus
DASKDFIEDLGLPKSVVDGTKLKG

SEQ ID NO: 2102921 - protein, 18 aa, Staphylococcus
DAYENLLFDCLKGDATNF

SEQ ID NO: 2102922 - protein, 17 aa, Staphylococcus
DCFKTNIPDIYALGDVI

SEQ ID NO: 2102923 - protein, 19 aa, Staphylococcus
DCQAIVKKAIVERLRRAYQ

SEQ ID NO: 2102924 - protein, 19 aa, Staphylococcus
DDFVYAWRKVVDPKTASEF

SEQ ID NO: 2102925 - protein, 20 aa, Staphylococcus
DDGKLVYDITLQKGKEQRDI

SEQ ID NO: 2102926 - protein, 18 aa, Staphylococcus
DDIDGWKSVSKESIVKHN

SEQ ID NO: 2102927 - protein, 17 aa, Staphylococcus
DDIEMLQDLVLAATNEA

SEQ ID NO: 2102928 - protein, 25 aa, Staphylococcus
DDINPSVLAHYWGGDKLNIRQDLEE

SEQ ID NO: 2102929 - protein, 17 aa, Staphylococcus
DDKRPAYSNQVANAEDI

SEQ ID NO: 2102930 - protein, 19 aa, Staphylococcus
DDLKSYRLARDIKDQIEEE

SEQ ID NO: 2102931 - protein, 18 aa, Staphylococcus
DDNQRAGVDANYYAKQVY

SEQ ID NO: 2102932 - protein, 26 aa, Staphylococcus
DDSKHKLQYKKRYAISNHDVSSAIQQ

SEQ ID NO: 2102933 - protein, 19 aa, Staphylococcus
DDVKMVGHSGDWIVNYRNK

SEQ ID NO: 2102934 - protein, 24 aa, Staphylococcus
DDVTANDFVYAWRKVVNPKTGSEY

SEQ ID NO: 2102935 - protein, 17 aa, Staphylococcus
DDYKEQKKLSAYQKQLL

SEQ ID NO: 2102936 - protein, 20 aa, Staphylococcus
DEAAIVKCNLWLRTADRIKI

SEQ ID NO: 2102937 - protein, 26 aa, Staphylococcus
DEAGKFLWETLRNNFYYSAKNVPKAS

SEQ ID NO: 2102938 - protein, 22 aa, Staphylococcus
DEEKATAIAKVNSELAKVQQQI

SEQ ID NO: 2102939 - protein, 24 aa, Staphylococcus
DEFPPIRTGNDYRIDTTRTDNNVY

SEQ ID NO: 2102940 - protein, 25 aa, Staphylococcus
DEFQLRARLFVDQIVSFVNNSPYDH

SEQ ID NO: 2102941 - protein, 21 aa, Staphylococcus
DEILSRYGKNANYYIETKSPD

SEQ ID NO: 2102942 - protein, 23 aa, Staphylococcus
DEISRPGPRIDEGLKQLRDAIYK

SEQ ID NO: 2102943 - protein, 17 aa, Staphylococcus
DELSLGMDTQWMNRAGD

SEQ ID NO: 2102944 - protein, 18 aa, Staphylococcus
DELTEFESAYAPPFSSPK

SEQ ID NO: 2102945 - protein, 22 aa, Staphylococcus
DELTEFEVAYAPPYSHPKDLIN

SEQ ID NO: 2102946 - protein, 23 aa, Staphylococcus
DELTEFEVAYAPPYSHPKDLINM

SEQ ID NO: 2102947 - protein, 19 aa, Staphylococcus
DEMKRLAGDKKVLFYSYEN

SEQ ID NO: 2102948 - protein, 21 aa, Staphylococcus
DENYFKSIEIFYNSFKDLENV

SEQ ID NO: 2102949 - protein, 19 aa, Staphylococcus
DERVIKHYGSLVPLTELEE

SEQ ID NO: 2102950 - protein, 25 aa, Staphylococcus
DESAIVKCNLWLRTADRVKIVVGRF

SEQ ID NO: 2102951 - protein, 24 aa, Staphylococcus
DESTRYPNIFLIGATVENDHAKLC

SEQ ID NO: 2102952 - protein, 23 aa, Staphylococcus
DETTLKYYVCTSEDMSEWKEYDY

SEQ ID NO: 2102953 - protein, 26 aa, Staphylococcus
DEVAEAFTATIPYKGHLIVMKDDYTD

SEQ ID NO: 2102954 - protein, 17 aa, Staphylococcus
DEVDPEYNAKDKAQQEQ

SEQ ID NO: 2102955 - protein, 17 aa, Staphylococcus
DEVKKMFQKEFKQNDIW

SEQ ID NO: 2102956 - protein, 20 aa, Staphylococcus
DEVMYWKDVIEEIRRNNPEL

SEQ ID NO: 2102957 - protein, 23 aa, Staphylococcus
DFEEMKKWIPLMMEGRENNGGVM

SEQ ID NO: 2102958 - protein, 20 aa, Staphylococcus
DFENGLLHLSKSVFPTDNFL

SEQ ID NO: 2102959 - protein, 21 aa, Staphylococcus
DFFRQRLGDEVLENLIEPLMG

SEQ ID NO: 2102960 - protein, 20 aa, Staphylococcus
DFFVACQFHPEFLSRPNRPQ

SEQ ID NO: 2102961 - protein, 20 aa, Staphylococcus
DFIEAPLFFNSEEQIALCHA

SEQ ID NO: 2102962 - protein, 24 aa, Staphylococcus
DFLDHRVIKHYGSLVPLTELSDSL

SEQ ID NO: 2102963 - protein, 20 aa, Staphylococcus
DFSTASLLVSHFSNDPKTNI

SEQ ID NO: 2102964 - protein, 34 aa, Staphylococcus
DFYCFPDHKWLYGPEGLGFLFVRKNIQKDLDIIF

SEQ ID NO: 2102965 - protein, 17 aa, Staphylococcus
DGAREIIGLSLNKLGYS

SEQ ID NO: 2102966 - protein, 20 aa, Staphylococcus
DGDAAMRFIRSRKEEGAGGD

SEQ ID NO: 2102967 - protein, 19 aa, Staphylococcus
DGEVTGVRFFEIKDDKKPI

SEQ ID NO: 2102968 - protein, 18 aa, Staphylococcus
DGFKEQDNGTLLKNLTTW

SEQ ID NO: 2102969 - protein, 19 aa, Staphylococcus
DGFLACGYIAKGRMEEPLQ

SEQ ID NO: 2102970 - protein, 24 aa, Staphylococcus
DGFLACGYVAKGRMEEPLEILNVI

SEQ ID NO: 2102971 - protein, 20 aa, Staphylococcus
DGGLKFVKGDNIDLNNPRTY

SEQ ID NO: 2102972 - protein, 17 aa, Staphylococcus
DGKHVLTTLTYKNNKVI

SEQ ID NO: 2102973 - protein, 19 aa, Staphylococcus
DGKIKPYLVKSYEQPSDDT

SEQ ID NO: 2102974 - protein, 20 aa, Staphylococcus
DGKPHILYRANPMVENGGED

SEQ ID NO: 2102975 - protein, 17 aa, Staphylococcus
DGLRSLKDPERYNQPAH

SEQ ID NO: 2102976 - protein, 20 aa, Staphylococcus
DGLSELLNQLFSNNKMKQTS

SEQ ID NO: 2102977 - protein, 26 aa, Staphylococcus
DGLSSGEKQTMYAIENNQYEVEDAEQ

SEQ ID NO: 2102978 - protein, 19 aa, Staphylococcus
DGMGPAYNSAYRYYADNPN

SEQ ID NO: 2102979 - protein, 36 aa, Staphylococcus
DGNPTIYKSSWKNIAPSYRSATRHLSQTYATDPNYA

SEQ ID NO: 2102980 - protein, 26 aa, Staphylococcus
DGQGTVWTHYAISKYLGGTDHSDPHA

SEQ ID NO: 2102981 - protein, 19 aa, Staphylococcus
DGQHFSWNYTAAGSNASAQ

SEQ ID NO: 2102982 - protein, 19 aa, Staphylococcus
DGQRINIKKGKKVQLAQQI

SEQ ID NO: 2102983 - protein, 19 aa, Staphylococcus
DGQTWSWNYTTAGAQSASS

SEQ ID NO: 2102984 - protein, 20 aa, Staphylococcus
DGRIHPGRIEDMVDKARKEV

SEQ ID NO: 2102985 - protein, 19 aa, Staphylococcus
DGRIHPGRIEDMVEKARKE

SEQ ID NO: 2102986 - protein, 20 aa, Staphylococcus
DGRIHPGRIEDMVEKARKEV

SEQ ID NO: 2102987 - protein, 19 aa, Staphylococcus
DGSINVYKNVPYDWRDSRT

SEQ ID NO: 2102988 - protein, 17 aa, Staphylococcus
DGSSTVGPIIEKLNEKF

SEQ ID NO: 2102989 - protein, 27 aa, Staphylococcus
DGSTDRISISNAITYEPIRKSIYADGN

SEQ ID NO: 2102990 - protein, 22 aa, Staphylococcus
DGTTCTVGGCTSADGKSVPDEH

SEQ ID NO: 2102991 - protein, 23 aa, Staphylococcus
DGVSLYKISGFRSYETQVNLYNQ

SEQ ID NO: 2102992 - protein, 20 aa, Staphylococcus
DGYDGVLIPGGFSFGDYLRS

SEQ ID NO: 2102993 - protein, 22 aa, Staphylococcus
DGYKPKELTVQFVPSQNADTLE

SEQ ID NO: 2102994 - protein, 24 aa, Staphylococcus
DGYLACGYVAKGRMEEPLQIVKVL

SEQ ID NO: 2102995 - protein, 24 aa, Staphylococcus
DGYLACGYVAKGRMEEPLQIVSVI

SEQ ID NO: 2102996 - protein, 24 aa, Staphylococcus
DGYLACGYVAKGRMEEPLQIVSVV

SEQ ID NO: 2102997 - protein, 20 aa, Staphylococcus
DHAKKLAALVNEESKAKQWI

SEQ ID NO: 2102998 - protein, 17 aa, Staphylococcus
DHAQEFVTPLAFQAIGR

SEQ ID NO: 2102999 - protein, 18 aa, Staphylococcus
DHVNVGLAVPKYVQNIDS

SEQ ID NO: 2103000 - protein, 25 aa, Staphylococcus
DIARKYFLERTFRKPSEFYNPIALY

SEQ ID NO: 2103001 - protein, 18 aa, Staphylococcus
DIDMNAFQHFAFLDQYKK

SEQ ID NO: 2103002 - protein, 18 aa, Staphylococcus
DIDMNAFQHFAFLNEYKK

SEQ ID NO: 2103003 - protein, 18 aa, Staphylococcus
DIDREKEKQLAIIERRAQ

SEQ ID NO: 2103004 - protein, 22 aa, Staphylococcus
DIDRLSLMSTFPEFKEREEQYG

SEQ ID NO: 2103005 - protein, 25 aa, Staphylococcus
DIETLRKWVPLMMEGRVDDGKMAAS

SEQ ID NO: 2103006 - protein, 19 aa, Staphylococcus
DIGYFCVDNLPPVLLPKFV

SEQ ID NO: 2103007 - protein, 34 aa, Staphylococcus
DIKKARKNGSKWIILNLHKPMYSKSYHALTDEDI

SEQ ID NO: 2103008 - protein, 23 aa, Staphylococcus
DIKMLKDPEKIYGKDDEHINLVF

SEQ ID NO: 2103009 - protein, 25 aa, Staphylococcus
DIKPFLKTRLISPIGKLRAGLDLVI

SEQ ID NO: 2103010 - protein, 37 aa, Staphylococcus
DIKPFLKTRLISPLGKLRAGLDLVIPPIKIENDISVG

SEQ ID NO: 2103011 - protein, 17 aa, Staphylococcus
DILSMIDLTAYKASKIS

SEQ ID NO: 2103012 - protein, 24 aa, Staphylococcus
DINPAVLSHYWGGDKMNIRQDLEE

SEQ ID NO: 2103013 - protein, 24 aa, Staphylococcus
DINPSVLAHYWGGDKMNIRQDLEE

SEQ ID NO: 2103014 - protein, 26 aa, Staphylococcus
DIPAMNGAAGFHLDKVLKQNGTGNGI

SEQ ID NO: 2103015 - protein, 17 aa, Staphylococcus
DITAAFDKIETGYQEKD

SEQ ID NO: 2103016 - protein, 18 aa, Staphylococcus
DITRIASSNAEMWKDILL

SEQ ID NO: 2103017 - protein, 18 aa, Staphylococcus
DITRIASSNAEMWKDITL

SEQ ID NO: 2103018 - protein, 18 aa, Staphylococcus
DITRIASSNAEMWRDITI

SEQ ID NO: 2103019 - protein, 29 aa, Staphylococcus
DITRIASSNPIMWRDITIENKNTILRILK

SEQ ID NO: 2103020 - protein, 32 aa, Staphylococcus
DIYKPTWKSEAYSYRSATMHLATTYATDSQYA

SEQ ID NO: 2103021 - protein, 20 aa, Staphylococcus
DKAKVSLAVPKYMDDVDSID

SEQ ID NO: 2103022 - protein, 18 aa, Staphylococcus
DKATELNTAMSQLQDGIA

SEQ ID NO: 2103023 - protein, 20 aa, Staphylococcus
DKAVALFLKECEDYEIDFQK

SEQ ID NO: 2103024 - protein, 26 aa, Staphylococcus
DKENKNALLFEWSRLNEMLDNQLYLV

SEQ ID NO: 2103025 - protein, 17 aa, Staphylococcus
DKFRAGASGSLMVNGNY

SEQ ID NO: 2103026 - protein, 17 aa, Staphylococcus
DKGELPFQSEADLKRIK

SEQ ID NO: 2103027 - protein, 17 aa, Staphylococcus
DKIEPLISKQIEDLNQS

SEQ ID NO: 2103028 - protein, 28 aa, Staphylococcus
DKILGVDLRGTFLMTKFLLPLMMDEGGS

SEQ ID NO: 2103029 - protein, 20 aa, Staphylococcus
DKIMGVDMRGTFLVTKFLLP

SEQ ID NO: 2103030 - protein, 25 aa, Staphylococcus
DKIYYKRGFNAKAYVEQHKPDYKDI

SEQ ID NO: 2103031 - protein, 23 aa, Staphylococcus
DKKAGEYHKKFQVKGIDDDVSYS

SEQ ID NO: 2103032 - protein, 20 aa, Staphylococcus
DKKDMPSLDKYNHTIHSDDQ

SEQ ID NO: 2103033 - protein, 21 aa, Staphylococcus
DKKWLTEQFLDNEIDKLDITT

SEQ ID NO: 2103034 - protein, 21 aa, Staphylococcus
DKLDEVISIVGKNAKHNLTKS

SEQ ID NO: 2103035 - protein, 24 aa, Staphylococcus
DKLDPHAWLSLDNGIQYVKNIQQA

SEQ ID NO: 2103036 - protein, 17 aa, Staphylococcus
DKLKLGVDSSWLNREGD

SEQ ID NO: 2103037 - protein, 23 aa, Staphylococcus
DKLNSIIKHYDLTQFDKKQMPDL

SEQ ID NO: 2103038 - protein, 17 aa, Staphylococcus
DKNKAFQALKLLPNDKN

SEQ ID NO: 2103039 - protein, 19 aa, Staphylococcus
DKQLKVIAKQSAKFDRAEG

SEQ ID NO: 2103040 - protein, 19 aa, Staphylococcus
DKTKMAGYISVPDAEIKEP

SEQ ID NO: 2103041 - protein, 27 aa, Staphylococcus
DLASSPHFNLFGIKGAYEGQSATFNTL

SEQ ID NO: 2103042 - protein, 18 aa, Staphylococcus
DLEKSGSVNTRYRNEVYQ

SEQ ID NO: 2103043 - protein, 20 aa, Staphylococcus
DLGIKALDSHTLKIDLEKPI

SEQ ID NO: 2103044 - protein, 20 aa, Staphylococcus
DLKDKIALFCDIDKESVIEC

SEQ ID NO: 2103045 - protein, 17 aa, Staphylococcus
DLKSYRLARDIKNQIEE

SEQ ID NO: 2103046 - protein, 17 aa, Staphylococcus
DLKSYRLARDIKTQIED

SEQ ID NO: 2103047 - protein, 19 aa, Staphylococcus
DLLGRLNFKLVKNAKGVKV

SEQ ID NO: 2103048 - protein, 24 aa, Staphylococcus
DLLKKDYKDALAIPNPSESGTALD

SEQ ID NO: 2103049 - protein, 24 aa, Staphylococcus
DLNQARTNLTLDRQPTLTTLQNAT

SEQ ID NO: 2103050 - protein, 19 aa, Staphylococcus
DLQKRGEVISEVMQEPTKS

SEQ ID NO: 2103051 - protein, 17 aa, Staphylococcus
DLRKELVKYYKSGLTLD

SEQ ID NO: 2103052 - protein, 20 aa, Staphylococcus
DLSDEWRNKIAKAFINVSKK

SEQ ID NO: 2103053 - protein, 25 aa, Staphylococcus
DLSDKTRIALAFFADKKGEYLITKE

SEQ ID NO: 2103054 - protein, 19 aa, Staphylococcus
DLTHKITVDGHVDTSKVGK

SEQ ID NO: 2103055 - protein, 21 aa, Staphylococcus
DLVGLDIAVSVIKGLQQDPDE

SEQ ID NO: 2103056 - protein, 18 aa, Staphylococcus
DLYHKYGKDSDYKKVAKQ

SEQ ID NO: 2103057 - protein, 21 aa, Staphylococcus
DMRGTFLVTKFLLPLMMEQGG

SEQ ID NO: 2103058 - protein, 25 aa, Staphylococcus
DNADNWKNNVGNFTKTAVVTLPNGQ

SEQ ID NO: 2103059 - protein, 22 aa, Staphylococcus
DNAELFYRHEVQDFSRRKDGKW

SEQ ID NO: 2103060 - protein, 18 aa, Staphylococcus
DNDPVVNGILWQEILNKP

SEQ ID NO: 2103061 - protein, 17 aa, Staphylococcus
DNDVMREFIKFTLEDKG

SEQ ID NO: 2103062 - protein, 32 aa, Staphylococcus
DNDWEITGIPSSLRIENAAGRTNNNSERNLEL

SEQ ID NO: 2103063 - protein, 17 aa, Staphylococcus
DNKAFQEFMKFTLEDKG

SEQ ID NO: 2103064 - protein, 22 aa, Staphylococcus
DNKGNPGLDVFVVRENTSDRSA

SEQ ID NO: 2103065 - protein, 24 aa, Staphylococcus
DNKLNVYTTVFAFQSFIEQIGGKY

SEQ ID NO: 2103066 - protein, 19 aa, Staphylococcus
DNNALKVVMHFEAQEAEAF

SEQ ID NO: 2103067 - protein, 24 aa, Staphylococcus
DNNMVFPGQVITVGGSASQSSSSN

SEQ ID NO: 2103068 - protein, 21 aa, Staphylococcus
DNPSIKAGQNYLDASNSNQND

SEQ ID NO: 2103069 - protein, 25 aa, Staphylococcus
DNPTYLPRFVFGHYMKSYLSKFDEQ

SEQ ID NO: 2103070 - protein, 25 aa, Staphylococcus
DNTKTHWSSYRFIQKSSNGTELQTK

SEQ ID NO: 2103071 - protein, 18 aa, Staphylococcus
DNVAIALGVAQAVGVEKD

SEQ ID NO: 2103072 - protein, 19 aa, Staphylococcus
DNVNRIIKYFHALNSTIAN

SEQ ID NO: 2103073 - protein, 24 aa, Staphylococcus
DNVNRVKVQFLPNNDIMTDTRRVA

SEQ ID NO: 2103074 - protein, 23 aa, Staphylococcus
DPASVPRNYDIIGSATPTSTSNS

SEQ ID NO: 2103075 - protein, 20 aa, Staphylococcus
DPESPWHDCNTKINLIGKNN

SEQ ID NO: 2103076 - protein, 31 aa, Staphylococcus
DPHQLKILYMHGGSWVAGPFKEHYQMMDQLA

SEQ ID NO: 2103077 - protein, 17 aa, Staphylococcus
DPISILFLGIDDNEGRE

SEQ ID NO: 2103078 - protein, 28 aa, Staphylococcus
DPMSYAKTPSLYVGGFYDPSLPTNRYRG

SEQ ID NO: 2103079 - protein, 20 aa, Staphylococcus
DPSYPIGYHFDLHLGTTEYE

SEQ ID NO: 2103080 - protein, 21 aa, Staphylococcus
DQADAAYEWQMGQYGNEGNRK

SEQ ID NO: 2103081 - protein, 26 aa, Staphylococcus
DQGPAFPFAECGAMSQAYIGYQLQES

SEQ ID NO: 2103082 - protein, 17 aa, Staphylococcus
DQLEKALSIGIIDKKIE

SEQ ID NO: 2103083 - protein, 19 aa, Staphylococcus
DQLIILTAIDYVYVNYNTD

SEQ ID NO: 2103084 - protein, 23 aa, Staphylococcus
DQLKSDLLFHKSLQIEQRDSSSY

SEQ ID NO: 2103085 - protein, 22 aa, Staphylococcus
DQLRKASLTTFDPATGEVKQAQ

SEQ ID NO: 2103086 - protein, 29 aa, Staphylococcus
DQQGNYHYTWKGNWSPDRLNHTNDSNHSQ

SEQ ID NO: 2103087 - protein, 25 aa, Staphylococcus
DQQGQYHYTWQGNWNPSNSDQGHTS

SEQ ID NO: 2103088 - protein, 34 aa, Staphylococcus
DQQNMRFSFVGSGNMPPNLHIVGSQTRVVRVTYA

SEQ ID NO: 2103089 - protein, 19 aa, Staphylococcus
DQYIHGEVANALDRKTEIE

SEQ ID NO: 2103090 - protein, 17 aa, Staphylococcus
DRGTLESVIYGNYSETA

SEQ ID NO: 2103091 - protein, 17 aa, Staphylococcus
DRIRVVVEVLPLTNFVP

SEQ ID NO: 2103092 - protein, 21 aa, Staphylococcus
DRKTKIVDVIDRVLHIDHVES

SEQ ID NO: 2103093 - protein, 26 aa, Staphylococcus
DRQGRLLNEYAYRLDAIPKSPGKGKE

SEQ ID NO: 2103094 - protein, 18 aa, Staphylococcus
DSAEYDGVGTVWTHQAVS

SEQ ID NO: 2103095 - protein, 18 aa, Staphylococcus
DSAVFKEDVVKLKAPMRV

SEQ ID NO: 2103096 - protein, 19 aa, Staphylococcus
DSDAVKNSTSIPFNIDAYM

SEQ ID NO: 2103097 - protein, 24 aa, Staphylococcus
DSDSFHASGIFPSTDKSFYNKFKS

SEQ ID NO: 2103098 - protein, 18 aa, Staphylococcus
DSFNRFVNIVKDGRDMPE

SEQ ID NO: 2103099 - protein, 23 aa, Staphylococcus
DSLSRIANKYGTSVTDLMNANNF

SEQ ID NO: 2103100 - protein, 19 aa, Staphylococcus
DSLWSIANKYNMPVDELKR

SEQ ID NO: 2103101 - protein, 33 aa, Staphylococcus
DSPYPHGQCTWYVYNRMAQFDKYVSGDLGDARN

SEQ ID NO: 2103102 - protein, 18 aa, Staphylococcus
DSQIPMNVLNHSILSGVA

SEQ ID NO: 2103103 - protein, 26 aa, Staphylococcus
DSSDDLRLGKFLKLSPDEILKKMNHL

SEQ ID NO: 2103104 - protein, 21 aa, Staphylococcus
DSSWFSKELGVKMLKDPDKIY

SEQ ID NO: 2103105 - protein, 20 aa, Staphylococcus
DSVEKAIVGGAQFIGQSYVK

SEQ ID NO: 2103106 - protein, 31 aa, Staphylococcus
DSVSKAIIGGAKFIGNSYVKAGQNTLYKMRW

SEQ ID NO: 2103107 - protein, 31 aa, Staphylococcus
DSVSKAIVGGAKFIGQSYVKAGQNTLYKMRW

SEQ ID NO: 2103108 - protein, 22 aa, Staphylococcus
DSYLKKIIKALVKEGLVNSSTG

SEQ ID NO: 2103109 - protein, 22 aa, Staphylococcus
DTKLKYYVCTCEDDKEWREYDY

SEQ ID NO: 2103110 - protein, 23 aa, Staphylococcus
DTKRWKNEVEPIIGKTDVFIYPH

SEQ ID NO: 2103111 - protein, 23 aa, Staphylococcus
DTTPKTHSAVVFEAGQAGASSYY

SEQ ID NO: 2103112 - protein, 25 aa, Staphylococcus
DTVSKAIVGGAQFIKDAYINQGQNT

SEQ ID NO: 2103113 - protein, 19 aa, Staphylococcus
DVAKEFWGKQGRVGIVPLI

SEQ ID NO: 2103114 - protein, 18 aa, Staphylococcus
DVDAAAVFQDARTIVKKD

SEQ ID NO: 2103115 - protein, 26 aa, Staphylococcus
DVDGILVPGGFGFRASEGKIAAIKYA

SEQ ID NO: 2103116 - protein, 26 aa, Staphylococcus
DVDSSWPNKEIKAFSPNSSHGTYDFW

SEQ ID NO: 2103117 - protein, 20 aa, Staphylococcus
DVDVSFNYGGSGALRQQIEK

SEQ ID NO: 2103118 - protein, 24 aa, Staphylococcus
DVGNEAFIRQVLYDNMKLQGNKYS

SEQ ID NO: 2103119 - protein, 18 aa, Staphylococcus
DVILGGGSKYFGKENGHL

SEQ ID NO: 2103120 - protein, 18 aa, Staphylococcus
DVILGGGSKYFGKENGNL

SEQ ID NO: 2103121 - protein, 18 aa, Staphylococcus
DVILGGGSKYFGKNNGNL

SEQ ID NO: 2103122 - protein, 24 aa, Staphylococcus
DVIPDAYCCALVLREDLINQHHHT

SEQ ID NO: 2103123 - protein, 21 aa, Staphylococcus
DVKEAEKLLKEAGYHKNSDGI

SEQ ID NO: 2103124 - protein, 18 aa, Staphylococcus
DVKMLKDPDKIYGNNKQH

SEQ ID NO: 2103125 - protein, 18 aa, Staphylococcus
DVKRELRSGDAYDSELDK

SEQ ID NO: 2103126 - protein, 17 aa, Staphylococcus
DVLKKPQAKEEIASKVN

SEQ ID NO: 2103127 - protein, 24 aa, Staphylococcus
DVNPKWPSKEIKAYSPDQSHGTYD

SEQ ID NO: 2103128 - protein, 25 aa, Staphylococcus
DVNSSWPDKKIKAFSPNSSHGTYDF

SEQ ID NO: 2103129 - protein, 25 aa, Staphylococcus
DVNSSWPNKKIKAFSPDQSHGTYDF

SEQ ID NO: 2103130 - protein, 25 aa, Staphylococcus
DVTFANCGLPYYLGNIIDDRSELLH

SEQ ID NO: 2103131 - protein, 18 aa, Staphylococcus
DVVYELLDQSGLNPHKSE

SEQ ID NO: 2103132 - protein, 17 aa, Staphylococcus
DWDHVDFVGQDSSDTVR

SEQ ID NO: 2103133 - protein, 36 aa, Staphylococcus
DWGQCTWHAFNRRAQIGKGISTYWWNANNWDDGARA

SEQ ID NO: 2103134 - protein, 18 aa, Staphylococcus
DWIDKDGYYYGFSGSALG

SEQ ID NO: 2103135 - protein, 21 aa, Staphylococcus
DYAAVDLMKAFGVQDTIKALP

SEQ ID NO: 2103136 - protein, 19 aa, Staphylococcus
DYFKMKPVGLIGNSGGIVS

SEQ ID NO: 2103137 - protein, 18 aa, Staphylococcus
DYGFKFDSARPMQIGLVY

SEQ ID NO: 2103138 - protein, 23 aa, Staphylococcus
DYSCSACLMYIGIDQDLRDNLLL

SEQ ID NO: 2103139 - protein, 23 aa, Staphylococcus
DYVKEVSNQFGFVNIGVQNYEAD

SEQ ID NO: 2103140 - protein, 19 aa, Staphylococcus
DYVKRVIGVPGDKVQYKKD

SEQ ID NO: 2103141 - protein, 31 aa, Staphylococcus
DYVKRVQKSKLWKSKDNGFNDLTRDGATDLN

SEQ ID NO: 2103142 - protein, 24 aa, Staphylococcus
EAAGLIKLKDNFGLSGSIKDIKDN

SEQ ID NO: 2103143 - protein, 28 aa, Staphylococcus
EADLKRIKSYAVGVGPEYTDLNEKNTKH

SEQ ID NO: 2103144 - protein, 29 aa, Staphylococcus
EAFEAEIKWLKAHGAHFLTEKEFQHYKEK

SEQ ID NO: 2103145 - protein, 20 aa, Staphylococcus
EAGKAFRDNQKWVTPLGRLG

SEQ ID NO: 2103146 - protein, 18 aa, Staphylococcus
EAIDKAFEAISMSSDKAK

SEQ ID NO: 2103147 - protein, 18 aa, Staphylococcus
EAKALGFAEADPTDDVEG

SEQ ID NO: 2103148 - protein, 21 aa, Staphylococcus
EAKKIMAAQGYTKAHPLKLTV

SEQ ID NO: 2103149 - protein, 20 aa, Staphylococcus
EAKSGELIRSITYPNFNNFK

SEQ ID NO: 2103150 - protein, 22 aa, Staphylococcus
EAKTLKKDYLATVKQKRAKINE

SEQ ID NO: 2103151 - protein, 24 aa, Staphylococcus
EALIIRKNLKNVYHEDGLFHLQYE

SEQ ID NO: 2103152 - protein, 21 aa, Staphylococcus
EALLKVKPDLILAHESQKGTS

SEQ ID NO: 2103153 - protein, 21 aa, Staphylococcus
EANAKVAKQNGYTGEANGDMG

SEQ ID NO: 2103154 - protein, 31 aa, Staphylococcus
EANEYRLSDSRPLPPIYGGPEGMRYFEASPP

SEQ ID NO: 2103155 - protein, 22 aa, Staphylococcus
EANIPFKKREQQAMLNFVEKGG

SEQ ID NO: 2103156 - protein, 19 aa, Staphylococcus
EARAVRSSRRPVRGQGGTR

SEQ ID NO: 2103157 - protein, 22 aa, Staphylococcus
EATDKMKLFRVGQTVTADGVDI

SEQ ID NO: 2103158 - protein, 27 aa, Staphylococcus
EATLNVPVDFYVRINMEAFVQAVDELG

SEQ ID NO: 2103159 - protein, 26 aa, Staphylococcus
EATNDGFRYVFSFKDASKDNSYSIVT

SEQ ID NO: 2103160 - protein, 21 aa, Staphylococcus
EATVTIARGQQFEFGDLKQYF

SEQ ID NO: 2103161 - protein, 18 aa, Staphylococcus
EAVKGNEGKTVYISHDSI

SEQ ID NO: 2103162 - protein, 18 aa, Staphylococcus
EAVRRRANEVLSNDRATN

SEQ ID NO: 2103163 - protein, 23 aa, Staphylococcus
EAYPELVSELASPFSAIYDTKAD

SEQ ID NO: 2103164 - protein, 19 aa, Staphylococcus
EDADAVIINSNFAIDQKLS

SEQ ID NO: 2103165 - protein, 17 aa, Staphylococcus
EDAGRGYRRVVPSPQPK

SEQ ID NO: 2103166 - protein, 42 aa, Staphylococcus
EDAKFLPNKILNIKYKLRPVNIPTPRQVTVNQSITYKTYAQY

SEQ ID NO: 2103167 - protein, 21 aa, Staphylococcus
EDDKPNIAIVYGVKKKTDKED

SEQ ID NO: 2103168 - protein, 25 aa, Staphylococcus
EDIEEMRKWIPLMMKGHNSSDIMAA

SEQ ID NO: 2103169 - protein, 25 aa, Staphylococcus
EDIEVMRKWIPLMMKGRQNDDGYMA

SEQ ID NO: 2103170 - protein, 25 aa, Staphylococcus
EDIEVMRKWIPLMMQGRVDDGKMAA

SEQ ID NO: 2103171 - protein, 24 aa, Staphylococcus
EDIPAETKNGGLLLKQNDTNGERI

SEQ ID NO: 2103172 - protein, 19 aa, Staphylococcus
EDIPRCIYTRLESASVGLS

SEQ ID NO: 2103173 - protein, 18 aa, Staphylococcus
EDKIMLSKNDKYWDRDKV

SEQ ID NO: 2103174 - protein, 19 aa, Staphylococcus
EDNVEIFVPMVQKIVDQGF

SEQ ID NO: 2103175 - protein, 17 aa, Staphylococcus
EDRGSILYNGKRLGEGM

SEQ ID NO: 2103176 - protein, 20 aa, Staphylococcus
EDTYHTPLSVFNMNGSNHSF

SEQ ID NO: 2103177 - protein, 19 aa, Staphylococcus
EDVQDAAAVKLYNTAGASQ

SEQ ID NO: 2103178 - protein, 19 aa, Staphylococcus
EDYENGLISEDEAMERDEQ

SEQ ID NO: 2103179 - protein, 17 aa, Staphylococcus
EDYRISPINGDLEGLGR

SEQ ID NO: 2103180 - protein, 29 aa, Staphylococcus
EDYTSYFPKYGYRNGVGKPEGIVVHDTAN

SEQ ID NO: 2103181 - protein, 36 aa, Staphylococcus
EEDYSSYFPKYGYRNGVGRPEGIVVHDTANENSTIT

SEQ ID NO: 2103182 - protein, 23 aa, Staphylococcus
EEFEISKQFWAHLVKTNAISNPR

SEQ ID NO: 2103183 - protein, 18 aa, Staphylococcus
EEFWKWYQEQSEFKFDNP

SEQ ID NO: 2103184 - protein, 18 aa, Staphylococcus
EEFWKWYQHQQVFDFDNP

SEQ ID NO: 2103185 - protein, 31 aa, Staphylococcus
EEHYTSYFPKYGYRNGVGKPEGIVVHDTAND

SEQ ID NO: 2103186 - protein, 22 aa, Staphylococcus
EEIEYARVWNQLGPLKNNMDGM

SEQ ID NO: 2103187 - protein, 21 aa, Staphylococcus
EEIKSQLPLHKSLKVSEHSAD

SEQ ID NO: 2103188 - protein, 23 aa, Staphylococcus
EEIYRIDHYLGKDMVQNIEVLRF

SEQ ID NO: 2103189 - protein, 24 aa, Staphylococcus
EELKRFKEKWSYLNSGMNNLFGSD

SEQ ID NO: 2103190 - protein, 21 aa, Staphylococcus
EEMRKWVPLMMEGHSSSDIMA

SEQ ID NO: 2103191 - protein, 31 aa, Staphylococcus
EENYSSYFPKYGYRNGVGKPEGIVVHDTAND

SEQ ID NO: 2103192 - protein, 36 aa, Staphylococcus
EENYTSYFPKYGYRYGVGRPEGIVVHDTANENSTID

SEQ ID NO: 2103193 - protein, 21 aa, Staphylococcus
EEQFRKGILPILKKEGYDVKI

SEQ ID NO: 2103194 - protein, 27 aa, Staphylococcus
EESNLPKKRSRRDLPAGDSNNANTATT

SEQ ID NO: 2103195 - protein, 21 aa, Staphylococcus
EETLKSVYLYVKPELQNNIGF

SEQ ID NO: 2103196 - protein, 24 aa, Staphylococcus
EFADYKCPYCKKVEDNIMPKLEKD

SEQ ID NO: 2103197 - protein, 22 aa, Staphylococcus
EFDIELSCFSEFDVDLSDVESV

SEQ ID NO: 2103198 - protein, 20 aa, Staphylococcus
EFEISKQFWGHLVKSGSIDN

SEQ ID NO: 2103199 - protein, 19 aa, Staphylococcus
EFTYNGKIIQALDLVETSR

SEQ ID NO: 2103200 - protein, 19 aa, Staphylococcus
EGAINAGGYDNAKVTKLID

SEQ ID NO: 2103201 - protein, 20 aa, Staphylococcus
EGAKIGEPVQNLLKSNDVSV

SEQ ID NO: 2103202 - protein, 20 aa, Staphylococcus
EGFESGLLELSKEVFPTDKY

SEQ ID NO: 2103203 - protein, 37 aa, Staphylococcus
EGGRIWTYKDGKPWYFLEEKYPDYGNLVPRDIATREI

SEQ ID NO: 2103204 - protein, 18 aa, Staphylococcus
EGKIKPSLINNLGSSTIQ

SEQ ID NO: 2103205 - protein, 20 aa, Staphylococcus
EGNAGLSLYSSTKFAVRGLT

SEQ ID NO: 2103206 - protein, 27 aa, Staphylococcus
EGNPTIYKPTWKSEALTYKEATSHLSH

SEQ ID NO: 2103207 - protein, 20 aa, Staphylococcus
EGPASAAYESSLRVESGQEK

SEQ ID NO: 2103208 - protein, 19 aa, Staphylococcus
EGSNLWFDNMVIPRTAQNK

SEQ ID NO: 2103209 - protein, 17 aa, Staphylococcus
EGTELTGKYTKETNDYL

SEQ ID NO: 2103210 - protein, 19 aa, Staphylococcus
EGTLAYDIYGKKEIEERHR

SEQ ID NO: 2103211 - protein, 29 aa, Staphylococcus
EGTTYHFASDGTYFEWQYYPSNGAADDTT

SEQ ID NO: 2103212 - protein, 25 aa, Staphylococcus
EGVAKLKPDLILTYDVNTKIKKYQK

SEQ ID NO: 2103213 - protein, 19 aa, Staphylococcus
EGVDVVLGMHPHVIQPVKW

SEQ ID NO: 2103214 - protein, 27 aa, Staphylococcus
EGVEKAFAIQAGREIRVIVSPDTIDDL

SEQ ID NO: 2103215 - protein, 22 aa, Staphylococcus
EGVFHFCAYSLVGESVEKPLEY

SEQ ID NO: 2103216 - protein, 26 aa, Staphylococcus
EGVYPEWQPGQKVHLVGHSMGGQTIR

SEQ ID NO: 2103217 - protein, 25 aa, Staphylococcus
EGYYEYRTNKGLLVVTAVGKKNQGY

SEQ ID NO: 2103218 - protein, 17 aa, Staphylococcus
EHFRVNRAFICGDAGHI

SEQ ID NO: 2103219 - protein, 18 aa, Staphylococcus
EHHIKHLLVETSVDKKAM

SEQ ID NO: 2103220 - protein, 17 aa, Staphylococcus
EHIKPLIQKQIKDLNQT

SEQ ID NO: 2103221 - protein, 24 aa, Staphylococcus
EHIKRTYPRLKITGAPFEAVGLPD

SEQ ID NO: 2103222 - protein, 19 aa, Staphylococcus
EHLYHLGWITKLRDDNDQR

SEQ ID NO: 2103223 - protein, 26 aa, Staphylococcus
EHYYEFKKDNGVLVVTADGKKNNGKI

SEQ ID NO: 2103224 - protein, 24 aa, Staphylococcus
EHYYEFRTHKGVLLVTADGKKDRG

SEQ ID NO: 2103225 - protein, 21 aa, Staphylococcus
EHYYEYRTSKGVLVVTANGQK

SEQ ID NO: 2103226 - protein, 19 aa, Staphylococcus
EIKNQIIAFEKMINSNNDE

SEQ ID NO: 2103227 - protein, 25 aa, Staphylococcus
EILGTYKLQGKKMIKEDQNGNQIKS

SEQ ID NO: 2103228 - protein, 21 aa, Staphylococcus
EILTRLRANDDLKDIPIHFAI

SEQ ID NO: 2103229 - protein, 26 aa, Staphylococcus
EIPSDLQFDIVFLFTKAMQLESMLTH

SEQ ID NO: 2103230 - protein, 26 aa, Staphylococcus
EIQAMSYRYLICMNVVINDLYQKGYL

SEQ ID NO: 2103231 - protein, 17 aa, Staphylococcus
EIQSQLESRGFTVQVPP

SEQ ID NO: 2103232 - protein, 19 aa, Staphylococcus
EISRRVGYKDPLLFSKNFT

SEQ ID NO: 2103233 - protein, 19 aa, Staphylococcus
EIYLISHALLETGNGTSEL

SEQ ID NO: 2103234 - protein, 20 aa, Staphylococcus
EKAKPLLKDKGYDLKIKTIN

SEQ ID NO: 2103235 - protein, 20 aa, Staphylococcus
EKAKPLLKKKGYDLEIKTIN

SEQ ID NO: 2103236 - protein, 24 aa, Staphylococcus
EKAKSLYPKVRMYYERSEPVAEAF

SEQ ID NO: 2103237 - protein, 26 aa, Staphylococcus
EKEDRYGRTLAYVWLDEKTMYNEELV

SEQ ID NO: 2103238 - protein, 26 aa, Staphylococcus
EKEDRYGRTLAYVWLDENIMYNEELV

SEQ ID NO: 2103239 - protein, 22 aa, Staphylococcus
EKEGKALELALYYDKGSSSQKE

SEQ ID NO: 2103240 - protein, 20 aa, Staphylococcus
EKEIEVYPGNEDLALIHLNK

SEQ ID NO: 2103241 - protein, 31 aa, Staphylococcus
EKEPWSQPPSGYKWYDPSTFKAGSYGSQHQH

SEQ ID NO: 2103242 - protein, 22 aa, Staphylococcus
EKFLLNNDIHLVGGHPMAGSHK

SEQ ID NO: 2103243 - protein, 23 aa, Staphylococcus
EKGETRKGMVIYHLNNAQKVVLQ

SEQ ID NO: 2103244 - protein, 22 aa, Staphylococcus
EKIAHAYAYGGPNMAVNSLEKL

SEQ ID NO: 2103245 - protein, 19 aa, Staphylococcus
EKKKEYKKNSSSKENQASQ

SEQ ID NO: 2103246 - protein, 22 aa, Staphylococcus
EKLDYSCSAFLMYIGIDKDVTS

SEQ ID NO: 2103247 - protein, 32 aa, Staphylococcus
EKLKEAARTGRPIEIFVGFNVSDAYHNGETIK

SEQ ID NO: 2103248 - protein, 19 aa, Staphylococcus
EKLNEKWAKNHKDAKISSG

SEQ ID NO: 2103249 - protein, 19 aa, Staphylococcus
EKLPPIPKKVFVDQKSNKQ

SEQ ID NO: 2103250 - protein, 23 aa, Staphylococcus
EKNKEGIGYFGYNFYEQNKDKLK

SEQ ID NO: 2103251 - protein, 20 aa, Staphylococcus
EKNNKGFFLMVEGASIDKSG

SEQ ID NO: 2103252 - protein, 18 aa, Staphylococcus
EKSISEKTTKKASTEESQ

SEQ ID NO: 2103253 - protein, 18 aa, Staphylococcus
EKTVKFNLPKNVSKVEPE

SEQ ID NO: 2103254 - protein, 17 aa, Staphylococcus
EKVEAIGRINNAKQEAL

SEQ ID NO: 2103255 - protein, 25 aa, Staphylococcus
EKVLPAVAAKSSFLGHPSESYVGQF

SEQ ID NO: 2103256 - protein, 18 aa, Staphylococcus
ELADYVFIGAGGGAIPLL

SEQ ID NO: 2103257 - protein, 21 aa, Staphylococcus
ELAMPRPYVFVSPKDFKNGTT

SEQ ID NO: 2103258 - protein, 24 aa, Staphylococcus
ELEKDAVWKKLDAVKHNRVDVLDR

SEQ ID NO: 2103259 - protein, 23 aa, Staphylococcus
ELGADPMTFLGLGGIGDLIVTCT

SEQ ID NO: 2103260 - protein, 18 aa, Staphylococcus
ELGIPVKVHISTNYNTMV

SEQ ID NO: 2103261 - protein, 19 aa, Staphylococcus
ELGTMFRPSVYGMNDVLKY

SEQ ID NO: 2103262 - protein, 21 aa, Staphylococcus
ELKATSGFRTSLLLYNHTSPK

SEQ ID NO: 2103263 - protein, 24 aa, Staphylococcus
ELKHKTKPAQSFEGDFKQSNTRAT

SEQ ID NO: 2103264 - protein, 18 aa, Staphylococcus
ELKQRYAKRLLKFRSVPN

SEQ ID NO: 2103265 - protein, 19 aa, Staphylococcus
ELMAEWLKTDERPEELAPF

SEQ ID NO: 2103266 - protein, 23 aa, Staphylococcus
ELTDAKFYYMDIIDSDDKLTTSQ

SEQ ID NO: 2103267 - protein, 45 aa, Staphylococcus
ELTPKQAEDVVYDWYKNQGFGNRLRNEFNYNPSKSTDEMYYIDYA

SEQ ID NO: 2103268 - protein, 30 aa, Staphylococcus
ELTPRNAKWFKERFNIDIYTEYEVNKINDS

SEQ ID NO: 2103269 - protein, 21 aa, Staphylococcus
ELTQIRPLRVMSPHAVQGGKI

SEQ ID NO: 2103270 - protein, 27 aa, Staphylococcus
EMIDAILKDKCRVLAAITYLEDEYGYR

SEQ ID NO: 2103271 - protein, 21 aa, Staphylococcus
EMNWNGGFNVKSYRTITNPGS

SEQ ID NO: 2103272 - protein, 25 aa, Staphylococcus
EMSQKLKSGQNVNGMVDNEGDTWYQ

SEQ ID NO: 2103273 - protein, 41 aa, Staphylococcus
EMYYIDYAASDAYGTGTPYVAIVDKHTGSIVDNYNNMTDEE

SEQ ID NO: 2103274 - protein, 19 aa, Staphylococcus
ENAIVKCNLWLRTADRVKI

SEQ ID NO: 2103275 - protein, 18 aa, Staphylococcus
ENDGNFAAALDTNKLIYT

SEQ ID NO: 2103276 - protein, 17 aa, Staphylococcus
ENDISVGEFFRKRLGNE

SEQ ID NO: 2103277 - protein, 17 aa, Staphylococcus
ENFKKKFQAYAKAMNTV

SEQ ID NO: 2103278 - protein, 19 aa, Staphylococcus
ENGDWGFSILDKNGDLVGS

SEQ ID NO: 2103279 - protein, 24 aa, Staphylococcus
ENGISIKQFQGFWDNLLNDAVRNE

SEQ ID NO: 2103280 - protein, 25 aa, Staphylococcus
ENHFTPRECKVIALNYASNHLNENY

SEQ ID NO: 2103281 - protein, 22 aa, Staphylococcus
ENKAGFKFLAGVGPNNFTDIGE

SEQ ID NO: 2103282 - protein, 26 aa, Staphylococcus
ENKDLKEIPIHFAIYKQSGENSIVPG

SEQ ID NO: 2103283 - protein, 18 aa, Staphylococcus
ENNDYVVVNVDWGIPNER

SEQ ID NO: 2103284 - protein, 23 aa, Staphylococcus
ENRLLHHNIHLVGGHPMAGSHKS

SEQ ID NO: 2103285 - protein, 26 aa, Staphylococcus
ENSDLKDIPIHFAIYKQSGQDSITPG

SEQ ID NO: 2103286 - protein, 26 aa, Staphylococcus
ENSDLKDIPIHFAIYKQSSQESITPG

SEQ ID NO: 2103287 - protein, 20 aa, Staphylococcus
ENTYDGTGFVIARTSNTDIT

SEQ ID NO: 2103288 - protein, 20 aa, Staphylococcus
ENTYDGTGFVIARTSQTDIT

SEQ ID NO: 2103289 - protein, 24 aa, Staphylococcus
ENYPEWYGGDGTDGMFSHQLNQGN

SEQ ID NO: 2103290 - protein, 19 aa, Staphylococcus
EPDTKIPDHVFEKTSVRHV

SEQ ID NO: 2103291 - protein, 25 aa, Staphylococcus
EPEKTSDGKWGFSYDDKDGNLAGSY

SEQ ID NO: 2103292 - protein, 17 aa, Staphylococcus
EPNWNIKLYERLDRPGI

SEQ ID NO: 2103293 - protein, 23 aa, Staphylococcus
EPPESFKPLIPFAENILPIHIKN

SEQ ID NO: 2103294 - protein, 23 aa, Staphylococcus
EPQLRGVNDIVIEKGQDYNLLNG

SEQ ID NO: 2103295 - protein, 20 aa, Staphylococcus
EPQVAYLSGIEFMSGSRDFG

SEQ ID NO: 2103296 - protein, 29 aa, Staphylococcus
EPTIHIKNFKEFARAPEFQHEQDASDEAK

SEQ ID NO: 2103297 - protein, 39 aa, Staphylococcus
EQGTSELTKLLAQQGGYDYFSFEAIRPSNNTQLHVTSTH

SEQ ID NO: 2103298 - protein, 28 aa, Staphylococcus
EQLAGDHKIHFKGYLGSNIVKFFDYTFA

SEQ ID NO: 2103299 - protein, 19 aa, Staphylococcus
EQLRYIYDVYFGKNDKVRV

SEQ ID NO: 2103300 - protein, 19 aa, Staphylococcus
EQNKSAFAFSKSVDDKVVS

SEQ ID NO: 2103301 - protein, 19 aa, Staphylococcus
EQNPSRFYEAKLNYNQNHF

SEQ ID NO: 2103302 - protein, 19 aa, Staphylococcus
EQSKSGFAFSKKVDSKVVK

SEQ ID NO: 2103303 - protein, 18 aa, Staphylococcus
EQVNQAGLVPSVDQIKQT

SEQ ID NO: 2103304 - protein, 26 aa, Staphylococcus
ERGVEFKIGTPIVACNEKGFKVKTND

SEQ ID NO: 2103305 - protein, 22 aa, Staphylococcus
ERKEKKSIFEQLGETFEELQKE

SEQ ID NO: 2103306 - protein, 22 aa, Staphylococcus
ERLKEAYSHKGWLDETGPKYPV

SEQ ID NO: 2103307 - protein, 18 aa, Staphylococcus
ERLKKAYDEKGWLNESGA

SEQ ID NO: 2103308 - protein, 19 aa, Staphylococcus
ERLKKAYNEKGWLNESGAK

SEQ ID NO: 2103309 - protein, 23 aa, Staphylococcus
ERLSELFGHIVWMNTIDMIRDSS

SEQ ID NO: 2103310 - protein, 32 aa, Staphylococcus
ERNLELVGNIAPGDYLGTVRLRKKEQPFEIRV

SEQ ID NO: 2103311 - protein, 20 aa, Staphylococcus
ERRIMKKHYLDGDFATHEYA

SEQ ID NO: 2103312 - protein, 23 aa, Staphylococcus
ERRTSGDYDLMFNQTWGLLYDPQ

SEQ ID NO: 2103313 - protein, 22 aa, Staphylococcus
ERYGKSYAGAYRDWKPGQKIHL

SEQ ID NO: 2103314 - protein, 20 aa, Staphylococcus
ESAFDAAICMAEQGKQVSIY

SEQ ID NO: 2103315 - protein, 22 aa, Staphylococcus
ESAGLIKLKKNFGLNGTTKDIE

SEQ ID NO: 2103316 - protein, 20 aa, Staphylococcus
ESAGYIKLSKDFGLKGSKKD

SEQ ID NO: 2103317 - protein, 23 aa, Staphylococcus
ESFEGVKRGRIVTKQDLTIDGHD

SEQ ID NO: 2103318 - protein, 23 aa, Staphylococcus
ESGDPVPDATITWLPNNSPDKNN

SEQ ID NO: 2103319 - protein, 25 aa, Staphylococcus
ESHDPHVWLDPVLDKHFAEKIKNDL

SEQ ID NO: 2103320 - protein, 18 aa, Staphylococcus
ESIGYLAERYDFVQKGVQ

SEQ ID NO: 2103321 - protein, 18 aa, Staphylococcus
ESIRYVKTGMTLTKAANI

SEQ ID NO: 2103322 - protein, 22 aa, Staphylococcus
ESKAAPKLAMRSFAAQPTTNTT

SEQ ID NO: 2103323 - protein, 19 aa, Staphylococcus
ESKARGILQDNMTNGYNGE

SEQ ID NO: 2103324 - protein, 23 aa, Staphylococcus
ESKLMMEKMMHWCHNAYGVNYAA

SEQ ID NO: 2103325 - protein, 19 aa, Staphylococcus
ESLEGMRVQTGNVRSVGPQ

SEQ ID NO: 2103326 - protein, 24 aa, Staphylococcus
ESNVEGLGVISYRTIDADDAAQLS

SEQ ID NO: 2103327 - protein, 24 aa, Staphylococcus
ESPDDLKVVVDLSGEKAGKYHEKF

SEQ ID NO: 2103328 - protein, 18 aa, Staphylococcus
ESQARGLLQDNMANSYNG

SEQ ID NO: 2103329 - protein, 19 aa, Staphylococcus
ESQARGVLQDNMANSYNGE

SEQ ID NO: 2103330 - protein, 21 aa, Staphylococcus
ESQQALIFCVGNIHGPGGKIA

SEQ ID NO: 2103331 - protein, 27 aa, Staphylococcus
ESQTDYPLKRVRYVKELMQKGLMTKEF

SEQ ID NO: 2103332 - protein, 26 aa, Staphylococcus
ESRGFTVQVPPEYLGGLNENNFINKN

SEQ ID NO: 2103333 - protein, 31 aa, Staphylococcus
ESSLRVESGQEKSVYDRPYEEDFEPDEDTDD

SEQ ID NO: 2103334 - protein, 37 aa, Staphylococcus
ESSYMVVRTIPKQVFVTSRVTPIPGIDNPNNPKDYLK

SEQ ID NO: 2103335 - protein, 22 aa, Staphylococcus
ESTRPGLNGRQRSDIHMAASKR

SEQ ID NO: 2103336 - protein, 46 aa, Staphylococcus
ESTRYPNVFLIGPTVRHADAILCYIYKFRSRFAVLAEQVMEREALE

SEQ ID NO: 2103337 - protein, 17 aa, Staphylococcus
ESTTEKKADDKKDKKTK

SEQ ID NO: 2103338 - protein, 22 aa, Staphylococcus
ESVAKLKPDLIITYNTDKNLKK

SEQ ID NO: 2103339 - protein, 26 aa, Staphylococcus
ESVEYGSSIGDEFKELIGNFKSDINP

SEQ ID NO: 2103340 - protein, 24 aa, Staphylococcus
ESVIECRDADSLYEIPLQLSKQEM

SEQ ID NO: 2103341 - protein, 25 aa, Staphylococcus
ESVIECRDAESLYEIPLQLSDQDMD

SEQ ID NO: 2103342 - protein, 19 aa, Staphylococcus
ESYLGRKKIMTELAEEIGL

SEQ ID NO: 2103343 - protein, 19 aa, Staphylococcus
ESYLGRKTIMTDIANEIGL

SEQ ID NO: 2103344 - protein, 19 aa, Staphylococcus
ESYLGRKTIMTDLAKDIGL

SEQ ID NO: 2103345 - protein, 26 aa, Staphylococcus
ESYQELCDFIKLVIQGGNAKKYVKDN

SEQ ID NO: 2103346 - protein, 25 aa, Staphylococcus
ETAIVKCNLWLRTADRIKIVVGQFK

SEQ ID NO: 2103347 - protein, 22 aa, Staphylococcus
ETALKYYVCTSDDMNDWKEYDY

SEQ ID NO: 2103348 - protein, 25 aa, Staphylococcus
ETIMKTGYDYSWFILTEDIIKKEFV

SEQ ID NO: 2103349 - protein, 37 aa, Staphylococcus
ETLATPPKTRTFMRAMATPRMLAAAVTSPDQDAQKSL

SEQ ID NO: 2103350 - protein, 22 aa, Staphylococcus
ETNKMLPAFGLKVDKKVDRNDS

SEQ ID NO: 2103351 - protein, 23 aa, Staphylococcus
ETNLKYYVCTSDDMKEWREYDYL

SEQ ID NO: 2103352 - protein, 17 aa, Staphylococcus
ETSKVIIPNNKVEFKGD

SEQ ID NO: 2103353 - protein, 17 aa, Staphylococcus
ETTNIWKNLPAVKNNNV

SEQ ID NO: 2103354 - protein, 21 aa, Staphylococcus
ETWAPSLILRLVLGQRATIIL

SEQ ID NO: 2103355 - protein, 22 aa, Staphylococcus
EVAKGKVASFIASDNVKGGEMG

SEQ ID NO: 2103356 - protein, 30 aa, Staphylococcus
EVANALDRKTEIERQANEDYENGLISEDEA

SEQ ID NO: 2103357 - protein, 25 aa, Staphylococcus
EVDGILVPGGFGFRASEGKISAIKY

SEQ ID NO: 2103358 - protein, 18 aa, Staphylococcus
EVGKLVAFLASDDSSFIT

SEQ ID NO: 2103359 - protein, 25 aa, Staphylococcus
EVKDLKENYDFIIIRAQYGSEKVDA

SEQ ID NO: 2103360 - protein, 23 aa, Staphylococcus
EVKGNKLIVKIYQLRGDISKGEP

SEQ ID NO: 2103361 - protein, 20 aa, Staphylococcus
EVLEGLKVQVDQAIYTAKDI

SEQ ID NO: 2103362 - protein, 19 aa, Staphylococcus
EVLGTYCATKHSVRSLTQT

SEQ ID NO: 2103363 - protein, 24 aa, Staphylococcus
EVMGGIEPTVDWLRDALKSGKHVI

SEQ ID NO: 2103364 - protein, 24 aa, Staphylococcus
EVMGGIEPTVDWLRESLKRKKHVI

SEQ ID NO: 2103365 - protein, 25 aa, Staphylococcus
EVMGGIEPTVDWLRSALKNKKHVIT

SEQ ID NO: 2103366 - protein, 25 aa, Staphylococcus
EVMGGIEPTVDWLRTALKNKKHVIT

SEQ ID NO: 2103367 - protein, 23 aa, Staphylococcus
EVMGGIEPTVEWLKKSLEQGKHV

SEQ ID NO: 2103368 - protein, 19 aa, Staphylococcus
EVNDAIANLHGDQKLAQAQ

SEQ ID NO: 2103369 - protein, 24 aa, Staphylococcus
EVPESFLRKFGYIVFPDNVAIAMG

SEQ ID NO: 2103370 - protein, 20 aa, Staphylococcus
EVREDIYGALRVSFKNPQDR

SEQ ID NO: 2103371 - protein, 19 aa, Staphylococcus
EVSAGIGIGDNVLKKLGNH

SEQ ID NO: 2103372 - protein, 17 aa, Staphylococcus
EVSTRIENDGNFAAALD

SEQ ID NO: 2103373 - protein, 17 aa, Staphylococcus
EVTKYILDSNNENSEDF

SEQ ID NO: 2103374 - protein, 18 aa, Staphylococcus
EYDYIFLTIGTLSYHDPY

SEQ ID NO: 2103375 - protein, 18 aa, Staphylococcus
EYEKEAKHLPAKTNKTRQ

SEQ ID NO: 2103376 - protein, 26 aa, Staphylococcus
EYFKTRIPEHAHWSAFGIGRMQFPTV

SEQ ID NO: 2103377 - protein, 25 aa, Staphylococcus
EYGDFKCPYCKKVEKNVMPKLKKHY

SEQ ID NO: 2103378 - protein, 25 aa, Staphylococcus
EYGDFKCPYCKKVEKNVMPTIKKDY

SEQ ID NO: 2103379 - protein, 25 aa, Staphylococcus
EYIAEKDPSIIFAMDRGQAVSDNAT

SEQ ID NO: 2103380 - protein, 19 aa, Staphylococcus
EYNDLAARVEKLYEELGAE

SEQ ID NO: 2103381 - protein, 20 aa, Staphylococcus
EYSSEECRIIAQNYTNHQYG

SEQ ID NO: 2103382 - protein, 21 aa, Staphylococcus
FAATLVLSACSQDDAKEDENK

SEQ ID NO: 2103383 - protein, 17 aa, Staphylococcus
FACILIPALTGCEKDFK

SEQ ID NO: 2103384 - protein, 17 aa, Staphylococcus
FAEENMPLQIDAPKKNP

SEQ ID NO: 2103385 - protein, 18 aa, Staphylococcus
FAGGLHKLGANIVAVNNQ

SEQ ID NO: 2103386 - protein, 19 aa, Staphylococcus
FAIPHRYSTHYLLLEEMRK

SEQ ID NO: 2103387 - protein, 25 aa, Staphylococcus
FAKQYDVKPGYIWEINTEKQGTPSQ

SEQ ID NO: 2103388 - protein, 23 aa, Staphylococcus
FANCALPYYLGNVVDSRNKVLEA

SEQ ID NO: 2103389 - protein, 17 aa, Staphylococcus
FANTYAFMVTKATAEKY

SEQ ID NO: 2103390 - protein, 23 aa, Staphylococcus
FASVLVLAACGGKDDSSKDSSDS

SEQ ID NO: 2103391 - protein, 28 aa, Staphylococcus
FATIVGVSREYVCIIGTQSAVVNYEEEI

SEQ ID NO: 2103392 - protein, 27 aa, Staphylococcus
FAVILTICLIGLIFLATNQNALAKVHQ

SEQ ID NO: 2103393 - protein, 20 aa, Staphylococcus
FAVSLSVLLASCNNEASENN

SEQ ID NO: 2103394 - protein, 24 aa, Staphylococcus
FCVDNLPPVLLPKFVELMEQGNPS

SEQ ID NO: 2103395 - protein, 17 aa, Staphylococcus
FDDVPTLIHSWMNSDIH

SEQ ID NO: 2103396 - protein, 18 aa, Staphylococcus
FDELLNMRGTENAYKLHR

SEQ ID NO: 2103397 - protein, 19 aa, Staphylococcus
FDGEIKEWSLSKDDGKLVY

SEQ ID NO: 2103398 - protein, 18 aa, Staphylococcus
FDGITYAKKAGWDSVEKA

SEQ ID NO: 2103399 - protein, 17 aa, Staphylococcus
FDKVNTLLGSNHPISEK

SEQ ID NO: 2103400 - protein, 25 aa, Staphylococcus
FDNKEFKRHRIGNGDNNVEMFNDSG

SEQ ID NO: 2103401 - protein, 26 aa, Staphylococcus
FDNPKYLPRFVFGHYMKSYLSNYDLL

SEQ ID NO: 2103402 - protein, 25 aa, Staphylococcus
FDQGNRYSVPYFFGTVGILYNKKAY

SEQ ID NO: 2103403 - protein, 28 aa, Staphylococcus
FDRRQQLGRSIGSYWGNANNWAYSAKNA

SEQ ID NO: 2103404 - protein, 24 aa, Staphylococcus
FDYVKDISEQFGFVNIGVANYEAD

SEQ ID NO: 2103405 - protein, 24 aa, Staphylococcus
FDYVKEIATQFGFVNIGVVNYEAD

SEQ ID NO: 2103406 - protein, 24 aa, Staphylococcus
FDYVKEISDQFGFINVGMTNYEAD

SEQ ID NO: 2103407 - protein, 24 aa, Staphylococcus
FDYVKEISEQFGFVNIGVTNYEAD

SEQ ID NO: 2103408 - protein, 24 aa, Staphylococcus
FDYVKEISQQFGFVNIGVTNYEAD

SEQ ID NO: 2103409 - protein, 20 aa, Staphylococcus
FEFFCRDILKDVQTSKYSPS

SEQ ID NO: 2103410 - protein, 17 aa, Staphylococcus
FEILLGKLLEKKYSDKV

SEQ ID NO: 2103411 - protein, 19 aa, Staphylococcus
FEISKQFWGHLVKNNSISN

SEQ ID NO: 2103412 - protein, 19 aa, Staphylococcus
FEISKQFWGHLVKSGQIEN

SEQ ID NO: 2103413 - protein, 19 aa, Staphylococcus
FEKAFDYATQYAKANPDTL

SEQ ID NO: 2103414 - protein, 19 aa, Staphylococcus
FELTDWKVEDKILMKKNPK

SEQ ID NO: 2103415 - protein, 25 aa, Staphylococcus
FENMLLKHDIHFIGGHPMAGSHKSG

SEQ ID NO: 2103416 - protein, 17 aa, Staphylococcus
FETATSDVPEQKYKELS

SEQ ID NO: 2103417 - protein, 18 aa, Staphylococcus
FFFACQFHPEFLSRPNRP

SEQ ID NO: 2103418 - protein, 19 aa, Staphylococcus
FFRQRLGDEVLEHLIEPLI

SEQ ID NO: 2103419 - protein, 18 aa, Staphylococcus
FGAMLYRQGNDVTLIDGW

SEQ ID NO: 2103420 - protein, 20 aa, Staphylococcus
FGAMLYRQGYDVTLIDGWEP

SEQ ID NO: 2103421 - protein, 17 aa, Staphylococcus
FGGLFLVNSKIQQRLGV

SEQ ID NO: 2103422 - protein, 17 aa, Staphylococcus
FGKSVDWTIQGTDNRNG

SEQ ID NO: 2103423 - protein, 17 aa, Staphylococcus
FGNCTYYAFDRRQQLGR

SEQ ID NO: 2103424 - protein, 18 aa, Staphylococcus
FGPGGRFGDLVFNTLGFK

SEQ ID NO: 2103425 - protein, 21 aa, Staphylococcus
FGSALILGACGNDDTSNENSD

SEQ ID NO: 2103426 - protein, 25 aa, Staphylococcus
FGSGERFGSMIFDTMGFTPADDNIK

SEQ ID NO: 2103427 - protein, 20 aa, Staphylococcus
FGSSIGDEVKTMIGDFKSDI

SEQ ID NO: 2103428 - protein, 19 aa, Staphylococcus
FHTNKGVLVVTAIGKKNTG

SEQ ID NO: 2103429 - protein, 22 aa, Staphylococcus
FIAFLCVSGLTLATNLESEASV

SEQ ID NO: 2103430 - protein, 18 aa, Staphylococcus
FIDRDKVDQPTLDQVKEA

SEQ ID NO: 2103431 - protein, 29 aa, Staphylococcus
FIFGFALVVICGIGLYAQGEKLEKEDSYN

SEQ ID NO: 2103432 - protein, 18 aa, Staphylococcus
FIILVILGLVRTFENYAI

SEQ ID NO: 2103433 - protein, 28 aa, Staphylococcus
FINKDVQNFLKQNIEDINFSNSDNNDDN

SEQ ID NO: 2103434 - protein, 24 aa, Staphylococcus
FITEKYIRMSGMKKTFENEADAKK

SEQ ID NO: 2103435 - protein, 18 aa, Staphylococcus
FKDITGWKKVSKESIIKK

SEQ ID NO: 2103436 - protein, 18 aa, Staphylococcus
FKEAIGTGAFKIGDAGKE

SEQ ID NO: 2103437 - protein, 29 aa, Staphylococcus
FKEDVVKLKAPMRVGGSVTYSSNGDGSIN

SEQ ID NO: 2103438 - protein, 17 aa, Staphylococcus
FKESLKYDNFTINGYQI

SEQ ID NO: 2103439 - protein, 21 aa, Staphylococcus
FKEVRHQLGNTVKWRYHYDDR

SEQ ID NO: 2103440 - protein, 20 aa, Staphylococcus
FKFDSARPMQIGLVYDALKN

SEQ ID NO: 2103441 - protein, 17 aa, Staphylococcus
FKGDPDFTIVNRLPKSM

SEQ ID NO: 2103442 - protein, 19 aa, Staphylococcus
FKGDPDFTIVNRLPKSMPQ

SEQ ID NO: 2103443 - protein, 19 aa, Staphylococcus
FKGKEKVHVDRVVDGDTFV

SEQ ID NO: 2103444 - protein, 24 aa, Staphylococcus
FKKAAPKAKIVYMGADNKDVINSV

SEQ ID NO: 2103445 - protein, 24 aa, Staphylococcus
FKKAAPKAKVVYVGADDKDYVKSM

SEQ ID NO: 2103446 - protein, 25 aa, Staphylococcus
FKKAAPKAKVVYVGASEDHYIKDMK

SEQ ID NO: 2103447 - protein, 24 aa, Staphylococcus
FKKAAPKAKVVYVGASEKNYVNDM

SEQ ID NO: 2103448 - protein, 17 aa, Staphylococcus
FKKAEKHLDNISDKAKK

SEQ ID NO: 2103449 - protein, 18 aa, Staphylococcus
FKKDGYDVVSNKNELANS

SEQ ID NO: 2103450 - protein, 18 aa, Staphylococcus
FKLECKDHNIDLEKLVYR

SEQ ID NO: 2103451 - protein, 17 aa, Staphylococcus
FKLPDHVSKLDPSETNA

SEQ ID NO: 2103452 - protein, 22 aa, Staphylococcus
FKNTGTYMFHCHILEHEDNGMM

SEQ ID NO: 2103453 - protein, 18 aa, Staphylococcus
FKQFRHGLSSFIEALADF

SEQ ID NO: 2103454 - protein, 23 aa, Staphylococcus
FKQQEPIVFTAMEPSWFSKELDV

SEQ ID NO: 2103455 - protein, 17 aa, Staphylococcus
FKQSNTRAISLFQDVPQ

SEQ ID NO: 2103456 - protein, 25 aa, Staphylococcus
FKQSNTRATGLFQQLPKIEDSTLTD

SEQ ID NO: 2103457 - protein, 17 aa, Staphylococcus
FKQVYNLSGGNKNYQRY

SEQ ID NO: 2103458 - protein, 21 aa, Staphylococcus
FKRADGLRVNGDIRRFDKVLC

SEQ ID NO: 2103459 - protein, 18 aa, Staphylococcus
FKRTKDILKYLGEHKTHQ

SEQ ID NO: 2103460 - protein, 22 aa, Staphylococcus
FKRVFSLIAILAIVFSTLGQTL

SEQ ID NO: 2103461 - protein, 17 aa, Staphylococcus
FKSFEITDSSSPYPQGQ

SEQ ID NO: 2103462 - protein, 19 aa, Staphylococcus
FKTAFGSTAEGRWLAKNAY

SEQ ID NO: 2103463 - protein, 17 aa, Staphylococcus
FKTNIPDIYALGDVITS

SEQ ID NO: 2103464 - protein, 22 aa, Staphylococcus
FLASCELPGLGGGQSKSTVRIS

SEQ ID NO: 2103465 - protein, 17 aa, Staphylococcus
FLEGAGIEEDDAGYIPV

SEQ ID NO: 2103466 - protein, 20 aa, Staphylococcus
FLLFLCLHNLLFPDTTKESM

SEQ ID NO: 2103467 - protein, 17 aa, Staphylococcus
FLNPATSKGVWQVRPVQ

SEQ ID NO: 2103468 - protein, 30 aa, Staphylococcus
FLQKRYDALKDLPMFQGIEFTQDREKLAEW

SEQ ID NO: 2103469 - protein, 18 aa, Staphylococcus
FLVLTACGQQKESKFDDK

SEQ ID NO: 2103470 - protein, 18 aa, Staphylococcus
FMEHVYYFKHDVSDEQSY

SEQ ID NO: 2103471 - protein, 17 aa, Staphylococcus
FMGGSSAQAAEKQQEVG

SEQ ID NO: 2103472 - protein, 18 aa, Staphylococcus
FMTNFRIALVKKENSGPY

SEQ ID NO: 2103473 - protein, 21 aa, Staphylococcus
FMVVLAGCGKGESDNTKSNEK

SEQ ID NO: 2103474 - protein, 33 aa, Staphylococcus
FNELKSQYYGNVPLELAFELFKLECKDHNIDLE

SEQ ID NO: 2103475 - protein, 23 aa, Staphylococcus
FNFNSDGTNWSWSYNADSSAQQA

SEQ ID NO: 2103476 - protein, 19 aa, Staphylococcus
FNHDLAFKYFNTMDSTTVA

SEQ ID NO: 2103477 - protein, 20 aa, Staphylococcus
FNHSNLYDWGQCTWHAFNRR

SEQ ID NO: 2103478 - protein, 35 aa, Staphylococcus
FNIDAYMSGANSGTRYKIDLNLDSKIADHVTKISV

SEQ ID NO: 2103479 - protein, 23 aa, Staphylococcus
FNKIKLQSMHFLKQPNGSNYTNK

SEQ ID NO: 2103480 - protein, 20 aa, Staphylococcus
FNLESGNGWFEKALEQAGKS

SEQ ID NO: 2103481 - protein, 21 aa, Staphylococcus
FNLESGNGWFEKALKQAGKST

SEQ ID NO: 2103482 - protein, 20 aa, Staphylococcus
FNNYVKYQFDMPVADDTAFT

SEQ ID NO: 2103483 - protein, 19 aa, Staphylococcus
FNPFRQIHAEINITMPSEK

SEQ ID NO: 2103484 - protein, 17 aa, Staphylococcus
FNQKYYNSFGFENTYAF

SEQ ID NO: 2103485 - protein, 24 aa, Staphylococcus
FNQSIDLLLSKRVDGTFNDSLSYL

SEQ ID NO: 2103486 - protein, 23 aa, Staphylococcus
FNRRAQIGKGISTYWWNANNWDN

SEQ ID NO: 2103487 - protein, 21 aa, Staphylococcus
FNRRSELGRSIGSTWGNANNW

SEQ ID NO: 2103488 - protein, 18 aa, Staphylococcus
FNTAYRYYADNPKTKEMD

SEQ ID NO: 2103489 - protein, 17 aa, Staphylococcus
FNTAYRYYKNQPGAKKM

SEQ ID NO: 2103490 - protein, 18 aa, Staphylococcus
FNTLGFKPADKHVKISPH

SEQ ID NO: 2103491 - protein, 28 aa, Staphylococcus
FPAFKNKNLRLAIAQSINKQGFVDSVKN

SEQ ID NO: 2103492 - protein, 23 aa, Staphylococcus
FPMISSNIYKNGKRIFKPSTIIK

SEQ ID NO: 2103493 - protein, 21 aa, Staphylococcus
FPNGKGASPNDFFTLESGDPV

SEQ ID NO: 2103494 - protein, 27 aa, Staphylococcus
FPNPQYLPRFVFGHYMKSHLSRYDQQY

SEQ ID NO: 2103495 - protein, 17 aa, Staphylococcus
FPNQVLKVSGSSKSTAN

SEQ ID NO: 2103496 - protein, 17 aa, Staphylococcus
FPNQVLKVSGSSSSASK

SEQ ID NO: 2103497 - protein, 21 aa, Staphylococcus
FPSMIAITLFGAAFTSQHAHA

SEQ ID NO: 2103498 - protein, 22 aa, Staphylococcus
FPSMIALTLFGAAFTTHHAEAS

SEQ ID NO: 2103499 - protein, 22 aa, Staphylococcus
FPTEKFRQMIDIMLTGSFIGTK

SEQ ID NO: 2103500 - protein, 20 aa, Staphylococcus
FQDFMKFVLEDKGKSAEDAG

SEQ ID NO: 2103501 - protein, 18 aa, Staphylococcus
FQDRRWMEDDYTKSETKR

SEQ ID NO: 2103502 - protein, 19 aa, Staphylococcus
FQEFMKFTLEDKGKAAEDA

SEQ ID NO: 2103503 - protein, 39 aa, Staphylococcus
FQITKRKVVNGITWYYGKLSNGKSVWIKKSDLQQQLVKL

SEQ ID NO: 2103504 - protein, 18 aa, Staphylococcus
FQTMPGWGSTATVNDQIN

SEQ ID NO: 2103505 - protein, 22 aa, Staphylococcus
FQTNYRNVYAIGDIVSNYYRHV

SEQ ID NO: 2103506 - protein, 17 aa, Staphylococcus
FQVKGIDDDVSYSVKPK

SEQ ID NO: 2103507 - protein, 38 aa, Staphylococcus
FRDIDRAMVWGFNWKLGPFQLWDLMGFDRVKSRIEDEL

SEQ ID NO: 2103508 - protein, 19 aa, Staphylococcus
FRDNQKWVTPLGRLGKPEE

SEQ ID NO: 2103509 - protein, 19 aa, Staphylococcus
FRDNQKWVTPLGRLGQPEE

SEQ ID NO: 2103510 - protein, 19 aa, Staphylococcus
FRDNQKWVTPLGRLGTPEE

SEQ ID NO: 2103511 - protein, 24 aa, Staphylococcus
FREKRSYRSFLFEQYLRLTRVRKP

SEQ ID NO: 2103512 - protein, 19 aa, Staphylococcus
FRENQKWVTPLGRLGTPDE

SEQ ID NO: 2103513 - protein, 18 aa, Staphylococcus
FRKPSDFYNLTSLVQGAK

SEQ ID NO: 2103514 - protein, 26 aa, Staphylococcus
FRKPSEFYNPIALYRGMKLRTLGKAN

SEQ ID NO: 2103515 - protein, 17 aa, Staphylococcus
FRKQTNIYLEKLTKEID

SEQ ID NO: 2103516 - protein, 17 aa, Staphylococcus
FRSDKDGLSELLNQLFS

SEQ ID NO: 2103517 - protein, 27 aa, Staphylococcus
FSAYEFKKRAEQCIADITARGKIPIIA

SEQ ID NO: 2103518 - protein, 20 aa, Staphylococcus
FSAYEFKKRAEVLIEDITKR

SEQ ID NO: 2103519 - protein, 19 aa, Staphylococcus
FSDINGWKSVSKESIIKHN

SEQ ID NO: 2103520 - protein, 21 aa, Staphylococcus
FSHPTKPIGLFYDKETAERIE

SEQ ID NO: 2103521 - protein, 37 aa, Staphylococcus
FSHSNLYTWGQCTWHVFNRRAAIGKGISTYWWNANNW

SEQ ID NO: 2103522 - protein, 31 aa, Staphylococcus
FSIRKFNIGIFSALITTVTFLAHPSQASASE

SEQ ID NO: 2103523 - protein, 17 aa, Staphylococcus
FSKHALNDFYITYFAQA

SEQ ID NO: 2103524 - protein, 25 aa, Staphylococcus
FSKQYDIKPGYIWEINTEKQGTPEQ

SEQ ID NO: 2103525 - protein, 17 aa, Staphylococcus
FSLIISLMIFTLVGCQS

SEQ ID NO: 2103526 - protein, 20 aa, Staphylococcus
FSNPYTYSSAVLVVRDNEKN

SEQ ID NO: 2103527 - protein, 20 aa, Staphylococcus
FSNPYTYSSAVLVVRENEKN

SEQ ID NO: 2103528 - protein, 19 aa, Staphylococcus
FSNPYTYSSGVLVVRDDEK

SEQ ID NO: 2103529 - protein, 17 aa, Staphylococcus
FSNSGLVGFRSAENYNE

SEQ ID NO: 2103530 - protein, 18 aa, Staphylococcus
FSPINGRVSIINRYPSKA

SEQ ID NO: 2103531 - protein, 21 aa, Staphylococcus
FSSLLILGACGQVGDNSIKND

SEQ ID NO: 2103532 - protein, 24 aa, Staphylococcus
FSSVAKPRMMYSVNKKTTSKATSS

SEQ ID NO: 2103533 - protein, 31 aa, Staphylococcus
FSVGASSILIAALLFMGGGSAQAAEQNQEQG

SEQ ID NO: 2103534 - protein, 18 aa, Staphylococcus
FSVPDCQAIVKKAIVERL

SEQ ID NO: 2103535 - protein, 32 aa, Staphylococcus
FTATIPRNGKLVVMKDEFTDFFAKEAKKRKTE

SEQ ID NO: 2103536 - protein, 24 aa, Staphylococcus
FTEQGYFRLGLDTLPEILTYHGPF

SEQ ID NO: 2103537 - protein, 24 aa, Staphylococcus
FTHWEELKSTWKFVDVIQDEWTMN

SEQ ID NO: 2103538 - protein, 17 aa, Staphylococcus
FTKAYGFDFNTVRPMQI

SEQ ID NO: 2103539 - protein, 18 aa, Staphylococcus
FTKSIAIEYGRENIRANA

SEQ ID NO: 2103540 - protein, 22 aa, Staphylococcus
FTQDYNFVRALKYDNVSIDGYK

SEQ ID NO: 2103541 - protein, 23 aa, Staphylococcus
FTQDYNFVRALKYDNVTINGYKV

SEQ ID NO: 2103542 - protein, 17 aa, Staphylococcus
FTRSTAIEYGRENIRAN

SEQ ID NO: 2103543 - protein, 21 aa, Staphylococcus
FTSFLILGACSNKDSSSENSN

SEQ ID NO: 2103544 - protein, 18 aa, Staphylococcus
FVDPNFVRAVKYHNVTFN

SEQ ID NO: 2103545 - protein, 21 aa, Staphylococcus
FVKDNHLKHLLVETSVDKKAM

SEQ ID NO: 2103546 - protein, 21 aa, Staphylococcus
FVSIIAVLLLAGCQSQEDKEK

SEQ ID NO: 2103547 - protein, 17 aa, Staphylococcus
FVTPLAFQAIGRNPVYT

SEQ ID NO: 2103548 - protein, 18 aa, Staphylococcus
FYFHKVGPNYSLKQVYID

SEQ ID NO: 2103549 - protein, 18 aa, Staphylococcus
FYTLEMDTNFNLKNVKAK

SEQ ID NO: 2103550 - protein, 18 aa, Staphylococcus
GAHVDLFSLVPVKRSHSV

SEQ ID NO: 2103551 - protein, 25 aa, Staphylococcus
GAKDIPFANNFRGEATVYRNTPTFK

SEQ ID NO: 2103552 - protein, 26 aa, Staphylococcus
GALNESFSDVFAYFIESDNFLIGEDI

SEQ ID NO: 2103553 - protein, 26 aa, Staphylococcus
GALNESFSDVFGYFVDPDDWLMGEDV

SEQ ID NO: 2103554 - protein, 29 aa, Staphylococcus
GALTGTMLLAGCSLSDFGLGNGASDDKNK

SEQ ID NO: 2103555 - protein, 18 aa, Staphylococcus
GANPITFLGLGGIGDLIV

SEQ ID NO: 2103556 - protein, 25 aa, Staphylococcus
GAPLKRGAATIAMLGKAPILPAAYV

SEQ ID NO: 2103557 - protein, 24 aa, Staphylococcus
GAPMKRGAVTIALMAQAPILPAAY

SEQ ID NO: 2103558 - protein, 24 aa, Staphylococcus
GASCLLAGCGSQNLAPLEDKTTKL

SEQ ID NO: 2103559 - protein, 25 aa, Staphylococcus
GASCLLAGCGSQNLAPLEDKTTKLR

SEQ ID NO: 2103560 - protein, 24 aa, Staphylococcus
GASCLLVGCGSQNLGPLEDKTTKL

SEQ ID NO: 2103561 - protein, 28 aa, Staphylococcus
GASGKFQFLQSTWDSVAPAEYQGQPAAS

SEQ ID NO: 2103562 - protein, 24 aa, Staphylococcus
GASLFLVGCGSQNLGPLEDKTTNL

SEQ ID NO: 2103563 - protein, 22 aa, Staphylococcus
GASLLLAGCGSQNLGPLEDKTT

SEQ ID NO: 2103564 - protein, 21 aa, Staphylococcus
GASSIIVASMLFVGVESAQAA

SEQ ID NO: 2103565 - protein, 24 aa, Staphylococcus
GASTHPGAGVPIVLTSAKITAEAM

SEQ ID NO: 2103566 - protein, 24 aa, Staphylococcus
GASTHPGAGVPIVLTSAKITVDEI

SEQ ID NO: 2103567 - protein, 24 aa, Staphylococcus
GASTHPGAGVPIVLTSAKITVEEI

SEQ ID NO: 2103568 - protein, 25 aa, Staphylococcus
GASTHPGAGVPIVLTSAKITVNEML

SEQ ID NO: 2103569 - protein, 19 aa, Staphylococcus
GAVKMGWEGLVPPRTPERD

SEQ ID NO: 2103570 - protein, 24 aa, Staphylococcus
GAVLIPSEISNAASQVNSAKQDLN

SEQ ID NO: 2103571 - protein, 23 aa, Staphylococcus
GAYDIHFVSGGFEYNFTSDGTNF

SEQ ID NO: 2103572 - protein, 17 aa, Staphylococcus
GAYGHVAYVEKVNSDGS

SEQ ID NO: 2103573 - protein, 19 aa, Staphylococcus
GAYNYDFVLGGNEYTFTSD

SEQ ID NO: 2103574 - protein, 27 aa, Staphylococcus
GAYRDWKPGQKIHLIGHSMGGQTVRLL

SEQ ID NO: 2103575 - protein, 25 aa, Staphylococcus
GCFWCLVKPFTSYPGIENVVSGYSG

SEQ ID NO: 2103576 - protein, 25 aa, Staphylococcus
GDAHHWNNRATREGYQVSSTPKKHT

SEQ ID NO: 2103577 - protein, 28 aa, Staphylococcus
GDAKAIVQCNLWLRTADRIKIVVGRFNA

SEQ ID NO: 2103578 - protein, 21 aa, Staphylococcus
GDARREVMAALAAAKDNNFEQ

SEQ ID NO: 2103579 - protein, 24 aa, Staphylococcus
GDFFRKRLGDEVLENLIEPLMGGI

SEQ ID NO: 2103580 - protein, 25 aa, Staphylococcus
GDFQFPNKPFKYGIHYSEVTDFNEF

SEQ ID NO: 2103581 - protein, 17 aa, Staphylococcus
GDGYPAFQKEYGFKFAS

SEQ ID NO: 2103582 - protein, 22 aa, Staphylococcus
GDILSLKADYTVDNSVKSGDTF

SEQ ID NO: 2103583 - protein, 17 aa, Staphylococcus
GDIQRTIQQLKLSKVED

SEQ ID NO: 2103584 - protein, 19 aa, Staphylococcus
GDKALAFIRSRKEEGAGGD

SEQ ID NO: 2103585 - protein, 35 aa, Staphylococcus
GDKSFPQIQYKNHDPIILVHGFNGYTADNGPVLGH

SEQ ID NO: 2103586 - protein, 17 aa, Staphylococcus
GDPDFTIVNRLPKSMPQ

SEQ ID NO: 2103587 - protein, 19 aa, Staphylococcus
GDPVTADDFVYAWRKVVDP

SEQ ID NO: 2103588 - protein, 25 aa, Staphylococcus
GDPVTAHDFEYAWKRVVNPDTASEY

SEQ ID NO: 2103589 - protein, 26 aa, Staphylococcus
GDPVTANDFVYAWRKALDPQTASEYA

SEQ ID NO: 2103590 - protein, 25 aa, Staphylococcus
GDPVTAQDFVYAWRKVVNPKTGSEF

SEQ ID NO: 2103591 - protein, 21 aa, Staphylococcus
GDQSYERLIRAIKTAAGVQNI

SEQ ID NO: 2103592 - protein, 23 aa, Staphylococcus
GDRLPWIHIDSIDNFEPLKSRTW

SEQ ID NO: 2103593 - protein, 21 aa, Staphylococcus
GDSFVNPFMKEVWDYDITVAK

SEQ ID NO: 2103594 - protein, 25 aa, Staphylococcus
GDSKLYYKYLEQIGAAMTDKNGKYI

SEQ ID NO: 2103595 - protein, 18 aa, Staphylococcus
GDSLSSIASRYGTTYRHI

SEQ ID NO: 2103596 - protein, 20 aa, Staphylococcus
GDWADCIVVAPATANTIAKL

SEQ ID NO: 2103597 - protein, 20 aa, Staphylococcus
GEANGDMGGVPTSDKAFSND

SEQ ID NO: 2103598 - protein, 18 aa, Staphylococcus
GEEYNLLNGVHAYDKEDG

SEQ ID NO: 2103599 - protein, 18 aa, Staphylococcus
GEGDIYFNSMSPRSDIKA

SEQ ID NO: 2103600 - protein, 20 aa, Staphylococcus
GEHKAHQYLVGFAAETQDIE

SEQ ID NO: 2103601 - protein, 27 aa, Staphylococcus
GEINQFGSLYIKYPTATYRIIFNIDQG

SEQ ID NO: 2103602 - protein, 17 aa, Staphylococcus
GELGAKVIMPIYPKVPH

SEQ ID NO: 2103603 - protein, 26 aa, Staphylococcus
GEPMFQFCLGIPWGAENDPETIEYFK

SEQ ID NO: 2103604 - protein, 19 aa, Staphylococcus
GEQVFKELINDPGDTNTAL

SEQ ID NO: 2103605 - protein, 20 aa, Staphylococcus
GESLWSIADQYGVSVDSIKQ

SEQ ID NO: 2103606 - protein, 21 aa, Staphylococcus
GESLWSISHHYGITVSKLKSL

SEQ ID NO: 2103607 - protein, 41 aa, Staphylococcus
GESTHKGLFGRQKADLNLFFPFTVTANVIGKAKEKEWREND

SEQ ID NO: 2103608 - protein, 24 aa, Staphylococcus
GEYDPHIWLDPKMDQTFAKEIKDA

SEQ ID NO: 2103609 - protein, 24 aa, Staphylococcus
GEYQLGKPFKIYKFNGQEDGNYYF

SEQ ID NO: 2103610 - protein, 25 aa, Staphylococcus
GFSLTHLIASLFNFDSDISDYEQPA

SEQ ID NO: 2103611 - protein, 19 aa, Staphylococcus
GGCLWGVQAFVKTLPGVVE

SEQ ID NO: 2103612 - protein, 24 aa, Staphylococcus
GGDDRPYHGFKRFNTPSSVAQDLV

SEQ ID NO: 2103613 - protein, 18 aa, Staphylococcus
GGFEKFIAGESDFSNASR

SEQ ID NO: 2103614 - protein, 18 aa, Staphylococcus
GGFEKFIAGETDFSNASR

SEQ ID NO: 2103615 - protein, 18 aa, Staphylococcus
GGGFQLANKGLIFSNGLN

SEQ ID NO: 2103616 - protein, 20 aa, Staphylococcus
GGGLAEMANRILSTSHKADD

SEQ ID NO: 2103617 - protein, 24 aa, Staphylococcus
GGGYQLAEKGLIFSNGLNGPKARL

SEQ ID NO: 2103618 - protein, 24 aa, Staphylococcus
GGKTYRFHLKKGVKFSDGSDFDAQ

SEQ ID NO: 2103619 - protein, 17 aa, Staphylococcus
GGKVKAVKFYKLKDTKT

SEQ ID NO: 2103620 - protein, 22 aa, Staphylococcus
GGQAYWSFGGLFLVNSKIQQRL

SEQ ID NO: 2103621 - protein, 17 aa, Staphylococcus
GGSIIFISDHYNADRNL

SEQ ID NO: 2103622 - protein, 19 aa, Staphylococcus
GGSTKAQFLANGGTEEAWN

SEQ ID NO: 2103623 - protein, 20 aa, Staphylococcus
GGSVKAQFLANGGTEAAWNA

SEQ ID NO: 2103624 - protein, 20 aa, Staphylococcus
GGSVNPGGGMPMVTLSGQQV

SEQ ID NO: 2103625 - protein, 24 aa, Staphylococcus
GGTEEAWNAIVMPESGGNPNAVNP

SEQ ID NO: 2103626 - protein, 19 aa, Staphylococcus
GGTEEMWENIVMPESGGNP

SEQ ID NO: 2103627 - protein, 17 aa, Staphylococcus
GGTKALWDNIVMPESSG

SEQ ID NO: 2103628 - protein, 24 aa, Staphylococcus
GGTLRLGLYPSEVKEGTLAYDIYG

SEQ ID NO: 2103629 - protein, 18 aa, Staphylococcus
GGTVDYGAAHAAKYGHER

SEQ ID NO: 2103630 - protein, 19 aa, Staphylococcus
GHHPEIILAGRRINDNMAE

SEQ ID NO: 2103631 - protein, 24 aa, Staphylococcus
GHPSESYVGQFLTQLGFKEALSPD

SEQ ID NO: 2103632 - protein, 19 aa, Staphylococcus
GHSEHQTGLAFDVGTSQPL

SEQ ID NO: 2103633 - protein, 19 aa, Staphylococcus
GHSLIRWDEQGDTLSNYSL

SEQ ID NO: 2103634 - protein, 26 aa, Staphylococcus
GIANYLPSGTNFDWAPGSGQPLSNSP

SEQ ID NO: 2103635 - protein, 20 aa, Staphylococcus
GIDGNATIYQPTWKSETSSY

SEQ ID NO: 2103636 - protein, 20 aa, Staphylococcus
GIGVGVAAGFAVSLRNRDDQ

SEQ ID NO: 2103637 - protein, 23 aa, Staphylococcus
GIICAVLLYFSYVGLGASSDKII

SEQ ID NO: 2103638 - protein, 18 aa, Staphylococcus
GINESVKHHAIIDKNTGK

SEQ ID NO: 2103639 - protein, 17 aa, Staphylococcus
GIPESKNLGGFPITGQF

SEQ ID NO: 2103640 - protein, 18 aa, Staphylococcus
GISTYWWNANNWDNAAAA

SEQ ID NO: 2103641 - protein, 28 aa, Staphylococcus
GIVASTLFLGACDLNIHLPGGNNDSSED

SEQ ID NO: 2103642 - protein, 29 aa, Staphylococcus
GKAFGNKDSRVDFGLSQWGLKQKPNESYI

SEQ ID NO: 2103643 - protein, 23 aa, Staphylococcus
GKDFIKYVICNTQLYDEAVLAHY

SEQ ID NO: 2103644 - protein, 18 aa, Staphylococcus
GKDYVWNPEAIRKMKHSG

SEQ ID NO: 2103645 - protein, 17 aa, Staphylococcus
GKEPAIIAEEYLKKHNY

SEQ ID NO: 2103646 - protein, 18 aa, Staphylococcus
GKEPAVIAEEFVKKHNYF

SEQ ID NO: 2103647 - protein, 17 aa, Staphylococcus
GKEPAVVAEEFLKKHHY

SEQ ID NO: 2103648 - protein, 17 aa, Staphylococcus
GKFVYDLDLQKGNNKHE

SEQ ID NO: 2103649 - protein, 19 aa, Staphylococcus
GKHIPYKFHASNVKKLPHY

SEQ ID NO: 2103650 - protein, 17 aa, Staphylococcus
GKHQYATGVTWASVNAQ

SEQ ID NO: 2103651 - protein, 17 aa, Staphylococcus
GKIDSVVHYDKDYNNAA

SEQ ID NO: 2103652 - protein, 20 aa, Staphylococcus
GKIIKTGGAITSPDGPIKAE

SEQ ID NO: 2103653 - protein, 18 aa, Staphylococcus
GKILGGFVVGPHATDLIS

SEQ ID NO: 2103654 - protein, 17 aa, Staphylococcus
GKILSIIQIPYKVEKGE

SEQ ID NO: 2103655 - protein, 23 aa, Staphylococcus
GKKIKGMTIGLAMNSVYYYQKEK

SEQ ID NO: 2103656 - protein, 25 aa, Staphylococcus
GKKKPISRPWIQDFTASYLGNGNYI

SEQ ID NO: 2103657 - protein, 23 aa, Staphylococcus
GKKTEELKHFAITRDMESIPNAP

SEQ ID NO: 2103658 - protein, 17 aa, Staphylococcus
GKLKVVTTNSILYDMVK

SEQ ID NO: 2103659 - protein, 21 aa, Staphylococcus
GKNETPEYVGLFYNAKSYDRE

SEQ ID NO: 2103660 - protein, 21 aa, Staphylococcus
GKPMEICFTNAFGAKPYQMLQ

SEQ ID NO: 2103661 - protein, 17 aa, Staphylococcus
GKRGRVGIVPLINNQAY

SEQ ID NO: 2103662 - protein, 29 aa, Staphylococcus
GKTASLLDMEVKGQLSLTQLKKVYSKELQ

SEQ ID NO: 2103663 - protein, 32 aa, Staphylococcus
GKTNSGANYYTWGQCTYYVYDKVGGSIGNTWG

SEQ ID NO: 2103664 - protein, 22 aa, Staphylococcus
GKTPYHRIVSLMPSNTEILYEL

SEQ ID NO: 2103665 - protein, 18 aa, Staphylococcus
GKTSMYILMPVPELKTGQ

SEQ ID NO: 2103666 - protein, 22 aa, Staphylococcus
GKVYEFHLKKNVKFSDGSALDA

SEQ ID NO: 2103667 - protein, 17 aa, Staphylococcus
GKWAYKVDLQKQGEEAE

SEQ ID NO: 2103668 - protein, 20 aa, Staphylococcus
GKYPGTWGVEQGKPYEVILE

SEQ ID NO: 2103669 - protein, 17 aa, Staphylococcus
GKYRQFIQSDLGHELDV

SEQ ID NO: 2103670 - protein, 19 aa, Staphylococcus
GLAIAKVFLENGAKVVLAD

SEQ ID NO: 2103671 - protein, 23 aa, Staphylococcus
GLASLDVVRYVAFHHPKLPITMT

SEQ ID NO: 2103672 - protein, 34 aa, Staphylococcus
GLDTLREIIKYHGPFKALRGFDYFSTMQQAINRY

SEQ ID NO: 2103673 - protein, 18 aa, Staphylococcus
GLIFIIALLCTVISINGN

SEQ ID NO: 2103674 - protein, 18 aa, Staphylococcus
GLILWLGIVEKRQHSDRL

SEQ ID NO: 2103675 - protein, 19 aa, Staphylococcus
GLLDFRRFGGTLHHRTAYA

SEQ ID NO: 2103676 - protein, 26 aa, Staphylococcus
GLNGPKARLKLLIGLSNQLNIVELKN

SEQ ID NO: 2103677 - protein, 21 aa, Staphylococcus
GLSNFFIYPGQKLKVPGGGSG

SEQ ID NO: 2103678 - protein, 20 aa, Staphylococcus
GLTTPLGWVNAKDVKVVNQS

SEQ ID NO: 2103679 - protein, 28 aa, Staphylococcus
GLVLIMFVLCGFIFPLTVTALGQVLFPE

SEQ ID NO: 2103680 - protein, 18 aa, Staphylococcus
GLYSIAWGTKNQQLLPAS

SEQ ID NO: 2103681 - protein, 18 aa, Staphylococcus
GLYSIAWGTNQQRLDNKD

SEQ ID NO: 2103682 - protein, 19 aa, Staphylococcus
GLYSIPWGTTQQQLEQANS

SEQ ID NO: 2103683 - protein, 19 aa, Staphylococcus
GLYTMPWGTSKQQIDNLKQ

SEQ ID NO: 2103684 - protein, 22 aa, Staphylococcus
GMGPSYNSAYRYFADNPETKEM

SEQ ID NO: 2103685 - protein, 17 aa, Staphylococcus
GMGPSYNSAYRYYADNP

SEQ ID NO: 2103686 - protein, 24 aa, Staphylococcus
GMHPHVIEPVKWVKGKDGNKTLVA

SEQ ID NO: 2103687 - protein, 24 aa, Staphylococcus
GMHPHVIQPVKWVKGKNQHQTLVA

SEQ ID NO: 2103688 - protein, 21 aa, Staphylococcus
GMKKLKPNHYLKIKEKLNTVR

SEQ ID NO: 2103689 - protein, 24 aa, Staphylococcus
GMSAVCAVVGFSFSGMSGEEAHAA

SEQ ID NO: 2103690 - protein, 17 aa, Staphylococcus
GNAEASGAGQGPDQATN

SEQ ID NO: 2103691 - protein, 18 aa, Staphylococcus
GNAFLPHALNEFKSDQYI

SEQ ID NO: 2103692 - protein, 26 aa, Staphylococcus
GNAHEIVIMPGIFPFIGETREAAEAQ

SEQ ID NO: 2103693 - protein, 19 aa, Staphylococcus
GNDKFYLVEDYNTGKKYGW

SEQ ID NO: 2103694 - protein, 19 aa, Staphylococcus
GNDKFYLVQDYNTGKKYGW

SEQ ID NO: 2103695 - protein, 27 aa, Staphylococcus
GNEALVRQVVYDLGRAFGNKNSRVDFG

SEQ ID NO: 2103696 - protein, 26 aa, Staphylococcus
GNEPFIRQLAYDYAKFQGSKHSKVDV

SEQ ID NO: 2103697 - protein, 22 aa, Staphylococcus
GNERFINVEIVHTHDYASFARS

SEQ ID NO: 2103698 - protein, 19 aa, Staphylococcus
GNHNKTYNDYGIEGNNGNY

SEQ ID NO: 2103699 - protein, 26 aa, Staphylococcus
GNKFSRADLGLTQWGLKQRPDETYID

SEQ ID NO: 2103700 - protein, 24 aa, Staphylococcus
GNLEHKGILGTGIVRIFDMTIAQT

SEQ ID NO: 2103701 - protein, 17 aa, Staphylococcus
GNLIYPGQSLTIPGASG

SEQ ID NO: 2103702 - protein, 17 aa, Staphylococcus
GNLSFAYFMKMYGTDKD

SEQ ID NO: 2103703 - protein, 37 aa, Staphylococcus
GNLYTAGQCTWYVFDKVGGKIGSTWGNANNWATSAQS

SEQ ID NO: 2103704 - protein, 31 aa, Staphylococcus
GNLYTAGQCTWYVFDRVDGKIGSTWGNANNW

SEQ ID NO: 2103705 - protein, 32 aa, Staphylococcus
GNNSPVYRAQLFLSPYGPPAYLQAINTNQANT

SEQ ID NO: 2103706 - protein, 19 aa, Staphylococcus
GNPDFALHTGDFVENSQTE

SEQ ID NO: 2103707 - protein, 25 aa, Staphylococcus
GNPTIYKPTWKHEAIDYRDATRHLS

SEQ ID NO: 2103708 - protein, 23 aa, Staphylococcus
GNRYDVGEKLGFVKTTIEYALKD

SEQ ID NO: 2103709 - protein, 29 aa, Staphylococcus
GNSTAPHLHFQRMQGGVGNEYSVNPDSYI

SEQ ID NO: 2103710 - protein, 19 aa, Staphylococcus
GNTKDIYDLNARREVTKYI

SEQ ID NO: 2103711 - protein, 19 aa, Staphylococcus
GNVSFNKNIIVDYGDNKNN

SEQ ID NO: 2103712 - protein, 18 aa, Staphylococcus
GNWGFSFTDKDGELAGSY

SEQ ID NO: 2103713 - protein, 18 aa, Staphylococcus
GPASAAYQSSLRVESGAE

SEQ ID NO: 2103714 - protein, 25 aa, Staphylococcus
GPEYYPPLFKEWHTFSTPDTLNKIS

SEQ ID NO: 2103715 - protein, 25 aa, Staphylococcus
GPKAFKLHTLAGFVTYKSAHKQTGI

SEQ ID NO: 2103716 - protein, 23 aa, Staphylococcus
GPKEIPYETLLFATGRQPNVHVA

SEQ ID NO: 2103717 - protein, 18 aa, Staphylococcus
GPVLFGFFGHSSIAIDHD

SEQ ID NO: 2103718 - protein, 18 aa, Staphylococcus
GPVLFGFFGHSSIALDHD

SEQ ID NO: 2103719 - protein, 24 aa, Staphylococcus
GQDKDLYASVMIAQAILESSSGNS

SEQ ID NO: 2103720 - protein, 20 aa, Staphylococcus
GQDYNLLNGISAYDKEDGDL

SEQ ID NO: 2103721 - protein, 20 aa, Staphylococcus
GQDYNVLNGISAYDKEDGDL

SEQ ID NO: 2103722 - protein, 18 aa, Staphylococcus
GQELMMLQKALTKEKMVG

SEQ ID NO: 2103723 - protein, 17 aa, Staphylococcus
GQFKQFRHGLSSFIEAL

SEQ ID NO: 2103724 - protein, 28 aa, Staphylococcus
GQGTVWTHYAISRFLGGTDHSDPHAYLQ

SEQ ID NO: 2103725 - protein, 28 aa, Staphylococcus
GQGTVWTHYAISRWLGGTDHADPHQYFS

SEQ ID NO: 2103726 - protein, 17 aa, Staphylococcus
GQIALSFAEYLKAETTL

SEQ ID NO: 2103727 - protein, 17 aa, Staphylococcus
GQIALSFAQYLKKETPL

SEQ ID NO: 2103728 - protein, 17 aa, Staphylococcus
GQKAEMCVVSHALNTIQ

SEQ ID NO: 2103729 - protein, 17 aa, Staphylococcus
GQKSYRTIHNTGQYNYI

SEQ ID NO: 2103730 - protein, 20 aa, Staphylococcus
GQLPPGRHVMTARIGNETKI

SEQ ID NO: 2103731 - protein, 25 aa, Staphylococcus
GQLSDKTKLALIFYADPKGKYSLTK

SEQ ID NO: 2103732 - protein, 21 aa, Staphylococcus
GQMKQAIRFVKDNHLKHLLVE

SEQ ID NO: 2103733 - protein, 24 aa, Staphylococcus
GQNTLYRMRWNPSSPGNHQYATDI

SEQ ID NO: 2103734 - protein, 25 aa, Staphylococcus
GQPFNEIYCAAKFGVEGYTESLASY

SEQ ID NO: 2103735 - protein, 24 aa, Staphylococcus
GQPFNEIYCATKFGVEGYTEAMAS

SEQ ID NO: 2103736 - protein, 26 aa, Staphylococcus
GQSGASALYGHVAFVEKVNDDGSIII

SEQ ID NO: 2103737 - protein, 19 aa, Staphylococcus
GQTKEAWGKGSVEEQTKGM

SEQ ID NO: 2103738 - protein, 18 aa, Staphylococcus
GQTYKLSKKATLGSNAFY

SEQ ID NO: 2103739 - protein, 17 aa, Staphylococcus
GQVDTYADRLVIKHNGQ

SEQ ID NO: 2103740 - protein, 29 aa, Staphylococcus
GRAFGNKNSRVDFGLSQWGLKQKPNESRI

SEQ ID NO: 2103741 - protein, 25 aa, Staphylococcus
GRALGGGCELVLYSPFVVAASETYI

SEQ ID NO: 2103742 - protein, 21 aa, Staphylococcus
GRFGDLVFNTLGFKPADKHVK

SEQ ID NO: 2103743 - protein, 27 aa, Staphylococcus
GRFVEEKGRVIGMPKLKGLKNKEKPDL

SEQ ID NO: 2103744 - protein, 18 aa, Staphylococcus
GRIHPGRIEDMVDKARKE

SEQ ID NO: 2103745 - protein, 18 aa, Staphylococcus
GRIHPGRIEDMVEKARKE

SEQ ID NO: 2103746 - protein, 22 aa, Staphylococcus
GRQAYTGSYNRAALKQQTVKQM

SEQ ID NO: 2103747 - protein, 22 aa, Staphylococcus
GRTINANDVLKLITANTTIPGL

SEQ ID NO: 2103748 - protein, 22 aa, Staphylococcus
GRTNQFGSLILKINQHQYKLII

SEQ ID NO: 2103749 - protein, 18 aa, Staphylococcus
GSDLAMPVANKLSETLDL

SEQ ID NO: 2103750 - protein, 19 aa, Staphylococcus
GSDLLEFYANQGVDGIVVE

SEQ ID NO: 2103751 - protein, 25 aa, Staphylococcus
GSEHYYEFRTNKGVLLVTADGKKDR

SEQ ID NO: 2103752 - protein, 17 aa, Staphylococcus
GSEILYDSFGLKMPEKV

SEQ ID NO: 2103753 - protein, 21 aa, Staphylococcus
GSGLNRRGYRIAQGEAPIKET

SEQ ID NO: 2103754 - protein, 22 aa, Staphylococcus
GSGLNRRGYRLAQGEAPIKETL

SEQ ID NO: 2103755 - protein, 46 aa, Staphylococcus
GSGSNAYTAGQCTYYVYDKVGGKIGSNWGNASNWANAAAQDGYNVS

SEQ ID NO: 2103756 - protein, 20 aa, Staphylococcus
GSGYWSGTFLHATNKSAPYY

SEQ ID NO: 2103757 - protein, 19 aa, Staphylococcus
GSIGNTWGNANNWANAAAQ

SEQ ID NO: 2103758 - protein, 28 aa, Staphylococcus
GSKIVRTLEVFGVQMLQYGDVSLVYTYE

SEQ ID NO: 2103759 - protein, 18 aa, Staphylococcus
GSMASLMLLLAAGAPQNA

SEQ ID NO: 2103760 - protein, 24 aa, Staphylococcus
GSMLPKIESAISFIKNNPKGSVLI

SEQ ID NO: 2103761 - protein, 24 aa, Staphylococcus
GSMLPKVEAALQFIEKNPKGSVLI

SEQ ID NO: 2103762 - protein, 25 aa, Staphylococcus
GSNGQWTIANKPSYISVDSATGKVT

SEQ ID NO: 2103763 - protein, 18 aa, Staphylococcus
GSNIKGMTIGLAMNSVYY

SEQ ID NO: 2103764 - protein, 23 aa, Staphylococcus
GSNSIKTTLTFDDLGITTSNNRH

SEQ ID NO: 2103765 - protein, 18 aa, Staphylococcus
GSQNLGPLEDKTTNLRDE

SEQ ID NO: 2103766 - protein, 20 aa, Staphylococcus
GSRMPYVFQATEVIKVPQYD

SEQ ID NO: 2103767 - protein, 20 aa, Staphylococcus
GSSIGDEIKTLIGNFKSDIN

SEQ ID NO: 2103768 - protein, 29 aa, Staphylococcus
GSSSYPQGQCTWYVDQRMKQFGQYIHSNL

SEQ ID NO: 2103769 - protein, 30 aa, Staphylococcus
GSTAEGRWLAKNAYKYGFILRYPKGKEKIT

SEQ ID NO: 2103770 - protein, 19 aa, Staphylococcus
GSVEFKVTSHLSVKQLKEA

SEQ ID NO: 2103771 - protein, 19 aa, Staphylococcus
GSVNNKLGWIAEKDLTSLS

SEQ ID NO: 2103772 - protein, 17 aa, Staphylococcus
GSVNPGGGMPMVTLSGM

SEQ ID NO: 2103773 - protein, 17 aa, Staphylococcus
GSVNPGGGMPMVTLSGQ

SEQ ID NO: 2103774 - protein, 18 aa, Staphylococcus
GSVNTRYRNEVYQLISDF

SEQ ID NO: 2103775 - protein, 17 aa, Staphylococcus
GSVSGKSAQTFKATKQQ

SEQ ID NO: 2103776 - protein, 19 aa, Staphylococcus
GSYALSRPLFLYVKEKSLK

SEQ ID NO: 2103777 - protein, 21 aa, Staphylococcus
GSYPLSRPLFLYVKEKSLEDN

SEQ ID NO: 2103778 - protein, 20 aa, Staphylococcus
GTALLLLSACNNGDSSSDSK

SEQ ID NO: 2103779 - protein, 18 aa, Staphylococcus
GTEDMWNTIVMPESGGNP

SEQ ID NO: 2103780 - protein, 23 aa, Staphylococcus
GTGSIQNDGLWYFIPNESSKGQM

SEQ ID NO: 2103781 - protein, 17 aa, Staphylococcus
GTITIGLVGKYVSLQDA

SEQ ID NO: 2103782 - protein, 29 aa, Staphylococcus
GTNTESWDALTKPNAAQILNAKYDVFYQG

SEQ ID NO: 2103783 - protein, 24 aa, Staphylococcus
GTQEAVETFTLYYDKQYGYIHRLF

SEQ ID NO: 2103784 - protein, 25 aa, Staphylococcus
GTVNGKSGWISKYYLTTPSSSSNST

SEQ ID NO: 2103785 - protein, 24 aa, Staphylococcus
GTVNGKSGWVSKYYLTAPTQSKVA

SEQ ID NO: 2103786 - protein, 17 aa, Staphylococcus
GTVNGKTGWIAEKDLVQ

SEQ ID NO: 2103787 - protein, 26 aa, Staphylococcus
GVATPVQVPVSLYVYQFDFSPNAYTT

SEQ ID NO: 2103788 - protein, 25 aa, Staphylococcus
GVDYGMPENTPVYSLTDGTVTQAGW

SEQ ID NO: 2103789 - protein, 28 aa, Staphylococcus
GVEKAFAIQAGREIRVIVSPDEIDDLKA

SEQ ID NO: 2103790 - protein, 28 aa, Staphylococcus
GVEKAFAIQAGREIRVIVSPDEIDDLKS

SEQ ID NO: 2103791 - protein, 20 aa, Staphylococcus
GVEKAFAIQAGREIRVVVSP

SEQ ID NO: 2103792 - protein, 28 aa, Staphylococcus
GVEKAFAIQAGREIRVVVSPEEIDDLKS

SEQ ID NO: 2103793 - protein, 18 aa, Staphylococcus
GVFLLLLAACGSNDGSKE

SEQ ID NO: 2103794 - protein, 33 aa, Staphylococcus
GVGAGEGQSLPAMWRTAGGIDSSRASNFVQGPP

SEQ ID NO: 2103795 - protein, 22 aa, Staphylococcus
GVIKRISMEYNKPDGPTFKEVR

SEQ ID NO: 2103796 - protein, 17 aa, Staphylococcus
GVIQRESGGNANAVNAS

SEQ ID NO: 2103797 - protein, 21 aa, Staphylococcus
GVKMLKDPDKIYGKEDQHINL

SEQ ID NO: 2103798 - protein, 25 aa, Staphylococcus
GVKRKEIKNPGGLKQIDYWYVDPSG

SEQ ID NO: 2103799 - protein, 17 aa, Staphylococcus
GVLFLAFGLHFKDRTEL

SEQ ID NO: 2103800 - protein, 24 aa, Staphylococcus
GVNVKGYFVWSLQDMFSWSNGYNK

SEQ ID NO: 2103801 - protein, 26 aa, Staphylococcus
GVYKDWKPGQKVHLVGHSMGGQTIRQ

SEQ ID NO: 2103802 - protein, 27 aa, Staphylococcus
GVYKDWKPGQKVHLVGHSMGGQTIRQL

SEQ ID NO: 2103803 - protein, 22 aa, Staphylococcus
GVYSATKFGVWAASEALRQEEA

SEQ ID NO: 2103804 - protein, 24 aa, Staphylococcus
GWGPDYPDPLTFLNIMTTGNSNNN

SEQ ID NO: 2103805 - protein, 18 aa, Staphylococcus
GYDAKFTLDKNFKNAIKA

SEQ ID NO: 2103806 - protein, 31 aa, Staphylococcus
GYDIYVRKGTTCFGVALGILRVVEAILNNQN

SEQ ID NO: 2103807 - protein, 27 aa, Staphylococcus
GYDLESRGCIFSNGLNGPKARLKLLVG

SEQ ID NO: 2103808 - protein, 18 aa, Staphylococcus
GYPFKKDVVVKWIDSSLV

SEQ ID NO: 2103809 - protein, 18 aa, Staphylococcus
GYQYEPWHLRYLGKEKAK

SEQ ID NO: 2103810 - protein, 18 aa, Staphylococcus
GYQYEPWHLRYLGKNNAA

SEQ ID NO: 2103811 - protein, 19 aa, Staphylococcus
GYTPKELTVQFVPSQNADT

SEQ ID NO: 2103812 - protein, 17 aa, Staphylococcus
HAANYGFIIRYPKNQSK

SEQ ID NO: 2103813 - protein, 19 aa, Staphylococcus
HAGYYPGAEPLHLRVYFEN

SEQ ID NO: 2103814 - protein, 19 aa, Staphylococcus
HALNEFKSDQYINLGNPGR

SEQ ID NO: 2103815 - protein, 31 aa, Staphylococcus
HARNSFSSIEGWKAVSKEAIIKKNPDILIST

SEQ ID NO: 2103816 - protein, 23 aa, Staphylococcus
HARVAGEPVLPMLQQRYGNNVDA

SEQ ID NO: 2103817 - protein, 17 aa, Staphylococcus
HAYAYGGPNMAVKSLEK

SEQ ID NO: 2103818 - protein, 18 aa, Staphylococcus
HCQVYDYIFLTIGTLSYH

SEQ ID NO: 2103819 - protein, 23 aa, Staphylococcus
HDFLSDITYQWERLARQFEKLGT

SEQ ID NO: 2103820 - protein, 29 aa, Staphylococcus
HDFMPGYNLFHIHPIFPIPEKEQFIAKIN

SEQ ID NO: 2103821 - protein, 25 aa, Staphylococcus
HDFMPGYNLFHIYPIFPLPERQKFF

SEQ ID NO: 2103822 - protein, 26 aa, Staphylococcus
HDFYPGYNLFHIYPIFPIPEREKFFA

SEQ ID NO: 2103823 - protein, 25 aa, Staphylococcus
HDIAPSHVAVCWDMGQETFRNQMYA

SEQ ID NO: 2103824 - protein, 24 aa, Staphylococcus
HDPHVWLDPVLNKKFAKEIKDELI

SEQ ID NO: 2103825 - protein, 20 aa, Staphylococcus
HDPYHLKGIKGFKPTPYPTY

SEQ ID NO: 2103826 - protein, 23 aa, Staphylococcus
HDSLGYLAERYHFQQEGVSGMNN

SEQ ID NO: 2103827 - protein, 21 aa, Staphylococcus
HDVHKALIVGAGYISLEVLEN

SEQ ID NO: 2103828 - protein, 25 aa, Staphylococcus
HEFIPGYSLFHIYPIFPIPERERFL

SEQ ID NO: 2103829 - protein, 25 aa, Staphylococcus
HEIQPTHVAVCWDMGQSTFRNDMFE

SEQ ID NO: 2103830 - protein, 22 aa, Staphylococcus
HEKDLRLGVDSSWLNRKGDGYP

SEQ ID NO: 2103831 - protein, 21 aa, Staphylococcus
HEKGFFEQIEEAFSELEKEFT

SEQ ID NO: 2103832 - protein, 32 aa, Staphylococcus
HENKSYILEGIREWQKQLSILATQIESEDSDG

SEQ ID NO: 2103833 - protein, 25 aa, Staphylococcus
HFESNGTHWSWNYAQNGQATPQQDV

SEQ ID NO: 2103834 - protein, 19 aa, Staphylococcus
HFFRERLGDEVLENLIEPL

SEQ ID NO: 2103835 - protein, 21 aa, Staphylococcus
HGGDISPLYKGGQDNMISSIT

SEQ ID NO: 2103836 - protein, 24 aa, Staphylococcus
HGNSVPRFHITWGTGPGLVEPFSR

SEQ ID NO: 2103837 - protein, 23 aa, Staphylococcus
HHHHGGYDPHVWLDPEKNKVFAI

SEQ ID NO: 2103838 - protein, 30 aa, Staphylococcus
HHHHGGYDPHVWLDPKFDQTFAKEIKDELI

SEQ ID NO: 2103839 - protein, 17 aa, Staphylococcus
HHMLTGNSLNHGHILIQ

SEQ ID NO: 2103840 - protein, 30 aa, Staphylococcus
HIMNLNGLNSFLIFPGQQLKVSGSVSSNSH

SEQ ID NO: 2103841 - protein, 24 aa, Staphylococcus
HINAWKPYRHDVLFSGVFKSQKES

SEQ ID NO: 2103842 - protein, 17 aa, Staphylococcus
HITACTWTSKKWPFTTP

SEQ ID NO: 2103843 - protein, 18 aa, Staphylococcus
HIVASSLVHLSANQVEKH

SEQ ID NO: 2103844 - protein, 22 aa, Staphylococcus
HKANQWLKHWEKQLAKDKKALA

SEQ ID NO: 2103845 - protein, 24 aa, Staphylococcus
HKDELRLGMDTQWMNRAGDGYPAF

SEQ ID NO: 2103846 - protein, 19 aa, Staphylococcus
HKDYYTSMTQLERETKEGI

SEQ ID NO: 2103847 - protein, 19 aa, Staphylococcus
HKIESFKFSGLTDAPIDYK

SEQ ID NO: 2103848 - protein, 22 aa, Staphylococcus
HKIYELDPKLWYFSSGSTTTTM

SEQ ID NO: 2103849 - protein, 35 aa, Staphylococcus
HKPEIKVLNELKGFKMINGGSVGLVNSELERTNVF

SEQ ID NO: 2103850 - protein, 26 aa, Staphylococcus
HKSLIYRYDATSGRTINANDVLKLIT

SEQ ID NO: 2103851 - protein, 31 aa, Staphylococcus
HKVKSGESLWSISSKYGISISKLKSLNHLSS

SEQ ID NO: 2103852 - protein, 21 aa, Staphylococcus
HKVSDLKASLINVKDTNKIKA

SEQ ID NO: 2103853 - protein, 31 aa, Staphylococcus
HLIGHSMGGQTVRLLEEMLRNRNPEEIEYQK

SEQ ID NO: 2103854 - protein, 23 aa, Staphylococcus
HLKLGVYQDGGRQLARFSQDGQN

SEQ ID NO: 2103855 - protein, 22 aa, Staphylococcus
HLTAPAEYYVWGAGPKANPYFY

SEQ ID NO: 2103856 - protein, 18 aa, Staphylococcus
HLVGHSMGGQTIRLMEHF

SEQ ID NO: 2103857 - protein, 22 aa, Staphylococcus
HNKANAGLGVYRVHKNGQVEYK

SEQ ID NO: 2103858 - protein, 21 aa, Staphylococcus
HNKKIIKRNIKYIKSKKSGYI

SEQ ID NO: 2103859 - protein, 17 aa, Staphylococcus
HNMKVLAQDGYRFAEPG

SEQ ID NO: 2103860 - protein, 22 aa, Staphylococcus
HNQGIDHIYAFQARGTDSYTIQ

SEQ ID NO: 2103861 - protein, 25 aa, Staphylococcus
HNVNLRNGDPFTIALFGVDSNAQRK

SEQ ID NO: 2103862 - protein, 23 aa, Staphylococcus
HPAAYDIATRMAKDWDQKDEERL

SEQ ID NO: 2103863 - protein, 24 aa, Staphylococcus
HPAAYKIATRIADDWNEEDENKLS

SEQ ID NO: 2103864 - protein, 28 aa, Staphylococcus
HPDLVKILGRLQYRTSYGQNVLKHSIEV

SEQ ID NO: 2103865 - protein, 19 aa, Staphylococcus
HPNEIGIFQTLIENVKENL

SEQ ID NO: 2103866 - protein, 22 aa, Staphylococcus
HQSIWKKICVNGTANALCSILE

SEQ ID NO: 2103867 - protein, 24 aa, Staphylococcus
HRDYRTTFELLKLIYDKQAAKVES

SEQ ID NO: 2103868 - protein, 20 aa, Staphylococcus
HRYSTHYLLLEEMRKQLHLD

SEQ ID NO: 2103869 - protein, 32 aa, Staphylococcus
HSDPVGYFSQWGYNMNQFYSLVQKHYKVLSGG

SEQ ID NO: 2103870 - protein, 22 aa, Staphylococcus
HSKEARKALKEDTKDGEKIVDL

SEQ ID NO: 2103871 - protein, 25 aa, Staphylococcus
HSNLYDWGQCTWHVFNKRAQIGKGI

SEQ ID NO: 2103872 - protein, 24 aa, Staphylococcus
HSPELRGVNDIVIEKGQNYNLLNG

SEQ ID NO: 2103873 - protein, 18 aa, Staphylococcus
HSRSDAMILSTFNQDKHQ

SEQ ID NO: 2103874 - protein, 25 aa, Staphylococcus
HTEKAIKKLGRFSSYKVANHLVPYE

SEQ ID NO: 2103875 - protein, 20 aa, Staphylococcus
HTGNSIQLWAEFPNYLNHKS

SEQ ID NO: 2103876 - protein, 18 aa, Staphylococcus
HTGPLGFQIPDVRQLFAM

SEQ ID NO: 2103877 - protein, 25 aa, Staphylococcus
HTLKVELTKPIPYINEMFAFGTFMP

SEQ ID NO: 2103878 - protein, 17 aa, Staphylococcus
HTTIAHRGASGYAPEHT

SEQ ID NO: 2103879 - protein, 20 aa, Staphylococcus
HVNMNAQVPLAWGAHRAANI

SEQ ID NO: 2103880 - protein, 17 aa, Staphylococcus
HVVKVTAGTYWYNDPYT

SEQ ID NO: 2103881 - protein, 18 aa, Staphylococcus
HWHGLEVNGKVDGGPSQV

SEQ ID NO: 2103882 - protein, 28 aa, Staphylococcus
HYRHVNLPAQVPLAWGAHRAASIIAEQI

SEQ ID NO: 2103883 - protein, 23 aa, Staphylococcus
HYSNGRAGWNIVTSGINHTAKNF

SEQ ID NO: 2103884 - protein, 17 aa, Staphylococcus
IAATAKRENAINDKGSY

SEQ ID NO: 2103885 - protein, 19 aa, Staphylococcus
IADHVTKISVNPAGSNTPV

SEQ ID NO: 2103886 - protein, 28 aa, Staphylococcus
IAESAIKCARAGATVAHIHARDPETGGI

SEQ ID NO: 2103887 - protein, 22 aa, Staphylococcus
IAESSPAYLSNILEQDFYDTND

SEQ ID NO: 2103888 - protein, 20 aa, Staphylococcus
IAFMKRNYNSAFVHAFVDGN

SEQ ID NO: 2103889 - protein, 17 aa, Staphylococcus
IALKKQYGIEGKLAVYV

SEQ ID NO: 2103890 - protein, 17 aa, Staphylococcus
IALVFVLAACGNGGSSK

SEQ ID NO: 2103891 - protein, 17 aa, Staphylococcus
IALVFVLAACGNNDSSS

SEQ ID NO: 2103892 - protein, 17 aa, Staphylococcus
IALVFVLAACGNNSSKD

SEQ ID NO: 2103893 - protein, 24 aa, Staphylococcus
IAPKKAEHFHIFMGDNNDSLLKEM

SEQ ID NO: 2103894 - protein, 17 aa, Staphylococcus
IAPTYVFDANQSSYKDT

SEQ ID NO: 2103895 - protein, 17 aa, Staphylococcus
IAQDYIKSGQNTLYKMR

SEQ ID NO: 2103896 - protein, 19 aa, Staphylococcus
IAQIKGHDQALIALLNGDV

SEQ ID NO: 2103897 - protein, 25 aa, Staphylococcus
IASSNADMWRDITFSNQENILHLLE

SEQ ID NO: 2103898 - protein, 23 aa, Staphylococcus
IASSNAEMWKDILLSNKQNIISL

SEQ ID NO: 2103899 - protein, 22 aa, Staphylococcus
IASSNAEMWKDITLNNKTFILD

SEQ ID NO: 2103900 - protein, 26 aa, Staphylococcus
IASSNAEMWRDITISNKTAILNLIQD

SEQ ID NO: 2103901 - protein, 22 aa, Staphylococcus
IASSSPEMWRDIMHENKSYILE

SEQ ID NO: 2103902 - protein, 17 aa, Staphylococcus
IATFAFAHNDAHAAEQN

SEQ ID NO: 2103903 - protein, 18 aa, Staphylococcus
IATVYNWNPKAKQLTYGT

SEQ ID NO: 2103904 - protein, 21 aa, Staphylococcus
IAVIYICAKIFITGDKIHNPL

SEQ ID NO: 2103905 - protein, 17 aa, Staphylococcus
IAVVALVFVITYGLNRH

SEQ ID NO: 2103906 - protein, 23 aa, Staphylococcus
ICLGVPIKLGQNGVEEILELTLS

SEQ ID NO: 2103907 - protein, 19 aa, Staphylococcus
ICLTLFVGACSTQDSSKKN

SEQ ID NO: 2103908 - protein, 23 aa, Staphylococcus
IDALTEFEVAYAPPYSHPKDLIN

SEQ ID NO: 2103909 - protein, 19 aa, Staphylococcus
IDEITARINLDGVSDTTEK

SEQ ID NO: 2103910 - protein, 24 aa, Staphylococcus
IDELTEFEVAYAPPYSHPKDLVNM

SEQ ID NO: 2103911 - protein, 18 aa, Staphylococcus
IDGKHVITSLTYKNNKVI

SEQ ID NO: 2103912 - protein, 27 aa, Staphylococcus
IDGNPNIYRPTWKSEASNYQSATSHLS

SEQ ID NO: 2103913 - protein, 21 aa, Staphylococcus
IDIASGSHLKVLPKENNDAVK

SEQ ID NO: 2103914 - protein, 21 aa, Staphylococcus
IDMNAFQHFAFLHEYEKANKG

SEQ ID NO: 2103915 - protein, 24 aa, Staphylococcus
IDMNAFQHFAFLNAYKKAHKDAKI

SEQ ID NO: 2103916 - protein, 17 aa, Staphylococcus
IDNEMKKGVNLGQISKM

SEQ ID NO: 2103917 - protein, 24 aa, Staphylococcus
IDNERIQKLLAFQMLYIGIDPKRG

SEQ ID NO: 2103918 - protein, 19 aa, Staphylococcus
IDNQAYWFITINAKERDAQ

SEQ ID NO: 2103919 - protein, 19 aa, Staphylococcus
IDPIGAWFTAFEAYQDTSD

SEQ ID NO: 2103920 - protein, 27 aa, Staphylococcus
IDPKRGPSLYSIIPMIEMMFGVHFIKG

SEQ ID NO: 2103921 - protein, 38 aa, Staphylococcus
IDPKRGPSLYSIIPMVEMMFGVHFIKGGMYGLTRGLVK

SEQ ID NO: 2103922 - protein, 17 aa, Staphylococcus
IDPMLGIEGSKYFIKLW

SEQ ID NO: 2103923 - protein, 18 aa, Staphylococcus
IDQAKALLQNKADNHELV

SEQ ID NO: 2103924 - protein, 19 aa, Staphylococcus
IDRGTVCSLGSHDGVGHVF

SEQ ID NO: 2103925 - protein, 20 aa, Staphylococcus
IDRLSLMSTFPNFKEQEEKY

SEQ ID NO: 2103926 - protein, 26 aa, Staphylococcus
IDSLDNGTYSYVFSFANKANPGTFTI

SEQ ID NO: 2103927 - protein, 19 aa, Staphylococcus
IDSNTVLYKAGLTNQEVNV

SEQ ID NO: 2103928 - protein, 19 aa, Staphylococcus
IDSSEAMNGYRRGAFDDMS

SEQ ID NO: 2103929 - protein, 18 aa, Staphylococcus
IDSSESMNGYRRGAYQDM

SEQ ID NO: 2103930 - protein, 27 aa, Staphylococcus
IDYAKRVKNSNLWKSQDNGFYDLTRDG

SEQ ID NO: 2103931 - protein, 18 aa, Staphylococcus
IDYKETIEQLSLVYYDEK

SEQ ID NO: 2103932 - protein, 30 aa, Staphylococcus
IDYVKRVENSNLWKTKDNGFYDLTTEGAQE

SEQ ID NO: 2103933 - protein, 17 aa, Staphylococcus
IEAPIVITGAMRSSNEI

SEQ ID NO: 2103934 - protein, 22 aa, Staphylococcus
IEEGGHLKEDIVNYNGSDSLSS

SEQ ID NO: 2103935 - protein, 35 aa, Staphylococcus
IEGNNGNYSYVFSFKDPQQNGVYSIVTVNSQGQPV

SEQ ID NO: 2103936 - protein, 25 aa, Staphylococcus
IEKAKSLYPKVRMYYERSEPVAEAF

SEQ ID NO: 2103937 - protein, 18 aa, Staphylococcus
IEKGISIDIARTHYTKES

SEQ ID NO: 2103938 - protein, 28 aa, Staphylococcus
IEKQKLRDMLGYFIKYVGSSSYDAPAVL

SEQ ID NO: 2103939 - protein, 17 aa, Staphylococcus
IEMYYNLLNYYDTRETT

SEQ ID NO: 2103940 - protein, 23 aa, Staphylococcus
IENDIKALLPFHKSLQIAERDEN

SEQ ID NO: 2103941 - protein, 18 aa, Staphylococcus
IENGKLKLNDKVKITNKY

SEQ ID NO: 2103942 - protein, 22 aa, Staphylococcus
IEQKAKEIISDKYLSPRAKQYR

SEQ ID NO: 2103943 - protein, 21 aa, Staphylococcus
IERLPLQWRSFFTNGEVIDLY

SEQ ID NO: 2103944 - protein, 17 aa, Staphylococcus
IESFPTEKFRQMIDIML

SEQ ID NO: 2103945 - protein, 17 aa, Staphylococcus
IESLPFIEAIRQIRSDL

SEQ ID NO: 2103946 - protein, 24 aa, Staphylococcus
IETANTDYLAWGAGPQANDRFIHV

SEQ ID NO: 2103947 - protein, 21 aa, Staphylococcus
IETAVAFADIYLMALPTKAMR

SEQ ID NO: 2103948 - protein, 28 aa, Staphylococcus
IETLKIADKRGFNSLSLITSGDHVRRAT

SEQ ID NO: 2103949 - protein, 19 aa, Staphylococcus
IEVGEKISKINVEKLPKEG

SEQ ID NO: 2103950 - protein, 23 aa, Staphylococcus
IEYAQSRYGSINAAVRFRTTHGW

SEQ ID NO: 2103951 - protein, 23 aa, Staphylococcus
IFEYDILVVALGFESETFGINGM

SEQ ID NO: 2103952 - protein, 17 aa, Staphylococcus
IFFIIVLVTLIVLVGVL

SEQ ID NO: 2103953 - protein, 18 aa, Staphylococcus
IFIYGCSKQPSSIKAKQD

SEQ ID NO: 2103954 - protein, 25 aa, Staphylococcus
IFKHYRKEYEYKKVLSKGEHKIGGK

SEQ ID NO: 2103955 - protein, 17 aa, Staphylococcus
IFLLGEGDIYFNSMSPR

SEQ ID NO: 2103956 - protein, 25 aa, Staphylococcus
IFNKEKRVEVALKRAQFEADTNYIP

SEQ ID NO: 2103957 - protein, 31 aa, Staphylococcus
IFSINASFRKYPNLKASLKDYADLIKHGIDG

SEQ ID NO: 2103958 - protein, 20 aa, Staphylococcus
IFYNGFNLESGNGWFEKALK

SEQ ID NO: 2103959 - protein, 18 aa, Staphylococcus
IFYSLGILTSDSFLSKNQ

SEQ ID NO: 2103960 - protein, 18 aa, Staphylococcus
IGILSLFTLFGTSISDAA

SEQ ID NO: 2103961 - protein, 26 aa, Staphylococcus
IGIYNEVPGNFGLWVQDQISDYLVIY

SEQ ID NO: 2103962 - protein, 19 aa, Staphylococcus
IGKEQMKWIKQDIKKARKN

SEQ ID NO: 2103963 - protein, 18 aa, Staphylococcus
IGLIHALTQFYSIDNQPL

SEQ ID NO: 2103964 - protein, 19 aa, Staphylococcus
IGNIHPVFNKKQQARAKIN

SEQ ID NO: 2103965 - protein, 18 aa, Staphylococcus
IGQMKYSGIPLVNVSVIA

SEQ ID NO: 2103966 - protein, 26 aa, Staphylococcus
IGQMSNDFSPIVLPNVQKVNVVNPGD

SEQ ID NO: 2103967 - protein, 21 aa, Staphylococcus
IGRPHYQFTNLKAAKKGSKVY

SEQ ID NO: 2103968 - protein, 23 aa, Staphylococcus
IGSAQKFTTGLMLKKLETEGKVN

SEQ ID NO: 2103969 - protein, 18 aa, Staphylococcus
IGSLLPEMCTLDCGSVNM

SEQ ID NO: 2103970 - protein, 19 aa, Staphylococcus
IGTHFKVRLYSDHIRIPKS

SEQ ID NO: 2103971 - protein, 25 aa, Staphylococcus
IGYRGLGQTKEAWGTGSVATQTQGM

SEQ ID NO: 2103972 - protein, 24 aa, Staphylococcus
IHLTAPSEYYVWGAGKATNPYFYQ

SEQ ID NO: 2103973 - protein, 27 aa, Staphylococcus
IHMAASKRLTGNVIGKADEKEWRENDG

SEQ ID NO: 2103974 - protein, 21 aa, Staphylococcus
IIDEFDELVYLFLKDDSQVHY

SEQ ID NO: 2103975 - protein, 21 aa, Staphylococcus
IIDGAKFIAQDYIKSGQNTLY

SEQ ID NO: 2103976 - protein, 25 aa, Staphylococcus
IIEHLKENLDWIWNSLSLRDQELFN

SEQ ID NO: 2103977 - protein, 19 aa, Staphylococcus
IIEYLKENLNWIWNSFSFE

SEQ ID NO: 2103978 - protein, 26 aa, Staphylococcus
IIHLLDRMGVMFNRTKEGLLDFRRFG

SEQ ID NO: 2103979 - protein, 22 aa, Staphylococcus
IIHLLDRMGVMFNRTNEGLLDF

SEQ ID NO: 2103980 - protein, 21 aa, Staphylococcus
IIIEGIGIKPNTEFLEGAGIE

SEQ ID NO: 2103981 - protein, 17 aa, Staphylococcus
IIIGAIVGGAATLADKS

SEQ ID NO: 2103982 - protein, 25 aa, Staphylococcus
IIKTLHLRKTIIAIPHHILVKIKPL

SEQ ID NO: 2103983 - protein, 20 aa, Staphylococcus
IILCCLLLVSCSNDKQSAAK

SEQ ID NO: 2103984 - protein, 18 aa, Staphylococcus
IILTKGPVLFGFFGHSSI

SEQ ID NO: 2103985 - protein, 18 aa, Staphylococcus
IISLIALCLMLAGCSNGD

SEQ ID NO: 2103986 - protein, 19 aa, Staphylococcus
IITVLPFGNLISQIKVKGT

SEQ ID NO: 2103987 - protein, 23 aa, Staphylococcus
IIVICASASLPKGETRLKLLEDN

SEQ ID NO: 2103988 - protein, 26 aa, Staphylococcus
IKANTPIRLYHYGLPSGNFKNDPMGT

SEQ ID NO: 2103989 - protein, 26 aa, Staphylococcus
IKDIKPSHVAICWDMGQATFRNDMYT

SEQ ID NO: 2103990 - protein, 20 aa, Staphylococcus
IKDTEKILKEEGYKKNHNGI

SEQ ID NO: 2103991 - protein, 23 aa, Staphylococcus
IKELKCKMIKEIKNEFYYGRSRK

SEQ ID NO: 2103992 - protein, 21 aa, Staphylococcus
IKELKYDWPSLSSESEKVLKK

SEQ ID NO: 2103993 - protein, 25 aa, Staphylococcus
IKETLAASLIKLANWTGDTPLIDPF

SEQ ID NO: 2103994 - protein, 24 aa, Staphylococcus
IKETLAASLIKLANWTGQTPLIDP

SEQ ID NO: 2103995 - protein, 27 aa, Staphylococcus
IKIPKHPKRIVILTSNFGNFKDLGVTP

SEQ ID NO: 2103996 - protein, 17 aa, Staphylococcus
IKKQRPDIDVTIYEATN

SEQ ID NO: 2103997 - protein, 20 aa, Staphylococcus
IKKSNTRSTSLFQQVPQIED

SEQ ID NO: 2103998 - protein, 19 aa, Staphylococcus
IKLGGIIEIYEKFTGDDPR

SEQ ID NO: 2103999 - protein, 21 aa, Staphylococcus
IKLMKEKPEVAPIPKKNSPNR

SEQ ID NO: 2104000 - protein, 22 aa, Staphylococcus
IKNGRTYVDGVLIVNKDIGLPS

SEQ ID NO: 2104001 - protein, 20 aa, Staphylococcus
IKPNTEFLEGAGIEEDDAGY

SEQ ID NO: 2104002 - protein, 33 aa, Staphylococcus
IKQARKKGANWIILNLHKPMYSKSYHALSDEDI

SEQ ID NO: 2104003 - protein, 23 aa, Staphylococcus
IKRGGDGYAPFQEHYGFAFNSIK

SEQ ID NO: 2104004 - protein, 26 aa, Staphylococcus
IKRTYPRLRITGAPFEAVGLPDCISQ

SEQ ID NO: 2104005 - protein, 19 aa, Staphylococcus
IKSAVEFIIQEEGRIDILI

SEQ ID NO: 2104006 - protein, 25 aa, Staphylococcus
IKSGATLYTVPWGNYNQVAGTVSKS

SEQ ID NO: 2104007 - protein, 18 aa, Staphylococcus
IKSNHIVVFMTFKEDVMP

SEQ ID NO: 2104008 - protein, 19 aa, Staphylococcus
IKSNLPFHKSFDIIKRNDT

SEQ ID NO: 2104009 - protein, 22 aa, Staphylococcus
IKVTSRGTGQWNLGEPPHEGTQ

SEQ ID NO: 2104010 - protein, 24 aa, Staphylococcus
ILAESGSARGFKPVGYSKGNSIYS

SEQ ID NO: 2104011 - protein, 18 aa, Staphylococcus
ILALVLCLVGCSNSNNDK

SEQ ID NO: 2104012 - protein, 23 aa, Staphylococcus
ILASSLFTAIPMTLAQTNPTSKD

SEQ ID NO: 2104013 - protein, 32 aa, Staphylococcus
ILDVASPYPYGQCTWYVYERVQQFDKHVGGHW

SEQ ID NO: 2104014 - protein, 19 aa, Staphylococcus
ILEELFQYRFEEHQIEGHS

SEQ ID NO: 2104015 - protein, 18 aa, Staphylococcus
ILEIREDILGALQISFKT

SEQ ID NO: 2104016 - protein, 18 aa, Staphylococcus
ILERFSGLQSGKDFFVGY

SEQ ID NO: 2104017 - protein, 18 aa, Staphylococcus
ILFALSVTLLCLSLTPNI

SEQ ID NO: 2104018 - protein, 17 aa, Staphylococcus
ILFVVLGGAAIFFYENK

SEQ ID NO: 2104019 - protein, 18 aa, Staphylococcus
ILGLIFLGLSKWYSSEDN

SEQ ID NO: 2104020 - protein, 19 aa, Staphylococcus
ILGSLLILSSCSNNDEKDK

SEQ ID NO: 2104021 - protein, 17 aa, Staphylococcus
ILIGAIIGGAATLADKS

SEQ ID NO: 2104022 - protein, 26 aa, Staphylococcus
ILILSIGLVGCHRLSKEESDPSDNAK

SEQ ID NO: 2104023 - protein, 19 aa, Staphylococcus
ILILVALPVSLAIKSEDRG

SEQ ID NO: 2104024 - protein, 18 aa, Staphylococcus
ILISGIIFLAFVLMPASW

SEQ ID NO: 2104025 - protein, 17 aa, Staphylococcus
ILLGAVIGGAATLADKS

SEQ ID NO: 2104026 - protein, 23 aa, Staphylococcus
ILLGCILGVVVGYIAAQKVLHEK

SEQ ID NO: 2104027 - protein, 18 aa, Staphylococcus
ILLGKLLEKKYSDKVDTK

SEQ ID NO: 2104028 - protein, 25 aa, Staphylococcus
ILLSIMLCVLVACGKEDSSNKGSKD

SEQ ID NO: 2104029 - protein, 17 aa, Staphylococcus
ILLSLVLTVALAACGNG

SEQ ID NO: 2104030 - protein, 23 aa, Staphylococcus
ILNAKYDVFYQGQPFATSQTVRF

SEQ ID NO: 2104031 - protein, 19 aa, Staphylococcus
ILNMASINGVIGFAGKAAY

SEQ ID NO: 2104032 - protein, 19 aa, Staphylococcus
ILNRAELNGVLSNDLHQSI

SEQ ID NO: 2104033 - protein, 23 aa, Staphylococcus
ILQKDMHRHLLPTFEKYEKLAKS

SEQ ID NO: 2104034 - protein, 21 aa, Staphylococcus
ILSGCSLPGLGDSRSDDDVKI

SEQ ID NO: 2104035 - protein, 18 aa, Staphylococcus
ILSLFKIAPVHAENASMS

SEQ ID NO: 2104036 - protein, 19 aa, Staphylococcus
ILSRLRANEDLKDIPIHFA

SEQ ID NO: 2104037 - protein, 17 aa, Staphylococcus
ILTGCSFSNEDKEEDHS

SEQ ID NO: 2104038 - protein, 24 aa, Staphylococcus
ILTMCMAISLYGCEENKKKKVAKK

SEQ ID NO: 2104039 - protein, 17 aa, Staphylococcus
ILVLFSTIFLASCELPG

SEQ ID NO: 2104040 - protein, 17 aa, Staphylococcus
ILVSFILASCGGKSNSD

SEQ ID NO: 2104041 - protein, 22 aa, Staphylococcus
IMDSSTGWLLLQGVISEYGDKE

SEQ ID NO: 2104042 - protein, 20 aa, Staphylococcus
IMLICGILLSSCGNQSSADL

SEQ ID NO: 2104043 - protein, 19 aa, Staphylococcus
IMPNRLVAAQTKFIYKSKN

SEQ ID NO: 2104044 - protein, 17 aa, Staphylococcus
IMSVDMRGTFLVTKFLL

SEQ ID NO: 2104045 - protein, 25 aa, Staphylococcus
IMTVVCVVIIFAFVRNEFVDRFNPF

SEQ ID NO: 2104046 - protein, 18 aa, Staphylococcus
IMVLAFMVVLAGCGKGES

SEQ ID NO: 2104047 - protein, 18 aa, Staphylococcus
IMVMFVLAGCGTENDEAK

SEQ ID NO: 2104048 - protein, 17 aa, Staphylococcus
IMYWKDAVEEIRRNNPE

SEQ ID NO: 2104049 - protein, 23 aa, Staphylococcus
INDLKFDLEHEMEMGIFQSIIEY

SEQ ID NO: 2104050 - protein, 22 aa, Staphylococcus
INEKNPDVILAMDRGQAIGEKS

SEQ ID NO: 2104051 - protein, 18 aa, Staphylococcus
INGVIGFAGKAAYNSAKH

SEQ ID NO: 2104052 - protein, 20 aa, Staphylococcus
INHAYAYGGPTMAVKSLEKL

SEQ ID NO: 2104053 - protein, 21 aa, Staphylococcus
INIYTTVFAFESFTKQIGGKY

SEQ ID NO: 2104054 - protein, 18 aa, Staphylococcus
INKISALMSSEPTSYGDP

SEQ ID NO: 2104055 - protein, 18 aa, Staphylococcus
INKKGRLPDGASLDDITL

SEQ ID NO: 2104056 - protein, 25 aa, Staphylococcus
INKTYKINPGEVIYTVPWGTSSQKA

SEQ ID NO: 2104057 - protein, 23 aa, Staphylococcus
INKWKKIDQVSALLPSSTAKKYN

SEQ ID NO: 2104058 - protein, 23 aa, Staphylococcus
INLRKNAKWSNGDPVTADDFVYA

SEQ ID NO: 2104059 - protein, 21 aa, Staphylococcus
INLYKISGFRSYQTQIQLFNN

SEQ ID NO: 2104060 - protein, 25 aa, Staphylococcus
INNEEKLIFWNPWDTDLSIQDADSN

SEQ ID NO: 2104061 - protein, 17 aa, Staphylococcus
INNQAYWFITINANEKD

SEQ ID NO: 2104062 - protein, 17 aa, Staphylococcus
INNQAYWFITINASEKD

SEQ ID NO: 2104063 - protein, 17 aa, Staphylococcus
INNYADYAATNLQYYGL

SEQ ID NO: 2104064 - protein, 25 aa, Staphylococcus
INVSEMNYGQGAGVVTSRTISASEA

SEQ ID NO: 2104065 - protein, 22 aa, Staphylococcus
INYAKERYGSIGNAISFREANG

SEQ ID NO: 2104066 - protein, 20 aa, Staphylococcus
INYANSRYGSLSNAIAFRQS

SEQ ID NO: 2104067 - protein, 19 aa, Staphylococcus
INYANSRYGSLSNATAFRA

SEQ ID NO: 2104068 - protein, 25 aa, Staphylococcus
INYQLKVPLIKAYMGMESDIFNFYA

SEQ ID NO: 2104069 - protein, 21 aa, Staphylococcus
IPAAGLGTRFLPATKAMPKEM

SEQ ID NO: 2104070 - protein, 17 aa, Staphylococcus
IPATGFVITGHVGEKNF

SEQ ID NO: 2104071 - protein, 27 aa, Staphylococcus
IPAYESAGAGGLKIIKVFKSSGKVTFE

SEQ ID NO: 2104072 - protein, 20 aa, Staphylococcus
IPFFGICLGMQLATVEYARN

SEQ ID NO: 2104073 - protein, 25 aa, Staphylococcus
IPKDPKRIVVLGATYAGGLKELDAN

SEQ ID NO: 2104074 - protein, 17 aa, Staphylococcus
IPKFIAPAMNVHMYENK

SEQ ID NO: 2104075 - protein, 25 aa, Staphylococcus
IPMIEMMHGVYYIKGGMYSFDKGLH

SEQ ID NO: 2104076 - protein, 18 aa, Staphylococcus
IPNKAAYLTIKRIGKDKA

SEQ ID NO: 2104077 - protein, 26 aa, Staphylococcus
IPSNTEILYRLGLGKNIIGVSTVDDY

SEQ ID NO: 2104078 - protein, 17 aa, Staphylococcus
IPTLDEILERYGTSANY

SEQ ID NO: 2104079 - protein, 21 aa, Staphylococcus
IPVTASALLLGACGSDSTDSK

SEQ ID NO: 2104080 - protein, 22 aa, Staphylococcus
IPVTASALLLGACGSNAADSKD

SEQ ID NO: 2104081 - protein, 17 aa, Staphylococcus
IPYKVEKGESIYQVDIS

SEQ ID NO: 2104082 - protein, 20 aa, Staphylococcus
IPYRFNEEIDDIDGSIVHFK

SEQ ID NO: 2104083 - protein, 24 aa, Staphylococcus
IQALCTTVLAPLGIYSDKIKNIKD

SEQ ID NO: 2104084 - protein, 17 aa, Staphylococcus
IQDLFMNDYLRVYTNND

SEQ ID NO: 2104085 - protein, 24 aa, Staphylococcus
IQEGAYNVTFDYEGFTYHFESDGT

SEQ ID NO: 2104086 - protein, 22 aa, Staphylococcus
IQHVKELRDIIINANLKNESVY

SEQ ID NO: 2104087 - protein, 17 aa, Staphylococcus
IQMFMRSYTGSANWETD

SEQ ID NO: 2104088 - protein, 34 aa, Staphylococcus
IQSHNGRYEYLFSFKNPKQQGTYTIVSVNGQGQP

SEQ ID NO: 2104089 - protein, 23 aa, Staphylococcus
IQSSSPWPPQVQHTPGKWVNATK

SEQ ID NO: 2104090 - protein, 17 aa, Staphylococcus
IRFVKDNHLKHLLVETS

SEQ ID NO: 2104091 - protein, 24 aa, Staphylococcus
IRIDGGVMAYTWPGEMLSDDSWKK

SEQ ID NO: 2104092 - protein, 17 aa, Staphylococcus
IRKSELVFKNAPQGMKF

SEQ ID NO: 2104093 - protein, 25 aa, Staphylococcus
IRQGFERFDTLVLTGGLGPTKDDLT

SEQ ID NO: 2104094 - protein, 19 aa, Staphylococcus
IRRILKCHPFHKGGFDPVP

SEQ ID NO: 2104095 - protein, 25 aa, Staphylococcus
IRTTEQLRLIGIIPEEVKTNGEPPE

SEQ ID NO: 2104096 - protein, 19 aa, Staphylococcus
IRTTVFAPLGIYSKKIKDI

SEQ ID NO: 2104097 - protein, 26 aa, Staphylococcus
ISDNELKKSIKIYLDKNEELSEASEY

SEQ ID NO: 2104098 - protein, 25 aa, Staphylococcus
ISDYNGNTSRGWVPASEISVKTTTP

SEQ ID NO: 2104099 - protein, 17 aa, Staphylococcus
ISEALLRSNAPKLYVSN

SEQ ID NO: 2104100 - protein, 25 aa, Staphylococcus
ISESNIKGLGIVSYRTIDADAATEL

SEQ ID NO: 2104101 - protein, 24 aa, Staphylococcus
ISHKYGISIAKLKSLNGLTSNLIF

SEQ ID NO: 2104102 - protein, 17 aa, Staphylococcus
ISISKLKSLNHLSSNII

SEQ ID NO: 2104103 - protein, 17 aa, Staphylococcus
ISKQFWSHLVKAGHIEN

SEQ ID NO: 2104104 - protein, 17 aa, Staphylococcus
ISKQFWSHLVKNKSISN

SEQ ID NO: 2104105 - protein, 23 aa, Staphylococcus
ISLEVLENLYARGLDVTLIHRSE

SEQ ID NO: 2104106 - protein, 17 aa, Staphylococcus
ISLMIIITTASLGMLST

SEQ ID NO: 2104107 - protein, 17 aa, Staphylococcus
ISSLFHFDDDISKYEHV

SEQ ID NO: 2104108 - protein, 17 aa, Staphylococcus
ISSLGVGAGEGQSLPAM

SEQ ID NO: 2104109 - protein, 20 aa, Staphylococcus
ISTIFLLAACNNNQKDNQSD

SEQ ID NO: 2104110 - protein, 17 aa, Staphylococcus
ISVLIILGIVKTFQDHD

SEQ ID NO: 2104111 - protein, 17 aa, Staphylococcus
ITAKPQYSLSFIGEQQP

SEQ ID NO: 2104112 - protein, 24 aa, Staphylococcus
ITDPTKAKGIIFLPEHLSQKQRWS

SEQ ID NO: 2104113 - protein, 23 aa, Staphylococcus
ITEKYIRMSGMKKTFENVNEAKK

SEQ ID NO: 2104114 - protein, 24 aa, Staphylococcus
ITGHYRNGILLSPIIGELMAEWLK

SEQ ID NO: 2104115 - protein, 21 aa, Staphylococcus
ITGYQYEPWHLRYLGKDTATK

SEQ ID NO: 2104116 - protein, 20 aa, Staphylococcus
ITHAHAYGGPIAAMDSVEAT

SEQ ID NO: 2104117 - protein, 19 aa, Staphylococcus
ITHYTLKPKVNGITAEDSA

SEQ ID NO: 2104118 - protein, 19 aa, Staphylococcus
ITIALPISQCAQAASYVVN

SEQ ID NO: 2104119 - protein, 25 aa, Staphylococcus
ITIDEAKSIAFNSEDILNFTQNKDE

SEQ ID NO: 2104120 - protein, 19 aa, Staphylococcus
ITIPGVLPLGNIKAKSIIT

SEQ ID NO: 2104121 - protein, 22 aa, Staphylococcus
ITKKDPEIILAMDRGSVVGGKS

SEQ ID NO: 2104122 - protein, 18 aa, Staphylococcus
ITKNVGYDIYVRKGTTCF

SEQ ID NO: 2104123 - protein, 23 aa, Staphylococcus
ITKYPGNADLAIVKFSPNDKNQN

SEQ ID NO: 2104124 - protein, 18 aa, Staphylococcus
ITLGVFILLIGALMLVGK

SEQ ID NO: 2104125 - protein, 23 aa, Staphylococcus
ITLIGVLFILAAIYLFAKPHIDQ

SEQ ID NO: 2104126 - protein, 18 aa, Staphylococcus
ITPGEFIAGATADDDKTK

SEQ ID NO: 2104127 - protein, 18 aa, Staphylococcus
ITPGEFIAGATADDGQTK

SEQ ID NO: 2104128 - protein, 19 aa, Staphylococcus
ITPKLMLQGSVDLLNEVST

SEQ ID NO: 2104129 - protein, 24 aa, Staphylococcus
ITRHKAKRALVVGAGYISLEVLEN

SEQ ID NO: 2104130 - protein, 18 aa, Staphylococcus
ITRIASSSPEMWRDIMHE

SEQ ID NO: 2104131 - protein, 20 aa, Staphylococcus
ITSAALFFGMNHVASADQIH

SEQ ID NO: 2104132 - protein, 22 aa, Staphylococcus
ITSEGAFKYFSKAFDIKPGYIW

SEQ ID NO: 2104133 - protein, 22 aa, Staphylococcus
ITSEGAFKYFSKQFNIHSGYIW

SEQ ID NO: 2104134 - protein, 19 aa, Staphylococcus
ITSEGAFKYFSKQYGITPG

SEQ ID NO: 2104135 - protein, 17 aa, Staphylococcus
ITSIVLLTACGNNNDNK

SEQ ID NO: 2104136 - protein, 20 aa, Staphylococcus
ITSLMILTACGNGNDKNSQS

SEQ ID NO: 2104137 - protein, 32 aa, Staphylococcus
ITTYDLLFRSGFEPDVDFVIRVGKPVISKKLN

SEQ ID NO: 2104138 - protein, 23 aa, Staphylococcus
ITVKKGNQVIGTFIKNNTGKWTK

SEQ ID NO: 2104139 - protein, 32 aa, Staphylococcus
ITVNAYCPGVAKTEMWDRIDAEMVKLDSNLKP

SEQ ID NO: 2104140 - protein, 24 aa, Staphylococcus
ITVPVKHVIYNVIASPKYTIQGQD

SEQ ID NO: 2104141 - protein, 20 aa, Staphylococcus
IVAASTILLAGCTTDKKEVK

SEQ ID NO: 2104142 - protein, 23 aa, Staphylococcus
IVAIAKGKGAAFLPSSLSEFKND

SEQ ID NO: 2104143 - protein, 17 aa, Staphylococcus
IVALLFALVLVTACGNV

SEQ ID NO: 2104144 - protein, 22 aa, Staphylococcus
IVALVLLVFAIRAVKVEPVEAM

SEQ ID NO: 2104145 - protein, 20 aa, Staphylococcus
IVEAISRLLKRPAQPNPEWS

SEQ ID NO: 2104146 - protein, 18 aa, Staphylococcus
IVEFSDGTTITIPKGKDG

SEQ ID NO: 2104147 - protein, 24 aa, Staphylococcus
IVEKLNEKWAKDHPNATISSGQAG

SEQ ID NO: 2104148 - protein, 18 aa, Staphylococcus
IVGGAQFIGQSYVKAGQN

SEQ ID NO: 2104149 - protein, 22 aa, Staphylococcus
IVGLGVSSVGFISHSADAAENT

SEQ ID NO: 2104150 - protein, 19 aa, Staphylococcus
IVIRRLGLDAKYDTQLDEW

SEQ ID NO: 2104151 - protein, 17 aa, Staphylococcus
IVKNMKQPDIIGVTEVQ

SEQ ID NO: 2104152 - protein, 19 aa, Staphylococcus
IVLCACQFSTLSSSKKDTK

SEQ ID NO: 2104153 - protein, 25 aa, Staphylococcus
IVLCISIALSACSTGQYSDAKKKDV

SEQ ID NO: 2104154 - protein, 22 aa, Staphylococcus
IVLSGCSLPGLGDGDGKDSVKI

SEQ ID NO: 2104155 - protein, 24 aa, Staphylococcus
IVLTNCLKSYDFNEALERYDKLRV

SEQ ID NO: 2104156 - protein, 20 aa, Staphylococcus
IVLTSTVLLAGCTTDKKEIK

SEQ ID NO: 2104157 - protein, 19 aa, Staphylococcus
IVLVLCLTVLSGCSLPGLG

SEQ ID NO: 2104158 - protein, 19 aa, Staphylococcus
IVNMKGHDQAVISLLNGDV

SEQ ID NO: 2104159 - protein, 25 aa, Staphylococcus
IVNRLPKSMPQYHIGHMTQIRNIQN

SEQ ID NO: 2104160 - protein, 23 aa, Staphylococcus
IVNRLPKSMPQYHVGHIKNIKII

SEQ ID NO: 2104161 - protein, 24 aa, Staphylococcus
IVNRLPKSMPQYHVGHIKQIRKIQ

SEQ ID NO: 2104162 - protein, 27 aa, Staphylococcus
IVNRLPKSMPQYHVGHIQRIRDIQAHI

SEQ ID NO: 2104163 - protein, 18 aa, Staphylococcus
IYAANKGTPFALPNTPWK

SEQ ID NO: 2104164 - protein, 18 aa, Staphylococcus
IYDLTPLKTFVFGRTVLL

SEQ ID NO: 2104165 - protein, 26 aa, Staphylococcus
IYDVPMHFTGHDWNSAGFNKSETQRI

SEQ ID NO: 2104166 - protein, 25 aa, Staphylococcus
IYGDFKCPYCKKVEKNVMPKLKEKY

SEQ ID NO: 2104167 - protein, 21 aa, Staphylococcus
IYGDGDGRTFTALSGANDVVA

SEQ ID NO: 2104168 - protein, 19 aa, Staphylococcus
IYGQLKLAGIDYKETIEQL

SEQ ID NO: 2104169 - protein, 22 aa, Staphylococcus
IYGTVNNLTGWVSLSKLTAPST

SEQ ID NO: 2104170 - protein, 31 aa, Staphylococcus
IYKRYEIARKYFLERTFRKPSDFYNLTSLVQ

SEQ ID NO: 2104171 - protein, 18 aa, Staphylococcus
IYLFAKPHIDSYLHDKDN

SEQ ID NO: 2104172 - protein, 19 aa, Staphylococcus
IYLIAHALIETGNGQSQLA

SEQ ID NO: 2104173 - protein, 18 aa, Staphylococcus
IYLIAHALLETGNGQSKL

SEQ ID NO: 2104174 - protein, 19 aa, Staphylococcus
IYLISHALIETGNGTSDLA

SEQ ID NO: 2104175 - protein, 18 aa, Staphylococcus
IYLISHALLETGNGQSQL

SEQ ID NO: 2104176 - protein, 18 aa, Staphylococcus
IYPIFPIPERERFLEQLK

SEQ ID NO: 2104177 - protein, 18 aa, Staphylococcus
IYPIFPLPERQKFFTQLK

SEQ ID NO: 2104178 - protein, 18 aa, Staphylococcus
IYPSHWSNGDFGLDAPDT

SEQ ID NO: 2104179 - protein, 18 aa, Staphylococcus
IYSDGEHPFTYDGQPIQV

SEQ ID NO: 2104180 - protein, 19 aa, Staphylococcus
IYTIKDLLTQAALPSSNSA

SEQ ID NO: 2104181 - protein, 24 aa, Staphylococcus
KAAEKEWRENDGLVSVISSQHPFN

SEQ ID NO: 2104182 - protein, 18 aa, Staphylococcus
KAALKEQVNQAGLVPSVD

SEQ ID NO: 2104183 - protein, 20 aa, Staphylococcus
KADEKEWRENDGLVSTISAQ

SEQ ID NO: 2104184 - protein, 24 aa, Staphylococcus
KADKRELISAKNHLDDPISTDGKT

SEQ ID NO: 2104185 - protein, 18 aa, Staphylococcus
KAESDLHHLAPQVRGVVG

SEQ ID NO: 2104186 - protein, 19 aa, Staphylococcus
KAHASNEITEEGKLGNKDG

SEQ ID NO: 2104187 - protein, 18 aa, Staphylococcus
KAIGRVSNLNGWKKGSRD

SEQ ID NO: 2104188 - protein, 21 aa, Staphylococcus
KAKEKEWRENDGLVSVISSQH

SEQ ID NO: 2104189 - protein, 20 aa, Staphylococcus
KAKKRPINFQQYHLTEDVHE

SEQ ID NO: 2104190 - protein, 23 aa, Staphylococcus
KAKNSFSNLDGWQKVSKEAIIKK

SEQ ID NO: 2104191 - protein, 18 aa, Staphylococcus
KAKPEVIFISGRTANQKN

SEQ ID NO: 2104192 - protein, 19 aa, Staphylococcus
KAKPILKKEGYDLKIKTIN

SEQ ID NO: 2104193 - protein, 17 aa, Staphylococcus
KAKQWIKDWDKQMADDK

SEQ ID NO: 2104194 - protein, 23 aa, Staphylococcus
KAKYSINVSPFISKALNNYKNQK

SEQ ID NO: 2104195 - protein, 18 aa, Staphylococcus
KALLQNKADNHELVQAKN

SEQ ID NO: 2104196 - protein, 17 aa, Staphylococcus
KAMKVGEPRPKYQDVKL

SEQ ID NO: 2104197 - protein, 17 aa, Staphylococcus
KANELKANNVVNESAKV

SEQ ID NO: 2104198 - protein, 19 aa, Staphylococcus
KANENLGLNPSHQGETNPT

SEQ ID NO: 2104199 - protein, 26 aa, Staphylococcus
KANGDGLYGYDVGKGHIVFYVSNGYV

SEQ ID NO: 2104200 - protein, 19 aa, Staphylococcus
KAQIKQAFINANRSQLQLS

SEQ ID NO: 2104201 - protein, 26 aa, Staphylococcus
KAQPATAYKHNYIIANAGSNYYNAPN

SEQ ID NO: 2104202 - protein, 20 aa, Staphylococcus
KAQQVDPDFSRRHATEKATH

SEQ ID NO: 2104203 - protein, 19 aa, Staphylococcus
KAQTPWYSYEGYTTYDPSF

SEQ ID NO: 2104204 - protein, 18 aa, Staphylococcus
KAVKNGRVEVVNGDEVSR

SEQ ID NO: 2104205 - protein, 25 aa, Staphylococcus
KAYGFKFKTVRPMQIGLVYDALKNK

SEQ ID NO: 2104206 - protein, 18 aa, Staphylococcus
KAYNEKGWLNESGAKYPV

SEQ ID NO: 2104207 - protein, 17 aa, Staphylococcus
KCKSLKVHGKKNVPQLH

SEQ ID NO: 2104208 - protein, 20 aa, Staphylococcus
KCLITTFLIVSSLLLAFSTI

SEQ ID NO: 2104209 - protein, 23 aa, Staphylococcus
KDAKRVVALEFSFVDALAALNVK

SEQ ID NO: 2104210 - protein, 25 aa, Staphylococcus
KDASKLLQIDGYYFEEVRRDHIYQS

SEQ ID NO: 2104211 - protein, 18 aa, Staphylococcus
KDDGYRFIEPGDGFLACG

SEQ ID NO: 2104212 - protein, 18 aa, Staphylococcus
KDDKDFGKSVDWTIQGTD

SEQ ID NO: 2104213 - protein, 22 aa, Staphylococcus
KDDLRLGTDSTWVKRAGDGYPA

SEQ ID NO: 2104214 - protein, 27 aa, Staphylococcus
KDDTLKYQFLCLDRPQNLSVASLNQLL

SEQ ID NO: 2104215 - protein, 18 aa, Staphylococcus
KDEKAFKGVKGVTYKVDY

SEQ ID NO: 2104216 - protein, 22 aa, Staphylococcus
KDEVLYWKDVVEEIRRNNPELE

SEQ ID NO: 2104217 - protein, 20 aa, Staphylococcus
KDEWIKAFLQGYGKPTNSLI

SEQ ID NO: 2104218 - protein, 17 aa, Staphylococcus
KDEYGLEPKQLIDVKAF

SEQ ID NO: 2104219 - protein, 19 aa, Staphylococcus
KDGDTLYQIALSHHLSLEQ

SEQ ID NO: 2104220 - protein, 21 aa, Staphylococcus
KDGKPLIVIYGDFKCPYCKKV

SEQ ID NO: 2104221 - protein, 23 aa, Staphylococcus
KDGKVKPLLVKSFKQKSDDTLTL

SEQ ID NO: 2104222 - protein, 21 aa, Staphylococcus
KDGSLGYVIKGQMVKPFDKEL

SEQ ID NO: 2104223 - protein, 17 aa, Staphylococcus
KDGSLGYVVKGQMEDKF

SEQ ID NO: 2104224 - protein, 18 aa, Staphylococcus
KDGYWYGFSGSALGISYN

SEQ ID NO: 2104225 - protein, 19 aa, Staphylococcus
KDIQRDAVFLVRPDGYISV

SEQ ID NO: 2104226 - protein, 18 aa, Staphylococcus
KDIRSIEVNSDMSDVTIK

SEQ ID NO: 2104227 - protein, 23 aa, Staphylococcus
KDKAEQIYYLALTQYLTQNSEFS

SEQ ID NO: 2104228 - protein, 18 aa, Staphylococcus
KDKLVLYAAGPDDLVKDM

SEQ ID NO: 2104229 - protein, 17 aa, Staphylococcus
KDKSEVYTQTYTPISGY

SEQ ID NO: 2104230 - protein, 18 aa, Staphylococcus
KDKSKWHLAINSKGKVYV

SEQ ID NO: 2104231 - protein, 20 aa, Staphylococcus
KDKYKKHDDYAAAYRNILDK

SEQ ID NO: 2104232 - protein, 23 aa, Staphylococcus
KDLLKPTLAKFIFTDANEHDFVT

SEQ ID NO: 2104233 - protein, 24 aa, Staphylococcus
KDLSGAMDKIRNGYQSKDAKQIKK

SEQ ID NO: 2104234 - protein, 19 aa, Staphylococcus
KDLYFAGASTHPGAGVPIV

SEQ ID NO: 2104235 - protein, 19 aa, Staphylococcus
KDNGFYDLTREGATNLNRQ

SEQ ID NO: 2104236 - protein, 25 aa, Staphylococcus
KDNLKDFYSNLAIPPEQVARTIQFA

SEQ ID NO: 2104237 - protein, 20 aa, Staphylococcus
KDQKRLSAYQKELLNDKIKV

SEQ ID NO: 2104238 - protein, 26 aa, Staphylococcus
KDRRAMITSEGAFKYFSKQYDIKPGY

SEQ ID NO: 2104239 - protein, 25 aa, Staphylococcus
KDTERWKKEVTPIIGKTDLFIFPHG

SEQ ID NO: 2104240 - protein, 27 aa, Staphylococcus
KDVDGILVPGGFGFRASEGKIAAIKYA

SEQ ID NO: 2104241 - protein, 25 aa, Staphylococcus
KDVDGILVPGGFGYRASEGKISAIR

SEQ ID NO: 2104242 - protein, 17 aa, Staphylococcus
KDYDFIIIRGQYGSEYV

SEQ ID NO: 2104243 - protein, 24 aa, Staphylococcus
KDYGFKFDSARPMQIGLVYDALKN

SEQ ID NO: 2104244 - protein, 25 aa, Staphylococcus
KDYVWNPDAIHSMKHSGSYMTKQIA

SEQ ID NO: 2104245 - protein, 21 aa, Staphylococcus
KEALLKAKSDLILAHESQKSS

SEQ ID NO: 2104246 - protein, 27 aa, Staphylococcus
KEFQKDPVWKKLDAVKHNRVDVVDRDL

SEQ ID NO: 2104247 - protein, 19 aa, Staphylococcus
KEGAYRFMNFLLDEKNNKQ

SEQ ID NO: 2104248 - protein, 20 aa, Staphylococcus
KEGKALFKKHKALENAKGVD

SEQ ID NO: 2104249 - protein, 24 aa, Staphylococcus
KEGLNIIYRSGFRSYAEQTQLYNS

SEQ ID NO: 2104250 - protein, 25 aa, Staphylococcus
KEGQWIARNAHRYGFIIRYPKGKEQ

SEQ ID NO: 2104251 - protein, 19 aa, Staphylococcus
KEGSNLWFDNMVIPKTAQN

SEQ ID NO: 2104252 - protein, 20 aa, Staphylococcus
KEGSNLWFDNMVIPKTAQNK

SEQ ID NO: 2104253 - protein, 20 aa, Staphylococcus
KEGSNLWFDNMVMPKTAQNK

SEQ ID NO: 2104254 - protein, 24 aa, Staphylococcus
KEHSDAVIVSAHWGNENHTMPNEK

SEQ ID NO: 2104255 - protein, 20 aa, Staphylococcus
KEIAKVWLAGLPDYQNKNVP

SEQ ID NO: 2104256 - protein, 19 aa, Staphylococcus
KEIIPSYGQSLIEDYALLK

SEQ ID NO: 2104257 - protein, 17 aa, Staphylococcus
KEINEEFEISKQFWAHL

SEQ ID NO: 2104258 - protein, 17 aa, Staphylococcus
KEINEEFEISKQFWGHL

SEQ ID NO: 2104259 - protein, 24 aa, Staphylococcus
KEINPTHVAVCWDMGQQTFRNEMF

SEQ ID NO: 2104260 - protein, 20 aa, Staphylococcus
KEIQPNWNIKLFERLDGPAL

SEQ ID NO: 2104261 - protein, 23 aa, Staphylococcus
KEIRDHLSTYLKQQGVNIITNSE

SEQ ID NO: 2104262 - protein, 21 aa, Staphylococcus
KEKEQQAIVNFVKRGGSVIFI

SEQ ID NO: 2104263 - protein, 18 aa, Staphylococcus
KEKFKSLLKETLPFHKSL

SEQ ID NO: 2104264 - protein, 25 aa, Staphylococcus
KEKQLAIIERRAQKIINDKYLSNRA

SEQ ID NO: 2104265 - protein, 18 aa, Staphylococcus
KELGIPVKVHVATNYNAM

SEQ ID NO: 2104266 - protein, 20 aa, Staphylococcus
KELSKILNIKGRVIPSTNSS

SEQ ID NO: 2104267 - protein, 21 aa, Staphylococcus
KELSKVLNIKGKVIPSTNSSV

SEQ ID NO: 2104268 - protein, 25 aa, Staphylococcus
KEMGVRLTPILGWAERGGASASGHG

SEQ ID NO: 2104269 - protein, 24 aa, Staphylococcus
KENAKLSDVAALFATTTNEIKNLN

SEQ ID NO: 2104270 - protein, 24 aa, Staphylococcus
KENCPDLRNTKVIDIIRELEEYGI

SEQ ID NO: 2104271 - protein, 21 aa, Staphylococcus
KENNDLVVVNVDWGITNERSV

SEQ ID NO: 2104272 - protein, 27 aa, Staphylococcus
KEPEQKSDGSWGFSFDDKDGNLAGSYV

SEQ ID NO: 2104273 - protein, 28 aa, Staphylococcus
KEPEQKSDGSWGFSFVDKSGKLAGSYIV

SEQ ID NO: 2104274 - protein, 17 aa, Staphylococcus
KEQAIKVANAMKRDGWT

SEQ ID NO: 2104275 - protein, 17 aa, Staphylococcus
KERGVAVEQVLEDVLYP

SEQ ID NO: 2104276 - protein, 20 aa, Staphylococcus
KESKARGVLQDNMANSYNGD

SEQ ID NO: 2104277 - protein, 21 aa, Staphylococcus
KESKDGMYYTFHEYKTQRDYK

SEQ ID NO: 2104278 - protein, 20 aa, Staphylococcus
KESKWQEPAYIVIENSEEKP

SEQ ID NO: 2104279 - protein, 21 aa, Staphylococcus
KESTLYKGPYDAFRKDFSHKI

SEQ ID NO: 2104280 - protein, 17 aa, Staphylococcus
KESVINFRPLNNVENHI

SEQ ID NO: 2104281 - protein, 20 aa, Staphylococcus
KETIEQLSLVYYDEKEEKWK

SEQ ID NO: 2104282 - protein, 27 aa, Staphylococcus
KETYLHGSINHQWGWIKQSDVATPAKS

SEQ ID NO: 2104283 - protein, 26 aa, Staphylococcus
KEVDFKLRKALIEQKGLYKGQYSDGK

SEQ ID NO: 2104284 - protein, 28 aa, Staphylococcus
KEVIPSNYTLASFNAYKKLKAQAQTILD

SEQ ID NO: 2104285 - protein, 23 aa, Staphylococcus
KEWREYDYLFLTFGTFSYHDPYH

SEQ ID NO: 2104286 - protein, 17 aa, Staphylococcus
KEYGIDFDTVRPMQIGL

SEQ ID NO: 2104287 - protein, 17 aa, Staphylococcus
KEYPGSYRYGFYSNGQE

SEQ ID NO: 2104288 - protein, 25 aa, Staphylococcus
KEYVWNPDAIHKMKHSGSYMTEQIA

SEQ ID NO: 2104289 - protein, 23 aa, Staphylococcus
KEYWGPKGRIGIVPMLDNKAYWF

SEQ ID NO: 2104290 - protein, 20 aa, Staphylococcus
KFAKEWMEFLKSKKAKNILK

SEQ ID NO: 2104291 - protein, 18 aa, Staphylococcus
KFDFLFVSDSLYLDNKTH

SEQ ID NO: 2104292 - protein, 20 aa, Staphylococcus
KFKKDGYDLVSNKTQLLNSQ

SEQ ID NO: 2104293 - protein, 18 aa, Staphylococcus
KFKNAYVPDREVKIHTNP

SEQ ID NO: 2104294 - protein, 17 aa, Staphylococcus
KFLALLATLTLAIVLSA

SEQ ID NO: 2104295 - protein, 23 aa, Staphylococcus
KFPKQCAYFNNLFFVGGSVNPGG

SEQ ID NO: 2104296 - protein, 17 aa, Staphylococcus
KFPPKSVWISFDDMEQS

SEQ ID NO: 2104297 - protein, 17 aa, Staphylococcus
KFSICKYTVGAFSTVIA

SEQ ID NO: 2104298 - protein, 36 aa, Staphylococcus
KFSIRKYTVGTFSTVIATLVFLGFNASHVQADELSV

SEQ ID NO: 2104299 - protein, 28 aa, Staphylococcus
KFTFGASSILIGSLLFLGVGTAQAAEED

SEQ ID NO: 2104300 - protein, 21 aa, Staphylococcus
KGDQYDVIFLFTKSMQLSDML

SEQ ID NO: 2104301 - protein, 19 aa, Staphylococcus
KGDYLGAIAKKFNTTVSKI

SEQ ID NO: 2104302 - protein, 25 aa, Staphylococcus
KGEPRSVKLIDQFGITKDDNKKDGN

SEQ ID NO: 2104303 - protein, 26 aa, Staphylococcus
KGFQEFMKFVLKDEGKSAEDAGYVAL

SEQ ID NO: 2104304 - protein, 24 aa, Staphylococcus
KGILEGQGAAFAQAAQKYDINEIY

SEQ ID NO: 2104305 - protein, 18 aa, Staphylococcus
KGIMAFSNHMGRGTEIIY

SEQ ID NO: 2104306 - protein, 17 aa, Staphylococcus
KGISEALLRSNAPKLYV

SEQ ID NO: 2104307 - protein, 25 aa, Staphylococcus
KGKIYVKIQSSWGAFINVIGNQSWG

SEQ ID NO: 2104308 - protein, 21 aa, Staphylococcus
KGNGSFLIKEQFIKAVKSNNV

SEQ ID NO: 2104309 - protein, 21 aa, Staphylococcus
KGNPEEVKYQKKHGGDISPLY

SEQ ID NO: 2104310 - protein, 27 aa, Staphylococcus
KGNRLFYLAMAPQFFGIISDYLKSSGL

SEQ ID NO: 2104311 - protein, 19 aa, Staphylococcus
KGNSALALNYHRIRDDNWF

SEQ ID NO: 2104312 - protein, 19 aa, Staphylococcus
KGPSIVMIPEVYKAVFEES

SEQ ID NO: 2104313 - protein, 22 aa, Staphylococcus
KGQCTWWAYQRRAQLGKPVSNR

SEQ ID NO: 2104314 - protein, 23 aa, Staphylococcus
KGQFKQFRHGLSSFIEALAENVQ

SEQ ID NO: 2104315 - protein, 23 aa, Staphylococcus
KGQFKQFRHGLSSFIEALAKNVE

SEQ ID NO: 2104316 - protein, 23 aa, Staphylococcus
KGQFKQFRHGLSSFIEALAKNVQ

SEQ ID NO: 2104317 - protein, 23 aa, Staphylococcus
KGQFKQFRHGLSSFIEALEQAVK

SEQ ID NO: 2104318 - protein, 17 aa, Staphylococcus
KGQSELGQVNLSDNQTT

SEQ ID NO: 2104319 - protein, 24 aa, Staphylococcus
KGTHGRPGSISVVGKIIDKGNYYK

SEQ ID NO: 2104320 - protein, 24 aa, Staphylococcus
KGTPFALPNTPWKPLRASDSKGIA

SEQ ID NO: 2104321 - protein, 29 aa, Staphylococcus
KGVKAFGPTGRFGGFLNRDLGIKHADTAM

SEQ ID NO: 2104322 - protein, 17 aa, Staphylococcus
KGYKEGTELTGKYTKET

SEQ ID NO: 2104323 - protein, 25 aa, Staphylococcus
KHDQYGRDLVYVWLDKDHMYNKELV

SEQ ID NO: 2104324 - protein, 17 aa, Staphylococcus
KHGSKFSIKEKGNEDKK

SEQ ID NO: 2104325 - protein, 18 aa, Staphylococcus
KHHYILIDPHEAYDLKGK

SEQ ID NO: 2104326 - protein, 24 aa, Staphylococcus
KHIRSYAIGVGPDYTSLNAENTKH

SEQ ID NO: 2104327 - protein, 25 aa, Staphylococcus
KHNYPRLRIAGASFEAVGLPDCILQ

SEQ ID NO: 2104328 - protein, 26 aa, Staphylococcus
KHVIPNIRGIELFTVQGQPFPSGKGT

SEQ ID NO: 2104329 - protein, 18 aa, Staphylococcus
KHVKAIKSGHVYEVDPKL

SEQ ID NO: 2104330 - protein, 18 aa, Staphylococcus
KIDPEKDPISILFLGIDD

SEQ ID NO: 2104331 - protein, 18 aa, Staphylococcus
KIEVVFKNTGTYMFHCHI

SEQ ID NO: 2104332 - protein, 18 aa, Staphylococcus
KIGQKEKIYASVMMAQAI

SEQ ID NO: 2104333 - protein, 27 aa, Staphylococcus
KIGSAESLFKAGANGKVQKLLVDTYNQ

SEQ ID NO: 2104334 - protein, 18 aa, Staphylococcus
KIGSTWGNANNWASAAQA

SEQ ID NO: 2104335 - protein, 20 aa, Staphylococcus
KIIKRRIEYTKSQNNGYIMV

SEQ ID NO: 2104336 - protein, 18 aa, Staphylococcus
KIISPYALVDNFSKDYRL

SEQ ID NO: 2104337 - protein, 22 aa, Staphylococcus
KIKARGELRVGLSADYAPYEFE

SEQ ID NO: 2104338 - protein, 17 aa, Staphylococcus
KINPSINGNTYRVTKKA

SEQ ID NO: 2104339 - protein, 25 aa, Staphylococcus
KINSVDCARELNSYYVGNVKSNEVP

SEQ ID NO: 2104340 - protein, 18 aa, Staphylococcus
KINTTVFAFQSFAEQIGG

SEQ ID NO: 2104341 - protein, 17 aa, Staphylococcus
KIPIIAGGTGLYIQSLI

SEQ ID NO: 2104342 - protein, 20 aa, Staphylococcus
KIQPDLKWLTEKQRQEYNNL

SEQ ID NO: 2104343 - protein, 18 aa, Staphylococcus
KISAIRYARENNVPYFGI

SEQ ID NO: 2104344 - protein, 18 aa, Staphylococcus
KITFNYGGSGALRQQIEK

SEQ ID NO: 2104345 - protein, 24 aa, Staphylococcus
KITHAHAYGGAIAAMDSVEATMNV

SEQ ID NO: 2104346 - protein, 21 aa, Staphylococcus
KITHAHAYGGPIAAMDSVEAT

SEQ ID NO: 2104347 - protein, 25 aa, Staphylococcus
KKADVKVGDAIKVTGTVNEYAIDGY

SEQ ID NO: 2104348 - protein, 20 aa, Staphylococcus
KKAHKDAKIEAISTTVLAPL

SEQ ID NO: 2104349 - protein, 22 aa, Staphylococcus
KKALGKEKSLFSFINKDGATQD

SEQ ID NO: 2104350 - protein, 21 aa, Staphylococcus
KKANENLGLNPSHKGETDPEK

SEQ ID NO: 2104351 - protein, 21 aa, Staphylococcus
KKDGSLGYVIKGQMVDEFEKA

SEQ ID NO: 2104352 - protein, 21 aa, Staphylococcus
KKDGSLGYVIKGQMVDSFEKA

SEQ ID NO: 2104353 - protein, 17 aa, Staphylococcus
KKDGYDIVKNKSQMQNS

SEQ ID NO: 2104354 - protein, 18 aa, Staphylococcus
KKDQVILELSQKAQERKA

SEQ ID NO: 2104355 - protein, 21 aa, Staphylococcus
KKDVLKWANKQGEQHKRAVTN

SEQ ID NO: 2104356 - protein, 25 aa, Staphylococcus
KKELVKYSKSYRTLNQVVSLQQNAY

SEQ ID NO: 2104357 - protein, 18 aa, Staphylococcus
KKEYKTKNSDAWKEAEKQ

SEQ ID NO: 2104358 - protein, 26 aa, Staphylococcus
KKFHQKFFPSYGFDNTYAFMVTKETA

SEQ ID NO: 2104359 - protein, 21 aa, Staphylococcus
KKGDGIYSYQVGKGHIAFAIE

SEQ ID NO: 2104360 - protein, 20 aa, Staphylococcus
KKGETNFAFTDDRGTDSLDK

SEQ ID NO: 2104361 - protein, 17 aa, Staphylococcus
KKGIFEQIEEAFNEMAS

SEQ ID NO: 2104362 - protein, 23 aa, Staphylococcus
KKGIKAGLADRWKVDNSGKEYEF

SEQ ID NO: 2104363 - protein, 21 aa, Staphylococcus
KKGTMGYGYQQYMKKHPEKAK

SEQ ID NO: 2104364 - protein, 17 aa, Staphylococcus
KKGVNLGQISKMSDKEI

SEQ ID NO: 2104365 - protein, 27 aa, Staphylococcus
KKGVWQVMPVKHEWDHGDFVGSDGTEA

SEQ ID NO: 2104366 - protein, 24 aa, Staphylococcus
KKHSDAVIVSAHWGNEGHHKENKT

SEQ ID NO: 2104367 - protein, 21 aa, Staphylococcus
KKIAYLKATFKKASKISKDTN

SEQ ID NO: 2104368 - protein, 23 aa, Staphylococcus
KKIHVYRPPYMMYGDDETEGKAV

SEQ ID NO: 2104369 - protein, 20 aa, Staphylococcus
KKIKGMTIGLAMNSTYYYQK

SEQ ID NO: 2104370 - protein, 19 aa, Staphylococcus
KKIMTELAEEIGLGDDLIT

SEQ ID NO: 2104371 - protein, 19 aa, Staphylococcus
KKKAIKQVRKEINALKVKD

SEQ ID NO: 2104372 - protein, 19 aa, Staphylococcus
KKKSIYDVKEFVDLCNDSI

SEQ ID NO: 2104373 - protein, 21 aa, Staphylococcus
KKKVEAKRVDAPIQEDTTQYQ

SEQ ID NO: 2104374 - protein, 20 aa, Staphylococcus
KKLDVALGYSTDGRIAAYGL

SEQ ID NO: 2104375 - protein, 26 aa, Staphylococcus
KKLIYRGIKSTVHFNSSEILNADIKT

SEQ ID NO: 2104376 - protein, 25 aa, Staphylococcus
KKLSDAMSDIREGYNGKDKKKIQKG

SEQ ID NO: 2104377 - protein, 19 aa, Staphylococcus
KKLSYKLSFNGFDPEQEYV

SEQ ID NO: 2104378 - protein, 26 aa, Staphylococcus
KKLTEKEMDAHLKAYLKANNDIIDNK

SEQ ID NO: 2104379 - protein, 24 aa, Staphylococcus
KKLVKDYKSEILVKKNSGINSLKD

SEQ ID NO: 2104380 - protein, 17 aa, Staphylococcus
KKMTFIISPQWFSTHGV

SEQ ID NO: 2104381 - protein, 17 aa, Staphylococcus
KKQLTLITCDNYNEQTN

SEQ ID NO: 2104382 - protein, 17 aa, Staphylococcus
KKQRLVFDPETGDYLPV

SEQ ID NO: 2104383 - protein, 25 aa, Staphylococcus
KKQRREFEETLPPLSKNLEDEDADS

SEQ ID NO: 2104384 - protein, 18 aa, Staphylococcus
KKQYKTKNSDAWKKAEEQ

SEQ ID NO: 2104385 - protein, 19 aa, Staphylococcus
KKRAEVLIEDITKRGKVPI

SEQ ID NO: 2104386 - protein, 24 aa, Staphylococcus
KKTFKPGLAQKWEVEDGGKTYRFH

SEQ ID NO: 2104387 - protein, 17 aa, Staphylococcus
KKVDVGFLPPTAYTLAH

SEQ ID NO: 2104388 - protein, 18 aa, Staphylococcus
KKVDVGFLPPTAYTLAHD

SEQ ID NO: 2104389 - protein, 25 aa, Staphylococcus
KKYALQYKKRYPIVNNQVDQAIKQA

SEQ ID NO: 2104390 - protein, 24 aa, Staphylococcus
KKYKFSTPYTYSSAVLVVRENEKN

SEQ ID NO: 2104391 - protein, 19 aa, Staphylococcus
KKYNGGLSSGEMQTKTAIE

SEQ ID NO: 2104392 - protein, 17 aa, Staphylococcus
KKYTDKQLDEFLKGTEA

SEQ ID NO: 2104393 - protein, 18 aa, Staphylococcus
KLAAGGFRDITRITSSNA

SEQ ID NO: 2104394 - protein, 17 aa, Staphylococcus
KLDAVKHNRVDVLDRDL

SEQ ID NO: 2104395 - protein, 17 aa, Staphylococcus
KLDDHTYVLLSSTSGNT

SEQ ID NO: 2104396 - protein, 23 aa, Staphylococcus
KLDPHAWLSIENGIKYVKTIQDS

SEQ ID NO: 2104397 - protein, 19 aa, Staphylococcus
KLDSIKSAVEFIIQEEGRI

SEQ ID NO: 2104398 - protein, 26 aa, Staphylococcus
KLEKELKSHLPFHKSLKVTKRDADTY

SEQ ID NO: 2104399 - protein, 17 aa, Staphylococcus
KLEKNDKGFFLMVEGAS

SEQ ID NO: 2104400 - protein, 22 aa, Staphylococcus
KLEKNNNGFFLMVEGASIDKTA

SEQ ID NO: 2104401 - protein, 18 aa, Staphylococcus
KLFPIPGGSILGVPTNLK

SEQ ID NO: 2104402 - protein, 24 aa, Staphylococcus
KLHNNNIYPIARIVTFKDTKLAEE

SEQ ID NO: 2104403 - protein, 26 aa, Staphylococcus
KLIVILCAIIVFIALIGVSLRSQSQS

SEQ ID NO: 2104404 - protein, 25 aa, Staphylococcus
KLIVVFCAIIIFIALIGLSIRSQTQ

SEQ ID NO: 2104405 - protein, 25 aa, Staphylococcus
KLIVVFCAIIVFIALIGLSIRSSTQ

SEQ ID NO: 2104406 - protein, 26 aa, Staphylococcus
KLIVVFCAVIIFIALIGLSLRSHTQS

SEQ ID NO: 2104407 - protein, 25 aa, Staphylococcus
KLIVVLCAIIVFIALIGLSIRSQNQ

SEQ ID NO: 2104408 - protein, 25 aa, Staphylococcus
KLIVVLCAIIVFIALIGLSIRSQTQ

SEQ ID NO: 2104409 - protein, 20 aa, Staphylococcus
KLKDERIVGTAGGGMVAVTV

SEQ ID NO: 2104410 - protein, 21 aa, Staphylococcus
KLKDERIVGTAGGGMVAVTVT

SEQ ID NO: 2104411 - protein, 20 aa, Staphylococcus
KLKEERIVGTAGGGMVAVTV

SEQ ID NO: 2104412 - protein, 23 aa, Staphylococcus
KLKEINLAPSERKEIVIDLSKMK

SEQ ID NO: 2104413 - protein, 22 aa, Staphylococcus
KLKKDAKWSNGDPVTAQDFVYA

SEQ ID NO: 2104414 - protein, 19 aa, Staphylococcus
KLKKIAPTYVFDANQSSYK

SEQ ID NO: 2104415 - protein, 25 aa, Staphylococcus
KLLYSSVFALMIVGVLLIFQNVQAH

SEQ ID NO: 2104416 - protein, 24 aa, Staphylococcus
KLNAVFKDGEIVSGESSIPKRNKQ

SEQ ID NO: 2104417 - protein, 17 aa, Staphylococcus
KLQDNRMSDVINSTDIK

SEQ ID NO: 2104418 - protein, 22 aa, Staphylococcus
KLRNGVKMIVNQAVSAVDYLYE

SEQ ID NO: 2104419 - protein, 26 aa, Staphylococcus
KLRTKEFKPDFTAKVKPFKYNGKTYA

SEQ ID NO: 2104420 - protein, 21 aa, Staphylococcus
KLSALPAVITKTDIMAHSDKS

SEQ ID NO: 2104421 - protein, 24 aa, Staphylococcus
KLSTKERLALAFCIDGVDQYTLTK

SEQ ID NO: 2104422 - protein, 20 aa, Staphylococcus
KLTNGKYVWIKESDLTKELV

SEQ ID NO: 2104423 - protein, 19 aa, Staphylococcus
KLTQELRAKGYNVSEASVS

SEQ ID NO: 2104424 - protein, 22 aa, Staphylococcus
KLVKDYKSEILVKKDSGIKSLK

SEQ ID NO: 2104425 - protein, 22 aa, Staphylococcus
KLYSYGPNWGRGGEVLYQAFGL

SEQ ID NO: 2104426 - protein, 22 aa, Staphylococcus
KLYTYGPNWGRGGEVIYQAFGL

SEQ ID NO: 2104427 - protein, 18 aa, Staphylococcus
KMDVAIMSPVTYTIGRDK

SEQ ID NO: 2104428 - protein, 24 aa, Staphylococcus
KMNSPEFKDLSLLVDTMHQAGADV

SEQ ID NO: 2104429 - protein, 20 aa, Staphylococcus
KMPDLDRYAKQTSSGEDASG

SEQ ID NO: 2104430 - protein, 18 aa, Staphylococcus
KNDKGFFLMVEGASIDKA

SEQ ID NO: 2104431 - protein, 25 aa, Staphylococcus
KNDRYGRVLAYVWLDKDTLFNELLV

SEQ ID NO: 2104432 - protein, 24 aa, Staphylococcus
KNGKEIKVRMIGMDTPETVKPNTP

SEQ ID NO: 2104433 - protein, 19 aa, Staphylococcus
KNGKILIVEYGDFKCPYCK

SEQ ID NO: 2104434 - protein, 26 aa, Staphylococcus
KNHDPIILVHGFNGFTADNGPGLGDS

SEQ ID NO: 2104435 - protein, 24 aa, Staphylococcus
KNHDPIILVHGFNGFTDDINPAVL

SEQ ID NO: 2104436 - protein, 19 aa, Staphylococcus
KNHTAVVFEAGQSGASALY

SEQ ID NO: 2104437 - protein, 19 aa, Staphylococcus
KNIKGMTIGLAMNSEYYYQ

SEQ ID NO: 2104438 - protein, 21 aa, Staphylococcus
KNKDMRYAIAQSIDKKAYVDN

SEQ ID NO: 2104439 - protein, 23 aa, Staphylococcus
KNKESIGYFGYNFYKQNKDKLKE

SEQ ID NO: 2104440 - protein, 26 aa, Staphylococcus
KNLGGFPISGAFLVCKNPEVVKEHDA

SEQ ID NO: 2104441 - protein, 17 aa, Staphylococcus
KNLKASSTYYDKVASAV

SEQ ID NO: 2104442 - protein, 24 aa, Staphylococcus
KNLLDASSYYKAMAKESGATLYQN

SEQ ID NO: 2104443 - protein, 30 aa, Staphylococcus
KNNLYTAGQCTWYVYDKVNGAIGSTWGTAN

SEQ ID NO: 2104444 - protein, 36 aa, Staphylococcus
KNNTRIGESITVRANILFDGETTPIVKESSYMVVRT

SEQ ID NO: 2104445 - protein, 33 aa, Staphylococcus
KNPALKYQFLRLDRPQLLSVDRLNRLLKGKGML

SEQ ID NO: 2104446 - protein, 19 aa, Staphylococcus
KNPERIAVVAPTYAGGIKY

SEQ ID NO: 2104447 - protein, 19 aa, Staphylococcus
KNPKRIAVLHPTYVGALVK

SEQ ID NO: 2104448 - protein, 24 aa, Staphylococcus
KNPKYLPRFVFGHYMKSYLSNYET

SEQ ID NO: 2104449 - protein, 18 aa, Staphylococcus
KNSALALNYHRVRKNDPL

SEQ ID NO: 2104450 - protein, 17 aa, Staphylococcus
KNSDFGKSVDWTIQGTD

SEQ ID NO: 2104451 - protein, 21 aa, Staphylococcus
KNSDFGKSVDWTIQGTDARNG

SEQ ID NO: 2104452 - protein, 27 aa, Staphylococcus
KNSDNYQWYMHMNKLNVQQGQSVNAGD

SEQ ID NO: 2104453 - protein, 20 aa, Staphylococcus
KNSGNLFFIPYVFKDDKIYY

SEQ ID NO: 2104454 - protein, 24 aa, Staphylococcus
KNSKDTGMMTYEFDGSTVNIEIYH

SEQ ID NO: 2104455 - protein, 26 aa, Staphylococcus
KNTKEYFAKIWLTARNDADDIFYEED

SEQ ID NO: 2104456 - protein, 26 aa, Staphylococcus
KNTSKIWKTKDNAFYDLSREGTSKLN

SEQ ID NO: 2104457 - protein, 25 aa, Staphylococcus
KNTYPRLRITGAPFEAVGLPDCIQQ

SEQ ID NO: 2104458 - protein, 17 aa, Staphylococcus
KNVEEVIDKIHLKELDN

SEQ ID NO: 2104459 - protein, 25 aa, Staphylococcus
KNVKAKWNISKAMIKEGNGGSDETE

SEQ ID NO: 2104460 - protein, 19 aa, Staphylococcus
KPEFPDRNDDEWLKTTMAH

SEQ ID NO: 2104461 - protein, 17 aa, Staphylococcus
KPEFPDRNDEEWLKTTL

SEQ ID NO: 2104462 - protein, 20 aa, Staphylococcus
KPEFPERNDEEWLKTTLAEY

SEQ ID NO: 2104463 - protein, 19 aa, Staphylococcus
KPEFPERNDEEWLKTTMAH

SEQ ID NO: 2104464 - protein, 17 aa, Staphylococcus
KPEGAINAGGYDNAKVT

SEQ ID NO: 2104465 - protein, 30 aa, Staphylococcus
KPFESAQGFDYRYHIGDNIVQYIVEDGYVK

SEQ ID NO: 2104466 - protein, 17 aa, Staphylococcus
KPFIKTKLISPIGKLRA

SEQ ID NO: 2104467 - protein, 18 aa, Staphylococcus
KPITESFHSFKQRFGEGK

SEQ ID NO: 2104468 - protein, 24 aa, Staphylococcus
KPKQKKFTIAFGVGTYEEQFRKGI

SEQ ID NO: 2104469 - protein, 19 aa, Staphylococcus
KPPNRFLIGATSYFDNYSV

SEQ ID NO: 2104470 - protein, 19 aa, Staphylococcus
KPSNSGLFVTVYDKTGKKT

SEQ ID NO: 2104471 - protein, 19 aa, Staphylococcus
KPSNSGLYTTVYDSKGHST

SEQ ID NO: 2104472 - protein, 25 aa, Staphylococcus
KPVQAGAYDIHFVNNGFQYNFTSNG

SEQ ID NO: 2104473 - protein, 25 aa, Staphylococcus
KQANTRATSLFATMPQASDNASSTD

SEQ ID NO: 2104474 - protein, 23 aa, Staphylococcus
KQCDFDFNISIIYDGYKFVNVNM

SEQ ID NO: 2104475 - protein, 18 aa, Staphylococcus
KQEANLYGNHNKTYNDYG

SEQ ID NO: 2104476 - protein, 34 aa, Staphylococcus
KQFISTFDHMDFLKWINLRNDYTVTWTSQKLNGR

SEQ ID NO: 2104477 - protein, 24 aa, Staphylococcus
KQGFATAKNNGWNTVKKAIVGGAK

SEQ ID NO: 2104478 - protein, 17 aa, Staphylococcus
KQHGGDISPLYKGGQDN

SEQ ID NO: 2104479 - protein, 19 aa, Staphylococcus
KQIKEDKVNYILAEENVSN

SEQ ID NO: 2104480 - protein, 17 aa, Staphylococcus
KQKGKFPKRSVWINFDD

SEQ ID NO: 2104481 - protein, 25 aa, Staphylococcus
KQMKQAIQFVKSHHLKHLLVETSVD

SEQ ID NO: 2104482 - protein, 24 aa, Staphylococcus
KQNDIWKHFKAVKTNQVYDLEEVP

SEQ ID NO: 2104483 - protein, 17 aa, Staphylococcus
KQNTEWVGYATPNKEAR

SEQ ID NO: 2104484 - protein, 19 aa, Staphylococcus
KQNYDVTFIDGWEPQAQAV

SEQ ID NO: 2104485 - protein, 19 aa, Staphylococcus
KQQARAKINEKFKTKQDQI

SEQ ID NO: 2104486 - protein, 18 aa, Staphylococcus
KQQIEIFGNREDLNSISQ

SEQ ID NO: 2104487 - protein, 23 aa, Staphylococcus
KQRTEGNNTYVLLQDSTQNTPLG

SEQ ID NO: 2104488 - protein, 19 aa, Staphylococcus
KQRWSHAVDQGIYNGGGIA

SEQ ID NO: 2104489 - protein, 24 aa, Staphylococcus
KQSNNRSTAMFQLLPDLSNNDENN

SEQ ID NO: 2104490 - protein, 20 aa, Staphylococcus
KQSYTGTIFVHGYGGSANSE

SEQ ID NO: 2104491 - protein, 24 aa, Staphylococcus
KQVEKRTGTQLVVLHYQSINKLCD

SEQ ID NO: 2104492 - protein, 18 aa, Staphylococcus
KQVLKNDVIKHVKAIKSG

SEQ ID NO: 2104493 - protein, 24 aa, Staphylococcus
KQYGIEGKLAVYVPTYRENYQANR

SEQ ID NO: 2104494 - protein, 21 aa, Staphylococcus
KQYGITPGYIWEINTEKQGTP

SEQ ID NO: 2104495 - protein, 17 aa, Staphylococcus
KQYGYIHRLFVKPHTYV

SEQ ID NO: 2104496 - protein, 23 aa, Staphylococcus
KRAGDGYPAFTKAYGFKFKTVRP

SEQ ID NO: 2104497 - protein, 28 aa, Staphylococcus
KRAQAGHTISTFWGDARNWAGQASGDGF

SEQ ID NO: 2104498 - protein, 19 aa, Staphylococcus
KRDADTYAIVILGLDQSPE

SEQ ID NO: 2104499 - protein, 20 aa, Staphylococcus
KREKEFKKEEKALDDSEKEF

SEQ ID NO: 2104500 - protein, 19 aa, Staphylococcus
KREQQAMLNFVEKGGNIIF

SEQ ID NO: 2104501 - protein, 19 aa, Staphylococcus
KRHADEYGFIIRYGKGKEN

SEQ ID NO: 2104502 - protein, 21 aa, Staphylococcus
KRLLESNIHLVSGHPMAGSHK

SEQ ID NO: 2104503 - protein, 22 aa, Staphylococcus
KRMKSKSIQVVVEFKEVPMNLY

SEQ ID NO: 2104504 - protein, 18 aa, Staphylococcus
KRRNTLYTAIVLLLALIL

SEQ ID NO: 2104505 - protein, 17 aa, Staphylococcus
KRSRKIGKLAQRSNKIV

SEQ ID NO: 2104506 - protein, 22 aa, Staphylococcus
KRSYKSFLLEKMIRMSGMKKTF

SEQ ID NO: 2104507 - protein, 19 aa, Staphylococcus
KRTPDILKYLGEHKAHQYL

SEQ ID NO: 2104508 - protein, 19 aa, Staphylococcus
KRTPDILKYLGEHKESQYL

SEQ ID NO: 2104509 - protein, 19 aa, Staphylococcus
KRVDIMLTNGLFREVEALL

SEQ ID NO: 2104510 - protein, 21 aa, Staphylococcus
KRWEKEVTPIVGKTDLFIFPH

SEQ ID NO: 2104511 - protein, 19 aa, Staphylococcus
KRYRLKQLLNSKAIEQDMT

SEQ ID NO: 2104512 - protein, 17 aa, Staphylococcus
KSAFQFDNDEVVNGIIW

SEQ ID NO: 2104513 - protein, 24 aa, Staphylococcus
KSAGHPIFNVLEGNMGNSYTNSGN

SEQ ID NO: 2104514 - protein, 24 aa, Staphylococcus
KSATKYHNVFGIAAFDANPLYNGI

SEQ ID NO: 2104515 - protein, 25 aa, Staphylococcus
KSAVTPIKYDYIIHNQKGSYYIDPL

SEQ ID NO: 2104516 - protein, 22 aa, Staphylococcus
KSDQVLGLFAEKNMPLQIDAPQ

SEQ ID NO: 2104517 - protein, 20 aa, Staphylococcus
KSFEYKDFKSYKDIIKKAQN

SEQ ID NO: 2104518 - protein, 18 aa, Staphylococcus
KSGANGWAVPSTTEHPED

SEQ ID NO: 2104519 - protein, 20 aa, Staphylococcus
KSGDSLSAIAAKYGTTYQKI

SEQ ID NO: 2104520 - protein, 20 aa, Staphylococcus
KSGDSLSSIASRYGTTYRHI

SEQ ID NO: 2104521 - protein, 31 aa, Staphylococcus
KSGESLWSISNRYGITIAKLKSLNGLTSNLI

SEQ ID NO: 2104522 - protein, 23 aa, Staphylococcus
KSGKGWTQYHMWVEAKGNEKNLQ

SEQ ID NO: 2104523 - protein, 25 aa, Staphylococcus
KSGTAISPRPAFILKSSKHKDLAKK

SEQ ID NO: 2104524 - protein, 20 aa, Staphylococcus
KSHHLKHLLVETSVDHKSMQ

SEQ ID NO: 2104525 - protein, 18 aa, Staphylococcus
KSHQSTNLINQFYDGLST

SEQ ID NO: 2104526 - protein, 19 aa, Staphylococcus
KSIAYGHSLIRWDEQGDTL

SEQ ID NO: 2104527 - protein, 26 aa, Staphylococcus
KSNLWLRTSDRVRLVMGRFKATTFEE

SEQ ID NO: 2104528 - protein, 25 aa, Staphylococcus
KSNNDEIFIETPFGGINESVKHHAI

SEQ ID NO: 2104529 - protein, 25 aa, Staphylococcus
KSNVANHWRIRTGIQQGDTALNTET

SEQ ID NO: 2104530 - protein, 21 aa, Staphylococcus
KSPDVYPAMEEKLLDTLNKHG

SEQ ID NO: 2104531 - protein, 21 aa, Staphylococcus
KSPDVYPGMEEKLLDSLNKHH

SEQ ID NO: 2104532 - protein, 19 aa, Staphylococcus
KSSDWLSNQFGVRFRYNAL

SEQ ID NO: 2104533 - protein, 19 aa, Staphylococcus
KSTITRLIYSILREDQYRV

SEQ ID NO: 2104534 - protein, 19 aa, Staphylococcus
KSTSGYIYPLASLKDKGVS

SEQ ID NO: 2104535 - protein, 22 aa, Staphylococcus
KSVNNQAWLAAYMLKQNGITPT

SEQ ID NO: 2104536 - protein, 18 aa, Staphylococcus
KTDLENFGELNAIFIKNK

SEQ ID NO: 2104537 - protein, 25 aa, Staphylococcus
KTEGLYGYTVGKGHITFHVTDGYVD

SEQ ID NO: 2104538 - protein, 27 aa, Staphylococcus
KTEHYYEFKTSKGFMIVTADGQKDHGV

SEQ ID NO: 2104539 - protein, 22 aa, Staphylococcus
KTGANLSDISHIYIAKKDPDNA

SEQ ID NO: 2104540 - protein, 19 aa, Staphylococcus
KTGPLEWENPQFIKSVKEH

SEQ ID NO: 2104541 - protein, 19 aa, Staphylococcus
KTGQAAAWGTTSSGSTGGT

SEQ ID NO: 2104542 - protein, 25 aa, Staphylococcus
KTIIYRYDATTGRRITGNDVLSLLR

SEQ ID NO: 2104543 - protein, 22 aa, Staphylococcus
KTKDLKNDKALFLLVNEGELST

SEQ ID NO: 2104544 - protein, 30 aa, Staphylococcus
KTKLISPIGKLRAGMDLFKKPIQIEDDISV

SEQ ID NO: 2104545 - protein, 20 aa, Staphylococcus
KTQALADLEHLTSLNNAQKE

SEQ ID NO: 2104546 - protein, 17 aa, Staphylococcus
KTSRKLLRAAAVGQEGV

SEQ ID NO: 2104547 - protein, 24 aa, Staphylococcus
KTTFKKDFNSRGYIQKHDPDYKEE

SEQ ID NO: 2104548 - protein, 17 aa, Staphylococcus
KTTPGYETTNIWKNLPA

SEQ ID NO: 2104549 - protein, 24 aa, Staphylococcus
KTVKENPLLSGRTFSINKKATLNN

SEQ ID NO: 2104550 - protein, 18 aa, Staphylococcus
KTVKFDLPDNVTKVNPKE

SEQ ID NO: 2104551 - protein, 19 aa, Staphylococcus
KTVRQALGHLVNRNKIATD

SEQ ID NO: 2104552 - protein, 21 aa, Staphylococcus
KVDAPKLYVSNVMTQPGETNN

SEQ ID NO: 2104553 - protein, 18 aa, Staphylococcus
KVDVAFISPVSYTIAHDQ

SEQ ID NO: 2104554 - protein, 17 aa, Staphylococcus
KVDVGLKQWGLAQRDDE

SEQ ID NO: 2104555 - protein, 20 aa, Staphylococcus
KVFVDLCNQAIKANEDILEY

SEQ ID NO: 2104556 - protein, 20 aa, Staphylococcus
KVHQTICTFSKVNKVSYIED

SEQ ID NO: 2104557 - protein, 20 aa, Staphylococcus
KVIPILKERGLIQAAYSEGT

SEQ ID NO: 2104558 - protein, 24 aa, Staphylococcus
KVKFKETQWDSMFAGLDSGRFDMI

SEQ ID NO: 2104559 - protein, 25 aa, Staphylococcus
KVKFKETQWDSMFAGLDSGRFNVIA

SEQ ID NO: 2104560 - protein, 20 aa, Staphylococcus
KVLAKEGAHVLALDISDELE

SEQ ID NO: 2104561 - protein, 28 aa, Staphylococcus
KVLGNKDSRVDFGLSQWGLKQQPNESYV

SEQ ID NO: 2104562 - protein, 26 aa, Staphylococcus
KVLIPISICTLIILLIGCGKSSDGLA

SEQ ID NO: 2104563 - protein, 20 aa, Staphylococcus
KVLKEKHLPVPKSIKDLTKP

SEQ ID NO: 2104564 - protein, 19 aa, Staphylococcus
KVNSSVKNGKWHISDQDHQ

SEQ ID NO: 2104565 - protein, 25 aa, Staphylococcus
KVPEKEWRVNDGLVSVVSAQHPFNQ

SEQ ID NO: 2104566 - protein, 18 aa, Staphylococcus
KVQSAIIKSLDQLGIHEK

SEQ ID NO: 2104567 - protein, 21 aa, Staphylococcus
KVQSGESLWTIAQKYNTSVDS

SEQ ID NO: 2104568 - protein, 19 aa, Staphylococcus
KVSGGVGIVSKWPIVQQEQ

SEQ ID NO: 2104569 - protein, 24 aa, Staphylococcus
KVSKVIKTDYGYHIIKADKESDFN

SEQ ID NO: 2104570 - protein, 18 aa, Staphylococcus
KVTFNYGGSGALRQQIEK

SEQ ID NO: 2104571 - protein, 20 aa, Staphylococcus
KVVKTDYGYHIIKADKETDF

SEQ ID NO: 2104572 - protein, 17 aa, Staphylococcus
KVVREESNLPKKRSRRD

SEQ ID NO: 2104573 - protein, 19 aa, Staphylococcus
KWAGTIGNGKMEIHPYNNL

SEQ ID NO: 2104574 - protein, 26 aa, Staphylococcus
KWISGMASMVMVLSMTMYCPGNAEAS

SEQ ID NO: 2104575 - protein, 18 aa, Staphylococcus
KWYQTQSDFTFKNPKYLP

SEQ ID NO: 2104576 - protein, 20 aa, Staphylococcus
KYAKEAGWDSVSKAIVGGAK

SEQ ID NO: 2104577 - protein, 24 aa, Staphylococcus
KYDPHIWLDPVIDQKFAKEIKDEL

SEQ ID NO: 2104578 - protein, 24 aa, Staphylococcus
KYDPHIWLDPVISQKFAKEIKDEL

SEQ ID NO: 2104579 - protein, 22 aa, Staphylococcus
KYDPHVWLDPVLSQQFAKDIKD

SEQ ID NO: 2104580 - protein, 24 aa, Staphylococcus
KYFNYHPQRPFNYYKDQHSLNQNI

SEQ ID NO: 2104581 - protein, 28 aa, Staphylococcus
KYHIKRNGMVFWFGLPKGQTPTGPVRFT

SEQ ID NO: 2104582 - protein, 21 aa, Staphylococcus
KYKDGDGFKDYSAVTKEDRKA

SEQ ID NO: 2104583 - protein, 23 aa, Staphylococcus
KYKIKMGQVAPWGTTTTTKPSTG

SEQ ID NO: 2104584 - protein, 24 aa, Staphylococcus
KYKKIAATVPFNYAKHNYLEQQEE

SEQ ID NO: 2104585 - protein, 24 aa, Staphylococcus
KYKKIAATVPFNYQKHKYLEQQEE

SEQ ID NO: 2104586 - protein, 19 aa, Staphylococcus
KYKLKPFLDPSKVYSETDR

SEQ ID NO: 2104587 - protein, 25 aa, Staphylococcus
KYMKSDQASALKFYEKKDAKENKTD

SEQ ID NO: 2104588 - protein, 26 aa, Staphylococcus
KYNIKSELTKQGYRVHEANIGAFSSN

SEQ ID NO: 2104589 - protein, 21 aa, Staphylococcus
KYNRNRIGNQIIKQYRQKYEY

SEQ ID NO: 2104590 - protein, 18 aa, Staphylococcus
KYQFLRLDQPQYLSEATL

SEQ ID NO: 2104591 - protein, 17 aa, Staphylococcus
KYQFMQSTWDHVAPSEY

SEQ ID NO: 2104592 - protein, 26 aa, Staphylococcus
KYQKEHGGEISPLYKGNNDNMVSSIT

SEQ ID NO: 2104593 - protein, 21 aa, Staphylococcus
KYSTELANIFYVRQKEQKGLG

SEQ ID NO: 2104594 - protein, 21 aa, Staphylococcus
KYTFTSNGNTWSWNYTYTGGA

SEQ ID NO: 2104595 - protein, 26 aa, Staphylococcus
KYTMPARNVNPIGYYQMMAEPGSSGG

SEQ ID NO: 2104596 - protein, 21 aa, Staphylococcus
KYVDVKSIYPAGADLHSYEPT

SEQ ID NO: 2104597 - protein, 39 aa, Staphylococcus
KYYKSGLTLDQAVAIQKGLKFKPQIQHTAGKWEDASATE

SEQ ID NO: 2104598 - protein, 23 aa, Staphylococcus
KYYRKQYEYKKVLSKGEHQIDGK

SEQ ID NO: 2104599 - protein, 24 aa, Staphylococcus
LAAIFLLTACGKGNDEKQSLEQDI

SEQ ID NO: 2104600 - protein, 17 aa, Staphylococcus
LADGRIYSAQQAKSNGL

SEQ ID NO: 2104601 - protein, 23 aa, Staphylococcus
LAENGHSVLMWGKNENTVDEINQ

SEQ ID NO: 2104602 - protein, 18 aa, Staphylococcus
LAERFPRITALKGSLFGV

SEQ ID NO: 2104603 - protein, 18 aa, Staphylococcus
LAEVKSAMDTSKFVNDPV

SEQ ID NO: 2104604 - protein, 17 aa, Staphylococcus
LAFIFVLAACGGGNNKK

SEQ ID NO: 2104605 - protein, 17 aa, Staphylococcus
LAFMVVLAGCGKGESDN

SEQ ID NO: 2104606 - protein, 23 aa, Staphylococcus
LAGDKKVLFYSYENFMVENASNS

SEQ ID NO: 2104607 - protein, 23 aa, Staphylococcus
LAGNKKILFYSYENFMVNHVANA

SEQ ID NO: 2104608 - protein, 21 aa, Staphylococcus
LAGNKKVLFYSYENFMVNNVA

SEQ ID NO: 2104609 - protein, 17 aa, Staphylococcus
LAGSYIVHSDGSVEKFD

SEQ ID NO: 2104610 - protein, 19 aa, Staphylococcus
LAIEGRDAIFSSQQLLKPF

SEQ ID NO: 2104611 - protein, 20 aa, Staphylococcus
LALKSREKFNDLSIALEKET

SEQ ID NO: 2104612 - protein, 17 aa, Staphylococcus
LALMLILAACGNKSDSD

SEQ ID NO: 2104613 - protein, 17 aa, Staphylococcus
LALMLILAACGNNSSDD

SEQ ID NO: 2104614 - protein, 19 aa, Staphylococcus
LALSLILGAAACSNDDSSK

SEQ ID NO: 2104615 - protein, 26 aa, Staphylococcus
LANDGKPVLGVCNGFQILTEIGLLPG

SEQ ID NO: 2104616 - protein, 20 aa, Staphylococcus
LANGTAIWVKAADVRDTLTR

SEQ ID NO: 2104617 - protein, 22 aa, Staphylococcus
LANKSFKVSKSVVIGNTTYLYG

SEQ ID NO: 2104618 - protein, 28 aa, Staphylococcus
LAQSPHYNLFGIKGSYQGKSADFNTLED

SEQ ID NO: 2104619 - protein, 21 aa, Staphylococcus
LASFLALAACSDDDKTSHKKD

SEQ ID NO: 2104620 - protein, 23 aa, Staphylococcus
LASFLVLAACGNSEESKSEDKKE

SEQ ID NO: 2104621 - protein, 17 aa, Staphylococcus
LASFLVLTACGQQKESK

SEQ ID NO: 2104622 - protein, 30 aa, Staphylococcus
LASTLILGACGKNDEKAALQKDIDKLQKEN

SEQ ID NO: 2104623 - protein, 31 aa, Staphylococcus
LASTLMLTACGKSNEKASLEKSIDQLEKENK

SEQ ID NO: 2104624 - protein, 19 aa, Staphylococcus
LATEIPKFIAPAMNVHMYE

SEQ ID NO: 2104625 - protein, 17 aa, Staphylococcus
LATGLALSAMVATTSSM

SEQ ID NO: 2104626 - protein, 31 aa, Staphylococcus
LATSDNYTFASLVFDPEALDSDAVKNSTSIP

SEQ ID NO: 2104627 - protein, 28 aa, Staphylococcus
LAVKNDLRFKKFVKNNHIPQEYKDPTQR

SEQ ID NO: 2104628 - protein, 22 aa, Staphylococcus
LCASLFILVIFVGGCGSFNKEA

SEQ ID NO: 2104629 - protein, 21 aa, Staphylococcus
LCNKSIKANEEILDYTKVFEK

SEQ ID NO: 2104630 - protein, 20 aa, Staphylococcus
LCSFLVLGACSQSDHDSKQD

SEQ ID NO: 2104631 - protein, 21 aa, Staphylococcus
LCSLYCLILSGCGQNNNEDLN

SEQ ID NO: 2104632 - protein, 17 aa, Staphylococcus
LCSTVLGTLVFAKFREK

SEQ ID NO: 2104633 - protein, 20 aa, Staphylococcus
LCTILFLAACNSNDNHERAK

SEQ ID NO: 2104634 - protein, 22 aa, Staphylococcus
LDAEGLPTLLNQAVDHHSDVAF

SEQ ID NO: 2104635 - protein, 17 aa, Staphylococcus
LDAGSWFNNAHPEYAKP

SEQ ID NO: 2104636 - protein, 24 aa, Staphylococcus
LDDYKEQKKLAAYQKQLLADKVKV

SEQ ID NO: 2104637 - protein, 22 aa, Staphylococcus
LDEILSRYGTKANYYIETKNPN

SEQ ID NO: 2104638 - protein, 22 aa, Staphylococcus
LDEILTRYGTDANYYIETKQPD

SEQ ID NO: 2104639 - protein, 24 aa, Staphylococcus
LDGNWNQSMFDNHEYQFTLTDSEG

SEQ ID NO: 2104640 - protein, 17 aa, Staphylococcus
LDISEWQGALTDAQVKA

SEQ ID NO: 2104641 - protein, 17 aa, Staphylococcus
LDKALSIGLIDKKAEDY

SEQ ID NO: 2104642 - protein, 20 aa, Staphylococcus
LDKDKYYLVSDYNSGKLYGW

SEQ ID NO: 2104643 - protein, 25 aa, Staphylococcus
LDKGKIGQSFLNWPKSTRTITPSFT

SEQ ID NO: 2104644 - protein, 25 aa, Staphylococcus
LDKIKQPHLIGPVHFERHKGHIDGN

SEQ ID NO: 2104645 - protein, 18 aa, Staphylococcus
LDLHTLLEKYGENSNYKE

SEQ ID NO: 2104646 - protein, 25 aa, Staphylococcus
LDLLLDIRCPVVITGAMRSSNEIGS

SEQ ID NO: 2104647 - protein, 26 aa, Staphylococcus
LDLTDWRVSPIFGDIEGLGHITISIG

SEQ ID NO: 2104648 - protein, 26 aa, Staphylococcus
LDNDIPIVLVSRSFNGIVSPVYAYEG

SEQ ID NO: 2104649 - protein, 19 aa, Staphylococcus
LDNKAYWFISVNAKQGDPK

SEQ ID NO: 2104650 - protein, 26 aa, Staphylococcus
LDNNIPIVLVSRSFNGIVSPVYAYEG

SEQ ID NO: 2104651 - protein, 21 aa, Staphylococcus
LDPKIFYPLIKKLKENNDYVV

SEQ ID NO: 2104652 - protein, 17 aa, Staphylococcus
LDPKLWYFASGSTTTTV

SEQ ID NO: 2104653 - protein, 17 aa, Staphylococcus
LDRFNRHVNVPKANNAV

SEQ ID NO: 2104654 - protein, 17 aa, Staphylococcus
LDSDLRDLANIATKNQM

SEQ ID NO: 2104655 - protein, 24 aa, Staphylococcus
LDSNLKPGEAFEQFSSAIKLGRYQ

SEQ ID NO: 2104656 - protein, 22 aa, Staphylococcus
LDSSRFQYYIGQALNVAPQSVY

SEQ ID NO: 2104657 - protein, 28 aa, Staphylococcus
LDTLVKLFYKECEEWNIELDTLINRRSG

SEQ ID NO: 2104658 - protein, 18 aa, Staphylococcus
LEAAKDALQQSIQAADNT

SEQ ID NO: 2104659 - protein, 18 aa, Staphylococcus
LEELLRNGNQEEIEYQKK

SEQ ID NO: 2104660 - protein, 22 aa, Staphylococcus
LEGLGRISIFIGTKETLYPDAL

SEQ ID NO: 2104661 - protein, 23 aa, Staphylococcus
LEGLGRLSIFIGTKETLYPDALK

SEQ ID NO: 2104662 - protein, 19 aa, Staphylococcus
LEKEKDLFELIKQDGVTQS

SEQ ID NO: 2104663 - protein, 20 aa, Staphylococcus
LEKTIKFTDFKTAKASEKNE

SEQ ID NO: 2104664 - protein, 21 aa, Staphylococcus
LELQSRLQIRINSPISGKVTI

SEQ ID NO: 2104665 - protein, 25 aa, Staphylococcus
LELTTSLRKALFNNQDMSTSSRKNE

SEQ ID NO: 2104666 - protein, 22 aa, Staphylococcus
LEMPNAAQSLTLFKSFATSPYK

SEQ ID NO: 2104667 - protein, 22 aa, Staphylococcus
LENVGKISFLFNHHKVSDLKAS

SEQ ID NO: 2104668 - protein, 18 aa, Staphylococcus
LEPGQKAKIEVVFKNTGT

SEQ ID NO: 2104669 - protein, 27 aa, Staphylococcus
LEPNWNIKLYERMDRPALESSNERHNA

SEQ ID NO: 2104670 - protein, 26 aa, Staphylococcus
LEPNWNIKLYERMDRPGLESSNERHN

SEQ ID NO: 2104671 - protein, 18 aa, Staphylococcus
LEPSWNIKLYERLDRPGI

SEQ ID NO: 2104672 - protein, 17 aa, Staphylococcus
LERMGLHRDSEGRLIPI

SEQ ID NO: 2104673 - protein, 25 aa, Staphylococcus
LESAGLIKLKDNFGLSGTTKDIKDN

SEQ ID NO: 2104674 - protein, 18 aa, Staphylococcus
LESGDAWFENALKQAGKS

SEQ ID NO: 2104675 - protein, 18 aa, Staphylococcus
LETGNGWFDKALEQAGKN

SEQ ID NO: 2104676 - protein, 18 aa, Staphylococcus
LETGNGWFDKALSQANKS

SEQ ID NO: 2104677 - protein, 18 aa, Staphylococcus
LFADEGVDVVLGMHPHVI

SEQ ID NO: 2104678 - protein, 19 aa, Staphylococcus
LFAEKDMPLQIDAPQQNPL

SEQ ID NO: 2104679 - protein, 17 aa, Staphylococcus
LFLKECSDYGIDFEKLI

SEQ ID NO: 2104680 - protein, 18 aa, Staphylococcus
LFRLALKSREKFNDLSIA

SEQ ID NO: 2104681 - protein, 19 aa, Staphylococcus
LFTLVCLCLIVIFIMILSA

SEQ ID NO: 2104682 - protein, 24 aa, Staphylococcus
LFVKPKLEQSIGFYSDNATDNKEN

SEQ ID NO: 2104683 - protein, 17 aa, Staphylococcus
LGAKVIMPIYPKVPHAT

SEQ ID NO: 2104684 - protein, 28 aa, Staphylococcus
LGASCLLVGCGSQNLGPLEVKTTQLRDE

SEQ ID NO: 2104685 - protein, 24 aa, Staphylococcus
LGASILLAGCGSQNLGPLEHKTTK

SEQ ID NO: 2104686 - protein, 20 aa, Staphylococcus
LGDWADAIIIAPATANTIAK

SEQ ID NO: 2104687 - protein, 23 aa, Staphylococcus
LGEHKESQYLVGFAAETQNIEAY

SEQ ID NO: 2104688 - protein, 23 aa, Staphylococcus
LGEHKRQQYLVGFAAETQNIEAY

SEQ ID NO: 2104689 - protein, 24 aa, Staphylococcus
LGGTLRLGLYPSKIKKDTLAYDIY

SEQ ID NO: 2104690 - protein, 25 aa, Staphylococcus
LGHNYWGGNRIKLTQELRAKGYNVS

SEQ ID NO: 2104691 - protein, 18 aa, Staphylococcus
LGIAGYALTGNEAHASET

SEQ ID NO: 2104692 - protein, 19 aa, Staphylococcus
LGICLILLIILIGSCIILT

SEQ ID NO: 2104693 - protein, 18 aa, Staphylococcus
LGKHKVDYVIKGLDKDVD

SEQ ID NO: 2104694 - protein, 17 aa, Staphylococcus
LGLDAKYDTQLDEWQYL

SEQ ID NO: 2104695 - protein, 24 aa, Staphylococcus
LGLSSFIILSACGQNTDNNNKKDN

SEQ ID NO: 2104696 - protein, 19 aa, Staphylococcus
LGMLILLAACGNKVDGTYK

SEQ ID NO: 2104697 - protein, 20 aa, Staphylococcus
LGNIKAKSIITVDHVTITEQ

SEQ ID NO: 2104698 - protein, 20 aa, Staphylococcus
LGNNKFYLVEDYNSGKKYGW

SEQ ID NO: 2104699 - protein, 20 aa, Staphylococcus
LGNNKFYLVQDYNTGEKFGW

SEQ ID NO: 2104700 - protein, 21 aa, Staphylococcus
LGQTKEAWGTGSVEEQTKGMI

SEQ ID NO: 2104701 - protein, 17 aa, Staphylococcus
LGSGFGAMLYRQGNDVT

SEQ ID NO: 2104702 - protein, 19 aa, Staphylococcus
LGSHDGVGHVFGRDITGKK

SEQ ID NO: 2104703 - protein, 17 aa, Staphylococcus
LGSSQGYSVIEIVEAAR

SEQ ID NO: 2104704 - protein, 17 aa, Staphylococcus
LGVVVGYVVARNLLHQK

SEQ ID NO: 2104705 - protein, 17 aa, Staphylococcus
LHRELGEIMTANVTVVR

SEQ ID NO: 2104706 - protein, 18 aa, Staphylococcus
LHTLPPHFELKTEKTKEL

SEQ ID NO: 2104707 - protein, 17 aa, Staphylococcus
LIAILTLMLFLTYGCQS

SEQ ID NO: 2104708 - protein, 18 aa, Staphylococcus
LIALCLMLAGCSNGDNKD

SEQ ID NO: 2104709 - protein, 25 aa, Staphylococcus
LIAVPAIFAYQLFKSSESAFQTSYS

SEQ ID NO: 2104710 - protein, 19 aa, Staphylococcus
LIAVRKGHKDDKKIKALIE

SEQ ID NO: 2104711 - protein, 18 aa, Staphylococcus
LIDEFDELAYLYLNTGNS

SEQ ID NO: 2104712 - protein, 18 aa, Staphylococcus
LIEGIKYAKEAGWDSVSK

SEQ ID NO: 2104713 - protein, 25 aa, Staphylococcus
LIENIKENLNWIWNSFSREDQKDFD

SEQ ID NO: 2104714 - protein, 24 aa, Staphylococcus
LIENVKENLNWIWNSFSRQDQIEF

SEQ ID NO: 2104715 - protein, 25 aa, Staphylococcus
LIESLPQRQVRTISTRANREARAVR

SEQ ID NO: 2104716 - protein, 23 aa, Staphylococcus
LIFAKAEIGNTFYSKNNDTTYKS

SEQ ID NO: 2104717 - protein, 21 aa, Staphylococcus
LIFEIACTKLDAYYIAYQKAP

SEQ ID NO: 2104718 - protein, 17 aa, Staphylococcus
LIFPNQVLKVSGSSSSA

SEQ ID NO: 2104719 - protein, 18 aa, Staphylococcus
LIGHLFEIIDPYSRNQQG

SEQ ID NO: 2104720 - protein, 33 aa, Staphylococcus
LIGHSMGGQTVRLLEEMLRKGNPEEVKYQKKHG

SEQ ID NO: 2104721 - protein, 19 aa, Staphylococcus
LIHPGDLIAVSSKGAALLG

SEQ ID NO: 2104722 - protein, 18 aa, Staphylococcus
LIKKGIDGNPNIYRPTWK

SEQ ID NO: 2104723 - protein, 27 aa, Staphylococcus
LIKKGKSVRCAIAYDIYDVNKPVILKA

SEQ ID NO: 2104724 - protein, 17 aa, Staphylococcus
LILLTFALIAIPVVFAN

SEQ ID NO: 2104725 - protein, 17 aa, Staphylococcus
LILLTFVLVVVPIIFAT

SEQ ID NO: 2104726 - protein, 20 aa, Staphylococcus
LILSACGKSEEKVSLENDIK

SEQ ID NO: 2104727 - protein, 17 aa, Staphylococcus
LILSFALILSACANKSE

SEQ ID NO: 2104728 - protein, 17 aa, Staphylococcus
LINEKYLIKQGKVAPWG

SEQ ID NO: 2104729 - protein, 18 aa, Staphylococcus
LIQDLFMNDYLRVYTNDD

SEQ ID NO: 2104730 - protein, 18 aa, Staphylococcus
LIQDLFMNDYLRVYTNND

SEQ ID NO: 2104731 - protein, 20 aa, Staphylococcus
LIRSITYPNFNNFKDLDLSH

SEQ ID NO: 2104732 - protein, 26 aa, Staphylococcus
LISDFNGNQSHGWIPSSEINIQTTTP

SEQ ID NO: 2104733 - protein, 18 aa, Staphylococcus
LISIMFLFAACSNDSSSK

SEQ ID NO: 2104734 - protein, 18 aa, Staphylococcus
LITGVVSLWTWWKNNNFT

SEQ ID NO: 2104735 - protein, 18 aa, Staphylococcus
LIVLILILSLFKIAPVHA

SEQ ID NO: 2104736 - protein, 26 aa, Staphylococcus
LKAIKSYAVGVGPEYTDLNIKNTRHL

SEQ ID NO: 2104737 - protein, 17 aa, Staphylococcus
LKASSTYYDKVASAVDK

SEQ ID NO: 2104738 - protein, 23 aa, Staphylococcus
LKDKFKGVEKIGATGSEDVEKVI

SEQ ID NO: 2104739 - protein, 20 aa, Staphylococcus
LKDKIALFCDIDKASVIECR

SEQ ID NO: 2104740 - protein, 19 aa, Staphylococcus
LKDLGFLIHPFTVNEEADM

SEQ ID NO: 2104741 - protein, 20 aa, Staphylococcus
LKDLGFLIHPYTVDKTTDMQ

SEQ ID NO: 2104742 - protein, 17 aa, Staphylococcus
LKDLGFLVHPFTVNETA

SEQ ID NO: 2104743 - protein, 26 aa, Staphylococcus
LKDNKAFGTFMKFVLEDKGKSAEKAG

SEQ ID NO: 2104744 - protein, 21 aa, Staphylococcus
LKEDRLASIGKDNFKFYKTDL

SEQ ID NO: 2104745 - protein, 21 aa, Staphylococcus
LKENLNWIWNSFSFEDQQQFQ

SEQ ID NO: 2104746 - protein, 22 aa, Staphylococcus
LKFNAPLYSLGYPWQNGDNTKA

SEQ ID NO: 2104747 - protein, 22 aa, Staphylococcus
LKFNSPLYSLGYPWQYNDNTKA

SEQ ID NO: 2104748 - protein, 17 aa, Staphylococcus
LKGIKGFKPTPYPTYNS

SEQ ID NO: 2104749 - protein, 22 aa, Staphylococcus
LKGQLPFHKSLAVTERDAHTVG

SEQ ID NO: 2104750 - protein, 21 aa, Staphylococcus
LKGSLFGVAIHIAFHEYLLPN

SEQ ID NO: 2104751 - protein, 20 aa, Staphylococcus
LKGSQSKVLKAEQSDDIKVE

SEQ ID NO: 2104752 - protein, 19 aa, Staphylococcus
LKIKNLKASSNYYDKVAEA

SEQ ID NO: 2104753 - protein, 18 aa, Staphylococcus
LKILEVREDILGALQVTF

SEQ ID NO: 2104754 - protein, 28 aa, Staphylococcus
LKKDEKAFKGDKGVSFKIDYKDDKAVEH

SEQ ID NO: 2104755 - protein, 19 aa, Staphylococcus
LKKDRDYIRLCNQSVKTNE

SEQ ID NO: 2104756 - protein, 18 aa, Staphylococcus
LKKEGIRYGYTLEDKAVK

SEQ ID NO: 2104757 - protein, 17 aa, Staphylococcus
LKKNFGLNGTTKDIESN

SEQ ID NO: 2104758 - protein, 17 aa, Staphylococcus
LKLLESAGYIKLSKDFG

SEQ ID NO: 2104759 - protein, 18 aa, Staphylococcus
LKNAEAINMGKKDVDELG

SEQ ID NO: 2104760 - protein, 22 aa, Staphylococcus
LKNKKLDVAVGYSTDGRIAAYD

SEQ ID NO: 2104761 - protein, 20 aa, Staphylococcus
LKNNMDGMDSLNVEKLPKGS

SEQ ID NO: 2104762 - protein, 22 aa, Staphylococcus
LKNQKLDVALGYTTDGRIAAYD

SEQ ID NO: 2104763 - protein, 17 aa, Staphylococcus
LKPDLIIADSNRHKGIY

SEQ ID NO: 2104764 - protein, 19 aa, Staphylococcus
LKPDLIIADSNRHKGIYKE

SEQ ID NO: 2104765 - protein, 21 aa, Staphylococcus
LKPNTKYYYKVGSLQGGQSTV

SEQ ID NO: 2104766 - protein, 19 aa, Staphylococcus
LKQMMTFKGDPEFTIVNRL

SEQ ID NO: 2104767 - protein, 17 aa, Staphylococcus
LKQTKIHPVKKELIADL

SEQ ID NO: 2104768 - protein, 20 aa, Staphylococcus
LKQYPDYMSPILGNMGSLFV

SEQ ID NO: 2104769 - protein, 24 aa, Staphylococcus
LKRLSKFSYGIGINYKKTEKELVE

SEQ ID NO: 2104770 - protein, 17 aa, Staphylococcus
LKRNFFNIIDYGKQVKN

SEQ ID NO: 2104771 - protein, 23 aa, Staphylococcus
LKSERFTYCTKIIYQAYKYGVSK

SEQ ID NO: 2104772 - protein, 20 aa, Staphylococcus
LKSLENDGGIFGVEKNDGNV

SEQ ID NO: 2104773 - protein, 21 aa, Staphylococcus
LKSNLIFPNQVLKVSGSSKST

SEQ ID NO: 2104774 - protein, 18 aa, Staphylococcus
LKTAKAKLDDEINQTVST

SEQ ID NO: 2104775 - protein, 17 aa, Staphylococcus
LKVKIYQLYGDISKGEP

SEQ ID NO: 2104776 - protein, 19 aa, Staphylococcus
LKVVMHFEAQEAEAFDLCI

SEQ ID NO: 2104777 - protein, 17 aa, Staphylococcus
LKYYDIITTSNLATKHP

SEQ ID NO: 2104778 - protein, 25 aa, Staphylococcus
LLADFNGNVTRGWVPADQVTIAQST

SEQ ID NO: 2104779 - protein, 23 aa, Staphylococcus
LLAGCDLGDMIGLNNSSEKSEHT

SEQ ID NO: 2104780 - protein, 18 aa, Staphylococcus
LLAGSIFFASTVIINTTY

SEQ ID NO: 2104781 - protein, 17 aa, Staphylococcus
LLASGVVLAACGQGGSS

SEQ ID NO: 2104782 - protein, 18 aa, Staphylococcus
LLFGFVITLGACGNEGAN

SEQ ID NO: 2104783 - protein, 17 aa, Staphylococcus
LLFLGVGTAQAAEEDHH

SEQ ID NO: 2104784 - protein, 20 aa, Staphylococcus
LLGLFATIALAIVLSACGNG

SEQ ID NO: 2104785 - protein, 17 aa, Staphylococcus
LLGLFILTGCSFSNEDK

SEQ ID NO: 2104786 - protein, 26 aa, Staphylococcus
LLGNEAIVRQAVYDFAKSQGNKFSRA

SEQ ID NO: 2104787 - protein, 28 aa, Staphylococcus
LLGNEALIRQVVFDAGKVLGNKDSRVDF

SEQ ID NO: 2104788 - protein, 22 aa, Staphylococcus
LLHLSKSVFPTDNFLYQDGQYL

SEQ ID NO: 2104789 - protein, 18 aa, Staphylococcus
LLKAKPDLILAHESQKST

SEQ ID NO: 2104790 - protein, 17 aa, Staphylococcus
LLKELAPDWNIKLFERL

SEQ ID NO: 2104791 - protein, 23 aa, Staphylococcus
LLLCATFSLVACGNRTQSDLNQF

SEQ ID NO: 2104792 - protein, 23 aa, Staphylococcus
LLLCLCMMFSPLTTYAAKTPTQI

SEQ ID NO: 2104793 - protein, 20 aa, Staphylococcus
LLNDKFRNIYHFLTHESYQE

SEQ ID NO: 2104794 - protein, 21 aa, Staphylococcus
LLNNQAYWFISINAKENDATM

SEQ ID NO: 2104795 - protein, 18 aa, Staphylococcus
LLSDNGVIFDIKGLINKN

SEQ ID NO: 2104796 - protein, 23 aa, Staphylococcus
LLSKELKAPVNIQRTTSDYKMIE

SEQ ID NO: 2104797 - protein, 17 aa, Staphylococcus
LLSLVMLILVACGQNDQ

SEQ ID NO: 2104798 - protein, 18 aa, Staphylococcus
LLSSCGNQSSADLKDFQT

SEQ ID NO: 2104799 - protein, 17 aa, Staphylococcus
LLSSYLLAGCSNNNILE

SEQ ID NO: 2104800 - protein, 20 aa, Staphylococcus
LLVISFVCYIYAKIPTEPDT

SEQ ID NO: 2104801 - protein, 17 aa, Staphylococcus
LMLAEKGFQVYATMRNL

SEQ ID NO: 2104802 - protein, 17 aa, Staphylococcus
LMLHKSGLYKYEASTNI

SEQ ID NO: 2104803 - protein, 17 aa, Staphylococcus
LMLSLLVTLTACGNDSK

SEQ ID NO: 2104804 - protein, 24 aa, Staphylococcus
LMPLSEFSKGLVEEWDQMIDVNLK

SEQ ID NO: 2104805 - protein, 18 aa, Staphylococcus
LMQLRVAIQKEPLDPKKV

SEQ ID NO: 2104806 - protein, 19 aa, Staphylococcus
LMVEGASIDKSGHPNDVTG

SEQ ID NO: 2104807 - protein, 20 aa, Staphylococcus
LNDAMHTLRDSIANVSNIKT

SEQ ID NO: 2104808 - protein, 19 aa, Staphylococcus
LNGNLIFPGQVLTINGSST

SEQ ID NO: 2104809 - protein, 26 aa, Staphylococcus
LNGPKARLKLLVGLSNQLTLKQLNSY

SEQ ID NO: 2104810 - protein, 25 aa, Staphylococcus
LNGPKARLKLLVGLSQNMNHQKLKN

SEQ ID NO: 2104811 - protein, 26 aa, Staphylococcus
LNGPKARLKLLVSLSNELNREQIKQY

SEQ ID NO: 2104812 - protein, 25 aa, Staphylococcus
LNHFYWEIPETYKAYNEEDLLQKLQ

SEQ ID NO: 2104813 - protein, 18 aa, Staphylococcus
LNKGEPFTIALFGVDSDA

SEQ ID NO: 2104814 - protein, 18 aa, Staphylococcus
LNKMMTFHGDPEFTIVNR

SEQ ID NO: 2104815 - protein, 18 aa, Staphylococcus
LNKNFKNAVKYGNVTFNG

SEQ ID NO: 2104816 - protein, 18 aa, Staphylococcus
LNKPLPYFNQMLAFGTYM

SEQ ID NO: 2104817 - protein, 18 aa, Staphylococcus
LNKRGYRLAQGEAPIKET

SEQ ID NO: 2104818 - protein, 20 aa, Staphylococcus
LNLDSPIAFTLRNMEDTDAI

SEQ ID NO: 2104819 - protein, 23 aa, Staphylococcus
LNLGVTPLIFPGDIIIVSPYETQ

SEQ ID NO: 2104820 - protein, 22 aa, Staphylococcus
LNLKLSNNQSFEYIASDGGQLK

SEQ ID NO: 2104821 - protein, 26 aa, Staphylococcus
LNLMGVIRMTKAVLPYMRNQRDGRII

SEQ ID NO: 2104822 - protein, 19 aa, Staphylococcus
LNNHTSLNPNIVYKTYTGE

SEQ ID NO: 2104823 - protein, 20 aa, Staphylococcus
LNNKNFYLISDFNGNQSHGW

SEQ ID NO: 2104824 - protein, 27 aa, Staphylococcus
LNPNLGEVIYPGQLVAVSEKGSAHLNN

SEQ ID NO: 2104825 - protein, 17 aa, Staphylococcus
LNRVNGVFFGQTFTVYF

SEQ ID NO: 2104826 - protein, 20 aa, Staphylococcus
LNSDSPMVFTLRNMEDTDQI

SEQ ID NO: 2104827 - protein, 18 aa, Staphylococcus
LNSHLKQIAQRESGGDIH

SEQ ID NO: 2104828 - protein, 19 aa, Staphylococcus
LNSTFTKMYGLRTYGYNLM

SEQ ID NO: 2104829 - protein, 24 aa, Staphylococcus
LNYISPKAAHWKIQVDASTGEILN

SEQ ID NO: 2104830 - protein, 19 aa, Staphylococcus
LNYTHSFEINRALVEKDIR

SEQ ID NO: 2104831 - protein, 25 aa, Staphylococcus
LPAKQRGALSVAYDLYVDIPDKPGM

SEQ ID NO: 2104832 - protein, 21 aa, Staphylococcus
LPISQCAQAASYVVNNENIDK

SEQ ID NO: 2104833 - protein, 28 aa, Staphylococcus
LPIVVGLLLVLGIAWGVYAFITNTPKNT

SEQ ID NO: 2104834 - protein, 18 aa, Staphylococcus
LPKDPSIYLYFPSVEDEE

SEQ ID NO: 2104835 - protein, 24 aa, Staphylococcus
LPKLPYKYGTYKGVVIHEVGEDNR

SEQ ID NO: 2104836 - protein, 17 aa, Staphylococcus
LPKYKPAVNSSINDYIR

SEQ ID NO: 2104837 - protein, 18 aa, Staphylococcus
LPKYKPQVSSSINNYIRS

SEQ ID NO: 2104838 - protein, 25 aa, Staphylococcus
LPKYNYKSGKFIGVVIHETANPSST

SEQ ID NO: 2104839 - protein, 21 aa, Staphylococcus
LPLFILYKIRGYFLKQENRKF

SEQ ID NO: 2104840 - protein, 20 aa, Staphylococcus
LPNFETALDIAKNEANMFGN

SEQ ID NO: 2104841 - protein, 21 aa, Staphylococcus
LPSMLALSLFGATLTAQHAHA

SEQ ID NO: 2104842 - protein, 21 aa, Staphylococcus
LPSMVALTLFGTAFTAHHAHA

SEQ ID NO: 2104843 - protein, 20 aa, Staphylococcus
LPSMVAVTLLGTAFTAHHAD

SEQ ID NO: 2104844 - protein, 19 aa, Staphylococcus
LPSVRGNMIDVEFKHLTKQ

SEQ ID NO: 2104845 - protein, 27 aa, Staphylococcus
LPTTGLRFFTVYGPWGRPDMALFKFTK

SEQ ID NO: 2104846 - protein, 22 aa, Staphylococcus
LPVTASALLLGACGNSATDSKE

SEQ ID NO: 2104847 - protein, 18 aa, Staphylococcus
LQDMFSWSNGYNKRYGLF

SEQ ID NO: 2104848 - protein, 17 aa, Staphylococcus
LQQLKGLIIVGDMQHQK

SEQ ID NO: 2104849 - protein, 22 aa, Staphylococcus
LQTKADTLGSINYSDADQPKKD

SEQ ID NO: 2104850 - protein, 20 aa, Staphylococcus
LQYKKRYPITNGDADTAIAQ

SEQ ID NO: 2104851 - protein, 17 aa, Staphylococcus
LRAVAEFTLNGVATGVS

SEQ ID NO: 2104852 - protein, 21 aa, Staphylococcus
LRDANGAIIAKGKYDSNTNKT

SEQ ID NO: 2104853 - protein, 20 aa, Staphylococcus
LRLGLYPCHIKEGTLADSIY

SEQ ID NO: 2104854 - protein, 20 aa, Staphylococcus
LRLGLYPCHIKEGTLAESIY

SEQ ID NO: 2104855 - protein, 17 aa, Staphylococcus
LRLLSDNGVIFDIKGLI

SEQ ID NO: 2104856 - protein, 17 aa, Staphylococcus
LRQSFFNNQDLSFNSRS

SEQ ID NO: 2104857 - protein, 17 aa, Staphylococcus
LRSGAMASVAPIINEVK

SEQ ID NO: 2104858 - protein, 18 aa, Staphylococcus
LRSKEIKDYINIKYDGAV

SEQ ID NO: 2104859 - protein, 31 aa, Staphylococcus
LSATLMLSACGKSDERASLEKDVKKLQKEND

SEQ ID NO: 2104860 - protein, 31 aa, Staphylococcus
LSATLTLSACGKSEEKASLEKSVDKLEKENK

SEQ ID NO: 2104861 - protein, 25 aa, Staphylococcus
LSDQEIKKEVAMMLLNPQLKKQFIN

SEQ ID NO: 2104862 - protein, 22 aa, Staphylococcus
LSEKELKKSIKTYLNTNKDLAD

SEQ ID NO: 2104863 - protein, 23 aa, Staphylococcus
LSEKQKLALAFCVEDVDRYTLTK

SEQ ID NO: 2104864 - protein, 21 aa, Staphylococcus
LSERTKQLRLKQLLNSQNIER

SEQ ID NO: 2104865 - protein, 25 aa, Staphylococcus
LSETLDLPHFVSYETAYACNHKDEM

SEQ ID NO: 2104866 - protein, 22 aa, Staphylococcus
LSGNKKVLFYSYENFMTNNVPN

SEQ ID NO: 2104867 - protein, 28 aa, Staphylococcus
LSGSRLLDLNLGFSQWGFKQKPNESYIE

SEQ ID NO: 2104868 - protein, 20 aa, Staphylococcus
LSHLRNIVRSLLGIAVPTQI

SEQ ID NO: 2104869 - protein, 25 aa, Staphylococcus
LSIGFGIGVFSEWKTLASKKDNGTK

SEQ ID NO: 2104870 - protein, 19 aa, Staphylococcus
LSIKPEKAKLIYGQSGKNE

SEQ ID NO: 2104871 - protein, 17 aa, Staphylococcus
LSIVFLLLIFCISGCGS

SEQ ID NO: 2104872 - protein, 24 aa, Staphylococcus
LSKDDGKLVYNFDLQKGKEKHEVT

SEQ ID NO: 2104873 - protein, 18 aa, Staphylococcus
LSKILNIKGKVIPSTNTS

SEQ ID NO: 2104874 - protein, 23 aa, Staphylococcus
LSKKKEQKFNHIVDLQERNLKNF

SEQ ID NO: 2104875 - protein, 19 aa, Staphylococcus
LSKNDKYWDRDKVKLDKVN

SEQ ID NO: 2104876 - protein, 21 aa, Staphylococcus
LSKNQKGMVVQQDWNGKHNKF

SEQ ID NO: 2104877 - protein, 28 aa, Staphylococcus
LSLFIVCFLLGCITWFGFEKQNNKINTI

SEQ ID NO: 2104878 - protein, 24 aa, Staphylococcus
LSMCAVLILSGCGYQHRDNKEVTL

SEQ ID NO: 2104879 - protein, 19 aa, Staphylococcus
LSMDIIYKPHYVFEPERIG

SEQ ID NO: 2104880 - protein, 19 aa, Staphylococcus
LSNFDYAMVEANQGEHAGY

SEQ ID NO: 2104881 - protein, 26 aa, Staphylococcus
LSNLAVKNDLHFKKFVKNNTLPSGYN

SEQ ID NO: 2104882 - protein, 24 aa, Staphylococcus
LSNNFVFPGQVLSVGGNNTNSSQY

SEQ ID NO: 2104883 - protein, 24 aa, Staphylococcus
LSNPSDHVMGLFPRVPTDRYRGNF

SEQ ID NO: 2104884 - protein, 22 aa, Staphylococcus
LSNYSLSYLFIEYLKKQSDNGE

SEQ ID NO: 2104885 - protein, 18 aa, Staphylococcus
LSPRAKQYRLKQLLNTKS

SEQ ID NO: 2104886 - protein, 19 aa, Staphylococcus
LSRFVISLLSFVLALTVVS

SEQ ID NO: 2104887 - protein, 22 aa, Staphylococcus
LSSCLILGACGNQDSEQKDEHK

SEQ ID NO: 2104888 - protein, 17 aa, Staphylococcus
LSSFIEALADFIKQKGV

SEQ ID NO: 2104889 - protein, 17 aa, Staphylococcus
LSSFLLLGACGNNDDSV

SEQ ID NO: 2104890 - protein, 26 aa, Staphylococcus
LSSFLVLSACSHSDHSDKKDSDKNSS

SEQ ID NO: 2104891 - protein, 20 aa, Staphylococcus
LSSIAAFFAINTAANAQESE

SEQ ID NO: 2104892 - protein, 18 aa, Staphylococcus
LSSKHKWSHAVDQGVYNN

SEQ ID NO: 2104893 - protein, 25 aa, Staphylococcus
LSSTSGNTPLGWYNVKDLNIKNLDE

SEQ ID NO: 2104894 - protein, 20 aa, Staphylococcus
LSSVAACIAFSNVADAQEET

SEQ ID NO: 2104895 - protein, 20 aa, Staphylococcus
LSSVCLIGLSSMHNTTFAKD

SEQ ID NO: 2104896 - protein, 23 aa, Staphylococcus
LSSVPLEAGQTYTVKDILSQTAL

SEQ ID NO: 2104897 - protein, 26 aa, Staphylococcus
LSTHQSDFNRLWSPDQYDNSFSLTTL

SEQ ID NO: 2104898 - protein, 19 aa, Staphylococcus
LSVLARGLREFPIDITAIV

SEQ ID NO: 2104899 - protein, 25 aa, Staphylococcus
LTAFDKKRMPNLKKYTQSIGTETSG

SEQ ID NO: 2104900 - protein, 28 aa, Staphylococcus
LTANKGAYRYYAFEGIRPSDNSDLHVTS

SEQ ID NO: 2104901 - protein, 26 aa, Staphylococcus
LTDADLIFYNGFNLESGNGWFEKALE

SEQ ID NO: 2104902 - protein, 19 aa, Staphylococcus
LTDADVIFYNGLNLESGDA

SEQ ID NO: 2104903 - protein, 19 aa, Staphylococcus
LTDADVIFYNGLNLETGNG

SEQ ID NO: 2104904 - protein, 20 aa, Staphylococcus
LTDFDHKKLPDLTHYNSSNP

SEQ ID NO: 2104905 - protein, 17 aa, Staphylococcus
LTDFDKKDMPSLDKYNH

SEQ ID NO: 2104906 - protein, 27 aa, Staphylococcus
LTDSEGATHYFYFPQSALIQNYQQDDN

SEQ ID NO: 2104907 - protein, 17 aa, Staphylococcus
LTHKIQVDGHVDTTKAG

SEQ ID NO: 2104908 - protein, 26 aa, Staphylococcus
LTIDELVEFEVAYAPPYSRPKDIINM

SEQ ID NO: 2104909 - protein, 25 aa, Staphylococcus
LTIISSGFGFYLYRSSHSPDQLDQV

SEQ ID NO: 2104910 - protein, 25 aa, Staphylococcus
LTIKLRKDAKWSNGDPVTAHDFEYA

SEQ ID NO: 2104911 - protein, 17 aa, Staphylococcus
LTIVGVVLILVAIYLFA

SEQ ID NO: 2104912 - protein, 19 aa, Staphylococcus
LTKPEYKNEISFPNIMDSS

SEQ ID NO: 2104913 - protein, 22 aa, Staphylococcus
LTLMLVLAACGNDDSKKEDDNK

SEQ ID NO: 2104914 - protein, 24 aa, Staphylococcus
LTLSLALAACSNGSDDDSSKKDDS

SEQ ID NO: 2104915 - protein, 17 aa, Staphylococcus
LTMLFILTACSNQIYGK

SEQ ID NO: 2104916 - protein, 21 aa, Staphylococcus
LTMPYIFERLFNYSGKNMADY

SEQ ID NO: 2104917 - protein, 21 aa, Staphylococcus
LTPQEKVALALYAPKSADFTV

SEQ ID NO: 2104918 - protein, 24 aa, Staphylococcus
LTRFKEKWQYLNIGMTNLFGSEIN

SEQ ID NO: 2104919 - protein, 17 aa, Staphylococcus
LTSLISSLFHFDDDISK

SEQ ID NO: 2104920 - protein, 18 aa, Staphylococcus
LTTGLRQSFFNNQDLSFN

SEQ ID NO: 2104921 - protein, 19 aa, Staphylococcus
LTTKAKYPIGTHFKVTLMS

SEQ ID NO: 2104922 - protein, 17 aa, Staphylococcus
LTTLSYKRNKVVKQSTV

SEQ ID NO: 2104923 - protein, 17 aa, Staphylococcus
LVALALVGVYKLWQDDR

SEQ ID NO: 2104924 - protein, 23 aa, Staphylococcus
LVDGAREAIGLALNKLGYSLNDT

SEQ ID NO: 2104925 - protein, 23 aa, Staphylococcus
LVDGAREIIGLGLNKLGYSLNDK

SEQ ID NO: 2104926 - protein, 25 aa, Staphylococcus
LVDPFCGSGTIAIEACLIAQNIAPG

SEQ ID NO: 2104927 - protein, 25 aa, Staphylococcus
LVEDYNSGKKYGWVKQSDVVYNTAK

SEQ ID NO: 2104928 - protein, 25 aa, Staphylococcus
LVEDYNTGKKYGWVKQSDVVYNTAK

SEQ ID NO: 2104929 - protein, 27 aa, Staphylococcus
LVETSRGYGGQPIKYSNLSSNTTNSSL

SEQ ID NO: 2104930 - protein, 24 aa, Staphylococcus
LVFFIGATVCWFTFEKQNYEETKI

SEQ ID NO: 2104931 - protein, 17 aa, Staphylococcus
LVGHSMGGQTIRQLEEL

SEQ ID NO: 2104932 - protein, 26 aa, Staphylococcus
LVGMRLRRVSPRKVIGPLIKAHKAGL

SEQ ID NO: 2104933 - protein, 19 aa, Staphylococcus
LVKKEGWAEVKQEKIADYA

SEQ ID NO: 2104934 - protein, 19 aa, Staphylococcus
LVLGFIVILAGCGKINEQD

SEQ ID NO: 2104935 - protein, 23 aa, Staphylococcus
LVLICTLTVIPMNGSAHAQTNQT

SEQ ID NO: 2104936 - protein, 24 aa, Staphylococcus
LVLSGCSLPGLGDGNAKDDVKITT

SEQ ID NO: 2104937 - protein, 22 aa, Staphylococcus
LVLSGCSLPGLGDGNSKDDVKI

SEQ ID NO: 2104938 - protein, 22 aa, Staphylococcus
LVLSGCSLPGLGDGNSKNDVKI

SEQ ID NO: 2104939 - protein, 25 aa, Staphylococcus
LVNDYNTGKTFGWVKQGDVVYNTAK

SEQ ID NO: 2104940 - protein, 25 aa, Staphylococcus
LVQDYNTGKKYGWVKQSDVTYNTAK

SEQ ID NO: 2104941 - protein, 26 aa, Staphylococcus
LVSDYNSGKLYGWVKQNETIYNTITP

SEQ ID NO: 2104942 - protein, 26 aa, Staphylococcus
LVSDYNSGKVYGWVKQGETVYNTVKS

SEQ ID NO: 2104943 - protein, 19 aa, Staphylococcus
LVSEMNWAASPGIVTYRTI

SEQ ID NO: 2104944 - protein, 25 aa, Staphylococcus
LVSEMNWSAAPGYMTYRTIPSYQVR

SEQ ID NO: 2104945 - protein, 22 aa, Staphylococcus
LVSLIVLAGCGEKGKDHSQENQ

SEQ ID NO: 2104946 - protein, 25 aa, Staphylococcus
LVTKYEGWEFLGLVKDDENAARGIV

SEQ ID NO: 2104947 - protein, 20 aa, Staphylococcus
LVTSLLLAGCSTGQSNDNKG

SEQ ID NO: 2104948 - protein, 20 aa, Staphylococcus
LVVASSLVLGACSTDTHEIK

SEQ ID NO: 2104949 - protein, 19 aa, Staphylococcus
LVVDHRPEVGAVFQTPAGY

SEQ ID NO: 2104950 - protein, 18 aa, Staphylococcus
LVVLVLSVVIFAAACGNS

SEQ ID NO: 2104951 - protein, 20 aa, Staphylococcus
LVYAKDVRQVLNYVEKGNAQ

SEQ ID NO: 2104952 - protein, 24 aa, Staphylococcus
LYAKGQCTYYVFDRIRQDGNMISN

SEQ ID NO: 2104953 - protein, 24 aa, Staphylococcus
LYAYGNCTYYVFNRRSELGRSIGS

SEQ ID NO: 2104954 - protein, 17 aa, Staphylococcus
LYGSVNNKLGWIAEKDL

SEQ ID NO: 2104955 - protein, 17 aa, Staphylococcus
LYISNVMTQPGETSDYD

SEQ ID NO: 2104956 - protein, 20 aa, Staphylococcus
LYNISKRSGVSVDNIKKWNN

SEQ ID NO: 2104957 - protein, 25 aa, Staphylococcus
LYNYGNCTYYAFNRRAELGKPIGSL

SEQ ID NO: 2104958 - protein, 19 aa, Staphylococcus
LYSIIPMIEMMFGVHFIKG

SEQ ID NO: 2104959 - protein, 26 aa, Staphylococcus
LYTAGQCTWYVFDRRSQAGKPISTYW

SEQ ID NO: 2104960 - protein, 36 aa, Staphylococcus
LYTAGQCTYYVYDKVGGKIGSTWGNANNWATAAAAD

SEQ ID NO: 2104961 - protein, 26 aa, Staphylococcus
LYTSGQCTWYVFDRRSQAGKPISTYW

SEQ ID NO: 2104962 - protein, 17 aa, Staphylococcus
LYTSVISNLCVKGIADA

SEQ ID NO: 2104963 - protein, 17 aa, Staphylococcus
LYTSVISNLCVKGISQA

SEQ ID NO: 2104964 - protein, 19 aa, Staphylococcus
LYTVPWGNYNQIAGTVSKS

SEQ ID NO: 2104965 - protein, 20 aa, Staphylococcus
LYTVPWGTPSQVASKVSGSG

SEQ ID NO: 2104966 - protein, 18 aa, Staphylococcus
LYTWGQCTYHVFNRRAQI

SEQ ID NO: 2104967 - protein, 17 aa, Staphylococcus
LYVANVMTQPGETNGYD

SEQ ID NO: 2104968 - protein, 17 aa, Staphylococcus
LYVSNVMTQPGETDNYD

SEQ ID NO: 2104969 - protein, 17 aa, Staphylococcus
LYVSNVMTQPGETNNYS

SEQ ID NO: 2104970 - protein, 28 aa, Staphylococcus
MAERTGVSASQWKGVIQRESGGNANAVN

SEQ ID NO: 2104971 - protein, 25 aa, Staphylococcus
MAFLLACCLGFLLFIATNQQALAKV

SEQ ID NO: 2104972 - protein, 21 aa, Staphylococcus
MALLFRHFFATSLHNQFMYNS

SEQ ID NO: 2104973 - protein, 19 aa, Staphylococcus
MALLFRHFYATSIHNQYMR

SEQ ID NO: 2104974 - protein, 18 aa, Staphylococcus
MALLFRHFYATSLHNQFM

SEQ ID NO: 2104975 - protein, 19 aa, Staphylococcus
MALLFRHFYATSLHNQFMY

SEQ ID NO: 2104976 - protein, 30 aa, Staphylococcus
MAQRTGVPASTWSAIIARESNGQANARNAS

SEQ ID NO: 2104977 - protein, 17 aa, Staphylococcus
MAVLLFLAACGGGHSQS

SEQ ID NO: 2104978 - protein, 18 aa, Staphylococcus
MDDLKRVRLDIDNEKEKQ

SEQ ID NO: 2104979 - protein, 26 aa, Staphylococcus
MDFIPNKLNKYSIRKFTVGTASILVG

SEQ ID NO: 2104980 - protein, 18 aa, Staphylococcus
MDGTYLVHMGINRHPGQE

SEQ ID NO: 2104981 - protein, 17 aa, Staphylococcus
MDLIKILFQKAQSLDSI

SEQ ID NO: 2104982 - protein, 17 aa, Staphylococcus
MEEPLEILNVINRYFDQ

SEQ ID NO: 2104983 - protein, 18 aa, Staphylococcus
MESRGMVLYINRNTRTTK

SEQ ID NO: 2104984 - protein, 18 aa, Staphylococcus
MFNKEMDGTYLVHMGINR

SEQ ID NO: 2104985 - protein, 18 aa, Staphylococcus
MGELINIKALVYTRNGTP

SEQ ID NO: 2104986 - protein, 17 aa, Staphylococcus
MGGQTIRQLEALLRNGN

SEQ ID NO: 2104987 - protein, 19 aa, Staphylococcus
MGGQTIRQLEELLRNGNPE

SEQ ID NO: 2104988 - protein, 19 aa, Staphylococcus
MGPSFNTAYRYYKNQPGAK

SEQ ID NO: 2104989 - protein, 19 aa, Staphylococcus
MGTDFIDYVICCGNEDYSE

SEQ ID NO: 2104990 - protein, 17 aa, Staphylococcus
MGVMFNRTNEGLLDFRR

SEQ ID NO: 2104991 - protein, 29 aa, Staphylococcus
MHPDLVKILGRLKFRTSYGQNVLKHSIEV

SEQ ID NO: 2104992 - protein, 17 aa, Staphylococcus
MIFLLIVALTACSNKTD

SEQ ID NO: 2104993 - protein, 17 aa, Staphylococcus
MILLTFALIAVPAIFAY

SEQ ID NO: 2104994 - protein, 24 aa, Staphylococcus
MISYAKERYGSIEVAISFRESNGW

SEQ ID NO: 2104995 - protein, 21 aa, Staphylococcus
MITSEGAFKYFAKQYDVKPGY

SEQ ID NO: 2104996 - protein, 17 aa, Staphylococcus
MIVDQVVNTVSHLYLTQ

SEQ ID NO: 2104997 - protein, 17 aa, Staphylococcus
MIVNQAVSAVDYLYEIR

SEQ ID NO: 2104998 - protein, 20 aa, Staphylococcus
MKELRRFVPSAKDEDWELHI

SEQ ID NO: 2104999 - protein, 20 aa, Staphylococcus
MKHPFHIHGTQFKVLSVDGE

SEQ ID NO: 2105000 - protein, 21 aa, Staphylococcus
MKVGEPRPKYQDVKLRKAMDY

SEQ ID NO: 2105001 - protein, 22 aa, Staphylococcus
MLIAGIFLLAACDKEQSKTYEG

SEQ ID NO: 2105002 - protein, 18 aa, Staphylococcus
MLLHNVIFSQQFRQNIDE

SEQ ID NO: 2105003 - protein, 18 aa, Staphylococcus
MLMVLTIIMSACSNNNNE

SEQ ID NO: 2105004 - protein, 24 aa, Staphylococcus
MLNFVEKGGNIIFISDHYNADRNL

SEQ ID NO: 2105005 - protein, 21 aa, Staphylococcus
MLNQYKIPYRFNEEIDDIDGS

SEQ ID NO: 2105006 - protein, 19 aa, Staphylococcus
MMAPRRRYSSGAPYTSQYM

SEQ ID NO: 2105007 - protein, 22 aa, Staphylococcus
MMQSGTKWFYVVYDSDDSISKD

SEQ ID NO: 2105008 - protein, 19 aa, Staphylococcus
MMYHMIKEHPEILKTTQNK

SEQ ID NO: 2105009 - protein, 19 aa, Staphylococcus
MNAFQHFAFLDQYKKAHKD

SEQ ID NO: 2105010 - protein, 19 aa, Staphylococcus
MNAFQHFAFLNEYKKAHKD

SEQ ID NO: 2105011 - protein, 17 aa, Staphylococcus
MNGYRRGAFDDMSKGMT

SEQ ID NO: 2105012 - protein, 18 aa, Staphylococcus
MNGYRRGAYQDMTKDMNS

SEQ ID NO: 2105013 - protein, 27 aa, Staphylococcus
MNLNGLNSFLIFPGQKLKVTGSTATVT

SEQ ID NO: 2105014 - protein, 19 aa, Staphylococcus
MNRDGSRMPYVFQATEVIK

SEQ ID NO: 2105015 - protein, 21 aa, Staphylococcus
MNYGHGAGVVTSRTISASQAA

SEQ ID NO: 2105016 - protein, 20 aa, Staphylococcus
MNYNGGPGVVSSRTISAGQA

SEQ ID NO: 2105017 - protein, 18 aa, Staphylococcus
MNYQGVGVVSTRTISASQ

SEQ ID NO: 2105018 - protein, 19 aa, Staphylococcus
MPKRFFSGQTKFLYKTKDK

SEQ ID NO: 2105019 - protein, 24 aa, Staphylococcus
MPSNTEILYELGLENRIVGVSTVD

SEQ ID NO: 2105020 - protein, 24 aa, Staphylococcus
MPSNTEILYELGLGKDVVGVSTVD

SEQ ID NO: 2105021 - protein, 25 aa, Staphylococcus
MPSNTEILYELGLKKQLIGVSTVDD

SEQ ID NO: 2105022 - protein, 25 aa, Staphylococcus
MPSNTEILYRLGLGNNIVGVSTVDD

SEQ ID NO: 2105023 - protein, 21 aa, Staphylococcus
MQFGTELTKILNICKEHELYV

SEQ ID NO: 2105024 - protein, 19 aa, Staphylococcus
MREFLKFTLDDKGKSAEDA

SEQ ID NO: 2105025 - protein, 19 aa, Staphylococcus
MRGTFLVTKFLLPLMLDNG

SEQ ID NO: 2105026 - protein, 20 aa, Staphylococcus
MRGTFLVTKFLLPLMMDHGG

SEQ ID NO: 2105027 - protein, 20 aa, Staphylococcus
MRGTFLVTKFLLPLMMDNGG

SEQ ID NO: 2105028 - protein, 21 aa, Staphylococcus
MRKVESQAGYNFLTGNGSNPI

SEQ ID NO: 2105029 - protein, 17 aa, Staphylococcus
MSESARGEGGRIWTYKD

SEQ ID NO: 2105030 - protein, 24 aa, Staphylococcus
MSEWKEYDYIFLTTGTFAYHDPYN

SEQ ID NO: 2105031 - protein, 24 aa, Staphylococcus
MSKQWKTKISNAFLDISKSEKGKK

SEQ ID NO: 2105032 - protein, 25 aa, Staphylococcus
MSLNGLSNFFIYPGQKLKVSGTAST

SEQ ID NO: 2105033 - protein, 29 aa, Staphylococcus
MSLPTKILLWIVGVLFLLAVIAVIYICAK

SEQ ID NO: 2105034 - protein, 17 aa, Staphylococcus
MTIGLAMNSVYYYQKEK

SEQ ID NO: 2105035 - protein, 19 aa, Staphylococcus
MTIIGVILILVAIYLFAKP

SEQ ID NO: 2105036 - protein, 19 aa, Staphylococcus
MTILGVILILVAVYLFAKP

SEQ ID NO: 2105037 - protein, 24 aa, Staphylococcus
MTLLSVRCQFTFKQAEKIESGTEF

SEQ ID NO: 2105038 - protein, 19 aa, Staphylococcus
MTMIGVILILVAVYLFAKP

SEQ ID NO: 2105039 - protein, 26 aa, Staphylococcus
MTQLERETKEGIDWKKETRDQGSQVL

SEQ ID NO: 2105040 - protein, 30 aa, Staphylococcus
MTVDAGFYKSVYNIGDFVWNDTNKNGIQDD

SEQ ID NO: 2105041 - protein, 22 aa, Staphylococcus
MVEGRSATISIHGAKGDDPIVF

SEQ ID NO: 2105042 - protein, 18 aa, Staphylococcus
MVSLRNAIQNEPQVESSS

SEQ ID NO: 2105043 - protein, 23 aa, Staphylococcus
MVTSEGAFKYFSKAFDIKPGYIW

SEQ ID NO: 2105044 - protein, 18 aa, Staphylococcus
MWKDITLNNKTFILDILQ

SEQ ID NO: 2105045 - protein, 18 aa, Staphylococcus
MYHYGKPTGKYKNDPAGT

SEQ ID NO: 2105046 - protein, 21 aa, Staphylococcus
MYIHCTLLPFIKAAGEMKTKP

SEQ ID NO: 2105047 - protein, 21 aa, Staphylococcus
MYVHCTLLPFIKAAGEMKTKP

SEQ ID NO: 2105048 - protein, 18 aa, Staphylococcus
NAAKALGYKIKLIGKGTY

SEQ ID NO: 2105049 - protein, 25 aa, Staphylococcus
NADDIKVAVDLSKARAGNYKEDYVV

SEQ ID NO: 2105050 - protein, 23 aa, Staphylococcus
NADSFHASGIFPSTDKSYYNQYK

SEQ ID NO: 2105051 - protein, 19 aa, Staphylococcus
NAEKSKTAFTFTKKEDDAT

SEQ ID NO: 2105052 - protein, 18 aa, Staphylococcus
NAGLKVKLLDIVIDENDP

SEQ ID NO: 2105053 - protein, 24 aa, Staphylococcus
NAHVKSSFDIKAFETRKDKITLKE

SEQ ID NO: 2105054 - protein, 18 aa, Staphylococcus
NAKELLATTVQRLAAEHT

SEQ ID NO: 2105055 - protein, 24 aa, Staphylococcus
NANGLPTDGFHFVWTQNTTASHSE

SEQ ID NO: 2105056 - protein, 17 aa, Staphylococcus
NANYSVKISNFIAKDLD

SEQ ID NO: 2105057 - protein, 17 aa, Staphylococcus
NAPKLYVSNVMTQPGET

SEQ ID NO: 2105058 - protein, 32 aa, Staphylococcus
NAPQGMKFFKVEPPKGNFASIVGINDEKLFIG

SEQ ID NO: 2105059 - protein, 26 aa, Staphylococcus
NASSGAYGLFQLLGHGEHAGMSVQDQ

SEQ ID NO: 2105060 - protein, 19 aa, Staphylococcus
NATRMKTMYDSIGESGKYF

SEQ ID NO: 2105061 - protein, 23 aa, Staphylococcus
NAVSAYDGYWLAAYQEQEPNREK

SEQ ID NO: 2105062 - protein, 21 aa, Staphylococcus
NAYKKLKAQAQTILDEEANNK

SEQ ID NO: 2105063 - protein, 17 aa, Staphylococcus
NDAFKYSDVKNYKDAIK

SEQ ID NO: 2105064 - protein, 20 aa, Staphylococcus
NDFILEPSFIEAVKNNNFVI

SEQ ID NO: 2105065 - protein, 23 aa, Staphylococcus
NDFYIACQFHPEFLSRPNRPQPI

SEQ ID NO: 2105066 - protein, 30 aa, Staphylococcus
NDHAKLCYIYKFRARFAVLAHEIAQREGLP

SEQ ID NO: 2105067 - protein, 20 aa, Staphylococcus
NDKIEEIQAFFANAKTYRDA

SEQ ID NO: 2105068 - protein, 25 aa, Staphylococcus
NDLRAGIYADGGRQLATFGTQSSPG

SEQ ID NO: 2105069 - protein, 21 aa, Staphylococcus
NDRFIHVELVHTHDYDSFARS

SEQ ID NO: 2105070 - protein, 24 aa, Staphylococcus
NDSLLKEMDHWPTYYPASLDKDDI

SEQ ID NO: 2105071 - protein, 17 aa, Staphylococcus
NDVSLWIEELKPDPMGF

SEQ ID NO: 2105072 - protein, 22 aa, Staphylococcus
NEEISKVVGNAVHFESGKVENY

SEQ ID NO: 2105073 - protein, 24 aa, Staphylococcus
NEIKKLDAGSWFDGKYSNEKVPLL

SEQ ID NO: 2105074 - protein, 25 aa, Staphylococcus
NEINPSHVAVCWDMGQSTFRNDMYT

SEQ ID NO: 2105075 - protein, 28 aa, Staphylococcus
NEIQPSHVAVCWDMGKSTFRNDMFDGYK

SEQ ID NO: 2105076 - protein, 23 aa, Staphylococcus
NEKKLKDNKGFQDFMKFVLEDKG

SEQ ID NO: 2105077 - protein, 19 aa, Staphylococcus
NELIPQFDYVKEIATQFGF

SEQ ID NO: 2105078 - protein, 17 aa, Staphylococcus
NELTQVRPLRIMSPHAV

SEQ ID NO: 2105079 - protein, 17 aa, Staphylococcus
NELTQVRPLRIMSPHSV

SEQ ID NO: 2105080 - protein, 22 aa, Staphylococcus
NELYDLINEKYLIKTGQVAPWG

SEQ ID NO: 2105081 - protein, 18 aa, Staphylococcus
NEMKKWLIQHCVKEKDII

SEQ ID NO: 2105082 - protein, 23 aa, Staphylococcus
NENVEVWLIKKGFNIYNRYTLHR

SEQ ID NO: 2105083 - protein, 26 aa, Staphylococcus
NEQVEVWLIRKGFNIYHHYTLNRFNE

SEQ ID NO: 2105084 - protein, 27 aa, Staphylococcus
NETYLHGVINNIWGWIKSTDVKQTPKV

SEQ ID NO: 2105085 - protein, 18 aa, Staphylococcus
NEVYNYYLDKHHRDSYDN

SEQ ID NO: 2105086 - protein, 26 aa, Staphylococcus
NFLDPSHFENGFSLTSLISSLFHFDD

SEQ ID NO: 2105087 - protein, 19 aa, Staphylococcus
NFTKSIAIEYGRDNIRANA

SEQ ID NO: 2105088 - protein, 17 aa, Staphylococcus
NFTSNGTNWSWNYAQVG

SEQ ID NO: 2105089 - protein, 18 aa, Staphylococcus
NGDENLRKAKQNATTAVG

SEQ ID NO: 2105090 - protein, 37 aa, Staphylococcus
NGDGAHAQDARWLTKHPKLQEYGQYHGGGAHYGVDYG

SEQ ID NO: 2105091 - protein, 21 aa, Staphylococcus
NGENIRAILDLSGEKAGKHTA

SEQ ID NO: 2105092 - protein, 38 aa, Staphylococcus
NGIDGNSDIYRPTWKSEASSYRDATAHLAKTYATDTQY

SEQ ID NO: 2105093 - protein, 19 aa, Staphylococcus
NGITVSLLCYTYGTNGQIS

SEQ ID NO: 2105094 - protein, 25 aa, Staphylococcus
NGKDKYYNMFGIGAVDSDAVKQGFA

SEQ ID NO: 2105095 - protein, 32 aa, Staphylococcus
NGKRIFKPSTIIKRNGVRYGLVGVTTPETKIK

SEQ ID NO: 2105096 - protein, 24 aa, Staphylococcus
NGKTFKVDEGIYWLNDPYSLDYER

SEQ ID NO: 2105097 - protein, 17 aa, Staphylococcus
NGLDFGVYSYSMYENPD

SEQ ID NO: 2105098 - protein, 24 aa, Staphylococcus
NGLPTDGFTYRWNQATTGTNTESW

SEQ ID NO: 2105099 - protein, 24 aa, Staphylococcus
NGNHTFQISANFRSYPSKKESLED

SEQ ID NO: 2105100 - protein, 17 aa, Staphylococcus
NGNQEEIDYQKAHGGTI

SEQ ID NO: 2105101 - protein, 17 aa, Staphylococcus
NGNQEEIEYQKKHGGTI

SEQ ID NO: 2105102 - protein, 19 aa, Staphylococcus
NGNTWSWNYTYTGGADTAQ

SEQ ID NO: 2105103 - protein, 25 aa, Staphylococcus
NGPGLGDSNYWGGERLNITQEARAK

SEQ ID NO: 2105104 - protein, 21 aa, Staphylococcus
NGPYGHVAFVERVNADGSVFI

SEQ ID NO: 2105105 - protein, 19 aa, Staphylococcus
NGQNFTWKYIYTGEADSQP

SEQ ID NO: 2105106 - protein, 37 aa, Staphylococcus
NGQSNPYNDYAIEGSEGNYSYIFSFQNQAQPGTYTIA

SEQ ID NO: 2105107 - protein, 25 aa, Staphylococcus
NGTVWTHYAVSHWLGGTDHTDPHAY

SEQ ID NO: 2105108 - protein, 23 aa, Staphylococcus
NGWCAGYTMAFLLNATYNTGHYN

SEQ ID NO: 2105109 - protein, 22 aa, Staphylococcus
NGYNKRYGLFYIDFETQKRYIK

SEQ ID NO: 2105110 - protein, 19 aa, Staphylococcus
NGYSARTAPIVYPVNTPGY

SEQ ID NO: 2105111 - protein, 17 aa, Staphylococcus
NHAQEFVTPLAFQAISR

SEQ ID NO: 2105112 - protein, 17 aa, Staphylococcus
NHAQEFVTPLAFQSISK

SEQ ID NO: 2105113 - protein, 23 aa, Staphylococcus
NHEHPVKYDLSFQTIEDGDSRNS

SEQ ID NO: 2105114 - protein, 17 aa, Staphylococcus
NHIETAPTVFVHGQKVE

SEQ ID NO: 2105115 - protein, 22 aa, Staphylococcus
NIEAFKTIAKAVGKEDKGKERL

SEQ ID NO: 2105116 - protein, 17 aa, Staphylococcus
NIEGAQKIYELFKPTLE

SEQ ID NO: 2105117 - protein, 25 aa, Staphylococcus
NIEPKKAAHFHIFMGNNKDKILKEL

SEQ ID NO: 2105118 - protein, 24 aa, Staphylococcus
NIIFKGFLGTNIVKFFDYTLASVG

SEQ ID NO: 2105119 - protein, 19 aa, Staphylococcus
NIMKLNGLNNFLIVPGQKL

SEQ ID NO: 2105120 - protein, 25 aa, Staphylococcus
NIPYFGICLGMQLATVEFARNVVGL

SEQ ID NO: 2105121 - protein, 18 aa, Staphylococcus
NISIRKSELVFKNAPQGM

SEQ ID NO: 2105122 - protein, 17 aa, Staphylococcus
NIVGFVNILECCRHHEV

SEQ ID NO: 2105123 - protein, 35 aa, Staphylococcus
NKARDFNVVTGDHFKGPITGYVNYGFQNYKINVDL

SEQ ID NO: 2105124 - protein, 18 aa, Staphylococcus
NKDIKVLNIFGDLKDGTH

SEQ ID NO: 2105125 - protein, 18 aa, Staphylococcus
NKDVVSIKKGKKVELAKQ

SEQ ID NO: 2105126 - protein, 17 aa, Staphylococcus
NKGAMILAHSVENNPND

SEQ ID NO: 2105127 - protein, 17 aa, Staphylococcus
NKGFTHYTLQPKVGNVF

SEQ ID NO: 2105128 - protein, 22 aa, Staphylococcus
NKHQCTWWAFKRRAQVGKPVSN

SEQ ID NO: 2105129 - protein, 18 aa, Staphylococcus
NKINEAFSTYKSSVDNDS

SEQ ID NO: 2105130 - protein, 23 aa, Staphylococcus
NKKLHAWLKLSTLIDDVKVKDTY

SEQ ID NO: 2105131 - protein, 26 aa, Staphylococcus
NKLIYTVKLPENFEYIDDSTVATFVN

SEQ ID NO: 2105132 - protein, 25 aa, Staphylococcus
NKLRNGVKMIVDQAVNSVNYLYENQ

SEQ ID NO: 2105133 - protein, 23 aa, Staphylococcus
NKLRNGVKMIVDQVVNTVSHLYL

SEQ ID NO: 2105134 - protein, 22 aa, Staphylococcus
NKLRNGVKMIVNQVANAVDRLY

SEQ ID NO: 2105135 - protein, 23 aa, Staphylococcus
NKLRNGVKMIVSQVVNAVDYLYE

SEQ ID NO: 2105136 - protein, 17 aa, Staphylococcus
NKMNVQWFDRETMSLQM

SEQ ID NO: 2105137 - protein, 22 aa, Staphylococcus
NKNVREAFDVVINRKEIAKNVS

SEQ ID NO: 2105138 - protein, 17 aa, Staphylococcus
NKPEVVVNLAAQAGVRY

SEQ ID NO: 2105139 - protein, 18 aa, Staphylococcus
NKSADALVGKLKDNNKKL

SEQ ID NO: 2105140 - protein, 25 aa, Staphylococcus
NKSAKKYHNVFGIGAYDDNPLIEGI

SEQ ID NO: 2105141 - protein, 23 aa, Staphylococcus
NKVKYHRIVSLMPSNTEILYRLG

SEQ ID NO: 2105142 - protein, 19 aa, Staphylococcus
NKYKVHDEYASAYKNVLEK

SEQ ID NO: 2105143 - protein, 26 aa, Staphylococcus
NLAIMGRYVLTPDIFDYLATQGEGAG

SEQ ID NO: 2105144 - protein, 24 aa, Staphylococcus
NLCVKGIADALLKVDAPKLYVSNV

SEQ ID NO: 2105145 - protein, 25 aa, Staphylococcus
NLCVKGMSEAILRSKAPKLYISNVM

SEQ ID NO: 2105146 - protein, 24 aa, Staphylococcus
NLETGNGWFKKALEQAGKSMDDKK

SEQ ID NO: 2105147 - protein, 18 aa, Staphylococcus
NLFHEITKLKSLDYELKV

SEQ ID NO: 2105148 - protein, 21 aa, Staphylococcus
NLKDVSRYFALAHYSKNYKKV

SEQ ID NO: 2105149 - protein, 21 aa, Staphylococcus
NLKPDHAFSLSEDESADETMQ

SEQ ID NO: 2105150 - protein, 25 aa, Staphylococcus
NLKSERFTYCTKIIYQAYKYGVSKN

SEQ ID NO: 2105151 - protein, 25 aa, Staphylococcus
NLMGVIRMTKAVLPIMRSQREGRVI

SEQ ID NO: 2105152 - protein, 19 aa, Staphylococcus
NLPPSCLKGVQTCLDNNIP

SEQ ID NO: 2105153 - protein, 38 aa, Staphylococcus
NLPPTCLEGLYACIDKQIPIVIVSRSFNGIVSPVYAYE

SEQ ID NO: 2105154 - protein, 26 aa, Staphylococcus
NLSEKEKLALVFLANESGEYAITKND

SEQ ID NO: 2105155 - protein, 30 aa, Staphylococcus
NLYTAGQCTWYVYDKVGGNIGSTWGNANNW

SEQ ID NO: 2105156 - protein, 29 aa, Staphylococcus
NLYTWGQCTWHVFNRRSEIGKGISTYWWN

SEQ ID NO: 2105157 - protein, 30 aa, Staphylococcus
NMHPELVKILGRLNYRTSYGQNVLKHSIEV

SEQ ID NO: 2105158 - protein, 17 aa, Staphylococcus
NMKFGVYSYSLYENADD

SEQ ID NO: 2105159 - protein, 25 aa, Staphylococcus
NMKKEVLDWADKRAKQKGLAVSNRY

SEQ ID NO: 2105160 - protein, 25 aa, Staphylococcus
NNKEFLKKRYEAMKQSPMFDNIEYT

SEQ ID NO: 2105161 - protein, 22 aa, Staphylococcus
NNKEGIGYFGYNFYEQNKDKLK

SEQ ID NO: 2105162 - protein, 17 aa, Staphylococcus
NNKKLDVALGYSTDGRI

SEQ ID NO: 2105163 - protein, 24 aa, Staphylococcus
NNKTFRIAFSYLLIENTKTHDLYL

SEQ ID NO: 2105164 - protein, 17 aa, Staphylococcus
NNKTYYLLADFNGNVTR

SEQ ID NO: 2105165 - protein, 22 aa, Staphylococcus
NNLLKGCGVLENQGQAFSQAAK

SEQ ID NO: 2105166 - protein, 21 aa, Staphylococcus
NNLVKSFKSIRDGYSEKDKKK

SEQ ID NO: 2105167 - protein, 23 aa, Staphylococcus
NNMIFPGQVISIGGSSNNSNNAS

SEQ ID NO: 2105168 - protein, 21 aa, Staphylococcus
NNMVFPGQVINVGGSASQSSN

SEQ ID NO: 2105169 - protein, 18 aa, Staphylococcus
NNNMVFPGQVIEIGGSSS

SEQ ID NO: 2105170 - protein, 30 aa, Staphylococcus
NNPAEEGRFLKFFVDDGLIKLKKGVKIQDA

SEQ ID NO: 2105171 - protein, 25 aa, Staphylococcus
NNPAEQGRFLKFFVDADLIKIKKGV

SEQ ID NO: 2105172 - protein, 30 aa, Staphylococcus; identical to SEQ ID NO: 1841069

SEQ ID NO: 2105173 - protein, 32 aa, Staphylococcus
NNPYMNMPDQEWRKNTGDGLSSGEKQTMYAIE

SEQ ID NO: 2105174 - protein, 26 aa, Staphylococcus
NNQKFLKKRYEAMKDFPMFDNIEYTE

SEQ ID NO: 2105175 - protein, 22 aa, Staphylococcus
NNRQSKKILINIGQMSNDFSPI

SEQ ID NO: 2105176 - protein, 30 aa, Staphylococcus
NNRTYRLTKKALLGDKSFYLITDYNKNTNV

SEQ ID NO: 2105177 - protein, 35 aa, Staphylococcus
NNTTFPKGWHEWVMAAKAKPVYGAKDFLNYANKKG

SEQ ID NO: 2105178 - protein, 24 aa, Staphylococcus
NNTYRTPLSPIFDATHSSGLPASN

SEQ ID NO: 2105179 - protein, 26 aa, Staphylococcus
NNVKFLKDRYEAMKNFPMFDNIEYTE

SEQ ID NO: 2105180 - protein, 27 aa, Staphylococcus
NNVKFLKDRYEKMKAFPMFDNIEYTED

SEQ ID NO: 2105181 - protein, 26 aa, Staphylococcus
NNVQFLKDRYHAMKDFPMFDNIEYTE

SEQ ID NO: 2105182 - protein, 17 aa, Staphylococcus
NNYADYAATQLVYYGLK

SEQ ID NO: 2105183 - protein, 24 aa, Staphylococcus
NPAEEGRFLKFFQDAGLIKIKKGV

SEQ ID NO: 2105184 - protein, 23 aa, Staphylococcus
NPAEEGRFLSFFVDEGLIKLKKG

SEQ ID NO: 2105185 - protein, 24 aa, Staphylococcus
NPAEEGRFLSFFVDKGLIKIKKGV

SEQ ID NO: 2105186 - protein, 23 aa, Staphylococcus
NPAEEGRFLSFFVNEGLIKLKKG

SEQ ID NO: 2105187 - protein, 24 aa, Staphylococcus
NPAEEGRFLSFFVNEGLIKLKKGV

SEQ ID NO: 2105188 - protein, 23 aa, Staphylococcus
NPAEEGRFLSFFVNEGLVKIKKG

SEQ ID NO: 2105189 - protein, 25 aa, Staphylococcus
NPDIILRLPHGMPDEVKKMFQKEFK

SEQ ID NO: 2105190 - protein, 18 aa, Staphylococcus
NPEAIHKMKHSGSYMTKQ

SEQ ID NO: 2105191 - protein, 19 aa, Staphylococcus
NPEDLKVTIDLSDKKAGEY

SEQ ID NO: 2105192 - protein, 19 aa, Staphylococcus
NPEEVKYQKEHGGEISPLY

SEQ ID NO: 2105193 - protein, 24 aa, Staphylococcus
NPGLKKRLLASTFYIKMNQDNVPE

SEQ ID NO: 2105194 - protein, 23 aa, Staphylococcus
NPGVKPLIHPGDLIAVSDKGSAT

SEQ ID NO: 2105195 - protein, 19 aa, Staphylococcus
NPGVTALIHPGDLIAVSEK

SEQ ID NO: 2105196 - protein, 24 aa, Staphylococcus
NPKPKEGIGTWIGKDISYLTKKFG

SEQ ID NO: 2105197 - protein, 18 aa, Staphylococcus
NPLNSYEIHEMFSEEKLK

SEQ ID NO: 2105198 - protein, 19 aa, Staphylococcus
NPMPPRTAKLIKQLIKDGS

SEQ ID NO: 2105199 - protein, 21 aa, Staphylococcus
NPNIPLIRLLDKGELPFQSEA

SEQ ID NO: 2105200 - protein, 21 aa, Staphylococcus
NPNSELIFGFNTMPANNGKGG

SEQ ID NO: 2105201 - protein, 22 aa, Staphylococcus
NPNVPLIKLMNKFELTNASEQD

SEQ ID NO: 2105202 - protein, 22 aa, Staphylococcus
NPQKEMGFNWYTTDKAEQPQVW

SEQ ID NO: 2105203 - protein, 18 aa, Staphylococcus
NPQYLKEAKLCDSIKATT

SEQ ID NO: 2105204 - protein, 23 aa, Staphylococcus
NPSQGQISRFLVKHQDKISAKRP

SEQ ID NO: 2105205 - protein, 23 aa, Staphylococcus
NQAGKYKIEYKVEDSNGASSKSI

SEQ ID NO: 2105206 - protein, 18 aa, Staphylococcus
NQAIKANEDILEYTKLFE

SEQ ID NO: 2105207 - protein, 19 aa, Staphylococcus
NQAPKRWPSNIPGSENVRD

SEQ ID NO: 2105208 - protein, 19 aa, Staphylococcus
NQAPKRWPSNVPGGDNVRD

SEQ ID NO: 2105209 - protein, 24 aa, Staphylococcus
NQAQKARLTDNINHANHIADVEQL

SEQ ID NO: 2105210 - protein, 18 aa, Staphylococcus
NQATSHIWENGKVDIAPN

SEQ ID NO: 2105211 - protein, 19 aa, Staphylococcus
NQESLKQTKIHPVKKELIA

SEQ ID NO: 2105212 - protein, 17 aa, Staphylococcus
NQFDFYKSKALRNHQSI

SEQ ID NO: 2105213 - protein, 21 aa, Staphylococcus
NQKKHQIRMLSIPRDTISYIP

SEQ ID NO: 2105214 - protein, 20 aa, Staphylococcus
NQLKKAYGKDLIKKSHNKNK

SEQ ID NO: 2105215 - protein, 21 aa, Staphylococcus
NQNTPIGWYNIKDVNIKNYGT

SEQ ID NO: 2105216 - protein, 32 aa, Staphylococcus
NQSEALKQLPNFQTALDIAKQEANLYGNHNKT

SEQ ID NO: 2105217 - protein, 23 aa, Staphylococcus
NQSMDLLLSKRVDATFNDSLSYL

SEQ ID NO: 2105218 - protein, 18 aa, Staphylococcus
NQSYSVKPGTKFYTVPWG

SEQ ID NO: 2105219 - protein, 18 aa, Staphylococcus
NQYSIPYFFGTVGILYNK

SEQ ID NO: 2105220 - protein, 18 aa, Staphylococcus
NRAFICGDAGHIHSPAGG

SEQ ID NO: 2105221 - protein, 21 aa, Staphylococcus
NRAGDGYPAFQKDYGFKFKSA

SEQ ID NO: 2105222 - protein, 22 aa, Staphylococcus
NRAGDGYPAFVKDYGFKFASAR

SEQ ID NO: 2105223 - protein, 22 aa, Staphylococcus
NRAGDGYPAFVKDYGFKFDSAR

SEQ ID NO: 2105224 - protein, 22 aa, Staphylococcus
NRKVVNGKTWYYGKLSNGKYVW

SEQ ID NO: 2105225 - protein, 20 aa, Staphylococcus
NRLSTVYNEVFQIHLQTEKG

SEQ ID NO: 2105226 - protein, 17 aa, Staphylococcus
NRSSGKMGYAIAEALAK

SEQ ID NO: 2105227 - protein, 17 aa, Staphylococcus
NRSSGKMGYALAEALRN

SEQ ID NO: 2105228 - protein, 17 aa, Staphylococcus
NRSSGKMGYALAQALKQ

SEQ ID NO: 2105229 - protein, 18 aa, Staphylococcus
NRVIFDFYDVDPYQQAAL

SEQ ID NO: 2105230 - protein, 24 aa, Staphylococcus
NSANYSVRISKFIADSLNQYRQAN

SEQ ID NO: 2105231 - protein, 21 aa, Staphylococcus
NSDFSSASLLVNEFSKNQKDD

SEQ ID NO: 2105232 - protein, 21 aa, Staphylococcus
NSDGDWGFSFTDKDGELAGSY

SEQ ID NO: 2105233 - protein, 17 aa, Staphylococcus
NSEIIDGLAELQDVDAS

SEQ ID NO: 2105234 - protein, 38 aa, Staphylococcus
NSGSPVFNSRNEVIGIHWGGAANSYNGAVFINKDVQNF

SEQ ID NO: 2105235 - protein, 19 aa, Staphylococcus
NSISKAIIDGAKFIAQDYI

SEQ ID NO: 2105236 - protein, 23 aa, Staphylococcus
NSKLLENITTWFGKQDNTPNLKE

SEQ ID NO: 2105237 - protein, 25 aa, Staphylococcus
NSKNEVIGVHAFRLNSGDYKKYNLN

SEQ ID NO: 2105238 - protein, 26 aa, Staphylococcus
NSKNEVLGVHAFRIASGDYQKYNLNT

SEQ ID NO: 2105239 - protein, 17 aa, Staphylococcus
NSKSDQVLGLFAEKNMP

SEQ ID NO: 2105240 - protein, 26 aa, Staphylococcus
NSNGEGGTLRITGTVSDNQPFNSQIR

SEQ ID NO: 2105241 - protein, 23 aa, Staphylococcus
NSNLIFPNQVLKVSGSSASTSRN

SEQ ID NO: 2105242 - protein, 25 aa, Staphylococcus
NSNYKEIVNQIVFTNGKTYTDSNNT

SEQ ID NO: 2105243 - protein, 26 aa, Staphylococcus
NSQLKVIPVDSIGRVAANNHGVYTTV

SEQ ID NO: 2105244 - protein, 25 aa, Staphylococcus
NSRHKASQVDPEFSHKQAQKKADVD

SEQ ID NO: 2105245 - protein, 18 aa, Staphylococcus
NSSIKKLIYRGIKSTVHF

SEQ ID NO: 2105246 - protein, 22 aa, Staphylococcus
NSVLCLMFFFKYRQLKKDHHFY

SEQ ID NO: 2105247 - protein, 31 aa, Staphylococcus
NSVSKAIIGGAKFIGKDYIKAGQNTLYKMRW

SEQ ID NO: 2105248 - protein, 19 aa, Staphylococcus
NTATVAWADQMKKLAGNKK

SEQ ID NO: 2105249 - protein, 19 aa, Staphylococcus
NTDDIKVAVDLSNAKAGKY

SEQ ID NO: 2105250 - protein, 25 aa, Staphylococcus
NTFMPHLDYDMSFMIQEYIEDKANV

SEQ ID NO: 2105251 - protein, 18 aa, Staphylococcus
NTGIIRAIVYYNDNLMSN

SEQ ID NO: 2105252 - protein, 24 aa, Staphylococcus
NTILRILKEWKNQMSDVINIIEHN

SEQ ID NO: 2105253 - protein, 23 aa, Staphylococcus
NTKKEWRGDYLIEQLSKDNSIKK

SEQ ID NO: 2105254 - protein, 17 aa, Staphylococcus
NTNLVDQFYHNVAQSQS

SEQ ID NO: 2105255 - protein, 23 aa, Staphylococcus
NTNTSGITADWANQAQPSTNQAD

SEQ ID NO: 2105256 - protein, 24 aa, Staphylococcus
NTTFAFKQNGEFEVIPNNANASTT

SEQ ID NO: 2105257 - protein, 23 aa, Staphylococcus
NTTIPGLRTNIIGTEKALAEAGG

SEQ ID NO: 2105258 - protein, 30 aa, Staphylococcus
NTVKKAIVGGAKFIAGSYINQGQNTLYKMR

SEQ ID NO: 2105259 - protein, 19 aa, Staphylococcus
NTYDGTGFVIARTSDTRIT

SEQ ID NO: 2105260 - protein, 19 aa, Staphylococcus
NTYDGTGFVIARTSQTDIT

SEQ ID NO: 2105261 - protein, 24 aa, Staphylococcus
NTYQKGQCTYYVFDKVREDHHQIA

SEQ ID NO: 2105262 - protein, 20 aa, Staphylococcus
NVDVSFNYGGSGALRQQIEK

SEQ ID NO: 2105263 - protein, 26 aa, Staphylococcus
NVIECRDAESLYEIPLQLSKQHMDDL

SEQ ID NO: 2105264 - protein, 17 aa, Staphylococcus
NVIGKVPEKEWRVNDGL

SEQ ID NO: 2105265 - protein, 20 aa, Staphylococcus
NVKAGSTLYTVPWGTPSQVA

SEQ ID NO: 2105266 - protein, 26 aa, Staphylococcus
NVKGNANIYYVPWSKDNQVVAKTPKN

SEQ ID NO: 2105267 - protein, 24 aa, Staphylococcus
NVKSSDWLSEHFGVRFRYNALGDL

SEQ ID NO: 2105268 - protein, 20 aa, Staphylococcus
NVLSKEKDLFELVKQDGVTQ

SEQ ID NO: 2105269 - protein, 25 aa, Staphylococcus
NVNFLKRRFEALSPLSMFKGIEYTE

SEQ ID NO: 2105270 - protein, 18 aa, Staphylococcus
NVSGWKAVDKESIIRKNP

SEQ ID NO: 2105271 - protein, 18 aa, Staphylococcus
NWNGGVNVKSYRTIYNPG

SEQ ID NO: 2105272 - protein, 21 aa, Staphylococcus
NYANSRYGSLDAAIAFRDNHG

SEQ ID NO: 2105273 - protein, 24 aa, Staphylococcus
NYATKLNSLIEHYSLTDFDKKHMP

SEQ ID NO: 2105274 - protein, 18 aa, Staphylococcus
NYDLEHPNEIGIFQTLIE

SEQ ID NO: 2105275 - protein, 20 aa, Staphylococcus
NYGHGPGVVTSRTISASQAG

SEQ ID NO: 2105276 - protein, 19 aa, Staphylococcus
NYHDYRFIDRDKVDQPTLD

SEQ ID NO: 2105277 - protein, 21 aa, Staphylococcus
NYKVSEAFLNKNTVQVTGGKN

SEQ ID NO: 2105278 - protein, 18 aa, Staphylococcus
NYNGGPGVVSTRTISASQ

SEQ ID NO: 2105279 - protein, 26 aa, Staphylococcus
NYNLFGMKGSYKGASVNFNTLEASSN

SEQ ID NO: 2105280 - protein, 18 aa, Staphylococcus
NYTVQFITPDGYILSPSK

SEQ ID NO: 2105281 - protein, 19 aa, Staphylococcus
NYYFPVLQGEHIKYVLTVT

SEQ ID NO: 2105282 - protein, 24 aa, Staphylococcus
PAMIKGDVDASVFQSRAYMESIND

SEQ ID NO: 2105283 - protein, 23 aa, Staphylococcus
PANNGKGGTYLIVKNADNDKQIV

SEQ ID NO: 2105284 - protein, 19 aa, Staphylococcus
PATSKGVWQVRPVQNGWDH

SEQ ID NO: 2105285 - protein, 17 aa, Staphylococcus
PAVASKSGLLAHPSESY

SEQ ID NO: 2105286 - protein, 19 aa, Staphylococcus
PCLITIFGATGDLSHRKLF

SEQ ID NO: 2105287 - protein, 18 aa, Staphylococcus
PDHVFEKTSVRHVQISEK

SEQ ID NO: 2105288 - protein, 17 aa, Staphylococcus
PDIKWAGTIGNGKMEIH

SEQ ID NO: 2105289 - protein, 17 aa, Staphylococcus
PDLIIADSNRHKGIYKD

SEQ ID NO: 2105290 - protein, 17 aa, Staphylococcus
PDPPRIDSNTVLYKAGL

SEQ ID NO: 2105291 - protein, 18 aa, Staphylococcus
PDPTAFLEIMTKGNAQNN

SEQ ID NO: 2105292 - protein, 18 aa, Staphylococcus
PDVYPGMEQQLLDTLNRH

SEQ ID NO: 2105293 - protein, 17 aa, Staphylococcus
PEAIHKMKHSGMYMTKE

SEQ ID NO: 2105294 - protein, 19 aa, Staphylococcus
PEANFPMSSIEAAIQAHLE

SEQ ID NO: 2105295 - protein, 24 aa, Staphylococcus
PEDMKRLNHYGVDGVFTNYPDLYK

SEQ ID NO: 2105296 - protein, 20 aa, Staphylococcus
PEDVLYDVVFLFPKSMQLKE

SEQ ID NO: 2105297 - protein, 21 aa, Staphylococcus
PEEYRYGFYVTPYLNRVNGVF

SEQ ID NO: 2105298 - protein, 27 aa, Staphylococcus
PEFKNKDLRLAIAQSIDKEGYVNSVKN

SEQ ID NO: 2105299 - protein, 21 aa, Staphylococcus
PEFNIKFTIIEPGGIQSEFMP

SEQ ID NO: 2105300 - protein, 18 aa, Staphylococcus
PEGYHWYDRSTFAPGSYG

SEQ ID NO: 2105301 - protein, 23 aa, Staphylococcus
PEKDFFIACQFHPEFLSRPNRPQ

SEQ ID NO: 2105302 - protein, 39 aa, Staphylococcus
PEKEPWSQPPSGYKWYDRSTFKLGSYGSTSSQLNSNHKN

SEQ ID NO: 2105303 - protein, 24 aa, Staphylococcus
PEKNSDGEWGFSFTDKDGNLAGSY

SEQ ID NO: 2105304 - protein, 27 aa, Staphylococcus
PESKNLGGFPITGQFLICTNPDTIAKH

SEQ ID NO: 2105305 - protein, 19 aa, Staphylococcus
PESNPLLVDMENSALSKLE

SEQ ID NO: 2105306 - protein, 19 aa, Staphylococcus
PESYLRKFNYLVFPDNVAI

SEQ ID NO: 2105307 - protein, 21 aa, Staphylococcus
PEVYKAVFEACGERFEDYIDM

SEQ ID NO: 2105308 - protein, 17 aa, Staphylococcus
PEVYKAVFEACGKNFED

SEQ ID NO: 2105309 - protein, 18 aa, Staphylococcus
PFFEYARTFDYIVVSDVG

SEQ ID NO: 2105310 - protein, 21 aa, Staphylococcus
PFFEYLRTFDFIVVSDVGLIN

SEQ ID NO: 2105311 - protein, 24 aa, Staphylococcus
PFKQRVTAELTMNYSMSLSGWGPD

SEQ ID NO: 2105312 - protein, 23 aa, Staphylococcus
PFMKEVWDYDITVAKAAAKAGFQ

SEQ ID NO: 2105313 - protein, 23 aa, Staphylococcus
PFNSQIRFKISATDNANNTTNNR

SEQ ID NO: 2105314 - protein, 23 aa, Staphylococcus
PGLVEPFSRFVLEKEQEGQFKFL

SEQ ID NO: 2105315 - protein, 18 aa, Staphylococcus
PGPYGHVAYVERVNGDGS

SEQ ID NO: 2105316 - protein, 25 aa, Staphylococcus
PGYNLFHIYPIFPLPERQKFFTQLK

SEQ ID NO: 2105317 - protein, 19 aa, Staphylococcus
PHIAASSLVNLSRDHKQDS

SEQ ID NO: 2105318 - protein, 19 aa, Staphylococcus
PHIIASSLVHLNAQHVEDS

SEQ ID NO: 2105319 - protein, 20 aa, Staphylococcus
PHLGHAMAVVGNAKINNEEK

SEQ ID NO: 2105320 - protein, 24 aa, Staphylococcus
PHRDYRTTFSLLYRLYDKLLTTVK

SEQ ID NO: 2105321 - protein, 26 aa, Staphylococcus
PIGSLWGDAGSWAVNARNAGFTVNNI

SEQ ID NO: 2105322 - protein, 17 aa, Staphylococcus
PIHFNLPFREPLTPNLE

SEQ ID NO: 2105323 - protein, 24 aa, Staphylococcus
PIKETLAASLIRLANWKGDSPLID

SEQ ID NO: 2105324 - protein, 17 aa, Staphylococcus
PIKGRVTILQPFPSKSH

SEQ ID NO: 2105325 - protein, 20 aa, Staphylococcus
PILAVGFIVMAVREEKKRKA

SEQ ID NO: 2105326 - protein, 21 aa, Staphylococcus
PKDPKRIAVVAPSYAGGIKKL

SEQ ID NO: 2105327 - protein, 26 aa, Staphylococcus
PKDPKRIAVVAPTFAGGLHKLGANIV

SEQ ID NO: 2105328 - protein, 22 aa, Staphylococcus
PKDPKRIAVVAPTYAGGIKKLG

SEQ ID NO: 2105329 - protein, 22 aa, Staphylococcus
PKGEGNKSLPDFLSDFKDDKYL

SEQ ID NO: 2105330 - protein, 17 aa, Staphylococcus
PKGSVYVLPNTGGTKAY

SEQ ID NO: 2105331 - protein, 18 aa, Staphylococcus
PKGSVYVLPNTGGTKAYD

SEQ ID NO: 2105332 - protein, 23 aa, Staphylococcus
PKHPKRVVVLEYSFVDALAALDV

SEQ ID NO: 2105333 - protein, 24 aa, Staphylococcus
PKHPKRVVVLEYSFVDALASLDVK

SEQ ID NO: 2105334 - protein, 17 aa, Staphylococcus
PKIFVPLIKNLKENNDL

SEQ ID NO: 2105335 - protein, 17 aa, Staphylococcus
PKKAIVLDYGALDTLKE

SEQ ID NO: 2105336 - protein, 22 aa, Staphylococcus
PKKGGFFEELEKTFKEINDELN

SEQ ID NO: 2105337 - protein, 18 aa, Staphylococcus
PKLEHLAVTFNEDGSSRT

SEQ ID NO: 2105338 - protein, 18 aa, Staphylococcus
PKLNVPLVKSYMDMQSDL

SEQ ID NO: 2105339 - protein, 18 aa, Staphylococcus
PKNALPLKYENNGVTYVN

SEQ ID NO: 2105340 - protein, 17 aa, Staphylococcus
PKNAVVLDYGALDVLKE

SEQ ID NO: 2105341 - protein, 18 aa, Staphylococcus
PKNAVVLDYGVLNDMKEM

SEQ ID NO: 2105342 - protein, 21 aa, Staphylococcus
PKNPKRIAVVAPSYAGGLKKL

SEQ ID NO: 2105343 - protein, 21 aa, Staphylococcus
PKNPKRIAVVAPTYAGGLKKL

SEQ ID NO: 2105344 - protein, 18 aa, Staphylococcus
PKNTEIDDQYIHGEVANA

SEQ ID NO: 2105345 - protein, 27 aa, Staphylococcus
PKSGTSISLRPAFILKSAKHKDAAKDY

SEQ ID NO: 2105346 - protein, 21 aa, Staphylococcus
PKTGGFLEEIEKTFREINDEI

SEQ ID NO: 2105347 - protein, 24 aa, Staphylococcus
PKVLITSLIFFASFLMIGELNHAW

SEQ ID NO: 2105348 - protein, 34 aa, Staphylococcus
PKYLPRFIFGHYMKSYLLHFDKIFDNLTLIHDEV

SEQ ID NO: 2105349 - protein, 25 aa, Staphylococcus
PLDHYKLSPMYGDLEGLGHITITTG

SEQ ID NO: 2105350 - protein, 21 aa, Staphylococcus
PLENAKHALQQSIDQATDTTG

SEQ ID NO: 2105351 - protein, 29 aa, Staphylococcus
PLGFQIPDVRQLFAMDITSRIIGRDKNKN

SEQ ID NO: 2105352 - protein, 18 aa, Staphylococcus
PLPYHFEFIDLLAESLNA

SEQ ID NO: 2105353 - protein, 18 aa, Staphylococcus
PMGFNAYEKGQCTYYAFD

SEQ ID NO: 2105354 - protein, 17 aa, Staphylococcus
PMGGIQIIPETNQVISP

SEQ ID NO: 2105355 - protein, 18 aa, Staphylococcus
PMGGIQIVPETNQIISPR

SEQ ID NO: 2105356 - protein, 25 aa, Staphylococcus
PMIEMMFGVHFIKGGMYGMAQGLTR

SEQ ID NO: 2105357 - protein, 25 aa, Staphylococcus
PMIEMMFGVHFIKGGMYGMVKGLEQ

SEQ ID NO: 2105358 - protein, 25 aa, Staphylococcus
PNDEMKGRIIGREGRNIRTLETLTG

SEQ ID NO: 2105359 - protein, 17 aa, Staphylococcus
PNGKVLGSLRDKYGNII

SEQ ID NO: 2105360 - protein, 43 aa, Staphylococcus
PNKLNKYAIRKFTVGTASLLIGATLVFGVGNVARADELDNASS

SEQ ID NO: 2105361 - protein, 25 aa, Staphylococcus
PNQAFKKEARFEVLDNQNHVFFTSD

SEQ ID NO: 2105362 - protein, 18 aa, Staphylococcus
PNSDITMISKAGSGNSES

SEQ ID NO: 2105363 - protein, 18 aa, Staphylococcus
PNTLRGINILVLPEANIP

SEQ ID NO: 2105364 - protein, 27 aa, Staphylococcus
PNTTVKRMAREAIENKVASQIQQINAN

SEQ ID NO: 2105365 - protein, 17 aa, Staphylococcus
PNVYPGMEEQLLETLKK

SEQ ID NO: 2105366 - protein, 26 aa, Staphylococcus
PNYNLFGIKGSYKGQSVNFNTLEAGS

SEQ ID NO: 2105367 - protein, 20 aa, Staphylococcus
PNYNSVGYSLTAPDAAGQRE

SEQ ID NO: 2105368 - protein, 24 aa, Staphylococcus
PPQVQRNGYGWSNATYSEIKNAMN

SEQ ID NO: 2105369 - protein, 24 aa, Staphylococcus
PQAFIRPLPHISFVQGDKNVNFLK

SEQ ID NO: 2105370 - protein, 18 aa, Staphylococcus
PQECNVIALNYADHHLKT

SEQ ID NO: 2105371 - protein, 22 aa, Staphylococcus
PQILRANILFDGETTPIEKEAH

SEQ ID NO: 2105372 - protein, 20 aa, Staphylococcus
PQLRGVNDIIIEKGEDYNLL

SEQ ID NO: 2105373 - protein, 18 aa, Staphylococcus
PQVQRTAGKWEDANYDEI

SEQ ID NO: 2105374 - protein, 17 aa, Staphylococcus
PQVQRTPGVWSNATFSE

SEQ ID NO: 2105375 - protein, 17 aa, Staphylococcus
PQYSLSFIGEQQPQESF

SEQ ID NO: 2105376 - protein, 20 aa, Staphylococcus
PRDTISYIPKVGYYDKITHA

SEQ ID NO: 2105377 - protein, 19 aa, Staphylococcus
PRINFNFKGTKPADSRYHD

SEQ ID NO: 2105378 - protein, 17 aa, Staphylococcus
PRLPILMTSRSANLPSV

SEQ ID NO: 2105379 - protein, 21 aa, Staphylococcus
PRSLVIAEVLKKAGYDVTTTP

SEQ ID NO: 2105380 - protein, 25 aa, Staphylococcus
PSIAISLLLTGCGQKDNGQDEGPKN

SEQ ID NO: 2105381 - protein, 33 aa, Staphylococcus
PSKGKADGVWFQLKPGIVSKAELVKTYGKPLNK

SEQ ID NO: 2105382 - protein, 18 aa, Staphylococcus
PSNMKFYATQPAKGSFST

SEQ ID NO: 2105383 - protein, 18 aa, Staphylococcus
PSNPKGRYISKFKESQLL

SEQ ID NO: 2105384 - protein, 23 aa, Staphylococcus
PSNTEILYELGLGDKVVGVSTVD

SEQ ID NO: 2105385 - protein, 22 aa, Staphylococcus
PSNTEILYQLGLGDDIVGVSTV

SEQ ID NO: 2105386 - protein, 19 aa, Staphylococcus
PSNYLAWGAGANANPYFYQ

SEQ ID NO: 2105387 - protein, 19 aa, Staphylococcus
PSQKEILSIVDEVKKSKQP

SEQ ID NO: 2105388 - protein, 19 aa, Staphylococcus
PSSVRGIAEISSIRQNDGY

SEQ ID NO: 2105389 - protein, 18 aa, Staphylococcus
PSYKEFQKDPVWKKLDAV

SEQ ID NO: 2105390 - protein, 18 aa, Staphylococcus
PTATRTALAQPKMAIKSN

SEQ ID NO: 2105391 - protein, 19 aa, Staphylococcus
PTDKPKTYGTFTFDPSIII

SEQ ID NO: 2105392 - protein, 19 aa, Staphylococcus
PTDYLSWGAGPNANGRFIN

SEQ ID NO: 2105393 - protein, 18 aa, Staphylococcus
PTDYLSWGAGPNANNRFI

SEQ ID NO: 2105394 - protein, 24 aa, Staphylococcus
PTEDELKHKSKPVQSFEYDIKKSN

SEQ ID NO: 2105395 - protein, 17 aa, Staphylococcus
PTGARSELEREIETIKR

SEQ ID NO: 2105396 - protein, 25 aa, Staphylococcus
PTGDQRVFRISTFNVTDEEKAQIKQ

SEQ ID NO: 2105397 - protein, 17 aa, Staphylococcus
PTIEVIDPVRFVSNRSS

SEQ ID NO: 2105398 - protein, 37 aa, Staphylococcus
PTMKLPYRFYFGGKLGTGFQWYSWIHIADLTRAILFL

SEQ ID NO: 2105399 - protein, 22 aa, Staphylococcus
PTQKYQFLRLDKSQNISSADLD

SEQ ID NO: 2105400 - protein, 23 aa, Staphylococcus
PTSAKAPTSIHPKSGTTSTKSST

SEQ ID NO: 2105401 - protein, 17 aa, Staphylococcus
PTSAKAYSLKPFNEQIF

SEQ ID NO: 2105402 - protein, 22 aa, Staphylococcus
PTSGNYWGGDRTDLQKDLENNG

SEQ ID NO: 2105403 - protein, 21 aa, Staphylococcus
PTSQYWWAYTEYFTGGVTPAA

SEQ ID NO: 2105404 - protein, 17 aa, Staphylococcus
PTYKAVKNIVGSNAVTR

SEQ ID NO: 2105405 - protein, 17 aa, Staphylococcus
PTYKHVKHLVGNKAIAR

SEQ ID NO: 2105406 - protein, 18 aa, Staphylococcus
PTYLSVGDGDPFYSQNES

SEQ ID NO: 2105407 - protein, 17 aa, Staphylococcus
PVAVAFGKQQPVIGFDI

SEQ ID NO: 2105408 - protein, 21 aa, Staphylococcus
PVEQPKLPILAKFNKDLKHNL

SEQ ID NO: 2105409 - protein, 18 aa, Staphylococcus
PVEVFDKIMGVDMRGTFL

SEQ ID NO: 2105410 - protein, 18 aa, Staphylococcus
PVEVGCLVPEGIDNVKII

SEQ ID NO: 2105411 - protein, 17 aa, Staphylococcus
PVHFERHKGHIDGNEVK

SEQ ID NO: 2105412 - protein, 18 aa, Staphylococcus
PVKAGAYDFSFVKDGFRY

SEQ ID NO: 2105413 - protein, 17 aa, Staphylococcus
PVQDGAYNINFNYNNTD

SEQ ID NO: 2105414 - protein, 18 aa, Staphylococcus
PVQEGAYNIAFDNSGYNF

SEQ ID NO: 2105415 - protein, 18 aa, Staphylococcus
PVVHNSRPKPGSKVKKNS

SEQ ID NO: 2105416 - protein, 23 aa, Staphylococcus
PWGRPDMALFKFTKAIVNDEEID

SEQ ID NO: 2105417 - protein, 18 aa, Staphylococcus
PWSQPPEGYHWYDRSTFA

SEQ ID NO: 2105418 - protein, 26 aa, Staphylococcus
PYPELKSELASPFAAIYDTQAKGKVS

SEQ ID NO: 2105419 - protein, 19 aa, Staphylococcus
QAEFKKVGIKLNINGETSD

SEQ ID NO: 2105420 - protein, 20 aa, Staphylococcus
QAEFLQAEFKKVGIKLNING

SEQ ID NO: 2105421 - protein, 20 aa, Staphylococcus
QAKAKLASITQVLNGTPSVA

SEQ ID NO: 2105422 - protein, 20 aa, Staphylococcus
QAKKALVVGAGYISLEVLEN

SEQ ID NO: 2105423 - protein, 25 aa, Staphylococcus
QAPDGMKFYMVYPDKGSYRTVVGVN

SEQ ID NO: 2105424 - protein, 26 aa, Staphylococcus
QASKRKIVDGAAYVYGTVNGKTGWIA

SEQ ID NO: 2105425 - protein, 17 aa, Staphylococcus
QAVNFSDIFLIALPTKA

SEQ ID NO: 2105426 - protein, 17 aa, Staphylococcus
QAVQSFLNDQVSKTEAK

SEQ ID NO: 2105427 - protein, 17 aa, Staphylococcus
QAVYVLLMLNLLSEHSV

SEQ ID NO: 2105428 - protein, 17 aa, Staphylococcus
QCTYHVFNRRAQIGKGI

SEQ ID NO: 2105429 - protein, 20 aa, Staphylococcus
QCTYYAFNRRAELGKPIGSL

SEQ ID NO: 2105430 - protein, 25 aa, Staphylococcus
QDAEGYPMKAAVTIDKRTGEFIDYI

SEQ ID NO: 2105431 - protein, 22 aa, Staphylococcus
QDAQFDVIFLFTKAMQLQDMLE

SEQ ID NO: 2105432 - protein, 22 aa, Staphylococcus
QDGDISVGHFFRERLGDEVLEN

SEQ ID NO: 2105433 - protein, 21 aa, Staphylococcus
QDGKPLIVMYGDFKCPYCKKV

SEQ ID NO: 2105434 - protein, 33 aa, Staphylococcus
QDIANYLPQYNYRYGKPEGIVMHDTANDNSTIT

SEQ ID NO: 2105435 - protein, 25 aa, Staphylococcus
QDNGTLLKNLTTWLGKSDSHESMKD

SEQ ID NO: 2105436 - protein, 23 aa, Staphylococcus
QDPHAWLSLDNGIKYVKTIQQTL

SEQ ID NO: 2105437 - protein, 20 aa, Staphylococcus
QDPHAWLSLENGIKYVETIR

SEQ ID NO: 2105438 - protein, 23 aa, Staphylococcus
QDSLSELLTAIFSSDSETTEHTA

SEQ ID NO: 2105439 - protein, 28 aa, Staphylococcus
QDTFKYSEVKSYKSAIKAAQRAFDGEIK

SEQ ID NO: 2105440 - protein, 24 aa, Staphylococcus
QDVKLRKAMDYAINKDEWIKAFLQ

SEQ ID NO: 2105441 - protein, 28 aa, Staphylococcus
QDYYAKVWLTVFKDYRGSGEVENHISNM

SEQ ID NO: 2105442 - protein, 25 aa, Staphylococcus
QEFIDAGGTKALWDSIVMPESGGNP

SEQ ID NO: 2105443 - protein, 23 aa, Staphylococcus
QEGAYNYTFDYNGFTYHFESDGT

SEQ ID NO: 2105444 - protein, 24 aa, Staphylococcus
QEMMRYGQSQGRNVNYLNRMPQFD

SEQ ID NO: 2105445 - protein, 19 aa, Staphylococcus
QEPIVFTSMEPSWFSKELD

SEQ ID NO: 2105446 - protein, 31 aa, Staphylococcus
QEYQLPFPKGVKGMLDKDGFKTIPHEQYSKY

SEQ ID NO: 2105447 - protein, 27 aa, Staphylococcus
QEYTIGPDLRKYFSLSNGQDIPNNSFT

SEQ ID NO: 2105448 - protein, 27 aa, Staphylococcus
QFDNSWCAGFSMAALLNATKNTDKYNA

SEQ ID NO: 2105449 - protein, 20 aa, Staphylococcus
QFEISKQFWGHLVKSGNIED

SEQ ID NO: 2105450 - protein, 22 aa, Staphylococcus
QFLLNHDIHLVGGHPMAGSHKS

SEQ ID NO: 2105451 - protein, 26 aa, Staphylococcus
QFMSTSFYNNWLYLYLFSSASQASQE

SEQ ID NO: 2105452 - protein, 35 aa, Staphylococcus
QFNLNGKTYHFWSDGTYFKWEYYPSNGSTVNSANQ

SEQ ID NO: 2105453 - protein, 17 aa, Staphylococcus
QGASFSQAAKKYGINEI

SEQ ID NO: 2105454 - protein, 24 aa, Staphylococcus
QGDDYRMILPFKESQARGLLQQNM

SEQ ID NO: 2105455 - protein, 24 aa, Staphylococcus
QGDNYRTILPFKESQARGLLQDNM

SEQ ID NO: 2105456 - protein, 25 aa, Staphylococcus
QGDNYRTILPFKESQARGVLQDNMA

SEQ ID NO: 2105457 - protein, 24 aa, Staphylococcus
QGDNYRTILPFKESQSRGLLQDNM

SEQ ID NO: 2105458 - protein, 25 aa, Staphylococcus
QGDNYRTLLPFKESKARGILQDNMT

SEQ ID NO: 2105459 - protein, 32 aa, Staphylococcus
QGDYHYTWKGNWSPDRLNSHNNYSYSNYSNNN

SEQ ID NO: 2105460 - protein, 22 aa, Staphylococcus
QGKIMLNKGYGFQDFDIAQKAS

SEQ ID NO: 2105461 - protein, 19 aa, Staphylococcus
QGKNESYPDYVERIKKQSK

SEQ ID NO: 2105462 - protein, 22 aa, Staphylococcus
QGNYHYTWQGNWSPDKVNHNNS

SEQ ID NO: 2105463 - protein, 23 aa, Staphylococcus
QGNYHYTWQGNWSPNQAQQGQYY

SEQ ID NO: 2105464 - protein, 25 aa, Staphylococcus
QGPPFPFPECGAMSQAYIGYQMQES

SEQ ID NO: 2105465 - protein, 21 aa, Staphylococcus
QGQNAVPVAQNITSGTPDSQA

SEQ ID NO: 2105466 - protein, 27 aa, Staphylococcus
QGQPFATSQTVRFIIRNVQPTAPQISE

SEQ ID NO: 2105467 - protein, 27 aa, Staphylococcus
QGYNLFHVYPIFPLPERERFLKQLQNI

SEQ ID NO: 2105468 - protein, 18 aa, Staphylococcus
QHGVVNVGYDLYIDIPDK

SEQ ID NO: 2105469 - protein, 26 aa, Staphylococcus
QHKVKSGESLWSIAQKYNTSVENIKQ

SEQ ID NO: 2105470 - protein, 20 aa, Staphylococcus
QHVGGVCLNVGCIPSKIFLE

SEQ ID NO: 2105471 - protein, 17 aa, Staphylococcus
QIEKGAPVDVFMSANTK

SEQ ID NO: 2105472 - protein, 17 aa, Staphylococcus
QIIKIKRIFILRDPRNN

SEQ ID NO: 2105473 - protein, 18 aa, Staphylococcus
QIKAVKNGRIETVNGDEI

SEQ ID NO: 2105474 - protein, 18 aa, Staphylococcus
QINKEKLAQLAESNDQSL

SEQ ID NO: 2105475 - protein, 24 aa, Staphylococcus
QIPSNELYDVIFLFPKSMQLESVL

SEQ ID NO: 2105476 - protein, 22 aa, Staphylococcus
QISRPGPRIDDGLKALRDAIYN

SEQ ID NO: 2105477 - protein, 32 aa, Staphylococcus
QIVKQDVQDGGIWRLVKIPDNVNRVKVQFLPN

SEQ ID NO: 2105478 - protein, 27 aa, Staphylococcus
QKADINMGMSYIVTGNVIGKVPEKEWR

SEQ ID NO: 2105479 - protein, 25 aa, Staphylococcus
QKAEARRIINQKAQDKITEINQNTQ

SEQ ID NO: 2105480 - protein, 24 aa, Staphylococcus
QKAHEQWIKDQVEWNKQNETRKQK

SEQ ID NO: 2105481 - protein, 18 aa, Staphylococcus
QKDPVWKKLDAVKNNRVD

SEQ ID NO: 2105482 - protein, 27 aa, Staphylococcus
QKDYGFKFKSARPMQIGLVYDALKNKK

SEQ ID NO: 2105483 - protein, 31 aa, Staphylococcus
QKEMGFSWYTTDRFKDAKVWVSESGRFDDAQ

SEQ ID NO: 2105484 - protein, 30 aa, Staphylococcus
QKEPWSEPKAGYKWYDPSTFAAGSYGGSQS

SEQ ID NO: 2105485 - protein, 26 aa, Staphylococcus
QKEYGFKFASARPMQIGLVYDALKNK

SEQ ID NO: 2105486 - protein, 21 aa, Staphylococcus
QKGMQGWKDYKKLMDKVKLAD

SEQ ID NO: 2105487 - protein, 19 aa, Staphylococcus
QKGTMGYGYQKYLKNHPNE

SEQ ID NO: 2105488 - protein, 17 aa, Staphylococcus
QKIKRNFDLFSYDKNNH

SEQ ID NO: 2105489 - protein, 24 aa, Staphylococcus
QKKHGGTISPLFKGNNDNMVSSIT

SEQ ID NO: 2105490 - protein, 25 aa, Staphylococcus
QKKHPKVLILMGIPGSYLVATDKSY

SEQ ID NO: 2105491 - protein, 18 aa, Staphylococcus
QKKLSAYQKQLLLDKVKV

SEQ ID NO: 2105492 - protein, 17 aa, Staphylococcus
QKLKRANLLVPLNHHKL

SEQ ID NO: 2105493 - protein, 30 aa, Staphylococcus
QKLMKLNGLKSFLIHPGQKLKVSGTVSTSK

SEQ ID NO: 2105494 - protein, 20 aa, Staphylococcus
QKPIVFTAMEPSWFSKELDI

SEQ ID NO: 2105495 - protein, 20 aa, Staphylococcus
QKQQNGVTWYYGKLTNGKYV

SEQ ID NO: 2105496 - protein, 28 aa, Staphylococcus
QKRAKINELMDFIELCNKSIKANEEILD

SEQ ID NO: 2105497 - protein, 18 aa, Staphylococcus
QKTFKQKFEAYIKALNKV

SEQ ID NO: 2105498 - protein, 21 aa, Staphylococcus
QKYQFLRLDKAQNLSTSSVNQ

SEQ ID NO: 2105499 - protein, 21 aa, Staphylococcus
QKYYNSFGFENTYAFMVTKEV

SEQ ID NO: 2105500 - protein, 19 aa, Staphylococcus
QLDEWKHLLDVVNHLDGEI

SEQ ID NO: 2105501 - protein, 23 aa, Staphylococcus
QLEARVDALYDKKMDEEDKALEE

SEQ ID NO: 2105502 - protein, 20 aa, Staphylococcus
QLEELLRNGNPEEVKYQKEH

SEQ ID NO: 2105503 - protein, 19 aa, Staphylococcus
QLIKNEAFKNLEVDVYDHD

SEQ ID NO: 2105504 - protein, 19 aa, Staphylococcus
QLKGIPGYIQSPYPTYNTL

SEQ ID NO: 2105505 - protein, 30 aa, Staphylococcus
QLLNRTGTTSGMRPASITAYNQAMQALKPD

SEQ ID NO: 2105506 - protein, 21 aa, Staphylococcus
QLQERRKHEIKERSTDPKSSE

SEQ ID NO: 2105507 - protein, 17 aa, Staphylococcus
QLTKDMAKKDIIKADED

SEQ ID NO: 2105508 - protein, 19 aa, Staphylococcus
QLTWFKNKMNVQWFDRETM

SEQ ID NO: 2105509 - protein, 18 aa, Staphylococcus
QLWDSWRGVNTEHLHAAG

SEQ ID NO: 2105510 - protein, 20 aa, Staphylococcus
QMELIKLLFKKAKEMDSYDK

SEQ ID NO: 2105511 - protein, 38 aa, Staphylococcus
QMICYDLRFPELLRYPARSGATIAFYVAQWPSARLNHW

SEQ ID NO: 2105512 - protein, 17 aa, Staphylococcus
QMNESKLEQSNRQRNND

SEQ ID NO: 2105513 - protein, 17 aa, Staphylococcus
QMSLPYPPQSYVGPSKW

SEQ ID NO: 2105514 - protein, 17 aa, Staphylococcus
QNALMFCVGNIHGPGKQ

SEQ ID NO: 2105515 - protein, 21 aa, Staphylococcus
QNAYNDYGIDSLDNGTYSYVF

SEQ ID NO: 2105516 - protein, 23 aa, Staphylococcus
QNDGYLWTINFNKYHIKRNGMVF

SEQ ID NO: 2105517 - protein, 20 aa, Staphylococcus
QNDKKREEPITEKATKQQKE

SEQ ID NO: 2105518 - protein, 26 aa, Staphylococcus
QNILRYGKSFVDICIYEQEDFVVVKL

SEQ ID NO: 2105519 - protein, 26 aa, Staphylococcus
QNIMKLNGLNSFLIHPGQVLKVSGTA
